United States Patent 7,655,785 (BIOINFORMATICALLY DETECTABLE GROUP OF NOVEL REGULATORY OLIGONUCLEOTIDES AND USES THEREOF) - sequence listing, part 50

SEQ ID NO: 2073022 - RNA, 21 nt, Homo sapiens
ccaugauguccuuggacucca

SEQ ID NO: 2073023 - RNA, 18 nt, Homo sapiens
uagaagaaaugcuaucag

SEQ ID NO: 2073024 - RNA, 23 nt, Homo sapiens
aacccauacaauguauguacaau

SEQ ID NO: 2073025 - RNA, 19 nt, Homo sapiens
gaaugacugacaaagacau

SEQ ID NO: 2073026 - RNA, 22 nt, Homo sapiens
aaauaucauucuuuguaucuua

SEQ ID NO: 2073027 - RNA, 15 nt, Homo sapiens
aaauaaaaaccauaa

SEQ ID NO: 2073028 - RNA, 11 nt, Homo sapiens
gugucagccau

SEQ ID NO: 2073029 - RNA, 13 nt, Homo sapiens
agcgugagccacu

SEQ ID NO: 2073030 - RNA, 20 nt, Homo sapiens
gacaucugaggaaaauggaa

SEQ ID NO: 2073031 - RNA, 16 nt, Homo sapiens
uuaagacagagucuca

SEQ ID NO: 2073032 - RNA, 12 nt, Homo sapiens
aaacacuccacc

SEQ ID NO: 2073033 - RNA, 14 nt, Homo sapiens
gaaaagaagcagua

SEQ ID NO: 2073034 - RNA, 15 nt, Homo sapiens
ugauggcgauucccu

SEQ ID NO: 2073035 - RNA, 14 nt, Homo sapiens
uucagacaagacag

SEQ ID NO: 2073036 - RNA, 18 nt, Homo sapiens
caaagggcccacagugac

SEQ ID NO: 2073037 - RNA, 12 nt, Homo sapiens
uaccacauucac

SEQ ID NO: 2073038 - RNA, 14 nt, Homo sapiens
ucccaccccuacac

SEQ ID NO: 2073039 - RNA, 11 nt, Homo sapiens
aagguucucug

SEQ ID NO: 2073040 - RNA, 14 nt, Homo sapiens
gauuauaccuggau

SEQ ID NO: 2073041 - RNA, 21 nt, Homo sapiens
ccucagaauuaaaacuuuaag

SEQ ID NO: 2073042 - RNA, 13 nt, Homo sapiens
ccagacacauuca

SEQ ID NO: 2073043 - RNA, 15 nt, Homo sapiens
ugacuuaagcugccu

SEQ ID NO: 2073044 - RNA, 15 nt, Homo sapiens
ucuggcuucugugau

SEQ ID NO: 2073045 - RNA, 20 nt, Homo sapiens
aaagcugccccuugggagac

SEQ ID NO: 2073046 - RNA, 22 nt, Homo sapiens
ggcauccacccagugcugccau

SEQ ID NO: 2073047 - RNA, 16 nt, Homo sapiens
uguaacaugacacuua

SEQ ID NO: 2073048 - RNA, 24 nt, Homo sapiens
gacggugucuuguucugucacuca

SEQ ID NO: 2073049 - RNA, 17 nt, Homo sapiens
aagacaguuucuugcaa

SEQ ID NO: 2073050 - RNA, 11 nt, Homo sapiens
ucaaaauggga

SEQ ID NO: 2073051 - RNA, 20 nt, Homo sapiens
cagugagccgagaucgugcc

SEQ ID NO: 2073052 - RNA, 16 nt, Homo sapiens
cuacuuucccucuggg

SEQ ID NO: 2073053 - RNA, 22 nt, Homo sapiens
aacauguuccugggaucacuga

SEQ ID NO: 2073054 - RNA, 17 nt, Homo sapiens
guggacaguccccaccu

SEQ ID NO: 2073055 - RNA, 20 nt, Homo sapiens
uaauauauuguacacuacag

SEQ ID NO: 2073056 - RNA, 22 nt, Homo sapiens
caacugacuuccaagauccuuu

SEQ ID NO: 2073057 - RNA, 22 nt, Homo sapiens
ccagccuuagagacuagacaaa

SEQ ID NO: 2073058 - RNA, 15 nt, Homo sapiens
augccuacagauaau

SEQ ID NO: 2073059 - RNA, 23 nt, Homo sapiens
gggucaaggaguacuccaagaca

SEQ ID NO: 2073060 - RNA, 21 nt, Homo sapiens
ugucugauuggcucacccaag

SEQ ID NO: 2073061 - RNA, 17 nt, Homo sapiens
aacaugaacccaaaaag

SEQ ID NO: 2073062 - RNA, 22 nt, Homo sapiens
uauaaauuuuuugugaucagua

SEQ ID NO: 2073063 - RNA, 18 nt, Homo sapiens
aaguaaugagggcugagu

SEQ ID NO: 2073064 - RNA, 15 nt, Homo sapiens
auugugcacaucucg

SEQ ID NO: 2073065 - RNA, 17 nt, Homo sapiens
ucgaggcucuugcucaa

SEQ ID NO: 2073066 - RNA, 18 nt, Homo sapiens
ucuccaucucugucucaa

SEQ ID NO: 2073067 - RNA, 18 nt, Homo sapiens
ggcauggccagguggcca

SEQ ID NO: 2073068 - RNA, 14 nt, Homo sapiens
gucugaauugagaa

SEQ ID NO: 2073069 - RNA, 15 nt, Homo sapiens
aaccaaguaucacac

SEQ ID NO: 2073070 - RNA, 15 nt, Homo sapiens
aauaaaguauuccac

SEQ ID NO: 2073071 - RNA, 24 nt, Homo sapiens
uugccaagacaaaucaacagaagc

SEQ ID NO: 2073072 - RNA, 16 nt, Homo sapiens
aucaauacaaccagcc

SEQ ID NO: 2073073 - RNA, 12 nt, Homo sapiens
acagaauauucu

SEQ ID NO: 2073074 - RNA, 16 nt, Homo sapiens
augaguuacugugcau

SEQ ID NO: 2073075 - RNA, 17 nt, Homo sapiens
aaaaauuaaacuaaaga

SEQ ID NO: 2073076 - RNA, 21 nt, Homo sapiens
caccccuuugucugucuuccu

SEQ ID NO: 2073077 - RNA, 12 nt, Homo sapiens
gaauguugcauu

SEQ ID NO: 2073078 - RNA, 22 nt, Homo sapiens
aggguaggcacgaagcaauuug

SEQ ID NO: 2073079 - RNA, 18 nt, Homo sapiens
cuucacguauucuuguau

SEQ ID NO: 2073080 - RNA, 17 nt, Homo sapiens
agcuagaauucacucca

SEQ ID NO: 2073081 - RNA, 13 nt, Homo sapiens
gcaaauacuguau

SEQ ID NO: 2073082 - RNA, 23 nt, Homo sapiens
aagcucuggcugaacccugugcu

SEQ ID NO: 2073083 - RNA, 12 nt, Homo sapiens
agcagugaccca

SEQ ID NO: 2073084 - RNA, 21 nt, Homo sapiens
uggaagguuagagguuuguca

SEQ ID NO: 2073085 - RNA, 17 nt, Homo sapiens
uucucuagggucugaua

SEQ ID NO: 2073086 - RNA, 15 nt, Homo sapiens
auccacccaccucag

SEQ ID NO: 2073087 - RNA, 20 nt, Homo sapiens
aaucaauguguacaagugga

SEQ ID NO: 2073088 - RNA, 23 nt, Homo sapiens
caugagaagguuggcgugcccug

SEQ ID NO: 2073089 - RNA, 13 nt, Homo sapiens
aucucuacugcuu

SEQ ID NO: 2073090 - RNA, 13 nt, Homo sapiens
gaagaguguuauu

SEQ ID NO: 2073091 - RNA, 20 nt, Homo sapiens
ccuuuuuuuaaaauucaccc

SEQ ID NO: 2073092 - RNA, 14 nt, Homo sapiens
uuuaaucaccacuc

SEQ ID NO: 2073093 - RNA, 14 nt, Homo sapiens
uauuugcacuauuu

SEQ ID NO: 2073094 - RNA, 14 nt, Homo sapiens
ugucaaugugauuu

SEQ ID NO: 2073095 - RNA, 15 nt, Homo sapiens
aaauauaucugcuau

SEQ ID NO: 2073096 - RNA, 20 nt, Homo sapiens
uaaucuuugcugaagcugag

SEQ ID NO: 2073097 - RNA, 20 nt, Homo sapiens
acuguacuaucagguucaca

SEQ ID NO: 2073098 - RNA, 18 nt, Homo sapiens
cuuggcuccaccacugau

SEQ ID NO: 2073099 - RNA, 18 nt, Homo sapiens
ucuuauuagaacaggcaa

SEQ ID NO: 2073100 - RNA, 12 nt, Homo sapiens
acuaacacagcc

SEQ ID NO: 2073101 - RNA, 12 nt, Homo sapiens
ucucacacugca

SEQ ID NO: 2073102 - RNA, 15 nt, Homo sapiens
ugccugucucccacc

SEQ ID NO: 2073103 - RNA, 12 nt, Homo sapiens
aggaaacauuca

SEQ ID NO: 2073104 - RNA, 15 nt, Homo sapiens
agaaaacuguuaaua

SEQ ID NO: 2073105 - RNA, 13 nt, Homo sapiens
uguaagcaauucu

SEQ ID NO: 2073106 - RNA, 17 nt, Homo sapiens
gguuugucagaggcuaa

SEQ ID NO: 2073107 - RNA, 14 nt, Homo sapiens
uguuuggauuggca

SEQ ID NO: 2073108 - RNA, 20 nt, Homo sapiens
caggaaaccaacacccaaag

SEQ ID NO: 2073109 - RNA, 12 nt, Homo sapiens
cuuaaacaucau

SEQ ID NO: 2073110 - RNA, 18 nt, Homo sapiens
uuacuucuucucauacua

SEQ ID NO: 2073111 - RNA, 19 nt, Homo sapiens
guuucugguauucacagaa

SEQ ID NO: 2073112 - RNA, 22 nt, Homo sapiens
uggcuggggccgcugggguccg

SEQ ID NO: 2073113 - RNA, 14 nt, Homo sapiens
aauagcauuugcca

SEQ ID NO: 2073114 - RNA, 14 nt, Homo sapiens
agcauuuucuugaa

SEQ ID NO: 2073115 - RNA, 13 nt, Homo sapiens
ccugcaugguguu

SEQ ID NO: 2073116 - RNA, 13 nt, Homo sapiens
uuauguuugccac

SEQ ID NO: 2073117 - RNA, 15 nt, Homo sapiens
auuucgcacaaugca

SEQ ID NO: 2073118 - RNA, 20 nt, Homo sapiens
ugaaacuagaagagauuucu

SEQ ID NO: 2073119 - RNA, 18 nt, Homo sapiens
cuuacagaaccaauucac

SEQ ID NO: 2073120 - RNA, 23 nt, Homo sapiens
ugaagucucuuuuucuuccucuc

SEQ ID NO: 2073121 - RNA, 16 nt, Homo sapiens
gagcuaagucacccag

SEQ ID NO: 2073122 - RNA, 14 nt, Homo sapiens
gaauaaaacauaca

SEQ ID NO: 2073123 - RNA, 19 nt, Homo sapiens
augacaacaaaagggaaaa

SEQ ID NO: 2073124 - RNA, 16 nt, Homo sapiens
cuuuucucacucagau

SEQ ID NO: 2073125 - RNA, 18 nt, Homo sapiens
accaccacccuugccaug

SEQ ID NO: 2073126 - RNA, 16 nt, Homo sapiens
uguuugggccacugcc

SEQ ID NO: 2073127 - RNA, 17 nt, Homo sapiens
uuucugaacagcuggug

SEQ ID NO: 2073128 - RNA, 18 nt, Homo sapiens
cuggaacacaaccauagc

SEQ ID NO: 2073129 - RNA, 22 nt, Homo sapiens
aguaccuuuuccuacacagcgg

SEQ ID NO: 2073130 - RNA, 17 nt, Homo sapiens
aauuccaucagcacaaa

SEQ ID NO: 2073131 - RNA, 14 nt, Homo sapiens
uuaaugaaugcuua

SEQ ID NO: 2073132 - RNA, 18 nt, Homo sapiens
cgcaguuuggagucacug

SEQ ID NO: 2073133 - RNA, 22 nt, Homo sapiens
uaagauguguuaggaaugucaa

SEQ ID NO: 2073134 - RNA, 22 nt, Homo sapiens
aagaauguuucuggaauucuuc

SEQ ID NO: 2073135 - RNA, 14 nt, Homo sapiens
caaccccuuuccac

SEQ ID NO: 2073136 - RNA, 22 nt, Homo sapiens
ucccucuaguuggcaagucuca

SEQ ID NO: 2073137 - RNA, 22 nt, Homo sapiens
auuguuuugugacuuuuagaca

SEQ ID NO: 2073138 - RNA, 23 nt, Homo sapiens
uaaacuuuccucuuccugccuag

SEQ ID NO: 2073139 - RNA, 17 nt, Homo sapiens
uuaaagacccaacuugc

SEQ ID NO: 2073140 - RNA, 13 nt, Homo sapiens
uuaguugagauuu

SEQ ID NO: 2073141 - RNA, 13 nt, Homo sapiens
aaacaucauuuca

SEQ ID NO: 2073142 - RNA, 17 nt, Homo sapiens
ugagucaugggauccca

SEQ ID NO: 2073143 - RNA, 22 nt, Homo sapiens
ugccaggcugaauuacagugaa

SEQ ID NO: 2073144 - RNA, 21 nt, Homo sapiens
uguucugcugauaucaacagc

SEQ ID NO: 2073145 - RNA, 17 nt, Homo sapiens
uccaucucugucucaaa

SEQ ID NO: 2073146 - RNA, 23 nt, Homo sapiens
uuaugagaggcaaugauuguuaa

SEQ ID NO: 2073147 - RNA, 13 nt, Homo sapiens
uugcacagugaua

SEQ ID NO: 2073148 - RNA, 22 nt, Homo sapiens
aguggagagaagcucuucaaua

SEQ ID NO: 2073149 - RNA, 14 nt, Homo sapiens
cccccuccugcaag

SEQ ID NO: 2073150 - RNA, 12 nt, Homo sapiens
agggcacuaccg

SEQ ID NO: 2073151 - RNA, 14 nt, Homo sapiens
agugucuugaaugu

SEQ ID NO: 2073152 - RNA, 22 nt, Homo sapiens
ccaggaugcccagaugaacuga

SEQ ID NO: 2073153 - RNA, 15 nt, Homo sapiens
uaagaguuguaugaa

SEQ ID NO: 2073154 - RNA, 14 nt, Homo sapiens
aaggcacaggugua

SEQ ID NO: 2073155 - RNA, 12 nt, Homo sapiens
agaaacaagaca

SEQ ID NO: 2073156 - RNA, 12 nt, Homo sapiens
gacuacaaagau

SEQ ID NO: 2073157 - RNA, 15 nt, Homo sapiens
aauugucacaucaag

SEQ ID NO: 2073158 - RNA, 13 nt, Homo sapiens
ucacugucugcug

SEQ ID NO: 2073159 - RNA, 12 nt, Homo sapiens
guuggacagccc

SEQ ID NO: 2073160 - RNA, 15 nt, Homo sapiens
uggauucagcauguc

SEQ ID NO: 2073161 - RNA, 16 nt, Homo sapiens
aagcagcccuuggcca

SEQ ID NO: 2073162 - RNA, 18 nt, Homo sapiens
ccaaggcuuuugcaaaga

SEQ ID NO: 2073163 - RNA, 13 nt, Homo sapiens
uguuaacauuuca

SEQ ID NO: 2073164 - RNA, 18 nt, Homo sapiens
caucaggccuguuuuaga

SEQ ID NO: 2073165 - RNA, 13 nt, Homo sapiens
aaaguaacugaau

SEQ ID NO: 2073166 - RNA, 14 nt, Homo sapiens
uguccaaggucuca

SEQ ID NO: 2073167 - RNA, 12 nt, Homo sapiens
cccauacugguu

SEQ ID NO: 2073168 - RNA, 22 nt, Homo sapiens
uaccacaaugcgcauguaguua

SEQ ID NO: 2073169 - RNA, 15 nt, Homo sapiens
acagaaccaauucac

SEQ ID NO: 2073170 - RNA, 22 nt, Homo sapiens
cuguaccacaucugcucuaggg

SEQ ID NO: 2073171 - RNA, 19 nt, Homo sapiens
gugggcagagguucauuuc

SEQ ID NO: 2073172 - RNA, 17 nt, Homo sapiens
gcaccuguacucaggag

SEQ ID NO: 2073173 - RNA, 18 nt, Homo sapiens
cuugcaggugacauuugc

SEQ ID NO: 2073174 - RNA, 19 nt, Homo sapiens
aucaccagcagacacugcc

SEQ ID NO: 2073175 - RNA, 15 nt, Homo sapiens
aguaugaaugcagug

SEQ ID NO: 2073176 - RNA, 17 nt, Homo sapiens
ggccugaggacccggcg

SEQ ID NO: 2073177 - RNA, 15 nt, Homo sapiens
augggcagcccaaag

SEQ ID NO: 2073178 - RNA, 15 nt, Homo sapiens
gccuuuugugugaug

SEQ ID NO: 2073179 - RNA, 12 nt, Homo sapiens
cuacaguuauua

SEQ ID NO: 2073180 - RNA, 22 nt, Homo sapiens
acaaaggaagaacaucuggauu

SEQ ID NO: 2073181 - RNA, 22 nt, Homo sapiens
gaguauguguauguacuuacau

SEQ ID NO: 2073182 - RNA, 20 nt, Homo sapiens
gggagguggagcuugcagug

SEQ ID NO: 2073183 - RNA, 17 nt, Homo sapiens
caagcuuuuaguaucca

SEQ ID NO: 2073184 - RNA, 14 nt, Homo sapiens
ggaugcccuguggg

SEQ ID NO: 2073185 - RNA, 21 nt, Homo sapiens
cuuauauuuguccaacaacug

SEQ ID NO: 2073186 - RNA, 19 nt, Homo sapiens
cuuaaacucuggacacucu

SEQ ID NO: 2073187 - RNA, 16 nt, Homo sapiens
aguucaguguugcaug

SEQ ID NO: 2073188 - RNA, 21 nt, Homo sapiens
cccaacaguaaucugcaucau

SEQ ID NO: 2073189 - RNA, 17 nt, Homo sapiens
auugaggagcugcacug

SEQ ID NO: 2073190 - RNA, 17 nt, Homo sapiens
guccaauuuuuacucag

SEQ ID NO: 2073191 - RNA, 18 nt, Homo sapiens
auccuggaugauuucauc

SEQ ID NO: 2073192 - RNA, 20 nt, Homo sapiens
gagcauccuuggcaguggga

SEQ ID NO: 2073193 - RNA, 17 nt, Homo sapiens
ucccaagcccuggugac

SEQ ID NO: 2073194 - RNA, 19 nt, Homo sapiens
uuaaguugauggugaugaa

SEQ ID NO: 2073195 - RNA, 21 nt, Homo sapiens
acugccccaaggaccuuacag

SEQ ID NO: 2073196 - RNA, 23 nt, Homo sapiens
gcauauuuauuucagauguuucg

SEQ ID NO: 2073197 - RNA, 22 nt, Homo sapiens
uccauucagugcagcauauaca

SEQ ID NO: 2073198 - RNA, 22 nt, Homo sapiens
uccccauccugggguugcccug

SEQ ID NO: 2073199 - RNA, 18 nt, Homo sapiens
gugucaaagauuuuaccu

SEQ ID NO: 2073200 - RNA, 18 nt, Homo sapiens
cccaaauuaguacagaaa

SEQ ID NO: 2073201 - RNA, 15 nt, Homo sapiens
cuaaagucucaggug

SEQ ID NO: 2073202 - RNA, 14 nt, Homo sapiens
cuggauuugcauac

SEQ ID NO: 2073203 - RNA, 19 nt, Homo sapiens
gucuauuuucucagucauu

SEQ ID NO: 2073204 - RNA, 15 nt, Homo sapiens
ucauaaguaaaccua

SEQ ID NO: 2073205 - RNA, 16 nt, Homo sapiens
cuuggaguuacaacag

SEQ ID NO: 2073206 - RNA, 19 nt, Homo sapiens
aucacugcgccacugcucc

SEQ ID NO: 2073207 - RNA, 15 nt, Homo sapiens
uccccuccucacagu

SEQ ID NO: 2073208 - RNA, 20 nt, Homo sapiens
aauaugccuaguuucuuaca

SEQ ID NO: 2073209 - RNA, 22 nt, Homo sapiens
cuuuauuacaguuuaucuaugg

SEQ ID NO: 2073210 - RNA, 20 nt, Homo sapiens
gagagcagcuggcucuccac

SEQ ID NO: 2073211 - RNA, 23 nt, Homo sapiens
uaccuguuaguauuauuguugca

SEQ ID NO: 2073212 - RNA, 12 nt, Homo sapiens
ccgagagcucuu

SEQ ID NO: 2073213 - RNA, 17 nt, Homo sapiens
acgcuauccaguugcag

SEQ ID NO: 2073214 - RNA, 12 nt, Homo sapiens
aaaaaccaaaag

SEQ ID NO: 2073215 - RNA, 12 nt, Homo sapiens
cagaaccacagg

SEQ ID NO: 2073216 - RNA, 12 nt, Homo sapiens
caggaccacaga

SEQ ID NO: 2073217 - RNA, 19 nt, Homo sapiens
ugagaauauagacagugcc

SEQ ID NO: 2073218 - RNA, 14 nt, Homo sapiens
gagggguauccucc

SEQ ID NO: 2073219 - RNA, 18 nt, Homo sapiens
ugaauacugcauuuacag

SEQ ID NO: 2073220 - RNA, 18 nt, Homo sapiens
gcaaaggucaagacugug

SEQ ID NO: 2073221 - RNA, 21 nt, Homo sapiens
auagacagcacuuggcuccuu

SEQ ID NO: 2073222 - RNA, 21 nt, Homo sapiens
cugucacccuccaccgagcca

SEQ ID NO: 2073223 - RNA, 20 nt, Homo sapiens
gggcaggcaggagcagggga

SEQ ID NO: 2073224 - RNA, 13 nt, Homo sapiens
ccucaugagcuga

SEQ ID NO: 2073225 - RNA, 16 nt, Homo sapiens
ucuucauguaccugcu

SEQ ID NO: 2073226 - RNA, 16 nt, Homo sapiens
aguccaacaaaccaca

SEQ ID NO: 2073227 - RNA, 12 nt, Homo sapiens
caaauccaagga

SEQ ID NO: 2073228 - RNA, 14 nt, Homo sapiens
aggacuauucccuu

SEQ ID NO: 2073229 - RNA, 21 nt, Homo sapiens
augcucauaaagauguuaaau

SEQ ID NO: 2073230 - RNA, 18 nt, Homo sapiens
ccagggcucuaauguguc

SEQ ID NO: 2073231 - RNA, 23 nt, Homo sapiens
ggacuauggagugcaccaaagag

SEQ ID NO: 2073232 - RNA, 23 nt, Homo sapiens
auccuaugucauuucuacuuuga

SEQ ID NO: 2073233 - RNA, 19 nt, Homo sapiens
caacaugccagccacugug

SEQ ID NO: 2073234 - RNA, 17 nt, Homo sapiens
cauuaaaauugugaugc

SEQ ID NO: 2073235 - RNA, 19 nt, Homo sapiens
auauaaaaacuccugggcu

SEQ ID NO: 2073236 - RNA, 16 nt, Homo sapiens
uuuaagaaaaaucaua

SEQ ID NO: 2073237 - RNA, 22 nt, Homo sapiens
gcugcaaagcaaaacagacugu

SEQ ID NO: 2073238 - RNA, 17 nt, Homo sapiens
uuauuaauuucuucaca

SEQ ID NO: 2073239 - RNA, 13 nt, Homo sapiens
auuacauacuauu

SEQ ID NO: 2073240 - RNA, 16 nt, Homo sapiens
ugcuaaagaauccaua

SEQ ID NO: 2073241 - RNA, 14 nt, Homo sapiens
auuauauuugacau

SEQ ID NO: 2073242 - RNA, 23 nt, Homo sapiens
gcugacacagaggcuggcacuga

SEQ ID NO: 2073243 - RNA, 15 nt, Homo sapiens
ugaaaaucuggugcu

SEQ ID NO: 2073244 - RNA, 23 nt, Homo sapiens
cucugcgaauauacuaaacauca

SEQ ID NO: 2073245 - RNA, 13 nt, Homo sapiens
aaugccucuucau

SEQ ID NO: 2073246 - RNA, 19 nt, Homo sapiens
caggcuagagugcaauggc

SEQ ID NO: 2073247 - RNA, 19 nt, Homo sapiens
caggcuggagugcaguggc

SEQ ID NO: 2073248 - RNA, 15 nt, Homo sapiens
uaaaagaaugacuau

SEQ ID NO: 2073249 - RNA, 15 nt, Homo sapiens
cauuucucucuccag

SEQ ID NO: 2073250 - RNA, 18 nt, Homo sapiens
gucugaauagaaucugga

SEQ ID NO: 2073251 - RNA, 12 nt, Homo sapiens
gaaaauugcaau

SEQ ID NO: 2073252 - RNA, 15 nt, Homo sapiens
auggaaauaguacua

SEQ ID NO: 2073253 - RNA, 19 nt, Homo sapiens
guggcccagggaagccaaa

SEQ ID NO: 2073254 - RNA, 17 nt, Homo sapiens
agugguccccagaggug

SEQ ID NO: 2073255 - RNA, 23 nt, Homo sapiens
cuggaaaacagaaaccauucuag

SEQ ID NO: 2073256 - RNA, 15 nt, Homo sapiens
agcccuccucuccca

SEQ ID NO: 2073257 - RNA, 18 nt, Homo sapiens
uuguucugcugucuggga

SEQ ID NO: 2073258 - RNA, 18 nt, Homo sapiens
gccccuggucccucugca

SEQ ID NO: 2073259 - RNA, 19 nt, Homo sapiens
ugugauuauuucacuuuag

SEQ ID NO: 2073260 - RNA, 20 nt, Homo sapiens
aaccccugucacacagggaa

SEQ ID NO: 2073261 - RNA, 20 nt, Homo sapiens
uauccacuacuccgugaagg

SEQ ID NO: 2073262 - RNA, 11 nt, Homo sapiens
uguuguucacg

SEQ ID NO: 2073263 - RNA, 16 nt, Homo sapiens
ugacuccuuucucuaa

SEQ ID NO: 2073264 - RNA, 18 nt, Homo sapiens
cagguucuuuaaaaugcc

SEQ ID NO: 2073265 - RNA, 23 nt, Homo sapiens
ccuugggccuuucagucccaaag

SEQ ID NO: 2073266 - RNA, 19 nt, Homo sapiens
cuccccgggcagcagagag

SEQ ID NO: 2073267 - RNA, 18 nt, Homo sapiens
gcaaaacucccaauggau

SEQ ID NO: 2073268 - RNA, 22 nt, Homo sapiens
ccugugugauacaagagucagc

SEQ ID NO: 2073269 - RNA, 18 nt, Homo sapiens
ucggugugaacuuuucuc

SEQ ID NO: 2073270 - RNA, 20 nt, Homo sapiens
uuagccaggauggucuggau

SEQ ID NO: 2073271 - RNA, 17 nt, Homo sapiens
ucaugcuuuugcuugca

SEQ ID NO: 2073272 - RNA, 16 nt, Homo sapiens
cauccuauucuuucga

SEQ ID NO: 2073273 - RNA, 19 nt, Homo sapiens
acagcagcugaagccagcu

SEQ ID NO: 2073274 - RNA, 17 nt, Homo sapiens
uuaaauuuuuuguugac

SEQ ID NO: 2073275 - RNA, 15 nt, Homo sapiens
ucacuucugucuccu

SEQ ID NO: 2073276 - RNA, 13 nt, Homo sapiens
ucugaaauccaua

SEQ ID NO: 2073277 - RNA, 16 nt, Homo sapiens
aagugacccugcucuc

SEQ ID NO: 2073278 - RNA, 17 nt, Homo sapiens
agauaauuauaauauac

SEQ ID NO: 2073279 - RNA, 14 nt, Homo sapiens
uaacacuaauaaua

SEQ ID NO: 2073280 - RNA, 15 nt, Homo sapiens
acuugcauugugauu

SEQ ID NO: 2073281 - RNA, 14 nt, Homo sapiens
aacuaugugaugaa

SEQ ID NO: 2073282 - RNA, 20 nt, Homo sapiens
cauagaugacccccagguau

SEQ ID NO: 2073283 - RNA, 11 nt, Homo sapiens
gccagcacuuc

SEQ ID NO: 2073284 - RNA, 21 nt, Homo sapiens
caaggccuaugccaccugcag

SEQ ID NO: 2073285 - RNA, 20 nt, Homo sapiens
gacaugcuaaccucucugaa

SEQ ID NO: 2073286 - RNA, 18 nt, Homo sapiens
agugcuaauaaaguuaaa

SEQ ID NO: 2073287 - RNA, 23 nt, Homo sapiens
auggcaacagaucuggaaccuca

SEQ ID NO: 2073288 - RNA, 23 nt, Homo sapiens
ucaauauuugaucuaaguugcau

SEQ ID NO: 2073289 - RNA, 15 nt, Homo sapiens
cacucagcacuuucc

SEQ ID NO: 2073290 - RNA, 22 nt, Homo sapiens
uuugauaagaaaaccgaacugg

SEQ ID NO: 2073291 - RNA, 14 nt, Homo sapiens
uaaaauguauucaa

SEQ ID NO: 2073292 - RNA, 17 nt, Homo sapiens
caguuuccuggggcaca

SEQ ID NO: 2073293 - RNA, 17 nt, Homo sapiens
ucguggugggugcucaa

SEQ ID NO: 2073294 - RNA, 12 nt, Homo sapiens
auuugcaacuca

SEQ ID NO: 2073295 - RNA, 19 nt, Homo sapiens
uuggguccaccaugcagaa

SEQ ID NO: 2073296 - RNA, 16 nt, Homo sapiens
uucuuagguaaccuua

SEQ ID NO: 2073297 - RNA, 15 nt, Homo sapiens
guggaaugcauccaa

SEQ ID NO: 2073298 - RNA, 20 nt, Homo sapiens
gcuuugaaaaaacaccauga

SEQ ID NO: 2073299 - RNA, 16 nt, Homo sapiens
caauuuguauuacuuu

SEQ ID NO: 2073300 - RNA, 22 nt, Homo sapiens
gggcaucggcaggagagugugu

SEQ ID NO: 2073301 - RNA, 17 nt, Homo sapiens
ucuggauucaaauguca

SEQ ID NO: 2073302 - RNA, 17 nt, Homo sapiens
uuaggaaaggagaucaa

SEQ ID NO: 2073303 - RNA, 19 nt, Homo sapiens
uaaugcucaacaauuuauc

SEQ ID NO: 2073304 - RNA, 18 nt, Homo sapiens
aaauuauguauguuuaca

SEQ ID NO: 2073305 - RNA, 16 nt, Homo sapiens
gccacagcagcuuugu

SEQ ID NO: 2073306 - RNA, 19 nt, Homo sapiens
agcuuguugaaaacccaga

SEQ ID NO: 2073307 - RNA, 14 nt, Homo sapiens
ccauucacuacuca

SEQ ID NO: 2073308 - RNA, 14 nt, Homo sapiens
aaacuugaacucca

SEQ ID NO: 2073309 - RNA, 15 nt, Homo sapiens
aauaaauaaacgagc

SEQ ID NO: 2073310 - RNA, 17 nt, Homo sapiens
ccuccuccaccacagaa

SEQ ID NO: 2073311 - RNA, 13 nt, Homo sapiens
cucccagacugca

SEQ ID NO: 2073312 - RNA, 22 nt, Homo sapiens
cccaucucuacaaaaauaaaga

SEQ ID NO: 2073313 - RNA, 22 nt, Homo sapiens
uaaugcuuuuacuaagcacugu

SEQ ID NO: 2073314 - RNA, 14 nt, Homo sapiens
uugaaguaugguug

SEQ ID NO: 2073315 - RNA, 16 nt, Homo sapiens
gaaugcaugcuuucca

SEQ ID NO: 2073316 - RNA, 22 nt, Homo sapiens
aaacucuguccacgauucacuc

SEQ ID NO: 2073317 - RNA, 16 nt, Homo sapiens
cuauaacuauguugau

SEQ ID NO: 2073318 - RNA, 18 nt, Homo sapiens
auuuuauuuuucucauga

SEQ ID NO: 2073319 - RNA, 20 nt, Homo sapiens
uaagacuucuggugcugcug

SEQ ID NO: 2073320 - RNA, 22 nt, Homo sapiens
aaugacuuuuaauuuucacuuu

SEQ ID NO: 2073321 - RNA, 20 nt, Homo sapiens
ucuuaucccuugacaaaaau

SEQ ID NO: 2073322 - RNA, 20 nt, Homo sapiens
ggcugcucggcuugaucaca

SEQ ID NO: 2073323 - RNA, 20 nt, Homo sapiens
gguggcgguggaccaaagga

SEQ ID NO: 2073324 - RNA, 13 nt, Homo sapiens
gggccucauucua

SEQ ID NO: 2073325 - RNA, 16 nt, Homo sapiens
gauguuagccugcaaa

SEQ ID NO: 2073326 - RNA, 16 nt, Homo sapiens
guuuaaaguugcacau

SEQ ID NO: 2073327 - RNA, 14 nt, Homo sapiens
ucugaucaguauug

SEQ ID NO: 2073328 - RNA, 20 nt, Homo sapiens
aagauuguccuuuucuccca

SEQ ID NO: 2073329 - RNA, 22 nt, Homo sapiens
auuuauuuuuuguuuguuuauu

SEQ ID NO: 2073330 - RNA, 16 nt, Homo sapiens
gucucccugagccugc

SEQ ID NO: 2073331 - RNA, 17 nt, Homo sapiens
aaacauaggaagcccuc

SEQ ID NO: 2073332 - RNA, 19 nt, Homo sapiens
cacagugaugaauguacua

SEQ ID NO: 2073333 - RNA, 15 nt, Homo sapiens
ugucaaaacaagacu

SEQ ID NO: 2073334 - RNA, 15 nt, Homo sapiens
aauccuuacuuuugu

SEQ ID NO: 2073335 - RNA, 23 nt, Homo sapiens
cuguuacauaacaagaaaaucaa

SEQ ID NO: 2073336 - RNA, 16 nt, Homo sapiens
auguguuucaggugga

SEQ ID NO: 2073337 - RNA, 15 nt, Homo sapiens
aacuaggaaaaucac

SEQ ID NO: 2073338 - RNA, 17 nt, Homo sapiens
accucuauauaccaaag

SEQ ID NO: 2073339 - RNA, 18 nt, Homo sapiens
gcaaagaacucauuugaa

SEQ ID NO: 2073340 - RNA, 18 nt, Homo sapiens
aacuaaauuugucuuuca

SEQ ID NO: 2073341 - RNA, 17 nt, Homo sapiens
ccucagugagcccaucu

SEQ ID NO: 2073342 - RNA, 16 nt, Homo sapiens
agaaggaagugagcau

SEQ ID NO: 2073343 - RNA, 17 nt, Homo sapiens
uuauauauuuauagcaa

SEQ ID NO: 2073344 - RNA, 15 nt, Homo sapiens
agugcuaagcugccc

SEQ ID NO: 2073345 - RNA, 20 nt, Homo sapiens
ccuagauuuuaaauagacaa

SEQ ID NO: 2073346 - RNA, 21 nt, Homo sapiens
gugauuuuauggugaugucac

SEQ ID NO: 2073347 - RNA, 19 nt, Homo sapiens
caaggguggcaggucacug

SEQ ID NO: 2073348 - RNA, 20 nt, Homo sapiens
ugcucaaagauguacugaga

SEQ ID NO: 2073349 - RNA, 19 nt, Homo sapiens
cacaccgugugccauagaa

SEQ ID NO: 2073350 - RNA, 15 nt, Homo sapiens
cuuauuuaugugaac

SEQ ID NO: 2073351 - RNA, 20 nt, Homo sapiens
uaucaaauagcgaugugcag

SEQ ID NO: 2073352 - RNA, 22 nt, Homo sapiens
ugaauaauuuucuggcacuggu

SEQ ID NO: 2073353 - RNA, 12 nt, Homo sapiens
auauucauuuca

SEQ ID NO: 2073354 - RNA, 18 nt, Homo sapiens
cuccugucccucauccau

SEQ ID NO: 2073355 - RNA, 12 nt, Homo sapiens
caagaaauggau

SEQ ID NO: 2073356 - RNA, 20 nt, Homo sapiens
gaagaccuucugaagaucuc

SEQ ID NO: 2073357 - RNA, 22 nt, Homo sapiens
aguucccuccugcagccugacc

SEQ ID NO: 2073358 - RNA, 15 nt, Homo sapiens
aaagauuuggaaaac

SEQ ID NO: 2073359 - RNA, 18 nt, Homo sapiens
gguccuacugcugugagc

SEQ ID NO: 2073360 - RNA, 15 nt, Homo sapiens
acaauggcaauagga

SEQ ID NO: 2073361 - RNA, 14 nt, Homo sapiens
uagcucgugugcuu

SEQ ID NO: 2073362 - RNA, 11 nt, Homo sapiens
cucauuucacu

SEQ ID NO: 2073363 - RNA, 16 nt, Homo sapiens
cuuuuaaaaucaguga

SEQ ID NO: 2073364 - RNA, 16 nt, Homo sapiens
cauuuuagaacagagg

SEQ ID NO: 2073365 - RNA, 17 nt, Homo sapiens
cagacagaaaaaacuga

SEQ ID NO: 2073366 - RNA, 17 nt, Homo sapiens
caaaguacugggauuac

SEQ ID NO: 2073367 - RNA, 18 nt, Homo sapiens
uauuuucuaaccaaauac

SEQ ID NO: 2073368 - RNA, 15 nt, Homo sapiens
guggaucaagcuugu

SEQ ID NO: 2073369 - RNA, 13 nt, Homo sapiens
aauuugguuaaua

SEQ ID NO: 2073370 - RNA, 18 nt, Homo sapiens
gcaaagggagcacugggu

SEQ ID NO: 2073371 - RNA, 19 nt, Homo sapiens
uugaugggugcugcccuca

SEQ ID NO: 2073372 - RNA, 22 nt, Homo sapiens
ucaaauauauuucaagcuauaa

SEQ ID NO: 2073373 - RNA, 15 nt, Homo sapiens
cacugugcaggccca

SEQ ID NO: 2073374 - RNA, 17 nt, Homo sapiens
cuuuggcuucagaauug

SEQ ID NO: 2073375 - RNA, 18 nt, Homo sapiens
ucuuuaaauuucaucuca

SEQ ID NO: 2073376 - RNA, 14 nt, Homo sapiens
ugcuuuuaucagug

SEQ ID NO: 2073377 - RNA, 21 nt, Homo sapiens
acaaaccgagugcaaugaaug

SEQ ID NO: 2073378 - RNA, 22 nt, Homo sapiens
uccucucccuugugagucuuca

SEQ ID NO: 2073379 - RNA, 16 nt, Homo sapiens
acucucgugcauuuca

SEQ ID NO: 2073380 - RNA, 15 nt, Homo sapiens
guaagaugacucuga

SEQ ID NO: 2073381 - RNA, 22 nt, Homo sapiens
gcccuucgcugccaggacaccu

SEQ ID NO: 2073382 - RNA, 22 nt, Homo sapiens
ugggugugcccacgaagacaac

SEQ ID NO: 2073383 - RNA, 16 nt, Homo sapiens
caauccugauucauau

SEQ ID NO: 2073384 - RNA, 21 nt, Homo sapiens
ggcuuaccuguacacugacuu

SEQ ID NO: 2073385 - RNA, 19 nt, Homo sapiens
ggcagcggggcaagcaaaa

SEQ ID NO: 2073386 - RNA, 18 nt, Homo sapiens
auaauaaaaggaguucag

SEQ ID NO: 2073387 - RNA, 17 nt, Homo sapiens
uuuacagucacauucag

SEQ ID NO: 2073388 - RNA, 12 nt, Homo sapiens
aaaaaugaauua

SEQ ID NO: 2073389 - RNA, 19 nt, Homo sapiens
acaguuguguuagccucuu

SEQ ID NO: 2073390 - RNA, 13 nt, Homo sapiens
ggaugggccuuug

SEQ ID NO: 2073391 - RNA, 19 nt, Homo sapiens
gaggauaagccacugggca

SEQ ID NO: 2073392 - RNA, 19 nt, Homo sapiens
cuuccuucucuacucaugc

SEQ ID NO: 2073393 - RNA, 11 nt, Homo sapiens
uuuccauacag

SEQ ID NO: 2073394 - RNA, 22 nt, Homo sapiens
agaagccagugcggcagguuca

SEQ ID NO: 2073395 - RNA, 22 nt, Homo sapiens
auuucuuuuaaaauaagcauuu

SEQ ID NO: 2073396 - RNA, 15 nt, Homo sapiens
aagugcgauaacuua

SEQ ID NO: 2073397 - RNA, 14 nt, Homo sapiens
gccagcugcagcug

SEQ ID NO: 2073398 - RNA, 20 nt, Homo sapiens
aauguccuuguggucuuugc

SEQ ID NO: 2073399 - RNA, 17 nt, Homo sapiens
cagauuuucaugcaaaa

SEQ ID NO: 2073400 - RNA, 23 nt, Homo sapiens
guugcaguuuuuuaaauguguuc

SEQ ID NO: 2073401 - RNA, 22 nt, Homo sapiens
uacuugaagauuaauguaggau

SEQ ID NO: 2073402 - RNA, 22 nt, Homo sapiens
ugcacuuagccaugauggcaac

SEQ ID NO: 2073403 - RNA, 15 nt, Homo sapiens
acacaugagaucuag

SEQ ID NO: 2073404 - RNA, 17 nt, Homo sapiens
aauuaccuuuaaugcaa

SEQ ID NO: 2073405 - RNA, 23 nt, Homo sapiens
guacacaacuuagaaaccaaauu

SEQ ID NO: 2073406 - RNA, 17 nt, Homo sapiens
uggaauauuugcuuuau

SEQ ID NO: 2073407 - RNA, 22 nt, Homo sapiens
auaaagauuuuuguuaagcuca

SEQ ID NO: 2073408 - RNA, 18 nt, Homo sapiens
cuuugaccucuucucucc

SEQ ID NO: 2073409 - RNA, 23 nt, Homo sapiens
uaucucaggggccaacuaggcag

SEQ ID NO: 2073410 - RNA, 14 nt, Homo sapiens
cccgacuuccugac

SEQ ID NO: 2073411 - RNA, 14 nt, Homo sapiens
cuaggaaaagggau

SEQ ID NO: 2073412 - RNA, 15 nt, Homo sapiens
ucacucugaccuuau

SEQ ID NO: 2073413 - RNA, 16 nt, Homo sapiens
gcugugguguguuccc

SEQ ID NO: 2073414 - RNA, 11 nt, Homo sapiens
aaucucaauac

SEQ ID NO: 2073415 - RNA, 21 nt, Homo sapiens
uuuaaaaauaaagcuacugaa

SEQ ID NO: 2073416 - RNA, 16 nt, Homo sapiens
uguccaccaccaccug

SEQ ID NO: 2073417 - RNA, 19 nt, Homo sapiens
auaggugcuacaaaaacac

SEQ ID NO: 2073418 - RNA, 21 nt, Homo sapiens
ucuucagacuuaaagcacuga

SEQ ID NO: 2073419 - RNA, 18 nt, Homo sapiens
aucuguuuccuguucucu

SEQ ID NO: 2073420 - RNA, 21 nt, Homo sapiens
agucuccccaccucuucccug

SEQ ID NO: 2073421 - RNA, 19 nt, Homo sapiens
caaugaaaacagucccauc

SEQ ID NO: 2073422 - RNA, 20 nt, Homo sapiens
ccugcugacaauuucccaca

SEQ ID NO: 2073423 - RNA, 16 nt, Homo sapiens
acaauucuucugucaa

SEQ ID NO: 2073424 - RNA, 13 nt, Homo sapiens
gccccagugacag

SEQ ID NO: 2073425 - RNA, 15 nt, Homo sapiens
ucagcaagacauaaa

SEQ ID NO: 2073426 - RNA, 15 nt, Homo sapiens
gcacuugauucagga

SEQ ID NO: 2073427 - RNA, 14 nt, Homo sapiens
gaccuaggcucaug

SEQ ID NO: 2073428 - RNA, 15 nt, Homo sapiens
ucugggcucugagua

SEQ ID NO: 2073429 - RNA, 14 nt, Homo sapiens
cuccugugugcugg

SEQ ID NO: 2073430 - RNA, 13 nt, Homo sapiens
ccagaaacuuuaa

SEQ ID NO: 2073431 - RNA, 14 nt, Homo sapiens
acugaaacauuuga

SEQ ID NO: 2073432 - RNA, 21 nt, Homo sapiens
ucauccauagacacaguauug

SEQ ID NO: 2073433 - RNA, 16 nt, Homo sapiens
guucagaucucauaga

SEQ ID NO: 2073434 - RNA, 13 nt, Homo sapiens
acagccagcuccu

SEQ ID NO: 2073435 - RNA, 15 nt, Homo sapiens
aaauaacugaaccaa

SEQ ID NO: 2073436 - RNA, 17 nt, Homo sapiens
caggaguaccuggaccu

SEQ ID NO: 2073437 - RNA, 20 nt, Homo sapiens
uguacaaugaacccccauga

SEQ ID NO: 2073438 - RNA, 15 nt, Homo sapiens
ucagugaacugugag

SEQ ID NO: 2073439 - RNA, 18 nt, Homo sapiens
uuacugucaaaauauuuc

SEQ ID NO: 2073440 - RNA, 22 nt, Homo sapiens
cuccuaccccuguccuggggcu

SEQ ID NO: 2073441 - RNA, 15 nt, Homo sapiens
ccucugcuugccagc

SEQ ID NO: 2073442 - RNA, 20 nt, Homo sapiens
aauucuuaccucauuugcau

SEQ ID NO: 2073443 - RNA, 18 nt, Homo sapiens
auuuaauuacuacuaggu

SEQ ID NO: 2073444 - RNA, 13 nt, Homo sapiens
ccuuucauuugaa

SEQ ID NO: 2073445 - RNA, 21 nt, Homo sapiens
uguuaacauggacaugaucuu

SEQ ID NO: 2073446 - RNA, 11 nt, Homo sapiens
augaguuaaau

SEQ ID NO: 2073447 - RNA, 18 nt, Homo sapiens
cucauuguacaagugaga

SEQ ID NO: 2073448 - RNA, 22 nt, Homo sapiens
auagaugcuggcccagggccca

SEQ ID NO: 2073449 - RNA, 16 nt, Homo sapiens
ucccagauagcugcau

SEQ ID NO: 2073450 - RNA, 10 nt, Homo sapiens
cccaguucuc

SEQ ID NO: 2073451 - RNA, 18 nt, Homo sapiens
caaucuuaacaaaaguga

SEQ ID NO: 2073452 - RNA, 21 nt, Homo sapiens
gcauauaaauuccccauauuu

SEQ ID NO: 2073453 - RNA, 14 nt, Homo sapiens
aucgaagcucuguu

SEQ ID NO: 2073454 - RNA, 21 nt, Homo sapiens
uacauuuuuugggcagcaauu

SEQ ID NO: 2073455 - RNA, 14 nt, Homo sapiens
ucuagugugcugcc

SEQ ID NO: 2073456 - RNA, 15 nt, Homo sapiens
uaaaagugacucuca

SEQ ID NO: 2073457 - RNA, 18 nt, Homo sapiens
gcggaucuuuggacagaa

SEQ ID NO: 2073458 - RNA, 14 nt, Homo sapiens
gauguccucaccac

SEQ ID NO: 2073459 - RNA, 13 nt, Homo sapiens
acaaacugaagag

SEQ ID NO: 2073460 - RNA, 19 nt, Homo sapiens
ggggguguaucacagucag

SEQ ID NO: 2073461 - RNA, 14 nt, Homo sapiens
caccucuccaggug

SEQ ID NO: 2073462 - RNA, 18 nt, Homo sapiens
gagcuucauauaccagca

SEQ ID NO: 2073463 - RNA, 14 nt, Homo sapiens
gaucacugccacac

SEQ ID NO: 2073464 - RNA, 14 nt, Homo sapiens
auaaacagcuucau

SEQ ID NO: 2073465 - RNA, 15 nt, Homo sapiens
ugcuuucaauugaug

SEQ ID NO: 2073466 - RNA, 22 nt, Homo sapiens
auuauucuuguaguuuaccucu

SEQ ID NO: 2073467 - RNA, 13 nt, Homo sapiens
gcucucgacagua

SEQ ID NO: 2073468 - RNA, 16 nt, Homo sapiens
gccugagagacccuca

SEQ ID NO: 2073469 - RNA, 17 nt, Homo sapiens
ccauuucugagaucaaa

SEQ ID NO: 2073470 - RNA, 15 nt, Homo sapiens
cugcaggugggauga

SEQ ID NO: 2073471 - RNA, 13 nt, Homo sapiens
agagccuguaaac

SEQ ID NO: 2073472 - RNA, 15 nt, Homo sapiens
auugggaguccaggc

SEQ ID NO: 2073473 - RNA, 16 nt, Homo sapiens
gcagaguacaaaguaa

SEQ ID NO: 2073474 - RNA, 21 nt, Homo sapiens
uuggucauauugccaacugga

SEQ ID NO: 2073475 - RNA, 19 nt, Homo sapiens
agaguacuuaauauacuca

SEQ ID NO: 2073476 - RNA, 18 nt, Homo sapiens
cugucauucaaaugggug

SEQ ID NO: 2073477 - RNA, 17 nt, Homo sapiens
gaagcuguauaauuaau

SEQ ID NO: 2073478 - RNA, 18 nt, Homo sapiens
aauuucgguuauagcuua

SEQ ID NO: 2073479 - RNA, 13 nt, Homo sapiens
auguuuacacugu

SEQ ID NO: 2073480 - RNA, 20 nt, Homo sapiens
aggucugguccgagucucag

SEQ ID NO: 2073481 - RNA, 23 nt, Homo sapiens
guuucagaagcauucaggcacug

SEQ ID NO: 2073482 - RNA, 12 nt, Homo sapiens
agccacaccgcu

SEQ ID NO: 2073483 - RNA, 16 nt, Homo sapiens
caaucaugcuguguaa

SEQ ID NO: 2073484 - RNA, 15 nt, Homo sapiens
cuuccauaggacaaa

SEQ ID NO: 2073485 - RNA, 15 nt, Homo sapiens
cccagggcacuucac

SEQ ID NO: 2073486 - RNA, 20 nt, Homo sapiens
uccucuaguuuuaagacuga

SEQ ID NO: 2073487 - RNA, 17 nt, Homo sapiens
guggaccaguucccuca

SEQ ID NO: 2073488 - RNA, 23 nt, Homo sapiens
auuucuucccgcacaaauuccac

SEQ ID NO: 2073489 - RNA, 15 nt, Homo sapiens
gacaauauacuucac

SEQ ID NO: 2073490 - RNA, 11 nt, Homo sapiens
cugacuuugaa

SEQ ID NO: 2073491 - RNA, 14 nt, Homo sapiens
ugggcaaugugaua

SEQ ID NO: 2073492 - RNA, 14 nt, Homo sapiens
accacccacuugau

SEQ ID NO: 2073493 - RNA, 22 nt, Homo sapiens
acagcuuauggcaucucauuga

SEQ ID NO: 2073494 - RNA, 17 nt, Homo sapiens
augcccucaucauccca

SEQ ID NO: 2073495 - RNA, 21 nt, Homo sapiens
cuuuugaggggcugacuucaa

SEQ ID NO: 2073496 - RNA, 19 nt, Homo sapiens
caaaauacagcacuuugac

SEQ ID NO: 2073497 - RNA, 20 nt, Homo sapiens
cugcaggcagccuugcccau

SEQ ID NO: 2073498 - RNA, 13 nt, Homo sapiens
uguaaauaugcaa

SEQ ID NO: 2073499 - RNA, 22 nt, Homo sapiens
uuacagaauaacugguacacuu

SEQ ID NO: 2073500 - RNA, 21 nt, Homo sapiens
gccaucugugcacacuaagaa

SEQ ID NO: 2073501 - RNA, 19 nt, Homo sapiens
caagaagaccaugaucuca

SEQ ID NO: 2073502 - RNA, 17 nt, Homo sapiens
accuaguaugcucagua

SEQ ID NO: 2073503 - RNA, 12 nt, Homo sapiens
ccugagaucccc

SEQ ID NO: 2073504 - RNA, 13 nt, Homo sapiens
uuuauauacuuag

SEQ ID NO: 2073505 - RNA, 20 nt, Homo sapiens
cagauuuucuaagaaccaaa

SEQ ID NO: 2073506 - RNA, 14 nt, Homo sapiens
acauccaugaaaau

SEQ ID NO: 2073507 - RNA, 22 nt, Homo sapiens
ugacgugccuuuugcaccccuc

SEQ ID NO: 2073508 - RNA, 20 nt, Homo sapiens
gaccagucccgucgugcagu

SEQ ID NO: 2073509 - RNA, 15 nt, Homo sapiens
cuauugucuguaaua

SEQ ID NO: 2073510 - RNA, 23 nt, Homo sapiens
auacagcuguccacacugaagaa

SEQ ID NO: 2073511 - RNA, 18 nt, Homo sapiens
ggauaauaacuagaucuc

SEQ ID NO: 2073512 - RNA, 22 nt, Homo sapiens
ugguucauccaucaucugcugc

SEQ ID NO: 2073513 - RNA, 21 nt, Homo sapiens
ugaccauaugcacaauuccau

SEQ ID NO: 2073514 - RNA, 16 nt, Homo sapiens
ccgggcuggccugaca

SEQ ID NO: 2073515 - RNA, 14 nt, Homo sapiens
ugaacuaaguuauu

SEQ ID NO: 2073516 - RNA, 14 nt, Homo sapiens
uguucuaaguauuu

SEQ ID NO: 2073517 - RNA, 24 nt, Homo sapiens
agauugcuagaaaagacauaauca

SEQ ID NO: 2073518 - RNA, 19 nt, Homo sapiens
uggagaacucagugccaca

SEQ ID NO: 2073519 - RNA, 22 nt, Homo sapiens
cauggugaaaccguaucucuaa

SEQ ID NO: 2073520 - RNA, 16 nt, Homo sapiens
guauuuuacuuuucca

SEQ ID NO: 2073521 - RNA, 13 nt, Homo sapiens
cccacugcuucua

SEQ ID NO: 2073522 - RNA, 17 nt, Homo sapiens
aaauauguucugacaua

SEQ ID NO: 2073523 - RNA, 13 nt, Homo sapiens
cagagccuagcca

SEQ ID NO: 2073524 - RNA, 16 nt, Homo sapiens
uagaacaagaugcacu

SEQ ID NO: 2073525 - RNA, 21 nt, Homo sapiens
gguccaaaggccagcggugac

SEQ ID NO: 2073526 - RNA, 21 nt, Homo sapiens
caagccugaaaguaauuucaa

SEQ ID NO: 2073527 - RNA, 14 nt, Homo sapiens
ccauuguaauauua

SEQ ID NO: 2073528 - RNA, 15 nt, Homo sapiens
ggccaaaguguacaa

SEQ ID NO: 2073529 - RNA, 19 nt, Homo sapiens
gggaccagugaccaucaca

SEQ ID NO: 2073530 - RNA, 22 nt, Homo sapiens
cuaguuuuaucuuaacacugaa

SEQ ID NO: 2073531 - RNA, 20 nt, Homo sapiens
cugggcaggaaaccccagcg

SEQ ID NO: 2073532 - RNA, 12 nt, Homo sapiens
gcuguaccacaa

SEQ ID NO: 2073533 - RNA, 22 nt, Homo sapiens
acuccacuggacagacccaggu

SEQ ID NO: 2073534 - RNA, 16 nt, Homo sapiens
uggccaggggccagga

SEQ ID NO: 2073535 - RNA, 15 nt, Homo sapiens
ccaggucucacgggc

SEQ ID NO: 2073536 - RNA, 15 nt, Homo sapiens
aaacccagugagaca

SEQ ID NO: 2073537 - RNA, 21 nt, Homo sapiens
aguagucacaaacugaucuaa

SEQ ID NO: 2073538 - RNA, 20 nt, Homo sapiens
gaugcacuaccauugcuguu

SEQ ID NO: 2073539 - RNA, 11 nt, Homo sapiens
auccugggcug

SEQ ID NO: 2073540 - RNA, 11 nt, Homo sapiens
augcugggcuc

SEQ ID NO: 2073541 - RNA, 15 nt, Homo sapiens
guuucagcauuccca

SEQ ID NO: 2073542 - RNA, 13 nt, Homo sapiens
aggaucucugaaa

SEQ ID NO: 2073543 - RNA, 19 nt, Homo sapiens
gcuuccuggaacuugcucu

SEQ ID NO: 2073544 - RNA, 15 nt, Homo sapiens
agaugacagggaaaa

SEQ ID NO: 2073545 - RNA, 14 nt, Homo sapiens
ucucuuugccucaa

SEQ ID NO: 2073546 - RNA, 15 nt, Homo sapiens
agaacuugaauuucu

SEQ ID NO: 2073547 - RNA, 14 nt, Homo sapiens
cauauauguauaau

SEQ ID NO: 2073548 - RNA, 17 nt, Homo sapiens
auggagaaccaccauuc

SEQ ID NO: 2073549 - RNA, 20 nt, Homo sapiens
uuucugcaucaguucacugc

SEQ ID NO: 2073550 - RNA, 18 nt, Homo sapiens
cugggauccaguguauaa

SEQ ID NO: 2073551 - RNA, 19 nt, Homo sapiens
augccucucucaggccaaa

SEQ ID NO: 2073552 - RNA, 17 nt, Homo sapiens
caagugugcacuccagc

SEQ ID NO: 2073553 - RNA, 13 nt, Homo sapiens
ggccugagcaaca

SEQ ID NO: 2073554 - RNA, 16 nt, Homo sapiens
ccugaugcagagccuu

SEQ ID NO: 2073555 - RNA, 14 nt, Homo sapiens
cugguaagggccaa

SEQ ID NO: 2073556 - RNA, 13 nt, Homo sapiens
auucucagcacuu

SEQ ID NO: 2073557 - RNA, 16 nt, Homo sapiens
ggaaagccuuccucaa

SEQ ID NO: 2073558 - RNA, 21 nt, Homo sapiens
uacuucagcucacacaugaga

SEQ ID NO: 2073559 - RNA, 19 nt, Homo sapiens
caaaauaggauuucuuaaa

SEQ ID NO: 2073560 - RNA, 18 nt, Homo sapiens
agugccuucagccaagac

SEQ ID NO: 2073561 - RNA, 15 nt, Homo sapiens
ccacaguugcucuau

SEQ ID NO: 2073562 - RNA, 15 nt, Homo sapiens
aggaagaucuugaga

SEQ ID NO: 2073563 - RNA, 18 nt, Homo sapiens
uauuuaaccuauuuccac

SEQ ID NO: 2073564 - RNA, 23 nt, Homo sapiens
guuuuguagagauggggucucac

SEQ ID NO: 2073565 - RNA, 11 nt, Homo sapiens
auaugugcacu

SEQ ID NO: 2073566 - RNA, 18 nt, Homo sapiens
auucuacuagcaggcaau

SEQ ID NO: 2073567 - RNA, 23 nt, Homo sapiens
uacacucauggggaagcuuccau

SEQ ID NO: 2073568 - RNA, 13 nt, Homo sapiens
ugccagugacaug

SEQ ID NO: 2073569 - RNA, 17 nt, Homo sapiens
ucuaugagggcuaauau

SEQ ID NO: 2073570 - RNA, 21 nt, Homo sapiens
agcaccuccgccagauccugc

SEQ ID NO: 2073571 - RNA, 11 nt, Homo sapiens
cguaucaugca

SEQ ID NO: 2073572 - RNA, 20 nt, Homo sapiens
augacugaaggacaucugac

SEQ ID NO: 2073573 - RNA, 23 nt, Homo sapiens
ccuugcuuucucuucuaauggaa

SEQ ID NO: 2073574 - RNA, 17 nt, Homo sapiens
ugacuugugucccauga

SEQ ID NO: 2073575 - RNA, 14 nt, Homo sapiens
auuguauuuaguua

SEQ ID NO: 2073576 - RNA, 18 nt, Homo sapiens
cccucaaccuccugugga

SEQ ID NO: 2073577 - RNA, 17 nt, Homo sapiens
ucccauaaagaaaguga

SEQ ID NO: 2073578 - RNA, 15 nt, Homo sapiens
cuccuccacucugag

SEQ ID NO: 2073579 - RNA, 12 nt, Homo sapiens
ugagaacacugu

SEQ ID NO: 2073580 - RNA, 16 nt, Homo sapiens
auugcuuuuccauuuc

SEQ ID NO: 2073581 - RNA, 14 nt, Homo sapiens
uuaaagaagcugca

SEQ ID NO: 2073582 - RNA, 14 nt, Homo sapiens
ucagugccaugacu

SEQ ID NO: 2073583 - RNA, 15 nt, Homo sapiens
gcaaagccaaaaccu

SEQ ID NO: 2073584 - RNA, 22 nt, Homo sapiens
uccgggagcggcuguugggcug

SEQ ID NO: 2073585 - RNA, 21 nt, Homo sapiens
uaucuuuaugcaaaaacauau

SEQ ID NO: 2073586 - RNA, 23 nt, Homo sapiens
guggcuucuccauccucauuugc

SEQ ID NO: 2073587 - RNA, 15 nt, Homo sapiens
ccugaauucuacuga

SEQ ID NO: 2073588 - RNA, 21 nt, Homo sapiens
agaucuguuaagugguuucau

SEQ ID NO: 2073589 - RNA, 17 nt, Homo sapiens
gcauuccuuuuucuuca

SEQ ID NO: 2073590 - RNA, 24 nt, Homo sapiens
uggucauuucuccccaugguaguu

SEQ ID NO: 2073591 - RNA, 20 nt, Homo sapiens
gcugacucuggccuuacaac

SEQ ID NO: 2073592 - RNA, 17 nt, Homo sapiens
aauuguuagauggcaau

SEQ ID NO: 2073593 - RNA, 17 nt, Homo sapiens
cucaggcagugcaguac

SEQ ID NO: 2073594 - RNA, 22 nt, Homo sapiens
gaaauguucucaugaacuaccc

SEQ ID NO: 2073595 - RNA, 19 nt, Homo sapiens
ccuguccucccgagcuccu

SEQ ID NO: 2073596 - RNA, 16 nt, Homo sapiens
aggugucccugagaac

SEQ ID NO: 2073597 - RNA, 16 nt, Homo sapiens
aggugucucugagaau

SEQ ID NO: 2073598 - RNA, 18 nt, Homo sapiens
ucuucugaauugacugua

SEQ ID NO: 2073599 - RNA, 19 nt, Homo sapiens
gaaacugaaacucacagua

SEQ ID NO: 2073600 - RNA, 13 nt, Homo sapiens
acaaauuccacag

SEQ ID NO: 2073601 - RNA, 21 nt, Homo sapiens
cagaugguugcaauugauccu

SEQ ID NO: 2073602 - RNA, 22 nt, Homo sapiens
uggacagucacugccacuuugc

SEQ ID NO: 2073603 - RNA, 14 nt, Homo sapiens
caccagccaucaug

SEQ ID NO: 2073604 - RNA, 15 nt, Homo sapiens
auguuuccagcauuc

SEQ ID NO: 2073605 - RNA, 23 nt, Homo sapiens
aauacacagaugauaauaugcua

SEQ ID NO: 2073606 - RNA, 17 nt, Homo sapiens
auauaccugguuuacuu

SEQ ID NO: 2073607 - RNA, 16 nt, Homo sapiens
auaccaaauggcacuu

SEQ ID NO: 2073608 - RNA, 19 nt, Homo sapiens
uguggaauugacucaaaaa

SEQ ID NO: 2073609 - RNA, 22 nt, Homo sapiens
ccaucaauauuauauucaagau

SEQ ID NO: 2073610 - RNA, 19 nt, Homo sapiens
gaaaauagagaugagcuuu

SEQ ID NO: 2073611 - RNA, 18 nt, Homo sapiens
aggacugugugaccuccc

SEQ ID NO: 2073612 - RNA, 23 nt, Homo sapiens
cuugaaagaaaggggcaggagcu

SEQ ID NO: 2073613 - RNA, 23 nt, Homo sapiens
gaaugagcuuccauuaugcugca

SEQ ID NO: 2073614 - RNA, 21 nt, Homo sapiens
guuggacacccagugccaggg

SEQ ID NO: 2073615 - RNA, 13 nt, Homo sapiens
uggugugaacucu

SEQ ID NO: 2073616 - RNA, 20 nt, Homo sapiens
ccaacgagacacauugccuu

SEQ ID NO: 2073617 - RNA, 14 nt, Homo sapiens
auugggaagcugua

SEQ ID NO: 2073618 - RNA, 16 nt, Homo sapiens
ucacccauuggugacc

SEQ ID NO: 2073619 - RNA, 15 nt, Homo sapiens
aauuaaugcauucaa

SEQ ID NO: 2073620 - RNA, 18 nt, Homo sapiens
ucagagaccuuccagaaa

SEQ ID NO: 2073621 - RNA, 14 nt, Homo sapiens
aagguucucugugc

SEQ ID NO: 2073622 - RNA, 15 nt, Homo sapiens
agcaaacaauggugu

SEQ ID NO: 2073623 - RNA, 17 nt, Homo sapiens
caguggcuucuugauga

SEQ ID NO: 2073624 - RNA, 13 nt, Homo sapiens
gugcccucucagg

SEQ ID NO: 2073625 - RNA, 16 nt, Homo sapiens
gcccuaguugugauca

SEQ ID NO: 2073626 - RNA, 19 nt, Homo sapiens
uccaggcuuaaaaucaguc

SEQ ID NO: 2073627 - RNA, 10 nt, Homo sapiens
cagagcaaaa

SEQ ID NO: 2073628 - RNA, 19 nt, Homo sapiens
ccaggcugcacugcaguga

SEQ ID NO: 2073629 - RNA, 22 nt, Homo sapiens
uucuuucaauauuuauuuccag

SEQ ID NO: 2073630 - RNA, 19 nt, Homo sapiens
guuacuguggccaguauuu

SEQ ID NO: 2073631 - RNA, 21 nt, Homo sapiens
uaagggcucacacauuuacug

SEQ ID NO: 2073632 - RNA, 21 nt, Homo sapiens
gcuugcccuguuaaaagauga

SEQ ID NO: 2073633 - RNA, 13 nt, Homo sapiens
gacagucuugcau

SEQ ID NO: 2073634 - RNA, 18 nt, Homo sapiens
agaucuggagcaacagcu

SEQ ID NO: 2073635 - RNA, 19 nt, Homo sapiens
gccuguaaucucacuacac

SEQ ID NO: 2073636 - RNA, 14 nt, Homo sapiens
aaucuaaaauggca

SEQ ID NO: 2073637 - RNA, 15 nt, Homo sapiens
cagcaguuacuguga

SEQ ID NO: 2073638 - RNA, 18 nt, Homo sapiens
caaauuagugaaccaaaa

SEQ ID NO: 2073639 - RNA, 13 nt, Homo sapiens
ccauauacuuuaa

SEQ ID NO: 2073640 - RNA, 12 nt, Homo sapiens
uguuuaguugca

SEQ ID NO: 2073641 - RNA, 17 nt, Homo sapiens
acuuaauacagauguau

SEQ ID NO: 2073642 - RNA, 19 nt, Homo sapiens
uguauuguucccagugaca

SEQ ID NO: 2073643 - RNA, 21 nt, Homo sapiens
uagcaaaacuaaauacuugcu

SEQ ID NO: 2073644 - RNA, 22 nt, Homo sapiens
caaagagacagcucuucuacua

SEQ ID NO: 2073645 - RNA, 14 nt, Homo sapiens
gaguucagugcuca

SEQ ID NO: 2073646 - RNA, 14 nt, Homo sapiens
aguagacugcagug

SEQ ID NO: 2073647 - RNA, 19 nt, Homo sapiens
agcagcacgccaaccccag

SEQ ID NO: 2073648 - RNA, 15 nt, Homo sapiens
ugcuauguucugucu

SEQ ID NO: 2073649 - RNA, 15 nt, Homo sapiens
auauagaacagugcu

SEQ ID NO: 2073650 - RNA, 12 nt, Homo sapiens
ugagcaugugau

SEQ ID NO: 2073651 - RNA, 22 nt, Homo sapiens
cauugauucuccuguccuugua

SEQ ID NO: 2073652 - RNA, 13 nt, Homo sapiens
cuuuguuaauuua

SEQ ID NO: 2073653 - RNA, 13 nt, Homo sapiens
cugggaauggagg

SEQ ID NO: 2073654 - RNA, 19 nt, Homo sapiens
uuauaguggugucccuaaa

SEQ ID NO: 2073655 - RNA, 16 nt, Homo sapiens
uuccuuuccuuuccuu

SEQ ID NO: 2073656 - RNA, 20 nt, Homo sapiens
aagcacaggugggcuuccca

SEQ ID NO: 2073657 - RNA, 19 nt, Homo sapiens
guuagccuggugacaggca

SEQ ID NO: 2073658 - RNA, 18 nt, Homo sapiens
gcagacacauugucauca

SEQ ID NO: 2073659 - RNA, 10 nt, Homo sapiens
cuaaacugua

SEQ ID NO: 2073660 - RNA, 17 nt, Homo sapiens
gcccacacacacccacu

SEQ ID NO: 2073661 - RNA, 15 nt, Homo sapiens
acauguucugugccu

SEQ ID NO: 2073662 - RNA, 22 nt, Homo sapiens
cugcuguuaucuuuuuaacugu

SEQ ID NO: 2073663 - RNA, 14 nt, Homo sapiens
aucccaaaugugga

SEQ ID NO: 2073664 - RNA, 22 nt, Homo sapiens
ggguaguuuuacccuauaucua

SEQ ID NO: 2073665 - RNA, 15 nt, Homo sapiens
ggucccccaugccac

SEQ ID NO: 2073666 - RNA, 16 nt, Homo sapiens
gguggugcaccacugu

SEQ ID NO: 2073667 - RNA, 21 nt, Homo sapiens
uuacuaaauaucauaaucuga

SEQ ID NO: 2073668 - RNA, 17 nt, Homo sapiens
gcguuugaacucaggga

SEQ ID NO: 2073669 - RNA, 16 nt, Homo sapiens
accaagaguauuccau

SEQ ID NO: 2073670 - RNA, 23 nt, Homo sapiens
aggccccucuccuccguggcaca

SEQ ID NO: 2073671 - RNA, 23 nt, Homo sapiens
caucgguucauauuaagacauaa

SEQ ID NO: 2073672 - RNA, 16 nt, Homo sapiens
aaccaugggcucaggg

SEQ ID NO: 2073673 - RNA, 14 nt, Homo sapiens
cuuccuggugagaa

SEQ ID NO: 2073674 - RNA, 14 nt, Homo sapiens
augucggucuugca

SEQ ID NO: 2073675 - RNA, 16 nt, Homo sapiens
aagucuaauucacagg

SEQ ID NO: 2073676 - RNA, 19 nt, Homo sapiens
augucuuuaaaaugauuca

SEQ ID NO: 2073677 - RNA, 12 nt, Homo sapiens
ugcaagaaucua

SEQ ID NO: 2073678 - RNA, 18 nt, Homo sapiens
cuauaaggccauaaaaca

SEQ ID NO: 2073679 - RNA, 19 nt, Homo sapiens
ugcuuaagugcaugcauug

SEQ ID NO: 2073680 - RNA, 22 nt, Homo sapiens
cauggggcauagaaacugagga

SEQ ID NO: 2073681 - RNA, 14 nt, Homo sapiens
auugacccagaaau

SEQ ID NO: 2073682 - RNA, 14 nt, Homo sapiens
auaaauccagugac

SEQ ID NO: 2073683 - RNA, 19 nt, Homo sapiens
ccuacuccaguaugacaga

SEQ ID NO: 2073684 - RNA, 22 nt, Homo sapiens
ccaggaguaccuggaccugucc

SEQ ID NO: 2073685 - RNA, 17 nt, Homo sapiens
uccauguuguaaaggaa

SEQ ID NO: 2073686 - RNA, 23 nt, Homo sapiens
cgucuuccugaguggugccaaac

SEQ ID NO: 2073687 - RNA, 21 nt, Homo sapiens
acggcuggaccugcacgccac

SEQ ID NO: 2073688 - RNA, 12 nt, Homo sapiens
uugacaucaugu

SEQ ID NO: 2073689 - RNA, 23 nt, Homo sapiens
cugaauccaaacuaauccaucac

SEQ ID NO: 2073690 - RNA, 20 nt, Homo sapiens
ugaacuuugggaagccuuua

SEQ ID NO: 2073691 - RNA, 21 nt, Homo sapiens
ucaaggaagggacaagacaaa

SEQ ID NO: 2073692 - RNA, 13 nt, Homo sapiens
uaaacuucacuga

SEQ ID NO: 2073693 - RNA, 14 nt, Homo sapiens
caagaaaaccacaa

SEQ ID NO: 2073694 - RNA, 17 nt, Homo sapiens
ggucucaucucccaggc

SEQ ID NO: 2073695 - RNA, 18 nt, Homo sapiens
aagaacuaaauaugcaau

SEQ ID NO: 2073696 - RNA, 13 nt, Homo sapiens
gauuccaugccau

SEQ ID NO: 2073697 - RNA, 23 nt, Homo sapiens
aaaauauucccacucagcacuca

SEQ ID NO: 2073698 - RNA, 20 nt, Homo sapiens
uggucaggggugagaccuga

SEQ ID NO: 2073699 - RNA, 20 nt, Homo sapiens
gcauaccaaauggcacuuuu

SEQ ID NO: 2073700 - RNA, 21 nt, Homo sapiens
aguaguuuuguaucaaccuaa

SEQ ID NO: 2073701 - RNA, 21 nt, Homo sapiens
ucaacccaauaauucuguauu

SEQ ID NO: 2073702 - RNA, 20 nt, Homo sapiens
cuauucaacacacacaugcu

SEQ ID NO: 2073703 - RNA, 15 nt, Homo sapiens
agcuagcgauuucag

SEQ ID NO: 2073704 - RNA, 16 nt, Homo sapiens
aaaggcugcugugaac

SEQ ID NO: 2073705 - RNA, 14 nt, Homo sapiens
ucagcuuaauucuc

SEQ ID NO: 2073706 - RNA, 20 nt, Homo sapiens
gcugaggcauccuuccucac

SEQ ID NO: 2073707 - RNA, 20 nt, Homo sapiens
agggcaugggagugaucuca

SEQ ID NO: 2073708 - RNA, 17 nt, Homo sapiens
agauccgagucuaccca

SEQ ID NO: 2073709 - RNA, 21 nt, Homo sapiens
aauacuuaaauaaacaugacc

SEQ ID NO: 2073710 - RNA, 15 nt, Homo sapiens
aaacauuucauuucc

SEQ ID NO: 2073711 - RNA, 19 nt, Homo sapiens
ucucuacuagcaccaucac

SEQ ID NO: 2073712 - RNA, 18 nt, Homo sapiens
ugggcuccucugcaucuu

SEQ ID NO: 2073713 - RNA, 20 nt, Homo sapiens
cuggcacugcuuccagugag

SEQ ID NO: 2073714 - RNA, 20 nt, Homo sapiens
aaagcacuggccuugccucc

SEQ ID NO: 2073715 - RNA, 15 nt, Homo sapiens
auccuccauugcucc

SEQ ID NO: 2073716 - RNA, 19 nt, Homo sapiens
agaggagggaggaggaaua

SEQ ID NO: 2073717 - RNA, 17 nt, Homo sapiens
caggacacgacuuguaa

SEQ ID NO: 2073718 - RNA, 14 nt, Homo sapiens
auugagugagcacc

SEQ ID NO: 2073719 - RNA, 12 nt, Homo sapiens
gggguuccucaa

SEQ ID NO: 2073720 - RNA, 16 nt, Homo sapiens
aaacuauuuauaucac

SEQ ID NO: 2073721 - RNA, 20 nt, Homo sapiens
uagauaaugaaugauaagca

SEQ ID NO: 2073722 - RNA, 22 nt, Homo sapiens
agaacucuccaucuuauuuuca

SEQ ID NO: 2073723 - RNA, 17 nt, Homo sapiens
ccaagcagaguguuuua

SEQ ID NO: 2073724 - RNA, 15 nt, Homo sapiens
uggugcuacagggaa

SEQ ID NO: 2073725 - RNA, 18 nt, Homo sapiens
cucccucugcugaucuca

SEQ ID NO: 2073726 - RNA, 14 nt, Homo sapiens
uucucuguugucaa

SEQ ID NO: 2073727 - RNA, 14 nt, Homo sapiens
cggcuccucaggga

SEQ ID NO: 2073728 - RNA, 20 nt, Homo sapiens
auguaucuaauuucauucaa

SEQ ID NO: 2073729 - RNA, 14 nt, Homo sapiens
gggcuccugaggga

SEQ ID NO: 2073730 - RNA, 13 nt, Homo sapiens
accugccaugcca

SEQ ID NO: 2073731 - RNA, 13 nt, Homo sapiens
ucaugccaagaca

SEQ ID NO: 2073732 - RNA, 17 nt, Homo sapiens
cuuuaaauggaauaauu

SEQ ID NO: 2073733 - RNA, 23 nt, Homo sapiens
gcucccucacccaggcacugggc

SEQ ID NO: 2073734 - RNA, 15 nt, Homo sapiens
cuuguuuaacauaua

SEQ ID NO: 2073735 - RNA, 17 nt, Homo sapiens
uauauugugccaagcga

SEQ ID NO: 2073736 - RNA, 14 nt, Homo sapiens
aguaucagcacuag

SEQ ID NO: 2073737 - RNA, 18 nt, Homo sapiens
acauauauauuaauacug

SEQ ID NO: 2073738 - RNA, 20 nt, Homo sapiens
aauaacacguccacuuucaa

SEQ ID NO: 2073739 - RNA, 22 nt, Homo sapiens
ugcugaugaucaaaaccugugc

SEQ ID NO: 2073740 - RNA, 19 nt, Homo sapiens
aagcauggucccuugucac

SEQ ID NO: 2073741 - RNA, 18 nt, Homo sapiens
ugggcaacauagcaagac

SEQ ID NO: 2073742 - RNA, 19 nt, Homo sapiens
cuuagucacaaagcccauc

SEQ ID NO: 2073743 - RNA, 12 nt, Homo sapiens
uauguuugcaaa

SEQ ID NO: 2073744 - RNA, 20 nt, Homo sapiens
uauucaccuuuucuucaaaa

SEQ ID NO: 2073745 - RNA, 14 nt, Homo sapiens
cacguggugcauuu

SEQ ID NO: 2073746 - RNA, 16 nt, Homo sapiens
uaaaagccgcccagug

SEQ ID NO: 2073747 - RNA, 22 nt, Homo sapiens
acuuauuuaugaacagacuuuu

SEQ ID NO: 2073748 - RNA, 21 nt, Homo sapiens
gcuugcuauucugucccuagg

SEQ ID NO: 2073749 - RNA, 12 nt, Homo sapiens
uuuuucucauga

SEQ ID NO: 2073750 - RNA, 21 nt, Homo sapiens
uccagacuugaaauucucauc

SEQ ID NO: 2073751 - RNA, 17 nt, Homo sapiens
uaucuucaaacuuucac

SEQ ID NO: 2073752 - RNA, 17 nt, Homo sapiens
aauccuguuacucuguc

SEQ ID NO: 2073753 - RNA, 19 nt, Homo sapiens
agccugcaauaagggaaaa

SEQ ID NO: 2073754 - RNA, 22 nt, Homo sapiens
aaggacagugucaaagugauaa

SEQ ID NO: 2073755 - RNA, 23 nt, Homo sapiens
uaaguggggugggaaggggagca

SEQ ID NO: 2073756 - RNA, 19 nt, Homo sapiens
uccaaagcgagcaagagaa

SEQ ID NO: 2073757 - RNA, 12 nt, Homo sapiens
cgggauucccug

SEQ ID NO: 2073758 - RNA, 17 nt, Homo sapiens
ugauuaaccgaggacag

SEQ ID NO: 2073759 - RNA, 12 nt, Homo sapiens
ucaagacuugau

SEQ ID NO: 2073760 - RNA, 19 nt, Homo sapiens
acaaccugccacaauguga

SEQ ID NO: 2073761 - RNA, 20 nt, Homo sapiens
gaaagucaaauuuacuuuaa

SEQ ID NO: 2073762 - RNA, 14 nt, Homo sapiens
cacuacugcuaaau

SEQ ID NO: 2073763 - RNA, 14 nt, Homo sapiens
uuauacuguacaau

SEQ ID NO: 2073764 - RNA, 18 nt, Homo sapiens
auaugccauaaaccucaa

SEQ ID NO: 2073765 - RNA, 12 nt, Homo sapiens
ccacaucuccug

SEQ ID NO: 2073766 - RNA, 15 nt, Homo sapiens
acacuugcaaccuac

SEQ ID NO: 2073767 - RNA, 14 nt, Homo sapiens
cugucaggucugau

SEQ ID NO: 2073768 - RNA, 14 nt, Homo sapiens
uuguucaaauguuc

SEQ ID NO: 2073769 - RNA, 14 nt, Homo sapiens
ugccauaaagccau

SEQ ID NO: 2073770 - RNA, 14 nt, Homo sapiens
acccacaaucccac

SEQ ID NO: 2073771 - RNA, 14 nt, Homo sapiens
aucucaaauucuca

SEQ ID NO: 2073772 - RNA, 21 nt, Homo sapiens
cuccggguuugagauggacac

SEQ ID NO: 2073773 - RNA, 19 nt, Homo sapiens
gagcucuacccugcucccu

SEQ ID NO: 2073774 - RNA, 23 nt, Homo sapiens
cagcccauggugagcucugggaa

SEQ ID NO: 2073775 - RNA, 23 nt, Homo sapiens
auacauucccucuaauuugaacu

SEQ ID NO: 2073776 - RNA, 16 nt, Homo sapiens
cccucucuagggaccc

SEQ ID NO: 2073777 - RNA, 20 nt, Homo sapiens
cugaagcccagcgacacaga

SEQ ID NO: 2073778 - RNA, 19 nt, Homo sapiens
cacgauugguaugaugcug

SEQ ID NO: 2073779 - RNA, 15 nt, Homo sapiens
gaaaucauagaaggu

SEQ ID NO: 2073780 - RNA, 17 nt, Homo sapiens
uaagugcuuaacauuug

SEQ ID NO: 2073781 - RNA, 17 nt, Homo sapiens
aacacgacugcaagcuc

SEQ ID NO: 2073782 - RNA, 21 nt, Homo sapiens
cugauaauguauaugaacuua

SEQ ID NO: 2073783 - RNA, 18 nt, Homo sapiens
gcuucaauuuauaccuca

SEQ ID NO: 2073784 - RNA, 17 nt, Homo sapiens
gauauucgguaauauca

SEQ ID NO: 2073785 - RNA, 16 nt, Homo sapiens
uucaaagaugauaauu

SEQ ID NO: 2073786 - RNA, 14 nt, Homo sapiens
auuauuauccuccu

SEQ ID NO: 2073787 - RNA, 15 nt, Homo sapiens
cugagccccagggag

SEQ ID NO: 2073788 - RNA, 21 nt, Homo sapiens
cuuugacugaucagugugaua

SEQ ID NO: 2073789 - RNA, 16 nt, Homo sapiens
aacuugggaacuacag

SEQ ID NO: 2073790 - RNA, 23 nt, Homo sapiens
aucuuagaacagauggcugugaa

SEQ ID NO: 2073791 - RNA, 16 nt, Homo sapiens
agaaucacuugaaccc

SEQ ID NO: 2073792 - RNA, 14 nt, Homo sapiens
uuucccacacccca

SEQ ID NO: 2073793 - RNA, 13 nt, Homo sapiens
caagagccuucaa

SEQ ID NO: 2073794 - RNA, 16 nt, Homo sapiens
agaucuuggggugcag

SEQ ID NO: 2073795 - RNA, 13 nt, Homo sapiens
cuucagcccugaa

SEQ ID NO: 2073796 - RNA, 20 nt, Homo sapiens
gauuguccagugcaaccaca

SEQ ID NO: 2073797 - RNA, 19 nt, Homo sapiens
cucccaacaagugcucuuu

SEQ ID NO: 2073798 - RNA, 18 nt, Homo sapiens
uuggaaaguucagccaga

SEQ ID NO: 2073799 - RNA, 15 nt, Homo sapiens
uuucucuugugcaau

SEQ ID NO: 2073800 - RNA, 22 nt, Homo sapiens
uauuugcuaccacagcaacuau

SEQ ID NO: 2073801 - RNA, 19 nt, Homo sapiens
aacccaauaaaacugaugu

SEQ ID NO: 2073802 - RNA, 12 nt, Homo sapiens
ggggcgugcaug

SEQ ID NO: 2073803 - RNA, 16 nt, Homo sapiens
uccuccagcuccugcc

SEQ ID NO: 2073804 - RNA, 21 nt, Homo sapiens
ccaaggcagagcgcaaagugc

SEQ ID NO: 2073805 - RNA, 19 nt, Homo sapiens
caccugcuccaauuucccc

SEQ ID NO: 2073806 - RNA, 19 nt, Homo sapiens
agcaggugguccugagacc

SEQ ID NO: 2073807 - RNA, 19 nt, Homo sapiens
ugaaaugcuggcauuugca

SEQ ID NO: 2073808 - RNA, 21 nt, Homo sapiens
acuugcauccaacuccaggau

SEQ ID NO: 2073809 - RNA, 19 nt, Homo sapiens
auguacuggagaguggcaa

SEQ ID NO: 2073810 - RNA, 19 nt, Homo sapiens
caggcccuacaaugcucau

SEQ ID NO: 2073811 - RNA, 18 nt, Homo sapiens
aauguccaagcaucagca

SEQ ID NO: 2073812 - RNA, 13 nt, Homo sapiens
gugacagcacuuu

SEQ ID NO: 2073813 - RNA, 21 nt, Homo sapiens
cuaguaaauuuucaaacuaga

SEQ ID NO: 2073814 - RNA, 12 nt, Homo sapiens
cuggcacugacu

SEQ ID NO: 2073815 - RNA, 23 nt, Homo sapiens
agucagaugguacggacuuccuu

SEQ ID NO: 2073816 - RNA, 21 nt, Homo sapiens
ccuaaguacuguaauaauacc

SEQ ID NO: 2073817 - RNA, 23 nt, Homo sapiens
auaauuuucuaccuggucucucc

SEQ ID NO: 2073818 - RNA, 17 nt, Homo sapiens
ugcaagagaaacugcag

SEQ ID NO: 2073819 - RNA, 17 nt, Homo sapiens
aaaaucagggccaccau

SEQ ID NO: 2073820 - RNA, 15 nt, Homo sapiens
ccaauaucuugccag

SEQ ID NO: 2073821 - RNA, 14 nt, Homo sapiens
ccccaggcucaacu

SEQ ID NO: 2073822 - RNA, 20 nt, Homo sapiens
ggcaugagggaucacagggc

SEQ ID NO: 2073823 - RNA, 21 nt, Homo sapiens
cccagaaacaaaucucaaagu

SEQ ID NO: 2073824 - RNA, 22 nt, Homo sapiens
aaccucagccaaacacagagcg

SEQ ID NO: 2073825 - RNA, 22 nt, Homo sapiens
gacauggaagguuagguuuguc

SEQ ID NO: 2073826 - RNA, 12 nt, Homo sapiens
uauugcaagaca

SEQ ID NO: 2073827 - RNA, 22 nt, Homo sapiens
uucuguuugaaugcggaaccau

SEQ ID NO: 2073828 - RNA, 15 nt, Homo sapiens
aauuuuaaacauauc

SEQ ID NO: 2073829 - RNA, 14 nt, Homo sapiens
ucugaguaagcccu

SEQ ID NO: 2073830 - RNA, 14 nt, Homo sapiens
uggagaggaacaca

SEQ ID NO: 2073831 - RNA, 12 nt, Homo sapiens
uaaucauacaaa

SEQ ID NO: 2073832 - RNA, 16 nt, Homo sapiens
ugggauuuaauuucca

SEQ ID NO: 2073833 - RNA, 19 nt, Homo sapiens
ucagccauaagaaagcacu

SEQ ID NO: 2073834 - RNA, 14 nt, Homo sapiens
uuugacacugcucu

SEQ ID NO: 2073835 - RNA, 18 nt, Homo sapiens
guuaguaaagaaaaguuu

SEQ ID NO: 2073836 - RNA, 21 nt, Homo sapiens
ccaaauuaaguauguuugaau

SEQ ID NO: 2073837 - RNA, 19 nt, Homo sapiens
caggacuccacacagcguu

SEQ ID NO: 2073838 - RNA, 12 nt, Homo sapiens
agagacacugcu

SEQ ID NO: 2073839 - RNA, 12 nt, Homo sapiens
acagacacuccu

SEQ ID NO: 2073840 - RNA, 23 nt, Homo sapiens
cacagcuugucucuugccugcca

SEQ ID NO: 2073841 - RNA, 19 nt, Homo sapiens
aaauuuuucuuuucuugau

SEQ ID NO: 2073842 - RNA, 14 nt, Homo sapiens
cccaguccaugcuu

SEQ ID NO: 2073843 - RNA, 18 nt, Homo sapiens
uugaaaguccuaggguga

SEQ ID NO: 2073844 - RNA, 22 nt, Homo sapiens
uccccuggggagucugggcaca

SEQ ID NO: 2073845 - RNA, 17 nt, Homo sapiens
gcuagcagaaguauaaa

SEQ ID NO: 2073846 - RNA, 19 nt, Homo sapiens
cuccugugaccccaccuug

SEQ ID NO: 2073847 - RNA, 20 nt, Homo sapiens
accagggguccuaaccacua

SEQ ID NO: 2073848 - RNA, 17 nt, Homo sapiens
gaccuggugcugccucu

SEQ ID NO: 2073849 - RNA, 16 nt, Homo sapiens
cuucuugcuucaguca

SEQ ID NO: 2073850 - RNA, 15 nt, Homo sapiens
aaucuaugccacuca

SEQ ID NO: 2073851 - RNA, 17 nt, Homo sapiens
augcuacaguacuaugu

SEQ ID NO: 2073852 - RNA, 19 nt, Homo sapiens
gcucaaaguacuacagcaa

SEQ ID NO: 2073853 - RNA, 22 nt, Homo sapiens
caguguucagagccaagcaaga

SEQ ID NO: 2073854 - RNA, 16 nt, Homo sapiens
uggccgggcacagcug

SEQ ID NO: 2073855 - RNA, 16 nt, Homo sapiens
cugcuguuuuauguca

SEQ ID NO: 2073856 - RNA, 20 nt, Homo sapiens
aucuuaagucauaaugaaua

SEQ ID NO: 2073857 - RNA, 15 nt, Homo sapiens
caugguuacauauca

SEQ ID NO: 2073858 - RNA, 12 nt, Homo sapiens
aacacagugcug

SEQ ID NO: 2073859 - RNA, 23 nt, Homo sapiens
auauuuaagcaauaaaacugcua

SEQ ID NO: 2073860 - RNA, 21 nt, Homo sapiens
agaaauugugaaaaaugagcu

SEQ ID NO: 2073861 - RNA, 18 nt, Homo sapiens
ggccuggugucuccucau

SEQ ID NO: 2073862 - RNA, 13 nt, Homo sapiens
ugaccagaagccu

SEQ ID NO: 2073863 - RNA, 14 nt, Homo sapiens
guccugaccuauaa

SEQ ID NO: 2073864 - RNA, 21 nt, Homo sapiens
ugagacuccucaguucuugcc

SEQ ID NO: 2073865 - RNA, 17 nt, Homo sapiens
cuugucaaagaaggugc

SEQ ID NO: 2073866 - RNA, 16 nt, Homo sapiens
cagcaagggcugauuc

SEQ ID NO: 2073867 - RNA, 15 nt, Homo sapiens
uuucaucugcucucc

SEQ ID NO: 2073868 - RNA, 21 nt, Homo sapiens
aacagacucauaccacacuua

SEQ ID NO: 2073869 - RNA, 22 nt, Homo sapiens
gucacuuguagguuucucugcc

SEQ ID NO: 2073870 - RNA, 22 nt, Homo sapiens
gaccugcaggcagagacugaaa

SEQ ID NO: 2073871 - RNA, 21 nt, Homo sapiens
uaaguguguuguuuaaucuga

SEQ ID NO: 2073872 - RNA, 20 nt, Homo sapiens
ggcugcgaacugugcaguua

SEQ ID NO: 2073873 - RNA, 19 nt, Homo sapiens
aagucaaaugugugcuuug

SEQ ID NO: 2073874 - RNA, 13 nt, Homo sapiens
ggcuccucucaga

SEQ ID NO: 2073875 - RNA, 13 nt, Homo sapiens
aaucacaaaaaca

SEQ ID NO: 2073876 - RNA, 14 nt, Homo sapiens
cccaguucauccca

SEQ ID NO: 2073877 - RNA, 16 nt, Homo sapiens
agauagauauaugcuc

SEQ ID NO: 2073878 - RNA, 20 nt, Homo sapiens
gaaaagugcauauuuaucca

SEQ ID NO: 2073879 - RNA, 22 nt, Homo sapiens
gacacauacaugucacauuuag

SEQ ID NO: 2073880 - RNA, 13 nt, Homo sapiens
acacccaccucag

SEQ ID NO: 2073881 - RNA, 19 nt, Homo sapiens
accaguaacggaacaguau

SEQ ID NO: 2073882 - RNA, 21 nt, Homo sapiens
ccgagaucgcaccagugcacu

SEQ ID NO: 2073883 - RNA, 23 nt, Homo sapiens
cugccccacuucucuacucugga

SEQ ID NO: 2073884 - RNA, 20 nt, Homo sapiens
aguucuuaggaacagacucg

SEQ ID NO: 2073885 - RNA, 14 nt, Homo sapiens
gagcuggaccugag

SEQ ID NO: 2073886 - RNA, 22 nt, Homo sapiens
gcaccaacacuuugguauucaa

SEQ ID NO: 2073887 - RNA, 14 nt, Homo sapiens
cagauuauaccugg

SEQ ID NO: 2073888 - RNA, 22 nt, Homo sapiens
caaugcucaguaacacagugca

SEQ ID NO: 2073889 - RNA, 17 nt, Homo sapiens
gcccucagcccucgggc

SEQ ID NO: 2073890 - RNA, 13 nt, Homo sapiens
uaucuauaaacac

SEQ ID NO: 2073891 - RNA, 11 nt, Homo sapiens
uccuacaaggg

SEQ ID NO: 2073892 - RNA, 22 nt, Homo sapiens
cuaguauuuauggguggauuua

SEQ ID NO: 2073893 - RNA, 19 nt, Homo sapiens
aaucuggguaucuuuccag

SEQ ID NO: 2073894 - RNA, 21 nt, Homo sapiens
acagcugguauggccuuaccu

SEQ ID NO: 2073895 - RNA, 22 nt, Homo sapiens
aaggagggagcucugaugagca

SEQ ID NO: 2073896 - RNA, 14 nt, Homo sapiens
guugcauauccaaa

SEQ ID NO: 2073897 - RNA, 19 nt, Homo sapiens
aaaccuugugacucagugu

SEQ ID NO: 2073898 - RNA, 15 nt, Homo sapiens
aucaggacccagagg

SEQ ID NO: 2073899 - RNA, 15 nt, Homo sapiens
gaacuuggcacacuc

SEQ ID NO: 2073900 - RNA, 12 nt, Homo sapiens
gcgucacuguga

SEQ ID NO: 2073901 - RNA, 20 nt, Homo sapiens
cacagaggggagucaccagc

SEQ ID NO: 2073902 - RNA, 14 nt, Homo sapiens
accccagaggacac

SEQ ID NO: 2073903 - RNA, 14 nt, Homo sapiens
accgugggcacuga

SEQ ID NO: 2073904 - RNA, 23 nt, Homo sapiens
uaaagaaugcaauccaugccaua

SEQ ID NO: 2073905 - RNA, 17 nt, Homo sapiens
uguauguuuacguccuu

SEQ ID NO: 2073906 - RNA, 17 nt, Homo sapiens
aaaauauggacuuccaa

SEQ ID NO: 2073907 - RNA, 20 nt, Homo sapiens
ugaaaaaaaugaucuauugc

SEQ ID NO: 2073908 - RNA, 23 nt, Homo sapiens
auaugugggugucagucagggac

SEQ ID NO: 2073909 - RNA, 18 nt, Homo sapiens
cccggaguaaucaggcag

SEQ ID NO: 2073910 - RNA, 22 nt, Homo sapiens
uggaaugccgcugucucugagg

SEQ ID NO: 2073911 - RNA, 16 nt, Homo sapiens
cuugucuuuaaaguua

SEQ ID NO: 2073912 - RNA, 19 nt, Homo sapiens
ggagaaaggacccucaaga

SEQ ID NO: 2073913 - RNA, 23 nt, Homo sapiens
ccugugaugucaugaaagcaccu

SEQ ID NO: 2073914 - RNA, 23 nt, Homo sapiens
gccucuggcuucccuaaacugca

SEQ ID NO: 2073915 - RNA, 16 nt, Homo sapiens
uugauucauauugcau

SEQ ID NO: 2073916 - RNA, 15 nt, Homo sapiens
gcagcaucugcucca

SEQ ID NO: 2073917 - RNA, 14 nt, Homo sapiens
agggucuggcuguc

SEQ ID NO: 2073918 - RNA, 21 nt, Homo sapiens
cauuuuuguaggaagcauuuu

SEQ ID NO: 2073919 - RNA, 18 nt, Homo sapiens
cccaaacuggagugcagu

SEQ ID NO: 2073920 - RNA, 15 nt, Homo sapiens
cccuuguccuugaaa

SEQ ID NO: 2073921 - RNA, 19 nt, Homo sapiens
auacaugcuuugaaguuuc

SEQ ID NO: 2073922 - RNA, 14 nt, Homo sapiens
cucucagcuucuaa

SEQ ID NO: 2073923 - RNA, 17 nt, Homo sapiens
ugaccuacucuugccug

SEQ ID NO: 2073924 - RNA, 14 nt, Homo sapiens
acaguucucagaaa

SEQ ID NO: 2073925 - RNA, 12 nt, Homo sapiens
agagucacugau

SEQ ID NO: 2073926 - RNA, 17 nt, Homo sapiens
gaggcugucacaguccu

SEQ ID NO: 2073927 - RNA, 16 nt, Homo sapiens
agggagccaugcucuu

SEQ ID NO: 2073928 - RNA, 16 nt, Homo sapiens
gauugguccuuuucaa

SEQ ID NO: 2073929 - RNA, 22 nt, Homo sapiens
acacugggcugcagagacugga

SEQ ID NO: 2073930 - RNA, 12 nt, Homo sapiens
aacacagugcag

SEQ ID NO: 2073931 - RNA, 14 nt, Homo sapiens
uuugcuauucuggc

SEQ ID NO: 2073932 - RNA, 17 nt, Homo sapiens
ucuuugcaccaaagaca

SEQ ID NO: 2073933 - RNA, 20 nt, Homo sapiens
aaucauuuugaguuugccuc

SEQ ID NO: 2073934 - RNA, 20 nt, Homo sapiens
agcuagagugcaguggugca

SEQ ID NO: 2073935 - RNA, 18 nt, Homo sapiens
gaagcuguuguacauuua

SEQ ID NO: 2073936 - RNA, 17 nt, Homo sapiens
uuuauuaaaauauuuca

SEQ ID NO: 2073937 - RNA, 21 nt, Homo sapiens
cuggaaaugguuuaccuaaaa

SEQ ID NO: 2073938 - RNA, 22 nt, Homo sapiens
ugucuuaaacuagguguucuaa

SEQ ID NO: 2073939 - RNA, 20 nt, Homo sapiens
gaaauaauugccaaauaccu

SEQ ID NO: 2073940 - RNA, 17 nt, Homo sapiens
gcugaaaacauaaccca

SEQ ID NO: 2073941 - RNA, 17 nt, Homo sapiens
cuccugugcuggugacc

SEQ ID NO: 2073942 - RNA, 15 nt, Homo sapiens
uguuaagacuugaca

SEQ ID NO: 2073943 - RNA, 19 nt, Homo sapiens
caaacccuagauuggggua

SEQ ID NO: 2073944 - RNA, 21 nt, Homo sapiens
ccaauguccagccucuuuaac

SEQ ID NO: 2073945 - RNA, 22 nt, Homo sapiens
cuucaauaugaaggacuauuaa

SEQ ID NO: 2073946 - RNA, 18 nt, Homo sapiens
caaggcgguggacuugaa

SEQ ID NO: 2073947 - RNA, 12 nt, Homo sapiens
gaggcagggaac

SEQ ID NO: 2073948 - RNA, 18 nt, Homo sapiens
cuucccaccucacaguga

SEQ ID NO: 2073949 - RNA, 20 nt, Homo sapiens
aaacaagaaaucugacaaua

SEQ ID NO: 2073950 - RNA, 19 nt, Homo sapiens
guuucacuguguuagccag

SEQ ID NO: 2073951 - RNA, 19 nt, Homo sapiens
ugacauucuuagcuguaac

SEQ ID NO: 2073952 - RNA, 13 nt, Homo sapiens
cagaguagccaug

SEQ ID NO: 2073953 - RNA, 17 nt, Homo sapiens
ucuucucaaagcuggga

SEQ ID NO: 2073954 - RNA, 17 nt, Homo sapiens
caccaggggugcacaau

SEQ ID NO: 2073955 - RNA, 19 nt, Homo sapiens
uuuucaucugaaaagcagu

SEQ ID NO: 2073956 - RNA, 16 nt, Homo sapiens
cagagagagauacucu

SEQ ID NO: 2073957 - RNA, 16 nt, Homo sapiens
auuuccaugauacaaa

SEQ ID NO: 2073958 - RNA, 22 nt, Homo sapiens
auccuuauaagagauucacuca

SEQ ID NO: 2073959 - RNA, 20 nt, Homo sapiens
cugaggugggaggaucucuu

SEQ ID NO: 2073960 - RNA, 16 nt, Homo sapiens
aaggucuauggcucau

SEQ ID NO: 2073961 - RNA, 18 nt, Homo sapiens
ugggugcagaagcugugg

SEQ ID NO: 2073962 - RNA, 18 nt, Homo sapiens
gcaagaagucaaaguaaa

SEQ ID NO: 2073963 - RNA, 18 nt, Homo sapiens
gaagugucuaaugcauua

SEQ ID NO: 2073964 - RNA, 17 nt, Homo sapiens
uagacuaagggcaggaa

SEQ ID NO: 2073965 - RNA, 11 nt, Homo sapiens
acccaccugcu

SEQ ID NO: 2073966 - RNA, 18 nt, Homo sapiens
ucagaauauuaagcacau

SEQ ID NO: 2073967 - RNA, 19 nt, Homo sapiens
gcugauacugggucugcga

SEQ ID NO: 2073968 - RNA, 14 nt, Homo sapiens
ugcucaguguuuca

SEQ ID NO: 2073969 - RNA, 14 nt, Homo sapiens
gcacagaugccugg

SEQ ID NO: 2073970 - RNA, 17 nt, Homo sapiens
ucuugguuuccaucaaa

SEQ ID NO: 2073971 - RNA, 18 nt, Homo sapiens
ggggcuuaggaaccuucu

SEQ ID NO: 2073972 - RNA, 23 nt, Homo sapiens
gaucaaauauauuucaagcuaua

SEQ ID NO: 2073973 - RNA, 15 nt, Homo sapiens
agucaggcccggccu

SEQ ID NO: 2073974 - RNA, 14 nt, Homo sapiens
uaguauugauucaa

SEQ ID NO: 2073975 - RNA, 14 nt, Homo sapiens
aauucauguugccu

SEQ ID NO: 2073976 - RNA, 16 nt, Homo sapiens
ccuuccucucaggcuc

SEQ ID NO: 2073977 - RNA, 20 nt, Homo sapiens
acccagacguggaguggagu

SEQ ID NO: 2073978 - RNA, 21 nt, Homo sapiens
cagggaaauuauaagugcaga

SEQ ID NO: 2073979 - RNA, 19 nt, Homo sapiens
gugucagaaacccuggucu

SEQ ID NO: 2073980 - RNA, 19 nt, Homo sapiens
ucauaagucuuugguacaa

SEQ ID NO: 2073981 - RNA, 15 nt, Homo sapiens
auauuuuacugaucu

SEQ ID NO: 2073982 - RNA, 22 nt, Homo sapiens
auggggcggguccuagcuguua

SEQ ID NO: 2073983 - RNA, 22 nt, Homo sapiens
auguugcacacccacucagcuc

SEQ ID NO: 2073984 - RNA, 18 nt, Homo sapiens
agacacagacuggcaaua

SEQ ID NO: 2073985 - RNA, 12 nt, Homo sapiens
cuugcacuauug

SEQ ID NO: 2073986 - RNA, 17 nt, Homo sapiens
ggccccugggccugcca

SEQ ID NO: 2073987 - RNA, 13 nt, Homo sapiens
uucucugugcucu

SEQ ID NO: 2073988 - RNA, 17 nt, Homo sapiens
cccuguuuccaaugcca

SEQ ID NO: 2073989 - RNA, 17 nt, Homo sapiens
ucaccauguaacaacca

SEQ ID NO: 2073990 - RNA, 15 nt, Homo sapiens
ugccucuucuuuaug

SEQ ID NO: 2073991 - RNA, 16 nt, Homo sapiens
gcugagcaaucugacc

SEQ ID NO: 2073992 - RNA, 14 nt, Homo sapiens
uaaaaggcccugug

SEQ ID NO: 2073993 - RNA, 22 nt, Homo sapiens
agacacaucuccuccauacuca

SEQ ID NO: 2073994 - RNA, 19 nt, Homo sapiens
cuaauauugaaaaugucac

SEQ ID NO: 2073995 - RNA, 13 nt, Homo sapiens
aaagauucaaauc

SEQ ID NO: 2073996 - RNA, 13 nt, Homo sapiens
gacaggcucuuag

SEQ ID NO: 2073997 - RNA, 18 nt, Homo sapiens
aaauauuaugcugcuuua

SEQ ID NO: 2073998 - RNA, 22 nt, Homo sapiens
ucugugcaugguggcaccagcg

SEQ ID NO: 2073999 - RNA, 14 nt, Homo sapiens
ucugcccacuguga

SEQ ID NO: 2074000 - RNA, 14 nt, Homo sapiens
agccucugaucagu

SEQ ID NO: 2074001 - RNA, 19 nt, Homo sapiens
ucugcaacccgguuuacca

SEQ ID NO: 2074002 - RNA, 17 nt, Homo sapiens
uguuucuuucauaugaa

SEQ ID NO: 2074003 - RNA, 17 nt, Homo sapiens
gagauagguacuauuau

SEQ ID NO: 2074004 - RNA, 18 nt, Homo sapiens
aucccaccuuuaccccac

SEQ ID NO: 2074005 - RNA, 20 nt, Homo sapiens
uuucugcuuuagacuugaaa

SEQ ID NO: 2074006 - RNA, 16 nt, Homo sapiens
cuuggcuaacauagca

SEQ ID NO: 2074007 - RNA, 20 nt, Homo sapiens
ucacaugcuagcagcuguga

SEQ ID NO: 2074008 - RNA, 15 nt, Homo sapiens
cucugccugggaugg

SEQ ID NO: 2074009 - RNA, 13 nt, Homo sapiens
aggaaagggcaaa

SEQ ID NO: 2074010 - RNA, 13 nt, Homo sapiens
gucuaagucauga

SEQ ID NO: 2074011 - RNA, 23 nt, Homo sapiens
auugauauacacggaugacuuaa

SEQ ID NO: 2074012 - RNA, 21 nt, Homo sapiens
agaucacaaagacagagacug

SEQ ID NO: 2074013 - RNA, 15 nt, Homo sapiens
uaagggguuugccau

SEQ ID NO: 2074014 - RNA, 22 nt, Homo sapiens
uccaugugaaacauguugccaa

SEQ ID NO: 2074015 - RNA, 20 nt, Homo sapiens
auagccucaccaaggugaca

SEQ ID NO: 2074016 - RNA, 12 nt, Homo sapiens
cagugacuggca

SEQ ID NO: 2074017 - RNA, 14 nt, Homo sapiens
gcaucacagcuaac

SEQ ID NO: 2074018 - RNA, 14 nt, Homo sapiens
aucuuugugccuca

SEQ ID NO: 2074019 - RNA, 18 nt, Homo sapiens
augcugcucaauuccuuc

SEQ ID NO: 2074020 - RNA, 17 nt, Homo sapiens
cuucuacuuguaaaaug

SEQ ID NO: 2074021 - RNA, 14 nt, Homo sapiens
cagggacacuccaa

SEQ ID NO: 2074022 - RNA, 18 nt, Homo sapiens
gggggcaauuuugcacug

SEQ ID NO: 2074023 - RNA, 23 nt, Homo sapiens
uuauuaaucauacaaacucucac

SEQ ID NO: 2074024 - RNA, 22 nt, Homo sapiens
gaacaauuguggucucucuuaa

SEQ ID NO: 2074025 - RNA, 23 nt, Homo sapiens
cugcuugacaaaggagcauugca

SEQ ID NO: 2074026 - RNA, 16 nt, Homo sapiens
acaauuaugauagcuu

SEQ ID NO: 2074027 - RNA, 14 nt, Homo sapiens
auuugcuucacuca

SEQ ID NO: 2074028 - RNA, 16 nt, Homo sapiens
gagcuccugggacccu

SEQ ID NO: 2074029 - RNA, 14 nt, Homo sapiens
cauaaaugaaucau

SEQ ID NO: 2074030 - RNA, 20 nt, Homo sapiens
ucuucgagccggcaacggca

SEQ ID NO: 2074031 - RNA, 16 nt, Homo sapiens
ggcacuccuuucuugc

SEQ ID NO: 2074032 - RNA, 13 nt, Homo sapiens
aacugucucagaa

SEQ ID NO: 2074033 - RNA, 17 nt, Homo sapiens
gggccgugagggguccc

SEQ ID NO: 2074034 - RNA, 20 nt, Homo sapiens
cccaugugcccauaagcaca

SEQ ID NO: 2074035 - RNA, 19 nt, Homo sapiens
ggcaccagacacccaggac

SEQ ID NO: 2074036 - RNA, 12 nt, Homo sapiens
uguacagaugau

SEQ ID NO: 2074037 - RNA, 19 nt, Homo sapiens
aacaucuaagccucuaaca

SEQ ID NO: 2074038 - RNA, 18 nt, Homo sapiens
uaaaacucacugugauca

SEQ ID NO: 2074039 - RNA, 17 nt, Homo sapiens
aaaugcauggugcaguu

SEQ ID NO: 2074040 - RNA, 16 nt, Homo sapiens
aggucugaaauggagg

SEQ ID NO: 2074041 - RNA, 23 nt, Homo sapiens
gaaauucaccuucaaaagcacug

SEQ ID NO: 2074042 - RNA, 21 nt, Homo sapiens
cuuuaaccucaucuacaagca

SEQ ID NO: 2074043 - RNA, 14 nt, Homo sapiens
guccugaagugacc

SEQ ID NO: 2074044 - RNA, 18 nt, Homo sapiens
ugggaagacuauggugcu

SEQ ID NO: 2074045 - RNA, 21 nt, Homo sapiens
ccucgaaagugucaucaauuu

SEQ ID NO: 2074046 - RNA, 14 nt, Homo sapiens
gggcccugugccag

SEQ ID NO: 2074047 - RNA, 21 nt, Homo sapiens
agucacaggaugagacaggag

SEQ ID NO: 2074048 - RNA, 12 nt, Homo sapiens
cccuaaagccag

SEQ ID NO: 2074049 - RNA, 23 nt, Homo sapiens
ggccaggcaacgugcgugucucu

SEQ ID NO: 2074050 - RNA, 13 nt, Homo sapiens
aauaaagguuuaa

SEQ ID NO: 2074051 - RNA, 14 nt, Homo sapiens
ccagugucacuuga

SEQ ID NO: 2074052 - RNA, 23 nt, Homo sapiens
ucacuggaaugaagaccaugccu

SEQ ID NO: 2074053 - RNA, 14 nt, Homo sapiens
gcuguaugucauua

SEQ ID NO: 2074054 - RNA, 15 nt, Homo sapiens
uccccaacuucccua

SEQ ID NO: 2074055 - RNA, 18 nt, Homo sapiens
ucauccagcaguguugcu

SEQ ID NO: 2074056 - RNA, 15 nt, Homo sapiens
acugcagcuuuacau

SEQ ID NO: 2074057 - RNA, 18 nt, Homo sapiens
auuuuagacuuccuguag

SEQ ID NO: 2074058 - RNA, 23 nt, Homo sapiens
gguccacaucccgggacgcagca

SEQ ID NO: 2074059 - RNA, 18 nt, Homo sapiens
uuaucacuuaaacuugca

SEQ ID NO: 2074060 - RNA, 24 nt, Homo sapiens
caggauagagacuggaacacuaga

SEQ ID NO: 2074061 - RNA, 12 nt, Homo sapiens
aauuccaugaau

SEQ ID NO: 2074062 - RNA, 11 nt, Homo sapiens
gugacagucau

SEQ ID NO: 2074063 - RNA, 19 nt, Homo sapiens
caauguugguuucacugag

SEQ ID NO: 2074064 - RNA, 20 nt, Homo sapiens
uggugaagaacaucccaagc

SEQ ID NO: 2074065 - RNA, 13 nt, Homo sapiens
aaccucaguugaa

SEQ ID NO: 2074066 - RNA, 16 nt, Homo sapiens
gccuaaucacucugag

SEQ ID NO: 2074067 - RNA, 22 nt, Homo sapiens
cuauagcaacucauugguggua

SEQ ID NO: 2074068 - RNA, 21 nt, Homo sapiens
agcuuaauggcucaugaccug

SEQ ID NO: 2074069 - RNA, 21 nt, Homo sapiens
accccaaaggaacacugacau

SEQ ID NO: 2074070 - RNA, 17 nt, Homo sapiens
aauccccggcugcuucc

SEQ ID NO: 2074071 - RNA, 22 nt, Homo sapiens
uggcagaaauacagucuuccac

SEQ ID NO: 2074072 - RNA, 14 nt, Homo sapiens
cuucucuauggccu

SEQ ID NO: 2074073 - RNA, 16 nt, Homo sapiens
uucagauacuugugaa

SEQ ID NO: 2074074 - RNA, 19 nt, Homo sapiens
gagaacugcauauguuucg

SEQ ID NO: 2074075 - RNA, 15 nt, Homo sapiens
gcaauagucaaaaac

SEQ ID NO: 2074076 - RNA, 19 nt, Homo sapiens
cacuaagguggacagcaga

SEQ ID NO: 2074077 - RNA, 14 nt, Homo sapiens
cauuauuuggcuua

SEQ ID NO: 2074078 - RNA, 20 nt, Homo sapiens
accccaggaugcaugcaggg

SEQ ID NO: 2074079 - RNA, 16 nt, Homo sapiens
gcccaaccuauccugu

SEQ ID NO: 2074080 - RNA, 23 nt, Homo sapiens
cugacaauuugugauaucuaaua

SEQ ID NO: 2074081 - RNA, 13 nt, Homo sapiens
uacucaaccaaau

SEQ ID NO: 2074082 - RNA, 16 nt, Homo sapiens
gaaacugaguccuguu

SEQ ID NO: 2074083 - RNA, 17 nt, Homo sapiens
cugaaucagaaauguaa

SEQ ID NO: 2074084 - RNA, 12 nt, Homo sapiens
cgcggggaccau

SEQ ID NO: 2074085 - RNA, 19 nt, Homo sapiens
uccugcaguguuuugcaua

SEQ ID NO: 2074086 - RNA, 16 nt, Homo sapiens
cuugcuccauuuacaa

SEQ ID NO: 2074087 - RNA, 21 nt, Homo sapiens
cuuugagaggcugagguggua

SEQ ID NO: 2074088 - RNA, 14 nt, Homo sapiens
gagagagaugcugc

SEQ ID NO: 2074089 - RNA, 21 nt, Homo sapiens
uuccugaagggggacacucca

SEQ ID NO: 2074090 - RNA, 15 nt, Homo sapiens
gcagauaacugcugu

SEQ ID NO: 2074091 - RNA, 21 nt, Homo sapiens
uggaugcugugcuacguguga

SEQ ID NO: 2074092 - RNA, 22 nt, Homo sapiens
uuaccauucugauggcacagaa

SEQ ID NO: 2074093 - RNA, 21 nt, Homo sapiens
acauggucacccccacucugc

SEQ ID NO: 2074094 - RNA, 22 nt, Homo sapiens
uaaaaugauauauuaaaccuuc

SEQ ID NO: 2074095 - RNA, 15 nt, Homo sapiens
auuucagugcugcug

SEQ ID NO: 2074096 - RNA, 20 nt, Homo sapiens
guaauaguaaacacagggaa

SEQ ID NO: 2074097 - RNA, 11 nt, Homo sapiens
gugggccacag

SEQ ID NO: 2074098 - RNA, 19 nt, Homo sapiens
ugcacagagauaugcacac

SEQ ID NO: 2074099 - RNA, 15 nt, Homo sapiens
uauauaucaaggaug

SEQ ID NO: 2074100 - RNA, 18 nt, Homo sapiens
cucaaaacuucagacaua

SEQ ID NO: 2074101 - RNA, 19 nt, Homo sapiens
gaugaaaaaauaacacugu

SEQ ID NO: 2074102 - RNA, 15 nt, Homo sapiens
ccuuugcagauauga

SEQ ID NO: 2074103 - RNA, 18 nt, Homo sapiens
uccagucuuccaccugga

SEQ ID NO: 2074104 - RNA, 16 nt, Homo sapiens
gacaugauuagcagaa

SEQ ID NO: 2074105 - RNA, 23 nt, Homo sapiens
cuuguguuuuuugcucacuguca

SEQ ID NO: 2074106 - RNA, 21 nt, Homo sapiens
ugguccacagggcaccugcca

SEQ ID NO: 2074107 - RNA, 16 nt, Homo sapiens
aaccugcuuccuucag

SEQ ID NO: 2074108 - RNA, 21 nt, Homo sapiens
auuucauauaaauggaaucac

SEQ ID NO: 2074109 - RNA, 14 nt, Homo sapiens
cugagcccaugaca

SEQ ID NO: 2074110 - RNA, 24 nt, Homo sapiens
ggugcagccagaggcaccucaaga

SEQ ID NO: 2074111 - RNA, 15 nt, Homo sapiens
ucaagggacaaggac

SEQ ID NO: 2074112 - RNA, 19 nt, Homo sapiens
ucuuagaguugauuccuca

SEQ ID NO: 2074113 - RNA, 16 nt, Homo sapiens
aaaaaccagacaagau

SEQ ID NO: 2074114 - RNA, 15 nt, Homo sapiens
uuccuguccagagag

SEQ ID NO: 2074115 - RNA, 22 nt, Homo sapiens
auauuuaacuuuuugccaaaua

SEQ ID NO: 2074116 - RNA, 16 nt, Homo sapiens
cagcauuuucauaucc

SEQ ID NO: 2074117 - RNA, 16 nt, Homo sapiens
uccaaccagaccugga

SEQ ID NO: 2074118 - RNA, 13 nt, Homo sapiens
guuaaaagcaaaa

SEQ ID NO: 2074119 - RNA, 14 nt, Homo sapiens
cacaaacuuaacau

SEQ ID NO: 2074120 - RNA, 18 nt, Homo sapiens
uccagcucaugacacugu

SEQ ID NO: 2074121 - RNA, 21 nt, Homo sapiens
caacagagcaagacuccaucu

SEQ ID NO: 2074122 - RNA, 19 nt, Homo sapiens
aaugguccuguuaugucau

SEQ ID NO: 2074123 - RNA, 15 nt, Homo sapiens
aacugggacguguau

SEQ ID NO: 2074124 - RNA, 19 nt, Homo sapiens
guuaaggggagcaacagag

SEQ ID NO: 2074125 - RNA, 15 nt, Homo sapiens
gggcugaucucaggg

SEQ ID NO: 2074126 - RNA, 18 nt, Homo sapiens
ccaccccacucacagaga

SEQ ID NO: 2074127 - RNA, 18 nt, Homo sapiens
augucaauaugagauauu

SEQ ID NO: 2074128 - RNA, 22 nt, Homo sapiens
agccacccugaguugcuuuuca

SEQ ID NO: 2074129 - RNA, 20 nt, Homo sapiens
uccucccucauucaucuugc

SEQ ID NO: 2074130 - RNA, 20 nt, Homo sapiens
agcaaaauucauaccugacu

SEQ ID NO: 2074131 - RNA, 18 nt, Homo sapiens
gauaaaaaaauuguuauu

SEQ ID NO: 2074132 - RNA, 22 nt, Homo sapiens
cuuccugucccacuacuguaga

SEQ ID NO: 2074133 - RNA, 13 nt, Homo sapiens
cauacaacuggac

SEQ ID NO: 2074134 - RNA, 21 nt, Homo sapiens
augugaagccaauucagacag

SEQ ID NO: 2074135 - RNA, 21 nt, Homo sapiens
gcacuugccugcugcuuggag

SEQ ID NO: 2074136 - RNA, 20 nt, Homo sapiens
aaugagaucguuguuuacag

SEQ ID NO: 2074137 - RNA, 14 nt, Homo sapiens
uuuguguauucuuc

SEQ ID NO: 2074138 - RNA, 15 nt, Homo sapiens
cacaggguguuggaa

SEQ ID NO: 2074139 - RNA, 12 nt, Homo sapiens
uggcugugaaag

SEQ ID NO: 2074140 - RNA, 20 nt, Homo sapiens
auuagccagucuuuacagcu

SEQ ID NO: 2074141 - RNA, 13 nt, Homo sapiens
cugaagccguguu

SEQ ID NO: 2074142 - RNA, 22 nt, Homo sapiens
cucggggguggagugagacuga

SEQ ID NO: 2074143 - RNA, 17 nt, Homo sapiens
uauuauguaaauuuugc

SEQ ID NO: 2074144 - RNA, 17 nt, Homo sapiens
ccugccagccacuguca

SEQ ID NO: 2074145 - RNA, 23 nt, Homo sapiens
uuggccaaaacaggcucaggcca

SEQ ID NO: 2074146 - RNA, 22 nt, Homo sapiens
gagcaucugcaacaaaaaguca

SEQ ID NO: 2074147 - RNA, 21 nt, Homo sapiens
cauguccugcugcuucugcaa

SEQ ID NO: 2074148 - RNA, 11 nt, Homo sapiens
cuccagaguug

SEQ ID NO: 2074149 - RNA, 14 nt, Homo sapiens
uguucauaauauca

SEQ ID NO: 2074150 - RNA, 14 nt, Homo sapiens
cuucuugugaucuu

SEQ ID NO: 2074151 - RNA, 21 nt, Homo sapiens
cuauaguacuuuaugcaucuc

SEQ ID NO: 2074152 - RNA, 14 nt, Homo sapiens
uccugacccuguga

SEQ ID NO: 2074153 - RNA, 16 nt, Homo sapiens
aacugguucuacaaau

SEQ ID NO: 2074154 - RNA, 18 nt, Homo sapiens
ggagagaagcaagccagc

SEQ ID NO: 2074155 - RNA, 20 nt, Homo sapiens
gcaaaagaaagcaaauuauu

SEQ ID NO: 2074156 - RNA, 15 nt, Homo sapiens
gugccaggacaauga

SEQ ID NO: 2074157 - RNA, 12 nt, Homo sapiens
agaauuucacaa

SEQ ID NO: 2074158 - RNA, 22 nt, Homo sapiens
aagggaacuugagcgugaaucu

SEQ ID NO: 2074159 - RNA, 19 nt, Homo sapiens
uuauacauguguaaacaau

SEQ ID NO: 2074160 - RNA, 20 nt, Homo sapiens
aacccugggcuauugcugcu

SEQ ID NO: 2074161 - RNA, 22 nt, Homo sapiens
aauucagucuuuucucugaaaa

SEQ ID NO: 2074162 - RNA, 12 nt, Homo sapiens
ucuuuugcaauu

SEQ ID NO: 2074163 - RNA, 20 nt, Homo sapiens
accgagagaaaaagcccagc

SEQ ID NO: 2074164 - RNA, 15 nt, Homo sapiens
aucuaaaaucugcua

SEQ ID NO: 2074165 - RNA, 19 nt, Homo sapiens
acguggaaccucugucuca

SEQ ID NO: 2074166 - RNA, 17 nt, Homo sapiens
cuacuggagauaccaga

SEQ ID NO: 2074167 - RNA, 15 nt, Homo sapiens
uggggcugauuguau

SEQ ID NO: 2074168 - RNA, 14 nt, Homo sapiens
augcaacuccaugc

SEQ ID NO: 2074169 - RNA, 19 nt, Homo sapiens
uauuaauuuuugaaaccca

SEQ ID NO: 2074170 - RNA, 19 nt, Homo sapiens
aaacugcggucagaugugg

SEQ ID NO: 2074171 - RNA, 23 nt, Homo sapiens
gucaaaaaccagaauuaggucaa

SEQ ID NO: 2074172 - RNA, 12 nt, Homo sapiens
acuccucuauca

SEQ ID NO: 2074173 - RNA, 22 nt, Homo sapiens
aggauuauauguauuaauacuu

SEQ ID NO: 2074174 - RNA, 17 nt, Homo sapiens
ggcuguguuuucgauga

SEQ ID NO: 2074175 - RNA, 21 nt, Homo sapiens
cauuucucuugcucaccaaga

SEQ ID NO: 2074176 - RNA, 16 nt, Homo sapiens
cggccuccauccugag

SEQ ID NO: 2074177 - RNA, 16 nt, Homo sapiens
auuugcugacacauca

SEQ ID NO: 2074178 - RNA, 16 nt, Homo sapiens
aauauccuuuaauuga

SEQ ID NO: 2074179 - RNA, 22 nt, Homo sapiens
uuaugccaaauugauugucaua

SEQ ID NO: 2074180 - RNA, 13 nt, Homo sapiens
auaauaaaaccaa

SEQ ID NO: 2074181 - RNA, 20 nt, Homo sapiens
aaaugaggaaaugccacaaa

SEQ ID NO: 2074182 - RNA, 17 nt, Homo sapiens
ucucuagaaagaauauu

SEQ ID NO: 2074183 - RNA, 23 nt, Homo sapiens
aaauacagugcuuuauggcucua

SEQ ID NO: 2074184 - RNA, 15 nt, Homo sapiens
ggaaucccacuguau

SEQ ID NO: 2074185 - RNA, 15 nt, Homo sapiens
ugaauaaugaaugaa

SEQ ID NO: 2074186 - RNA, 17 nt, Homo sapiens
caaaccuccaaaagccc

SEQ ID NO: 2074187 - RNA, 17 nt, Homo sapiens
caaguagcugggauuac

SEQ ID NO: 2074188 - RNA, 17 nt, Homo sapiens
cuaccaggaagaaggac

SEQ ID NO: 2074189 - RNA, 15 nt, Homo sapiens
aaguucagaucuuaa

SEQ ID NO: 2074190 - RNA, 13 nt, Homo sapiens
cccucuucccuga

SEQ ID NO: 2074191 - RNA, 15 nt, Homo sapiens
caagaaagauuucau

SEQ ID NO: 2074192 - RNA, 22 nt, Homo sapiens
aguuuaccucaggugugccugu

SEQ ID NO: 2074193 - RNA, 20 nt, Homo sapiens
gcacuacauaaucucuggaa

SEQ ID NO: 2074194 - RNA, 20 nt, Homo sapiens
caaagucauccccucucagg

SEQ ID NO: 2074195 - RNA, 14 nt, Homo sapiens
uucaugucaucaaa

SEQ ID NO: 2074196 - RNA, 17 nt, Homo sapiens
uccccucagagugcaag

SEQ ID NO: 2074197 - RNA, 23 nt, Homo sapiens
gcuuuacaaggaguaacaaaaca

SEQ ID NO: 2074198 - RNA, 14 nt, Homo sapiens
cuaaggugugcucu

SEQ ID NO: 2074199 - RNA, 18 nt, Homo sapiens
gauguggccugcauguac

SEQ ID NO: 2074200 - RNA, 17 nt, Homo sapiens
aggaaagcguuuggaaa

SEQ ID NO: 2074201 - RNA, 17 nt, Homo sapiens
gauaauuuucauagcug

SEQ ID NO: 2074202 - RNA, 23 nt, Homo sapiens
cuggaaucacaaaccaagccaug

SEQ ID NO: 2074203 - RNA, 13 nt, Homo sapiens
uccgcccgcccac

SEQ ID NO: 2074204 - RNA, 12 nt, Homo sapiens
aguccucuagca

SEQ ID NO: 2074205 - RNA, 18 nt, Homo sapiens
agcucaaggcaaugggcu

SEQ ID NO: 2074206 - RNA, 16 nt, Homo sapiens
ucagagcauugugcaa

SEQ ID NO: 2074207 - RNA, 18 nt, Homo sapiens
aguugcugucauccacuu

SEQ ID NO: 2074208 - RNA, 21 nt, Homo sapiens
gaugaagcucuggccaaccaa

SEQ ID NO: 2074209 - RNA, 17 nt, Homo sapiens
cuaucaaaaagauauca

SEQ ID NO: 2074210 - RNA, 20 nt, Homo sapiens
uaagauggcaacuguauuaa

SEQ ID NO: 2074211 - RNA, 23 nt, Homo sapiens
cacuacacaggaggcugaggcag

SEQ ID NO: 2074212 - RNA, 12 nt, Homo sapiens
ccuuugcugacc

SEQ ID NO: 2074213 - RNA, 23 nt, Homo sapiens
aggagaauggcgugaaccuggga

SEQ ID NO: 2074214 - RNA, 17 nt, Homo sapiens
agccuggccuccugccu

SEQ ID NO: 2074215 - RNA, 23 nt, Homo sapiens
acccugugacccucucacuuugg

SEQ ID NO: 2074216 - RNA, 14 nt, Homo sapiens
agccaccaguucuc

SEQ ID NO: 2074217 - RNA, 21 nt, Homo sapiens
ugaaacacuuucaggaccuuc

SEQ ID NO: 2074218 - RNA, 22 nt, Homo sapiens
uaaugucauagguaagaaacac

SEQ ID NO: 2074219 - RNA, 14 nt, Homo sapiens
ucacggccuggcau

SEQ ID NO: 2074220 - RNA, 18 nt, Homo sapiens
acaguuucuugcuuggaa

SEQ ID NO: 2074221 - RNA, 17 nt, Homo sapiens
cuuaaugcuauuugcca

SEQ ID NO: 2074222 - RNA, 18 nt, Homo sapiens
gcuaacauagcacaguau

SEQ ID NO: 2074223 - RNA, 14 nt, Homo sapiens
uguugacaugugcu

SEQ ID NO: 2074224 - RNA, 20 nt, Homo sapiens
gcuggguguguuucaggaca

SEQ ID NO: 2074225 - RNA, 17 nt, Homo sapiens
gggacgcacagugcagu

SEQ ID NO: 2074226 - RNA, 15 nt, Homo sapiens
caaugacacagucuu

SEQ ID NO: 2074227 - RNA, 15 nt, Homo sapiens
caaagacacagacuu

SEQ ID NO: 2074228 - RNA, 20 nt, Homo sapiens
uucaagugauggucauucau

SEQ ID NO: 2074229 - RNA, 23 nt, Homo sapiens
auugggugccagcauacauuuuc

SEQ ID NO: 2074230 - RNA, 22 nt, Homo sapiens
ugaucuguggagaauguacaca

SEQ ID NO: 2074231 - RNA, 23 nt, Homo sapiens
uccaggacuggggcuugccaggc

SEQ ID NO: 2074232 - RNA, 20 nt, Homo sapiens
gcagccucacaguccuuacc

SEQ ID NO: 2074233 - RNA, 16 nt, Homo sapiens
gaaauucuccacugug

SEQ ID NO: 2074234 - RNA, 21 nt, Homo sapiens
cuaaaauaauuuuauuaugca

SEQ ID NO: 2074235 - RNA, 12 nt, Homo sapiens
cuccuugcaguu

SEQ ID NO: 2074236 - RNA, 9 nt, Homo sapiens
ccagugggc

SEQ ID NO: 2074237 - RNA, 21 nt, Homo sapiens
gagugcaguggcaucaucuca

SEQ ID NO: 2074238 - RNA, 17 nt, Homo sapiens
aaaggacaaacagugaa

SEQ ID NO: 2074239 - RNA, 18 nt, Homo sapiens
auucagagcuuucaagga

SEQ ID NO: 2074240 - RNA, 18 nt, Homo sapiens
cugggggaaauuggcgau

SEQ ID NO: 2074241 - RNA, 16 nt, Homo sapiens
ugacgcaccacugcca

SEQ ID NO: 2074242 - RNA, 15 nt, Homo sapiens
cugggcacaaacaga

SEQ ID NO: 2074243 - RNA, 22 nt, Homo sapiens
uucuacucgaguuacagacaaa

SEQ ID NO: 2074244 - RNA, 14 nt, Homo sapiens
uaccauuuccucag

SEQ ID NO: 2074245 - RNA, 12 nt, Homo sapiens
guguacuguaau

SEQ ID NO: 2074246 - RNA, 18 nt, Homo sapiens
ggagcccgucaggccaca

SEQ ID NO: 2074247 - RNA, 18 nt, Homo sapiens
ucccaucugucaccaauu

SEQ ID NO: 2074248 - RNA, 20 nt, Homo sapiens
ucaacccugugaucuauacc

SEQ ID NO: 2074249 - RNA, 18 nt, Homo sapiens
guaaagaguuaguuugag

SEQ ID NO: 2074250 - RNA, 13 nt, Homo sapiens
agcugcaucuacu

SEQ ID NO: 2074251 - RNA, 24 nt, Homo sapiens
ggacagcuccuggaccaggcccau

SEQ ID NO: 2074252 - RNA, 15 nt, Homo sapiens
ccaauaacuuuucac

SEQ ID NO: 2074253 - RNA, 15 nt, Homo sapiens
cugacucugacucau

SEQ ID NO: 2074254 - RNA, 20 nt, Homo sapiens
cugcuaaggcuccuccuugc

SEQ ID NO: 2074255 - RNA, 12 nt, Homo sapiens
ucucucucaccu

SEQ ID NO: 2074256 - RNA, 16 nt, Homo sapiens
caagcaaaaugcaaac

SEQ ID NO: 2074257 - RNA, 21 nt, Homo sapiens
cacgcugauguuuauguacug

SEQ ID NO: 2074258 - RNA, 13 nt, Homo sapiens
uacggcagucaca

SEQ ID NO: 2074259 - RNA, 19 nt, Homo sapiens
cauuuaaaacauuaaaaua

SEQ ID NO: 2074260 - RNA, 17 nt, Homo sapiens
cuguuagcauaauguga

SEQ ID NO: 2074261 - RNA, 12 nt, Homo sapiens
cuacuucucacc

SEQ ID NO: 2074262 - RNA, 18 nt, Homo sapiens
acagaagggcuaacucag

SEQ ID NO: 2074263 - RNA, 15 nt, Homo sapiens
ucuaucuaaugacau

SEQ ID NO: 2074264 - RNA, 16 nt, Homo sapiens
ucuuggggcccagugc

SEQ ID NO: 2074265 - RNA, 14 nt, Homo sapiens
cuguuaaccaaagg

SEQ ID NO: 2074266 - RNA, 19 nt, Homo sapiens
aggaauuuuuuucaguauu

SEQ ID NO: 2074267 - RNA, 22 nt, Homo sapiens
aacuaauuguauuuagugacaa

SEQ ID NO: 2074268 - RNA, 13 nt, Homo sapiens
uuuuauaauuaau

SEQ ID NO: 2074269 - RNA, 23 nt, Homo sapiens
uccaaauuuaaccauaaaucaau

SEQ ID NO: 2074270 - RNA, 12 nt, Homo sapiens
auuuacacucag

SEQ ID NO: 2074271 - RNA, 19 nt, Homo sapiens
cauuggaggggcuggcacu

SEQ ID NO: 2074272 - RNA, 16 nt, Homo sapiens
gccagucacugcugca

SEQ ID NO: 2074273 - RNA, 13 nt, Homo sapiens
cagagaagcugua

SEQ ID NO: 2074274 - RNA, 14 nt, Homo sapiens
gcagaccucaugcc

SEQ ID NO: 2074275 - RNA, 17 nt, Homo sapiens
ugaaaugcaucauucuu

SEQ ID NO: 2074276 - RNA, 23 nt, Homo sapiens
ugcagccuaagaagaaggccaga

SEQ ID NO: 2074277 - RNA, 18 nt, Homo sapiens
cugauuuaacacuaucca

SEQ ID NO: 2074278 - RNA, 18 nt, Homo sapiens
ucaaucaagaugggugau

SEQ ID NO: 2074279 - RNA, 18 nt, Homo sapiens
aaagaagcaaucuccuua

SEQ ID NO: 2074280 - RNA, 21 nt, Homo sapiens
ucuucccgcacaaauuccaca

SEQ ID NO: 2074281 - RNA, 20 nt, Homo sapiens
gaaagacuuucucugccccu

SEQ ID NO: 2074282 - RNA, 20 nt, Homo sapiens
ucccagagcacaagaaggcc

SEQ ID NO: 2074283 - RNA, 19 nt, Homo sapiens
ggguaauagaaaugcauac

SEQ ID NO: 2074284 - RNA, 19 nt, Homo sapiens
gaacacuggaacauuccag

SEQ ID NO: 2074285 - RNA, 21 nt, Homo sapiens
uaaaaugagggugcccagcuu

SEQ ID NO: 2074286 - RNA, 21 nt, Homo sapiens
aauucagcauguguucauucu

SEQ ID NO: 2074287 - RNA, 15 nt, Homo sapiens
aacgagccuuuucac

SEQ ID NO: 2074288 - RNA, 14 nt, Homo sapiens
agacuuggggccag

SEQ ID NO: 2074289 - RNA, 22 nt, Homo sapiens
ugacuauggagucuugugaaag

SEQ ID NO: 2074290 - RNA, 15 nt, Homo sapiens
gccaccaucuuugca

SEQ ID NO: 2074291 - RNA, 14 nt, Homo sapiens
uaauacuuuugcug

SEQ ID NO: 2074292 - RNA, 20 nt, Homo sapiens
ucuaaaaugaguuaccuaca

SEQ ID NO: 2074293 - RNA, 18 nt, Homo sapiens
ugcaucagaaaaugcagc

SEQ ID NO: 2074294 - RNA, 18 nt, Homo sapiens
cagcaccuccuccaugca

SEQ ID NO: 2074295 - RNA, 13 nt, Homo sapiens
uguuggucuguag

SEQ ID NO: 2074296 - RNA, 17 nt, Homo sapiens
gugcagaugcugcugaa

SEQ ID NO: 2074297 - RNA, 19 nt, Homo sapiens
uccuggcuaacacggugaa

SEQ ID NO: 2074298 - RNA, 19 nt, Homo sapiens
uaaauagguuuuucuugcu

SEQ ID NO: 2074299 - RNA, 21 nt, Homo sapiens
gcaugcuucuauuagucaccu

SEQ ID NO: 2074300 - RNA, 20 nt, Homo sapiens
ccucgaaaaccaucacauga

SEQ ID NO: 2074301 - RNA, 13 nt, Homo sapiens
agcagccacgagg

SEQ ID NO: 2074302 - RNA, 15 nt, Homo sapiens
gagugugcagacuga

SEQ ID NO: 2074303 - RNA, 13 nt, Homo sapiens
ccuggugcugcug

SEQ ID NO: 2074304 - RNA, 22 nt, Homo sapiens
acaggagguuguggaugcucca

SEQ ID NO: 2074305 - RNA, 14 nt, Homo sapiens
accuucagagccag

SEQ ID NO: 2074306 - RNA, 23 nt, Homo sapiens
gggcuguuuuuguuccugccuuu

SEQ ID NO: 2074307 - RNA, 20 nt, Homo sapiens
gccuggcuaacauggugaaa

SEQ ID NO: 2074308 - RNA, 18 nt, Homo sapiens
gcacauuugucacugaau

SEQ ID NO: 2074309 - RNA, 17 nt, Homo sapiens
gcuguacugagcacuga

SEQ ID NO: 2074310 - RNA, 20 nt, Homo sapiens
auuugacuucagccagguga

SEQ ID NO: 2074311 - RNA, 15 nt, Homo sapiens
uagcgccucuuuuau

SEQ ID NO: 2074312 - RNA, 23 nt, Homo sapiens
uucauuggacccugacuguauac

SEQ ID NO: 2074313 - RNA, 17 nt, Homo sapiens
cggacucuuugcuguug

SEQ ID NO: 2074314 - RNA, 15 nt, Homo sapiens
uauuacuaaggagua

SEQ ID NO: 2074315 - RNA, 21 nt, Homo sapiens
cagguagugggugaaugugug

SEQ ID NO: 2074316 - RNA, 12 nt, Homo sapiens
cuaaaagauuau

SEQ ID NO: 2074317 - RNA, 17 nt, Homo sapiens
guaugaucucucuagcu

SEQ ID NO: 2074318 - RNA, 17 nt, Homo sapiens
ggcaaagccuucauugc

SEQ ID NO: 2074319 - RNA, 14 nt, Homo sapiens
cucccaagguccuc

SEQ ID NO: 2074320 - RNA, 15 nt, Homo sapiens
uuaauuugaaaccag

SEQ ID NO: 2074321 - RNA, 21 nt, Homo sapiens
auuaagugggguagacugagg

SEQ ID NO: 2074322 - RNA, 22 nt, Homo sapiens
caaagcuuucauguaaacugug

SEQ ID NO: 2074323 - RNA, 20 nt, Homo sapiens
uguucguggagucucauggg

SEQ ID NO: 2074324 - RNA, 23 nt, Homo sapiens
agucaccuguaaauugauucaag

SEQ ID NO: 2074325 - RNA, 20 nt, Homo sapiens
cccacgugugcagacugugg

SEQ ID NO: 2074326 - RNA, 15 nt, Homo sapiens
acuugacauguagcu

SEQ ID NO: 2074327 - RNA, 17 nt, Homo sapiens
aaggagaggaguucuuu

SEQ ID NO: 2074328 - RNA, 16 nt, Homo sapiens
agccaggcugccaagg

SEQ ID NO: 2074329 - RNA, 15 nt, Homo sapiens
aaagucuugccuugc

SEQ ID NO: 2074330 - RNA, 21 nt, Homo sapiens
ggaugcccccaggcagccacc

SEQ ID NO: 2074331 - RNA, 16 nt, Homo sapiens
aucgggccaucucaga

SEQ ID NO: 2074332 - RNA, 15 nt, Homo sapiens
gguucucuacaggcc

SEQ ID NO: 2074333 - RNA, 15 nt, Homo sapiens
ucauucagcuaacaa

SEQ ID NO: 2074334 - RNA, 18 nt, Homo sapiens
aaucuuccaucugcaucu

SEQ ID NO: 2074335 - RNA, 15 nt, Homo sapiens
cgauguacacacaca

SEQ ID NO: 2074336 - RNA, 14 nt, Homo sapiens
ccuuguuguauucc

SEQ ID NO: 2074337 - RNA, 19 nt, Homo sapiens
uaugagcccuauauauuca

SEQ ID NO: 2074338 - RNA, 16 nt, Homo sapiens
caucaauaaaacacaa

SEQ ID NO: 2074339 - RNA, 16 nt, Homo sapiens
cuuuuaaaauauucua

SEQ ID NO: 2074340 - RNA, 12 nt, Homo sapiens
ugcagugggugg

SEQ ID NO: 2074341 - RNA, 18 nt, Homo sapiens
ugucuccugaccugaaau

SEQ ID NO: 2074342 - RNA, 12 nt, Homo sapiens
acuuugcugauu

SEQ ID NO: 2074343 - RNA, 21 nt, Homo sapiens
gauuuucaagaucaaacuucc

SEQ ID NO: 2074344 - RNA, 12 nt, Homo sapiens
guccauuauuca

SEQ ID NO: 2074345 - RNA, 13 nt, Homo sapiens
auuuaugugaugg

SEQ ID NO: 2074346 - RNA, 12 nt, Homo sapiens
acuuggugcugc

SEQ ID NO: 2074347 - RNA, 13 nt, Homo sapiens
gauguaagagcuu

SEQ ID NO: 2074348 - RNA, 18 nt, Homo sapiens
ccuugcaaucacaaaagg

SEQ ID NO: 2074349 - RNA, 22 nt, Homo sapiens
ugcaaaucagccaugugcugcg

SEQ ID NO: 2074350 - RNA, 15 nt, Homo sapiens
uccacugucaagaaa

SEQ ID NO: 2074351 - RNA, 12 nt, Homo sapiens
ccaauuccugau

SEQ ID NO: 2074352 - RNA, 17 nt, Homo sapiens
uaucuuccagaaacuac

SEQ ID NO: 2074353 - RNA, 19 nt, Homo sapiens
accaggcugcucagggcug

SEQ ID NO: 2074354 - RNA, 17 nt, Homo sapiens
ugggaauuuucuuccaa

SEQ ID NO: 2074355 - RNA, 16 nt, Homo sapiens
gcaggagggacagucu

SEQ ID NO: 2074356 - RNA, 20 nt, Homo sapiens
auaugcaccaaaucaucucu

SEQ ID NO: 2074357 - RNA, 21 nt, Homo sapiens
accuuguguacuuucuucccu

SEQ ID NO: 2074358 - RNA, 12 nt, Homo sapiens
uuuuuuaagggc

SEQ ID NO: 2074359 - RNA, 14 nt, Homo sapiens
ccuugugacccagg

SEQ ID NO: 2074360 - RNA, 15 nt, Homo sapiens
gugacauuugggaga

SEQ ID NO: 2074361 - RNA, 17 nt, Homo sapiens
uagagaugagcuuucuu

SEQ ID NO: 2074362 - RNA, 20 nt, Homo sapiens
gggccacccaaauguguaca

SEQ ID NO: 2074363 - RNA, 20 nt, Homo sapiens
auucuagccaaacuauucua

SEQ ID NO: 2074364 - RNA, 14 nt, Homo sapiens
gaugucuaccucag

SEQ ID NO: 2074365 - RNA, 15 nt, Homo sapiens
gaauguacuugauau

SEQ ID NO: 2074366 - RNA, 21 nt, Homo sapiens
ugugaaaggaagcuccacugu

SEQ ID NO: 2074367 - RNA, 14 nt, Homo sapiens
cuuugaaugacaaa

SEQ ID NO: 2074368 - RNA, 17 nt, Homo sapiens
caagggcaucauccuca

SEQ ID NO: 2074369 - RNA, 23 nt, Homo sapiens
caacagacacccuccacucugag

SEQ ID NO: 2074370 - RNA, 13 nt, Homo sapiens
ccaucugugguuu

SEQ ID NO: 2074371 - RNA, 17 nt, Homo sapiens
ccuauuccaguguccau

SEQ ID NO: 2074372 - RNA, 21 nt, Homo sapiens
acagcggaggagaccagcuca

SEQ ID NO: 2074373 - RNA, 23 nt, Homo sapiens
auggaaguugcagugagcugaua

SEQ ID NO: 2074374 - RNA, 13 nt, Homo sapiens
ucauguagccuca

SEQ ID NO: 2074375 - RNA, 14 nt, Homo sapiens
accacuggagauca

SEQ ID NO: 2074376 - RNA, 15 nt, Homo sapiens
auauaaagauuaaca

SEQ ID NO: 2074377 - RNA, 14 nt, Homo sapiens
caaacaaaaggaaa

SEQ ID NO: 2074378 - RNA, 14 nt, Homo sapiens
ccagcucagucuca

SEQ ID NO: 2074379 - RNA, 12 nt, Homo sapiens
cacuugaccuca

SEQ ID NO: 2074380 - RNA, 14 nt, Homo sapiens
cucauccccaagga

SEQ ID NO: 2074381 - RNA, 15 nt, Homo sapiens
aacaggccucagggc

SEQ ID NO: 2074382 - RNA, 21 nt, Homo sapiens
ugaccaccaacauucuguguu

SEQ ID NO: 2074383 - RNA, 18 nt, Homo sapiens
ucuccacaaaaacucuua

SEQ ID NO: 2074384 - RNA, 13 nt, Homo sapiens
ucggcucacugca

SEQ ID NO: 2074385 - RNA, 13 nt, Homo sapiens
gagagcagugugg

SEQ ID NO: 2074386 - RNA, 21 nt, Homo sapiens
uggacagacacuguugcaaag

SEQ ID NO: 2074387 - RNA, 18 nt, Homo sapiens
uacaaauguuagagccau

SEQ ID NO: 2074388 - RNA, 17 nt, Homo sapiens
guccacccccauuguga

SEQ ID NO: 2074389 - RNA, 22 nt, Homo sapiens
agaauauucuucuaaguauuuu

SEQ ID NO: 2074390 - RNA, 20 nt, Homo sapiens
uuuguaucauuaugaaguca

SEQ ID NO: 2074391 - RNA, 14 nt, Homo sapiens
uaaaaaaguuuaca

SEQ ID NO: 2074392 - RNA, 14 nt, Homo sapiens
uaaucuaguuuuau

SEQ ID NO: 2074393 - RNA, 20 nt, Homo sapiens
accaucaauuuuaguuguca

SEQ ID NO: 2074394 - RNA, 20 nt, Homo sapiens
caccuagaaaggaacugcaa

SEQ ID NO: 2074395 - RNA, 23 nt, Homo sapiens
ccugccuggcacuuacugguccu

SEQ ID NO: 2074396 - RNA, 18 nt, Homo sapiens
cauuuguaaaaauacugu

SEQ ID NO: 2074397 - RNA, 12 nt, Homo sapiens
ccaagccagcug

SEQ ID NO: 2074398 - RNA, 13 nt, Homo sapiens
auccuaagcaaaa

SEQ ID NO: 2074399 - RNA, 21 nt, Homo sapiens
aauugguuaguuaacacugaa

SEQ ID NO: 2074400 - RNA, 18 nt, Homo sapiens
cuuucaucacaaauccaa

SEQ ID NO: 2074401 - RNA, 21 nt, Homo sapiens
gcacuacauucauuuagcuaa

SEQ ID NO: 2074402 - RNA, 19 nt, Homo sapiens
acccucugggaaccuccca

SEQ ID NO: 2074403 - RNA, 14 nt, Homo sapiens
cacugguaauccca

SEQ ID NO: 2074404 - RNA, 12 nt, Homo sapiens
aguggcaaaaaa

SEQ ID NO: 2074405 - RNA, 15 nt, Homo sapiens
caggauguacaaaga

SEQ ID NO: 2074406 - RNA, 13 nt, Homo sapiens
guaucuaccaucu

SEQ ID NO: 2074407 - RNA, 15 nt, Homo sapiens
ugauuaggaagcauu

SEQ ID NO: 2074408 - RNA, 22 nt, Homo sapiens
cuucuggggacaccucaggagc

SEQ ID NO: 2074409 - RNA, 22 nt, Homo sapiens
uguaaugguaucuuaaagugug

SEQ ID NO: 2074410 - RNA, 15 nt, Homo sapiens
uguuauaguugaaga

SEQ ID NO: 2074411 - RNA, 12 nt, Homo sapiens
ggaaaaggaaug

SEQ ID NO: 2074412 - RNA, 12 nt, Homo sapiens
agaaaagggaug

SEQ ID NO: 2074413 - RNA, 16 nt, Homo sapiens
ugauccagagcacaga

SEQ ID NO: 2074414 - RNA, 14 nt, Homo sapiens
uaucucuguuuccu

SEQ ID NO: 2074415 - RNA, 14 nt, Homo sapiens
cagcccugcugcuu

SEQ ID NO: 2074416 - RNA, 21 nt, Homo sapiens
gccccacccuuuccucuuaau

SEQ ID NO: 2074417 - RNA, 22 nt, Homo sapiens
guaccaaagaaacaccacuuaa

SEQ ID NO: 2074418 - RNA, 23 nt, Homo sapiens
cuccuugguucuugaggggacca

SEQ ID NO: 2074419 - RNA, 13 nt, Homo sapiens
acccucugcugca

SEQ ID NO: 2074420 - RNA, 19 nt, Homo sapiens
cacucaaggcggugcuuga

SEQ ID NO: 2074421 - RNA, 20 nt, Homo sapiens
ccugagguuugaaucugacu

SEQ ID NO: 2074422 - RNA, 15 nt, Homo sapiens
aagcaaaacuuaacu

SEQ ID NO: 2074423 - RNA, 14 nt, Homo sapiens
gcuucagcaucucc

SEQ ID NO: 2074424 - RNA, 17 nt, Homo sapiens
cacauauugagaaccua

SEQ ID NO: 2074425 - RNA, 19 nt, Homo sapiens
uuacugaucucuuuaagua

SEQ ID NO: 2074426 - RNA, 14 nt, Homo sapiens
caaagaauacuaga

SEQ ID NO: 2074427 - RNA, 17 nt, Homo sapiens
cccgagggcgccaugca

SEQ ID NO: 2074428 - RNA, 19 nt, Homo sapiens
acauuucuguaaauaccau

SEQ ID NO: 2074429 - RNA, 12 nt, Homo sapiens
ggcaguacaaug

SEQ ID NO: 2074430 - RNA, 20 nt, Homo sapiens
aggagacacgacagcacaca

SEQ ID NO: 2074431 - RNA, 12 nt, Homo sapiens
agaagguggucu

SEQ ID NO: 2074432 - RNA, 17 nt, Homo sapiens
ugcagugccccuagcuu

SEQ ID NO: 2074433 - RNA, 19 nt, Homo sapiens
aacaaacucuacuauccaa

SEQ ID NO: 2074434 - RNA, 22 nt, Homo sapiens
acaaguaagagguuaugccaaa

SEQ ID NO: 2074435 - RNA, 23 nt, Homo sapiens
auuuguguugaaggaacuugucu

SEQ ID NO: 2074436 - RNA, 13 nt, Homo sapiens
acaugcccugugu

SEQ ID NO: 2074437 - RNA, 19 nt, Homo sapiens
uacaagauuuuuuuacuua

SEQ ID NO: 2074438 - RNA, 13 nt, Homo sapiens
gagugacucacua

SEQ ID NO: 2074439 - RNA, 18 nt, Homo sapiens
uaucagcggcagcauucu

SEQ ID NO: 2074440 - RNA, 14 nt, Homo sapiens
aagaacucucugga

SEQ ID NO: 2074441 - RNA, 12 nt, Homo sapiens
aggagaagcagc

SEQ ID NO: 2074442 - RNA, 21 nt, Homo sapiens
acaaaaaaaacaaaaaaccca

SEQ ID NO: 2074443 - RNA, 15 nt, Homo sapiens
caggagagcugcagu

SEQ ID NO: 2074444 - RNA, 14 nt, Homo sapiens
uagggaagcucagg

SEQ ID NO: 2074445 - RNA, 16 nt, Homo sapiens
ugaaccggcucccacc

SEQ ID NO: 2074446 - RNA, 14 nt, Homo sapiens
uuuaaaccagggau

SEQ ID NO: 2074447 - RNA, 16 nt, Homo sapiens
auuuuguuugcaucug

SEQ ID NO: 2074448 - RNA, 15 nt, Homo sapiens
aagguuauaacugug

SEQ ID NO: 2074449 - RNA, 16 nt, Homo sapiens
gcaccaucacacaugc

SEQ ID NO: 2074450 - RNA, 21 nt, Homo sapiens
ugccuugaaggggcagcugug

SEQ ID NO: 2074451 - RNA, 20 nt, Homo sapiens
ucuggggauacuggcaaagc

SEQ ID NO: 2074452 - RNA, 15 nt, Homo sapiens
cuagaauucuggugu

SEQ ID NO: 2074453 - RNA, 15 nt, Homo sapiens
uagaaaauuaaauga

SEQ ID NO: 2074454 - RNA, 15 nt, Homo sapiens
ggacaguugggcuau

SEQ ID NO: 2074455 - RNA, 22 nt, Homo sapiens
gggccuaauaaaacugauguga

SEQ ID NO: 2074456 - RNA, 22 nt, Homo sapiens
cccucuggaguggccacuaagc

SEQ ID NO: 2074457 - RNA, 14 nt, Homo sapiens
gugcagaaacuacc

SEQ ID NO: 2074458 - RNA, 18 nt, Homo sapiens
ccacuacgggcaccuaaa

SEQ ID NO: 2074459 - RNA, 22 nt, Homo sapiens
cagugcagcucgugauuggaaa

SEQ ID NO: 2074460 - RNA, 21 nt, Homo sapiens
gccuuuauuuuuaaccugcca

SEQ ID NO: 2074461 - RNA, 18 nt, Homo sapiens
caauaugggcucaaguca

SEQ ID NO: 2074462 - RNA, 15 nt, Homo sapiens
agucugauaaacuga

SEQ ID NO: 2074463 - RNA, 14 nt, Homo sapiens
gaagugccaucuca

SEQ ID NO: 2074464 - RNA, 15 nt, Homo sapiens
cucugucuccuaagc

SEQ ID NO: 2074465 - RNA, 22 nt, Homo sapiens
aaaagcaugaauuggaacugca

SEQ ID NO: 2074466 - RNA, 12 nt, Homo sapiens
uuauuggcugcu

SEQ ID NO: 2074467 - RNA, 18 nt, Homo sapiens
ccuuccaggugauucugu

SEQ ID NO: 2074468 - RNA, 23 nt, Homo sapiens
cagacuaaguugcuaaccucaau

SEQ ID NO: 2074469 - RNA, 21 nt, Homo sapiens
ggaauuaggaagaccaagaca

SEQ ID NO: 2074470 - RNA, 13 nt, Homo sapiens
ccugcacuacucu

SEQ ID NO: 2074471 - RNA, 13 nt, Homo sapiens
acuguacuccucc

SEQ ID NO: 2074472 - RNA, 13 nt, Homo sapiens
ucauaauaccuca

SEQ ID NO: 2074473 - RNA, 12 nt, Homo sapiens
acuuugugacug

SEQ ID NO: 2074474 - RNA, 22 nt, Homo sapiens
acaggguccccacacaacagug

SEQ ID NO: 2074475 - RNA, 17 nt, Homo sapiens
ugugggacugagaugca

SEQ ID NO: 2074476 - RNA, 14 nt, Homo sapiens
aguagcacccccag

SEQ ID NO: 2074477 - RNA, 14 nt, Homo sapiens
accaugacugugac

SEQ ID NO: 2074478 - RNA, 22 nt, Homo sapiens
uuuuucuccagaagauggugcu

SEQ ID NO: 2074479 - RNA, 19 nt, Homo sapiens
gucucaauucuuuguauau

SEQ ID NO: 2074480 - RNA, 14 nt, Homo sapiens
aggcuggcaguaca

SEQ ID NO: 2074481 - RNA, 19 nt, Homo sapiens
uggcuacuaguuuaagcaa

SEQ ID NO: 2074482 - RNA, 16 nt, Homo sapiens
ucucauuuagaacuug

SEQ ID NO: 2074483 - RNA, 15 nt, Homo sapiens
auauggacuuccaau

SEQ ID NO: 2074484 - RNA, 13 nt, Homo sapiens
ccaccacuauaaa

SEQ ID NO: 2074485 - RNA, 19 nt, Homo sapiens
ggucuccaagggagggugc

SEQ ID NO: 2074486 - RNA, 22 nt, Homo sapiens
caaauauuaguuuuuauuaaac

SEQ ID NO: 2074487 - RNA, 20 nt, Homo sapiens
ccuucgguuguaaguagcca

SEQ ID NO: 2074488 - RNA, 19 nt, Homo sapiens
auuuacagucuaguacuua

SEQ ID NO: 2074489 - RNA, 19 nt, Homo sapiens
aagccagcaccggaccagc

SEQ ID NO: 2074490 - RNA, 14 nt, Homo sapiens
guccucucaacucu

SEQ ID NO: 2074491 - RNA, 13 nt, Homo sapiens
agccuccuaggcu

SEQ ID NO: 2074492 - RNA, 17 nt, Homo sapiens
gaaagaugcaguccuca

SEQ ID NO: 2074493 - RNA, 22 nt, Homo sapiens
ccauagcaauuccccuacauca

SEQ ID NO: 2074494 - RNA, 14 nt, Homo sapiens
uccacauuauacau

SEQ ID NO: 2074495 - RNA, 17 nt, Homo sapiens
aauguaucaacacacau

SEQ ID NO: 2074496 - RNA, 16 nt, Homo sapiens
augaacaccauaccuu

SEQ ID NO: 2074497 - RNA, 16 nt, Homo sapiens
ugccuggccuggcaca

SEQ ID NO: 2074498 - RNA, 17 nt, Homo sapiens
gagauauucugucaaau

SEQ ID NO: 2074499 - RNA, 20 nt, Homo sapiens
acuuccccgcauuccaggcu

SEQ ID NO: 2074500 - RNA, 22 nt, Homo sapiens
guguucccgacauaacauugua

SEQ ID NO: 2074501 - RNA, 19 nt, Homo sapiens
ugcaaaugcacucaucaca

SEQ ID NO: 2074502 - RNA, 20 nt, Homo sapiens
uagaaagcagagauuuucaa

SEQ ID NO: 2074503 - RNA, 21 nt, Homo sapiens
uuauacaucaccuuuuugacu

SEQ ID NO: 2074504 - RNA, 15 nt, Homo sapiens
ccuggucugugcauu

SEQ ID NO: 2074505 - RNA, 17 nt, Homo sapiens
ccucagaauugaucauu

SEQ ID NO: 2074506 - RNA, 23 nt, Homo sapiens
uagcuggagagagaguucucaca

SEQ ID NO: 2074507 - RNA, 20 nt, Homo sapiens
agccuuuguugaacuguuag

SEQ ID NO: 2074508 - RNA, 17 nt, Homo sapiens
uggcugaaggacuguga

SEQ ID NO: 2074509 - RNA, 17 nt, Homo sapiens
ccuuggugaaauucacc

SEQ ID NO: 2074510 - RNA, 20 nt, Homo sapiens
agaaacaaacuccauuacuc

SEQ ID NO: 2074511 - RNA, 11 nt, Homo sapiens
aggugcacagg

SEQ ID NO: 2074512 - RNA, 13 nt, Homo sapiens
uaaaagacuuuga

SEQ ID NO: 2074513 - RNA, 11 nt, Homo sapiens
aauugcacaau

SEQ ID NO: 2074514 - RNA, 11 nt, Homo sapiens
ugcugcacugc

SEQ ID NO: 2074515 - RNA, 15 nt, Homo sapiens
ucuuuaacaaccucu

SEQ ID NO: 2074516 - RNA, 23 nt, Homo sapiens
auugccuugugaauuugcugcua

SEQ ID NO: 2074517 - RNA, 16 nt, Homo sapiens
caggauuauucccacc

SEQ ID NO: 2074518 - RNA, 18 nt, Homo sapiens
uuucuucucgccuaggau

SEQ ID NO: 2074519 - RNA, 15 nt, Homo sapiens
uccuuuuguguacag

SEQ ID NO: 2074520 - RNA, 19 nt, Homo sapiens
agcggagagagccaagacg

SEQ ID NO: 2074521 - RNA, 18 nt, Homo sapiens
acucuaaauauuucauga

SEQ ID NO: 2074522 - RNA, 12 nt, Homo sapiens
uuuuauuaucaa

SEQ ID NO: 2074523 - RNA, 18 nt, Homo sapiens
uuaaauaauagacauaca

SEQ ID NO: 2074524 - RNA, 16 nt, Homo sapiens
cuuggaaaaaaaccac

SEQ ID NO: 2074525 - RNA, 15 nt, Homo sapiens
ugauuaccugccaau

SEQ ID NO: 2074526 - RNA, 15 nt, Homo sapiens
acccacucacauucc

SEQ ID NO: 2074527 - RNA, 17 nt, Homo sapiens
aaggaaaacugccauaa

SEQ ID NO: 2074528 - RNA, 24 nt, Homo sapiens
ugugggucuauguaaaugcaucug

SEQ ID NO: 2074529 - RNA, 17 nt, Homo sapiens
uggacaaaugcauuuag

SEQ ID NO: 2074530 - RNA, 15 nt, Homo sapiens
aagaaaaagguuuaa

SEQ ID NO: 2074531 - RNA, 15 nt, Homo sapiens
guuuagagagccugu

SEQ ID NO: 2074532 - RNA, 17 nt, Homo sapiens
uaugauauauauguaua

SEQ ID NO: 2074533 - RNA, 18 nt, Homo sapiens
cgucuaguuaacauuuca

SEQ ID NO: 2074534 - RNA, 20 nt, Homo sapiens
ugacaugcauucacauaucu

SEQ ID NO: 2074535 - RNA, 16 nt, Homo sapiens
gacuugacccuuuccu

SEQ ID NO: 2074536 - RNA, 11 nt, Homo sapiens
ccccuugccug

SEQ ID NO: 2074537 - RNA, 22 nt, Homo sapiens
guacaagguauguacaguucau

SEQ ID NO: 2074538 - RNA, 17 nt, Homo sapiens
cuuuguauuaccaaagc

SEQ ID NO: 2074539 - RNA, 14 nt, Homo sapiens
accuggcacauuca

SEQ ID NO: 2074540 - RNA, 16 nt, Homo sapiens
aaaguauaaaauagua

SEQ ID NO: 2074541 - RNA, 21 nt, Homo sapiens
aaggaacaaaaauuacaaaga

SEQ ID NO: 2074542 - RNA, 21 nt, Homo sapiens
aucugugggucuccauccucc

SEQ ID NO: 2074543 - RNA, 23 nt, Homo sapiens
cuucagggggccaggugcacaga

SEQ ID NO: 2074544 - RNA, 12 nt, Homo sapiens
auuuuacuugca

SEQ ID NO: 2074545 - RNA, 12 nt, Homo sapiens
agcuuacuuuua

SEQ ID NO: 2074546 - RNA, 22 nt, Homo sapiens
gcagaaaagaaaccggaccccc

SEQ ID NO: 2074547 - RNA, 13 nt, Homo sapiens
caugaacccaaaa

SEQ ID NO: 2074548 - RNA, 20 nt, Homo sapiens
gucagaggaccccagggugg

SEQ ID NO: 2074549 - RNA, 16 nt, Homo sapiens
gugagugugcugcugu

SEQ ID NO: 2074550 - RNA, 15 nt, Homo sapiens
augccauagcaagau

SEQ ID NO: 2074551 - RNA, 15 nt, Homo sapiens
guuucucucaaugaa

SEQ ID NO: 2074552 - RNA, 17 nt, Homo sapiens
caaaggcauaucuucua

SEQ ID NO: 2074553 - RNA, 17 nt, Homo sapiens
ucacacauuacaaaguu

SEQ ID NO: 2074554 - RNA, 10 nt, Homo sapiens
uagcacacau

SEQ ID NO: 2074555 - RNA, 22 nt, Homo sapiens
agucacauggccuaugcacaua

SEQ ID NO: 2074556 - RNA, 22 nt, Homo sapiens
gaaguaugagggaaaaugagua

SEQ ID NO: 2074557 - RNA, 22 nt, Homo sapiens
acugcacaucuagagaaaaaca

SEQ ID NO: 2074558 - RNA, 16 nt, Homo sapiens
augagccacugugcuu

SEQ ID NO: 2074559 - RNA, 18 nt, Homo sapiens
uuguacuucuguaccugu

SEQ ID NO: 2074560 - RNA, 11 nt, Homo sapiens
uccuaagacau

SEQ ID NO: 2074561 - RNA, 17 nt, Homo sapiens
uauaagaaaaccaaaca

SEQ ID NO: 2074562 - RNA, 19 nt, Homo sapiens
ucaaauguaaauuuacuga

SEQ ID NO: 2074563 - RNA, 20 nt, Homo sapiens
uauuaacaaauugcauuugu

SEQ ID NO: 2074564 - RNA, 22 nt, Homo sapiens
uuaaauucacaugcagucucag

SEQ ID NO: 2074565 - RNA, 19 nt, Homo sapiens
ccagacaucuggacacugg

SEQ ID NO: 2074566 - RNA, 23 nt, Homo sapiens
caaaucauguuuuuucugcaaug

SEQ ID NO: 2074567 - RNA, 23 nt, Homo sapiens
cuaacauuuauuaagcacguauu

SEQ ID NO: 2074568 - RNA, 23 nt, Homo sapiens
ggcuaccgugggucaaccuggga

SEQ ID NO: 2074569 - RNA, 13 nt, Homo sapiens
aagccagcacuca

SEQ ID NO: 2074570 - RNA, 23 nt, Homo sapiens
aguagacagauguuggugcaaua

SEQ ID NO: 2074571 - RNA, 19 nt, Homo sapiens
uuggacuguaagggauuga

SEQ ID NO: 2074572 - RNA, 17 nt, Homo sapiens
agcaguugggaaguuac

SEQ ID NO: 2074573 - RNA, 17 nt, Homo sapiens
auccccugcuacccuag

SEQ ID NO: 2074574 - RNA, 16 nt, Homo sapiens
acuacugugucacugu

SEQ ID NO: 2074575 - RNA, 15 nt, Homo sapiens
aaugacgucuucacc

SEQ ID NO: 2074576 - RNA, 20 nt, Homo sapiens
uacugcacuuacgcuaucca

SEQ ID NO: 2074577 - RNA, 17 nt, Homo sapiens
ccuuccccgugcccuac

SEQ ID NO: 2074578 - RNA, 13 nt, Homo sapiens
ugugcucauagaa

SEQ ID NO: 2074579 - RNA, 15 nt, Homo sapiens
guaaucauauaucaa

SEQ ID NO: 2074580 - RNA, 21 nt, Homo sapiens
cccaagucugaacguggaauu

SEQ ID NO: 2074581 - RNA, 23 nt, Homo sapiens
uacggguaacagugaggcuggga

SEQ ID NO: 2074582 - RNA, 13 nt, Homo sapiens
acaucauauaccu

SEQ ID NO: 2074583 - RNA, 17 nt, Homo sapiens
ggaagccccacuugaag

SEQ ID NO: 2074584 - RNA, 18 nt, Homo sapiens
auugcuugggucucucuc

SEQ ID NO: 2074585 - RNA, 18 nt, Homo sapiens
aguccagauuuacacugg

SEQ ID NO: 2074586 - RNA, 22 nt, Homo sapiens
acccagggugugaacauguucu

SEQ ID NO: 2074587 - RNA, 20 nt, Homo sapiens
ucagacaauugcauugcuac

SEQ ID NO: 2074588 - RNA, 14 nt, Homo sapiens
caguuaacucuccc

SEQ ID NO: 2074589 - RNA, 15 nt, Homo sapiens
agauguaaaugccac

SEQ ID NO: 2074590 - RNA, 10 nt, Homo sapiens
ccugagacag

SEQ ID NO: 2074591 - RNA, 17 nt, Homo sapiens
gaaucgccccagacucc

SEQ ID NO: 2074592 - RNA, 12 nt, Homo sapiens
ugguguauuuga

SEQ ID NO: 2074593 - RNA, 15 nt, Homo sapiens
ggaaagcaugcauug

SEQ ID NO: 2074594 - RNA, 13 nt, Homo sapiens
aagcgagcacagu

SEQ ID NO: 2074595 - RNA, 15 nt, Homo sapiens
aagagagaagccagc

SEQ ID NO: 2074596 - RNA, 18 nt, Homo sapiens
gagcaggagcauccucug

SEQ ID NO: 2074597 - RNA, 19 nt, Homo sapiens
agggguggaguuuuguaua

SEQ ID NO: 2074598 - RNA, 15 nt, Homo sapiens
guaauuuuaucuaaa

SEQ ID NO: 2074599 - RNA, 22 nt, Homo sapiens
ucccguuccgugggaugccaua

SEQ ID NO: 2074600 - RNA, 15 nt, Homo sapiens
caaauuaaguauguu

SEQ ID NO: 2074601 - RNA, 15 nt, Homo sapiens
uacuguacauacaaa

SEQ ID NO: 2074602 - RNA, 16 nt, Homo sapiens
acuuucaagacagaug

SEQ ID NO: 2074603 - RNA, 17 nt, Homo sapiens
aagagugggcuuuccag

SEQ ID NO: 2074604 - RNA, 19 nt, Homo sapiens
accucucuaagccacagcu

SEQ ID NO: 2074605 - RNA, 12 nt, Homo sapiens
ccuuccaagcac

SEQ ID NO: 2074606 - RNA, 17 nt, Homo sapiens
gacagaugugguugcau

SEQ ID NO: 2074607 - RNA, 18 nt, Homo sapiens
uuucaaccgcuugccaua

SEQ ID NO: 2074608 - RNA, 24 nt, Homo sapiens
ucuaacccaacugacuuguaucug

SEQ ID NO: 2074609 - RNA, 13 nt, Homo sapiens
uuauuucugugaa

SEQ ID NO: 2074610 - RNA, 12 nt, Homo sapiens
aggcaugugcaa

SEQ ID NO: 2074611 - RNA, 22 nt, Homo sapiens
caugagauggaggccuccuuau

SEQ ID NO: 2074612 - RNA, 16 nt, Homo sapiens
gaagggggacacucca

SEQ ID NO: 2074613 - RNA, 17 nt, Homo sapiens
cauccgugcuaugacau

SEQ ID NO: 2074614 - RNA, 22 nt, Homo sapiens
ugauguuuacagugucugugug

SEQ ID NO: 2074615 - RNA, 24 nt, Homo sapiens
ggugccccuauacaaaacaccaga

SEQ ID NO: 2074616 - RNA, 18 nt, Homo sapiens
ggacuuuuauugugaauu

SEQ ID NO: 2074617 - RNA, 18 nt, Homo sapiens
uuaaaugaacuacugcua

SEQ ID NO: 2074618 - RNA, 17 nt, Homo sapiens
ucaccguccucacccau

SEQ ID NO: 2074619 - RNA, 16 nt, Homo sapiens
auggcugcugcucacc

SEQ ID NO: 2074620 - RNA, 14 nt, Homo sapiens
ucaacagaauucac

SEQ ID NO: 2074621 - RNA, 15 nt, Homo sapiens
uacaguuacuuccuu

SEQ ID NO: 2074622 - RNA, 10 nt, Homo sapiens
cugucuuuca

SEQ ID NO: 2074623 - RNA, 18 nt, Homo sapiens
aucugcaaauaguuucaa

SEQ ID NO: 2074624 - RNA, 20 nt, Homo sapiens
cgguaaacacgccugcaaac

SEQ ID NO: 2074625 - RNA, 16 nt, Homo sapiens
cuuuccucccccagcg

SEQ ID NO: 2074626 - RNA, 17 nt, Homo sapiens
aaggauuugaaaacacc

SEQ ID NO: 2074627 - RNA, 12 nt, Homo sapiens
ccguagauuccc

SEQ ID NO: 2074628 - RNA, 21 nt, Homo sapiens
auuucagcaacaaccaucuca

SEQ ID NO: 2074629 - RNA, 16 nt, Homo sapiens
guacuauguaucaaug

SEQ ID NO: 2074630 - RNA, 17 nt, Homo sapiens
uacggaacacugucaau

SEQ ID NO: 2074631 - RNA, 14 nt, Homo sapiens
agaaggaguguaug

SEQ ID NO: 2074632 - RNA, 16 nt, Homo sapiens
ugcucuacugcuucag

SEQ ID NO: 2074633 - RNA, 22 nt, Homo sapiens
agcuauuuaagugauacauacc

SEQ ID NO: 2074634 - RNA, 22 nt, Homo sapiens
agaauggagauaugcauucaag

SEQ ID NO: 2074635 - RNA, 21 nt, Homo sapiens
uacugugucaggaaacauauu

SEQ ID NO: 2074636 - RNA, 19 nt, Homo sapiens
ucaggaaauaucugugaag

SEQ ID NO: 2074637 - RNA, 21 nt, Homo sapiens
uaagucccgcauauacuuuaa

SEQ ID NO: 2074638 - RNA, 15 nt, Homo sapiens
gagacgggcaucgca

SEQ ID NO: 2074639 - RNA, 23 nt, Homo sapiens
cuuuucuggccaaaagcaguaaa

SEQ ID NO: 2074640 - RNA, 15 nt, Homo sapiens
cauuugagaauaguu

SEQ ID NO: 2074641 - RNA, 22 nt, Homo sapiens
ugugucugccccuaugugacag

SEQ ID NO: 2074642 - RNA, 15 nt, Homo sapiens
uucacuuuugacaaa

SEQ ID NO: 2074643 - RNA, 14 nt, Homo sapiens
auguaucugaauau

SEQ ID NO: 2074644 - RNA, 15 nt, Homo sapiens
agcccagaaccacag

SEQ ID NO: 2074645 - RNA, 22 nt, Homo sapiens
gugccuguaaucccagcuacau

SEQ ID NO: 2074646 - RNA, 21 nt, Homo sapiens
gaacuccuggccucaagggau

SEQ ID NO: 2074647 - RNA, 12 nt, Homo sapiens
uuuaaagggagg

SEQ ID NO: 2074648 - RNA, 17 nt, Homo sapiens
acuuguucauuuuucuc

SEQ ID NO: 2074649 - RNA, 22 nt, Homo sapiens
ggccacugggucucacuccuga

SEQ ID NO: 2074650 - RNA, 22 nt, Homo sapiens
gguuaauggcuaguacuguauu

SEQ ID NO: 2074651 - RNA, 21 nt, Homo sapiens
ucuuaaucauuauccuucuaa

SEQ ID NO: 2074652 - RNA, 20 nt, Homo sapiens
aagcugaacccuccugauga

SEQ ID NO: 2074653 - RNA, 22 nt, Homo sapiens
aaauccucauguuacucagugu

SEQ ID NO: 2074654 - RNA, 18 nt, Homo sapiens
caauauccaaaccaaaua

SEQ ID NO: 2074655 - RNA, 14 nt, Homo sapiens
gcucuuacucccuc

SEQ ID NO: 2074656 - RNA, 21 nt, Homo sapiens
cgcuccccuggagagggugau

SEQ ID NO: 2074657 - RNA, 23 nt, Homo sapiens
gaaggccucuuguugagugccag

SEQ ID NO: 2074658 - RNA, 17 nt, Homo sapiens
uauucauacagcacuac

SEQ ID NO: 2074659 - RNA, 17 nt, Homo sapiens
cacugugcuucgagcca

SEQ ID NO: 2074660 - RNA, 19 nt, Homo sapiens
cuuauucccaguguuccau

SEQ ID NO: 2074661 - RNA, 15 nt, Homo sapiens
ggucaguagacugug

SEQ ID NO: 2074662 - RNA, 22 nt, Homo sapiens
ucucuuaaaccacagcacuauu

SEQ ID NO: 2074663 - RNA, 15 nt, Homo sapiens
agugaugugguggga

SEQ ID NO: 2074664 - RNA, 17 nt, Homo sapiens
gugagcccccagagcug

SEQ ID NO: 2074665 - RNA, 16 nt, Homo sapiens
cuuucagcugcugcuu

SEQ ID NO: 2074666 - RNA, 21 nt, Homo sapiens
aacuuguagcauuaaacaauc

SEQ ID NO: 2074667 - RNA, 16 nt, Homo sapiens
gugagugagacucugc

SEQ ID NO: 2074668 - RNA, 18 nt, Homo sapiens
accugcuaaucacaucca

SEQ ID NO: 2074669 - RNA, 19 nt, Homo sapiens
ucuuuaauuguaucuccuu

SEQ ID NO: 2074670 - RNA, 16 nt, Homo sapiens
ugaaaagggcacuccc

SEQ ID NO: 2074671 - RNA, 13 nt, Homo sapiens
aaauaauuguaug

SEQ ID NO: 2074672 - RNA, 18 nt, Homo sapiens
ggcucuuuccuugcucaa

SEQ ID NO: 2074673 - RNA, 18 nt, Homo sapiens
gaccgcccccuccucuag

SEQ ID NO: 2074674 - RNA, 21 nt, Homo sapiens
accucacgcucuggacaugau

SEQ ID NO: 2074675 - RNA, 21 nt, Homo sapiens
auaaaugagcgcagcagagau

SEQ ID NO: 2074676 - RNA, 20 nt, Homo sapiens
ucuaugaaagcuaugaaugu

SEQ ID NO: 2074677 - RNA, 16 nt, Homo sapiens
aaaagaaauucuguua

SEQ ID NO: 2074678 - RNA, 20 nt, Homo sapiens
cugaaucaaggaaagccagg

SEQ ID NO: 2074679 - RNA, 19 nt, Homo sapiens
gcuguuauucuuguuauac

SEQ ID NO: 2074680 - RNA, 18 nt, Homo sapiens
ucaacaauaaagacugag

SEQ ID NO: 2074681 - RNA, 17 nt, Homo sapiens
ccccacccccugggcag

SEQ ID NO: 2074682 - RNA, 16 nt, Homo sapiens
auuuucucugauacuu

SEQ ID NO: 2074683 - RNA, 14 nt, Homo sapiens
agugaagagcauuu

SEQ ID NO: 2074684 - RNA, 18 nt, Homo sapiens
gcgcucauucuauuuuau

SEQ ID NO: 2074685 - RNA, 15 nt, Homo sapiens
gaaaucucacugggg

SEQ ID NO: 2074686 - RNA, 16 nt, Homo sapiens
cagcaaagcagcagug

SEQ ID NO: 2074687 - RNA, 16 nt, Homo sapiens
ugugcgugugugcaag

SEQ ID NO: 2074688 - RNA, 18 nt, Homo sapiens
cagcaggccucugggacc

SEQ ID NO: 2074689 - RNA, 24 nt, Homo sapiens
auucaaugaucuuagaaguacuga

SEQ ID NO: 2074690 - RNA, 21 nt, Homo sapiens
uaacaguucauguuugcuuca

SEQ ID NO: 2074691 - RNA, 13 nt, Homo sapiens
auaccaccuucaa

SEQ ID NO: 2074692 - RNA, 16 nt, Homo sapiens
ccagacuguguauuca

SEQ ID NO: 2074693 - RNA, 15 nt, Homo sapiens
acuucuugucagaca

SEQ ID NO: 2074694 - RNA, 15 nt, Homo sapiens
ugagacugaguucua

SEQ ID NO: 2074695 - RNA, 23 nt, Homo sapiens
gagugucuuuccacggagccacu

SEQ ID NO: 2074696 - RNA, 14 nt, Homo sapiens
gaucucgacucacu

SEQ ID NO: 2074697 - RNA, 16 nt, Homo sapiens
ucaaaauuuaacaguu

SEQ ID NO: 2074698 - RNA, 14 nt, Homo sapiens
caaaccaccuuccc

SEQ ID NO: 2074699 - RNA, 17 nt, Homo sapiens
uccuccacauccugugu

SEQ ID NO: 2074700 - RNA, 19 nt, Homo sapiens
agugaguucccuuagugaa

SEQ ID NO: 2074701 - RNA, 20 nt, Homo sapiens
gugccaggccagugaccuca

SEQ ID NO: 2074702 - RNA, 20 nt, Homo sapiens
ugguagagcugacaaagcag

SEQ ID NO: 2074703 - RNA, 20 nt, Homo sapiens
ugagccaugaaaucaacuca

SEQ ID NO: 2074704 - RNA, 14 nt, Homo sapiens
cuagaguguuguug

SEQ ID NO: 2074705 - RNA, 13 nt, Homo sapiens
gguugcagugagc

SEQ ID NO: 2074706 - RNA, 14 nt, Homo sapiens
aaauuguauauuca

SEQ ID NO: 2074707 - RNA, 23 nt, Homo sapiens
accuggucuguuuucugugcacu

SEQ ID NO: 2074708 - RNA, 22 nt, Homo sapiens
ccaguguccccuccacugucac

SEQ ID NO: 2074709 - RNA, 14 nt, Homo sapiens
ucucacuaguguca

SEQ ID NO: 2074710 - RNA, 21 nt, Homo sapiens
gaucauugaaaguaaaaaaua

SEQ ID NO: 2074711 - RNA, 22 nt, Homo sapiens
cugucucuccuaccugucuucu

SEQ ID NO: 2074712 - RNA, 20 nt, Homo sapiens
uuuaaacuaucuugugugau

SEQ ID NO: 2074713 - RNA, 18 nt, Homo sapiens
uagaauuaugcuguuaaa

SEQ ID NO: 2074714 - RNA, 17 nt, Homo sapiens
cauuuuuaaguauuuca

SEQ ID NO: 2074715 - RNA, 17 nt, Homo sapiens
aaugaugcacacugagg

SEQ ID NO: 2074716 - RNA, 23 nt, Homo sapiens
gcucuguaguuuaugaugcaaau

SEQ ID NO: 2074717 - RNA, 20 nt, Homo sapiens
cugggcuccguuguaccaag

SEQ ID NO: 2074718 - RNA, 19 nt, Homo sapiens
uggagauagccccacagga

SEQ ID NO: 2074719 - RNA, 13 nt, Homo sapiens
auaauuuggucau

SEQ ID NO: 2074720 - RNA, 13 nt, Homo sapiens
uugccauguggac

SEQ ID NO: 2074721 - RNA, 22 nt, Homo sapiens
auccugcucauaacaucuuuga

SEQ ID NO: 2074722 - RNA, 16 nt, Homo sapiens
caagaaucuaaacuuu

SEQ ID NO: 2074723 - RNA, 13 nt, Homo sapiens
aguugcacacuca

SEQ ID NO: 2074724 - RNA, 13 nt, Homo sapiens
acuguuugucuca

SEQ ID NO: 2074725 - RNA, 17 nt, Homo sapiens
caagucaacacucuucu

SEQ ID NO: 2074726 - RNA, 15 nt, Homo sapiens
uuuuccuccaggcaa

SEQ ID NO: 2074727 - RNA, 12 nt, Homo sapiens
gaacaguauuac

SEQ ID NO: 2074728 - RNA, 22 nt, Homo sapiens
ucauuguaaacaaacuguguaa

SEQ ID NO: 2074729 - RNA, 17 nt, Homo sapiens
cugaauccauauuucaa

SEQ ID NO: 2074730 - RNA, 10 nt, Homo sapiens
ccucagccac

SEQ ID NO: 2074731 - RNA, 13 nt, Homo sapiens
gagccucacugau

SEQ ID NO: 2074732 - RNA, 22 nt, Homo sapiens
uaaaccuuuuuggacacacaaa

SEQ ID NO: 2074733 - RNA, 19 nt, Homo sapiens
uugcagaaccagugacaau

SEQ ID NO: 2074734 - RNA, 15 nt, Homo sapiens
gggaagagucuucca

SEQ ID NO: 2074735 - RNA, 23 nt, Homo sapiens
ugccauuuucagaaucaucuuuu

SEQ ID NO: 2074736 - RNA, 18 nt, Homo sapiens
uucgguugacccagguca

SEQ ID NO: 2074737 - RNA, 14 nt, Homo sapiens
ccaaugggccucca

SEQ ID NO: 2074738 - RNA, 23 nt, Homo sapiens
agccugagggcuaguuaauccaa

SEQ ID NO: 2074739 - RNA, 21 nt, Homo sapiens
cugccugugaaugcugaguga

SEQ ID NO: 2074740 - RNA, 15 nt, Homo sapiens
uugacuucucuugaa

SEQ ID NO: 2074741 - RNA, 15 nt, Homo sapiens
uuauuaauuacuuac

SEQ ID NO: 2074742 - RNA, 18 nt, Homo sapiens
aaugggcagcucaucucu

SEQ ID NO: 2074743 - RNA, 22 nt, Homo sapiens
agcccugaguuucaaguauccu

SEQ ID NO: 2074744 - RNA, 22 nt, Homo sapiens
aagcaaucagcaaacacaauaa

SEQ ID NO: 2074745 - RNA, 23 nt, Homo sapiens
agcuucauuauuacguggcaaaa

SEQ ID NO: 2074746 - RNA, 13 nt, Homo sapiens
cuccaagcuccau

SEQ ID NO: 2074747 - RNA, 16 nt, Homo sapiens
acuccucaacugggaa

SEQ ID NO: 2074748 - RNA, 21 nt, Homo sapiens
uaauaauaacaacaacuuaau

SEQ ID NO: 2074749 - RNA, 14 nt, Homo sapiens
uguguuacauacac

SEQ ID NO: 2074750 - RNA, 23 nt, Homo sapiens
acaugcaaagauccccaaaacag

SEQ ID NO: 2074751 - RNA, 23 nt, Homo sapiens
aaauauuuuauaugaaauguuuc

SEQ ID NO: 2074752 - RNA, 17 nt, Homo sapiens
uccaaaggaaucuccag

SEQ ID NO: 2074753 - RNA, 23 nt, Homo sapiens
uacuuuccaacauuauccugugu

SEQ ID NO: 2074754 - RNA, 19 nt, Homo sapiens
gucccuugagacuccccaa

SEQ ID NO: 2074755 - RNA, 23 nt, Homo sapiens
ugcacccaccuuucugcacauaa

SEQ ID NO: 2074756 - RNA, 15 nt, Homo sapiens
aucacuacagaucuc

SEQ ID NO: 2074757 - RNA, 23 nt, Homo sapiens
ucacaggaaggaaacaacauuuu

SEQ ID NO: 2074758 - RNA, 15 nt, Homo sapiens
gggcucccuggccca

SEQ ID NO: 2074759 - RNA, 14 nt, Homo sapiens
cuguugaaaagcca

SEQ ID NO: 2074760 - RNA, 14 nt, Homo sapiens
guccugagcacugc

SEQ ID NO: 2074761 - RNA, 13 nt, Homo sapiens
ggagaguccaggc

SEQ ID NO: 2074762 - RNA, 23 nt, Homo sapiens
cccucagccacgccucucucagc

SEQ ID NO: 2074763 - RNA, 19 nt, Homo sapiens
aucuauaaagaagaacuug

SEQ ID NO: 2074764 - RNA, 15 nt, Homo sapiens
ucagagaaaacacuu

SEQ ID NO: 2074765 - RNA, 19 nt, Homo sapiens
uaaaucauauuaguauuaa

SEQ ID NO: 2074766 - RNA, 19 nt, Homo sapiens
agaaucauugaaguauuuu

SEQ ID NO: 2074767 - RNA, 18 nt, Homo sapiens
ugcuggcaccaccaggca

SEQ ID NO: 2074768 - RNA, 11 nt, Homo sapiens
gcccuaaugcg

SEQ ID NO: 2074769 - RNA, 13 nt, Homo sapiens
ugaaagacaucaa

SEQ ID NO: 2074770 - RNA, 13 nt, Homo sapiens
uucaagacagaaa

SEQ ID NO: 2074771 - RNA, 19 nt, Homo sapiens
cugauuugauaccauggca

SEQ ID NO: 2074772 - RNA, 22 nt, Homo sapiens
aagccuuccagggauuugccuc

SEQ ID NO: 2074773 - RNA, 17 nt, Homo sapiens
cacucaauaugugauuu

SEQ ID NO: 2074774 - RNA, 21 nt, Homo sapiens
aacacuaaaaaggcauguaau

SEQ ID NO: 2074775 - RNA, 14 nt, Homo sapiens
ucagccuuguccua

SEQ ID NO: 2074776 - RNA, 20 nt, Homo sapiens
auauuaaaacugcacugcca

SEQ ID NO: 2074777 - RNA, 15 nt, Homo sapiens
cuuaguugcacuuca

SEQ ID NO: 2074778 - RNA, 13 nt, Homo sapiens
cauacuguucuca

SEQ ID NO: 2074779 - RNA, 16 nt, Homo sapiens
cugcucucccacugca

SEQ ID NO: 2074780 - RNA, 14 nt, Homo sapiens
gacaauggacugua

SEQ ID NO: 2074781 - RNA, 14 nt, Homo sapiens
auauuagggaguaa

SEQ ID NO: 2074782 - RNA, 16 nt, Homo sapiens
cuaauaguuuuucacu

SEQ ID NO: 2074783 - RNA, 19 nt, Homo sapiens
auauuguuuaaugcaaaug

SEQ ID NO: 2074784 - RNA, 19 nt, Homo sapiens
agaagauccaagaggcccu

SEQ ID NO: 2074785 - RNA, 16 nt, Homo sapiens
cacaaggucacuagau

SEQ ID NO: 2074786 - RNA, 19 nt, Homo sapiens
cagaugcagccgugcagga

SEQ ID NO: 2074787 - RNA, 18 nt, Homo sapiens
ucaugcuagccucacgaa

SEQ ID NO: 2074788 - RNA, 17 nt, Homo sapiens
caagcuucuguccugcc

SEQ ID NO: 2074789 - RNA, 16 nt, Homo sapiens
cagcagaucccagcuc

SEQ ID NO: 2074790 - RNA, 13 nt, Homo sapiens
aucagaauauuaa

SEQ ID NO: 2074791 - RNA, 13 nt, Homo sapiens
cauaaaaucacag

SEQ ID NO: 2074792 - RNA, 20 nt, Homo sapiens
aguacauggcauugagacau

SEQ ID NO: 2074793 - RNA, 20 nt, Homo sapiens
cacugaaaauuuaacaguau

SEQ ID NO: 2074794 - RNA, 22 nt, Homo sapiens
uauauuugauacauauaauucu

SEQ ID NO: 2074795 - RNA, 21 nt, Homo sapiens
agguugugcccuguggcugcc

SEQ ID NO: 2074796 - RNA, 19 nt, Homo sapiens
uauuuuguaagagugagcu

SEQ ID NO: 2074797 - RNA, 12 nt, Homo sapiens
uuaauucccaau

SEQ ID NO: 2074798 - RNA, 18 nt, Homo sapiens
agucauuccaaucagcca

SEQ ID NO: 2074799 - RNA, 23 nt, Homo sapiens
acagcucaguucuagucucucug

SEQ ID NO: 2074800 - RNA, 22 nt, Homo sapiens
cucauagguugagcaauuuccc

SEQ ID NO: 2074801 - RNA, 23 nt, Homo sapiens
augugugugcagaauucuaggca

SEQ ID NO: 2074802 - RNA, 15 nt, Homo sapiens
cccaagucccuguca

SEQ ID NO: 2074803 - RNA, 16 nt, Homo sapiens
uaauaaaaguacaugu

SEQ ID NO: 2074804 - RNA, 20 nt, Homo sapiens
gaagugucccugugaucuug

SEQ ID NO: 2074805 - RNA, 11 nt, Homo sapiens
cuucacugggc

SEQ ID NO: 2074806 - RNA, 20 nt, Homo sapiens
aauugaaaacacacucaaaa

SEQ ID NO: 2074807 - RNA, 18 nt, Homo sapiens
uaaaaggaaauguaaaag

SEQ ID NO: 2074808 - RNA, 15 nt, Homo sapiens
auccuuuacuguuag

SEQ ID NO: 2074809 - RNA, 14 nt, Homo sapiens
caccuccugcaaua

SEQ ID NO: 2074810 - RNA, 13 nt, Homo sapiens
agcacaguuugaa

SEQ ID NO: 2074811 - RNA, 22 nt, Homo sapiens
uugaagucaugcuccccugugc

SEQ ID NO: 2074812 - RNA, 15 nt, Homo sapiens
guuaauccacaucuu

SEQ ID NO: 2074813 - RNA, 23 nt, Homo sapiens
uaauagagauuaaaaacaacaaa

SEQ ID NO: 2074814 - RNA, 17 nt, Homo sapiens
aaaggacuccacccauc

SEQ ID NO: 2074815 - RNA, 17 nt, Homo sapiens
agacacuugcugaguga

SEQ ID NO: 2074816 - RNA, 16 nt, Homo sapiens
auaauccaguaaucua

SEQ ID NO: 2074817 - RNA, 19 nt, Homo sapiens
agaucacuacucagugcau

SEQ ID NO: 2074818 - RNA, 18 nt, Homo sapiens
cauuaaaauaugcacuaa

SEQ ID NO: 2074819 - RNA, 23 nt, Homo sapiens
ugucucaauucaaauccauagau

SEQ ID NO: 2074820 - RNA, 13 nt, Homo sapiens
gauccaggauaau

SEQ ID NO: 2074821 - RNA, 21 nt, Homo sapiens
caaacucuuugcccaguucau

SEQ ID NO: 2074822 - RNA, 18 nt, Homo sapiens
acuuuuucuuguauucau

SEQ ID NO: 2074823 - RNA, 18 nt, Homo sapiens
cagaauguucuauuguca

SEQ ID NO: 2074824 - RNA, 18 nt, Homo sapiens
cacuuuacaaaaguauua

SEQ ID NO: 2074825 - RNA, 14 nt, Homo sapiens
uaacccaaaccuca

SEQ ID NO: 2074826 - RNA, 14 nt, Homo sapiens
auacugaugcauug

SEQ ID NO: 2074827 - RNA, 23 nt, Homo sapiens
cgaggcagacgucugucaggggc

SEQ ID NO: 2074828 - RNA, 22 nt, Homo sapiens
gaccucugcugagugcugggca

SEQ ID NO: 2074829 - RNA, 22 nt, Homo sapiens
agauuguucuguccaguuucca

SEQ ID NO: 2074830 - RNA, 17 nt, Homo sapiens
agaaaaggaaaagccaa

SEQ ID NO: 2074831 - RNA, 23 nt, Homo sapiens
aaguaauuucuuugaucuggaca

SEQ ID NO: 2074832 - RNA, 22 nt, Homo sapiens
uauuugguuuuuugcaguucac

SEQ ID NO: 2074833 - RNA, 15 nt, Homo sapiens
accccuuagcaauaa

SEQ ID NO: 2074834 - RNA, 12 nt, Homo sapiens
cagcaguuuuau

SEQ ID NO: 2074835 - RNA, 17 nt, Homo sapiens
gaaacacaugccaguuu

SEQ ID NO: 2074836 - RNA, 14 nt, Homo sapiens
caacaucuggucuu

SEQ ID NO: 2074837 - RNA, 23 nt, Homo sapiens
auaaccuuuggccuuauggauuu

SEQ ID NO: 2074838 - RNA, 22 nt, Homo sapiens
auuuccagcuuucuccccgcua

SEQ ID NO: 2074839 - RNA, 22 nt, Homo sapiens
guucuugaaaauaagauuccag

SEQ ID NO: 2074840 - RNA, 22 nt, Homo sapiens
gaguucuggaugucuggcucaa

SEQ ID NO: 2074841 - RNA, 22 nt, Homo sapiens
augacauugauuucuaaugaua

SEQ ID NO: 2074842 - RNA, 13 nt, Homo sapiens
ccugaccgugcua

SEQ ID NO: 2074843 - RNA, 16 nt, Homo sapiens
cugccacgguccuuug

SEQ ID NO: 2074844 - RNA, 15 nt, Homo sapiens
cuccuucagcagcua

SEQ ID NO: 2074845 - RNA, 16 nt, Homo sapiens
cuuuagcuuaccuggg

SEQ ID NO: 2074846 - RNA, 14 nt, Homo sapiens
aauauguagcaaug

SEQ ID NO: 2074847 - RNA, 14 nt, Homo sapiens
ccucggggacacua

SEQ ID NO: 2074848 - RNA, 13 nt, Homo sapiens
cugacccacugcu

SEQ ID NO: 2074849 - RNA, 22 nt, Homo sapiens
uucauagaauaacaacugcugg

SEQ ID NO: 2074850 - RNA, 20 nt, Homo sapiens
acaucuuuguuuaccauuaa

SEQ ID NO: 2074851 - RNA, 13 nt, Homo sapiens
accaccccuacca

SEQ ID NO: 2074852 - RNA, 19 nt, Homo sapiens
cagcuguuacuuucuuuca

SEQ ID NO: 2074853 - RNA, 23 nt, Homo sapiens
gacccagaggguggguguucaua

SEQ ID NO: 2074854 - RNA, 18 nt, Homo sapiens
auugcucuauauguaaua

SEQ ID NO: 2074855 - RNA, 13 nt, Homo sapiens
acugaucauuaaa

SEQ ID NO: 2074856 - RNA, 14 nt, Homo sapiens
agacuauagccauc

SEQ ID NO: 2074857 - RNA, 21 nt, Homo sapiens
agcaaaaggcagcucaccccu

SEQ ID NO: 2074858 - RNA, 13 nt, Homo sapiens
caauuugccauug

SEQ ID NO: 2074859 - RNA, 14 nt, Homo sapiens
auuaugcucuuaau

SEQ ID NO: 2074860 - RNA, 13 nt, Homo sapiens
cagccagggccag

SEQ ID NO: 2074861 - RNA, 12 nt, Homo sapiens
ucuaaaugaagu

SEQ ID NO: 2074862 - RNA, 13 nt, Homo sapiens
ugcggcuugugag

SEQ ID NO: 2074863 - RNA, 19 nt, Homo sapiens
cuggcagacuuacaaagcu

SEQ ID NO: 2074864 - RNA, 17 nt, Homo sapiens
gcugaaagaacauggac

SEQ ID NO: 2074865 - RNA, 20 nt, Homo sapiens
uauauacaguaacuuuaugu

SEQ ID NO: 2074866 - RNA, 22 nt, Homo sapiens
uaccagggcucuguauucugca

SEQ ID NO: 2074867 - RNA, 20 nt, Homo sapiens
agaggccaccuaugccagug

SEQ ID NO: 2074868 - RNA, 13 nt, Homo sapiens
ucugcaugagcug

SEQ ID NO: 2074869 - RNA, 16 nt, Homo sapiens
auuuuguugcuuucuu

SEQ ID NO: 2074870 - RNA, 13 nt, Homo sapiens
ccagcauuuggca

SEQ ID NO: 2074871 - RNA, 19 nt, Homo sapiens
caaaaucaacaugacuggu

SEQ ID NO: 2074872 - RNA, 15 nt, Homo sapiens
ggucaugguggugca

SEQ ID NO: 2074873 - RNA, 23 nt, Homo sapiens
cccccauaaaagauauguugaag

SEQ ID NO: 2074874 - RNA, 22 nt, Homo sapiens
aguguguccuggggacuuccuc

SEQ ID NO: 2074875 - RNA, 21 nt, Homo sapiens
cacuuuuuuuauaagcaaaaa

SEQ ID NO: 2074876 - RNA, 22 nt, Homo sapiens
cuucaugcaggugaaacccagu

SEQ ID NO: 2074877 - RNA, 21 nt, Homo sapiens
cacaguguugccagagccuua

SEQ ID NO: 2074878 - RNA, 18 nt, Homo sapiens
cuuuuaaaauacauuugg

SEQ ID NO: 2074879 - RNA, 20 nt, Homo sapiens
uucauaguggauuaaugcau

SEQ ID NO: 2074880 - RNA, 17 nt, Homo sapiens
gauaauagguagccugc

SEQ ID NO: 2074881 - RNA, 19 nt, Homo sapiens
augaacuuaacaugcugug

SEQ ID NO: 2074882 - RNA, 16 nt, Homo sapiens
acaugccaauuucagc

SEQ ID NO: 2074883 - RNA, 21 nt, Homo sapiens
uuggaaaaauguuugucucag

SEQ ID NO: 2074884 - RNA, 16 nt, Homo sapiens
uuaauuaccuggugag

SEQ ID NO: 2074885 - RNA, 23 nt, Homo sapiens
agccguuugagaagaaaacaucu

SEQ ID NO: 2074886 - RNA, 17 nt, Homo sapiens
auuuggacaagugcugu

SEQ ID NO: 2074887 - RNA, 19 nt, Homo sapiens
cucuaagcacaaagugauu

SEQ ID NO: 2074888 - RNA, 13 nt, Homo sapiens
gguguggccucag

SEQ ID NO: 2074889 - RNA, 14 nt, Homo sapiens
cugauauggcuuuu

SEQ ID NO: 2074890 - RNA, 20 nt, Homo sapiens
ucucugcaauuuuacuguga

SEQ ID NO: 2074891 - RNA, 13 nt, Homo sapiens
aacugaaauguua

SEQ ID NO: 2074892 - RNA, 15 nt, Homo sapiens
cccacuucugcacuu

SEQ ID NO: 2074893 - RNA, 20 nt, Homo sapiens
acacccacucccuuccccau

SEQ ID NO: 2074894 - RNA, 16 nt, Homo sapiens
gucaaauccauguguc

SEQ ID NO: 2074895 - RNA, 17 nt, Homo sapiens
uuuugauuguuauguaa

SEQ ID NO: 2074896 - RNA, 19 nt, Homo sapiens
ugagugcacugacugugaa

SEQ ID NO: 2074897 - RNA, 16 nt, Homo sapiens
guuuaaaaccugggau

SEQ ID NO: 2074898 - RNA, 22 nt, Homo sapiens
cacuauggguggggcacuccuu

SEQ ID NO: 2074899 - RNA, 15 nt, Homo sapiens
acucuugcaauccac

SEQ ID NO: 2074900 - RNA, 21 nt, Homo sapiens
uuagguuuccacguaagucac

SEQ ID NO: 2074901 - RNA, 14 nt, Homo sapiens
aaggccaacacaac

SEQ ID NO: 2074902 - RNA, 23 nt, Homo sapiens
agcauuuagauaaucuugugcaa

SEQ ID NO: 2074903 - RNA, 17 nt, Homo sapiens
gaugggaccagggaugg

SEQ ID NO: 2074904 - RNA, 17 nt, Homo sapiens
ucauaguuuauuuucau

SEQ ID NO: 2074905 - RNA, 20 nt, Homo sapiens
guggcugccccggccuccuc

SEQ ID NO: 2074906 - RNA, 23 nt, Homo sapiens
cauccucccuguuccccacaggu

SEQ ID NO: 2074907 - RNA, 17 nt, Homo sapiens
agcucugccccuucccc

SEQ ID NO: 2074908 - RNA, 14 nt, Homo sapiens
gaugggagguugug

SEQ ID NO: 2074909 - RNA, 15 nt, Homo sapiens
acauaauaccaccau

SEQ ID NO: 2074910 - RNA, 16 nt, Homo sapiens
ccucaacccaagggga

SEQ ID NO: 2074911 - RNA, 23 nt, Homo sapiens
ugcagucaaaggaacgccuuccc

SEQ ID NO: 2074912 - RNA, 15 nt, Homo sapiens
cuuuucaaacugaua

SEQ ID NO: 2074913 - RNA, 16 nt, Homo sapiens
aggaugcuucugcuca

SEQ ID NO: 2074914 - RNA, 13 nt, Homo sapiens
gugcgaguccucc

SEQ ID NO: 2074915 - RNA, 17 nt, Homo sapiens
gcugauggugcaaugac

SEQ ID NO: 2074916 - RNA, 16 nt, Homo sapiens
cagugcacuguauaua

SEQ ID NO: 2074917 - RNA, 13 nt, Homo sapiens
ucaaaugugcauc

SEQ ID NO: 2074918 - RNA, 19 nt, Homo sapiens
gggcugcgagcauuucccu

SEQ ID NO: 2074919 - RNA, 14 nt, Homo sapiens
uuacauuguaguua

SEQ ID NO: 2074920 - RNA, 12 nt, Homo sapiens
gugccaaaaauc

SEQ ID NO: 2074921 - RNA, 19 nt, Homo sapiens
uuuuauaaaaaugagugcu

SEQ ID NO: 2074922 - RNA, 10 nt, Homo sapiens
aaacuugaac

SEQ ID NO: 2074923 - RNA, 18 nt, Homo sapiens
aauuaugaaacauuuuag

SEQ ID NO: 2074924 - RNA, 18 nt, Homo sapiens
uuguacagugucugugcc

SEQ ID NO: 2074925 - RNA, 16 nt, Homo sapiens
agugagugcugcucau

SEQ ID NO: 2074926 - RNA, 18 nt, Homo sapiens
ggcaggacugaguccccu

SEQ ID NO: 2074927 - RNA, 21 nt, Homo sapiens
ccuaugcaugguuucagcacu

SEQ ID NO: 2074928 - RNA, 15 nt, Homo sapiens
cacgaugucaaggac

SEQ ID NO: 2074929 - RNA, 19 nt, Homo sapiens
ccugcagucaucuugacca

SEQ ID NO: 2074930 - RNA, 17 nt, Homo sapiens
guaaacaacagacugca

SEQ ID NO: 2074931 - RNA, 15 nt, Homo sapiens
ggaggauguauguca

SEQ ID NO: 2074932 - RNA, 18 nt, Homo sapiens
gaggccagugggcgggcc

SEQ ID NO: 2074933 - RNA, 19 nt, Homo sapiens
uguaaagagagcaagacag

SEQ ID NO: 2074934 - RNA, 22 nt, Homo sapiens
agggaaggaggccacuuugaga

SEQ ID NO: 2074935 - RNA, 16 nt, Homo sapiens
uaaaacgcaugugcag

SEQ ID NO: 2074936 - RNA, 15 nt, Homo sapiens
ccucuucugcucuuu

SEQ ID NO: 2074937 - RNA, 16 nt, Homo sapiens
ugauuaggacuuuuau

SEQ ID NO: 2074938 - RNA, 14 nt, Homo sapiens
ucacaacucucugg

SEQ ID NO: 2074939 - RNA, 13 nt, Homo sapiens
aaaagcuuagcag

SEQ ID NO: 2074940 - RNA, 15 nt, Homo sapiens
gugaacugugagggu

SEQ ID NO: 2074941 - RNA, 19 nt, Homo sapiens
ugcugacagucaugcaguc

SEQ ID NO: 2074942 - RNA, 19 nt, Homo sapiens
accaauucuggacagacag

SEQ ID NO: 2074943 - RNA, 21 nt, Homo sapiens
uacauuuggcuccacuguaaa

SEQ ID NO: 2074944 - RNA, 22 nt, Homo sapiens
ugaacaaaaccuacgcacauac

SEQ ID NO: 2074945 - RNA, 20 nt, Homo sapiens
ucgaagaaacccuugcugcu

SEQ ID NO: 2074946 - RNA, 12 nt, Homo sapiens
aauuuuacccuu

SEQ ID NO: 2074947 - RNA, 19 nt, Homo sapiens
uagacauuuuuuuguucca

SEQ ID NO: 2074948 - RNA, 16 nt, Homo sapiens
aggcaaagaaagcucu

SEQ ID NO: 2074949 - RNA, 20 nt, Homo sapiens
ucuucaggaauguggcugca

SEQ ID NO: 2074950 - RNA, 20 nt, Homo sapiens
acgguuucgaagucauuaaa

SEQ ID NO: 2074951 - RNA, 22 nt, Homo sapiens
ccgggcuuuuccaagcugccac

SEQ ID NO: 2074952 - RNA, 15 nt, Homo sapiens
uuaacaugcugugua

SEQ ID NO: 2074953 - RNA, 20 nt, Homo sapiens
ugauucccuuguuauucaac

SEQ ID NO: 2074954 - RNA, 18 nt, Homo sapiens
caaaacccucagcacugu

SEQ ID NO: 2074955 - RNA, 22 nt, Homo sapiens
uggcaauucuucuucucaagca

SEQ ID NO: 2074956 - RNA, 22 nt, Homo sapiens
uuuguaacaugacacauuugaa

SEQ ID NO: 2074957 - RNA, 20 nt, Homo sapiens
agaucuggggaggcaggcau

SEQ ID NO: 2074958 - RNA, 15 nt, Homo sapiens
aauuggcacuaaaga

SEQ ID NO: 2074959 - RNA, 22 nt, Homo sapiens
cccuuggaauaaaaacauuucu

SEQ ID NO: 2074960 - RNA, 20 nt, Homo sapiens
ccucucucuuaccugggacc

SEQ ID NO: 2074961 - RNA, 14 nt, Homo sapiens
agcagaagccaaau

SEQ ID NO: 2074962 - RNA, 17 nt, Homo sapiens
uagaggaugauguaauu

SEQ ID NO: 2074963 - RNA, 12 nt, Homo sapiens
auguucucaugu

SEQ ID NO: 2074964 - RNA, 12 nt, Homo sapiens
aggcucucaggc

SEQ ID NO: 2074965 - RNA, 18 nt, Homo sapiens
cagcuuauugucuaguga

SEQ ID NO: 2074966 - RNA, 18 nt, Homo sapiens
agauucccucuuccugcc

SEQ ID NO: 2074967 - RNA, 12 nt, Homo sapiens
caucugcuccuc

SEQ ID NO: 2074968 - RNA, 20 nt, Homo sapiens
acacagugccuguaaaucuc

SEQ ID NO: 2074969 - RNA, 21 nt, Homo sapiens
acuggauggaaagacaaacug

SEQ ID NO: 2074970 - RNA, 16 nt, Homo sapiens
augguccauugcuacu

SEQ ID NO: 2074971 - RNA, 21 nt, Homo sapiens
gggugggaggggcccacagga

SEQ ID NO: 2074972 - RNA, 15 nt, Homo sapiens
uccuauaaucuguca

SEQ ID NO: 2074973 - RNA, 11 nt, Homo sapiens
ccaugcaaugc

SEQ ID NO: 2074974 - RNA, 21 nt, Homo sapiens
cuaguuaauguuuauuguuca

SEQ ID NO: 2074975 - RNA, 21 nt, Homo sapiens
ccccauuuccuccucaucuga

SEQ ID NO: 2074976 - RNA, 16 nt, Homo sapiens
cucccuccaguaccau

SEQ ID NO: 2074977 - RNA, 12 nt, Homo sapiens
aauacauuacau

SEQ ID NO: 2074978 - RNA, 12 nt, Homo sapiens
uauucauuucaa

SEQ ID NO: 2074979 - RNA, 14 nt, Homo sapiens
ccaaaggagaagag

SEQ ID NO: 2074980 - RNA, 19 nt, Homo sapiens
ugacugaauucugccuugg

SEQ ID NO: 2074981 - RNA, 15 nt, Homo sapiens
cugucuucacaugua

SEQ ID NO: 2074982 - RNA, 18 nt, Homo sapiens
uaacuucuaaaacuguac

SEQ ID NO: 2074983 - RNA, 15 nt, Homo sapiens
gcuguugagggccaa

SEQ ID NO: 2074984 - RNA, 14 nt, Homo sapiens
cuaggauaagcacu

SEQ ID NO: 2074985 - RNA, 21 nt, Homo sapiens
uaugauuauuaacgaugucca

SEQ ID NO: 2074986 - RNA, 12 nt, Homo sapiens
uccugccguccc

SEQ ID NO: 2074987 - RNA, 15 nt, Homo sapiens
ugccuugaagccacu

SEQ ID NO: 2074988 - RNA, 12 nt, Homo sapiens
aaaaacuugggu

SEQ ID NO: 2074989 - RNA, 14 nt, Homo sapiens
acgcacacauggac

SEQ ID NO: 2074990 - RNA, 14 nt, Homo sapiens
cccuuccuguuuca

SEQ ID NO: 2074991 - RNA, 17 nt, Homo sapiens
aagcaaguuuucuucca

SEQ ID NO: 2074992 - RNA, 15 nt, Homo sapiens
aaggagccagugggg

SEQ ID NO: 2074993 - RNA, 15 nt, Homo sapiens
auaaucaagagccuu

SEQ ID NO: 2074994 - RNA, 14 nt, Homo sapiens
aacuguacuacauc

SEQ ID NO: 2074995 - RNA, 20 nt, Homo sapiens
agaaaugguauguagagcuu

SEQ ID NO: 2074996 - RNA, 14 nt, Homo sapiens
aauauuuauugucu

SEQ ID NO: 2074997 - RNA, 18 nt, Homo sapiens
uccugcccagcacaggaa

SEQ ID NO: 2074998 - RNA, 16 nt, Homo sapiens
agccuucgaguggcca

SEQ ID NO: 2074999 - RNA, 12 nt, Homo sapiens
gucaacugagag

SEQ ID NO: 2075000 - RNA, 21 nt, Homo sapiens
ccagguuuaaggucaccugca

SEQ ID NO: 2075001 - RNA, 19 nt, Homo sapiens
aaugucacaacauggugcu

SEQ ID NO: 2075002 - RNA, 20 nt, Homo sapiens
aaaugccuccaagccauuca

SEQ ID NO: 2075003 - RNA, 19 nt, Homo sapiens
ccagugagacagcucugca

SEQ ID NO: 2075004 - RNA, 22 nt, Homo sapiens
accuaauauuuggagcuaucag

SEQ ID NO: 2075005 - RNA, 23 nt, Homo sapiens
uauuuauugcuguguaacacugu

SEQ ID NO: 2075006 - RNA, 20 nt, Homo sapiens
acggagucuugcucugucac

SEQ ID NO: 2075007 - RNA, 18 nt, Homo sapiens
aaccauggcacuugaugu

SEQ ID NO: 2075008 - RNA, 14 nt, Homo sapiens
uggaauuuugcaaa

SEQ ID NO: 2075009 - RNA, 13 nt, Homo sapiens
acuuuaucaauua

SEQ ID NO: 2075010 - RNA, 15 nt, Homo sapiens
auucccacaccucca

SEQ ID NO: 2075011 - RNA, 17 nt, Homo sapiens
ccuuucuucagcucuga

SEQ ID NO: 2075012 - RNA, 16 nt, Homo sapiens
aagauauuuuucauga

SEQ ID NO: 2075013 - RNA, 13 nt, Homo sapiens
auagggcaagaau

SEQ ID NO: 2075014 - RNA, 21 nt, Homo sapiens
acuuuucuuaaaaaguuauaa

SEQ ID NO: 2075015 - RNA, 20 nt, Homo sapiens
uaagccaagagucaugucaa

SEQ ID NO: 2075016 - RNA, 14 nt, Homo sapiens
auuuauuuauucau

SEQ ID NO: 2075017 - RNA, 20 nt, Homo sapiens
aauuacagacucaguagcca

SEQ ID NO: 2075018 - RNA, 17 nt, Homo sapiens
gccuacaaccaucccug

SEQ ID NO: 2075019 - RNA, 12 nt, Homo sapiens
acugauacuaca

SEQ ID NO: 2075020 - RNA, 13 nt, Homo sapiens
aguccuucucacc

SEQ ID NO: 2075021 - RNA, 20 nt, Homo sapiens
uccaaauaaggauuuguuca

SEQ ID NO: 2075022 - RNA, 19 nt, Homo sapiens
cuugaaagugaacaaucag

SEQ ID NO: 2075023 - RNA, 15 nt, Homo sapiens
ggccugaacaaaaua

SEQ ID NO: 2075024 - RNA, 22 nt, Homo sapiens
auuggauuuccuaauacuguca

SEQ ID NO: 2075025 - RNA, 13 nt, Homo sapiens
gauggacucagga

SEQ ID NO: 2075026 - RNA, 14 nt, Homo sapiens
uuugauuucuauuc

SEQ ID NO: 2075027 - RNA, 22 nt, Homo sapiens
guuuucagugcugugucauucc

SEQ ID NO: 2075028 - RNA, 21 nt, Homo sapiens
aggcucggaggacccuggaaa

SEQ ID NO: 2075029 - RNA, 21 nt, Homo sapiens
acuuauuguggauaacaaaga

SEQ ID NO: 2075030 - RNA, 15 nt, Homo sapiens
caggagcguguccua

SEQ ID NO: 2075031 - RNA, 21 nt, Homo sapiens
ugggagugcccccaacagcac

SEQ ID NO: 2075032 - RNA, 16 nt, Homo sapiens
caaggcugccagacau

SEQ ID NO: 2075033 - RNA, 21 nt, Homo sapiens
cugagagugaaaccaugacug

SEQ ID NO: 2075034 - RNA, 15 nt, Homo sapiens
aaggcaucgucaugc

SEQ ID NO: 2075035 - RNA, 16 nt, Homo sapiens
uucauguuuucacuua

SEQ ID NO: 2075036 - RNA, 21 nt, Homo sapiens
guugucccaaugaaauacuga

SEQ ID NO: 2075037 - RNA, 22 nt, Homo sapiens
uuguuaaaacauuggcauuuga

SEQ ID NO: 2075038 - RNA, 12 nt, Homo sapiens
guuuccugaaac

SEQ ID NO: 2075039 - RNA, 15 nt, Homo sapiens
cugcugcucccucag

SEQ ID NO: 2075040 - RNA, 19 nt, Homo sapiens
uuagaagaaaauggaugac

SEQ ID NO: 2075041 - RNA, 18 nt, Homo sapiens
ggcuccagaugcagggca

SEQ ID NO: 2075042 - RNA, 15 nt, Homo sapiens
uuuucaacauuucaa

SEQ ID NO: 2075043 - RNA, 15 nt, Homo sapiens
uuaaauacauaaaua

SEQ ID NO: 2075044 - RNA, 15 nt, Homo sapiens
uugcacacaugcaca

SEQ ID NO: 2075045 - RNA, 15 nt, Homo sapiens
aauugcacuauugca

SEQ ID NO: 2075046 - RNA, 19 nt, Homo sapiens
aggguuuuguggaugauuu

SEQ ID NO: 2075047 - RNA, 20 nt, Homo sapiens
ggccuugccagcaacaccug

SEQ ID NO: 2075048 - RNA, 15 nt, Homo sapiens
aacucccucugggaa

SEQ ID NO: 2075049 - RNA, 16 nt, Homo sapiens
guuacagaauuccuac

SEQ ID NO: 2075050 - RNA, 18 nt, Homo sapiens
ugccucccuccccagugc

SEQ ID NO: 2075051 - RNA, 17 nt, Homo sapiens
gaaaacggagagggaau

SEQ ID NO: 2075052 - RNA, 14 nt, Homo sapiens
uggcucaugccugu

SEQ ID NO: 2075053 - RNA, 15 nt, Homo sapiens
acaugacuguauaau

SEQ ID NO: 2075054 - RNA, 11 nt, Homo sapiens
auuucuuugcc

SEQ ID NO: 2075055 - RNA, 22 nt, Homo sapiens
uggaaguaaccauuugcacugg

SEQ ID NO: 2075056 - RNA, 22 nt, Homo sapiens
acugcuucaaucucaauugcuu

SEQ ID NO: 2075057 - RNA, 23 nt, Homo sapiens
uccgugguggcaccgagaccaaa

SEQ ID NO: 2075058 - RNA, 15 nt, Homo sapiens
aguuacaaccugaag

SEQ ID NO: 2075059 - RNA, 14 nt, Homo sapiens
ucucuguaaccaga

SEQ ID NO: 2075060 - RNA, 21 nt, Homo sapiens
acaugcuuuuccaaacccagg

SEQ ID NO: 2075061 - RNA, 21 nt, Homo sapiens
uucucuuaaguggucuaguca

SEQ ID NO: 2075062 - RNA, 15 nt, Homo sapiens
agggcaacuguagaa

SEQ ID NO: 2075063 - RNA, 10 nt, Homo sapiens
uuaccaauua

SEQ ID NO: 2075064 - RNA, 19 nt, Homo sapiens
uguuaccauacugucucug

SEQ ID NO: 2075065 - RNA, 22 nt, Homo sapiens
auccuuaaggcauauacuuugu

SEQ ID NO: 2075066 - RNA, 12 nt, Homo sapiens
ccacuggcauua

SEQ ID NO: 2075067 - RNA, 13 nt, Homo sapiens
ucugauacagaca

SEQ ID NO: 2075068 - RNA, 17 nt, Homo sapiens
cuccuugucccccguga

SEQ ID NO: 2075069 - RNA, 23 nt, Homo sapiens
uuuuauuuuuagacagagucuca

SEQ ID NO: 2075070 - RNA, 22 nt, Homo sapiens
ccccagccagggcucaaucucu

SEQ ID NO: 2075071 - RNA, 12 nt, Homo sapiens
ucugcuuccaac

SEQ ID NO: 2075072 - RNA, 19 nt, Homo sapiens
uuccagcuacuuuugccaa

SEQ ID NO: 2075073 - RNA, 16 nt, Homo sapiens
uauguaguuuuguaca

SEQ ID NO: 2075074 - RNA, 16 nt, Homo sapiens
cuguggccuucgucac

SEQ ID NO: 2075075 - RNA, 17 nt, Homo sapiens
gcagggacaucaucucu

SEQ ID NO: 2075076 - RNA, 18 nt, Homo sapiens
ugacagaagcuucugccc

SEQ ID NO: 2075077 - RNA, 14 nt, Homo sapiens
aaauaaacaugacc

SEQ ID NO: 2075078 - RNA, 15 nt, Homo sapiens
cggccagguacaaca

SEQ ID NO: 2075079 - RNA, 16 nt, Homo sapiens
caaacuugaaaacaga

SEQ ID NO: 2075080 - RNA, 15 nt, Homo sapiens
gcucuaaaugucaau

SEQ ID NO: 2075081 - RNA, 19 nt, Homo sapiens
guuuuccuucucaucugug

SEQ ID NO: 2075082 - RNA, 19 nt, Homo sapiens
ucacgccuguaaucccagc

SEQ ID NO: 2075083 - RNA, 14 nt, Homo sapiens
uuccaguggaugag

SEQ ID NO: 2075084 - RNA, 23 nt, Homo sapiens
gaaucuuguuaauuucauuccaa

SEQ ID NO: 2075085 - RNA, 21 nt, Homo sapiens
ccagugcuuugcacacaagcu

SEQ ID NO: 2075086 - RNA, 17 nt, Homo sapiens
uaaagugaguacuguua

SEQ ID NO: 2075087 - RNA, 20 nt, Homo sapiens
gaauuguggcuguucacucc

SEQ ID NO: 2075088 - RNA, 18 nt, Homo sapiens
agcagcggggcagugugg

SEQ ID NO: 2075089 - RNA, 18 nt, Homo sapiens
aaaagagacaaacuguaa

SEQ ID NO: 2075090 - RNA, 23 nt, Homo sapiens
cugcccacucugaccgggcuucc

SEQ ID NO: 2075091 - RNA, 22 nt, Homo sapiens
uucccaaauguauucuacuugu

SEQ ID NO: 2075092 - RNA, 15 nt, Homo sapiens
auaggugugugagac

SEQ ID NO: 2075093 - RNA, 14 nt, Homo sapiens
auggcagugaugaa

SEQ ID NO: 2075094 - RNA, 19 nt, Homo sapiens
gccauucuugcauugauau

SEQ ID NO: 2075095 - RNA, 21 nt, Homo sapiens
gguugcuguugugcagugugc

SEQ ID NO: 2075096 - RNA, 15 nt, Homo sapiens
uagauaucaugcaaa

SEQ ID NO: 2075097 - RNA, 19 nt, Homo sapiens
ugggggccccgucucaggu

SEQ ID NO: 2075098 - RNA, 15 nt, Homo sapiens
uauuauccauucagu

SEQ ID NO: 2075099 - RNA, 17 nt, Homo sapiens
uuauagcucucaucacu

SEQ ID NO: 2075100 - RNA, 17 nt, Homo sapiens
agagccaggaugcccag

SEQ ID NO: 2075101 - RNA, 13 nt, Homo sapiens
uuacagccgugag

SEQ ID NO: 2075102 - RNA, 14 nt, Homo sapiens
uaucuucaguuuaa

SEQ ID NO: 2075103 - RNA, 14 nt, Homo sapiens
ucagauaccaugca

SEQ ID NO: 2075104 - RNA, 17 nt, Homo sapiens
ucacgggaccaguauug

SEQ ID NO: 2075105 - RNA, 19 nt, Homo sapiens
cacagaugcacacacagau

SEQ ID NO: 2075106 - RNA, 14 nt, Homo sapiens
uagaaguuacugaa

SEQ ID NO: 2075107 - RNA, 17 nt, Homo sapiens
gaaagaaggacccagaa

SEQ ID NO: 2075108 - RNA, 20 nt, Homo sapiens
uauuuguuuggucacugcua

SEQ ID NO: 2075109 - RNA, 20 nt, Homo sapiens
uuacaacacuuuaaguaaaa

SEQ ID NO: 2075110 - RNA, 20 nt, Homo sapiens
uugcaucucaguaugaauua

SEQ ID NO: 2075111 - RNA, 13 nt, Homo sapiens
auuugcucaugga

SEQ ID NO: 2075112 - RNA, 13 nt, Homo sapiens
aagcuuugcccuc

SEQ ID NO: 2075113 - RNA, 22 nt, Homo sapiens
gcaagauccccgccacccgggg

SEQ ID NO: 2075114 - RNA, 14 nt, Homo sapiens
accccuaggagcaa

SEQ ID NO: 2075115 - RNA, 19 nt, Homo sapiens
guauauuuauuucuagcaa

SEQ ID NO: 2075116 - RNA, 14 nt, Homo sapiens
cugagcauggggcg

SEQ ID NO: 2075117 - RNA, 17 nt, Homo sapiens
aaugccacauacuugca

SEQ ID NO: 2075118 - RNA, 13 nt, Homo sapiens
aacuggugauaua

SEQ ID NO: 2075119 - RNA, 12 nt, Homo sapiens
gcaucacugggg

SEQ ID NO: 2075120 - RNA, 18 nt, Homo sapiens
caaagccauucuuuuaaa

SEQ ID NO: 2075121 - RNA, 13 nt, Homo sapiens
acuccucuaguca

SEQ ID NO: 2075122 - RNA, 20 nt, Homo sapiens
auaauggcaucaauauacau

SEQ ID NO: 2075123 - RNA, 23 nt, Homo sapiens
cauccuaaaugaguaaacccagc

SEQ ID NO: 2075124 - RNA, 22 nt, Homo sapiens
ucaaccccagggcuccagcacu

SEQ ID NO: 2075125 - RNA, 13 nt, Homo sapiens
augugaacugacu

SEQ ID NO: 2075126 - RNA, 17 nt, Homo sapiens
ggugccaugccugcucc

SEQ ID NO: 2075127 - RNA, 13 nt, Homo sapiens
aucaaauugaucu

SEQ ID NO: 2075128 - RNA, 12 nt, Homo sapiens
ggcugacaucug

SEQ ID NO: 2075129 - RNA, 18 nt, Homo sapiens
agccaaaacugagcauaa

SEQ ID NO: 2075130 - RNA, 23 nt, Homo sapiens
cuuccgugggucaucccagcacc

SEQ ID NO: 2075131 - RNA, 15 nt, Homo sapiens
cuucaucugggacaa

SEQ ID NO: 2075132 - RNA, 17 nt, Homo sapiens
ugcagugacagcuugag

SEQ ID NO: 2075133 - RNA, 13 nt, Homo sapiens
ucucugcaaaaaa

SEQ ID NO: 2075134 - RNA, 23 nt, Homo sapiens
gggccagcuuuuccucaccagga

SEQ ID NO: 2075135 - RNA, 13 nt, Homo sapiens
cuggccucuagaa

SEQ ID NO: 2075136 - RNA, 18 nt, Homo sapiens
guagcuggggcuacagga

SEQ ID NO: 2075137 - RNA, 22 nt, Homo sapiens
cucugcuuaaacaaagcaguau

SEQ ID NO: 2075138 - RNA, 17 nt, Homo sapiens
augagacuuucuaaauc

SEQ ID NO: 2075139 - RNA, 15 nt, Homo sapiens
cagcccugcucccug

SEQ ID NO: 2075140 - RNA, 14 nt, Homo sapiens
ccuggcauggcacc

SEQ ID NO: 2075141 - RNA, 14 nt, Homo sapiens
gaauuaugggagaa

SEQ ID NO: 2075142 - RNA, 15 nt, Homo sapiens
gaaagaguagugcau

SEQ ID NO: 2075143 - RNA, 18 nt, Homo sapiens
agagagugagagcacaaa

SEQ ID NO: 2075144 - RNA, 12 nt, Homo sapiens
cuccaaaacaca

SEQ ID NO: 2075145 - RNA, 13 nt, Homo sapiens
caacagccaaaac

SEQ ID NO: 2075146 - RNA, 19 nt, Homo sapiens
ucacaagucagcacuaccu

SEQ ID NO: 2075147 - RNA, 13 nt, Homo sapiens
aagaaccucucac

SEQ ID NO: 2075148 - RNA, 16 nt, Homo sapiens
ugaagucagcucagac

SEQ ID NO: 2075149 - RNA, 19 nt, Homo sapiens
agguuggugaaguguaaua

SEQ ID NO: 2075150 - RNA, 22 nt, Homo sapiens
agacuaccggacacucgucacc

SEQ ID NO: 2075151 - RNA, 22 nt, Homo sapiens
cccuuacagagcauacaacaga

SEQ ID NO: 2075152 - RNA, 20 nt, Homo sapiens
caaucuuuacacaaugucac

SEQ ID NO: 2075153 - RNA, 16 nt, Homo sapiens
ugcuccugugcaggga

SEQ ID NO: 2075154 - RNA, 15 nt, Homo sapiens
auuacuuguguuacu

SEQ ID NO: 2075155 - RNA, 15 nt, Homo sapiens
agaaugugcucaugc

SEQ ID NO: 2075156 - RNA, 15 nt, Homo sapiens
gcauugccagcucuu

SEQ ID NO: 2075157 - RNA, 19 nt, Homo sapiens
gcaaaagagucaacaguau

SEQ ID NO: 2075158 - RNA, 22 nt, Homo sapiens
gaguugagucuccucucugaga

SEQ ID NO: 2075159 - RNA, 17 nt, Homo sapiens
ucucauaccucugacca

SEQ ID NO: 2075160 - RNA, 15 nt, Homo sapiens
ucugagaagacacaa

SEQ ID NO: 2075161 - RNA, 12 nt, Homo sapiens
ccgccaccucag

SEQ ID NO: 2075162 - RNA, 17 nt, Homo sapiens
uccuuuguucucccaaa

SEQ ID NO: 2075163 - RNA, 17 nt, Homo sapiens
aaucuauuucauaccau

SEQ ID NO: 2075164 - RNA, 15 nt, Homo sapiens
ucugugcccagaaua

SEQ ID NO: 2075165 - RNA, 13 nt, Homo sapiens
agggacagucuca

SEQ ID NO: 2075166 - RNA, 20 nt, Homo sapiens
gccacagcaccccgaaggga

SEQ ID NO: 2075167 - RNA, 22 nt, Homo sapiens
cuguagucccagcuacucggga

SEQ ID NO: 2075168 - RNA, 17 nt, Homo sapiens
ugauaauuacuuuccag

SEQ ID NO: 2075169 - RNA, 15 nt, Homo sapiens
ccagagugcuuauaa

SEQ ID NO: 2075170 - RNA, 12 nt, Homo sapiens
ucuaucucucaa

SEQ ID NO: 2075171 - RNA, 13 nt, Homo sapiens
cuugaccaaagcu

SEQ ID NO: 2075172 - RNA, 15 nt, Homo sapiens
uuccugacuuacaau

SEQ ID NO: 2075173 - RNA, 11 nt, Homo sapiens
ccaaugccugu

SEQ ID NO: 2075174 - RNA, 13 nt, Homo sapiens
aaggacagcugaa

SEQ ID NO: 2075175 - RNA, 11 nt, Homo sapiens
cuuaaaggcac

SEQ ID NO: 2075176 - RNA, 15 nt, Homo sapiens
ucagcuaccauucaa

SEQ ID NO: 2075177 - RNA, 19 nt, Homo sapiens
cuuacugucugcacuugaa

SEQ ID NO: 2075178 - RNA, 18 nt, Homo sapiens
ugccuauuugaaguacag

SEQ ID NO: 2075179 - RNA, 14 nt, Homo sapiens
ccacccaacccaaa

SEQ ID NO: 2075180 - RNA, 14 nt, Homo sapiens
agaccaaaagcaac

SEQ ID NO: 2075181 - RNA, 22 nt, Homo sapiens
ugacuucugccccagcuuuauc

SEQ ID NO: 2075182 - RNA, 16 nt, Homo sapiens
cugauuacucagagca

SEQ ID NO: 2075183 - RNA, 16 nt, Homo sapiens
uaauaacugcaguguu

SEQ ID NO: 2075184 - RNA, 14 nt, Homo sapiens
ccuuccuccugggc

SEQ ID NO: 2075185 - RNA, 14 nt, Homo sapiens
ucuggcucuugucc

SEQ ID NO: 2075186 - RNA, 19 nt, Homo sapiens
auucucauuugucacacac

SEQ ID NO: 2075187 - RNA, 19 nt, Homo sapiens
uagccaccuguuuagccua

SEQ ID NO: 2075188 - RNA, 15 nt, Homo sapiens
uaaaucccaaguguc

SEQ ID NO: 2075189 - RNA, 18 nt, Homo sapiens
acgcugccucaacacuga

SEQ ID NO: 2075190 - RNA, 12 nt, Homo sapiens
cuugauugcuca

SEQ ID NO: 2075191 - RNA, 18 nt, Homo sapiens
aaucauacuguaaggaaa

SEQ ID NO: 2075192 - RNA, 19 nt, Homo sapiens
uucagggagcucgcauucu

SEQ ID NO: 2075193 - RNA, 17 nt, Homo sapiens
aaccagaaaucuaaucu

SEQ ID NO: 2075194 - RNA, 24 nt, Homo sapiens
ccagagagcagcuucagugacaaa

SEQ ID NO: 2075195 - RNA, 17 nt, Homo sapiens
cugugccccagcagugc

SEQ ID NO: 2075196 - RNA, 14 nt, Homo sapiens
ccuccccaccugcu

SEQ ID NO: 2075197 - RNA, 20 nt, Homo sapiens
auucucuaaccgaauauuca

SEQ ID NO: 2075198 - RNA, 15 nt, Homo sapiens
caaagcccaacugug

SEQ ID NO: 2075199 - RNA, 15 nt, Homo sapiens
aagaaaagcauucaa

SEQ ID NO: 2075200 - RNA, 15 nt, Homo sapiens
ugaggaggaggacac

SEQ ID NO: 2075201 - RNA, 15 nt, Homo sapiens
uggggccaacuggaa

SEQ ID NO: 2075202 - RNA, 22 nt, Homo sapiens
ucuaagcugcagcuuccuguca

SEQ ID NO: 2075203 - RNA, 20 nt, Homo sapiens
uacucucaggcauggaugaa

SEQ ID NO: 2075204 - RNA, 12 nt, Homo sapiens
cuagacacuccu

SEQ ID NO: 2075205 - RNA, 12 nt, Homo sapiens
ccuggaggccag

SEQ ID NO: 2075206 - RNA, 18 nt, Homo sapiens
uaccaaugcuuacgucaa

SEQ ID NO: 2075207 - RNA, 16 nt, Homo sapiens
cccuggaacuggagaa

SEQ ID NO: 2075208 - RNA, 22 nt, Homo sapiens
ccuggcaggggaaacucuggug

SEQ ID NO: 2075209 - RNA, 23 nt, Homo sapiens
aaagaaaaauaucuuggccuaaa

SEQ ID NO: 2075210 - RNA, 22 nt, Homo sapiens
caguuaaaguagaucaccuccu

SEQ ID NO: 2075211 - RNA, 23 nt, Homo sapiens
caugcuugcauaagagcuuaaga

SEQ ID NO: 2075212 - RNA, 18 nt, Homo sapiens
accaaguaucacacuuua

SEQ ID NO: 2075213 - RNA, 23 nt, Homo sapiens
gaauuccucuuuggccacaagaa

SEQ ID NO: 2075214 - RNA, 15 nt, Homo sapiens
gagaucugugccaua

SEQ ID NO: 2075215 - RNA, 15 nt, Homo sapiens
ccuaaggcuccccac

SEQ ID NO: 2075216 - RNA, 13 nt, Homo sapiens
guuuccucuguau

SEQ ID NO: 2075217 - RNA, 13 nt, Homo sapiens
cacauacccaccc

SEQ ID NO: 2075218 - RNA, 16 nt, Homo sapiens
cgguggacccagggau

SEQ ID NO: 2075219 - RNA, 22 nt, Homo sapiens
gauucaagacaagagcuguuau

SEQ ID NO: 2075220 - RNA, 21 nt, Homo sapiens
auuucauccagggaaaugccu

SEQ ID NO: 2075221 - RNA, 18 nt, Homo sapiens
augcggccucugagacau

SEQ ID NO: 2075222 - RNA, 21 nt, Homo sapiens
uacaagucaucauaauucagc

SEQ ID NO: 2075223 - RNA, 22 nt, Homo sapiens
cuguucugugugggucugggga

SEQ ID NO: 2075224 - RNA, 19 nt, Homo sapiens
uaauuguuacaauuuucua

SEQ ID NO: 2075225 - RNA, 20 nt, Homo sapiens
aaaguuuuuauucugaauaa

SEQ ID NO: 2075226 - RNA, 13 nt, Homo sapiens
cauucccccaugu

SEQ ID NO: 2075227 - RNA, 19 nt, Homo sapiens
uguccagggcagaggccau

SEQ ID NO: 2075228 - RNA, 15 nt, Homo sapiens
cugcacagagucagg

SEQ ID NO: 2075229 - RNA, 20 nt, Homo sapiens
ucuuaaauauguauaugaca

SEQ ID NO: 2075230 - RNA, 23 nt, Homo sapiens
agcaguuuacucuagacuaaaga

SEQ ID NO: 2075231 - RNA, 24 nt, Homo sapiens
acucuuuaaaggauaauuauccaa

SEQ ID NO: 2075232 - RNA, 15 nt, Homo sapiens
uucuuuaucuugaca

SEQ ID NO: 2075233 - RNA, 16 nt, Homo sapiens
accugccccugccuga

SEQ ID NO: 2075234 - RNA, 18 nt, Homo sapiens
uccaaaaauggcagugac

SEQ ID NO: 2075235 - RNA, 16 nt, Homo sapiens
cacucuuugcacacuc

SEQ ID NO: 2075236 - RNA, 23 nt, Homo sapiens
aaugcuaggaguagaaaaugguc

SEQ ID NO: 2075237 - RNA, 13 nt, Homo sapiens
cugguuuucacau

SEQ ID NO: 2075238 - RNA, 18 nt, Homo sapiens
ucuuuuucaaaacuaguu

SEQ ID NO: 2075239 - RNA, 14 nt, Homo sapiens
cuccaccucuggug

SEQ ID NO: 2075240 - RNA, 17 nt, Homo sapiens
gcuagacuguaagcccu

SEQ ID NO: 2075241 - RNA, 18 nt, Homo sapiens
uuuaaaugucaguugaaa

SEQ ID NO: 2075242 - RNA, 22 nt, Homo sapiens
ucuuaauucccaaucccauucc

SEQ ID NO: 2075243 - RNA, 18 nt, Homo sapiens
ucauggcucugaacugca

SEQ ID NO: 2075244 - RNA, 16 nt, Homo sapiens
accgagccucugucac

SEQ ID NO: 2075245 - RNA, 15 nt, Homo sapiens
gcugcucaggcccau

SEQ ID NO: 2075246 - RNA, 16 nt, Homo sapiens
uggcugugcacuuacc

SEQ ID NO: 2075247 - RNA, 24 nt, Homo sapiens
ugcccauuagcccacugccuggaa

SEQ ID NO: 2075248 - RNA, 20 nt, Homo sapiens
aaggaucucuauaacagauc

SEQ ID NO: 2075249 - RNA, 17 nt, Homo sapiens
gcaugugcagcuauuua

SEQ ID NO: 2075250 - RNA, 19 nt, Homo sapiens
caggccauaccaggugcua

SEQ ID NO: 2075251 - RNA, 19 nt, Homo sapiens
uacuuugccaacuugccau

SEQ ID NO: 2075252 - RNA, 19 nt, Homo sapiens
ccucccuccacuccucuca

SEQ ID NO: 2075253 - RNA, 23 nt, Homo sapiens
uacaauacauauaucuacacaua

SEQ ID NO: 2075254 - RNA, 18 nt, Homo sapiens
uaaauaaauuuuaauuaa

SEQ ID NO: 2075255 - RNA, 13 nt, Homo sapiens
uaauuccuaugaa

SEQ ID NO: 2075256 - RNA, 14 nt, Homo sapiens
caauagaguucucc

SEQ ID NO: 2075257 - RNA, 20 nt, Homo sapiens
cuuuuaagaugugucuucaa

SEQ ID NO: 2075258 - RNA, 16 nt, Homo sapiens
aucuuaauacuguuau

SEQ ID NO: 2075259 - RNA, 17 nt, Homo sapiens
ucugagggaaagugcau

SEQ ID NO: 2075260 - RNA, 18 nt, Homo sapiens
agaggcuucuccaaaggg

SEQ ID NO: 2075261 - RNA, 16 nt, Homo sapiens
aagaaauaaaccucau

SEQ ID NO: 2075262 - RNA, 14 nt, Homo sapiens
agcucuggaugaag

SEQ ID NO: 2075263 - RNA, 17 nt, Homo sapiens
uauuaagguguggcuuu

SEQ ID NO: 2075264 - RNA, 20 nt, Homo sapiens
aguacaggaucuuuggucua

SEQ ID NO: 2075265 - RNA, 23 nt, Homo sapiens
gaaaggaccuuaccuguguuuca

SEQ ID NO: 2075266 - RNA, 22 nt, Homo sapiens
acaauaaacucgugacuugucc

SEQ ID NO: 2075267 - RNA, 12 nt, Homo sapiens
cuccaucuguca

SEQ ID NO: 2075268 - RNA, 22 nt, Homo sapiens
uaauaugaaaaucuccaucuca

SEQ ID NO: 2075269 - RNA, 20 nt, Homo sapiens
ugaagaucugguuccagaac

SEQ ID NO: 2075270 - RNA, 14 nt, Homo sapiens
acaggguucauuga

SEQ ID NO: 2075271 - RNA, 16 nt, Homo sapiens
uuucuauuaagauaua

SEQ ID NO: 2075272 - RNA, 20 nt, Homo sapiens
gaaccuggggugugguucca

SEQ ID NO: 2075273 - RNA, 18 nt, Homo sapiens
caucugugccuucucuau

SEQ ID NO: 2075274 - RNA, 19 nt, Homo sapiens
cauuauccaucuuucacua

SEQ ID NO: 2075275 - RNA, 23 nt, Homo sapiens
aaauaacuaaaagguaugcaauc

SEQ ID NO: 2075276 - RNA, 22 nt, Homo sapiens
acagucucugggagacuuuccc

SEQ ID NO: 2075277 - RNA, 22 nt, Homo sapiens
cacgucugcagaaacagugcaa

SEQ ID NO: 2075278 - RNA, 11 nt, Homo sapiens
gaagugcuugc

SEQ ID NO: 2075279 - RNA, 15 nt, Homo sapiens
gucggauuaccaaaa

SEQ ID NO: 2075280 - RNA, 22 nt, Homo sapiens
uacuuuagguaguagaaucuca

SEQ ID NO: 2075281 - RNA, 17 nt, Homo sapiens
gucucaugccccgccau

SEQ ID NO: 2075282 - RNA, 17 nt, Homo sapiens
ugaauguuagacucugg

SEQ ID NO: 2075283 - RNA, 22 nt, Homo sapiens
uaaacaagaaaucugacaauag

SEQ ID NO: 2075284 - RNA, 16 nt, Homo sapiens
cuuauugugugaaggu

SEQ ID NO: 2075285 - RNA, 17 nt, Homo sapiens
aggaucaccagugcauc

SEQ ID NO: 2075286 - RNA, 18 nt, Homo sapiens
auuauaaauaaaugccaa

SEQ ID NO: 2075287 - RNA, 13 nt, Homo sapiens
acuaagauguuca

SEQ ID NO: 2075288 - RNA, 12 nt, Homo sapiens
aauagucauucc

SEQ ID NO: 2075289 - RNA, 13 nt, Homo sapiens
uaacaaugcaugc

SEQ ID NO: 2075290 - RNA, 18 nt, Homo sapiens
uaacccuaggcaucacau

SEQ ID NO: 2075291 - RNA, 18 nt, Homo sapiens
aucacugacucugacuca

SEQ ID NO: 2075292 - RNA, 18 nt, Homo sapiens
uuuggggggaguaaagaa

SEQ ID NO: 2075293 - RNA, 15 nt, Homo sapiens
cuucacuugcacugg

SEQ ID NO: 2075294 - RNA, 22 nt, Homo sapiens
uuuuccgggaacaaaaugaugu

SEQ ID NO: 2075295 - RNA, 20 nt, Homo sapiens
ucaaccugcacuucauaucu

SEQ ID NO: 2075296 - RNA, 18 nt, Homo sapiens
ugucccaaacaugcacuu

SEQ ID NO: 2075297 - RNA, 23 nt, Homo sapiens
cagaaggagggagaccccaaaaa

SEQ ID NO: 2075298 - RNA, 22 nt, Homo sapiens
gaccauuugacuguucaaugau

SEQ ID NO: 2075299 - RNA, 13 nt, Homo sapiens
cagaccucggugg

SEQ ID NO: 2075300 - RNA, 18 nt, Homo sapiens
gcacuuauauagcaccuu

SEQ ID NO: 2075301 - RNA, 22 nt, Homo sapiens
ucccugucugugucccagccac

SEQ ID NO: 2075302 - RNA, 22 nt, Homo sapiens
aaucuuuauaguucuacuccau

SEQ ID NO: 2075303 - RNA, 13 nt, Homo sapiens
auuucauucugaa

SEQ ID NO: 2075304 - RNA, 21 nt, Homo sapiens
ucuacuugccucauuucccua

SEQ ID NO: 2075305 - RNA, 17 nt, Homo sapiens
aucgacuuugugucucu

SEQ ID NO: 2075306 - RNA, 18 nt, Homo sapiens
acccuaaugcuaguuuca

SEQ ID NO: 2075307 - RNA, 19 nt, Homo sapiens
uccagggaauggagcucag

SEQ ID NO: 2075308 - RNA, 21 nt, Homo sapiens
cuuccccucuuuuggccaaau

SEQ ID NO: 2075309 - RNA, 23 nt, Homo sapiens
aacuuguuuaauuccucaguggg

SEQ ID NO: 2075310 - RNA, 19 nt, Homo sapiens
ggaggcaagcguguucuca

SEQ ID NO: 2075311 - RNA, 13 nt, Homo sapiens
aagucagcuccag

SEQ ID NO: 2075312 - RNA, 16 nt, Homo sapiens
uucaccauguugccaa

SEQ ID NO: 2075313 - RNA, 15 nt, Homo sapiens
ccuggugcugcugcu

SEQ ID NO: 2075314 - RNA, 17 nt, Homo sapiens
uguacaugugcuugcca

SEQ ID NO: 2075315 - RNA, 19 nt, Homo sapiens
ccacacgcacuggugccaa

SEQ ID NO: 2075316 - RNA, 18 nt, Homo sapiens
aggauauuaucuaccugu

SEQ ID NO: 2075317 - RNA, 20 nt, Homo sapiens
gugugcugggaucuacuuuc

SEQ ID NO: 2075318 - RNA, 18 nt, Homo sapiens
uuaaacucugagugcaaa

SEQ ID NO: 2075319 - RNA, 16 nt, Homo sapiens
uccaggcuggggccau

SEQ ID NO: 2075320 - RNA, 17 nt, Homo sapiens
cccuucucccaguccaa

SEQ ID NO: 2075321 - RNA, 15 nt, Homo sapiens
aaaaccuugguuauc

SEQ ID NO: 2075322 - RNA, 21 nt, Homo sapiens
uugguucaauaaagcacugag

SEQ ID NO: 2075323 - RNA, 12 nt, Homo sapiens
guauuuuagacu

SEQ ID NO: 2075324 - RNA, 20 nt, Homo sapiens
cgggacagauggacagacag

SEQ ID NO: 2075325 - RNA, 19 nt, Homo sapiens
ccccccagccuccagagaa

SEQ ID NO: 2075326 - RNA, 21 nt, Homo sapiens
acucaccgcucacccuccuga

SEQ ID NO: 2075327 - RNA, 21 nt, Homo sapiens
gugagaagacuggcaggcagc

SEQ ID NO: 2075328 - RNA, 12 nt, Homo sapiens
gugaaaauauga

SEQ ID NO: 2075329 - RNA, 20 nt, Homo sapiens
aauacucugcccucuagagc

SEQ ID NO: 2075330 - RNA, 12 nt, Homo sapiens
ggagagagccaa

SEQ ID NO: 2075331 - RNA, 18 nt, Homo sapiens
ucugcagucucuauacca

SEQ ID NO: 2075332 - RNA, 21 nt, Homo sapiens
caagaaucuagaagaugugua

SEQ ID NO: 2075333 - RNA, 16 nt, Homo sapiens
ggugacuucaggugga

SEQ ID NO: 2075334 - RNA, 20 nt, Homo sapiens
uacauaggcaucauuucaca

SEQ ID NO: 2075335 - RNA, 18 nt, Homo sapiens
uucuacagcuaggacuua

SEQ ID NO: 2075336 - RNA, 20 nt, Homo sapiens
uuccuccuggcuuccagggg

SEQ ID NO: 2075337 - RNA, 17 nt, Homo sapiens
aguaucauuacauauag

SEQ ID NO: 2075338 - RNA, 17 nt, Homo sapiens
cucugaucccauauucu

SEQ ID NO: 2075339 - RNA, 15 nt, Homo sapiens
auaaagaaugcucau

SEQ ID NO: 2075340 - RNA, 19 nt, Homo sapiens
agcucagugcucucuccac

SEQ ID NO: 2075341 - RNA, 13 nt, Homo sapiens
ugucccugagcag

SEQ ID NO: 2075342 - RNA, 21 nt, Homo sapiens
agaagcuggcuaguccuuucu

SEQ ID NO: 2075343 - RNA, 20 nt, Homo sapiens
aauaaaauauggacuuccaa

SEQ ID NO: 2075344 - RNA, 18 nt, Homo sapiens
uaagccccaagcgaauuu

SEQ ID NO: 2075345 - RNA, 22 nt, Homo sapiens
aucccagggcucccugccauuu

SEQ ID NO: 2075346 - RNA, 22 nt, Homo sapiens
ccuaggcuaccucaagacucac

SEQ ID NO: 2075347 - RNA, 23 nt, Homo sapiens
cauuauacacaaagaauacuuuc

SEQ ID NO: 2075348 - RNA, 16 nt, Homo sapiens
ccacucuuugcuacaa

SEQ ID NO: 2075349 - RNA, 15 nt, Homo sapiens
gaaugcuuugccaua

SEQ ID NO: 2075350 - RNA, 16 nt, Homo sapiens
gucucugcucuugccu

SEQ ID NO: 2075351 - RNA, 24 nt, Homo sapiens
auuugaaccagugauccauguccu

SEQ ID NO: 2075352 - RNA, 13 nt, Homo sapiens
gauggacaacuca

SEQ ID NO: 2075353 - RNA, 14 nt, Homo sapiens
gcugaaaagugcuu

SEQ ID NO: 2075354 - RNA, 19 nt, Homo sapiens
guauuuuagcaggguacau

SEQ ID NO: 2075355 - RNA, 18 nt, Homo sapiens
aaaacuacugacagggag

SEQ ID NO: 2075356 - RNA, 19 nt, Homo sapiens
auggaccaauuagcauucc

SEQ ID NO: 2075357 - RNA, 12 nt, Homo sapiens
auagaaacugag

SEQ ID NO: 2075358 - RNA, 22 nt, Homo sapiens
ugaacuuuccaaaaccuaaaga

SEQ ID NO: 2075359 - RNA, 12 nt, Homo sapiens
uuacaaacagac

SEQ ID NO: 2075360 - RNA, 15 nt, Homo sapiens
uugucugagaacaaa

SEQ ID NO: 2075361 - RNA, 23 nt, Homo sapiens
uucacaucucuguagauacaggg

SEQ ID NO: 2075362 - RNA, 14 nt, Homo sapiens
gccagcauaugcag

SEQ ID NO: 2075363 - RNA, 14 nt, Homo sapiens
gauguaaccaagcu

SEQ ID NO: 2075364 - RNA, 21 nt, Homo sapiens
gccgcugcugagcugcgugcc

SEQ ID NO: 2075365 - RNA, 22 nt, Homo sapiens
acaaagacuccucugggccugg

SEQ ID NO: 2075366 - RNA, 23 nt, Homo sapiens
ucccccucccccagccacucccc

SEQ ID NO: 2075367 - RNA, 21 nt, Homo sapiens
cuugccauuauuaacccauuu

SEQ ID NO: 2075368 - RNA, 10 nt, Homo sapiens
acacacaguc

SEQ ID NO: 2075369 - RNA, 16 nt, Homo sapiens
cuuuucugugucauac

SEQ ID NO: 2075370 - RNA, 19 nt, Homo sapiens
cugaagcgagcccucagga

SEQ ID NO: 2075371 - RNA, 17 nt, Homo sapiens
acucccccaaccaagga

SEQ ID NO: 2075372 - RNA, 21 nt, Homo sapiens
cuucucacuagcugucucagg

SEQ ID NO: 2075373 - RNA, 15 nt, Homo sapiens
uguccucaucagucu

SEQ ID NO: 2075374 - RNA, 18 nt, Homo sapiens
cccuaagcagaccacuga

SEQ ID NO: 2075375 - RNA, 13 nt, Homo sapiens
ucucuaaaacugc

SEQ ID NO: 2075376 - RNA, 20 nt, Homo sapiens
uccuaccgaaaccuugccuu

SEQ ID NO: 2075377 - RNA, 15 nt, Homo sapiens
gccuggcuucuggag

SEQ ID NO: 2075378 - RNA, 19 nt, Homo sapiens
caguuaucuugaucucccu

SEQ ID NO: 2075379 - RNA, 17 nt, Homo sapiens
uaaguaaaugagccuuu

SEQ ID NO: 2075380 - RNA, 19 nt, Homo sapiens
aaaguaggcaucuaaagaa

SEQ ID NO: 2075381 - RNA, 20 nt, Homo sapiens
uccuuccuguggguggggcu

SEQ ID NO: 2075382 - RNA, 13 nt, Homo sapiens
gagauauuuacau

SEQ ID NO: 2075383 - RNA, 19 nt, Homo sapiens
ucagacauuugguauauua

SEQ ID NO: 2075384 - RNA, 12 nt, Homo sapiens
uuuggacaaucu

SEQ ID NO: 2075385 - RNA, 14 nt, Homo sapiens
ccuaaagaauccca

SEQ ID NO: 2075386 - RNA, 21 nt, Homo sapiens
gucccaagauguugauuuuua

SEQ ID NO: 2075387 - RNA, 14 nt, Homo sapiens
aggucagggagcaa

SEQ ID NO: 2075388 - RNA, 15 nt, Homo sapiens
ugccucuugcaauuc

SEQ ID NO: 2075389 - RNA, 16 nt, Homo sapiens
aucucuaaaaugcugu

SEQ ID NO: 2075390 - RNA, 20 nt, Homo sapiens
aaaaauauauuuaauggcaa

SEQ ID NO: 2075391 - RNA, 11 nt, Homo sapiens
agacuacaggg

SEQ ID NO: 2075392 - RNA, 23 nt, Homo sapiens
ugggugauguagagauuuaccug

SEQ ID NO: 2075393 - RNA, 18 nt, Homo sapiens
cagugccacgacauggcu

SEQ ID NO: 2075394 - RNA, 18 nt, Homo sapiens
uaagaacuuuuucacuuc

SEQ ID NO: 2075395 - RNA, 20 nt, Homo sapiens
uuugaagcagauguggugau

SEQ ID NO: 2075396 - RNA, 20 nt, Homo sapiens
ugaggaaauugcacacagua

SEQ ID NO: 2075397 - RNA, 14 nt, Homo sapiens
ugcacacacacaga

SEQ ID NO: 2075398 - RNA, 13 nt, Homo sapiens
cccugucuggaac

SEQ ID NO: 2075399 - RNA, 18 nt, Homo sapiens
cccaggggccggccagug

SEQ ID NO: 2075400 - RNA, 15 nt, Homo sapiens
uuuaucagaauauca

SEQ ID NO: 2075401 - RNA, 16 nt, Homo sapiens
ugauccguuccauugc

SEQ ID NO: 2075402 - RNA, 13 nt, Homo sapiens
ccggcuuuccucu

SEQ ID NO: 2075403 - RNA, 16 nt, Homo sapiens
agccucacgaaacugg

SEQ ID NO: 2075404 - RNA, 20 nt, Homo sapiens
agugccucuugucugaggga

SEQ ID NO: 2075405 - RNA, 14 nt, Homo sapiens
gggcccaccuggcc

SEQ ID NO: 2075406 - RNA, 21 nt, Homo sapiens
aaauauuuaagugcagucauu

SEQ ID NO: 2075407 - RNA, 10 nt, Homo sapiens
auuguggcau

SEQ ID NO: 2075408 - RNA, 17 nt, Homo sapiens
gaccaucucucccuccu

SEQ ID NO: 2075409 - RNA, 19 nt, Homo sapiens
agaauuggccaucuuaaaa

SEQ ID NO: 2075410 - RNA, 13 nt, Homo sapiens
uagaggaagacga

SEQ ID NO: 2075411 - RNA, 23 nt, Homo sapiens
acuucugcaacaagcaugcagcu

SEQ ID NO: 2075412 - RNA, 13 nt, Homo sapiens
uauuuucauuucu

SEQ ID NO: 2075413 - RNA, 21 nt, Homo sapiens
acaaagcacuggccuugccuc

SEQ ID NO: 2075414 - RNA, 13 nt, Homo sapiens
uaugagcccagau

SEQ ID NO: 2075415 - RNA, 23 nt, Homo sapiens
guaauucuaaaugaauguuuaca

SEQ ID NO: 2075416 - RNA, 23 nt, Homo sapiens
aagcagggcuauauuucagugac

SEQ ID NO: 2075417 - RNA, 17 nt, Homo sapiens
uauauaugugaugaucu

SEQ ID NO: 2075418 - RNA, 12 nt, Homo sapiens
ggcuugaugucc

SEQ ID NO: 2075419 - RNA, 12 nt, Homo sapiens
ucaaaagcaaac

SEQ ID NO: 2075420 - RNA, 21 nt, Homo sapiens
cuauaucgaauauaguucugu

SEQ ID NO: 2075421 - RNA, 20 nt, Homo sapiens
aaaguuagucaauccuguca

SEQ ID NO: 2075422 - RNA, 22 nt, Homo sapiens
ccacagcgauccacggagcuga

SEQ ID NO: 2075423 - RNA, 17 nt, Homo sapiens
ucacugccucauggcau

SEQ ID NO: 2075424 - RNA, 18 nt, Homo sapiens
uucuuaauccaguucugc

SEQ ID NO: 2075425 - RNA, 14 nt, Homo sapiens
gcuggggugucaau

SEQ ID NO: 2075426 - RNA, 14 nt, Homo sapiens
gaaggugagccaga

SEQ ID NO: 2075427 - RNA, 21 nt, Homo sapiens
auccaauucuuugaauuuccc

SEQ ID NO: 2075428 - RNA, 20 nt, Homo sapiens
uaaacuguaaaguucaauug

SEQ ID NO: 2075429 - RNA, 13 nt, Homo sapiens
uaaauaggagcuu

SEQ ID NO: 2075430 - RNA, 23 nt, Homo sapiens
auggccuggcugcugcugugcag

SEQ ID NO: 2075431 - RNA, 13 nt, Homo sapiens
ccaaauacucaau

SEQ ID NO: 2075432 - RNA, 14 nt, Homo sapiens
aucauacuuccauc

SEQ ID NO: 2075433 - RNA, 16 nt, Homo sapiens
cauacauuagugccau

SEQ ID NO: 2075434 - RNA, 17 nt, Homo sapiens
acauuagaugaaguuac

SEQ ID NO: 2075435 - RNA, 16 nt, Homo sapiens
uuagcuuacugauuaa

SEQ ID NO: 2075436 - RNA, 14 nt, Homo sapiens
cuuagucucagcac

SEQ ID NO: 2075437 - RNA, 16 nt, Homo sapiens
agagaauaaguggcuu

SEQ ID NO: 2075438 - RNA, 17 nt, Homo sapiens
uuagaggacacuauuga

SEQ ID NO: 2075439 - RNA, 20 nt, Homo sapiens
acuaaaauuuuaggcacucu

SEQ ID NO: 2075440 - RNA, 20 nt, Homo sapiens
gaccagccagugucuguuca

SEQ ID NO: 2075441 - RNA, 20 nt, Homo sapiens
aauggccuaaacuucagagg

SEQ ID NO: 2075442 - RNA, 17 nt, Homo sapiens
auggauaucccuaccuu

SEQ ID NO: 2075443 - RNA, 23 nt, Homo sapiens
auuacaauuuguauuacuuucuc

SEQ ID NO: 2075444 - RNA, 18 nt, Homo sapiens
ugcucagaauucaucuga

SEQ ID NO: 2075445 - RNA, 17 nt, Homo sapiens
uuggugcuuuucacuug

SEQ ID NO: 2075446 - RNA, 18 nt, Homo sapiens
uccugcccaagcacuuca

SEQ ID NO: 2075447 - RNA, 22 nt, Homo sapiens
ucucguuucugcccagcccucu

SEQ ID NO: 2075448 - RNA, 17 nt, Homo sapiens
aaugcuggcccugauga

SEQ ID NO: 2075449 - RNA, 14 nt, Homo sapiens
gcaaaaaucuccca

SEQ ID NO: 2075450 - RNA, 14 nt, Homo sapiens
cuaccaaugccaaa

SEQ ID NO: 2075451 - RNA, 19 nt, Homo sapiens
augcaauguaagcauacuu

SEQ ID NO: 2075452 - RNA, 19 nt, Homo sapiens
ugccccagagaagccucag

SEQ ID NO: 2075453 - RNA, 14 nt, Homo sapiens
uuugacaaccauga

SEQ ID NO: 2075454 - RNA, 22 nt, Homo sapiens
caugguuguugcauauaguuaa

SEQ ID NO: 2075455 - RNA, 19 nt, Homo sapiens
auuucuccuccaugggaga

SEQ ID NO: 2075456 - RNA, 18 nt, Homo sapiens
cugugccacacaauggau

SEQ ID NO: 2075457 - RNA, 16 nt, Homo sapiens
cuuagccagcccuggc

SEQ ID NO: 2075458 - RNA, 14 nt, Homo sapiens
uuuguacaaaagag

SEQ ID NO: 2075459 - RNA, 13 nt, Homo sapiens
aauguuucacuac

SEQ ID NO: 2075460 - RNA, 16 nt, Homo sapiens
ggcccuucacuuccau

SEQ ID NO: 2075461 - RNA, 23 nt, Homo sapiens
gcuuuaauuguuaagauaugaug

SEQ ID NO: 2075462 - RNA, 16 nt, Homo sapiens
cagugacaaguagggc

SEQ ID NO: 2075463 - RNA, 17 nt, Homo sapiens
aggagggccccuggggc

SEQ ID NO: 2075464 - RNA, 18 nt, Homo sapiens
aacuucgaccuacugaaa

SEQ ID NO: 2075465 - RNA, 13 nt, Homo sapiens
auucucuauuuau

SEQ ID NO: 2075466 - RNA, 23 nt, Homo sapiens
cccgcccaggccaucaccacagc

SEQ ID NO: 2075467 - RNA, 12 nt, Homo sapiens
uuucucacugag

SEQ ID NO: 2075468 - RNA, 19 nt, Homo sapiens
cagacugaagagcagguga

SEQ ID NO: 2075469 - RNA, 18 nt, Homo sapiens
uccccuggguucacagau

SEQ ID NO: 2075470 - RNA, 20 nt, Homo sapiens
ccucccauaauugcuuugcc

SEQ ID NO: 2075471 - RNA, 13 nt, Homo sapiens
caaauaguuccau

SEQ ID NO: 2075472 - RNA, 13 nt, Homo sapiens
ugcgucacuguga

SEQ ID NO: 2075473 - RNA, 21 nt, Homo sapiens
cagagaaagcuugaggccaug

SEQ ID NO: 2075474 - RNA, 12 nt, Homo sapiens
uuauccaugccu

SEQ ID NO: 2075475 - RNA, 15 nt, Homo sapiens
cagucuggugcccag

SEQ ID NO: 2075476 - RNA, 14 nt, Homo sapiens
ucuuugcaaaguau

SEQ ID NO: 2075477 - RNA, 14 nt, Homo sapiens
guacucacauauaa

SEQ ID NO: 2075478 - RNA, 11 nt, Homo sapiens
agacacugugg

SEQ ID NO: 2075479 - RNA, 20 nt, Homo sapiens
cugcuccaggagguuugcag

SEQ ID NO: 2075480 - RNA, 22 nt, Homo sapiens
guuugacacaccauuauauuua

SEQ ID NO: 2075481 - RNA, 21 nt, Homo sapiens
gccaacauguggcuccuccca

SEQ ID NO: 2075482 - RNA, 16 nt, Homo sapiens
agcaagugacaugcca

SEQ ID NO: 2075483 - RNA, 19 nt, Homo sapiens
cugagaggcaccaguccag

SEQ ID NO: 2075484 - RNA, 19 nt, Homo sapiens
cauucuccuuguguuacua

SEQ ID NO: 2075485 - RNA, 18 nt, Homo sapiens
uuauuugaaaauuugcug

SEQ ID NO: 2075486 - RNA, 21 nt, Homo sapiens
aguaacacagugcagugcuca

SEQ ID NO: 2075487 - RNA, 17 nt, Homo sapiens
ugagcugggcaccacag

SEQ ID NO: 2075488 - RNA, 14 nt, Homo sapiens
gauauuccauagua

SEQ ID NO: 2075489 - RNA, 14 nt, Homo sapiens
gccaggugagcucu

SEQ ID NO: 2075490 - RNA, 21 nt, Homo sapiens
ccugcugcgggggagccaguu

SEQ ID NO: 2075491 - RNA, 13 nt, Homo sapiens
aaaaaugcugcuc

SEQ ID NO: 2075492 - RNA, 14 nt, Homo sapiens
ccugcacaaacaua

SEQ ID NO: 2075493 - RNA, 18 nt, Homo sapiens
aagcaacagacucucaca

SEQ ID NO: 2075494 - RNA, 13 nt, Homo sapiens
uuucuggugccau

SEQ ID NO: 2075495 - RNA, 17 nt, Homo sapiens
ccucacuaccagaagaa

SEQ ID NO: 2075496 - RNA, 20 nt, Homo sapiens
ccaaggcuuuugcaaagaua

SEQ ID NO: 2075497 - RNA, 16 nt, Homo sapiens
gaauuacuugaaccug

SEQ ID NO: 2075498 - RNA, 22 nt, Homo sapiens
uauuuuccccucaagauuauca

SEQ ID NO: 2075499 - RNA, 14 nt, Homo sapiens
cucuauaauugcca

SEQ ID NO: 2075500 - RNA, 14 nt, Homo sapiens
aaggcaaauacaau

SEQ ID NO: 2075501 - RNA, 22 nt, Homo sapiens
acaccuggguggacacaaggca

SEQ ID NO: 2075502 - RNA, 16 nt, Homo sapiens
guucacucagagggaa

SEQ ID NO: 2075503 - RNA, 12 nt, Homo sapiens
uuccucugccac

SEQ ID NO: 2075504 - RNA, 12 nt, Homo sapiens
uucgucugccag

SEQ ID NO: 2075505 - RNA, 19 nt, Homo sapiens
uccugcccagcacaggaau

SEQ ID NO: 2075506 - RNA, 20 nt, Homo sapiens
gcccacugccugcccagugc

SEQ ID NO: 2075507 - RNA, 14 nt, Homo sapiens
guucuacaguuaau

SEQ ID NO: 2075508 - RNA, 21 nt, Homo sapiens
uagaacuggaagguacuuuaa

SEQ ID NO: 2075509 - RNA, 19 nt, Homo sapiens
augauacuugguccuuaaa

SEQ ID NO: 2075510 - RNA, 21 nt, Homo sapiens
aauucacucugaguguuuuau

SEQ ID NO: 2075511 - RNA, 17 nt, Homo sapiens
gacacgcacuucugggg

SEQ ID NO: 2075512 - RNA, 14 nt, Homo sapiens
uuauccuguucuca

SEQ ID NO: 2075513 - RNA, 14 nt, Homo sapiens
guuuaccacuaacu

SEQ ID NO: 2075514 - RNA, 23 nt, Homo sapiens
cacucugguggcaggugccuugu

SEQ ID NO: 2075515 - RNA, 17 nt, Homo sapiens
ugcuccauagagcagug

SEQ ID NO: 2075516 - RNA, 12 nt, Homo sapiens
cacuguugcuua

SEQ ID NO: 2075517 - RNA, 12 nt, Homo sapiens
cuuuccuuucaa

SEQ ID NO: 2075518 - RNA, 10 nt, Homo sapiens
cauugcacag

SEQ ID NO: 2075519 - RNA, 17 nt, Homo sapiens
ucccaguucauguugcu

SEQ ID NO: 2075520 - RNA, 22 nt, Homo sapiens
gccaaccuguaauaaauaugag

SEQ ID NO: 2075521 - RNA, 16 nt, Homo sapiens
uaggcuuucauguugc

SEQ ID NO: 2075522 - RNA, 14 nt, Homo sapiens
agcacuuuguauga

SEQ ID NO: 2075523 - RNA, 14 nt, Homo sapiens
auaaaagacacucc

SEQ ID NO: 2075524 - RNA, 22 nt, Homo sapiens
ugcucuuggggaaggggacaga

SEQ ID NO: 2075525 - RNA, 14 nt, Homo sapiens
aaauuuugugcaaa

SEQ ID NO: 2075526 - RNA, 19 nt, Homo sapiens
caaugcugaaugccuguua

SEQ ID NO: 2075527 - RNA, 20 nt, Homo sapiens
cauagaaguguugagccaug

SEQ ID NO: 2075528 - RNA, 11 nt, Homo sapiens
aucugccauug

SEQ ID NO: 2075529 - RNA, 20 nt, Homo sapiens
uuaagaggcagggucucacu

SEQ ID NO: 2075530 - RNA, 15 nt, Homo sapiens
acauuauacauuuga

SEQ ID NO: 2075531 - RNA, 18 nt, Homo sapiens
auaauaaauaaacuucaa

SEQ ID NO: 2075532 - RNA, 18 nt, Homo sapiens
uaacuaugaccaugcuga

SEQ ID NO: 2075533 - RNA, 23 nt, Homo sapiens
aaaauguagcaugauguauuuaa

SEQ ID NO: 2075534 - RNA, 17 nt, Homo sapiens
aggcacaccagugcaag

SEQ ID NO: 2075535 - RNA, 19 nt, Homo sapiens
ucggcucuggagauuaucc

SEQ ID NO: 2075536 - RNA, 22 nt, Homo sapiens
uaaaguuuccccucuauuuugg

SEQ ID NO: 2075537 - RNA, 15 nt, Homo sapiens
ugcugagcacccucu

SEQ ID NO: 2075538 - RNA, 16 nt, Homo sapiens
ugucauagcuaugaca

SEQ ID NO: 2075539 - RNA, 13 nt, Homo sapiens
gcuguaguaacug

SEQ ID NO: 2075540 - RNA, 14 nt, Homo sapiens
ggcugggcuccuca

SEQ ID NO: 2075541 - RNA, 20 nt, Homo sapiens
cucacccagucuucuacaca

SEQ ID NO: 2075542 - RNA, 14 nt, Homo sapiens
cuagaaaaucugag

SEQ ID NO: 2075543 - RNA, 16 nt, Homo sapiens
gacacauuugaaauca

SEQ ID NO: 2075544 - RNA, 23 nt, Homo sapiens
gcuuaaacuacaaacacaagcaa

SEQ ID NO: 2075545 - RNA, 17 nt, Homo sapiens
guagcauuggucaggga

SEQ ID NO: 2075546 - RNA, 18 nt, Homo sapiens
cuguguuuaacugcugca

SEQ ID NO: 2075547 - RNA, 17 nt, Homo sapiens
acuauggagucuuguga

SEQ ID NO: 2075548 - RNA, 21 nt, Homo sapiens
ccuugggccuuucagucccaa

SEQ ID NO: 2075549 - RNA, 18 nt, Homo sapiens
ucuuacugcuuaauucaa

SEQ ID NO: 2075550 - RNA, 15 nt, Homo sapiens
cugggacauggugga

SEQ ID NO: 2075551 - RNA, 14 nt, Homo sapiens
acuugugauucaaa

SEQ ID NO: 2075552 - RNA, 16 nt, Homo sapiens
aagcauacaacuggac

SEQ ID NO: 2075553 - RNA, 20 nt, Homo sapiens
ugucuucaaagcaaagcucu

SEQ ID NO: 2075554 - RNA, 17 nt, Homo sapiens
guuuuuauucugaauaa

SEQ ID NO: 2075555 - RNA, 23 nt, Homo sapiens
ucaagaggaauuccagcaucuga

SEQ ID NO: 2075556 - RNA, 21 nt, Homo sapiens
ucaaagccauauggacacugu

SEQ ID NO: 2075557 - RNA, 22 nt, Homo sapiens
ggaaaggcaaaugcccaaggga

SEQ ID NO: 2075558 - RNA, 21 nt, Homo sapiens
ugugccccuugacaacuggca

SEQ ID NO: 2075559 - RNA, 18 nt, Homo sapiens
gaccuuuuggaaugacug

SEQ ID NO: 2075560 - RNA, 18 nt, Homo sapiens
ccaugugggcugaaggau

SEQ ID NO: 2075561 - RNA, 17 nt, Homo sapiens
uacauauuaucaugucu

SEQ ID NO: 2075562 - RNA, 16 nt, Homo sapiens
aucuucucaaguucua

SEQ ID NO: 2075563 - RNA, 13 nt, Homo sapiens
uacauagucuuug

SEQ ID NO: 2075564 - RNA, 23 nt, Homo sapiens
gacagucccuugcugacauggcu

SEQ ID NO: 2075565 - RNA, 15 nt, Homo sapiens
gacuccccugaagaa

SEQ ID NO: 2075566 - RNA, 16 nt, Homo sapiens
gagguugggcugagac

SEQ ID NO: 2075567 - RNA, 18 nt, Homo sapiens
ucacacauuugccuugac

SEQ ID NO: 2075568 - RNA, 18 nt, Homo sapiens
cagucuacguucuccagc

SEQ ID NO: 2075569 - RNA, 23 nt, Homo sapiens
acugaucaauuucaacauggacu

SEQ ID NO: 2075570 - RNA, 14 nt, Homo sapiens
ugaugaugaugaua

SEQ ID NO: 2075571 - RNA, 11 nt, Homo sapiens
ggaaggugacu

SEQ ID NO: 2075572 - RNA, 13 nt, Homo sapiens
agggagagcaccu

SEQ ID NO: 2075573 - RNA, 19 nt, Homo sapiens
uugacguuucuucuuucua

SEQ ID NO: 2075574 - RNA, 15 nt, Homo sapiens
aaacauuucugugaa

SEQ ID NO: 2075575 - RNA, 23 nt, Homo sapiens
caggcuguuggaaaauccagaac

SEQ ID NO: 2075576 - RNA, 15 nt, Homo sapiens
cuggcugaugaucca

SEQ ID NO: 2075577 - RNA, 16 nt, Homo sapiens
ucacgggucacuugaa

SEQ ID NO: 2075578 - RNA, 16 nt, Homo sapiens
auccagcucugggagc

SEQ ID NO: 2075579 - RNA, 17 nt, Homo sapiens
ucucaacauuaccaaaa

SEQ ID NO: 2075580 - RNA, 13 nt, Homo sapiens
aauuaguauuuau

SEQ ID NO: 2075581 - RNA, 14 nt, Homo sapiens
gaugcacauuucau

SEQ ID NO: 2075582 - RNA, 16 nt, Homo sapiens
acugccgacaucagca

SEQ ID NO: 2075583 - RNA, 13 nt, Homo sapiens
cuacaacauguga

SEQ ID NO: 2075584 - RNA, 17 nt, Homo sapiens
ggaggauguucgucuca

SEQ ID NO: 2075585 - RNA, 20 nt, Homo sapiens
ccaucugcucaccagaucuc

SEQ ID NO: 2075586 - RNA, 14 nt, Homo sapiens
gcaaaaacauaugu

SEQ ID NO: 2075587 - RNA, 16 nt, Homo sapiens
uauacugagcugcuaa

SEQ ID NO: 2075588 - RNA, 12 nt, Homo sapiens
uuaagccuuaaa

SEQ ID NO: 2075589 - RNA, 14 nt, Homo sapiens
guuuucugugcacu

SEQ ID NO: 2075590 - RNA, 14 nt, Homo sapiens
gccaucacuagaag

SEQ ID NO: 2075591 - RNA, 20 nt, Homo sapiens
aagacugcugguugacauca

SEQ ID NO: 2075592 - RNA, 22 nt, Homo sapiens
uguguagcucucacaugcacag

SEQ ID NO: 2075593 - RNA, 17 nt, Homo sapiens
cugggaaggacauaaaa

SEQ ID NO: 2075594 - RNA, 14 nt, Homo sapiens
ccccuuuccccacg

SEQ ID NO: 2075595 - RNA, 14 nt, Homo sapiens
cauacuuccaucug

SEQ ID NO: 2075596 - RNA, 21 nt, Homo sapiens
uaaucuuaaauuuauuagaua

SEQ ID NO: 2075597 - RNA, 18 nt, Homo sapiens
agacaacuucccaaagca

SEQ ID NO: 2075598 - RNA, 17 nt, Homo sapiens
uuauuuggacagccaag

SEQ ID NO: 2075599 - RNA, 14 nt, Homo sapiens
gacucuuaagaaga

SEQ ID NO: 2075600 - RNA, 16 nt, Homo sapiens
caaaccacaacugaca

SEQ ID NO: 2075601 - RNA, 23 nt, Homo sapiens
cucuuguauuaaacucuucacaa

SEQ ID NO: 2075602 - RNA, 16 nt, Homo sapiens
aauggucucagcuuga

SEQ ID NO: 2075603 - RNA, 13 nt, Homo sapiens
uucuacuagccau

SEQ ID NO: 2075604 - RNA, 14 nt, Homo sapiens
aaaaaugugacuca

SEQ ID NO: 2075605 - RNA, 16 nt, Homo sapiens
aguaggacaaagggag

SEQ ID NO: 2075606 - RNA, 16 nt, Homo sapiens
ucuggauucugccuaa

SEQ ID NO: 2075607 - RNA, 15 nt, Homo sapiens
aggccacacuggcau

SEQ ID NO: 2075608 - RNA, 17 nt, Homo sapiens
uggccauccacaaacag

SEQ ID NO: 2075609 - RNA, 18 nt, Homo sapiens
cuguucucucugugcucu

SEQ ID NO: 2075610 - RNA, 18 nt, Homo sapiens
uuaaccuuccaagacuga

SEQ ID NO: 2075611 - RNA, 11 nt, Homo sapiens
acaaacagacc

SEQ ID NO: 2075612 - RNA, 18 nt, Homo sapiens
caucuccccucagauucc

SEQ ID NO: 2075613 - RNA, 19 nt, Homo sapiens
uaaauaucaacccacuuaa

SEQ ID NO: 2075614 - RNA, 17 nt, Homo sapiens
ugacuaagaaaaucagu

SEQ ID NO: 2075615 - RNA, 22 nt, Homo sapiens
uuugcucccuaccugacugcca

SEQ ID NO: 2075616 - RNA, 17 nt, Homo sapiens
gauuucuaaagcugaaa

SEQ ID NO: 2075617 - RNA, 12 nt, Homo sapiens
ccggacaugucu

SEQ ID NO: 2075618 - RNA, 12 nt, Homo sapiens
uauuugaaucuu

SEQ ID NO: 2075619 - RNA, 16 nt, Homo sapiens
gaacccuuccugagac

SEQ ID NO: 2075620 - RNA, 16 nt, Homo sapiens
uaggaauaaauaaaaa

SEQ ID NO: 2075621 - RNA, 13 nt, Homo sapiens
agaaaacaacuuc

SEQ ID NO: 2075622 - RNA, 22 nt, Homo sapiens
uacuucaacacuucauguauug

SEQ ID NO: 2075623 - RNA, 12 nt, Homo sapiens
uccagcauuugc

SEQ ID NO: 2075624 - RNA, 14 nt, Homo sapiens
guccccuuguucua

SEQ ID NO: 2075625 - RNA, 18 nt, Homo sapiens
ccaaucugugagaaguuu

SEQ ID NO: 2075626 - RNA, 13 nt, Homo sapiens
uaacaugcuuaug

SEQ ID NO: 2075627 - RNA, 17 nt, Homo sapiens
ugcuggugaaaacaauu

SEQ ID NO: 2075628 - RNA, 19 nt, Homo sapiens
auuccuaagaggaguuuau

SEQ ID NO: 2075629 - RNA, 14 nt, Homo sapiens
aggcauuccagggu

SEQ ID NO: 2075630 - RNA, 14 nt, Homo sapiens
cagcauucaggggu

SEQ ID NO: 2075631 - RNA, 15 nt, Homo sapiens
acuccagccugggca

SEQ ID NO: 2075632 - RNA, 23 nt, Homo sapiens
ccccagggugagcagggcccuca

SEQ ID NO: 2075633 - RNA, 18 nt, Homo sapiens
ccccuguggccacuuucc

SEQ ID NO: 2075634 - RNA, 18 nt, Homo sapiens
ugcagaccccuuggccag

SEQ ID NO: 2075635 - RNA, 21 nt, Homo sapiens
aacauuuacuuuugcucccua

SEQ ID NO: 2075636 - RNA, 14 nt, Homo sapiens
ugaauuuucccuga

SEQ ID NO: 2075637 - RNA, 15 nt, Homo sapiens
caugccuauuuacug

SEQ ID NO: 2075638 - RNA, 12 nt, Homo sapiens
ucuggggguccc

SEQ ID NO: 2075639 - RNA, 22 nt, Homo sapiens
ucugucugaauuauucugccua

SEQ ID NO: 2075640 - RNA, 23 nt, Homo sapiens
gaaagaaaugcuaaccuguggaa

SEQ ID NO: 2075641 - RNA, 13 nt, Homo sapiens
accaaacacucag

SEQ ID NO: 2075642 - RNA, 16 nt, Homo sapiens
aaacuuuauugacaag

SEQ ID NO: 2075643 - RNA, 15 nt, Homo sapiens
ugauaucucuuuuau

SEQ ID NO: 2075644 - RNA, 16 nt, Homo sapiens
ucagcucaggcagcuc

SEQ ID NO: 2075645 - RNA, 17 nt, Homo sapiens
acuucagaguaagacaa

SEQ ID NO: 2075646 - RNA, 18 nt, Homo sapiens
ugauugcaccaacagguc

SEQ ID NO: 2075647 - RNA, 20 nt, Homo sapiens
gagaccaccuuuuugaguga

SEQ ID NO: 2075648 - RNA, 20 nt, Homo sapiens
agaaauuaggagugcugaua

SEQ ID NO: 2075649 - RNA, 14 nt, Homo sapiens
aucuuccaaagaca

SEQ ID NO: 2075650 - RNA, 15 nt, Homo sapiens
acccccaagcacucc

SEQ ID NO: 2075651 - RNA, 13 nt, Homo sapiens
cauacucaccuca

SEQ ID NO: 2075652 - RNA, 13 nt, Homo sapiens
auuuccaguuuuu

SEQ ID NO: 2075653 - RNA, 19 nt, Homo sapiens
agaaggucauaagggagca

SEQ ID NO: 2075654 - RNA, 19 nt, Homo sapiens
guguguuugugugcaugaa

SEQ ID NO: 2075655 - RNA, 23 nt, Homo sapiens
cuugaauguaagaacaugaccuc

SEQ ID NO: 2075656 - RNA, 18 nt, Homo sapiens
auaaacugacuaaacuua

SEQ ID NO: 2075657 - RNA, 18 nt, Homo sapiens
uggaaaguguucauugca

SEQ ID NO: 2075658 - RNA, 12 nt, Homo sapiens
uauuuccacuga

SEQ ID NO: 2075659 - RNA, 17 nt, Homo sapiens
uuucauuauagcacgaa

SEQ ID NO: 2075660 - RNA, 15 nt, Homo sapiens
uacauaguacauaca

SEQ ID NO: 2075661 - RNA, 18 nt, Homo sapiens
uuaagaggauagauuuca

SEQ ID NO: 2075662 - RNA, 16 nt, Homo sapiens
uauuuguaaauuuugg

SEQ ID NO: 2075663 - RNA, 16 nt, Homo sapiens
aguauugguguaugua

SEQ ID NO: 2075664 - RNA, 20 nt, Homo sapiens
ugugggaaugcggcaagaag

SEQ ID NO: 2075665 - RNA, 17 nt, Homo sapiens
gauucuguagcuuuaac

SEQ ID NO: 2075666 - RNA, 12 nt, Homo sapiens
acauuauuccaa

SEQ ID NO: 2075667 - RNA, 20 nt, Homo sapiens
gccuaaagauuuugaucuca

SEQ ID NO: 2075668 - RNA, 14 nt, Homo sapiens
aggaaaagucccaa

SEQ ID NO: 2075669 - RNA, 21 nt, Homo sapiens
cauagauccccccacugagcu

SEQ ID NO: 2075670 - RNA, 16 nt, Homo sapiens
aagacagcugacagau

SEQ ID NO: 2075671 - RNA, 13 nt, Homo sapiens
gaaugugcacucu

SEQ ID NO: 2075672 - RNA, 23 nt, Homo sapiens
uuaaacacuaaucacaaacugaa

SEQ ID NO: 2075673 - RNA, 18 nt, Homo sapiens
gggggcuagaaaucuguu

SEQ ID NO: 2075674 - RNA, 14 nt, Homo sapiens
caacacucaucaca

SEQ ID NO: 2075675 - RNA, 15 nt, Homo sapiens
uucuacguggaugau

SEQ ID NO: 2075676 - RNA, 15 nt, Homo sapiens
cucagcaugcagaag

SEQ ID NO: 2075677 - RNA, 19 nt, Homo sapiens
uuaaaauuaucaauaucua

SEQ ID NO: 2075678 - RNA, 14 nt, Homo sapiens
aucacuugagguca

SEQ ID NO: 2075679 - RNA, 14 nt, Homo sapiens
uuuuuccucugcau

SEQ ID NO: 2075680 - RNA, 16 nt, Homo sapiens
gagugcaguggcguga

SEQ ID NO: 2075681 - RNA, 20 nt, Homo sapiens
uaucuacgcccuuccugugc

SEQ ID NO: 2075682 - RNA, 22 nt, Homo sapiens
augcuguauauccuuucuaaca

SEQ ID NO: 2075683 - RNA, 22 nt, Homo sapiens
ugcacuggggagcccgucucag

SEQ ID NO: 2075684 - RNA, 16 nt, Homo sapiens
aacugauaaguuucau

SEQ ID NO: 2075685 - RNA, 22 nt, Homo sapiens
uuaguugaccaacuauauugcg

SEQ ID NO: 2075686 - RNA, 23 nt, Homo sapiens
augagcuggggaugucucucaug

SEQ ID NO: 2075687 - RNA, 17 nt, Homo sapiens
gugagggguagugggau

SEQ ID NO: 2075688 - RNA, 14 nt, Homo sapiens
guggagcugcucaa

SEQ ID NO: 2075689 - RNA, 20 nt, Homo sapiens
uggucuggguggaugugagc

SEQ ID NO: 2075690 - RNA, 20 nt, Homo sapiens
cuuaaaccuuaagauacuaa

SEQ ID NO: 2075691 - RNA, 17 nt, Homo sapiens
ccaguccucaggcagca

SEQ ID NO: 2075692 - RNA, 23 nt, Homo sapiens
acacccugguucccaccauuccc

SEQ ID NO: 2075693 - RNA, 22 nt, Homo sapiens
acuucccacacgauuagcuuua

SEQ ID NO: 2075694 - RNA, 14 nt, Homo sapiens
gcagucccgggugg

SEQ ID NO: 2075695 - RNA, 23 nt, Homo sapiens
cuuaaccagucucucaagugaug

SEQ ID NO: 2075696 - RNA, 23 nt, Homo sapiens
cagcuggcgucaugcaaagucau

SEQ ID NO: 2075697 - RNA, 24 nt, Homo sapiens
cgaagcucauucccaacgugcaaa

SEQ ID NO: 2075698 - RNA, 14 nt, Homo sapiens
aauaauuguggaga

SEQ ID NO: 2075699 - RNA, 12 nt, Homo sapiens
cuguaaucaaua

SEQ ID NO: 2075700 - RNA, 14 nt, Homo sapiens
uaacagcaaauaac

SEQ ID NO: 2075701 - RNA, 13 nt, Homo sapiens
auauuuuuuacaa

SEQ ID NO: 2075702 - RNA, 18 nt, Homo sapiens
ccagcaaacguacgggaa

SEQ ID NO: 2075703 - RNA, 17 nt, Homo sapiens
aaaaagaggcauuccag

SEQ ID NO: 2075704 - RNA, 13 nt, Homo sapiens
uaucuaacagaca

SEQ ID NO: 2075705 - RNA, 18 nt, Homo sapiens
aaauuuaauaccagauac

SEQ ID NO: 2075706 - RNA, 12 nt, Homo sapiens
aaggaacuggaa

SEQ ID NO: 2075707 - RNA, 14 nt, Homo sapiens
cagggccccuguga

SEQ ID NO: 2075708 - RNA, 14 nt, Homo sapiens
gcuaagacugaugu

SEQ ID NO: 2075709 - RNA, 13 nt, Homo sapiens
cagucaaccuggg

SEQ ID NO: 2075710 - RNA, 18 nt, Homo sapiens
gacccaaacauaugcaca

SEQ ID NO: 2075711 - RNA, 21 nt, Homo sapiens
caauagaaggauguacauuuc

SEQ ID NO: 2075712 - RNA, 18 nt, Homo sapiens
ggcaccacgaagcuguga

SEQ ID NO: 2075713 - RNA, 13 nt, Homo sapiens
cucuccauauccc

SEQ ID NO: 2075714 - RNA, 17 nt, Homo sapiens
ucuuagucucagcacua

SEQ ID NO: 2075715 - RNA, 15 nt, Homo sapiens
cauaccaagugcuuu

SEQ ID NO: 2075716 - RNA, 15 nt, Homo sapiens
uccccaaccacagag

SEQ ID NO: 2075717 - RNA, 20 nt, Homo sapiens
cuccccaccccacacacacu

SEQ ID NO: 2075718 - RNA, 14 nt, Homo sapiens
caggccaaugucag

SEQ ID NO: 2075719 - RNA, 13 nt, Homo sapiens
aaacauauacaaa

SEQ ID NO: 2075720 - RNA, 13 nt, Homo sapiens
ugacucaccacga

SEQ ID NO: 2075721 - RNA, 17 nt, Homo sapiens
aggcuuaacacaguggg

SEQ ID NO: 2075722 - RNA, 15 nt, Homo sapiens
agagaaagacaaaau

SEQ ID NO: 2075723 - RNA, 17 nt, Homo sapiens
aagucccuuugugacuu

SEQ ID NO: 2075724 - RNA, 17 nt, Homo sapiens
uaaugcauuuaucaaua

SEQ ID NO: 2075725 - RNA, 13 nt, Homo sapiens
cguggccuggcau

SEQ ID NO: 2075726 - RNA, 21 nt, Homo sapiens
uuuaagccaaagaaacaagcu

SEQ ID NO: 2075727 - RNA, 20 nt, Homo sapiens
aagaccugcgauggacuuca

SEQ ID NO: 2075728 - RNA, 21 nt, Homo sapiens
cuacuggaugcuuacagugac

SEQ ID NO: 2075729 - RNA, 12 nt, Homo sapiens
caucaacuacua

SEQ ID NO: 2075730 - RNA, 19 nt, Homo sapiens
auguucuuugugugauuaa

SEQ ID NO: 2075731 - RNA, 16 nt, Homo sapiens
agcugaccccugcuga

SEQ ID NO: 2075732 - RNA, 15 nt, Homo sapiens
gcugauccugcugac

SEQ ID NO: 2075733 - RNA, 15 nt, Homo sapiens
auaacucugugaucu

SEQ ID NO: 2075734 - RNA, 17 nt, Homo sapiens
cguuauauuaaaacacu

SEQ ID NO: 2075735 - RNA, 21 nt, Homo sapiens
cagaaaacaaacacacgagga

SEQ ID NO: 2075736 - RNA, 19 nt, Homo sapiens
ugcaccaacccacugccca

SEQ ID NO: 2075737 - RNA, 15 nt, Homo sapiens
cccugucgcgucuca

SEQ ID NO: 2075738 - RNA, 18 nt, Homo sapiens
cagggacuguaaaaccac

SEQ ID NO: 2075739 - RNA, 19 nt, Homo sapiens
aaacacaaaugcagggauu

SEQ ID NO: 2075740 - RNA, 21 nt, Homo sapiens
cagagguccccugaggucaug

SEQ ID NO: 2075741 - RNA, 22 nt, Homo sapiens
ccaucacuggcucucuaauucc

SEQ ID NO: 2075742 - RNA, 23 nt, Homo sapiens
augauugucuaaccaauugugag

SEQ ID NO: 2075743 - RNA, 22 nt, Homo sapiens
ugauggcccuaaguuaagcaaa

SEQ ID NO: 2075744 - RNA, 20 nt, Homo sapiens
ccuggcacccccacaagcug

SEQ ID NO: 2075745 - RNA, 20 nt, Homo sapiens
accaacccugcaggccucau

SEQ ID NO: 2075746 - RNA, 19 nt, Homo sapiens
agaccagccuggccaagag

SEQ ID NO: 2075747 - RNA, 16 nt, Homo sapiens
aggagggaaggauuua

SEQ ID NO: 2075748 - RNA, 18 nt, Homo sapiens
uaggaugacugcugugaa

SEQ ID NO: 2075749 - RNA, 15 nt, Homo sapiens
agcacaauuugcacu

SEQ ID NO: 2075750 - RNA, 13 nt, Homo sapiens
ucauagccaaaaa

SEQ ID NO: 2075751 - RNA, 20 nt, Homo sapiens
aaaugacugucccauucucc

SEQ ID NO: 2075752 - RNA, 20 nt, Homo sapiens
uacacauuuuucagauauaa

SEQ ID NO: 2075753 - RNA, 16 nt, Homo sapiens
cauuuuuaaucugugu

SEQ ID NO: 2075754 - RNA, 11 nt, Homo sapiens
aagccaaauac

SEQ ID NO: 2075755 - RNA, 20 nt, Homo sapiens
agugcaguggugugaucucg

SEQ ID NO: 2075756 - RNA, 19 nt, Homo sapiens
auguuguucaccagugcuu

SEQ ID NO: 2075757 - RNA, 23 nt, Homo sapiens
guugaaccacgugaaacugcugu

SEQ ID NO: 2075758 - RNA, 22 nt, Homo sapiens
ugcuguuuuuguucuacucuag

SEQ ID NO: 2075759 - RNA, 18 nt, Homo sapiens
uccugagaaugaaugagu

SEQ ID NO: 2075760 - RNA, 16 nt, Homo sapiens
ugauggucacaugggg

SEQ ID NO: 2075761 - RNA, 18 nt, Homo sapiens
auuucauuccauugccua

SEQ ID NO: 2075762 - RNA, 13 nt, Homo sapiens
ucuggaacacuuu

SEQ ID NO: 2075763 - RNA, 17 nt, Homo sapiens
aagauacgugcaugaaa

SEQ ID NO: 2075764 - RNA, 17 nt, Homo sapiens
ucccacccggcugcaua

SEQ ID NO: 2075765 - RNA, 22 nt, Homo sapiens
guauuuuccaacuuguucaaau

SEQ ID NO: 2075766 - RNA, 20 nt, Homo sapiens
acugaggcagcgaccucaag

SEQ ID NO: 2075767 - RNA, 14 nt, Homo sapiens
uugggagcuuuaaa

SEQ ID NO: 2075768 - RNA, 23 nt, Homo sapiens
gaugauuuuguaaaaguggcauu

SEQ ID NO: 2075769 - RNA, 17 nt, Homo sapiens
uaacuagauacagaaua

SEQ ID NO: 2075770 - RNA, 13 nt, Homo sapiens
accugucucucuc

SEQ ID NO: 2075771 - RNA, 21 nt, Homo sapiens
uccaaacagaccccuguucau

SEQ ID NO: 2075772 - RNA, 18 nt, Homo sapiens
uaauccaauccacuaaca

SEQ ID NO: 2075773 - RNA, 19 nt, Homo sapiens
gacaguauguaugccuucg

SEQ ID NO: 2075774 - RNA, 19 nt, Homo sapiens
gaggcuuugcugcugugaa

SEQ ID NO: 2075775 - RNA, 23 nt, Homo sapiens
acaaaguggaugccugcugcauc

SEQ ID NO: 2075776 - RNA, 20 nt, Homo sapiens
ugggacuggagucagaugag

SEQ ID NO: 2075777 - RNA, 23 nt, Homo sapiens
gugaaucuuugucagcaguuccc

SEQ ID NO: 2075778 - RNA, 19 nt, Homo sapiens
uucuuuauugcacuaggaa

SEQ ID NO: 2075779 - RNA, 21 nt, Homo sapiens
aguuucagauuugccauucaa

SEQ ID NO: 2075780 - RNA, 18 nt, Homo sapiens
agugcaacagcacuggcu

SEQ ID NO: 2075781 - RNA, 12 nt, Homo sapiens
aaacacuccaca

SEQ ID NO: 2075782 - RNA, 20 nt, Homo sapiens
caauugauguuuuacgugca

SEQ ID NO: 2075783 - RNA, 20 nt, Homo sapiens
uucuuuguguuuggaucaaa

SEQ ID NO: 2075784 - RNA, 19 nt, Homo sapiens
ugaccaucccaacuuuggu

SEQ ID NO: 2075785 - RNA, 22 nt, Homo sapiens
acaggagcguguacuaccccag

SEQ ID NO: 2075786 - RNA, 22 nt, Homo sapiens
gccagagcccuucacugccaug

SEQ ID NO: 2075787 - RNA, 22 nt, Homo sapiens
acuaauaaaugccaacugguca

SEQ ID NO: 2075788 - RNA, 22 nt, Homo sapiens
aggauaccacuuuucauugcaa

SEQ ID NO: 2075789 - RNA, 21 nt, Homo sapiens
gacuauauacauguguguaua

SEQ ID NO: 2075790 - RNA, 19 nt, Homo sapiens
acccagcaagggcacuuaa

SEQ ID NO: 2075791 - RNA, 15 nt, Homo sapiens
uuccucugcuuugaa

SEQ ID NO: 2075792 - RNA, 19 nt, Homo sapiens
agagacuuuguaaaaaaga

SEQ ID NO: 2075793 - RNA, 14 nt, Homo sapiens
uauuuuagccuuua

SEQ ID NO: 2075794 - RNA, 18 nt, Homo sapiens
uauaaaaaugagugcuua

SEQ ID NO: 2075795 - RNA, 14 nt, Homo sapiens
uauuuaagccuuuu

SEQ ID NO: 2075796 - RNA, 15 nt, Homo sapiens
uguaaagaaugucua

SEQ ID NO: 2075797 - RNA, 22 nt, Homo sapiens
ucucaucgaauaagacucauca

SEQ ID NO: 2075798 - RNA, 14 nt, Homo sapiens
cagguccuuccuuu

SEQ ID NO: 2075799 - RNA, 21 nt, Homo sapiens
ccaggcugagguccugaucag

SEQ ID NO: 2075800 - RNA, 14 nt, Homo sapiens
acugagacauuaca

SEQ ID NO: 2075801 - RNA, 17 nt, Homo sapiens
aaacuacugaacuguua

SEQ ID NO: 2075802 - RNA, 22 nt, Homo sapiens
ggauccaauaugacucagagaa

SEQ ID NO: 2075803 - RNA, 14 nt, Homo sapiens
agcauaacauggag

SEQ ID NO: 2075804 - RNA, 12 nt, Homo sapiens
ucccaagugcca

SEQ ID NO: 2075805 - RNA, 18 nt, Homo sapiens
uguacucuugaacuucuu

SEQ ID NO: 2075806 - RNA, 19 nt, Homo sapiens
ugagcuggcaaccagccag

SEQ ID NO: 2075807 - RNA, 18 nt, Homo sapiens
aaugagaaagguauauau

SEQ ID NO: 2075808 - RNA, 16 nt, Homo sapiens
uucaucuggauuccag

SEQ ID NO: 2075809 - RNA, 17 nt, Homo sapiens
gauagcgaaugcacuca

SEQ ID NO: 2075810 - RNA, 22 nt, Homo sapiens
gagccuggcuggagagcugcua

SEQ ID NO: 2075811 - RNA, 11 nt, Homo sapiens
uuaaaacacuu

SEQ ID NO: 2075812 - RNA, 16 nt, Homo sapiens
aguuggccaauuucac

SEQ ID NO: 2075813 - RNA, 18 nt, Homo sapiens
agugagguagugccaaug

SEQ ID NO: 2075814 - RNA, 17 nt, Homo sapiens
aacaucccuuauaccac

SEQ ID NO: 2075815 - RNA, 17 nt, Homo sapiens
uuaaauccaacuuucac

SEQ ID NO: 2075816 - RNA, 21 nt, Homo sapiens
ccaacauaauuaagcuguaua

SEQ ID NO: 2075817 - RNA, 13 nt, Homo sapiens
aacaaauaugcuu

SEQ ID NO: 2075818 - RNA, 21 nt, Homo sapiens
uggaccacuuuguauacacuc

SEQ ID NO: 2075819 - RNA, 17 nt, Homo sapiens
agggcuggagccugggg

SEQ ID NO: 2075820 - RNA, 22 nt, Homo sapiens
aucuguugcaaacucagccuca

SEQ ID NO: 2075821 - RNA, 20 nt, Homo sapiens
gcccacagggaacacauucc

SEQ ID NO: 2075822 - RNA, 19 nt, Homo sapiens
ggcuaguuaaggugugcaa

SEQ ID NO: 2075823 - RNA, 21 nt, Homo sapiens
gagaguguggaaaaaaaaaga

SEQ ID NO: 2075824 - RNA, 15 nt, Homo sapiens
acagaagggcaguga

SEQ ID NO: 2075825 - RNA, 16 nt, Homo sapiens
aaaccaauccuaugca

SEQ ID NO: 2075826 - RNA, 16 nt, Homo sapiens
aaaacuauuauaugua

SEQ ID NO: 2075827 - RNA, 22 nt, Homo sapiens
cagcccuggggacaccugccca

SEQ ID NO: 2075828 - RNA, 18 nt, Homo sapiens
agcugaaaguucuugcuc

SEQ ID NO: 2075829 - RNA, 20 nt, Homo sapiens
gccaaaagucccucccugcc

SEQ ID NO: 2075830 - RNA, 21 nt, Homo sapiens
gccuccccaugggcacagugg

SEQ ID NO: 2075831 - RNA, 16 nt, Homo sapiens
auggagaucagagguu

SEQ ID NO: 2075832 - RNA, 15 nt, Homo sapiens
uuggccacacacuga

SEQ ID NO: 2075833 - RNA, 16 nt, Homo sapiens
gugauuaacaucuaca

SEQ ID NO: 2075834 - RNA, 12 nt, Homo sapiens
aaaaauuacauu

SEQ ID NO: 2075835 - RNA, 20 nt, Homo sapiens
gcugccaauaaacuguuaca

SEQ ID NO: 2075836 - RNA, 22 nt, Homo sapiens
uuccuacccacaccucugccag

SEQ ID NO: 2075837 - RNA, 20 nt, Homo sapiens
ugccucauaggcuucuggga

SEQ ID NO: 2075838 - RNA, 18 nt, Homo sapiens
auagcuaggugacauaua

SEQ ID NO: 2075839 - RNA, 20 nt, Homo sapiens
aaccuggguaacuagggaag

SEQ ID NO: 2075840 - RNA, 17 nt, Homo sapiens
aaggcaucugacaugca

SEQ ID NO: 2075841 - RNA, 11 nt, Homo sapiens
ggaacugugua

SEQ ID NO: 2075842 - RNA, 16 nt, Homo sapiens
acacaagcaaccaaug

SEQ ID NO: 2075843 - RNA, 20 nt, Homo sapiens
guagaugacaaauauucuga

SEQ ID NO: 2075844 - RNA, 12 nt, Homo sapiens
caguaguauucu

SEQ ID NO: 2075845 - RNA, 20 nt, Homo sapiens
gcugucaugcccagcuugga

SEQ ID NO: 2075846 - RNA, 17 nt, Homo sapiens
acacaaaccagccucaa

SEQ ID NO: 2075847 - RNA, 23 nt, Homo sapiens
aguguugcccaggcuggucucaa

SEQ ID NO: 2075848 - RNA, 20 nt, Homo sapiens
gggaagccaggauuggggac

SEQ ID NO: 2075849 - RNA, 16 nt, Homo sapiens
ggcacaggagacucca

SEQ ID NO: 2075850 - RNA, 19 nt, Homo sapiens
aaggccuuuccuacaugcc

SEQ ID NO: 2075851 - RNA, 12 nt, Homo sapiens
aaguaacuauaa

SEQ ID NO: 2075852 - RNA, 13 nt, Homo sapiens
uacaugucaauaa

SEQ ID NO: 2075853 - RNA, 16 nt, Homo sapiens
ugaguaaaaucacaga

SEQ ID NO: 2075854 - RNA, 19 nt, Homo sapiens
agaaguacuuuucuguuca

SEQ ID NO: 2075855 - RNA, 14 nt, Homo sapiens
cagcugaugacuca

SEQ ID NO: 2075856 - RNA, 14 nt, Homo sapiens
ugucauagacuccu

SEQ ID NO: 2075857 - RNA, 21 nt, Homo sapiens
gagcagcuucugccacuuccc

SEQ ID NO: 2075858 - RNA, 18 nt, Homo sapiens
accuuugcuuaccuuguu

SEQ ID NO: 2075859 - RNA, 20 nt, Homo sapiens
cuaaaggauccagagagcag

SEQ ID NO: 2075860 - RNA, 18 nt, Homo sapiens
caugaaaaaugaucucug

SEQ ID NO: 2075861 - RNA, 22 nt, Homo sapiens
aauuuguguguuuuuagcugug

SEQ ID NO: 2075862 - RNA, 23 nt, Homo sapiens
uacagucuauuugagacuccuca

SEQ ID NO: 2075863 - RNA, 20 nt, Homo sapiens
aauacggcuuuuccaaugau

SEQ ID NO: 2075864 - RNA, 13 nt, Homo sapiens
cucucucuaccag

SEQ ID NO: 2075865 - RNA, 18 nt, Homo sapiens
gugacaugcggcugccca

SEQ ID NO: 2075866 - RNA, 14 nt, Homo sapiens
agcaccaggggaug

SEQ ID NO: 2075867 - RNA, 23 nt, Homo sapiens
gugcauuuuuacuauuguuacau

SEQ ID NO: 2075868 - RNA, 23 nt, Homo sapiens
ccuucacaaccagccacacagag

SEQ ID NO: 2075869 - RNA, 19 nt, Homo sapiens
uucuuuugaaucaaucugg

SEQ ID NO: 2075870 - RNA, 14 nt, Homo sapiens
aaagcguccucuca

SEQ ID NO: 2075871 - RNA, 14 nt, Homo sapiens
agggaccuugucuc

SEQ ID NO: 2075872 - RNA, 17 nt, Homo sapiens
uggaauccuauauagaa

SEQ ID NO: 2075873 - RNA, 17 nt, Homo sapiens
caaauuacaaguauuca

SEQ ID NO: 2075874 - RNA, 18 nt, Homo sapiens
uaaagccucugugcugca

SEQ ID NO: 2075875 - RNA, 21 nt, Homo sapiens
ggaguuggaauguuguaguua

SEQ ID NO: 2075876 - RNA, 13 nt, Homo sapiens
uuugcguacuugu

SEQ ID NO: 2075877 - RNA, 20 nt, Homo sapiens
ucaugaauaauccaccccuu

SEQ ID NO: 2075878 - RNA, 17 nt, Homo sapiens
uuggaaaacacuuucau

SEQ ID NO: 2075879 - RNA, 19 nt, Homo sapiens
auaggaaaagaaucuccuu

SEQ ID NO: 2075880 - RNA, 14 nt, Homo sapiens
uagccccucucuua

SEQ ID NO: 2075881 - RNA, 21 nt, Homo sapiens
aaaggugugccuggcagccau

SEQ ID NO: 2075882 - RNA, 20 nt, Homo sapiens
accucagggguuaagagcuc

SEQ ID NO: 2075883 - RNA, 14 nt, Homo sapiens
uaguucuauuucua

SEQ ID NO: 2075884 - RNA, 19 nt, Homo sapiens
auuacagcaguugacucag

SEQ ID NO: 2075885 - RNA, 19 nt, Homo sapiens
uguacugguaauuguacaa

SEQ ID NO: 2075886 - RNA, 13 nt, Homo sapiens
auacuuuuuacaa

SEQ ID NO: 2075887 - RNA, 18 nt, Homo sapiens
cugcugcaugaccuauca

SEQ ID NO: 2075888 - RNA, 22 nt, Homo sapiens
uaaguugucuaaacaaugcuga

SEQ ID NO: 2075889 - RNA, 23 nt, Homo sapiens
uucauugcccccagggcacuuca

SEQ ID NO: 2075890 - RNA, 14 nt, Homo sapiens
uuaaagcaaaugaa

SEQ ID NO: 2075891 - RNA, 22 nt, Homo sapiens
ucacauucccucucauccaggu

SEQ ID NO: 2075892 - RNA, 13 nt, Homo sapiens
uuccaaagccaga

SEQ ID NO: 2075893 - RNA, 20 nt, Homo sapiens
ccaggcuggagugcaauggu

SEQ ID NO: 2075894 - RNA, 20 nt, Homo sapiens
ccaggcuagagugcaguggu

SEQ ID NO: 2075895 - RNA, 23 nt, Homo sapiens
aaaaccaccaccaucaccagaca

SEQ ID NO: 2075896 - RNA, 15 nt, Homo sapiens
uaaauuauaccauga

SEQ ID NO: 2075897 - RNA, 17 nt, Homo sapiens
agcaggggcagcuucau

SEQ ID NO: 2075898 - RNA, 16 nt, Homo sapiens
guuguuuuaaagucag

SEQ ID NO: 2075899 - RNA, 22 nt, Homo sapiens
agccacccuuggucucaugccc

SEQ ID NO: 2075900 - RNA, 19 nt, Homo sapiens
cuaucuuugguauaugaua

SEQ ID NO: 2075901 - RNA, 20 nt, Homo sapiens
ggaggaacugcuugugcacu

SEQ ID NO: 2075902 - RNA, 12 nt, Homo sapiens
caacaugacugu

SEQ ID NO: 2075903 - RNA, 19 nt, Homo sapiens
cuccagacauacaaacaua

SEQ ID NO: 2075904 - RNA, 19 nt, Homo sapiens
uggagggcugcagagccug

SEQ ID NO: 2075905 - RNA, 17 nt, Homo sapiens
acauuggagcugacugu

SEQ ID NO: 2075906 - RNA, 20 nt, Homo sapiens
uuccuacagcacuacugggu

SEQ ID NO: 2075907 - RNA, 15 nt, Homo sapiens
agugauggaguuccu

SEQ ID NO: 2075908 - RNA, 22 nt, Homo sapiens
auucaaaccuaaguugcuggac

SEQ ID NO: 2075909 - RNA, 13 nt, Homo sapiens
agagagcagcagc

SEQ ID NO: 2075910 - RNA, 12 nt, Homo sapiens
cugaaacugugu

SEQ ID NO: 2075911 - RNA, 12 nt, Homo sapiens
gucaccaagaaa

SEQ ID NO: 2075912 - RNA, 15 nt, Homo sapiens
aaccuguuccugacu

SEQ ID NO: 2075913 - RNA, 16 nt, Homo sapiens
acauuaagacacaccu

SEQ ID NO: 2075914 - RNA, 17 nt, Homo sapiens
uaaaauaaaagcacuua

SEQ ID NO: 2075915 - RNA, 13 nt, Homo sapiens
caugacauaugac

SEQ ID NO: 2075916 - RNA, 13 nt, Homo sapiens
gacucuuccaggu

SEQ ID NO: 2075917 - RNA, 12 nt, Homo sapiens
aauaaaugcuca

SEQ ID NO: 2075918 - RNA, 15 nt, Homo sapiens
ccugcaguaaucucc

SEQ ID NO: 2075919 - RNA, 22 nt, Homo sapiens
uagagauggggucucacagugu

SEQ ID NO: 2075920 - RNA, 14 nt, Homo sapiens
uugaaaaugcauua

SEQ ID NO: 2075921 - RNA, 15 nt, Homo sapiens
aaaaugcacguagcu

SEQ ID NO: 2075922 - RNA, 18 nt, Homo sapiens
gcaugguuuuacagugaa

SEQ ID NO: 2075923 - RNA, 18 nt, Homo sapiens
caguggcccugagcagua

SEQ ID NO: 2075924 - RNA, 11 nt, Homo sapiens
guagucucucu

SEQ ID NO: 2075925 - RNA, 19 nt, Homo sapiens
cacaugagaagugauaaaa

SEQ ID NO: 2075926 - RNA, 18 nt, Homo sapiens
aguggcaccuaauaaaga

SEQ ID NO: 2075927 - RNA, 22 nt, Homo sapiens
caaauucggauguaugaucucu

SEQ ID NO: 2075928 - RNA, 12 nt, Homo sapiens
ugcuuccuugcc

SEQ ID NO: 2075929 - RNA, 19 nt, Homo sapiens
cugggaucucaaccccagc

SEQ ID NO: 2075930 - RNA, 19 nt, Homo sapiens
caucagacugucaagaaga

SEQ ID NO: 2075931 - RNA, 17 nt, Homo sapiens
augcuaauuuuauuaua

SEQ ID NO: 2075932 - RNA, 16 nt, Homo sapiens
acucagugcagcaaua

SEQ ID NO: 2075933 - RNA, 20 nt, Homo sapiens
uauuccucuuugcccaaaau

SEQ ID NO: 2075934 - RNA, 22 nt, Homo sapiens
gccccuccccagacucucaggu

SEQ ID NO: 2075935 - RNA, 14 nt, Homo sapiens
agauuuucugggau

SEQ ID NO: 2075936 - RNA, 17 nt, Homo sapiens
uuccucuugacccugca

SEQ ID NO: 2075937 - RNA, 20 nt, Homo sapiens
agagccucucccacaccacu

SEQ ID NO: 2075938 - RNA, 21 nt, Homo sapiens
gauccaauggaauacugaaaa

SEQ ID NO: 2075939 - RNA, 12 nt, Homo sapiens
gcuucucuggga

SEQ ID NO: 2075940 - RNA, 16 nt, Homo sapiens
gcccucagaacaaucc

SEQ ID NO: 2075941 - RNA, 16 nt, Homo sapiens
auacuuucucuucaaa

SEQ ID NO: 2075942 - RNA, 14 nt, Homo sapiens
ugaacagcugugag

SEQ ID NO: 2075943 - RNA, 14 nt, Homo sapiens
uuaaaggcuuugca

SEQ ID NO: 2075944 - RNA, 13 nt, Homo sapiens
aagagcaaaaaua

SEQ ID NO: 2075945 - RNA, 20 nt, Homo sapiens
uucauguuuugcuaaugcuc

SEQ ID NO: 2075946 - RNA, 13 nt, Homo sapiens
ggagacuccauga

SEQ ID NO: 2075947 - RNA, 13 nt, Homo sapiens
cuacaauucauug

SEQ ID NO: 2075948 - RNA, 16 nt, Homo sapiens
aagaauaaacacuggu

SEQ ID NO: 2075949 - RNA, 13 nt, Homo sapiens
agggggcgugccu

SEQ ID NO: 2075950 - RNA, 22 nt, Homo sapiens
guaaaacauaauguaucaugaa

SEQ ID NO: 2075951 - RNA, 21 nt, Homo sapiens
gugauguaccaguuuguccau

SEQ ID NO: 2075952 - RNA, 20 nt, Homo sapiens
aucaguucccccaguaccuc

SEQ ID NO: 2075953 - RNA, 21 nt, Homo sapiens
uaauucacucaagcacugaua

SEQ ID NO: 2075954 - RNA, 21 nt, Homo sapiens
guccagacccugaagauuuca

SEQ ID NO: 2075955 - RNA, 13 nt, Homo sapiens
aaucuuacuuugu

SEQ ID NO: 2075956 - RNA, 23 nt, Homo sapiens
uuagugaccccugccuacuuccu

SEQ ID NO: 2075957 - RNA, 14 nt, Homo sapiens
accugcaacacaac

SEQ ID NO: 2075958 - RNA, 18 nt, Homo sapiens
guauguguaccuaaggga

SEQ ID NO: 2075959 - RNA, 20 nt, Homo sapiens
ucuagacugccagggagacc

SEQ ID NO: 2075960 - RNA, 12 nt, Homo sapiens
cuagugcuggua

SEQ ID NO: 2075961 - RNA, 16 nt, Homo sapiens
aaaaccagucuucucc

SEQ ID NO: 2075962 - RNA, 12 nt, Homo sapiens
cuuaucacaaaa

SEQ ID NO: 2075963 - RNA, 12 nt, Homo sapiens
cuuuucacaaau

SEQ ID NO: 2075964 - RNA, 21 nt, Homo sapiens
uuuuguaugaaauauauguga

SEQ ID NO: 2075965 - RNA, 13 nt, Homo sapiens
accucuaugcaau

SEQ ID NO: 2075966 - RNA, 12 nt, Homo sapiens
ggggaacagagc

SEQ ID NO: 2075967 - RNA, 23 nt, Homo sapiens
uaaaaaguaccacauuccaugac

SEQ ID NO: 2075968 - RNA, 17 nt, Homo sapiens
gauucugguuccagggu

SEQ ID NO: 2075969 - RNA, 22 nt, Homo sapiens
uaccauuuuuuuuuaacacugu

SEQ ID NO: 2075970 - RNA, 19 nt, Homo sapiens
gcuauaccacagucuuucg

SEQ ID NO: 2075971 - RNA, 13 nt, Homo sapiens
cuccagacagggu

SEQ ID NO: 2075972 - RNA, 23 nt, Homo sapiens
uaaagugauuccuucuugcucag

SEQ ID NO: 2075973 - RNA, 16 nt, Homo sapiens
cacaguugagugcauc

SEQ ID NO: 2075974 - RNA, 15 nt, Homo sapiens
ucaaaaucuuuccaa

SEQ ID NO: 2075975 - RNA, 23 nt, Homo sapiens
uguuuacauaucaccucauggcc

SEQ ID NO: 2075976 - RNA, 18 nt, Homo sapiens
guuugacacgaagccuua

SEQ ID NO: 2075977 - RNA, 23 nt, Homo sapiens
acuaaggggcaacaaaugcauca

SEQ ID NO: 2075978 - RNA, 23 nt, Homo sapiens
uguuagaaaugcaaauucucaag

SEQ ID NO: 2075979 - RNA, 15 nt, Homo sapiens
cauccugaacagcau

SEQ ID NO: 2075980 - RNA, 20 nt, Homo sapiens
gcuguggggcgggcaugggg

SEQ ID NO: 2075981 - RNA, 15 nt, Homo sapiens
uucuggccucugcug

SEQ ID NO: 2075982 - RNA, 19 nt, Homo sapiens
caagggacaaggacacgcg

SEQ ID NO: 2075983 - RNA, 24 nt, Homo sapiens
cauugcacucuagccuggcaacag

SEQ ID NO: 2075984 - RNA, 23 nt, Homo sapiens
auguauuuacuuuuuauuugcaa

SEQ ID NO: 2075985 - RNA, 16 nt, Homo sapiens
aaacuaaaagacauuu

SEQ ID NO: 2075986 - RNA, 17 nt, Homo sapiens
ugauauugcauaugcau

SEQ ID NO: 2075987 - RNA, 17 nt, Homo sapiens
cccagccucacuccauu

SEQ ID NO: 2075988 - RNA, 14 nt, Homo sapiens
gagugcucugaaga

SEQ ID NO: 2075989 - RNA, 19 nt, Homo sapiens
cuucugcuguauacuguac

SEQ ID NO: 2075990 - RNA, 15 nt, Homo sapiens
uguagcuucucuugc

SEQ ID NO: 2075991 - RNA, 24 nt, Homo sapiens
cauuucccuacccuaaagcgacau

SEQ ID NO: 2075992 - RNA, 12 nt, Homo sapiens
aaaaccagacaa

SEQ ID NO: 2075993 - RNA, 18 nt, Homo sapiens
cauaacugaucuauuuau

SEQ ID NO: 2075994 - RNA, 13 nt, Homo sapiens
ccacacagggugc

SEQ ID NO: 2075995 - RNA, 18 nt, Homo sapiens
aauagugaauaaagucau

SEQ ID NO: 2075996 - RNA, 21 nt, Homo sapiens
acuaacccaaugccugugaag

SEQ ID NO: 2075997 - RNA, 13 nt, Homo sapiens
cuuaaaaauuuau

SEQ ID NO: 2075998 - RNA, 21 nt, Homo sapiens
uuccuggccugagagucagcu

SEQ ID NO: 2075999 - RNA, 20 nt, Homo sapiens
gaaguacagcagaagcccca

SEQ ID NO: 2076000 - RNA, 16 nt, Homo sapiens
ucccauggacacucca

SEQ ID NO: 2076001 - RNA, 11 nt, Homo sapiens
ucaaaugugca

SEQ ID NO: 2076002 - RNA, 14 nt, Homo sapiens
cauacauuaucuca

SEQ ID NO: 2076003 - RNA, 20 nt, Homo sapiens
gcgaggaaaaacaacaaaua

SEQ ID NO: 2076004 - RNA, 21 nt, Homo sapiens
caguguagcccacacuugaga

SEQ ID NO: 2076005 - RNA, 16 nt, Homo sapiens
auaucuucuacaugca

SEQ ID NO: 2076006 - RNA, 18 nt, Homo sapiens
auaccagaugaacauuuc

SEQ ID NO: 2076007 - RNA, 18 nt, Homo sapiens
uccucagguaacagucgu

SEQ ID NO: 2076008 - RNA, 19 nt, Homo sapiens
aauuuaucucuuuaguuag

SEQ ID NO: 2076009 - RNA, 16 nt, Homo sapiens
gcagagaccauaagag

SEQ ID NO: 2076010 - RNA, 12 nt, Homo sapiens
aagggcacucug

SEQ ID NO: 2076011 - RNA, 24 nt, Homo sapiens
uauauguuuugugggaacagaugu

SEQ ID NO: 2076012 - RNA, 16 nt, Homo sapiens
caaagagaugaggaaa

SEQ ID NO: 2076013 - RNA, 23 nt, Homo sapiens
uuccugggaaaggccuccaaagc

SEQ ID NO: 2076014 - RNA, 22 nt, Homo sapiens
ccaagccugggcuugagcugca

SEQ ID NO: 2076015 - RNA, 15 nt, Homo sapiens
uccagcccacacccc

SEQ ID NO: 2076016 - RNA, 18 nt, Homo sapiens
ucaccagcagacacugcc

SEQ ID NO: 2076017 - RNA, 14 nt, Homo sapiens
guucccccacugau

SEQ ID NO: 2076018 - RNA, 13 nt, Homo sapiens
cugcgcagucauu

SEQ ID NO: 2076019 - RNA, 19 nt, Homo sapiens
aagauggcauuucaccaug

SEQ ID NO: 2076020 - RNA, 16 nt, Homo sapiens
cagccuguccaacaga

SEQ ID NO: 2076021 - RNA, 15 nt, Homo sapiens
aaaaaugucaucuca

SEQ ID NO: 2076022 - RNA, 22 nt, Homo sapiens
ccuagcugggccaacuccagug

SEQ ID NO: 2076023 - RNA, 15 nt, Homo sapiens
uaaaauuaguuccau

SEQ ID NO: 2076024 - RNA, 20 nt, Homo sapiens
gccacaggccugagauuuca

SEQ ID NO: 2076025 - RNA, 15 nt, Homo sapiens
cauaauaaaauauca

SEQ ID NO: 2076026 - RNA, 20 nt, Homo sapiens
ggccaaacacccaagcacaa

SEQ ID NO: 2076027 - RNA, 21 nt, Homo sapiens
cuggauaacuuagguggcaag

SEQ ID NO: 2076028 - RNA, 18 nt, Homo sapiens
caguggcgugaucucggc

SEQ ID NO: 2076029 - RNA, 18 nt, Homo sapiens
cuuuuguuccuuuguuaa

SEQ ID NO: 2076030 - RNA, 21 nt, Homo sapiens
ucagguggagagcacuagaag

SEQ ID NO: 2076031 - RNA, 19 nt, Homo sapiens
cauggguggguggggaguc

SEQ ID NO: 2076032 - RNA, 21 nt, Homo sapiens
agaagaggagaaaaaaacuuc

SEQ ID NO: 2076033 - RNA, 17 nt, Homo sapiens
cuuuuauaccuaucuga

SEQ ID NO: 2076034 - RNA, 17 nt, Homo sapiens
uuauaaaaucaaacaga

SEQ ID NO: 2076035 - RNA, 18 nt, Homo sapiens
agcuccagguacauauca

SEQ ID NO: 2076036 - RNA, 17 nt, Homo sapiens
caucucauuaauucaau

SEQ ID NO: 2076037 - RNA, 18 nt, Homo sapiens
augcagauuccucagauu

SEQ ID NO: 2076038 - RNA, 19 nt, Homo sapiens
cuugcuucuaaaugcccag

SEQ ID NO: 2076039 - RNA, 14 nt, Homo sapiens
guuguagcagaaac

SEQ ID NO: 2076040 - RNA, 17 nt, Homo sapiens
aaucuaucacccaggaa

SEQ ID NO: 2076041 - RNA, 21 nt, Homo sapiens
gcaauuaaaggguuaaugugu

SEQ ID NO: 2076042 - RNA, 19 nt, Homo sapiens
auccauucagcaucagaga

SEQ ID NO: 2076043 - RNA, 22 nt, Homo sapiens
aacauacaagagacauauaaug

SEQ ID NO: 2076044 - RNA, 15 nt, Homo sapiens
uugcccagcacuguc

SEQ ID NO: 2076045 - RNA, 20 nt, Homo sapiens
aguggcacugaaguggcccu

SEQ ID NO: 2076046 - RNA, 22 nt, Homo sapiens
aacugccacauacaccacaaaa

SEQ ID NO: 2076047 - RNA, 19 nt, Homo sapiens
agugggcuaggaggacaag

SEQ ID NO: 2076048 - RNA, 14 nt, Homo sapiens
acugccacaucauu

SEQ ID NO: 2076049 - RNA, 15 nt, Homo sapiens
aguaagcaagauuua

SEQ ID NO: 2076050 - RNA, 21 nt, Homo sapiens
uguuuucucuggaaugguaca

SEQ ID NO: 2076051 - RNA, 20 nt, Homo sapiens
auuccgucaccacgacuggc

SEQ ID NO: 2076052 - RNA, 22 nt, Homo sapiens
agggacuuggacaggagucagu

SEQ ID NO: 2076053 - RNA, 13 nt, Homo sapiens
auuagagcuuaaa

SEQ ID NO: 2076054 - RNA, 17 nt, Homo sapiens
gauccuguuacuugcuu

SEQ ID NO: 2076055 - RNA, 20 nt, Homo sapiens
acuggggcuggccccagcca

SEQ ID NO: 2076056 - RNA, 22 nt, Homo sapiens
gcccuuuuaaauggcaugacaa

SEQ ID NO: 2076057 - RNA, 18 nt, Homo sapiens
ugaaggaacauuccuuag

SEQ ID NO: 2076058 - RNA, 22 nt, Homo sapiens
ucuguagacugccaucauugau

SEQ ID NO: 2076059 - RNA, 17 nt, Homo sapiens
agcauuagaauggagga

SEQ ID NO: 2076060 - RNA, 16 nt, Homo sapiens
uacuucuggagucuau

SEQ ID NO: 2076061 - RNA, 18 nt, Homo sapiens
acuagucauagaaauacc

SEQ ID NO: 2076062 - RNA, 18 nt, Homo sapiens
ucuuaucccagugaucac

SEQ ID NO: 2076063 - RNA, 21 nt, Homo sapiens
gcaugcauuuugcagcaguga

SEQ ID NO: 2076064 - RNA, 18 nt, Homo sapiens
cagauuuggaugcacuca

SEQ ID NO: 2076065 - RNA, 13 nt, Homo sapiens
ugauggcacugag

SEQ ID NO: 2076066 - RNA, 21 nt, Homo sapiens
caguguaacgaugcacuuugg

SEQ ID NO: 2076067 - RNA, 18 nt, Homo sapiens
gcacacuuccaccauagc

SEQ ID NO: 2076068 - RNA, 17 nt, Homo sapiens
gaacugucuacccuguu

SEQ ID NO: 2076069 - RNA, 16 nt, Homo sapiens
gccuggcuucaccgca

SEQ ID NO: 2076070 - RNA, 14 nt, Homo sapiens
guugaugccagaca

SEQ ID NO: 2076071 - RNA, 16 nt, Homo sapiens
cagcaguguggucucu

SEQ ID NO: 2076072 - RNA, 22 nt, Homo sapiens
acaaggcgucucuucaaacagu

SEQ ID NO: 2076073 - RNA, 14 nt, Homo sapiens
uguugagacgccuu

SEQ ID NO: 2076074 - RNA, 14 nt, Homo sapiens
ccaccuuucuggac

SEQ ID NO: 2076075 - RNA, 17 nt, Homo sapiens
cccccuuuggcacugga

SEQ ID NO: 2076076 - RNA, 19 nt, Homo sapiens
agauacacagauauauaca

SEQ ID NO: 2076077 - RNA, 12 nt, Homo sapiens
agcuucuacccu

SEQ ID NO: 2076078 - RNA, 18 nt, Homo sapiens
uggaaaucugaacauucu

SEQ ID NO: 2076079 - RNA, 22 nt, Homo sapiens
caccauuuugucaggugggaga

SEQ ID NO: 2076080 - RNA, 23 nt, Homo sapiens
ccaggcuugggcuccauucccau

SEQ ID NO: 2076081 - RNA, 17 nt, Homo sapiens
ccccgugaagcaaucau

SEQ ID NO: 2076082 - RNA, 18 nt, Homo sapiens
cuugcaggguuucucgcc

SEQ ID NO: 2076083 - RNA, 19 nt, Homo sapiens
agcccaggauacuggcaca

SEQ ID NO: 2076084 - RNA, 16 nt, Homo sapiens
aauguuacauuauuau

SEQ ID NO: 2076085 - RNA, 14 nt, Homo sapiens
aaaauuguagcuuu

SEQ ID NO: 2076086 - RNA, 15 nt, Homo sapiens
aauaaauaaaaagcg

SEQ ID NO: 2076087 - RNA, 15 nt, Homo sapiens
aaaagcugaucauaa

SEQ ID NO: 2076088 - RNA, 17 nt, Homo sapiens
cagaagaguuucuuaac

SEQ ID NO: 2076089 - RNA, 16 nt, Homo sapiens
ggcauaaacuugaaaa

SEQ ID NO: 2076090 - RNA, 14 nt, Homo sapiens
aaaauugcuauaaa

SEQ ID NO: 2076091 - RNA, 18 nt, Homo sapiens
uggauauuauucuuguag

SEQ ID NO: 2076092 - RNA, 19 nt, Homo sapiens
cagcccuggcaacugcuaa

SEQ ID NO: 2076093 - RNA, 22 nt, Homo sapiens
uaccacagcucagccacuguga

SEQ ID NO: 2076094 - RNA, 20 nt, Homo sapiens
cagagccugcagggugaccu

SEQ ID NO: 2076095 - RNA, 19 nt, Homo sapiens
agacuggcugaaaaaccua

SEQ ID NO: 2076096 - RNA, 19 nt, Homo sapiens
uccaaaggcuccugagaca

SEQ ID NO: 2076097 - RNA, 14 nt, Homo sapiens
aagaugugcuuaua

SEQ ID NO: 2076098 - RNA, 20 nt, Homo sapiens
uuauaauagcauucauuucc

SEQ ID NO: 2076099 - RNA, 16 nt, Homo sapiens
gaaauaaaaaagucuc

SEQ ID NO: 2076100 - RNA, 15 nt, Homo sapiens
guucugagaccagug

SEQ ID NO: 2076101 - RNA, 23 nt, Homo sapiens
acuucauucagaccagugaaaga

SEQ ID NO: 2076102 - RNA, 16 nt, Homo sapiens
cugaguuccugcaugc

SEQ ID NO: 2076103 - RNA, 22 nt, Homo sapiens
cauugcccccagggcacuucac

SEQ ID NO: 2076104 - RNA, 22 nt, Homo sapiens
uuuguauuuuaagauccagaaa

SEQ ID NO: 2076105 - RNA, 14 nt, Homo sapiens
uugaauacugugaa

SEQ ID NO: 2076106 - RNA, 21 nt, Homo sapiens
cuuauguuucaauaacagcug

SEQ ID NO: 2076107 - RNA, 19 nt, Homo sapiens
agacaucuuugcuuaugaa

SEQ ID NO: 2076108 - RNA, 23 nt, Homo sapiens
cugagugaauguuaacaugcgca

SEQ ID NO: 2076109 - RNA, 22 nt, Homo sapiens
cccauugaaacaaaacauugau

SEQ ID NO: 2076110 - RNA, 22 nt, Homo sapiens
cacaaaacaccaaagaauugua

SEQ ID NO: 2076111 - RNA, 22 nt, Homo sapiens
ugggagucaggaccuccgggga

SEQ ID NO: 2076112 - RNA, 17 nt, Homo sapiens
gccaugacaagaacaaa

SEQ ID NO: 2076113 - RNA, 15 nt, Homo sapiens
cccagggaugcucuu

SEQ ID NO: 2076114 - RNA, 20 nt, Homo sapiens
caacuccugucuaacugcug

SEQ ID NO: 2076115 - RNA, 14 nt, Homo sapiens
ggaacaagcaugau

SEQ ID NO: 2076116 - RNA, 13 nt, Homo sapiens
uaagaaucauugu

SEQ ID NO: 2076117 - RNA, 21 nt, Homo sapiens
ucacugcagccuuucacagga

SEQ ID NO: 2076118 - RNA, 17 nt, Homo sapiens
ugagagcacccacugaa

SEQ ID NO: 2076119 - RNA, 22 nt, Homo sapiens
aaacaaauucaagaaugcagua

SEQ ID NO: 2076120 - RNA, 19 nt, Homo sapiens
cguugcugcguucuuucaa

SEQ ID NO: 2076121 - RNA, 19 nt, Homo sapiens
acacuaaaacuuuccugac

SEQ ID NO: 2076122 - RNA, 18 nt, Homo sapiens
agaaagcacuacaaucau

SEQ ID NO: 2076123 - RNA, 16 nt, Homo sapiens
cuagauuuucuacuuu

SEQ ID NO: 2076124 - RNA, 14 nt, Homo sapiens
ugaacaucccuuau

SEQ ID NO: 2076125 - RNA, 13 nt, Homo sapiens
gccauugaacuca

SEQ ID NO: 2076126 - RNA, 14 nt, Homo sapiens
ggcaccaucugcca

SEQ ID NO: 2076127 - RNA, 20 nt, Homo sapiens
uaaauuaauuugaccaucuc

SEQ ID NO: 2076128 - RNA, 24 nt, Homo sapiens
aacuucuacuucugcccuugccaa

SEQ ID NO: 2076129 - RNA, 16 nt, Homo sapiens
cuucuugaaacagccu

SEQ ID NO: 2076130 - RNA, 16 nt, Homo sapiens
aauaacgauaaaagac

SEQ ID NO: 2076131 - RNA, 23 nt, Homo sapiens
ucuguccucuugccuuuuacuua

SEQ ID NO: 2076132 - RNA, 20 nt, Homo sapiens
uguacaacaaugcuuugaua

SEQ ID NO: 2076133 - RNA, 23 nt, Homo sapiens
cuugaggucugacuuuuggcucc

SEQ ID NO: 2076134 - RNA, 18 nt, Homo sapiens
cucuuagauuauguucaa

SEQ ID NO: 2076135 - RNA, 12 nt, Homo sapiens
cagguagacuuu

SEQ ID NO: 2076136 - RNA, 21 nt, Homo sapiens
gcagcagcaaggaaagcucac

SEQ ID NO: 2076137 - RNA, 22 nt, Homo sapiens
gccauucuuauggccacaagca

SEQ ID NO: 2076138 - RNA, 19 nt, Homo sapiens
gaaaauaaauucagaucaa

SEQ ID NO: 2076139 - RNA, 21 nt, Homo sapiens
acgcaggccacccgggcugcc

SEQ ID NO: 2076140 - RNA, 21 nt, Homo sapiens
uggagcuaauggcgaucaucu

SEQ ID NO: 2076141 - RNA, 15 nt, Homo sapiens
ugccagcagagccag

SEQ ID NO: 2076142 - RNA, 21 nt, Homo sapiens
cauguguucucuauuuugccu

SEQ ID NO: 2076143 - RNA, 19 nt, Homo sapiens
acauggaaaaauccuguca

SEQ ID NO: 2076144 - RNA, 15 nt, Homo sapiens
auuacagucaucugu

SEQ ID NO: 2076145 - RNA, 17 nt, Homo sapiens
auuguuuucaguguaca

SEQ ID NO: 2076146 - RNA, 23 nt, Homo sapiens
acagucuauuugagacuccucag

SEQ ID NO: 2076147 - RNA, 21 nt, Homo sapiens
cugcaagucuccuagaagccc

SEQ ID NO: 2076148 - RNA, 15 nt, Homo sapiens
gggaggcgaugccag

SEQ ID NO: 2076149 - RNA, 19 nt, Homo sapiens
ccuccacuccagcucugag

SEQ ID NO: 2076150 - RNA, 20 nt, Homo sapiens
gccaagaucgcgccacugca

SEQ ID NO: 2076151 - RNA, 15 nt, Homo sapiens
agcuuuccaaugugu

SEQ ID NO: 2076152 - RNA, 23 nt, Homo sapiens
cacagccaacgagacacauugcc

SEQ ID NO: 2076153 - RNA, 18 nt, Homo sapiens
cuguccugaccaucgcac

SEQ ID NO: 2076154 - RNA, 21 nt, Homo sapiens
aagacaaaauuguaagccaga

SEQ ID NO: 2076155 - RNA, 19 nt, Homo sapiens
acaggaaaaagacuaagcc

SEQ ID NO: 2076156 - RNA, 19 nt, Homo sapiens
aagccaagagucaugucaa

SEQ ID NO: 2076157 - RNA, 23 nt, Homo sapiens
ucugaaaggauguggaagagcau

SEQ ID NO: 2076158 - RNA, 19 nt, Homo sapiens
uccagaccauugucuucca

SEQ ID NO: 2076159 - RNA, 15 nt, Homo sapiens
ucucuggucuuccag

SEQ ID NO: 2076160 - RNA, 22 nt, Homo sapiens
aggaacgucugguccuaaccag

SEQ ID NO: 2076161 - RNA, 21 nt, Homo sapiens
gccucaaccucccaagcaguu

SEQ ID NO: 2076162 - RNA, 20 nt, Homo sapiens
caugagggcaggcacauguu

SEQ ID NO: 2076163 - RNA, 16 nt, Homo sapiens
aucuugaauccuucca

SEQ ID NO: 2076164 - RNA, 14 nt, Homo sapiens
auuuuuuaacuuuu

SEQ ID NO: 2076165 - RNA, 17 nt, Homo sapiens
uacaauucagucuucuc

SEQ ID NO: 2076166 - RNA, 18 nt, Homo sapiens
ggucauucuuuugccaca

SEQ ID NO: 2076167 - RNA, 18 nt, Homo sapiens
aggccacacccagaguag

SEQ ID NO: 2076168 - RNA, 18 nt, Homo sapiens
ccaggcugcagugcaaug

SEQ ID NO: 2076169 - RNA, 16 nt, Homo sapiens
agauagcuucacccca

SEQ ID NO: 2076170 - RNA, 18 nt, Homo sapiens
uagucagcuacuucugaa

SEQ ID NO: 2076171 - RNA, 20 nt, Homo sapiens
cagaauccucucagagucau

SEQ ID NO: 2076172 - RNA, 17 nt, Homo sapiens
ccagggaaggcugugca

SEQ ID NO: 2076173 - RNA, 15 nt, Homo sapiens
aggaaguagcacagg

SEQ ID NO: 2076174 - RNA, 17 nt, Homo sapiens
gagaaugccuaggccag

SEQ ID NO: 2076175 - RNA, 23 nt, Homo sapiens
uaguucuagaaaaacaggcacuu

SEQ ID NO: 2076176 - RNA, 15 nt, Homo sapiens
guuauucaacagcaa

SEQ ID NO: 2076177 - RNA, 19 nt, Homo sapiens
aaaaugcaccucauuccag

SEQ ID NO: 2076178 - RNA, 16 nt, Homo sapiens
cucaagcccugagggg

SEQ ID NO: 2076179 - RNA, 19 nt, Homo sapiens
aggccagcuggcagcagag

SEQ ID NO: 2076180 - RNA, 15 nt, Homo sapiens
ucuucugagcaccua

SEQ ID NO: 2076181 - RNA, 23 nt, Homo sapiens
aucuaacagcccugugcagcagc

SEQ ID NO: 2076182 - RNA, 14 nt, Homo sapiens
caggauggacucca

SEQ ID NO: 2076183 - RNA, 14 nt, Homo sapiens
aauauaaaccgugg

SEQ ID NO: 2076184 - RNA, 15 nt, Homo sapiens
gccucaaaucuuccu

SEQ ID NO: 2076185 - RNA, 22 nt, Homo sapiens
cagcaaguuggcaaaacagaca

SEQ ID NO: 2076186 - RNA, 19 nt, Homo sapiens
auagauggguuauuucaac

SEQ ID NO: 2076187 - RNA, 19 nt, Homo sapiens
cauuucuacucucccaugg

SEQ ID NO: 2076188 - RNA, 20 nt, Homo sapiens
acucauaggcuuauuuccaa

SEQ ID NO: 2076189 - RNA, 15 nt, Homo sapiens
agccuccucucccua

SEQ ID NO: 2076190 - RNA, 14 nt, Homo sapiens
ccaguuggcuaggg

SEQ ID NO: 2076191 - RNA, 15 nt, Homo sapiens
ccaauaaaaugccuc

SEQ ID NO: 2076192 - RNA, 15 nt, Homo sapiens
ucccacacuuugaag

SEQ ID NO: 2076193 - RNA, 19 nt, Homo sapiens
gacagggucccugcugugu

SEQ ID NO: 2076194 - RNA, 11 nt, Homo sapiens
accacaggcuu

SEQ ID NO: 2076195 - RNA, 21 nt, Homo sapiens
ugaauucuaccuuuaaggguu

SEQ ID NO: 2076196 - RNA, 17 nt, Homo sapiens
caggcuggagugcagug

SEQ ID NO: 2076197 - RNA, 17 nt, Homo sapiens
caggcuagagugcaaug

SEQ ID NO: 2076198 - RNA, 19 nt, Homo sapiens
agauuuuauucuuauuuca

SEQ ID NO: 2076199 - RNA, 18 nt, Homo sapiens
caggcauagaggcuucuc

SEQ ID NO: 2076200 - RNA, 21 nt, Homo sapiens
auggccgcgucacuucucuga

SEQ ID NO: 2076201 - RNA, 16 nt, Homo sapiens
aacauguuucuuugua

SEQ ID NO: 2076202 - RNA, 15 nt, Homo sapiens
gacgugucucaggag

SEQ ID NO: 2076203 - RNA, 20 nt, Homo sapiens
cuguaaagcuuugugcagau

SEQ ID NO: 2076204 - RNA, 18 nt, Homo sapiens
ugcccaggucccuccuca

SEQ ID NO: 2076205 - RNA, 14 nt, Homo sapiens
agacagagucuuac

SEQ ID NO: 2076206 - RNA, 16 nt, Homo sapiens
auuuuaagaaagagaa

SEQ ID NO: 2076207 - RNA, 19 nt, Homo sapiens
cccucaaccuccuguggaa

SEQ ID NO: 2076208 - RNA, 21 nt, Homo sapiens
auuuguaauuccuuacuguaa

SEQ ID NO: 2076209 - RNA, 19 nt, Homo sapiens
uggccaaauaugcacuuuc

SEQ ID NO: 2076210 - RNA, 16 nt, Homo sapiens
ccugaaugcucuguag

SEQ ID NO: 2076211 - RNA, 16 nt, Homo sapiens
acagacagagaaggca

SEQ ID NO: 2076212 - RNA, 15 nt, Homo sapiens
uaugccuccauuuca

SEQ ID NO: 2076213 - RNA, 18 nt, Homo sapiens
uuugccaccccuguccag

SEQ ID NO: 2076214 - RNA, 14 nt, Homo sapiens
uauucuccuccgag

SEQ ID NO: 2076215 - RNA, 16 nt, Homo sapiens
aacuuacuuaguguua

SEQ ID NO: 2076216 - RNA, 22 nt, Homo sapiens
caggacuguuuuauaaacugcu

SEQ ID NO: 2076217 - RNA, 19 nt, Homo sapiens
acuaaaccauugugcauuc

SEQ ID NO: 2076218 - RNA, 22 nt, Homo sapiens
cacccugggcaaugcagugcag

SEQ ID NO: 2076219 - RNA, 20 nt, Homo sapiens
uuagcauauuuuaaugcagu

SEQ ID NO: 2076220 - RNA, 19 nt, Homo sapiens
uccaagauuuaaaugccau

SEQ ID NO: 2076221 - RNA, 15 nt, Homo sapiens
aaaugcaaucaauuu

SEQ ID NO: 2076222 - RNA, 13 nt, Homo sapiens
cucuccuauguag

SEQ ID NO: 2076223 - RNA, 19 nt, Homo sapiens
ugggaaauuuuucuuucua

SEQ ID NO: 2076224 - RNA, 14 nt, Homo sapiens
cuaaggaaauugag

SEQ ID NO: 2076225 - RNA, 15 nt, Homo sapiens
ugaacccagaaggca

SEQ ID NO: 2076226 - RNA, 14 nt, Homo sapiens
uccaccugcacaaa

SEQ ID NO: 2076227 - RNA, 14 nt, Homo sapiens
ccuaaauguauacc

SEQ ID NO: 2076228 - RNA, 18 nt, Homo sapiens
gccucccaaagugcugag

SEQ ID NO: 2076229 - RNA, 17 nt, Homo sapiens
uugagaugccuguugaa

SEQ ID NO: 2076230 - RNA, 23 nt, Homo sapiens
caaauagaagcuucuugcuccug

SEQ ID NO: 2076231 - RNA, 16 nt, Homo sapiens
gaccaauaaauuugua

SEQ ID NO: 2076232 - RNA, 19 nt, Homo sapiens
cacuggagguugaagccaa

SEQ ID NO: 2076233 - RNA, 13 nt, Homo sapiens
cuacauaccucau

SEQ ID NO: 2076234 - RNA, 17 nt, Homo sapiens
uugcagaguggccuaga

SEQ ID NO: 2076235 - RNA, 22 nt, Homo sapiens
ggcugggguggggguggggaga

SEQ ID NO: 2076236 - RNA, 21 nt, Homo sapiens
cauuucaggugugagauguaa

SEQ ID NO: 2076237 - RNA, 13 nt, Homo sapiens
uuuggcugugaug

SEQ ID NO: 2076238 - RNA, 18 nt, Homo sapiens
gaagccuugcugaacuaa

SEQ ID NO: 2076239 - RNA, 15 nt, Homo sapiens
uuaaaauaguuacaa

SEQ ID NO: 2076240 - RNA, 15 nt, Homo sapiens
gccucacccagauga

SEQ ID NO: 2076241 - RNA, 12 nt, Homo sapiens
cuuuuauuacau

SEQ ID NO: 2076242 - RNA, 11 nt, Homo sapiens
caaagugcuaa

SEQ ID NO: 2076243 - RNA, 11 nt, Homo sapiens
uacagugccac

SEQ ID NO: 2076244 - RNA, 20 nt, Homo sapiens
uaagcauuuucuacacagcg

SEQ ID NO: 2076245 - RNA, 21 nt, Homo sapiens
acgccucacugaaacauggcu

SEQ ID NO: 2076246 - RNA, 23 nt, Homo sapiens
auuacuaguguuuaagucauuuu

SEQ ID NO: 2076247 - RNA, 19 nt, Homo sapiens
gcagacaauaaacccucag

SEQ ID NO: 2076248 - RNA, 13 nt, Homo sapiens
agccuuugaucuu

SEQ ID NO: 2076249 - RNA, 20 nt, Homo sapiens
gucagaggauggccaguguc

SEQ ID NO: 2076250 - RNA, 22 nt, Homo sapiens
ccauguuaugugacuaucuuua

SEQ ID NO: 2076251 - RNA, 15 nt, Homo sapiens
aaaggccagguugcu

SEQ ID NO: 2076252 - RNA, 20 nt, Homo sapiens
uacuucaguauuaaauuaga

SEQ ID NO: 2076253 - RNA, 15 nt, Homo sapiens
gccagccagugccau

SEQ ID NO: 2076254 - RNA, 20 nt, Homo sapiens
caaaugcaugauauuguaug

SEQ ID NO: 2076255 - RNA, 17 nt, Homo sapiens
aaaucugggcacauggg

SEQ ID NO: 2076256 - RNA, 17 nt, Homo sapiens
gccucagggaccaagga

SEQ ID NO: 2076257 - RNA, 20 nt, Homo sapiens
ccuggaaugcauucacucag

SEQ ID NO: 2076258 - RNA, 19 nt, Homo sapiens
auuagugaauuacacucaa

SEQ ID NO: 2076259 - RNA, 23 nt, Homo sapiens
ucuuccaucagcucucugcaaag

SEQ ID NO: 2076260 - RNA, 15 nt, Homo sapiens
cuuaaucacuacugu

SEQ ID NO: 2076261 - RNA, 19 nt, Homo sapiens
ugccuucaaaaugcugcuu

SEQ ID NO: 2076262 - RNA, 18 nt, Homo sapiens
ccagagagcaggggagcu

SEQ ID NO: 2076263 - RNA, 15 nt, Homo sapiens
gaccuacagugcugu

SEQ ID NO: 2076264 - RNA, 16 nt, Homo sapiens
uccuuaccuuuacaua

SEQ ID NO: 2076265 - RNA, 15 nt, Homo sapiens
ugccuuccaccugua

SEQ ID NO: 2076266 - RNA, 21 nt, Homo sapiens
ggacccacuacccuucuccuu

SEQ ID NO: 2076267 - RNA, 18 nt, Homo sapiens
uauuuuaacaaugugccc

SEQ ID NO: 2076268 - RNA, 12 nt, Homo sapiens
gauuacccugag

SEQ ID NO: 2076269 - RNA, 10 nt, Homo sapiens
ggacccugcc

SEQ ID NO: 2076270 - RNA, 18 nt, Homo sapiens
agggauagcgcuguugau

SEQ ID NO: 2076271 - RNA, 12 nt, Homo sapiens
ucuuaagccauc

SEQ ID NO: 2076272 - RNA, 21 nt, Homo sapiens
acauauagcugauaaagccua

SEQ ID NO: 2076273 - RNA, 17 nt, Homo sapiens
aaggaguacuccaagac

SEQ ID NO: 2076274 - RNA, 14 nt, Homo sapiens
gcauagcuggacau

SEQ ID NO: 2076275 - RNA, 16 nt, Homo sapiens
ccaaugcucuccuuaa

SEQ ID NO: 2076276 - RNA, 15 nt, Homo sapiens
gguucuaauaggcca

SEQ ID NO: 2076277 - RNA, 16 nt, Homo sapiens
caaccaggaguaccug

SEQ ID NO: 2076278 - RNA, 16 nt, Homo sapiens
augggccccaggggaa

SEQ ID NO: 2076279 - RNA, 14 nt, Homo sapiens
agccucgaacuccu

SEQ ID NO: 2076280 - RNA, 13 nt, Homo sapiens
ugcuauucuccau

SEQ ID NO: 2076281 - RNA, 15 nt, Homo sapiens
uuggaagaaauaucc

SEQ ID NO: 2076282 - RNA, 21 nt, Homo sapiens
ccccaccuuucucgcuggaau

SEQ ID NO: 2076283 - RNA, 21 nt, Homo sapiens
ggaguuaauuuuauugauaau

SEQ ID NO: 2076284 - RNA, 16 nt, Homo sapiens
uucaacagcucaccaa

SEQ ID NO: 2076285 - RNA, 13 nt, Homo sapiens
auugcuacuauaa

SEQ ID NO: 2076286 - RNA, 22 nt, Homo sapiens
uggacuuguauauuuguacaaa

SEQ ID NO: 2076287 - RNA, 16 nt, Homo sapiens
aagccauagucucucu

SEQ ID NO: 2076288 - RNA, 13 nt, Homo sapiens
ugucucaguuuuc

SEQ ID NO: 2076289 - RNA, 13 nt, Homo sapiens
ucagaaacaguau

SEQ ID NO: 2076290 - RNA, 13 nt, Homo sapiens
acaguaacuguaa

SEQ ID NO: 2076291 - RNA, 21 nt, Homo sapiens
ucugacaagcuggccaaaguc

SEQ ID NO: 2076292 - RNA, 20 nt, Homo sapiens
uauuuuuucuugcaaauacc

SEQ ID NO: 2076293 - RNA, 22 nt, Homo sapiens
uugcaggugacauuugcucuga

SEQ ID NO: 2076294 - RNA, 21 nt, Homo sapiens
uuuguguaucguaaccagcca

SEQ ID NO: 2076295 - RNA, 19 nt, Homo sapiens
uccccagcucucaguaguu

SEQ ID NO: 2076296 - RNA, 12 nt, Homo sapiens
cagaauccagcu

SEQ ID NO: 2076297 - RNA, 15 nt, Homo sapiens
ugccaaccggucacc

SEQ ID NO: 2076298 - RNA, 14 nt, Homo sapiens
uaagugugccaaau

SEQ ID NO: 2076299 - RNA, 17 nt, Homo sapiens
uccaacaccaagcacag

SEQ ID NO: 2076300 - RNA, 14 nt, Homo sapiens
caugaauccagucc

SEQ ID NO: 2076301 - RNA, 14 nt, Homo sapiens
uagcuaacagugaa

SEQ ID NO: 2076302 - RNA, 14 nt, Homo sapiens
gcccuggggagaaa

SEQ ID NO: 2076303 - RNA, 23 nt, Homo sapiens
acgucucucaccuagaccuugcc

SEQ ID NO: 2076304 - RNA, 17 nt, Homo sapiens
gccucugccuuugcacc

SEQ ID NO: 2076305 - RNA, 16 nt, Homo sapiens
caugaguaucaucaga

SEQ ID NO: 2076306 - RNA, 20 nt, Homo sapiens
uugauuuacaagcaucaugg

SEQ ID NO: 2076307 - RNA, 18 nt, Homo sapiens
uucucauuacccacccga

SEQ ID NO: 2076308 - RNA, 12 nt, Homo sapiens
ucucagcacuug

SEQ ID NO: 2076309 - RNA, 12 nt, Homo sapiens
ucacagcacuag

SEQ ID NO: 2076310 - RNA, 20 nt, Homo sapiens
gcuaagaaauagacagucag

SEQ ID NO: 2076311 - RNA, 19 nt, Homo sapiens
auguuuauuuuucuugucu

SEQ ID NO: 2076312 - RNA, 18 nt, Homo sapiens
ccugcagccucacuucua

SEQ ID NO: 2076313 - RNA, 22 nt, Homo sapiens
gucuugaucagacauucagaga

SEQ ID NO: 2076314 - RNA, 17 nt, Homo sapiens
ucugaacugcuugcuac

SEQ ID NO: 2076315 - RNA, 14 nt, Homo sapiens
uccacugugccuuu

SEQ ID NO: 2076316 - RNA, 22 nt, Homo sapiens
aguaacuggugauauaucucaa

SEQ ID NO: 2076317 - RNA, 14 nt, Homo sapiens
caaaacuacugaca

SEQ ID NO: 2076318 - RNA, 23 nt, Homo sapiens
gagcuaugugacucggauggucu

SEQ ID NO: 2076319 - RNA, 19 nt, Homo sapiens
ggcuugggccuaggcugca

SEQ ID NO: 2076320 - RNA, 23 nt, Homo sapiens
aacauggugaaacuccaucucua

SEQ ID NO: 2076321 - RNA, 20 nt, Homo sapiens
ugguuccucaacccucucaa

SEQ ID NO: 2076322 - RNA, 22 nt, Homo sapiens
gaggccugggugugaccugaca

SEQ ID NO: 2076323 - RNA, 18 nt, Homo sapiens
ucuuugaucuggacagaa

SEQ ID NO: 2076324 - RNA, 22 nt, Homo sapiens
guccucaagaagaaaguguuca

SEQ ID NO: 2076325 - RNA, 18 nt, Homo sapiens
uaucacuucacuguucuc

SEQ ID NO: 2076326 - RNA, 22 nt, Homo sapiens
uaaauuauacuggagaagucuu

SEQ ID NO: 2076327 - RNA, 19 nt, Homo sapiens
augucaaccuuuguaagaa

SEQ ID NO: 2076328 - RNA, 19 nt, Homo sapiens
augauagaacuguacuguu

SEQ ID NO: 2076329 - RNA, 21 nt, Homo sapiens
acucuugugaauuauucugau

SEQ ID NO: 2076330 - RNA, 15 nt, Homo sapiens
cuuuccaaagcauuu

SEQ ID NO: 2076331 - RNA, 16 nt, Homo sapiens
cuugaagaauguugau

SEQ ID NO: 2076332 - RNA, 19 nt, Homo sapiens
gguaaagggaggacagcuu

SEQ ID NO: 2076333 - RNA, 19 nt, Homo sapiens
auacucuagaacaugcaca

SEQ ID NO: 2076334 - RNA, 13 nt, Homo sapiens
aagcucauuucau

SEQ ID NO: 2076335 - RNA, 21 nt, Homo sapiens
gcaccgggcuggcugcuugca

SEQ ID NO: 2076336 - RNA, 14 nt, Homo sapiens
gugccuaccuggcc

SEQ ID NO: 2076337 - RNA, 16 nt, Homo sapiens
gggaucccuccuccag

SEQ ID NO: 2076338 - RNA, 20 nt, Homo sapiens
agcccugucuguuugccaca

SEQ ID NO: 2076339 - RNA, 20 nt, Homo sapiens
auguguccaaucggagacaa

SEQ ID NO: 2076340 - RNA, 20 nt, Homo sapiens
uuugaaugagaccuggaaca

SEQ ID NO: 2076341 - RNA, 18 nt, Homo sapiens
cuggucuauauaaccaca

SEQ ID NO: 2076342 - RNA, 14 nt, Homo sapiens
ucuaauaacuagcc

SEQ ID NO: 2076343 - RNA, 14 nt, Homo sapiens
gguuagaagcaagg

SEQ ID NO: 2076344 - RNA, 19 nt, Homo sapiens
cucgcaacccugccuguca

SEQ ID NO: 2076345 - RNA, 14 nt, Homo sapiens
gaaaucaacuugug

SEQ ID NO: 2076346 - RNA, 19 nt, Homo sapiens
ugguuuuugguuacaugga

SEQ ID NO: 2076347 - RNA, 23 nt, Homo sapiens
acccagguuggcgacugcaacag

SEQ ID NO: 2076348 - RNA, 22 nt, Homo sapiens
cccuggggccuagacucuguaa

SEQ ID NO: 2076349 - RNA, 19 nt, Homo sapiens
auaaucaucccuccuugcc

SEQ ID NO: 2076350 - RNA, 22 nt, Homo sapiens
cuaguaccuuuuuuuagaaaca

SEQ ID NO: 2076351 - RNA, 17 nt, Homo sapiens
gaaagaaucucuugaga

SEQ ID NO: 2076352 - RNA, 21 nt, Homo sapiens
accccaagggggcugcugcuc

SEQ ID NO: 2076353 - RNA, 21 nt, Homo sapiens
cuuagcuuaucuuucuuucca

SEQ ID NO: 2076354 - RNA, 12 nt, Homo sapiens
gagucuauguuc

SEQ ID NO: 2076355 - RNA, 20 nt, Homo sapiens
uuaaacauaagcuaaaucau

SEQ ID NO: 2076356 - RNA, 14 nt, Homo sapiens
gaacuaacugccau

SEQ ID NO: 2076357 - RNA, 21 nt, Homo sapiens
cccagcugacgcgacuaucau

SEQ ID NO: 2076358 - RNA, 18 nt, Homo sapiens
cauauauacuugcaagau

SEQ ID NO: 2076359 - RNA, 16 nt, Homo sapiens
cauguacgauucacuc

SEQ ID NO: 2076360 - RNA, 17 nt, Homo sapiens
ugcaggauuucuucaca

SEQ ID NO: 2076361 - RNA, 14 nt, Homo sapiens
uccucuuugcccug

SEQ ID NO: 2076362 - RNA, 18 nt, Homo sapiens
ucaugcuguguaauauca

SEQ ID NO: 2076363 - RNA, 21 nt, Homo sapiens
ggagaacugugcucucccaaa

SEQ ID NO: 2076364 - RNA, 19 nt, Homo sapiens
uggacuuuugcagcuuccu

SEQ ID NO: 2076365 - RNA, 17 nt, Homo sapiens
ggaagacugugcagaag

SEQ ID NO: 2076366 - RNA, 21 nt, Homo sapiens
acucugcacucucauugucaa

SEQ ID NO: 2076367 - RNA, 14 nt, Homo sapiens
uucuuacugcuuaa

SEQ ID NO: 2076368 - RNA, 13 nt, Homo sapiens
ccauuacuguaau

SEQ ID NO: 2076369 - RNA, 14 nt, Homo sapiens
cagauucugugaga

SEQ ID NO: 2076370 - RNA, 22 nt, Homo sapiens
agagccagacugucucaaauaa

SEQ ID NO: 2076371 - RNA, 23 nt, Homo sapiens
ugacacccacucuccugugagau

SEQ ID NO: 2076372 - RNA, 23 nt, Homo sapiens
ucucugccuguacugaagcugaa

SEQ ID NO: 2076373 - RNA, 18 nt, Homo sapiens
cugucgccgcuagucuua

SEQ ID NO: 2076374 - RNA, 21 nt, Homo sapiens
acauucuucaguuuuucacuu

SEQ ID NO: 2076375 - RNA, 17 nt, Homo sapiens
augcuccuuccaacagg

SEQ ID NO: 2076376 - RNA, 19 nt, Homo sapiens
auaggugcucuuccucauc

SEQ ID NO: 2076377 - RNA, 17 nt, Homo sapiens
gauucuaaaacauucuu

SEQ ID NO: 2076378 - RNA, 22 nt, Homo sapiens
aacaaggugcccuuuagccaga

SEQ ID NO: 2076379 - RNA, 19 nt, Homo sapiens
acggcagccucaaccuccc

SEQ ID NO: 2076380 - RNA, 15 nt, Homo sapiens
cuacugguaaccaag

SEQ ID NO: 2076381 - RNA, 18 nt, Homo sapiens
ccaggccugagcaacaaa

SEQ ID NO: 2076382 - RNA, 16 nt, Homo sapiens
cugcuccaacuccaua

SEQ ID NO: 2076383 - RNA, 15 nt, Homo sapiens
acuuuuggcuuguaa

SEQ ID NO: 2076384 - RNA, 16 nt, Homo sapiens
gauuuuuuuaaaguag

SEQ ID NO: 2076385 - RNA, 23 nt, Homo sapiens
aaccccucccuacuguuggaugu

SEQ ID NO: 2076386 - RNA, 16 nt, Homo sapiens
cauagaccuaacugug

SEQ ID NO: 2076387 - RNA, 14 nt, Homo sapiens
cauguucacuguga

SEQ ID NO: 2076388 - RNA, 21 nt, Homo sapiens
ucucagcucacugcaaccucu

SEQ ID NO: 2076389 - RNA, 21 nt, Homo sapiens
gccucccacccuucucaggga

SEQ ID NO: 2076390 - RNA, 15 nt, Homo sapiens
accuuaauauucucc

SEQ ID NO: 2076391 - RNA, 16 nt, Homo sapiens
acuguaacacuguaua

SEQ ID NO: 2076392 - RNA, 15 nt, Homo sapiens
uuaguauaccagaga

SEQ ID NO: 2076393 - RNA, 18 nt, Homo sapiens
agggaaaaucuucacuuu

SEQ ID NO: 2076394 - RNA, 15 nt, Homo sapiens
aguaaugcacucuca

SEQ ID NO: 2076395 - RNA, 22 nt, Homo sapiens
gagacaggagaaacacuugaac

SEQ ID NO: 2076396 - RNA, 18 nt, Homo sapiens
acagaagaucuauauugu

SEQ ID NO: 2076397 - RNA, 13 nt, Homo sapiens
augugucaguuca

SEQ ID NO: 2076398 - RNA, 19 nt, Homo sapiens
cugagauuuuuuuguguau

SEQ ID NO: 2076399 - RNA, 21 nt, Homo sapiens
ucauucagcgcaugcaccuuc

SEQ ID NO: 2076400 - RNA, 13 nt, Homo sapiens
ggcagagcacagc

SEQ ID NO: 2076401 - RNA, 16 nt, Homo sapiens
acugcuuaagugccua

SEQ ID NO: 2076402 - RNA, 22 nt, Homo sapiens
aauaaagucugucaugccaaaa

SEQ ID NO: 2076403 - RNA, 12 nt, Homo sapiens
cuuaaaaacugu

SEQ ID NO: 2076404 - RNA, 16 nt, Homo sapiens
gauggugguauuguga

SEQ ID NO: 2076405 - RNA, 15 nt, Homo sapiens
uaugucaaagcaaca

SEQ ID NO: 2076406 - RNA, 15 nt, Homo sapiens
cucaaaauaugucaa

SEQ ID NO: 2076407 - RNA, 18 nt, Homo sapiens
ugaggcaagagaauuacu

SEQ ID NO: 2076408 - RNA, 23 nt, Homo sapiens
auuaucuuacuugcaaaauggag

SEQ ID NO: 2076409 - RNA, 17 nt, Homo sapiens
ggcucugauucuucauu

SEQ ID NO: 2076410 - RNA, 19 nt, Homo sapiens
aagacugguuuucugccaa

SEQ ID NO: 2076411 - RNA, 20 nt, Homo sapiens
ugccauguggcagaucuaca

SEQ ID NO: 2076412 - RNA, 13 nt, Homo sapiens
ucccaauuauuua

SEQ ID NO: 2076413 - RNA, 14 nt, Homo sapiens
uguuagauuccucu

SEQ ID NO: 2076414 - RNA, 17 nt, Homo sapiens
agaauuugcucgcuaca

SEQ ID NO: 2076415 - RNA, 11 nt, Homo sapiens
gaagugcuaaa

SEQ ID NO: 2076416 - RNA, 23 nt, Homo sapiens
auaugagaauguauuaguacaaa

SEQ ID NO: 2076417 - RNA, 15 nt, Homo sapiens
uuuuuaaaaagcaac

SEQ ID NO: 2076418 - RNA, 20 nt, Homo sapiens
caaugaccccuguaaggggc

SEQ ID NO: 2076419 - RNA, 11 nt, Homo sapiens
aguagcuuugg

SEQ ID NO: 2076420 - RNA, 15 nt, Homo sapiens
auaaaagaaucugau

SEQ ID NO: 2076421 - RNA, 16 nt, Homo sapiens
ccagcaccaccagguc

SEQ ID NO: 2076422 - RNA, 19 nt, Homo sapiens
agccuuagagcucuugugu

SEQ ID NO: 2076423 - RNA, 18 nt, Homo sapiens
aauacaguauuauagaca

SEQ ID NO: 2076424 - RNA, 23 nt, Homo sapiens
agagugcggcgugggggcacuga

SEQ ID NO: 2076425 - RNA, 20 nt, Homo sapiens
gagcuguaucuugauguuua

SEQ ID NO: 2076426 - RNA, 16 nt, Homo sapiens
ucagaucucaugggau

SEQ ID NO: 2076427 - RNA, 19 nt, Homo sapiens
uguaucagucuuucuugag

SEQ ID NO: 2076428 - RNA, 22 nt, Homo sapiens
aaguauaggccaggcacagugg

SEQ ID NO: 2076429 - RNA, 19 nt, Homo sapiens
ugagauguggguauagcuc

SEQ ID NO: 2076430 - RNA, 18 nt, Homo sapiens
uguuucaaaaaaucugac

SEQ ID NO: 2076431 - RNA, 18 nt, Homo sapiens
uuuuauuuuuuaaguuca

SEQ ID NO: 2076432 - RNA, 17 nt, Homo sapiens
uccauucccaacucucu

SEQ ID NO: 2076433 - RNA, 23 nt, Homo sapiens
aucaaccagcaggaaaguacaga

SEQ ID NO: 2076434 - RNA, 16 nt, Homo sapiens
aaguaagagacucagc

SEQ ID NO: 2076435 - RNA, 15 nt, Homo sapiens
agggacagucucacc

SEQ ID NO: 2076436 - RNA, 17 nt, Homo sapiens
ugaauaugauuaguaaa

SEQ ID NO: 2076437 - RNA, 14 nt, Homo sapiens
cucuuccucugcag

SEQ ID NO: 2076438 - RNA, 14 nt, Homo sapiens
ucucauaauuccua

SEQ ID NO: 2076439 - RNA, 13 nt, Homo sapiens
cucccuucugucc

SEQ ID NO: 2076440 - RNA, 14 nt, Homo sapiens
ccacaaugccucuc

SEQ ID NO: 2076441 - RNA, 13 nt, Homo sapiens
aaaauguacucag

SEQ ID NO: 2076442 - RNA, 17 nt, Homo sapiens
auacucuguugccuccu

SEQ ID NO: 2076443 - RNA, 15 nt, Homo sapiens
auaacuuauuugccc

SEQ ID NO: 2076444 - RNA, 18 nt, Homo sapiens
ggaaacuguugccagaga

SEQ ID NO: 2076445 - RNA, 17 nt, Homo sapiens
cagacaagcaacccaaa

SEQ ID NO: 2076446 - RNA, 17 nt, Homo sapiens
gaaggcaaagagaccac

SEQ ID NO: 2076447 - RNA, 16 nt, Homo sapiens
gccuccuucaaaaagc

SEQ ID NO: 2076448 - RNA, 18 nt, Homo sapiens
gcugauggguaguaccug

SEQ ID NO: 2076449 - RNA, 15 nt, Homo sapiens
ucccaucccacugcu

SEQ ID NO: 2076450 - RNA, 22 nt, Homo sapiens
augacgguguuaauuuugcuaa

SEQ ID NO: 2076451 - RNA, 18 nt, Homo sapiens
ugcagccuuucacaggac

SEQ ID NO: 2076452 - RNA, 22 nt, Homo sapiens
auuuccaggaaaaaauaaaaag

SEQ ID NO: 2076453 - RNA, 19 nt, Homo sapiens
ccacaggugcccgccacca

SEQ ID NO: 2076454 - RNA, 16 nt, Homo sapiens
cacuccaucacugaga

SEQ ID NO: 2076455 - RNA, 21 nt, Homo sapiens
gcuguucuucuguucugcaga

SEQ ID NO: 2076456 - RNA, 17 nt, Homo sapiens
caaaggaacacugacau

SEQ ID NO: 2076457 - RNA, 16 nt, Homo sapiens
agagcggucucaggcu

SEQ ID NO: 2076458 - RNA, 22 nt, Homo sapiens
aaacauguuuaucguauuugau

SEQ ID NO: 2076459 - RNA, 17 nt, Homo sapiens
gucagaugaggcccugc

SEQ ID NO: 2076460 - RNA, 23 nt, Homo sapiens
uguaguuuucccugcacuguguc

SEQ ID NO: 2076461 - RNA, 19 nt, Homo sapiens
cccuggaaucagaagcacu

SEQ ID NO: 2076462 - RNA, 13 nt, Homo sapiens
uauuugcaauauu

SEQ ID NO: 2076463 - RNA, 21 nt, Homo sapiens
cuuaauagcuguaguuuuccc

SEQ ID NO: 2076464 - RNA, 16 nt, Homo sapiens
gaagucccuguucuca

SEQ ID NO: 2076465 - RNA, 16 nt, Homo sapiens
guuccuuacugcagaa

SEQ ID NO: 2076466 - RNA, 17 nt, Homo sapiens
gugccuacauguucuca

SEQ ID NO: 2076467 - RNA, 16 nt, Homo sapiens
caaguaaagugcuuaa

SEQ ID NO: 2076468 - RNA, 23 nt, Homo sapiens
aacaauuuggucuuagcuuuaca

SEQ ID NO: 2076469 - RNA, 22 nt, Homo sapiens
ucugacaauauacaagcuuuua

SEQ ID NO: 2076470 - RNA, 20 nt, Homo sapiens
gcuuucuccuguagcacaaa

SEQ ID NO: 2076471 - RNA, 15 nt, Homo sapiens
aagucggaugucaga

SEQ ID NO: 2076472 - RNA, 20 nt, Homo sapiens
cagugaguaaucaauacaga

SEQ ID NO: 2076473 - RNA, 13 nt, Homo sapiens
aaaaugucucagu

SEQ ID NO: 2076474 - RNA, 14 nt, Homo sapiens
gccuccaugcugcc

SEQ ID NO: 2076475 - RNA, 14 nt, Homo sapiens
cacacucaaaagac

SEQ ID NO: 2076476 - RNA, 21 nt, Homo sapiens
aggugccuggggcuggcugca

SEQ ID NO: 2076477 - RNA, 13 nt, Homo sapiens
cucaguacuggug

SEQ ID NO: 2076478 - RNA, 15 nt, Homo sapiens
cauagccuuucccua

SEQ ID NO: 2076479 - RNA, 19 nt, Homo sapiens
cacaucuaacaaagucaag

SEQ ID NO: 2076480 - RNA, 16 nt, Homo sapiens
cuuucuguugucauug

SEQ ID NO: 2076481 - RNA, 17 nt, Homo sapiens
aaauauuuacaguacuu

SEQ ID NO: 2076482 - RNA, 16 nt, Homo sapiens
auauauaaugcaacaa

SEQ ID NO: 2076483 - RNA, 19 nt, Homo sapiens
aucuuauacuguacaauaa

SEQ ID NO: 2076484 - RNA, 19 nt, Homo sapiens
gacugcuaaaugcacugac

SEQ ID NO: 2076485 - RNA, 21 nt, Homo sapiens
gcugugggaaaccucauuguu

SEQ ID NO: 2076486 - RNA, 23 nt, Homo sapiens
gguaggucauucuuuugccacau

SEQ ID NO: 2076487 - RNA, 23 nt, Homo sapiens
agagacuucucccauagcaaaga

SEQ ID NO: 2076488 - RNA, 12 nt, Homo sapiens
agaaaacauuuu

SEQ ID NO: 2076489 - RNA, 12 nt, Homo sapiens
auauaacaugua

SEQ ID NO: 2076490 - RNA, 19 nt, Homo sapiens
uguuguggucugagccaaa

SEQ ID NO: 2076491 - RNA, 12 nt, Homo sapiens
ugugaaagucag

SEQ ID NO: 2076492 - RNA, 13 nt, Homo sapiens
uuggggucaggaa

SEQ ID NO: 2076493 - RNA, 15 nt, Homo sapiens
cuggccagugcccug

SEQ ID NO: 2076494 - RNA, 13 nt, Homo sapiens
ugaaaaucuccau

SEQ ID NO: 2076495 - RNA, 18 nt, Homo sapiens
accuccagcucucaguua

SEQ ID NO: 2076496 - RNA, 17 nt, Homo sapiens
gccugcuggauguggag

SEQ ID NO: 2076497 - RNA, 22 nt, Homo sapiens
guagccauuucuucuguucuac

SEQ ID NO: 2076498 - RNA, 18 nt, Homo sapiens
ugucucaggcucaaguuu

SEQ ID NO: 2076499 - RNA, 21 nt, Homo sapiens
gccccccccuugaaucugcag

SEQ ID NO: 2076500 - RNA, 21 nt, Homo sapiens
cacuucucuccuccacucuga

SEQ ID NO: 2076501 - RNA, 17 nt, Homo sapiens
gacguggugcuucucac

SEQ ID NO: 2076502 - RNA, 16 nt, Homo sapiens
ugucagcaucugacca

SEQ ID NO: 2076503 - RNA, 23 nt, Homo sapiens
ccaggaugcuaaagaugaugaug

SEQ ID NO: 2076504 - RNA, 16 nt, Homo sapiens
aagauauaacauucag

SEQ ID NO: 2076505 - RNA, 20 nt, Homo sapiens
cugcaccaugcugcugggga

SEQ ID NO: 2076506 - RNA, 18 nt, Homo sapiens
uguacguuuugcacauuu

SEQ ID NO: 2076507 - RNA, 22 nt, Homo sapiens
gugaagauuucauggacacuga

SEQ ID NO: 2076508 - RNA, 18 nt, Homo sapiens
accuuuccucucccucag

SEQ ID NO: 2076509 - RNA, 20 nt, Homo sapiens
ucaguuucccuccuucccaa

SEQ ID NO: 2076510 - RNA, 16 nt, Homo sapiens
uuuaagacaaguucaa

SEQ ID NO: 2076511 - RNA, 14 nt, Homo sapiens
agauucuagaugau

SEQ ID NO: 2076512 - RNA, 11 nt, Homo sapiens
acaucaaagag

SEQ ID NO: 2076513 - RNA, 16 nt, Homo sapiens
uggaggaaaacugaga

SEQ ID NO: 2076514 - RNA, 14 nt, Homo sapiens
agaaauacagucuu

SEQ ID NO: 2076515 - RNA, 19 nt, Homo sapiens
uggcccugggagagccaga

SEQ ID NO: 2076516 - RNA, 13 nt, Homo sapiens
ccaggacugugac

SEQ ID NO: 2076517 - RNA, 18 nt, Homo sapiens
cuuaaauuuuaaagccug

SEQ ID NO: 2076518 - RNA, 16 nt, Homo sapiens
ccucccuggaugacau

SEQ ID NO: 2076519 - RNA, 16 nt, Homo sapiens
auauuaagaagcaaua

SEQ ID NO: 2076520 - RNA, 13 nt, Homo sapiens
ccagggaaggugg

SEQ ID NO: 2076521 - RNA, 15 nt, Homo sapiens
gguuggagugcucuu

SEQ ID NO: 2076522 - RNA, 18 nt, Homo sapiens
cccuggaccuugggccua

SEQ ID NO: 2076523 - RNA, 18 nt, Homo sapiens
gagucuucuaauguaaau

SEQ ID NO: 2076524 - RNA, 22 nt, Homo sapiens
ugauuuuaaaauccccaugccu

SEQ ID NO: 2076525 - RNA, 20 nt, Homo sapiens
uuuagaaacuccaaugaaag

SEQ ID NO: 2076526 - RNA, 16 nt, Homo sapiens
auguuuuuucugcaau

SEQ ID NO: 2076527 - RNA, 20 nt, Homo sapiens
ugaaguucuuuuacuguaau

SEQ ID NO: 2076528 - RNA, 20 nt, Homo sapiens
ucucuccagagagcaaacau

SEQ ID NO: 2076529 - RNA, 18 nt, Homo sapiens
gucuauuuaagugcaauu

SEQ ID NO: 2076530 - RNA, 12 nt, Homo sapiens
uacuuugugcau

SEQ ID NO: 2076531 - RNA, 11 nt, Homo sapiens
ccuaaccacua

SEQ ID NO: 2076532 - RNA, 14 nt, Homo sapiens
cucuucuaacucau

SEQ ID NO: 2076533 - RNA, 14 nt, Homo sapiens
augagcucuuccaa

SEQ ID NO: 2076534 - RNA, 17 nt, Homo sapiens
uuuauuacauugcugcc

SEQ ID NO: 2076535 - RNA, 14 nt, Homo sapiens
gucaauuuaugaau

SEQ ID NO: 2076536 - RNA, 15 nt, Homo sapiens
ugaauagauggaauu

SEQ ID NO: 2076537 - RNA, 18 nt, Homo sapiens
auuugcaacagcaaauua

SEQ ID NO: 2076538 - RNA, 19 nt, Homo sapiens
uuagaggaggcaacacuga

SEQ ID NO: 2076539 - RNA, 18 nt, Homo sapiens
gcagggagggcuguggug

SEQ ID NO: 2076540 - RNA, 20 nt, Homo sapiens
gauucccgggcuuaccaggu

SEQ ID NO: 2076541 - RNA, 16 nt, Homo sapiens
caagagguggggacca

SEQ ID NO: 2076542 - RNA, 15 nt, Homo sapiens
uuucagaaaauauua

SEQ ID NO: 2076543 - RNA, 22 nt, Homo sapiens
uuccaccagggccagagcagcu

SEQ ID NO: 2076544 - RNA, 16 nt, Homo sapiens
aaguccacaguggaac

SEQ ID NO: 2076545 - RNA, 20 nt, Homo sapiens
cccugggcagugagugccau

SEQ ID NO: 2076546 - RNA, 22 nt, Homo sapiens
cagucuugcaacagugccaugu

SEQ ID NO: 2076547 - RNA, 22 nt, Homo sapiens
auucagcuuuucauaauaucua

SEQ ID NO: 2076548 - RNA, 12 nt, Homo sapiens
uuucuuccugag

SEQ ID NO: 2076549 - RNA, 19 nt, Homo sapiens
uaaccuccuuuacccucau

SEQ ID NO: 2076550 - RNA, 22 nt, Homo sapiens
guauuaauaugcuacaguacua

SEQ ID NO: 2076551 - RNA, 21 nt, Homo sapiens
uaugaguggcuucugggagau

SEQ ID NO: 2076552 - RNA, 15 nt, Homo sapiens
uggacuacaggacaa

SEQ ID NO: 2076553 - RNA, 15 nt, Homo sapiens
aaaagggaugcugua

SEQ ID NO: 2076554 - RNA, 21 nt, Homo sapiens
cccggggcggcaggaaggggg

SEQ ID NO: 2076555 - RNA, 17 nt, Homo sapiens
cauauuccuuucuauca

SEQ ID NO: 2076556 - RNA, 23 nt, Homo sapiens
uagcaaagauuaaaugugucauu

SEQ ID NO: 2076557 - RNA, 15 nt, Homo sapiens
auuaccgucugugau

SEQ ID NO: 2076558 - RNA, 12 nt, Homo sapiens
cgucaccuccag

SEQ ID NO: 2076559 - RNA, 20 nt, Homo sapiens
aucccacggaaaaugccaau

SEQ ID NO: 2076560 - RNA, 16 nt, Homo sapiens
gcaugugccuguauuc

SEQ ID NO: 2076561 - RNA, 19 nt, Homo sapiens
aggcucuaauguacaauaa

SEQ ID NO: 2076562 - RNA, 18 nt, Homo sapiens
gccauauucacaccucac

SEQ ID NO: 2076563 - RNA, 14 nt, Homo sapiens
acaauuuuccugug

SEQ ID NO: 2076564 - RNA, 18 nt, Homo sapiens
uacucuaaaauggacauu

SEQ ID NO: 2076565 - RNA, 20 nt, Homo sapiens
ggcccugggguaccaugugg

SEQ ID NO: 2076566 - RNA, 18 nt, Homo sapiens
uggaugugcccacaggga

SEQ ID NO: 2076567 - RNA, 16 nt, Homo sapiens
uccuuccaauuuggaa

SEQ ID NO: 2076568 - RNA, 14 nt, Homo sapiens
cuucaucuggaguc

SEQ ID NO: 2076569 - RNA, 14 nt, Homo sapiens
auuuugcugagaug

SEQ ID NO: 2076570 - RNA, 19 nt, Homo sapiens
auauuuuuuucaacugcca

SEQ ID NO: 2076571 - RNA, 20 nt, Homo sapiens
ugaaauuaauuugugaauuu

SEQ ID NO: 2076572 - RNA, 15 nt, Homo sapiens
aaauguucucaugaa

SEQ ID NO: 2076573 - RNA, 15 nt, Homo sapiens
aauuuuucucuuuaa

SEQ ID NO: 2076574 - RNA, 15 nt, Homo sapiens
aguggagacuugcuu

SEQ ID NO: 2076575 - RNA, 15 nt, Homo sapiens
auacagaucaucuug

SEQ ID NO: 2076576 - RNA, 16 nt, Homo sapiens
aagaaguuauauucug

SEQ ID NO: 2076577 - RNA, 14 nt, Homo sapiens
gccagcuucaggug

SEQ ID NO: 2076578 - RNA, 12 nt, Homo sapiens
cugggccagugc

SEQ ID NO: 2076579 - RNA, 14 nt, Homo sapiens
ccuuugcuucauuc

SEQ ID NO: 2076580 - RNA, 15 nt, Homo sapiens
uaauauacagugugu

SEQ ID NO: 2076581 - RNA, 19 nt, Homo sapiens
ugacucuaggcuucagguu

SEQ ID NO: 2076582 - RNA, 20 nt, Homo sapiens
acuugaugacccccaaccaa

SEQ ID NO: 2076583 - RNA, 20 nt, Homo sapiens
augccauuccagcuuccuuc

SEQ ID NO: 2076584 - RNA, 20 nt, Homo sapiens
aaauuuaauuaaagccuuaa

SEQ ID NO: 2076585 - RNA, 15 nt, Homo sapiens
aguugcuugcuaaua

SEQ ID NO: 2076586 - RNA, 14 nt, Homo sapiens
accacucugggcac

SEQ ID NO: 2076587 - RNA, 17 nt, Homo sapiens
cauuccuuacuugcacu

SEQ ID NO: 2076588 - RNA, 13 nt, Homo sapiens
cuuuauguggaaa

SEQ ID NO: 2076589 - RNA, 17 nt, Homo sapiens
uguggaugauaaaacac

SEQ ID NO: 2076590 - RNA, 19 nt, Homo sapiens
gaauaaaaauagaaaccug

SEQ ID NO: 2076591 - RNA, 15 nt, Homo sapiens
cacagugaauccaga

SEQ ID NO: 2076592 - RNA, 12 nt, Homo sapiens
uucaaaugaauu

SEQ ID NO: 2076593 - RNA, 18 nt, Homo sapiens
cucagcuucuucuuucau

SEQ ID NO: 2076594 - RNA, 20 nt, Homo sapiens
ccuguguguccaaaacugcc

SEQ ID NO: 2076595 - RNA, 13 nt, Homo sapiens
uuacagaguaucu

SEQ ID NO: 2076596 - RNA, 15 nt, Homo sapiens
accagagcuguggag

SEQ ID NO: 2076597 - RNA, 17 nt, Homo sapiens
aucuuucauccuugacu

SEQ ID NO: 2076598 - RNA, 13 nt, Homo sapiens
gucaugcacugag

SEQ ID NO: 2076599 - RNA, 21 nt, Homo sapiens
uuaauagaaagauacaaccuu

SEQ ID NO: 2076600 - RNA, 20 nt, Homo sapiens
cuaccacagcaacuauauau

SEQ ID NO: 2076601 - RNA, 17 nt, Homo sapiens
ugaauuugcacuguuua

SEQ ID NO: 2076602 - RNA, 13 nt, Homo sapiens
ugcucugccaucu

SEQ ID NO: 2076603 - RNA, 19 nt, Homo sapiens
cugcccuucccccugcaaa

SEQ ID NO: 2076604 - RNA, 20 nt, Homo sapiens
ggccucagaugaugggguca

SEQ ID NO: 2076605 - RNA, 21 nt, Homo sapiens
acugcucagaacuugcugcug

SEQ ID NO: 2076606 - RNA, 15 nt, Homo sapiens
ucauuucauguauag

SEQ ID NO: 2076607 - RNA, 21 nt, Homo sapiens
cugagauuuuugauaucucaa

SEQ ID NO: 2076608 - RNA, 21 nt, Homo sapiens
gugggaaggucccuuguuucc

SEQ ID NO: 2076609 - RNA, 22 nt, Homo sapiens
caugucuauuuuugaugacuca

SEQ ID NO: 2076610 - RNA, 23 nt, Homo sapiens
ggaaacaauguauugucugccca

SEQ ID NO: 2076611 - RNA, 19 nt, Homo sapiens
gagcugucccaccugcaca

SEQ ID NO: 2076612 - RNA, 15 nt, Homo sapiens
ugguauuaauacugc

SEQ ID NO: 2076613 - RNA, 21 nt, Homo sapiens
uuguagaguggcccagaauug

SEQ ID NO: 2076614 - RNA, 19 nt, Homo sapiens
cucauaauuuauacagguc

SEQ ID NO: 2076615 - RNA, 21 nt, Homo sapiens
cacagcuaugaaggcuguaca

SEQ ID NO: 2076616 - RNA, 23 nt, Homo sapiens
gggccucaggcucugcacagaca

SEQ ID NO: 2076617 - RNA, 16 nt, Homo sapiens
ccacccccagcucaau

SEQ ID NO: 2076618 - RNA, 21 nt, Homo sapiens
aagccccugugacccucucac

SEQ ID NO: 2076619 - RNA, 23 nt, Homo sapiens
ugucuuucaagugaaaccagcuu

SEQ ID NO: 2076620 - RNA, 21 nt, Homo sapiens
uacccugagauacuucccaaa

SEQ ID NO: 2076621 - RNA, 18 nt, Homo sapiens
acaauaugacacuuguaa

SEQ ID NO: 2076622 - RNA, 19 nt, Homo sapiens
cauacuguagaaaccagcu

SEQ ID NO: 2076623 - RNA, 16 nt, Homo sapiens
auggaguguuugacga

SEQ ID NO: 2076624 - RNA, 15 nt, Homo sapiens
gccuuugacauuuaa

SEQ ID NO: 2076625 - RNA, 12 nt, Homo sapiens
agcacacuuuuu

SEQ ID NO: 2076626 - RNA, 17 nt, Homo sapiens
ucacuauggacuuaccc

SEQ ID NO: 2076627 - RNA, 14 nt, Homo sapiens
ugaguugugaugaa

SEQ ID NO: 2076628 - RNA, 13 nt, Homo sapiens
uuuagaacagaaa

SEQ ID NO: 2076629 - RNA, 14 nt, Homo sapiens
aggccaggaccaca

SEQ ID NO: 2076630 - RNA, 21 nt, Homo sapiens
gccugccccugcugcuuggga

SEQ ID NO: 2076631 - RNA, 14 nt, Homo sapiens
aaauauaauugaca

SEQ ID NO: 2076632 - RNA, 14 nt, Homo sapiens
aagaaaaauuaucu

SEQ ID NO: 2076633 - RNA, 16 nt, Homo sapiens
uucucuucaaauuuag

SEQ ID NO: 2076634 - RNA, 16 nt, Homo sapiens
acaauauucaaucaaa

SEQ ID NO: 2076635 - RNA, 19 nt, Homo sapiens
accuccagucccccuaucc

SEQ ID NO: 2076636 - RNA, 22 nt, Homo sapiens
aacucuggacacucuauaugua

SEQ ID NO: 2076637 - RNA, 18 nt, Homo sapiens
cacaguguugcauaugag

SEQ ID NO: 2076638 - RNA, 21 nt, Homo sapiens
aacaacugcauaaccuuuaca

SEQ ID NO: 2076639 - RNA, 15 nt, Homo sapiens
cucauuucaucucau

SEQ ID NO: 2076640 - RNA, 22 nt, Homo sapiens
guguguauauaaauacaugcac

SEQ ID NO: 2076641 - RNA, 19 nt, Homo sapiens
uugccccuggcuuugccuc

SEQ ID NO: 2076642 - RNA, 17 nt, Homo sapiens
cgugccuuccccgugcg

SEQ ID NO: 2076643 - RNA, 17 nt, Homo sapiens
cuuccagcaaaauccaa

SEQ ID NO: 2076644 - RNA, 13 nt, Homo sapiens
uccagcucuaugu

SEQ ID NO: 2076645 - RNA, 13 nt, Homo sapiens
gcaucuagucaag

SEQ ID NO: 2076646 - RNA, 22 nt, Homo sapiens
uuggggggucagggugcugucc

SEQ ID NO: 2076647 - RNA, 22 nt, Homo sapiens
auucccagauuugaagacaaaa

SEQ ID NO: 2076648 - RNA, 18 nt, Homo sapiens
cuuaggauucuguucccu

SEQ ID NO: 2076649 - RNA, 18 nt, Homo sapiens
uagcaccguuugugacag

SEQ ID NO: 2076650 - RNA, 14 nt, Homo sapiens
agcaacguguuaau

SEQ ID NO: 2076651 - RNA, 15 nt, Homo sapiens
gaugaaggggccaga

SEQ ID NO: 2076652 - RNA, 15 nt, Homo sapiens
ggugcagggacccga

SEQ ID NO: 2076653 - RNA, 23 nt, Homo sapiens
ugcucuuuguagcuaacagugaa

SEQ ID NO: 2076654 - RNA, 16 nt, Homo sapiens
ucuaauuaugcaauua

SEQ ID NO: 2076655 - RNA, 16 nt, Homo sapiens
ugucacuccauaaaaa

SEQ ID NO: 2076656 - RNA, 21 nt, Homo sapiens
auuauugugacuucacuguau

SEQ ID NO: 2076657 - RNA, 16 nt, Homo sapiens
ugucuucacaaccucc

SEQ ID NO: 2076658 - RNA, 23 nt, Homo sapiens
cuucucuguaaguaauugccaca

SEQ ID NO: 2076659 - RNA, 13 nt, Homo sapiens
uuuggaaaccaca

SEQ ID NO: 2076660 - RNA, 17 nt, Homo sapiens
agguccugucucugcac

SEQ ID NO: 2076661 - RNA, 20 nt, Homo sapiens
gcuuuggagacgccucccca

SEQ ID NO: 2076662 - RNA, 20 nt, Homo sapiens
augaaaaaaaguacauguau

SEQ ID NO: 2076663 - RNA, 20 nt, Homo sapiens
gcagucacacuguuacucca

SEQ ID NO: 2076664 - RNA, 18 nt, Homo sapiens
auaaacugugugcaacag

SEQ ID NO: 2076665 - RNA, 22 nt, Homo sapiens
cuuuggcacacccucucugucc

SEQ ID NO: 2076666 - RNA, 14 nt, Homo sapiens
ccccucugcugcaa

SEQ ID NO: 2076667 - RNA, 19 nt, Homo sapiens
cgucuccaaggaggugaca

SEQ ID NO: 2076668 - RNA, 19 nt, Homo sapiens
aaaccccagccacuuccug

SEQ ID NO: 2076669 - RNA, 17 nt, Homo sapiens
uacagugccacugcaau

SEQ ID NO: 2076670 - RNA, 12 nt, Homo sapiens
uaacuacauauu

SEQ ID NO: 2076671 - RNA, 22 nt, Homo sapiens
agugucacuuuuuuccugucaa

SEQ ID NO: 2076672 - RNA, 18 nt, Homo sapiens
cacaaaauaaccaauccu

SEQ ID NO: 2076673 - RNA, 18 nt, Homo sapiens
ugccaaauaaacagcuau

SEQ ID NO: 2076674 - RNA, 13 nt, Homo sapiens
cagcuacauuccu

SEQ ID NO: 2076675 - RNA, 16 nt, Homo sapiens
ucuccuuaaacuacca

SEQ ID NO: 2076676 - RNA, 14 nt, Homo sapiens
uugguccucuugcc

SEQ ID NO: 2076677 - RNA, 16 nt, Homo sapiens
aaaaauggauagcuca

SEQ ID NO: 2076678 - RNA, 21 nt, Homo sapiens
ucuguagguugcacacuuugg

SEQ ID NO: 2076679 - RNA, 21 nt, Homo sapiens
auuagaguugugauacagagu

SEQ ID NO: 2076680 - RNA, 19 nt, Homo sapiens
gcucauuuuaggccuccuc

SEQ ID NO: 2076681 - RNA, 17 nt, Homo sapiens
ugaaaaauaagucacuu

SEQ ID NO: 2076682 - RNA, 17 nt, Homo sapiens
uccaaagacugaaggag

SEQ ID NO: 2076683 - RNA, 20 nt, Homo sapiens
gcaaaaaaaaaaauuacauu

SEQ ID NO: 2076684 - RNA, 16 nt, Homo sapiens
ggaagcaaauggcaaa

SEQ ID NO: 2076685 - RNA, 13 nt, Homo sapiens
gaaaaagagccau

SEQ ID NO: 2076686 - RNA, 12 nt, Homo sapiens
uucugcacugaa

SEQ ID NO: 2076687 - RNA, 16 nt, Homo sapiens
gggcaggcaggggcca

SEQ ID NO: 2076688 - RNA, 21 nt, Homo sapiens
uuuccuguguacacgugacag

SEQ ID NO: 2076689 - RNA, 16 nt, Homo sapiens
uuccccucuugucucc

SEQ ID NO: 2076690 - RNA, 22 nt, Homo sapiens
auuuauaugaagcaagcugugu

SEQ ID NO: 2076691 - RNA, 22 nt, Homo sapiens
aaugccuuuuguuuccaggaaa

SEQ ID NO: 2076692 - RNA, 19 nt, Homo sapiens
ggccagggcaaugccauca

SEQ ID NO: 2076693 - RNA, 20 nt, Homo sapiens
uggcacuuuuucacauaagc

SEQ ID NO: 2076694 - RNA, 15 nt, Homo sapiens
aggaauaucacacuc

SEQ ID NO: 2076695 - RNA, 12 nt, Homo sapiens
guggacugugcc

SEQ ID NO: 2076696 - RNA, 22 nt, Homo sapiens
cuccaggcaggucugaagcuca

SEQ ID NO: 2076697 - RNA, 17 nt, Homo sapiens
auguggcacacaauccu

SEQ ID NO: 2076698 - RNA, 12 nt, Homo sapiens
ccccacugacca

SEQ ID NO: 2076699 - RNA, 21 nt, Homo sapiens
guaccauauucagcauuugau

SEQ ID NO: 2076700 - RNA, 17 nt, Homo sapiens
ugagugaucccauuucu

SEQ ID NO: 2076701 - RNA, 16 nt, Homo sapiens
caucauauuguaugua

SEQ ID NO: 2076702 - RNA, 13 nt, Homo sapiens
ucauucaguacuu

SEQ ID NO: 2076703 - RNA, 20 nt, Homo sapiens
aucuggguuaauucauuugg

SEQ ID NO: 2076704 - RNA, 17 nt, Homo sapiens
ugagaaucaugcacuuu

SEQ ID NO: 2076705 - RNA, 16 nt, Homo sapiens
uuuaagauaccuugau

SEQ ID NO: 2076706 - RNA, 17 nt, Homo sapiens
aaaugcucagaccagcu

SEQ ID NO: 2076707 - RNA, 15 nt, Homo sapiens
aauaugaauggagug

SEQ ID NO: 2076708 - RNA, 22 nt, Homo sapiens
ccacagggucugccuccagcca

SEQ ID NO: 2076709 - RNA, 17 nt, Homo sapiens
cuuuguaauauuuucca

SEQ ID NO: 2076710 - RNA, 12 nt, Homo sapiens
aagaaaacugga

SEQ ID NO: 2076711 - RNA, 12 nt, Homo sapiens
aaaaaaacugaa

SEQ ID NO: 2076712 - RNA, 12 nt, Homo sapiens
aaggaaacuggg

SEQ ID NO: 2076713 - RNA, 16 nt, Homo sapiens
aggggcacuucauuga

SEQ ID NO: 2076714 - RNA, 21 nt, Homo sapiens
gaucauauuucacaauccugu

SEQ ID NO: 2076715 - RNA, 16 nt, Homo sapiens
gaaagugaaagcaaau

SEQ ID NO: 2076716 - RNA, 12 nt, Homo sapiens
acuugagacaaa

SEQ ID NO: 2076717 - RNA, 19 nt, Homo sapiens
ccuugggcagaaugaauuc

SEQ ID NO: 2076718 - RNA, 19 nt, Homo sapiens
uauuucacuaaucaugaga

SEQ ID NO: 2076719 - RNA, 17 nt, Homo sapiens
ucccgcuaugauggaag

SEQ ID NO: 2076720 - RNA, 13 nt, Homo sapiens
ggggccacuuuca

SEQ ID NO: 2076721 - RNA, 22 nt, Homo sapiens
auuggcuaaaagacaugcauuu

SEQ ID NO: 2076722 - RNA, 18 nt, Homo sapiens
uggaagacacauugaaag

SEQ ID NO: 2076723 - RNA, 20 nt, Homo sapiens
cuccaagggcaucacugggu

SEQ ID NO: 2076724 - RNA, 20 nt, Homo sapiens
caaggccagcccacacagcc

SEQ ID NO: 2076725 - RNA, 23 nt, Homo sapiens
acagaagugagcuccugccuuag

SEQ ID NO: 2076726 - RNA, 13 nt, Homo sapiens
cuuccuuccagac

SEQ ID NO: 2076727 - RNA, 11 nt, Homo sapiens
gauaucuugga

SEQ ID NO: 2076728 - RNA, 13 nt, Homo sapiens
cagcuguuuaugc

SEQ ID NO: 2076729 - RNA, 13 nt, Homo sapiens
uugguguucuucc

SEQ ID NO: 2076730 - RNA, 21 nt, Homo sapiens
gggacaaaggagccugugaac

SEQ ID NO: 2076731 - RNA, 23 nt, Homo sapiens
acugcaaccucugccucccaggu

SEQ ID NO: 2076732 - RNA, 23 nt, Homo sapiens
gagcuugcuccagauucugaugc

SEQ ID NO: 2076733 - RNA, 13 nt, Homo sapiens
ccaccagugccuc

SEQ ID NO: 2076734 - RNA, 16 nt, Homo sapiens
gaccuuuggagaccau

SEQ ID NO: 2076735 - RNA, 14 nt, Homo sapiens
ugguaauagcugua

SEQ ID NO: 2076736 - RNA, 22 nt, Homo sapiens
agcacucagaaaagaaaaccau

SEQ ID NO: 2076737 - RNA, 17 nt, Homo sapiens
acgcuuguuugccugaa

SEQ ID NO: 2076738 - RNA, 21 nt, Homo sapiens
aaauauuaggagacacaggga

SEQ ID NO: 2076739 - RNA, 18 nt, Homo sapiens
uuagucugucauccagaa

SEQ ID NO: 2076740 - RNA, 15 nt, Homo sapiens
cauucuccugccuca

SEQ ID NO: 2076741 - RNA, 23 nt, Homo sapiens
uguuuuaauccuuaacacauuca

SEQ ID NO: 2076742 - RNA, 21 nt, Homo sapiens
accugcacacgagcagacacc

SEQ ID NO: 2076743 - RNA, 16 nt, Homo sapiens
ggcauuaaagugcugu

SEQ ID NO: 2076744 - RNA, 11 nt, Homo sapiens
cuccucaggcu

SEQ ID NO: 2076745 - RNA, 21 nt, Homo sapiens
cccgaggccuagaguggcagc

SEQ ID NO: 2076746 - RNA, 23 nt, Homo sapiens
aauuaacuccuucaauauuucua

SEQ ID NO: 2076747 - RNA, 15 nt, Homo sapiens
ucuguaucugccaug

SEQ ID NO: 2076748 - RNA, 18 nt, Homo sapiens
augugaaguuuugcaaau

SEQ ID NO: 2076749 - RNA, 21 nt, Homo sapiens
gaaacucauaauagacuuccc

SEQ ID NO: 2076750 - RNA, 17 nt, Homo sapiens
guuauugccucuacuuu

SEQ ID NO: 2076751 - RNA, 17 nt, Homo sapiens
agugccggcugccaaga

SEQ ID NO: 2076752 - RNA, 21 nt, Homo sapiens
aagauaucuuuggauaauguu

SEQ ID NO: 2076753 - RNA, 18 nt, Homo sapiens
gccaucacuagaagaaaa

SEQ ID NO: 2076754 - RNA, 20 nt, Homo sapiens
uuuauuuaguuuuuaacaau

SEQ ID NO: 2076755 - RNA, 17 nt, Homo sapiens
cuuuccuagcacccuau

SEQ ID NO: 2076756 - RNA, 23 nt, Homo sapiens
ccaugacuggcugucugccugua

SEQ ID NO: 2076757 - RNA, 22 nt, Homo sapiens
ucuugaauaaauuugcccaaaa

SEQ ID NO: 2076758 - RNA, 15 nt, Homo sapiens
ucagacguuccauac

SEQ ID NO: 2076759 - RNA, 18 nt, Homo sapiens
gagugauucuugcugcua

SEQ ID NO: 2076760 - RNA, 15 nt, Homo sapiens
gaagcugugucuuua

SEQ ID NO: 2076761 - RNA, 12 nt, Homo sapiens
cuguggugagaa

SEQ ID NO: 2076762 - RNA, 20 nt, Homo sapiens
ugggcaagagaugggacaag

SEQ ID NO: 2076763 - RNA, 22 nt, Homo sapiens
gcccaauugagauccaguuuuu

SEQ ID NO: 2076764 - RNA, 20 nt, Homo sapiens
uguguucacacuguaaacau

SEQ ID NO: 2076765 - RNA, 16 nt, Homo sapiens
gaguuccagggcugcu

SEQ ID NO: 2076766 - RNA, 19 nt, Homo sapiens
gaauuacuccaaaaagaca

SEQ ID NO: 2076767 - RNA, 22 nt, Homo sapiens
guauaacaagccaaacauucuu

SEQ ID NO: 2076768 - RNA, 12 nt, Homo sapiens
cucauuaauuca

SEQ ID NO: 2076769 - RNA, 19 nt, Homo sapiens
acuuuuaugugagauuucc

SEQ ID NO: 2076770 - RNA, 22 nt, Homo sapiens
ugccugagaauuuaauuuuuaa

SEQ ID NO: 2076771 - RNA, 21 nt, Homo sapiens
gccacugggccugucacugau

SEQ ID NO: 2076772 - RNA, 18 nt, Homo sapiens
gaaauugaagugucuucu

SEQ ID NO: 2076773 - RNA, 18 nt, Homo sapiens
guuguuuuauauguugcu

SEQ ID NO: 2076774 - RNA, 21 nt, Homo sapiens
aguuccuucacuuacagaugg

SEQ ID NO: 2076775 - RNA, 19 nt, Homo sapiens
cauaaaucuguuagcauua

SEQ ID NO: 2076776 - RNA, 21 nt, Homo sapiens
aagagaaucaacauuucucaa

SEQ ID NO: 2076777 - RNA, 20 nt, Homo sapiens
aauugcagaguacuggcuga

SEQ ID NO: 2076778 - RNA, 15 nt, Homo sapiens
uuuguugcagccaaa

SEQ ID NO: 2076779 - RNA, 19 nt, Homo sapiens
accacaacugacacaggaa

SEQ ID NO: 2076780 - RNA, 12 nt, Homo sapiens
aauuaaaaucca

SEQ ID NO: 2076781 - RNA, 12 nt, Homo sapiens
acuaaaaauacu

SEQ ID NO: 2076782 - RNA, 13 nt, Homo sapiens
ucuaggguccagu

SEQ ID NO: 2076783 - RNA, 22 nt, Homo sapiens
gauaaagaccuuccagcuccug

SEQ ID NO: 2076784 - RNA, 22 nt, Homo sapiens
auuaguuuaccucauccaugca

SEQ ID NO: 2076785 - RNA, 22 nt, Homo sapiens
augauucauuuuaacaucugag

SEQ ID NO: 2076786 - RNA, 22 nt, Homo sapiens
uuccugaccuccgccauccacc

SEQ ID NO: 2076787 - RNA, 18 nt, Homo sapiens
uguguagucaagucacca

SEQ ID NO: 2076788 - RNA, 18 nt, Homo sapiens
uuggaugagcauggagcu

SEQ ID NO: 2076789 - RNA, 17 nt, Homo sapiens
cacugacuccucacugg

SEQ ID NO: 2076790 - RNA, 23 nt, Homo sapiens
uggccuggggcaggucacuuuac

SEQ ID NO: 2076791 - RNA, 20 nt, Homo sapiens
ggcaaguguaaaaagaugac

SEQ ID NO: 2076792 - RNA, 19 nt, Homo sapiens
aauauauuauuuccuuuau

SEQ ID NO: 2076793 - RNA, 19 nt, Homo sapiens
agcuaucugucaucucucu

SEQ ID NO: 2076794 - RNA, 19 nt, Homo sapiens
ucuuaaacuggaacaugcu

SEQ ID NO: 2076795 - RNA, 16 nt, Homo sapiens
ggaacuugccugccuu

SEQ ID NO: 2076796 - RNA, 22 nt, Homo sapiens
uuugcaucagcaacaaccagca

SEQ ID NO: 2076797 - RNA, 15 nt, Homo sapiens
ucauacagaaggcaa

SEQ ID NO: 2076798 - RNA, 18 nt, Homo sapiens
ggauuccucgaaacugcc

SEQ ID NO: 2076799 - RNA, 18 nt, Homo sapiens
cuaauuaaagaugguuua

SEQ ID NO: 2076800 - RNA, 23 nt, Homo sapiens
uaccaaguuuuauugucaagaca

SEQ ID NO: 2076801 - RNA, 12 nt, Homo sapiens
aagacacuguua

SEQ ID NO: 2076802 - RNA, 11 nt, Homo sapiens
agauugaauau

SEQ ID NO: 2076803 - RNA, 16 nt, Homo sapiens
uaguaugugcauaaug

SEQ ID NO: 2076804 - RNA, 18 nt, Homo sapiens
agaaguuuguagccaggu

SEQ ID NO: 2076805 - RNA, 18 nt, Homo sapiens
cucagacguuccauaccc

SEQ ID NO: 2076806 - RNA, 14 nt, Homo sapiens
cacauggacacaga

SEQ ID NO: 2076807 - RNA, 21 nt, Homo sapiens
caaaauauuuggaaugaagga

SEQ ID NO: 2076808 - RNA, 12 nt, Homo sapiens
caauccuuaaca

SEQ ID NO: 2076809 - RNA, 19 nt, Homo sapiens
auaaaucaaugucacuuaa

SEQ ID NO: 2076810 - RNA, 23 nt, Homo sapiens
agcucuugacagaaagcaguucu

SEQ ID NO: 2076811 - RNA, 21 nt, Homo sapiens
cccuugugucaagacauuucu

SEQ ID NO: 2076812 - RNA, 15 nt, Homo sapiens
gcagacucaccaccu

SEQ ID NO: 2076813 - RNA, 22 nt, Homo sapiens
uagucagaauuagcugcuucua

SEQ ID NO: 2076814 - RNA, 20 nt, Homo sapiens
agguucccacucugggcaaa

SEQ ID NO: 2076815 - RNA, 16 nt, Homo sapiens
agacuguagcuucucu

SEQ ID NO: 2076816 - RNA, 15 nt, Homo sapiens
acugcacacugccug

SEQ ID NO: 2076817 - RNA, 19 nt, Homo sapiens
ccuccgucauccaugcccu

SEQ ID NO: 2076818 - RNA, 14 nt, Homo sapiens
cgucagcugggaca

SEQ ID NO: 2076819 - RNA, 13 nt, Homo sapiens
agauuuacccauc

SEQ ID NO: 2076820 - RNA, 21 nt, Homo sapiens
auaagcucuaguucuuaacaa

SEQ ID NO: 2076821 - RNA, 22 nt, Homo sapiens
acuguauguuuacuucucacca

SEQ ID NO: 2076822 - RNA, 23 nt, Homo sapiens
ugcccugcgaaguggcucucagg

SEQ ID NO: 2076823 - RNA, 13 nt, Homo sapiens
aauacagcacuuu

SEQ ID NO: 2076824 - RNA, 20 nt, Homo sapiens
uuaguccgcaaguucaggga

SEQ ID NO: 2076825 - RNA, 13 nt, Homo sapiens
ggaugugauugcc

SEQ ID NO: 2076826 - RNA, 17 nt, Homo sapiens
agcuucuauugccauga

SEQ ID NO: 2076827 - RNA, 22 nt, Homo sapiens
agguucuugaugucauguacuu

SEQ ID NO: 2076828 - RNA, 21 nt, Homo sapiens
aaaucaucucuuuaaccuaag

SEQ ID NO: 2076829 - RNA, 15 nt, Homo sapiens
cugacccaacacuua

SEQ ID NO: 2076830 - RNA, 20 nt, Homo sapiens
auaucuuuaaauaaauguga

SEQ ID NO: 2076831 - RNA, 21 nt, Homo sapiens
auggaagguuagguuugucaa

SEQ ID NO: 2076832 - RNA, 18 nt, Homo sapiens
aauaaugacaaaugcccu

SEQ ID NO: 2076833 - RNA, 13 nt, Homo sapiens
auauauuuaacua

SEQ ID NO: 2076834 - RNA, 21 nt, Homo sapiens
ccugcccugaggcugugagca

SEQ ID NO: 2076835 - RNA, 19 nt, Homo sapiens
cauuguauuaacgcaaaua

SEQ ID NO: 2076836 - RNA, 23 nt, Homo sapiens
aucaugagcaagugaacacuguu

SEQ ID NO: 2076837 - RNA, 13 nt, Homo sapiens
gggagcugccaag

SEQ ID NO: 2076838 - RNA, 21 nt, Homo sapiens
cagacaggcggggcccagcgc

SEQ ID NO: 2076839 - RNA, 21 nt, Homo sapiens
gugcugggauuacagguguga

SEQ ID NO: 2076840 - RNA, 16 nt, Homo sapiens
agugaggcaggugaca

SEQ ID NO: 2076841 - RNA, 14 nt, Homo sapiens
uucuuauccuuaca

SEQ ID NO: 2076842 - RNA, 15 nt, Homo sapiens
accaacuguacaaaa

SEQ ID NO: 2076843 - RNA, 17 nt, Homo sapiens
aguaagaugcacugaaa

SEQ ID NO: 2076844 - RNA, 20 nt, Homo sapiens
uggagaaaagggauggagcu

SEQ ID NO: 2076845 - RNA, 18 nt, Homo sapiens
uuaccaaagcaagguaca

SEQ ID NO: 2076846 - RNA, 21 nt, Homo sapiens
aaagucaucccucuguucaca

SEQ ID NO: 2076847 - RNA, 19 nt, Homo sapiens
ucccacaggcaccagcaaa

SEQ ID NO: 2076848 - RNA, 13 nt, Homo sapiens
aggacagacuggc

SEQ ID NO: 2076849 - RNA, 13 nt, Homo sapiens
acugcacccagga

SEQ ID NO: 2076850 - RNA, 14 nt, Homo sapiens
caugucugcauuuc

SEQ ID NO: 2076851 - RNA, 14 nt, Homo sapiens
aaggguugcuugcu

SEQ ID NO: 2076852 - RNA, 13 nt, Homo sapiens
ucucagcucccau

SEQ ID NO: 2076853 - RNA, 19 nt, Homo sapiens
gcucuuggcuccacuggga

SEQ ID NO: 2076854 - RNA, 14 nt, Homo sapiens
acaaaaagagcuuu

SEQ ID NO: 2076855 - RNA, 17 nt, Homo sapiens
uuguugaaagaaaguau

SEQ ID NO: 2076856 - RNA, 22 nt, Homo sapiens
ggaugucccaccucucugagcu

SEQ ID NO: 2076857 - RNA, 18 nt, Homo sapiens
aagggcucacgcauucag

SEQ ID NO: 2076858 - RNA, 13 nt, Homo sapiens
auaguguccaggc

SEQ ID NO: 2076859 - RNA, 18 nt, Homo sapiens
ggcugcagggcuggguca

SEQ ID NO: 2076860 - RNA, 19 nt, Homo sapiens
aauacaggggugaaagggg

SEQ ID NO: 2076861 - RNA, 17 nt, Homo sapiens
ccuuccacuuccaucug

SEQ ID NO: 2076862 - RNA, 19 nt, Homo sapiens
ugugauauuuuuacuugca

SEQ ID NO: 2076863 - RNA, 20 nt, Homo sapiens
caaacacaaggucauggcca

SEQ ID NO: 2076864 - RNA, 18 nt, Homo sapiens
cagugugacuuuaucuuc

SEQ ID NO: 2076865 - RNA, 17 nt, Homo sapiens
cagccugggaggcacag

SEQ ID NO: 2076866 - RNA, 19 nt, Homo sapiens
aguuuaccucauccaugca

SEQ ID NO: 2076867 - RNA, 17 nt, Homo sapiens
cauuucuguaaauacca

SEQ ID NO: 2076868 - RNA, 17 nt, Homo sapiens
acuuuucugguuccaaa

SEQ ID NO: 2076869 - RNA, 13 nt, Homo sapiens
uagagaagccaua

SEQ ID NO: 2076870 - RNA, 18 nt, Homo sapiens
aguagagcaaaucuauga

SEQ ID NO: 2076871 - RNA, 14 nt, Homo sapiens
aaguguucauuuua

SEQ ID NO: 2076872 - RNA, 17 nt, Homo sapiens
ucuggcacagccugcac

SEQ ID NO: 2076873 - RNA, 20 nt, Homo sapiens
gcauggcugccaaugggagc

SEQ ID NO: 2076874 - RNA, 14 nt, Homo sapiens
cucuccacacaggu

SEQ ID NO: 2076875 - RNA, 15 nt, Homo sapiens
caucaucuuguucag

SEQ ID NO: 2076876 - RNA, 14 nt, Homo sapiens
cccaucccuaucca

SEQ ID NO: 2076877 - RNA, 13 nt, Homo sapiens
agacccaacaaug

SEQ ID NO: 2076878 - RNA, 17 nt, Homo sapiens
aguauauugauaaccuu

SEQ ID NO: 2076879 - RNA, 15 nt, Homo sapiens
uaaaauggacagaau

SEQ ID NO: 2076880 - RNA, 14 nt, Homo sapiens
uuuauacauaaaca

SEQ ID NO: 2076881 - RNA, 23 nt, Homo sapiens
gucauuaauggcauaugguccua

SEQ ID NO: 2076882 - RNA, 20 nt, Homo sapiens
guuaauaaauuaaaacaugc

SEQ ID NO: 2076883 - RNA, 16 nt, Homo sapiens
aucgaucuguacugua

SEQ ID NO: 2076884 - RNA, 20 nt, Homo sapiens
ggaugguccucuuaccaaca

SEQ ID NO: 2076885 - RNA, 21 nt, Homo sapiens
gugacuaccgugccagcagcg

SEQ ID NO: 2076886 - RNA, 18 nt, Homo sapiens
ccuaucaguuauuaauuu

SEQ ID NO: 2076887 - RNA, 20 nt, Homo sapiens
uugugacaggaaagcccucc

SEQ ID NO: 2076888 - RNA, 17 nt, Homo sapiens
auaaauuaauuugacca

SEQ ID NO: 2076889 - RNA, 22 nt, Homo sapiens
acacaugacgcaccaguuacag

SEQ ID NO: 2076890 - RNA, 24 nt, Homo sapiens
auuuuguaugaaaaaucaauguca

SEQ ID NO: 2076891 - RNA, 15 nt, Homo sapiens
aaauuaaaugcaugu

SEQ ID NO: 2076892 - RNA, 16 nt, Homo sapiens
acauuggcaaguguaa

SEQ ID NO: 2076893 - RNA, 17 nt, Homo sapiens
caacuauuaagauaucu

SEQ ID NO: 2076894 - RNA, 14 nt, Homo sapiens
uguacauacuguau

SEQ ID NO: 2076895 - RNA, 21 nt, Homo sapiens
uggucaaguuuuucucucaaa

SEQ ID NO: 2076896 - RNA, 22 nt, Homo sapiens
agugugaagacccaaaacagcu

SEQ ID NO: 2076897 - RNA, 20 nt, Homo sapiens
gcagggaaggaucccaugag

SEQ ID NO: 2076898 - RNA, 18 nt, Homo sapiens
acugcaccgccucagggu

SEQ ID NO: 2076899 - RNA, 21 nt, Homo sapiens
uuucuuuguaaugaaaaccac

SEQ ID NO: 2076900 - RNA, 12 nt, Homo sapiens
aaaccuccacug

SEQ ID NO: 2076901 - RNA, 20 nt, Homo sapiens
gaaaagaaauuguccuugaa

SEQ ID NO: 2076902 - RNA, 16 nt, Homo sapiens
uguaagccuaguugcu

SEQ ID NO: 2076903 - RNA, 14 nt, Homo sapiens
cauagcuggucuua

SEQ ID NO: 2076904 - RNA, 11 nt, Homo sapiens
aauuucagggu

SEQ ID NO: 2076905 - RNA, 16 nt, Homo sapiens
agccuaacuccauccc

SEQ ID NO: 2076906 - RNA, 13 nt, Homo sapiens
uuauaucugugaa

SEQ ID NO: 2076907 - RNA, 19 nt, Homo sapiens
agccaccacccacaaucac

SEQ ID NO: 2076908 - RNA, 22 nt, Homo sapiens
aaccaucucugugauuaccucu

SEQ ID NO: 2076909 - RNA, 18 nt, Homo sapiens
aaaacacacguagacuga

SEQ ID NO: 2076910 - RNA, 12 nt, Homo sapiens
ucuuucucucag

SEQ ID NO: 2076911 - RNA, 20 nt, Homo sapiens
ucuuccgggagcuggugaca

SEQ ID NO: 2076912 - RNA, 18 nt, Homo sapiens
gaaguugucuccuuccau

SEQ ID NO: 2076913 - RNA, 20 nt, Homo sapiens
caagagcgcaccauugcacu

SEQ ID NO: 2076914 - RNA, 13 nt, Homo sapiens
uaucccuuaccug

SEQ ID NO: 2076915 - RNA, 12 nt, Homo sapiens
gggcucagcaaa

SEQ ID NO: 2076916 - RNA, 22 nt, Homo sapiens
auacaaccuaacuuauggacug

SEQ ID NO: 2076917 - RNA, 19 nt, Homo sapiens
gugcugggugagcucuucc

SEQ ID NO: 2076918 - RNA, 19 nt, Homo sapiens
ccaucugcccggcacuggg

SEQ ID NO: 2076919 - RNA, 14 nt, Homo sapiens
gcuugaacccagga

SEQ ID NO: 2076920 - RNA, 17 nt, Homo sapiens
caaaaaauuagccagau

SEQ ID NO: 2076921 - RNA, 18 nt, Homo sapiens
uaacuccccuguuucaau

SEQ ID NO: 2076922 - RNA, 23 nt, Homo sapiens
ggagaugccacuucucacucacc

SEQ ID NO: 2076923 - RNA, 21 nt, Homo sapiens
cuuuuacccggcacauucccc

SEQ ID NO: 2076924 - RNA, 18 nt, Homo sapiens
cagugcauccuucaucac

SEQ ID NO: 2076925 - RNA, 11 nt, Homo sapiens
gacucaucccc

SEQ ID NO: 2076926 - RNA, 20 nt, Homo sapiens
uucuguaauauuuacaaugu

SEQ ID NO: 2076927 - RNA, 16 nt, Homo sapiens
aaauauauucuuucaa

SEQ ID NO: 2076928 - RNA, 15 nt, Homo sapiens
auguuucagagcuca

SEQ ID NO: 2076929 - RNA, 17 nt, Homo sapiens
uaaaaccugugugccau

SEQ ID NO: 2076930 - RNA, 16 nt, Homo sapiens
agcaauguaacauuaa

SEQ ID NO: 2076931 - RNA, 17 nt, Homo sapiens
ucuuaagagaacauuau

SEQ ID NO: 2076932 - RNA, 18 nt, Homo sapiens
cugauccuccaacagcug

SEQ ID NO: 2076933 - RNA, 16 nt, Homo sapiens
uuguaauugcaugaca

SEQ ID NO: 2076934 - RNA, 22 nt, Homo sapiens
aguaccaccaagggaucugcca

SEQ ID NO: 2076935 - RNA, 18 nt, Homo sapiens
gaagagcagcauuuccca

SEQ ID NO: 2076936 - RNA, 20 nt, Homo sapiens
cucggacuuacugccugacc

SEQ ID NO: 2076937 - RNA, 22 nt, Homo sapiens
auauagaaaaaaaaacccugug

SEQ ID NO: 2076938 - RNA, 18 nt, Homo sapiens
caacaugaaacaccaaga

SEQ ID NO: 2076939 - RNA, 23 nt, Homo sapiens
agaggaggggacccauguaaucc

SEQ ID NO: 2076940 - RNA, 12 nt, Homo sapiens
gguaaauacugg

SEQ ID NO: 2076941 - RNA, 22 nt, Homo sapiens
guuuaaaagcaaaacugcaaau

SEQ ID NO: 2076942 - RNA, 19 nt, Homo sapiens
uggaaaaaaaccacagcca

SEQ ID NO: 2076943 - RNA, 23 nt, Homo sapiens
acuugcugcugagugcaccacuu

SEQ ID NO: 2076944 - RNA, 20 nt, Homo sapiens
ggaagauccugaagcaguuc

SEQ ID NO: 2076945 - RNA, 12 nt, Homo sapiens
guaugauugaca

SEQ ID NO: 2076946 - RNA, 18 nt, Homo sapiens
ucuaacucagaaacauca

SEQ ID NO: 2076947 - RNA, 14 nt, Homo sapiens
guaccacacauauu

SEQ ID NO: 2076948 - RNA, 15 nt, Homo sapiens
ccaggccugagcaac

SEQ ID NO: 2076949 - RNA, 17 nt, Homo sapiens
ggauccguuugaccaau

SEQ ID NO: 2076950 - RNA, 13 nt, Homo sapiens
uuaaaggugccag

SEQ ID NO: 2076951 - RNA, 17 nt, Homo sapiens
accccgcugauggagcc

SEQ ID NO: 2076952 - RNA, 15 nt, Homo sapiens
uacuuuguacaaaga

SEQ ID NO: 2076953 - RNA, 14 nt, Homo sapiens
ccuggacuccagua

SEQ ID NO: 2076954 - RNA, 19 nt, Homo sapiens
cugaaugggacccuguuga

SEQ ID NO: 2076955 - RNA, 15 nt, Homo sapiens
uggcaccucagacaa

SEQ ID NO: 2076956 - RNA, 12 nt, Homo sapiens
guguaguauuua

SEQ ID NO: 2076957 - RNA, 21 nt, Homo sapiens
agccuggcugcccaucaugug

SEQ ID NO: 2076958 - RNA, 21 nt, Homo sapiens
ccugcccugacaugcacaccu

SEQ ID NO: 2076959 - RNA, 23 nt, Homo sapiens
ccagcaacugaauaaauaccucu

SEQ ID NO: 2076960 - RNA, 14 nt, Homo sapiens
augccuguaaucuc

SEQ ID NO: 2076961 - RNA, 21 nt, Homo sapiens
auucaaauuuuaucuccagau

SEQ ID NO: 2076962 - RNA, 19 nt, Homo sapiens
cagaguaucugaagggaau

SEQ ID NO: 2076963 - RNA, 23 nt, Homo sapiens
ucccugucugucugucucucuuu

SEQ ID NO: 2076964 - RNA, 13 nt, Homo sapiens
aauugacacuuaa

SEQ ID NO: 2076965 - RNA, 13 nt, Homo sapiens
ccucuuucccucc

SEQ ID NO: 2076966 - RNA, 22 nt, Homo sapiens
cauuuggagagggggccuggga

SEQ ID NO: 2076967 - RNA, 20 nt, Homo sapiens
gcuuuagguaaaaagcuuaa

SEQ ID NO: 2076968 - RNA, 17 nt, Homo sapiens
aucagccugcuccagcu

SEQ ID NO: 2076969 - RNA, 16 nt, Homo sapiens
augagaagaacacauc

SEQ ID NO: 2076970 - RNA, 11 nt, Homo sapiens
uaugucucagg

SEQ ID NO: 2076971 - RNA, 19 nt, Homo sapiens
agcucuggaggugcugcuc

SEQ ID NO: 2076972 - RNA, 20 nt, Homo sapiens
uuaccagguccauuuugccu

SEQ ID NO: 2076973 - RNA, 13 nt, Homo sapiens
ucauuuugcacug

SEQ ID NO: 2076974 - RNA, 17 nt, Homo sapiens
acucucuccaucagaag

SEQ ID NO: 2076975 - RNA, 18 nt, Homo sapiens
cccaggcccuuggcugca

SEQ ID NO: 2076976 - RNA, 17 nt, Homo sapiens
gugaauaaaagcaucag

SEQ ID NO: 2076977 - RNA, 12 nt, Homo sapiens
agccuccacugc

SEQ ID NO: 2076978 - RNA, 22 nt, Homo sapiens
cugauagcuauaauugggucau

SEQ ID NO: 2076979 - RNA, 15 nt, Homo sapiens
uaaagccagucauca

SEQ ID NO: 2076980 - RNA, 18 nt, Homo sapiens
uagccauguuaacaugac

SEQ ID NO: 2076981 - RNA, 14 nt, Homo sapiens
ccacaaggaccucu

SEQ ID NO: 2076982 - RNA, 16 nt, Homo sapiens
cccuauacuuaggcau

SEQ ID NO: 2076983 - RNA, 15 nt, Homo sapiens
uuuaugaaguuaaca

SEQ ID NO: 2076984 - RNA, 17 nt, Homo sapiens
cuucugacgcagccuga

SEQ ID NO: 2076985 - RNA, 22 nt, Homo sapiens
cauaucauuuuuuuaacacaua

SEQ ID NO: 2076986 - RNA, 13 nt, Homo sapiens
cagcuaaagcaau

SEQ ID NO: 2076987 - RNA, 18 nt, Homo sapiens
caugaaugugagucauua

SEQ ID NO: 2076988 - RNA, 18 nt, Homo sapiens
gccccugccccauuuccu

SEQ ID NO: 2076989 - RNA, 14 nt, Homo sapiens
uuuagaugcauauu

SEQ ID NO: 2076990 - RNA, 15 nt, Homo sapiens
agcugggcaugaacg

SEQ ID NO: 2076991 - RNA, 14 nt, Homo sapiens
gcagcuuuccaguu

SEQ ID NO: 2076992 - RNA, 16 nt, Homo sapiens
gaaauuggaagacuug

SEQ ID NO: 2076993 - RNA, 14 nt, Homo sapiens
cagccagccgugag

SEQ ID NO: 2076994 - RNA, 20 nt, Homo sapiens
ccaugaaugaaccccuggcu

SEQ ID NO: 2076995 - RNA, 17 nt, Homo sapiens
cuauuuaacuugagggu

SEQ ID NO: 2076996 - RNA, 19 nt, Homo sapiens
ggugagugcuugucaugga

SEQ ID NO: 2076997 - RNA, 14 nt, Homo sapiens
gcaucuccaggaag

SEQ ID NO: 2076998 - RNA, 23 nt, Homo sapiens
agggcucuaccuccccugcguca

SEQ ID NO: 2076999 - RNA, 13 nt, Homo sapiens
aggaggagugcau

SEQ ID NO: 2077000 - RNA, 21 nt, Homo sapiens
uugacacucugcagacugcua

SEQ ID NO: 2077001 - RNA, 23 nt, Homo sapiens
uugagcuaggggggucagccagc

SEQ ID NO: 2077002 - RNA, 20 nt, Homo sapiens
auguguuuacauuuacugaa

SEQ ID NO: 2077003 - RNA, 22 nt, Homo sapiens
accaagaagcccaagauaucag

SEQ ID NO: 2077004 - RNA, 21 nt, Homo sapiens
acaguagcauacugaugagac

SEQ ID NO: 2077005 - RNA, 14 nt, Homo sapiens
uucccucaccuguc

SEQ ID NO: 2077006 - RNA, 21 nt, Homo sapiens
auaacuggauugcagacuguu

SEQ ID NO: 2077007 - RNA, 15 nt, Homo sapiens
uauagaagucuucau

SEQ ID NO: 2077008 - RNA, 15 nt, Homo sapiens
uccccucucugcugc

SEQ ID NO: 2077009 - RNA, 19 nt, Homo sapiens
uaagaguguucaacuguga

SEQ ID NO: 2077010 - RNA, 16 nt, Homo sapiens
cugagacggagucuca

SEQ ID NO: 2077011 - RNA, 22 nt, Homo sapiens
agccgcagagacccucucagcc

SEQ ID NO: 2077012 - RNA, 21 nt, Homo sapiens
uuacaagauggagaaacaaca

SEQ ID NO: 2077013 - RNA, 21 nt, Homo sapiens
cucagcaguccacaaagcauu

SEQ ID NO: 2077014 - RNA, 12 nt, Homo sapiens
accuucuguucc

SEQ ID NO: 2077015 - RNA, 15 nt, Homo sapiens
cuuugaagucugauu

SEQ ID NO: 2077016 - RNA, 23 nt, Homo sapiens
gcagcaagguggccacaguguca

SEQ ID NO: 2077017 - RNA, 16 nt, Homo sapiens
ugcauuuccuuucuac

SEQ ID NO: 2077018 - RNA, 17 nt, Homo sapiens
acugcuuuucauuagca

SEQ ID NO: 2077019 - RNA, 20 nt, Homo sapiens
acucacugaaucuaaccaua

SEQ ID NO: 2077020 - RNA, 16 nt, Homo sapiens
cuauuagcuccacaaa

SEQ ID NO: 2077021 - RNA, 20 nt, Homo sapiens
ccauugacaggcacuauucu

SEQ ID NO: 2077022 - RNA, 20 nt, Homo sapiens
gacaggccgggcaguguccc

SEQ ID NO: 2077023 - RNA, 24 nt, Homo sapiens
aguacucaguaaaucagugcagua

SEQ ID NO: 2077024 - RNA, 17 nt, Homo sapiens
uggcacuugcuaacaaa

SEQ ID NO: 2077025 - RNA, 16 nt, Homo sapiens
uggccaacaugaugaa

SEQ ID NO: 2077026 - RNA, 22 nt, Homo sapiens
ucccaaaauuguuuugagcuuu

SEQ ID NO: 2077027 - RNA, 14 nt, Homo sapiens
acuagcuuacugag

SEQ ID NO: 2077028 - RNA, 21 nt, Homo sapiens
aucaaugaagauuuuuaauua

SEQ ID NO: 2077029 - RNA, 16 nt, Homo sapiens
caguuuaauauuccaa

SEQ ID NO: 2077030 - RNA, 14 nt, Homo sapiens
cugcaggagcaguu

SEQ ID NO: 2077031 - RNA, 18 nt, Homo sapiens
aggagaggggcacagggu

SEQ ID NO: 2077032 - RNA, 19 nt, Homo sapiens
ccugccagauaaccaagug

SEQ ID NO: 2077033 - RNA, 21 nt, Homo sapiens
cauguagcccccuggccucug

SEQ ID NO: 2077034 - RNA, 21 nt, Homo sapiens
gcuucuaugaaagacucaaaa

SEQ ID NO: 2077035 - RNA, 18 nt, Homo sapiens
aauacaaagaaccaagaa

SEQ ID NO: 2077036 - RNA, 17 nt, Homo sapiens
aaaugcaacaacaugua

SEQ ID NO: 2077037 - RNA, 23 nt, Homo sapiens
cuucagacguguaugcaaaugag

SEQ ID NO: 2077038 - RNA, 18 nt, Homo sapiens
aauaucaacucucacucc

SEQ ID NO: 2077039 - RNA, 17 nt, Homo sapiens
ccucucuguuuacccuc

SEQ ID NO: 2077040 - RNA, 15 nt, Homo sapiens
uaggcucauacucaa

SEQ ID NO: 2077041 - RNA, 19 nt, Homo sapiens
agacuuuuaacuucaccuu

SEQ ID NO: 2077042 - RNA, 19 nt, Homo sapiens
agcuugauucucagcacuu

SEQ ID NO: 2077043 - RNA, 23 nt, Homo sapiens
ucccugaaacaucucaacaaccu

SEQ ID NO: 2077044 - RNA, 22 nt, Homo sapiens
ggaauccuggcagcccagagac

SEQ ID NO: 2077045 - RNA, 22 nt, Homo sapiens
aaguccugaaguagaugguuga

SEQ ID NO: 2077046 - RNA, 21 nt, Homo sapiens
acugagagcccacugcaguua

SEQ ID NO: 2077047 - RNA, 20 nt, Homo sapiens
gcuccucuccagacacagag

SEQ ID NO: 2077048 - RNA, 21 nt, Homo sapiens
gccuucccaaguugugcuuga

SEQ ID NO: 2077049 - RNA, 15 nt, Homo sapiens
uauuuguccucaugu

SEQ ID NO: 2077050 - RNA, 12 nt, Homo sapiens
caaagucauccc

SEQ ID NO: 2077051 - RNA, 16 nt, Homo sapiens
uaaagagccaguuuau

SEQ ID NO: 2077052 - RNA, 16 nt, Homo sapiens
uacaugcccaucccag

SEQ ID NO: 2077053 - RNA, 22 nt, Homo sapiens
gagcccaagugccaucccacau

SEQ ID NO: 2077054 - RNA, 14 nt, Homo sapiens
aagcugaggcugcu

SEQ ID NO: 2077055 - RNA, 23 nt, Homo sapiens
augguuauuccccccuacuugag

SEQ ID NO: 2077056 - RNA, 21 nt, Homo sapiens
ucauuucucaaaaaccacagu

SEQ ID NO: 2077057 - RNA, 14 nt, Homo sapiens
uccucaaagggaga

SEQ ID NO: 2077058 - RNA, 18 nt, Homo sapiens
uuaaaauguauaccaagg

SEQ ID NO: 2077059 - RNA, 21 nt, Homo sapiens
gacuagaaaaucugaguuuua

SEQ ID NO: 2077060 - RNA, 18 nt, Homo sapiens
cagaaugaaaacuguaaa

SEQ ID NO: 2077061 - RNA, 17 nt, Homo sapiens
gaagauuagagguuugu

SEQ ID NO: 2077062 - RNA, 24 nt, Homo sapiens
cuguuugucuauaugucuagcuca

SEQ ID NO: 2077063 - RNA, 19 nt, Homo sapiens
cucauuugucacacacuuu

SEQ ID NO: 2077064 - RNA, 18 nt, Homo sapiens
aguguaccugccauaaca

SEQ ID NO: 2077065 - RNA, 22 nt, Homo sapiens
aauaaugaguuagaacuauuaa

SEQ ID NO: 2077066 - RNA, 14 nt, Homo sapiens
cacugacacaaaag

SEQ ID NO: 2077067 - RNA, 17 nt, Homo sapiens
aacuaugugggucugug

SEQ ID NO: 2077068 - RNA, 17 nt, Homo sapiens
uggcccagggaagccaa

SEQ ID NO: 2077069 - RNA, 17 nt, Homo sapiens
cagaguuggagacucag

SEQ ID NO: 2077070 - RNA, 13 nt, Homo sapiens
aaacuuuuuccac

SEQ ID NO: 2077071 - RNA, 18 nt, Homo sapiens
ugcccaagcuggagugaa

SEQ ID NO: 2077072 - RNA, 14 nt, Homo sapiens
ggaacucuccuuug

SEQ ID NO: 2077073 - RNA, 19 nt, Homo sapiens
gccuaaaauauauuccuga

SEQ ID NO: 2077074 - RNA, 13 nt, Homo sapiens
uacugucgcaucu

SEQ ID NO: 2077075 - RNA, 17 nt, Homo sapiens
ucacauuaucaucugaa

SEQ ID NO: 2077076 - RNA, 22 nt, Homo sapiens
auaaggaguugccgcauauuau

SEQ ID NO: 2077077 - RNA, 16 nt, Homo sapiens
gggcgagaaacaagac

SEQ ID NO: 2077078 - RNA, 16 nt, Homo sapiens
ggccaaggacagggug

SEQ ID NO: 2077079 - RNA, 23 nt, Homo sapiens
aucauucagaaugugcaaagcag

SEQ ID NO: 2077080 - RNA, 17 nt, Homo sapiens
aaaaucugggcacaugg

SEQ ID NO: 2077081 - RNA, 16 nt, Homo sapiens
auuucucucagauuuc

SEQ ID NO: 2077082 - RNA, 12 nt, Homo sapiens
aauucacuuuag

SEQ ID NO: 2077083 - RNA, 12 nt, Homo sapiens
uuugcaggugcu

SEQ ID NO: 2077084 - RNA, 12 nt, Homo sapiens
uaaucacuauug

SEQ ID NO: 2077085 - RNA, 12 nt, Homo sapiens
ggcucaggguug

SEQ ID NO: 2077086 - RNA, 23 nt, Homo sapiens
uuauugaauaacgcacaguauuu

SEQ ID NO: 2077087 - RNA, 21 nt, Homo sapiens
aucucuaauuagucuaucaaa

SEQ ID NO: 2077088 - RNA, 20 nt, Homo sapiens
cacacuccacucugauucac

SEQ ID NO: 2077089 - RNA, 13 nt, Homo sapiens
acaacagugaaaa

SEQ ID NO: 2077090 - RNA, 15 nt, Homo sapiens
caccaaagucaggga

SEQ ID NO: 2077091 - RNA, 21 nt, Homo sapiens
uugccugggggcuuuugccac

SEQ ID NO: 2077092 - RNA, 21 nt, Homo sapiens
cuggcauuacaauugcaguuu

SEQ ID NO: 2077093 - RNA, 19 nt, Homo sapiens
cauugaagccgacucuggc

SEQ ID NO: 2077094 - RNA, 18 nt, Homo sapiens
cagguuaagacaaagggu

SEQ ID NO: 2077095 - RNA, 22 nt, Homo sapiens
caccccuccaugauuccaaggg

SEQ ID NO: 2077096 - RNA, 16 nt, Homo sapiens
gaagaguuauaaagua

SEQ ID NO: 2077097 - RNA, 22 nt, Homo sapiens
ugucaguauuucaacugcugua

SEQ ID NO: 2077098 - RNA, 16 nt, Homo sapiens
cuggauuccuuuggaa

SEQ ID NO: 2077099 - RNA, 12 nt, Homo sapiens
gggcgccaaguc

SEQ ID NO: 2077100 - RNA, 19 nt, Homo sapiens
gcaaugggguccacuuccc

SEQ ID NO: 2077101 - RNA, 17 nt, Homo sapiens
gaggguggcugccuccu

SEQ ID NO: 2077102 - RNA, 22 nt, Homo sapiens
uugaaaugaguaaaaacuagaa

SEQ ID NO: 2077103 - RNA, 20 nt, Homo sapiens
gugcugggauuacaggugua

SEQ ID NO: 2077104 - RNA, 19 nt, Homo sapiens
gucuggaggggcauggcca

SEQ ID NO: 2077105 - RNA, 23 nt, Homo sapiens
aguggcucacgccuaugauccca

SEQ ID NO: 2077106 - RNA, 23 nt, Homo sapiens
cccauuuguugcugcugcugcuc

SEQ ID NO: 2077107 - RNA, 21 nt, Homo sapiens
uaccaaguuucauaccaaaua

SEQ ID NO: 2077108 - RNA, 22 nt, Homo sapiens
uugaauggagcuggugagauca

SEQ ID NO: 2077109 - RNA, 13 nt, Homo sapiens
cugcagcaaacac

SEQ ID NO: 2077110 - RNA, 20 nt, Homo sapiens
ccuaaucacaugugcugcaa

SEQ ID NO: 2077111 - RNA, 21 nt, Homo sapiens
ccagugcuaagcugcccugag

SEQ ID NO: 2077112 - RNA, 22 nt, Homo sapiens
ccuccagcacgcgacuucucag

SEQ ID NO: 2077113 - RNA, 19 nt, Homo sapiens
uucacaucagaacagacaa

SEQ ID NO: 2077114 - RNA, 19 nt, Homo sapiens
uccaccccgacugcucagu

SEQ ID NO: 2077115 - RNA, 18 nt, Homo sapiens
aggcauugagggcucuaa

SEQ ID NO: 2077116 - RNA, 19 nt, Homo sapiens
agagagcggcugguucauu

SEQ ID NO: 2077117 - RNA, 22 nt, Homo sapiens
uacagugaagcaacagcuuugc

SEQ ID NO: 2077118 - RNA, 16 nt, Homo sapiens
acauuugcaccacuug

SEQ ID NO: 2077119 - RNA, 14 nt, Homo sapiens
caaugaugaaauau

SEQ ID NO: 2077120 - RNA, 14 nt, Homo sapiens
aaucaagauguuca

SEQ ID NO: 2077121 - RNA, 19 nt, Homo sapiens
auuuauggauuuaugacau

SEQ ID NO: 2077122 - RNA, 22 nt, Homo sapiens
uguucauuuugucacaagcugu

SEQ ID NO: 2077123 - RNA, 21 nt, Homo sapiens
gcugcacccuguauggagcua

SEQ ID NO: 2077124 - RNA, 15 nt, Homo sapiens
gcugaagaaaccugg

SEQ ID NO: 2077125 - RNA, 20 nt, Homo sapiens
cagcugguccugaccaggau

SEQ ID NO: 2077126 - RNA, 17 nt, Homo sapiens
acccgcccgagggaugg

SEQ ID NO: 2077127 - RNA, 15 nt, Homo sapiens
cuaugacacugagca

SEQ ID NO: 2077128 - RNA, 13 nt, Homo sapiens
ccuccgucuuccu

SEQ ID NO: 2077129 - RNA, 12 nt, Homo sapiens
uccauguacuug

SEQ ID NO: 2077130 - RNA, 15 nt, Homo sapiens
gccagguguggaaca

SEQ ID NO: 2077131 - RNA, 13 nt, Homo sapiens
aaaaaacuuggca

SEQ ID NO: 2077132 - RNA, 18 nt, Homo sapiens
aggacgcacccccacugc

SEQ ID NO: 2077133 - RNA, 12 nt, Homo sapiens
gagaguccugug

SEQ ID NO: 2077134 - RNA, 23 nt, Homo sapiens
ccaguccaucucaagugccauau

SEQ ID NO: 2077135 - RNA, 17 nt, Homo sapiens
agcagauggacuugaaa

SEQ ID NO: 2077136 - RNA, 19 nt, Homo sapiens
gguuggccaggcacggugg

SEQ ID NO: 2077137 - RNA, 13 nt, Homo sapiens
cccuccuucaucc

SEQ ID NO: 2077138 - RNA, 12 nt, Homo sapiens
acugcuuugaca

SEQ ID NO: 2077139 - RNA, 11 nt, Homo sapiens
uguuacacugu

SEQ ID NO: 2077140 - RNA, 16 nt, Homo sapiens
ugugcaccaauuauca

SEQ ID NO: 2077141 - RNA, 16 nt, Homo sapiens
ggcuagguccagaucc

SEQ ID NO: 2077142 - RNA, 19 nt, Homo sapiens
uucuuuuguaagugcuaca

SEQ ID NO: 2077143 - RNA, 16 nt, Homo sapiens
gaggcucuugcucaag

SEQ ID NO: 2077144 - RNA, 14 nt, Homo sapiens
gucuuuuuguuaug

SEQ ID NO: 2077145 - RNA, 19 nt, Homo sapiens
uguccuuuuucacuuugaa

SEQ ID NO: 2077146 - RNA, 21 nt, Homo sapiens
uuuaggucaguagacugugau

SEQ ID NO: 2077147 - RNA, 13 nt, Homo sapiens
aaaagaugccguu

SEQ ID NO: 2077148 - RNA, 14 nt, Homo sapiens
cuuugugaaucuga

SEQ ID NO: 2077149 - RNA, 19 nt, Homo sapiens
caaugcacauccauuccca

SEQ ID NO: 2077150 - RNA, 14 nt, Homo sapiens
agcaaaaugccaaa

SEQ ID NO: 2077151 - RNA, 13 nt, Homo sapiens
uggggccucaggc

SEQ ID NO: 2077152 - RNA, 17 nt, Homo sapiens
aggaggcccacuguguc

SEQ ID NO: 2077153 - RNA, 18 nt, Homo sapiens
uucuuuuucguuggugua

SEQ ID NO: 2077154 - RNA, 19 nt, Homo sapiens
aucuuguaaauaaagacau

SEQ ID NO: 2077155 - RNA, 21 nt, Homo sapiens
uaaaaacuguuuaccacuguu

SEQ ID NO: 2077156 - RNA, 15 nt, Homo sapiens
uguaaagcaggugcc

SEQ ID NO: 2077157 - RNA, 20 nt, Homo sapiens
uggcacauuuuucucuuguu

SEQ ID NO: 2077158 - RNA, 10 nt, Homo sapiens
aacaaugccc

SEQ ID NO: 2077159 - RNA, 13 nt, Homo sapiens
gaauaaaauauga

SEQ ID NO: 2077160 - RNA, 23 nt, Homo sapiens
uuauauuacuugccuaucugacu

SEQ ID NO: 2077161 - RNA, 16 nt, Homo sapiens
ucccacaaaagacaga

SEQ ID NO: 2077162 - RNA, 15 nt, Homo sapiens
cuggucagaugauau

SEQ ID NO: 2077163 - RNA, 15 nt, Homo sapiens
gauuaaagauugcuu

SEQ ID NO: 2077164 - RNA, 22 nt, Homo sapiens
ugggggcagggcaugacuuugu

SEQ ID NO: 2077165 - RNA, 20 nt, Homo sapiens
aagaaguuguaguguuauca

SEQ ID NO: 2077166 - RNA, 22 nt, Homo sapiens
guaaauucuagcuuagucuaca

SEQ ID NO: 2077167 - RNA, 20 nt, Homo sapiens
gaugcagagcuuucaaggau

SEQ ID NO: 2077168 - RNA, 15 nt, Homo sapiens
ugcucuuuugcacaa

SEQ ID NO: 2077169 - RNA, 15 nt, Homo sapiens
accaguuuaccugaa

SEQ ID NO: 2077170 - RNA, 15 nt, Homo sapiens
guaaauuuguauaaa

SEQ ID NO: 2077171 - RNA, 13 nt, Homo sapiens
ucuuagucuuacc

SEQ ID NO: 2077172 - RNA, 15 nt, Homo sapiens
aauuuaacugcuuaa

SEQ ID NO: 2077173 - RNA, 11 nt, Homo sapiens
ugacugaugac

SEQ ID NO: 2077174 - RNA, 23 nt, Homo sapiens
agaggcuuauucaguucuuacac

SEQ ID NO: 2077175 - RNA, 21 nt, Homo sapiens
uuauucuuuccuucuuucauu

SEQ ID NO: 2077176 - RNA, 16 nt, Homo sapiens
aucuauaaacacuguu

SEQ ID NO: 2077177 - RNA, 23 nt, Homo sapiens
uccaacaucccuuauaccacugu

SEQ ID NO: 2077178 - RNA, 22 nt, Homo sapiens
cugggagccagugugcccaaaa

SEQ ID NO: 2077179 - RNA, 21 nt, Homo sapiens
uacugcaagguucaacuuauu

SEQ ID NO: 2077180 - RNA, 16 nt, Homo sapiens
cuugguacaagcuccu

SEQ ID NO: 2077181 - RNA, 20 nt, Homo sapiens
gcagugcuuuucacuacuuu

SEQ ID NO: 2077182 - RNA, 14 nt, Homo sapiens
uuccaguacuuccu

SEQ ID NO: 2077183 - RNA, 18 nt, Homo sapiens
caauugucuuaaaaccag

SEQ ID NO: 2077184 - RNA, 20 nt, Homo sapiens
gaguggcucacccuguccag

SEQ ID NO: 2077185 - RNA, 18 nt, Homo sapiens
cuaaaaguucucaaugua

SEQ ID NO: 2077186 - RNA, 12 nt, Homo sapiens
gacacugcagcc

SEQ ID NO: 2077187 - RNA, 16 nt, Homo sapiens
uccaacuccugguuca

SEQ ID NO: 2077188 - RNA, 16 nt, Homo sapiens
auuggcagcacccacu

SEQ ID NO: 2077189 - RNA, 17 nt, Homo sapiens
aauuacuauuuacuuua

SEQ ID NO: 2077190 - RNA, 17 nt, Homo sapiens
aauucccuuuuaaucaa

SEQ ID NO: 2077191 - RNA, 18 nt, Homo sapiens
ucauuaggcuuacguacu

SEQ ID NO: 2077192 - RNA, 15 nt, Homo sapiens
auuucaccaagccaa

SEQ ID NO: 2077193 - RNA, 14 nt, Homo sapiens
cugcuaauccugag

SEQ ID NO: 2077194 - RNA, 23 nt, Homo sapiens
caaacagccccucuggacacagc

SEQ ID NO: 2077195 - RNA, 19 nt, Homo sapiens
cauuccugugcggacagcc

SEQ ID NO: 2077196 - RNA, 14 nt, Homo sapiens
acugccagugcaga

SEQ ID NO: 2077197 - RNA, 13 nt, Homo sapiens
cuuuaacucuuau

SEQ ID NO: 2077198 - RNA, 13 nt, Homo sapiens
uuguuacuuugaa

SEQ ID NO: 2077199 - RNA, 13 nt, Homo sapiens
uuaaaaucuguca

SEQ ID NO: 2077200 - RNA, 14 nt, Homo sapiens
gaguggcacguuua

SEQ ID NO: 2077201 - RNA, 17 nt, Homo sapiens
auacucuucaaggacuu

SEQ ID NO: 2077202 - RNA, 14 nt, Homo sapiens
guuauagcuucagg

SEQ ID NO: 2077203 - RNA, 13 nt, Homo sapiens
ucaaauauugaau

SEQ ID NO: 2077204 - RNA, 13 nt, Homo sapiens
augaaauacuuaa

SEQ ID NO: 2077205 - RNA, 19 nt, Homo sapiens
gccuucagaucuugguguu

SEQ ID NO: 2077206 - RNA, 19 nt, Homo sapiens
agggcacuaaacucagauu

SEQ ID NO: 2077207 - RNA, 14 nt, Homo sapiens
ugagaacaccagag

SEQ ID NO: 2077208 - RNA, 18 nt, Homo sapiens
gaagagauacccacagag

SEQ ID NO: 2077209 - RNA, 23 nt, Homo sapiens
auugcaacccagggcaaauggaa

SEQ ID NO: 2077210 - RNA, 18 nt, Homo sapiens
uuuccuuuguaaguuccu

SEQ ID NO: 2077211 - RNA, 21 nt, Homo sapiens
uggcaaaggucccugagcucu

SEQ ID NO: 2077212 - RNA, 16 nt, Homo sapiens
ggcucgaccucgcugc

SEQ ID NO: 2077213 - RNA, 18 nt, Homo sapiens
auauaaauucugauuuaa

SEQ ID NO: 2077214 - RNA, 21 nt, Homo sapiens
uucccauuacuuuaauacuca

SEQ ID NO: 2077215 - RNA, 21 nt, Homo sapiens
aggcaucauuccaccauggcu

SEQ ID NO: 2077216 - RNA, 15 nt, Homo sapiens
cucaaugccaguaac

SEQ ID NO: 2077217 - RNA, 14 nt, Homo sapiens
auauguaacauguc

SEQ ID NO: 2077218 - RNA, 20 nt, Homo sapiens
accacagcugccuccgggcc

SEQ ID NO: 2077219 - RNA, 14 nt, Homo sapiens
accacucaagacca

SEQ ID NO: 2077220 - RNA, 17 nt, Homo sapiens
uuaaaagagaagcauca

SEQ ID NO: 2077221 - RNA, 13 nt, Homo sapiens
cuucuucuucuag

SEQ ID NO: 2077222 - RNA, 20 nt, Homo sapiens
agcucuuucuucuuugaauu

SEQ ID NO: 2077223 - RNA, 10 nt, Homo sapiens
cagagccauc

SEQ ID NO: 2077224 - RNA, 14 nt, Homo sapiens
aacaauaagaacaa

SEQ ID NO: 2077225 - RNA, 16 nt, Homo sapiens
acaugcuugcauuaua

SEQ ID NO: 2077226 - RNA, 13 nt, Homo sapiens
aacaccuaugcaa

SEQ ID NO: 2077227 - RNA, 14 nt, Homo sapiens
cuaguguugcuugg

SEQ ID NO: 2077228 - RNA, 20 nt, Homo sapiens
ggcucuuaugugugccuuug

SEQ ID NO: 2077229 - RNA, 14 nt, Homo sapiens
uugaaauagugucu

SEQ ID NO: 2077230 - RNA, 17 nt, Homo sapiens
gcagccugcagacucac

SEQ ID NO: 2077231 - RNA, 17 nt, Homo sapiens
aucuaguugucaauaaa

SEQ ID NO: 2077232 - RNA, 16 nt, Homo sapiens
cucaauaaauguugcu

SEQ ID NO: 2077233 - RNA, 14 nt, Homo sapiens
ugauuauauucaca

SEQ ID NO: 2077234 - RNA, 15 nt, Homo sapiens
cacuccuuuuuugca

SEQ ID NO: 2077235 - RNA, 20 nt, Homo sapiens
cacucuacuaaugccucuuc

SEQ ID NO: 2077236 - RNA, 18 nt, Homo sapiens
ucuaagaugccagcauau

SEQ ID NO: 2077237 - RNA, 22 nt, Homo sapiens
cuccaaagaaauguaagggaaa

SEQ ID NO: 2077238 - RNA, 14 nt, Homo sapiens
uggaguacacagcu

SEQ ID NO: 2077239 - RNA, 15 nt, Homo sapiens
caguaaccaugcaaa

SEQ ID NO: 2077240 - RNA, 14 nt, Homo sapiens
uaacuagcugagca

SEQ ID NO: 2077241 - RNA, 13 nt, Homo sapiens
gaggugucucagg

SEQ ID NO: 2077242 - RNA, 14 nt, Homo sapiens
auugacuauauaca

SEQ ID NO: 2077243 - RNA, 19 nt, Homo sapiens
aggugacaaugucccccau

SEQ ID NO: 2077244 - RNA, 12 nt, Homo sapiens
ugccaaguggcc

SEQ ID NO: 2077245 - RNA, 17 nt, Homo sapiens
aaauaagaucagacucu

SEQ ID NO: 2077246 - RNA, 15 nt, Homo sapiens
auugauaagaaccuu

SEQ ID NO: 2077247 - RNA, 19 nt, Homo sapiens
cagagugugcagacugaug

SEQ ID NO: 2077248 - RNA, 17 nt, Homo sapiens
ugagucuuggugcuauc

SEQ ID NO: 2077249 - RNA, 21 nt, Homo sapiens
gcauuuuccagcacuuugcaa

SEQ ID NO: 2077250 - RNA, 13 nt, Homo sapiens
cccaggacacgac

SEQ ID NO: 2077251 - RNA, 23 nt, Homo sapiens
uucacaagccuccuguaccucag

SEQ ID NO: 2077252 - RNA, 15 nt, Homo sapiens
uagcaucugagcucc

SEQ ID NO: 2077253 - RNA, 23 nt, Homo sapiens
gaguuuugaagcuuuaagcaaau

SEQ ID NO: 2077254 - RNA, 18 nt, Homo sapiens
cuagauucaaagguucua

SEQ ID NO: 2077255 - RNA, 17 nt, Homo sapiens
cacucuugccaaccugu

SEQ ID NO: 2077256 - RNA, 15 nt, Homo sapiens
ccuagccuugcacuu

SEQ ID NO: 2077257 - RNA, 22 nt, Homo sapiens
cggauaguaagaaaacaaacag

SEQ ID NO: 2077258 - RNA, 16 nt, Homo sapiens
aaaucccaucagguca

SEQ ID NO: 2077259 - RNA, 13 nt, Homo sapiens
aucaccaugauuu

SEQ ID NO: 2077260 - RNA, 19 nt, Homo sapiens
ggcacccccuggcuugaac

SEQ ID NO: 2077261 - RNA, 13 nt, Homo sapiens
cggccucagucuc

SEQ ID NO: 2077262 - RNA, 15 nt, Homo sapiens
ucuuuccacucugga

SEQ ID NO: 2077263 - RNA, 16 nt, Homo sapiens
ccaggcagucgggggc

SEQ ID NO: 2077264 - RNA, 22 nt, Homo sapiens
cuuugaagugacuucacagaga

SEQ ID NO: 2077265 - RNA, 15 nt, Homo sapiens
cagaauguacuugau

SEQ ID NO: 2077266 - RNA, 17 nt, Homo sapiens
ugaccuaccccagccag

SEQ ID NO: 2077267 - RNA, 19 nt, Homo sapiens
uucuuaaugcuuuccuccc

SEQ ID NO: 2077268 - RNA, 18 nt, Homo sapiens
cugaaauaacauggccuu

SEQ ID NO: 2077269 - RNA, 23 nt, Homo sapiens
ugggggcuaagguuuccagucag

SEQ ID NO: 2077270 - RNA, 20 nt, Homo sapiens
ugaggguaucugacaaugcu

SEQ ID NO: 2077271 - RNA, 15 nt, Homo sapiens
cagaccaacuacccc

SEQ ID NO: 2077272 - RNA, 14 nt, Homo sapiens
augcucucucaccu

SEQ ID NO: 2077273 - RNA, 19 nt, Homo sapiens
uuucccaccucaccugaga

SEQ ID NO: 2077274 - RNA, 19 nt, Homo sapiens
gcucaauucaagugacaca

SEQ ID NO: 2077275 - RNA, 14 nt, Homo sapiens
uagaaaggggccca

SEQ ID NO: 2077276 - RNA, 14 nt, Homo sapiens
cagucaucuugacc

SEQ ID NO: 2077277 - RNA, 14 nt, Homo sapiens
aagugaugugauuu

SEQ ID NO: 2077278 - RNA, 21 nt, Homo sapiens
cacaaaaguccacugaugcaa

SEQ ID NO: 2077279 - RNA, 20 nt, Homo sapiens
uacaaagacagccacuuuua

SEQ ID NO: 2077280 - RNA, 19 nt, Homo sapiens
ggaagccacagggugagca

SEQ ID NO: 2077281 - RNA, 18 nt, Homo sapiens
gugaggcggucggaucua

SEQ ID NO: 2077282 - RNA, 18 nt, Homo sapiens
uaaaagaugauuucucaa

SEQ ID NO: 2077283 - RNA, 17 nt, Homo sapiens
ucugugcccggugccau

SEQ ID NO: 2077284 - RNA, 14 nt, Homo sapiens
aaugcucauauuaa

SEQ ID NO: 2077285 - RNA, 14 nt, Homo sapiens
agaucucaugagaa

SEQ ID NO: 2077286 - RNA, 14 nt, Homo sapiens
ucacguggucaagg

SEQ ID NO: 2077287 - RNA, 18 nt, Homo sapiens
agccuacugguagaaaaa

SEQ ID NO: 2077288 - RNA, 21 nt, Homo sapiens
gccuucacuccggugugccug

SEQ ID NO: 2077289 - RNA, 12 nt, Homo sapiens
auccccaaggac

SEQ ID NO: 2077290 - RNA, 16 nt, Homo sapiens
cuguauuuagugauua

SEQ ID NO: 2077291 - RNA, 21 nt, Homo sapiens
uauuauuuuauuauauugccu

SEQ ID NO: 2077292 - RNA, 21 nt, Homo sapiens
caacauaccaauuuucugcua

SEQ ID NO: 2077293 - RNA, 15 nt, Homo sapiens
aaauggcagaaccaa

SEQ ID NO: 2077294 - RNA, 22 nt, Homo sapiens
cuuggccucucuguacacugcc

SEQ ID NO: 2077295 - RNA, 23 nt, Homo sapiens
uguccugaacugugaguccugau

SEQ ID NO: 2077296 - RNA, 15 nt, Homo sapiens
acaugagacuaagag

SEQ ID NO: 2077297 - RNA, 17 nt, Homo sapiens
aagccaggaccugcugu

SEQ ID NO: 2077298 - RNA, 20 nt, Homo sapiens
uuaguuucagcugaccagaa

SEQ ID NO: 2077299 - RNA, 20 nt, Homo sapiens
gcacauugauuugugcuaug

SEQ ID NO: 2077300 - RNA, 17 nt, Homo sapiens
acauagaaaacaaucaa

SEQ ID NO: 2077301 - RNA, 14 nt, Homo sapiens
cuucaaaaagcaau

SEQ ID NO: 2077302 - RNA, 23 nt, Homo sapiens
uuccccaaagacgaccagcauuu

SEQ ID NO: 2077303 - RNA, 19 nt, Homo sapiens
cagacaacauuaugaucua

SEQ ID NO: 2077304 - RNA, 18 nt, Homo sapiens
uaaaaauucaaccacaga

SEQ ID NO: 2077305 - RNA, 18 nt, Homo sapiens
acuuaacggaccaaagca

SEQ ID NO: 2077306 - RNA, 20 nt, Homo sapiens
aaagaugauuucucaaaaau

SEQ ID NO: 2077307 - RNA, 15 nt, Homo sapiens
cuggaaucucaaaag

SEQ ID NO: 2077308 - RNA, 15 nt, Homo sapiens
aaucagaugaauuga

SEQ ID NO: 2077309 - RNA, 20 nt, Homo sapiens
ucaaucuucggggugugaug

SEQ ID NO: 2077310 - RNA, 10 nt, Homo sapiens
ggaugggagc

SEQ ID NO: 2077311 - RNA, 13 nt, Homo sapiens
aucuuaagucaua

SEQ ID NO: 2077312 - RNA, 16 nt, Homo sapiens
guagcacuuacguaaa

SEQ ID NO: 2077313 - RNA, 15 nt, Homo sapiens
cugucacugccaaac

SEQ ID NO: 2077314 - RNA, 20 nt, Homo sapiens
uccaucagaggacaccugua

SEQ ID NO: 2077315 - RNA, 15 nt, Homo sapiens
gcccaacagcacuuu

SEQ ID NO: 2077316 - RNA, 23 nt, Homo sapiens
ucaugauuucaaugauuguuuaa

SEQ ID NO: 2077317 - RNA, 13 nt, Homo sapiens
aggagaaacugag

SEQ ID NO: 2077318 - RNA, 13 nt, Homo sapiens
acuaggguguaaa

SEQ ID NO: 2077319 - RNA, 20 nt, Homo sapiens
gcugucgagaaacagccugu

SEQ ID NO: 2077320 - RNA, 16 nt, Homo sapiens
cugucuugaugacugc

SEQ ID NO: 2077321 - RNA, 22 nt, Homo sapiens
acacuuugggaggcugaggcag

SEQ ID NO: 2077322 - RNA, 18 nt, Homo sapiens
guaguucucaggaccugu

SEQ ID NO: 2077323 - RNA, 23 nt, Homo sapiens
gcaaauauuuugucacugcugua

SEQ ID NO: 2077324 - RNA, 18 nt, Homo sapiens
uguggaauuacauaacag

SEQ ID NO: 2077325 - RNA, 12 nt, Homo sapiens
agcagugccuug

SEQ ID NO: 2077326 - RNA, 12 nt, Homo sapiens
acacagcuccuc

SEQ ID NO: 2077327 - RNA, 12 nt, Homo sapiens
acagagcuccug

SEQ ID NO: 2077328 - RNA, 15 nt, Homo sapiens
uggagcagaacuuuc

SEQ ID NO: 2077329 - RNA, 17 nt, Homo sapiens
ugcacuacauaaucucu

SEQ ID NO: 2077330 - RNA, 14 nt, Homo sapiens
ugugucauuuauaa

SEQ ID NO: 2077331 - RNA, 15 nt, Homo sapiens
guucuuuugacugaa

SEQ ID NO: 2077332 - RNA, 17 nt, Homo sapiens
cuuuggagaugcugagg

SEQ ID NO: 2077333 - RNA, 13 nt, Homo sapiens
caguucugcugac

SEQ ID NO: 2077334 - RNA, 18 nt, Homo sapiens
gagagcugggcagacagg

SEQ ID NO: 2077335 - RNA, 15 nt, Homo sapiens
ccacaccugcagugc

SEQ ID NO: 2077336 - RNA, 16 nt, Homo sapiens
caagcuccaaauccaa

SEQ ID NO: 2077337 - RNA, 18 nt, Homo sapiens
caagcauuuaccaugugc

SEQ ID NO: 2077338 - RNA, 21 nt, Homo sapiens
cugcucaccagaucucaggca

SEQ ID NO: 2077339 - RNA, 21 nt, Homo sapiens
guccgugggccguaucuguca

SEQ ID NO: 2077340 - RNA, 16 nt, Homo sapiens
ugaaaaugaguuguga

SEQ ID NO: 2077341 - RNA, 21 nt, Homo sapiens
caauuucaaaaugcaugugau

SEQ ID NO: 2077342 - RNA, 24 nt, Homo sapiens
gcuuuucaugcguguguguugucu

SEQ ID NO: 2077343 - RNA, 22 nt, Homo sapiens
aguuggggccauugcuuaccuu

SEQ ID NO: 2077344 - RNA, 22 nt, Homo sapiens
aguucucagaacuguuggcugc

SEQ ID NO: 2077345 - RNA, 13 nt, Homo sapiens
acacugugcccug

SEQ ID NO: 2077346 - RNA, 16 nt, Homo sapiens
acauccuugauuacuu

SEQ ID NO: 2077347 - RNA, 12 nt, Homo sapiens
agcucuucccac

SEQ ID NO: 2077348 - RNA, 14 nt, Homo sapiens
uacuucucugcuau

SEQ ID NO: 2077349 - RNA, 16 nt, Homo sapiens
aucucauuucuagaga

SEQ ID NO: 2077350 - RNA, 16 nt, Homo sapiens
ccuagccccacccaga

SEQ ID NO: 2077351 - RNA, 21 nt, Homo sapiens
cagcuuauaaaaucaaacaga

SEQ ID NO: 2077352 - RNA, 21 nt, Homo sapiens
caguuguuaaaaugagcauug

SEQ ID NO: 2077353 - RNA, 13 nt, Homo sapiens
ucuauuaucucaa

SEQ ID NO: 2077354 - RNA, 13 nt, Homo sapiens
ccccaaagucuua

SEQ ID NO: 2077355 - RNA, 15 nt, Homo sapiens
ggccaaauguucaau

SEQ ID NO: 2077356 - RNA, 18 nt, Homo sapiens
uuugagcuuuaucucuaa

SEQ ID NO: 2077357 - RNA, 21 nt, Homo sapiens
ugagaagcugcucaacuugca

SEQ ID NO: 2077358 - RNA, 21 nt, Homo sapiens
acaggccauugugaaccaaug

SEQ ID NO: 2077359 - RNA, 18 nt, Homo sapiens
uaauuuaguucucagcuc

SEQ ID NO: 2077360 - RNA, 15 nt, Homo sapiens
gugacaaacuggcag

SEQ ID NO: 2077361 - RNA, 17 nt, Homo sapiens
ggagguaguuaagggau

SEQ ID NO: 2077362 - RNA, 20 nt, Homo sapiens
ucagcaaacggugaccagca

SEQ ID NO: 2077363 - RNA, 17 nt, Homo sapiens
cucaacagacccaguga

SEQ ID NO: 2077364 - RNA, 23 nt, Homo sapiens
cuaggugggucaacuccaaggca

SEQ ID NO: 2077365 - RNA, 15 nt, Homo sapiens
ucagcaucugugaug

SEQ ID NO: 2077366 - RNA, 21 nt, Homo sapiens
ugcagguuccuuaucugucac

SEQ ID NO: 2077367 - RNA, 16 nt, Homo sapiens
gagaaugagaagggaa

SEQ ID NO: 2077368 - RNA, 22 nt, Homo sapiens
acccuggaccaguggucucaca

SEQ ID NO: 2077369 - RNA, 18 nt, Homo sapiens
auuccuucacucauccag

SEQ ID NO: 2077370 - RNA, 15 nt, Homo sapiens
cauuuuaaaaaccag

SEQ ID NO: 2077371 - RNA, 22 nt, Homo sapiens
aacuguuauuuauaaucacuuu

SEQ ID NO: 2077372 - RNA, 18 nt, Homo sapiens
acacggggcuugcaacuu

SEQ ID NO: 2077373 - RNA, 14 nt, Homo sapiens
gcaguccagugaga

SEQ ID NO: 2077374 - RNA, 17 nt, Homo sapiens
acauuuacauagugcaa

SEQ ID NO: 2077375 - RNA, 16 nt, Homo sapiens
aauacggcuuuuccaa

SEQ ID NO: 2077376 - RNA, 14 nt, Homo sapiens
uuuaagacugauaa

SEQ ID NO: 2077377 - RNA, 18 nt, Homo sapiens
acggcuccuccuuaugac

SEQ ID NO: 2077378 - RNA, 14 nt, Homo sapiens
cuggaacccaacag

SEQ ID NO: 2077379 - RNA, 14 nt, Homo sapiens
aaacauacuucuaa

SEQ ID NO: 2077380 - RNA, 19 nt, Homo sapiens
caaagggacacacagugac

SEQ ID NO: 2077381 - RNA, 17 nt, Homo sapiens
auauguguauguacguu

SEQ ID NO: 2077382 - RNA, 18 nt, Homo sapiens
ggacccagggaaugccag

SEQ ID NO: 2077383 - RNA, 17 nt, Homo sapiens
aauuuaaacguauaaua

SEQ ID NO: 2077384 - RNA, 17 nt, Homo sapiens
uggagacugacaaccuc

SEQ ID NO: 2077385 - RNA, 15 nt, Homo sapiens
guguaccuccucuca

SEQ ID NO: 2077386 - RNA, 14 nt, Homo sapiens
ggcaccuucaccug

SEQ ID NO: 2077387 - RNA, 22 nt, Homo sapiens
cucaacuuguguuuuguauuua

SEQ ID NO: 2077388 - RNA, 12 nt, Homo sapiens
ucaaagaaagaa

SEQ ID NO: 2077389 - RNA, 21 nt, Homo sapiens
ccaugaugugaagaguuucac

SEQ ID NO: 2077390 - RNA, 15 nt, Homo sapiens
cacgucuaacuggaa

SEQ ID NO: 2077391 - RNA, 16 nt, Homo sapiens
acuaaaaaaaugcaaa

SEQ ID NO: 2077392 - RNA, 14 nt, Homo sapiens
aagcaauuuacuga

SEQ ID NO: 2077393 - RNA, 17 nt, Homo sapiens
gcuggagcccgcacugu

SEQ ID NO: 2077394 - RNA, 11 nt, Homo sapiens
uaccacuccca

SEQ ID NO: 2077395 - RNA, 18 nt, Homo sapiens
caaucuauuuuugugugc

SEQ ID NO: 2077396 - RNA, 20 nt, Homo sapiens
cauccauauauauucaucag

SEQ ID NO: 2077397 - RNA, 22 nt, Homo sapiens
guucugaugccaauacuaguca

SEQ ID NO: 2077398 - RNA, 22 nt, Homo sapiens
cuuggccagaagggggccauga

SEQ ID NO: 2077399 - RNA, 13 nt, Homo sapiens
ccucccuucacag

SEQ ID NO: 2077400 - RNA, 18 nt, Homo sapiens
cuccuuuuucuaccuuuu

SEQ ID NO: 2077401 - RNA, 17 nt, Homo sapiens
cucaguuccugcagcag

SEQ ID NO: 2077402 - RNA, 21 nt, Homo sapiens
acucaaaaauccuaacauuca

SEQ ID NO: 2077403 - RNA, 16 nt, Homo sapiens
uuaauauguucauuaa

SEQ ID NO: 2077404 - RNA, 21 nt, Homo sapiens
ugacuacugcccacaccaacg

SEQ ID NO: 2077405 - RNA, 14 nt, Homo sapiens
ccugaaagccacaa

SEQ ID NO: 2077406 - RNA, 18 nt, Homo sapiens
ucacuuuuuuucuuuucu

SEQ ID NO: 2077407 - RNA, 18 nt, Homo sapiens
cuauccucucuuccucuu

SEQ ID NO: 2077408 - RNA, 21 nt, Homo sapiens
gaggaccugcgcaaagggcgg

SEQ ID NO: 2077409 - RNA, 23 nt, Homo sapiens
ggagugcaguggcaucaucucag

SEQ ID NO: 2077410 - RNA, 15 nt, Homo sapiens
ucaaauuaauugugu

SEQ ID NO: 2077411 - RNA, 17 nt, Homo sapiens
agaaagcaaagauuauu

SEQ ID NO: 2077412 - RNA, 17 nt, Homo sapiens
uuucuccuguuggcuca

SEQ ID NO: 2077413 - RNA, 18 nt, Homo sapiens
aaucaucaaguaauacaa

SEQ ID NO: 2077414 - RNA, 22 nt, Homo sapiens
aaguugcgcuuaaauaagacaa

SEQ ID NO: 2077415 - RNA, 20 nt, Homo sapiens
acuaaugcccuaucuuagua

SEQ ID NO: 2077416 - RNA, 14 nt, Homo sapiens
gaugaaacuccuga

SEQ ID NO: 2077417 - RNA, 12 nt, Homo sapiens
acuuuaucugaa

SEQ ID NO: 2077418 - RNA, 14 nt, Homo sapiens
ccuggcccaucuca

SEQ ID NO: 2077419 - RNA, 13 nt, Homo sapiens
ucccaaaauacua

SEQ ID NO: 2077420 - RNA, 17 nt, Homo sapiens
uguaucauagcgauauu

SEQ ID NO: 2077421 - RNA, 21 nt, Homo sapiens
agccucguuggagagcagcag

SEQ ID NO: 2077422 - RNA, 22 nt, Homo sapiens
agugucuugagcucuaaaguag

SEQ ID NO: 2077423 - RNA, 14 nt, Homo sapiens
uccuggcugugaca

SEQ ID NO: 2077424 - RNA, 16 nt, Homo sapiens
gcaacacugcaggaca

SEQ ID NO: 2077425 - RNA, 13 nt, Homo sapiens
aguugcaguagua

SEQ ID NO: 2077426 - RNA, 19 nt, Homo sapiens
aaaauccccuguugugugg

SEQ ID NO: 2077427 - RNA, 21 nt, Homo sapiens
auuuuaucaaacacacuucca

SEQ ID NO: 2077428 - RNA, 21 nt, Homo sapiens
aggagaccuguaucaaacugc

SEQ ID NO: 2077429 - RNA, 16 nt, Homo sapiens
cuaauguuugcauaua

SEQ ID NO: 2077430 - RNA, 17 nt, Homo sapiens
aucuacacuccagugag

SEQ ID NO: 2077431 - RNA, 19 nt, Homo sapiens
uguaguggcacaaucucag

SEQ ID NO: 2077432 - RNA, 16 nt, Homo sapiens
uucccuuguauggaua

SEQ ID NO: 2077433 - RNA, 23 nt, Homo sapiens
cugguauuaacuuuauacacuug

SEQ ID NO: 2077434 - RNA, 23 nt, Homo sapiens
gaaauaucuauguuuuaccaagc

SEQ ID NO: 2077435 - RNA, 15 nt, Homo sapiens
aggaaaccacaguga

SEQ ID NO: 2077436 - RNA, 17 nt, Homo sapiens
guugacguugaucuccu

SEQ ID NO: 2077437 - RNA, 12 nt, Homo sapiens
aaucagugaaga

SEQ ID NO: 2077438 - RNA, 15 nt, Homo sapiens
uacagucacauucag

SEQ ID NO: 2077439 - RNA, 15 nt, Homo sapiens
ggcuaagcacuuuau

SEQ ID NO: 2077440 - RNA, 21 nt, Homo sapiens
cuggugggggccucuuuacca

SEQ ID NO: 2077441 - RNA, 12 nt, Homo sapiens
uuuccagccuuc

SEQ ID NO: 2077442 - RNA, 14 nt, Homo sapiens
cuccucccauguca

SEQ ID NO: 2077443 - RNA, 17 nt, Homo sapiens
acucccugcagaugcca

SEQ ID NO: 2077444 - RNA, 22 nt, Homo sapiens
ucaaagcaggaauugguggcag

SEQ ID NO: 2077445 - RNA, 22 nt, Homo sapiens
agggucacgcuugccuggucac

SEQ ID NO: 2077446 - RNA, 13 nt, Homo sapiens
aaccaaugcacac

SEQ ID NO: 2077447 - RNA, 17 nt, Homo sapiens
aagcaacagauggauag

SEQ ID NO: 2077448 - RNA, 18 nt, Homo sapiens
cagcuccaaccugcaaag

SEQ ID NO: 2077449 - RNA, 17 nt, Homo sapiens
cuccaucucauguauca

SEQ ID NO: 2077450 - RNA, 20 nt, Homo sapiens
ugcccccaccacggccacug

SEQ ID NO: 2077451 - RNA, 20 nt, Homo sapiens
uuaucugaucgggauaacaa

SEQ ID NO: 2077452 - RNA, 19 nt, Homo sapiens
ggaaaaaugauccagugga

SEQ ID NO: 2077453 - RNA, 18 nt, Homo sapiens
aaccagguccaaugagcu

SEQ ID NO: 2077454 - RNA, 12 nt, Homo sapiens
gcugcuuuccag

SEQ ID NO: 2077455 - RNA, 22 nt, Homo sapiens
aagucagaggagauguggucaa

SEQ ID NO: 2077456 - RNA, 15 nt, Homo sapiens
gugugucagggauga

SEQ ID NO: 2077457 - RNA, 15 nt, Homo sapiens
gagcugcugcaugag

SEQ ID NO: 2077458 - RNA, 17 nt, Homo sapiens
ucaugucauuaugacau

SEQ ID NO: 2077459 - RNA, 23 nt, Homo sapiens
gccuucauggaacucagcugucu

SEQ ID NO: 2077460 - RNA, 11 nt, Homo sapiens
aaacacauguu

SEQ ID NO: 2077461 - RNA, 16 nt, Homo sapiens
gucucuuuuuuuggcc

SEQ ID NO: 2077462 - RNA, 16 nt, Homo sapiens
uguaugccacaucuca

SEQ ID NO: 2077463 - RNA, 20 nt, Homo sapiens
aguauuccuaaccugucaga

SEQ ID NO: 2077464 - RNA, 21 nt, Homo sapiens
ugaagcccuccaaaagcacuu

SEQ ID NO: 2077465 - RNA, 17 nt, Homo sapiens
ucaccuaacagaauauu

SEQ ID NO: 2077466 - RNA, 19 nt, Homo sapiens
uauuuuaauuccacuuuaa

SEQ ID NO: 2077467 - RNA, 15 nt, Homo sapiens
cagacaaauuacuga

SEQ ID NO: 2077468 - RNA, 20 nt, Homo sapiens
gcacuguuuauguuacagug

SEQ ID NO: 2077469 - RNA, 20 nt, Homo sapiens
acggguguaaacacugaugg

SEQ ID NO: 2077470 - RNA, 16 nt, Homo sapiens
uccuccgggggccaag

SEQ ID NO: 2077471 - RNA, 17 nt, Homo sapiens
aaacaaaacaccaggga

SEQ ID NO: 2077472 - RNA, 20 nt, Homo sapiens
uuguaaagugaagaauccuu

SEQ ID NO: 2077473 - RNA, 13 nt, Homo sapiens
cauuaucuuauca

SEQ ID NO: 2077474 - RNA, 22 nt, Homo sapiens
cagcacuguuacaagaggccau

SEQ ID NO: 2077475 - RNA, 18 nt, Homo sapiens
ugugacauuuuacauuaa

SEQ ID NO: 2077476 - RNA, 17 nt, Homo sapiens
ucuacugaacaguccau

SEQ ID NO: 2077477 - RNA, 14 nt, Homo sapiens
aggggcuggcugga

SEQ ID NO: 2077478 - RNA, 16 nt, Homo sapiens
acccuuguccacaggc

SEQ ID NO: 2077479 - RNA, 12 nt, Homo sapiens
caaaucagacac

SEQ ID NO: 2077480 - RNA, 15 nt, Homo sapiens
uguuuacucauugcc

SEQ ID NO: 2077481 - RNA, 13 nt, Homo sapiens
cucaggccaguaa

SEQ ID NO: 2077482 - RNA, 22 nt, Homo sapiens
cuuggcuggugugguacagaga

SEQ ID NO: 2077483 - RNA, 15 nt, Homo sapiens
ccuaccucuggugau

SEQ ID NO: 2077484 - RNA, 13 nt, Homo sapiens
ggauguaucucac

SEQ ID NO: 2077485 - RNA, 19 nt, Homo sapiens
acugugucuggcguucuca

SEQ ID NO: 2077486 - RNA, 23 nt, Homo sapiens
cgcacccccacugcuguuuucac

SEQ ID NO: 2077487 - RNA, 15 nt, Homo sapiens
gaaauguuugcugaa

SEQ ID NO: 2077488 - RNA, 22 nt, Homo sapiens
cugaguaucacaucacacaaaa

SEQ ID NO: 2077489 - RNA, 13 nt, Homo sapiens
ccagguacaucca

SEQ ID NO: 2077490 - RNA, 20 nt, Homo sapiens
auuuccaaauguggccucca

SEQ ID NO: 2077491 - RNA, 21 nt, Homo sapiens
aggagacuuaggaaccuacca

SEQ ID NO: 2077492 - RNA, 19 nt, Homo sapiens
uagagagucuccaagagaa

SEQ ID NO: 2077493 - RNA, 20 nt, Homo sapiens
cccaggaaggccacagugcu

SEQ ID NO: 2077494 - RNA, 17 nt, Homo sapiens
uaacagaguaucagauc

SEQ ID NO: 2077495 - RNA, 12 nt, Homo sapiens
cuggggugggag

SEQ ID NO: 2077496 - RNA, 19 nt, Homo sapiens
auaaaagauuuacauucca

SEQ ID NO: 2077497 - RNA, 22 nt, Homo sapiens
ugaccuggugggagcaccugcc

SEQ ID NO: 2077498 - RNA, 19 nt, Homo sapiens
ucccuugugagucuucacu

SEQ ID NO: 2077499 - RNA, 12 nt, Homo sapiens
acuguugaacuu

SEQ ID NO: 2077500 - RNA, 14 nt, Homo sapiens
gacccagggccuga

SEQ ID NO: 2077501 - RNA, 23 nt, Homo sapiens
auugaagccuuugccagccauuc

SEQ ID NO: 2077502 - RNA, 22 nt, Homo sapiens
agcagcucuucuggcuguguug

SEQ ID NO: 2077503 - RNA, 21 nt, Homo sapiens
aguugagagggugcaguccag

SEQ ID NO: 2077504 - RNA, 21 nt, Homo sapiens
cagaaguuugagaucagccug

SEQ ID NO: 2077505 - RNA, 13 nt, Homo sapiens
gcaaccaauaaaa

SEQ ID NO: 2077506 - RNA, 23 nt, Homo sapiens
uucggagaggccaagucuaauga

SEQ ID NO: 2077507 - RNA, 15 nt, Homo sapiens
ucacaaugagauuga

SEQ ID NO: 2077508 - RNA, 15 nt, Homo sapiens
ucuaaaauagcaccc

SEQ ID NO: 2077509 - RNA, 20 nt, Homo sapiens
cgagagcugggacucaguuc

SEQ ID NO: 2077510 - RNA, 12 nt, Homo sapiens
gugcacauuuau

SEQ ID NO: 2077511 - RNA, 19 nt, Homo sapiens
guccugcagugcucauuca

SEQ ID NO: 2077512 - RNA, 21 nt, Homo sapiens
uguaaaaaacaaacauuugaa

SEQ ID NO: 2077513 - RNA, 19 nt, Homo sapiens
aacgauaaaagacagugaa

SEQ ID NO: 2077514 - RNA, 22 nt, Homo sapiens
uuucauuuugccaaaaaggggu

SEQ ID NO: 2077515 - RNA, 20 nt, Homo sapiens
augcuggcagccauggccau

SEQ ID NO: 2077516 - RNA, 17 nt, Homo sapiens
ucuccugugaacacugg

SEQ ID NO: 2077517 - RNA, 22 nt, Homo sapiens
guuaauauuaauuuauauuugu

SEQ ID NO: 2077518 - RNA, 20 nt, Homo sapiens
ucaacuaggcucauacucaa

SEQ ID NO: 2077519 - RNA, 20 nt, Homo sapiens
cugggcucagacauccacau

SEQ ID NO: 2077520 - RNA, 14 nt, Homo sapiens
uuaucagcaaaaaa

SEQ ID NO: 2077521 - RNA, 20 nt, Homo sapiens
aaucuuucagcacucagaaa

SEQ ID NO: 2077522 - RNA, 20 nt, Homo sapiens
aagauggccuuugcuuauga

SEQ ID NO: 2077523 - RNA, 15 nt, Homo sapiens
agaaacagugugcau

SEQ ID NO: 2077524 - RNA, 16 nt, Homo sapiens
ccacuucagaaauaua

SEQ ID NO: 2077525 - RNA, 22 nt, Homo sapiens
aaaauugcugcaccaaugcacu

SEQ ID NO: 2077526 - RNA, 21 nt, Homo sapiens
ugaucucaggggucuuaccuu

SEQ ID NO: 2077527 - RNA, 22 nt, Homo sapiens
ucagcaagacuucucuuugccu

SEQ ID NO: 2077528 - RNA, 12 nt, Homo sapiens
agagccaugcca

SEQ ID NO: 2077529 - RNA, 15 nt, Homo sapiens
cugauguacucuaaa

SEQ ID NO: 2077530 - RNA, 12 nt, Homo sapiens
caauuacuguga

SEQ ID NO: 2077531 - RNA, 19 nt, Homo sapiens
uuugaugaggcccuccaca

SEQ ID NO: 2077532 - RNA, 23 nt, Homo sapiens
aacauaccauuucuacaccucaa

SEQ ID NO: 2077533 - RNA, 24 nt, Homo sapiens
aagauauucagguggccagaagag

SEQ ID NO: 2077534 - RNA, 23 nt, Homo sapiens
cacagggagaauugaaacugagu

SEQ ID NO: 2077535 - RNA, 14 nt, Homo sapiens
uguaauacuggaau

SEQ ID NO: 2077536 - RNA, 21 nt, Homo sapiens
gcccuucccacuggaggucac

SEQ ID NO: 2077537 - RNA, 16 nt, Homo sapiens
cauaaagaagcaauaa

SEQ ID NO: 2077538 - RNA, 14 nt, Homo sapiens
uacuauuuuuacug

SEQ ID NO: 2077539 - RNA, 17 nt, Homo sapiens
aggucaaaaaucugucc

SEQ ID NO: 2077540 - RNA, 13 nt, Homo sapiens
uaaauauugcucu

SEQ ID NO: 2077541 - RNA, 13 nt, Homo sapiens
agcuaccaggaag

SEQ ID NO: 2077542 - RNA, 14 nt, Homo sapiens
uccaaggcagugga

SEQ ID NO: 2077543 - RNA, 14 nt, Homo sapiens
uuauuuaugcguaa

SEQ ID NO: 2077544 - RNA, 15 nt, Homo sapiens
agugagacaggugau

SEQ ID NO: 2077545 - RNA, 18 nt, Homo sapiens
acuucuaaagaaguucaa

SEQ ID NO: 2077546 - RNA, 15 nt, Homo sapiens
ccauccuucccucau

SEQ ID NO: 2077547 - RNA, 13 nt, Homo sapiens
ccaugcaaugccu

SEQ ID NO: 2077548 - RNA, 17 nt, Homo sapiens
ucaccaacuccuaguuc

SEQ ID NO: 2077549 - RNA, 17 nt, Homo sapiens
aagaugggaaaaccaug

SEQ ID NO: 2077550 - RNA, 17 nt, Homo sapiens
ggaacagcaggugccag

SEQ ID NO: 2077551 - RNA, 20 nt, Homo sapiens
cgccuacucccagcuggugg

SEQ ID NO: 2077552 - RNA, 16 nt, Homo sapiens
gccugggcaacaaagu

SEQ ID NO: 2077553 - RNA, 13 nt, Homo sapiens
ggccccaucccag

SEQ ID NO: 2077554 - RNA, 20 nt, Homo sapiens
ccaucuuacagagacucucc

SEQ ID NO: 2077555 - RNA, 23 nt, Homo sapiens
acguccugggugcugucaugccc

SEQ ID NO: 2077556 - RNA, 15 nt, Homo sapiens
aucugacuaugacau

SEQ ID NO: 2077557 - RNA, 22 nt, Homo sapiens
uuauuuagagacagagucucac

SEQ ID NO: 2077558 - RNA, 22 nt, Homo sapiens
cuagaguucuccagacaggguu

SEQ ID NO: 2077559 - RNA, 17 nt, Homo sapiens
cagugcaggcacaguau

SEQ ID NO: 2077560 - RNA, 16 nt, Homo sapiens
accuuccaaaccucaa

SEQ ID NO: 2077561 - RNA, 18 nt, Homo sapiens
agacaauauggucccaaa

SEQ ID NO: 2077562 - RNA, 12 nt, Homo sapiens
ggagacuguccc

SEQ ID NO: 2077563 - RNA, 19 nt, Homo sapiens
auaauuauuucagauuccu

SEQ ID NO: 2077564 - RNA, 16 nt, Homo sapiens
uauaagguacauauuu

SEQ ID NO: 2077565 - RNA, 13 nt, Homo sapiens
aucauggccucuu

SEQ ID NO: 2077566 - RNA, 22 nt, Homo sapiens
auagacuuauguguuuugcuaa

SEQ ID NO: 2077567 - RNA, 19 nt, Homo sapiens
ucagcaguaucaaggcuga

SEQ ID NO: 2077568 - RNA, 12 nt, Homo sapiens
aggggagugcau

SEQ ID NO: 2077569 - RNA, 15 nt, Homo sapiens
acuaugaguucacau

SEQ ID NO: 2077570 - RNA, 23 nt, Homo sapiens
uucagaccccaaaggagucagag

SEQ ID NO: 2077571 - RNA, 12 nt, Homo sapiens
cuggacaccagg

SEQ ID NO: 2077572 - RNA, 12 nt, Homo sapiens
aaaaacacauaa

SEQ ID NO: 2077573 - RNA, 12 nt, Homo sapiens
auaaacacaaaa

SEQ ID NO: 2077574 - RNA, 21 nt, Homo sapiens
aaaguuguaguucuugugcau

SEQ ID NO: 2077575 - RNA, 19 nt, Homo sapiens
ccuguucugugucugcugu

SEQ ID NO: 2077576 - RNA, 13 nt, Homo sapiens
ugcauucucucau

SEQ ID NO: 2077577 - RNA, 19 nt, Homo sapiens
uaaagagcagccuggcuaa

SEQ ID NO: 2077578 - RNA, 14 nt, Homo sapiens
ccagaaacuuuaag

SEQ ID NO: 2077579 - RNA, 14 nt, Homo sapiens
ucugugcacaugcc

SEQ ID NO: 2077580 - RNA, 21 nt, Homo sapiens
acucccucucucccuuuuacc

SEQ ID NO: 2077581 - RNA, 16 nt, Homo sapiens
cauuuugcucugugaa

SEQ ID NO: 2077582 - RNA, 14 nt, Homo sapiens
acugagcacuuuga

SEQ ID NO: 2077583 - RNA, 21 nt, Homo sapiens
guugauauuaaagaaucaaaa

SEQ ID NO: 2077584 - RNA, 22 nt, Homo sapiens
gaccaggcaaugugacuuugca

SEQ ID NO: 2077585 - RNA, 22 nt, Homo sapiens
gaaaaaguguuuuuacauauag

SEQ ID NO: 2077586 - RNA, 13 nt, Homo sapiens
cuagaauccccac

SEQ ID NO: 2077587 - RNA, 17 nt, Homo sapiens
uggguauccuacuacuu

SEQ ID NO: 2077588 - RNA, 14 nt, Homo sapiens
guaggcucauuuac

SEQ ID NO: 2077589 - RNA, 19 nt, Homo sapiens
ugcagggaagagggcagua

SEQ ID NO: 2077590 - RNA, 15 nt, Homo sapiens
gacccucaaugccaa

SEQ ID NO: 2077591 - RNA, 17 nt, Homo sapiens
auuguauaaaugcaaua

SEQ ID NO: 2077592 - RNA, 19 nt, Homo sapiens
aagauccugucuugcugag

SEQ ID NO: 2077593 - RNA, 16 nt, Homo sapiens
aagggcuaaacaugug

SEQ ID NO: 2077594 - RNA, 16 nt, Homo sapiens
acuauucagaggaaaa

SEQ ID NO: 2077595 - RNA, 15 nt, Homo sapiens
cuucucuuccuguaa

SEQ ID NO: 2077596 - RNA, 18 nt, Homo sapiens
gccugaaaugacauuuca

SEQ ID NO: 2077597 - RNA, 15 nt, Homo sapiens
ucaaagacaauggaa

SEQ ID NO: 2077598 - RNA, 20 nt, Homo sapiens
cauguccucuucaaagguga

SEQ ID NO: 2077599 - RNA, 14 nt, Homo sapiens
guuuacaugugaug

SEQ ID NO: 2077600 - RNA, 16 nt, Homo sapiens
gcaauagaaauccaau

SEQ ID NO: 2077601 - RNA, 20 nt, Homo sapiens
gcucuggccaaccaaagaca

SEQ ID NO: 2077602 - RNA, 17 nt, Homo sapiens
ucccccagcagccuggg

SEQ ID NO: 2077603 - RNA, 17 nt, Homo sapiens
auuaaauguuuauaauu

SEQ ID NO: 2077604 - RNA, 21 nt, Homo sapiens
agguauuuuguaauauucucu

SEQ ID NO: 2077605 - RNA, 13 nt, Homo sapiens
uuauuguucaaua

SEQ ID NO: 2077606 - RNA, 19 nt, Homo sapiens
uguaccuaggauauguuaa

SEQ ID NO: 2077607 - RNA, 15 nt, Homo sapiens
uugacugugauuuau

SEQ ID NO: 2077608 - RNA, 16 nt, Homo sapiens
acauagguaaaaacug

SEQ ID NO: 2077609 - RNA, 21 nt, Homo sapiens
auucucugcagcccauuccca

SEQ ID NO: 2077610 - RNA, 18 nt, Homo sapiens
uucagucucagcugcuga

SEQ ID NO: 2077611 - RNA, 22 nt, Homo sapiens
ccucguuggaagaggaacagca

SEQ ID NO: 2077612 - RNA, 18 nt, Homo sapiens
uccagcggggcuucuggg

SEQ ID NO: 2077613 - RNA, 20 nt, Homo sapiens
cuggggggacccagugcaga

SEQ ID NO: 2077614 - RNA, 14 nt, Homo sapiens
agggaguugcucac

SEQ ID NO: 2077615 - RNA, 13 nt, Homo sapiens
ggccgugcagugg

SEQ ID NO: 2077616 - RNA, 15 nt, Homo sapiens
ggaauaucaaugccc

SEQ ID NO: 2077617 - RNA, 13 nt, Homo sapiens
cccuccuccacuu

SEQ ID NO: 2077618 - RNA, 20 nt, Homo sapiens
uaacuuuauacacuuggauu

SEQ ID NO: 2077619 - RNA, 15 nt, Homo sapiens
auuccccaucucagg

SEQ ID NO: 2077620 - RNA, 13 nt, Homo sapiens
acacacgcuuucu

SEQ ID NO: 2077621 - RNA, 20 nt, Homo sapiens
ucuuacaaaauacacauucu

SEQ ID NO: 2077622 - RNA, 22 nt, Homo sapiens
guuuucauccauuaaaauuaau

SEQ ID NO: 2077623 - RNA, 14 nt, Homo sapiens
uucagugacuuaau

SEQ ID NO: 2077624 - RNA, 15 nt, Homo sapiens
augugucucaggaaa

SEQ ID NO: 2077625 - RNA, 22 nt, Homo sapiens
cuuaugauagcaaauggccuca

SEQ ID NO: 2077626 - RNA, 20 nt, Homo sapiens
gcccaggcuggagugcaacg

SEQ ID NO: 2077627 - RNA, 20 nt, Homo sapiens
ugcagacuguucuuacugua

SEQ ID NO: 2077628 - RNA, 12 nt, Homo sapiens
cgggugugcuau

SEQ ID NO: 2077629 - RNA, 16 nt, Homo sapiens
gcuuuggauuugacau

SEQ ID NO: 2077630 - RNA, 20 nt, Homo sapiens
cugacggggaggaaccacug

SEQ ID NO: 2077631 - RNA, 22 nt, Homo sapiens
aacaaacucauucauuagucau

SEQ ID NO: 2077632 - RNA, 21 nt, Homo sapiens
guuauaacucugcacuacucc

SEQ ID NO: 2077633 - RNA, 16 nt, Homo sapiens
caugauuuccauuaaa

SEQ ID NO: 2077634 - RNA, 15 nt, Homo sapiens
acauguaacauuaaa

SEQ ID NO: 2077635 - RNA, 18 nt, Homo sapiens
caguaaucugcaucauaa

SEQ ID NO: 2077636 - RNA, 23 nt, Homo sapiens
auuugugugugugauauaugcau

SEQ ID NO: 2077637 - RNA, 22 nt, Homo sapiens
ccagcauggccacccucaagag

SEQ ID NO: 2077638 - RNA, 15 nt, Homo sapiens
aguggcauccauuuc

SEQ ID NO: 2077639 - RNA, 16 nt, Homo sapiens
gugacuaauggcauga

SEQ ID NO: 2077640 - RNA, 11 nt, Homo sapiens
ugggaggacag

SEQ ID NO: 2077641 - RNA, 17 nt, Homo sapiens
caaaaugcaaaccaaac

SEQ ID NO: 2077642 - RNA, 15 nt, Homo sapiens
uaggaggcaaagguu

SEQ ID NO: 2077643 - RNA, 16 nt, Homo sapiens
ucagcaccuacagugu

SEQ ID NO: 2077644 - RNA, 20 nt, Homo sapiens
ucugcauccagagauucauu

SEQ ID NO: 2077645 - RNA, 18 nt, Homo sapiens
ucccucugugucugcucu

SEQ ID NO: 2077646 - RNA, 12 nt, Homo sapiens
cgcaguggcuca

SEQ ID NO: 2077647 - RNA, 12 nt, Homo sapiens
ugcugccagcuu

SEQ ID NO: 2077648 - RNA, 19 nt, Homo sapiens
ucagaauucuucauccuaa

SEQ ID NO: 2077649 - RNA, 13 nt, Homo sapiens
agauacugaggaa

SEQ ID NO: 2077650 - RNA, 12 nt, Homo sapiens
gcacaaguauua

SEQ ID NO: 2077651 - RNA, 20 nt, Homo sapiens
cuugucaacaugcauugcca

SEQ ID NO: 2077652 - RNA, 15 nt, Homo sapiens
uuaaaauauaguguu

SEQ ID NO: 2077653 - RNA, 17 nt, Homo sapiens
uucuaaagcaggcaauc

SEQ ID NO: 2077654 - RNA, 22 nt, Homo sapiens
acuuuauaaauaaacaugagcg

SEQ ID NO: 2077655 - RNA, 15 nt, Homo sapiens
acgcauugcagccau

SEQ ID NO: 2077656 - RNA, 14 nt, Homo sapiens
uucacaucugucac

SEQ ID NO: 2077657 - RNA, 18 nt, Homo sapiens
cagcuaccucaaccaaug

SEQ ID NO: 2077658 - RNA, 15 nt, Homo sapiens
cccacuugccuguca

SEQ ID NO: 2077659 - RNA, 17 nt, Homo sapiens
gggaaaagggaaccauu

SEQ ID NO: 2077660 - RNA, 20 nt, Homo sapiens
gacuccauagcuccuuccca

SEQ ID NO: 2077661 - RNA, 18 nt, Homo sapiens
uugcugauggcuugacau

SEQ ID NO: 2077662 - RNA, 13 nt, Homo sapiens
auguaggugagcc

SEQ ID NO: 2077663 - RNA, 21 nt, Homo sapiens
gaauuaauaaacugguguucu

SEQ ID NO: 2077664 - RNA, 16 nt, Homo sapiens
caaguauuuucuacua

SEQ ID NO: 2077665 - RNA, 23 nt, Homo sapiens
acagcccaggacaccuuucucug

SEQ ID NO: 2077666 - RNA, 15 nt, Homo sapiens
ugaccucaagugauu

SEQ ID NO: 2077667 - RNA, 15 nt, Homo sapiens
aucuugauacauuca

SEQ ID NO: 2077668 - RNA, 12 nt, Homo sapiens
ucaaugugaaaa

SEQ ID NO: 2077669 - RNA, 16 nt, Homo sapiens
augugauggaacacac

SEQ ID NO: 2077670 - RNA, 18 nt, Homo sapiens
aacaaaucuucacugagc

SEQ ID NO: 2077671 - RNA, 18 nt, Homo sapiens
aauggagccaugacaaga

SEQ ID NO: 2077672 - RNA, 18 nt, Homo sapiens
cagugugagauacugugu

SEQ ID NO: 2077673 - RNA, 18 nt, Homo sapiens
uccuaaugucagaacaga

SEQ ID NO: 2077674 - RNA, 15 nt, Homo sapiens
guucaaggaccacau

SEQ ID NO: 2077675 - RNA, 21 nt, Homo sapiens
cuggagaaaaaacacacuccu

SEQ ID NO: 2077676 - RNA, 20 nt, Homo sapiens
uuuggcaggcuuuuuuccag

SEQ ID NO: 2077677 - RNA, 18 nt, Homo sapiens
gucaugcgucucuggccc

SEQ ID NO: 2077678 - RNA, 20 nt, Homo sapiens
auaauugucaaaaaccagaa

SEQ ID NO: 2077679 - RNA, 17 nt, Homo sapiens
uggccaacauagugaaa

SEQ ID NO: 2077680 - RNA, 20 nt, Homo sapiens
cuuuuuaauauugauaugcu

SEQ ID NO: 2077681 - RNA, 15 nt, Homo sapiens
uucuuuucuuuacaa

SEQ ID NO: 2077682 - RNA, 15 nt, Homo sapiens
cacauuaccauucau

SEQ ID NO: 2077683 - RNA, 18 nt, Homo sapiens
uagacgccuuccagguca

SEQ ID NO: 2077684 - RNA, 20 nt, Homo sapiens
aucuuuggaaugcaugccag

SEQ ID NO: 2077685 - RNA, 16 nt, Homo sapiens
uucccugaacacucau

SEQ ID NO: 2077686 - RNA, 17 nt, Homo sapiens
uaauuuuuacaugacca

SEQ ID NO: 2077687 - RNA, 22 nt, Homo sapiens
gccggcaaccccaguucugcuc

SEQ ID NO: 2077688 - RNA, 14 nt, Homo sapiens
auuucgugugccgc

SEQ ID NO: 2077689 - RNA, 21 nt, Homo sapiens
aagcuuggcugucucaucccc

SEQ ID NO: 2077690 - RNA, 17 nt, Homo sapiens
auauccuuucacucugc

SEQ ID NO: 2077691 - RNA, 22 nt, Homo sapiens
cacgcacauagagauaugcaca

SEQ ID NO: 2077692 - RNA, 10 nt, Homo sapiens
uggagcucaa

SEQ ID NO: 2077693 - RNA, 19 nt, Homo sapiens
cuuuaaucacugcauuuca

SEQ ID NO: 2077694 - RNA, 19 nt, Homo sapiens
auauuguuugugauggauu

SEQ ID NO: 2077695 - RNA, 22 nt, Homo sapiens
aaauaaagccacuuuccucuuc

SEQ ID NO: 2077696 - RNA, 16 nt, Homo sapiens
caccgaggaguccagu

SEQ ID NO: 2077697 - RNA, 20 nt, Homo sapiens
uaaaaaggaauccacuccca

SEQ ID NO: 2077698 - RNA, 11 nt, Homo sapiens
ugugcacauuu

SEQ ID NO: 2077699 - RNA, 18 nt, Homo sapiens
cugagucccagcaauucu

SEQ ID NO: 2077700 - RNA, 21 nt, Homo sapiens
acuuccuuugacuuucugugu

SEQ ID NO: 2077701 - RNA, 21 nt, Homo sapiens
cucuucaacugaccagccucc

SEQ ID NO: 2077702 - RNA, 20 nt, Homo sapiens
uaggaggugugggugccuuc

SEQ ID NO: 2077703 - RNA, 19 nt, Homo sapiens
aagcucgugacaagugccu

SEQ ID NO: 2077704 - RNA, 24 nt, Homo sapiens
ccuuccagggguuuacagucuauu

SEQ ID NO: 2077705 - RNA, 12 nt, Homo sapiens
uggggaggacca

SEQ ID NO: 2077706 - RNA, 15 nt, Homo sapiens
uuugaguuucucucc

SEQ ID NO: 2077707 - RNA, 15 nt, Homo sapiens
cagucugucuacugu

SEQ ID NO: 2077708 - RNA, 23 nt, Homo sapiens
ucaacauuccagggaugagccaa

SEQ ID NO: 2077709 - RNA, 17 nt, Homo sapiens
caacauuuuuacauuua

SEQ ID NO: 2077710 - RNA, 20 nt, Homo sapiens
acauuaggucaccugugcac

SEQ ID NO: 2077711 - RNA, 16 nt, Homo sapiens
aaagauccuauagcuc

SEQ ID NO: 2077712 - RNA, 15 nt, Homo sapiens
caccaugcaccccug

SEQ ID NO: 2077713 - RNA, 22 nt, Homo sapiens
uuagauauuuuucauaaacaag

SEQ ID NO: 2077714 - RNA, 17 nt, Homo sapiens
ugaucaaaaauaaacua

SEQ ID NO: 2077715 - RNA, 22 nt, Homo sapiens
uuaccccuuuucggccccaugu

SEQ ID NO: 2077716 - RNA, 22 nt, Homo sapiens
uugucuguuaaaugaacuugau

SEQ ID NO: 2077717 - RNA, 19 nt, Homo sapiens
ucgguacugagcagccacu

SEQ ID NO: 2077718 - RNA, 20 nt, Homo sapiens
caucuacagaccugcggcuu

SEQ ID NO: 2077719 - RNA, 12 nt, Homo sapiens
uguuucuuccaa

SEQ ID NO: 2077720 - RNA, 23 nt, Homo sapiens
agaaguuacacagaaaugcugcu

SEQ ID NO: 2077721 - RNA, 16 nt, Homo sapiens
gaaugugaagccagau

SEQ ID NO: 2077722 - RNA, 22 nt, Homo sapiens
auauacugcuugucaucugcau

SEQ ID NO: 2077723 - RNA, 22 nt, Homo sapiens
gauugucaacacaaacuggcuu

SEQ ID NO: 2077724 - RNA, 20 nt, Homo sapiens
cuguccagccagcuccugca

SEQ ID NO: 2077725 - RNA, 17 nt, Homo sapiens
aaauguuuauacuguau

SEQ ID NO: 2077726 - RNA, 20 nt, Homo sapiens
ugagcugcagcugagccuga

SEQ ID NO: 2077727 - RNA, 18 nt, Homo sapiens
agccaggcacacacugug

SEQ ID NO: 2077728 - RNA, 12 nt, Homo sapiens
caccuguggcca

SEQ ID NO: 2077729 - RNA, 23 nt, Homo sapiens
ucuuagucuauagaaaugaucau

SEQ ID NO: 2077730 - RNA, 16 nt, Homo sapiens
guaauaccugauugau

SEQ ID NO: 2077731 - RNA, 13 nt, Homo sapiens
ugcaucucuaaua

SEQ ID NO: 2077732 - RNA, 18 nt, Homo sapiens
aaaagagccacuuucaag

SEQ ID NO: 2077733 - RNA, 21 nt, Homo sapiens
gugguugucuuauugcaccau

SEQ ID NO: 2077734 - RNA, 18 nt, Homo sapiens
ucugacaccagagcccac

SEQ ID NO: 2077735 - RNA, 15 nt, Homo sapiens
uaauguuuugcuuaa

SEQ ID NO: 2077736 - RNA, 18 nt, Homo sapiens
cgugaccugccaggcaca

SEQ ID NO: 2077737 - RNA, 16 nt, Homo sapiens
aguuccuuucaauggu

SEQ ID NO: 2077738 - RNA, 15 nt, Homo sapiens
auccaggacugagau

SEQ ID NO: 2077739 - RNA, 17 nt, Homo sapiens
uugcuagccaucuugau

SEQ ID NO: 2077740 - RNA, 20 nt, Homo sapiens
augaugugguuuuuugccag

SEQ ID NO: 2077741 - RNA, 20 nt, Homo sapiens
acguuugacuagccaucuca

SEQ ID NO: 2077742 - RNA, 23 nt, Homo sapiens
agaaaucauuauugagucaccau

SEQ ID NO: 2077743 - RNA, 17 nt, Homo sapiens
uuaauauauacuaugag

SEQ ID NO: 2077744 - RNA, 10 nt, Homo sapiens
uuuccagaaa

SEQ ID NO: 2077745 - RNA, 18 nt, Homo sapiens
aguugaagcacaaccacu

SEQ ID NO: 2077746 - RNA, 17 nt, Homo sapiens
cacagagcuaaggccaa

SEQ ID NO: 2077747 - RNA, 20 nt, Homo sapiens
acacaugcugaacaucacag

SEQ ID NO: 2077748 - RNA, 23 nt, Homo sapiens
cuuaaaucuuaaaaguguuguua

SEQ ID NO: 2077749 - RNA, 14 nt, Homo sapiens
cauuuuugcugaau

SEQ ID NO: 2077750 - RNA, 18 nt, Homo sapiens
caauaaaugaaugaauaa

SEQ ID NO: 2077751 - RNA, 18 nt, Homo sapiens
cuggauggcaucuagcca

SEQ ID NO: 2077752 - RNA, 22 nt, Homo sapiens
acagcaagguguggaggcuccu

SEQ ID NO: 2077753 - RNA, 14 nt, Homo sapiens
agucugcucaaggu

SEQ ID NO: 2077754 - RNA, 20 nt, Homo sapiens
uagaaacaccaguaccugaa

SEQ ID NO: 2077755 - RNA, 20 nt, Homo sapiens
cucacugguuuucaauacca

SEQ ID NO: 2077756 - RNA, 23 nt, Homo sapiens
cuuauauugaagacaauuugaua

SEQ ID NO: 2077757 - RNA, 15 nt, Homo sapiens
cugugucguagccaa

SEQ ID NO: 2077758 - RNA, 18 nt, Homo sapiens
uuucaguugcaguaguau

SEQ ID NO: 2077759 - RNA, 22 nt, Homo sapiens
cauuauuuucugucagaugaga

SEQ ID NO: 2077760 - RNA, 17 nt, Homo sapiens
gaccugccccucccucu

SEQ ID NO: 2077761 - RNA, 15 nt, Homo sapiens
uuauuugaaggccag

SEQ ID NO: 2077762 - RNA, 19 nt, Homo sapiens
ucugucuuguucacugcag

SEQ ID NO: 2077763 - RNA, 24 nt, Homo sapiens
gcacgucacccuccugagccucac

SEQ ID NO: 2077764 - RNA, 14 nt, Homo sapiens
agcacuuaauaauu

SEQ ID NO: 2077765 - RNA, 16 nt, Homo sapiens
uucuaaucacaguguu

SEQ ID NO: 2077766 - RNA, 21 nt, Homo sapiens
uguugcccaggcuggucucaa

SEQ ID NO: 2077767 - RNA, 17 nt, Homo sapiens
ucaaauucagcucugau

SEQ ID NO: 2077768 - RNA, 17 nt, Homo sapiens
accgcagucgucgcaca

SEQ ID NO: 2077769 - RNA, 22 nt, Homo sapiens
ccauaugaauuuacuacuuuaa

SEQ ID NO: 2077770 - RNA, 16 nt, Homo sapiens
cauacuccuuccauca

SEQ ID NO: 2077771 - RNA, 19 nt, Homo sapiens
aguacacccaguugccaaa

SEQ ID NO: 2077772 - RNA, 11 nt, Homo sapiens
ucucuguuauc

SEQ ID NO: 2077773 - RNA, 21 nt, Homo sapiens
gacacccauaauaaaauauca

SEQ ID NO: 2077774 - RNA, 20 nt, Homo sapiens
uuuccuucggguuggcaaaa

SEQ ID NO: 2077775 - RNA, 19 nt, Homo sapiens
gggcugggagaaggugcuu

SEQ ID NO: 2077776 - RNA, 17 nt, Homo sapiens
cguggcuuuuagacaga

SEQ ID NO: 2077777 - RNA, 23 nt, Homo sapiens
gccagaacguggcucugcuggcc

SEQ ID NO: 2077778 - RNA, 16 nt, Homo sapiens
ucuauuuucucugaua

SEQ ID NO: 2077779 - RNA, 23 nt, Homo sapiens
uccaauaucagugcucgagacac

SEQ ID NO: 2077780 - RNA, 22 nt, Homo sapiens
ggaaaauuagcuuuuaguuuua

SEQ ID NO: 2077781 - RNA, 20 nt, Homo sapiens
uaauaaaggaacugcaucag

SEQ ID NO: 2077782 - RNA, 15 nt, Homo sapiens
gaagaaggccagaga

SEQ ID NO: 2077783 - RNA, 19 nt, Homo sapiens
cugacaaagugugucucaa

SEQ ID NO: 2077784 - RNA, 17 nt, Homo sapiens
ccaggaaagaagcauuu

SEQ ID NO: 2077785 - RNA, 13 nt, Homo sapiens
aaacuguucuuca

SEQ ID NO: 2077786 - RNA, 16 nt, Homo sapiens
gguagcuuaccugaca

SEQ ID NO: 2077787 - RNA, 21 nt, Homo sapiens
auuugucuguaaaaaauggag

SEQ ID NO: 2077788 - RNA, 17 nt, Homo sapiens
acaucucccugugggau

SEQ ID NO: 2077789 - RNA, 12 nt, Homo sapiens
uccucuuaccug

SEQ ID NO: 2077790 - RNA, 19 nt, Homo sapiens
agggucuggaacaccaggc

SEQ ID NO: 2077791 - RNA, 12 nt, Homo sapiens
gcacaaugucau

SEQ ID NO: 2077792 - RNA, 21 nt, Homo sapiens
cugagucaggacuugaaccca

SEQ ID NO: 2077793 - RNA, 22 nt, Homo sapiens
agugccuuccucucucuaccag

SEQ ID NO: 2077794 - RNA, 19 nt, Homo sapiens
uggagcaggagccccgcca

SEQ ID NO: 2077795 - RNA, 20 nt, Homo sapiens
aaauguauuuuagacuuccu

SEQ ID NO: 2077796 - RNA, 16 nt, Homo sapiens
agacuuucaagggaau

SEQ ID NO: 2077797 - RNA, 16 nt, Homo sapiens
uaugcaguauucuugc

SEQ ID NO: 2077798 - RNA, 16 nt, Homo sapiens
ugaaacuaaagcaaua

SEQ ID NO: 2077799 - RNA, 19 nt, Homo sapiens
uuccguuuuagaaaaggaa

SEQ ID NO: 2077800 - RNA, 23 nt, Homo sapiens
cuugccgaaccaggagcugcuca

SEQ ID NO: 2077801 - RNA, 17 nt, Homo sapiens
gccaggggaguuuccaa

SEQ ID NO: 2077802 - RNA, 16 nt, Homo sapiens
cugccugccucgggga

SEQ ID NO: 2077803 - RNA, 15 nt, Homo sapiens
auaaguuguauaagu

SEQ ID NO: 2077804 - RNA, 12 nt, Homo sapiens
gacauucugggg

SEQ ID NO: 2077805 - RNA, 12 nt, Homo sapiens
aguaagccucau

SEQ ID NO: 2077806 - RNA, 13 nt, Homo sapiens
ugcucagcuccua

SEQ ID NO: 2077807 - RNA, 22 nt, Homo sapiens
acaagggggaagggaugcaggg

SEQ ID NO: 2077808 - RNA, 12 nt, Homo sapiens
aagagcauuugg

SEQ ID NO: 2077809 - RNA, 14 nt, Homo sapiens
guauuuuucuuugu

SEQ ID NO: 2077810 - RNA, 14 nt, Homo sapiens
cuuuuuuuguaugu

SEQ ID NO: 2077811 - RNA, 15 nt, Homo sapiens
ucaagaaacugagga

SEQ ID NO: 2077812 - RNA, 15 nt, Homo sapiens
cuuccagcacugacu

SEQ ID NO: 2077813 - RNA, 14 nt, Homo sapiens
auaggcagcugucc

SEQ ID NO: 2077814 - RNA, 18 nt, Homo sapiens
uagugcaugcaucucuuu

SEQ ID NO: 2077815 - RNA, 18 nt, Homo sapiens
uaaaauauuugaaugaaa

SEQ ID NO: 2077816 - RNA, 11 nt, Homo sapiens
acagugacauu

SEQ ID NO: 2077817 - RNA, 23 nt, Homo sapiens
uccgcacccaguuugauaccugc

SEQ ID NO: 2077818 - RNA, 20 nt, Homo sapiens
cucaauauuuacuauuucaa

SEQ ID NO: 2077819 - RNA, 16 nt, Homo sapiens
cuaacacuuaccccau

SEQ ID NO: 2077820 - RNA, 17 nt, Homo sapiens
aaucaugagcaagugaa

SEQ ID NO: 2077821 - RNA, 20 nt, Homo sapiens
caucugucuugucauuccag

SEQ ID NO: 2077822 - RNA, 15 nt, Homo sapiens
ugauguuccacaaaa

SEQ ID NO: 2077823 - RNA, 16 nt, Homo sapiens
aagggacauauucauu

SEQ ID NO: 2077824 - RNA, 16 nt, Homo sapiens
uguuuaucaagccaua

SEQ ID NO: 2077825 - RNA, 15 nt, Homo sapiens
cccacggacaaaacc

SEQ ID NO: 2077826 - RNA, 15 nt, Homo sapiens
gcuucgcggucuguu

SEQ ID NO: 2077827 - RNA, 22 nt, Homo sapiens
gggacuauuuugcaugcugaaa

SEQ ID NO: 2077828 - RNA, 18 nt, Homo sapiens
ugcuucugaaugugcuga

SEQ ID NO: 2077829 - RNA, 24 nt, Homo sapiens
cauccauguuccgagaagaacaga

SEQ ID NO: 2077830 - RNA, 15 nt, Homo sapiens
auccgagugugauuu

SEQ ID NO: 2077831 - RNA, 22 nt, Homo sapiens
auaaagccaaauuuccaguuua

SEQ ID NO: 2077832 - RNA, 14 nt, Homo sapiens
cuggauuccuguca

SEQ ID NO: 2077833 - RNA, 21 nt, Homo sapiens
ugaggccacccagaggcagca

SEQ ID NO: 2077834 - RNA, 20 nt, Homo sapiens
cuguuuuucagauacacugu

SEQ ID NO: 2077835 - RNA, 14 nt, Homo sapiens
gcaagucagaauag

SEQ ID NO: 2077836 - RNA, 14 nt, Homo sapiens
aagguaacuacugc

SEQ ID NO: 2077837 - RNA, 17 nt, Homo sapiens
uacuuagcagcuaucuc

SEQ ID NO: 2077838 - RNA, 11 nt, Homo sapiens
cuaugggacuc

SEQ ID NO: 2077839 - RNA, 23 nt, Homo sapiens
guuaagcauuaccacucaggcau

SEQ ID NO: 2077840 - RNA, 16 nt, Homo sapiens
caaagauccacccaaa

SEQ ID NO: 2077841 - RNA, 15 nt, Homo sapiens
caugagcgugacacu

SEQ ID NO: 2077842 - RNA, 13 nt, Homo sapiens
aacuaacacagcc

SEQ ID NO: 2077843 - RNA, 21 nt, Homo sapiens
gcacuagaucucccuuaauaa

SEQ ID NO: 2077844 - RNA, 21 nt, Homo sapiens
augucuuuauuaaauguagaa

SEQ ID NO: 2077845 - RNA, 20 nt, Homo sapiens
gaucagaaggcuggggccag

SEQ ID NO: 2077846 - RNA, 18 nt, Homo sapiens
agaguggcauuggcagca

SEQ ID NO: 2077847 - RNA, 22 nt, Homo sapiens
aauggagaauuaaaaauaccaa

SEQ ID NO: 2077848 - RNA, 16 nt, Homo sapiens
ugaccaaaaaccaaaa

SEQ ID NO: 2077849 - RNA, 14 nt, Homo sapiens
aauaaaauuguaca

SEQ ID NO: 2077850 - RNA, 14 nt, Homo sapiens
aaucccauugucac

SEQ ID NO: 2077851 - RNA, 16 nt, Homo sapiens
cagaauaaaaucucua

SEQ ID NO: 2077852 - RNA, 19 nt, Homo sapiens
aaccauuguuuacagagcu

SEQ ID NO: 2077853 - RNA, 22 nt, Homo sapiens
agaugaagaaggagcagaauaa

SEQ ID NO: 2077854 - RNA, 20 nt, Homo sapiens
accuucugaugaaguuguac

SEQ ID NO: 2077855 - RNA, 17 nt, Homo sapiens
acccuuagccacuucau

SEQ ID NO: 2077856 - RNA, 24 nt, Homo sapiens
auguuugacaaaacacagccaagg

SEQ ID NO: 2077857 - RNA, 21 nt, Homo sapiens
uuuaaugcuccaaaugcugac

SEQ ID NO: 2077858 - RNA, 22 nt, Homo sapiens
auccaugcggccuggguguccu

SEQ ID NO: 2077859 - RNA, 22 nt, Homo sapiens
acuguacaauaaguuacuugaa

SEQ ID NO: 2077860 - RNA, 18 nt, Homo sapiens
aacaugugacuaauugga

SEQ ID NO: 2077861 - RNA, 14 nt, Homo sapiens
cuguugcacagcca

SEQ ID NO: 2077862 - RNA, 16 nt, Homo sapiens
uccuccaugcucccuu

SEQ ID NO: 2077863 - RNA, 15 nt, Homo sapiens
uuaagucagcaaauc

SEQ ID NO: 2077864 - RNA, 14 nt, Homo sapiens
ugaaggcccaagag

SEQ ID NO: 2077865 - RNA, 19 nt, Homo sapiens
cauuguuccugcgcugcaa

SEQ ID NO: 2077866 - RNA, 21 nt, Homo sapiens
auggacaauuaugauagcuua

SEQ ID NO: 2077867 - RNA, 13 nt, Homo sapiens
cagcucccugaau

SEQ ID NO: 2077868 - RNA, 15 nt, Homo sapiens
aaugcaugucuuaaa

SEQ ID NO: 2077869 - RNA, 17 nt, Homo sapiens
agacacccuaacucuug

SEQ ID NO: 2077870 - RNA, 22 nt, Homo sapiens
uugucaacaaagucacccacuu

SEQ ID NO: 2077871 - RNA, 18 nt, Homo sapiens
ggaguaucugaaaggaau

SEQ ID NO: 2077872 - RNA, 19 nt, Homo sapiens
gcccagugacaaagacucc

SEQ ID NO: 2077873 - RNA, 19 nt, Homo sapiens
cuccuugucacugaagauu

SEQ ID NO: 2077874 - RNA, 12 nt, Homo sapiens
cagggacaugua

SEQ ID NO: 2077875 - RNA, 18 nt, Homo sapiens
guuuugaagcuguugcua

SEQ ID NO: 2077876 - RNA, 16 nt, Homo sapiens
aauauguauccucuau

SEQ ID NO: 2077877 - RNA, 19 nt, Homo sapiens
aagcacaugccucucucag

SEQ ID NO: 2077878 - RNA, 13 nt, Homo sapiens
caucguucaucca

SEQ ID NO: 2077879 - RNA, 20 nt, Homo sapiens
aaucuucugccuucucauga

SEQ ID NO: 2077880 - RNA, 19 nt, Homo sapiens
ucaauucccugaaaaacua

SEQ ID NO: 2077881 - RNA, 10 nt, Homo sapiens
agagcacugg

SEQ ID NO: 2077882 - RNA, 20 nt, Homo sapiens
gcaucaggagcugcucaggc

SEQ ID NO: 2077883 - RNA, 20 nt, Homo sapiens
ggagcugaaaaagauggaau

SEQ ID NO: 2077884 - RNA, 14 nt, Homo sapiens
ggaacucaguguga

SEQ ID NO: 2077885 - RNA, 24 nt, Homo sapiens
aagccaugagaauguuuuagcaca

SEQ ID NO: 2077886 - RNA, 15 nt, Homo sapiens
gggaauaaacuguug

SEQ ID NO: 2077887 - RNA, 14 nt, Homo sapiens
uagauuuuggcaaa

SEQ ID NO: 2077888 - RNA, 19 nt, Homo sapiens
caaacaucauuuuacucuu

SEQ ID NO: 2077889 - RNA, 19 nt, Homo sapiens
cuaaaucuguuugacaguc

SEQ ID NO: 2077890 - RNA, 15 nt, Homo sapiens
ucugacucugagcua

SEQ ID NO: 2077891 - RNA, 14 nt, Homo sapiens
uucucagaccucca

SEQ ID NO: 2077892 - RNA, 18 nt, Homo sapiens
guguaauaucauuucaua

SEQ ID NO: 2077893 - RNA, 15 nt, Homo sapiens
agccaggacaucucu

SEQ ID NO: 2077894 - RNA, 17 nt, Homo sapiens
uccgcuuucucuugcug

SEQ ID NO: 2077895 - RNA, 15 nt, Homo sapiens
agcuaaagaggcuga

SEQ ID NO: 2077896 - RNA, 16 nt, Homo sapiens
gagccugaggcaugag

SEQ ID NO: 2077897 - RNA, 15 nt, Homo sapiens
ucgggagcaaaccaa

SEQ ID NO: 2077898 - RNA, 19 nt, Homo sapiens
caagugaccgacaaaauuc

SEQ ID NO: 2077899 - RNA, 17 nt, Homo sapiens
auucuguuauauagugg

SEQ ID NO: 2077900 - RNA, 12 nt, Homo sapiens
auagaaagccaa

SEQ ID NO: 2077901 - RNA, 19 nt, Homo sapiens
caggucacccuuugcugug

SEQ ID NO: 2077902 - RNA, 20 nt, Homo sapiens
ugaugugcaaaggcaucuga

SEQ ID NO: 2077903 - RNA, 20 nt, Homo sapiens
aagggauggacaucuuguca

SEQ ID NO: 2077904 - RNA, 21 nt, Homo sapiens
ccauccugcagauacuuugaa

SEQ ID NO: 2077905 - RNA, 20 nt, Homo sapiens
acagaccuacugcacugagu

SEQ ID NO: 2077906 - RNA, 22 nt, Homo sapiens
auuauguaacuccuccauccau

SEQ ID NO: 2077907 - RNA, 19 nt, Homo sapiens
aauuuagucuagacacaau

SEQ ID NO: 2077908 - RNA, 17 nt, Homo sapiens
aucccgucgacguagaa

SEQ ID NO: 2077909 - RNA, 23 nt, Homo sapiens
acauuggcagugugucacacuga

SEQ ID NO: 2077910 - RNA, 19 nt, Homo sapiens
acugcaaugccaguuuccu

SEQ ID NO: 2077911 - RNA, 12 nt, Homo sapiens
accaaccacagc

SEQ ID NO: 2077912 - RNA, 18 nt, Homo sapiens
ucuccccagcccagagac

SEQ ID NO: 2077913 - RNA, 17 nt, Homo sapiens
gcagugagcuguguucu

SEQ ID NO: 2077914 - RNA, 15 nt, Homo sapiens
augaaaaaagcuuua

SEQ ID NO: 2077915 - RNA, 13 nt, Homo sapiens
uaaucuacuguaa

SEQ ID NO: 2077916 - RNA, 20 nt, Homo sapiens
cuuucauauuuuccaaauua

SEQ ID NO: 2077917 - RNA, 21 nt, Homo sapiens
acugaggacuguuugcaauug

SEQ ID NO: 2077918 - RNA, 13 nt, Homo sapiens
auauauacacaca

SEQ ID NO: 2077919 - RNA, 21 nt, Homo sapiens
uuuauaauguauacauuacau

SEQ ID NO: 2077920 - RNA, 10 nt, Homo sapiens
gcauguugcc

SEQ ID NO: 2077921 - RNA, 12 nt, Homo sapiens
acaguauuucca

SEQ ID NO: 2077922 - RNA, 22 nt, Homo sapiens
caggaguuugaggcugcagcga

SEQ ID NO: 2077923 - RNA, 17 nt, Homo sapiens
cuguacuucugugugca

SEQ ID NO: 2077924 - RNA, 20 nt, Homo sapiens
ugaauuucuccgaaugucaa

SEQ ID NO: 2077925 - RNA, 16 nt, Homo sapiens
gaaacuggacucacau

SEQ ID NO: 2077926 - RNA, 15 nt, Homo sapiens
acuaggggagggggu

SEQ ID NO: 2077927 - RNA, 23 nt, Homo sapiens
uaccuguuuuguggucagcugua

SEQ ID NO: 2077928 - RNA, 21 nt, Homo sapiens
uuaaaaucauucaauaucuga

SEQ ID NO: 2077929 - RNA, 15 nt, Homo sapiens
caaugaguuugggca

SEQ ID NO: 2077930 - RNA, 14 nt, Homo sapiens
caugaaaagauuau

SEQ ID NO: 2077931 - RNA, 21 nt, Homo sapiens
gccuugucucucacugcauuu

SEQ ID NO: 2077932 - RNA, 18 nt, Homo sapiens
cagguucacacucagaaa

SEQ ID NO: 2077933 - RNA, 21 nt, Homo sapiens
gaccuguaucaaacugcuuuu

SEQ ID NO: 2077934 - RNA, 14 nt, Homo sapiens
gaaaauaauuugag

SEQ ID NO: 2077935 - RNA, 14 nt, Homo sapiens
gaaauuaauuugug

SEQ ID NO: 2077936 - RNA, 21 nt, Homo sapiens
ucaccagucugucuacugugg

SEQ ID NO: 2077937 - RNA, 18 nt, Homo sapiens
agaaaccucuuuauccaa

SEQ ID NO: 2077938 - RNA, 22 nt, Homo sapiens
auacaggcauacacaugcacgc

SEQ ID NO: 2077939 - RNA, 14 nt, Homo sapiens
ucugugcuguguau

SEQ ID NO: 2077940 - RNA, 16 nt, Homo sapiens
gcaccccaggcagcuc

SEQ ID NO: 2077941 - RNA, 21 nt, Homo sapiens
uaagucauuccuccagugcau

SEQ ID NO: 2077942 - RNA, 16 nt, Homo sapiens
ccagguauuacacaag

SEQ ID NO: 2077943 - RNA, 20 nt, Homo sapiens
uguguuauaguaggauuaau

SEQ ID NO: 2077944 - RNA, 15 nt, Homo sapiens
uuuccuacuaucauc

SEQ ID NO: 2077945 - RNA, 15 nt, Homo sapiens
cuuaaacccauacaa

SEQ ID NO: 2077946 - RNA, 18 nt, Homo sapiens
auagcagggcugggcucu

SEQ ID NO: 2077947 - RNA, 16 nt, Homo sapiens
uuaggcaauacaccaa

SEQ ID NO: 2077948 - RNA, 16 nt, Homo sapiens
aaaugugaacauggaa

SEQ ID NO: 2077949 - RNA, 14 nt, Homo sapiens
cuggggaggugaac

SEQ ID NO: 2077950 - RNA, 21 nt, Homo sapiens
acucuuguguuuuuugcucac

SEQ ID NO: 2077951 - RNA, 14 nt, Homo sapiens
caacaagaacugca

SEQ ID NO: 2077952 - RNA, 16 nt, Homo sapiens
cugugguuaacaucuc

SEQ ID NO: 2077953 - RNA, 22 nt, Homo sapiens
ccucaaaugagaaaaugucuuu

SEQ ID NO: 2077954 - RNA, 21 nt, Homo sapiens
aagauuagugauucaucuuca

SEQ ID NO: 2077955 - RNA, 12 nt, Homo sapiens
ucaaacugugaa

SEQ ID NO: 2077956 - RNA, 12 nt, Homo sapiens
gcccacugggcc

SEQ ID NO: 2077957 - RNA, 13 nt, Homo sapiens
uaguaagugcuuu

SEQ ID NO: 2077958 - RNA, 20 nt, Homo sapiens
uaggaaagugccugcuuuua

SEQ ID NO: 2077959 - RNA, 21 nt, Homo sapiens
gccuacuuucacacuaagaaa

SEQ ID NO: 2077960 - RNA, 16 nt, Homo sapiens
ucuaauuccuguugcu

SEQ ID NO: 2077961 - RNA, 22 nt, Homo sapiens
uuccugcgcgucaucucugaca

SEQ ID NO: 2077962 - RNA, 20 nt, Homo sapiens
uaaagugaggccacugaaga

SEQ ID NO: 2077963 - RNA, 16 nt, Homo sapiens
cuggguggaucggccu

SEQ ID NO: 2077964 - RNA, 14 nt, Homo sapiens
ccacucagggguca

SEQ ID NO: 2077965 - RNA, 19 nt, Homo sapiens
auagaugaacuauuagaca

SEQ ID NO: 2077966 - RNA, 20 nt, Homo sapiens
acacucacuccacaacccaa

SEQ ID NO: 2077967 - RNA, 21 nt, Homo sapiens
gaagauugcgguuuacagcua

SEQ ID NO: 2077968 - RNA, 15 nt, Homo sapiens
acucugaauuccaag

SEQ ID NO: 2077969 - RNA, 18 nt, Homo sapiens
auucagugcaccugccuc

SEQ ID NO: 2077970 - RNA, 18 nt, Homo sapiens
caccugaccagaaugcgc

SEQ ID NO: 2077971 - RNA, 18 nt, Homo sapiens
uauuccuccaaaucucuu

SEQ ID NO: 2077972 - RNA, 19 nt, Homo sapiens
ccugggagaccagggacca

SEQ ID NO: 2077973 - RNA, 13 nt, Homo sapiens
cagucauuucaau

SEQ ID NO: 2077974 - RNA, 13 nt, Homo sapiens
cauggugaugcaa

SEQ ID NO: 2077975 - RNA, 20 nt, Homo sapiens
auucaacaacuacuacuuga

SEQ ID NO: 2077976 - RNA, 16 nt, Homo sapiens
ugaaaacaucugcaca

SEQ ID NO: 2077977 - RNA, 15 nt, Homo sapiens
caaaaaugcacccaa

SEQ ID NO: 2077978 - RNA, 17 nt, Homo sapiens
ucugauucacagucuca

SEQ ID NO: 2077979 - RNA, 18 nt, Homo sapiens
aacaccuucauccagauu

SEQ ID NO: 2077980 - RNA, 15 nt, Homo sapiens
cacuucuguaugcau

SEQ ID NO: 2077981 - RNA, 17 nt, Homo sapiens
gaaaggacccugugagc

SEQ ID NO: 2077982 - RNA, 17 nt, Homo sapiens
accuccaccuccuccag

SEQ ID NO: 2077983 - RNA, 15 nt, Homo sapiens
ccaaaguauucauau

SEQ ID NO: 2077984 - RNA, 23 nt, Homo sapiens
augucucucuugagcuacaguag

SEQ ID NO: 2077985 - RNA, 16 nt, Homo sapiens
gacacauguccaagaa

SEQ ID NO: 2077986 - RNA, 22 nt, Homo sapiens
uagggggagcaaaucgugccuu

SEQ ID NO: 2077987 - RNA, 18 nt, Homo sapiens
cucgccuucaucucccaa

SEQ ID NO: 2077988 - RNA, 17 nt, Homo sapiens
cuuccuggucuuugaau

SEQ ID NO: 2077989 - RNA, 15 nt, Homo sapiens
aagccuugcccagca

SEQ ID NO: 2077990 - RNA, 13 nt, Homo sapiens
ucccauguuguca

SEQ ID NO: 2077991 - RNA, 17 nt, Homo sapiens
auggggccacagccaga

SEQ ID NO: 2077992 - RNA, 15 nt, Homo sapiens
ucuuuucuccuccuc

SEQ ID NO: 2077993 - RNA, 18 nt, Homo sapiens
acgauucuucacuucuug

SEQ ID NO: 2077994 - RNA, 16 nt, Homo sapiens
gcugugaacauggacu

SEQ ID NO: 2077995 - RNA, 21 nt, Homo sapiens
cuuugagucaauagcuugucu

SEQ ID NO: 2077996 - RNA, 17 nt, Homo sapiens
aaaagcacgacagugga

SEQ ID NO: 2077997 - RNA, 17 nt, Homo sapiens
aucuaaaaacuuagaaa

SEQ ID NO: 2077998 - RNA, 20 nt, Homo sapiens
ccuugugguugaaaaccaca

SEQ ID NO: 2077999 - RNA, 13 nt, Homo sapiens
caccuucaccuuc

SEQ ID NO: 2078000 - RNA, 14 nt, Homo sapiens
gcaggcacagagga

SEQ ID NO: 2078001 - RNA, 15 nt, Homo sapiens
cucaauaaguuuauu

SEQ ID NO: 2078002 - RNA, 17 nt, Homo sapiens
uuugcuucuugccauca

SEQ ID NO: 2078003 - RNA, 22 nt, Homo sapiens
aucuuguguuaacuugccucca

SEQ ID NO: 2078004 - RNA, 21 nt, Homo sapiens
agauggaccggcccacacucc

SEQ ID NO: 2078005 - RNA, 16 nt, Homo sapiens
aggcaaaaaugugccc

SEQ ID NO: 2078006 - RNA, 23 nt, Homo sapiens
cucccaggcugcuggagugcagu

SEQ ID NO: 2078007 - RNA, 21 nt, Homo sapiens
ccuuugucuaaguagggccag

SEQ ID NO: 2078008 - RNA, 22 nt, Homo sapiens
ugacaaauauuuuagaagcuaa

SEQ ID NO: 2078009 - RNA, 13 nt, Homo sapiens
cacuucugagcuc

SEQ ID NO: 2078010 - RNA, 19 nt, Homo sapiens
guucacucuucucagccac

SEQ ID NO: 2078011 - RNA, 15 nt, Homo sapiens
cugcaccuugccagg

SEQ ID NO: 2078012 - RNA, 14 nt, Homo sapiens
uacuuaugaugaug

SEQ ID NO: 2078013 - RNA, 14 nt, Homo sapiens
uccaaacuguguca

SEQ ID NO: 2078014 - RNA, 18 nt, Homo sapiens
ugcugacgggacccacau

SEQ ID NO: 2078015 - RNA, 22 nt, Homo sapiens
augaagguggagggucucuagu

SEQ ID NO: 2078016 - RNA, 14 nt, Homo sapiens
aagucacugucaga

SEQ ID NO: 2078017 - RNA, 16 nt, Homo sapiens
auaaaagacuauucua

SEQ ID NO: 2078018 - RNA, 14 nt, Homo sapiens
uacuccugugcugg

SEQ ID NO: 2078019 - RNA, 12 nt, Homo sapiens
cagcaaugauua

SEQ ID NO: 2078020 - RNA, 18 nt, Homo sapiens
uccucuggggaagggaac

SEQ ID NO: 2078021 - RNA, 12 nt, Homo sapiens
uuuaaauggagg

SEQ ID NO: 2078022 - RNA, 19 nt, Homo sapiens
cauuuuuuaaaacaagaaa

SEQ ID NO: 2078023 - RNA, 21 nt, Homo sapiens
gcccagaauccccaagugccu

SEQ ID NO: 2078024 - RNA, 16 nt, Homo sapiens
gcuacugccaaccucg

SEQ ID NO: 2078025 - RNA, 16 nt, Homo sapiens
aaugaauacugggaau

SEQ ID NO: 2078026 - RNA, 10 nt, Homo sapiens
gaaaccagag

SEQ ID NO: 2078027 - RNA, 19 nt, Homo sapiens
agauaagugcagucacaga

SEQ ID NO: 2078028 - RNA, 23 nt, Homo sapiens
agcuguuguaguuacaguaaaua

SEQ ID NO: 2078029 - RNA, 21 nt, Homo sapiens
uuucuuguuugauuuuugaca

SEQ ID NO: 2078030 - RNA, 14 nt, Homo sapiens
agaaggcucagccu

SEQ ID NO: 2078031 - RNA, 13 nt, Homo sapiens
gugugacaggucc

SEQ ID NO: 2078032 - RNA, 18 nt, Homo sapiens
uguuguuugguucaggga

SEQ ID NO: 2078033 - RNA, 16 nt, Homo sapiens
aauaaaaacucaagga

SEQ ID NO: 2078034 - RNA, 16 nt, Homo sapiens
gaaaaaaaaauacuua

SEQ ID NO: 2078035 - RNA, 14 nt, Homo sapiens
ucccaagucaaaca

SEQ ID NO: 2078036 - RNA, 23 nt, Homo sapiens
acagugaaaauguaagcuguuua

SEQ ID NO: 2078037 - RNA, 17 nt, Homo sapiens
ccaucaauucuuagaau

SEQ ID NO: 2078038 - RNA, 22 nt, Homo sapiens
aucagguagacuuuuaauauca

SEQ ID NO: 2078039 - RNA, 23 nt, Homo sapiens
uccuuuaggucugguuguugcac

SEQ ID NO: 2078040 - RNA, 14 nt, Homo sapiens
uacagacucugauu

SEQ ID NO: 2078041 - RNA, 19 nt, Homo sapiens
aggaccaauugacucucac

SEQ ID NO: 2078042 - RNA, 21 nt, Homo sapiens
cagugggaccccacagaguug

SEQ ID NO: 2078043 - RNA, 18 nt, Homo sapiens
cacaaaauacagcacuuu

SEQ ID NO: 2078044 - RNA, 17 nt, Homo sapiens
uucugaaucaaggugau

SEQ ID NO: 2078045 - RNA, 15 nt, Homo sapiens
uccucuuaauuccca

SEQ ID NO: 2078046 - RNA, 23 nt, Homo sapiens
agguaccuucucaccugugagac

SEQ ID NO: 2078047 - RNA, 14 nt, Homo sapiens
uuucaagcucugca

SEQ ID NO: 2078048 - RNA, 24 nt, Homo sapiens
cagcuacuuggaaggcugaggcag

SEQ ID NO: 2078049 - RNA, 15 nt, Homo sapiens
aaucaaucuacucaa

SEQ ID NO: 2078050 - RNA, 14 nt, Homo sapiens
gcaaucaugugcuu

SEQ ID NO: 2078051 - RNA, 24 nt, Homo sapiens
ggaaaagaaaucuaugauuccagg

SEQ ID NO: 2078052 - RNA, 15 nt, Homo sapiens
cuucguacaguucuu

SEQ ID NO: 2078053 - RNA, 22 nt, Homo sapiens
ccagugugcuugggaucuucaa

SEQ ID NO: 2078054 - RNA, 18 nt, Homo sapiens
gcucacugaaucuucacg

SEQ ID NO: 2078055 - RNA, 20 nt, Homo sapiens
caaggcaguucuguguccuc

SEQ ID NO: 2078056 - RNA, 19 nt, Homo sapiens
aaauagauuucuuugcaca

SEQ ID NO: 2078057 - RNA, 17 nt, Homo sapiens
aaauaauuuuacauguc

SEQ ID NO: 2078058 - RNA, 12 nt, Homo sapiens
gaauaaucucau

SEQ ID NO: 2078059 - RNA, 23 nt, Homo sapiens
auucacaaagaaacguugcgaaa

SEQ ID NO: 2078060 - RNA, 21 nt, Homo sapiens
uucuuccuuaaagcauuugca

SEQ ID NO: 2078061 - RNA, 21 nt, Homo sapiens
ucccuucaucuggaaccauca

SEQ ID NO: 2078062 - RNA, 21 nt, Homo sapiens
accuuggaaaugaccaggcca

SEQ ID NO: 2078063 - RNA, 11 nt, Homo sapiens
cagacauguau

SEQ ID NO: 2078064 - RNA, 11 nt, Homo sapiens
aaagugacaug

SEQ ID NO: 2078065 - RNA, 13 nt, Homo sapiens
cuccuuuacuaaa

SEQ ID NO: 2078066 - RNA, 17 nt, Homo sapiens
aggcaggagaacuacuu

SEQ ID NO: 2078067 - RNA, 16 nt, Homo sapiens
agguugggaaugaggc

SEQ ID NO: 2078068 - RNA, 18 nt, Homo sapiens
aaacaugaaaacauugau

SEQ ID NO: 2078069 - RNA, 14 nt, Homo sapiens
agagugaacauauc

SEQ ID NO: 2078070 - RNA, 14 nt, Homo sapiens
uaaauauugucaua

SEQ ID NO: 2078071 - RNA, 15 nt, Homo sapiens
acagagcguccuucc

SEQ ID NO: 2078072 - RNA, 20 nt, Homo sapiens
cgcccaccucggccucccaa

SEQ ID NO: 2078073 - RNA, 20 nt, Homo sapiens
gggcagaagugaaugccugu

SEQ ID NO: 2078074 - RNA, 19 nt, Homo sapiens
uuuguccccuccaaaucuc

SEQ ID NO: 2078075 - RNA, 22 nt, Homo sapiens
ucauuagggaaaugcaagucaa

SEQ ID NO: 2078076 - RNA, 16 nt, Homo sapiens
uugucuacuugcucca

SEQ ID NO: 2078077 - RNA, 21 nt, Homo sapiens
gaaauaaagcguccucucagu

SEQ ID NO: 2078078 - RNA, 17 nt, Homo sapiens
auucacccaagggucag

SEQ ID NO: 2078079 - RNA, 23 nt, Homo sapiens
ugcaauaaaagguauugagccau

SEQ ID NO: 2078080 - RNA, 17 nt, Homo sapiens
ccauuccggguucacuc

SEQ ID NO: 2078081 - RNA, 22 nt, Homo sapiens
caacauagucauaaaauaguau

SEQ ID NO: 2078082 - RNA, 15 nt, Homo sapiens
ccaaacucugccagc

SEQ ID NO: 2078083 - RNA, 18 nt, Homo sapiens
gugacaugaacuacagac

SEQ ID NO: 2078084 - RNA, 18 nt, Homo sapiens
cuucccauuucucuacac

SEQ ID NO: 2078085 - RNA, 23 nt, Homo sapiens
aauaccuccaaagauauuuucag

SEQ ID NO: 2078086 - RNA, 13 nt, Homo sapiens
gcuucacaguacc

SEQ ID NO: 2078087 - RNA, 17 nt, Homo sapiens
ucaccgagcgggugcaa

SEQ ID NO: 2078088 - RNA, 22 nt, Homo sapiens
ccacguccagcuggaaggguca

SEQ ID NO: 2078089 - RNA, 21 nt, Homo sapiens
aagagguuuuaaaaaaauccc

SEQ ID NO: 2078090 - RNA, 13 nt, Homo sapiens
uuugacccacuca

SEQ ID NO: 2078091 - RNA, 11 nt, Homo sapiens
cuucagaacag

SEQ ID NO: 2078092 - RNA, 15 nt, Homo sapiens
ggcuacacagggaug

SEQ ID NO: 2078093 - RNA, 22 nt, Homo sapiens
ggauaguuugggggaacuugua

SEQ ID NO: 2078094 - RNA, 14 nt, Homo sapiens
uucccucuccagcc

SEQ ID NO: 2078095 - RNA, 23 nt, Homo sapiens
caggagcggcgaugcacucgcac

SEQ ID NO: 2078096 - RNA, 16 nt, Homo sapiens
ccauuuuuuucacuca

SEQ ID NO: 2078097 - RNA, 14 nt, Homo sapiens
cagcggcugcccuc

SEQ ID NO: 2078098 - RNA, 15 nt, Homo sapiens
cucugaggacacaga

SEQ ID NO: 2078099 - RNA, 18 nt, Homo sapiens
aggcaucaaaaaaacaag

SEQ ID NO: 2078100 - RNA, 19 nt, Homo sapiens
cagauugaauuugccuaau

SEQ ID NO: 2078101 - RNA, 14 nt, Homo sapiens
aaagcucuguugca

SEQ ID NO: 2078102 - RNA, 11 nt, Homo sapiens
caguguuuaca

SEQ ID NO: 2078103 - RNA, 19 nt, Homo sapiens
gcuggcccccaccgcugug

SEQ ID NO: 2078104 - RNA, 13 nt, Homo sapiens
gaugccauagcau

SEQ ID NO: 2078105 - RNA, 21 nt, Homo sapiens
cacuuggagcuaaaacuggcc

SEQ ID NO: 2078106 - RNA, 20 nt, Homo sapiens
agaacuugcaauaccaaugu

SEQ ID NO: 2078107 - RNA, 15 nt, Homo sapiens
agaucugaacccagc

SEQ ID NO: 2078108 - RNA, 15 nt, Homo sapiens
acauaggaagcccuc

SEQ ID NO: 2078109 - RNA, 14 nt, Homo sapiens
acuaagcaauuucc

SEQ ID NO: 2078110 - RNA, 16 nt, Homo sapiens
gaaauaaguuguuuca

SEQ ID NO: 2078111 - RNA, 22 nt, Homo sapiens
ggcaaccucugagccaucccag

SEQ ID NO: 2078112 - RNA, 17 nt, Homo sapiens
aagucacuuaacuauaa

SEQ ID NO: 2078113 - RNA, 15 nt, Homo sapiens
auucgaaugacacug

SEQ ID NO: 2078114 - RNA, 15 nt, Homo sapiens
caaugcaauguggaa

SEQ ID NO: 2078115 - RNA, 19 nt, Homo sapiens
gcaaaauacaugacauuua

SEQ ID NO: 2078116 - RNA, 21 nt, Homo sapiens
ucuggaaauuuuuacuuuaaa

SEQ ID NO: 2078117 - RNA, 18 nt, Homo sapiens
gauaaucagaagcuauaa

SEQ ID NO: 2078118 - RNA, 12 nt, Homo sapiens
aaucuacacucc

SEQ ID NO: 2078119 - RNA, 12 nt, Homo sapiens
cacuuacaauuu

SEQ ID NO: 2078120 - RNA, 14 nt, Homo sapiens
auguuugcacugau

SEQ ID NO: 2078121 - RNA, 16 nt, Homo sapiens
aucuucacugaauauc

SEQ ID NO: 2078122 - RNA, 19 nt, Homo sapiens
uguaacauagaguauauaa

SEQ ID NO: 2078123 - RNA, 15 nt, Homo sapiens
gcccagcugaucuaa

SEQ ID NO: 2078124 - RNA, 24 nt, Homo sapiens
gaaugcuuaccaaguccugggaau

SEQ ID NO: 2078125 - RNA, 22 nt, Homo sapiens
ccaagucauccucccaccucag

SEQ ID NO: 2078126 - RNA, 17 nt, Homo sapiens
auuucuauccugaguag

SEQ ID NO: 2078127 - RNA, 17 nt, Homo sapiens
cccagcccuauggaugu

SEQ ID NO: 2078128 - RNA, 12 nt, Homo sapiens
gccaauccaugc

SEQ ID NO: 2078129 - RNA, 23 nt, Homo sapiens
aggaacuagacuuuccuuugcac

SEQ ID NO: 2078130 - RNA, 15 nt, Homo sapiens
uugacuaccugaugu

SEQ ID NO: 2078131 - RNA, 18 nt, Homo sapiens
caggugcaaucuacugga

SEQ ID NO: 2078132 - RNA, 19 nt, Homo sapiens
gguugcgggggagcuggaa

SEQ ID NO: 2078133 - RNA, 19 nt, Homo sapiens
uccaacacuuugagcauuu

SEQ ID NO: 2078134 - RNA, 13 nt, Homo sapiens
ucccgcaggcuuc

SEQ ID NO: 2078135 - RNA, 22 nt, Homo sapiens
cauuauccuuuuaucucacaaa

SEQ ID NO: 2078136 - RNA, 17 nt, Homo sapiens
aagaauaugcaucuuaa

SEQ ID NO: 2078137 - RNA, 21 nt, Homo sapiens
gaucaguagccccuaaucaca

SEQ ID NO: 2078138 - RNA, 21 nt, Homo sapiens
cuggaagcuuuguccccugcu

SEQ ID NO: 2078139 - RNA, 16 nt, Homo sapiens
cccauugauguacuuu

SEQ ID NO: 2078140 - RNA, 21 nt, Homo sapiens
ugcacagcaaaagaaacuauc

SEQ ID NO: 2078141 - RNA, 20 nt, Homo sapiens
ccuugcccuuccagcccuuu

SEQ ID NO: 2078142 - RNA, 18 nt, Homo sapiens
gucugugagaugcuagaa

SEQ ID NO: 2078143 - RNA, 16 nt, Homo sapiens
acuauaaagcuguuau

SEQ ID NO: 2078144 - RNA, 12 nt, Homo sapiens
ucuaagaaagaa

SEQ ID NO: 2078145 - RNA, 20 nt, Homo sapiens
auguaaugaucuuggaccau

SEQ ID NO: 2078146 - RNA, 23 nt, Homo sapiens
cuucuuggccaugggaggccuuu

SEQ ID NO: 2078147 - RNA, 18 nt, Homo sapiens
gcccaucucaggugccac

SEQ ID NO: 2078148 - RNA, 20 nt, Homo sapiens
aucacuuccuauaugcacuu

SEQ ID NO: 2078149 - RNA, 20 nt, Homo sapiens
gagccuucucagaagcacag

SEQ ID NO: 2078150 - RNA, 22 nt, Homo sapiens
augcugcuaugaagacuacuuu

SEQ ID NO: 2078151 - RNA, 18 nt, Homo sapiens
cugggcaaggaagcuuug

SEQ ID NO: 2078152 - RNA, 21 nt, Homo sapiens
guaacacugaugauagguuaa

SEQ ID NO: 2078153 - RNA, 16 nt, Homo sapiens
aaaucauuaacacuuu

SEQ ID NO: 2078154 - RNA, 14 nt, Homo sapiens
acuaaaauguucua

SEQ ID NO: 2078155 - RNA, 23 nt, Homo sapiens
auguguauggguuaaaucaaaga

SEQ ID NO: 2078156 - RNA, 23 nt, Homo sapiens
accgugcucauugcuaaccacug

SEQ ID NO: 2078157 - RNA, 15 nt, Homo sapiens
acaaaccacuguaca

SEQ ID NO: 2078158 - RNA, 16 nt, Homo sapiens
aacacgcguauuuaca

SEQ ID NO: 2078159 - RNA, 24 nt, Homo sapiens
gugccagcucaggugacuggagcc

SEQ ID NO: 2078160 - RNA, 16 nt, Homo sapiens
auguacaggcugagac

SEQ ID NO: 2078161 - RNA, 19 nt, Homo sapiens
cuaauauuagggaguaaaa

SEQ ID NO: 2078162 - RNA, 12 nt, Homo sapiens
ugcugccugaau

SEQ ID NO: 2078163 - RNA, 20 nt, Homo sapiens
cccacguggacucugugcuc

SEQ ID NO: 2078164 - RNA, 21 nt, Homo sapiens
auuuuaauuaaaaucaauuca

SEQ ID NO: 2078165 - RNA, 22 nt, Homo sapiens
cgggacagaccagcagcaaucu

SEQ ID NO: 2078166 - RNA, 22 nt, Homo sapiens
aggcuucagugagccaugauca

SEQ ID NO: 2078167 - RNA, 22 nt, Homo sapiens
ucaaucucuuaaagagaaucca

SEQ ID NO: 2078168 - RNA, 22 nt, Homo sapiens
uugcaacuuuaguuuguguuau

SEQ ID NO: 2078169 - RNA, 15 nt, Homo sapiens
uauguucauaucuau

SEQ ID NO: 2078170 - RNA, 20 nt, Homo sapiens
acagcacuguauguguugca

SEQ ID NO: 2078171 - RNA, 16 nt, Homo sapiens
uaaaagugcacauuaa

SEQ ID NO: 2078172 - RNA, 16 nt, Homo sapiens
uguuuauguaacuauc

SEQ ID NO: 2078173 - RNA, 18 nt, Homo sapiens
cccuggcaccuguggcca

SEQ ID NO: 2078174 - RNA, 22 nt, Homo sapiens
ucagaaaaaaaaaaaaaagccu

SEQ ID NO: 2078175 - RNA, 13 nt, Homo sapiens
aaauaugcaguga

SEQ ID NO: 2078176 - RNA, 15 nt, Homo sapiens
ugggacgaaagcaca

SEQ ID NO: 2078177 - RNA, 19 nt, Homo sapiens
augucuaaguaugccucag

SEQ ID NO: 2078178 - RNA, 22 nt, Homo sapiens
gcauuuguuuccucaucuuuaa

SEQ ID NO: 2078179 - RNA, 16 nt, Homo sapiens
acccccaggaccccug

SEQ ID NO: 2078180 - RNA, 16 nt, Homo sapiens
uuuacuuuaaaaagua

SEQ ID NO: 2078181 - RNA, 14 nt, Homo sapiens
gaguuggugugcua

SEQ ID NO: 2078182 - RNA, 13 nt, Homo sapiens
aggccagugucug

SEQ ID NO: 2078183 - RNA, 18 nt, Homo sapiens
gcacauuucauaguuuca

SEQ ID NO: 2078184 - RNA, 20 nt, Homo sapiens
cucugggccaagacuccugu

SEQ ID NO: 2078185 - RNA, 20 nt, Homo sapiens
gacauggagaacaacccaag

SEQ ID NO: 2078186 - RNA, 19 nt, Homo sapiens
ugaagaaucuaaugaaugu

SEQ ID NO: 2078187 - RNA, 16 nt, Homo sapiens
aaagccacaucuugcu

SEQ ID NO: 2078188 - RNA, 21 nt, Homo sapiens
gcucucuugugacgugcacug

SEQ ID NO: 2078189 - RNA, 17 nt, Homo sapiens
uuuccuuucgucugcca

SEQ ID NO: 2078190 - RNA, 12 nt, Homo sapiens
ugaguacuguua

SEQ ID NO: 2078191 - RNA, 15 nt, Homo sapiens
uccaaguauuuugcc

SEQ ID NO: 2078192 - RNA, 19 nt, Homo sapiens
caaauuaacuagauacaga

SEQ ID NO: 2078193 - RNA, 13 nt, Homo sapiens
acaggaucaugua

SEQ ID NO: 2078194 - RNA, 15 nt, Homo sapiens
auccuuuuauucucc

SEQ ID NO: 2078195 - RNA, 21 nt, Homo sapiens
aauauccuguguaacacuugg

SEQ ID NO: 2078196 - RNA, 19 nt, Homo sapiens
aggugagaguauagugcau

SEQ ID NO: 2078197 - RNA, 23 nt, Homo sapiens
gauccugcuguggccucacuucc

SEQ ID NO: 2078198 - RNA, 13 nt, Homo sapiens
acuugaacccagg

SEQ ID NO: 2078199 - RNA, 20 nt, Homo sapiens
gggucuuggggacuaaccca

SEQ ID NO: 2078200 - RNA, 20 nt, Homo sapiens
uacauacuuuaucaaugugu

SEQ ID NO: 2078201 - RNA, 12 nt, Homo sapiens
auguggcccaac

SEQ ID NO: 2078202 - RNA, 20 nt, Homo sapiens
auugcccaaauaauauuuua

SEQ ID NO: 2078203 - RNA, 16 nt, Homo sapiens
aggaagauguaugcuu

SEQ ID NO: 2078204 - RNA, 21 nt, Homo sapiens
uaccaguugcccuagcccaga

SEQ ID NO: 2078205 - RNA, 22 nt, Homo sapiens
uaauuuuaacagacauguauac

SEQ ID NO: 2078206 - RNA, 17 nt, Homo sapiens
agggacaagcauguuga

SEQ ID NO: 2078207 - RNA, 13 nt, Homo sapiens
caugugacauuua

SEQ ID NO: 2078208 - RNA, 15 nt, Homo sapiens
aggaucaguuugcag

SEQ ID NO: 2078209 - RNA, 11 nt, Homo sapiens
aaauaccucau

SEQ ID NO: 2078210 - RNA, 20 nt, Homo sapiens
accugaggcccccaucuccu

SEQ ID NO: 2078211 - RNA, 13 nt, Homo sapiens
cugaccaaagaga

SEQ ID NO: 2078212 - RNA, 23 nt, Homo sapiens
gcuccauguugcuucacucuauc

SEQ ID NO: 2078213 - RNA, 11 nt, Homo sapiens
gcuauucccug

SEQ ID NO: 2078214 - RNA, 16 nt, Homo sapiens
ggagacugucucaaga

SEQ ID NO: 2078215 - RNA, 18 nt, Homo sapiens
ugguggggaccagcuaau

SEQ ID NO: 2078216 - RNA, 16 nt, Homo sapiens
gcuuuuugaaauaagg

SEQ ID NO: 2078217 - RNA, 20 nt, Homo sapiens
agagucuuugauucaccaaa

SEQ ID NO: 2078218 - RNA, 13 nt, Homo sapiens
uauccuagcacau

SEQ ID NO: 2078219 - RNA, 19 nt, Homo sapiens
gucuccuuugcucuugcca

SEQ ID NO: 2078220 - RNA, 22 nt, Homo sapiens
uugagguuuuguaaaacuguua

SEQ ID NO: 2078221 - RNA, 22 nt, Homo sapiens
cuugaccuaaugagguagcuau

SEQ ID NO: 2078222 - RNA, 19 nt, Homo sapiens
uuuagcuguauucauauau

SEQ ID NO: 2078223 - RNA, 17 nt, Homo sapiens
cuuuucccauugccaug

SEQ ID NO: 2078224 - RNA, 13 nt, Homo sapiens
guuccccaaaaca

SEQ ID NO: 2078225 - RNA, 14 nt, Homo sapiens
gaaacugagucacu

SEQ ID NO: 2078226 - RNA, 19 nt, Homo sapiens
cauggccagcagcaccugc

SEQ ID NO: 2078227 - RNA, 18 nt, Homo sapiens
cuacucuuugccaauccc

SEQ ID NO: 2078228 - RNA, 15 nt, Homo sapiens
uggcauaaccugucu

SEQ ID NO: 2078229 - RNA, 17 nt, Homo sapiens
aauuuaauauacugcau

SEQ ID NO: 2078230 - RNA, 19 nt, Homo sapiens
ccuuguuauuuaacccauu

SEQ ID NO: 2078231 - RNA, 17 nt, Homo sapiens
uccucccccaguuccuc

SEQ ID NO: 2078232 - RNA, 21 nt, Homo sapiens
aagggaccccagauaccugug

SEQ ID NO: 2078233 - RNA, 22 nt, Homo sapiens
gccccaggcacuuugcaucaca

SEQ ID NO: 2078234 - RNA, 16 nt, Homo sapiens
auugcagcaagcaaua

SEQ ID NO: 2078235 - RNA, 16 nt, Homo sapiens
gcuucagagacacaca

SEQ ID NO: 2078236 - RNA, 16 nt, Homo sapiens
aacucugcacuacucc

SEQ ID NO: 2078237 - RNA, 16 nt, Homo sapiens
ccuucucccacacugc

SEQ ID NO: 2078238 - RNA, 18 nt, Homo sapiens
gggaaccucacucuugcc

SEQ ID NO: 2078239 - RNA, 18 nt, Homo sapiens
accaauuugcaccaguuu

SEQ ID NO: 2078240 - RNA, 20 nt, Homo sapiens
acagagucuugcucugucuc

SEQ ID NO: 2078241 - RNA, 17 nt, Homo sapiens
caaaaucacaauucucu

SEQ ID NO: 2078242 - RNA, 11 nt, Homo sapiens
ccuauuugacu

SEQ ID NO: 2078243 - RNA, 13 nt, Homo sapiens
ugaucuucagggc

SEQ ID NO: 2078244 - RNA, 14 nt, Homo sapiens
gggacccugcacag

SEQ ID NO: 2078245 - RNA, 19 nt, Homo sapiens
aguugagcucuaucuucau

SEQ ID NO: 2078246 - RNA, 15 nt, Homo sapiens
agagcaucugcaaca

SEQ ID NO: 2078247 - RNA, 15 nt, Homo sapiens
auaaagauuucuagu

SEQ ID NO: 2078248 - RNA, 19 nt, Homo sapiens
aaucccagacuacuucagc

SEQ ID NO: 2078249 - RNA, 17 nt, Homo sapiens
cauaaugaguuccugag

SEQ ID NO: 2078250 - RNA, 15 nt, Homo sapiens
agagaaacacugcug

SEQ ID NO: 2078251 - RNA, 15 nt, Homo sapiens
acucuagaucagaau

SEQ ID NO: 2078252 - RNA, 15 nt, Homo sapiens
cugagggcaggguuc

SEQ ID NO: 2078253 - RNA, 22 nt, Homo sapiens
ucucagagugguucugagauua

SEQ ID NO: 2078254 - RNA, 15 nt, Homo sapiens
uuguaaauacuccau

SEQ ID NO: 2078255 - RNA, 20 nt, Homo sapiens
gggauuucauuucaggugca

SEQ ID NO: 2078256 - RNA, 20 nt, Homo sapiens
ugcacuuguggcaacagaua

SEQ ID NO: 2078257 - RNA, 14 nt, Homo sapiens
gaaagugacaugca

SEQ ID NO: 2078258 - RNA, 18 nt, Homo sapiens
uaagccagacgugguggc

SEQ ID NO: 2078259 - RNA, 18 nt, Homo sapiens
uaacauuucuguucucau

SEQ ID NO: 2078260 - RNA, 13 nt, Homo sapiens
cccagacuccuga

SEQ ID NO: 2078261 - RNA, 19 nt, Homo sapiens
ugauacuuuuuucauuauu

SEQ ID NO: 2078262 - RNA, 12 nt, Homo sapiens
agugggccucau

SEQ ID NO: 2078263 - RNA, 17 nt, Homo sapiens
ccuuugauguggaugaa

SEQ ID NO: 2078264 - RNA, 16 nt, Homo sapiens
ucauauuucaaaccac

SEQ ID NO: 2078265 - RNA, 18 nt, Homo sapiens
ucccaaauauuacaacaa

SEQ ID NO: 2078266 - RNA, 12 nt, Homo sapiens
gggccgugacag

SEQ ID NO: 2078267 - RNA, 16 nt, Homo sapiens
aggcugccccucucac

SEQ ID NO: 2078268 - RNA, 18 nt, Homo sapiens
aggcugucugugccaugg

SEQ ID NO: 2078269 - RNA, 17 nt, Homo sapiens
agcugcucagugcaacu

SEQ ID NO: 2078270 - RNA, 14 nt, Homo sapiens
gcacuucacagcug

SEQ ID NO: 2078271 - RNA, 11 nt, Homo sapiens
cuaauugugga

SEQ ID NO: 2078272 - RNA, 14 nt, Homo sapiens
caauuuacacugcc

SEQ ID NO: 2078273 - RNA, 15 nt, Homo sapiens
gagccugguccuucc

SEQ ID NO: 2078274 - RNA, 19 nt, Homo sapiens
aaguaccccugauaagcaa

SEQ ID NO: 2078275 - RNA, 15 nt, Homo sapiens
uaaaaacuuguacua

SEQ ID NO: 2078276 - RNA, 23 nt, Homo sapiens
guuacagcucauguuuucuauau

SEQ ID NO: 2078277 - RNA, 19 nt, Homo sapiens
cauuauuuuuccacuuugu

SEQ ID NO: 2078278 - RNA, 17 nt, Homo sapiens
ucucaccacgggaaagc

SEQ ID NO: 2078279 - RNA, 16 nt, Homo sapiens
agcccacauacuggau

SEQ ID NO: 2078280 - RNA, 14 nt, Homo sapiens
aagcuuuaugauuu

SEQ ID NO: 2078281 - RNA, 22 nt, Homo sapiens
ugauguaaaaaugaaaagccaa

SEQ ID NO: 2078282 - RNA, 20 nt, Homo sapiens
ugauagaaccauugcaauau

SEQ ID NO: 2078283 - RNA, 14 nt, Homo sapiens
augcucagggucaa

SEQ ID NO: 2078284 - RNA, 19 nt, Homo sapiens
agaaauguaacauacucau

SEQ ID NO: 2078285 - RNA, 18 nt, Homo sapiens
gaaccacagcagacacca

SEQ ID NO: 2078286 - RNA, 22 nt, Homo sapiens
cuaggguuuaugcuuaauuuua

SEQ ID NO: 2078287 - RNA, 13 nt, Homo sapiens
guucccaugagau

SEQ ID NO: 2078288 - RNA, 15 nt, Homo sapiens
auuuucaucuucuuc

SEQ ID NO: 2078289 - RNA, 16 nt, Homo sapiens
ugucuacaccauuaug

SEQ ID NO: 2078290 - RNA, 19 nt, Homo sapiens
uggccaggccuaguaacca

SEQ ID NO: 2078291 - RNA, 23 nt, Homo sapiens
acuguacacuuguuuggugcuaa

SEQ ID NO: 2078292 - RNA, 21 nt, Homo sapiens
ggguuuugucucugcaucuca

SEQ ID NO: 2078293 - RNA, 15 nt, Homo sapiens
ccaaauggcugcuuu

SEQ ID NO: 2078294 - RNA, 16 nt, Homo sapiens
gacugaagacucagcc

SEQ ID NO: 2078295 - RNA, 14 nt, Homo sapiens
aaacuucuuucacu

SEQ ID NO: 2078296 - RNA, 17 nt, Homo sapiens
agugggaauccgggaca

SEQ ID NO: 2078297 - RNA, 15 nt, Homo sapiens
auucagcauguccaa

SEQ ID NO: 2078298 - RNA, 15 nt, Homo sapiens
guccaaccagaaaca

SEQ ID NO: 2078299 - RNA, 19 nt, Homo sapiens
ucugagacuccagaccuga

SEQ ID NO: 2078300 - RNA, 19 nt, Homo sapiens
auuucuaacauaaguaaga

SEQ ID NO: 2078301 - RNA, 20 nt, Homo sapiens
accagaaggaagcccucuca

SEQ ID NO: 2078302 - RNA, 22 nt, Homo sapiens
cagauguugcaucccugaaaca

SEQ ID NO: 2078303 - RNA, 11 nt, Homo sapiens
gacacacugug

SEQ ID NO: 2078304 - RNA, 17 nt, Homo sapiens
cugcuuccuggcuccuu

SEQ ID NO: 2078305 - RNA, 18 nt, Homo sapiens
agagcaagacuccaucuc

SEQ ID NO: 2078306 - RNA, 19 nt, Homo sapiens
auccagcaaaaugucuccu

SEQ ID NO: 2078307 - RNA, 19 nt, Homo sapiens
ggaaaggaauccacaucau

SEQ ID NO: 2078308 - RNA, 13 nt, Homo sapiens
uuggugcaauaca

SEQ ID NO: 2078309 - RNA, 14 nt, Homo sapiens
uguucuauugucau

SEQ ID NO: 2078310 - RNA, 19 nt, Homo sapiens
gcuacagaaaauaaucugg

SEQ ID NO: 2078311 - RNA, 15 nt, Homo sapiens
cugaaaacaguaaaa

SEQ ID NO: 2078312 - RNA, 23 nt, Homo sapiens
uauccccagggacagaaaccaag

SEQ ID NO: 2078313 - RNA, 22 nt, Homo sapiens
cuuuaggaaagagaagcuuuca

SEQ ID NO: 2078314 - RNA, 16 nt, Homo sapiens
uacauucaacucugau

SEQ ID NO: 2078315 - RNA, 13 nt, Homo sapiens
uaaaauagucuca

SEQ ID NO: 2078316 - RNA, 13 nt, Homo sapiens
agggucucuucag

SEQ ID NO: 2078317 - RNA, 13 nt, Homo sapiens
augggcucugcau

SEQ ID NO: 2078318 - RNA, 17 nt, Homo sapiens
uccaaagccggcuugau

SEQ ID NO: 2078319 - RNA, 19 nt, Homo sapiens
auuauuucuuuucuaaaac

SEQ ID NO: 2078320 - RNA, 18 nt, Homo sapiens
ugcucguaugaauucauu

SEQ ID NO: 2078321 - RNA, 20 nt, Homo sapiens
cagaaggaagacuucauccc

SEQ ID NO: 2078322 - RNA, 20 nt, Homo sapiens
uuuaauaucuggcacuguua

SEQ ID NO: 2078323 - RNA, 14 nt, Homo sapiens
gcuucgucagcucc

SEQ ID NO: 2078324 - RNA, 12 nt, Homo sapiens
aggccucacuca

SEQ ID NO: 2078325 - RNA, 14 nt, Homo sapiens
acuucacacacagg

SEQ ID NO: 2078326 - RNA, 14 nt, Homo sapiens
cucaagaaagcccu

SEQ ID NO: 2078327 - RNA, 19 nt, Homo sapiens
cccaugugggcugaaggau

SEQ ID NO: 2078328 - RNA, 23 nt, Homo sapiens
cccucugcuuuucuucccagcaa

SEQ ID NO: 2078329 - RNA, 19 nt, Homo sapiens
ucugagacacaccccaaca

SEQ ID NO: 2078330 - RNA, 20 nt, Homo sapiens
gugaaauaagccagacauca

SEQ ID NO: 2078331 - RNA, 16 nt, Homo sapiens
acauucuguguucaca

SEQ ID NO: 2078332 - RNA, 21 nt, Homo sapiens
uuaguuaacuaugauuccaau

SEQ ID NO: 2078333 - RNA, 23 nt, Homo sapiens
cuggauuauguuauacaaggcaa

SEQ ID NO: 2078334 - RNA, 22 nt, Homo sapiens
aucuucuuccagauuuccuuuc

SEQ ID NO: 2078335 - RNA, 15 nt, Homo sapiens
uaagguccccacugc

SEQ ID NO: 2078336 - RNA, 17 nt, Homo sapiens
cuguuccaccaaauaca

SEQ ID NO: 2078337 - RNA, 19 nt, Homo sapiens
ucagagcaugauacaaauu

SEQ ID NO: 2078338 - RNA, 20 nt, Homo sapiens
agucuugcucuucaaugcua

SEQ ID NO: 2078339 - RNA, 18 nt, Homo sapiens
cuucauccuagcacuaaa

SEQ ID NO: 2078340 - RNA, 13 nt, Homo sapiens
ucaccucuucaca

SEQ ID NO: 2078341 - RNA, 14 nt, Homo sapiens
uggaaggugucauu

SEQ ID NO: 2078342 - RNA, 19 nt, Homo sapiens
acauuuaaauguaacuuau

SEQ ID NO: 2078343 - RNA, 15 nt, Homo sapiens
cuugaauacaaguuu

SEQ ID NO: 2078344 - RNA, 19 nt, Homo sapiens
agaagaauuuuucugucuu

SEQ ID NO: 2078345 - RNA, 15 nt, Homo sapiens
aacugagccaaacac

SEQ ID NO: 2078346 - RNA, 19 nt, Homo sapiens
uuuagaaauuauauuuuag

SEQ ID NO: 2078347 - RNA, 23 nt, Homo sapiens
cccgcuauuaucagaucaugccc

SEQ ID NO: 2078348 - RNA, 21 nt, Homo sapiens
gccuaauauuuaugacuuuca

SEQ ID NO: 2078349 - RNA, 19 nt, Homo sapiens
auuaaaacucauaauuauu

SEQ ID NO: 2078350 - RNA, 15 nt, Homo sapiens
ucuagugcugugaaa

SEQ ID NO: 2078351 - RNA, 23 nt, Homo sapiens
aagcuggaagaagugagcagugu

SEQ ID NO: 2078352 - RNA, 15 nt, Homo sapiens
gucuaguggaaccaa

SEQ ID NO: 2078353 - RNA, 14 nt, Homo sapiens
uaaaauacauauaa

SEQ ID NO: 2078354 - RNA, 14 nt, Homo sapiens
uaaaaaacauauau

SEQ ID NO: 2078355 - RNA, 14 nt, Homo sapiens
auaauuacuaauua

SEQ ID NO: 2078356 - RNA, 19 nt, Homo sapiens
caguaguuauaaaguccuu

SEQ ID NO: 2078357 - RNA, 15 nt, Homo sapiens
agaauuaacacauga

SEQ ID NO: 2078358 - RNA, 20 nt, Homo sapiens
guguugauacuguugcacgu

SEQ ID NO: 2078359 - RNA, 13 nt, Homo sapiens
cuaucauucucag

SEQ ID NO: 2078360 - RNA, 15 nt, Homo sapiens
ugggaccugaugacc

SEQ ID NO: 2078361 - RNA, 13 nt, Homo sapiens
auguuggucaaaa

SEQ ID NO: 2078362 - RNA, 16 nt, Homo sapiens
uaugccccugcacuga

SEQ ID NO: 2078363 - RNA, 20 nt, Homo sapiens
gcggaucacuuaaagucagg

SEQ ID NO: 2078364 - RNA, 20 nt, Homo sapiens
caacagcaagucacccauca

SEQ ID NO: 2078365 - RNA, 22 nt, Homo sapiens
caaugaccuguauuuugccaga

SEQ ID NO: 2078366 - RNA, 18 nt, Homo sapiens
auaauauucacacauauu

SEQ ID NO: 2078367 - RNA, 11 nt, Homo sapiens
ggguggcauug

SEQ ID NO: 2078368 - RNA, 15 nt, Homo sapiens
cccccugaguuuccu

SEQ ID NO: 2078369 - RNA, 15 nt, Homo sapiens
uuguaugacauauua

SEQ ID NO: 2078370 - RNA, 14 nt, Homo sapiens
aaugcagugcagca

SEQ ID NO: 2078371 - RNA, 14 nt, Homo sapiens
acaaaugugauaau

SEQ ID NO: 2078372 - RNA, 18 nt, Homo sapiens
gccaagggcugagugucc

SEQ ID NO: 2078373 - RNA, 19 nt, Homo sapiens
cccacuugucaaguucagc

SEQ ID NO: 2078374 - RNA, 13 nt, Homo sapiens
cgccugugcacac

SEQ ID NO: 2078375 - RNA, 16 nt, Homo sapiens
acuagaaaacauucca

SEQ ID NO: 2078376 - RNA, 13 nt, Homo sapiens
gggccagugcugg

SEQ ID NO: 2078377 - RNA, 19 nt, Homo sapiens
auucaucucucuuuaauau

SEQ ID NO: 2078378 - RNA, 22 nt, Homo sapiens
ugcauuugagaauaguuuuccc

SEQ ID NO: 2078379 - RNA, 23 nt, Homo sapiens
aggaaauuugcaaauauuagcuu

SEQ ID NO: 2078380 - RNA, 18 nt, Homo sapiens
aggcuucuauuaccuauu

SEQ ID NO: 2078381 - RNA, 21 nt, Homo sapiens
cauuuucucuauucuuuccau

SEQ ID NO: 2078382 - RNA, 17 nt, Homo sapiens
gauauaauaauuacuua

SEQ ID NO: 2078383 - RNA, 21 nt, Homo sapiens
gcacaucuugucuaauuuuca

SEQ ID NO: 2078384 - RNA, 19 nt, Homo sapiens
agacuggccuaggggccag

SEQ ID NO: 2078385 - RNA, 21 nt, Homo sapiens
cucuuugcccaguucauccca

SEQ ID NO: 2078386 - RNA, 20 nt, Homo sapiens
gugcaagaaggauaccaaau

SEQ ID NO: 2078387 - RNA, 22 nt, Homo sapiens
cagcuggcgaacccugggccau

SEQ ID NO: 2078388 - RNA, 21 nt, Homo sapiens
uauauuuuuuucaacugccaa

SEQ ID NO: 2078389 - RNA, 16 nt, Homo sapiens
aaguauaacuuauuca

SEQ ID NO: 2078390 - RNA, 21 nt, Homo sapiens
augcucaaggaagggacaaga

SEQ ID NO: 2078391 - RNA, 23 nt, Homo sapiens
gagaagaauuuucagaccccagc

SEQ ID NO: 2078392 - RNA, 22 nt, Homo sapiens
ccacuggucuguagggauuuuu

SEQ ID NO: 2078393 - RNA, 21 nt, Homo sapiens
cugagauagcagaggggcucc

SEQ ID NO: 2078394 - RNA, 22 nt, Homo sapiens
ucaaaauaaaaagugacacagc

SEQ ID NO: 2078395 - RNA, 22 nt, Homo sapiens
cacccagccccagccagggcuc

SEQ ID NO: 2078396 - RNA, 13 nt, Homo sapiens
aaggauccuccaa

SEQ ID NO: 2078397 - RNA, 16 nt, Homo sapiens
cccaacugcaggucca

SEQ ID NO: 2078398 - RNA, 16 nt, Homo sapiens
cugaaguaagcaaaga

SEQ ID NO: 2078399 - RNA, 16 nt, Homo sapiens
acauccagaguucugu

SEQ ID NO: 2078400 - RNA, 17 nt, Homo sapiens
ucuccaucuaccuucca

SEQ ID NO: 2078401 - RNA, 19 nt, Homo sapiens
ccuggacuggaucaagaag

SEQ ID NO: 2078402 - RNA, 14 nt, Homo sapiens
acaacuuugugcuu

SEQ ID NO: 2078403 - RNA, 19 nt, Homo sapiens
cuaucaccucuuaugcaca

SEQ ID NO: 2078404 - RNA, 13 nt, Homo sapiens
cugggcauugcuu

SEQ ID NO: 2078405 - RNA, 14 nt, Homo sapiens
ugacuugcaaucca

SEQ ID NO: 2078406 - RNA, 15 nt, Homo sapiens
aauggcaguauuuca

SEQ ID NO: 2078407 - RNA, 13 nt, Homo sapiens
caggggcccucac

SEQ ID NO: 2078408 - RNA, 16 nt, Homo sapiens
cuugccuccgugccca

SEQ ID NO: 2078409 - RNA, 18 nt, Homo sapiens
cuaauaauaaaugcauag

SEQ ID NO: 2078410 - RNA, 18 nt, Homo sapiens
gacauacucucugccugg

SEQ ID NO: 2078411 - RNA, 20 nt, Homo sapiens
uguauugaaguccuccagac

SEQ ID NO: 2078412 - RNA, 14 nt, Homo sapiens
agggagacagagac

SEQ ID NO: 2078413 - RNA, 14 nt, Homo sapiens
guuggaagugcaga

SEQ ID NO: 2078414 - RNA, 19 nt, Homo sapiens
caucgucucauguaaaaua

SEQ ID NO: 2078415 - RNA, 13 nt, Homo sapiens
auuggggucuguu

SEQ ID NO: 2078416 - RNA, 20 nt, Homo sapiens
caugagugucaacuccagga

SEQ ID NO: 2078417 - RNA, 13 nt, Homo sapiens
ucugagcacuguu

SEQ ID NO: 2078418 - RNA, 16 nt, Homo sapiens
ggcauauggagccacg

SEQ ID NO: 2078419 - RNA, 11 nt, Homo sapiens
cugaguggagu

SEQ ID NO: 2078420 - RNA, 17 nt, Homo sapiens
ucaggccuaggugcgca

SEQ ID NO: 2078421 - RNA, 13 nt, Homo sapiens
cauugucaccucu

SEQ ID NO: 2078422 - RNA, 15 nt, Homo sapiens
ggcuuccuucauuuc

SEQ ID NO: 2078423 - RNA, 19 nt, Homo sapiens
agggcucugacucugccag

SEQ ID NO: 2078424 - RNA, 20 nt, Homo sapiens
cucgaacuccugaccucagg

SEQ ID NO: 2078425 - RNA, 13 nt, Homo sapiens
caccauucguaca

SEQ ID NO: 2078426 - RNA, 23 nt, Homo sapiens
cacucgucuuucccuuuaccacu

SEQ ID NO: 2078427 - RNA, 17 nt, Homo sapiens
agccaggggcugcucau

SEQ ID NO: 2078428 - RNA, 15 nt, Homo sapiens
ucaaacgaugugcaa

SEQ ID NO: 2078429 - RNA, 19 nt, Homo sapiens
guuaaacuguuagcacugu

SEQ ID NO: 2078430 - RNA, 23 nt, Homo sapiens
gggucccagaaagggacagggaa

SEQ ID NO: 2078431 - RNA, 16 nt, Homo sapiens
cagacaggcucagguu

SEQ ID NO: 2078432 - RNA, 15 nt, Homo sapiens
uuguuuagaaagaau

SEQ ID NO: 2078433 - RNA, 18 nt, Homo sapiens
auagcccgaagucucaug

SEQ ID NO: 2078434 - RNA, 18 nt, Homo sapiens
cuaguuuaugguucugca

SEQ ID NO: 2078435 - RNA, 13 nt, Homo sapiens
auacauuacaugu

SEQ ID NO: 2078436 - RNA, 17 nt, Homo sapiens
ggcacacugagccagca

SEQ ID NO: 2078437 - RNA, 13 nt, Homo sapiens
aggaacacugaca

SEQ ID NO: 2078438 - RNA, 18 nt, Homo sapiens
cugucuguggggugguuc

SEQ ID NO: 2078439 - RNA, 14 nt, Homo sapiens
gcugcaugcgagug

SEQ ID NO: 2078440 - RNA, 11 nt, Homo sapiens
gaauaaagccu

SEQ ID NO: 2078441 - RNA, 18 nt, Homo sapiens
cuguucaaagaugcauuu

SEQ ID NO: 2078442 - RNA, 19 nt, Homo sapiens
caugccccucccccagcug

SEQ ID NO: 2078443 - RNA, 17 nt, Homo sapiens
ucaccucuuaugcacac

SEQ ID NO: 2078444 - RNA, 20 nt, Homo sapiens
cagggaaucagggagcacug

SEQ ID NO: 2078445 - RNA, 12 nt, Homo sapiens
ugacaaccucuu

SEQ ID NO: 2078446 - RNA, 16 nt, Homo sapiens
acgcuuuuaauucuca

SEQ ID NO: 2078447 - RNA, 17 nt, Homo sapiens
gaagaccagcuuugcag

SEQ ID NO: 2078448 - RNA, 18 nt, Homo sapiens
auugcauuuaaguucccu

SEQ ID NO: 2078449 - RNA, 19 nt, Homo sapiens
uuaaacauuuucauaaaau

SEQ ID NO: 2078450 - RNA, 17 nt, Homo sapiens
gcugcaagacaucugcu

SEQ ID NO: 2078451 - RNA, 18 nt, Homo sapiens
aauauuuuuaacaaguca

SEQ ID NO: 2078452 - RNA, 20 nt, Homo sapiens
gccaaaaucaauacaauccu

SEQ ID NO: 2078453 - RNA, 16 nt, Homo sapiens
uguggacuccaugccu

SEQ ID NO: 2078454 - RNA, 21 nt, Homo sapiens
ggagauaacagccucuugccc

SEQ ID NO: 2078455 - RNA, 20 nt, Homo sapiens
caauuuaagggcucagcaua

SEQ ID NO: 2078456 - RNA, 15 nt, Homo sapiens
ucggccccucugauu

SEQ ID NO: 2078457 - RNA, 15 nt, Homo sapiens
ucaacuuugauacuu

SEQ ID NO: 2078458 - RNA, 17 nt, Homo sapiens
agcaagugugcucuccu

SEQ ID NO: 2078459 - RNA, 12 nt, Homo sapiens
gccuuccugacc

SEQ ID NO: 2078460 - RNA, 20 nt, Homo sapiens
gaaauuaaacagauuagaaa

SEQ ID NO: 2078461 - RNA, 17 nt, Homo sapiens
cucaaucaugugccaga

SEQ ID NO: 2078462 - RNA, 20 nt, Homo sapiens
gguagucaugcugugcauuu

SEQ ID NO: 2078463 - RNA, 21 nt, Homo sapiens
cagcaaaauuaaauacauaaa

SEQ ID NO: 2078464 - RNA, 16 nt, Homo sapiens
gugauugacacacagc

SEQ ID NO: 2078465 - RNA, 14 nt, Homo sapiens
caguauagucacaa

SEQ ID NO: 2078466 - RNA, 16 nt, Homo sapiens
uaacugagcacuuuga

SEQ ID NO: 2078467 - RNA, 16 nt, Homo sapiens
aggaggggguucuucc

SEQ ID NO: 2078468 - RNA, 23 nt, Homo sapiens
ucuggaucacagacacugcacag

SEQ ID NO: 2078469 - RNA, 14 nt, Homo sapiens
aucacaucaugcug

SEQ ID NO: 2078470 - RNA, 13 nt, Homo sapiens
accugcuuggucu

SEQ ID NO: 2078471 - RNA, 22 nt, Homo sapiens
ugugacucuuuccuaaagccaa

SEQ ID NO: 2078472 - RNA, 22 nt, Homo sapiens
ucuaaacagugggaguaccaaa

SEQ ID NO: 2078473 - RNA, 20 nt, Homo sapiens
uuguaucuuucuuucucuaa

SEQ ID NO: 2078474 - RNA, 18 nt, Homo sapiens
ucuuugcagagccuuuua

SEQ ID NO: 2078475 - RNA, 16 nt, Homo sapiens
gaaccacugcaccacc

SEQ ID NO: 2078476 - RNA, 16 nt, Homo sapiens
ucaauuuuuaaauuuc

SEQ ID NO: 2078477 - RNA, 21 nt, Homo sapiens
aaauauguguacacauaugaa

SEQ ID NO: 2078478 - RNA, 21 nt, Homo sapiens
aacaucugccuugcugcaccu

SEQ ID NO: 2078479 - RNA, 19 nt, Homo sapiens
uaguucagguccaaauuca

SEQ ID NO: 2078480 - RNA, 14 nt, Homo sapiens
gaacauauguuugc

SEQ ID NO: 2078481 - RNA, 16 nt, Homo sapiens
gagcacaaaaugauaa

SEQ ID NO: 2078482 - RNA, 13 nt, Homo sapiens
cucuccugugaga

SEQ ID NO: 2078483 - RNA, 19 nt, Homo sapiens
aaauaaugauucaauguga

SEQ ID NO: 2078484 - RNA, 15 nt, Homo sapiens
acccauuccugugua

SEQ ID NO: 2078485 - RNA, 21 nt, Homo sapiens
ugcacuccagauaugugccaa

SEQ ID NO: 2078486 - RNA, 14 nt, Homo sapiens
uugagcuacuucag

SEQ ID NO: 2078487 - RNA, 18 nt, Homo sapiens
agaaaaaaaaaacacuug

SEQ ID NO: 2078488 - RNA, 22 nt, Homo sapiens
accucagggguuaagagcucag

SEQ ID NO: 2078489 - RNA, 22 nt, Homo sapiens
agcugccaagccccauccugcc

SEQ ID NO: 2078490 - RNA, 14 nt, Homo sapiens
aguauucauuuucc

SEQ ID NO: 2078491 - RNA, 21 nt, Homo sapiens
uaaacagauuugauugugagg

SEQ ID NO: 2078492 - RNA, 15 nt, Homo sapiens
gaaauaacauugcac

SEQ ID NO: 2078493 - RNA, 14 nt, Homo sapiens
aauccaagacuguc

SEQ ID NO: 2078494 - RNA, 16 nt, Homo sapiens
gaaguaacauuugccu

SEQ ID NO: 2078495 - RNA, 13 nt, Homo sapiens
auauaccaaagca

SEQ ID NO: 2078496 - RNA, 15 nt, Homo sapiens
cuucuggcugugcua

SEQ ID NO: 2078497 - RNA, 22 nt, Homo sapiens
aauuuuaguguuaaugacucuu

SEQ ID NO: 2078498 - RNA, 15 nt, Homo sapiens
aucuugagagcugcu

SEQ ID NO: 2078499 - RNA, 16 nt, Homo sapiens
cagacuucaucuucaa

SEQ ID NO: 2078500 - RNA, 15 nt, Homo sapiens
guucaagaccagccu

SEQ ID NO: 2078501 - RNA, 17 nt, Homo sapiens
acaaaagggccaggugc

SEQ ID NO: 2078502 - RNA, 15 nt, Homo sapiens
ucaaagaaguacugu

SEQ ID NO: 2078503 - RNA, 15 nt, Homo sapiens
agcuggacaaggugu

SEQ ID NO: 2078504 - RNA, 15 nt, Homo sapiens
aaaugaaaauuccau

SEQ ID NO: 2078505 - RNA, 14 nt, Homo sapiens
cagggcaaucaaug

SEQ ID NO: 2078506 - RNA, 16 nt, Homo sapiens
uaguuuucaaaacaca

SEQ ID NO: 2078507 - RNA, 22 nt, Homo sapiens
ucucugagauguguucagauag

SEQ ID NO: 2078508 - RNA, 20 nt, Homo sapiens
ccaucugucacuugcauucc

SEQ ID NO: 2078509 - RNA, 18 nt, Homo sapiens
acacaaagcucugucaau

SEQ ID NO: 2078510 - RNA, 13 nt, Homo sapiens
cgggauccagcuc

SEQ ID NO: 2078511 - RNA, 19 nt, Homo sapiens
uuaagaccuacuguucuaa

SEQ ID NO: 2078512 - RNA, 21 nt, Homo sapiens
aguugcccaccaaaacacaga

SEQ ID NO: 2078513 - RNA, 21 nt, Homo sapiens
auucccacagcacuaauucaa

SEQ ID NO: 2078514 - RNA, 15 nt, Homo sapiens
augguuacauaucaa

SEQ ID NO: 2078515 - RNA, 15 nt, Homo sapiens
ggaauugcauacaac

SEQ ID NO: 2078516 - RNA, 17 nt, Homo sapiens
aaugccaugaacaaauu

SEQ ID NO: 2078517 - RNA, 19 nt, Homo sapiens
ccuugagugaggcagugac

SEQ ID NO: 2078518 - RNA, 18 nt, Homo sapiens
acuaggccagacauagca

SEQ ID NO: 2078519 - RNA, 15 nt, Homo sapiens
uguaucgggcaaaaa

SEQ ID NO: 2078520 - RNA, 19 nt, Homo sapiens
cagaauucuucauccuaaa

SEQ ID NO: 2078521 - RNA, 21 nt, Homo sapiens
acaacccacaccgucuuccuu

SEQ ID NO: 2078522 - RNA, 13 nt, Homo sapiens
aguacuauuaaca

SEQ ID NO: 2078523 - RNA, 18 nt, Homo sapiens
gcauaugaggaugcagag

SEQ ID NO: 2078524 - RNA, 19 nt, Homo sapiens
caaaucuggcuccuuuaca

SEQ ID NO: 2078525 - RNA, 21 nt, Homo sapiens
guauagaaaaucuucauggaa

SEQ ID NO: 2078526 - RNA, 17 nt, Homo sapiens
aucuuaaaaauuaaaga

SEQ ID NO: 2078527 - RNA, 13 nt, Homo sapiens
gagguguggcugu

SEQ ID NO: 2078528 - RNA, 22 nt, Homo sapiens
cucugcaugauuagugcaauaa

SEQ ID NO: 2078529 - RNA, 17 nt, Homo sapiens
uuaaauacccaucuuca

SEQ ID NO: 2078530 - RNA, 10 nt, Homo sapiens
ucaacugagu

SEQ ID NO: 2078531 - RNA, 23 nt, Homo sapiens
uucaauuucccacccaucuccag

SEQ ID NO: 2078532 - RNA, 21 nt, Homo sapiens
aggaaaaccaucucugugauu

SEQ ID NO: 2078533 - RNA, 12 nt, Homo sapiens
caaaauaugugu

SEQ ID NO: 2078534 - RNA, 22 nt, Homo sapiens
gaaaaaucaguuuuuguucuua

SEQ ID NO: 2078535 - RNA, 16 nt, Homo sapiens
gaucuuucauuuugca

SEQ ID NO: 2078536 - RNA, 21 nt, Homo sapiens
uuagacccgcccuccccuuuu

SEQ ID NO: 2078537 - RNA, 15 nt, Homo sapiens
acugaacucacuuuc

SEQ ID NO: 2078538 - RNA, 22 nt, Homo sapiens
guuugcgggggucugagucuau

SEQ ID NO: 2078539 - RNA, 20 nt, Homo sapiens
auaauucacucaagcacuga

SEQ ID NO: 2078540 - RNA, 13 nt, Homo sapiens
auuggcucagccc

SEQ ID NO: 2078541 - RNA, 19 nt, Homo sapiens
auuaaauaguuauauaauu

SEQ ID NO: 2078542 - RNA, 13 nt, Homo sapiens
gaaaccugacacc

SEQ ID NO: 2078543 - RNA, 12 nt, Homo sapiens
gauuacuuauaa

SEQ ID NO: 2078544 - RNA, 19 nt, Homo sapiens
gugcuaaauaaacaacaaa

SEQ ID NO: 2078545 - RNA, 16 nt, Homo sapiens
cuugcaagaauggaga

SEQ ID NO: 2078546 - RNA, 19 nt, Homo sapiens
gugccagaggccagaccca

SEQ ID NO: 2078547 - RNA, 16 nt, Homo sapiens
acacaccugaugauuu

SEQ ID NO: 2078548 - RNA, 20 nt, Homo sapiens
cacauggcggagaguuuuaa

SEQ ID NO: 2078549 - RNA, 18 nt, Homo sapiens
uggccaggcuggucucaa

SEQ ID NO: 2078550 - RNA, 15 nt, Homo sapiens
aauauauacauucua

SEQ ID NO: 2078551 - RNA, 21 nt, Homo sapiens
acucagcucugucugcucaau

SEQ ID NO: 2078552 - RNA, 19 nt, Homo sapiens
gugaccuggaaucagugaa

SEQ ID NO: 2078553 - RNA, 18 nt, Homo sapiens
ugaguauuggaagacuug

SEQ ID NO: 2078554 - RNA, 23 nt, Homo sapiens
ggaauaauuaagauuguuucaga

SEQ ID NO: 2078555 - RNA, 17 nt, Homo sapiens
gcuccuugcugcauuga

SEQ ID NO: 2078556 - RNA, 23 nt, Homo sapiens
uuuccauauauuggcacugcuaa

SEQ ID NO: 2078557 - RNA, 23 nt, Homo sapiens
acaaaucuccucgacugcuuuag

SEQ ID NO: 2078558 - RNA, 19 nt, Homo sapiens
guucuggcugucaccaagc

SEQ ID NO: 2078559 - RNA, 23 nt, Homo sapiens
cguggauuguauuuaagacauaa

SEQ ID NO: 2078560 - RNA, 20 nt, Homo sapiens
cagagaggggacauuucccu

SEQ ID NO: 2078561 - RNA, 18 nt, Homo sapiens
aggaaggagauuccacac

SEQ ID NO: 2078562 - RNA, 19 nt, Homo sapiens
agccuccugcucugugaag

SEQ ID NO: 2078563 - RNA, 18 nt, Homo sapiens
augcucuggcuugcccca

SEQ ID NO: 2078564 - RNA, 20 nt, Homo sapiens
uauggacuccuguuguugaa

SEQ ID NO: 2078565 - RNA, 20 nt, Homo sapiens
gaagugcuuucuucucccaa

SEQ ID NO: 2078566 - RNA, 20 nt, Homo sapiens
gaagccagaaggugcagggg

SEQ ID NO: 2078567 - RNA, 20 nt, Homo sapiens
gaauguguuucaaacuguaa

SEQ ID NO: 2078568 - RNA, 14 nt, Homo sapiens
acucuucauucagu

SEQ ID NO: 2078569 - RNA, 20 nt, Homo sapiens
cacaugcugagucucccaag

SEQ ID NO: 2078570 - RNA, 15 nt, Homo sapiens
ugccagccacuguca

SEQ ID NO: 2078571 - RNA, 21 nt, Homo sapiens
gagccucuuguggaccccgcc

SEQ ID NO: 2078572 - RNA, 23 nt, Homo sapiens
gcucauuuuacgcugucucugac

SEQ ID NO: 2078573 - RNA, 13 nt, Homo sapiens
ccuuucgagcucu

SEQ ID NO: 2078574 - RNA, 13 nt, Homo sapiens
cagaauccucuca

SEQ ID NO: 2078575 - RNA, 18 nt, Homo sapiens
ugaucuucuaaucuguga

SEQ ID NO: 2078576 - RNA, 21 nt, Homo sapiens
caccugucgcacccacuguga

SEQ ID NO: 2078577 - RNA, 13 nt, Homo sapiens
uugaacauuugca

SEQ ID NO: 2078578 - RNA, 21 nt, Homo sapiens
guugccaaagagaaacaaaaa

SEQ ID NO: 2078579 - RNA, 13 nt, Homo sapiens
ucucccugcuuug

SEQ ID NO: 2078580 - RNA, 20 nt, Homo sapiens
uuuccugccuuuuaguuccu

SEQ ID NO: 2078581 - RNA, 23 nt, Homo sapiens
auggaaaaccuucaagaucucau

SEQ ID NO: 2078582 - RNA, 14 nt, Homo sapiens
auaaguuauacagu

SEQ ID NO: 2078583 - RNA, 14 nt, Homo sapiens
aaaucauauucuca

SEQ ID NO: 2078584 - RNA, 23 nt, Homo sapiens
gaagaagaugcugugaacaccag

SEQ ID NO: 2078585 - RNA, 17 nt, Homo sapiens
uccggccugcgucucca

SEQ ID NO: 2078586 - RNA, 13 nt, Homo sapiens
uacuguaauuccu

SEQ ID NO: 2078587 - RNA, 15 nt, Homo sapiens
ugaggaacccuuaca

SEQ ID NO: 2078588 - RNA, 14 nt, Homo sapiens
aggagaagcugcau

SEQ ID NO: 2078589 - RNA, 18 nt, Homo sapiens
aauuuaucuuuaccaaaa

SEQ ID NO: 2078590 - RNA, 17 nt, Homo sapiens
cuuggcugcaggcaaca

SEQ ID NO: 2078591 - RNA, 15 nt, Homo sapiens
gaaaaguguggcuug

SEQ ID NO: 2078592 - RNA, 18 nt, Homo sapiens
ugagcugggagcccggca

SEQ ID NO: 2078593 - RNA, 22 nt, Homo sapiens
agaaucaguguguuacuaucua

SEQ ID NO: 2078594 - RNA, 22 nt, Homo sapiens
ucuuuaaaauguauuuuucaca

SEQ ID NO: 2078595 - RNA, 15 nt, Homo sapiens
uuugaacuacuagaa

SEQ ID NO: 2078596 - RNA, 19 nt, Homo sapiens
acacacacgaugcauuuaa

SEQ ID NO: 2078597 - RNA, 20 nt, Homo sapiens
uucaauaaagcacugagcaa

SEQ ID NO: 2078598 - RNA, 16 nt, Homo sapiens
cuacauucugaaggcc

SEQ ID NO: 2078599 - RNA, 15 nt, Homo sapiens
aaagcacugacuucu

SEQ ID NO: 2078600 - RNA, 12 nt, Homo sapiens
auaucaugaaga

SEQ ID NO: 2078601 - RNA, 15 nt, Homo sapiens
agcuaucugcaccuc

SEQ ID NO: 2078602 - RNA, 16 nt, Homo sapiens
ccccuuauuugcacuu

SEQ ID NO: 2078603 - RNA, 23 nt, Homo sapiens
guuuuuauggcuuuugugcauua

SEQ ID NO: 2078604 - RNA, 13 nt, Homo sapiens
uacauaagaccau

SEQ ID NO: 2078605 - RNA, 22 nt, Homo sapiens
auaaguuuuccuuuuguuuucc

SEQ ID NO: 2078606 - RNA, 22 nt, Homo sapiens
gcuuccuugccugaugacaaua

SEQ ID NO: 2078607 - RNA, 18 nt, Homo sapiens
acccaugagauucauuca

SEQ ID NO: 2078608 - RNA, 12 nt, Homo sapiens
cugcuacugugu

SEQ ID NO: 2078609 - RNA, 20 nt, Homo sapiens
ugcccaggcuggaaugcagu

SEQ ID NO: 2078610 - RNA, 17 nt, Homo sapiens
cugccuauccucuguau

SEQ ID NO: 2078611 - RNA, 15 nt, Homo sapiens
aguuuucagcuuuaa

SEQ ID NO: 2078612 - RNA, 18 nt, Homo sapiens
agccuuaagcacaauuaa

SEQ ID NO: 2078613 - RNA, 17 nt, Homo sapiens
ugauauaaaagcugcau

SEQ ID NO: 2078614 - RNA, 13 nt, Homo sapiens
ugcaaaacuuuag

SEQ ID NO: 2078615 - RNA, 16 nt, Homo sapiens
aaauauuucugauacu

SEQ ID NO: 2078616 - RNA, 13 nt, Homo sapiens
uguagaacuucaa

SEQ ID NO: 2078617 - RNA, 14 nt, Homo sapiens
aaauaagagauuug

SEQ ID NO: 2078618 - RNA, 21 nt, Homo sapiens
cagcauuuucauauccaagau

SEQ ID NO: 2078619 - RNA, 22 nt, Homo sapiens
gauuugucccuaugcauaucag

SEQ ID NO: 2078620 - RNA, 15 nt, Homo sapiens
ucuggggcagauccc

SEQ ID NO: 2078621 - RNA, 14 nt, Homo sapiens
accccaaacccauc

SEQ ID NO: 2078622 - RNA, 13 nt, Homo sapiens
aggucaggacuca

SEQ ID NO: 2078623 - RNA, 20 nt, Homo sapiens
gacaauaggccauguuaauu

SEQ ID NO: 2078624 - RNA, 19 nt, Homo sapiens
cuugcauacaccacugcaa

SEQ ID NO: 2078625 - RNA, 14 nt, Homo sapiens
cuaauuaaauggca

SEQ ID NO: 2078626 - RNA, 17 nt, Homo sapiens
accugcacuucauaucu

SEQ ID NO: 2078627 - RNA, 21 nt, Homo sapiens
ggguccauuuggguacgucug

SEQ ID NO: 2078628 - RNA, 14 nt, Homo sapiens
cucugcuuacuuuu

SEQ ID NO: 2078629 - RNA, 12 nt, Homo sapiens
cagcuguguuac

SEQ ID NO: 2078630 - RNA, 17 nt, Homo sapiens
uucagcuguacauacuc

SEQ ID NO: 2078631 - RNA, 16 nt, Homo sapiens
aucuagcauagcacaa

SEQ ID NO: 2078632 - RNA, 15 nt, Homo sapiens
augguacuacaacca

SEQ ID NO: 2078633 - RNA, 15 nt, Homo sapiens
agucuugcucugucg

SEQ ID NO: 2078634 - RNA, 21 nt, Homo sapiens
aagcuaguuaaugucagugac

SEQ ID NO: 2078635 - RNA, 17 nt, Homo sapiens
ucucggcucacugcaag

SEQ ID NO: 2078636 - RNA, 20 nt, Homo sapiens
cucugcccugcccuagcucc

SEQ ID NO: 2078637 - RNA, 18 nt, Homo sapiens
ccgcuuugaaagaagcaa

SEQ ID NO: 2078638 - RNA, 21 nt, Homo sapiens
uuacccugguggaggcuucuu

SEQ ID NO: 2078639 - RNA, 14 nt, Homo sapiens
augugugucagccc

SEQ ID NO: 2078640 - RNA, 13 nt, Homo sapiens
ugcgugugugcaa

SEQ ID NO: 2078641 - RNA, 20 nt, Homo sapiens
cacggugggcugaguacagu

SEQ ID NO: 2078642 - RNA, 12 nt, Homo sapiens
gaggaucauuug

SEQ ID NO: 2078643 - RNA, 19 nt, Homo sapiens
gccaggcugccugugugca

SEQ ID NO: 2078644 - RNA, 21 nt, Homo sapiens
cugccauuuuuugucugugau

SEQ ID NO: 2078645 - RNA, 16 nt, Homo sapiens
uccagguuacuaaagg

SEQ ID NO: 2078646 - RNA, 22 nt, Homo sapiens
uaagaaagcuucuugugauccu

SEQ ID NO: 2078647 - RNA, 15 nt, Homo sapiens
uacccaauuguuuca

SEQ ID NO: 2078648 - RNA, 19 nt, Homo sapiens
auacuucuuuuucauuauu

SEQ ID NO: 2078649 - RNA, 20 nt, Homo sapiens
caccagccgaggccacagaa

SEQ ID NO: 2078650 - RNA, 20 nt, Homo sapiens
ccuagccccgagacaccauc

SEQ ID NO: 2078651 - RNA, 22 nt, Homo sapiens
uguguguuagcagucaaaucua

SEQ ID NO: 2078652 - RNA, 23 nt, Homo sapiens
ccugcugcaggggcucuggagag

SEQ ID NO: 2078653 - RNA, 23 nt, Homo sapiens
cuuccuuuuuucucuuacuauau

SEQ ID NO: 2078654 - RNA, 21 nt, Homo sapiens
gguaccugcccucuauuuauu

SEQ ID NO: 2078655 - RNA, 17 nt, Homo sapiens
ucucugcaaagacuaga

SEQ ID NO: 2078656 - RNA, 14 nt, Homo sapiens
gccaugggugcaug

SEQ ID NO: 2078657 - RNA, 17 nt, Homo sapiens
gcaucccagccucagaa

SEQ ID NO: 2078658 - RNA, 17 nt, Homo sapiens
uggauuacuauugcaaa

SEQ ID NO: 2078659 - RNA, 16 nt, Homo sapiens
cuauuaacaacccaua

SEQ ID NO: 2078660 - RNA, 14 nt, Homo sapiens
ccucagccuccuga

SEQ ID NO: 2078661 - RNA, 23 nt, Homo sapiens
uaaaagcccuagacuggugcuaa

SEQ ID NO: 2078662 - RNA, 13 nt, Homo sapiens
caaagaaggcauu

SEQ ID NO: 2078663 - RNA, 19 nt, Homo sapiens
uuccuggccucuucugggc

SEQ ID NO: 2078664 - RNA, 21 nt, Homo sapiens
auucuccucucucuaucccug

SEQ ID NO: 2078665 - RNA, 23 nt, Homo sapiens
aguucuugaacaguuuaugcagu

SEQ ID NO: 2078666 - RNA, 16 nt, Homo sapiens
uucaaguuuucucaga

SEQ ID NO: 2078667 - RNA, 16 nt, Homo sapiens
aaaacuaguucuuagg

SEQ ID NO: 2078668 - RNA, 19 nt, Homo sapiens
auuaacaaaugugcugcuu

SEQ ID NO: 2078669 - RNA, 23 nt, Homo sapiens
uugagaauauuauaaaaauauca

SEQ ID NO: 2078670 - RNA, 20 nt, Homo sapiens
cuacuuuacuguugguggca

SEQ ID NO: 2078671 - RNA, 17 nt, Homo sapiens
aauaaaguuaaacugau

SEQ ID NO: 2078672 - RNA, 19 nt, Homo sapiens
ucugcuuuugaaaucugua

SEQ ID NO: 2078673 - RNA, 13 nt, Homo sapiens
aauuuugcuuuau

SEQ ID NO: 2078674 - RNA, 17 nt, Homo sapiens
acagccagcuccuggcu

SEQ ID NO: 2078675 - RNA, 13 nt, Homo sapiens
acacggacugagg

SEQ ID NO: 2078676 - RNA, 18 nt, Homo sapiens
uccaaaacucuuucauaa

SEQ ID NO: 2078677 - RNA, 14 nt, Homo sapiens
uuuaaguuuugaca

SEQ ID NO: 2078678 - RNA, 16 nt, Homo sapiens
uccuucuuauguuucu

SEQ ID NO: 2078679 - RNA, 16 nt, Homo sapiens
auguguccuccugcuc

SEQ ID NO: 2078680 - RNA, 20 nt, Homo sapiens
aacugauucucuaugacaug

SEQ ID NO: 2078681 - RNA, 21 nt, Homo sapiens
cugucuggcuuuaaccugagc

SEQ ID NO: 2078682 - RNA, 18 nt, Homo sapiens
cuguguguguuagcuugu

SEQ ID NO: 2078683 - RNA, 10 nt, Homo sapiens
cugagccaug

SEQ ID NO: 2078684 - RNA, 19 nt, Homo sapiens
gccuuugucagaacuagaa

SEQ ID NO: 2078685 - RNA, 22 nt, Homo sapiens
gaaccacauucagggaaauggc

SEQ ID NO: 2078686 - RNA, 22 nt, Homo sapiens
ccucccuauuaaccuagagauu

SEQ ID NO: 2078687 - RNA, 15 nt, Homo sapiens
accgcugagcaguga

SEQ ID NO: 2078688 - RNA, 23 nt, Homo sapiens
uaaaacgcaugugcagcuauuua

SEQ ID NO: 2078689 - RNA, 16 nt, Homo sapiens
cuguuuuauauucaac

SEQ ID NO: 2078690 - RNA, 16 nt, Homo sapiens
agagccacucuucaag

SEQ ID NO: 2078691 - RNA, 13 nt, Homo sapiens
gugaacugagcug

SEQ ID NO: 2078692 - RNA, 11 nt, Homo sapiens
ccaauggcucc

SEQ ID NO: 2078693 - RNA, 17 nt, Homo sapiens
uccucaagaaguaauaa

SEQ ID NO: 2078694 - RNA, 12 nt, Homo sapiens
gagaaagugacc

SEQ ID NO: 2078695 - RNA, 23 nt, Homo sapiens
aguuaaagugaauaaccacuuaa

SEQ ID NO: 2078696 - RNA, 15 nt, Homo sapiens
aggaaaugauuaauu

SEQ ID NO: 2078697 - RNA, 13 nt, Homo sapiens
ggacagcccuucc

SEQ ID NO: 2078698 - RNA, 17 nt, Homo sapiens
cuggggaggcugaggca

SEQ ID NO: 2078699 - RNA, 17 nt, Homo sapiens
ugcaguagagagcaaag

SEQ ID NO: 2078700 - RNA, 15 nt, Homo sapiens
aaggagggucucuug

SEQ ID NO: 2078701 - RNA, 12 nt, Homo sapiens
guccuuucuuuu

SEQ ID NO: 2078702 - RNA, 15 nt, Homo sapiens
uguuuaaguggcuuu

SEQ ID NO: 2078703 - RNA, 11 nt, Homo sapiens
ucucagacuuu

SEQ ID NO: 2078704 - RNA, 20 nt, Homo sapiens
augcaguuguggugugccau

SEQ ID NO: 2078705 - RNA, 20 nt, Homo sapiens
aauguguguauuuagugaaa

SEQ ID NO: 2078706 - RNA, 15 nt, Homo sapiens
aggcagcagugugag

SEQ ID NO: 2078707 - RNA, 14 nt, Homo sapiens
uccugugucacuga

SEQ ID NO: 2078708 - RNA, 15 nt, Homo sapiens
auccucaauuaucuu

SEQ ID NO: 2078709 - RNA, 16 nt, Homo sapiens
ccuccugacagcaaua

SEQ ID NO: 2078710 - RNA, 23 nt, Homo sapiens
ccagcaugaagguggggccagug

SEQ ID NO: 2078711 - RNA, 14 nt, Homo sapiens
aaauagaacuugau

SEQ ID NO: 2078712 - RNA, 15 nt, Homo sapiens
uccaggaaacaugaa

SEQ ID NO: 2078713 - RNA, 14 nt, Homo sapiens
ugaaggaaugcaau

SEQ ID NO: 2078714 - RNA, 18 nt, Homo sapiens
ugaugucaugaaagcacc

SEQ ID NO: 2078715 - RNA, 15 nt, Homo sapiens
acuggaagcacagcu

SEQ ID NO: 2078716 - RNA, 19 nt, Homo sapiens
ccugcaggagaaagccaag

SEQ ID NO: 2078717 - RNA, 20 nt, Homo sapiens
cugaagggcuucuucuuaua

SEQ ID NO: 2078718 - RNA, 21 nt, Homo sapiens
uaggaacugcugggcuuggca

SEQ ID NO: 2078719 - RNA, 15 nt, Homo sapiens
ggaaaacagaccugu

SEQ ID NO: 2078720 - RNA, 21 nt, Homo sapiens
ucagcuuucaaagcauuuaca

SEQ ID NO: 2078721 - RNA, 23 nt, Homo sapiens
caugcaaacugcuuuauuuuccc

SEQ ID NO: 2078722 - RNA, 14 nt, Homo sapiens
aaacggcaguauca

SEQ ID NO: 2078723 - RNA, 17 nt, Homo sapiens
cccaacuugagauguau

SEQ ID NO: 2078724 - RNA, 22 nt, Homo sapiens
ucacccccucgggucuccucac

SEQ ID NO: 2078725 - RNA, 22 nt, Homo sapiens
gcucuccucgggcccuguggug

SEQ ID NO: 2078726 - RNA, 12 nt, Homo sapiens
caggaugugcua

SEQ ID NO: 2078727 - RNA, 17 nt, Homo sapiens
aagugcuucuccagccu

SEQ ID NO: 2078728 - RNA, 17 nt, Homo sapiens
caaaccauuauucauuu

SEQ ID NO: 2078729 - RNA, 14 nt, Homo sapiens
cuuaauuuucagua

SEQ ID NO: 2078730 - RNA, 13 nt, Homo sapiens
ugaugacauuccc

SEQ ID NO: 2078731 - RNA, 19 nt, Homo sapiens
aguggggcuggaagcagaa

SEQ ID NO: 2078732 - RNA, 17 nt, Homo sapiens
gacugcaugacagucac

SEQ ID NO: 2078733 - RNA, 21 nt, Homo sapiens
cuguccuaaucauacaccaga

SEQ ID NO: 2078734 - RNA, 14 nt, Homo sapiens
agcacuagaucucc

SEQ ID NO: 2078735 - RNA, 16 nt, Homo sapiens
uggaggcacacagcug

SEQ ID NO: 2078736 - RNA, 22 nt, Homo sapiens
aguaaaugagggaguccagucc

SEQ ID NO: 2078737 - RNA, 19 nt, Homo sapiens
gucccaaacagagggccac

SEQ ID NO: 2078738 - RNA, 15 nt, Homo sapiens
cagccucgcaugcca

SEQ ID NO: 2078739 - RNA, 15 nt, Homo sapiens
uaaaaacucuuauaa

SEQ ID NO: 2078740 - RNA, 16 nt, Homo sapiens
agauccccguguuacu

SEQ ID NO: 2078741 - RNA, 16 nt, Homo sapiens
cagaggcuggcacuga

SEQ ID NO: 2078742 - RNA, 13 nt, Homo sapiens
gucauuacaagcu

SEQ ID NO: 2078743 - RNA, 20 nt, Homo sapiens
cguguaucuaauucagcuga

SEQ ID NO: 2078744 - RNA, 16 nt, Homo sapiens
uauacauugucuugau

SEQ ID NO: 2078745 - RNA, 16 nt, Homo sapiens
uuuuuguaaaagaagc

SEQ ID NO: 2078746 - RNA, 13 nt, Homo sapiens
ugcugaagggcag

SEQ ID NO: 2078747 - RNA, 16 nt, Homo sapiens
augaauuugucgcaaa

SEQ ID NO: 2078748 - RNA, 19 nt, Homo sapiens
ggcuggaaagagugaugcc

SEQ ID NO: 2078749 - RNA, 16 nt, Homo sapiens
ucuaaugaagaauucu

SEQ ID NO: 2078750 - RNA, 22 nt, Homo sapiens
cugaauauggacccugcugaaa

SEQ ID NO: 2078751 - RNA, 23 nt, Homo sapiens
uuggacaaucaugaaauaugcau

SEQ ID NO: 2078752 - RNA, 19 nt, Homo sapiens
uugaaaaggguaggcacga

SEQ ID NO: 2078753 - RNA, 12 nt, Homo sapiens
aagguccacucc

SEQ ID NO: 2078754 - RNA, 16 nt, Homo sapiens
ucaacagaccuaagaa

SEQ ID NO: 2078755 - RNA, 19 nt, Homo sapiens
cucaugcuaagacucagug

SEQ ID NO: 2078756 - RNA, 15 nt, Homo sapiens
caaaagcccauucau

SEQ ID NO: 2078757 - RNA, 15 nt, Homo sapiens
aaggcccuuacaccc

SEQ ID NO: 2078758 - RNA, 23 nt, Homo sapiens
ugaacugcuugcuaccaaucugu

SEQ ID NO: 2078759 - RNA, 18 nt, Homo sapiens
ugaggauagagacuugca

SEQ ID NO: 2078760 - RNA, 22 nt, Homo sapiens
uucuuuuccugggaauggaaua

SEQ ID NO: 2078761 - RNA, 14 nt, Homo sapiens
uguacagucuugua

SEQ ID NO: 2078762 - RNA, 17 nt, Homo sapiens
uauacauguguguauau

SEQ ID NO: 2078763 - RNA, 16 nt, Homo sapiens
uagugcacacuuguau

SEQ ID NO: 2078764 - RNA, 14 nt, Homo sapiens
uuuuucugcacuau

SEQ ID NO: 2078765 - RNA, 18 nt, Homo sapiens
gaaagcuauauaagacaa

SEQ ID NO: 2078766 - RNA, 14 nt, Homo sapiens
uggcagacuuacaa

SEQ ID NO: 2078767 - RNA, 18 nt, Homo sapiens
guacauuagucauucaau

SEQ ID NO: 2078768 - RNA, 17 nt, Homo sapiens
cucagccuccucaguag

SEQ ID NO: 2078769 - RNA, 14 nt, Homo sapiens
uuccuuugaaauuu

SEQ ID NO: 2078770 - RNA, 22 nt, Homo sapiens
auaacuggcuucugcuugucau

SEQ ID NO: 2078771 - RNA, 17 nt, Homo sapiens
acuugcccuguucucuu

SEQ ID NO: 2078772 - RNA, 16 nt, Homo sapiens
ucuaagguaacauuua

SEQ ID NO: 2078773 - RNA, 15 nt, Homo sapiens
uguucucacagugac

SEQ ID NO: 2078774 - RNA, 17 nt, Homo sapiens
aaugaaagguagugagu

SEQ ID NO: 2078775 - RNA, 18 nt, Homo sapiens
ugcccacacacuuuccau

SEQ ID NO: 2078776 - RNA, 23 nt, Homo sapiens
agccugggggguccucaucugca

SEQ ID NO: 2078777 - RNA, 20 nt, Homo sapiens
aguugcuuguaaaauuucac

SEQ ID NO: 2078778 - RNA, 15 nt, Homo sapiens
gauuaaugcuaucaa

SEQ ID NO: 2078779 - RNA, 14 nt, Homo sapiens
cuuugcaauccaaa

SEQ ID NO: 2078780 - RNA, 16 nt, Homo sapiens
uuaucagugauggucu

SEQ ID NO: 2078781 - RNA, 18 nt, Homo sapiens
cacuuugaaauaccucau

SEQ ID NO: 2078782 - RNA, 16 nt, Homo sapiens
ugaauaauacaguauc

SEQ ID NO: 2078783 - RNA, 14 nt, Homo sapiens
uaauucuuuuauca

SEQ ID NO: 2078784 - RNA, 11 nt, Homo sapiens
agcacaaacau

SEQ ID NO: 2078785 - RNA, 23 nt, Homo sapiens
ugugaagggauuuguuuugucaa

SEQ ID NO: 2078786 - RNA, 22 nt, Homo sapiens
auaguuuaggaaaaugagagga

SEQ ID NO: 2078787 - RNA, 12 nt, Homo sapiens
aagaaagggcaa

SEQ ID NO: 2078788 - RNA, 14 nt, Homo sapiens
ccaucaggacuuuc

SEQ ID NO: 2078789 - RNA, 19 nt, Homo sapiens
guauuagugacaccacaca

SEQ ID NO: 2078790 - RNA, 13 nt, Homo sapiens
uggguaaugcaac

SEQ ID NO: 2078791 - RNA, 17 nt, Homo sapiens
ugaugcuauuuaugcaa

SEQ ID NO: 2078792 - RNA, 19 nt, Homo sapiens
cucugagcugcuaggaacc

SEQ ID NO: 2078793 - RNA, 19 nt, Homo sapiens
uaaugauuguuuaaagguu

SEQ ID NO: 2078794 - RNA, 16 nt, Homo sapiens
gccucaucucagaccc

SEQ ID NO: 2078795 - RNA, 20 nt, Homo sapiens
acaaggcugaaaagugcuuu

SEQ ID NO: 2078796 - RNA, 20 nt, Homo sapiens
ugaaagaguagugcauuuaa

SEQ ID NO: 2078797 - RNA, 15 nt, Homo sapiens
ucauuauuuuucaau

SEQ ID NO: 2078798 - RNA, 22 nt, Homo sapiens
caaucggacuccuggucuccuc

SEQ ID NO: 2078799 - RNA, 12 nt, Homo sapiens
aaauugccuccu

SEQ ID NO: 2078800 - RNA, 15 nt, Homo sapiens
gaauaguaauuuaga

SEQ ID NO: 2078801 - RNA, 21 nt, Homo sapiens
aggugggggaacacugagaaa

SEQ ID NO: 2078802 - RNA, 16 nt, Homo sapiens
aggucagcacaagaua

SEQ ID NO: 2078803 - RNA, 13 nt, Homo sapiens
gaacaugcaguuc

SEQ ID NO: 2078804 - RNA, 19 nt, Homo sapiens
ucaauaguguccuaugcaa

SEQ ID NO: 2078805 - RNA, 14 nt, Homo sapiens
agccgagauugcac

SEQ ID NO: 2078806 - RNA, 19 nt, Homo sapiens
cacuugggucuucccugua

SEQ ID NO: 2078807 - RNA, 15 nt, Homo sapiens
auuucaauauuagca

SEQ ID NO: 2078808 - RNA, 13 nt, Homo sapiens
aucugugcaauaa

SEQ ID NO: 2078809 - RNA, 14 nt, Homo sapiens
uaugcaagcacaaa

SEQ ID NO: 2078810 - RNA, 23 nt, Homo sapiens
aggggguucuuauuuugcauucc

SEQ ID NO: 2078811 - RNA, 22 nt, Homo sapiens
gccuauuugcugaccacacucc

SEQ ID NO: 2078812 - RNA, 15 nt, Homo sapiens
ugcauucacagcuac

SEQ ID NO: 2078813 - RNA, 15 nt, Homo sapiens
uucugcaucuugggg

SEQ ID NO: 2078814 - RNA, 20 nt, Homo sapiens
gccauggggaagauggagca

SEQ ID NO: 2078815 - RNA, 15 nt, Homo sapiens
aacaguguguuggcg

SEQ ID NO: 2078816 - RNA, 17 nt, Homo sapiens
aauuucauuuuuuaugu

SEQ ID NO: 2078817 - RNA, 21 nt, Homo sapiens
auaaucuuguagacacuuacu

SEQ ID NO: 2078818 - RNA, 17 nt, Homo sapiens
aggugacggcacuccca

SEQ ID NO: 2078819 - RNA, 17 nt, Homo sapiens
uccugagcagcugggau

SEQ ID NO: 2078820 - RNA, 19 nt, Homo sapiens
aauuagucucaguucucuu

SEQ ID NO: 2078821 - RNA, 19 nt, Homo sapiens
augacaaccuccauucuau

SEQ ID NO: 2078822 - RNA, 11 nt, Homo sapiens
caccauucuga

SEQ ID NO: 2078823 - RNA, 16 nt, Homo sapiens
agaaucgcuagacuaa

SEQ ID NO: 2078824 - RNA, 14 nt, Homo sapiens
agccaggugcaaaa

SEQ ID NO: 2078825 - RNA, 21 nt, Homo sapiens
aaggacccuauauguggcauu

SEQ ID NO: 2078826 - RNA, 12 nt, Homo sapiens
cuugagcagcug

SEQ ID NO: 2078827 - RNA, 19 nt, Homo sapiens
caaccucauugacaagaac

SEQ ID NO: 2078828 - RNA, 16 nt, Homo sapiens
aaggggcacugguggc

SEQ ID NO: 2078829 - RNA, 14 nt, Homo sapiens
ugcuuugaggacaa

SEQ ID NO: 2078830 - RNA, 21 nt, Homo sapiens
cacagauccccuggaaaccca

SEQ ID NO: 2078831 - RNA, 15 nt, Homo sapiens
ugcacagauugcuga

SEQ ID NO: 2078832 - RNA, 17 nt, Homo sapiens
auaaucccauacucuca

SEQ ID NO: 2078833 - RNA, 17 nt, Homo sapiens
agcuaauugagaccaca

SEQ ID NO: 2078834 - RNA, 13 nt, Homo sapiens
acuucaauaucca

SEQ ID NO: 2078835 - RNA, 23 nt, Homo sapiens
agccuuccagggauuugccucac

SEQ ID NO: 2078836 - RNA, 18 nt, Homo sapiens
uguccucuuccaccacag

SEQ ID NO: 2078837 - RNA, 16 nt, Homo sapiens
cuuggcuucugugaug

SEQ ID NO: 2078838 - RNA, 18 nt, Homo sapiens
ccccucccccuaaggcag

SEQ ID NO: 2078839 - RNA, 17 nt, Homo sapiens
caggucaucuccuuuca

SEQ ID NO: 2078840 - RNA, 18 nt, Homo sapiens
aucauccccauccuccag

SEQ ID NO: 2078841 - RNA, 20 nt, Homo sapiens
guuuaccucacuggugcauu

SEQ ID NO: 2078842 - RNA, 22 nt, Homo sapiens
ugggagaaguggccccucguga

SEQ ID NO: 2078843 - RNA, 19 nt, Homo sapiens
gggcauccugugccacuaa

SEQ ID NO: 2078844 - RNA, 17 nt, Homo sapiens
uaaaaaauaaugguguc

SEQ ID NO: 2078845 - RNA, 11 nt, Homo sapiens
uaaacuuucaa

SEQ ID NO: 2078846 - RNA, 16 nt, Homo sapiens
auacacaucucuguca

SEQ ID NO: 2078847 - RNA, 13 nt, Homo sapiens
cuugaccucguga

SEQ ID NO: 2078848 - RNA, 22 nt, Homo sapiens
uugaagccgucucaugcagaag

SEQ ID NO: 2078849 - RNA, 16 nt, Homo sapiens
uacacauagcauguaa

SEQ ID NO: 2078850 - RNA, 21 nt, Homo sapiens
accaugaugaccugaaguuca

SEQ ID NO: 2078851 - RNA, 11 nt, Homo sapiens
ucacugagcuc

SEQ ID NO: 2078852 - RNA, 14 nt, Homo sapiens
uuaauuaaaagugu

SEQ ID NO: 2078853 - RNA, 20 nt, Homo sapiens
acuucucaucacacacaugg

SEQ ID NO: 2078854 - RNA, 17 nt, Homo sapiens
acagcagcagugccaua

SEQ ID NO: 2078855 - RNA, 15 nt, Homo sapiens
cucucucucucacac

SEQ ID NO: 2078856 - RNA, 22 nt, Homo sapiens
caaguaaaacaaaugaaauuua

SEQ ID NO: 2078857 - RNA, 21 nt, Homo sapiens
gggcacaaacugcagcuguga

SEQ ID NO: 2078858 - RNA, 23 nt, Homo sapiens
ucccuacccacucuuugcuacaa

SEQ ID NO: 2078859 - RNA, 18 nt, Homo sapiens
uaauuucaaucaaccaaa

SEQ ID NO: 2078860 - RNA, 14 nt, Homo sapiens
uauguucauugcca

SEQ ID NO: 2078861 - RNA, 14 nt, Homo sapiens
auuguucaaagcca

SEQ ID NO: 2078862 - RNA, 14 nt, Homo sapiens
augccacccuagcc

SEQ ID NO: 2078863 - RNA, 18 nt, Homo sapiens
uccaaagccggcuugauu

SEQ ID NO: 2078864 - RNA, 21 nt, Homo sapiens
cccaguuccucccccaguucc

SEQ ID NO: 2078865 - RNA, 21 nt, Homo sapiens
gagggugggaaggaaacaacc

SEQ ID NO: 2078866 - RNA, 15 nt, Homo sapiens
gcucuguaguggaau

SEQ ID NO: 2078867 - RNA, 22 nt, Homo sapiens
auaugcagaacguauuuagcca

SEQ ID NO: 2078868 - RNA, 16 nt, Homo sapiens
acucccagugaugcug

SEQ ID NO: 2078869 - RNA, 18 nt, Homo sapiens
aauaucaccaaaaaccua

SEQ ID NO: 2078870 - RNA, 17 nt, Homo sapiens
aaaaccacgaaagcaca

SEQ ID NO: 2078871 - RNA, 16 nt, Homo sapiens
gggcggccagugcggc

SEQ ID NO: 2078872 - RNA, 22 nt, Homo sapiens
gguuggggaaacagcaucucca

SEQ ID NO: 2078873 - RNA, 19 nt, Homo sapiens
agccugcacuacucccuca

SEQ ID NO: 2078874 - RNA, 17 nt, Homo sapiens
uguugugaaacuguaaa

SEQ ID NO: 2078875 - RNA, 15 nt, Homo sapiens
uuaugaugcauacag

SEQ ID NO: 2078876 - RNA, 13 nt, Homo sapiens
acacugauacacu

SEQ ID NO: 2078877 - RNA, 13 nt, Homo sapiens
uggaagauuggaa

SEQ ID NO: 2078878 - RNA, 13 nt, Homo sapiens
ucaaagauucaaa

SEQ ID NO: 2078879 - RNA, 14 nt, Homo sapiens
agugcagguucuga

SEQ ID NO: 2078880 - RNA, 19 nt, Homo sapiens
aauguuauuggaagcugau

SEQ ID NO: 2078881 - RNA, 19 nt, Homo sapiens
cgaaccauggugaacucca

SEQ ID NO: 2078882 - RNA, 16 nt, Homo sapiens
cuccuuugagucuuug

SEQ ID NO: 2078883 - RNA, 17 nt, Homo sapiens
ucaugugcgaacacagu

SEQ ID NO: 2078884 - RNA, 19 nt, Homo sapiens
cacuuaacuacuuaucucu

SEQ ID NO: 2078885 - RNA, 20 nt, Homo sapiens
uaggcugcugcccugcugug

SEQ ID NO: 2078886 - RNA, 21 nt, Homo sapiens
ugcuuaaauuauuuuuauaca

SEQ ID NO: 2078887 - RNA, 16 nt, Homo sapiens
gaugcuuacuacagaa

SEQ ID NO: 2078888 - RNA, 23 nt, Homo sapiens
ccagaggcucuaauguacaauaa

SEQ ID NO: 2078889 - RNA, 20 nt, Homo sapiens
agguuuggacaaaauggaau

SEQ ID NO: 2078890 - RNA, 15 nt, Homo sapiens
agaacugcuugcauu

SEQ ID NO: 2078891 - RNA, 17 nt, Homo sapiens
ucuguuagaugcuacua

SEQ ID NO: 2078892 - RNA, 20 nt, Homo sapiens
uccaacgaauagcuccucua

SEQ ID NO: 2078893 - RNA, 23 nt, Homo sapiens
aggaggugaaagaaagggaccca

SEQ ID NO: 2078894 - RNA, 19 nt, Homo sapiens
aguaaaauuauacugugug

SEQ ID NO: 2078895 - RNA, 20 nt, Homo sapiens
acagcagcacuguucugucc

SEQ ID NO: 2078896 - RNA, 15 nt, Homo sapiens
agaagcugagacaca

SEQ ID NO: 2078897 - RNA, 15 nt, Homo sapiens
gacagauggaccaaa

SEQ ID NO: 2078898 - RNA, 20 nt, Homo sapiens
gcuuuggcucgggacuucaa

SEQ ID NO: 2078899 - RNA, 22 nt, Homo sapiens
caaauacugauggugcauuuua

SEQ ID NO: 2078900 - RNA, 20 nt, Homo sapiens
ugguguuccauugccucuuu

SEQ ID NO: 2078901 - RNA, 15 nt, Homo sapiens
cuagagggggucuca

SEQ ID NO: 2078902 - RNA, 22 nt, Homo sapiens
gcacaaaagucucaauguucca

SEQ ID NO: 2078903 - RNA, 23 nt, Homo sapiens
uauguuuggaauauuccacuauu

SEQ ID NO: 2078904 - RNA, 18 nt, Homo sapiens
cuccugugucuugcaaug

SEQ ID NO: 2078905 - RNA, 14 nt, Homo sapiens
accuuucugaguga

SEQ ID NO: 2078906 - RNA, 21 nt, Homo sapiens
uauugugcacaagucuuucca

SEQ ID NO: 2078907 - RNA, 16 nt, Homo sapiens
cugugccuuuuaucua

SEQ ID NO: 2078908 - RNA, 18 nt, Homo sapiens
cauaaaggacacuggauc

SEQ ID NO: 2078909 - RNA, 20 nt, Homo sapiens
uuggaaaaacaacagcgaca

SEQ ID NO: 2078910 - RNA, 15 nt, Homo sapiens
cagguacuaugcaga

SEQ ID NO: 2078911 - RNA, 16 nt, Homo sapiens
gccaaaggacacggcu

SEQ ID NO: 2078912 - RNA, 22 nt, Homo sapiens
ucugcauuucuuaccaguguga

SEQ ID NO: 2078913 - RNA, 18 nt, Homo sapiens
ggcccuggaugugcccac

SEQ ID NO: 2078914 - RNA, 14 nt, Homo sapiens
agcugcaggugcca

SEQ ID NO: 2078915 - RNA, 14 nt, Homo sapiens
cuuccaaacucuuc

SEQ ID NO: 2078916 - RNA, 22 nt, Homo sapiens
cugcuuuagcuuuccaauaugc

SEQ ID NO: 2078917 - RNA, 12 nt, Homo sapiens
guguuguucauu

SEQ ID NO: 2078918 - RNA, 20 nt, Homo sapiens
uggccaaggugaauagcaca

SEQ ID NO: 2078919 - RNA, 14 nt, Homo sapiens
acuacagugagaaa

SEQ ID NO: 2078920 - RNA, 17 nt, Homo sapiens
aauuucaaaaugcaugu

SEQ ID NO: 2078921 - RNA, 20 nt, Homo sapiens
cugcuucaugacauuccuaa

SEQ ID NO: 2078922 - RNA, 21 nt, Homo sapiens
cugaaaaucuccuuccagggc

SEQ ID NO: 2078923 - RNA, 21 nt, Homo sapiens
caaaaaguuguuuuauccauu

SEQ ID NO: 2078924 - RNA, 17 nt, Homo sapiens
ccugcccguaaacacgc

SEQ ID NO: 2078925 - RNA, 17 nt, Homo sapiens
uaaguauaucuaucuau

SEQ ID NO: 2078926 - RNA, 12 nt, Homo sapiens
gccugcccuccc

SEQ ID NO: 2078927 - RNA, 22 nt, Homo sapiens
aaaaauacaacagugcauuuac

SEQ ID NO: 2078928 - RNA, 15 nt, Homo sapiens
cuaagauaaauucau

SEQ ID NO: 2078929 - RNA, 21 nt, Homo sapiens
aucagccugggcaaugugaua

SEQ ID NO: 2078930 - RNA, 23 nt, Homo sapiens
gaaacacauucuuauugacaauu

SEQ ID NO: 2078931 - RNA, 18 nt, Homo sapiens
aguaacuucacauuaaaa

SEQ ID NO: 2078932 - RNA, 17 nt, Homo sapiens
gcaucugagugggccca

SEQ ID NO: 2078933 - RNA, 21 nt, Homo sapiens
uaauguauuuguuugcaauuu

SEQ ID NO: 2078934 - RNA, 17 nt, Homo sapiens
cccggagcuaacacugg

SEQ ID NO: 2078935 - RNA, 20 nt, Homo sapiens
cucaccaacugcaccaguga

SEQ ID NO: 2078936 - RNA, 16 nt, Homo sapiens
caauucuccugccuca

SEQ ID NO: 2078937 - RNA, 17 nt, Homo sapiens
ucuagaauccugcuuua

SEQ ID NO: 2078938 - RNA, 18 nt, Homo sapiens
ugauaaaagagaagccaa

SEQ ID NO: 2078939 - RNA, 23 nt, Homo sapiens
uugcucagugggggcagagccac

SEQ ID NO: 2078940 - RNA, 18 nt, Homo sapiens
aaggauccagagacuugg

SEQ ID NO: 2078941 - RNA, 23 nt, Homo sapiens
ucaggagcaggggcauugcugau

SEQ ID NO: 2078942 - RNA, 13 nt, Homo sapiens
uuacacauucuca

SEQ ID NO: 2078943 - RNA, 19 nt, Homo sapiens
uaaaagguagagucuuaca

SEQ ID NO: 2078944 - RNA, 17 nt, Homo sapiens
uucaaaauguacuaugu

SEQ ID NO: 2078945 - RNA, 18 nt, Homo sapiens
caucuggaaucugaggca

SEQ ID NO: 2078946 - RNA, 20 nt, Homo sapiens
ugacuuaaagugcaaaaagc

SEQ ID NO: 2078947 - RNA, 12 nt, Homo sapiens
ucaaaagcacaa

SEQ ID NO: 2078948 - RNA, 17 nt, Homo sapiens
ccuauaccccucaucac

SEQ ID NO: 2078949 - RNA, 17 nt, Homo sapiens
uugccucuaugugcaac

SEQ ID NO: 2078950 - RNA, 14 nt, Homo sapiens
uacacacucaguga

SEQ ID NO: 2078951 - RNA, 20 nt, Homo sapiens
ugcuuugacaugacugcaau

SEQ ID NO: 2078952 - RNA, 16 nt, Homo sapiens
ucuccgccauugagaa

SEQ ID NO: 2078953 - RNA, 14 nt, Homo sapiens
gagugcgugcucag

SEQ ID NO: 2078954 - RNA, 19 nt, Homo sapiens
uggggcacagucauucaca

SEQ ID NO: 2078955 - RNA, 18 nt, Homo sapiens
aaaucuguguaacuguaa

SEQ ID NO: 2078956 - RNA, 18 nt, Homo sapiens
guaucauauuaacauauu

SEQ ID NO: 2078957 - RNA, 13 nt, Homo sapiens
cucucugccuauu

SEQ ID NO: 2078958 - RNA, 22 nt, Homo sapiens
aucaaugcaagagugauugcag

SEQ ID NO: 2078959 - RNA, 20 nt, Homo sapiens
aauauuacccagcugaauag

SEQ ID NO: 2078960 - RNA, 14 nt, Homo sapiens
auggaggcacacag

SEQ ID NO: 2078961 - RNA, 14 nt, Homo sapiens
ucuugguuuccaaa

SEQ ID NO: 2078962 - RNA, 16 nt, Homo sapiens
ugaagcagagaggcac

SEQ ID NO: 2078963 - RNA, 19 nt, Homo sapiens
gugggugugcuguugccuu

SEQ ID NO: 2078964 - RNA, 13 nt, Homo sapiens
ccuggugcugaga

SEQ ID NO: 2078965 - RNA, 19 nt, Homo sapiens
augagauuccagguccuga

SEQ ID NO: 2078966 - RNA, 20 nt, Homo sapiens
aggcuggucccuaugucaug

SEQ ID NO: 2078967 - RNA, 23 nt, Homo sapiens
aauaauccucaguuuuugugaaa

SEQ ID NO: 2078968 - RNA, 19 nt, Homo sapiens
agccuggccaagagaccag

SEQ ID NO: 2078969 - RNA, 21 nt, Homo sapiens
aaacuucguaagaacauguua

SEQ ID NO: 2078970 - RNA, 16 nt, Homo sapiens
uugaaucuacauucac

SEQ ID NO: 2078971 - RNA, 19 nt, Homo sapiens
aagacuuuguccccacuua

SEQ ID NO: 2078972 - RNA, 16 nt, Homo sapiens
gaacaagaauugcuaa

SEQ ID NO: 2078973 - RNA, 18 nt, Homo sapiens
agcuacagccagcggcau

SEQ ID NO: 2078974 - RNA, 23 nt, Homo sapiens
uuuaucacuucauucacauucag

SEQ ID NO: 2078975 - RNA, 20 nt, Homo sapiens
ucuuucucugccagugacag

SEQ ID NO: 2078976 - RNA, 20 nt, Homo sapiens
agugcaauggcaggaucuca

SEQ ID NO: 2078977 - RNA, 14 nt, Homo sapiens
accauaacagugcc

SEQ ID NO: 2078978 - RNA, 15 nt, Homo sapiens
acccaacgugaugcu

SEQ ID NO: 2078979 - RNA, 18 nt, Homo sapiens
ccaaagccagaaccagau

SEQ ID NO: 2078980 - RNA, 23 nt, Homo sapiens
cacucccuuucuucuucuucuaa

SEQ ID NO: 2078981 - RNA, 15 nt, Homo sapiens
ucugcuaaauuucaa

SEQ ID NO: 2078982 - RNA, 23 nt, Homo sapiens
cuuguuauucgaaccacugagag

SEQ ID NO: 2078983 - RNA, 14 nt, Homo sapiens
cacuccuucucuca

SEQ ID NO: 2078984 - RNA, 14 nt, Homo sapiens
acucacaugccgcc

SEQ ID NO: 2078985 - RNA, 16 nt, Homo sapiens
cauuuucaagacacag

SEQ ID NO: 2078986 - RNA, 16 nt, Homo sapiens
cuugcuuauucacuga

SEQ ID NO: 2078987 - RNA, 12 nt, Homo sapiens
caaaaaugaacu

SEQ ID NO: 2078988 - RNA, 15 nt, Homo sapiens
cagcuguacugagga

SEQ ID NO: 2078989 - RNA, 15 nt, Homo sapiens
uguuaacuguacuga

SEQ ID NO: 2078990 - RNA, 13 nt, Homo sapiens
ugucuugguggau

SEQ ID NO: 2078991 - RNA, 23 nt, Homo sapiens
cagaaaugagaucaggcucugcc

SEQ ID NO: 2078992 - RNA, 20 nt, Homo sapiens
uccaugggccauaugaaaag

SEQ ID NO: 2078993 - RNA, 23 nt, Homo sapiens
cuugguguguucguggagccaca

SEQ ID NO: 2078994 - RNA, 24 nt, Homo sapiens
uccccgugucuguucaguuagcau

SEQ ID NO: 2078995 - RNA, 15 nt, Homo sapiens
gagccuggaagacac

SEQ ID NO: 2078996 - RNA, 20 nt, Homo sapiens
agucccaggggcagccacac

SEQ ID NO: 2078997 - RNA, 14 nt, Homo sapiens
gacagaagcguaua

SEQ ID NO: 2078998 - RNA, 22 nt, Homo sapiens
cauuuacaaagcaaaaagagau

SEQ ID NO: 2078999 - RNA, 17 nt, Homo sapiens
cugacauauaucuauua

SEQ ID NO: 2079000 - RNA, 19 nt, Homo sapiens
aacacggggcuugcaacuu

SEQ ID NO: 2079001 - RNA, 14 nt, Homo sapiens
ggcuuuuauugcca

SEQ ID NO: 2079002 - RNA, 13 nt, Homo sapiens
aggauaugcagua

SEQ ID NO: 2079003 - RNA, 13 nt, Homo sapiens
agaaaaugcaauu

SEQ ID NO: 2079004 - RNA, 20 nt, Homo sapiens
acacuaaaacaccucagcug

SEQ ID NO: 2079005 - RNA, 19 nt, Homo sapiens
acuuucauccucaagcuca

SEQ ID NO: 2079006 - RNA, 18 nt, Homo sapiens
ggcucccacuucuuggga

SEQ ID NO: 2079007 - RNA, 17 nt, Homo sapiens
aagaauagaaaacuggg

SEQ ID NO: 2079008 - RNA, 17 nt, Homo sapiens
agaaagagagaaccaag

SEQ ID NO: 2079009 - RNA, 14 nt, Homo sapiens
uuaauaguauaucu

SEQ ID NO: 2079010 - RNA, 14 nt, Homo sapiens
augacuguuuguua

SEQ ID NO: 2079011 - RNA, 18 nt, Homo sapiens
caguggugcaaucuuggc

SEQ ID NO: 2079012 - RNA, 12 nt, Homo sapiens
uaguaguacuua

SEQ ID NO: 2079013 - RNA, 15 nt, Homo sapiens
auaugcaguaugcua

SEQ ID NO: 2079014 - RNA, 15 nt, Homo sapiens
ugagaaaucucaucc

SEQ ID NO: 2079015 - RNA, 14 nt, Homo sapiens
aagaggaacagcac

SEQ ID NO: 2079016 - RNA, 19 nt, Homo sapiens
cugugaaagaaccaaaaga

SEQ ID NO: 2079017 - RNA, 16 nt, Homo sapiens
uaccuugguauaucau

SEQ ID NO: 2079018 - RNA, 20 nt, Homo sapiens
uaauauuuguuccucuaggu

SEQ ID NO: 2079019 - RNA, 14 nt, Homo sapiens
uggcucagccucaa

SEQ ID NO: 2079020 - RNA, 19 nt, Homo sapiens
uucagaugauucuaugucu

SEQ ID NO: 2079021 - RNA, 19 nt, Homo sapiens
cauccgguuugccauguug

SEQ ID NO: 2079022 - RNA, 13 nt, Homo sapiens
auugagaccaagg

SEQ ID NO: 2079023 - RNA, 15 nt, Homo sapiens
guaugaaugcagugg

SEQ ID NO: 2079024 - RNA, 22 nt, Homo sapiens
uuacugcauagcagaccacaca

SEQ ID NO: 2079025 - RNA, 13 nt, Homo sapiens
cacaugcccauga

SEQ ID NO: 2079026 - RNA, 12 nt, Homo sapiens
cuuuuguuucag

SEQ ID NO: 2079027 - RNA, 15 nt, Homo sapiens
cuuguaaaacuguga

SEQ ID NO: 2079028 - RNA, 13 nt, Homo sapiens
ccucaucaucaga

SEQ ID NO: 2079029 - RNA, 13 nt, Homo sapiens
ccagcucaucucc

SEQ ID NO: 2079030 - RNA, 15 nt, Homo sapiens
accgugcgagcugcc

SEQ ID NO: 2079031 - RNA, 14 nt, Homo sapiens
augcagacauuuac

SEQ ID NO: 2079032 - RNA, 13 nt, Homo sapiens
gaaaccacagguu

SEQ ID NO: 2079033 - RNA, 15 nt, Homo sapiens
gaaaauggaaccagg

SEQ ID NO: 2079034 - RNA, 22 nt, Homo sapiens
caaggaaccuaauugaaauuua

SEQ ID NO: 2079035 - RNA, 13 nt, Homo sapiens
ucagaaauguuaa

SEQ ID NO: 2079036 - RNA, 13 nt, Homo sapiens
ccaucccaaaaau

SEQ ID NO: 2079037 - RNA, 22 nt, Homo sapiens
ugcgcuuauuuggaaauuuuag

SEQ ID NO: 2079038 - RNA, 22 nt, Homo sapiens
agugucaugucagcaucagcuc

SEQ ID NO: 2079039 - RNA, 22 nt, Homo sapiens
caguguuuggaugaaaaaagcc

SEQ ID NO: 2079040 - RNA, 13 nt, Homo sapiens
uuuccuguucucu

SEQ ID NO: 2079041 - RNA, 13 nt, Homo sapiens
uccacuguuucau

SEQ ID NO: 2079042 - RNA, 24 nt, Homo sapiens
cugccaagauacuugaacacugug

SEQ ID NO: 2079043 - RNA, 14 nt, Homo sapiens
aacucggggacaaa

SEQ ID NO: 2079044 - RNA, 17 nt, Homo sapiens
auagugucugcugcugc

SEQ ID NO: 2079045 - RNA, 21 nt, Homo sapiens
uguaggaugugucacuguugg

SEQ ID NO: 2079046 - RNA, 22 nt, Homo sapiens
gccuggcuguggccuaaccugc

SEQ ID NO: 2079047 - RNA, 13 nt, Homo sapiens
uagaugacuacuu

SEQ ID NO: 2079048 - RNA, 20 nt, Homo sapiens
ucuuaucuuugcucccugca

SEQ ID NO: 2079049 - RNA, 20 nt, Homo sapiens
cucccucccagagcaccugc

SEQ ID NO: 2079050 - RNA, 22 nt, Homo sapiens
ccucucugaacugcaacacugg

SEQ ID NO: 2079051 - RNA, 16 nt, Homo sapiens
agaccaggucuuguuu

SEQ ID NO: 2079052 - RNA, 14 nt, Homo sapiens
gccucucucaggag

SEQ ID NO: 2079053 - RNA, 18 nt, Homo sapiens
gccauuguuucuccuggg

SEQ ID NO: 2079054 - RNA, 17 nt, Homo sapiens
acacauuggaaugccuu

SEQ ID NO: 2079055 - RNA, 12 nt, Homo sapiens
gcccucucaggu

SEQ ID NO: 2079056 - RNA, 15 nt, Homo sapiens
cugacacugugaccc

SEQ ID NO: 2079057 - RNA, 22 nt, Homo sapiens
cauugugagacacuaaaaacug

SEQ ID NO: 2079058 - RNA, 17 nt, Homo sapiens
gaaauguucugucaaau

SEQ ID NO: 2079059 - RNA, 22 nt, Homo sapiens
uuaucccuuuacaaugugaaua

SEQ ID NO: 2079060 - RNA, 16 nt, Homo sapiens
uaauuugucacuggaa

SEQ ID NO: 2079061 - RNA, 14 nt, Homo sapiens
cuuauaacuuguaa

SEQ ID NO: 2079062 - RNA, 16 nt, Homo sapiens
gguucuuugcugcauu

SEQ ID NO: 2079063 - RNA, 11 nt, Homo sapiens
gcuugcuccca

SEQ ID NO: 2079064 - RNA, 20 nt, Homo sapiens
aaguuaaauuagcuuucuga

SEQ ID NO: 2079065 - RNA, 11 nt, Homo sapiens
aagcucucuuu

SEQ ID NO: 2079066 - RNA, 16 nt, Homo sapiens
aguuaaggugugcaaa

SEQ ID NO: 2079067 - RNA, 16 nt, Homo sapiens
uaacgugauacauuug

SEQ ID NO: 2079068 - RNA, 18 nt, Homo sapiens
aauaggauuaaugaucau

SEQ ID NO: 2079069 - RNA, 15 nt, Homo sapiens
uaauauaugcucaac

SEQ ID NO: 2079070 - RNA, 16 nt, Homo sapiens
ucuuccagaaguguga

SEQ ID NO: 2079071 - RNA, 19 nt, Homo sapiens
aaggcaucuaagacauuca

SEQ ID NO: 2079072 - RNA, 22 nt, Homo sapiens
gcucacucccugggaaaggggu

SEQ ID NO: 2079073 - RNA, 14 nt, Homo sapiens
ggaacaaaucucuc

SEQ ID NO: 2079074 - RNA, 24 nt, Homo sapiens
cagggauugauuuuaaaauguaca

SEQ ID NO: 2079075 - RNA, 16 nt, Homo sapiens
uuuuaccagucucaca

SEQ ID NO: 2079076 - RNA, 19 nt, Homo sapiens
cuccagagggaauugcaga

SEQ ID NO: 2079077 - RNA, 22 nt, Homo sapiens
acgacucaaaaugacaguuuca

SEQ ID NO: 2079078 - RNA, 21 nt, Homo sapiens
agagaccugacccuucucuca

SEQ ID NO: 2079079 - RNA, 14 nt, Homo sapiens
augggaaagacaug

SEQ ID NO: 2079080 - RNA, 18 nt, Homo sapiens
ugcccaacccuaucccag

SEQ ID NO: 2079081 - RNA, 16 nt, Homo sapiens
ugggcuucuucagaac

SEQ ID NO: 2079082 - RNA, 12 nt, Homo sapiens
agggucagugga

SEQ ID NO: 2079083 - RNA, 15 nt, Homo sapiens
ggcugacaccaagaa

SEQ ID NO: 2079084 - RNA, 12 nt, Homo sapiens
uuaauuucuaac

SEQ ID NO: 2079085 - RNA, 19 nt, Homo sapiens
cacugcccuccagggccag

SEQ ID NO: 2079086 - RNA, 21 nt, Homo sapiens
acagguaaaaagccucaccca

SEQ ID NO: 2079087 - RNA, 17 nt, Homo sapiens
aaaaaugaugggacaau

SEQ ID NO: 2079088 - RNA, 17 nt, Homo sapiens
ucaguugcuuugcccaa

SEQ ID NO: 2079089 - RNA, 15 nt, Homo sapiens
guccuguacccagug

SEQ ID NO: 2079090 - RNA, 22 nt, Homo sapiens
caaaucagaggugcaggccacc

SEQ ID NO: 2079091 - RNA, 14 nt, Homo sapiens
cugccucuguggaa

SEQ ID NO: 2079092 - RNA, 16 nt, Homo sapiens
aauagcacugccagga

SEQ ID NO: 2079093 - RNA, 17 nt, Homo sapiens
aaaacagugugaugcaa

SEQ ID NO: 2079094 - RNA, 18 nt, Homo sapiens
gcagacccuuuucaucuc

SEQ ID NO: 2079095 - RNA, 22 nt, Homo sapiens
cugaaguuagggaugacuguga

SEQ ID NO: 2079096 - RNA, 20 nt, Homo sapiens
uaucuuugucuguucacuuu

SEQ ID NO: 2079097 - RNA, 18 nt, Homo sapiens
aucacgggcgguccugca

SEQ ID NO: 2079098 - RNA, 20 nt, Homo sapiens
agaaaugcaagggggacaca

SEQ ID NO: 2079099 - RNA, 15 nt, Homo sapiens
gauucacagucucau

SEQ ID NO: 2079100 - RNA, 12 nt, Homo sapiens
ggaagagcuaau

SEQ ID NO: 2079101 - RNA, 17 nt, Homo sapiens
uggugaaaugcagaguc

SEQ ID NO: 2079102 - RNA, 22 nt, Homo sapiens
aucauuucccaucuggaccugg

SEQ ID NO: 2079103 - RNA, 23 nt, Homo sapiens
guccaagcuguggagacucuugu

SEQ ID NO: 2079104 - RNA, 12 nt, Homo sapiens
uguuuuguacaa

SEQ ID NO: 2079105 - RNA, 14 nt, Homo sapiens
agcaucugucucaa

SEQ ID NO: 2079106 - RNA, 21 nt, Homo sapiens
aaacuguacccuauguucacu

SEQ ID NO: 2079107 - RNA, 21 nt, Homo sapiens
acgcaccgccugaaggcacag

SEQ ID NO: 2079108 - RNA, 24 nt, Homo sapiens
cucuuuggaaacaauaugcaaugu

SEQ ID NO: 2079109 - RNA, 14 nt, Homo sapiens
aaggaaucacguua

SEQ ID NO: 2079110 - RNA, 15 nt, Homo sapiens
gaaucaaaucugugc

SEQ ID NO: 2079111 - RNA, 22 nt, Homo sapiens
auguuuaugguaauacacauau

SEQ ID NO: 2079112 - RNA, 15 nt, Homo sapiens
gucaucugucuuuca

SEQ ID NO: 2079113 - RNA, 19 nt, Homo sapiens
ugguuggaagggaauagaa

SEQ ID NO: 2079114 - RNA, 23 nt, Homo sapiens
cagaugcacacacagaugcacac

SEQ ID NO: 2079115 - RNA, 18 nt, Homo sapiens
gauuuccuggagugcccu

SEQ ID NO: 2079116 - RNA, 13 nt, Homo sapiens
gaaagacuugaaa

SEQ ID NO: 2079117 - RNA, 24 nt, Homo sapiens
cagaguggaguugaaacugcuaua

SEQ ID NO: 2079118 - RNA, 15 nt, Homo sapiens
acgugaggccugcac

SEQ ID NO: 2079119 - RNA, 14 nt, Homo sapiens
auccagcuacuuag

SEQ ID NO: 2079120 - RNA, 18 nt, Homo sapiens
gccuucccaaaauggcaa

SEQ ID NO: 2079121 - RNA, 14 nt, Homo sapiens
cuuuuuaaaaaacu

SEQ ID NO: 2079122 - RNA, 18 nt, Homo sapiens
gacacuaaccagagucag

SEQ ID NO: 2079123 - RNA, 18 nt, Homo sapiens
caauugugacagcaguuu

SEQ ID NO: 2079124 - RNA, 17 nt, Homo sapiens
cuuucuucagcucugaa

SEQ ID NO: 2079125 - RNA, 18 nt, Homo sapiens
caccaaagaucugcuccu

SEQ ID NO: 2079126 - RNA, 13 nt, Homo sapiens
aagucacugcaca

SEQ ID NO: 2079127 - RNA, 13 nt, Homo sapiens
gggaaauugcagc

SEQ ID NO: 2079128 - RNA, 15 nt, Homo sapiens
gggaguccagggugg

SEQ ID NO: 2079129 - RNA, 18 nt, Homo sapiens
gcugacuuguaucuucag

SEQ ID NO: 2079130 - RNA, 17 nt, Homo sapiens
uaauauccaagacuuag

SEQ ID NO: 2079131 - RNA, 16 nt, Homo sapiens
aauaucccuuacuuua

SEQ ID NO: 2079132 - RNA, 17 nt, Homo sapiens
uauaaucuccauuucaa

SEQ ID NO: 2079133 - RNA, 16 nt, Homo sapiens
ucuucaccucugcuac

SEQ ID NO: 2079134 - RNA, 20 nt, Homo sapiens
agauggcuggcuggugauag

SEQ ID NO: 2079135 - RNA, 21 nt, Homo sapiens
agccgagaucacgccacugca

SEQ ID NO: 2079136 - RNA, 20 nt, Homo sapiens
uaauucucuucgcugugaug

SEQ ID NO: 2079137 - RNA, 19 nt, Homo sapiens
guauuccucaugucaucaa

SEQ ID NO: 2079138 - RNA, 22 nt, Homo sapiens
guacaacuuuuuaaauagggaa

SEQ ID NO: 2079139 - RNA, 17 nt, Homo sapiens
ccaguaguggacaacag

SEQ ID NO: 2079140 - RNA, 21 nt, Homo sapiens
augcaaaggcguaucaguuca

SEQ ID NO: 2079141 - RNA, 13 nt, Homo sapiens
gcuauuuaugcaa

SEQ ID NO: 2079142 - RNA, 14 nt, Homo sapiens
gguuagccugguga

SEQ ID NO: 2079143 - RNA, 20 nt, Homo sapiens
guauacuuccuuaugcuucu

SEQ ID NO: 2079144 - RNA, 22 nt, Homo sapiens
aggaaauguguguauuuaguga

SEQ ID NO: 2079145 - RNA, 22 nt, Homo sapiens
ccccuggacuauggugcuguau

SEQ ID NO: 2079146 - RNA, 19 nt, Homo sapiens
ugggcaacaagagcgagac

SEQ ID NO: 2079147 - RNA, 19 nt, Homo sapiens
ucaccaguguccccuccac

SEQ ID NO: 2079148 - RNA, 14 nt, Homo sapiens
aggccaucaccaca

SEQ ID NO: 2079149 - RNA, 20 nt, Homo sapiens
cguucucuucucucuucaau

SEQ ID NO: 2079150 - RNA, 19 nt, Homo sapiens
caagccugcugucuuguga

SEQ ID NO: 2079151 - RNA, 14 nt, Homo sapiens
ucuuuagaugccaa

SEQ ID NO: 2079152 - RNA, 17 nt, Homo sapiens
aauccccggaaaacugg

SEQ ID NO: 2079153 - RNA, 14 nt, Homo sapiens
uccaucccuacccc

SEQ ID NO: 2079154 - RNA, 18 nt, Homo sapiens
ugguggcucuucagagga

SEQ ID NO: 2079155 - RNA, 23 nt, Homo sapiens
aaccugugcucauuuugcaauuu

SEQ ID NO: 2079156 - RNA, 11 nt, Homo sapiens
uucugccaaaa

SEQ ID NO: 2079157 - RNA, 11 nt, Homo sapiens
aacugccauua

SEQ ID NO: 2079158 - RNA, 22 nt, Homo sapiens
uguguauuuguauuaauaaagc

SEQ ID NO: 2079159 - RNA, 19 nt, Homo sapiens
augucagauaaguguaaau

SEQ ID NO: 2079160 - RNA, 19 nt, Homo sapiens
aagcgauucuugugccuca

SEQ ID NO: 2079161 - RNA, 20 nt, Homo sapiens
acagaccuaggauuucauga

SEQ ID NO: 2079162 - RNA, 20 nt, Homo sapiens
caucuauguaucuaccaucu

SEQ ID NO: 2079163 - RNA, 13 nt, Homo sapiens
cacagaggacagu

SEQ ID NO: 2079164 - RNA, 15 nt, Homo sapiens
ccuguggaugcugcu

SEQ ID NO: 2079165 - RNA, 17 nt, Homo sapiens
aguguccuucuugcucc

SEQ ID NO: 2079166 - RNA, 21 nt, Homo sapiens
uucaugucgaggcuagaggca

SEQ ID NO: 2079167 - RNA, 17 nt, Homo sapiens
gcucuuuuguguagcuc

SEQ ID NO: 2079168 - RNA, 17 nt, Homo sapiens
gcuguggcuaugggaau

SEQ ID NO: 2079169 - RNA, 13 nt, Homo sapiens
guagaguccuugg

SEQ ID NO: 2079170 - RNA, 20 nt, Homo sapiens
uuucuccagacuuaaaacau

SEQ ID NO: 2079171 - RNA, 17 nt, Homo sapiens
acagcaguguggucucu

SEQ ID NO: 2079172 - RNA, 19 nt, Homo sapiens
cagacaagaaugugcacuc

SEQ ID NO: 2079173 - RNA, 21 nt, Homo sapiens
aaacugugagauaaauaucau

SEQ ID NO: 2079174 - RNA, 23 nt, Homo sapiens
ccauuuuaauuuuaaagugcaaa

SEQ ID NO: 2079175 - RNA, 17 nt, Homo sapiens
uugcccuuuggccagug

SEQ ID NO: 2079176 - RNA, 17 nt, Homo sapiens
cuucauggaggggguca

SEQ ID NO: 2079177 - RNA, 17 nt, Homo sapiens
caauuucugcuguacau

SEQ ID NO: 2079178 - RNA, 14 nt, Homo sapiens
acagcacacacuuc

SEQ ID NO: 2079179 - RNA, 21 nt, Homo sapiens
cauuguagccuaauauucaug

SEQ ID NO: 2079180 - RNA, 19 nt, Homo sapiens
uuuuaaccccgucaacaaa

SEQ ID NO: 2079181 - RNA, 17 nt, Homo sapiens
uuuaacuugcaguauau

SEQ ID NO: 2079182 - RNA, 15 nt, Homo sapiens
aauguccaacuaaaa

SEQ ID NO: 2079183 - RNA, 14 nt, Homo sapiens
ugguucaucccuuu

SEQ ID NO: 2079184 - RNA, 15 nt, Homo sapiens
acauaaagacugugc

SEQ ID NO: 2079185 - RNA, 16 nt, Homo sapiens
ucccccgccacuccug

SEQ ID NO: 2079186 - RNA, 11 nt, Homo sapiens
ucgaugugcuc

SEQ ID NO: 2079187 - RNA, 20 nt, Homo sapiens
uugggcuacuguagauuugu

SEQ ID NO: 2079188 - RNA, 19 nt, Homo sapiens
uuaaauuacacaguucaca

SEQ ID NO: 2079189 - RNA, 20 nt, Homo sapiens
aaaguuauauuuacuuuaaa

SEQ ID NO: 2079190 - RNA, 22 nt, Homo sapiens
ccucuuggagaagucucagcua

SEQ ID NO: 2079191 - RNA, 22 nt, Homo sapiens
uagaguucuccagacaggguuc

SEQ ID NO: 2079192 - RNA, 20 nt, Homo sapiens
auacuauugaaguauguagu

SEQ ID NO: 2079193 - RNA, 17 nt, Homo sapiens
uacaauuaauaguuugu

SEQ ID NO: 2079194 - RNA, 13 nt, Homo sapiens
ucggcacccugca

SEQ ID NO: 2079195 - RNA, 12 nt, Homo sapiens
ugauggaggaac

SEQ ID NO: 2079196 - RNA, 19 nt, Homo sapiens
auccuucugucuccagggc

SEQ ID NO: 2079197 - RNA, 21 nt, Homo sapiens
cauuuguagcuuugcccauug

SEQ ID NO: 2079198 - RNA, 17 nt, Homo sapiens
auuuacaagacugcuga

SEQ ID NO: 2079199 - RNA, 19 nt, Homo sapiens
ugguaaucuuuucugaggu

SEQ ID NO: 2079200 - RNA, 16 nt, Homo sapiens
gcagguguucugcuga

SEQ ID NO: 2079201 - RNA, 18 nt, Homo sapiens
uauacaauugucauguau

SEQ ID NO: 2079202 - RNA, 20 nt, Homo sapiens
uauuucagacauagauuuca

SEQ ID NO: 2079203 - RNA, 17 nt, Homo sapiens
acucggggcaggccagc

SEQ ID NO: 2079204 - RNA, 16 nt, Homo sapiens
gcugggccucauucua

SEQ ID NO: 2079205 - RNA, 21 nt, Homo sapiens
accucgaguacugugggcaau

SEQ ID NO: 2079206 - RNA, 19 nt, Homo sapiens
gaucuguguuuuauugaca

SEQ ID NO: 2079207 - RNA, 16 nt, Homo sapiens
aagggcuugaggugaa

SEQ ID NO: 2079208 - RNA, 17 nt, Homo sapiens
caaaugugauacauuua

SEQ ID NO: 2079209 - RNA, 18 nt, Homo sapiens
ugcccuccaucucagcca

SEQ ID NO: 2079210 - RNA, 14 nt, Homo sapiens
augcugcaguucca

SEQ ID NO: 2079211 - RNA, 13 nt, Homo sapiens
uuuacgugcaaac

SEQ ID NO: 2079212 - RNA, 15 nt, Homo sapiens
gacagugcauuugcc

SEQ ID NO: 2079213 - RNA, 15 nt, Homo sapiens
gccuggggucuggag

SEQ ID NO: 2079214 - RNA, 15 nt, Homo sapiens
auacauccuggguaa

SEQ ID NO: 2079215 - RNA, 22 nt, Homo sapiens
gucauauuucacagcaccaaaa

SEQ ID NO: 2079216 - RNA, 13 nt, Homo sapiens
guucacacuuugc

SEQ ID NO: 2079217 - RNA, 15 nt, Homo sapiens
caagaaggcuuuauu

SEQ ID NO: 2079218 - RNA, 14 nt, Homo sapiens
ugacaugugacucc

SEQ ID NO: 2079219 - RNA, 22 nt, Homo sapiens
cucaggaaugcagcacaguacu

SEQ ID NO: 2079220 - RNA, 14 nt, Homo sapiens
uugcaacagacugu

SEQ ID NO: 2079221 - RNA, 16 nt, Homo sapiens
agggaccucaagcacc

SEQ ID NO: 2079222 - RNA, 20 nt, Homo sapiens
uucccauucugccccagagu

SEQ ID NO: 2079223 - RNA, 17 nt, Homo sapiens
ugcacagcuggagaaau

SEQ ID NO: 2079224 - RNA, 14 nt, Homo sapiens
uuauaaacagcagg

SEQ ID NO: 2079225 - RNA, 21 nt, Homo sapiens
gaacaugauuuuacaaguaua

SEQ ID NO: 2079226 - RNA, 19 nt, Homo sapiens
aaaauacuuuuacucugcc

SEQ ID NO: 2079227 - RNA, 15 nt, Homo sapiens
cucccuguccauccc

SEQ ID NO: 2079228 - RNA, 22 nt, Homo sapiens
aucagaaguguuaagugacaug

SEQ ID NO: 2079229 - RNA, 17 nt, Homo sapiens
uccaggaagagcugugu

SEQ ID NO: 2079230 - RNA, 23 nt, Homo sapiens
auacuaguuugcuuugcugacca

SEQ ID NO: 2079231 - RNA, 14 nt, Homo sapiens
auagaaaaauguau

SEQ ID NO: 2079232 - RNA, 18 nt, Homo sapiens
aauaucuuuaaaugaugu

SEQ ID NO: 2079233 - RNA, 18 nt, Homo sapiens
uaauacuagauugaucua

SEQ ID NO: 2079234 - RNA, 22 nt, Homo sapiens
agaaaaguugggcuuucacaaa

SEQ ID NO: 2079235 - RNA, 13 nt, Homo sapiens
ugugugccacuca

SEQ ID NO: 2079236 - RNA, 15 nt, Homo sapiens
aaauguaacugugcc

SEQ ID NO: 2079237 - RNA, 20 nt, Homo sapiens
agaauuuacucaggcaugau

SEQ ID NO: 2079238 - RNA, 13 nt, Homo sapiens
caaacuacuucau

SEQ ID NO: 2079239 - RNA, 19 nt, Homo sapiens
cucacucuuccacauuccc

SEQ ID NO: 2079240 - RNA, 15 nt, Homo sapiens
ugauaguagucuuua

SEQ ID NO: 2079241 - RNA, 13 nt, Homo sapiens
uccucuucucaaa

SEQ ID NO: 2079242 - RNA, 14 nt, Homo sapiens
aacacucagcugcu

SEQ ID NO: 2079243 - RNA, 23 nt, Homo sapiens
auuuuauagucucaaaucaaaua

SEQ ID NO: 2079244 - RNA, 12 nt, Homo sapiens
gaagaacauuuu

SEQ ID NO: 2079245 - RNA, 18 nt, Homo sapiens
agaccauauaacugugau

SEQ ID NO: 2079246 - RNA, 15 nt, Homo sapiens
auuccucccauucaa

SEQ ID NO: 2079247 - RNA, 17 nt, Homo sapiens
cccuaagucacauauca

SEQ ID NO: 2079248 - RNA, 18 nt, Homo sapiens
cuccccaggagcucaggu

SEQ ID NO: 2079249 - RNA, 18 nt, Homo sapiens
cugccaauauccuaauaa

SEQ ID NO: 2079250 - RNA, 19 nt, Homo sapiens
aauuaguuuaccucaucca

SEQ ID NO: 2079251 - RNA, 22 nt, Homo sapiens
acuuuccuauuuucuuuuccau

SEQ ID NO: 2079252 - RNA, 20 nt, Homo sapiens
ucacaccugacucugaaauc

SEQ ID NO: 2079253 - RNA, 19 nt, Homo sapiens
gccugcccugcccaggugg

SEQ ID NO: 2079254 - RNA, 18 nt, Homo sapiens
augaugcccuccccucag

SEQ ID NO: 2079255 - RNA, 13 nt, Homo sapiens
acuggagugcucu

SEQ ID NO: 2079256 - RNA, 17 nt, Homo sapiens
aaucgagucuaccucuu

SEQ ID NO: 2079257 - RNA, 14 nt, Homo sapiens
ccuuacaaaugaaa

SEQ ID NO: 2079258 - RNA, 20 nt, Homo sapiens
ccugcuacacaaaagccaaa

SEQ ID NO: 2079259 - RNA, 18 nt, Homo sapiens
uaauaguuuugauccuaa

SEQ ID NO: 2079260 - RNA, 18 nt, Homo sapiens
guguucuccuccuauuca

SEQ ID NO: 2079261 - RNA, 20 nt, Homo sapiens
aauggcgugaucucggcuca

SEQ ID NO: 2079262 - RNA, 18 nt, Homo sapiens
cgaggugccuucuucagg

SEQ ID NO: 2079263 - RNA, 17 nt, Homo sapiens
gaaaauuauuccuugcu

SEQ ID NO: 2079264 - RNA, 18 nt, Homo sapiens
uuucagauuccacacaaa

SEQ ID NO: 2079265 - RNA, 13 nt, Homo sapiens
aaaacacuucugu

SEQ ID NO: 2079266 - RNA, 12 nt, Homo sapiens
augauacuuuaa

SEQ ID NO: 2079267 - RNA, 15 nt, Homo sapiens
guuuccaacaauuca

SEQ ID NO: 2079268 - RNA, 20 nt, Homo sapiens
aaaauaaucaguguuuccaa

SEQ ID NO: 2079269 - RNA, 14 nt, Homo sapiens
uaaacagcagguga

SEQ ID NO: 2079270 - RNA, 16 nt, Homo sapiens
uagaagccacagugcc

SEQ ID NO: 2079271 - RNA, 19 nt, Homo sapiens
cacugguuuguuucucaag

SEQ ID NO: 2079272 - RNA, 17 nt, Homo sapiens
aaaauaaaacacauuua

SEQ ID NO: 2079273 - RNA, 20 nt, Homo sapiens
gcacaaucuacacugccuua

SEQ ID NO: 2079274 - RNA, 13 nt, Homo sapiens
uccccauugccuu

SEQ ID NO: 2079275 - RNA, 21 nt, Homo sapiens
ugggcagcuguuagaguccaa

SEQ ID NO: 2079276 - RNA, 20 nt, Homo sapiens
ggucagggccagacuggaag

SEQ ID NO: 2079277 - RNA, 14 nt, Homo sapiens
aucucuucuuaaug

SEQ ID NO: 2079278 - RNA, 14 nt, Homo sapiens
uuaaugucaucucu

SEQ ID NO: 2079279 - RNA, 16 nt, Homo sapiens
ccaggcccugccauug

SEQ ID NO: 2079280 - RNA, 16 nt, Homo sapiens
ugacaaugcugccaug

SEQ ID NO: 2079281 - RNA, 16 nt, Homo sapiens
aacacccuuucaucuc

SEQ ID NO: 2079282 - RNA, 17 nt, Homo sapiens
cuccagaacccauuuga

SEQ ID NO: 2079283 - RNA, 15 nt, Homo sapiens
aagcuucuugugauc

SEQ ID NO: 2079284 - RNA, 15 nt, Homo sapiens
aaaaugcaacaugug

SEQ ID NO: 2079285 - RNA, 17 nt, Homo sapiens
acaucucuuugauguca

SEQ ID NO: 2079286 - RNA, 18 nt, Homo sapiens
aacuccuuucagccacau

SEQ ID NO: 2079287 - RNA, 17 nt, Homo sapiens
uuugaaucuacauucac

SEQ ID NO: 2079288 - RNA, 15 nt, Homo sapiens
ugccgcugucucuga

SEQ ID NO: 2079289 - RNA, 14 nt, Homo sapiens
aguaugagggaaaa

SEQ ID NO: 2079290 - RNA, 16 nt, Homo sapiens
auguuaguagcacuga

SEQ ID NO: 2079291 - RNA, 14 nt, Homo sapiens
aagaaagaaugcau

SEQ ID NO: 2079292 - RNA, 18 nt, Homo sapiens
gaccaacaggcccagcuu

SEQ ID NO: 2079293 - RNA, 21 nt, Homo sapiens
acaaaugguggguacaaaaag

SEQ ID NO: 2079294 - RNA, 23 nt, Homo sapiens
uggcacccagagaaaaggacucc

SEQ ID NO: 2079295 - RNA, 12 nt, Homo sapiens
uccugcagacac

SEQ ID NO: 2079296 - RNA, 23 nt, Homo sapiens
aagaguuggagugagaugaagga

SEQ ID NO: 2079297 - RNA, 16 nt, Homo sapiens
auuucuguguuacuca

SEQ ID NO: 2079298 - RNA, 19 nt, Homo sapiens
uaacugcucaguguuucau

SEQ ID NO: 2079299 - RNA, 16 nt, Homo sapiens
auaaucacaguugugu

SEQ ID NO: 2079300 - RNA, 18 nt, Homo sapiens
cacauuggagacaucugc

SEQ ID NO: 2079301 - RNA, 22 nt, Homo sapiens
uucccuucuacaaggacuccau

SEQ ID NO: 2079302 - RNA, 14 nt, Homo sapiens
caggagaccugcuc

SEQ ID NO: 2079303 - RNA, 17 nt, Homo sapiens
uuuaacauuuuccaaaa

SEQ ID NO: 2079304 - RNA, 19 nt, Homo sapiens
uugcagucucucucugcca

SEQ ID NO: 2079305 - RNA, 14 nt, Homo sapiens
aauaugcaguuccu

SEQ ID NO: 2079306 - RNA, 15 nt, Homo sapiens
ugaccagugcugcug

SEQ ID NO: 2079307 - RNA, 17 nt, Homo sapiens
ccuccggcgucuugccc

SEQ ID NO: 2079308 - RNA, 20 nt, Homo sapiens
acaugggugugccaggcuag

SEQ ID NO: 2079309 - RNA, 20 nt, Homo sapiens
gcugcuuuugaugaaaagca

SEQ ID NO: 2079310 - RNA, 17 nt, Homo sapiens
ugucuaauaaaauauaa

SEQ ID NO: 2079311 - RNA, 21 nt, Homo sapiens
uaacuucagauacuugugaac

SEQ ID NO: 2079312 - RNA, 16 nt, Homo sapiens
cucaggaccuagggau

SEQ ID NO: 2079313 - RNA, 19 nt, Homo sapiens
cuucaccaggaccaguuca

SEQ ID NO: 2079314 - RNA, 17 nt, Homo sapiens
ugaucaugucagccuca

SEQ ID NO: 2079315 - RNA, 21 nt, Homo sapiens
ucaguucuguguggugcauuc

SEQ ID NO: 2079316 - RNA, 22 nt, Homo sapiens
ugaaggaggugagggaugugaa

SEQ ID NO: 2079317 - RNA, 17 nt, Homo sapiens
acagucccagauacacu

SEQ ID NO: 2079318 - RNA, 16 nt, Homo sapiens
uccuacucacacuuca

SEQ ID NO: 2079319 - RNA, 17 nt, Homo sapiens
gugccugucacuacugg

SEQ ID NO: 2079320 - RNA, 23 nt, Homo sapiens
auuuugaaaugaaacaagcuuac

SEQ ID NO: 2079321 - RNA, 23 nt, Homo sapiens
cauaauaaagcaaucugauucag

SEQ ID NO: 2079322 - RNA, 22 nt, Homo sapiens
ccagacauuuacaaaguuguuu

SEQ ID NO: 2079323 - RNA, 16 nt, Homo sapiens
cuuuucccuucagucu

SEQ ID NO: 2079324 - RNA, 18 nt, Homo sapiens
ugggcccaaugcacuuug

SEQ ID NO: 2079325 - RNA, 22 nt, Homo sapiens
ccuggcccgcuaaggugaaaag

SEQ ID NO: 2079326 - RNA, 20 nt, Homo sapiens
cugaauuugcaaaguacugu

SEQ ID NO: 2079327 - RNA, 20 nt, Homo sapiens
accacauuugcuagagggag

SEQ ID NO: 2079328 - RNA, 21 nt, Homo sapiens
ccuggggaugaagcucacugg

SEQ ID NO: 2079329 - RNA, 16 nt, Homo sapiens
uccugaccucagguga

SEQ ID NO: 2079330 - RNA, 19 nt, Homo sapiens
agacaggccccgugaggca

SEQ ID NO: 2079331 - RNA, 23 nt, Homo sapiens
acacuguaagaguucacauggaa

SEQ ID NO: 2079332 - RNA, 12 nt, Homo sapiens
gcaaaguacugu

SEQ ID NO: 2079333 - RNA, 11 nt, Homo sapiens
aggacaucuua

SEQ ID NO: 2079334 - RNA, 22 nt, Homo sapiens
aauccaacugucagaucuggau

SEQ ID NO: 2079335 - RNA, 14 nt, Homo sapiens
cugaaaaaugcaaa

SEQ ID NO: 2079336 - RNA, 18 nt, Homo sapiens
caacagguaaaacagggc

SEQ ID NO: 2079337 - RNA, 23 nt, Homo sapiens
cguggauguauggggaaucuaag

SEQ ID NO: 2079338 - RNA, 22 nt, Homo sapiens
ucuaauucuauuaaagugcuaa

SEQ ID NO: 2079339 - RNA, 21 nt, Homo sapiens
uuucagcauggaggguuuuaa

SEQ ID NO: 2079340 - RNA, 18 nt, Homo sapiens
uaacaugauuguuugaca

SEQ ID NO: 2079341 - RNA, 14 nt, Homo sapiens
ugacaugugcagug

SEQ ID NO: 2079342 - RNA, 19 nt, Homo sapiens
uccuuuuacaauuguugaa

SEQ ID NO: 2079343 - RNA, 14 nt, Homo sapiens
uaagacaacaggca

SEQ ID NO: 2079344 - RNA, 18 nt, Homo sapiens
cucuguuuucaugcuauu

SEQ ID NO: 2079345 - RNA, 18 nt, Homo sapiens
uccauggcccugccaugc

SEQ ID NO: 2079346 - RNA, 20 nt, Homo sapiens
cuauaacuauguugauaaaa

SEQ ID NO: 2079347 - RNA, 18 nt, Homo sapiens
aaaucuucccaguauuau

SEQ ID NO: 2079348 - RNA, 20 nt, Homo sapiens
uucaauauuuuuguauauac

SEQ ID NO: 2079349 - RNA, 15 nt, Homo sapiens
cuguguauucuaguu

SEQ ID NO: 2079350 - RNA, 23 nt, Homo sapiens
gcuguggccgucuccucccucag

SEQ ID NO: 2079351 - RNA, 21 nt, Homo sapiens
uccgucucaaaaaaagggcaa

SEQ ID NO: 2079352 - RNA, 16 nt, Homo sapiens
cauccacccgcugccc

SEQ ID NO: 2079353 - RNA, 21 nt, Homo sapiens
aacucucuucuuccauuagaa

SEQ ID NO: 2079354 - RNA, 13 nt, Homo sapiens
augaugcaguuuc

SEQ ID NO: 2079355 - RNA, 14 nt, Homo sapiens
ggcaccacagagaa

SEQ ID NO: 2079356 - RNA, 13 nt, Homo sapiens
ucaggccuccagc

SEQ ID NO: 2079357 - RNA, 15 nt, Homo sapiens
ugucuguguauacau

SEQ ID NO: 2079358 - RNA, 15 nt, Homo sapiens
gugccucaccuucca

SEQ ID NO: 2079359 - RNA, 22 nt, Homo sapiens
cuggcuuugcacuugaccucau

SEQ ID NO: 2079360 - RNA, 21 nt, Homo sapiens
caugagcgucuguggagccau

SEQ ID NO: 2079361 - RNA, 17 nt, Homo sapiens
aaguguuuagaaaucau

SEQ ID NO: 2079362 - RNA, 20 nt, Homo sapiens
gcaaauaaaauaaaugaaau

SEQ ID NO: 2079363 - RNA, 15 nt, Homo sapiens
ugagacccugucuca

SEQ ID NO: 2079364 - RNA, 20 nt, Homo sapiens
guggcacaaucucagcucac

SEQ ID NO: 2079365 - RNA, 22 nt, Homo sapiens
ucucuucagccccuagugcuau

SEQ ID NO: 2079366 - RNA, 23 nt, Homo sapiens
acauuuucucugaugaugucaca

SEQ ID NO: 2079367 - RNA, 18 nt, Homo sapiens
aaaagcuagauacuggaa

SEQ ID NO: 2079368 - RNA, 18 nt, Homo sapiens
uacaccauuaucuuggaa

SEQ ID NO: 2079369 - RNA, 16 nt, Homo sapiens
caauauggauuucuua

SEQ ID NO: 2079370 - RNA, 17 nt, Homo sapiens
aagauacacugcagcug

SEQ ID NO: 2079371 - RNA, 15 nt, Homo sapiens
agcagaggucuucag

SEQ ID NO: 2079372 - RNA, 23 nt, Homo sapiens
ugaaugccucccucaaaggaccu

SEQ ID NO: 2079373 - RNA, 16 nt, Homo sapiens
uuucaaaaacagcuac

SEQ ID NO: 2079374 - RNA, 19 nt, Homo sapiens
ccagcccuccccaccugcu

SEQ ID NO: 2079375 - RNA, 22 nt, Homo sapiens
ugccacugaggggggauccagu

SEQ ID NO: 2079376 - RNA, 14 nt, Homo sapiens
uagaagacuacaau

SEQ ID NO: 2079377 - RNA, 17 nt, Homo sapiens
ugucgauuuucaauaau

SEQ ID NO: 2079378 - RNA, 22 nt, Homo sapiens
augauauggagguucaaugaga

SEQ ID NO: 2079379 - RNA, 14 nt, Homo sapiens
ucuaguucauugaa

SEQ ID NO: 2079380 - RNA, 14 nt, Homo sapiens
cccuuacacacuca

SEQ ID NO: 2079381 - RNA, 17 nt, Homo sapiens
cggaagggguuccucaa

SEQ ID NO: 2079382 - RNA, 19 nt, Homo sapiens
cacaucucuguagauacag

SEQ ID NO: 2079383 - RNA, 21 nt, Homo sapiens
cuuaagucuuuauuaacuuug

SEQ ID NO: 2079384 - RNA, 16 nt, Homo sapiens
aggcauugcacaggga

SEQ ID NO: 2079385 - RNA, 18 nt, Homo sapiens
gccaccagccacuuuagu

SEQ ID NO: 2079386 - RNA, 15 nt, Homo sapiens
gccuuugaccaucuc

SEQ ID NO: 2079387 - RNA, 15 nt, Homo sapiens
accccucuaccuccu

SEQ ID NO: 2079388 - RNA, 12 nt, Homo sapiens
ucucucacauua

SEQ ID NO: 2079389 - RNA, 14 nt, Homo sapiens
uccagcacuggaag

SEQ ID NO: 2079390 - RNA, 18 nt, Homo sapiens
cuuagaauaaaauuguaa

SEQ ID NO: 2079391 - RNA, 19 nt, Homo sapiens
agccaggaaagaagaguug

SEQ ID NO: 2079392 - RNA, 18 nt, Homo sapiens
auauuguaaagauccuau

SEQ ID NO: 2079393 - RNA, 16 nt, Homo sapiens
auucagagagcagcuu

SEQ ID NO: 2079394 - RNA, 16 nt, Homo sapiens
ucuucauugucuacau

SEQ ID NO: 2079395 - RNA, 22 nt, Homo sapiens
uggucccugccuuaggccuacc

SEQ ID NO: 2079396 - RNA, 15 nt, Homo sapiens
gccccuaugugacag

SEQ ID NO: 2079397 - RNA, 17 nt, Homo sapiens
ccuccccagcccaggaa

SEQ ID NO: 2079398 - RNA, 21 nt, Homo sapiens
cagagcagcuuggcccaggga

SEQ ID NO: 2079399 - RNA, 23 nt, Homo sapiens
acagaagacccgcucuccaucuu

SEQ ID NO: 2079400 - RNA, 18 nt, Homo sapiens
gauagaacuguacuguuu

SEQ ID NO: 2079401 - RNA, 20 nt, Homo sapiens
aguguuugucugucuugaca

SEQ ID NO: 2079402 - RNA, 15 nt, Homo sapiens
aaguaaacucaaaca

SEQ ID NO: 2079403 - RNA, 21 nt, Homo sapiens
uuaagcaaaggaaaccaaagg

SEQ ID NO: 2079404 - RNA, 15 nt, Homo sapiens
accugccacuaggcu

SEQ ID NO: 2079405 - RNA, 21 nt, Homo sapiens
ccuuugcugucacuuucucuc

SEQ ID NO: 2079406 - RNA, 22 nt, Homo sapiens
cacuacagcugagcagauguaa

SEQ ID NO: 2079407 - RNA, 13 nt, Homo sapiens
gcauuuugcaaac

SEQ ID NO: 2079408 - RNA, 17 nt, Homo sapiens
aagcugccgguucuuaa

SEQ ID NO: 2079409 - RNA, 21 nt, Homo sapiens
ugauauuuccuucaccaccuc

SEQ ID NO: 2079410 - RNA, 15 nt, Homo sapiens
aacagauuacuagaa

SEQ ID NO: 2079411 - RNA, 13 nt, Homo sapiens
auuucucucugac

SEQ ID NO: 2079412 - RNA, 19 nt, Homo sapiens
cuaacuuauccaucuuuga

SEQ ID NO: 2079413 - RNA, 20 nt, Homo sapiens
cgugccaaaaaucuuuucau

SEQ ID NO: 2079414 - RNA, 23 nt, Homo sapiens
cucuuagagaaagaacuaugaaa

SEQ ID NO: 2079415 - RNA, 19 nt, Homo sapiens
ucuccugccuuugccucca

SEQ ID NO: 2079416 - RNA, 10 nt, Homo sapiens
accucugaga

SEQ ID NO: 2079417 - RNA, 19 nt, Homo sapiens
uaaaacucaacauuacugu

SEQ ID NO: 2079418 - RNA, 13 nt, Homo sapiens
aaucugcaaggac

SEQ ID NO: 2079419 - RNA, 14 nt, Homo sapiens
uggccacacugggg

SEQ ID NO: 2079420 - RNA, 21 nt, Homo sapiens
accuggcaacaaaaaguaaug

SEQ ID NO: 2079421 - RNA, 17 nt, Homo sapiens
auuuacaacucauucca

SEQ ID NO: 2079422 - RNA, 18 nt, Homo sapiens
auacaccacugcaaaaug

SEQ ID NO: 2079423 - RNA, 13 nt, Homo sapiens
ggcucauuuacuu

SEQ ID NO: 2079424 - RNA, 14 nt, Homo sapiens
ugaggcugucacag

SEQ ID NO: 2079425 - RNA, 13 nt, Homo sapiens
uagaucuuucuag

SEQ ID NO: 2079426 - RNA, 20 nt, Homo sapiens
ucugaaucgagugagacaaa

SEQ ID NO: 2079427 - RNA, 14 nt, Homo sapiens
ccucaaucauagcc

SEQ ID NO: 2079428 - RNA, 19 nt, Homo sapiens
cccgauggggaacaguguu

SEQ ID NO: 2079429 - RNA, 20 nt, Homo sapiens
ucacauaacuucucugaguc

SEQ ID NO: 2079430 - RNA, 15 nt, Homo sapiens
uauuucucuucuacc

SEQ ID NO: 2079431 - RNA, 13 nt, Homo sapiens
aagcaaaacugca

SEQ ID NO: 2079432 - RNA, 17 nt, Homo sapiens
agauaggacaacacugc

SEQ ID NO: 2079433 - RNA, 15 nt, Homo sapiens
auccccucucugugg

SEQ ID NO: 2079434 - RNA, 22 nt, Homo sapiens
aacugcauucuucugagcacug

SEQ ID NO: 2079435 - RNA, 17 nt, Homo sapiens
aauaucuuccacagagg

SEQ ID NO: 2079436 - RNA, 19 nt, Homo sapiens
ugccaggauuaaaagccau

SEQ ID NO: 2079437 - RNA, 19 nt, Homo sapiens
ugaggcagagucucauucu

SEQ ID NO: 2079438 - RNA, 14 nt, Homo sapiens
uuguaauagugcca

SEQ ID NO: 2079439 - RNA, 15 nt, Homo sapiens
guuauuuuaauuauc

SEQ ID NO: 2079440 - RNA, 15 nt, Homo sapiens
agaguguaaugggga

SEQ ID NO: 2079441 - RNA, 13 nt, Homo sapiens
uggaaccuggacc

SEQ ID NO: 2079442 - RNA, 15 nt, Homo sapiens
cagcccccacugacc

SEQ ID NO: 2079443 - RNA, 20 nt, Homo sapiens
uauaguuaugcauacauaca

SEQ ID NO: 2079444 - RNA, 21 nt, Homo sapiens
caacaaggaagagcugcucac

SEQ ID NO: 2079445 - RNA, 18 nt, Homo sapiens
uauggugauucaaaugca

SEQ ID NO: 2079446 - RNA, 18 nt, Homo sapiens
uggagaguggcaucuucu

SEQ ID NO: 2079447 - RNA, 12 nt, Homo sapiens
acacaggaugag

SEQ ID NO: 2079448 - RNA, 20 nt, Homo sapiens
agucaauaaaagagcugucu

SEQ ID NO: 2079449 - RNA, 15 nt, Homo sapiens
uaucuguguggugau

SEQ ID NO: 2079450 - RNA, 12 nt, Homo sapiens
cauuauguauga

SEQ ID NO: 2079451 - RNA, 17 nt, Homo sapiens
acaaaugugcucuaugu

SEQ ID NO: 2079452 - RNA, 17 nt, Homo sapiens
aauaaagugaacuuugu

SEQ ID NO: 2079453 - RNA, 22 nt, Homo sapiens
accucagugguuagaagcaugu

SEQ ID NO: 2079454 - RNA, 14 nt, Homo sapiens
accccugcacuacu

SEQ ID NO: 2079455 - RNA, 22 nt, Homo sapiens
uaaaccagguuugcaccuaagu

SEQ ID NO: 2079456 - RNA, 15 nt, Homo sapiens
ugaaguugcugcuuc

SEQ ID NO: 2079457 - RNA, 21 nt, Homo sapiens
cagugcccaccaacaucccau

SEQ ID NO: 2079458 - RNA, 17 nt, Homo sapiens
uuauuucauucauaucc

SEQ ID NO: 2079459 - RNA, 17 nt, Homo sapiens
auacaaauaacugauga

SEQ ID NO: 2079460 - RNA, 15 nt, Homo sapiens
cgaagcugaccugca

SEQ ID NO: 2079461 - RNA, 16 nt, Homo sapiens
cuugagagaggccaca

SEQ ID NO: 2079462 - RNA, 20 nt, Homo sapiens
gccccuauagaaacaccagu

SEQ ID NO: 2079463 - RNA, 15 nt, Homo sapiens
gcagucuaauuacau

SEQ ID NO: 2079464 - RNA, 12 nt, Homo sapiens
ugaaaaggugau

SEQ ID NO: 2079465 - RNA, 14 nt, Homo sapiens
aacacugucccaag

SEQ ID NO: 2079466 - RNA, 22 nt, Homo sapiens
aagugcugggauuacaggugug

SEQ ID NO: 2079467 - RNA, 19 nt, Homo sapiens
cccaucgugaagaagccug

SEQ ID NO: 2079468 - RNA, 14 nt, Homo sapiens
acggacucccgggc

SEQ ID NO: 2079469 - RNA, 22 nt, Homo sapiens
aucuguuuauuuacaagggaag

SEQ ID NO: 2079470 - RNA, 19 nt, Homo sapiens
caccucauucugaacccuu

SEQ ID NO: 2079471 - RNA, 13 nt, Homo sapiens
gagcuagaaccug

SEQ ID NO: 2079472 - RNA, 16 nt, Homo sapiens
caaacucccgaccuca

SEQ ID NO: 2079473 - RNA, 16 nt, Homo sapiens
gacaauaaacccucag

SEQ ID NO: 2079474 - RNA, 16 nt, Homo sapiens
cuuauucaucagggag

SEQ ID NO: 2079475 - RNA, 17 nt, Homo sapiens
gcagccuccaacacaag

SEQ ID NO: 2079476 - RNA, 13 nt, Homo sapiens
gaguagcuggaau

SEQ ID NO: 2079477 - RNA, 17 nt, Homo sapiens
gaucuagcuucaugccu

SEQ ID NO: 2079478 - RNA, 16 nt, Homo sapiens
aagccucaucaucaga

SEQ ID NO: 2079479 - RNA, 13 nt, Homo sapiens
cauaauuuugcca

SEQ ID NO: 2079480 - RNA, 20 nt, Homo sapiens
gacuacaaccaauuuacacu

SEQ ID NO: 2079481 - RNA, 21 nt, Homo sapiens
accagcaaacagcugaaagag

SEQ ID NO: 2079482 - RNA, 13 nt, Homo sapiens
ugaccagugcagu

SEQ ID NO: 2079483 - RNA, 22 nt, Homo sapiens
guaugucuacacguaaguauaa

SEQ ID NO: 2079484 - RNA, 21 nt, Homo sapiens
aaaguauguuuucaauguuuc

SEQ ID NO: 2079485 - RNA, 23 nt, Homo sapiens
aucugagaccccaaacucuccaa

SEQ ID NO: 2079486 - RNA, 22 nt, Homo sapiens
cuguaauuaaguaaaccaaaaa

SEQ ID NO: 2079487 - RNA, 16 nt, Homo sapiens
aacaagucccuguaau

SEQ ID NO: 2079488 - RNA, 19 nt, Homo sapiens
uaaaucauucuuacuaaaa

SEQ ID NO: 2079489 - RNA, 15 nt, Homo sapiens
agcucuugggccuga

SEQ ID NO: 2079490 - RNA, 17 nt, Homo sapiens
augaacacacauggaug

SEQ ID NO: 2079491 - RNA, 16 nt, Homo sapiens
uuagaagaaaauggau

SEQ ID NO: 2079492 - RNA, 14 nt, Homo sapiens
uauccagucaaaga

SEQ ID NO: 2079493 - RNA, 20 nt, Homo sapiens
accagugaagacgucagggg

SEQ ID NO: 2079494 - RNA, 16 nt, Homo sapiens
cuaacaaaggcagcug

SEQ ID NO: 2079495 - RNA, 20 nt, Homo sapiens
gcgacugagccaugcucaga

SEQ ID NO: 2079496 - RNA, 20 nt, Homo sapiens
agagaaccucacgcaccucc

SEQ ID NO: 2079497 - RNA, 21 nt, Homo sapiens
ucauccuuggucuaugugcuc

SEQ ID NO: 2079498 - RNA, 22 nt, Homo sapiens
cuaagaaucauccucaugccuu

SEQ ID NO: 2079499 - RNA, 23 nt, Homo sapiens
ucucccuuuccauggcaaauggg

SEQ ID NO: 2079500 - RNA, 12 nt, Homo sapiens
ccuagaacuucc

SEQ ID NO: 2079501 - RNA, 13 nt, Homo sapiens
uucucuuucuccc

SEQ ID NO: 2079502 - RNA, 15 nt, Homo sapiens
cagugccuuucuucu

SEQ ID NO: 2079503 - RNA, 23 nt, Homo sapiens
guuaggaaaauuucacauuaaua

SEQ ID NO: 2079504 - RNA, 12 nt, Homo sapiens
caaaaucaggaa

SEQ ID NO: 2079505 - RNA, 22 nt, Homo sapiens
aggaaacucgaauaaaggaugg

SEQ ID NO: 2079506 - RNA, 21 nt, Homo sapiens
uaugauggggcaugugccaua

SEQ ID NO: 2079507 - RNA, 14 nt, Homo sapiens
gcgagcacuuucca

SEQ ID NO: 2079508 - RNA, 15 nt, Homo sapiens
caugagcuugccuaa

SEQ ID NO: 2079509 - RNA, 15 nt, Homo sapiens
uaccagagacucuga

SEQ ID NO: 2079510 - RNA, 13 nt, Homo sapiens
uuagccuguguca

SEQ ID NO: 2079511 - RNA, 23 nt, Homo sapiens
agugcgugcucccgaugcugcua

SEQ ID NO: 2079512 - RNA, 13 nt, Homo sapiens
aguuaucaucuca

SEQ ID NO: 2079513 - RNA, 22 nt, Homo sapiens
uaaacaauuccuuacauuuacc

SEQ ID NO: 2079514 - RNA, 13 nt, Homo sapiens
uggugugccaugc

SEQ ID NO: 2079515 - RNA, 19 nt, Homo sapiens
ugcuagcagcugugauggu

SEQ ID NO: 2079516 - RNA, 14 nt, Homo sapiens
gagcaaaaagacca

SEQ ID NO: 2079517 - RNA, 17 nt, Homo sapiens
ggcaucucucugggaug

SEQ ID NO: 2079518 - RNA, 16 nt, Homo sapiens
uccaaugcauugcuaa

SEQ ID NO: 2079519 - RNA, 17 nt, Homo sapiens
aacagccacuacauuac

SEQ ID NO: 2079520 - RNA, 14 nt, Homo sapiens
uguuguccaggaaa

SEQ ID NO: 2079521 - RNA, 13 nt, Homo sapiens
ugugggauaucac

SEQ ID NO: 2079522 - RNA, 16 nt, Homo sapiens
cggccagccaugucug

SEQ ID NO: 2079523 - RNA, 14 nt, Homo sapiens
aauuacguaugcaa

SEQ ID NO: 2079524 - RNA, 16 nt, Homo sapiens
cauauaggacacacau

SEQ ID NO: 2079525 - RNA, 17 nt, Homo sapiens
aguguccuaagugcuaa

SEQ ID NO: 2079526 - RNA, 14 nt, Homo sapiens
aauguacacugauu

SEQ ID NO: 2079527 - RNA, 15 nt, Homo sapiens
uaggaaauaucauua

SEQ ID NO: 2079528 - RNA, 16 nt, Homo sapiens
gaacucugcaacugaa

SEQ ID NO: 2079529 - RNA, 16 nt, Homo sapiens
ccucuuuuccccauga

SEQ ID NO: 2079530 - RNA, 18 nt, Homo sapiens
uagagauauguaucauaa

SEQ ID NO: 2079531 - RNA, 16 nt, Homo sapiens
aggugucucuuucauc

SEQ ID NO: 2079532 - RNA, 15 nt, Homo sapiens
caaaugaaggaugaa

SEQ ID NO: 2079533 - RNA, 12 nt, Homo sapiens
aucuaguuuaca

SEQ ID NO: 2079534 - RNA, 18 nt, Homo sapiens
acaguuuggagcccacau

SEQ ID NO: 2079535 - RNA, 15 nt, Homo sapiens
caucuggcggaucca

SEQ ID NO: 2079536 - RNA, 16 nt, Homo sapiens
ucuccugauuauuuau

SEQ ID NO: 2079537 - RNA, 16 nt, Homo sapiens
acaacucggggacaaa

SEQ ID NO: 2079538 - RNA, 21 nt, Homo sapiens
cuuagaacuguggccguuccu

SEQ ID NO: 2079539 - RNA, 19 nt, Homo sapiens
aguuauggcuauaggugcu

SEQ ID NO: 2079540 - RNA, 18 nt, Homo sapiens
acagggcugacauugugg

SEQ ID NO: 2079541 - RNA, 18 nt, Homo sapiens
ugggcugaggccagggga

SEQ ID NO: 2079542 - RNA, 17 nt, Homo sapiens
uggacaaaugaugccau

SEQ ID NO: 2079543 - RNA, 21 nt, Homo sapiens
auaauuuuccucaaucacacu

SEQ ID NO: 2079544 - RNA, 19 nt, Homo sapiens
cagucagagggcaacagga

SEQ ID NO: 2079545 - RNA, 19 nt, Homo sapiens
ccccagaaauucuggccca

SEQ ID NO: 2079546 - RNA, 14 nt, Homo sapiens
cuaaacuaacaaga

SEQ ID NO: 2079547 - RNA, 21 nt, Homo sapiens
uuccauaagcuuggugacaaa

SEQ ID NO: 2079548 - RNA, 21 nt, Homo sapiens
aaugccauccucaaacacugc

SEQ ID NO: 2079549 - RNA, 18 nt, Homo sapiens
gaaguuaaagguauuuau

SEQ ID NO: 2079550 - RNA, 11 nt, Homo sapiens
gcagcggcccc

SEQ ID NO: 2079551 - RNA, 22 nt, Homo sapiens
auaccuccucccuaaugcucac

SEQ ID NO: 2079552 - RNA, 23 nt, Homo sapiens
uuuauagaacauauuuuccuuua

SEQ ID NO: 2079553 - RNA, 19 nt, Homo sapiens
ucagucugggugggacuua

SEQ ID NO: 2079554 - RNA, 22 nt, Homo sapiens
agcaacaucuuuuuaaccugca

SEQ ID NO: 2079555 - RNA, 15 nt, Homo sapiens
caaugacuuccauau

SEQ ID NO: 2079556 - RNA, 14 nt, Homo sapiens
agccccuacugugg

SEQ ID NO: 2079557 - RNA, 14 nt, Homo sapiens
acaauaaagcaaua

SEQ ID NO: 2079558 - RNA, 14 nt, Homo sapiens
ucaccuucugggca

SEQ ID NO: 2079559 - RNA, 19 nt, Homo sapiens
ucgccagcaaaacuuagau

SEQ ID NO: 2079560 - RNA, 21 nt, Homo sapiens
guccuugugaguccaucuaac

SEQ ID NO: 2079561 - RNA, 18 nt, Homo sapiens
cccuaacaaagaccauga

SEQ ID NO: 2079562 - RNA, 12 nt, Homo sapiens
acucuuugcaac

SEQ ID NO: 2079563 - RNA, 23 nt, Homo sapiens
aguuauagaagagaaaugcugcu

SEQ ID NO: 2079564 - RNA, 22 nt, Homo sapiens
aagaaugucuccugccacuccu

SEQ ID NO: 2079565 - RNA, 13 nt, Homo sapiens
auccaacccgggg

SEQ ID NO: 2079566 - RNA, 17 nt, Homo sapiens
uauucacugauuugaca

SEQ ID NO: 2079567 - RNA, 14 nt, Homo sapiens
aagcugaugaggcu

SEQ ID NO: 2079568 - RNA, 19 nt, Homo sapiens
ugucacgugacccugugcc

SEQ ID NO: 2079569 - RNA, 21 nt, Homo sapiens
gagacaccaccacccuugcca

SEQ ID NO: 2079570 - RNA, 13 nt, Homo sapiens
cugcuacccagua

SEQ ID NO: 2079571 - RNA, 20 nt, Homo sapiens
cccagcuuauaaacagaagu

SEQ ID NO: 2079572 - RNA, 21 nt, Homo sapiens
gaaaaugaucuuaauuuacuu

SEQ ID NO: 2079573 - RNA, 12 nt, Homo sapiens
uucuuacacuga

SEQ ID NO: 2079574 - RNA, 17 nt, Homo sapiens
ugcugcuggaaguagaa

SEQ ID NO: 2079575 - RNA, 12 nt, Homo sapiens
cccucugccuca

SEQ ID NO: 2079576 - RNA, 14 nt, Homo sapiens
gaauguacuggcga

SEQ ID NO: 2079577 - RNA, 17 nt, Homo sapiens
acccacaccgucuuccu

SEQ ID NO: 2079578 - RNA, 18 nt, Homo sapiens
uauuugaguauugcugau

SEQ ID NO: 2079579 - RNA, 19 nt, Homo sapiens
ccagacccugaagauuuca

SEQ ID NO: 2079580 - RNA, 20 nt, Homo sapiens
ugugcccuccaccuaccugc

SEQ ID NO: 2079581 - RNA, 12 nt, Homo sapiens
uagaaaaccaua

SEQ ID NO: 2079582 - RNA, 17 nt, Homo sapiens
auucuaauaacugcuua

SEQ ID NO: 2079583 - RNA, 23 nt, Homo sapiens
auguagcuuccaccucauggauu

SEQ ID NO: 2079584 - RNA, 23 nt, Homo sapiens
acuaccccaggacgcaugcaggg

SEQ ID NO: 2079585 - RNA, 21 nt, Homo sapiens
auuauauaaaauacauaauau

SEQ ID NO: 2079586 - RNA, 16 nt, Homo sapiens
gauuuaucuagcuguc

SEQ ID NO: 2079587 - RNA, 20 nt, Homo sapiens
aaaugaaugauucuacagcu

SEQ ID NO: 2079588 - RNA, 18 nt, Homo sapiens
cuuucauuugcuuuggaa

SEQ ID NO: 2079589 - RNA, 22 nt, Homo sapiens
agacacccuaacucuugcucac

SEQ ID NO: 2079590 - RNA, 15 nt, Homo sapiens
gaauugucuugcaag

SEQ ID NO: 2079591 - RNA, 15 nt, Homo sapiens
aagacugaaaugccu

SEQ ID NO: 2079592 - RNA, 18 nt, Homo sapiens
agagcgaggaaaggauuu

SEQ ID NO: 2079593 - RNA, 14 nt, Homo sapiens
agcauguacagugu

SEQ ID NO: 2079594 - RNA, 19 nt, Homo sapiens
cuuggaggcugucuucuca

SEQ ID NO: 2079595 - RNA, 14 nt, Homo sapiens
aacccucacugugu

SEQ ID NO: 2079596 - RNA, 14 nt, Homo sapiens
ccaucugcauuuga

SEQ ID NO: 2079597 - RNA, 20 nt, Homo sapiens
uacuaagugaugcugugaua

SEQ ID NO: 2079598 - RNA, 16 nt, Homo sapiens
uuaggauaauacauaa

SEQ ID NO: 2079599 - RNA, 22 nt, Homo sapiens
agccuggugacaggcagacaca

SEQ ID NO: 2079600 - RNA, 16 nt, Homo sapiens
ccaccucuaccaaaaa

SEQ ID NO: 2079601 - RNA, 23 nt, Homo sapiens
gauccaaacagaaaagugcaaag

SEQ ID NO: 2079602 - RNA, 23 nt, Homo sapiens
acugaggaugauguuauucacag

SEQ ID NO: 2079603 - RNA, 15 nt, Homo sapiens
cauauggacucugca

SEQ ID NO: 2079604 - RNA, 14 nt, Homo sapiens
aauguugggagaaa

SEQ ID NO: 2079605 - RNA, 16 nt, Homo sapiens
gggaaggggaaggaua

SEQ ID NO: 2079606 - RNA, 14 nt, Homo sapiens
ugccaacuggaaag

SEQ ID NO: 2079607 - RNA, 23 nt, Homo sapiens
agggcaaguguucccaaauugac

SEQ ID NO: 2079608 - RNA, 19 nt, Homo sapiens
ugcaucguccccuccccca

SEQ ID NO: 2079609 - RNA, 13 nt, Homo sapiens
auguuaacaugcg

SEQ ID NO: 2079610 - RNA, 17 nt, Homo sapiens
cuuccaguuugcuugau

SEQ ID NO: 2079611 - RNA, 16 nt, Homo sapiens
uagcuaagcaucuccu

SEQ ID NO: 2079612 - RNA, 13 nt, Homo sapiens
acacuuacuccag

SEQ ID NO: 2079613 - RNA, 21 nt, Homo sapiens
guuuuaacucuaucugucaua

SEQ ID NO: 2079614 - RNA, 12 nt, Homo sapiens
ugggaauugcau

SEQ ID NO: 2079615 - RNA, 21 nt, Homo sapiens
uggcaaauguaacugugccag

SEQ ID NO: 2079616 - RNA, 15 nt, Homo sapiens
aguugacuugacaga

SEQ ID NO: 2079617 - RNA, 21 nt, Homo sapiens
cauggaccaugcugucuggca

SEQ ID NO: 2079618 - RNA, 23 nt, Homo sapiens
uaucucauuuuacacaaagggaa

SEQ ID NO: 2079619 - RNA, 22 nt, Homo sapiens
auucuguugaaccaccugugua

SEQ ID NO: 2079620 - RNA, 20 nt, Homo sapiens
acuaggccauuagcccuuca

SEQ ID NO: 2079621 - RNA, 18 nt, Homo sapiens
cuuccuggacagcugugc

SEQ ID NO: 2079622 - RNA, 14 nt, Homo sapiens
ggaagaugugugau

SEQ ID NO: 2079623 - RNA, 16 nt, Homo sapiens
guccgguguucuaaga

SEQ ID NO: 2079624 - RNA, 22 nt, Homo sapiens
acucuguuccuacuggagauac

SEQ ID NO: 2079625 - RNA, 20 nt, Homo sapiens
gaauucaguugcuuugccca

SEQ ID NO: 2079626 - RNA, 17 nt, Homo sapiens
uguuccuuucagaugac

SEQ ID NO: 2079627 - RNA, 13 nt, Homo sapiens
auaaacuacacaa

SEQ ID NO: 2079628 - RNA, 17 nt, Homo sapiens
aaucaagccugauucaa

SEQ ID NO: 2079629 - RNA, 13 nt, Homo sapiens
auguauccaacaa

SEQ ID NO: 2079630 - RNA, 13 nt, Homo sapiens
gagacuccgucuc

SEQ ID NO: 2079631 - RNA, 13 nt, Homo sapiens
aagacuccaucuc

SEQ ID NO: 2079632 - RNA, 15 nt, Homo sapiens
cucaguuucuaggca

SEQ ID NO: 2079633 - RNA, 17 nt, Homo sapiens
auguauauaaagcuuuu

SEQ ID NO: 2079634 - RNA, 17 nt, Homo sapiens
caaugacaucucagggg

SEQ ID NO: 2079635 - RNA, 16 nt, Homo sapiens
ugagugagcuggugac

SEQ ID NO: 2079636 - RNA, 23 nt, Homo sapiens
ggcucaaccacacacaccugucu

SEQ ID NO: 2079637 - RNA, 22 nt, Homo sapiens
acucagugauacucaugaccau

SEQ ID NO: 2079638 - RNA, 17 nt, Homo sapiens
uccauaaugcuacuguc

SEQ ID NO: 2079639 - RNA, 22 nt, Homo sapiens
uuccaaugcuguggguuuccaa

SEQ ID NO: 2079640 - RNA, 16 nt, Homo sapiens
uuuaggagucugagca

SEQ ID NO: 2079641 - RNA, 17 nt, Homo sapiens
uuggcagaagcaguugc

SEQ ID NO: 2079642 - RNA, 12 nt, Homo sapiens
gaaaauaugccu

SEQ ID NO: 2079643 - RNA, 15 nt, Homo sapiens
cacugcaagcucugc

SEQ ID NO: 2079644 - RNA, 13 nt, Homo sapiens
acuaacacuggcu

SEQ ID NO: 2079645 - RNA, 14 nt, Homo sapiens
acaguaacauagcu

SEQ ID NO: 2079646 - RNA, 13 nt, Homo sapiens
aauaaaaccucag

SEQ ID NO: 2079647 - RNA, 15 nt, Homo sapiens
ccaagggcagaucac

SEQ ID NO: 2079648 - RNA, 16 nt, Homo sapiens
gauaguucuauaagaa

SEQ ID NO: 2079649 - RNA, 15 nt, Homo sapiens
cagaguugcaaagau

SEQ ID NO: 2079650 - RNA, 13 nt, Homo sapiens
ccaccaccaaaau

SEQ ID NO: 2079651 - RNA, 16 nt, Homo sapiens
gauuuggccacacugg

SEQ ID NO: 2079652 - RNA, 17 nt, Homo sapiens
ccugcccaagcacuuca

SEQ ID NO: 2079653 - RNA, 16 nt, Homo sapiens
cugagagcaguuacug

SEQ ID NO: 2079654 - RNA, 17 nt, Homo sapiens
cucaugccuguaaucuc

SEQ ID NO: 2079655 - RNA, 13 nt, Homo sapiens
ucucagcacuuug

SEQ ID NO: 2079656 - RNA, 20 nt, Homo sapiens
uguacaacuuuuuaccuagu

SEQ ID NO: 2079657 - RNA, 22 nt, Homo sapiens
auuacagacaugaacugccagg

SEQ ID NO: 2079658 - RNA, 14 nt, Homo sapiens
gugauuuacauuuc

SEQ ID NO: 2079659 - RNA, 15 nt, Homo sapiens
augauuucaguucua

SEQ ID NO: 2079660 - RNA, 14 nt, Homo sapiens
cggaacauguaaaa

SEQ ID NO: 2079661 - RNA, 12 nt, Homo sapiens
cgugagaaggag

SEQ ID NO: 2079662 - RNA, 19 nt, Homo sapiens
ucccagaacacggcagcug

SEQ ID NO: 2079663 - RNA, 19 nt, Homo sapiens
ucuaacuguuguuacugga

SEQ ID NO: 2079664 - RNA, 19 nt, Homo sapiens
caaagaucuuuuccagagu

SEQ ID NO: 2079665 - RNA, 13 nt, Homo sapiens
cuacagacuccaa

SEQ ID NO: 2079666 - RNA, 13 nt, Homo sapiens
gucugaccuggug

SEQ ID NO: 2079667 - RNA, 20 nt, Homo sapiens
aaaggauuuuaccaaagcau

SEQ ID NO: 2079668 - RNA, 12 nt, Homo sapiens
acaguaccugau

SEQ ID NO: 2079669 - RNA, 18 nt, Homo sapiens
cacaucuaaagcuuuauc

SEQ ID NO: 2079670 - RNA, 12 nt, Homo sapiens
ugcucuaucuca

SEQ ID NO: 2079671 - RNA, 20 nt, Homo sapiens
uaaccgcuugguuugcaacc

SEQ ID NO: 2079672 - RNA, 14 nt, Homo sapiens
accauuucagagag

SEQ ID NO: 2079673 - RNA, 15 nt, Homo sapiens
caacugcgacuguga

SEQ ID NO: 2079674 - RNA, 17 nt, Homo sapiens
uguguggggugggcaca

SEQ ID NO: 2079675 - RNA, 17 nt, Homo sapiens
ucuuauauuaaagaagu

SEQ ID NO: 2079676 - RNA, 16 nt, Homo sapiens
guggagguugcaguga

SEQ ID NO: 2079677 - RNA, 20 nt, Homo sapiens
uguggaauugacucaaaaau

SEQ ID NO: 2079678 - RNA, 17 nt, Homo sapiens
agccucgccaacauggu

SEQ ID NO: 2079679 - RNA, 13 nt, Homo sapiens
cacccacucagga

SEQ ID NO: 2079680 - RNA, 17 nt, Homo sapiens
acuuuuuagccagugac

SEQ ID NO: 2079681 - RNA, 16 nt, Homo sapiens
uuguaaugucaccacc

SEQ ID NO: 2079682 - RNA, 16 nt, Homo sapiens
gcaccugccucagcaa

SEQ ID NO: 2079683 - RNA, 17 nt, Homo sapiens
cuuggucuaagugugcu

SEQ ID NO: 2079684 - RNA, 21 nt, Homo sapiens
acucaggucuguaacugccca

SEQ ID NO: 2079685 - RNA, 22 nt, Homo sapiens
auuuaaaaaaacagacucccau

SEQ ID NO: 2079686 - RNA, 21 nt, Homo sapiens
caagaggggguggaggggugu

SEQ ID NO: 2079687 - RNA, 19 nt, Homo sapiens
caucucagggaacugaccc

SEQ ID NO: 2079688 - RNA, 13 nt, Homo sapiens
uacacauacauac

SEQ ID NO: 2079689 - RNA, 15 nt, Homo sapiens
aagaaaagcugccau

SEQ ID NO: 2079690 - RNA, 18 nt, Homo sapiens
ucuguucauucacugcac

SEQ ID NO: 2079691 - RNA, 20 nt, Homo sapiens
gaaacuggaauaaguguuua

SEQ ID NO: 2079692 - RNA, 21 nt, Homo sapiens
auaugauuuauauuacugucu

SEQ ID NO: 2079693 - RNA, 17 nt, Homo sapiens
guggggcucaaaaccuc

SEQ ID NO: 2079694 - RNA, 17 nt, Homo sapiens
gggccagcugggcugcc

SEQ ID NO: 2079695 - RNA, 14 nt, Homo sapiens
aauauucccagccu

SEQ ID NO: 2079696 - RNA, 16 nt, Homo sapiens
aaauggcaaaugcacu

SEQ ID NO: 2079697 - RNA, 20 nt, Homo sapiens
gaaauaaugugaaugcgagg

SEQ ID NO: 2079698 - RNA, 23 nt, Homo sapiens
gccagcccugccuggaggaccug

SEQ ID NO: 2079699 - RNA, 14 nt, Homo sapiens
guguuuagaaauca

SEQ ID NO: 2079700 - RNA, 15 nt, Homo sapiens
cuggcaaucuugccc

SEQ ID NO: 2079701 - RNA, 15 nt, Homo sapiens
auugaucuguguuaa

SEQ ID NO: 2079702 - RNA, 15 nt, Homo sapiens
ucugcaguuuugaca

SEQ ID NO: 2079703 - RNA, 15 nt, Homo sapiens
gaaaagcugcugaca

SEQ ID NO: 2079704 - RNA, 16 nt, Homo sapiens
agcaucuggcucuaau

SEQ ID NO: 2079705 - RNA, 20 nt, Homo sapiens
cagugguauuguuucuguca

SEQ ID NO: 2079706 - RNA, 21 nt, Homo sapiens
caugagagaaggaggggagca

SEQ ID NO: 2079707 - RNA, 20 nt, Homo sapiens
aaauacuuuauagcacaugg

SEQ ID NO: 2079708 - RNA, 13 nt, Homo sapiens
uagcaugaggcca

SEQ ID NO: 2079709 - RNA, 16 nt, Homo sapiens
cccuucuuuucugacu

SEQ ID NO: 2079710 - RNA, 22 nt, Homo sapiens
agcaauuuuuccaaaagccagu

SEQ ID NO: 2079711 - RNA, 19 nt, Homo sapiens
guccauguggacugugcca

SEQ ID NO: 2079712 - RNA, 16 nt, Homo sapiens
cuuaagaaagugucuc

SEQ ID NO: 2079713 - RNA, 18 nt, Homo sapiens
agaaugcauuccagaaca

SEQ ID NO: 2079714 - RNA, 17 nt, Homo sapiens
ccugugacauuuugcca

SEQ ID NO: 2079715 - RNA, 19 nt, Homo sapiens
auugauagaacuacuuuga

SEQ ID NO: 2079716 - RNA, 14 nt, Homo sapiens
ugaggaggagacag

SEQ ID NO: 2079717 - RNA, 21 nt, Homo sapiens
auuuuaggcagggauuugagg

SEQ ID NO: 2079718 - RNA, 15 nt, Homo sapiens
gacaucaaguguaau

SEQ ID NO: 2079719 - RNA, 16 nt, Homo sapiens
gucgacuucaugacaa

SEQ ID NO: 2079720 - RNA, 22 nt, Homo sapiens
accuagaagggcaggaguuccu

SEQ ID NO: 2079721 - RNA, 18 nt, Homo sapiens
gaagaaaagcaugcauau

SEQ ID NO: 2079722 - RNA, 13 nt, Homo sapiens
auaaaauuucccc

SEQ ID NO: 2079723 - RNA, 23 nt, Homo sapiens
uaagacuguuuuuaaguaacuua

SEQ ID NO: 2079724 - RNA, 19 nt, Homo sapiens
cuggcagccgugccuucag

SEQ ID NO: 2079725 - RNA, 16 nt, Homo sapiens
cagguuaccucacuuu

SEQ ID NO: 2079726 - RNA, 20 nt, Homo sapiens
caucccgcgcgcccuuccuu

SEQ ID NO: 2079727 - RNA, 15 nt, Homo sapiens
ggauauuuaguucaa

SEQ ID NO: 2079728 - RNA, 14 nt, Homo sapiens
uugcuucucuagcu

SEQ ID NO: 2079729 - RNA, 15 nt, Homo sapiens
ugaagaaaguuugcu

SEQ ID NO: 2079730 - RNA, 16 nt, Homo sapiens
uccuggaguacaccaa

SEQ ID NO: 2079731 - RNA, 21 nt, Homo sapiens
acccugacacggacugugcau

SEQ ID NO: 2079732 - RNA, 15 nt, Homo sapiens
gcauucauccaacag

SEQ ID NO: 2079733 - RNA, 16 nt, Homo sapiens
auguccaccaugaacu

SEQ ID NO: 2079734 - RNA, 19 nt, Homo sapiens
aguuugagaccacccuggg

SEQ ID NO: 2079735 - RNA, 17 nt, Homo sapiens
cccauugcaaacauuau

SEQ ID NO: 2079736 - RNA, 21 nt, Homo sapiens
ucuaauccaugugcugcugug

SEQ ID NO: 2079737 - RNA, 23 nt, Homo sapiens
cauaaacaaauguaaugggcaua

SEQ ID NO: 2079738 - RNA, 17 nt, Homo sapiens
agcaggacuaggcaugu

SEQ ID NO: 2079739 - RNA, 14 nt, Homo sapiens
aucagugcagugau

SEQ ID NO: 2079740 - RNA, 14 nt, Homo sapiens
cagccccuguagaa

SEQ ID NO: 2079741 - RNA, 20 nt, Homo sapiens
aaguugcugcugugaaucug

SEQ ID NO: 2079742 - RNA, 14 nt, Homo sapiens
cagaaggaaccagc

SEQ ID NO: 2079743 - RNA, 17 nt, Homo sapiens
ccauugggcuacuguag

SEQ ID NO: 2079744 - RNA, 23 nt, Homo sapiens
ccagcagaaaucaucaucaugau

SEQ ID NO: 2079745 - RNA, 14 nt, Homo sapiens
ggagcagcugagau

SEQ ID NO: 2079746 - RNA, 17 nt, Homo sapiens
aaccucuagagucacug

SEQ ID NO: 2079747 - RNA, 18 nt, Homo sapiens
gccuccccccucacuugu

SEQ ID NO: 2079748 - RNA, 14 nt, Homo sapiens
ucuuguucauccaa

SEQ ID NO: 2079749 - RNA, 16 nt, Homo sapiens
aaacacuagacuguau

SEQ ID NO: 2079750 - RNA, 20 nt, Homo sapiens
ggagaaggcaggaacacugg

SEQ ID NO: 2079751 - RNA, 20 nt, Homo sapiens
ugcagauugaagcauuucag

SEQ ID NO: 2079752 - RNA, 14 nt, Homo sapiens
cacugcucaagaag

SEQ ID NO: 2079753 - RNA, 14 nt, Homo sapiens
aaaguuuguugaaa

SEQ ID NO: 2079754 - RNA, 23 nt, Homo sapiens
cugaggacgagacccccauccag

SEQ ID NO: 2079755 - RNA, 22 nt, Homo sapiens
uaaauguuauuuaagaaugaca

SEQ ID NO: 2079756 - RNA, 17 nt, Homo sapiens
cuggacaaccagaggag

SEQ ID NO: 2079757 - RNA, 16 nt, Homo sapiens
gccugugcccuugcug

SEQ ID NO: 2079758 - RNA, 11 nt, Homo sapiens
aacucagggag

SEQ ID NO: 2079759 - RNA, 16 nt, Homo sapiens
augaagaaucugcucu

SEQ ID NO: 2079760 - RNA, 17 nt, Homo sapiens
aguacaccccaacagca

SEQ ID NO: 2079761 - RNA, 21 nt, Homo sapiens
ccuaauauuuuguucugcaaa

SEQ ID NO: 2079762 - RNA, 14 nt, Homo sapiens
uggagcaaaccauu

SEQ ID NO: 2079763 - RNA, 20 nt, Homo sapiens
uaacagggagaaguagcuag

SEQ ID NO: 2079764 - RNA, 18 nt, Homo sapiens
caggccuuuuugagccaa

SEQ ID NO: 2079765 - RNA, 23 nt, Homo sapiens
agggugggguaaccaaauguugg

SEQ ID NO: 2079766 - RNA, 16 nt, Homo sapiens
uauaaagucaggaccu

SEQ ID NO: 2079767 - RNA, 15 nt, Homo sapiens
agacccgcucuccau

SEQ ID NO: 2079768 - RNA, 11 nt, Homo sapiens
ggaaugcuacu

SEQ ID NO: 2079769 - RNA, 19 nt, Homo sapiens
aucuuugucuguucacuuu

SEQ ID NO: 2079770 - RNA, 23 nt, Homo sapiens
auuguaaagauccuauagcucuu

SEQ ID NO: 2079771 - RNA, 18 nt, Homo sapiens
ugccuccacucaccacaa

SEQ ID NO: 2079772 - RNA, 18 nt, Homo sapiens
aggggagggcaggcuugg

SEQ ID NO: 2079773 - RNA, 22 nt, Homo sapiens
uucauaauaaacuagauacugu

SEQ ID NO: 2079774 - RNA, 13 nt, Homo sapiens
cucgcuggaccaa

SEQ ID NO: 2079775 - RNA, 16 nt, Homo sapiens
gacauucaaggcauuu

SEQ ID NO: 2079776 - RNA, 16 nt, Homo sapiens
ucgcaaggccugugcu

SEQ ID NO: 2079777 - RNA, 17 nt, Homo sapiens
ucugcccuccugccaaa

SEQ ID NO: 2079778 - RNA, 23 nt, Homo sapiens
agguuccaacuggaaacccuuag

SEQ ID NO: 2079779 - RNA, 16 nt, Homo sapiens
ugcauuuccauuucuc

SEQ ID NO: 2079780 - RNA, 14 nt, Homo sapiens
auaacuaccuucca

SEQ ID NO: 2079781 - RNA, 19 nt, Homo sapiens
cucuuuuugggugauuaaa

SEQ ID NO: 2079782 - RNA, 19 nt, Homo sapiens
cucaaucucaggucuucac

SEQ ID NO: 2079783 - RNA, 22 nt, Homo sapiens
acuuucuucuagcugagcuuua

SEQ ID NO: 2079784 - RNA, 19 nt, Homo sapiens
ucagaaccucuuccccaga

SEQ ID NO: 2079785 - RNA, 13 nt, Homo sapiens
acaacccucugga

SEQ ID NO: 2079786 - RNA, 20 nt, Homo sapiens
caagugcuucuccagccuca

SEQ ID NO: 2079787 - RNA, 18 nt, Homo sapiens
cccaaauucuccuccuga

SEQ ID NO: 2079788 - RNA, 19 nt, Homo sapiens
gucagcaucugaccaucug

SEQ ID NO: 2079789 - RNA, 15 nt, Homo sapiens
ucaccucagcugaua

SEQ ID NO: 2079790 - RNA, 14 nt, Homo sapiens
cuuccuccauugca

SEQ ID NO: 2079791 - RNA, 14 nt, Homo sapiens
aaacaucccaagaa

SEQ ID NO: 2079792 - RNA, 20 nt, Homo sapiens
acucaucugaaauguuacaa

SEQ ID NO: 2079793 - RNA, 21 nt, Homo sapiens
cauacagacagcacaaggugg

SEQ ID NO: 2079794 - RNA, 14 nt, Homo sapiens
cuuuggguacuuau

SEQ ID NO: 2079795 - RNA, 14 nt, Homo sapiens
ugcaugcagaaagg

SEQ ID NO: 2079796 - RNA, 22 nt, Homo sapiens
aagcauguggaaaugacccaaa

SEQ ID NO: 2079797 - RNA, 18 nt, Homo sapiens
gcugcugaggacaauguc

SEQ ID NO: 2079798 - RNA, 21 nt, Homo sapiens
cuaaaaaaaaugcauauuaau

SEQ ID NO: 2079799 - RNA, 16 nt, Homo sapiens
uugaggauuguggaaa

SEQ ID NO: 2079800 - RNA, 21 nt, Homo sapiens
uuccuuccaaugucuggagac

SEQ ID NO: 2079801 - RNA, 18 nt, Homo sapiens
uuggucuuagcuuuacau

SEQ ID NO: 2079802 - RNA, 13 nt, Homo sapiens
auagugugagaac

SEQ ID NO: 2079803 - RNA, 18 nt, Homo sapiens
cuaaagcuauguuacaug

SEQ ID NO: 2079804 - RNA, 15 nt, Homo sapiens
ccuuaggaaaaacau

SEQ ID NO: 2079805 - RNA, 21 nt, Homo sapiens
cuuacauuauuaaucauucca

SEQ ID NO: 2079806 - RNA, 17 nt, Homo sapiens
agcucacugcaaccucc

SEQ ID NO: 2079807 - RNA, 23 nt, Homo sapiens
aagcuggaggacuagaaccugga

SEQ ID NO: 2079808 - RNA, 13 nt, Homo sapiens
gugauuucagaga

SEQ ID NO: 2079809 - RNA, 12 nt, Homo sapiens
acacuccaugag

SEQ ID NO: 2079810 - RNA, 22 nt, Homo sapiens
uuaacgacagaagguugccagg

SEQ ID NO: 2079811 - RNA, 19 nt, Homo sapiens
uauucugugaaacuaauca

SEQ ID NO: 2079812 - RNA, 21 nt, Homo sapiens
agacaguacucuuaacuccua

SEQ ID NO: 2079813 - RNA, 18 nt, Homo sapiens
uaacagcuguggcucacg

SEQ ID NO: 2079814 - RNA, 23 nt, Homo sapiens
accccugcccccagccccggggu

SEQ ID NO: 2079815 - RNA, 23 nt, Homo sapiens
aguguauuuuauguguggcccaa

SEQ ID NO: 2079816 - RNA, 19 nt, Homo sapiens
uuagacaaaggcucuacac

SEQ ID NO: 2079817 - RNA, 16 nt, Homo sapiens
gacucuguaaccaccu

SEQ ID NO: 2079818 - RNA, 20 nt, Homo sapiens
aauuccuacacucuugacua

SEQ ID NO: 2079819 - RNA, 19 nt, Homo sapiens
uccugaccucgugauccac

SEQ ID NO: 2079820 - RNA, 15 nt, Homo sapiens
agucaaacagugugg

SEQ ID NO: 2079821 - RNA, 17 nt, Homo sapiens
uuucagccgagguccaa

SEQ ID NO: 2079822 - RNA, 13 nt, Homo sapiens
cauuguagacaug

SEQ ID NO: 2079823 - RNA, 15 nt, Homo sapiens
agcugccuguuuccu

SEQ ID NO: 2079824 - RNA, 17 nt, Homo sapiens
aagcuaauugugcacau

SEQ ID NO: 2079825 - RNA, 15 nt, Homo sapiens
ugcuaaauacuguac

SEQ ID NO: 2079826 - RNA, 19 nt, Homo sapiens
gagaauaauucuugcaaua

SEQ ID NO: 2079827 - RNA, 13 nt, Homo sapiens
gaaaccaacuguu

SEQ ID NO: 2079828 - RNA, 15 nt, Homo sapiens
aaauguuaugugcuc

SEQ ID NO: 2079829 - RNA, 13 nt, Homo sapiens
ccaucuauucucu

SEQ ID NO: 2079830 - RNA, 13 nt, Homo sapiens
gacaggggagaaa

SEQ ID NO: 2079831 - RNA, 16 nt, Homo sapiens
ccugcugggggcagca

SEQ ID NO: 2079832 - RNA, 20 nt, Homo sapiens
aaaugacuaaaagucuucgg

SEQ ID NO: 2079833 - RNA, 20 nt, Homo sapiens
ugguuguccccguaccacca

SEQ ID NO: 2079834 - RNA, 19 nt, Homo sapiens
uugcuugcacaaaccaauu

SEQ ID NO: 2079835 - RNA, 14 nt, Homo sapiens
gaaaggcaucaguc

SEQ ID NO: 2079836 - RNA, 18 nt, Homo sapiens
aaagguucuucaucccuu

SEQ ID NO: 2079837 - RNA, 22 nt, Homo sapiens
acuauucuaaugaaaacauuaa

SEQ ID NO: 2079838 - RNA, 21 nt, Homo sapiens
ccauguaccaguguacugcuu

SEQ ID NO: 2079839 - RNA, 20 nt, Homo sapiens
gaggcaucaguugcuauaua

SEQ ID NO: 2079840 - RNA, 15 nt, Homo sapiens
ugcagauaacaaaca

SEQ ID NO: 2079841 - RNA, 13 nt, Homo sapiens
cuauauauucaaa

SEQ ID NO: 2079842 - RNA, 15 nt, Homo sapiens
agccagccaggacuc

SEQ ID NO: 2079843 - RNA, 18 nt, Homo sapiens
ggcaaauggcugagaugg

SEQ ID NO: 2079844 - RNA, 13 nt, Homo sapiens
acaguugugaugu

SEQ ID NO: 2079845 - RNA, 14 nt, Homo sapiens
ggaggcugcaguga

SEQ ID NO: 2079846 - RNA, 15 nt, Homo sapiens
auaauuaaucagcuc

SEQ ID NO: 2079847 - RNA, 23 nt, Homo sapiens
ggaggucgggauggggcuuguag

SEQ ID NO: 2079848 - RNA, 12 nt, Homo sapiens
gacgcacuguau

SEQ ID NO: 2079849 - RNA, 16 nt, Homo sapiens
aaugccugguaccaga

SEQ ID NO: 2079850 - RNA, 16 nt, Homo sapiens
guccagagcuucaggg

SEQ ID NO: 2079851 - RNA, 12 nt, Homo sapiens
uagaaacaaagg

SEQ ID NO: 2079852 - RNA, 22 nt, Homo sapiens
auacuaauuuauaauccacagu

SEQ ID NO: 2079853 - RNA, 22 nt, Homo sapiens
uuggacaaaccgagugcaauga

SEQ ID NO: 2079854 - RNA, 22 nt, Homo sapiens
accuggccccgccccuccuaca

SEQ ID NO: 2079855 - RNA, 14 nt, Homo sapiens
guccuuccuugaac

SEQ ID NO: 2079856 - RNA, 22 nt, Homo sapiens
aggcugggcacagaggucagga

SEQ ID NO: 2079857 - RNA, 14 nt, Homo sapiens
cauacaucaagcca

SEQ ID NO: 2079858 - RNA, 20 nt, Homo sapiens
uaggcaccuaccaccacgcc

SEQ ID NO: 2079859 - RNA, 21 nt, Homo sapiens
gcuugggaacuguaagcucaa

SEQ ID NO: 2079860 - RNA, 21 nt, Homo sapiens
gucaggcagguuugccaguga

SEQ ID NO: 2079861 - RNA, 18 nt, Homo sapiens
gaaaaauaaagaugugcu

SEQ ID NO: 2079862 - RNA, 18 nt, Homo sapiens
cucacaaaugcugugguu

SEQ ID NO: 2079863 - RNA, 18 nt, Homo sapiens
augcaguauugagcacug

SEQ ID NO: 2079864 - RNA, 20 nt, Homo sapiens
auauuauguuuccuaauuaa

SEQ ID NO: 2079865 - RNA, 18 nt, Homo sapiens
ugcuacgaagaaagacuc

SEQ ID NO: 2079866 - RNA, 20 nt, Homo sapiens
guccaaucacauucaggcau

SEQ ID NO: 2079867 - RNA, 21 nt, Homo sapiens
ucuuugagcgcccacuagacc

SEQ ID NO: 2079868 - RNA, 20 nt, Homo sapiens
ucuucuacuuuuaacuaaua

SEQ ID NO: 2079869 - RNA, 12 nt, Homo sapiens
cacaugcugucu

SEQ ID NO: 2079870 - RNA, 14 nt, Homo sapiens
cggaagaacaugaa

SEQ ID NO: 2079871 - RNA, 17 nt, Homo sapiens
aaaauauguaauuucaa

SEQ ID NO: 2079872 - RNA, 14 nt, Homo sapiens
ugacaagcaaagaa

SEQ ID NO: 2079873 - RNA, 18 nt, Homo sapiens
uuuuguauuccacauucu

SEQ ID NO: 2079874 - RNA, 17 nt, Homo sapiens
uugggaguaggugcuaa

SEQ ID NO: 2079875 - RNA, 19 nt, Homo sapiens
ugauaaccuaacacuauca

SEQ ID NO: 2079876 - RNA, 10 nt, Homo sapiens
guagauuccc

SEQ ID NO: 2079877 - RNA, 19 nt, Homo sapiens
cuggcagagauucugguac

SEQ ID NO: 2079878 - RNA, 14 nt, Homo sapiens
acaaaaauguacaa

SEQ ID NO: 2079879 - RNA, 20 nt, Homo sapiens
ugcugcacaaacaugaaaau

SEQ ID NO: 2079880 - RNA, 16 nt, Homo sapiens
aagaacgcgacuucca

SEQ ID NO: 2079881 - RNA, 14 nt, Homo sapiens
gagagcccaugaga

SEQ ID NO: 2079882 - RNA, 20 nt, Homo sapiens
ggauggagugcaguggcuca

SEQ ID NO: 2079883 - RNA, 14 nt, Homo sapiens
gagccaccaugccc

SEQ ID NO: 2079884 - RNA, 17 nt, Homo sapiens
aaaccauguauucccuu

SEQ ID NO: 2079885 - RNA, 15 nt, Homo sapiens
aaagucuacacugcc

SEQ ID NO: 2079886 - RNA, 23 nt, Homo sapiens
aagucauagguuacagaccucag

SEQ ID NO: 2079887 - RNA, 17 nt, Homo sapiens
cugcccacaacucccuu

SEQ ID NO: 2079888 - RNA, 18 nt, Homo sapiens
uaaggcaaugguuucaca

SEQ ID NO: 2079889 - RNA, 15 nt, Homo sapiens
ucacuggagcacaau

SEQ ID NO: 2079890 - RNA, 15 nt, Homo sapiens
uccaaagagccaugu

SEQ ID NO: 2079891 - RNA, 20 nt, Homo sapiens
acucaucguucuaaaaucaa

SEQ ID NO: 2079892 - RNA, 19 nt, Homo sapiens
uccguauugaacauguaca

SEQ ID NO: 2079893 - RNA, 23 nt, Homo sapiens
uggggggggguccuaaauguaau

SEQ ID NO: 2079894 - RNA, 19 nt, Homo sapiens
auauuuuaaagcacuuuaa

SEQ ID NO: 2079895 - RNA, 21 nt, Homo sapiens
cugaaagugaaaguccagaaa

SEQ ID NO: 2079896 - RNA, 14 nt, Homo sapiens
auauuuacaaugua

SEQ ID NO: 2079897 - RNA, 16 nt, Homo sapiens
gccaagggggugacug

SEQ ID NO: 2079898 - RNA, 22 nt, Homo sapiens
aacuucaggaaagcagcaguuu

SEQ ID NO: 2079899 - RNA, 12 nt, Homo sapiens
ccuauaccauau

SEQ ID NO: 2079900 - RNA, 15 nt, Homo sapiens
gcccccgggccugca

SEQ ID NO: 2079901 - RNA, 18 nt, Homo sapiens
gucagaacagccagguag

SEQ ID NO: 2079902 - RNA, 17 nt, Homo sapiens
cuuaucaggauaccaga

SEQ ID NO: 2079903 - RNA, 13 nt, Homo sapiens
ugccauuguccag

SEQ ID NO: 2079904 - RNA, 14 nt, Homo sapiens
ucuucucccugugu

SEQ ID NO: 2079905 - RNA, 17 nt, Homo sapiens
cagaucauugugaaauu

SEQ ID NO: 2079906 - RNA, 21 nt, Homo sapiens
auuuauauagcaagugcuauu

SEQ ID NO: 2079907 - RNA, 22 nt, Homo sapiens
ggcagccuugggggggcugccu

SEQ ID NO: 2079908 - RNA, 19 nt, Homo sapiens
cugagcugaaagaggccaa

SEQ ID NO: 2079909 - RNA, 18 nt, Homo sapiens
ccaaacagcaaaccaaga

SEQ ID NO: 2079910 - RNA, 16 nt, Homo sapiens
aucagaaaugucauca

SEQ ID NO: 2079911 - RNA, 23 nt, Homo sapiens
gguaaaucuaguaccaugucgua

SEQ ID NO: 2079912 - RNA, 20 nt, Homo sapiens
agggcauucuuucccaguga

SEQ ID NO: 2079913 - RNA, 18 nt, Homo sapiens
gugcucuggggcacuguu

SEQ ID NO: 2079914 - RNA, 23 nt, Homo sapiens
ccagcugcugugccccaccacgu

SEQ ID NO: 2079915 - RNA, 23 nt, Homo sapiens
uagcuuauaagagggcauauaca

SEQ ID NO: 2079916 - RNA, 15 nt, Homo sapiens
caggauugacaggcc

SEQ ID NO: 2079917 - RNA, 17 nt, Homo sapiens
uggugucuccuuuacua

SEQ ID NO: 2079918 - RNA, 21 nt, Homo sapiens
acaucauucugugucucugca

SEQ ID NO: 2079919 - RNA, 12 nt, Homo sapiens
caagacaggcag

SEQ ID NO: 2079920 - RNA, 17 nt, Homo sapiens
cuuuuccaacccaugag

SEQ ID NO: 2079921 - RNA, 18 nt, Homo sapiens
gauguuuuacgugcaaac

SEQ ID NO: 2079922 - RNA, 14 nt, Homo sapiens
gucuucaagcagau

SEQ ID NO: 2079923 - RNA, 23 nt, Homo sapiens
gaagggcugauugggauuuccau

SEQ ID NO: 2079924 - RNA, 17 nt, Homo sapiens
uucagacuugauuuaca

SEQ ID NO: 2079925 - RNA, 15 nt, Homo sapiens
augccacccugcaau

SEQ ID NO: 2079926 - RNA, 18 nt, Homo sapiens
acaaaccugcuugucaau

SEQ ID NO: 2079927 - RNA, 13 nt, Homo sapiens
ucuccuuacaguc

SEQ ID NO: 2079928 - RNA, 13 nt, Homo sapiens
cugaacacacauu

SEQ ID NO: 2079929 - RNA, 18 nt, Homo sapiens
gaucaaagaaauucagaa

SEQ ID NO: 2079930 - RNA, 15 nt, Homo sapiens
auucugucacccaga

SEQ ID NO: 2079931 - RNA, 19 nt, Homo sapiens
uaaaccaaggacugagcac

SEQ ID NO: 2079932 - RNA, 20 nt, Homo sapiens
cugcccucugggucccuccu

SEQ ID NO: 2079933 - RNA, 15 nt, Homo sapiens
accucguauuucacc

SEQ ID NO: 2079934 - RNA, 21 nt, Homo sapiens
ggcacuaagucaugguccugg

SEQ ID NO: 2079935 - RNA, 19 nt, Homo sapiens
auauaggcauuucacaaaa

SEQ ID NO: 2079936 - RNA, 14 nt, Homo sapiens
gggccauguccaaa

SEQ ID NO: 2079937 - RNA, 19 nt, Homo sapiens
cagacauccuagcauuugu

SEQ ID NO: 2079938 - RNA, 23 nt, Homo sapiens
augugcuuguuagcuguuucuca

SEQ ID NO: 2079939 - RNA, 12 nt, Homo sapiens
uuugacacugaa

SEQ ID NO: 2079940 - RNA, 13 nt, Homo sapiens
acuaaacauacau

SEQ ID NO: 2079941 - RNA, 13 nt, Homo sapiens
uccugucauugcg

SEQ ID NO: 2079942 - RNA, 16 nt, Homo sapiens
uacaauuuucauccca

SEQ ID NO: 2079943 - RNA, 21 nt, Homo sapiens
cccugaguucccaaagggagg

SEQ ID NO: 2079944 - RNA, 15 nt, Homo sapiens
aauuaaccauugcua

SEQ ID NO: 2079945 - RNA, 12 nt, Homo sapiens
aacuccuuccau

SEQ ID NO: 2079946 - RNA, 20 nt, Homo sapiens
uguaaggugcuugcucccca

SEQ ID NO: 2079947 - RNA, 16 nt, Homo sapiens
agcaaaaggcugagaa

SEQ ID NO: 2079948 - RNA, 21 nt, Homo sapiens
ccaaguguacauuugauuuga

SEQ ID NO: 2079949 - RNA, 24 nt, Homo sapiens
gguucuguagagccaauuagacuu

SEQ ID NO: 2079950 - RNA, 19 nt, Homo sapiens
agauucuuuggcuguguuu

SEQ ID NO: 2079951 - RNA, 16 nt, Homo sapiens
aaagggaccaucugcu

SEQ ID NO: 2079952 - RNA, 14 nt, Homo sapiens
aaauauuuacagua

SEQ ID NO: 2079953 - RNA, 14 nt, Homo sapiens
gaauaaagugcaaa

SEQ ID NO: 2079954 - RNA, 19 nt, Homo sapiens
ucccccuuugugcacauuu

SEQ ID NO: 2079955 - RNA, 15 nt, Homo sapiens
ucauauuuacugguc

SEQ ID NO: 2079956 - RNA, 14 nt, Homo sapiens
ccuacaaaauuuca

SEQ ID NO: 2079957 - RNA, 16 nt, Homo sapiens
uaacuuaaaauuacaa

SEQ ID NO: 2079958 - RNA, 17 nt, Homo sapiens
ggaagcucccucccuca

SEQ ID NO: 2079959 - RNA, 18 nt, Homo sapiens
ucagugacuuugagcuga

SEQ ID NO: 2079960 - RNA, 18 nt, Homo sapiens
auuuauaugaauuuccac

SEQ ID NO: 2079961 - RNA, 15 nt, Homo sapiens
ugacuuugacuuccc

SEQ ID NO: 2079962 - RNA, 20 nt, Homo sapiens
agcaaagcaugccaauuucu

SEQ ID NO: 2079963 - RNA, 19 nt, Homo sapiens
auguaugugcacauguguc

SEQ ID NO: 2079964 - RNA, 17 nt, Homo sapiens
aacaccaaaaagggauc

SEQ ID NO: 2079965 - RNA, 19 nt, Homo sapiens
gauagccgggcuccaggga

SEQ ID NO: 2079966 - RNA, 20 nt, Homo sapiens
ucccaagcacccagagcuuu

SEQ ID NO: 2079967 - RNA, 19 nt, Homo sapiens
acgcuuguaauuggaauac

SEQ ID NO: 2079968 - RNA, 21 nt, Homo sapiens
caaaccuaaaaucuguuuuuc

SEQ ID NO: 2079969 - RNA, 13 nt, Homo sapiens
gggaggcagggga

SEQ ID NO: 2079970 - RNA, 14 nt, Homo sapiens
auugaccccuuccu

SEQ ID NO: 2079971 - RNA, 19 nt, Homo sapiens
cuuuuuguccuguacccag

SEQ ID NO: 2079972 - RNA, 15 nt, Homo sapiens
ggcccacccccagga

SEQ ID NO: 2079973 - RNA, 16 nt, Homo sapiens
guaccugguugguccu

SEQ ID NO: 2079974 - RNA, 21 nt, Homo sapiens
uccccaagcuggcagcuguca

SEQ ID NO: 2079975 - RNA, 12 nt, Homo sapiens
ccuccuucccaa

SEQ ID NO: 2079976 - RNA, 17 nt, Homo sapiens
uggacaucuacccagau

SEQ ID NO: 2079977 - RNA, 19 nt, Homo sapiens
uggccugcugugauuccac

SEQ ID NO: 2079978 - RNA, 23 nt, Homo sapiens
agauagcccaggagcaacagccu

SEQ ID NO: 2079979 - RNA, 19 nt, Homo sapiens
ugggcuaaugaagaucaua

SEQ ID NO: 2079980 - RNA, 23 nt, Homo sapiens
acagguuacuacccucacccuuu

SEQ ID NO: 2079981 - RNA, 20 nt, Homo sapiens
gaccauaaaggcauggcauu

SEQ ID NO: 2079982 - RNA, 17 nt, Homo sapiens
ccaaaggaagcacaugc

SEQ ID NO: 2079983 - RNA, 18 nt, Homo sapiens
auucaaaguguuguguuc

SEQ ID NO: 2079984 - RNA, 15 nt, Homo sapiens
uggaggccucugcaa

SEQ ID NO: 2079985 - RNA, 21 nt, Homo sapiens
uuaauauuauuacuguugaua

SEQ ID NO: 2079986 - RNA, 17 nt, Homo sapiens
auugccaaccaguuuga

SEQ ID NO: 2079987 - RNA, 15 nt, Homo sapiens
aagcaucucugacca

SEQ ID NO: 2079988 - RNA, 12 nt, Homo sapiens
cugugugcuacu

SEQ ID NO: 2079989 - RNA, 16 nt, Homo sapiens
ggagugggcaccucag

SEQ ID NO: 2079990 - RNA, 19 nt, Homo sapiens
caccaacugaaguggcuaa

SEQ ID NO: 2079991 - RNA, 15 nt, Homo sapiens
aauuaaagucuucca

SEQ ID NO: 2079992 - RNA, 19 nt, Homo sapiens
ccagccacauugagacuuu

SEQ ID NO: 2079993 - RNA, 14 nt, Homo sapiens
aaggugacagagca

SEQ ID NO: 2079994 - RNA, 13 nt, Homo sapiens
ggacuuccuugcu

SEQ ID NO: 2079995 - RNA, 12 nt, Homo sapiens
cucucaagucaa

SEQ ID NO: 2079996 - RNA, 20 nt, Homo sapiens
uggcagcauucccaccaaca

SEQ ID NO: 2079997 - RNA, 13 nt, Homo sapiens
agagagauggaau

SEQ ID NO: 2079998 - RNA, 18 nt, Homo sapiens
gaaaacuacugauacuuu

SEQ ID NO: 2079999 - RNA, 23 nt, Homo sapiens
ccugaccuccuuuaugguuaaua

SEQ ID NO: 2080000 - RNA, 12 nt, Homo sapiens
ggcaaacaggca

SEQ ID NO: 2080001 - RNA, 12 nt, Homo sapiens
caaaaacacaaa

SEQ ID NO: 2080002 - RNA, 19 nt, Homo sapiens
ccaggccucgccugcccuc

SEQ ID NO: 2080003 - RNA, 22 nt, Homo sapiens
acaaauuuuucaaaucauuccu

SEQ ID NO: 2080004 - RNA, 16 nt, Homo sapiens
cauuaugccacuuccu

SEQ ID NO: 2080005 - RNA, 19 nt, Homo sapiens
gucagaagaagacagcaaa

SEQ ID NO: 2080006 - RNA, 21 nt, Homo sapiens
ugucuugccuuuuucauuauu

SEQ ID NO: 2080007 - RNA, 16 nt, Homo sapiens
aauauacuucugcugu

SEQ ID NO: 2080008 - RNA, 19 nt, Homo sapiens
uuugacccgaaguaguuga

SEQ ID NO: 2080009 - RNA, 22 nt, Homo sapiens
ugaagaacacagcaugugccaa

SEQ ID NO: 2080010 - RNA, 12 nt, Homo sapiens
auaaaaccugcc

SEQ ID NO: 2080011 - RNA, 14 nt, Homo sapiens
cauagcacuugccg

SEQ ID NO: 2080012 - RNA, 13 nt, Homo sapiens
ccuggcugaugau

SEQ ID NO: 2080013 - RNA, 16 nt, Homo sapiens
aaugaaaccuuccucu

SEQ ID NO: 2080014 - RNA, 22 nt, Homo sapiens
ccagaauucugggcaagucacc

SEQ ID NO: 2080015 - RNA, 13 nt, Homo sapiens
caugcuacugcca

SEQ ID NO: 2080016 - RNA, 13 nt, Homo sapiens
uuucaacuccaga

SEQ ID NO: 2080017 - RNA, 17 nt, Homo sapiens
ucuuauauaguauucau

SEQ ID NO: 2080018 - RNA, 20 nt, Homo sapiens
gacaugccuugaaaccagaa

SEQ ID NO: 2080019 - RNA, 17 nt, Homo sapiens
ucucugccacuccugac

SEQ ID NO: 2080020 - RNA, 22 nt, Homo sapiens
ccugguccucacacucacccaa

SEQ ID NO: 2080021 - RNA, 19 nt, Homo sapiens
ucggaaacuauaaguaauu

SEQ ID NO: 2080022 - RNA, 22 nt, Homo sapiens
guuuaaagucucaguuucuugc

SEQ ID NO: 2080023 - RNA, 15 nt, Homo sapiens
agcacaccucugggg

SEQ ID NO: 2080024 - RNA, 15 nt, Homo sapiens
auagcagaggggcca

SEQ ID NO: 2080025 - RNA, 23 nt, Homo sapiens
ccugacuggggucauuguguaag

SEQ ID NO: 2080026 - RNA, 21 nt, Homo sapiens
ggugcugcuuucuuguugcug

SEQ ID NO: 2080027 - RNA, 17 nt, Homo sapiens
ccucuagaacagccaga

SEQ ID NO: 2080028 - RNA, 21 nt, Homo sapiens
uaaugguaaaauaaaaugccu

SEQ ID NO: 2080029 - RNA, 19 nt, Homo sapiens
aaauaucucaauuaccaau

SEQ ID NO: 2080030 - RNA, 12 nt, Homo sapiens
ccugguguuucu

SEQ ID NO: 2080031 - RNA, 13 nt, Homo sapiens
uccaucuguugac

SEQ ID NO: 2080032 - RNA, 17 nt, Homo sapiens
aguugucaucaaacaua

SEQ ID NO: 2080033 - RNA, 18 nt, Homo sapiens
uaacuuggccauguucuc

SEQ ID NO: 2080034 - RNA, 17 nt, Homo sapiens
uucucauccuuugccag

SEQ ID NO: 2080035 - RNA, 15 nt, Homo sapiens
ccucucccugccaag

SEQ ID NO: 2080036 - RNA, 17 nt, Homo sapiens
cagauuuguucuagaua

SEQ ID NO: 2080037 - RNA, 14 nt, Homo sapiens
uaggaggaugcugu

SEQ ID NO: 2080038 - RNA, 20 nt, Homo sapiens
ccauauuuucaccauuugau

SEQ ID NO: 2080039 - RNA, 23 nt, Homo sapiens
auuccagguagcucggcaccaac

SEQ ID NO: 2080040 - RNA, 18 nt, Homo sapiens
uauuuauaagagugccgu

SEQ ID NO: 2080041 - RNA, 22 nt, Homo sapiens
auacuggcuaacagauguugaa

SEQ ID NO: 2080042 - RNA, 19 nt, Homo sapiens
guccccagacuccaccaag

SEQ ID NO: 2080043 - RNA, 12 nt, Homo sapiens
uauuaaguaaaa

SEQ ID NO: 2080044 - RNA, 21 nt, Homo sapiens
auccuaggcuuaaaugcaaua

SEQ ID NO: 2080045 - RNA, 16 nt, Homo sapiens
aggcacgucugcagaa

SEQ ID NO: 2080046 - RNA, 18 nt, Homo sapiens
acugugccugagcucuga

SEQ ID NO: 2080047 - RNA, 19 nt, Homo sapiens
agaggucuugaucuuugga

SEQ ID NO: 2080048 - RNA, 20 nt, Homo sapiens
ggagagaggcucagccacac

SEQ ID NO: 2080049 - RNA, 14 nt, Homo sapiens
agccaaucugcaau

SEQ ID NO: 2080050 - RNA, 14 nt, Homo sapiens
uugacuucaugcca

SEQ ID NO: 2080051 - RNA, 13 nt, Homo sapiens
uuaaguccaccuc

SEQ ID NO: 2080052 - RNA, 13 nt, Homo sapiens
gucaaacaguaau

SEQ ID NO: 2080053 - RNA, 23 nt, Homo sapiens
ugagaaaaguuuaaagacacuua

SEQ ID NO: 2080054 - RNA, 13 nt, Homo sapiens
cccccuucaggag

SEQ ID NO: 2080055 - RNA, 21 nt, Homo sapiens
uguuaguaaaggaaccauucc

SEQ ID NO: 2080056 - RNA, 18 nt, Homo sapiens
uuguguuacugcagugac

SEQ ID NO: 2080057 - RNA, 22 nt, Homo sapiens
uacaauuauggaaauauaguuc

SEQ ID NO: 2080058 - RNA, 21 nt, Homo sapiens
ucugugcaaggaaauuugcaa

SEQ ID NO: 2080059 - RNA, 22 nt, Homo sapiens
ggguuugagcacaaucuguucu

SEQ ID NO: 2080060 - RNA, 14 nt, Homo sapiens
aauagagccaacug

SEQ ID NO: 2080061 - RNA, 13 nt, Homo sapiens
ugucaucugucag

SEQ ID NO: 2080062 - RNA, 23 nt, Homo sapiens
caccgcaagcuuugagugggaca

SEQ ID NO: 2080063 - RNA, 19 nt, Homo sapiens
cugcucacggaccccaugu

SEQ ID NO: 2080064 - RNA, 15 nt, Homo sapiens
ucacugucuguuguu

SEQ ID NO: 2080065 - RNA, 14 nt, Homo sapiens
uccuggggcaucca

SEQ ID NO: 2080066 - RNA, 20 nt, Homo sapiens
ugccuucgguuuguauuuag

SEQ ID NO: 2080067 - RNA, 17 nt, Homo sapiens
ggccaguuuucuguuca

SEQ ID NO: 2080068 - RNA, 13 nt, Homo sapiens
aauuccucuggga

SEQ ID NO: 2080069 - RNA, 16 nt, Homo sapiens
auggcuugaggccaga

SEQ ID NO: 2080070 - RNA, 22 nt, Homo sapiens
ucaucaacuuauuauaugacua

SEQ ID NO: 2080071 - RNA, 23 nt, Homo sapiens
augaauucgaugcguauucugug

SEQ ID NO: 2080072 - RNA, 19 nt, Homo sapiens
gaaauucaggaugcuguga

SEQ ID NO: 2080073 - RNA, 14 nt, Homo sapiens
uuguggcugucaaa

SEQ ID NO: 2080074 - RNA, 17 nt, Homo sapiens
ucuugaugcaugcacug

SEQ ID NO: 2080075 - RNA, 21 nt, Homo sapiens
aagucaggcuagcugugcugg

SEQ ID NO: 2080076 - RNA, 20 nt, Homo sapiens
ugccucccuuaaucugccag

SEQ ID NO: 2080077 - RNA, 18 nt, Homo sapiens
uggguagucauucuuaca

SEQ ID NO: 2080078 - RNA, 22 nt, Homo sapiens
agaagguuugcaccccuccuau

SEQ ID NO: 2080079 - RNA, 17 nt, Homo sapiens
ccuaguccgcugaagau

SEQ ID NO: 2080080 - RNA, 23 nt, Homo sapiens
caauaugaaaacgaaguuaaaua

SEQ ID NO: 2080081 - RNA, 17 nt, Homo sapiens
ggcccuucacugccuuu

SEQ ID NO: 2080082 - RNA, 17 nt, Homo sapiens
accaggaucgcuuugua

SEQ ID NO: 2080083 - RNA, 17 nt, Homo sapiens
aaaccauuuuuuccuac

SEQ ID NO: 2080084 - RNA, 22 nt, Homo sapiens
cacgacuggucaccuugcacuc

SEQ ID NO: 2080085 - RNA, 22 nt, Homo sapiens
uggauuuugggagugacucaag

SEQ ID NO: 2080086 - RNA, 14 nt, Homo sapiens
aagaaaaaaucugc

SEQ ID NO: 2080087 - RNA, 17 nt, Homo sapiens
gcugcucacugcucaca

SEQ ID NO: 2080088 - RNA, 18 nt, Homo sapiens
guauuaacgugucagggc

SEQ ID NO: 2080089 - RNA, 21 nt, Homo sapiens
uccacauggaaucaaucuuua

SEQ ID NO: 2080090 - RNA, 21 nt, Homo sapiens
aaggcauucuguauaaaugca

SEQ ID NO: 2080091 - RNA, 14 nt, Homo sapiens
ccauagcaccucca

SEQ ID NO: 2080092 - RNA, 17 nt, Homo sapiens
aauuuucccucuucacu

SEQ ID NO: 2080093 - RNA, 13 nt, Homo sapiens
gaaaggaagcauu

SEQ ID NO: 2080094 - RNA, 21 nt, Homo sapiens
gaguugggaguuauuacucaa

SEQ ID NO: 2080095 - RNA, 17 nt, Homo sapiens
uguuaaguuacauuuac

SEQ ID NO: 2080096 - RNA, 15 nt, Homo sapiens
ccagacccacaaggc

SEQ ID NO: 2080097 - RNA, 22 nt, Homo sapiens
cuauuccaaucuacaacuggaa

SEQ ID NO: 2080098 - RNA, 23 nt, Homo sapiens
accaaggggugggccacagccau

SEQ ID NO: 2080099 - RNA, 12 nt, Homo sapiens
ggauacagucau

SEQ ID NO: 2080100 - RNA, 19 nt, Homo sapiens
aaauauacacacagcagua

SEQ ID NO: 2080101 - RNA, 13 nt, Homo sapiens
gccuuagcaguaa

SEQ ID NO: 2080102 - RNA, 16 nt, Homo sapiens
caacuucuuuccucug

SEQ ID NO: 2080103 - RNA, 13 nt, Homo sapiens
guucacacuguaa

SEQ ID NO: 2080104 - RNA, 17 nt, Homo sapiens
acagaacaccuaugcaa

SEQ ID NO: 2080105 - RNA, 13 nt, Homo sapiens
cugcaaguaucca

SEQ ID NO: 2080106 - RNA, 21 nt, Homo sapiens
gaagcucuggugacaccagcc

SEQ ID NO: 2080107 - RNA, 14 nt, Homo sapiens
aaaaguaggcugcc

SEQ ID NO: 2080108 - RNA, 21 nt, Homo sapiens
agcuggggauguuuaguaaua

SEQ ID NO: 2080109 - RNA, 20 nt, Homo sapiens
aaauauugucauaggauuaa

SEQ ID NO: 2080110 - RNA, 17 nt, Homo sapiens
ucagacacaaacaaaca

SEQ ID NO: 2080111 - RNA, 15 nt, Homo sapiens
uucauacaacaugca

SEQ ID NO: 2080112 - RNA, 16 nt, Homo sapiens
acagucuuugcaguuc

SEQ ID NO: 2080113 - RNA, 18 nt, Homo sapiens
uugaagucagauguggua

SEQ ID NO: 2080114 - RNA, 16 nt, Homo sapiens
caaaaaagucaagaac

SEQ ID NO: 2080115 - RNA, 19 nt, Homo sapiens
gcagagcagacaggcuaca

SEQ ID NO: 2080116 - RNA, 20 nt, Homo sapiens
ucauuaguagagcaguauau

SEQ ID NO: 2080117 - RNA, 14 nt, Homo sapiens
gaacaguaugaauu

SEQ ID NO: 2080118 - RNA, 21 nt, Homo sapiens
uaaaagcagagagaaguacuu

SEQ ID NO: 2080119 - RNA, 18 nt, Homo sapiens
uggagugaccauagcucc

SEQ ID NO: 2080120 - RNA, 17 nt, Homo sapiens
cugccaugccacugcca

SEQ ID NO: 2080121 - RNA, 20 nt, Homo sapiens
uguugcaugauaaacauuca

SEQ ID NO: 2080122 - RNA, 14 nt, Homo sapiens
ucaaugucuuaggu

SEQ ID NO: 2080123 - RNA, 17 nt, Homo sapiens
auguuuaguaaucauau

SEQ ID NO: 2080124 - RNA, 15 nt, Homo sapiens
gagugcaguggcgca

SEQ ID NO: 2080125 - RNA, 21 nt, Homo sapiens
aacugucgugcaaacccagug

SEQ ID NO: 2080126 - RNA, 21 nt, Homo sapiens
caagugugaauacugcuugaa

SEQ ID NO: 2080127 - RNA, 12 nt, Homo sapiens
gaguacacagcu

SEQ ID NO: 2080128 - RNA, 23 nt, Homo sapiens
aagcuaaauauuuaacauuguug

SEQ ID NO: 2080129 - RNA, 13 nt, Homo sapiens
gaaauguaacaua

SEQ ID NO: 2080130 - RNA, 17 nt, Homo sapiens
gaauucuuuacaauaaa

SEQ ID NO: 2080131 - RNA, 14 nt, Homo sapiens
cucaaccuauggua

SEQ ID NO: 2080132 - RNA, 17 nt, Homo sapiens
uacugcuaccacaacua

SEQ ID NO: 2080133 - RNA, 21 nt, Homo sapiens
cuugcucuccuggagcaagcu

SEQ ID NO: 2080134 - RNA, 13 nt, Homo sapiens
agauacaaacugc

SEQ ID NO: 2080135 - RNA, 18 nt, Homo sapiens
acuuauaguacaugauaa

SEQ ID NO: 2080136 - RNA, 23 nt, Homo sapiens
acacccaaguugaagacuuuguu

SEQ ID NO: 2080137 - RNA, 13 nt, Homo sapiens
uuuaguuacuuua

SEQ ID NO: 2080138 - RNA, 12 nt, Homo sapiens
cuauucaaugau

SEQ ID NO: 2080139 - RNA, 20 nt, Homo sapiens
uaaucaagagaaacuucaaa

SEQ ID NO: 2080140 - RNA, 13 nt, Homo sapiens
gccguaguaccuc

SEQ ID NO: 2080141 - RNA, 17 nt, Homo sapiens
auucuuuuuccaucccu

SEQ ID NO: 2080142 - RNA, 12 nt, Homo sapiens
augcuaccugau

SEQ ID NO: 2080143 - RNA, 16 nt, Homo sapiens
uccaugaccaggccac

SEQ ID NO: 2080144 - RNA, 22 nt, Homo sapiens
ccauaggagccgacucuuugau

SEQ ID NO: 2080145 - RNA, 17 nt, Homo sapiens
uaauuuuaaaguaucau

SEQ ID NO: 2080146 - RNA, 17 nt, Homo sapiens
gucccuuccccaugcuu

SEQ ID NO: 2080147 - RNA, 21 nt, Homo sapiens
gacauuacaauguguaaugga

SEQ ID NO: 2080148 - RNA, 22 nt, Homo sapiens
ccuuugcuacuacuaugugcag

SEQ ID NO: 2080149 - RNA, 21 nt, Homo sapiens
auguggccacuaggaggaaug

SEQ ID NO: 2080150 - RNA, 15 nt, Homo sapiens
uggggaaaaggcauu

SEQ ID NO: 2080151 - RNA, 14 nt, Homo sapiens
ccucugcugcccac

SEQ ID NO: 2080152 - RNA, 19 nt, Homo sapiens
gcugugcaauuacugccug

SEQ ID NO: 2080153 - RNA, 18 nt, Homo sapiens
gugaacguggcagugcuu

SEQ ID NO: 2080154 - RNA, 14 nt, Homo sapiens
cucccccacuccac

SEQ ID NO: 2080155 - RNA, 14 nt, Homo sapiens
cagcaacacagcca

SEQ ID NO: 2080156 - RNA, 19 nt, Homo sapiens
ccaucuugguucuagccgc

SEQ ID NO: 2080157 - RNA, 21 nt, Homo sapiens
uaaauucucauaaguagcauu

SEQ ID NO: 2080158 - RNA, 21 nt, Homo sapiens
agaggaugcucuuucccagga

SEQ ID NO: 2080159 - RNA, 14 nt, Homo sapiens
uugggcuagauccc

SEQ ID NO: 2080160 - RNA, 18 nt, Homo sapiens
gaaucccuuucucacuuu

SEQ ID NO: 2080161 - RNA, 19 nt, Homo sapiens
cacuuugagaagcugaggu

SEQ ID NO: 2080162 - RNA, 17 nt, Homo sapiens
gggaccagagcugccac

SEQ ID NO: 2080163 - RNA, 18 nt, Homo sapiens
cugugcuucgacuacugc

SEQ ID NO: 2080164 - RNA, 16 nt, Homo sapiens
uuguuacagcuacuau

SEQ ID NO: 2080165 - RNA, 13 nt, Homo sapiens
uacagacaacaaa

SEQ ID NO: 2080166 - RNA, 17 nt, Homo sapiens
ugggcagcauaaaguca

SEQ ID NO: 2080167 - RNA, 14 nt, Homo sapiens
uuugaggucuacau

SEQ ID NO: 2080168 - RNA, 13 nt, Homo sapiens
agagacuuuguca

SEQ ID NO: 2080169 - RNA, 18 nt, Homo sapiens
ucuccuagcucccugcca

SEQ ID NO: 2080170 - RNA, 22 nt, Homo sapiens
uagacuugccaacaccacagaa

SEQ ID NO: 2080171 - RNA, 22 nt, Homo sapiens
ugacgucacuggaccacugggc

SEQ ID NO: 2080172 - RNA, 14 nt, Homo sapiens
gccucucucaggcc

SEQ ID NO: 2080173 - RNA, 14 nt, Homo sapiens
cccugccugagggu

SEQ ID NO: 2080174 - RNA, 22 nt, Homo sapiens
ucccaccccauauuguucuuca

SEQ ID NO: 2080175 - RNA, 14 nt, Homo sapiens
gaaagcaacuucau

SEQ ID NO: 2080176 - RNA, 15 nt, Homo sapiens
ccagguggugaauuu

SEQ ID NO: 2080177 - RNA, 21 nt, Homo sapiens
agggauggaaauaacgggugg

SEQ ID NO: 2080178 - RNA, 23 nt, Homo sapiens
auaaguauuuaauucauguugcc

SEQ ID NO: 2080179 - RNA, 17 nt, Homo sapiens
guacuuguuucaucugg

SEQ ID NO: 2080180 - RNA, 17 nt, Homo sapiens
ucacaucagaacagaca

SEQ ID NO: 2080181 - RNA, 22 nt, Homo sapiens
cauguggcaucgcagucucuua

SEQ ID NO: 2080182 - RNA, 15 nt, Homo sapiens
uaaugauucaaugug

SEQ ID NO: 2080183 - RNA, 14 nt, Homo sapiens
aagguacacuggua

SEQ ID NO: 2080184 - RNA, 22 nt, Homo sapiens
gcuuuugccaguauuaugcaua

SEQ ID NO: 2080185 - RNA, 18 nt, Homo sapiens
aagaugucacaagggauu

SEQ ID NO: 2080186 - RNA, 13 nt, Homo sapiens
uuuguuuguacug

SEQ ID NO: 2080187 - RNA, 13 nt, Homo sapiens
cuuguuugcacug

SEQ ID NO: 2080188 - RNA, 12 nt, Homo sapiens
cacagaauguga

SEQ ID NO: 2080189 - RNA, 21 nt, Homo sapiens
ggucccuaaaagcauuugaca

SEQ ID NO: 2080190 - RNA, 12 nt, Homo sapiens
cugugggaccag

SEQ ID NO: 2080191 - RNA, 14 nt, Homo sapiens
uuauagaacaguug

SEQ ID NO: 2080192 - RNA, 18 nt, Homo sapiens
acucuaacaaacaagaga

SEQ ID NO: 2080193 - RNA, 21 nt, Homo sapiens
ucuucacuauucagaacuugu

SEQ ID NO: 2080194 - RNA, 15 nt, Homo sapiens
aaggacaucagcaaa

SEQ ID NO: 2080195 - RNA, 19 nt, Homo sapiens
agagaacuaaagcuggaga

SEQ ID NO: 2080196 - RNA, 20 nt, Homo sapiens
ggcuuuacaguguaaacugu

SEQ ID NO: 2080197 - RNA, 14 nt, Homo sapiens
aucuauaguagaca

SEQ ID NO: 2080198 - RNA, 16 nt, Homo sapiens
gagggagguaacgggu

SEQ ID NO: 2080199 - RNA, 23 nt, Homo sapiens
ugcaaaaauaaaaggaaaaccag

SEQ ID NO: 2080200 - RNA, 22 nt, Homo sapiens
uggcaucuuggaaaucauugug

SEQ ID NO: 2080201 - RNA, 15 nt, Homo sapiens
ugacagaacacuguc

SEQ ID NO: 2080202 - RNA, 19 nt, Homo sapiens
auaaaauguguacagugaa

SEQ ID NO: 2080203 - RNA, 14 nt, Homo sapiens
gcagggcugugaug

SEQ ID NO: 2080204 - RNA, 13 nt, Homo sapiens
agugcauuugacu

SEQ ID NO: 2080205 - RNA, 13 nt, Homo sapiens
acugcauuucacu

SEQ ID NO: 2080206 - RNA, 23 nt, Homo sapiens
caaugaaaaaagucuccauagga

SEQ ID NO: 2080207 - RNA, 15 nt, Homo sapiens
uucaaacacaaccua

SEQ ID NO: 2080208 - RNA, 17 nt, Homo sapiens
gccagaggagaagacaa

SEQ ID NO: 2080209 - RNA, 18 nt, Homo sapiens
ccacaccguuguuuaggg

SEQ ID NO: 2080210 - RNA, 21 nt, Homo sapiens
ccaggcugcuagaggugcuca

SEQ ID NO: 2080211 - RNA, 14 nt, Homo sapiens
caaugauauugaca

SEQ ID NO: 2080212 - RNA, 17 nt, Homo sapiens
uagcucuggaccagccu

SEQ ID NO: 2080213 - RNA, 20 nt, Homo sapiens
gcccagagaagccaaaagau

SEQ ID NO: 2080214 - RNA, 22 nt, Homo sapiens
cagucacgccugaaacuuugag

SEQ ID NO: 2080215 - RNA, 17 nt, Homo sapiens
ugcacagugugugacuu

SEQ ID NO: 2080216 - RNA, 20 nt, Homo sapiens
uguauguauuuucaguuaca

SEQ ID NO: 2080217 - RNA, 16 nt, Homo sapiens
gucucacugucugcug

SEQ ID NO: 2080218 - RNA, 17 nt, Homo sapiens
aaaaugcgggcauuuaa

SEQ ID NO: 2080219 - RNA, 14 nt, Homo sapiens
auauuucaggcaua

SEQ ID NO: 2080220 - RNA, 19 nt, Homo sapiens
uuagaaaagguuucuuaaa

SEQ ID NO: 2080221 - RNA, 16 nt, Homo sapiens
uuaccaaaaaccaugu

SEQ ID NO: 2080222 - RNA, 14 nt, Homo sapiens
accgcuguuuguau

SEQ ID NO: 2080223 - RNA, 21 nt, Homo sapiens
acuauaugcauaaacaacagu

SEQ ID NO: 2080224 - RNA, 16 nt, Homo sapiens
caccaagaaaccacug

SEQ ID NO: 2080225 - RNA, 17 nt, Homo sapiens
ccauguuguaaugcugc

SEQ ID NO: 2080226 - RNA, 19 nt, Homo sapiens
uuuguauaaaauagacaaa

SEQ ID NO: 2080227 - RNA, 13 nt, Homo sapiens
ugaagccaaagaa

SEQ ID NO: 2080228 - RNA, 19 nt, Homo sapiens
agaugagcagucacacugu

SEQ ID NO: 2080229 - RNA, 17 nt, Homo sapiens
agguuugucccagucag

SEQ ID NO: 2080230 - RNA, 17 nt, Homo sapiens
uaaacuggauacuguac

SEQ ID NO: 2080231 - RNA, 14 nt, Homo sapiens
cucugcuccaaagu

SEQ ID NO: 2080232 - RNA, 21 nt, Homo sapiens
gacaaauauuuuagaagcuaa

SEQ ID NO: 2080233 - RNA, 13 nt, Homo sapiens
cuuagaaagggaa

SEQ ID NO: 2080234 - RNA, 17 nt, Homo sapiens
cagcuccuaggaaaaug

SEQ ID NO: 2080235 - RNA, 17 nt, Homo sapiens
aaaauguauauuuugau

SEQ ID NO: 2080236 - RNA, 16 nt, Homo sapiens
auacucuuucuuugca

SEQ ID NO: 2080237 - RNA, 21 nt, Homo sapiens
auaugaaauuauaaugcaaua

SEQ ID NO: 2080238 - RNA, 13 nt, Homo sapiens
uuagucauguaag

SEQ ID NO: 2080239 - RNA, 22 nt, Homo sapiens
uccagagcccaaggucagggag

SEQ ID NO: 2080240 - RNA, 18 nt, Homo sapiens
ccacccugcuucugcugc

SEQ ID NO: 2080241 - RNA, 23 nt, Homo sapiens
cuggaacuggcugugaagaccca

SEQ ID NO: 2080242 - RNA, 14 nt, Homo sapiens
caauuucuccaaag

SEQ ID NO: 2080243 - RNA, 15 nt, Homo sapiens
caacuugaauuacaa

SEQ ID NO: 2080244 - RNA, 14 nt, Homo sapiens
gucaucugccaacu

SEQ ID NO: 2080245 - RNA, 11 nt, Homo sapiens
ggccuguggug

SEQ ID NO: 2080246 - RNA, 23 nt, Homo sapiens
cagaagcgcuccaguaucuccaa

SEQ ID NO: 2080247 - RNA, 20 nt, Homo sapiens
gccaccaggaagcacagguc

SEQ ID NO: 2080248 - RNA, 14 nt, Homo sapiens
ugcuuuuuccuuag

SEQ ID NO: 2080249 - RNA, 19 nt, Homo sapiens
cuuggaugguuaguuucac

SEQ ID NO: 2080250 - RNA, 18 nt, Homo sapiens
aaaguauuuuaucugccu

SEQ ID NO: 2080251 - RNA, 19 nt, Homo sapiens
guucaagcgauucuccugu

SEQ ID NO: 2080252 - RNA, 21 nt, Homo sapiens
agguuauuaugauuagcuuug

SEQ ID NO: 2080253 - RNA, 14 nt, Homo sapiens
gauuuaauaugcaa

SEQ ID NO: 2080254 - RNA, 13 nt, Homo sapiens
caagagugcugag

SEQ ID NO: 2080255 - RNA, 18 nt, Homo sapiens
cagagacucagcgcuccu

SEQ ID NO: 2080256 - RNA, 20 nt, Homo sapiens
uccacauccccaccuuccaa

SEQ ID NO: 2080257 - RNA, 13 nt, Homo sapiens
aagcccucuucaa

SEQ ID NO: 2080258 - RNA, 18 nt, Homo sapiens
aaaagaaccgagcaauuu

SEQ ID NO: 2080259 - RNA, 14 nt, Homo sapiens
uugucacaugaaac

SEQ ID NO: 2080260 - RNA, 15 nt, Homo sapiens
uggacggacaagaca

SEQ ID NO: 2080261 - RNA, 11 nt, Homo sapiens
aggcacuucac

SEQ ID NO: 2080262 - RNA, 23 nt, Homo sapiens
aaaucauuucauguuagucuuac

SEQ ID NO: 2080263 - RNA, 15 nt, Homo sapiens
aguccugagacuuuu

SEQ ID NO: 2080264 - RNA, 14 nt, Homo sapiens
aagcaacuuuccuu

SEQ ID NO: 2080265 - RNA, 17 nt, Homo sapiens
agcccacuuuguucgca

SEQ ID NO: 2080266 - RNA, 12 nt, Homo sapiens
caucagcacaaa

SEQ ID NO: 2080267 - RNA, 16 nt, Homo sapiens
ucccaugacucuugga

SEQ ID NO: 2080268 - RNA, 16 nt, Homo sapiens
auaugacccacacugc

SEQ ID NO: 2080269 - RNA, 13 nt, Homo sapiens
aaacacugaauua

SEQ ID NO: 2080270 - RNA, 18 nt, Homo sapiens
cccaagacccuagugaaa

SEQ ID NO: 2080271 - RNA, 15 nt, Homo sapiens
aggucccucagacau

SEQ ID NO: 2080272 - RNA, 15 nt, Homo sapiens
uuggcauugcaauga

SEQ ID NO: 2080273 - RNA, 17 nt, Homo sapiens
auguaauggacuaugca

SEQ ID NO: 2080274 - RNA, 18 nt, Homo sapiens
cuguauaacccuguuaca

SEQ ID NO: 2080275 - RNA, 18 nt, Homo sapiens
gugcagggaagugcagag

SEQ ID NO: 2080276 - RNA, 19 nt, Homo sapiens
uccugaggggauaucccua

SEQ ID NO: 2080277 - RNA, 17 nt, Homo sapiens
auuugcuuuaucuacuu

SEQ ID NO: 2080278 - RNA, 14 nt, Homo sapiens
agauaauaugagaa

SEQ ID NO: 2080279 - RNA, 14 nt, Homo sapiens
uuuuccauggacau

SEQ ID NO: 2080280 - RNA, 19 nt, Homo sapiens
aggaaaaaauaaaagaucu

SEQ ID NO: 2080281 - RNA, 16 nt, Homo sapiens
cuuacagaacuacuuc

SEQ ID NO: 2080282 - RNA, 23 nt, Homo sapiens
uuuaccauaagggacugugccag

SEQ ID NO: 2080283 - RNA, 22 nt, Homo sapiens
cuuggaaaaaauaaaaacauca

SEQ ID NO: 2080284 - RNA, 18 nt, Homo sapiens
auggaaauguuuacagau

SEQ ID NO: 2080285 - RNA, 16 nt, Homo sapiens
cuggccaccagcuucc

SEQ ID NO: 2080286 - RNA, 21 nt, Homo sapiens
aauuuauaaugaauacuuucu

SEQ ID NO: 2080287 - RNA, 18 nt, Homo sapiens
cuguggaaguaucuuggu

SEQ ID NO: 2080288 - RNA, 17 nt, Homo sapiens
aaaacaauucugugaca

SEQ ID NO: 2080289 - RNA, 22 nt, Homo sapiens
auagugucauccucacagugaa

SEQ ID NO: 2080290 - RNA, 15 nt, Homo sapiens
auaucaugcaaauuu

SEQ ID NO: 2080291 - RNA, 16 nt, Homo sapiens
uaaauguaaucacgag

SEQ ID NO: 2080292 - RNA, 14 nt, Homo sapiens
gugacuaucacccc

SEQ ID NO: 2080293 - RNA, 17 nt, Homo sapiens
uucugaagccucacuua

SEQ ID NO: 2080294 - RNA, 13 nt, Homo sapiens
uggagauucccau

SEQ ID NO: 2080295 - RNA, 12 nt, Homo sapiens
ccuuucauucua

SEQ ID NO: 2080296 - RNA, 12 nt, Homo sapiens
ccauucauucaa

SEQ ID NO: 2080297 - RNA, 18 nt, Homo sapiens
uuuuccaugacugcauuu

SEQ ID NO: 2080298 - RNA, 19 nt, Homo sapiens
ggacaguuuaucaugaagc

SEQ ID NO: 2080299 - RNA, 14 nt, Homo sapiens
agcugagauuacag

SEQ ID NO: 2080300 - RNA, 23 nt, Homo sapiens
gaacucauucucuucuugcuaua

SEQ ID NO: 2080301 - RNA, 23 nt, Homo sapiens
ggcgucuccaaggaggugacacu

SEQ ID NO: 2080302 - RNA, 18 nt, Homo sapiens
aggcccggacucaccaac

SEQ ID NO: 2080303 - RNA, 16 nt, Homo sapiens
agaauugagucuucca

SEQ ID NO: 2080304 - RNA, 23 nt, Homo sapiens
gaguuggacccauugccagugag

SEQ ID NO: 2080305 - RNA, 22 nt, Homo sapiens
aguuggcaggagcuccuggaag

SEQ ID NO: 2080306 - RNA, 18 nt, Homo sapiens
ccuccacuugccuuguga

SEQ ID NO: 2080307 - RNA, 13 nt, Homo sapiens
uuguacauuucac

SEQ ID NO: 2080308 - RNA, 17 nt, Homo sapiens
agcacagcucuccuccu

SEQ ID NO: 2080309 - RNA, 14 nt, Homo sapiens
caguacuuuuauua

SEQ ID NO: 2080310 - RNA, 14 nt, Homo sapiens
acaauggaguauuc

SEQ ID NO: 2080311 - RNA, 18 nt, Homo sapiens
acagagcaagacugucuc

SEQ ID NO: 2080312 - RNA, 16 nt, Homo sapiens
cauaccuucugaugaa

SEQ ID NO: 2080313 - RNA, 23 nt, Homo sapiens
gggcccaucucccugcuuugguc

SEQ ID NO: 2080314 - RNA, 22 nt, Homo sapiens
cagaagacuugccugcuaggga

SEQ ID NO: 2080315 - RNA, 16 nt, Homo sapiens
ugccggcccagugaca

SEQ ID NO: 2080316 - RNA, 24 nt, Homo sapiens
acacauuaauaaacaaucucccaa

SEQ ID NO: 2080317 - RNA, 15 nt, Homo sapiens
cacuaaguaaccucu

SEQ ID NO: 2080318 - RNA, 14 nt, Homo sapiens
guggccacuuucca

SEQ ID NO: 2080319 - RNA, 16 nt, Homo sapiens
acucuuccaaaggcau

SEQ ID NO: 2080320 - RNA, 13 nt, Homo sapiens
ggacugcagcucc

SEQ ID NO: 2080321 - RNA, 23 nt, Homo sapiens
accugguacaaaugcacgucaca

SEQ ID NO: 2080322 - RNA, 21 nt, Homo sapiens
uaucaggacugugaccaaagc

SEQ ID NO: 2080323 - RNA, 17 nt, Homo sapiens
aaaaaauuuauuauguc

SEQ ID NO: 2080324 - RNA, 18 nt, Homo sapiens
aaauguuaugacuaugua

SEQ ID NO: 2080325 - RNA, 18 nt, Homo sapiens
agauuuccuccuggccuu

SEQ ID NO: 2080326 - RNA, 22 nt, Homo sapiens
agcuugucugguaaguggcuuc

SEQ ID NO: 2080327 - RNA, 14 nt, Homo sapiens
cacacauccuguca

SEQ ID NO: 2080328 - RNA, 14 nt, Homo sapiens
gugaauggcuuugu

SEQ ID NO: 2080329 - RNA, 13 nt, Homo sapiens
acacuauuuacaa

SEQ ID NO: 2080330 - RNA, 19 nt, Homo sapiens
ggucauaucuagucacuug

SEQ ID NO: 2080331 - RNA, 21 nt, Homo sapiens
cuuacaagaguggacucagug

SEQ ID NO: 2080332 - RNA, 12 nt, Homo sapiens
gucuuuuacccg

SEQ ID NO: 2080333 - RNA, 17 nt, Homo sapiens
agaaaauaauugcaaau

SEQ ID NO: 2080334 - RNA, 19 nt, Homo sapiens
uggaaaauucuauggaaua

SEQ ID NO: 2080335 - RNA, 22 nt, Homo sapiens
ggcaaugcccugugcaugccau

SEQ ID NO: 2080336 - RNA, 19 nt, Homo sapiens
ggaaacuguuguguccaau

SEQ ID NO: 2080337 - RNA, 16 nt, Homo sapiens
ccuccacgccauuucc

SEQ ID NO: 2080338 - RNA, 20 nt, Homo sapiens
ugagacagagucuuacucug

SEQ ID NO: 2080339 - RNA, 16 nt, Homo sapiens
cugcccacucugcaag

SEQ ID NO: 2080340 - RNA, 19 nt, Homo sapiens
agauggcgaccaccaaagu

SEQ ID NO: 2080341 - RNA, 13 nt, Homo sapiens
cuuguccuaauaa

SEQ ID NO: 2080342 - RNA, 22 nt, Homo sapiens
auguaaaauauuguuacuagag

SEQ ID NO: 2080343 - RNA, 13 nt, Homo sapiens
cugauggaucccg

SEQ ID NO: 2080344 - RNA, 19 nt, Homo sapiens
cuggucaacuugagcaugu

SEQ ID NO: 2080345 - RNA, 17 nt, Homo sapiens
acacauaauuaacacuu

SEQ ID NO: 2080346 - RNA, 13 nt, Homo sapiens
agagaaagccagg

SEQ ID NO: 2080347 - RNA, 14 nt, Homo sapiens
cacucuggagcauu

SEQ ID NO: 2080348 - RNA, 15 nt, Homo sapiens
uaaaaaaauuaguga

SEQ ID NO: 2080349 - RNA, 23 nt, Homo sapiens
augauuuaauuuuuuaaacugua

SEQ ID NO: 2080350 - RNA, 12 nt, Homo sapiens
gauagcuuuauu

SEQ ID NO: 2080351 - RNA, 16 nt, Homo sapiens
ucuacuacagaguguu

SEQ ID NO: 2080352 - RNA, 20 nt, Homo sapiens
ugugaaaguuacaaauugcu

SEQ ID NO: 2080353 - RNA, 17 nt, Homo sapiens
gggugaccucuugccuc

SEQ ID NO: 2080354 - RNA, 14 nt, Homo sapiens
acagaaaaauugaa

SEQ ID NO: 2080355 - RNA, 21 nt, Homo sapiens
accucauuuaccauaaaaauc

SEQ ID NO: 2080356 - RNA, 17 nt, Homo sapiens
gcuacuuagcuggccaa

SEQ ID NO: 2080357 - RNA, 15 nt, Homo sapiens
aacccaucacugugu

SEQ ID NO: 2080358 - RNA, 17 nt, Homo sapiens
gaaggagccagugccca

SEQ ID NO: 2080359 - RNA, 17 nt, Homo sapiens
uuuacaaaggagaaaga

SEQ ID NO: 2080360 - RNA, 20 nt, Homo sapiens
gcuauggagagggcuugaaa

SEQ ID NO: 2080361 - RNA, 21 nt, Homo sapiens
aaggucauuaaaccagaucau

SEQ ID NO: 2080362 - RNA, 16 nt, Homo sapiens
caggagccgagccaau

SEQ ID NO: 2080363 - RNA, 14 nt, Homo sapiens
agucuauugcaguu

SEQ ID NO: 2080364 - RNA, 18 nt, Homo sapiens
cugucuuugcagggcaca

SEQ ID NO: 2080365 - RNA, 13 nt, Homo sapiens
cauuaccccauac

SEQ ID NO: 2080366 - RNA, 18 nt, Homo sapiens
accuaccaccuucccucu

SEQ ID NO: 2080367 - RNA, 13 nt, Homo sapiens
caaagacugugaa

SEQ ID NO: 2080368 - RNA, 16 nt, Homo sapiens
caugaaacuguacaua

SEQ ID NO: 2080369 - RNA, 15 nt, Homo sapiens
ucccacugaaaugga

SEQ ID NO: 2080370 - RNA, 19 nt, Homo sapiens
agccccucuggacacagcc

SEQ ID NO: 2080371 - RNA, 14 nt, Homo sapiens
ccauucacuccugc

SEQ ID NO: 2080372 - RNA, 14 nt, Homo sapiens
caugaucaugccac

SEQ ID NO: 2080373 - RNA, 12 nt, Homo sapiens
caggacaucucu

SEQ ID NO: 2080374 - RNA, 13 nt, Homo sapiens
gaacuaccaaaau

SEQ ID NO: 2080375 - RNA, 19 nt, Homo sapiens
aguaucuaccuuuugcuac

SEQ ID NO: 2080376 - RNA, 12 nt, Homo sapiens
ugguccaugcag

SEQ ID NO: 2080377 - RNA, 19 nt, Homo sapiens
uauucauuuauuggcuuaa

SEQ ID NO: 2080378 - RNA, 19 nt, Homo sapiens
caaucuaagggucucucau

SEQ ID NO: 2080379 - RNA, 12 nt, Homo sapiens
gacuccaucucu

SEQ ID NO: 2080380 - RNA, 12 nt, Homo sapiens
gugcccaucagc

SEQ ID NO: 2080381 - RNA, 12 nt, Homo sapiens
guguccaucagu

SEQ ID NO: 2080382 - RNA, 16 nt, Homo sapiens
accuaggccucagcug

SEQ ID NO: 2080383 - RNA, 20 nt, Homo sapiens
ccccaggcaaggaugucuga

SEQ ID NO: 2080384 - RNA, 13 nt, Homo sapiens
aagauaguuguaa

SEQ ID NO: 2080385 - RNA, 17 nt, Homo sapiens
gcuuuucagugauacuc

SEQ ID NO: 2080386 - RNA, 19 nt, Homo sapiens
guacaguauauucuuguaa

SEQ ID NO: 2080387 - RNA, 17 nt, Homo sapiens
ucauaugugcaguauuu

SEQ ID NO: 2080388 - RNA, 16 nt, Homo sapiens
gcccugccuugcugca

SEQ ID NO: 2080389 - RNA, 22 nt, Homo sapiens
ucccacuuggaggccuuucauc

SEQ ID NO: 2080390 - RNA, 23 nt, Homo sapiens
ccacgcagcacccuucucggaga

SEQ ID NO: 2080391 - RNA, 15 nt, Homo sapiens
aucaaaugagcaucu

SEQ ID NO: 2080392 - RNA, 14 nt, Homo sapiens
gcugcucacuuaaa

SEQ ID NO: 2080393 - RNA, 13 nt, Homo sapiens
uaccaaaugaggg

SEQ ID NO: 2080394 - RNA, 20 nt, Homo sapiens
agaaacuccaaaguccacac

SEQ ID NO: 2080395 - RNA, 22 nt, Homo sapiens
accggcgugcaccaccaugcca

SEQ ID NO: 2080396 - RNA, 12 nt, Homo sapiens
ccaacaccacag

SEQ ID NO: 2080397 - RNA, 17 nt, Homo sapiens
uaaagcgugugugaaca

SEQ ID NO: 2080398 - RNA, 23 nt, Homo sapiens
cuugguucuacguggaugauuuc

SEQ ID NO: 2080399 - RNA, 20 nt, Homo sapiens
ugcucagaaauguugguuac

SEQ ID NO: 2080400 - RNA, 13 nt, Homo sapiens
uccgagcauucca

SEQ ID NO: 2080401 - RNA, 20 nt, Homo sapiens
gcaugaaggcagccacagac

SEQ ID NO: 2080402 - RNA, 20 nt, Homo sapiens
cauaccaaguugauacuuga

SEQ ID NO: 2080403 - RNA, 20 nt, Homo sapiens
cucuacagacuccaaaaggc

SEQ ID NO: 2080404 - RNA, 23 nt, Homo sapiens
cagagggggccuucacagugacc

SEQ ID NO: 2080405 - RNA, 15 nt, Homo sapiens
uguaucuaugcauuu

SEQ ID NO: 2080406 - RNA, 17 nt, Homo sapiens
uguuccaauuugacaaa

SEQ ID NO: 2080407 - RNA, 22 nt, Homo sapiens
cuuguuuguuugagcuuaggga

SEQ ID NO: 2080408 - RNA, 14 nt, Homo sapiens
aaaaguaaagacua

SEQ ID NO: 2080409 - RNA, 11 nt, Homo sapiens
cgcaccugccc

SEQ ID NO: 2080410 - RNA, 22 nt, Homo sapiens
ucucaaggucacgggaccccua

SEQ ID NO: 2080411 - RNA, 23 nt, Homo sapiens
uuccaguacuuccugcaguacaa

SEQ ID NO: 2080412 - RNA, 20 nt, Homo sapiens
aggccaggcgcgguggcuca

SEQ ID NO: 2080413 - RNA, 21 nt, Homo sapiens
cacacuuuggucauuucucaa

SEQ ID NO: 2080414 - RNA, 12 nt, Homo sapiens
aaccucauucuc

SEQ ID NO: 2080415 - RNA, 17 nt, Homo sapiens
uucagccacuucugcag

SEQ ID NO: 2080416 - RNA, 13 nt, Homo sapiens
uuucuaguagcac

SEQ ID NO: 2080417 - RNA, 20 nt, Homo sapiens
cauuuuuuuuuuuuaaagga

SEQ ID NO: 2080418 - RNA, 14 nt, Homo sapiens
agacaugguggggu

SEQ ID NO: 2080419 - RNA, 23 nt, Homo sapiens
uguaccuuccacaagacucagaa

SEQ ID NO: 2080420 - RNA, 18 nt, Homo sapiens
aucuuggcuuugccacac

SEQ ID NO: 2080421 - RNA, 21 nt, Homo sapiens
uccccugaaaaacugaucaaa

SEQ ID NO: 2080422 - RNA, 21 nt, Homo sapiens
caucaucccuucuuccauccu

SEQ ID NO: 2080423 - RNA, 12 nt, Homo sapiens
cuccccuguauu

SEQ ID NO: 2080424 - RNA, 18 nt, Homo sapiens
aucuucuuauaacuugua

SEQ ID NO: 2080425 - RNA, 22 nt, Homo sapiens
cuguacuauccuguaaauauau

SEQ ID NO: 2080426 - RNA, 20 nt, Homo sapiens
uccccucuuauguaccucuu

SEQ ID NO: 2080427 - RNA, 13 nt, Homo sapiens
caggccagcugcu

SEQ ID NO: 2080428 - RNA, 19 nt, Homo sapiens
gaaaaucuuuaggcuuuca

SEQ ID NO: 2080429 - RNA, 12 nt, Homo sapiens
uuuugauugcau

SEQ ID NO: 2080430 - RNA, 13 nt, Homo sapiens
acuuaagaggcag

SEQ ID NO: 2080431 - RNA, 20 nt, Homo sapiens
caacacgccuaaaacucaaa

SEQ ID NO: 2080432 - RNA, 23 nt, Homo sapiens
ccacauccugugucagaaacccu

SEQ ID NO: 2080433 - RNA, 22 nt, Homo sapiens
ucugcuuguauuccaagcauau

SEQ ID NO: 2080434 - RNA, 14 nt, Homo sapiens
auucccaccaaggu

SEQ ID NO: 2080435 - RNA, 15 nt, Homo sapiens
cuuuauuaaaacagu

SEQ ID NO: 2080436 - RNA, 19 nt, Homo sapiens
auuccaauauaaaggcagg

SEQ ID NO: 2080437 - RNA, 19 nt, Homo sapiens
ugcauguaauggacuaugc

SEQ ID NO: 2080438 - RNA, 16 nt, Homo sapiens
ucaauguccagugagu

SEQ ID NO: 2080439 - RNA, 15 nt, Homo sapiens
ccaaauugcuucuag

SEQ ID NO: 2080440 - RNA, 21 nt, Homo sapiens
ucccgcccucaagaaucuccc

SEQ ID NO: 2080441 - RNA, 20 nt, Homo sapiens
gcaucaauuccaucagcaca

SEQ ID NO: 2080442 - RNA, 23 nt, Homo sapiens
ucaaaagcggggcuucaucugca

SEQ ID NO: 2080443 - RNA, 17 nt, Homo sapiens
cuuaaaucucacucuag

SEQ ID NO: 2080444 - RNA, 18 nt, Homo sapiens
uuuugcccacacuuggga

SEQ ID NO: 2080445 - RNA, 17 nt, Homo sapiens
gcugcagguuggaacua

SEQ ID NO: 2080446 - RNA, 16 nt, Homo sapiens
cuguggccugccaguc

SEQ ID NO: 2080447 - RNA, 21 nt, Homo sapiens
cuccugauguagcuugagaua

SEQ ID NO: 2080448 - RNA, 18 nt, Homo sapiens
cugaacagaagauuuggc

SEQ ID NO: 2080449 - RNA, 17 nt, Homo sapiens
uugccaacucgaacaaa

SEQ ID NO: 2080450 - RNA, 23 nt, Homo sapiens
aacaggaaacugggaaucucaua

SEQ ID NO: 2080451 - RNA, 10 nt, Homo sapiens
aucccacuga

SEQ ID NO: 2080452 - RNA, 16 nt, Homo sapiens
aguuaaugucagugac

SEQ ID NO: 2080453 - RNA, 18 nt, Homo sapiens
ccuguaggucuaugaugu

SEQ ID NO: 2080454 - RNA, 22 nt, Homo sapiens
ccucagucuggcaaugggacuc

SEQ ID NO: 2080455 - RNA, 20 nt, Homo sapiens
uuuggucuguuuugccuuca

SEQ ID NO: 2080456 - RNA, 23 nt, Homo sapiens
uguaguguuaaagugaaucucaa

SEQ ID NO: 2080457 - RNA, 17 nt, Homo sapiens
gccugugugagcaucuc

SEQ ID NO: 2080458 - RNA, 13 nt, Homo sapiens
uauucuaaccuac

SEQ ID NO: 2080459 - RNA, 15 nt, Homo sapiens
cagcuccugccaggg

SEQ ID NO: 2080460 - RNA, 16 nt, Homo sapiens
acaucgcagauucucc

SEQ ID NO: 2080461 - RNA, 14 nt, Homo sapiens
guugcuauacaugu

SEQ ID NO: 2080462 - RNA, 19 nt, Homo sapiens
aaacagauggcacuuugaa

SEQ ID NO: 2080463 - RNA, 22 nt, Homo sapiens
uuguaagaaauaacacugugaa

SEQ ID NO: 2080464 - RNA, 17 nt, Homo sapiens
ugaagugccacaugaca

SEQ ID NO: 2080465 - RNA, 16 nt, Homo sapiens
uugaaggacuacaggu

SEQ ID NO: 2080466 - RNA, 19 nt, Homo sapiens
acagaucaagcugugagac

SEQ ID NO: 2080467 - RNA, 17 nt, Homo sapiens
acucugggcacaagcag

SEQ ID NO: 2080468 - RNA, 19 nt, Homo sapiens
gaaccauuugggauggaga

SEQ ID NO: 2080469 - RNA, 23 nt, Homo sapiens
aaagaugguggagauuggcaugc

SEQ ID NO: 2080470 - RNA, 18 nt, Homo sapiens
gcccuggccucugcucaa

SEQ ID NO: 2080471 - RNA, 11 nt, Homo sapiens
ugucugagaug

SEQ ID NO: 2080472 - RNA, 18 nt, Homo sapiens
cugcccuugucugagaug

SEQ ID NO: 2080473 - RNA, 18 nt, Homo sapiens
ucaacaaaaagacaugga

SEQ ID NO: 2080474 - RNA, 15 nt, Homo sapiens
auuuugggggucauc

SEQ ID NO: 2080475 - RNA, 19 nt, Homo sapiens
accaccacccuugccaugg

SEQ ID NO: 2080476 - RNA, 20 nt, Homo sapiens
caagcugaaaacaaacaaga

SEQ ID NO: 2080477 - RNA, 19 nt, Homo sapiens
guuuugucagacuuccaaa

SEQ ID NO: 2080478 - RNA, 16 nt, Homo sapiens
auaggauugcuucaau

SEQ ID NO: 2080479 - RNA, 19 nt, Homo sapiens
caccccucuucugcuccuu

SEQ ID NO: 2080480 - RNA, 16 nt, Homo sapiens
gcagaagcacauauga

SEQ ID NO: 2080481 - RNA, 23 nt, Homo sapiens
aggcaaggaguuugagaccagcu

SEQ ID NO: 2080482 - RNA, 22 nt, Homo sapiens
gccagagguaauguuaguaaau

SEQ ID NO: 2080483 - RNA, 22 nt, Homo sapiens
aacaguucucagaaaugucaug

SEQ ID NO: 2080484 - RNA, 15 nt, Homo sapiens
uucauuuacuguggc

SEQ ID NO: 2080485 - RNA, 15 nt, Homo sapiens
gacgugcagccacac

SEQ ID NO: 2080486 - RNA, 20 nt, Homo sapiens
aaauaacuggaaaacagaac

SEQ ID NO: 2080487 - RNA, 16 nt, Homo sapiens
agccacaguucugacg

SEQ ID NO: 2080488 - RNA, 19 nt, Homo sapiens
ggaaauaugccacugaccg

SEQ ID NO: 2080489 - RNA, 14 nt, Homo sapiens
uguaaccacugcac

SEQ ID NO: 2080490 - RNA, 21 nt, Homo sapiens
cuacagcauccuggacaacaa

SEQ ID NO: 2080491 - RNA, 15 nt, Homo sapiens
caccaaaucaucucu

SEQ ID NO: 2080492 - RNA, 14 nt, Homo sapiens
gagagagaaggcag

SEQ ID NO: 2080493 - RNA, 16 nt, Homo sapiens
ccugagaaacguccau

SEQ ID NO: 2080494 - RNA, 23 nt, Homo sapiens
guagccugggcucacugugcugg

SEQ ID NO: 2080495 - RNA, 10 nt, Homo sapiens
uuaacuauug

SEQ ID NO: 2080496 - RNA, 14 nt, Homo sapiens
caccuuaauaugcu

SEQ ID NO: 2080497 - RNA, 18 nt, Homo sapiens
aaggaaauaaagcguccu

SEQ ID NO: 2080498 - RNA, 14 nt, Homo sapiens
aagcaaaaugcuuc

SEQ ID NO: 2080499 - RNA, 19 nt, Homo sapiens
agagauaugcacacacaga

SEQ ID NO: 2080500 - RNA, 18 nt, Homo sapiens
ucacagcaaagcaacaau

SEQ ID NO: 2080501 - RNA, 21 nt, Homo sapiens
ggagcuggaaauaaaccugga

SEQ ID NO: 2080502 - RNA, 16 nt, Homo sapiens
cccuccagagcaggag

SEQ ID NO: 2080503 - RNA, 24 nt, Homo sapiens
auuauagugaaacauguacuuuga

SEQ ID NO: 2080504 - RNA, 17 nt, Homo sapiens
agaggcugccccucuca

SEQ ID NO: 2080505 - RNA, 12 nt, Homo sapiens
aaaaauaaugug

SEQ ID NO: 2080506 - RNA, 19 nt, Homo sapiens
auucuuugcgguauucuug

SEQ ID NO: 2080507 - RNA, 12 nt, Homo sapiens
cugaggaugcug

SEQ ID NO: 2080508 - RNA, 20 nt, Homo sapiens
gugcagcauuguuggcuguu

SEQ ID NO: 2080509 - RNA, 19 nt, Homo sapiens
ccuauauuguuuucagugu

SEQ ID NO: 2080510 - RNA, 18 nt, Homo sapiens
acugaaauagagugaauu

SEQ ID NO: 2080511 - RNA, 12 nt, Homo sapiens
agaguccaguga

SEQ ID NO: 2080512 - RNA, 22 nt, Homo sapiens
ucaauuuggcaaaacaaaaugu

SEQ ID NO: 2080513 - RNA, 17 nt, Homo sapiens
auuauccuucuacuugu

SEQ ID NO: 2080514 - RNA, 22 nt, Homo sapiens
caaggggcugaaaagaucugaa

SEQ ID NO: 2080515 - RNA, 19 nt, Homo sapiens
ggucaguuuggugucaaca

SEQ ID NO: 2080516 - RNA, 20 nt, Homo sapiens
aagauacaggacauucucau

SEQ ID NO: 2080517 - RNA, 17 nt, Homo sapiens
gagccacagcagcauuu

SEQ ID NO: 2080518 - RNA, 13 nt, Homo sapiens
cuuucuaagcccu

SEQ ID NO: 2080519 - RNA, 17 nt, Homo sapiens
ggaaaccuuccacccag

SEQ ID NO: 2080520 - RNA, 20 nt, Homo sapiens
ccagaguugcugggagcuga

SEQ ID NO: 2080521 - RNA, 16 nt, Homo sapiens
aaaugcucuuuugcac

SEQ ID NO: 2080522 - RNA, 16 nt, Homo sapiens
uuucaaugaaacaaag

SEQ ID NO: 2080523 - RNA, 11 nt, Homo sapiens
caguaguggug

SEQ ID NO: 2080524 - RNA, 17 nt, Homo sapiens
guguguguauacaugcc

SEQ ID NO: 2080525 - RNA, 12 nt, Homo sapiens
auucagucacau

SEQ ID NO: 2080526 - RNA, 12 nt, Homo sapiens
cauauguguucc

SEQ ID NO: 2080527 - RNA, 11 nt, Homo sapiens
accuaugccug

SEQ ID NO: 2080528 - RNA, 11 nt, Homo sapiens
ccacacuuuca

SEQ ID NO: 2080529 - RNA, 15 nt, Homo sapiens
augugguacuugagg

SEQ ID NO: 2080530 - RNA, 11 nt, Homo sapiens
aguuuugcacu

SEQ ID NO: 2080531 - RNA, 16 nt, Homo sapiens
uagcucugcugcugau

SEQ ID NO: 2080532 - RNA, 21 nt, Homo sapiens
uccuuuccugaucacuaugca

SEQ ID NO: 2080533 - RNA, 22 nt, Homo sapiens
agcccugcucuggggugcugag

SEQ ID NO: 2080534 - RNA, 14 nt, Homo sapiens
ucauuuuguugcuu

SEQ ID NO: 2080535 - RNA, 13 nt, Homo sapiens
gcggcgugggcga

SEQ ID NO: 2080536 - RNA, 16 nt, Homo sapiens
ccuagccagaggcucu

SEQ ID NO: 2080537 - RNA, 22 nt, Homo sapiens
gcacauugucaccccaagccau

SEQ ID NO: 2080538 - RNA, 14 nt, Homo sapiens
acaauaaaccuccg

SEQ ID NO: 2080539 - RNA, 19 nt, Homo sapiens
augugugaaaaagaugcca

SEQ ID NO: 2080540 - RNA, 13 nt, Homo sapiens
aggauaacuaaaa

SEQ ID NO: 2080541 - RNA, 19 nt, Homo sapiens
cagcaaauaaagcagucau

SEQ ID NO: 2080542 - RNA, 22 nt, Homo sapiens
ugccaaagcuuuacuacugugg

SEQ ID NO: 2080543 - RNA, 19 nt, Homo sapiens
uuccugucccacuacugua

SEQ ID NO: 2080544 - RNA, 16 nt, Homo sapiens
caaauggcagaaccaa

SEQ ID NO: 2080545 - RNA, 16 nt, Homo sapiens
aggggcccgcuugccu

SEQ ID NO: 2080546 - RNA, 20 nt, Homo sapiens
uaaaguugguucacuucaaa

SEQ ID NO: 2080547 - RNA, 22 nt, Homo sapiens
cugcaaaggacagauccaggga

SEQ ID NO: 2080548 - RNA, 11 nt, Homo sapiens
augaagcacau

SEQ ID NO: 2080549 - RNA, 21 nt, Homo sapiens
ugugccucaacauacuguuga

SEQ ID NO: 2080550 - RNA, 14 nt, Homo sapiens
gcucaugagcuccu

SEQ ID NO: 2080551 - RNA, 15 nt, Homo sapiens
ugcaagugugcaugg

SEQ ID NO: 2080552 - RNA, 21 nt, Homo sapiens
aaguucuaugaagaguauuaa

SEQ ID NO: 2080553 - RNA, 14 nt, Homo sapiens
gcaacagagcaaaa

SEQ ID NO: 2080554 - RNA, 23 nt, Homo sapiens
cugagaacccugcguggggacag

SEQ ID NO: 2080555 - RNA, 14 nt, Homo sapiens
aaaucagucuuccu

SEQ ID NO: 2080556 - RNA, 13 nt, Homo sapiens
augagaagucacu

SEQ ID NO: 2080557 - RNA, 14 nt, Homo sapiens
gcaaacuuacaggu

SEQ ID NO: 2080558 - RNA, 19 nt, Homo sapiens
ugaauguguagaaccuucc

SEQ ID NO: 2080559 - RNA, 16 nt, Homo sapiens
aagcgaugaaacugga

SEQ ID NO: 2080560 - RNA, 23 nt, Homo sapiens
gucaauuucaguguaugauauac

SEQ ID NO: 2080561 - RNA, 19 nt, Homo sapiens
ccucauucacaaaguauaa

SEQ ID NO: 2080562 - RNA, 12 nt, Homo sapiens
cucauccuggca

SEQ ID NO: 2080563 - RNA, 19 nt, Homo sapiens
aggaguucugcucauucua

SEQ ID NO: 2080564 - RNA, 21 nt, Homo sapiens
auucugaguaacaucagcagg

SEQ ID NO: 2080565 - RNA, 11 nt, Homo sapiens
aacaauuccac

SEQ ID NO: 2080566 - RNA, 14 nt, Homo sapiens
ccugccccagcacu

SEQ ID NO: 2080567 - RNA, 13 nt, Homo sapiens
gagaccugccccu

SEQ ID NO: 2080568 - RNA, 17 nt, Homo sapiens
gcugaaauucaccaaga

SEQ ID NO: 2080569 - RNA, 21 nt, Homo sapiens
agagacaacagauuuacaucc

SEQ ID NO: 2080570 - RNA, 16 nt, Homo sapiens
aaauaugugacugaca

SEQ ID NO: 2080571 - RNA, 21 nt, Homo sapiens
cucagucccugacuaacagcc

SEQ ID NO: 2080572 - RNA, 21 nt, Homo sapiens
cucagugccaccuaugccugu

SEQ ID NO: 2080573 - RNA, 12 nt, Homo sapiens
guuucugagaaa

SEQ ID NO: 2080574 - RNA, 12 nt, Homo sapiens
auuucugaaaaa

SEQ ID NO: 2080575 - RNA, 17 nt, Homo sapiens
guccuccgguugcauac

SEQ ID NO: 2080576 - RNA, 17 nt, Homo sapiens
aggggccugcaggugag

SEQ ID NO: 2080577 - RNA, 14 nt, Homo sapiens
uaaaguuuugcaac

SEQ ID NO: 2080578 - RNA, 23 nt, Homo sapiens
ugagcacuguuuauacacugugu

SEQ ID NO: 2080579 - RNA, 14 nt, Homo sapiens
gaauaugggagaaa

SEQ ID NO: 2080580 - RNA, 21 nt, Homo sapiens
augacugcugaaugacauauu

SEQ ID NO: 2080581 - RNA, 20 nt, Homo sapiens
uggauaucaacugcuuguaa

SEQ ID NO: 2080582 - RNA, 16 nt, Homo sapiens
uguccugccuccucau

SEQ ID NO: 2080583 - RNA, 23 nt, Homo sapiens
cugauugcuggcaacaacagauu

SEQ ID NO: 2080584 - RNA, 16 nt, Homo sapiens
ugcuguacccaguuuc

SEQ ID NO: 2080585 - RNA, 20 nt, Homo sapiens
cagcagagccuggaagacac

SEQ ID NO: 2080586 - RNA, 17 nt, Homo sapiens
aggugccacuccagugc

SEQ ID NO: 2080587 - RNA, 17 nt, Homo sapiens
uaauaccaaaauugagc

SEQ ID NO: 2080588 - RNA, 15 nt, Homo sapiens
aauauauucuuucaa

SEQ ID NO: 2080589 - RNA, 18 nt, Homo sapiens
accucaaggccuacugac

SEQ ID NO: 2080590 - RNA, 15 nt, Homo sapiens
augacaaucaguuau

SEQ ID NO: 2080591 - RNA, 16 nt, Homo sapiens
uccagggaaacagccu

SEQ ID NO: 2080592 - RNA, 14 nt, Homo sapiens
uccagguucacuga

SEQ ID NO: 2080593 - RNA, 20 nt, Homo sapiens
uauguggaguucaucuugaa

SEQ ID NO: 2080594 - RNA, 21 nt, Homo sapiens
aucacaucauuuuuaagcacu

SEQ ID NO: 2080595 - RNA, 18 nt, Homo sapiens
uacauuuccaaauucaca

SEQ ID NO: 2080596 - RNA, 17 nt, Homo sapiens
caaguaaauuuguauaa

SEQ ID NO: 2080597 - RNA, 21 nt, Homo sapiens
ugccaggggcuucccacuuug

SEQ ID NO: 2080598 - RNA, 22 nt, Homo sapiens
aaugcauuauuuugucauaaaa

SEQ ID NO: 2080599 - RNA, 23 nt, Homo sapiens
aggcaggugaauuguuugaaccu

SEQ ID NO: 2080600 - RNA, 17 nt, Homo sapiens
uuauauuucuguguaca

SEQ ID NO: 2080601 - RNA, 16 nt, Homo sapiens
gcuuucugucugugaa

SEQ ID NO: 2080602 - RNA, 17 nt, Homo sapiens
ccggcugggugagcuga

SEQ ID NO: 2080603 - RNA, 13 nt, Homo sapiens
ugugaaugaucaa

SEQ ID NO: 2080604 - RNA, 19 nt, Homo sapiens
ccauggugcuggggagcca

SEQ ID NO: 2080605 - RNA, 14 nt, Homo sapiens
agaagcuauggaac

SEQ ID NO: 2080606 - RNA, 18 nt, Homo sapiens
aacaggaaggaaccagaa

SEQ ID NO: 2080607 - RNA, 13 nt, Homo sapiens
gccuucuuauauc

SEQ ID NO: 2080608 - RNA, 15 nt, Homo sapiens
aaugucuucuugaaa

SEQ ID NO: 2080609 - RNA, 14 nt, Homo sapiens
uauuuacauauaau

SEQ ID NO: 2080610 - RNA, 18 nt, Homo sapiens
caaaaugggccucaugga

SEQ ID NO: 2080611 - RNA, 20 nt, Homo sapiens
aaccaguccgccgcugcaca

SEQ ID NO: 2080612 - RNA, 23 nt, Homo sapiens
uucagaacauaaaugcacaaaau

SEQ ID NO: 2080613 - RNA, 12 nt, Homo sapiens
auuuuaccuguu

SEQ ID NO: 2080614 - RNA, 16 nt, Homo sapiens
aaguaauauuggcuau

SEQ ID NO: 2080615 - RNA, 19 nt, Homo sapiens
acuuacacaucuuccacag

SEQ ID NO: 2080616 - RNA, 22 nt, Homo sapiens
cgagccucugucacugcaggca

SEQ ID NO: 2080617 - RNA, 17 nt, Homo sapiens
auuuugcauaguaccaa

SEQ ID NO: 2080618 - RNA, 23 nt, Homo sapiens
uacagaccugcuuuuugaaauga

SEQ ID NO: 2080619 - RNA, 19 nt, Homo sapiens
ucauuuuuuccagucuucc

SEQ ID NO: 2080620 - RNA, 14 nt, Homo sapiens
gagggacucaaggg

SEQ ID NO: 2080621 - RNA, 16 nt, Homo sapiens
auuuuccugaauauua

SEQ ID NO: 2080622 - RNA, 21 nt, Homo sapiens
cuauuuguagauuaggauuaa

SEQ ID NO: 2080623 - RNA, 15 nt, Homo sapiens
cugccucccuagcuu

SEQ ID NO: 2080624 - RNA, 13 nt, Homo sapiens
aacuuaacuauca

SEQ ID NO: 2080625 - RNA, 20 nt, Homo sapiens
gagccucgccccuccagugu

SEQ ID NO: 2080626 - RNA, 20 nt, Homo sapiens
gugcuugggaucuucaauga

SEQ ID NO: 2080627 - RNA, 18 nt, Homo sapiens
auuuuaguaagaagacua

SEQ ID NO: 2080628 - RNA, 19 nt, Homo sapiens
uagagaaguuacacagaaa

SEQ ID NO: 2080629 - RNA, 20 nt, Homo sapiens
cugggccaaguuccucuagu

SEQ ID NO: 2080630 - RNA, 21 nt, Homo sapiens
ccaccaucuccagcugaucac

SEQ ID NO: 2080631 - RNA, 18 nt, Homo sapiens
caugaggccuccugccau

SEQ ID NO: 2080632 - RNA, 23 nt, Homo sapiens
cugggaaaaaaguuuugaugaaa

SEQ ID NO: 2080633 - RNA, 20 nt, Homo sapiens
uaaauggaacaaacaaugaa

SEQ ID NO: 2080634 - RNA, 15 nt, Homo sapiens
accugcuucagugaa

SEQ ID NO: 2080635 - RNA, 14 nt, Homo sapiens
aagucaugggagaa

SEQ ID NO: 2080636 - RNA, 15 nt, Homo sapiens
auuucuauaaauaga

SEQ ID NO: 2080637 - RNA, 16 nt, Homo sapiens
cccacugcuggugcca

SEQ ID NO: 2080638 - RNA, 17 nt, Homo sapiens
aauuugaauggugcaga

SEQ ID NO: 2080639 - RNA, 17 nt, Homo sapiens
augccaagcacugugcu

SEQ ID NO: 2080640 - RNA, 15 nt, Homo sapiens
ucaguggcuuugcau

SEQ ID NO: 2080641 - RNA, 18 nt, Homo sapiens
cugcagaccucacuguca

SEQ ID NO: 2080642 - RNA, 18 nt, Homo sapiens
cucuguauacaaaacccu

SEQ ID NO: 2080643 - RNA, 18 nt, Homo sapiens
aagauggcuuuuucuccu

SEQ ID NO: 2080644 - RNA, 22 nt, Homo sapiens
aagggaaucauuuuucacugua

SEQ ID NO: 2080645 - RNA, 19 nt, Homo sapiens
aagcagguggcaucucuaa

SEQ ID NO: 2080646 - RNA, 12 nt, Homo sapiens
auaaguccuugc

SEQ ID NO: 2080647 - RNA, 14 nt, Homo sapiens
uguaauaagcacuu

SEQ ID NO: 2080648 - RNA, 12 nt, Homo sapiens
aaccugccuccc

SEQ ID NO: 2080649 - RNA, 22 nt, Homo sapiens
ucuaaaaagauuagcaagguca

SEQ ID NO: 2080650 - RNA, 17 nt, Homo sapiens
ccaaagggggacaguga

SEQ ID NO: 2080651 - RNA, 20 nt, Homo sapiens
gcuucuuuccagaaaccaaa

SEQ ID NO: 2080652 - RNA, 19 nt, Homo sapiens
aaggccacugcuacaucuc

SEQ ID NO: 2080653 - RNA, 16 nt, Homo sapiens
uacuuuugcacuuuga

SEQ ID NO: 2080654 - RNA, 22 nt, Homo sapiens
ucuuagaugcaguucugaagaa

SEQ ID NO: 2080655 - RNA, 22 nt, Homo sapiens
ggcagucgaguuucuacguggu

SEQ ID NO: 2080656 - RNA, 12 nt, Homo sapiens
cacgcuggacag

SEQ ID NO: 2080657 - RNA, 18 nt, Homo sapiens
cuuuagugcuuugugaua

SEQ ID NO: 2080658 - RNA, 13 nt, Homo sapiens
ugugaagugcaga

SEQ ID NO: 2080659 - RNA, 15 nt, Homo sapiens
ggaagcuacccaagg

SEQ ID NO: 2080660 - RNA, 18 nt, Homo sapiens
uguauuguuaaugcauca

SEQ ID NO: 2080661 - RNA, 13 nt, Homo sapiens
aguguucugggug

SEQ ID NO: 2080662 - RNA, 15 nt, Homo sapiens
auuccuuacauuuac

SEQ ID NO: 2080663 - RNA, 17 nt, Homo sapiens
cacuuacugcaaaggcu

SEQ ID NO: 2080664 - RNA, 22 nt, Homo sapiens
aacuuaccaggcaccaaaagaa

SEQ ID NO: 2080665 - RNA, 19 nt, Homo sapiens
cucaccuuugggcaaaggc

SEQ ID NO: 2080666 - RNA, 13 nt, Homo sapiens
gacggucagucca

SEQ ID NO: 2080667 - RNA, 15 nt, Homo sapiens
gggccacacuaccca

SEQ ID NO: 2080668 - RNA, 23 nt, Homo sapiens
uucaucaauuuuuauacauauca

SEQ ID NO: 2080669 - RNA, 19 nt, Homo sapiens
cuaauuuuaguauucauuc

SEQ ID NO: 2080670 - RNA, 13 nt, Homo sapiens
gccuuugagcuca

SEQ ID NO: 2080671 - RNA, 18 nt, Homo sapiens
uauuucagugaauuugca

SEQ ID NO: 2080672 - RNA, 21 nt, Homo sapiens
ucaccucagagacauacaccu

SEQ ID NO: 2080673 - RNA, 12 nt, Homo sapiens
aggacaccugcc

SEQ ID NO: 2080674 - RNA, 13 nt, Homo sapiens
ccaggauuugcac

SEQ ID NO: 2080675 - RNA, 16 nt, Homo sapiens
cucauuaaugacacuu

SEQ ID NO: 2080676 - RNA, 23 nt, Homo sapiens
gcuacuuuaacaccagguuuaug

SEQ ID NO: 2080677 - RNA, 16 nt, Homo sapiens
acaaccugaaucuuuu

SEQ ID NO: 2080678 - RNA, 14 nt, Homo sapiens
guaauaacugauga

SEQ ID NO: 2080679 - RNA, 19 nt, Homo sapiens
auucuguaucauugauuca

SEQ ID NO: 2080680 - RNA, 19 nt, Homo sapiens
ccucaauuccaacacugau

SEQ ID NO: 2080681 - RNA, 13 nt, Homo sapiens
uacuuauggcuca

SEQ ID NO: 2080682 - RNA, 14 nt, Homo sapiens
accuccacgggcuc

SEQ ID NO: 2080683 - RNA, 19 nt, Homo sapiens
aggcagagaggagccagga

SEQ ID NO: 2080684 - RNA, 14 nt, Homo sapiens
ugagcuaagcauuu

SEQ ID NO: 2080685 - RNA, 19 nt, Homo sapiens
agaauuucugcuaaauauc

SEQ ID NO: 2080686 - RNA, 18 nt, Homo sapiens
uaaaagccaaccuucaaa

SEQ ID NO: 2080687 - RNA, 19 nt, Homo sapiens
aagaaguuaacuacagugu

SEQ ID NO: 2080688 - RNA, 19 nt, Homo sapiens
aggaagcuucaaaacauug

SEQ ID NO: 2080689 - RNA, 20 nt, Homo sapiens
ucacacuuuaaaaaauacac

SEQ ID NO: 2080690 - RNA, 23 nt, Homo sapiens
cacaauauuaaguguuguacaau

SEQ ID NO: 2080691 - RNA, 16 nt, Homo sapiens
agaagaucauugccau

SEQ ID NO: 2080692 - RNA, 20 nt, Homo sapiens
caacauuacuguuaacugug

SEQ ID NO: 2080693 - RNA, 17 nt, Homo sapiens
uagacagaaaccaagcc

SEQ ID NO: 2080694 - RNA, 15 nt, Homo sapiens
ugugcgucucucuuu

SEQ ID NO: 2080695 - RNA, 13 nt, Homo sapiens
agggaccaggugu

SEQ ID NO: 2080696 - RNA, 15 nt, Homo sapiens
augacugaagacagg

SEQ ID NO: 2080697 - RNA, 11 nt, Homo sapiens
ccucuucucaa

SEQ ID NO: 2080698 - RNA, 22 nt, Homo sapiens
aggcagaggcccaggcugccgu

SEQ ID NO: 2080699 - RNA, 20 nt, Homo sapiens
ugccagaugugggcucagau

SEQ ID NO: 2080700 - RNA, 20 nt, Homo sapiens
gugggucucugggcugucag

SEQ ID NO: 2080701 - RNA, 11 nt, Homo sapiens
uaaacuagucu

SEQ ID NO: 2080702 - RNA, 22 nt, Homo sapiens
guuagauaaugaaugauaagca

SEQ ID NO: 2080703 - RNA, 13 nt, Homo sapiens
aaagagcugcaca

SEQ ID NO: 2080704 - RNA, 19 nt, Homo sapiens
ccuucaaaacacucaucuc

SEQ ID NO: 2080705 - RNA, 23 nt, Homo sapiens
caaaccaauuucaaauuauuuug

SEQ ID NO: 2080706 - RNA, 22 nt, Homo sapiens
gggcuccccuucgcguauuuca

SEQ ID NO: 2080707 - RNA, 14 nt, Homo sapiens
cugccuguagcccc

SEQ ID NO: 2080708 - RNA, 23 nt, Homo sapiens
ucuggggaggcaggcauuccuga

SEQ ID NO: 2080709 - RNA, 18 nt, Homo sapiens
cugauucuguuguguuca

SEQ ID NO: 2080710 - RNA, 22 nt, Homo sapiens
cugugcccuccugacccauugc

SEQ ID NO: 2080711 - RNA, 14 nt, Homo sapiens
uugagaaacccaag

SEQ ID NO: 2080712 - RNA, 21 nt, Homo sapiens
ggggccuuccuguguggccug

SEQ ID NO: 2080713 - RNA, 16 nt, Homo sapiens
uaaugccaccaaagga

SEQ ID NO: 2080714 - RNA, 21 nt, Homo sapiens
auauaaugcuugcaccucagg

SEQ ID NO: 2080715 - RNA, 23 nt, Homo sapiens
aaaguuguuuuaucuggugggaa

SEQ ID NO: 2080716 - RNA, 20 nt, Homo sapiens
uuugcaaauaacugaucuca

SEQ ID NO: 2080717 - RNA, 15 nt, Homo sapiens
uuauauguacuguuu

SEQ ID NO: 2080718 - RNA, 20 nt, Homo sapiens
gucugggagaaauugacaga

SEQ ID NO: 2080719 - RNA, 22 nt, Homo sapiens
ugggcaacccccaggucugcag

SEQ ID NO: 2080720 - RNA, 20 nt, Homo sapiens
cauccgcaaauuuucuucca

SEQ ID NO: 2080721 - RNA, 19 nt, Homo sapiens
cacccagcccccacauccu

SEQ ID NO: 2080722 - RNA, 17 nt, Homo sapiens
gaaaaucucagcaauga

SEQ ID NO: 2080723 - RNA, 20 nt, Homo sapiens
uaaccagaucauugugaaau

SEQ ID NO: 2080724 - RNA, 22 nt, Homo sapiens
uaacacgaauccugacaccacc

SEQ ID NO: 2080725 - RNA, 15 nt, Homo sapiens
caaggcuaguuccuu

SEQ ID NO: 2080726 - RNA, 15 nt, Homo sapiens
cccgcuggaccaaag

SEQ ID NO: 2080727 - RNA, 17 nt, Homo sapiens
agcaaagcuuaaaugcc

SEQ ID NO: 2080728 - RNA, 11 nt, Homo sapiens
gguucacacag

SEQ ID NO: 2080729 - RNA, 14 nt, Homo sapiens
aaguugcuaauaca

SEQ ID NO: 2080730 - RNA, 16 nt, Homo sapiens
uggagcaaauguccua

SEQ ID NO: 2080731 - RNA, 22 nt, Homo sapiens
aagcauaugcagccaaccaaga

SEQ ID NO: 2080732 - RNA, 22 nt, Homo sapiens
ucucaucucccugcaaccuccg

SEQ ID NO: 2080733 - RNA, 14 nt, Homo sapiens
auucucaucacuca

SEQ ID NO: 2080734 - RNA, 22 nt, Homo sapiens
gaggaauauuucaagcucugca

SEQ ID NO: 2080735 - RNA, 18 nt, Homo sapiens
uucuaaaacuacugccuu

SEQ ID NO: 2080736 - RNA, 16 nt, Homo sapiens
accuugauugcaccaa

SEQ ID NO: 2080737 - RNA, 12 nt, Homo sapiens
ugggcagggucu

SEQ ID NO: 2080738 - RNA, 22 nt, Homo sapiens
ccucagcccaggucagcuguua

SEQ ID NO: 2080739 - RNA, 16 nt, Homo sapiens
cuaugcuuuggaauac

SEQ ID NO: 2080740 - RNA, 19 nt, Homo sapiens
cagauauacacauggaugc

SEQ ID NO: 2080741 - RNA, 11 nt, Homo sapiens
uuuacauucau

SEQ ID NO: 2080742 - RNA, 15 nt, Homo sapiens
uguaaugcaaaaggc

SEQ ID NO: 2080743 - RNA, 14 nt, Homo sapiens
ccacauaaauuuua

SEQ ID NO: 2080744 - RNA, 21 nt, Homo sapiens
caaugauacccaacaguuuau

SEQ ID NO: 2080745 - RNA, 20 nt, Homo sapiens
acacacuuucugacugcaac

SEQ ID NO: 2080746 - RNA, 21 nt, Homo sapiens
caagcaccacucugggcacaa

SEQ ID NO: 2080747 - RNA, 16 nt, Homo sapiens
guaaauaaaaguacaa

SEQ ID NO: 2080748 - RNA, 14 nt, Homo sapiens
agacuaagaauuag

SEQ ID NO: 2080749 - RNA, 14 nt, Homo sapiens
ucauguuaugauaa

SEQ ID NO: 2080750 - RNA, 15 nt, Homo sapiens
ucaggggacuugaau

SEQ ID NO: 2080751 - RNA, 12 nt, Homo sapiens
auccuguuacuu

SEQ ID NO: 2080752 - RNA, 23 nt, Homo sapiens
ucccaauaacuaaugcuaagaaa

SEQ ID NO: 2080753 - RNA, 21 nt, Homo sapiens
aauuugugugcuucugcucau

SEQ ID NO: 2080754 - RNA, 19 nt, Homo sapiens
cugcuugaccguacucuca

SEQ ID NO: 2080755 - RNA, 14 nt, Homo sapiens
ccacaggcacaggu

SEQ ID NO: 2080756 - RNA, 21 nt, Homo sapiens
aaaaugucucuuguggcccau

SEQ ID NO: 2080757 - RNA, 16 nt, Homo sapiens
uacagaguauauuucc

SEQ ID NO: 2080758 - RNA, 22 nt, Homo sapiens
uaggaggaaaaagaaaugcauu

SEQ ID NO: 2080759 - RNA, 18 nt, Homo sapiens
uguaguaaauaaugcuuu

SEQ ID NO: 2080760 - RNA, 18 nt, Homo sapiens
aaaccaugacugaggcag

SEQ ID NO: 2080761 - RNA, 13 nt, Homo sapiens
aucaaaacauauc

SEQ ID NO: 2080762 - RNA, 18 nt, Homo sapiens
gaaaaggguuucuugaca

SEQ ID NO: 2080763 - RNA, 11 nt, Homo sapiens
agccggagccu

SEQ ID NO: 2080764 - RNA, 13 nt, Homo sapiens
aaggaccaauagc

SEQ ID NO: 2080765 - RNA, 22 nt, Homo sapiens
cuuugcccccgacggcugugac

SEQ ID NO: 2080766 - RNA, 18 nt, Homo sapiens
cacuggucgagagccaaa

SEQ ID NO: 2080767 - RNA, 13 nt, Homo sapiens
uggacuugucuuc

SEQ ID NO: 2080768 - RNA, 14 nt, Homo sapiens
gcaguccucaggaa

SEQ ID NO: 2080769 - RNA, 20 nt, Homo sapiens
uaaacuaguaugaaauaacg

SEQ ID NO: 2080770 - RNA, 17 nt, Homo sapiens
aaauggcuuccuggcaa

SEQ ID NO: 2080771 - RNA, 13 nt, Homo sapiens
uaaguaaacugcc

SEQ ID NO: 2080772 - RNA, 23 nt, Homo sapiens
cauacaagcauaagcaaaacuua

SEQ ID NO: 2080773 - RNA, 15 nt, Homo sapiens
caaacuccuauuuca

SEQ ID NO: 2080774 - RNA, 14 nt, Homo sapiens
gcaagucaggacau

SEQ ID NO: 2080775 - RNA, 18 nt, Homo sapiens
cugccucuuucccuagga

SEQ ID NO: 2080776 - RNA, 16 nt, Homo sapiens
ugugaaauuuacauca

SEQ ID NO: 2080777 - RNA, 17 nt, Homo sapiens
acaaguggcucaucauc

SEQ ID NO: 2080778 - RNA, 20 nt, Homo sapiens
guggauaaauuuuggaagaa

SEQ ID NO: 2080779 - RNA, 19 nt, Homo sapiens
gucacuuuuagaugugguu

SEQ ID NO: 2080780 - RNA, 12 nt, Homo sapiens
acguuugauaca

SEQ ID NO: 2080781 - RNA, 13 nt, Homo sapiens
ccagaaagcaguu

SEQ ID NO: 2080782 - RNA, 17 nt, Homo sapiens
uuuuauuugcaacuuua

SEQ ID NO: 2080783 - RNA, 15 nt, Homo sapiens
ucagggagcauuuau

SEQ ID NO: 2080784 - RNA, 18 nt, Homo sapiens
gcuggaaccugcaaaaaa

SEQ ID NO: 2080785 - RNA, 16 nt, Homo sapiens
gagguggggccuggag

SEQ ID NO: 2080786 - RNA, 14 nt, Homo sapiens
aagggcuacuuaau

SEQ ID NO: 2080787 - RNA, 22 nt, Homo sapiens
acauauaaaugaaucugguguu

SEQ ID NO: 2080788 - RNA, 13 nt, Homo sapiens
uagacugugccag

SEQ ID NO: 2080789 - RNA, 20 nt, Homo sapiens
cuuuacuucauggacuucca

SEQ ID NO: 2080790 - RNA, 21 nt, Homo sapiens
gugauucuguuuauucuucca

SEQ ID NO: 2080791 - RNA, 16 nt, Homo sapiens
ucuuguuuaacauaua

SEQ ID NO: 2080792 - RNA, 17 nt, Homo sapiens
gucucuccugaugcuca

SEQ ID NO: 2080793 - RNA, 16 nt, Homo sapiens
uggaaaugacccaaac

SEQ ID NO: 2080794 - RNA, 14 nt, Homo sapiens
caaugccauuucag

SEQ ID NO: 2080795 - RNA, 18 nt, Homo sapiens
acgaauauggacauauca

SEQ ID NO: 2080796 - RNA, 15 nt, Homo sapiens
ccucucaggagccau

SEQ ID NO: 2080797 - RNA, 12 nt, Homo sapiens
aagaaaguguau

SEQ ID NO: 2080798 - RNA, 11 nt, Homo sapiens
uuuaacugucc

SEQ ID NO: 2080799 - RNA, 22 nt, Homo sapiens
aucucucccuccccugccauuu

SEQ ID NO: 2080800 - RNA, 17 nt, Homo sapiens
gcuuuuccauucugggu

SEQ ID NO: 2080801 - RNA, 13 nt, Homo sapiens
ccugagaccucaa

SEQ ID NO: 2080802 - RNA, 13 nt, Homo sapiens
uuugagacuccaa

SEQ ID NO: 2080803 - RNA, 12 nt, Homo sapiens
ugucucagcaau

SEQ ID NO: 2080804 - RNA, 17 nt, Homo sapiens
gggcagagcucagagga

SEQ ID NO: 2080805 - RNA, 16 nt, Homo sapiens
aggaaaaauagcaaca

SEQ ID NO: 2080806 - RNA, 16 nt, Homo sapiens
ggccucugagaagcuc

SEQ ID NO: 2080807 - RNA, 14 nt, Homo sapiens
uggccacacuggaa

SEQ ID NO: 2080808 - RNA, 14 nt, Homo sapiens
cgugcccauuucac

SEQ ID NO: 2080809 - RNA, 12 nt, Homo sapiens
caaaauauguca

SEQ ID NO: 2080810 - RNA, 18 nt, Homo sapiens
cagcaggccuuucgaucc

SEQ ID NO: 2080811 - RNA, 13 nt, Homo sapiens
acaucuuuuacau

SEQ ID NO: 2080812 - RNA, 13 nt, Homo sapiens
auugcagacuguu

SEQ ID NO: 2080813 - RNA, 15 nt, Homo sapiens
ugcuguuuugccagc

SEQ ID NO: 2080814 - RNA, 16 nt, Homo sapiens
ucugugaugcucccaa

SEQ ID NO: 2080815 - RNA, 22 nt, Homo sapiens
uuugauaccauggcacugacaa

SEQ ID NO: 2080816 - RNA, 17 nt, Homo sapiens
uuaaaagguccaguucu

SEQ ID NO: 2080817 - RNA, 18 nt, Homo sapiens
aagcgggugguggcucug

SEQ ID NO: 2080818 - RNA, 18 nt, Homo sapiens
cagagcugcagccaguca

SEQ ID NO: 2080819 - RNA, 19 nt, Homo sapiens
caauguuaaagaugcacag

SEQ ID NO: 2080820 - RNA, 18 nt, Homo sapiens
guguuuuaaaacaacaac

SEQ ID NO: 2080821 - RNA, 15 nt, Homo sapiens
gaccuccagcuuucc

SEQ ID NO: 2080822 - RNA, 23 nt, Homo sapiens
gugagcguagcagcucagcucuu

SEQ ID NO: 2080823 - RNA, 14 nt, Homo sapiens
augcuggucauccu

SEQ ID NO: 2080824 - RNA, 23 nt, Homo sapiens
uguggggccucaggcuccgggca

SEQ ID NO: 2080825 - RNA, 14 nt, Homo sapiens
aaggaaaacaguaa

SEQ ID NO: 2080826 - RNA, 19 nt, Homo sapiens
guauguaaaagaaaaucca

SEQ ID NO: 2080827 - RNA, 14 nt, Homo sapiens
cuuucucucucuaa

SEQ ID NO: 2080828 - RNA, 23 nt, Homo sapiens
agagcaaagacuuaaucauauca

SEQ ID NO: 2080829 - RNA, 15 nt, Homo sapiens
cugaaguuucauuua

SEQ ID NO: 2080830 - RNA, 14 nt, Homo sapiens
gcagucaagcccug

SEQ ID NO: 2080831 - RNA, 14 nt, Homo sapiens
uaaaaagccugcau

SEQ ID NO: 2080832 - RNA, 23 nt, Homo sapiens
uucaguacuugugaaacacagcu

SEQ ID NO: 2080833 - RNA, 14 nt, Homo sapiens
ugcuuaaauugugg

SEQ ID NO: 2080834 - RNA, 23 nt, Homo sapiens
cacuguggagacuuucuguuacu

SEQ ID NO: 2080835 - RNA, 16 nt, Homo sapiens
uguucacucagcacuu

SEQ ID NO: 2080836 - RNA, 13 nt, Homo sapiens
ucacaucuuggca

SEQ ID NO: 2080837 - RNA, 21 nt, Homo sapiens
gcugcacugaucacccaaugc

SEQ ID NO: 2080838 - RNA, 20 nt, Homo sapiens
acugcugggggugagcugua

SEQ ID NO: 2080839 - RNA, 21 nt, Homo sapiens
cucugcagcccacagaggaca

SEQ ID NO: 2080840 - RNA, 20 nt, Homo sapiens
augcacacacacacaucuca

SEQ ID NO: 2080841 - RNA, 16 nt, Homo sapiens
uaauuuucuuuccgac

SEQ ID NO: 2080842 - RNA, 16 nt, Homo sapiens
accaucccagcacugc

SEQ ID NO: 2080843 - RNA, 13 nt, Homo sapiens
aggaaaauuccau

SEQ ID NO: 2080844 - RNA, 22 nt, Homo sapiens
ggaaucaauucaauuuggacug

SEQ ID NO: 2080845 - RNA, 22 nt, Homo sapiens
cauguuuuccagcuccucaucc

SEQ ID NO: 2080846 - RNA, 14 nt, Homo sapiens
gugaaaucaaugug

SEQ ID NO: 2080847 - RNA, 19 nt, Homo sapiens
caaaacuguaacugcauua

SEQ ID NO: 2080848 - RNA, 17 nt, Homo sapiens
cuccuauacuauugaag

SEQ ID NO: 2080849 - RNA, 18 nt, Homo sapiens
ccauagcagcagugcaug

SEQ ID NO: 2080850 - RNA, 13 nt, Homo sapiens
cuauguacuguaa

SEQ ID NO: 2080851 - RNA, 21 nt, Homo sapiens
gacuauugacaucagcaucac

SEQ ID NO: 2080852 - RNA, 18 nt, Homo sapiens
cauacugaucccuuuccc

SEQ ID NO: 2080853 - RNA, 14 nt, Homo sapiens
ugucaacagaauuu

SEQ ID NO: 2080854 - RNA, 21 nt, Homo sapiens
uuucuccuucccaaggcagcu

SEQ ID NO: 2080855 - RNA, 17 nt, Homo sapiens
ucaccugacugcaauga

SEQ ID NO: 2080856 - RNA, 13 nt, Homo sapiens
ccugccuucucag

SEQ ID NO: 2080857 - RNA, 17 nt, Homo sapiens
ccaugucucgacucauc

SEQ ID NO: 2080858 - RNA, 19 nt, Homo sapiens
gaaauauuuuacaguuuuu

SEQ ID NO: 2080859 - RNA, 11 nt, Homo sapiens
uacauucugua

SEQ ID NO: 2080860 - RNA, 18 nt, Homo sapiens
acacauuucacugugaug

SEQ ID NO: 2080861 - RNA, 23 nt, Homo sapiens
acaucucugcaguuuuucccaag

SEQ ID NO: 2080862 - RNA, 15 nt, Homo sapiens
aggcagaaagcaaaa

SEQ ID NO: 2080863 - RNA, 16 nt, Homo sapiens
cauguggcuuuuuuaa

SEQ ID NO: 2080864 - RNA, 15 nt, Homo sapiens
aauuuuauuacauau

SEQ ID NO: 2080865 - RNA, 22 nt, Homo sapiens
aaugcaccuagcugugcaagac

SEQ ID NO: 2080866 - RNA, 13 nt, Homo sapiens
uguaauguguacu

SEQ ID NO: 2080867 - RNA, 20 nt, Homo sapiens
cagagaucucuguagaagga

SEQ ID NO: 2080868 - RNA, 15 nt, Homo sapiens
ugggcuuccugauga

SEQ ID NO: 2080869 - RNA, 13 nt, Homo sapiens
agcuuacuacagu

SEQ ID NO: 2080870 - RNA, 13 nt, Homo sapiens
caaauaauuauca

SEQ ID NO: 2080871 - RNA, 11 nt, Homo sapiens
uacuauuucau

SEQ ID NO: 2080872 - RNA, 19 nt, Homo sapiens
aagcuuuugguaauauuca

SEQ ID NO: 2080873 - RNA, 18 nt, Homo sapiens
cuguuuaauuccuggaaa

SEQ ID NO: 2080874 - RNA, 16 nt, Homo sapiens
uuuucacauaugacaa

SEQ ID NO: 2080875 - RNA, 20 nt, Homo sapiens
guuggaagugagggucagag

SEQ ID NO: 2080876 - RNA, 17 nt, Homo sapiens
agggaauaauccagaaa

SEQ ID NO: 2080877 - RNA, 16 nt, Homo sapiens
accuauuucugaugau

SEQ ID NO: 2080878 - RNA, 20 nt, Homo sapiens
agaacacaugugcagucacu

SEQ ID NO: 2080879 - RNA, 22 nt, Homo sapiens
aaacuuaucacgccuacuuaag

SEQ ID NO: 2080880 - RNA, 19 nt, Homo sapiens
uaaucccacccaccucacc

SEQ ID NO: 2080881 - RNA, 16 nt, Homo sapiens
ucugaggccucagagu

SEQ ID NO: 2080882 - RNA, 14 nt, Homo sapiens
aaaccucuucacgg

SEQ ID NO: 2080883 - RNA, 16 nt, Homo sapiens
uaauuuucaagcaaag

SEQ ID NO: 2080884 - RNA, 18 nt, Homo sapiens
gccuccugacucacugac

SEQ ID NO: 2080885 - RNA, 23 nt, Homo sapiens
cacaauccuguggaucugggcaa

SEQ ID NO: 2080886 - RNA, 17 nt, Homo sapiens
cccagccagcaguucag

SEQ ID NO: 2080887 - RNA, 17 nt, Homo sapiens
caggaaaagguccuuga

SEQ ID NO: 2080888 - RNA, 18 nt, Homo sapiens
uuccacuccuuccagaac

SEQ ID NO: 2080889 - RNA, 13 nt, Homo sapiens
ccagcacuugaau

SEQ ID NO: 2080890 - RNA, 20 nt, Homo sapiens
ccuaaauauacaucugugua

SEQ ID NO: 2080891 - RNA, 23 nt, Homo sapiens
augugccugcuucagccucccac

SEQ ID NO: 2080892 - RNA, 15 nt, Homo sapiens
cagcgauggcaguga

SEQ ID NO: 2080893 - RNA, 16 nt, Homo sapiens
cucuggagcaauguug

SEQ ID NO: 2080894 - RNA, 16 nt, Homo sapiens
cuauuguucacuuuau

SEQ ID NO: 2080895 - RNA, 20 nt, Homo sapiens
cuuucuguacuaaacauuuc

SEQ ID NO: 2080896 - RNA, 19 nt, Homo sapiens
aaaauucagguauuacuga

SEQ ID NO: 2080897 - RNA, 18 nt, Homo sapiens
uauuugacuuaccaugga

SEQ ID NO: 2080898 - RNA, 21 nt, Homo sapiens
accaaaaacaaaaaccaaaug

SEQ ID NO: 2080899 - RNA, 11 nt, Homo sapiens
augauuuuccu

SEQ ID NO: 2080900 - RNA, 14 nt, Homo sapiens
gcaauaaauauuag

SEQ ID NO: 2080901 - RNA, 14 nt, Homo sapiens
uuucugaugauguc

SEQ ID NO: 2080902 - RNA, 20 nt, Homo sapiens
uaagaagaggagccucagaa

SEQ ID NO: 2080903 - RNA, 21 nt, Homo sapiens
cuuauuacaauuuguucaucc

SEQ ID NO: 2080904 - RNA, 21 nt, Homo sapiens
ccucuuuuucugaagcuacuu

SEQ ID NO: 2080905 - RNA, 19 nt, Homo sapiens
uggggagggagagccauca

SEQ ID NO: 2080906 - RNA, 13 nt, Homo sapiens
ccuccucaugaaa

SEQ ID NO: 2080907 - RNA, 21 nt, Homo sapiens
ccuaguuccauucuuggucaa

SEQ ID NO: 2080908 - RNA, 18 nt, Homo sapiens
gucgcaucucagugcagg

SEQ ID NO: 2080909 - RNA, 20 nt, Homo sapiens
cucucuugauuaagaucuca

SEQ ID NO: 2080910 - RNA, 17 nt, Homo sapiens
ucugcagacuggcaguc

SEQ ID NO: 2080911 - RNA, 14 nt, Homo sapiens
ccagugccuacauc

SEQ ID NO: 2080912 - RNA, 18 nt, Homo sapiens
auuaauucucagauuccu

SEQ ID NO: 2080913 - RNA, 15 nt, Homo sapiens
ugagcgcaagccaca

SEQ ID NO: 2080914 - RNA, 15 nt, Homo sapiens
uaaauuaacucacua

SEQ ID NO: 2080915 - RNA, 14 nt, Homo sapiens
gaacaauucaagaa

SEQ ID NO: 2080916 - RNA, 14 nt, Homo sapiens
gcucccuuccugcc

SEQ ID NO: 2080917 - RNA, 21 nt, Homo sapiens
ccuggagcagccaccccaugc

SEQ ID NO: 2080918 - RNA, 17 nt, Homo sapiens
gacacuuuuuggacuca

SEQ ID NO: 2080919 - RNA, 16 nt, Homo sapiens
agucaauccugucaua

SEQ ID NO: 2080920 - RNA, 14 nt, Homo sapiens
gugagggcaagagg

SEQ ID NO: 2080921 - RNA, 14 nt, Homo sapiens
guaaaagcaaaaaa

SEQ ID NO: 2080922 - RNA, 17 nt, Homo sapiens
uucuauuuuaugaaccu

SEQ ID NO: 2080923 - RNA, 14 nt, Homo sapiens
gacagcauccucuc

SEQ ID NO: 2080924 - RNA, 24 nt, Homo sapiens
uaauuuccacuugggacuagauca

SEQ ID NO: 2080925 - RNA, 22 nt, Homo sapiens
agagagucgcaucucagugcag

SEQ ID NO: 2080926 - RNA, 23 nt, Homo sapiens
ucaacgcuuaaaggugucuuccu

SEQ ID NO: 2080927 - RNA, 20 nt, Homo sapiens
gccacauguccuccaucagg

SEQ ID NO: 2080928 - RNA, 18 nt, Homo sapiens
agacaugguauugacuca

SEQ ID NO: 2080929 - RNA, 15 nt, Homo sapiens
acaauaauucaucaa

SEQ ID NO: 2080930 - RNA, 23 nt, Homo sapiens
caucuuuguggcgggagugcuca

SEQ ID NO: 2080931 - RNA, 22 nt, Homo sapiens
ccgccagcgaacuugacaauug

SEQ ID NO: 2080932 - RNA, 21 nt, Homo sapiens
uuguaccauauagagguguaa

SEQ ID NO: 2080933 - RNA, 9 nt, Homo sapiens
ucugggcuu

SEQ ID NO: 2080934 - RNA, 17 nt, Homo sapiens
aggaaaaauauugaacu

SEQ ID NO: 2080935 - RNA, 14 nt, Homo sapiens
gaaagaaaaccugg

SEQ ID NO: 2080936 - RNA, 13 nt, Homo sapiens
gugugugccucau

SEQ ID NO: 2080937 - RNA, 18 nt, Homo sapiens
aaacccagagcggaagga

SEQ ID NO: 2080938 - RNA, 15 nt, Homo sapiens
ugaaugcggcccaac

SEQ ID NO: 2080939 - RNA, 14 nt, Homo sapiens
uugaagcccaagaa

SEQ ID NO: 2080940 - RNA, 17 nt, Homo sapiens
aaaugaaaaugucuugu

SEQ ID NO: 2080941 - RNA, 15 nt, Homo sapiens
acuauguccagcuag

SEQ ID NO: 2080942 - RNA, 11 nt, Homo sapiens
uccaaccacug

SEQ ID NO: 2080943 - RNA, 14 nt, Homo sapiens
gcucuuaugccauu

SEQ ID NO: 2080944 - RNA, 20 nt, Homo sapiens
gcaguaaaguuccaugaaga

SEQ ID NO: 2080945 - RNA, 21 nt, Homo sapiens
aggcaaauccgaaaucagcag

SEQ ID NO: 2080946 - RNA, 14 nt, Homo sapiens
uaccaagaucacaa

SEQ ID NO: 2080947 - RNA, 16 nt, Homo sapiens
accugcccucucucag

SEQ ID NO: 2080948 - RNA, 15 nt, Homo sapiens
uauacaguccuagag

SEQ ID NO: 2080949 - RNA, 20 nt, Homo sapiens
cuauuuuuuuccuccuuugc

SEQ ID NO: 2080950 - RNA, 22 nt, Homo sapiens
gccaugagaugauacauccaaa

SEQ ID NO: 2080951 - RNA, 17 nt, Homo sapiens
ugacagagcgagacucc

SEQ ID NO: 2080952 - RNA, 16 nt, Homo sapiens
cacuccaagugcccca

SEQ ID NO: 2080953 - RNA, 19 nt, Homo sapiens
cuugugcuucuucacuuac

SEQ ID NO: 2080954 - RNA, 13 nt, Homo sapiens
caaacgagacuuu

SEQ ID NO: 2080955 - RNA, 19 nt, Homo sapiens
aaaguccugucaccaagga

SEQ ID NO: 2080956 - RNA, 13 nt, Homo sapiens
gaauaaauaccuc

SEQ ID NO: 2080957 - RNA, 16 nt, Homo sapiens
ugcacuagccaaccca

SEQ ID NO: 2080958 - RNA, 13 nt, Homo sapiens
agcaacccuguga

SEQ ID NO: 2080959 - RNA, 19 nt, Homo sapiens
ucccuaggggacacuuccc

SEQ ID NO: 2080960 - RNA, 18 nt, Homo sapiens
caguacucccuuccauac

SEQ ID NO: 2080961 - RNA, 15 nt, Homo sapiens
auauaauucuguaca

SEQ ID NO: 2080962 - RNA, 20 nt, Homo sapiens
caaaaacaacagccaaaaca

SEQ ID NO: 2080963 - RNA, 18 nt, Homo sapiens
ggcaaaugccugacucag

SEQ ID NO: 2080964 - RNA, 18 nt, Homo sapiens
uauuaaguaugauugaca

SEQ ID NO: 2080965 - RNA, 16 nt, Homo sapiens
gaaccccuuucccacc

SEQ ID NO: 2080966 - RNA, 19 nt, Homo sapiens
cucgaaaaagaaucugcuu

SEQ ID NO: 2080967 - RNA, 18 nt, Homo sapiens
ugccccgcuauuccucac

SEQ ID NO: 2080968 - RNA, 22 nt, Homo sapiens
uuccugccugcggaccagauga

SEQ ID NO: 2080969 - RNA, 19 nt, Homo sapiens
gaucacgccauugcacucc

SEQ ID NO: 2080970 - RNA, 17 nt, Homo sapiens
cuccuauugaaagacca

SEQ ID NO: 2080971 - RNA, 13 nt, Homo sapiens
agaugaccugcug

SEQ ID NO: 2080972 - RNA, 22 nt, Homo sapiens
ugcuaaagcacuuugcacuuaa

SEQ ID NO: 2080973 - RNA, 16 nt, Homo sapiens
agccaugucugugcug

SEQ ID NO: 2080974 - RNA, 14 nt, Homo sapiens
ggaacacugcacuc

SEQ ID NO: 2080975 - RNA, 19 nt, Homo sapiens
aaggcccucuauuucucuc

SEQ ID NO: 2080976 - RNA, 19 nt, Homo sapiens
uccauggccagcagcaccu

SEQ ID NO: 2080977 - RNA, 20 nt, Homo sapiens
ugauuagacagaacaccuau

SEQ ID NO: 2080978 - RNA, 22 nt, Homo sapiens
ccauuuuuuuuaaguuugacua

SEQ ID NO: 2080979 - RNA, 14 nt, Homo sapiens
cuuucugcaugcuu

SEQ ID NO: 2080980 - RNA, 17 nt, Homo sapiens
uaacaaauugcauuugu

SEQ ID NO: 2080981 - RNA, 14 nt, Homo sapiens
agugcauguggaaa

SEQ ID NO: 2080982 - RNA, 17 nt, Homo sapiens
uuccuguugaaucuugc

SEQ ID NO: 2080983 - RNA, 18 nt, Homo sapiens
cucauucccaacgugcaa

SEQ ID NO: 2080984 - RNA, 19 nt, Homo sapiens
acuguuccaaagccaguga

SEQ ID NO: 2080985 - RNA, 15 nt, Homo sapiens
ccuacagauagucaa

SEQ ID NO: 2080986 - RNA, 13 nt, Homo sapiens
caaaaacaacaac

SEQ ID NO: 2080987 - RNA, 23 nt, Homo sapiens
uuuuuccuuccuuaucacugaca

SEQ ID NO: 2080988 - RNA, 12 nt, Homo sapiens
aaaggggacaag

SEQ ID NO: 2080989 - RNA, 17 nt, Homo sapiens
cagggagggaaguguga

SEQ ID NO: 2080990 - RNA, 16 nt, Homo sapiens
gaguguuauuugcaca

SEQ ID NO: 2080991 - RNA, 17 nt, Homo sapiens
cauuucaugaagcaaga

SEQ ID NO: 2080992 - RNA, 15 nt, Homo sapiens
uauuuuauugagcaa

SEQ ID NO: 2080993 - RNA, 20 nt, Homo sapiens
accaagaguagcaccuucag

SEQ ID NO: 2080994 - RNA, 13 nt, Homo sapiens
uuccucaggguuc

SEQ ID NO: 2080995 - RNA, 16 nt, Homo sapiens
aaaacugauguuacua

SEQ ID NO: 2080996 - RNA, 13 nt, Homo sapiens
uugcauugcagag

SEQ ID NO: 2080997 - RNA, 22 nt, Homo sapiens
cuccacucaguugcaacuugga

SEQ ID NO: 2080998 - RNA, 13 nt, Homo sapiens
aaagaccuaccua

SEQ ID NO: 2080999 - RNA, 15 nt, Homo sapiens
gagcgagacugucuc

SEQ ID NO: 2081000 - RNA, 23 nt, Homo sapiens
auuagcuuuaauuaagcucucau

SEQ ID NO: 2081001 - RNA, 13 nt, Homo sapiens
acuguguuugcau

SEQ ID NO: 2081002 - RNA, 13 nt, Homo sapiens
acccccagcucaa

SEQ ID NO: 2081003 - RNA, 20 nt, Homo sapiens
ugggaggagagccacugggc

SEQ ID NO: 2081004 - RNA, 19 nt, Homo sapiens
uuaaauugcagaugguuaa

SEQ ID NO: 2081005 - RNA, 21 nt, Homo sapiens
ucacaauuucugggugaugaa

SEQ ID NO: 2081006 - RNA, 15 nt, Homo sapiens
auguucuaaggcucu

SEQ ID NO: 2081007 - RNA, 15 nt, Homo sapiens
ugcccuaagaacuuu

SEQ ID NO: 2081008 - RNA, 20 nt, Homo sapiens
gcuaagaugggaugugccga

SEQ ID NO: 2081009 - RNA, 17 nt, Homo sapiens
gcaucaguagcaucugu

SEQ ID NO: 2081010 - RNA, 18 nt, Homo sapiens
cacgugauggaccaaagc

SEQ ID NO: 2081011 - RNA, 12 nt, Homo sapiens
ggccaagcugaa

SEQ ID NO: 2081012 - RNA, 19 nt, Homo sapiens
ccagauucaugcacuguag

SEQ ID NO: 2081013 - RNA, 13 nt, Homo sapiens
cugcagcacuuua

SEQ ID NO: 2081014 - RNA, 16 nt, Homo sapiens
uggcccauaaugugaa

SEQ ID NO: 2081015 - RNA, 13 nt, Homo sapiens
acuucgacuguga

SEQ ID NO: 2081016 - RNA, 18 nt, Homo sapiens
cugagcuuuguguagcuc

SEQ ID NO: 2081017 - RNA, 17 nt, Homo sapiens
guacauuguauucuguu

SEQ ID NO: 2081018 - RNA, 15 nt, Homo sapiens
cuuguguuugcugcu

SEQ ID NO: 2081019 - RNA, 13 nt, Homo sapiens
ugagcaaccaguu

SEQ ID NO: 2081020 - RNA, 16 nt, Homo sapiens
ggaauaacaacuuuca

SEQ ID NO: 2081021 - RNA, 23 nt, Homo sapiens
accaaaacuaguucaaaugauga

SEQ ID NO: 2081022 - RNA, 16 nt, Homo sapiens
gaaaaugcgaacaacc

SEQ ID NO: 2081023 - RNA, 14 nt, Homo sapiens
ccugguuuccugcc

SEQ ID NO: 2081024 - RNA, 19 nt, Homo sapiens
gccucucucuugcuuacaa

SEQ ID NO: 2081025 - RNA, 13 nt, Homo sapiens
uaguagagcaaag

SEQ ID NO: 2081026 - RNA, 12 nt, Homo sapiens
ucagauagagau

SEQ ID NO: 2081027 - RNA, 15 nt, Homo sapiens
aaauuuuaaucaaaa

SEQ ID NO: 2081028 - RNA, 11 nt, Homo sapiens
aaaacauuccc

SEQ ID NO: 2081029 - RNA, 14 nt, Homo sapiens
caauaccaauguuc

SEQ ID NO: 2081030 - RNA, 11 nt, Homo sapiens
aaccccacugc

SEQ ID NO: 2081031 - RNA, 18 nt, Homo sapiens
ggucccaggcuucccaaa

SEQ ID NO: 2081032 - RNA, 11 nt, Homo sapiens
aggcagcacuu

SEQ ID NO: 2081033 - RNA, 22 nt, Homo sapiens
cccagaggagccaccaguucuc

SEQ ID NO: 2081034 - RNA, 10 nt, Homo sapiens
cucuguccac

SEQ ID NO: 2081035 - RNA, 19 nt, Homo sapiens
uucugccuugaaauaccug

SEQ ID NO: 2081036 - RNA, 14 nt, Homo sapiens
uauuguggugccac

SEQ ID NO: 2081037 - RNA, 19 nt, Homo sapiens
guaggcugucugugccaug

SEQ ID NO: 2081038 - RNA, 15 nt, Homo sapiens
uuuuguguuccucuu

SEQ ID NO: 2081039 - RNA, 23 nt, Homo sapiens
cuuggggacuaacccaaugccug

SEQ ID NO: 2081040 - RNA, 14 nt, Homo sapiens
ugugauucuuugag

SEQ ID NO: 2081041 - RNA, 16 nt, Homo sapiens
uaaguuguuauuucag

SEQ ID NO: 2081042 - RNA, 19 nt, Homo sapiens
acccagacuggagugcagu

SEQ ID NO: 2081043 - RNA, 21 nt, Homo sapiens
uuugcugucacuuucucucuu

SEQ ID NO: 2081044 - RNA, 10 nt, Homo sapiens
acugccagug

SEQ ID NO: 2081045 - RNA, 15 nt, Homo sapiens
aaucagacucuuuag

SEQ ID NO: 2081046 - RNA, 16 nt, Homo sapiens
ccuauuaaaacacagc

SEQ ID NO: 2081047 - RNA, 21 nt, Homo sapiens
auuuacuuagcagaaccacau

SEQ ID NO: 2081048 - RNA, 17 nt, Homo sapiens
cccuaaaucuugacuac

SEQ ID NO: 2081049 - RNA, 22 nt, Homo sapiens
ccuccauuugcaauugaccucu

SEQ ID NO: 2081050 - RNA, 20 nt, Homo sapiens
ucuauucuuuguaccaucug

SEQ ID NO: 2081051 - RNA, 16 nt, Homo sapiens
ugucgggaauuuuccc

SEQ ID NO: 2081052 - RNA, 15 nt, Homo sapiens
acuucugcuuuccac

SEQ ID NO: 2081053 - RNA, 15 nt, Homo sapiens
acuuuugcuuucuac

SEQ ID NO: 2081054 - RNA, 15 nt, Homo sapiens
aagcaccugcucaac

SEQ ID NO: 2081055 - RNA, 14 nt, Homo sapiens
aaaucugcugcacc

SEQ ID NO: 2081056 - RNA, 17 nt, Homo sapiens
cugcaaaucugccugau

SEQ ID NO: 2081057 - RNA, 20 nt, Homo sapiens
aaagaccagggcuuuuccca

SEQ ID NO: 2081058 - RNA, 13 nt, Homo sapiens
uaugugaaugcuc

SEQ ID NO: 2081059 - RNA, 19 nt, Homo sapiens
caccaaggaaauauugaga

SEQ ID NO: 2081060 - RNA, 21 nt, Homo sapiens
agauuaaccuucucuguccga

SEQ ID NO: 2081061 - RNA, 20 nt, Homo sapiens
ugcgcucggccugcucgccc

SEQ ID NO: 2081062 - RNA, 19 nt, Homo sapiens
cucuucaacaugacaucca

SEQ ID NO: 2081063 - RNA, 16 nt, Homo sapiens
aaaccagggaugucug

SEQ ID NO: 2081064 - RNA, 17 nt, Homo sapiens
auguugcuuuugcaccu

SEQ ID NO: 2081065 - RNA, 22 nt, Homo sapiens
ugcuucaaauaaaguccugaca

SEQ ID NO: 2081066 - RNA, 15 nt, Homo sapiens
gucauaaaugucaca

SEQ ID NO: 2081067 - RNA, 20 nt, Homo sapiens
aaacucacugaaucuaacca

SEQ ID NO: 2081068 - RNA, 17 nt, Homo sapiens
ggcaauauuauguaacc

SEQ ID NO: 2081069 - RNA, 15 nt, Homo sapiens
cugcauuuagcacaa

SEQ ID NO: 2081070 - RNA, 21 nt, Homo sapiens
cuuagagugggaccaacuucc

SEQ ID NO: 2081071 - RNA, 18 nt, Homo sapiens
ucuaaauuuuaauugcac

SEQ ID NO: 2081072 - RNA, 18 nt, Homo sapiens
gacacgugauggaccaaa

SEQ ID NO: 2081073 - RNA, 22 nt, Homo sapiens
auauguacauaggcagcacuag

SEQ ID NO: 2081074 - RNA, 20 nt, Homo sapiens
aguccuggaagccagcuuuc

SEQ ID NO: 2081075 - RNA, 15 nt, Homo sapiens
agcuugcaguuucau

SEQ ID NO: 2081076 - RNA, 22 nt, Homo sapiens
cucaauguuucuggacauucuc

SEQ ID NO: 2081077 - RNA, 18 nt, Homo sapiens
ucccagaagggaguugcu

SEQ ID NO: 2081078 - RNA, 15 nt, Homo sapiens
uccaucuucuuugca

SEQ ID NO: 2081079 - RNA, 13 nt, Homo sapiens
aaucaccacucaa

SEQ ID NO: 2081080 - RNA, 22 nt, Homo sapiens
cauaauuuuuauuuuuggcaaa

SEQ ID NO: 2081081 - RNA, 13 nt, Homo sapiens
ggugcccacaggc

SEQ ID NO: 2081082 - RNA, 18 nt, Homo sapiens
agcuguuauuuuuaggca

SEQ ID NO: 2081083 - RNA, 20 nt, Homo sapiens
cacuguggaacacuaaagag

SEQ ID NO: 2081084 - RNA, 18 nt, Homo sapiens
agcucagcauuuccacac

SEQ ID NO: 2081085 - RNA, 22 nt, Homo sapiens
uccugagucaccccucugucca

SEQ ID NO: 2081086 - RNA, 19 nt, Homo sapiens
uaaaauugcuucuuuacca

SEQ ID NO: 2081087 - RNA, 17 nt, Homo sapiens
ggaaaggacaguguggg

SEQ ID NO: 2081088 - RNA, 16 nt, Homo sapiens
aacccacgaggaccau

SEQ ID NO: 2081089 - RNA, 12 nt, Homo sapiens
uaauuaacaaua

SEQ ID NO: 2081090 - RNA, 17 nt, Homo sapiens
agcugugcaugcucagc

SEQ ID NO: 2081091 - RNA, 13 nt, Homo sapiens
uaagauucuugac

SEQ ID NO: 2081092 - RNA, 15 nt, Homo sapiens
ggguucaucuaggga

SEQ ID NO: 2081093 - RNA, 23 nt, Homo sapiens
ccagauaaaauguucagugcaau

SEQ ID NO: 2081094 - RNA, 19 nt, Homo sapiens
cgaaacccuugacuguuau

SEQ ID NO: 2081095 - RNA, 23 nt, Homo sapiens
auugccucuaugugcaacugaca

SEQ ID NO: 2081096 - RNA, 15 nt, Homo sapiens
uggaagaacacuguu

SEQ ID NO: 2081097 - RNA, 19 nt, Homo sapiens
guguggugagaucaugcca

SEQ ID NO: 2081098 - RNA, 16 nt, Homo sapiens
aaaaguacugcauuuu

SEQ ID NO: 2081099 - RNA, 14 nt, Homo sapiens
gguaaucauuccag

SEQ ID NO: 2081100 - RNA, 16 nt, Homo sapiens
cccugccuccugccac

SEQ ID NO: 2081101 - RNA, 22 nt, Homo sapiens
gagguagaggggaaggaaaucu

SEQ ID NO: 2081102 - RNA, 15 nt, Homo sapiens
aucccccuuucucua

SEQ ID NO: 2081103 - RNA, 15 nt, Homo sapiens
uucuucauauccuuc

SEQ ID NO: 2081104 - RNA, 20 nt, Homo sapiens
guggccucugcaggccuagg

SEQ ID NO: 2081105 - RNA, 22 nt, Homo sapiens
gccacugcaccugaccugcuga

SEQ ID NO: 2081106 - RNA, 13 nt, Homo sapiens
gggcgagaaacaa

SEQ ID NO: 2081107 - RNA, 22 nt, Homo sapiens
auuuagaguagguauuaaucuu

SEQ ID NO: 2081108 - RNA, 12 nt, Homo sapiens
auauauauucac

SEQ ID NO: 2081109 - RNA, 21 nt, Homo sapiens
gauuuuuagccccaaaucucu

SEQ ID NO: 2081110 - RNA, 18 nt, Homo sapiens
cacuauguguuagagucc

SEQ ID NO: 2081111 - RNA, 16 nt, Homo sapiens
gacuggggguggggca

SEQ ID NO: 2081112 - RNA, 15 nt, Homo sapiens
ccagggaagugcucu

SEQ ID NO: 2081113 - RNA, 15 nt, Homo sapiens
ucgugcuaaacgcac

SEQ ID NO: 2081114 - RNA, 14 nt, Homo sapiens
uauuacuugugcac

SEQ ID NO: 2081115 - RNA, 15 nt, Homo sapiens
ucauguuuugcuaau

SEQ ID NO: 2081116 - RNA, 22 nt, Homo sapiens
uucccugccuugcugacaauaa

SEQ ID NO: 2081117 - RNA, 20 nt, Homo sapiens
agaauauuaaaaauuaauuc

SEQ ID NO: 2081118 - RNA, 18 nt, Homo sapiens
aauuuauacacacaaaaa

SEQ ID NO: 2081119 - RNA, 18 nt, Homo sapiens
agcucagguagcacuuua

SEQ ID NO: 2081120 - RNA, 22 nt, Homo sapiens
uaaggauaugagccuuugcaca

SEQ ID NO: 2081121 - RNA, 17 nt, Homo sapiens
ucagaauuagcugcuuc

SEQ ID NO: 2081122 - RNA, 17 nt, Homo sapiens
ccagaguuuacauucua

SEQ ID NO: 2081123 - RNA, 18 nt, Homo sapiens
uacuguugggacuuggga

SEQ ID NO: 2081124 - RNA, 18 nt, Homo sapiens
agggcaucucaauggcau

SEQ ID NO: 2081125 - RNA, 23 nt, Homo sapiens
augcugagagagcuggaggcacc

SEQ ID NO: 2081126 - RNA, 18 nt, Homo sapiens
ccucagccccuccagucg

SEQ ID NO: 2081127 - RNA, 16 nt, Homo sapiens
uuucacuggagcacaa

SEQ ID NO: 2081128 - RNA, 11 nt, Homo sapiens
ugcuccaguca

SEQ ID NO: 2081129 - RNA, 22 nt, Homo sapiens
ucucaggauaaaguuugcuaag

SEQ ID NO: 2081130 - RNA, 20 nt, Homo sapiens
uucauccuaaaaaguuccau

SEQ ID NO: 2081131 - RNA, 22 nt, Homo sapiens
gaaagaguuuccgaagagugaa

SEQ ID NO: 2081132 - RNA, 18 nt, Homo sapiens
ugagaagcugggcaugaa

SEQ ID NO: 2081133 - RNA, 23 nt, Homo sapiens
uacaggaagcaccccaugccaaa

SEQ ID NO: 2081134 - RNA, 11 nt, Homo sapiens
ggcugcucccc

SEQ ID NO: 2081135 - RNA, 15 nt, Homo sapiens
uaggugaaaguuaau

SEQ ID NO: 2081136 - RNA, 12 nt, Homo sapiens
ugucugggguga

SEQ ID NO: 2081137 - RNA, 19 nt, Homo sapiens
uaaguuccaaaaauaccau

SEQ ID NO: 2081138 - RNA, 17 nt, Homo sapiens
gaaaaucuauccuuuaa

SEQ ID NO: 2081139 - RNA, 16 nt, Homo sapiens
cacuuuaaaaccaguu

SEQ ID NO: 2081140 - RNA, 22 nt, Homo sapiens
aaagguuggccuuacuguugaa

SEQ ID NO: 2081141 - RNA, 20 nt, Homo sapiens
acuagcugucucaggaguag

SEQ ID NO: 2081142 - RNA, 15 nt, Homo sapiens
uuucccaauacauac

SEQ ID NO: 2081143 - RNA, 16 nt, Homo sapiens
aaaaauucccuaaaga

SEQ ID NO: 2081144 - RNA, 15 nt, Homo sapiens
aaaugggaacugaug

SEQ ID NO: 2081145 - RNA, 18 nt, Homo sapiens
ugacaccaaaacaugccg

SEQ ID NO: 2081146 - RNA, 17 nt, Homo sapiens
cagccacugcuuuacag

SEQ ID NO: 2081147 - RNA, 18 nt, Homo sapiens
guguagcccucacacugu

SEQ ID NO: 2081148 - RNA, 16 nt, Homo sapiens
acuguaggcagggaac

SEQ ID NO: 2081149 - RNA, 14 nt, Homo sapiens
ugguuuaacuaaua

SEQ ID NO: 2081150 - RNA, 13 nt, Homo sapiens
gccucagggccaa

SEQ ID NO: 2081151 - RNA, 13 nt, Homo sapiens
aaaacuacauuga

SEQ ID NO: 2081152 - RNA, 18 nt, Homo sapiens
aagagcagcuaaaaccua

SEQ ID NO: 2081153 - RNA, 15 nt, Homo sapiens
uucccuuaacuccaa

SEQ ID NO: 2081154 - RNA, 14 nt, Homo sapiens
cuuaugaaaacacc

SEQ ID NO: 2081155 - RNA, 19 nt, Homo sapiens
cccccuguagacuagugcc

SEQ ID NO: 2081156 - RNA, 12 nt, Homo sapiens
ggaguugcuaag

SEQ ID NO: 2081157 - RNA, 17 nt, Homo sapiens
cuucaugggccuuccau

SEQ ID NO: 2081158 - RNA, 15 nt, Homo sapiens
auguccuucuugucc

SEQ ID NO: 2081159 - RNA, 19 nt, Homo sapiens
ccuucucccucaugcauga

SEQ ID NO: 2081160 - RNA, 19 nt, Homo sapiens
agaaaggggcuagcacugg

SEQ ID NO: 2081161 - RNA, 20 nt, Homo sapiens
aguucugcugucucccugaa

SEQ ID NO: 2081162 - RNA, 20 nt, Homo sapiens
uaggcucuuugucaucuuau

SEQ ID NO: 2081163 - RNA, 19 nt, Homo sapiens
ugcucuugagucuuugcag

SEQ ID NO: 2081164 - RNA, 21 nt, Homo sapiens
ugguguaguuucugcauuuca

SEQ ID NO: 2081165 - RNA, 17 nt, Homo sapiens
caggggaccacaccucc

SEQ ID NO: 2081166 - RNA, 18 nt, Homo sapiens
auccaucuucccuacccu

SEQ ID NO: 2081167 - RNA, 18 nt, Homo sapiens
aagaccaagacacagauc

SEQ ID NO: 2081168 - RNA, 17 nt, Homo sapiens
gugcgccgagucugucu

SEQ ID NO: 2081169 - RNA, 18 nt, Homo sapiens
agaauauuaagcacauua

SEQ ID NO: 2081170 - RNA, 16 nt, Homo sapiens
cauccaggucuugacu

SEQ ID NO: 2081171 - RNA, 14 nt, Homo sapiens
gcaaguaucauaau

SEQ ID NO: 2081172 - RNA, 21 nt, Homo sapiens
cugacacaaaagaagaaauaa

SEQ ID NO: 2081173 - RNA, 17 nt, Homo sapiens
auggaauuggaacuccu

SEQ ID NO: 2081174 - RNA, 20 nt, Homo sapiens
ugguuguagaaggagccuug

SEQ ID NO: 2081175 - RNA, 14 nt, Homo sapiens
ccuauccugaagau

SEQ ID NO: 2081176 - RNA, 19 nt, Homo sapiens
auguucuccucaaacauuu

SEQ ID NO: 2081177 - RNA, 18 nt, Homo sapiens
ucuguugaaucacaguau

SEQ ID NO: 2081178 - RNA, 17 nt, Homo sapiens
gcauucucucauucccu

SEQ ID NO: 2081179 - RNA, 13 nt, Homo sapiens
accauaacagcca

SEQ ID NO: 2081180 - RNA, 13 nt, Homo sapiens
uuagagaaugaga

SEQ ID NO: 2081181 - RNA, 16 nt, Homo sapiens
ccaugggggugcugca

SEQ ID NO: 2081182 - RNA, 24 nt, Homo sapiens
ugaaaacaauucuuauugacucau

SEQ ID NO: 2081183 - RNA, 18 nt, Homo sapiens
ugcuuaaacuugacccag

SEQ ID NO: 2081184 - RNA, 17 nt, Homo sapiens
ucagcuucaaggaguau

SEQ ID NO: 2081185 - RNA, 14 nt, Homo sapiens
acaugacacugacc

SEQ ID NO: 2081186 - RNA, 23 nt, Homo sapiens
cucugagccaaccuuaaaccucu

SEQ ID NO: 2081187 - RNA, 14 nt, Homo sapiens
ugcugagugagcug

SEQ ID NO: 2081188 - RNA, 23 nt, Homo sapiens
cuuccuccccuguucauucugca

SEQ ID NO: 2081189 - RNA, 16 nt, Homo sapiens
ugaaugauuaguagga

SEQ ID NO: 2081190 - RNA, 19 nt, Homo sapiens
uagugguuggauguaguca

SEQ ID NO: 2081191 - RNA, 19 nt, Homo sapiens
ccuaaaagugggcuugauu

SEQ ID NO: 2081192 - RNA, 16 nt, Homo sapiens
cuugauucuaaagggg

SEQ ID NO: 2081193 - RNA, 16 nt, Homo sapiens
ucuucugagcaccuac

SEQ ID NO: 2081194 - RNA, 14 nt, Homo sapiens
ucauauuuuguaua

SEQ ID NO: 2081195 - RNA, 14 nt, Homo sapiens
cuaagacccugugu

SEQ ID NO: 2081196 - RNA, 14 nt, Homo sapiens
ugugcagccauagu

SEQ ID NO: 2081197 - RNA, 14 nt, Homo sapiens
agcugcaaguguau

SEQ ID NO: 2081198 - RNA, 16 nt, Homo sapiens
uugggacccccuucaa

SEQ ID NO: 2081199 - RNA, 20 nt, Homo sapiens
guugaaaaccacagucagug

SEQ ID NO: 2081200 - RNA, 17 nt, Homo sapiens
cagcgucacuccagugc

SEQ ID NO: 2081201 - RNA, 23 nt, Homo sapiens
uggcacacaccguggccuaccug

SEQ ID NO: 2081202 - RNA, 16 nt, Homo sapiens
gcgcaggcugaucacc

SEQ ID NO: 2081203 - RNA, 13 nt, Homo sapiens
uagccuugcacuu

SEQ ID NO: 2081204 - RNA, 16 nt, Homo sapiens
ucaaggagauauauca

SEQ ID NO: 2081205 - RNA, 16 nt, Homo sapiens
guuuaagggugauagu

SEQ ID NO: 2081206 - RNA, 17 nt, Homo sapiens
gccagccagugaccuga

SEQ ID NO: 2081207 - RNA, 21 nt, Homo sapiens
cugggcagcugauuuugucac

SEQ ID NO: 2081208 - RNA, 17 nt, Homo sapiens
gaacacuggcagacugu

SEQ ID NO: 2081209 - RNA, 22 nt, Homo sapiens
aacaaugccuuguuguauuccu

SEQ ID NO: 2081210 - RNA, 22 nt, Homo sapiens
aagcaguucauucuaccaagcu

SEQ ID NO: 2081211 - RNA, 13 nt, Homo sapiens
cauuuuacuguac

SEQ ID NO: 2081212 - RNA, 17 nt, Homo sapiens
aagauauuuugaacuaa

SEQ ID NO: 2081213 - RNA, 17 nt, Homo sapiens
ggaaaacucaccauuuc

SEQ ID NO: 2081214 - RNA, 18 nt, Homo sapiens
ccuccuuccccugugguc

SEQ ID NO: 2081215 - RNA, 18 nt, Homo sapiens
ggcuuuuggcagcaaagu

SEQ ID NO: 2081216 - RNA, 15 nt, Homo sapiens
cagaaaagugauuag

SEQ ID NO: 2081217 - RNA, 21 nt, Homo sapiens
aacuguuuacucacauugucc

SEQ ID NO: 2081218 - RNA, 21 nt, Homo sapiens
cuugggcugagugcagccaaa

SEQ ID NO: 2081219 - RNA, 20 nt, Homo sapiens
cccuguguauucuagugaau

SEQ ID NO: 2081220 - RNA, 22 nt, Homo sapiens
ucagaaggaaaccgaaacugac

SEQ ID NO: 2081221 - RNA, 21 nt, Homo sapiens
cuuuacauaagaaauguauuc

SEQ ID NO: 2081222 - RNA, 10 nt, Homo sapiens
uugcauuuaa

SEQ ID NO: 2081223 - RNA, 18 nt, Homo sapiens
aucccucugggcacuggu

SEQ ID NO: 2081224 - RNA, 16 nt, Homo sapiens
agcuauucaaguauuc

SEQ ID NO: 2081225 - RNA, 16 nt, Homo sapiens
cgcucacccagucacc

SEQ ID NO: 2081226 - RNA, 19 nt, Homo sapiens
uguccgacucuucugagca

SEQ ID NO: 2081227 - RNA, 20 nt, Homo sapiens
aaacuugguauaucuggcca

SEQ ID NO: 2081228 - RNA, 17 nt, Homo sapiens
ugcaaagggacauugaa

SEQ ID NO: 2081229 - RNA, 15 nt, Homo sapiens
gaagcaggacccagu

SEQ ID NO: 2081230 - RNA, 16 nt, Homo sapiens
agcccaacagcacuuu

SEQ ID NO: 2081231 - RNA, 23 nt, Homo sapiens
guauauuugugauagcacuuucu

SEQ ID NO: 2081232 - RNA, 19 nt, Homo sapiens
ugcuguuuaaagucacauc

SEQ ID NO: 2081233 - RNA, 14 nt, Homo sapiens
ccuacccacuucca

SEQ ID NO: 2081234 - RNA, 21 nt, Homo sapiens
aauuugguuuguuaauucuua

SEQ ID NO: 2081235 - RNA, 18 nt, Homo sapiens
aggugggggaugcugagg

SEQ ID NO: 2081236 - RNA, 21 nt, Homo sapiens
ggauucauguccagagcucau

SEQ ID NO: 2081237 - RNA, 15 nt, Homo sapiens
cuuucccacucucag

SEQ ID NO: 2081238 - RNA, 17 nt, Homo sapiens
aggguuccuguagaccu

SEQ ID NO: 2081239 - RNA, 16 nt, Homo sapiens
uucucuccugugugcu

SEQ ID NO: 2081240 - RNA, 11 nt, Homo sapiens
aauaaaccaca

SEQ ID NO: 2081241 - RNA, 21 nt, Homo sapiens
gagcaguuugguuucuagcau

SEQ ID NO: 2081242 - RNA, 14 nt, Homo sapiens
aaaggccuuuggga

SEQ ID NO: 2081243 - RNA, 16 nt, Homo sapiens
ccuacauccagcuccu

SEQ ID NO: 2081244 - RNA, 23 nt, Homo sapiens
acucuggggagccugagccacaa

SEQ ID NO: 2081245 - RNA, 16 nt, Homo sapiens
ugaguaguguggaauu

SEQ ID NO: 2081246 - RNA, 15 nt, Homo sapiens
uucuaaaugaacuca

SEQ ID NO: 2081247 - RNA, 18 nt, Homo sapiens
cuguagauucuguggaac

SEQ ID NO: 2081248 - RNA, 15 nt, Homo sapiens
cacuucucucaggau

SEQ ID NO: 2081249 - RNA, 18 nt, Homo sapiens
uauaaccccagccugacc

SEQ ID NO: 2081250 - RNA, 17 nt, Homo sapiens
gcacaaacugcagcugu

SEQ ID NO: 2081251 - RNA, 16 nt, Homo sapiens
agccuucaagugccaa

SEQ ID NO: 2081252 - RNA, 20 nt, Homo sapiens
ucuuuccuauuugcacacgu

SEQ ID NO: 2081253 - RNA, 22 nt, Homo sapiens
uucagcuccagccccuuuccaa

SEQ ID NO: 2081254 - RNA, 14 nt, Homo sapiens
augugccaguuccu

SEQ ID NO: 2081255 - RNA, 20 nt, Homo sapiens
cauuacacgaucaccugcau

SEQ ID NO: 2081256 - RNA, 13 nt, Homo sapiens
cuguucagaaaua

SEQ ID NO: 2081257 - RNA, 17 nt, Homo sapiens
ggagagaaacacugcug

SEQ ID NO: 2081258 - RNA, 14 nt, Homo sapiens
acccuccuguccag

SEQ ID NO: 2081259 - RNA, 15 nt, Homo sapiens
guucccacuccuuca

SEQ ID NO: 2081260 - RNA, 14 nt, Homo sapiens
ccaggaccagcugg

SEQ ID NO: 2081261 - RNA, 22 nt, Homo sapiens
aucuacuucaacacuucaugua

SEQ ID NO: 2081262 - RNA, 21 nt, Homo sapiens
uaagggcuggucucugcugaa

SEQ ID NO: 2081263 - RNA, 13 nt, Homo sapiens
ugggaccacagag

SEQ ID NO: 2081264 - RNA, 21 nt, Homo sapiens
auuggcacaagcucccuggug

SEQ ID NO: 2081265 - RNA, 12 nt, Homo sapiens
uagacaucagaa

SEQ ID NO: 2081266 - RNA, 23 nt, Homo sapiens
cacugugcuucuuaauguguaau

SEQ ID NO: 2081267 - RNA, 22 nt, Homo sapiens
aaauuuauaaaggucugcacuc

SEQ ID NO: 2081268 - RNA, 21 nt, Homo sapiens
ccugccagggcccgaccuggg

SEQ ID NO: 2081269 - RNA, 22 nt, Homo sapiens
ccugaaaugccaagugccugcu

SEQ ID NO: 2081270 - RNA, 21 nt, Homo sapiens
cacccugugccaucaccauaa

SEQ ID NO: 2081271 - RNA, 13 nt, Homo sapiens
uccucacugaaaa

SEQ ID NO: 2081272 - RNA, 15 nt, Homo sapiens
aguguaauaaaucaa

SEQ ID NO: 2081273 - RNA, 15 nt, Homo sapiens
ccugacgacacugaa

SEQ ID NO: 2081274 - RNA, 23 nt, Homo sapiens
ucauauauuuuuaccaucugcug

SEQ ID NO: 2081275 - RNA, 19 nt, Homo sapiens
ucuggcaccaucagccugu

SEQ ID NO: 2081276 - RNA, 19 nt, Homo sapiens
aggaagagccaggugcugc

SEQ ID NO: 2081277 - RNA, 23 nt, Homo sapiens
uagccuguucuuuuaccacugac

SEQ ID NO: 2081278 - RNA, 21 nt, Homo sapiens
gcaguguauagaaaaaccaaa

SEQ ID NO: 2081279 - RNA, 21 nt, Homo sapiens
aaauggggccagauccagccu

SEQ ID NO: 2081280 - RNA, 15 nt, Homo sapiens
aaugucaguauuuca

SEQ ID NO: 2081281 - RNA, 14 nt, Homo sapiens
ucaauggauccaca

SEQ ID NO: 2081282 - RNA, 18 nt, Homo sapiens
cacacagucacauucgaa

SEQ ID NO: 2081283 - RNA, 18 nt, Homo sapiens
aaguaucaagccaugugc

SEQ ID NO: 2081284 - RNA, 16 nt, Homo sapiens
aaguugcucuguaugu

SEQ ID NO: 2081285 - RNA, 17 nt, Homo sapiens
caaucuuagacauuuau

SEQ ID NO: 2081286 - RNA, 16 nt, Homo sapiens
cauuaauaaaguugcu

SEQ ID NO: 2081287 - RNA, 22 nt, Homo sapiens
uuggagucaaaaggcaaaucau

SEQ ID NO: 2081288 - RNA, 11 nt, Homo sapiens
aaaccugaugc

SEQ ID NO: 2081289 - RNA, 18 nt, Homo sapiens
aaacucuuuaacuuguaa

SEQ ID NO: 2081290 - RNA, 18 nt, Homo sapiens
ugucaagggauuacuuau

SEQ ID NO: 2081291 - RNA, 17 nt, Homo sapiens
gcaaauagagagucucc

SEQ ID NO: 2081292 - RNA, 14 nt, Homo sapiens
uuuuauuuauaugu

SEQ ID NO: 2081293 - RNA, 15 nt, Homo sapiens
uaauuaccuggugag

SEQ ID NO: 2081294 - RNA, 12 nt, Homo sapiens
aucucaaucucc

SEQ ID NO: 2081295 - RNA, 14 nt, Homo sapiens
aauacauguuuuca

SEQ ID NO: 2081296 - RNA, 14 nt, Homo sapiens
uuauugauacaaca

SEQ ID NO: 2081297 - RNA, 22 nt, Homo sapiens
uucugugggagaauucuuacau

SEQ ID NO: 2081298 - RNA, 14 nt, Homo sapiens
cacaccauucaggu

SEQ ID NO: 2081299 - RNA, 16 nt, Homo sapiens
uauaguuagcuuuauu

SEQ ID NO: 2081300 - RNA, 18 nt, Homo sapiens
ucucuuacaccugccaug

SEQ ID NO: 2081301 - RNA, 21 nt, Homo sapiens
cccaugcaucuuccacuggaa

SEQ ID NO: 2081302 - RNA, 13 nt, Homo sapiens
ucgucuuugcaga

SEQ ID NO: 2081303 - RNA, 20 nt, Homo sapiens
acugccuuccaggagcaauu

SEQ ID NO: 2081304 - RNA, 20 nt, Homo sapiens
cauuuaaaacaagacuucag

SEQ ID NO: 2081305 - RNA, 16 nt, Homo sapiens
uaagugcacaccgugu

SEQ ID NO: 2081306 - RNA, 12 nt, Homo sapiens
ugaaauugaacc

SEQ ID NO: 2081307 - RNA, 16 nt, Homo sapiens
ccaggggcugcucauc

SEQ ID NO: 2081308 - RNA, 14 nt, Homo sapiens
cucuucaaggacuu

SEQ ID NO: 2081309 - RNA, 14 nt, Homo sapiens
ugaccagugcaguu

SEQ ID NO: 2081310 - RNA, 21 nt, Homo sapiens
cucauagcuaauuuuugcaaa

SEQ ID NO: 2081311 - RNA, 14 nt, Homo sapiens
ugaaagacaaagaa

SEQ ID NO: 2081312 - RNA, 20 nt, Homo sapiens
cauaacaguuuuaugcugau

SEQ ID NO: 2081313 - RNA, 19 nt, Homo sapiens
ugacagagugagacccugu

SEQ ID NO: 2081314 - RNA, 17 nt, Homo sapiens
auugcuuugcacuuuuc

SEQ ID NO: 2081315 - RNA, 15 nt, Homo sapiens
agcucucacaugcac

SEQ ID NO: 2081316 - RNA, 16 nt, Homo sapiens
aauuccuagucacaau

SEQ ID NO: 2081317 - RNA, 16 nt, Homo sapiens
aacagauuguuugcaa

SEQ ID NO: 2081318 - RNA, 16 nt, Homo sapiens
caguagcuccaacacu

SEQ ID NO: 2081319 - RNA, 16 nt, Homo sapiens
cucacucccauaagcu

SEQ ID NO: 2081320 - RNA, 21 nt, Homo sapiens
cugcauaguauuccauugugu

SEQ ID NO: 2081321 - RNA, 15 nt, Homo sapiens
gcagagacacuuugu

SEQ ID NO: 2081322 - RNA, 17 nt, Homo sapiens
aaagugcuggaauuaca

SEQ ID NO: 2081323 - RNA, 20 nt, Homo sapiens
aagccaugcugcuuugcaca

SEQ ID NO: 2081324 - RNA, 16 nt, Homo sapiens
aaggaugacaaaaugg

SEQ ID NO: 2081325 - RNA, 12 nt, Homo sapiens
gaaaugcugauu

SEQ ID NO: 2081326 - RNA, 19 nt, Homo sapiens
ucucuaacccuuucaaaag

SEQ ID NO: 2081327 - RNA, 21 nt, Homo sapiens
uccagccccauagaaaacaau

SEQ ID NO: 2081328 - RNA, 19 nt, Homo sapiens
agggaaugccuggggauuc

SEQ ID NO: 2081329 - RNA, 17 nt, Homo sapiens
aagcaauuuacugauga

SEQ ID NO: 2081330 - RNA, 21 nt, Homo sapiens
cccacgacugcccggcagggu

SEQ ID NO: 2081331 - RNA, 15 nt, Homo sapiens
acuggcaugggagac

SEQ ID NO: 2081332 - RNA, 14 nt, Homo sapiens
gaaaugaauagacu

SEQ ID NO: 2081333 - RNA, 16 nt, Homo sapiens
cgccaagcaaccuggg

SEQ ID NO: 2081334 - RNA, 15 nt, Homo sapiens
agccagaucucauga

SEQ ID NO: 2081335 - RNA, 17 nt, Homo sapiens
uccaaaguacacuguuu

SEQ ID NO: 2081336 - RNA, 16 nt, Homo sapiens
gggagcaggcgguggg

SEQ ID NO: 2081337 - RNA, 16 nt, Homo sapiens
aaauuuguaugcucaa

SEQ ID NO: 2081338 - RNA, 12 nt, Homo sapiens
auguuuucacaa

SEQ ID NO: 2081339 - RNA, 18 nt, Homo sapiens
aguuaccaaacauuacaa

SEQ ID NO: 2081340 - RNA, 21 nt, Homo sapiens
aagugcggcacugcaaagaga

SEQ ID NO: 2081341 - RNA, 17 nt, Homo sapiens
aguuuccaaaaccagaa

SEQ ID NO: 2081342 - RNA, 14 nt, Homo sapiens
ccuaaucacucuga

SEQ ID NO: 2081343 - RNA, 20 nt, Homo sapiens
agugaggacaaaaucacauu

SEQ ID NO: 2081344 - RNA, 15 nt, Homo sapiens
uguauaguguucaca

SEQ ID NO: 2081345 - RNA, 20 nt, Homo sapiens
aacccacucagagaugcauu

SEQ ID NO: 2081346 - RNA, 15 nt, Homo sapiens
agugaugccaugaag

SEQ ID NO: 2081347 - RNA, 23 nt, Homo sapiens
aagugugugccaccaugccucac

SEQ ID NO: 2081348 - RNA, 14 nt, Homo sapiens
uuccucccugcuua

SEQ ID NO: 2081349 - RNA, 13 nt, Homo sapiens
cuuuacaaagcug

SEQ ID NO: 2081350 - RNA, 20 nt, Homo sapiens
guauucacgugcagcagcaa

SEQ ID NO: 2081351 - RNA, 14 nt, Homo sapiens
uacaggcacccacc

SEQ ID NO: 2081352 - RNA, 13 nt, Homo sapiens
aauuugcugcuau

SEQ ID NO: 2081353 - RNA, 12 nt, Homo sapiens
aacuuuccuuca

SEQ ID NO: 2081354 - RNA, 20 nt, Homo sapiens
uauuggaugacuaacuauca

SEQ ID NO: 2081355 - RNA, 17 nt, Homo sapiens
caugaaagauaagcuuu

SEQ ID NO: 2081356 - RNA, 23 nt, Homo sapiens
aucauacuaccggcuacaucaaa

SEQ ID NO: 2081357 - RNA, 17 nt, Homo sapiens
ccagaggcuuccagucu

SEQ ID NO: 2081358 - RNA, 16 nt, Homo sapiens
cgcaccuugucaugua

SEQ ID NO: 2081359 - RNA, 15 nt, Homo sapiens
cuucucccacacugc

SEQ ID NO: 2081360 - RNA, 17 nt, Homo sapiens
gaagggggagcugggga

SEQ ID NO: 2081361 - RNA, 20 nt, Homo sapiens
aagggccaccuacaauacau

SEQ ID NO: 2081362 - RNA, 14 nt, Homo sapiens
guuuuuucugcaau

SEQ ID NO: 2081363 - RNA, 11 nt, Homo sapiens
uguucaucucu

SEQ ID NO: 2081364 - RNA, 13 nt, Homo sapiens
gucuucccuguau

SEQ ID NO: 2081365 - RNA, 22 nt, Homo sapiens
agaaagacuguaagcuccauga

SEQ ID NO: 2081366 - RNA, 17 nt, Homo sapiens
cuuguguccacugugac

SEQ ID NO: 2081367 - RNA, 23 nt, Homo sapiens
aacaaaucugcaccccacuucag

SEQ ID NO: 2081368 - RNA, 20 nt, Homo sapiens
gcgcugaguauggagcagcc

SEQ ID NO: 2081369 - RNA, 22 nt, Homo sapiens
acuuaguaaguaauaucaaagc

SEQ ID NO: 2081370 - RNA, 15 nt, Homo sapiens
cagcaauucuccugc

SEQ ID NO: 2081371 - RNA, 16 nt, Homo sapiens
gaaaaugaacugccca

SEQ ID NO: 2081372 - RNA, 22 nt, Homo sapiens
caaaaacuggguaaugcaacuc

SEQ ID NO: 2081373 - RNA, 22 nt, Homo sapiens
augcugggugguuuucccacga

SEQ ID NO: 2081374 - RNA, 17 nt, Homo sapiens
caucaccuccaccauac

SEQ ID NO: 2081375 - RNA, 14 nt, Homo sapiens
gcaccuucauucuc

SEQ ID NO: 2081376 - RNA, 20 nt, Homo sapiens
aaauccggucagccaagugc

SEQ ID NO: 2081377 - RNA, 16 nt, Homo sapiens
aaguuuaacauauaca

SEQ ID NO: 2081378 - RNA, 16 nt, Homo sapiens
gacuuagaaaaauccu

SEQ ID NO: 2081379 - RNA, 20 nt, Homo sapiens
ucgcccagcaccccugcuga

SEQ ID NO: 2081380 - RNA, 17 nt, Homo sapiens
cugcucggcuugaucac

SEQ ID NO: 2081381 - RNA, 20 nt, Homo sapiens
cuuggugucgggcaugacac

SEQ ID NO: 2081382 - RNA, 12 nt, Homo sapiens
gagggcuuucag

SEQ ID NO: 2081383 - RNA, 22 nt, Homo sapiens
aauacauguauuuaaaaaaaca

SEQ ID NO: 2081384 - RNA, 22 nt, Homo sapiens
gcaaaacuuuuaaacuacaggu

SEQ ID NO: 2081385 - RNA, 21 nt, Homo sapiens
gugcagccccuuccuggugac

SEQ ID NO: 2081386 - RNA, 17 nt, Homo sapiens
uucauauuuuaaacaga

SEQ ID NO: 2081387 - RNA, 22 nt, Homo sapiens
caauaaauacagaaaagucaua

SEQ ID NO: 2081388 - RNA, 20 nt, Homo sapiens
aguuugagaccagccucauc

SEQ ID NO: 2081389 - RNA, 17 nt, Homo sapiens
ucagaaaagaaaaccau

SEQ ID NO: 2081390 - RNA, 14 nt, Homo sapiens
aguuguggccucau

SEQ ID NO: 2081391 - RNA, 18 nt, Homo sapiens
uacuaaaguuuuacagaa

SEQ ID NO: 2081392 - RNA, 17 nt, Homo sapiens
uccuguuaagugaauaa

SEQ ID NO: 2081393 - RNA, 12 nt, Homo sapiens
aggaacaaugcc

SEQ ID NO: 2081394 - RNA, 13 nt, Homo sapiens
aacugagagcaga

SEQ ID NO: 2081395 - RNA, 13 nt, Homo sapiens
cuacaauuugcca

SEQ ID NO: 2081396 - RNA, 23 nt, Homo sapiens
uggaauuuucuuacccauauauc

SEQ ID NO: 2081397 - RNA, 22 nt, Homo sapiens
uuuuuaauuaaaugaagccaag

SEQ ID NO: 2081398 - RNA, 18 nt, Homo sapiens
uaggugauccuguugaga

SEQ ID NO: 2081399 - RNA, 21 nt, Homo sapiens
cccacccugggaucucaggag

SEQ ID NO: 2081400 - RNA, 13 nt, Homo sapiens
aauaaacagucac

SEQ ID NO: 2081401 - RNA, 22 nt, Homo sapiens
ggcugacggcgcaagaccagcu

SEQ ID NO: 2081402 - RNA, 17 nt, Homo sapiens
acaaacaaccugccaca

SEQ ID NO: 2081403 - RNA, 19 nt, Homo sapiens
caaaguuaagaaucuuuau

SEQ ID NO: 2081404 - RNA, 21 nt, Homo sapiens
uguggcaugauguuucuucca

SEQ ID NO: 2081405 - RNA, 17 nt, Homo sapiens
accugugcuuggaacca

SEQ ID NO: 2081406 - RNA, 16 nt, Homo sapiens
agauuaaacaaacaaa

SEQ ID NO: 2081407 - RNA, 22 nt, Homo sapiens
ccgaugcugaccucaccugguc

SEQ ID NO: 2081408 - RNA, 15 nt, Homo sapiens
uaaaaugcauugaaa

SEQ ID NO: 2081409 - RNA, 16 nt, Homo sapiens
cuuagaaacacauaaa

SEQ ID NO: 2081410 - RNA, 22 nt, Homo sapiens
uaauguguugugaaaauuuaau

SEQ ID NO: 2081411 - RNA, 20 nt, Homo sapiens
cuggagcccauccagucucc

SEQ ID NO: 2081412 - RNA, 23 nt, Homo sapiens
agaaccauaaagaaaagaugaaa

SEQ ID NO: 2081413 - RNA, 20 nt, Homo sapiens
aucuccuuuuaucuggugcc

SEQ ID NO: 2081414 - RNA, 11 nt, Homo sapiens
cugacacuguc

SEQ ID NO: 2081415 - RNA, 11 nt, Homo sapiens
cgcacacuggg

SEQ ID NO: 2081416 - RNA, 20 nt, Homo sapiens
cuaacaaacugaaaaaucua

SEQ ID NO: 2081417 - RNA, 15 nt, Homo sapiens
caauaccagugacac

SEQ ID NO: 2081418 - RNA, 16 nt, Homo sapiens
cuaagaaaauacugga

SEQ ID NO: 2081419 - RNA, 20 nt, Homo sapiens
cuuuccugguuuucaucagg

SEQ ID NO: 2081420 - RNA, 12 nt, Homo sapiens
ugugugggucua

SEQ ID NO: 2081421 - RNA, 22 nt, Homo sapiens
cacuuuuuuuauaagcaaaaac

SEQ ID NO: 2081422 - RNA, 22 nt, Homo sapiens
agcuaccacgggucugccaugc

SEQ ID NO: 2081423 - RNA, 18 nt, Homo sapiens
ucuugugugcauugcugu

SEQ ID NO: 2081424 - RNA, 21 nt, Homo sapiens
gaaagugcaaagugcccucau

SEQ ID NO: 2081425 - RNA, 16 nt, Homo sapiens
auaacaacacuguguu

SEQ ID NO: 2081426 - RNA, 23 nt, Homo sapiens
ccccucauccgauuccccuguag

SEQ ID NO: 2081427 - RNA, 18 nt, Homo sapiens
gaaugaccagccugucca

SEQ ID NO: 2081428 - RNA, 22 nt, Homo sapiens
aggagucucugccacccacuca

SEQ ID NO: 2081429 - RNA, 15 nt, Homo sapiens
uuuuuuaaagccagu

SEQ ID NO: 2081430 - RNA, 21 nt, Homo sapiens
acaagaaaauguauccaagga

SEQ ID NO: 2081431 - RNA, 20 nt, Homo sapiens
aggucagcagccucccugaa

SEQ ID NO: 2081432 - RNA, 22 nt, Homo sapiens
aaucugagaaaaggcaaaagaa

SEQ ID NO: 2081433 - RNA, 14 nt, Homo sapiens
aaacuccaaugaaa

SEQ ID NO: 2081434 - RNA, 24 nt, Homo sapiens
aucagaccugucuuccaaggagac

SEQ ID NO: 2081435 - RNA, 15 nt, Homo sapiens
uacuaauuaucuuau

SEQ ID NO: 2081436 - RNA, 23 nt, Homo sapiens
cucuguuauuuguccucauguga

SEQ ID NO: 2081437 - RNA, 14 nt, Homo sapiens
gggcagcuuugccc

SEQ ID NO: 2081438 - RNA, 19 nt, Homo sapiens
gaaagggugagacuccauc

SEQ ID NO: 2081439 - RNA, 20 nt, Homo sapiens
gucgcugaaauuaaaugcca

SEQ ID NO: 2081440 - RNA, 20 nt, Homo sapiens
uaauguuauccucuugcuau

SEQ ID NO: 2081441 - RNA, 16 nt, Homo sapiens
ccagaagaauauucag

SEQ ID NO: 2081442 - RNA, 21 nt, Homo sapiens
agguaucugguaucugcaugu

SEQ ID NO: 2081443 - RNA, 15 nt, Homo sapiens
ccaguagugaccaau

SEQ ID NO: 2081444 - RNA, 19 nt, Homo sapiens
ccucauugcuaccacagac

SEQ ID NO: 2081445 - RNA, 21 nt, Homo sapiens
ugggguaggcugucugugcca

SEQ ID NO: 2081446 - RNA, 13 nt, Homo sapiens
aggaaacacuggc

SEQ ID NO: 2081447 - RNA, 16 nt, Homo sapiens
uuggacagaagcagcu

SEQ ID NO: 2081448 - RNA, 22 nt, Homo sapiens
ucaccauguuggccaggcugcu

SEQ ID NO: 2081449 - RNA, 22 nt, Homo sapiens
ugcgcaacaacaaggacccugu

SEQ ID NO: 2081450 - RNA, 12 nt, Homo sapiens
uugaaaugucaa

SEQ ID NO: 2081451 - RNA, 21 nt, Homo sapiens
uggacccacccaccacagccc

SEQ ID NO: 2081452 - RNA, 14 nt, Homo sapiens
ugggaugaugccuc

SEQ ID NO: 2081453 - RNA, 19 nt, Homo sapiens
uccguugagcuugcuuuua

SEQ ID NO: 2081454 - RNA, 22 nt, Homo sapiens
uuacaucugaacaaaaugccuu

SEQ ID NO: 2081455 - RNA, 15 nt, Homo sapiens
gccuggcuucuggga

SEQ ID NO: 2081456 - RNA, 23 nt, Homo sapiens
ucuccuucacucugacaguauua

SEQ ID NO: 2081457 - RNA, 17 nt, Homo sapiens
gauaagccugagccuua

SEQ ID NO: 2081458 - RNA, 18 nt, Homo sapiens
auaguuggucaucuagca

SEQ ID NO: 2081459 - RNA, 17 nt, Homo sapiens
accucucagcugcugaa

SEQ ID NO: 2081460 - RNA, 16 nt, Homo sapiens
ugcauuauaucaaauc

SEQ ID NO: 2081461 - RNA, 17 nt, Homo sapiens
aaaggcuaaacauaugg

SEQ ID NO: 2081462 - RNA, 11 nt, Homo sapiens
cgucugugaau

SEQ ID NO: 2081463 - RNA, 14 nt, Homo sapiens
uggagggaaagggg

SEQ ID NO: 2081464 - RNA, 16 nt, Homo sapiens
uaaucuguguguauau

SEQ ID NO: 2081465 - RNA, 19 nt, Homo sapiens
uaaagacaaagacauuauu

SEQ ID NO: 2081466 - RNA, 16 nt, Homo sapiens
augaaggcagagccau

SEQ ID NO: 2081467 - RNA, 17 nt, Homo sapiens
acuuauuauugaugaua

SEQ ID NO: 2081468 - RNA, 22 nt, Homo sapiens
ccugcucuggacuugcccucuc

SEQ ID NO: 2081469 - RNA, 19 nt, Homo sapiens
acagugauauacuuacuca

SEQ ID NO: 2081470 - RNA, 22 nt, Homo sapiens
agucucuacccaguagaugcca

SEQ ID NO: 2081471 - RNA, 16 nt, Homo sapiens
uaaauuuaugugaugg

SEQ ID NO: 2081472 - RNA, 15 nt, Homo sapiens
auuucaauaaccuuu

SEQ ID NO: 2081473 - RNA, 14 nt, Homo sapiens
cuggagccugcaga

SEQ ID NO: 2081474 - RNA, 18 nt, Homo sapiens
uauucaaacuaccuauau

SEQ ID NO: 2081475 - RNA, 12 nt, Homo sapiens
auagaaguccau

SEQ ID NO: 2081476 - RNA, 12 nt, Homo sapiens
ccugaaguauuu

SEQ ID NO: 2081477 - RNA, 18 nt, Homo sapiens
ccuacugguguaaucuca

SEQ ID NO: 2081478 - RNA, 15 nt, Homo sapiens
uccugucugauucuc

SEQ ID NO: 2081479 - RNA, 13 nt, Homo sapiens
uuccucccauuca

SEQ ID NO: 2081480 - RNA, 16 nt, Homo sapiens
gucucugaugcagcuu

SEQ ID NO: 2081481 - RNA, 18 nt, Homo sapiens
ucuucaaaauaucaagug

SEQ ID NO: 2081482 - RNA, 23 nt, Homo sapiens
uuugaaugaugagccuucgugcc

SEQ ID NO: 2081483 - RNA, 13 nt, Homo sapiens
guagucucaggac

SEQ ID NO: 2081484 - RNA, 16 nt, Homo sapiens
aguguugacauagccu

SEQ ID NO: 2081485 - RNA, 14 nt, Homo sapiens
uauuuuccaugaaa

SEQ ID NO: 2081486 - RNA, 15 nt, Homo sapiens
uuaccuuuaccccau

SEQ ID NO: 2081487 - RNA, 21 nt, Homo sapiens
aaagacaauaaaacacuuuug

SEQ ID NO: 2081488 - RNA, 12 nt, Homo sapiens
aaggaaaugcag

SEQ ID NO: 2081489 - RNA, 18 nt, Homo sapiens
caauuuugcacugaagag

SEQ ID NO: 2081490 - RNA, 15 nt, Homo sapiens
gaacauggcauguga

SEQ ID NO: 2081491 - RNA, 20 nt, Homo sapiens
uguuuuaauuuuugugauuu

SEQ ID NO: 2081492 - RNA, 19 nt, Homo sapiens
aauucacccaccagacuuu

SEQ ID NO: 2081493 - RNA, 14 nt, Homo sapiens
cucacaacucucug

SEQ ID NO: 2081494 - RNA, 21 nt, Homo sapiens
auuuuaaugaagaaaguggaa

SEQ ID NO: 2081495 - RNA, 21 nt, Homo sapiens
acuggcagaucgcucacuguu

SEQ ID NO: 2081496 - RNA, 17 nt, Homo sapiens
uaaauguguuagcacug

SEQ ID NO: 2081497 - RNA, 16 nt, Homo sapiens
agacaugugcacuuga

SEQ ID NO: 2081498 - RNA, 19 nt, Homo sapiens
ucuaacaagcuaugggaau

SEQ ID NO: 2081499 - RNA, 16 nt, Homo sapiens
ucccaccccacuccag

SEQ ID NO: 2081500 - RNA, 21 nt, Homo sapiens
uguauucucugagcugugcag

SEQ ID NO: 2081501 - RNA, 17 nt, Homo sapiens
cagugacccuggagcua

SEQ ID NO: 2081502 - RNA, 23 nt, Homo sapiens
cauacgaaccuaaagaauaugaa

SEQ ID NO: 2081503 - RNA, 17 nt, Homo sapiens
uccccaagcaccuuccc

SEQ ID NO: 2081504 - RNA, 14 nt, Homo sapiens
gcagcucaggauag

SEQ ID NO: 2081505 - RNA, 22 nt, Homo sapiens
cagggguggcugccucauuuag

SEQ ID NO: 2081506 - RNA, 18 nt, Homo sapiens
ccuaagguugcagacucu

SEQ ID NO: 2081507 - RNA, 22 nt, Homo sapiens
uuccugcugcuggggccagcga

SEQ ID NO: 2081508 - RNA, 22 nt, Homo sapiens
auaucaguauucugacauguaa

SEQ ID NO: 2081509 - RNA, 14 nt, Homo sapiens
uacugcauguuugc

SEQ ID NO: 2081510 - RNA, 12 nt, Homo sapiens
auuuaggggcaa

SEQ ID NO: 2081511 - RNA, 20 nt, Homo sapiens
ucuguauuacagcuuucaca

SEQ ID NO: 2081512 - RNA, 23 nt, Homo sapiens
uauuuguagccaaagaaauuuca

SEQ ID NO: 2081513 - RNA, 13 nt, Homo sapiens
aacaccuccucau

SEQ ID NO: 2081514 - RNA, 15 nt, Homo sapiens
uaacuagaguauaaa

SEQ ID NO: 2081515 - RNA, 17 nt, Homo sapiens
agaugcaucacugggug

SEQ ID NO: 2081516 - RNA, 20 nt, Homo sapiens
ucuuagugcuucagaguuug

SEQ ID NO: 2081517 - RNA, 20 nt, Homo sapiens
gccuccgcggacugggguca

SEQ ID NO: 2081518 - RNA, 11 nt, Homo sapiens
guucucaggcc

SEQ ID NO: 2081519 - RNA, 16 nt, Homo sapiens
caacagcgcccaaagg

SEQ ID NO: 2081520 - RNA, 20 nt, Homo sapiens
cuuaagccaacaaccacagu

SEQ ID NO: 2081521 - RNA, 15 nt, Homo sapiens
ggggagaaacccaga

SEQ ID NO: 2081522 - RNA, 16 nt, Homo sapiens
cugccccugagcccau

SEQ ID NO: 2081523 - RNA, 15 nt, Homo sapiens
augauuaaacuuccu

SEQ ID NO: 2081524 - RNA, 15 nt, Homo sapiens
uacaauaaguuaacu

SEQ ID NO: 2081525 - RNA, 12 nt, Homo sapiens
agagagcuccug

SEQ ID NO: 2081526 - RNA, 15 nt, Homo sapiens
agcuugguuccugcc

SEQ ID NO: 2081527 - RNA, 19 nt, Homo sapiens
aacgcaggagaaucacugc

SEQ ID NO: 2081528 - RNA, 13 nt, Homo sapiens
caagaggggaaaa

SEQ ID NO: 2081529 - RNA, 17 nt, Homo sapiens
cugccugaagucacaca

SEQ ID NO: 2081530 - RNA, 13 nt, Homo sapiens
ugcacacauauac

SEQ ID NO: 2081531 - RNA, 23 nt, Homo sapiens
ugaccaaccgaacaugaccaaaa

SEQ ID NO: 2081532 - RNA, 21 nt, Homo sapiens
auagguuuuucucauguaucu

SEQ ID NO: 2081533 - RNA, 18 nt, Homo sapiens
ccuguuugucugaugugg

SEQ ID NO: 2081534 - RNA, 19 nt, Homo sapiens
gaagcucagcugccuuccu

SEQ ID NO: 2081535 - RNA, 18 nt, Homo sapiens
gguggcaugaguugaaga

SEQ ID NO: 2081536 - RNA, 19 nt, Homo sapiens
gucauucaagccugugaau

SEQ ID NO: 2081537 - RNA, 22 nt, Homo sapiens
uucugugcagauaaacagaaau

SEQ ID NO: 2081538 - RNA, 16 nt, Homo sapiens
cuacauuugcuccauc

SEQ ID NO: 2081539 - RNA, 17 nt, Homo sapiens
aguaggcccuuacuucu

SEQ ID NO: 2081540 - RNA, 17 nt, Homo sapiens
aaaggggguaugugaua

SEQ ID NO: 2081541 - RNA, 20 nt, Homo sapiens
auuacuuuucuuacucugaa

SEQ ID NO: 2081542 - RNA, 19 nt, Homo sapiens
uuccucgcaggucucagcc

SEQ ID NO: 2081543 - RNA, 17 nt, Homo sapiens
gaauauucaacagcuca

SEQ ID NO: 2081544 - RNA, 14 nt, Homo sapiens
ccugccgcugcacc

SEQ ID NO: 2081545 - RNA, 22 nt, Homo sapiens
guccaaaauaaaaccucagcua

SEQ ID NO: 2081546 - RNA, 16 nt, Homo sapiens
gggcauggcugcugac

SEQ ID NO: 2081547 - RNA, 17 nt, Homo sapiens
ggacauucugcuaagau

SEQ ID NO: 2081548 - RNA, 22 nt, Homo sapiens
aaaccaaugaaauuuugauuaa

SEQ ID NO: 2081549 - RNA, 15 nt, Homo sapiens
gugaaacucaucuca

SEQ ID NO: 2081550 - RNA, 16 nt, Homo sapiens
auuaccaaaacacugc

SEQ ID NO: 2081551 - RNA, 15 nt, Homo sapiens
auucucuauguauca

SEQ ID NO: 2081552 - RNA, 12 nt, Homo sapiens
ccucuuccauca

SEQ ID NO: 2081553 - RNA, 18 nt, Homo sapiens
gcagcuuuuucaaagugu

SEQ ID NO: 2081554 - RNA, 14 nt, Homo sapiens
agucaacagugaaa

SEQ ID NO: 2081555 - RNA, 17 nt, Homo sapiens
uagguauauauaugcca

SEQ ID NO: 2081556 - RNA, 14 nt, Homo sapiens
ucaugaaacugucc

SEQ ID NO: 2081557 - RNA, 17 nt, Homo sapiens
cacuucagaauuccaua

SEQ ID NO: 2081558 - RNA, 16 nt, Homo sapiens
cauuaggaacagagua

SEQ ID NO: 2081559 - RNA, 23 nt, Homo sapiens
gugucaccccucacugugacuga

SEQ ID NO: 2081560 - RNA, 18 nt, Homo sapiens
uucauaggucuccaagac

SEQ ID NO: 2081561 - RNA, 13 nt, Homo sapiens
aaucuugcaacug

SEQ ID NO: 2081562 - RNA, 13 nt, Homo sapiens
ggucacaguccac

SEQ ID NO: 2081563 - RNA, 13 nt, Homo sapiens
cguuaugguguuu

SEQ ID NO: 2081564 - RNA, 14 nt, Homo sapiens
ugaaggcaaaucuc

SEQ ID NO: 2081565 - RNA, 12 nt, Homo sapiens
ucaucaaugaau

SEQ ID NO: 2081566 - RNA, 21 nt, Homo sapiens
gcuacucaggaggcugaggca

SEQ ID NO: 2081567 - RNA, 19 nt, Homo sapiens
cuuuugcacaucuagugag

SEQ ID NO: 2081568 - RNA, 18 nt, Homo sapiens
ccuguuuuccacaccauc

SEQ ID NO: 2081569 - RNA, 12 nt, Homo sapiens
auuucaucugcu

SEQ ID NO: 2081570 - RNA, 16 nt, Homo sapiens
uccaucucaagugcca

SEQ ID NO: 2081571 - RNA, 16 nt, Homo sapiens
uuaaauaaacuuuauu

SEQ ID NO: 2081572 - RNA, 16 nt, Homo sapiens
ccaugagaaucuuaau

SEQ ID NO: 2081573 - RNA, 18 nt, Homo sapiens
ccacgccucuugaccagg

SEQ ID NO: 2081574 - RNA, 14 nt, Homo sapiens
aguuacugugguca

SEQ ID NO: 2081575 - RNA, 22 nt, Homo sapiens
uaagcaucuuuauaugcuugug

SEQ ID NO: 2081576 - RNA, 13 nt, Homo sapiens
aauaauaccucaa

SEQ ID NO: 2081577 - RNA, 17 nt, Homo sapiens
gccacaccccagacucc

SEQ ID NO: 2081578 - RNA, 22 nt, Homo sapiens
acauaauuucagugggaaauau

SEQ ID NO: 2081579 - RNA, 18 nt, Homo sapiens
gccaacaccuucuuggcu

SEQ ID NO: 2081580 - RNA, 17 nt, Homo sapiens
gagaugagguuucacca

SEQ ID NO: 2081581 - RNA, 12 nt, Homo sapiens
ucugccaggcaa

SEQ ID NO: 2081582 - RNA, 19 nt, Homo sapiens
agccccuccucccucagac

SEQ ID NO: 2081583 - RNA, 22 nt, Homo sapiens
ugagcccagcugggucaggcag

SEQ ID NO: 2081584 - RNA, 19 nt, Homo sapiens
uuggacuacauauuugcac

SEQ ID NO: 2081585 - RNA, 19 nt, Homo sapiens
uuguaaauuuuagagcaua

SEQ ID NO: 2081586 - RNA, 20 nt, Homo sapiens
cauggcgaaaggagugacuu

SEQ ID NO: 2081587 - RNA, 16 nt, Homo sapiens
cagguccaggccagug

SEQ ID NO: 2081588 - RNA, 15 nt, Homo sapiens
agggggacacuccau

SEQ ID NO: 2081589 - RNA, 17 nt, Homo sapiens
gaccuccggccaggugc

SEQ ID NO: 2081590 - RNA, 21 nt, Homo sapiens
ugucaacuggagugcucucuc

SEQ ID NO: 2081591 - RNA, 15 nt, Homo sapiens
aacuauacacuuaau

SEQ ID NO: 2081592 - RNA, 14 nt, Homo sapiens
augguuuccucauu

SEQ ID NO: 2081593 - RNA, 23 nt, Homo sapiens
gagggacaaacucacucaguaaa

SEQ ID NO: 2081594 - RNA, 19 nt, Homo sapiens
cacacccgugugcacacuc

SEQ ID NO: 2081595 - RNA, 19 nt, Homo sapiens
aauaaaggaaccauaauca

SEQ ID NO: 2081596 - RNA, 20 nt, Homo sapiens
agguuaaaaaaaaaagucac

SEQ ID NO: 2081597 - RNA, 21 nt, Homo sapiens
uguauuuuggucauauugcca

SEQ ID NO: 2081598 - RNA, 16 nt, Homo sapiens
aggugguggugguggu

SEQ ID NO: 2081599 - RNA, 20 nt, Homo sapiens
ucuagguuucagcaacaaga

SEQ ID NO: 2081600 - RNA, 15 nt, Homo sapiens
augauuagcacuuaa

SEQ ID NO: 2081601 - RNA, 15 nt, Homo sapiens
aauagugucauccuc

SEQ ID NO: 2081602 - RNA, 18 nt, Homo sapiens
aggaggugccacuggagu

SEQ ID NO: 2081603 - RNA, 21 nt, Homo sapiens
ggugucauagaauagcauguu

SEQ ID NO: 2081604 - RNA, 18 nt, Homo sapiens
cuccagaaggaaaggagg

SEQ ID NO: 2081605 - RNA, 16 nt, Homo sapiens
aaaauguccugccuuu

SEQ ID NO: 2081606 - RNA, 16 nt, Homo sapiens
gcucgacacuuaccac

SEQ ID NO: 2081607 - RNA, 15 nt, Homo sapiens
ccagcaugugugugu

SEQ ID NO: 2081608 - RNA, 20 nt, Homo sapiens
ucaugauuucccuuguagaa

SEQ ID NO: 2081609 - RNA, 16 nt, Homo sapiens
cagaggaaauucuuuc

SEQ ID NO: 2081610 - RNA, 18 nt, Homo sapiens
auaugcugaacgcagaag

SEQ ID NO: 2081611 - RNA, 19 nt, Homo sapiens
ggugugcugagguguuaga

SEQ ID NO: 2081612 - RNA, 22 nt, Homo sapiens
uaucgggagaggggauucacaa

SEQ ID NO: 2081613 - RNA, 21 nt, Homo sapiens
ugccuuggaugagaagugucu

SEQ ID NO: 2081614 - RNA, 18 nt, Homo sapiens
ugcccugggauguccaca

SEQ ID NO: 2081615 - RNA, 22 nt, Homo sapiens
cccauuucuuaccaugcauuuc

SEQ ID NO: 2081616 - RNA, 21 nt, Homo sapiens
uacagacugcagacauucuca

SEQ ID NO: 2081617 - RNA, 23 nt, Homo sapiens
ucuaacuauauguacagcucucc

SEQ ID NO: 2081618 - RNA, 20 nt, Homo sapiens
caccugcugguuguugccag

SEQ ID NO: 2081619 - RNA, 22 nt, Homo sapiens
gaucagugauuuucaaaccuca

SEQ ID NO: 2081620 - RNA, 22 nt, Homo sapiens
cuccuguuuguugagugcacug

SEQ ID NO: 2081621 - RNA, 23 nt, Homo sapiens
ucaaaaaauugcacauaguagaa

SEQ ID NO: 2081622 - RNA, 13 nt, Homo sapiens
uauacacauacau

SEQ ID NO: 2081623 - RNA, 18 nt, Homo sapiens
gacccuguucccugucua

SEQ ID NO: 2081624 - RNA, 13 nt, Homo sapiens
ucagaaaauaccu

SEQ ID NO: 2081625 - RNA, 19 nt, Homo sapiens
agcucuccccaaacuugcu

SEQ ID NO: 2081626 - RNA, 23 nt, Homo sapiens
cauguguaccuacagagcagcca

SEQ ID NO: 2081627 - RNA, 18 nt, Homo sapiens
ugcugauuuaaacacauu

SEQ ID NO: 2081628 - RNA, 13 nt, Homo sapiens
cauuucaaaggga

SEQ ID NO: 2081629 - RNA, 20 nt, Homo sapiens
aauucugagacaugugucaa

SEQ ID NO: 2081630 - RNA, 15 nt, Homo sapiens
caagaaacauuucag

SEQ ID NO: 2081631 - RNA, 20 nt, Homo sapiens
guaacacagugcaguacuca

SEQ ID NO: 2081632 - RNA, 20 nt, Homo sapiens
agauguucagauugcuuuga

SEQ ID NO: 2081633 - RNA, 19 nt, Homo sapiens
auuuuaugaguucuguaua

SEQ ID NO: 2081634 - RNA, 14 nt, Homo sapiens
acuaaaagauugag

SEQ ID NO: 2081635 - RNA, 16 nt, Homo sapiens
auggagggagaagcua

SEQ ID NO: 2081636 - RNA, 17 nt, Homo sapiens
ggcaauaaaagcccagg

SEQ ID NO: 2081637 - RNA, 19 nt, Homo sapiens
caccgacccgacacucuca

SEQ ID NO: 2081638 - RNA, 22 nt, Homo sapiens
uuaaaucacagauggguauuaa

SEQ ID NO: 2081639 - RNA, 12 nt, Homo sapiens
gagaagaagcag

SEQ ID NO: 2081640 - RNA, 17 nt, Homo sapiens
cuuuauaaagagugcua

SEQ ID NO: 2081641 - RNA, 23 nt, Homo sapiens
gcauaucccaccaaccuccagug

SEQ ID NO: 2081642 - RNA, 15 nt, Homo sapiens
ucggcuuuuugccau

SEQ ID NO: 2081643 - RNA, 19 nt, Homo sapiens
guugccuuugcucuuauaa

SEQ ID NO: 2081644 - RNA, 12 nt, Homo sapiens
ccgauucucugc

SEQ ID NO: 2081645 - RNA, 15 nt, Homo sapiens
ccauugugcauucua

SEQ ID NO: 2081646 - RNA, 12 nt, Homo sapiens
gcugaaaacccc

SEQ ID NO: 2081647 - RNA, 18 nt, Homo sapiens
cagacucguucuucuggg

SEQ ID NO: 2081648 - RNA, 22 nt, Homo sapiens
cuguagaccaccuaauaucaau

SEQ ID NO: 2081649 - RNA, 18 nt, Homo sapiens
auggagaggggguacaau

SEQ ID NO: 2081650 - RNA, 14 nt, Homo sapiens
aaauuugagaguga

SEQ ID NO: 2081651 - RNA, 18 nt, Homo sapiens
augcauuucaagcagcug

SEQ ID NO: 2081652 - RNA, 12 nt, Homo sapiens
uucaaaaaucau

SEQ ID NO: 2081653 - RNA, 14 nt, Homo sapiens
uuuguugaccucaa

SEQ ID NO: 2081654 - RNA, 16 nt, Homo sapiens
gaagugccaugcucag

SEQ ID NO: 2081655 - RNA, 16 nt, Homo sapiens
acugagagaucugcug

SEQ ID NO: 2081656 - RNA, 14 nt, Homo sapiens
auacaccagcaaug

SEQ ID NO: 2081657 - RNA, 18 nt, Homo sapiens
aaaugauccuuaugaugu

SEQ ID NO: 2081658 - RNA, 19 nt, Homo sapiens
uauuuccauucaacaagag

SEQ ID NO: 2081659 - RNA, 13 nt, Homo sapiens
ucuuuaaucacau

SEQ ID NO: 2081660 - RNA, 13 nt, Homo sapiens
ccaggcagaucca

SEQ ID NO: 2081661 - RNA, 19 nt, Homo sapiens
uagaauaaugugggaagaa

SEQ ID NO: 2081662 - RNA, 13 nt, Homo sapiens
uccugccaccacg

SEQ ID NO: 2081663 - RNA, 17 nt, Homo sapiens
uaggggaggggggagcc

SEQ ID NO: 2081664 - RNA, 21 nt, Homo sapiens
uuggauaaguugugauuugac

SEQ ID NO: 2081665 - RNA, 18 nt, Homo sapiens
aagucaauguacuuguuu

SEQ ID NO: 2081666 - RNA, 22 nt, Homo sapiens
gugaaugcugggccccugcuca

SEQ ID NO: 2081667 - RNA, 12 nt, Homo sapiens
uuucuaugugua

SEQ ID NO: 2081668 - RNA, 13 nt, Homo sapiens
gucuccaagacca

SEQ ID NO: 2081669 - RNA, 16 nt, Homo sapiens
uugugauguguccuga

SEQ ID NO: 2081670 - RNA, 12 nt, Homo sapiens
ugugccaaagau

SEQ ID NO: 2081671 - RNA, 12 nt, Homo sapiens
ucuuccaaacag

SEQ ID NO: 2081672 - RNA, 14 nt, Homo sapiens
aaacacaaggucau

SEQ ID NO: 2081673 - RNA, 22 nt, Homo sapiens
guagcaaugugccuugauugau

SEQ ID NO: 2081674 - RNA, 15 nt, Homo sapiens
ccuguagcucaguca

SEQ ID NO: 2081675 - RNA, 22 nt, Homo sapiens
ugcauaaaugcgauccacagaa

SEQ ID NO: 2081676 - RNA, 22 nt, Homo sapiens
caucugaauuugcccugggaaa

SEQ ID NO: 2081677 - RNA, 17 nt, Homo sapiens
gugcuacacuugcaccu

SEQ ID NO: 2081678 - RNA, 15 nt, Homo sapiens
ggagagcacugccag

SEQ ID NO: 2081679 - RNA, 12 nt, Homo sapiens
ugcuaccaaggc

SEQ ID NO: 2081680 - RNA, 13 nt, Homo sapiens
caggaguuccuuu

SEQ ID NO: 2081681 - RNA, 20 nt, Homo sapiens
gcagucagguccaugugcac

SEQ ID NO: 2081682 - RNA, 23 nt, Homo sapiens
ccucccagugaccccugaccuca

SEQ ID NO: 2081683 - RNA, 19 nt, Homo sapiens
cauugucaccccaagccau

SEQ ID NO: 2081684 - RNA, 16 nt, Homo sapiens
cuggagccaaguccag

SEQ ID NO: 2081685 - RNA, 21 nt, Homo sapiens
ugaagaacaucccaagccaga

SEQ ID NO: 2081686 - RNA, 21 nt, Homo sapiens
gaacuggauucuuaaccaaga

SEQ ID NO: 2081687 - RNA, 15 nt, Homo sapiens
cauggacagcaucaa

SEQ ID NO: 2081688 - RNA, 15 nt, Homo sapiens
caaaugucaugcugc

SEQ ID NO: 2081689 - RNA, 22 nt, Homo sapiens
ucacacaugccacuaugagcuu

SEQ ID NO: 2081690 - RNA, 12 nt, Homo sapiens
gacccaggaaag

SEQ ID NO: 2081691 - RNA, 14 nt, Homo sapiens
uaaaacuuugccau

SEQ ID NO: 2081692 - RNA, 21 nt, Homo sapiens
agaauccccgaaaccuccuau

SEQ ID NO: 2081693 - RNA, 19 nt, Homo sapiens
cccccguguggacacagau

SEQ ID NO: 2081694 - RNA, 23 nt, Homo sapiens
uuaaacuggaaaggaucugugau

SEQ ID NO: 2081695 - RNA, 13 nt, Homo sapiens
auuccaggcuccu

SEQ ID NO: 2081696 - RNA, 22 nt, Homo sapiens
augugauuuuccuuuguagcua

SEQ ID NO: 2081697 - RNA, 11 nt, Homo sapiens
cuuacugagcu

SEQ ID NO: 2081698 - RNA, 16 nt, Homo sapiens
uucacaaacaaauggc

SEQ ID NO: 2081699 - RNA, 20 nt, Homo sapiens
ugaaaccguaucucuaauaa

SEQ ID NO: 2081700 - RNA, 17 nt, Homo sapiens
gcccuaaccccuuccag

SEQ ID NO: 2081701 - RNA, 22 nt, Homo sapiens
cuuauuaaaauauuuucuuaau

SEQ ID NO: 2081702 - RNA, 16 nt, Homo sapiens
uuugugacuuuccuaa

SEQ ID NO: 2081703 - RNA, 16 nt, Homo sapiens
ucugcaaccccaggua

SEQ ID NO: 2081704 - RNA, 14 nt, Homo sapiens
uaaucaccaaagua

SEQ ID NO: 2081705 - RNA, 12 nt, Homo sapiens
uauagacagucc

SEQ ID NO: 2081706 - RNA, 18 nt, Homo sapiens
agcagcuuugggauccca

SEQ ID NO: 2081707 - RNA, 15 nt, Homo sapiens
gaagagcugucuucc

SEQ ID NO: 2081708 - RNA, 22 nt, Homo sapiens
aagugaaaagcaggcaaaagac

SEQ ID NO: 2081709 - RNA, 17 nt, Homo sapiens
ucuguuagcugcucacu

SEQ ID NO: 2081710 - RNA, 21 nt, Homo sapiens
uguccucccaggaaccaaaaa

SEQ ID NO: 2081711 - RNA, 15 nt, Homo sapiens
aggguuagcucaguu

SEQ ID NO: 2081712 - RNA, 23 nt, Homo sapiens
uccagauccucuuuccccacuga

SEQ ID NO: 2081713 - RNA, 18 nt, Homo sapiens
gcuggagugcaguggugu

SEQ ID NO: 2081714 - RNA, 22 nt, Homo sapiens
cagcacugccggcccagugaca

SEQ ID NO: 2081715 - RNA, 19 nt, Homo sapiens
aacccucaacugacaugaa

SEQ ID NO: 2081716 - RNA, 19 nt, Homo sapiens
aggaacuguuauaauuuau

SEQ ID NO: 2081717 - RNA, 16 nt, Homo sapiens
uucuguacauguggaa

SEQ ID NO: 2081718 - RNA, 19 nt, Homo sapiens
cucaugcugugugacucaa

SEQ ID NO: 2081719 - RNA, 19 nt, Homo sapiens
auauuuuuugcacagcuag

SEQ ID NO: 2081720 - RNA, 18 nt, Homo sapiens
cuggagcaucugacucac

SEQ ID NO: 2081721 - RNA, 18 nt, Homo sapiens
ugagacuccucaguucuu

SEQ ID NO: 2081722 - RNA, 17 nt, Homo sapiens
uuaaugucuggugcuuu

SEQ ID NO: 2081723 - RNA, 21 nt, Homo sapiens
cuguuuugcauggaguauuau

SEQ ID NO: 2081724 - RNA, 23 nt, Homo sapiens
auggcuugccuaagacuugccca

SEQ ID NO: 2081725 - RNA, 19 nt, Homo sapiens
ucucccuggccccagugac

SEQ ID NO: 2081726 - RNA, 16 nt, Homo sapiens
uagccuaauacaacau

SEQ ID NO: 2081727 - RNA, 12 nt, Homo sapiens
cccagcuacucg

SEQ ID NO: 2081728 - RNA, 20 nt, Homo sapiens
agucaacucuucagccucau

SEQ ID NO: 2081729 - RNA, 19 nt, Homo sapiens
cugccauugucgucuuuau

SEQ ID NO: 2081730 - RNA, 19 nt, Homo sapiens
caugggagacacugaugua

SEQ ID NO: 2081731 - RNA, 10 nt, Homo sapiens
ucaugcccuc

SEQ ID NO: 2081732 - RNA, 19 nt, Homo sapiens
cuccaguaccuugcuucuu

SEQ ID NO: 2081733 - RNA, 18 nt, Homo sapiens
cuugguuuccaucaaagc

SEQ ID NO: 2081734 - RNA, 17 nt, Homo sapiens
caagaagucaaaguaaa

SEQ ID NO: 2081735 - RNA, 17 nt, Homo sapiens
ucccuccugguaccaag

SEQ ID NO: 2081736 - RNA, 18 nt, Homo sapiens
ucuuccucaagucuugac

SEQ ID NO: 2081737 - RNA, 17 nt, Homo sapiens
ucuucucauagcauuaa

SEQ ID NO: 2081738 - RNA, 18 nt, Homo sapiens
agccuucccaacaugccu

SEQ ID NO: 2081739 - RNA, 15 nt, Homo sapiens
aacauuccugugaaa

SEQ ID NO: 2081740 - RNA, 20 nt, Homo sapiens
gagacccaacagcagugauc

SEQ ID NO: 2081741 - RNA, 18 nt, Homo sapiens
ucaggacagaacaguguu

SEQ ID NO: 2081742 - RNA, 15 nt, Homo sapiens
uagaaaguaacuuaa

SEQ ID NO: 2081743 - RNA, 16 nt, Homo sapiens
cagaucuuggacucau

SEQ ID NO: 2081744 - RNA, 13 nt, Homo sapiens
accuauuugacuu

SEQ ID NO: 2081745 - RNA, 15 nt, Homo sapiens
acaggccauugugaa

SEQ ID NO: 2081746 - RNA, 17 nt, Homo sapiens
ugagggcagacuggggc

SEQ ID NO: 2081747 - RNA, 19 nt, Homo sapiens
cacuuuuuccuuacugugc

SEQ ID NO: 2081748 - RNA, 13 nt, Homo sapiens
auccaucccucca

SEQ ID NO: 2081749 - RNA, 13 nt, Homo sapiens
ccuuuuccacuuu

SEQ ID NO: 2081750 - RNA, 13 nt, Homo sapiens
caaaauccaaaaa

SEQ ID NO: 2081751 - RNA, 21 nt, Homo sapiens
acagccucccacccccaucuc

SEQ ID NO: 2081752 - RNA, 15 nt, Homo sapiens
cagcaugaagaauuu

SEQ ID NO: 2081753 - RNA, 17 nt, Homo sapiens
ugauagcagaaugugcu

SEQ ID NO: 2081754 - RNA, 22 nt, Homo sapiens
acauccaggugggaggugucag

SEQ ID NO: 2081755 - RNA, 19 nt, Homo sapiens
cagagcuuuacagugccac

SEQ ID NO: 2081756 - RNA, 22 nt, Homo sapiens
cucagaagacacugaugggcaa

SEQ ID NO: 2081757 - RNA, 19 nt, Homo sapiens
uggaagugaggcauugcac

SEQ ID NO: 2081758 - RNA, 23 nt, Homo sapiens
aaaaauacggcuuuuccaaugau

SEQ ID NO: 2081759 - RNA, 11 nt, Homo sapiens
gauugcacaga

SEQ ID NO: 2081760 - RNA, 14 nt, Homo sapiens
uauucucagcacuu

SEQ ID NO: 2081761 - RNA, 15 nt, Homo sapiens
ggugaccacaaaaga

SEQ ID NO: 2081762 - RNA, 14 nt, Homo sapiens
accugugcuuugag

SEQ ID NO: 2081763 - RNA, 13 nt, Homo sapiens
uuuauuucaucuc

SEQ ID NO: 2081764 - RNA, 16 nt, Homo sapiens
cguacaucugcaauau

SEQ ID NO: 2081765 - RNA, 16 nt, Homo sapiens
aaacugcuuugugcau

SEQ ID NO: 2081766 - RNA, 17 nt, Homo sapiens
aaaccaauaguccccau

SEQ ID NO: 2081767 - RNA, 18 nt, Homo sapiens
agggaaucucauccauca

SEQ ID NO: 2081768 - RNA, 15 nt, Homo sapiens
aggcaacauccaaaa

SEQ ID NO: 2081769 - RNA, 15 nt, Homo sapiens
aauucuagugcugcu

SEQ ID NO: 2081770 - RNA, 21 nt, Homo sapiens
auguuggacagacacuguugc

SEQ ID NO: 2081771 - RNA, 16 nt, Homo sapiens
uuaccuuuguucccaa

SEQ ID NO: 2081772 - RNA, 14 nt, Homo sapiens
accuugcucugcca

SEQ ID NO: 2081773 - RNA, 15 nt, Homo sapiens
uccgaagucuuccau

SEQ ID NO: 2081774 - RNA, 22 nt, Homo sapiens
ugaaauuguaagugaaguaaaa

SEQ ID NO: 2081775 - RNA, 16 nt, Homo sapiens
ccaugggcaaagccau

SEQ ID NO: 2081776 - RNA, 15 nt, Homo sapiens
ggcccggccagccau

SEQ ID NO: 2081777 - RNA, 18 nt, Homo sapiens
gagccagccacacuugaa

SEQ ID NO: 2081778 - RNA, 13 nt, Homo sapiens
aagggccaaagaa

SEQ ID NO: 2081779 - RNA, 13 nt, Homo sapiens
cugagccacugga

SEQ ID NO: 2081780 - RNA, 15 nt, Homo sapiens
gaaccgucaauguga

SEQ ID NO: 2081781 - RNA, 23 nt, Homo sapiens
uuuucugugauaacucugcaaag

SEQ ID NO: 2081782 - RNA, 14 nt, Homo sapiens
ccucugucuccuaa

SEQ ID NO: 2081783 - RNA, 16 nt, Homo sapiens
cuucaaucuuaaaaca

SEQ ID NO: 2081784 - RNA, 12 nt, Homo sapiens
aaaaacaauaaa

SEQ ID NO: 2081785 - RNA, 23 nt, Homo sapiens
agcagcacuguucuguccucaag

SEQ ID NO: 2081786 - RNA, 16 nt, Homo sapiens
cuaucugcuuagcaac

SEQ ID NO: 2081787 - RNA, 12 nt, Homo sapiens
auggcugagaug

SEQ ID NO: 2081788 - RNA, 20 nt, Homo sapiens
uggauggggcuuccagcuca

SEQ ID NO: 2081789 - RNA, 14 nt, Homo sapiens
uuuacccucaggca

SEQ ID NO: 2081790 - RNA, 14 nt, Homo sapiens
uuacacuugucuca

SEQ ID NO: 2081791 - RNA, 16 nt, Homo sapiens
uguguaugucugguaa

SEQ ID NO: 2081792 - RNA, 17 nt, Homo sapiens
cauuucauauaaaugga

SEQ ID NO: 2081793 - RNA, 20 nt, Homo sapiens
cuguccugaccugucucacc

SEQ ID NO: 2081794 - RNA, 16 nt, Homo sapiens
ccccguggucuuugaa

SEQ ID NO: 2081795 - RNA, 12 nt, Homo sapiens
cacuuugacagc

SEQ ID NO: 2081796 - RNA, 18 nt, Homo sapiens
gcaaccucugccucccag

SEQ ID NO: 2081797 - RNA, 20 nt, Homo sapiens
ucuuugaacccuugcuugca

SEQ ID NO: 2081798 - RNA, 15 nt, Homo sapiens
ugcaguuuccaaucc

SEQ ID NO: 2081799 - RNA, 19 nt, Homo sapiens
gcugcccuucuucuugacc

SEQ ID NO: 2081800 - RNA, 15 nt, Homo sapiens
cuggaucuaccagca

SEQ ID NO: 2081801 - RNA, 20 nt, Homo sapiens
agcccucuagggcagggugg

SEQ ID NO: 2081802 - RNA, 21 nt, Homo sapiens
gaaaugaaauauuguuuccaa

SEQ ID NO: 2081803 - RNA, 14 nt, Homo sapiens
aaaauugacaauga

SEQ ID NO: 2081804 - RNA, 17 nt, Homo sapiens
cagcugaauaaccugca

SEQ ID NO: 2081805 - RNA, 21 nt, Homo sapiens
caacuuuucaaguaguuuuau

SEQ ID NO: 2081806 - RNA, 18 nt, Homo sapiens
caagaugaaauuccauuu

SEQ ID NO: 2081807 - RNA, 16 nt, Homo sapiens
agcuauuuuuauacac

SEQ ID NO: 2081808 - RNA, 20 nt, Homo sapiens
cacuuccuuggacuacuugu

SEQ ID NO: 2081809 - RNA, 17 nt, Homo sapiens
guguagcugagcacagc

SEQ ID NO: 2081810 - RNA, 22 nt, Homo sapiens
aaugaggggaagccauuuucca

SEQ ID NO: 2081811 - RNA, 13 nt, Homo sapiens
ugaggcaucucuc

SEQ ID NO: 2081812 - RNA, 23 nt, Homo sapiens
gacucugaaaaacauuccaggaa

SEQ ID NO: 2081813 - RNA, 20 nt, Homo sapiens
acugaauggacuuugcacac

SEQ ID NO: 2081814 - RNA, 22 nt, Homo sapiens
gacacaaucucggcucacugaa

SEQ ID NO: 2081815 - RNA, 14 nt, Homo sapiens
auaaccuagccuua

SEQ ID NO: 2081816 - RNA, 15 nt, Homo sapiens
agguaugaugugcug

SEQ ID NO: 2081817 - RNA, 17 nt, Homo sapiens
agcugcacuccaugagu

SEQ ID NO: 2081818 - RNA, 14 nt, Homo sapiens
cuacuagaugugaa

SEQ ID NO: 2081819 - RNA, 15 nt, Homo sapiens
aguugcuuugcccaa

SEQ ID NO: 2081820 - RNA, 21 nt, Homo sapiens
uuggagucagacaagccugag

SEQ ID NO: 2081821 - RNA, 14 nt, Homo sapiens
uaaauugcaguuua

SEQ ID NO: 2081822 - RNA, 14 nt, Homo sapiens
uguuaugcaaaaaa

SEQ ID NO: 2081823 - RNA, 22 nt, Homo sapiens
ccuaugcaccagguauuuaaca

SEQ ID NO: 2081824 - RNA, 18 nt, Homo sapiens
aucuaacuacaaggacaa

SEQ ID NO: 2081825 - RNA, 23 nt, Homo sapiens
ugggaucccacuauauugcacag

SEQ ID NO: 2081826 - RNA, 12 nt, Homo sapiens
aaagaaauccau

SEQ ID NO: 2081827 - RNA, 16 nt, Homo sapiens
cucucuuccaaguccu

SEQ ID NO: 2081828 - RNA, 15 nt, Homo sapiens
aacauuauacacaaa

SEQ ID NO: 2081829 - RNA, 22 nt, Homo sapiens
ucaauacacucaagugccauuc

SEQ ID NO: 2081830 - RNA, 17 nt, Homo sapiens
ugcacauuuaugaauca

SEQ ID NO: 2081831 - RNA, 13 nt, Homo sapiens
aggaggaauuuac

SEQ ID NO: 2081832 - RNA, 20 nt, Homo sapiens
ugguacuccacauauuucag

SEQ ID NO: 2081833 - RNA, 21 nt, Homo sapiens
uccugaaauagggagacugac

SEQ ID NO: 2081834 - RNA, 17 nt, Homo sapiens
caaaauaaaacagaugu

SEQ ID NO: 2081835 - RNA, 17 nt, Homo sapiens
aaaucaagaccaaagag

SEQ ID NO: 2081836 - RNA, 18 nt, Homo sapiens
uccaauaaagaguuccuu

SEQ ID NO: 2081837 - RNA, 22 nt, Homo sapiens
ucagcaugcauccuuugcacug

SEQ ID NO: 2081838 - RNA, 17 nt, Homo sapiens
caaguuguuugagaaau

SEQ ID NO: 2081839 - RNA, 17 nt, Homo sapiens
agacccuuuucucagga

SEQ ID NO: 2081840 - RNA, 20 nt, Homo sapiens
guggagaacagaaauccacg

SEQ ID NO: 2081841 - RNA, 15 nt, Homo sapiens
gugcacuagcauuuu

SEQ ID NO: 2081842 - RNA, 18 nt, Homo sapiens
cuguuuaaagcuuugaau

SEQ ID NO: 2081843 - RNA, 17 nt, Homo sapiens
aguuuugauaaaguaau

SEQ ID NO: 2081844 - RNA, 15 nt, Homo sapiens
uacaugugcacuccc

SEQ ID NO: 2081845 - RNA, 17 nt, Homo sapiens
ucucgggugggggagcc

SEQ ID NO: 2081846 - RNA, 17 nt, Homo sapiens
cuguccuacaauaucau

SEQ ID NO: 2081847 - RNA, 15 nt, Homo sapiens
gcccggaaacuccac

SEQ ID NO: 2081848 - RNA, 15 nt, Homo sapiens
uagauuaaacaaaca

SEQ ID NO: 2081849 - RNA, 16 nt, Homo sapiens
uuccaguaacccaaau

SEQ ID NO: 2081850 - RNA, 21 nt, Homo sapiens
aaaagguaccccgauggccaa

SEQ ID NO: 2081851 - RNA, 22 nt, Homo sapiens
gugcuucuuaaaauagccauaa

SEQ ID NO: 2081852 - RNA, 19 nt, Homo sapiens
aguucuugggcuggaccug

SEQ ID NO: 2081853 - RNA, 18 nt, Homo sapiens
ucagaaaauacuagccua

SEQ ID NO: 2081854 - RNA, 22 nt, Homo sapiens
acguuggggcaacuacagcucu

SEQ ID NO: 2081855 - RNA, 19 nt, Homo sapiens
gaccaugaggagaugcugg

SEQ ID NO: 2081856 - RNA, 19 nt, Homo sapiens
ggaggaagugauaguuucu

SEQ ID NO: 2081857 - RNA, 14 nt, Homo sapiens
ccugggcugugcua

SEQ ID NO: 2081858 - RNA, 17 nt, Homo sapiens
caacuuauuauaugacu

SEQ ID NO: 2081859 - RNA, 22 nt, Homo sapiens
aaggcaaaaaaggaugcaacaa

SEQ ID NO: 2081860 - RNA, 14 nt, Homo sapiens
cugagaaucuagcc

SEQ ID NO: 2081861 - RNA, 15 nt, Homo sapiens
cucagugauugcaau

SEQ ID NO: 2081862 - RNA, 18 nt, Homo sapiens
caucccagacacauucac

SEQ ID NO: 2081863 - RNA, 16 nt, Homo sapiens
uaagagguuuguauau

SEQ ID NO: 2081864 - RNA, 18 nt, Homo sapiens
aauguauuuugacacugg

SEQ ID NO: 2081865 - RNA, 13 nt, Homo sapiens
ucauuguauucag

SEQ ID NO: 2081866 - RNA, 22 nt, Homo sapiens
guagauacucucagcaccaaga

SEQ ID NO: 2081867 - RNA, 18 nt, Homo sapiens
uaguguccccccuugaag

SEQ ID NO: 2081868 - RNA, 23 nt, Homo sapiens
uguaugugagagauucugugauc

SEQ ID NO: 2081869 - RNA, 16 nt, Homo sapiens
uccagcagcagcacuu

SEQ ID NO: 2081870 - RNA, 21 nt, Homo sapiens
augugucacuacucacagucu

SEQ ID NO: 2081871 - RNA, 16 nt, Homo sapiens
gugccuguaaucacag

SEQ ID NO: 2081872 - RNA, 20 nt, Homo sapiens
auccaugugcugcuguggca

SEQ ID NO: 2081873 - RNA, 16 nt, Homo sapiens
ugagauuacaggcacc

SEQ ID NO: 2081874 - RNA, 21 nt, Homo sapiens
aguacccacucuggagcauuu

SEQ ID NO: 2081875 - RNA, 22 nt, Homo sapiens
aguguugcccaggcuggucuca

SEQ ID NO: 2081876 - RNA, 13 nt, Homo sapiens
gccaguucuccuu

SEQ ID NO: 2081877 - RNA, 22 nt, Homo sapiens
cagucccuuucagcugcugcuu

SEQ ID NO: 2081878 - RNA, 21 nt, Homo sapiens
uauaacagaauuaaaguagau

SEQ ID NO: 2081879 - RNA, 19 nt, Homo sapiens
gcaccaaaucaaaaucucu

SEQ ID NO: 2081880 - RNA, 22 nt, Homo sapiens
cagaaagugacaagcucacaga

SEQ ID NO: 2081881 - RNA, 14 nt, Homo sapiens
agaugacaaaccau

SEQ ID NO: 2081882 - RNA, 21 nt, Homo sapiens
caguaacauuucuguucucau

SEQ ID NO: 2081883 - RNA, 16 nt, Homo sapiens
caugaggccaucucag

SEQ ID NO: 2081884 - RNA, 23 nt, Homo sapiens
gauucgcccuccucccugucaua

SEQ ID NO: 2081885 - RNA, 19 nt, Homo sapiens
uucugcuuauuucaucugu

SEQ ID NO: 2081886 - RNA, 19 nt, Homo sapiens
cgacugagaaccgugacau

SEQ ID NO: 2081887 - RNA, 16 nt, Homo sapiens
guagccacuucacuuu

SEQ ID NO: 2081888 - RNA, 23 nt, Homo sapiens
cauaguaaugagugaguucucac

SEQ ID NO: 2081889 - RNA, 17 nt, Homo sapiens
ucucuccccauggggca

SEQ ID NO: 2081890 - RNA, 14 nt, Homo sapiens
acaaagacauggaa

SEQ ID NO: 2081891 - RNA, 20 nt, Homo sapiens
cagagcucagcacagccuca

SEQ ID NO: 2081892 - RNA, 20 nt, Homo sapiens
uaccaagaacugaaggcaua

SEQ ID NO: 2081893 - RNA, 21 nt, Homo sapiens
ugcgcuguggacacugagaac

SEQ ID NO: 2081894 - RNA, 18 nt, Homo sapiens
aagucucucguaguguua

SEQ ID NO: 2081895 - RNA, 12 nt, Homo sapiens
acggcacugugg

SEQ ID NO: 2081896 - RNA, 12 nt, Homo sapiens
auugcacugcug

SEQ ID NO: 2081897 - RNA, 16 nt, Homo sapiens
gguaugauaagcuuua

SEQ ID NO: 2081898 - RNA, 17 nt, Homo sapiens
uugaaugcuuaauucaa

SEQ ID NO: 2081899 - RNA, 20 nt, Homo sapiens
cggcaguucugggugcuccc

SEQ ID NO: 2081900 - RNA, 13 nt, Homo sapiens
ugcacucuagccg

SEQ ID NO: 2081901 - RNA, 21 nt, Homo sapiens
cccugugugugugugugcuga

SEQ ID NO: 2081902 - RNA, 17 nt, Homo sapiens
ugugaaggccaugauau

SEQ ID NO: 2081903 - RNA, 12 nt, Homo sapiens
cagcugugcugu

SEQ ID NO: 2081904 - RNA, 12 nt, Homo sapiens
auacugugaaau

SEQ ID NO: 2081905 - RNA, 15 nt, Homo sapiens
acagcuuuucuugau

SEQ ID NO: 2081906 - RNA, 12 nt, Homo sapiens
cgcaccaugugg

SEQ ID NO: 2081907 - RNA, 15 nt, Homo sapiens
cagcgcgugcacagc

SEQ ID NO: 2081908 - RNA, 12 nt, Homo sapiens
acacugucaugc

SEQ ID NO: 2081909 - RNA, 19 nt, Homo sapiens
uuucccgcgcuccaugccu

SEQ ID NO: 2081910 - RNA, 22 nt, Homo sapiens
ccaugggauuuuaucuguggau

SEQ ID NO: 2081911 - RNA, 17 nt, Homo sapiens
gacaccuggacaauauu

SEQ ID NO: 2081912 - RNA, 20 nt, Homo sapiens
uggcuuauauucuaagucac

SEQ ID NO: 2081913 - RNA, 14 nt, Homo sapiens
ggacuguaagggau

SEQ ID NO: 2081914 - RNA, 23 nt, Homo sapiens
ggccuuguuucaaaauucucauu

SEQ ID NO: 2081915 - RNA, 14 nt, Homo sapiens
agaaccacucauaa

SEQ ID NO: 2081916 - RNA, 17 nt, Homo sapiens
ucagcaagaauuugauc

SEQ ID NO: 2081917 - RNA, 18 nt, Homo sapiens
cacucuccgaagucugau

SEQ ID NO: 2081918 - RNA, 20 nt, Homo sapiens
cugaguggaaugcagggaag

SEQ ID NO: 2081919 - RNA, 16 nt, Homo sapiens
gcaggcaagcagaugu

SEQ ID NO: 2081920 - RNA, 23 nt, Homo sapiens
gauuccgcaccaauaaagccuuc

SEQ ID NO: 2081921 - RNA, 14 nt, Homo sapiens
aaaugugccuucau

SEQ ID NO: 2081922 - RNA, 16 nt, Homo sapiens
aguguuaagugugcag

SEQ ID NO: 2081923 - RNA, 18 nt, Homo sapiens
aagcccuccccaucccau

SEQ ID NO: 2081924 - RNA, 19 nt, Homo sapiens
ucacagagugagacuccau

SEQ ID NO: 2081925 - RNA, 12 nt, Homo sapiens
uaaugacucucu

SEQ ID NO: 2081926 - RNA, 18 nt, Homo sapiens
uaaccacuaacauuguga

SEQ ID NO: 2081927 - RNA, 18 nt, Homo sapiens
caguacccagagaccaag

SEQ ID NO: 2081928 - RNA, 15 nt, Homo sapiens
cuagauuauaucaaa

SEQ ID NO: 2081929 - RNA, 19 nt, Homo sapiens
aaaagccuuggccucagag

SEQ ID NO: 2081930 - RNA, 19 nt, Homo sapiens
ugauaccauggcacugaca

SEQ ID NO: 2081931 - RNA, 19 nt, Homo sapiens
uugucauguuaugcaguga

SEQ ID NO: 2081932 - RNA, 20 nt, Homo sapiens
cuugcacacagggaggcugu

SEQ ID NO: 2081933 - RNA, 18 nt, Homo sapiens
ccagcacuuugggagacc

SEQ ID NO: 2081934 - RNA, 13 nt, Homo sapiens
ugaaggcugagug

SEQ ID NO: 2081935 - RNA, 22 nt, Homo sapiens
cauacucuguguaaucucugau

SEQ ID NO: 2081936 - RNA, 13 nt, Homo sapiens
gugagccacugug

SEQ ID NO: 2081937 - RNA, 20 nt, Homo sapiens
uuaucaaauuugccaugaca

SEQ ID NO: 2081938 - RNA, 20 nt, Homo sapiens
auaugaaaaucuccaucuca

SEQ ID NO: 2081939 - RNA, 19 nt, Homo sapiens
ccuccagggcgagcacuuu

SEQ ID NO: 2081940 - RNA, 17 nt, Homo sapiens
agcucugagccuuccac

SEQ ID NO: 2081941 - RNA, 12 nt, Homo sapiens
acuccagccaaa

SEQ ID NO: 2081942 - RNA, 20 nt, Homo sapiens
ucccacccacaugugacaca

SEQ ID NO: 2081943 - RNA, 22 nt, Homo sapiens
ggcauuugauuaaauuaugaau

SEQ ID NO: 2081944 - RNA, 17 nt, Homo sapiens
cauucuuugugguuaaa

SEQ ID NO: 2081945 - RNA, 22 nt, Homo sapiens
aaaucuaaaaaacgaaaagucu

SEQ ID NO: 2081946 - RNA, 12 nt, Homo sapiens
ccaucugcauuu

SEQ ID NO: 2081947 - RNA, 12 nt, Homo sapiens
ugguucuuucau

SEQ ID NO: 2081948 - RNA, 20 nt, Homo sapiens
gcuuaggaaagaacaucacu

SEQ ID NO: 2081949 - RNA, 21 nt, Homo sapiens
aguuugcuuauguaaucucac

SEQ ID NO: 2081950 - RNA, 16 nt, Homo sapiens
caggagccuaccacaa

SEQ ID NO: 2081951 - RNA, 12 nt, Homo sapiens
accaggccucug

SEQ ID NO: 2081952 - RNA, 14 nt, Homo sapiens
gcccacauauuuca

SEQ ID NO: 2081953 - RNA, 18 nt, Homo sapiens
agcgaggaggcuccagag

SEQ ID NO: 2081954 - RNA, 20 nt, Homo sapiens
ugugcccuccaaagagccuu

SEQ ID NO: 2081955 - RNA, 14 nt, Homo sapiens
cagacaugaacugc

SEQ ID NO: 2081956 - RNA, 18 nt, Homo sapiens
gaaaaugaaccauucaca

SEQ ID NO: 2081957 - RNA, 18 nt, Homo sapiens
gcaaccuccgccucccag

SEQ ID NO: 2081958 - RNA, 18 nt, Homo sapiens
auacuaaaccagcauacc

SEQ ID NO: 2081959 - RNA, 15 nt, Homo sapiens
ugcaguuauguuauc

SEQ ID NO: 2081960 - RNA, 16 nt, Homo sapiens
uccuguuuacugaaaa

SEQ ID NO: 2081961 - RNA, 14 nt, Homo sapiens
auguaaagugcaau

SEQ ID NO: 2081962 - RNA, 20 nt, Homo sapiens
ucugccuuuagcuuugacag

SEQ ID NO: 2081963 - RNA, 15 nt, Homo sapiens
aagugagacaaucac

SEQ ID NO: 2081964 - RNA, 17 nt, Homo sapiens
acuugagcgugaaucug

SEQ ID NO: 2081965 - RNA, 15 nt, Homo sapiens
aaugagcuuccauua

SEQ ID NO: 2081966 - RNA, 13 nt, Homo sapiens
ucguagccaucuc

SEQ ID NO: 2081967 - RNA, 17 nt, Homo sapiens
uuguaaguaaauugccu

SEQ ID NO: 2081968 - RNA, 15 nt, Homo sapiens
ccagucauucuggga

SEQ ID NO: 2081969 - RNA, 17 nt, Homo sapiens
aggaaaacaccuuuauu

SEQ ID NO: 2081970 - RNA, 23 nt, Homo sapiens
guaguucaaagagucugucuuga

SEQ ID NO: 2081971 - RNA, 15 nt, Homo sapiens
uuaccgacacuguca

SEQ ID NO: 2081972 - RNA, 21 nt, Homo sapiens
cacccuggaaccgggaagggu

SEQ ID NO: 2081973 - RNA, 12 nt, Homo sapiens
auuuuuuccaca

SEQ ID NO: 2081974 - RNA, 15 nt, Homo sapiens
ugccgcauuccugca

SEQ ID NO: 2081975 - RNA, 22 nt, Homo sapiens
guaauaaacucauuucuagcag

SEQ ID NO: 2081976 - RNA, 20 nt, Homo sapiens
cagaaucacauguaauccaa

SEQ ID NO: 2081977 - RNA, 20 nt, Homo sapiens
cuguaaucucggaaggcuga

SEQ ID NO: 2081978 - RNA, 20 nt, Homo sapiens
ccaagugggaaacaagaaca

SEQ ID NO: 2081979 - RNA, 18 nt, Homo sapiens
auuacugugugugagcca

SEQ ID NO: 2081980 - RNA, 12 nt, Homo sapiens
augggcacugau

SEQ ID NO: 2081981 - RNA, 12 nt, Homo sapiens
ccuaccaaauau

SEQ ID NO: 2081982 - RNA, 13 nt, Homo sapiens
uguauggauaugu

SEQ ID NO: 2081983 - RNA, 14 nt, Homo sapiens
uaaaacuaagcaca

SEQ ID NO: 2081984 - RNA, 17 nt, Homo sapiens
guuuguaagacuuacaa

SEQ ID NO: 2081985 - RNA, 20 nt, Homo sapiens
agcaccaaaauuaugguguu

SEQ ID NO: 2081986 - RNA, 21 nt, Homo sapiens
aaugugauuauuuuaugcaca

SEQ ID NO: 2081987 - RNA, 18 nt, Homo sapiens
ggccaacaaggacucaga

SEQ ID NO: 2081988 - RNA, 19 nt, Homo sapiens
uuaaaugcauguccucaaa

SEQ ID NO: 2081989 - RNA, 12 nt, Homo sapiens
ccuuuucagggc

SEQ ID NO: 2081990 - RNA, 20 nt, Homo sapiens
gcucagguuuugagaagcca

SEQ ID NO: 2081991 - RNA, 18 nt, Homo sapiens
cuuggucgccuagacugg

SEQ ID NO: 2081992 - RNA, 22 nt, Homo sapiens
cauguaacgcaaguucccaguu

SEQ ID NO: 2081993 - RNA, 22 nt, Homo sapiens
uaggcuuaucagggaguuacag

SEQ ID NO: 2081994 - RNA, 16 nt, Homo sapiens
cacuggagccugcaau

SEQ ID NO: 2081995 - RNA, 23 nt, Homo sapiens
uaacacauagcgccgugcuguaa

SEQ ID NO: 2081996 - RNA, 16 nt, Homo sapiens
cccuagggcucuccaa

SEQ ID NO: 2081997 - RNA, 21 nt, Homo sapiens
caggaguucagggucauagca

SEQ ID NO: 2081998 - RNA, 17 nt, Homo sapiens
cccaggucagcaucucg

SEQ ID NO: 2081999 - RNA, 22 nt, Homo sapiens
aguagucagaacuauaacauuc

SEQ ID NO: 2082000 - RNA, 23 nt, Homo sapiens
gacaucccugauucucucuccau

SEQ ID NO: 2082001 - RNA, 13 nt, Homo sapiens
uuacguaguucua

SEQ ID NO: 2082002 - RNA, 23 nt, Homo sapiens
uaaacaaugaugcccugcuccag

SEQ ID NO: 2082003 - RNA, 17 nt, Homo sapiens
gccucgcggucuugggc

SEQ ID NO: 2082004 - RNA, 13 nt, Homo sapiens
ucuuaaucuaaga

SEQ ID NO: 2082005 - RNA, 18 nt, Homo sapiens
uaauuuuuagauauucau

SEQ ID NO: 2082006 - RNA, 13 nt, Homo sapiens
gucauguuugcag

SEQ ID NO: 2082007 - RNA, 17 nt, Homo sapiens
cucuucaaucucuggaa

SEQ ID NO: 2082008 - RNA, 16 nt, Homo sapiens
gaagccugaggcaaaa

SEQ ID NO: 2082009 - RNA, 17 nt, Homo sapiens
ugggucaaggacagggc

SEQ ID NO: 2082010 - RNA, 13 nt, Homo sapiens
aagcuggcuuccu

SEQ ID NO: 2082011 - RNA, 21 nt, Homo sapiens
ucauuuccuauguaacugcau

SEQ ID NO: 2082012 - RNA, 13 nt, Homo sapiens
acaguaguguucu

SEQ ID NO: 2082013 - RNA, 20 nt, Homo sapiens
accucacaggccccaggaaa

SEQ ID NO: 2082014 - RNA, 17 nt, Homo sapiens
ucgagguagguggauca

SEQ ID NO: 2082015 - RNA, 17 nt, Homo sapiens
gguuucuccagagggaa

SEQ ID NO: 2082016 - RNA, 23 nt, Homo sapiens
aaagcuaaggaccuuaagacaga

SEQ ID NO: 2082017 - RNA, 15 nt, Homo sapiens
guacagccgugcaca

SEQ ID NO: 2082018 - RNA, 12 nt, Homo sapiens
caaauacauucc

SEQ ID NO: 2082019 - RNA, 21 nt, Homo sapiens
uaaguaauugccacagcugua

SEQ ID NO: 2082020 - RNA, 20 nt, Homo sapiens
acugccucuuccucccucau

SEQ ID NO: 2082021 - RNA, 20 nt, Homo sapiens
ucuuacacacugucuguaua

SEQ ID NO: 2082022 - RNA, 15 nt, Homo sapiens
cugccaugucacaau

SEQ ID NO: 2082023 - RNA, 19 nt, Homo sapiens
cuaugcacagauuaaacuu

SEQ ID NO: 2082024 - RNA, 19 nt, Homo sapiens
augggcgcaggcccaguga

SEQ ID NO: 2082025 - RNA, 14 nt, Homo sapiens
cggugaacucuggc

SEQ ID NO: 2082026 - RNA, 19 nt, Homo sapiens
cagaugcugaaagagaaaa

SEQ ID NO: 2082027 - RNA, 15 nt, Homo sapiens
ucagaggagccaaua

SEQ ID NO: 2082028 - RNA, 15 nt, Homo sapiens
guaauaacuucucug

SEQ ID NO: 2082029 - RNA, 18 nt, Homo sapiens
gacccaccacuggaagca

SEQ ID NO: 2082030 - RNA, 21 nt, Homo sapiens
aggauggcuugcgcucaggag

SEQ ID NO: 2082031 - RNA, 20 nt, Homo sapiens
ccaggccugggaauggauua

SEQ ID NO: 2082032 - RNA, 20 nt, Homo sapiens
aggcuggaguggaguggcac

SEQ ID NO: 2082033 - RNA, 13 nt, Homo sapiens
ucccagcugugcu

SEQ ID NO: 2082034 - RNA, 22 nt, Homo sapiens
agaaauauuuaguaucuaguca

SEQ ID NO: 2082035 - RNA, 12 nt, Homo sapiens
uucugucuguag

SEQ ID NO: 2082036 - RNA, 13 nt, Homo sapiens
agucuuccaugac

SEQ ID NO: 2082037 - RNA, 20 nt, Homo sapiens
aggaacucaauaaagugcuu

SEQ ID NO: 2082038 - RNA, 18 nt, Homo sapiens
acugcauucuucugagca

SEQ ID NO: 2082039 - RNA, 22 nt, Homo sapiens
gccuggcccaccuuccccagaa

SEQ ID NO: 2082040 - RNA, 17 nt, Homo sapiens
cucacgcugccauuucc

SEQ ID NO: 2082041 - RNA, 12 nt, Homo sapiens
augaaugcagug

SEQ ID NO: 2082042 - RNA, 20 nt, Homo sapiens
gagguuucccaaugguguuu

SEQ ID NO: 2082043 - RNA, 20 nt, Homo sapiens
ucaaucaaccugcacuucau

SEQ ID NO: 2082044 - RNA, 19 nt, Homo sapiens
acaugagccuuuguugcua

SEQ ID NO: 2082045 - RNA, 14 nt, Homo sapiens
caagucccaucuca

SEQ ID NO: 2082046 - RNA, 22 nt, Homo sapiens
accuugucccuugucaguucca

SEQ ID NO: 2082047 - RNA, 22 nt, Homo sapiens
uugggacccugcuuuagagcua

SEQ ID NO: 2082048 - RNA, 17 nt, Homo sapiens
uugacuucgacugugac

SEQ ID NO: 2082049 - RNA, 17 nt, Homo sapiens
cacccaaaucacaucuc

SEQ ID NO: 2082050 - RNA, 17 nt, Homo sapiens
gaaucugcuguugccau

SEQ ID NO: 2082051 - RNA, 21 nt, Homo sapiens
gggauggccagagaugcugga

SEQ ID NO: 2082052 - RNA, 15 nt, Homo sapiens
agauaaccauauuca

SEQ ID NO: 2082053 - RNA, 13 nt, Homo sapiens
gacuauacauacu

SEQ ID NO: 2082054 - RNA, 24 nt, Homo sapiens
uagaagggccagauuucauucuca

SEQ ID NO: 2082055 - RNA, 21 nt, Homo sapiens
cacuccuuucuugcacuauuc

SEQ ID NO: 2082056 - RNA, 16 nt, Homo sapiens
agcauagccagcauuc

SEQ ID NO: 2082057 - RNA, 14 nt, Homo sapiens
agcaccuaaacuua

SEQ ID NO: 2082058 - RNA, 22 nt, Homo sapiens
gucagacuuugcugcauuuuac

SEQ ID NO: 2082059 - RNA, 21 nt, Homo sapiens
uuugaagcacaacucccuuaa

SEQ ID NO: 2082060 - RNA, 15 nt, Homo sapiens
cgcaaggccugugcu

SEQ ID NO: 2082061 - RNA, 23 nt, Homo sapiens
aguuuuaaaaaaaacaauuccac

SEQ ID NO: 2082062 - RNA, 22 nt, Homo sapiens
agaccuaacccaccauagucaa

SEQ ID NO: 2082063 - RNA, 17 nt, Homo sapiens
gaagaaaccgauuuuua

SEQ ID NO: 2082064 - RNA, 15 nt, Homo sapiens
guguacccauauaua

SEQ ID NO: 2082065 - RNA, 15 nt, Homo sapiens
ugugagcaugacuua

SEQ ID NO: 2082066 - RNA, 22 nt, Homo sapiens
cuuuaaauacuauuauuugcua

SEQ ID NO: 2082067 - RNA, 12 nt, Homo sapiens
uguacuguaaac

SEQ ID NO: 2082068 - RNA, 22 nt, Homo sapiens
uuuccauauagcucgagcaaaa

SEQ ID NO: 2082069 - RNA, 18 nt, Homo sapiens
aacuggauaaaaucuucc

SEQ ID NO: 2082070 - RNA, 20 nt, Homo sapiens
ugcugaccccugugugacau

SEQ ID NO: 2082071 - RNA, 18 nt, Homo sapiens
uguaacggccaacacuuu

SEQ ID NO: 2082072 - RNA, 15 nt, Homo sapiens
cagaaauuccaacuc

SEQ ID NO: 2082073 - RNA, 22 nt, Homo sapiens
aucucuugccugcuccaucuca

SEQ ID NO: 2082074 - RNA, 14 nt, Homo sapiens
aagcuuccuucaac

SEQ ID NO: 2082075 - RNA, 13 nt, Homo sapiens
aagcaaacacuua

SEQ ID NO: 2082076 - RNA, 22 nt, Homo sapiens
ucucgaagcaguauucuaguga

SEQ ID NO: 2082077 - RNA, 15 nt, Homo sapiens
augacauauguagau

SEQ ID NO: 2082078 - RNA, 15 nt, Homo sapiens
cuaaugcauuuugca

SEQ ID NO: 2082079 - RNA, 14 nt, Homo sapiens
gugagcacaaagaa

SEQ ID NO: 2082080 - RNA, 17 nt, Homo sapiens
caucugucuugucauuc

SEQ ID NO: 2082081 - RNA, 17 nt, Homo sapiens
auaugcccacauuuagu

SEQ ID NO: 2082082 - RNA, 16 nt, Homo sapiens
uccuccacauccuuuc

SEQ ID NO: 2082083 - RNA, 23 nt, Homo sapiens
ccguugcuacaagucaccuggug

SEQ ID NO: 2082084 - RNA, 14 nt, Homo sapiens
uggaaaaugugcaa

SEQ ID NO: 2082085 - RNA, 14 nt, Homo sapiens
uaagcucagugaua

SEQ ID NO: 2082086 - RNA, 17 nt, Homo sapiens
ucucccaguccauuucc

SEQ ID NO: 2082087 - RNA, 18 nt, Homo sapiens
uagcaaaauuacuaccag

SEQ ID NO: 2082088 - RNA, 16 nt, Homo sapiens
agcaagacuccauuuc

SEQ ID NO: 2082089 - RNA, 16 nt, Homo sapiens
cuuaaaaugugcagua

SEQ ID NO: 2082090 - RNA, 22 nt, Homo sapiens
gaggauguucgucucaguuugu

SEQ ID NO: 2082091 - RNA, 15 nt, Homo sapiens
augguugccaggacg

SEQ ID NO: 2082092 - RNA, 14 nt, Homo sapiens
guauugaucaaugc

SEQ ID NO: 2082093 - RNA, 23 nt, Homo sapiens
gaaagccucucaguacagcacuc

SEQ ID NO: 2082094 - RNA, 17 nt, Homo sapiens
uaaaagacguugccuau

SEQ ID NO: 2082095 - RNA, 16 nt, Homo sapiens
uccugaggagcccuga

SEQ ID NO: 2082096 - RNA, 15 nt, Homo sapiens
auacuuaaugcauau

SEQ ID NO: 2082097 - RNA, 14 nt, Homo sapiens
cuaacauagugucu

SEQ ID NO: 2082098 - RNA, 14 nt, Homo sapiens
ccucaggcagcuca

SEQ ID NO: 2082099 - RNA, 16 nt, Homo sapiens
gaaaaggcaagacuug

SEQ ID NO: 2082100 - RNA, 19 nt, Homo sapiens
cuagcccuccccccagcuc

SEQ ID NO: 2082101 - RNA, 21 nt, Homo sapiens
cucgcccagacaccaugugca

SEQ ID NO: 2082102 - RNA, 16 nt, Homo sapiens
uaaguaaaccaaaaag

SEQ ID NO: 2082103 - RNA, 13 nt, Homo sapiens
cccuacccggcuc

SEQ ID NO: 2082104 - RNA, 17 nt, Homo sapiens
aaauaagacuuccacuc

SEQ ID NO: 2082105 - RNA, 14 nt, Homo sapiens
agaaacuuuccauc

SEQ ID NO: 2082106 - RNA, 23 nt, Homo sapiens
uccaugcaacuggaguuccuuau

SEQ ID NO: 2082107 - RNA, 16 nt, Homo sapiens
augcagucuauuccag

SEQ ID NO: 2082108 - RNA, 13 nt, Homo sapiens
aggaggcugcuuc

SEQ ID NO: 2082109 - RNA, 20 nt, Homo sapiens
ugacauguauaguauacucu

SEQ ID NO: 2082110 - RNA, 21 nt, Homo sapiens
aaccuaacuggcuuacuuccu

SEQ ID NO: 2082111 - RNA, 12 nt, Homo sapiens
ccagugcccauc

SEQ ID NO: 2082112 - RNA, 18 nt, Homo sapiens
acauauaaagcacuauac

SEQ ID NO: 2082113 - RNA, 20 nt, Homo sapiens
auuguacgugggagaggcag

SEQ ID NO: 2082114 - RNA, 12 nt, Homo sapiens
cuugguacccac

SEQ ID NO: 2082115 - RNA, 22 nt, Homo sapiens
cagaggauuucuuuagugucau

SEQ ID NO: 2082116 - RNA, 21 nt, Homo sapiens
uggcaagugaauuugccugua

SEQ ID NO: 2082117 - RNA, 17 nt, Homo sapiens
cagcacccccagugcag

SEQ ID NO: 2082118 - RNA, 16 nt, Homo sapiens
guggucagagugccac

SEQ ID NO: 2082119 - RNA, 15 nt, Homo sapiens
acuucuaaaugcaua

SEQ ID NO: 2082120 - RNA, 19 nt, Homo sapiens
uuucagaugauucuauguc

SEQ ID NO: 2082121 - RNA, 22 nt, Homo sapiens
uuccacauaggaaaaugccaug

SEQ ID NO: 2082122 - RNA, 13 nt, Homo sapiens
acacaaaugugac

SEQ ID NO: 2082123 - RNA, 19 nt, Homo sapiens
gaugcaggauguucaggga

SEQ ID NO: 2082124 - RNA, 16 nt, Homo sapiens
acagcaugccuucaaa

SEQ ID NO: 2082125 - RNA, 16 nt, Homo sapiens
ucacuauaaccaucag

SEQ ID NO: 2082126 - RNA, 17 nt, Homo sapiens
uagaaugcuuggcacuc

SEQ ID NO: 2082127 - RNA, 11 nt, Homo sapiens
aaacuaacuug

SEQ ID NO: 2082128 - RNA, 15 nt, Homo sapiens
gaguuuagggaacaa

SEQ ID NO: 2082129 - RNA, 17 nt, Homo sapiens
cugccugugaaugcuga

SEQ ID NO: 2082130 - RNA, 17 nt, Homo sapiens
uauauauguguaugcac

SEQ ID NO: 2082131 - RNA, 12 nt, Homo sapiens
uggaagcacuug

SEQ ID NO: 2082132 - RNA, 21 nt, Homo sapiens
agugcuggggaacaaccagag

SEQ ID NO: 2082133 - RNA, 13 nt, Homo sapiens
uuucuagacuguc

SEQ ID NO: 2082134 - RNA, 13 nt, Homo sapiens
ccgucagaucucu

SEQ ID NO: 2082135 - RNA, 20 nt, Homo sapiens
uuauaucuaaaucuguccaa

SEQ ID NO: 2082136 - RNA, 21 nt, Homo sapiens
aaaauaggagagagaucauga

SEQ ID NO: 2082137 - RNA, 14 nt, Homo sapiens
gcagaaaacagagg

SEQ ID NO: 2082138 - RNA, 20 nt, Homo sapiens
aggcuauauuucugggauga

SEQ ID NO: 2082139 - RNA, 21 nt, Homo sapiens
aagggaguugcucacucagga

SEQ ID NO: 2082140 - RNA, 15 nt, Homo sapiens
ucuggcacguggcca

SEQ ID NO: 2082141 - RNA, 16 nt, Homo sapiens
aagaggaaaaaaagcc

SEQ ID NO: 2082142 - RNA, 16 nt, Homo sapiens
ggaaagaaacuaccuu

SEQ ID NO: 2082143 - RNA, 23 nt, Homo sapiens
gacucauggcagcuguuucucau

SEQ ID NO: 2082144 - RNA, 20 nt, Homo sapiens
uuaguauuauuguugcauua

SEQ ID NO: 2082145 - RNA, 22 nt, Homo sapiens
uguaccauauucagcauuugau

SEQ ID NO: 2082146 - RNA, 13 nt, Homo sapiens
uccuuuucuauua

SEQ ID NO: 2082147 - RNA, 15 nt, Homo sapiens
auauacaugcucaac

SEQ ID NO: 2082148 - RNA, 20 nt, Homo sapiens
ucuauugagugaacagaauu

SEQ ID NO: 2082149 - RNA, 14 nt, Homo sapiens
uucuacuuugccac

SEQ ID NO: 2082150 - RNA, 22 nt, Homo sapiens
cuaugauauuuucugugccuga

SEQ ID NO: 2082151 - RNA, 24 nt, Homo sapiens
gcgguggccacagcgugcuggcga

SEQ ID NO: 2082152 - RNA, 23 nt, Homo sapiens
agucaaggauggaugcagaucca

SEQ ID NO: 2082153 - RNA, 16 nt, Homo sapiens
agagcugguggaccca

SEQ ID NO: 2082154 - RNA, 19 nt, Homo sapiens
acagcccacggggaucaca

SEQ ID NO: 2082155 - RNA, 14 nt, Homo sapiens
aaacauuuuacaga

SEQ ID NO: 2082156 - RNA, 14 nt, Homo sapiens
ucaauacagcuuca

SEQ ID NO: 2082157 - RNA, 16 nt, Homo sapiens
auaagaaaguauaaag

SEQ ID NO: 2082158 - RNA, 20 nt, Homo sapiens
ucccgaggaugcugucagga

SEQ ID NO: 2082159 - RNA, 15 nt, Homo sapiens
ucucuagaagugcca

SEQ ID NO: 2082160 - RNA, 15 nt, Homo sapiens
uggcucugaagccaa

SEQ ID NO: 2082161 - RNA, 23 nt, Homo sapiens
gugucauuuaugugucaguucau

SEQ ID NO: 2082162 - RNA, 23 nt, Homo sapiens
gaaacacaucuucccuagagggu

SEQ ID NO: 2082163 - RNA, 23 nt, Homo sapiens
ggcaugugcggcugaacugagaa

SEQ ID NO: 2082164 - RNA, 18 nt, Homo sapiens
auucuccugccucagccu

SEQ ID NO: 2082165 - RNA, 18 nt, Homo sapiens
ucucccgggacuaccugg

SEQ ID NO: 2082166 - RNA, 15 nt, Homo sapiens
ggcauuuccugggug

SEQ ID NO: 2082167 - RNA, 18 nt, Homo sapiens
guaauaaaugugacucag

SEQ ID NO: 2082168 - RNA, 20 nt, Homo sapiens
gcauuuagacccugcauuua

SEQ ID NO: 2082169 - RNA, 20 nt, Homo sapiens
cuucccuuaacuccaagaac

SEQ ID NO: 2082170 - RNA, 19 nt, Homo sapiens
agcgauccucccaccucag

SEQ ID NO: 2082171 - RNA, 15 nt, Homo sapiens
ucucuaugugaauau

SEQ ID NO: 2082172 - RNA, 19 nt, Homo sapiens
uuuaucacacuucugugag

SEQ ID NO: 2082173 - RNA, 23 nt, Homo sapiens
aagugcugggaugacagguguga

SEQ ID NO: 2082174 - RNA, 18 nt, Homo sapiens
agcagggauuaaccucug

SEQ ID NO: 2082175 - RNA, 15 nt, Homo sapiens
cccagccugaaagau

SEQ ID NO: 2082176 - RNA, 15 nt, Homo sapiens
agccuuuucccuuag

SEQ ID NO: 2082177 - RNA, 22 nt, Homo sapiens
ugaucuucagggaacugcauag

SEQ ID NO: 2082178 - RNA, 15 nt, Homo sapiens
ucccguacugucugu

SEQ ID NO: 2082179 - RNA, 15 nt, Homo sapiens
uaaccucaaaacugu

SEQ ID NO: 2082180 - RNA, 14 nt, Homo sapiens
ucucuugacagucu

SEQ ID NO: 2082181 - RNA, 19 nt, Homo sapiens
ugcccaggaccaucuuccc

SEQ ID NO: 2082182 - RNA, 18 nt, Homo sapiens
ucuaacuggacaugaagg

SEQ ID NO: 2082183 - RNA, 18 nt, Homo sapiens
uaccacagugucuguauc

SEQ ID NO: 2082184 - RNA, 22 nt, Homo sapiens
gaucaugguuuagggugaucag

SEQ ID NO: 2082185 - RNA, 21 nt, Homo sapiens
augcuggcuuuucaccccaga

SEQ ID NO: 2082186 - RNA, 19 nt, Homo sapiens
aucuuuccuaggcagauca

SEQ ID NO: 2082187 - RNA, 13 nt, Homo sapiens
ucaagaaacugau

SEQ ID NO: 2082188 - RNA, 21 nt, Homo sapiens
cuccugggaaugaagcaaugc

SEQ ID NO: 2082189 - RNA, 21 nt, Homo sapiens
ucucagcuucacccugaggug

SEQ ID NO: 2082190 - RNA, 12 nt, Homo sapiens
uugauacaacag

SEQ ID NO: 2082191 - RNA, 21 nt, Homo sapiens
auagaagggcaauauuuuauc

SEQ ID NO: 2082192 - RNA, 12 nt, Homo sapiens
ugaugacaucca

SEQ ID NO: 2082193 - RNA, 14 nt, Homo sapiens
agagugguuuccaa

SEQ ID NO: 2082194 - RNA, 20 nt, Homo sapiens
aguguauuuuauaagcauuu

SEQ ID NO: 2082195 - RNA, 19 nt, Homo sapiens
agaacaugaccuccgugua

SEQ ID NO: 2082196 - RNA, 16 nt, Homo sapiens
cccagcuacucaggag

SEQ ID NO: 2082197 - RNA, 14 nt, Homo sapiens
cuaggaaccagcca

SEQ ID NO: 2082198 - RNA, 14 nt, Homo sapiens
aaugacucuggaac

SEQ ID NO: 2082199 - RNA, 17 nt, Homo sapiens
augauagucaucaucaa

SEQ ID NO: 2082200 - RNA, 17 nt, Homo sapiens
cauauucaaugcaagua

SEQ ID NO: 2082201 - RNA, 16 nt, Homo sapiens
ccuucuaguuaccaca

SEQ ID NO: 2082202 - RNA, 16 nt, Homo sapiens
uuuaauaagaguaaaa

SEQ ID NO: 2082203 - RNA, 18 nt, Homo sapiens
uccacuuggaaauggcau

SEQ ID NO: 2082204 - RNA, 16 nt, Homo sapiens
acuucuuuuuaaucuu

SEQ ID NO: 2082205 - RNA, 19 nt, Homo sapiens
gggccgcucucccccugca

SEQ ID NO: 2082206 - RNA, 14 nt, Homo sapiens
aaaaguaaugacuu

SEQ ID NO: 2082207 - RNA, 17 nt, Homo sapiens
cccuugagcuacuucaa

SEQ ID NO: 2082208 - RNA, 19 nt, Homo sapiens
caaaagcagcacaaggaau

SEQ ID NO: 2082209 - RNA, 22 nt, Homo sapiens
uuauccaagaccugaaagaugg

SEQ ID NO: 2082210 - RNA, 15 nt, Homo sapiens
cuuggauaccagcuc

SEQ ID NO: 2082211 - RNA, 22 nt, Homo sapiens
cugcucuugcaguugcucugac

SEQ ID NO: 2082212 - RNA, 16 nt, Homo sapiens
gaacaugaaaugcccu

SEQ ID NO: 2082213 - RNA, 20 nt, Homo sapiens
auaucuuugcugcuuuccag

SEQ ID NO: 2082214 - RNA, 20 nt, Homo sapiens
gggaaaaaaacaguugcaua

SEQ ID NO: 2082215 - RNA, 18 nt, Homo sapiens
caggagcccugcuaugaa

SEQ ID NO: 2082216 - RNA, 15 nt, Homo sapiens
acaacuuuagaauuu

SEQ ID NO: 2082217 - RNA, 21 nt, Homo sapiens
ccucuaaaacuagaaaaggaa

SEQ ID NO: 2082218 - RNA, 14 nt, Homo sapiens
uagacugagucaga

SEQ ID NO: 2082219 - RNA, 13 nt, Homo sapiens
aaauaaauagugu

SEQ ID NO: 2082220 - RNA, 23 nt, Homo sapiens
acacagacccacacauguuuaca

SEQ ID NO: 2082221 - RNA, 17 nt, Homo sapiens
ggccaaggucagggagc

SEQ ID NO: 2082222 - RNA, 19 nt, Homo sapiens
aaaauccaacucucugaga

SEQ ID NO: 2082223 - RNA, 21 nt, Homo sapiens
cuguucuaccaagaacugaag

SEQ ID NO: 2082224 - RNA, 22 nt, Homo sapiens
gagagcucaggauggcucagac

SEQ ID NO: 2082225 - RNA, 23 nt, Homo sapiens
cacucucucucuguuaaagauca

SEQ ID NO: 2082226 - RNA, 23 nt, Homo sapiens
gauccaggaacacaugcacacac

SEQ ID NO: 2082227 - RNA, 18 nt, Homo sapiens
caaaggucccugagcucu

SEQ ID NO: 2082228 - RNA, 19 nt, Homo sapiens
aguccuaugucucagugcc

SEQ ID NO: 2082229 - RNA, 21 nt, Homo sapiens
aggugggucuaccucaucucu

SEQ ID NO: 2082230 - RNA, 17 nt, Homo sapiens
gagccuuggaauucuau

SEQ ID NO: 2082231 - RNA, 15 nt, Homo sapiens
gacgagguccucaca

SEQ ID NO: 2082232 - RNA, 19 nt, Homo sapiens
acuuuaaucccacuugccc

SEQ ID NO: 2082233 - RNA, 22 nt, Homo sapiens
augccuuuucccaaaauguuga

SEQ ID NO: 2082234 - RNA, 17 nt, Homo sapiens
augacauucaugccugg

SEQ ID NO: 2082235 - RNA, 19 nt, Homo sapiens
agugagucgaggacaggga

SEQ ID NO: 2082236 - RNA, 16 nt, Homo sapiens
gccacccagccucuug

SEQ ID NO: 2082237 - RNA, 17 nt, Homo sapiens
uuacauugccaagucag

SEQ ID NO: 2082238 - RNA, 13 nt, Homo sapiens
ccugcucugcucg

SEQ ID NO: 2082239 - RNA, 14 nt, Homo sapiens
uggguaggccccac

SEQ ID NO: 2082240 - RNA, 19 nt, Homo sapiens
caauaaagcaaugugguag

SEQ ID NO: 2082241 - RNA, 15 nt, Homo sapiens
uguuauuuacacugg

SEQ ID NO: 2082242 - RNA, 19 nt, Homo sapiens
gggaucugucacaccagcc

SEQ ID NO: 2082243 - RNA, 21 nt, Homo sapiens
gguaacauuuugacaacugaa

SEQ ID NO: 2082244 - RNA, 16 nt, Homo sapiens
gaccccaucugugaau

SEQ ID NO: 2082245 - RNA, 16 nt, Homo sapiens
caagugcgugacugua

SEQ ID NO: 2082246 - RNA, 20 nt, Homo sapiens
caccuguaauuccagcacuu

SEQ ID NO: 2082247 - RNA, 14 nt, Homo sapiens
ugagaugucuucaa

SEQ ID NO: 2082248 - RNA, 23 nt, Homo sapiens
ggaagucugauagcgucucugca

SEQ ID NO: 2082249 - RNA, 12 nt, Homo sapiens
augucacucugg

SEQ ID NO: 2082250 - RNA, 22 nt, Homo sapiens
aaaccuguauaacccuguuaca

SEQ ID NO: 2082251 - RNA, 17 nt, Homo sapiens
aguaauaagauggcugu

SEQ ID NO: 2082252 - RNA, 21 nt, Homo sapiens
cugaaaaugucacauucuauu

SEQ ID NO: 2082253 - RNA, 13 nt, Homo sapiens
uacauugucuuga

SEQ ID NO: 2082254 - RNA, 21 nt, Homo sapiens
guuuucuuuuucagauuuaug

SEQ ID NO: 2082255 - RNA, 23 nt, Homo sapiens
ucauagcuaagaaauaaaacugu

SEQ ID NO: 2082256 - RNA, 14 nt, Homo sapiens
ugcucugcuuuuag

SEQ ID NO: 2082257 - RNA, 17 nt, Homo sapiens
cuccagaacaaaccucu

SEQ ID NO: 2082258 - RNA, 16 nt, Homo sapiens
ccugccccugccccaa

SEQ ID NO: 2082259 - RNA, 12 nt, Homo sapiens
aaauaguuuaac

SEQ ID NO: 2082260 - RNA, 17 nt, Homo sapiens
aaagcugaugaggcugg

SEQ ID NO: 2082261 - RNA, 21 nt, Homo sapiens
ccuccccaguagcugggauua

SEQ ID NO: 2082262 - RNA, 20 nt, Homo sapiens
ccugaaggaaaauaaacuga

SEQ ID NO: 2082263 - RNA, 13 nt, Homo sapiens
caguuuuuccucc

SEQ ID NO: 2082264 - RNA, 13 nt, Homo sapiens
aaauaauacagga

SEQ ID NO: 2082265 - RNA, 14 nt, Homo sapiens
uggccucugauaca

SEQ ID NO: 2082266 - RNA, 13 nt, Homo sapiens
uacucaauggagu

SEQ ID NO: 2082267 - RNA, 20 nt, Homo sapiens
acauuucccuccugggagag

SEQ ID NO: 2082268 - RNA, 15 nt, Homo sapiens
gucuuaaccuaccug

SEQ ID NO: 2082269 - RNA, 14 nt, Homo sapiens
agacaauaaacccu

SEQ ID NO: 2082270 - RNA, 16 nt, Homo sapiens
uuguccugugcuugcu

SEQ ID NO: 2082271 - RNA, 19 nt, Homo sapiens
uuuccuuaguuuucuagua

SEQ ID NO: 2082272 - RNA, 17 nt, Homo sapiens
caaaacuucagacauag

SEQ ID NO: 2082273 - RNA, 16 nt, Homo sapiens
aggcugccucccaaca

SEQ ID NO: 2082274 - RNA, 19 nt, Homo sapiens
cucucgugaguauauugau

SEQ ID NO: 2082275 - RNA, 13 nt, Homo sapiens
ucuccaucuucca

SEQ ID NO: 2082276 - RNA, 14 nt, Homo sapiens
guuuugaaaaccua

SEQ ID NO: 2082277 - RNA, 14 nt, Homo sapiens
cccauaucugugaa

SEQ ID NO: 2082278 - RNA, 13 nt, Homo sapiens
agaccgucuuccu

SEQ ID NO: 2082279 - RNA, 18 nt, Homo sapiens
aauagccauguacuauaa

SEQ ID NO: 2082280 - RNA, 17 nt, Homo sapiens
ccaauguuuauugggca

SEQ ID NO: 2082281 - RNA, 14 nt, Homo sapiens
gauggagaggcaug

SEQ ID NO: 2082282 - RNA, 13 nt, Homo sapiens
ucaacgugcauuu

SEQ ID NO: 2082283 - RNA, 18 nt, Homo sapiens
uaaaaaguucucauugaa

SEQ ID NO: 2082284 - RNA, 23 nt, Homo sapiens
gaaauaaauaaaccugaauguac

SEQ ID NO: 2082285 - RNA, 19 nt, Homo sapiens
augcacuugaaaugauggu

SEQ ID NO: 2082286 - RNA, 20 nt, Homo sapiens
agggagacaccaguggugcg

SEQ ID NO: 2082287 - RNA, 22 nt, Homo sapiens
gggccuuaggaagagccuucca

SEQ ID NO: 2082288 - RNA, 22 nt, Homo sapiens
ucgcuguuggagcaaaccauua

SEQ ID NO: 2082289 - RNA, 13 nt, Homo sapiens
agauaaccuuguu

SEQ ID NO: 2082290 - RNA, 22 nt, Homo sapiens
auuucuccaggauuuccugcuu

SEQ ID NO: 2082291 - RNA, 20 nt, Homo sapiens
uaaacugagaguaauucauc

SEQ ID NO: 2082292 - RNA, 21 nt, Homo sapiens
cuaggcuguuaaccuaugauu

SEQ ID NO: 2082293 - RNA, 14 nt, Homo sapiens
aaauaaauuaugcu

SEQ ID NO: 2082294 - RNA, 19 nt, Homo sapiens
uacaaaguuggcuuagaua

SEQ ID NO: 2082295 - RNA, 17 nt, Homo sapiens
cacaaaauuaugcugca

SEQ ID NO: 2082296 - RNA, 14 nt, Homo sapiens
cuuucucucaguga

SEQ ID NO: 2082297 - RNA, 23 nt, Homo sapiens
aguuuaaggguggaaaaaugccc

SEQ ID NO: 2082298 - RNA, 18 nt, Homo sapiens
agcaggccuaagacaugu

SEQ ID NO: 2082299 - RNA, 14 nt, Homo sapiens
aucacgccuggcua

SEQ ID NO: 2082300 - RNA, 12 nt, Homo sapiens
cauugguguuga

SEQ ID NO: 2082301 - RNA, 21 nt, Homo sapiens
uacuuuauguuacuacaugca

SEQ ID NO: 2082302 - RNA, 21 nt, Homo sapiens
uuguguauuccacuuaggaag

SEQ ID NO: 2082303 - RNA, 16 nt, Homo sapiens
augagcacacacacac

SEQ ID NO: 2082304 - RNA, 16 nt, Homo sapiens
ccugucuguuuccucu

SEQ ID NO: 2082305 - RNA, 17 nt, Homo sapiens
aauccaggacagcauua

SEQ ID NO: 2082306 - RNA, 13 nt, Homo sapiens
aucauacaguucc

SEQ ID NO: 2082307 - RNA, 10 nt, Homo sapiens
auuguucucc

SEQ ID NO: 2082308 - RNA, 14 nt, Homo sapiens
acccccccaaaaca

SEQ ID NO: 2082309 - RNA, 16 nt, Homo sapiens
uaccucuaaauuucca

SEQ ID NO: 2082310 - RNA, 13 nt, Homo sapiens
uugccacauuucu

SEQ ID NO: 2082311 - RNA, 19 nt, Homo sapiens
uccagcaguguugcucagc

SEQ ID NO: 2082312 - RNA, 22 nt, Homo sapiens
ccaucaggauccagucuggaaa

SEQ ID NO: 2082313 - RNA, 22 nt, Homo sapiens
gcuacuuuuuuuuaguucaaua

SEQ ID NO: 2082314 - RNA, 13 nt, Homo sapiens
auauauaugcaua

SEQ ID NO: 2082315 - RNA, 18 nt, Homo sapiens
uuauuaaauauaaauauc

SEQ ID NO: 2082316 - RNA, 17 nt, Homo sapiens
ucaccugcccugcugag

SEQ ID NO: 2082317 - RNA, 23 nt, Homo sapiens
ccaucuguuugauacaguauuau

SEQ ID NO: 2082318 - RNA, 17 nt, Homo sapiens
ccaaagugcugggauua

SEQ ID NO: 2082319 - RNA, 13 nt, Homo sapiens
cuuggaccucagu

SEQ ID NO: 2082320 - RNA, 19 nt, Homo sapiens
cagcugcagccacuuucug

SEQ ID NO: 2082321 - RNA, 13 nt, Homo sapiens
cugguugauuugu

SEQ ID NO: 2082322 - RNA, 16 nt, Homo sapiens
uuccucucauuucccu

SEQ ID NO: 2082323 - RNA, 22 nt, Homo sapiens
gucacucaccacuacaucacuu

SEQ ID NO: 2082324 - RNA, 16 nt, Homo sapiens
caguuacccaacagaa

SEQ ID NO: 2082325 - RNA, 16 nt, Homo sapiens
uauaaauggacuugcu

SEQ ID NO: 2082326 - RNA, 23 nt, Homo sapiens
acagaguaacugaccuucauuuc

SEQ ID NO: 2082327 - RNA, 15 nt, Homo sapiens
auacuuuacaaacca

SEQ ID NO: 2082328 - RNA, 20 nt, Homo sapiens
aaugauucucaagaucaaag

SEQ ID NO: 2082329 - RNA, 20 nt, Homo sapiens
gacagagacuugggggccau

SEQ ID NO: 2082330 - RNA, 17 nt, Homo sapiens
ccuggccccugggccug

SEQ ID NO: 2082331 - RNA, 14 nt, Homo sapiens
aacauauugccaug

SEQ ID NO: 2082332 - RNA, 16 nt, Homo sapiens
aagguuugccugugua

SEQ ID NO: 2082333 - RNA, 16 nt, Homo sapiens
ucucuggcuuccaugc

SEQ ID NO: 2082334 - RNA, 16 nt, Homo sapiens
uaugaaguagcaauuu

SEQ ID NO: 2082335 - RNA, 17 nt, Homo sapiens
aacccaacaugacuguu

SEQ ID NO: 2082336 - RNA, 23 nt, Homo sapiens
guaugauccuaaugaaugcauaa

SEQ ID NO: 2082337 - RNA, 20 nt, Homo sapiens
caggaaucuccucacugaaa

SEQ ID NO: 2082338 - RNA, 17 nt, Homo sapiens
aucucagcacugcccca

SEQ ID NO: 2082339 - RNA, 19 nt, Homo sapiens
gcacaucuacaugccaugc

SEQ ID NO: 2082340 - RNA, 16 nt, Homo sapiens
ugcagugagugcugcu

SEQ ID NO: 2082341 - RNA, 22 nt, Homo sapiens
gggccuccuuguccaggucuca

SEQ ID NO: 2082342 - RNA, 16 nt, Homo sapiens
cccauguaaccacugc

SEQ ID NO: 2082343 - RNA, 20 nt, Homo sapiens
uacaaaaauuagccgggcau

SEQ ID NO: 2082344 - RNA, 24 nt, Homo sapiens
uagacugacuaggauucugcagga

SEQ ID NO: 2082345 - RNA, 13 nt, Homo sapiens
aucugacuaugac

SEQ ID NO: 2082346 - RNA, 19 nt, Homo sapiens
acauaagggguuugccauu

SEQ ID NO: 2082347 - RNA, 13 nt, Homo sapiens
aaugcacucuggg

SEQ ID NO: 2082348 - RNA, 14 nt, Homo sapiens
uuacuuuguacaaa

SEQ ID NO: 2082349 - RNA, 16 nt, Homo sapiens
ucuccuagagcucugu

SEQ ID NO: 2082350 - RNA, 20 nt, Homo sapiens
gucaucuccaucagcuguaa

SEQ ID NO: 2082351 - RNA, 13 nt, Homo sapiens
gcuucauugcacu

SEQ ID NO: 2082352 - RNA, 19 nt, Homo sapiens
gaggaauaaagcugugagc

SEQ ID NO: 2082353 - RNA, 23 nt, Homo sapiens
ucacuagagcugggaaacaggga

SEQ ID NO: 2082354 - RNA, 18 nt, Homo sapiens
auauugcaguaguauuua

SEQ ID NO: 2082355 - RNA, 14 nt, Homo sapiens
aaaauaaauuugca

SEQ ID NO: 2082356 - RNA, 21 nt, Homo sapiens
uguuaaaacugggacagggga

SEQ ID NO: 2082357 - RNA, 19 nt, Homo sapiens
gccuuaaacacacauugca

SEQ ID NO: 2082358 - RNA, 21 nt, Homo sapiens
caaagcgguuuaaccacauua

SEQ ID NO: 2082359 - RNA, 21 nt, Homo sapiens
aacaccugcauucuucccuua

SEQ ID NO: 2082360 - RNA, 13 nt, Homo sapiens
gauuauauaucau

SEQ ID NO: 2082361 - RNA, 22 nt, Homo sapiens
caaaugaaugagcucucuaaua

SEQ ID NO: 2082362 - RNA, 22 nt, Homo sapiens
auaucauuuuaaaaacuuuauu

SEQ ID NO: 2082363 - RNA, 16 nt, Homo sapiens
aguaucuucaaaaaua

SEQ ID NO: 2082364 - RNA, 14 nt, Homo sapiens
caugucacacuggc

SEQ ID NO: 2082365 - RNA, 16 nt, Homo sapiens
cgccuggcagaacuga

SEQ ID NO: 2082366 - RNA, 14 nt, Homo sapiens
gaagaagcugagga

SEQ ID NO: 2082367 - RNA, 21 nt, Homo sapiens
uuuaguagagacaggguuuca

SEQ ID NO: 2082368 - RNA, 13 nt, Homo sapiens
uaccucaaccaau

SEQ ID NO: 2082369 - RNA, 15 nt, Homo sapiens
auuuacaagcacgau

SEQ ID NO: 2082370 - RNA, 14 nt, Homo sapiens
ucccuccagcacaa

SEQ ID NO: 2082371 - RNA, 17 nt, Homo sapiens
uccugaguagcugggau

SEQ ID NO: 2082372 - RNA, 16 nt, Homo sapiens
cuacagcuacauugag

SEQ ID NO: 2082373 - RNA, 15 nt, Homo sapiens
ggcuuaaugagcaua

SEQ ID NO: 2082374 - RNA, 12 nt, Homo sapiens
agaauuugugcc

SEQ ID NO: 2082375 - RNA, 15 nt, Homo sapiens
uagaaagaugacaaa

SEQ ID NO: 2082376 - RNA, 15 nt, Homo sapiens
aaucuuuacacaaug

SEQ ID NO: 2082377 - RNA, 17 nt, Homo sapiens
agguaaacaaacaaaua

SEQ ID NO: 2082378 - RNA, 19 nt, Homo sapiens
cuuucucaguucagaguug

SEQ ID NO: 2082379 - RNA, 21 nt, Homo sapiens
cuaccaauuucuuuuauguua

SEQ ID NO: 2082380 - RNA, 15 nt, Homo sapiens
gcuccagauggugcu

SEQ ID NO: 2082381 - RNA, 14 nt, Homo sapiens
gcacugcaugaaua

SEQ ID NO: 2082382 - RNA, 15 nt, Homo sapiens
caggcagggugcagu

SEQ ID NO: 2082383 - RNA, 21 nt, Homo sapiens
cuuacagauccugcagucaau

SEQ ID NO: 2082384 - RNA, 16 nt, Homo sapiens
uguaggugaaaggcau

SEQ ID NO: 2082385 - RNA, 17 nt, Homo sapiens
auugucuaaugacagau

SEQ ID NO: 2082386 - RNA, 21 nt, Homo sapiens
gaaguauuuguguaccuggau

SEQ ID NO: 2082387 - RNA, 14 nt, Homo sapiens
ggugcugugacacc

SEQ ID NO: 2082388 - RNA, 19 nt, Homo sapiens
aaauacaucaaggaguuau

SEQ ID NO: 2082389 - RNA, 19 nt, Homo sapiens
aucaugcaaaugcuguauu

SEQ ID NO: 2082390 - RNA, 12 nt, Homo sapiens
ccccacucugua

SEQ ID NO: 2082391 - RNA, 21 nt, Homo sapiens
acugcccuuucaaagcacuua

SEQ ID NO: 2082392 - RNA, 20 nt, Homo sapiens
uucuuccugcauagucuguu

SEQ ID NO: 2082393 - RNA, 19 nt, Homo sapiens
agaucaaaauccuacagau

SEQ ID NO: 2082394 - RNA, 22 nt, Homo sapiens
gaaauugaaguuucagagcuac

SEQ ID NO: 2082395 - RNA, 22 nt, Homo sapiens
ucaaagugagaaaaugccucaa

SEQ ID NO: 2082396 - RNA, 13 nt, Homo sapiens
caaaaaugacaga

SEQ ID NO: 2082397 - RNA, 22 nt, Homo sapiens
agccaggauggucuugaucucc

SEQ ID NO: 2082398 - RNA, 13 nt, Homo sapiens
cacacucuucagu

SEQ ID NO: 2082399 - RNA, 15 nt, Homo sapiens
auggugcacugagcu

SEQ ID NO: 2082400 - RNA, 12 nt, Homo sapiens
uguguugcaaag

SEQ ID NO: 2082401 - RNA, 19 nt, Homo sapiens
cugcuucccaaacucccag

SEQ ID NO: 2082402 - RNA, 19 nt, Homo sapiens
cuacuaaaaauacaaaaau

SEQ ID NO: 2082403 - RNA, 15 nt, Homo sapiens
ugaagugacacuuug

SEQ ID NO: 2082404 - RNA, 16 nt, Homo sapiens
cacacaucaccaggug

SEQ ID NO: 2082405 - RNA, 18 nt, Homo sapiens
ugcucuuucaaugcagca

SEQ ID NO: 2082406 - RNA, 18 nt, Homo sapiens
auauagacagugcccuug

SEQ ID NO: 2082407 - RNA, 17 nt, Homo sapiens
cucuggucauagaaaca

SEQ ID NO: 2082408 - RNA, 20 nt, Homo sapiens
aagaauucuguacuuccaau

SEQ ID NO: 2082409 - RNA, 18 nt, Homo sapiens
acagguggugucacuguc

SEQ ID NO: 2082410 - RNA, 17 nt, Homo sapiens
uaagaauuagacaucuu

SEQ ID NO: 2082411 - RNA, 15 nt, Homo sapiens
auuggccuccagggc

SEQ ID NO: 2082412 - RNA, 22 nt, Homo sapiens
cccugaccugugagcccagcug

SEQ ID NO: 2082413 - RNA, 16 nt, Homo sapiens
gaguaaauacagguag

SEQ ID NO: 2082414 - RNA, 16 nt, Homo sapiens
ugggggcuguccugcu

SEQ ID NO: 2082415 - RNA, 18 nt, Homo sapiens
aguuugaauuuguauuaa

SEQ ID NO: 2082416 - RNA, 17 nt, Homo sapiens
aguagcugaaaugcaag

SEQ ID NO: 2082417 - RNA, 21 nt, Homo sapiens
accauacauaauaaccaaaca

SEQ ID NO: 2082418 - RNA, 12 nt, Homo sapiens
uuacugaaguua

SEQ ID NO: 2082419 - RNA, 14 nt, Homo sapiens
cucuaugccaggcu

SEQ ID NO: 2082420 - RNA, 14 nt, Homo sapiens
caggaagccucuca

SEQ ID NO: 2082421 - RNA, 22 nt, Homo sapiens
cauuucuacuuuuugcaccuua

SEQ ID NO: 2082422 - RNA, 20 nt, Homo sapiens
aaacaugguuugacucuggu

SEQ ID NO: 2082423 - RNA, 19 nt, Homo sapiens
uaaugaaguuaagaaccug

SEQ ID NO: 2082424 - RNA, 17 nt, Homo sapiens
cauaauguuaagcuuua

SEQ ID NO: 2082425 - RNA, 13 nt, Homo sapiens
uguuguugccaaa

SEQ ID NO: 2082426 - RNA, 23 nt, Homo sapiens
cuguguggaguggacacccugac

SEQ ID NO: 2082427 - RNA, 14 nt, Homo sapiens
gauugaacacugcg

SEQ ID NO: 2082428 - RNA, 21 nt, Homo sapiens
aucgaggugaaaggcucagua

SEQ ID NO: 2082429 - RNA, 19 nt, Homo sapiens
cucuguuaugcaagcacaa

SEQ ID NO: 2082430 - RNA, 20 nt, Homo sapiens
uucgaaaagcacuuugaaaa

SEQ ID NO: 2082431 - RNA, 17 nt, Homo sapiens
ugaaguugguuuagcuu

SEQ ID NO: 2082432 - RNA, 14 nt, Homo sapiens
uaugaacuacaaag

SEQ ID NO: 2082433 - RNA, 17 nt, Homo sapiens
ucaauaaaccacaagca

SEQ ID NO: 2082434 - RNA, 17 nt, Homo sapiens
uguuauauaauuuagac

SEQ ID NO: 2082435 - RNA, 13 nt, Homo sapiens
gcaggugccaaug

SEQ ID NO: 2082436 - RNA, 14 nt, Homo sapiens
aaguagaauucuua

SEQ ID NO: 2082437 - RNA, 13 nt, Homo sapiens
ucacaaaugggau

SEQ ID NO: 2082438 - RNA, 16 nt, Homo sapiens
cagcuuggagugccac

SEQ ID NO: 2082439 - RNA, 22 nt, Homo sapiens
acacuucgcucuugaggagcuc

SEQ ID NO: 2082440 - RNA, 17 nt, Homo sapiens
agacccaccacaccgca

SEQ ID NO: 2082441 - RNA, 16 nt, Homo sapiens
gucauuuuacaagcau

SEQ ID NO: 2082442 - RNA, 15 nt, Homo sapiens
ggaagaugcccucaa

SEQ ID NO: 2082443 - RNA, 13 nt, Homo sapiens
uuugucaguguau

SEQ ID NO: 2082444 - RNA, 16 nt, Homo sapiens
uaaaaacaaagaaaua

SEQ ID NO: 2082445 - RNA, 15 nt, Homo sapiens
uuuccuccuuugcag

SEQ ID NO: 2082446 - RNA, 23 nt, Homo sapiens
ggacuauauaaaguacuacugua

SEQ ID NO: 2082447 - RNA, 22 nt, Homo sapiens
uagcauaaauacuuauggcuca

SEQ ID NO: 2082448 - RNA, 16 nt, Homo sapiens
ccaggacuugugcaga

SEQ ID NO: 2082449 - RNA, 14 nt, Homo sapiens
aaacuucacugugc

SEQ ID NO: 2082450 - RNA, 20 nt, Homo sapiens
acuugcuuuucagaacauag

SEQ ID NO: 2082451 - RNA, 19 nt, Homo sapiens
gaaauugcauuuccugaca

SEQ ID NO: 2082452 - RNA, 19 nt, Homo sapiens
ucccacugcaacuugugaa

SEQ ID NO: 2082453 - RNA, 19 nt, Homo sapiens
guaacgaaugguacuacaa

SEQ ID NO: 2082454 - RNA, 12 nt, Homo sapiens
ucauaagauauu

SEQ ID NO: 2082455 - RNA, 13 nt, Homo sapiens
auuugucaacaaa

SEQ ID NO: 2082456 - RNA, 23 nt, Homo sapiens
uacuucuaaauuauaccaugaga

SEQ ID NO: 2082457 - RNA, 13 nt, Homo sapiens
aguacaaguauau

SEQ ID NO: 2082458 - RNA, 23 nt, Homo sapiens
uccaggccaugauggccuuacac

SEQ ID NO: 2082459 - RNA, 17 nt, Homo sapiens
uaggacauauaccuucu

SEQ ID NO: 2082460 - RNA, 14 nt, Homo sapiens
ugcacaccaaaaaa

SEQ ID NO: 2082461 - RNA, 20 nt, Homo sapiens
cccuuccuucuuugucuugc

SEQ ID NO: 2082462 - RNA, 21 nt, Homo sapiens
aacguuucaaagcacauaugu

SEQ ID NO: 2082463 - RNA, 18 nt, Homo sapiens
caacugcccaguuuccag

SEQ ID NO: 2082464 - RNA, 16 nt, Homo sapiens
cccaaguuauccaccu

SEQ ID NO: 2082465 - RNA, 19 nt, Homo sapiens
cucuggggcucaagcaguu

SEQ ID NO: 2082466 - RNA, 19 nt, Homo sapiens
guucuuuugauacauuuau

SEQ ID NO: 2082467 - RNA, 18 nt, Homo sapiens
auauaagaaugagccugu

SEQ ID NO: 2082468 - RNA, 20 nt, Homo sapiens
gaacauggauuccacugaaa

SEQ ID NO: 2082469 - RNA, 13 nt, Homo sapiens
gccagccucagug

SEQ ID NO: 2082470 - RNA, 22 nt, Homo sapiens
ugcugucauuaguauuucacaa

SEQ ID NO: 2082471 - RNA, 22 nt, Homo sapiens
gagacagcuugaucaaaggcac

SEQ ID NO: 2082472 - RNA, 23 nt, Homo sapiens
caucauggaggucauacaugcau

SEQ ID NO: 2082473 - RNA, 16 nt, Homo sapiens
uaugauauauugcugu

SEQ ID NO: 2082474 - RNA, 21 nt, Homo sapiens
cagcuggcuuugcacuugacc

SEQ ID NO: 2082475 - RNA, 18 nt, Homo sapiens
aauauaguuuaggaguaa

SEQ ID NO: 2082476 - RNA, 17 nt, Homo sapiens
gaauacuacuacaggaa

SEQ ID NO: 2082477 - RNA, 19 nt, Homo sapiens
gcugauggugacauugcac

SEQ ID NO: 2082478 - RNA, 13 nt, Homo sapiens
cccaguccacuga

SEQ ID NO: 2082479 - RNA, 17 nt, Homo sapiens
ugcuccugaagcccuau

SEQ ID NO: 2082480 - RNA, 23 nt, Homo sapiens
aaaagcaugacuauuuccaccau

SEQ ID NO: 2082481 - RNA, 20 nt, Homo sapiens
cuugacugccgcaucauggg

SEQ ID NO: 2082482 - RNA, 14 nt, Homo sapiens
guaaaaacuuguac

SEQ ID NO: 2082483 - RNA, 24 nt, Homo sapiens
aucagagagcugcccuucagcgau

SEQ ID NO: 2082484 - RNA, 18 nt, Homo sapiens
cagauucuugcugugacc

SEQ ID NO: 2082485 - RNA, 19 nt, Homo sapiens
ccggcacccugauccucac

SEQ ID NO: 2082486 - RNA, 19 nt, Homo sapiens
uagagauuucccacauucc

SEQ ID NO: 2082487 - RNA, 16 nt, Homo sapiens
agaaaaguauuuccaa

SEQ ID NO: 2082488 - RNA, 18 nt, Homo sapiens
aaggacucuggaagauuu

SEQ ID NO: 2082489 - RNA, 13 nt, Homo sapiens
ggcaugauggugc

SEQ ID NO: 2082490 - RNA, 13 nt, Homo sapiens
ugugugauugcac

SEQ ID NO: 2082491 - RNA, 19 nt, Homo sapiens
ugcacauacuugagacugu

SEQ ID NO: 2082492 - RNA, 22 nt, Homo sapiens
aaucauaugguugacaguaugc

SEQ ID NO: 2082493 - RNA, 20 nt, Homo sapiens
augcuggaaccugcaaaaaa

SEQ ID NO: 2082494 - RNA, 16 nt, Homo sapiens
augcacugaguaugca

SEQ ID NO: 2082495 - RNA, 20 nt, Homo sapiens
cacccagcgcccucuaccuc

SEQ ID NO: 2082496 - RNA, 14 nt, Homo sapiens
ccucggucacucca

SEQ ID NO: 2082497 - RNA, 17 nt, Homo sapiens
gaaagaggaagcuuucu

SEQ ID NO: 2082498 - RNA, 12 nt, Homo sapiens
ccauuugcaaua

SEQ ID NO: 2082499 - RNA, 13 nt, Homo sapiens
agcugauccaguu

SEQ ID NO: 2082500 - RNA, 14 nt, Homo sapiens
aggggugugcugag

SEQ ID NO: 2082501 - RNA, 18 nt, Homo sapiens
gggaaggcaaaugaugcc

SEQ ID NO: 2082502 - RNA, 18 nt, Homo sapiens
auuaagucagagccaaca

SEQ ID NO: 2082503 - RNA, 15 nt, Homo sapiens
cuauuuuuguacaaa

SEQ ID NO: 2082504 - RNA, 14 nt, Homo sapiens
ugcggaaugcauug

SEQ ID NO: 2082505 - RNA, 15 nt, Homo sapiens
cuguauuauugcaau

SEQ ID NO: 2082506 - RNA, 23 nt, Homo sapiens
aaagugcccgcagagcccaccuu

SEQ ID NO: 2082507 - RNA, 22 nt, Homo sapiens
aaaggaaggcuucugugucaau

SEQ ID NO: 2082508 - RNA, 18 nt, Homo sapiens
agacaauuggucaaaaug

SEQ ID NO: 2082509 - RNA, 23 nt, Homo sapiens
gcaaaccuauuucccuugccuca

SEQ ID NO: 2082510 - RNA, 14 nt, Homo sapiens
ugagcaagucccau

SEQ ID NO: 2082511 - RNA, 22 nt, Homo sapiens
uccaacuugaugucaagcaaug

SEQ ID NO: 2082512 - RNA, 16 nt, Homo sapiens
ugccaacauacuuuaa

SEQ ID NO: 2082513 - RNA, 22 nt, Homo sapiens
cuggagaugcagcuacuggaau

SEQ ID NO: 2082514 - RNA, 21 nt, Homo sapiens
uuuaccaaaaccauccauccc

SEQ ID NO: 2082515 - RNA, 13 nt, Homo sapiens
uacucccaggcac

SEQ ID NO: 2082516 - RNA, 15 nt, Homo sapiens
aacuccuggccucaa

SEQ ID NO: 2082517 - RNA, 16 nt, Homo sapiens
cacacagacaggguuu

SEQ ID NO: 2082518 - RNA, 19 nt, Homo sapiens
uuuaagaaggcauuggcau

SEQ ID NO: 2082519 - RNA, 16 nt, Homo sapiens
caaaggaagacuugaa

SEQ ID NO: 2082520 - RNA, 20 nt, Homo sapiens
agccagcaggagcucugacu

SEQ ID NO: 2082521 - RNA, 23 nt, Homo sapiens
agcuucucuacagacuccaaaag

SEQ ID NO: 2082522 - RNA, 12 nt, Homo sapiens
gcccugaccaau

SEQ ID NO: 2082523 - RNA, 23 nt, Homo sapiens
ccauggugggagagacugugagg

SEQ ID NO: 2082524 - RNA, 18 nt, Homo sapiens
aauuaaagucuacacugc

SEQ ID NO: 2082525 - RNA, 15 nt, Homo sapiens
agccauuuuuacugu

SEQ ID NO: 2082526 - RNA, 20 nt, Homo sapiens
ugcuguguaauaucaaacac

SEQ ID NO: 2082527 - RNA, 18 nt, Homo sapiens
aguuuaacaaccauuuaa

SEQ ID NO: 2082528 - RNA, 21 nt, Homo sapiens
gagaccuuugauuuuuugccc

SEQ ID NO: 2082529 - RNA, 17 nt, Homo sapiens
cuccacuugaagcacuu

SEQ ID NO: 2082530 - RNA, 15 nt, Homo sapiens
ugaaauaaagucaaa

SEQ ID NO: 2082531 - RNA, 18 nt, Homo sapiens
ccuggguaggccccacaa

SEQ ID NO: 2082532 - RNA, 14 nt, Homo sapiens
cugcuccaugcaga

SEQ ID NO: 2082533 - RNA, 20 nt, Homo sapiens
uauauuccuuugccaauuca

SEQ ID NO: 2082534 - RNA, 17 nt, Homo sapiens
aauucucucucuugcag

SEQ ID NO: 2082535 - RNA, 16 nt, Homo sapiens
cagagugcaacccagu

SEQ ID NO: 2082536 - RNA, 21 nt, Homo sapiens
ucccaaauuucauaccuauca

SEQ ID NO: 2082537 - RNA, 18 nt, Homo sapiens
cagcuagacauugcaauu

SEQ ID NO: 2082538 - RNA, 16 nt, Homo sapiens
agggcugaaucuucug

SEQ ID NO: 2082539 - RNA, 19 nt, Homo sapiens
cagagacuuuguguuuaca

SEQ ID NO: 2082540 - RNA, 19 nt, Homo sapiens
aggucaugccacugcacuc

SEQ ID NO: 2082541 - RNA, 19 nt, Homo sapiens
ggcaaguucuggagcucuu

SEQ ID NO: 2082542 - RNA, 19 nt, Homo sapiens
ugguuccaagaaagaucca

SEQ ID NO: 2082543 - RNA, 18 nt, Homo sapiens
acaaauuguuuuuacugu

SEQ ID NO: 2082544 - RNA, 21 nt, Homo sapiens
aagugcugggauuacaggugu

SEQ ID NO: 2082545 - RNA, 12 nt, Homo sapiens
uauguacuucag

SEQ ID NO: 2082546 - RNA, 13 nt, Homo sapiens
aacuuuugugcuc

SEQ ID NO: 2082547 - RNA, 18 nt, Homo sapiens
gugcuuguaaaaagucaa

SEQ ID NO: 2082548 - RNA, 14 nt, Homo sapiens
agacauuuugaaau

SEQ ID NO: 2082549 - RNA, 14 nt, Homo sapiens
ugacuucaaugaua

SEQ ID NO: 2082550 - RNA, 19 nt, Homo sapiens
ggcugaccugcuguggaug

SEQ ID NO: 2082551 - RNA, 14 nt, Homo sapiens
accccaagggacaa

SEQ ID NO: 2082552 - RNA, 21 nt, Homo sapiens
gaccacaggugcacgccacca

SEQ ID NO: 2082553 - RNA, 14 nt, Homo sapiens
uuuuaaucuucuca

SEQ ID NO: 2082554 - RNA, 14 nt, Homo sapiens
uccccuucucucau

SEQ ID NO: 2082555 - RNA, 23 nt, Homo sapiens
aucuuucuuuccaaaacauuucu

SEQ ID NO: 2082556 - RNA, 16 nt, Homo sapiens
cacagcuuccugaguc

SEQ ID NO: 2082557 - RNA, 16 nt, Homo sapiens
cuccugcugagcugcc

SEQ ID NO: 2082558 - RNA, 15 nt, Homo sapiens
gauauucucuaguca

SEQ ID NO: 2082559 - RNA, 11 nt, Homo sapiens
gggcauuccug

SEQ ID NO: 2082560 - RNA, 20 nt, Homo sapiens
uaucaaaauucuguuuugua

SEQ ID NO: 2082561 - RNA, 13 nt, Homo sapiens
ugcugaaaaagua

SEQ ID NO: 2082562 - RNA, 15 nt, Homo sapiens
cuaugaguucacaug

SEQ ID NO: 2082563 - RNA, 23 nt, Homo sapiens
uuuugggaaaaaaacauacacaa

SEQ ID NO: 2082564 - RNA, 23 nt, Homo sapiens
ccugacgcgcgcccgcagggugg

SEQ ID NO: 2082565 - RNA, 22 nt, Homo sapiens
aacagauuucaaaaaaaaaccc

SEQ ID NO: 2082566 - RNA, 13 nt, Homo sapiens
ggcccgccucucc

SEQ ID NO: 2082567 - RNA, 20 nt, Homo sapiens
caaguuccugcacuccagaa

SEQ ID NO: 2082568 - RNA, 17 nt, Homo sapiens
uguuugcuacaaauagu

SEQ ID NO: 2082569 - RNA, 17 nt, Homo sapiens
uggccugagaauaugua

SEQ ID NO: 2082570 - RNA, 16 nt, Homo sapiens
uugguccuggggacca

SEQ ID NO: 2082571 - RNA, 16 nt, Homo sapiens
uggcuuuugugcauua

SEQ ID NO: 2082572 - RNA, 20 nt, Homo sapiens
acucaggugcugaaggguaa

SEQ ID NO: 2082573 - RNA, 16 nt, Homo sapiens
ugugaacuugaagaag

SEQ ID NO: 2082574 - RNA, 13 nt, Homo sapiens
uccuuuugguucc

SEQ ID NO: 2082575 - RNA, 19 nt, Homo sapiens
uuuuguauacccugaagaa

SEQ ID NO: 2082576 - RNA, 24 nt, Homo sapiens
cauguuggccaggcuggucucaaa

SEQ ID NO: 2082577 - RNA, 20 nt, Homo sapiens
acugugaacugggcauuuca

SEQ ID NO: 2082578 - RNA, 14 nt, Homo sapiens
agcacgcugaaggc

SEQ ID NO: 2082579 - RNA, 19 nt, Homo sapiens
gcacuuugaaauaccucau

SEQ ID NO: 2082580 - RNA, 13 nt, Homo sapiens
uguacuauguguu

SEQ ID NO: 2082581 - RNA, 16 nt, Homo sapiens
aaaauuuuuacauuca

SEQ ID NO: 2082582 - RNA, 21 nt, Homo sapiens
ccucaggguggggggugacag

SEQ ID NO: 2082583 - RNA, 14 nt, Homo sapiens
aaacaaaaacuguu

SEQ ID NO: 2082584 - RNA, 16 nt, Homo sapiens
agauuccccuguguca

SEQ ID NO: 2082585 - RNA, 13 nt, Homo sapiens
aacguuccacaac

SEQ ID NO: 2082586 - RNA, 18 nt, Homo sapiens
gauaacaguuacuccagu

SEQ ID NO: 2082587 - RNA, 23 nt, Homo sapiens
acuuaggggaguucaguauuuaa

SEQ ID NO: 2082588 - RNA, 14 nt, Homo sapiens
auuuuuugccauuu

SEQ ID NO: 2082589 - RNA, 20 nt, Homo sapiens
auaauauuuguguguucacu

SEQ ID NO: 2082590 - RNA, 19 nt, Homo sapiens
acagaaagcagauaccuca

SEQ ID NO: 2082591 - RNA, 16 nt, Homo sapiens
ucaaugggaccugugg

SEQ ID NO: 2082592 - RNA, 16 nt, Homo sapiens
gacuuuucaccuuaau

SEQ ID NO: 2082593 - RNA, 17 nt, Homo sapiens
ucccugaaacauugcau

SEQ ID NO: 2082594 - RNA, 22 nt, Homo sapiens
gacugaaugugccuaauggaga

SEQ ID NO: 2082595 - RNA, 21 nt, Homo sapiens
gacgguaacuuggcugcauuu

SEQ ID NO: 2082596 - RNA, 14 nt, Homo sapiens
uaugcaguccuuua

SEQ ID NO: 2082597 - RNA, 15 nt, Homo sapiens
agcaacaugugacaa

SEQ ID NO: 2082598 - RNA, 21 nt, Homo sapiens
ccaggacucagugaucccugg

SEQ ID NO: 2082599 - RNA, 16 nt, Homo sapiens
agcuuuacuacugugg

SEQ ID NO: 2082600 - RNA, 23 nt, Homo sapiens
aaaaaggagccuuuugcucucug

SEQ ID NO: 2082601 - RNA, 22 nt, Homo sapiens
guacucaguaacacagugcagu

SEQ ID NO: 2082602 - RNA, 22 nt, Homo sapiens
gagugagaggguuugagucaaa

SEQ ID NO: 2082603 - RNA, 13 nt, Homo sapiens
auauucauuugga

SEQ ID NO: 2082604 - RNA, 20 nt, Homo sapiens
agucuauaccauagcaaugu

SEQ ID NO: 2082605 - RNA, 15 nt, Homo sapiens
cuaaaugacuuucaa

SEQ ID NO: 2082606 - RNA, 18 nt, Homo sapiens
ugauugcuaucagcaaug

SEQ ID NO: 2082607 - RNA, 18 nt, Homo sapiens
ugggcauaguggcacuug

SEQ ID NO: 2082608 - RNA, 21 nt, Homo sapiens
ucaccauuuaaucauuuccag

SEQ ID NO: 2082609 - RNA, 22 nt, Homo sapiens
uuuuaaaaaacucuuuggugca

SEQ ID NO: 2082610 - RNA, 14 nt, Homo sapiens
aaaugcuucugcac

SEQ ID NO: 2082611 - RNA, 16 nt, Homo sapiens
ugugaugguauuugag

SEQ ID NO: 2082612 - RNA, 19 nt, Homo sapiens
aucuuggacugacauuuag

SEQ ID NO: 2082613 - RNA, 21 nt, Homo sapiens
aacugggacguguauuuccau

SEQ ID NO: 2082614 - RNA, 20 nt, Homo sapiens
uuagaaauacuuuuccuuaa

SEQ ID NO: 2082615 - RNA, 13 nt, Homo sapiens
augugaacauuua

SEQ ID NO: 2082616 - RNA, 15 nt, Homo sapiens
uacauacaccagcau

SEQ ID NO: 2082617 - RNA, 13 nt, Homo sapiens
gaaaagcauguua

SEQ ID NO: 2082618 - RNA, 24 nt, Homo sapiens
ggugcacauugguuuaagcccaga

SEQ ID NO: 2082619 - RNA, 23 nt, Homo sapiens
ucuguuugaaauucuagagccag

SEQ ID NO: 2082620 - RNA, 14 nt, Homo sapiens
uccugcccaaaaug

SEQ ID NO: 2082621 - RNA, 20 nt, Homo sapiens
gcacaccucagccccacuga

SEQ ID NO: 2082622 - RNA, 13 nt, Homo sapiens
agaauaugugauc

SEQ ID NO: 2082623 - RNA, 15 nt, Homo sapiens
ggagcaucauucugu

SEQ ID NO: 2082624 - RNA, 14 nt, Homo sapiens
gccccacauugcac

SEQ ID NO: 2082625 - RNA, 13 nt, Homo sapiens
aagaaugguggga

SEQ ID NO: 2082626 - RNA, 20 nt, Homo sapiens
cacaggagacauuacuauag

SEQ ID NO: 2082627 - RNA, 18 nt, Homo sapiens
uccugccucuacugggaa

SEQ ID NO: 2082628 - RNA, 13 nt, Homo sapiens
gacuucuucccaa

SEQ ID NO: 2082629 - RNA, 16 nt, Homo sapiens
gccugccacugagcag

SEQ ID NO: 2082630 - RNA, 20 nt, Homo sapiens
cugaaggacucaacauuaca

SEQ ID NO: 2082631 - RNA, 18 nt, Homo sapiens
cucagcuuugagaagccu

SEQ ID NO: 2082632 - RNA, 18 nt, Homo sapiens
aaaauauucuucuuugau

SEQ ID NO: 2082633 - RNA, 21 nt, Homo sapiens
gaaugaaauauaaacugugag

SEQ ID NO: 2082634 - RNA, 17 nt, Homo sapiens
uuauuugcacuugugga

SEQ ID NO: 2082635 - RNA, 14 nt, Homo sapiens
guggaggacuuuga

SEQ ID NO: 2082636 - RNA, 14 nt, Homo sapiens
uuugauaaagcagu

SEQ ID NO: 2082637 - RNA, 17 nt, Homo sapiens
uccugugaacacuggag

SEQ ID NO: 2082638 - RNA, 19 nt, Homo sapiens
accaggaucgcuuuguacu

SEQ ID NO: 2082639 - RNA, 22 nt, Homo sapiens
aagcuaaugacgaggaaccgaa

SEQ ID NO: 2082640 - RNA, 13 nt, Homo sapiens
gacacaggaaaaa

SEQ ID NO: 2082641 - RNA, 15 nt, Homo sapiens
cauuaucacagugaa

SEQ ID NO: 2082642 - RNA, 20 nt, Homo sapiens
uugaaaaauaaaaaccauaa

SEQ ID NO: 2082643 - RNA, 15 nt, Homo sapiens
cacccaacaagccau

SEQ ID NO: 2082644 - RNA, 15 nt, Homo sapiens
gagagaggcugggau

SEQ ID NO: 2082645 - RNA, 18 nt, Homo sapiens
uccugcugcucccucaga

SEQ ID NO: 2082646 - RNA, 15 nt, Homo sapiens
accauguuagccuua

SEQ ID NO: 2082647 - RNA, 15 nt, Homo sapiens
uaaaaacacugcuga

SEQ ID NO: 2082648 - RNA, 17 nt, Homo sapiens
augucuuggacacugua

SEQ ID NO: 2082649 - RNA, 12 nt, Homo sapiens
aaucacuaaccc

SEQ ID NO: 2082650 - RNA, 18 nt, Homo sapiens
uauggggccaaaauagca

SEQ ID NO: 2082651 - RNA, 21 nt, Homo sapiens
agcaggccaaggucugagcca

SEQ ID NO: 2082652 - RNA, 17 nt, Homo sapiens
guacaaagguugcagug

SEQ ID NO: 2082653 - RNA, 21 nt, Homo sapiens
gugcuaaagccaaccagccuu

SEQ ID NO: 2082654 - RNA, 13 nt, Homo sapiens
auguaaaguuaaa

SEQ ID NO: 2082655 - RNA, 17 nt, Homo sapiens
ucccacucccaucuccu

SEQ ID NO: 2082656 - RNA, 20 nt, Homo sapiens
aagaauggggaucacagaga

SEQ ID NO: 2082657 - RNA, 18 nt, Homo sapiens
uuugagacaaagucucac

SEQ ID NO: 2082658 - RNA, 23 nt, Homo sapiens
uccaagccugaccacgcuuucua

SEQ ID NO: 2082659 - RNA, 16 nt, Homo sapiens
ucaucuugagccugag

SEQ ID NO: 2082660 - RNA, 20 nt, Homo sapiens
uccaggacucagggacucag

SEQ ID NO: 2082661 - RNA, 13 nt, Homo sapiens
acaugcuucauga

SEQ ID NO: 2082662 - RNA, 19 nt, Homo sapiens
agacgugcgcgaugugaca

SEQ ID NO: 2082663 - RNA, 18 nt, Homo sapiens
auucucaguauccacugu

SEQ ID NO: 2082664 - RNA, 14 nt, Homo sapiens
gcagcccagcacaa

SEQ ID NO: 2082665 - RNA, 21 nt, Homo sapiens
ugccacagaugauacuuccaa

SEQ ID NO: 2082666 - RNA, 11 nt, Homo sapiens
uguaacauacu

SEQ ID NO: 2082667 - RNA, 19 nt, Homo sapiens
caggauccaauaauuuucc

SEQ ID NO: 2082668 - RNA, 13 nt, Homo sapiens
caccaaagcuggc

SEQ ID NO: 2082669 - RNA, 22 nt, Homo sapiens
aauuguuuuuguacaguuauca

SEQ ID NO: 2082670 - RNA, 22 nt, Homo sapiens
cagacuuggcucagcucgggga

SEQ ID NO: 2082671 - RNA, 20 nt, Homo sapiens
uauguccgcagaauggacuu

SEQ ID NO: 2082672 - RNA, 14 nt, Homo sapiens
aaggggcuuugucc

SEQ ID NO: 2082673 - RNA, 19 nt, Homo sapiens
ccugccugaauaaaguaau

SEQ ID NO: 2082674 - RNA, 16 nt, Homo sapiens
ccugugcugaccaaag

SEQ ID NO: 2082675 - RNA, 15 nt, Homo sapiens
aggcuggguccugcc

SEQ ID NO: 2082676 - RNA, 20 nt, Homo sapiens
gguguuugaaaauaguuuau

SEQ ID NO: 2082677 - RNA, 23 nt, Homo sapiens
agcagcacagucacccauggaac

SEQ ID NO: 2082678 - RNA, 19 nt, Homo sapiens
uuucaauuagggaugcuca

SEQ ID NO: 2082679 - RNA, 17 nt, Homo sapiens
gagggccccgcccagug

SEQ ID NO: 2082680 - RNA, 20 nt, Homo sapiens
agucacagagauaauucuag

SEQ ID NO: 2082681 - RNA, 18 nt, Homo sapiens
caaggcaaagacuauucc

SEQ ID NO: 2082682 - RNA, 17 nt, Homo sapiens
cacagcaggacuccauc

SEQ ID NO: 2082683 - RNA, 18 nt, Homo sapiens
aguagccucaauucucca

SEQ ID NO: 2082684 - RNA, 19 nt, Homo sapiens
ccuaaauuuuuacaucaaa

SEQ ID NO: 2082685 - RNA, 23 nt, Homo sapiens
cuaauccaccccaauccucccag

SEQ ID NO: 2082686 - RNA, 14 nt, Homo sapiens
agaucaacucuguc

SEQ ID NO: 2082687 - RNA, 16 nt, Homo sapiens
uuaacaggacaguuga

SEQ ID NO: 2082688 - RNA, 18 nt, Homo sapiens
cucuucccgggaucacuu

SEQ ID NO: 2082689 - RNA, 19 nt, Homo sapiens
gguugccuggacaccccac

SEQ ID NO: 2082690 - RNA, 22 nt, Homo sapiens
ugcuaauccucgcaaccuugag

SEQ ID NO: 2082691 - RNA, 16 nt, Homo sapiens
uccccccuccauuccc

SEQ ID NO: 2082692 - RNA, 14 nt, Homo sapiens
caagugaggccaua

SEQ ID NO: 2082693 - RNA, 16 nt, Homo sapiens
gcuggccucucuagca

SEQ ID NO: 2082694 - RNA, 22 nt, Homo sapiens
uuucucuugcucaccaagaagu

SEQ ID NO: 2082695 - RNA, 15 nt, Homo sapiens
acccuucucagggac

SEQ ID NO: 2082696 - RNA, 15 nt, Homo sapiens
cacaaggagaaccca

SEQ ID NO: 2082697 - RNA, 22 nt, Homo sapiens
ugcuggagagguuaaggugcaa

SEQ ID NO: 2082698 - RNA, 17 nt, Homo sapiens
ucagaucugaacacagu

SEQ ID NO: 2082699 - RNA, 19 nt, Homo sapiens
ugucuuucucagaggacaa

SEQ ID NO: 2082700 - RNA, 13 nt, Homo sapiens
gaagcuccacugu

SEQ ID NO: 2082701 - RNA, 12 nt, Homo sapiens
aaagcagugugu

SEQ ID NO: 2082702 - RNA, 15 nt, Homo sapiens
gggcucuaccucucu

SEQ ID NO: 2082703 - RNA, 18 nt, Homo sapiens
aaggaagcuccacuguca

SEQ ID NO: 2082704 - RNA, 19 nt, Homo sapiens
uugaauguucucuuaagaa

SEQ ID NO: 2082705 - RNA, 15 nt, Homo sapiens
caggcacugccugga

SEQ ID NO: 2082706 - RNA, 15 nt, Homo sapiens
caguccccagcccuu

SEQ ID NO: 2082707 - RNA, 17 nt, Homo sapiens
cguacaaacauccaaaa

SEQ ID NO: 2082708 - RNA, 15 nt, Homo sapiens
ugaccugguacugag

SEQ ID NO: 2082709 - RNA, 15 nt, Homo sapiens
aacccuugagaugau

SEQ ID NO: 2082710 - RNA, 18 nt, Homo sapiens
cuuucuaaaggaaaucaa

SEQ ID NO: 2082711 - RNA, 23 nt, Homo sapiens
gauuuuauguuuaaaauggcauu

SEQ ID NO: 2082712 - RNA, 15 nt, Homo sapiens
uuucaauaaaccuaa

SEQ ID NO: 2082713 - RNA, 20 nt, Homo sapiens
cuggaaauaacugagcacuu

SEQ ID NO: 2082714 - RNA, 15 nt, Homo sapiens
uuacaaccuugucag

SEQ ID NO: 2082715 - RNA, 16 nt, Homo sapiens
ccuacauugaggagcu

SEQ ID NO: 2082716 - RNA, 17 nt, Homo sapiens
aaccuugaaugcugcca

SEQ ID NO: 2082717 - RNA, 18 nt, Homo sapiens
ucauuccucacaaugagg

SEQ ID NO: 2082718 - RNA, 20 nt, Homo sapiens
acgccuccccuuugugacuu

SEQ ID NO: 2082719 - RNA, 18 nt, Homo sapiens
agcugguguuagggcuau

SEQ ID NO: 2082720 - RNA, 11 nt, Homo sapiens
agaauauucuu

SEQ ID NO: 2082721 - RNA, 15 nt, Homo sapiens
uugguccuccugucc

SEQ ID NO: 2082722 - RNA, 14 nt, Homo sapiens
ucagcucacugcaa

SEQ ID NO: 2082723 - RNA, 16 nt, Homo sapiens
aaauuauauguauacu

SEQ ID NO: 2082724 - RNA, 18 nt, Homo sapiens
uguuugcgcuugaccaug

SEQ ID NO: 2082725 - RNA, 13 nt, Homo sapiens
gcucuccuugcac

SEQ ID NO: 2082726 - RNA, 13 nt, Homo sapiens
cuggauucauuuc

SEQ ID NO: 2082727 - RNA, 17 nt, Homo sapiens
aggcuagaaccaccugc

SEQ ID NO: 2082728 - RNA, 20 nt, Homo sapiens
cagaugggcauaugugucag

SEQ ID NO: 2082729 - RNA, 13 nt, Homo sapiens
aagucaguaucau

SEQ ID NO: 2082730 - RNA, 18 nt, Homo sapiens
agcaucccagccucagaa

SEQ ID NO: 2082731 - RNA, 22 nt, Homo sapiens
guauuuauuguuuaagcagaaa

SEQ ID NO: 2082732 - RNA, 17 nt, Homo sapiens
cuaagcaaguauauuua

SEQ ID NO: 2082733 - RNA, 11 nt, Homo sapiens
auaaacuguaa

SEQ ID NO: 2082734 - RNA, 19 nt, Homo sapiens
agggaacagcaaaccaaug

SEQ ID NO: 2082735 - RNA, 13 nt, Homo sapiens
ccagacauggugu

SEQ ID NO: 2082736 - RNA, 16 nt, Homo sapiens
gagcggaagagcaugu

SEQ ID NO: 2082737 - RNA, 13 nt, Homo sapiens
ucacuggccucuc

SEQ ID NO: 2082738 - RNA, 18 nt, Homo sapiens
auucaaacauuauucuca

SEQ ID NO: 2082739 - RNA, 19 nt, Homo sapiens
cacagaauucauucacuca

SEQ ID NO: 2082740 - RNA, 15 nt, Homo sapiens
gcaccacaucucuau

SEQ ID NO: 2082741 - RNA, 23 nt, Homo sapiens
uuccugccuuugauguggaugaa

SEQ ID NO: 2082742 - RNA, 13 nt, Homo sapiens
cccggcugugauu

SEQ ID NO: 2082743 - RNA, 18 nt, Homo sapiens
agugaaggugguggggcu

SEQ ID NO: 2082744 - RNA, 16 nt, Homo sapiens
cagcuacugaaccagc

SEQ ID NO: 2082745 - RNA, 16 nt, Homo sapiens
aaucucagucccugac

SEQ ID NO: 2082746 - RNA, 16 nt, Homo sapiens
aacaacauccacuguu

SEQ ID NO: 2082747 - RNA, 18 nt, Homo sapiens
auaauuuuguugcuacau

SEQ ID NO: 2082748 - RNA, 15 nt, Homo sapiens
aauucugaaaacuga

SEQ ID NO: 2082749 - RNA, 19 nt, Homo sapiens
accuccaaauguccuuaaa

SEQ ID NO: 2082750 - RNA, 19 nt, Homo sapiens
aucuucccugccccugugc

SEQ ID NO: 2082751 - RNA, 23 nt, Homo sapiens
caugaagaaauacugcacuuaca

SEQ ID NO: 2082752 - RNA, 17 nt, Homo sapiens
aguacugaaauacauau

SEQ ID NO: 2082753 - RNA, 14 nt, Homo sapiens
gaggccccuggugg

SEQ ID NO: 2082754 - RNA, 13 nt, Homo sapiens
aaaaauugucauu

SEQ ID NO: 2082755 - RNA, 18 nt, Homo sapiens
cccauaauaaaauaucau

SEQ ID NO: 2082756 - RNA, 16 nt, Homo sapiens
cuacauguacaauaag

SEQ ID NO: 2082757 - RNA, 16 nt, Homo sapiens
cuuaacacauucaaua

SEQ ID NO: 2082758 - RNA, 14 nt, Homo sapiens
cuuccuguguccug

SEQ ID NO: 2082759 - RNA, 13 nt, Homo sapiens
aauacaauguuau

SEQ ID NO: 2082760 - RNA, 13 nt, Homo sapiens
aaaacaauguaau

SEQ ID NO: 2082761 - RNA, 14 nt, Homo sapiens
gaagauggagacac

SEQ ID NO: 2082762 - RNA, 16 nt, Homo sapiens
auguauaauaugcaau

SEQ ID NO: 2082763 - RNA, 20 nt, Homo sapiens
acaccagcagcccugucacg

SEQ ID NO: 2082764 - RNA, 15 nt, Homo sapiens
aucuacauacacagu

SEQ ID NO: 2082765 - RNA, 22 nt, Homo sapiens
acaguguauguacuaagcagua

SEQ ID NO: 2082766 - RNA, 16 nt, Homo sapiens
cugggcaauauuuucu

SEQ ID NO: 2082767 - RNA, 17 nt, Homo sapiens
gccuucagaaugcuccu

SEQ ID NO: 2082768 - RNA, 20 nt, Homo sapiens
aaauguucucaugaacuacc

SEQ ID NO: 2082769 - RNA, 20 nt, Homo sapiens
auuuaaaauuccauuaucuu

SEQ ID NO: 2082770 - RNA, 22 nt, Homo sapiens
auuagcaaguuacagugaugcu

SEQ ID NO: 2082771 - RNA, 19 nt, Homo sapiens
caguacucaggcagugcaa

SEQ ID NO: 2082772 - RNA, 19 nt, Homo sapiens
augcagucuuguacuguga

SEQ ID NO: 2082773 - RNA, 12 nt, Homo sapiens
auuauguaaaua

SEQ ID NO: 2082774 - RNA, 16 nt, Homo sapiens
agaguugcuuaaugaa

SEQ ID NO: 2082775 - RNA, 17 nt, Homo sapiens
cuuaaguagauaaggaa

SEQ ID NO: 2082776 - RNA, 22 nt, Homo sapiens
gaauggcugcaccuuuuugcau

SEQ ID NO: 2082777 - RNA, 12 nt, Homo sapiens
acaucaccagug

SEQ ID NO: 2082778 - RNA, 12 nt, Homo sapiens
cagaagcacaug

SEQ ID NO: 2082779 - RNA, 16 nt, Homo sapiens
accaaccgaaacugaa

SEQ ID NO: 2082780 - RNA, 16 nt, Homo sapiens
aagugaaccaucucag

SEQ ID NO: 2082781 - RNA, 17 nt, Homo sapiens
uaugcuuuugguggcua

SEQ ID NO: 2082782 - RNA, 16 nt, Homo sapiens
caaagagagaaaguuu

SEQ ID NO: 2082783 - RNA, 15 nt, Homo sapiens
cugagauuucuuaaa

SEQ ID NO: 2082784 - RNA, 14 nt, Homo sapiens
ucacugcaaccucu

SEQ ID NO: 2082785 - RNA, 20 nt, Homo sapiens
ucaauucuuagaauaucuaa

SEQ ID NO: 2082786 - RNA, 17 nt, Homo sapiens
aaagacauccauaaaga

SEQ ID NO: 2082787 - RNA, 13 nt, Homo sapiens
auauuuguuccca

SEQ ID NO: 2082788 - RNA, 14 nt, Homo sapiens
cguggacucugcac

SEQ ID NO: 2082789 - RNA, 16 nt, Homo sapiens
cugccagcauaauacu

SEQ ID NO: 2082790 - RNA, 18 nt, Homo sapiens
guauggaaaguucuuaua

SEQ ID NO: 2082791 - RNA, 13 nt, Homo sapiens
uugggcucugcgu

SEQ ID NO: 2082792 - RNA, 15 nt, Homo sapiens
aauuuaaaaagccca

SEQ ID NO: 2082793 - RNA, 18 nt, Homo sapiens
acgcacucaacuuccuuu

SEQ ID NO: 2082794 - RNA, 20 nt, Homo sapiens
auauguuuggaauauuccac

SEQ ID NO: 2082795 - RNA, 19 nt, Homo sapiens
ccauauaucuuauguuaaa

SEQ ID NO: 2082796 - RNA, 20 nt, Homo sapiens
gucaaauuccaaggaacuaa

SEQ ID NO: 2082797 - RNA, 19 nt, Homo sapiens
agcugacccggccucucug

SEQ ID NO: 2082798 - RNA, 23 nt, Homo sapiens
cagaagaaaaaguugcagucuca

SEQ ID NO: 2082799 - RNA, 17 nt, Homo sapiens
cuuggcuacacagggau

SEQ ID NO: 2082800 - RNA, 18 nt, Homo sapiens
ccagguguggaacagccc

SEQ ID NO: 2082801 - RNA, 16 nt, Homo sapiens
gcuuucauccuguguc

SEQ ID NO: 2082802 - RNA, 21 nt, Homo sapiens
uauccauuuaaacuaaccuuu

SEQ ID NO: 2082803 - RNA, 23 nt, Homo sapiens
ccucaaauuuaaaggcuaccuua

SEQ ID NO: 2082804 - RNA, 13 nt, Homo sapiens
ggcugugacuccc

SEQ ID NO: 2082805 - RNA, 20 nt, Homo sapiens
gguuacaagaaacagccacu

SEQ ID NO: 2082806 - RNA, 15 nt, Homo sapiens
agcccucaugaucau

SEQ ID NO: 2082807 - RNA, 15 nt, Homo sapiens
ucaucucaaccccau

SEQ ID NO: 2082808 - RNA, 18 nt, Homo sapiens
gcucucauccauuccucu

SEQ ID NO: 2082809 - RNA, 19 nt, Homo sapiens
cugcaaaggcgcagugcuu

SEQ ID NO: 2082810 - RNA, 21 nt, Homo sapiens
uaccuuuucucuucauuuucc

SEQ ID NO: 2082811 - RNA, 22 nt, Homo sapiens
cuggggguuggcccucacugca

SEQ ID NO: 2082812 - RNA, 17 nt, Homo sapiens
acuugugauuggcugca

SEQ ID NO: 2082813 - RNA, 14 nt, Homo sapiens
auuucuccuuggau

SEQ ID NO: 2082814 - RNA, 22 nt, Homo sapiens
gacauagaaaguucauggaacu

SEQ ID NO: 2082815 - RNA, 15 nt, Homo sapiens
aucucuacuaaaaau

SEQ ID NO: 2082816 - RNA, 17 nt, Homo sapiens
agccuuuagaacacugu

SEQ ID NO: 2082817 - RNA, 19 nt, Homo sapiens
caaaaucuuguuaauguca

SEQ ID NO: 2082818 - RNA, 17 nt, Homo sapiens
aagaauuucacaagcua

SEQ ID NO: 2082819 - RNA, 15 nt, Homo sapiens
augucuuaaugcaaa

SEQ ID NO: 2082820 - RNA, 20 nt, Homo sapiens
agagcgcuuuugucugcaau

SEQ ID NO: 2082821 - RNA, 16 nt, Homo sapiens
ugacuucugagcaguu

SEQ ID NO: 2082822 - RNA, 14 nt, Homo sapiens
acagaauagcacaa

SEQ ID NO: 2082823 - RNA, 19 nt, Homo sapiens
gcauuucacaaaacagccu

SEQ ID NO: 2082824 - RNA, 12 nt, Homo sapiens
auguaugacaag

SEQ ID NO: 2082825 - RNA, 18 nt, Homo sapiens
acuggcaucugacacaaa

SEQ ID NO: 2082826 - RNA, 20 nt, Homo sapiens
gaguaggguagaccaaauca

SEQ ID NO: 2082827 - RNA, 16 nt, Homo sapiens
uguuucucagucucac

SEQ ID NO: 2082828 - RNA, 21 nt, Homo sapiens
ugcagccgccgaaaaacagga

SEQ ID NO: 2082829 - RNA, 22 nt, Homo sapiens
gccucuuccgugacgucacugg

SEQ ID NO: 2082830 - RNA, 12 nt, Homo sapiens
ucaaggcauuua

SEQ ID NO: 2082831 - RNA, 16 nt, Homo sapiens
aaacuaguacuauuau

SEQ ID NO: 2082832 - RNA, 12 nt, Homo sapiens
aaucaauagugc

SEQ ID NO: 2082833 - RNA, 21 nt, Homo sapiens
augauucuuuguuacaggcac

SEQ ID NO: 2082834 - RNA, 20 nt, Homo sapiens
guccaugugcacugcaaugc

SEQ ID NO: 2082835 - RNA, 16 nt, Homo sapiens
guuuccacagccugca

SEQ ID NO: 2082836 - RNA, 13 nt, Homo sapiens
cauacuuaucucu

SEQ ID NO: 2082837 - RNA, 19 nt, Homo sapiens
cuggaacgcagugguguuu

SEQ ID NO: 2082838 - RNA, 14 nt, Homo sapiens
cagagggauaaaaa

SEQ ID NO: 2082839 - RNA, 17 nt, Homo sapiens
gagaggaaaaguggaug

SEQ ID NO: 2082840 - RNA, 15 nt, Homo sapiens
uguuaccauucacaa

SEQ ID NO: 2082841 - RNA, 18 nt, Homo sapiens
aagacauugacagcaauu

SEQ ID NO: 2082842 - RNA, 20 nt, Homo sapiens
caauucuaaauccgacuuga

SEQ ID NO: 2082843 - RNA, 14 nt, Homo sapiens
cauagcauagccag

SEQ ID NO: 2082844 - RNA, 17 nt, Homo sapiens
caugguagacugugaca

SEQ ID NO: 2082845 - RNA, 19 nt, Homo sapiens
aucuuuuauagacgcucuu

SEQ ID NO: 2082846 - RNA, 13 nt, Homo sapiens
aaaauuacauguu

SEQ ID NO: 2082847 - RNA, 20 nt, Homo sapiens
ccucaugauaugucagggcg

SEQ ID NO: 2082848 - RNA, 16 nt, Homo sapiens
caguuugcugccaugg

SEQ ID NO: 2082849 - RNA, 21 nt, Homo sapiens
uaaagccacuguaugauucuc

SEQ ID NO: 2082850 - RNA, 13 nt, Homo sapiens
auacauacaugua

SEQ ID NO: 2082851 - RNA, 18 nt, Homo sapiens
ucacacauccgcuucaua

SEQ ID NO: 2082852 - RNA, 19 nt, Homo sapiens
acuguaguaaauaaugcuu

SEQ ID NO: 2082853 - RNA, 22 nt, Homo sapiens
ucuuaacaaaccaacaucuuug

SEQ ID NO: 2082854 - RNA, 20 nt, Homo sapiens
gccaauuaaaaacaugaauu

SEQ ID NO: 2082855 - RNA, 21 nt, Homo sapiens
ggcaggaggggugaguccccu

SEQ ID NO: 2082856 - RNA, 21 nt, Homo sapiens
ucaaacugcaugauucaugcc

SEQ ID NO: 2082857 - RNA, 14 nt, Homo sapiens
cuaucccugcacau

SEQ ID NO: 2082858 - RNA, 16 nt, Homo sapiens
acuguuugauuuggau

SEQ ID NO: 2082859 - RNA, 19 nt, Homo sapiens
cauccuuuuuaaaugagac

SEQ ID NO: 2082860 - RNA, 19 nt, Homo sapiens
aauuuauuuaaguucacaa

SEQ ID NO: 2082861 - RNA, 14 nt, Homo sapiens
cucaagaguacaga

SEQ ID NO: 2082862 - RNA, 18 nt, Homo sapiens
acaagugcgccuugcaaa

SEQ ID NO: 2082863 - RNA, 23 nt, Homo sapiens
ucuuauucuggcggcagcgccuu

SEQ ID NO: 2082864 - RNA, 18 nt, Homo sapiens
cagcuccauccuugcauc

SEQ ID NO: 2082865 - RNA, 15 nt, Homo sapiens
ccuuggcuuguuauu

SEQ ID NO: 2082866 - RNA, 19 nt, Homo sapiens
aaacacaauccauugucau

SEQ ID NO: 2082867 - RNA, 21 nt, Homo sapiens
ucaaagcuaaauuccacacua

SEQ ID NO: 2082868 - RNA, 17 nt, Homo sapiens
gaauaaauguaucugaa

SEQ ID NO: 2082869 - RNA, 15 nt, Homo sapiens
aaccauaaacuucau

SEQ ID NO: 2082870 - RNA, 17 nt, Homo sapiens
caucaacaacacagcaa

SEQ ID NO: 2082871 - RNA, 14 nt, Homo sapiens
ggacacaacacaga

SEQ ID NO: 2082872 - RNA, 23 nt, Homo sapiens
cauacguggaaacaauccuguua

SEQ ID NO: 2082873 - RNA, 22 nt, Homo sapiens
uggcaucacgucagugcucaga

SEQ ID NO: 2082874 - RNA, 13 nt, Homo sapiens
cuuuucacacugu

SEQ ID NO: 2082875 - RNA, 14 nt, Homo sapiens
cacccacuugguau

SEQ ID NO: 2082876 - RNA, 19 nt, Homo sapiens
guuaauuguaauugcauga

SEQ ID NO: 2082877 - RNA, 20 nt, Homo sapiens
agaaggucuguggugcagug

SEQ ID NO: 2082878 - RNA, 20 nt, Homo sapiens
ccgccaccacgcccggcuaa

SEQ ID NO: 2082879 - RNA, 14 nt, Homo sapiens
aaaacuuaacuauc

SEQ ID NO: 2082880 - RNA, 12 nt, Homo sapiens
uuguuaugcuau

SEQ ID NO: 2082881 - RNA, 21 nt, Homo sapiens
caaagcaggguucugaggcaa

SEQ ID NO: 2082882 - RNA, 19 nt, Homo sapiens
caugaaugcaaaacauuuc

SEQ ID NO: 2082883 - RNA, 16 nt, Homo sapiens
uaauagaaaugcauac

SEQ ID NO: 2082884 - RNA, 18 nt, Homo sapiens
aauuagcuuuuucauccc

SEQ ID NO: 2082885 - RNA, 23 nt, Homo sapiens
auauaauggaagagaaaucucau

SEQ ID NO: 2082886 - RNA, 20 nt, Homo sapiens
gaaacaaauaauuugaacuu

SEQ ID NO: 2082887 - RNA, 14 nt, Homo sapiens
uaagauccacaaau

SEQ ID NO: 2082888 - RNA, 12 nt, Homo sapiens
agaacugugaua

SEQ ID NO: 2082889 - RNA, 22 nt, Homo sapiens
cauuccacauccccaccuucca

SEQ ID NO: 2082890 - RNA, 21 nt, Homo sapiens
cccaggcccuaggauuccucc

SEQ ID NO: 2082891 - RNA, 22 nt, Homo sapiens
uggggcugcuuaggaaaccuca

SEQ ID NO: 2082892 - RNA, 21 nt, Homo sapiens
agcccuuccccucugcagcuu

SEQ ID NO: 2082893 - RNA, 22 nt, Homo sapiens
gaaguucaaacccuguauccaa

SEQ ID NO: 2082894 - RNA, 21 nt, Homo sapiens
acguggccaggagccaugaca

SEQ ID NO: 2082895 - RNA, 15 nt, Homo sapiens
uagaauaaaugaaga

SEQ ID NO: 2082896 - RNA, 12 nt, Homo sapiens
ggcuaccaucug

SEQ ID NO: 2082897 - RNA, 12 nt, Homo sapiens
aaucauauucuc

SEQ ID NO: 2082898 - RNA, 20 nt, Homo sapiens
acugugccauguguuuaucc

SEQ ID NO: 2082899 - RNA, 22 nt, Homo sapiens
ccuagcccagacucugagcugc

SEQ ID NO: 2082900 - RNA, 15 nt, Homo sapiens
cccaggcacugcaaa

SEQ ID NO: 2082901 - RNA, 16 nt, Homo sapiens
aggaucaggcugcugg

SEQ ID NO: 2082902 - RNA, 23 nt, Homo sapiens
gcaaggaaacuauguaacaugua

SEQ ID NO: 2082903 - RNA, 18 nt, Homo sapiens
cugggaaaugagcaggga

SEQ ID NO: 2082904 - RNA, 17 nt, Homo sapiens
aaggcaccugaaugugu

SEQ ID NO: 2082905 - RNA, 18 nt, Homo sapiens
aaguuguguguugcugcu

SEQ ID NO: 2082906 - RNA, 15 nt, Homo sapiens
aauguaucauucagu

SEQ ID NO: 2082907 - RNA, 19 nt, Homo sapiens
uuucccagagucaucugau

SEQ ID NO: 2082908 - RNA, 23 nt, Homo sapiens
aaauaaucacacacacacuugcu

SEQ ID NO: 2082909 - RNA, 12 nt, Homo sapiens
aaugaaucuuca

SEQ ID NO: 2082910 - RNA, 18 nt, Homo sapiens
uuugacuagccaucucaa

SEQ ID NO: 2082911 - RNA, 14 nt, Homo sapiens
uacgacaacuugca

SEQ ID NO: 2082912 - RNA, 17 nt, Homo sapiens
aaccugggaaggccagc

SEQ ID NO: 2082913 - RNA, 23 nt, Homo sapiens
ugccaccccucuucugcuccuua

SEQ ID NO: 2082914 - RNA, 18 nt, Homo sapiens
cagagauacgcaaacaca

SEQ ID NO: 2082915 - RNA, 18 nt, Homo sapiens
gaccugaccggcaccugc

SEQ ID NO: 2082916 - RNA, 11 nt, Homo sapiens
ugucaagcaau

SEQ ID NO: 2082917 - RNA, 14 nt, Homo sapiens
ggaccugggguccc

SEQ ID NO: 2082918 - RNA, 17 nt, Homo sapiens
cugcaggacacagaucu

SEQ ID NO: 2082919 - RNA, 22 nt, Homo sapiens
agcugaccccgagaagugcucu

SEQ ID NO: 2082920 - RNA, 20 nt, Homo sapiens
ugaaauacgccagaacugcu

SEQ ID NO: 2082921 - RNA, 15 nt, Homo sapiens
uguuuagccuaguca

SEQ ID NO: 2082922 - RNA, 14 nt, Homo sapiens
cacccgugugcaca

SEQ ID NO: 2082923 - RNA, 22 nt, Homo sapiens
aaguguccuggaaauucugcug

SEQ ID NO: 2082924 - RNA, 15 nt, Homo sapiens
gcauacugagaauau

SEQ ID NO: 2082925 - RNA, 14 nt, Homo sapiens
aaaugucaggccuu

SEQ ID NO: 2082926 - RNA, 23 nt, Homo sapiens
auuuugucugcuuaguaucucau

SEQ ID NO: 2082927 - RNA, 20 nt, Homo sapiens
aacagauaacagugugcuca

SEQ ID NO: 2082928 - RNA, 19 nt, Homo sapiens
agugaacaaauuuacagag

SEQ ID NO: 2082929 - RNA, 13 nt, Homo sapiens
aauacauuugcua

SEQ ID NO: 2082930 - RNA, 20 nt, Homo sapiens
gagauagaggaugggcagcu

SEQ ID NO: 2082931 - RNA, 19 nt, Homo sapiens
aagggucuacaauucucca

SEQ ID NO: 2082932 - RNA, 14 nt, Homo sapiens
cagaggccaccuuu

SEQ ID NO: 2082933 - RNA, 14 nt, Homo sapiens
aagccaugccaugc

SEQ ID NO: 2082934 - RNA, 20 nt, Homo sapiens
aguauuaagugacagugcua

SEQ ID NO: 2082935 - RNA, 13 nt, Homo sapiens
agcaggaaauacc

SEQ ID NO: 2082936 - RNA, 24 nt, Homo sapiens
uacaguuaauuaugugcauauuaa

SEQ ID NO: 2082937 - RNA, 20 nt, Homo sapiens
uaauucuuacacugccugua

SEQ ID NO: 2082938 - RNA, 14 nt, Homo sapiens
gaugacauggucca

SEQ ID NO: 2082939 - RNA, 22 nt, Homo sapiens
uguccuccugauccugacacau

SEQ ID NO: 2082940 - RNA, 14 nt, Homo sapiens
agucuuuccugaua

SEQ ID NO: 2082941 - RNA, 22 nt, Homo sapiens
aaccuuaaagaaccaucagcau

SEQ ID NO: 2082942 - RNA, 11 nt, Homo sapiens
guauuugccau

SEQ ID NO: 2082943 - RNA, 16 nt, Homo sapiens
gaagaauuuacuuugg

SEQ ID NO: 2082944 - RNA, 21 nt, Homo sapiens
ucucaugagugccaagcaaaa

SEQ ID NO: 2082945 - RNA, 19 nt, Homo sapiens
caacaauacaugcugcuaa

SEQ ID NO: 2082946 - RNA, 19 nt, Homo sapiens
auugcuuauaacaagcaua

SEQ ID NO: 2082947 - RNA, 21 nt, Homo sapiens
uauucuuuacaaaaugaaugc

SEQ ID NO: 2082948 - RNA, 15 nt, Homo sapiens
aaauacaagaaccaa

SEQ ID NO: 2082949 - RNA, 17 nt, Homo sapiens
aaucuguacaugucucc

SEQ ID NO: 2082950 - RNA, 17 nt, Homo sapiens
uaagaccauaacagcca

SEQ ID NO: 2082951 - RNA, 13 nt, Homo sapiens
uucauucacauuc

SEQ ID NO: 2082952 - RNA, 22 nt, Homo sapiens
uugugccauguucaaaagaagu

SEQ ID NO: 2082953 - RNA, 16 nt, Homo sapiens
aacuucgguugcagau

SEQ ID NO: 2082954 - RNA, 16 nt, Homo sapiens
uacaaggacaaugccu

SEQ ID NO: 2082955 - RNA, 17 nt, Homo sapiens
accaacaaacaaugcca

SEQ ID NO: 2082956 - RNA, 21 nt, Homo sapiens
caauuguaaacagaaauugca

SEQ ID NO: 2082957 - RNA, 16 nt, Homo sapiens
acuauguaaaugugaa

SEQ ID NO: 2082958 - RNA, 16 nt, Homo sapiens
agggguuccagcacaa

SEQ ID NO: 2082959 - RNA, 15 nt, Homo sapiens
uauuuugguuuagug

SEQ ID NO: 2082960 - RNA, 15 nt, Homo sapiens
uauugcaguuuauca

SEQ ID NO: 2082961 - RNA, 17 nt, Homo sapiens
cugagaucacaccacug

SEQ ID NO: 2082962 - RNA, 23 nt, Homo sapiens
uaguaauuuuaguuauacuccuc

SEQ ID NO: 2082963 - RNA, 20 nt, Homo sapiens
ugguaauaaaugugacucag

SEQ ID NO: 2082964 - RNA, 18 nt, Homo sapiens
ucucagcccccaccucag

SEQ ID NO: 2082965 - RNA, 20 nt, Homo sapiens
uugaaauuaagaaggcaaaa

SEQ ID NO: 2082966 - RNA, 22 nt, Homo sapiens
caagagcucaaggucaaugaca

SEQ ID NO: 2082967 - RNA, 23 nt, Homo sapiens
gugcucggcagucauacuggggu

SEQ ID NO: 2082968 - RNA, 15 nt, Homo sapiens
cccagagguggaugu

SEQ ID NO: 2082969 - RNA, 21 nt, Homo sapiens
aggcaccuuaacuggagacca

SEQ ID NO: 2082970 - RNA, 20 nt, Homo sapiens
acccagcuugugccuguggu

SEQ ID NO: 2082971 - RNA, 19 nt, Homo sapiens
ccugucaauacuauggagu

SEQ ID NO: 2082972 - RNA, 21 nt, Homo sapiens
uagaaggaaacuagcuuacau

SEQ ID NO: 2082973 - RNA, 19 nt, Homo sapiens
uuagcuguuuuuuucauua

SEQ ID NO: 2082974 - RNA, 20 nt, Homo sapiens
aacauuuccaaaaguggcua

SEQ ID NO: 2082975 - RNA, 17 nt, Homo sapiens
caauuuacgaaaccaaa

SEQ ID NO: 2082976 - RNA, 15 nt, Homo sapiens
guagguuugcuucaa

SEQ ID NO: 2082977 - RNA, 18 nt, Homo sapiens
aacuaggugaucucaguu

SEQ ID NO: 2082978 - RNA, 22 nt, Homo sapiens
ugcggacacuuuugaggacaag

SEQ ID NO: 2082979 - RNA, 19 nt, Homo sapiens
uaaaaauuauauguuuaua

SEQ ID NO: 2082980 - RNA, 13 nt, Homo sapiens
accaaaucacuga

SEQ ID NO: 2082981 - RNA, 20 nt, Homo sapiens
uugggcaccagcucaugcca

SEQ ID NO: 2082982 - RNA, 23 nt, Homo sapiens
auuguucuguuuguguuauuuca

SEQ ID NO: 2082983 - RNA, 14 nt, Homo sapiens
aauaaaaccuguua

SEQ ID NO: 2082984 - RNA, 15 nt, Homo sapiens
caaugugaacacugg

SEQ ID NO: 2082985 - RNA, 13 nt, Homo sapiens
agaaaacaugaga

SEQ ID NO: 2082986 - RNA, 22 nt, Homo sapiens
cggagaguuuccuauguuucac

SEQ ID NO: 2082987 - RNA, 15 nt, Homo sapiens
ugagcuucaauauaa

SEQ ID NO: 2082988 - RNA, 16 nt, Homo sapiens
cagcauuccaugacca

SEQ ID NO: 2082989 - RNA, 16 nt, Homo sapiens
ugauugcucccaggau

SEQ ID NO: 2082990 - RNA, 21 nt, Homo sapiens
agacuugggaucugcaagaag

SEQ ID NO: 2082991 - RNA, 17 nt, Homo sapiens
ugagaagugcaacugcu

SEQ ID NO: 2082992 - RNA, 19 nt, Homo sapiens
gacugcucagaacuugcug

SEQ ID NO: 2082993 - RNA, 20 nt, Homo sapiens
gacccaaagaccaauauuca

SEQ ID NO: 2082994 - RNA, 21 nt, Homo sapiens
gaaguacaaagguugcagugc

SEQ ID NO: 2082995 - RNA, 22 nt, Homo sapiens
acccagaggguggguguucaua

SEQ ID NO: 2082996 - RNA, 19 nt, Homo sapiens
ucuagaaucauacuuaaca

SEQ ID NO: 2082997 - RNA, 23 nt, Homo sapiens
uggcacuaguauuucuaugaaau

SEQ ID NO: 2082998 - RNA, 14 nt, Homo sapiens
cauuaucuguauua

SEQ ID NO: 2082999 - RNA, 16 nt, Homo sapiens
ugaaagaugaucauuu

SEQ ID NO: 2083000 - RNA, 13 nt, Homo sapiens
uaaaguucaauuu

SEQ ID NO: 2083001 - RNA, 18 nt, Homo sapiens
augcauugaaagaauuag

SEQ ID NO: 2083002 - RNA, 22 nt, Homo sapiens
ugcaacccgguuuaccaguuua

SEQ ID NO: 2083003 - RNA, 12 nt, Homo sapiens
ucucuucugugu

SEQ ID NO: 2083004 - RNA, 22 nt, Homo sapiens
guguugcaccaggcacugcugc

SEQ ID NO: 2083005 - RNA, 17 nt, Homo sapiens
gucacacucuucaguga

SEQ ID NO: 2083006 - RNA, 14 nt, Homo sapiens
guucugugaccacu

SEQ ID NO: 2083007 - RNA, 17 nt, Homo sapiens
cuugaaguucugaaauu

SEQ ID NO: 2083008 - RNA, 21 nt, Homo sapiens
ucagugccacuugacauuccu

SEQ ID NO: 2083009 - RNA, 18 nt, Homo sapiens
auauauaagaaagacauc

SEQ ID NO: 2083010 - RNA, 13 nt, Homo sapiens
uguugagguguga

SEQ ID NO: 2083011 - RNA, 14 nt, Homo sapiens
agaaucacagaaca

SEQ ID NO: 2083012 - RNA, 19 nt, Homo sapiens
uauucaaguaacacuuuaa

SEQ ID NO: 2083013 - RNA, 18 nt, Homo sapiens
augauccccaagugguga

SEQ ID NO: 2083014 - RNA, 17 nt, Homo sapiens
ugauccuugcugauaaa

SEQ ID NO: 2083015 - RNA, 19 nt, Homo sapiens
gacagccucuucuguccca

SEQ ID NO: 2083016 - RNA, 20 nt, Homo sapiens
ugugaagccugcagagugca

SEQ ID NO: 2083017 - RNA, 21 nt, Homo sapiens
augcaggcaugcuggcuccca

SEQ ID NO: 2083018 - RNA, 12 nt, Homo sapiens
caguaguaucaa

SEQ ID NO: 2083019 - RNA, 15 nt, Homo sapiens
aucaauaaagcacua

SEQ ID NO: 2083020 - RNA, 18 nt, Homo sapiens
ugccccaaguccucauuu

SEQ ID NO: 2083021 - RNA, 21 nt, Homo sapiens
uuccuccuuugggcccagcgg

SEQ ID NO: 2083022 - RNA, 16 nt, Homo sapiens
uagucaguuacugaug

SEQ ID NO: 2083023 - RNA, 20 nt, Homo sapiens
gaaaaaucagaugaauugau

SEQ ID NO: 2083024 - RNA, 15 nt, Homo sapiens
uugcaugugcugcag

SEQ ID NO: 2083025 - RNA, 15 nt, Homo sapiens
aaacguccacagagu

SEQ ID NO: 2083026 - RNA, 16 nt, Homo sapiens
cugauguuaaccaaug

SEQ ID NO: 2083027 - RNA, 18 nt, Homo sapiens
agaaauaauugugucaug

SEQ ID NO: 2083028 - RNA, 14 nt, Homo sapiens
acaagccugaggga

SEQ ID NO: 2083029 - RNA, 21 nt, Homo sapiens
uaggggaagggcuuugagggu

SEQ ID NO: 2083030 - RNA, 14 nt, Homo sapiens
uaucacaguauuau

SEQ ID NO: 2083031 - RNA, 20 nt, Homo sapiens
aguuuuucucuggccuuuaa

SEQ ID NO: 2083032 - RNA, 12 nt, Homo sapiens
cagugcauuuac

SEQ ID NO: 2083033 - RNA, 21 nt, Homo sapiens
cugaaaaaugacugucccauu

SEQ ID NO: 2083034 - RNA, 21 nt, Homo sapiens
aaaacugcuuacuuaugccau

SEQ ID NO: 2083035 - RNA, 20 nt, Homo sapiens
caugugcacaagugugcaca

SEQ ID NO: 2083036 - RNA, 14 nt, Homo sapiens
cacagccacuaaga

SEQ ID NO: 2083037 - RNA, 21 nt, Homo sapiens
auuauuuaucagcccuauucu

SEQ ID NO: 2083038 - RNA, 14 nt, Homo sapiens
gggucgcugcauaa

SEQ ID NO: 2083039 - RNA, 15 nt, Homo sapiens
agugaggaacccuga

SEQ ID NO: 2083040 - RNA, 11 nt, Homo sapiens
gugagccagac

SEQ ID NO: 2083041 - RNA, 17 nt, Homo sapiens
agaucgugccacugcac

SEQ ID NO: 2083042 - RNA, 16 nt, Homo sapiens
uguuacuguucuugcu

SEQ ID NO: 2083043 - RNA, 20 nt, Homo sapiens
gaugccaagcuuuuuugcca

SEQ ID NO: 2083044 - RNA, 16 nt, Homo sapiens
ucuggcaaucuugccc

SEQ ID NO: 2083045 - RNA, 16 nt, Homo sapiens
acuguaacacuuuaca

SEQ ID NO: 2083046 - RNA, 13 nt, Homo sapiens
aggccauagcaau

SEQ ID NO: 2083047 - RNA, 19 nt, Homo sapiens
gaacucagcugaggccuug

SEQ ID NO: 2083048 - RNA, 17 nt, Homo sapiens
aguccuucaagauucca

SEQ ID NO: 2083049 - RNA, 14 nt, Homo sapiens
aauaaauguugcca

SEQ ID NO: 2083050 - RNA, 20 nt, Homo sapiens
ugccagucagcaaccuguaa

SEQ ID NO: 2083051 - RNA, 13 nt, Homo sapiens
uaacuuguuuaca

SEQ ID NO: 2083052 - RNA, 13 nt, Homo sapiens
uagcauguuugcu

SEQ ID NO: 2083053 - RNA, 15 nt, Homo sapiens
aaucucacagcauuu

SEQ ID NO: 2083054 - RNA, 21 nt, Homo sapiens
aauuuccuuuuugacacugaa

SEQ ID NO: 2083055 - RNA, 23 nt, Homo sapiens
augaaacucuuuggaacaacagc

SEQ ID NO: 2083056 - RNA, 23 nt, Homo sapiens
uagcuuguuuuauuuugugcuau

SEQ ID NO: 2083057 - RNA, 13 nt, Homo sapiens
aagcuuauuuccc

SEQ ID NO: 2083058 - RNA, 18 nt, Homo sapiens
cagccagcccauggcccc

SEQ ID NO: 2083059 - RNA, 13 nt, Homo sapiens
acagauggaccaa

SEQ ID NO: 2083060 - RNA, 23 nt, Homo sapiens
uaaaagaaaaaguaugugaauau

SEQ ID NO: 2083061 - RNA, 15 nt, Homo sapiens
ucagcaaaccucagu

SEQ ID NO: 2083062 - RNA, 15 nt, Homo sapiens
acauguggcaaaaua

SEQ ID NO: 2083063 - RNA, 16 nt, Homo sapiens
agacugagcucaaggu

SEQ ID NO: 2083064 - RNA, 24 nt, Homo sapiens
aacauugcagagcuaagcagucgu

SEQ ID NO: 2083065 - RNA, 14 nt, Homo sapiens
accaccccuaccac

SEQ ID NO: 2083066 - RNA, 12 nt, Homo sapiens
guaccuucccac

SEQ ID NO: 2083067 - RNA, 15 nt, Homo sapiens
uauuugagacuagga

SEQ ID NO: 2083068 - RNA, 11 nt, Homo sapiens
guucacuuccc

SEQ ID NO: 2083069 - RNA, 15 nt, Homo sapiens
acucuagacuaaaga

SEQ ID NO: 2083070 - RNA, 15 nt, Homo sapiens
ugagacagacauuca

SEQ ID NO: 2083071 - RNA, 23 nt, Homo sapiens
gccacugcccucuccacacccau

SEQ ID NO: 2083072 - RNA, 21 nt, Homo sapiens
aggaaaucuuuacuccuguaa

SEQ ID NO: 2083073 - RNA, 17 nt, Homo sapiens
ccuuuccccucccucag

SEQ ID NO: 2083074 - RNA, 14 nt, Homo sapiens
agucagucauguca

SEQ ID NO: 2083075 - RNA, 14 nt, Homo sapiens
agauucauaaauac

SEQ ID NO: 2083076 - RNA, 16 nt, Homo sapiens
ggcugcacagcucaac

SEQ ID NO: 2083077 - RNA, 16 nt, Homo sapiens
agugccuggguggaug

SEQ ID NO: 2083078 - RNA, 18 nt, Homo sapiens
uaguucacauacaaauca

SEQ ID NO: 2083079 - RNA, 15 nt, Homo sapiens
cgacugaagucagug

SEQ ID NO: 2083080 - RNA, 15 nt, Homo sapiens
ugggacuguguuucc

SEQ ID NO: 2083081 - RNA, 14 nt, Homo sapiens
cauacucugugcaa

SEQ ID NO: 2083082 - RNA, 15 nt, Homo sapiens
acauguaccacugag

SEQ ID NO: 2083083 - RNA, 19 nt, Homo sapiens
cagagaaaagucaggugca

SEQ ID NO: 2083084 - RNA, 18 nt, Homo sapiens
cacacuuaucaauggcac

SEQ ID NO: 2083085 - RNA, 11 nt, Homo sapiens
ugcucugcuau

SEQ ID NO: 2083086 - RNA, 12 nt, Homo sapiens
cagagagugaau

SEQ ID NO: 2083087 - RNA, 13 nt, Homo sapiens
auacaaauggauu

SEQ ID NO: 2083088 - RNA, 21 nt, Homo sapiens
uacauugaaaacaacaaaaca

SEQ ID NO: 2083089 - RNA, 23 nt, Homo sapiens
guacacuguucccaauauguagc

SEQ ID NO: 2083090 - RNA, 14 nt, Homo sapiens
uuauaaaugagcaa

SEQ ID NO: 2083091 - RNA, 15 nt, Homo sapiens
aagcaaaugucaugc

SEQ ID NO: 2083092 - RNA, 22 nt, Homo sapiens
uaauugccuagaaauaucuuuc

SEQ ID NO: 2083093 - RNA, 13 nt, Homo sapiens
agugaaggaagaa

SEQ ID NO: 2083094 - RNA, 13 nt, Homo sapiens
uucaaaagaagac

SEQ ID NO: 2083095 - RNA, 13 nt, Homo sapiens
aagacaaguucaa

SEQ ID NO: 2083096 - RNA, 20 nt, Homo sapiens
cugagcccccacugcuucua

SEQ ID NO: 2083097 - RNA, 24 nt, Homo sapiens
aggaacagaccugaggcuuaucuu

SEQ ID NO: 2083098 - RNA, 23 nt, Homo sapiens
guagaaguuuggcugcugucaua

SEQ ID NO: 2083099 - RNA, 21 nt, Homo sapiens
auuuuuuuaauuucugaagaa

SEQ ID NO: 2083100 - RNA, 17 nt, Homo sapiens
ucaguuucccuccuucc

SEQ ID NO: 2083101 - RNA, 22 nt, Homo sapiens
gaaagccgggcaugacggcuca

SEQ ID NO: 2083102 - RNA, 18 nt, Homo sapiens
agcaagacuccauuucaa

SEQ ID NO: 2083103 - RNA, 13 nt, Homo sapiens
uaauaaaacuauu

SEQ ID NO: 2083104 - RNA, 15 nt, Homo sapiens
cccuggugaccagac

SEQ ID NO: 2083105 - RNA, 14 nt, Homo sapiens
ucaaaucauauccu

SEQ ID NO: 2083106 - RNA, 14 nt, Homo sapiens
uggacgugucaggu

SEQ ID NO: 2083107 - RNA, 15 nt, Homo sapiens
aggucuaaucaguga

SEQ ID NO: 2083108 - RNA, 23 nt, Homo sapiens
ugcgguggcucaugccuguaauc

SEQ ID NO: 2083109 - RNA, 21 nt, Homo sapiens
ucuucccuggguuuucugccc

SEQ ID NO: 2083110 - RNA, 12 nt, Homo sapiens
gcccacccaggg

SEQ ID NO: 2083111 - RNA, 22 nt, Homo sapiens
aguguaccgcgucuacccuggg

SEQ ID NO: 2083112 - RNA, 14 nt, Homo sapiens
uuaauaauguuuca

SEQ ID NO: 2083113 - RNA, 20 nt, Homo sapiens
uuuauuggcugagauaugaa

SEQ ID NO: 2083114 - RNA, 21 nt, Homo sapiens
aaugagcugcacuccaugagu

SEQ ID NO: 2083115 - RNA, 18 nt, Homo sapiens
aucacccuaccaacuuua

SEQ ID NO: 2083116 - RNA, 12 nt, Homo sapiens
cagucauugcug

SEQ ID NO: 2083117 - RNA, 20 nt, Homo sapiens
cagacacacaagcagacaca

SEQ ID NO: 2083118 - RNA, 17 nt, Homo sapiens
accuaugucccuucuca

SEQ ID NO: 2083119 - RNA, 16 nt, Homo sapiens
aaauuuaugcauuuca

SEQ ID NO: 2083120 - RNA, 18 nt, Homo sapiens
aguuuaaugccuagcaga

SEQ ID NO: 2083121 - RNA, 21 nt, Homo sapiens
agacguggugugagagggaca

SEQ ID NO: 2083122 - RNA, 21 nt, Homo sapiens
aaagcacccuguaucacagac

SEQ ID NO: 2083123 - RNA, 16 nt, Homo sapiens
gcaaagggacauugaa

SEQ ID NO: 2083124 - RNA, 17 nt, Homo sapiens
ugcccuuccccuuccca

SEQ ID NO: 2083125 - RNA, 20 nt, Homo sapiens
acuaauaaucaccauaugcu

SEQ ID NO: 2083126 - RNA, 22 nt, Homo sapiens
acugcugggcccgauucugaua

SEQ ID NO: 2083127 - RNA, 17 nt, Homo sapiens
gacauggaccuacugca

SEQ ID NO: 2083128 - RNA, 23 nt, Homo sapiens
cuggaacuguagugguagcuuuc

SEQ ID NO: 2083129 - RNA, 22 nt, Homo sapiens
ugggagccaguccuccacucga

SEQ ID NO: 2083130 - RNA, 15 nt, Homo sapiens
aaauucuacuguaug

SEQ ID NO: 2083131 - RNA, 14 nt, Homo sapiens
uucagucugaucca

SEQ ID NO: 2083132 - RNA, 13 nt, Homo sapiens
gauguguugcccc

SEQ ID NO: 2083133 - RNA, 16 nt, Homo sapiens
cggagcaucucagaag

SEQ ID NO: 2083134 - RNA, 21 nt, Homo sapiens
ugcuuccucccaacaagcagc

SEQ ID NO: 2083135 - RNA, 16 nt, Homo sapiens
uuaaauagaacuugau

SEQ ID NO: 2083136 - RNA, 11 nt, Homo sapiens
cuguguuucaa

SEQ ID NO: 2083137 - RNA, 18 nt, Homo sapiens
uugaacuaggcugagcaa

SEQ ID NO: 2083138 - RNA, 14 nt, Homo sapiens
ugugugugugugaa

SEQ ID NO: 2083139 - RNA, 14 nt, Homo sapiens
uuccuguuacuuua

SEQ ID NO: 2083140 - RNA, 16 nt, Homo sapiens
gcucaauacaauguga

SEQ ID NO: 2083141 - RNA, 11 nt, Homo sapiens
gaguccucuau

SEQ ID NO: 2083142 - RNA, 19 nt, Homo sapiens
gcuucucugggggccucuu

SEQ ID NO: 2083143 - RNA, 15 nt, Homo sapiens
auaaucuuagaacag

SEQ ID NO: 2083144 - RNA, 22 nt, Homo sapiens
ccacacaguggccggggcugaa

SEQ ID NO: 2083145 - RNA, 23 nt, Homo sapiens
agaacuggaaagacauagccaac

SEQ ID NO: 2083146 - RNA, 23 nt, Homo sapiens
cuaaagccuuccuauuuugcaua

SEQ ID NO: 2083147 - RNA, 17 nt, Homo sapiens
ugauggccuuguuucaa

SEQ ID NO: 2083148 - RNA, 18 nt, Homo sapiens
augagaaagccugagaag

SEQ ID NO: 2083149 - RNA, 14 nt, Homo sapiens
caggucuacaguga

SEQ ID NO: 2083150 - RNA, 16 nt, Homo sapiens
uauaacuucugaagua

SEQ ID NO: 2083151 - RNA, 13 nt, Homo sapiens
auccauuuuacac

SEQ ID NO: 2083152 - RNA, 11 nt, Homo sapiens
ccaagcccagg

SEQ ID NO: 2083153 - RNA, 13 nt, Homo sapiens
cagaugucagcuu

SEQ ID NO: 2083154 - RNA, 13 nt, Homo sapiens
uggccccagcucc

SEQ ID NO: 2083155 - RNA, 16 nt, Homo sapiens
agaaugaugcuaugaa

SEQ ID NO: 2083156 - RNA, 22 nt, Homo sapiens
aaaggucuaugcucauaacugu

SEQ ID NO: 2083157 - RNA, 18 nt, Homo sapiens
agaccccucccacuccug

SEQ ID NO: 2083158 - RNA, 19 nt, Homo sapiens
agcaggagcagcugugcug

SEQ ID NO: 2083159 - RNA, 13 nt, Homo sapiens
agcugccauguca

SEQ ID NO: 2083160 - RNA, 22 nt, Homo sapiens
uucugccugcuccaucgcgcca

SEQ ID NO: 2083161 - RNA, 15 nt, Homo sapiens
agcugggaagacccu

SEQ ID NO: 2083162 - RNA, 12 nt, Homo sapiens
gaacagacuuuu

SEQ ID NO: 2083163 - RNA, 22 nt, Homo sapiens
cuuaugggucccccucagcaag

SEQ ID NO: 2083164 - RNA, 14 nt, Homo sapiens
auagagccuuugau

SEQ ID NO: 2083165 - RNA, 17 nt, Homo sapiens
gagaugcccauucucuu

SEQ ID NO: 2083166 - RNA, 18 nt, Homo sapiens
auucagugagacacagag

SEQ ID NO: 2083167 - RNA, 18 nt, Homo sapiens
caagugauauugucuuca

SEQ ID NO: 2083168 - RNA, 16 nt, Homo sapiens
accuacccccaaaaaa

SEQ ID NO: 2083169 - RNA, 18 nt, Homo sapiens
aauuguguauugaugcaa

SEQ ID NO: 2083170 - RNA, 21 nt, Homo sapiens
cuuaaguuuuagucuuuagaa

SEQ ID NO: 2083171 - RNA, 17 nt, Homo sapiens
cucuauucucugcaauu

SEQ ID NO: 2083172 - RNA, 23 nt, Homo sapiens
ccuagcaggcacaggacaccugg

SEQ ID NO: 2083173 - RNA, 13 nt, Homo sapiens
caugugcauauag

SEQ ID NO: 2083174 - RNA, 18 nt, Homo sapiens
cacagcucaacucggggg

SEQ ID NO: 2083175 - RNA, 21 nt, Homo sapiens
aaugaacgcguguucuguaau

SEQ ID NO: 2083176 - RNA, 12 nt, Homo sapiens
uaaauugcacac

SEQ ID NO: 2083177 - RNA, 20 nt, Homo sapiens
ggauuauucccaccugccac

SEQ ID NO: 2083178 - RNA, 14 nt, Homo sapiens
cuuccucugugcca

SEQ ID NO: 2083179 - RNA, 14 nt, Homo sapiens
aaauaucuagccca

SEQ ID NO: 2083180 - RNA, 14 nt, Homo sapiens
auugcuaugaauga

SEQ ID NO: 2083181 - RNA, 20 nt, Homo sapiens
ggucaauuuuguuauguaua

SEQ ID NO: 2083182 - RNA, 16 nt, Homo sapiens
aauuggacuggugaaa

SEQ ID NO: 2083183 - RNA, 18 nt, Homo sapiens
aacauccauauugcacaa

SEQ ID NO: 2083184 - RNA, 14 nt, Homo sapiens
ucauuugcagucag

SEQ ID NO: 2083185 - RNA, 17 nt, Homo sapiens
aauaucucaccacagug

SEQ ID NO: 2083186 - RNA, 17 nt, Homo sapiens
cugauuuguaacccacu

SEQ ID NO: 2083187 - RNA, 13 nt, Homo sapiens
cuuccaugauacu

SEQ ID NO: 2083188 - RNA, 15 nt, Homo sapiens
ugauggagccugaac

SEQ ID NO: 2083189 - RNA, 18 nt, Homo sapiens
gcuacucaggagacugag

SEQ ID NO: 2083190 - RNA, 21 nt, Homo sapiens
ucaaacauauucuaaugccug

SEQ ID NO: 2083191 - RNA, 16 nt, Homo sapiens
gguugaggaauguguu

SEQ ID NO: 2083192 - RNA, 14 nt, Homo sapiens
aucaaaucauucaa

SEQ ID NO: 2083193 - RNA, 17 nt, Homo sapiens
gcucacgucacacuugg

SEQ ID NO: 2083194 - RNA, 16 nt, Homo sapiens
aaugccacucuguaau

SEQ ID NO: 2083195 - RNA, 17 nt, Homo sapiens
agaucacgaggucagga

SEQ ID NO: 2083196 - RNA, 19 nt, Homo sapiens
cauucaguuaaaaauccag

SEQ ID NO: 2083197 - RNA, 23 nt, Homo sapiens
ugauuuuacucauauguggaauc

SEQ ID NO: 2083198 - RNA, 22 nt, Homo sapiens
cacccucacacacacagcuggg

SEQ ID NO: 2083199 - RNA, 13 nt, Homo sapiens
gccuccaugaccu

SEQ ID NO: 2083200 - RNA, 18 nt, Homo sapiens
acaugcccuaaugucugu

SEQ ID NO: 2083201 - RNA, 16 nt, Homo sapiens
cccauuucuccagaac

SEQ ID NO: 2083202 - RNA, 19 nt, Homo sapiens
ccaucagcacucuguaaaa

SEQ ID NO: 2083203 - RNA, 13 nt, Homo sapiens
ucgcacacagggc

SEQ ID NO: 2083204 - RNA, 20 nt, Homo sapiens
ucaugcacaguaaauucugc

SEQ ID NO: 2083205 - RNA, 18 nt, Homo sapiens
uaaacuguuagcacuguu

SEQ ID NO: 2083206 - RNA, 15 nt, Homo sapiens
ucaagacucaccuca

SEQ ID NO: 2083207 - RNA, 14 nt, Homo sapiens
auacucuucaagga

SEQ ID NO: 2083208 - RNA, 21 nt, Homo sapiens
uaauauuuuauucucauuuaa

SEQ ID NO: 2083209 - RNA, 21 nt, Homo sapiens
ggccucugccugggacacugc

SEQ ID NO: 2083210 - RNA, 14 nt, Homo sapiens
uuaguaacauucau

SEQ ID NO: 2083211 - RNA, 16 nt, Homo sapiens
ucaccucucagcugcu

SEQ ID NO: 2083212 - RNA, 14 nt, Homo sapiens
ugcccacuccgcca

SEQ ID NO: 2083213 - RNA, 14 nt, Homo sapiens
auggcgugaucuca

SEQ ID NO: 2083214 - RNA, 18 nt, Homo sapiens
cccugugucugcuguaga

SEQ ID NO: 2083215 - RNA, 23 nt, Homo sapiens
augaggcaacccgugcucagcug

SEQ ID NO: 2083216 - RNA, 17 nt, Homo sapiens
uuucuguuuacugucaa

SEQ ID NO: 2083217 - RNA, 15 nt, Homo sapiens
uuuccuaaacccagu

SEQ ID NO: 2083218 - RNA, 21 nt, Homo sapiens
augugccccagcaggcaugga

SEQ ID NO: 2083219 - RNA, 15 nt, Homo sapiens
agcuaaaugcaggga

SEQ ID NO: 2083220 - RNA, 14 nt, Homo sapiens
acagaaacugcaug

SEQ ID NO: 2083221 - RNA, 15 nt, Homo sapiens
gucugugugcuacua

SEQ ID NO: 2083222 - RNA, 17 nt, Homo sapiens
gaaucucuucacuaccc

SEQ ID NO: 2083223 - RNA, 17 nt, Homo sapiens
cacugaagcacgugaga

SEQ ID NO: 2083224 - RNA, 14 nt, Homo sapiens
ccacucaccuauca

SEQ ID NO: 2083225 - RNA, 12 nt, Homo sapiens
uuugcucaugga

SEQ ID NO: 2083226 - RNA, 23 nt, Homo sapiens
uccuccugugcuauuuguacaaa

SEQ ID NO: 2083227 - RNA, 16 nt, Homo sapiens
auaugacacaucucug

SEQ ID NO: 2083228 - RNA, 18 nt, Homo sapiens
caggaaauaacccacaaa

SEQ ID NO: 2083229 - RNA, 14 nt, Homo sapiens
cugcaugcccagag

SEQ ID NO: 2083230 - RNA, 17 nt, Homo sapiens
cuuccaaauccaaaagc

SEQ ID NO: 2083231 - RNA, 15 nt, Homo sapiens
caugucagccucaug

SEQ ID NO: 2083232 - RNA, 18 nt, Homo sapiens
uucugauaaaguuccuua

SEQ ID NO: 2083233 - RNA, 19 nt, Homo sapiens
aacuucugauuucucuuca

SEQ ID NO: 2083234 - RNA, 16 nt, Homo sapiens
ugauggcagguccucu

SEQ ID NO: 2083235 - RNA, 15 nt, Homo sapiens
aguauccaugcaugu

SEQ ID NO: 2083236 - RNA, 23 nt, Homo sapiens
ucaguuuuuguauggaagccacc

SEQ ID NO: 2083237 - RNA, 16 nt, Homo sapiens
auuuaauaguguuaau

SEQ ID NO: 2083238 - RNA, 15 nt, Homo sapiens
ugaucuauacaaauu

SEQ ID NO: 2083239 - RNA, 15 nt, Homo sapiens
ucauaauuagaacaa

SEQ ID NO: 2083240 - RNA, 16 nt, Homo sapiens
gcgcguggugcugagu

SEQ ID NO: 2083241 - RNA, 18 nt, Homo sapiens
aggaacccaucacugugu

SEQ ID NO: 2083242 - RNA, 16 nt, Homo sapiens
ucuaacuacaaggaca

SEQ ID NO: 2083243 - RNA, 21 nt, Homo sapiens
ugccacuccugcuucucuggg

SEQ ID NO: 2083244 - RNA, 15 nt, Homo sapiens
cugaccuacucuugc

SEQ ID NO: 2083245 - RNA, 13 nt, Homo sapiens
uguguccuccugc

SEQ ID NO: 2083246 - RNA, 22 nt, Homo sapiens
aggcuucucuucugacccaggg

SEQ ID NO: 2083247 - RNA, 23 nt, Homo sapiens
cugagccccucaauccuaucaca

SEQ ID NO: 2083248 - RNA, 16 nt, Homo sapiens
gaagguauaugccaaa

SEQ ID NO: 2083249 - RNA, 19 nt, Homo sapiens
aagaguccaagaagccagc

SEQ ID NO: 2083250 - RNA, 18 nt, Homo sapiens
ccugcuuugaggacaaag

SEQ ID NO: 2083251 - RNA, 19 nt, Homo sapiens
guguacagucuuguauuaa

SEQ ID NO: 2083252 - RNA, 16 nt, Homo sapiens
aauuguuuuuuaucuu

SEQ ID NO: 2083253 - RNA, 11 nt, Homo sapiens
cgucacagccu

SEQ ID NO: 2083254 - RNA, 17 nt, Homo sapiens
aacauaaaggacaggcc

SEQ ID NO: 2083255 - RNA, 22 nt, Homo sapiens
gccaugauguauauccauauaa

SEQ ID NO: 2083256 - RNA, 17 nt, Homo sapiens
uacaguaaauacacugu

SEQ ID NO: 2083257 - RNA, 15 nt, Homo sapiens
accuguuucccgggc

SEQ ID NO: 2083258 - RNA, 14 nt, Homo sapiens
agcggaucucacuc

SEQ ID NO: 2083259 - RNA, 22 nt, Homo sapiens
acagcacaaccggucccuucca

SEQ ID NO: 2083260 - RNA, 14 nt, Homo sapiens
cggcagcacaagcu

SEQ ID NO: 2083261 - RNA, 19 nt, Homo sapiens
aaaucacgccgcaugcaca

SEQ ID NO: 2083262 - RNA, 17 nt, Homo sapiens
uaaaagauaagugcagu

SEQ ID NO: 2083263 - RNA, 16 nt, Homo sapiens
accuguaaucauauaa

SEQ ID NO: 2083264 - RNA, 17 nt, Homo sapiens
ugaacaaagagagcuca

SEQ ID NO: 2083265 - RNA, 21 nt, Homo sapiens
uuggggaggggccucccugug

SEQ ID NO: 2083266 - RNA, 14 nt, Homo sapiens
cauguuugacgugg

SEQ ID NO: 2083267 - RNA, 20 nt, Homo sapiens
auauuggccaaacuggugca

SEQ ID NO: 2083268 - RNA, 22 nt, Homo sapiens
caauagacauugcaaacucuca

SEQ ID NO: 2083269 - RNA, 12 nt, Homo sapiens
cauguagcuguu

SEQ ID NO: 2083270 - RNA, 23 nt, Homo sapiens
ccacaaggaauccccagauauuu

SEQ ID NO: 2083271 - RNA, 17 nt, Homo sapiens
auuuuuaguuugcuaag

SEQ ID NO: 2083272 - RNA, 17 nt, Homo sapiens
aggcccaccuaccuuca

SEQ ID NO: 2083273 - RNA, 22 nt, Homo sapiens
uuauauacaaagcugucacuca

SEQ ID NO: 2083274 - RNA, 18 nt, Homo sapiens
cagagguaaaagugugag

SEQ ID NO: 2083275 - RNA, 18 nt, Homo sapiens
uuuugauggugucuguga

SEQ ID NO: 2083276 - RNA, 18 nt, Homo sapiens
aaugacugacuugucuaa

SEQ ID NO: 2083277 - RNA, 15 nt, Homo sapiens
uuaaugaaauaccaa

SEQ ID NO: 2083278 - RNA, 22 nt, Homo sapiens
acacagcagcuguucaacaaga

SEQ ID NO: 2083279 - RNA, 18 nt, Homo sapiens
gaauuaagucagagccaa

SEQ ID NO: 2083280 - RNA, 16 nt, Homo sapiens
ggugaccucacaguac

SEQ ID NO: 2083281 - RNA, 21 nt, Homo sapiens
aaccagagcuggaacacaaua

SEQ ID NO: 2083282 - RNA, 19 nt, Homo sapiens
cuuaaauaaacucaaugag

SEQ ID NO: 2083283 - RNA, 16 nt, Homo sapiens
uuaaauaaacaugacc

SEQ ID NO: 2083284 - RNA, 14 nt, Homo sapiens
gagcagcugcugaa

SEQ ID NO: 2083285 - RNA, 19 nt, Homo sapiens
ccuacucugcaacucucag

SEQ ID NO: 2083286 - RNA, 14 nt, Homo sapiens
agcaacaagccuca

SEQ ID NO: 2083287 - RNA, 21 nt, Homo sapiens
cucugaaauuggucacuuucc

SEQ ID NO: 2083288 - RNA, 13 nt, Homo sapiens
cacugccaagagc

SEQ ID NO: 2083289 - RNA, 17 nt, Homo sapiens
cuuagagggugauggaa

SEQ ID NO: 2083290 - RNA, 13 nt, Homo sapiens
augaaaucucagg

SEQ ID NO: 2083291 - RNA, 20 nt, Homo sapiens
uaucuauacauaauggcuga

SEQ ID NO: 2083292 - RNA, 22 nt, Homo sapiens
uaaguauccugagagcccagaa

SEQ ID NO: 2083293 - RNA, 13 nt, Homo sapiens
uggugaggcaaua

SEQ ID NO: 2083294 - RNA, 16 nt, Homo sapiens
agaugguaaucuuuuc

SEQ ID NO: 2083295 - RNA, 23 nt, Homo sapiens
ugaagguaacuauuagaauauaa

SEQ ID NO: 2083296 - RNA, 18 nt, Homo sapiens
ucaugguggguucagggg

SEQ ID NO: 2083297 - RNA, 20 nt, Homo sapiens
gucccuuggucuguacaaau

SEQ ID NO: 2083298 - RNA, 19 nt, Homo sapiens
ggguuucacuauguugccu

SEQ ID NO: 2083299 - RNA, 14 nt, Homo sapiens
auuuuuucuugcau

SEQ ID NO: 2083300 - RNA, 20 nt, Homo sapiens
gccauaguggaucacucacc

SEQ ID NO: 2083301 - RNA, 20 nt, Homo sapiens
gcacgcuccugccuacccag

SEQ ID NO: 2083302 - RNA, 20 nt, Homo sapiens
aauggggucccccucccacu

SEQ ID NO: 2083303 - RNA, 17 nt, Homo sapiens
acugcuucucuuugugc

SEQ ID NO: 2083304 - RNA, 17 nt, Homo sapiens
cuaggggcuggggccaa

SEQ ID NO: 2083305 - RNA, 13 nt, Homo sapiens
cacugauauccuc

SEQ ID NO: 2083306 - RNA, 21 nt, Homo sapiens
uccuguaaaggucaacaauaa

SEQ ID NO: 2083307 - RNA, 14 nt, Homo sapiens
uggccagacaagaa

SEQ ID NO: 2083308 - RNA, 22 nt, Homo sapiens
aggcaugggcagcaaccccugc

SEQ ID NO: 2083309 - RNA, 15 nt, Homo sapiens
ccugcacacagagug

SEQ ID NO: 2083310 - RNA, 15 nt, Homo sapiens
agaacuguccacauc

SEQ ID NO: 2083311 - RNA, 14 nt, Homo sapiens
agccucugugcugc

SEQ ID NO: 2083312 - RNA, 23 nt, Homo sapiens
agaggagaaaaaaacuucuuuaa

SEQ ID NO: 2083313 - RNA, 13 nt, Homo sapiens
cucccuugucuca

SEQ ID NO: 2083314 - RNA, 19 nt, Homo sapiens
cacuaaacagacuauuuaa

SEQ ID NO: 2083315 - RNA, 20 nt, Homo sapiens
ucgucucggccccucugauu

SEQ ID NO: 2083316 - RNA, 21 nt, Homo sapiens
caccugaacuuucucuagcaa

SEQ ID NO: 2083317 - RNA, 16 nt, Homo sapiens
uaaaucuauucugcua

SEQ ID NO: 2083318 - RNA, 18 nt, Homo sapiens
guauugauaaacuuugaa

SEQ ID NO: 2083319 - RNA, 18 nt, Homo sapiens
ugccgucuaccugagggg

SEQ ID NO: 2083320 - RNA, 18 nt, Homo sapiens
auuccugcgcauggugca

SEQ ID NO: 2083321 - RNA, 18 nt, Homo sapiens
gguggagaagaucgcaug

SEQ ID NO: 2083322 - RNA, 16 nt, Homo sapiens
cccacuccaucuggua

SEQ ID NO: 2083323 - RNA, 20 nt, Homo sapiens
ucaggugcagucccaguccu

SEQ ID NO: 2083324 - RNA, 13 nt, Homo sapiens
ggcaauucacaaa

SEQ ID NO: 2083325 - RNA, 13 nt, Homo sapiens
ugacaguaugcau

SEQ ID NO: 2083326 - RNA, 15 nt, Homo sapiens
aauguauguauauau

SEQ ID NO: 2083327 - RNA, 17 nt, Homo sapiens
cugcaguucuuguggaa

SEQ ID NO: 2083328 - RNA, 22 nt, Homo sapiens
gcugguuuuacauuagauuuau

SEQ ID NO: 2083329 - RNA, 22 nt, Homo sapiens
uucuaccugccacucacacagc

SEQ ID NO: 2083330 - RNA, 17 nt, Homo sapiens
aagauggagacacccuc

SEQ ID NO: 2083331 - RNA, 18 nt, Homo sapiens
cuucaccaagugaucaaa

SEQ ID NO: 2083332 - RNA, 20 nt, Homo sapiens
ccucccuggaugacauuaaa

SEQ ID NO: 2083333 - RNA, 18 nt, Homo sapiens
uagcaauuaaacuuugua

SEQ ID NO: 2083334 - RNA, 13 nt, Homo sapiens
gcugggagacaca

SEQ ID NO: 2083335 - RNA, 18 nt, Homo sapiens
aaugcccauuuuugcuaa

SEQ ID NO: 2083336 - RNA, 19 nt, Homo sapiens
uucagaauauauugaauag

SEQ ID NO: 2083337 - RNA, 15 nt, Homo sapiens
cugucuguacuucau

SEQ ID NO: 2083338 - RNA, 19 nt, Homo sapiens
uaggagcugcaguucuugu

SEQ ID NO: 2083339 - RNA, 16 nt, Homo sapiens
cuuccucgaggucaua

SEQ ID NO: 2083340 - RNA, 18 nt, Homo sapiens
cuguuauuuaauuagcca

SEQ ID NO: 2083341 - RNA, 16 nt, Homo sapiens
cuuacucccuaucuaa

SEQ ID NO: 2083342 - RNA, 20 nt, Homo sapiens
acacaaggcugggcaccucu

SEQ ID NO: 2083343 - RNA, 14 nt, Homo sapiens
gcggccuccaugca

SEQ ID NO: 2083344 - RNA, 17 nt, Homo sapiens
uggagggggcugggcuc

SEQ ID NO: 2083345 - RNA, 16 nt, Homo sapiens
ugacucaagaagugaa

SEQ ID NO: 2083346 - RNA, 15 nt, Homo sapiens
ccgggagacucaaag

SEQ ID NO: 2083347 - RNA, 21 nt, Homo sapiens
ccucccaaagugcugggauua

SEQ ID NO: 2083348 - RNA, 15 nt, Homo sapiens
cugacggcgccuuuu

SEQ ID NO: 2083349 - RNA, 13 nt, Homo sapiens
uugaaaucuauga

SEQ ID NO: 2083350 - RNA, 19 nt, Homo sapiens
ucaauagucaguuacugau

SEQ ID NO: 2083351 - RNA, 14 nt, Homo sapiens
aguuugacugugcu

SEQ ID NO: 2083352 - RNA, 18 nt, Homo sapiens
uaacaucaacaggacuua

SEQ ID NO: 2083353 - RNA, 16 nt, Homo sapiens
agcagaccucguuucu

SEQ ID NO: 2083354 - RNA, 13 nt, Homo sapiens
cugucucugucau

SEQ ID NO: 2083355 - RNA, 13 nt, Homo sapiens
gucgguguguaau

SEQ ID NO: 2083356 - RNA, 15 nt, Homo sapiens
caagucgaugaacua

SEQ ID NO: 2083357 - RNA, 21 nt, Homo sapiens
gagcagcuuuaaacucaggga

SEQ ID NO: 2083358 - RNA, 21 nt, Homo sapiens
auucuucacuggugagacaau

SEQ ID NO: 2083359 - RNA, 20 nt, Homo sapiens
cagaugguagaacuaaacaa

SEQ ID NO: 2083360 - RNA, 20 nt, Homo sapiens
aaggaguaaccaauuucuuu

SEQ ID NO: 2083361 - RNA, 22 nt, Homo sapiens
cuugauauguaaguacuuccac

SEQ ID NO: 2083362 - RNA, 18 nt, Homo sapiens
caaucaauggugcaaaaa

SEQ ID NO: 2083363 - RNA, 23 nt, Homo sapiens
cugaaucauccgaggcaaagaga

SEQ ID NO: 2083364 - RNA, 16 nt, Homo sapiens
ccauagaaacugaggc

SEQ ID NO: 2083365 - RNA, 16 nt, Homo sapiens
cauggugaaaauguac

SEQ ID NO: 2083366 - RNA, 14 nt, Homo sapiens
ugcuuccuguguaa

SEQ ID NO: 2083367 - RNA, 22 nt, Homo sapiens
gauauauuagggacacuuucac

SEQ ID NO: 2083368 - RNA, 22 nt, Homo sapiens
aggguccaaccagaccuggaag

SEQ ID NO: 2083369 - RNA, 16 nt, Homo sapiens
ccacacccugccugcu

SEQ ID NO: 2083370 - RNA, 20 nt, Homo sapiens
aaaguuugcuguaccacaau

SEQ ID NO: 2083371 - RNA, 14 nt, Homo sapiens
cugagugguccaca

SEQ ID NO: 2083372 - RNA, 15 nt, Homo sapiens
ccugcucagcagcca

SEQ ID NO: 2083373 - RNA, 20 nt, Homo sapiens
uacaacugcaccugucauca

SEQ ID NO: 2083374 - RNA, 13 nt, Homo sapiens
aggaagagugcaa

SEQ ID NO: 2083375 - RNA, 23 nt, Homo sapiens
uugucaauaaauggcccggacau

SEQ ID NO: 2083376 - RNA, 18 nt, Homo sapiens
acccagugugugcucagc

SEQ ID NO: 2083377 - RNA, 18 nt, Homo sapiens
uguucugguggccccuuc

SEQ ID NO: 2083378 - RNA, 15 nt, Homo sapiens
uuuuugcaguauggu

SEQ ID NO: 2083379 - RNA, 19 nt, Homo sapiens
uauaacuccuuguuucaga

SEQ ID NO: 2083380 - RNA, 19 nt, Homo sapiens
cuuccuuagccuugcucag

SEQ ID NO: 2083381 - RNA, 19 nt, Homo sapiens
aagcuaugugagcucacca

SEQ ID NO: 2083382 - RNA, 15 nt, Homo sapiens
gaagaugaugcuauu

SEQ ID NO: 2083383 - RNA, 23 nt, Homo sapiens
aucccacucuucuugcagcuguu

SEQ ID NO: 2083384 - RNA, 15 nt, Homo sapiens
uuucucaaacugagc

SEQ ID NO: 2083385 - RNA, 22 nt, Homo sapiens
ugcacccaccuuucugcacaua

SEQ ID NO: 2083386 - RNA, 20 nt, Homo sapiens
aacccagccagaguuugccu

SEQ ID NO: 2083387 - RNA, 12 nt, Homo sapiens
gcacccacugug

SEQ ID NO: 2083388 - RNA, 14 nt, Homo sapiens
uucugaucagaggu

SEQ ID NO: 2083389 - RNA, 15 nt, Homo sapiens
acccaacuugccaaa

SEQ ID NO: 2083390 - RNA, 14 nt, Homo sapiens
uuccugcacauuaa

SEQ ID NO: 2083391 - RNA, 13 nt, Homo sapiens
cacagggcaguac

SEQ ID NO: 2083392 - RNA, 20 nt, Homo sapiens
gaagaccggcugguggagcu

SEQ ID NO: 2083393 - RNA, 18 nt, Homo sapiens
uaucccccaccaaaaaca

SEQ ID NO: 2083394 - RNA, 18 nt, Homo sapiens
cagagccaugccaggcug

SEQ ID NO: 2083395 - RNA, 23 nt, Homo sapiens
gcuacacguuggaguauaccuau

SEQ ID NO: 2083396 - RNA, 13 nt, Homo sapiens
ggggggcaaggug

SEQ ID NO: 2083397 - RNA, 17 nt, Homo sapiens
uuccaagauaaaaccag

SEQ ID NO: 2083398 - RNA, 14 nt, Homo sapiens
ccuuucgacuugca

SEQ ID NO: 2083399 - RNA, 17 nt, Homo sapiens
aaagaaaacacacuccu

SEQ ID NO: 2083400 - RNA, 18 nt, Homo sapiens
ucaugucuguaaucccag

SEQ ID NO: 2083401 - RNA, 15 nt, Homo sapiens
ggcuccaagaccuag

SEQ ID NO: 2083402 - RNA, 22 nt, Homo sapiens
aacacggugaaaccccaucucu

SEQ ID NO: 2083403 - RNA, 17 nt, Homo sapiens
ucuuuguauaugcauuc

SEQ ID NO: 2083404 - RNA, 18 nt, Homo sapiens
aaguaacucccacuccua

SEQ ID NO: 2083405 - RNA, 20 nt, Homo sapiens
cauuauccuuuuaucucaca

SEQ ID NO: 2083406 - RNA, 15 nt, Homo sapiens
guccucauuguucag

SEQ ID NO: 2083407 - RNA, 13 nt, Homo sapiens
ugcagagacagag

SEQ ID NO: 2083408 - RNA, 17 nt, Homo sapiens
cucuguugucuaaaaua

SEQ ID NO: 2083409 - RNA, 12 nt, Homo sapiens
gacuaacccaau

SEQ ID NO: 2083410 - RNA, 15 nt, Homo sapiens
cacugcaagcacugc

SEQ ID NO: 2083411 - RNA, 17 nt, Homo sapiens
cccagcugaucauguca

SEQ ID NO: 2083412 - RNA, 22 nt, Homo sapiens
ccagcugaucaugucagccuca

SEQ ID NO: 2083413 - RNA, 18 nt, Homo sapiens
ugacaagaacaaagccac

SEQ ID NO: 2083414 - RNA, 20 nt, Homo sapiens
uauaaaccguggucucaugu

SEQ ID NO: 2083415 - RNA, 18 nt, Homo sapiens
ugacccuucuccaaaggc

SEQ ID NO: 2083416 - RNA, 22 nt, Homo sapiens
uacuuaccuguuuucuccuccc

SEQ ID NO: 2083417 - RNA, 21 nt, Homo sapiens
cgccuucuuagaguuuuauuc

SEQ ID NO: 2083418 - RNA, 13 nt, Homo sapiens
cuguacucaggag

SEQ ID NO: 2083419 - RNA, 21 nt, Homo sapiens
cuuaguacaccauaaacuggg

SEQ ID NO: 2083420 - RNA, 15 nt, Homo sapiens
uccagacggugugca

SEQ ID NO: 2083421 - RNA, 19 nt, Homo sapiens
uuauuuuuauaucagccug

SEQ ID NO: 2083422 - RNA, 11 nt, Homo sapiens
uuucagaacac

SEQ ID NO: 2083423 - RNA, 17 nt, Homo sapiens
gaucugggcacaaucau

SEQ ID NO: 2083424 - RNA, 18 nt, Homo sapiens
cuaaguccaacuacuaaa

SEQ ID NO: 2083425 - RNA, 19 nt, Homo sapiens
cuuucaggguuuucuaacc

SEQ ID NO: 2083426 - RNA, 17 nt, Homo sapiens
gcuccuccugcccucca

SEQ ID NO: 2083427 - RNA, 22 nt, Homo sapiens
ucuaauuccacuuguucauucu

SEQ ID NO: 2083428 - RNA, 22 nt, Homo sapiens
cuuuggccuccauauugcucuc

SEQ ID NO: 2083429 - RNA, 14 nt, Homo sapiens
cuuggaacugcauu

SEQ ID NO: 2083430 - RNA, 16 nt, Homo sapiens
ugcucuacccaugagc

SEQ ID NO: 2083431 - RNA, 18 nt, Homo sapiens
auuuugaaaucaugaaga

SEQ ID NO: 2083432 - RNA, 13 nt, Homo sapiens
cuccccacucuag

SEQ ID NO: 2083433 - RNA, 14 nt, Homo sapiens
uggauuaaccugcc

SEQ ID NO: 2083434 - RNA, 22 nt, Homo sapiens
gagaccaagacucugaaaucuc

SEQ ID NO: 2083435 - RNA, 22 nt, Homo sapiens
ucuaggauaagcacuagaucuc

SEQ ID NO: 2083436 - RNA, 13 nt, Homo sapiens
auuuuaaagacaa

SEQ ID NO: 2083437 - RNA, 20 nt, Homo sapiens
cucaauugaaagugggcaaa

SEQ ID NO: 2083438 - RNA, 22 nt, Homo sapiens
cccuugcuguaugcugaucauc

SEQ ID NO: 2083439 - RNA, 17 nt, Homo sapiens
cccagggagaggcugug

SEQ ID NO: 2083440 - RNA, 16 nt, Homo sapiens
uaaaagagauuucaag

SEQ ID NO: 2083441 - RNA, 21 nt, Homo sapiens
uagaauauccuacuucuccag

SEQ ID NO: 2083442 - RNA, 16 nt, Homo sapiens
cccacccuugcccacc

SEQ ID NO: 2083443 - RNA, 14 nt, Homo sapiens
ugguuuuaccccag

SEQ ID NO: 2083444 - RNA, 12 nt, Homo sapiens
agaugccaguga

SEQ ID NO: 2083445 - RNA, 22 nt, Homo sapiens
cauuuuauggugccuaguauug

SEQ ID NO: 2083446 - RNA, 22 nt, Homo sapiens
ugugauuggcagcuucaaaaca

SEQ ID NO: 2083447 - RNA, 14 nt, Homo sapiens
cauauauaugucag

SEQ ID NO: 2083448 - RNA, 11 nt, Homo sapiens
cccaucugccg

SEQ ID NO: 2083449 - RNA, 20 nt, Homo sapiens
aaguuguuuaccucuuuguc

SEQ ID NO: 2083450 - RNA, 22 nt, Homo sapiens
cgagaaggccgaggaauccuca

SEQ ID NO: 2083451 - RNA, 21 nt, Homo sapiens
ggauuuuaacuuaacugaaau

SEQ ID NO: 2083452 - RNA, 11 nt, Homo sapiens
caucuugccuc

SEQ ID NO: 2083453 - RNA, 18 nt, Homo sapiens
cgaggcaggggcucugcu

SEQ ID NO: 2083454 - RNA, 20 nt, Homo sapiens
uaguucagaggaagcacaua

SEQ ID NO: 2083455 - RNA, 19 nt, Homo sapiens
gucuccacuaaaugagcuc

SEQ ID NO: 2083456 - RNA, 22 nt, Homo sapiens
ucaagcuauucucaugccucag

SEQ ID NO: 2083457 - RNA, 19 nt, Homo sapiens
acggaaggucaguugccau

SEQ ID NO: 2083458 - RNA, 17 nt, Homo sapiens
uugcucgaagacuguga

SEQ ID NO: 2083459 - RNA, 17 nt, Homo sapiens
gcuuucaucacuaccuu

SEQ ID NO: 2083460 - RNA, 17 nt, Homo sapiens
aguuucucagcucccau

SEQ ID NO: 2083461 - RNA, 14 nt, Homo sapiens
caacuacuacuuga

SEQ ID NO: 2083462 - RNA, 22 nt, Homo sapiens
auguaaauuaguuugacacugc

SEQ ID NO: 2083463 - RNA, 15 nt, Homo sapiens
ugauuccucuuggca

SEQ ID NO: 2083464 - RNA, 21 nt, Homo sapiens
aacuugucaaggaauguuauc

SEQ ID NO: 2083465 - RNA, 22 nt, Homo sapiens
ccaguaggaaaagcaaugcuuu

SEQ ID NO: 2083466 - RNA, 17 nt, Homo sapiens
cacaaccuugcaguauu

SEQ ID NO: 2083467 - RNA, 16 nt, Homo sapiens
cgauuucauaccuuau

SEQ ID NO: 2083468 - RNA, 15 nt, Homo sapiens
aaacauuaaugcaau

SEQ ID NO: 2083469 - RNA, 17 nt, Homo sapiens
uaaagauaaaauuugau

SEQ ID NO: 2083470 - RNA, 15 nt, Homo sapiens
cucgagacacaguga

SEQ ID NO: 2083471 - RNA, 13 nt, Homo sapiens
uaagaacugcugu

SEQ ID NO: 2083472 - RNA, 14 nt, Homo sapiens
ugugagacacuaaa

SEQ ID NO: 2083473 - RNA, 17 nt, Homo sapiens
cacccaguugugacaau

SEQ ID NO: 2083474 - RNA, 13 nt, Homo sapiens
ugcccaaggagcc

SEQ ID NO: 2083475 - RNA, 13 nt, Homo sapiens
uauccucuugcca

SEQ ID NO: 2083476 - RNA, 15 nt, Homo sapiens
ccuggaagcagggac

SEQ ID NO: 2083477 - RNA, 13 nt, Homo sapiens
gcuuaugaauaua

SEQ ID NO: 2083478 - RNA, 20 nt, Homo sapiens
agcucacccuucgucaugga

SEQ ID NO: 2083479 - RNA, 15 nt, Homo sapiens
cauaugcaugccagg

SEQ ID NO: 2083480 - RNA, 16 nt, Homo sapiens
auacagaucucagggc

SEQ ID NO: 2083481 - RNA, 14 nt, Homo sapiens
auaucuguauauau

SEQ ID NO: 2083482 - RNA, 14 nt, Homo sapiens
gugucuguguguau

SEQ ID NO: 2083483 - RNA, 14 nt, Homo sapiens
cauggccaccucca

SEQ ID NO: 2083484 - RNA, 19 nt, Homo sapiens
ugccggcucuuuccuugcu

SEQ ID NO: 2083485 - RNA, 20 nt, Homo sapiens
ucuacauagugacaugcaca

SEQ ID NO: 2083486 - RNA, 16 nt, Homo sapiens
agugacuccaagaaca

SEQ ID NO: 2083487 - RNA, 15 nt, Homo sapiens
uguuuuccaguauua

SEQ ID NO: 2083488 - RNA, 14 nt, Homo sapiens
gccccgccacagcc

SEQ ID NO: 2083489 - RNA, 19 nt, Homo sapiens
auaaagacaaucacugcca

SEQ ID NO: 2083490 - RNA, 15 nt, Homo sapiens
aaagugcuccugaga

SEQ ID NO: 2083491 - RNA, 15 nt, Homo sapiens
gcgcccuuaccuucc

SEQ ID NO: 2083492 - RNA, 16 nt, Homo sapiens
gaaaucucuagcucag

SEQ ID NO: 2083493 - RNA, 20 nt, Homo sapiens
cauuauuccugcacucacag

SEQ ID NO: 2083494 - RNA, 14 nt, Homo sapiens
gcucuccagaccug

SEQ ID NO: 2083495 - RNA, 18 nt, Homo sapiens
auguccucuauaccugug

SEQ ID NO: 2083496 - RNA, 15 nt, Homo sapiens
gagaggggaggccaa

SEQ ID NO: 2083497 - RNA, 20 nt, Homo sapiens
caacguacuauggaagccac

SEQ ID NO: 2083498 - RNA, 20 nt, Homo sapiens
cgccuguaaucccagcacuu

SEQ ID NO: 2083499 - RNA, 13 nt, Homo sapiens
gagcucagggcug

SEQ ID NO: 2083500 - RNA, 23 nt, Homo sapiens
ugacucgggagcugcacacaccu

SEQ ID NO: 2083501 - RNA, 21 nt, Homo sapiens
uacgaauugaaaauuaaggaa

SEQ ID NO: 2083502 - RNA, 15 nt, Homo sapiens
acaauugcaguuuug

SEQ ID NO: 2083503 - RNA, 19 nt, Homo sapiens
agagaccgagccucuguca

SEQ ID NO: 2083504 - RNA, 22 nt, Homo sapiens
aaugggcauugagaucuacugg

SEQ ID NO: 2083505 - RNA, 15 nt, Homo sapiens
uggagcauaacugga

SEQ ID NO: 2083506 - RNA, 18 nt, Homo sapiens
cuguauagaccaugcaca

SEQ ID NO: 2083507 - RNA, 16 nt, Homo sapiens
ucacugaaaacaguaa

SEQ ID NO: 2083508 - RNA, 18 nt, Homo sapiens
cagacuuuaaaauucuaa

SEQ ID NO: 2083509 - RNA, 18 nt, Homo sapiens
cuguguaccucacugucc

SEQ ID NO: 2083510 - RNA, 15 nt, Homo sapiens
guacaucugcaauau

SEQ ID NO: 2083511 - RNA, 9 nt, Homo sapiens
cuccaucuc

SEQ ID NO: 2083512 - RNA, 20 nt, Homo sapiens
cuuccaucugauuccagcac

SEQ ID NO: 2083513 - RNA, 12 nt, Homo sapiens
gcuuaugauuca

SEQ ID NO: 2083514 - RNA, 15 nt, Homo sapiens
ucaaaguaaaacuug

SEQ ID NO: 2083515 - RNA, 22 nt, Homo sapiens
ccaggagcccacagugccugua

SEQ ID NO: 2083516 - RNA, 15 nt, Homo sapiens
acucugccuuucuaa

SEQ ID NO: 2083517 - RNA, 23 nt, Homo sapiens
agauuauauggacuuucuugcaa

SEQ ID NO: 2083518 - RNA, 18 nt, Homo sapiens
aggaagguaguucaagaa

SEQ ID NO: 2083519 - RNA, 20 nt, Homo sapiens
ggaaacacugauuuuguaaa

SEQ ID NO: 2083520 - RNA, 22 nt, Homo sapiens
ugguccuuaaaaaauaugcucu

SEQ ID NO: 2083521 - RNA, 17 nt, Homo sapiens
agauaauaaucuuggcu

SEQ ID NO: 2083522 - RNA, 19 nt, Homo sapiens
guaaauaccaagagcaauu

SEQ ID NO: 2083523 - RNA, 13 nt, Homo sapiens
cucuuuacuugaa

SEQ ID NO: 2083524 - RNA, 16 nt, Homo sapiens
agagacaguaacacaa

SEQ ID NO: 2083525 - RNA, 15 nt, Homo sapiens
aucuguacuauccag

SEQ ID NO: 2083526 - RNA, 20 nt, Homo sapiens
gggugcgagagaggugggca

SEQ ID NO: 2083527 - RNA, 18 nt, Homo sapiens
caccaucguguuugcaaa

SEQ ID NO: 2083528 - RNA, 20 nt, Homo sapiens
agcauggcccgggccuuauc

SEQ ID NO: 2083529 - RNA, 16 nt, Homo sapiens
ucacucuauacaucuu

SEQ ID NO: 2083530 - RNA, 14 nt, Homo sapiens
uggauaugugccag

SEQ ID NO: 2083531 - RNA, 19 nt, Homo sapiens
uuauaaaagccagcaggcu

SEQ ID NO: 2083532 - RNA, 16 nt, Homo sapiens
uucaccuccaacugga

SEQ ID NO: 2083533 - RNA, 14 nt, Homo sapiens
cugagcaccucuca

SEQ ID NO: 2083534 - RNA, 18 nt, Homo sapiens
aaucauguugaaacaaac

SEQ ID NO: 2083535 - RNA, 15 nt, Homo sapiens
aaagcccauucauuc

SEQ ID NO: 2083536 - RNA, 14 nt, Homo sapiens
uaagcagaggaauu

SEQ ID NO: 2083537 - RNA, 17 nt, Homo sapiens
gcaccaagcgugauucc

SEQ ID NO: 2083538 - RNA, 16 nt, Homo sapiens
ucuuuauaucugaacc

SEQ ID NO: 2083539 - RNA, 21 nt, Homo sapiens
cauuggagcaagcuugcccua

SEQ ID NO: 2083540 - RNA, 16 nt, Homo sapiens
ucaagcuggugcuacu

SEQ ID NO: 2083541 - RNA, 16 nt, Homo sapiens
uuucucuguaguuccu

SEQ ID NO: 2083542 - RNA, 14 nt, Homo sapiens
agacuuugcuguua

SEQ ID NO: 2083543 - RNA, 20 nt, Homo sapiens
gcauuauguccacuguguau

SEQ ID NO: 2083544 - RNA, 21 nt, Homo sapiens
auaaaagaaccgagcaauuuu

SEQ ID NO: 2083545 - RNA, 23 nt, Homo sapiens
uucuucgcacagugucuagaucc

SEQ ID NO: 2083546 - RNA, 13 nt, Homo sapiens
uuaaaaauuguca

SEQ ID NO: 2083547 - RNA, 16 nt, Homo sapiens
auuuuuugagucuguu

SEQ ID NO: 2083548 - RNA, 16 nt, Homo sapiens
ugauucaggcuuauaa

SEQ ID NO: 2083549 - RNA, 23 nt, Homo sapiens
cuccuugaaguucguggaaggcu

SEQ ID NO: 2083550 - RNA, 19 nt, Homo sapiens
cagcuucagauaccaugca

SEQ ID NO: 2083551 - RNA, 22 nt, Homo sapiens
cccuguaguuaggccuggcuca

SEQ ID NO: 2083552 - RNA, 23 nt, Homo sapiens
gccuguggguuugguccuugaac

SEQ ID NO: 2083553 - RNA, 23 nt, Homo sapiens
cugccuucaccaucuacaccagu

SEQ ID NO: 2083554 - RNA, 13 nt, Homo sapiens
gcaaucacauagu

SEQ ID NO: 2083555 - RNA, 12 nt, Homo sapiens
ugcgugaguaug

SEQ ID NO: 2083556 - RNA, 19 nt, Homo sapiens
acuuguuuuaaacuugccu

SEQ ID NO: 2083557 - RNA, 17 nt, Homo sapiens
cagaugggaauugcaca

SEQ ID NO: 2083558 - RNA, 14 nt, Homo sapiens
ugugugggcccaag

SEQ ID NO: 2083559 - RNA, 21 nt, Homo sapiens
gcaauugauuucuuuucuucc

SEQ ID NO: 2083560 - RNA, 16 nt, Homo sapiens
aagacacuuuuaccga

SEQ ID NO: 2083561 - RNA, 22 nt, Homo sapiens
cucugaucuccauaaacaugaa

SEQ ID NO: 2083562 - RNA, 13 nt, Homo sapiens
cagcaacuugaac

SEQ ID NO: 2083563 - RNA, 18 nt, Homo sapiens
ccacauauagagcuccag

SEQ ID NO: 2083564 - RNA, 12 nt, Homo sapiens
uggcucugugaa

SEQ ID NO: 2083565 - RNA, 21 nt, Homo sapiens
uauucucagcagagugcuuua

SEQ ID NO: 2083566 - RNA, 15 nt, Homo sapiens
cugaaagcaguguau

SEQ ID NO: 2083567 - RNA, 18 nt, Homo sapiens
uucauucucuuauauagu

SEQ ID NO: 2083568 - RNA, 23 nt, Homo sapiens
ucccuccagccaauaggcagcuu

SEQ ID NO: 2083569 - RNA, 18 nt, Homo sapiens
cagaccugcauugaacag

SEQ ID NO: 2083570 - RNA, 22 nt, Homo sapiens
gcaaagauaugugggugcuccu

SEQ ID NO: 2083571 - RNA, 22 nt, Homo sapiens
acaaaaacagguauauacuuug

SEQ ID NO: 2083572 - RNA, 14 nt, Homo sapiens
cagauggcacuuug

SEQ ID NO: 2083573 - RNA, 17 nt, Homo sapiens
cagcuuauauucaucca

SEQ ID NO: 2083574 - RNA, 20 nt, Homo sapiens
ggauggacgaacaggggcca

SEQ ID NO: 2083575 - RNA, 20 nt, Homo sapiens
cugcuuuguuuuggcugcuc

SEQ ID NO: 2083576 - RNA, 23 nt, Homo sapiens
ucccucaagccagacucugccaa

SEQ ID NO: 2083577 - RNA, 13 nt, Homo sapiens
gcccugaacaaaa

SEQ ID NO: 2083578 - RNA, 15 nt, Homo sapiens
auaauucuucaccua

SEQ ID NO: 2083579 - RNA, 22 nt, Homo sapiens
ccagaucgggagcaaaccaaag

SEQ ID NO: 2083580 - RNA, 23 nt, Homo sapiens
gcuuuuugggaccaucacugaga

SEQ ID NO: 2083581 - RNA, 15 nt, Homo sapiens
gccaacugcugcuuu

SEQ ID NO: 2083582 - RNA, 14 nt, Homo sapiens
gaaacaagauuguu

SEQ ID NO: 2083583 - RNA, 19 nt, Homo sapiens
uagcauagaauagcgacag

SEQ ID NO: 2083584 - RNA, 20 nt, Homo sapiens
ggaaaagaauucucagcaga

SEQ ID NO: 2083585 - RNA, 20 nt, Homo sapiens
guuuugucucugcaucucau

SEQ ID NO: 2083586 - RNA, 16 nt, Homo sapiens
aaugugaggcaauaag

SEQ ID NO: 2083587 - RNA, 15 nt, Homo sapiens
uugguuucacagaua

SEQ ID NO: 2083588 - RNA, 22 nt, Homo sapiens
aagaguguggagucauucucau

SEQ ID NO: 2083589 - RNA, 16 nt, Homo sapiens
agaaaaaaaaucuuau

SEQ ID NO: 2083590 - RNA, 16 nt, Homo sapiens
uguucuauucaucuca

SEQ ID NO: 2083591 - RNA, 12 nt, Homo sapiens
cuuccaccucau

SEQ ID NO: 2083592 - RNA, 21 nt, Homo sapiens
uauggacucaguuuucuugca

SEQ ID NO: 2083593 - RNA, 16 nt, Homo sapiens
aguguacaugugugaa

SEQ ID NO: 2083594 - RNA, 19 nt, Homo sapiens
aauuucauuuccagcauuu

SEQ ID NO: 2083595 - RNA, 16 nt, Homo sapiens
ugggggcuugcaagua

SEQ ID NO: 2083596 - RNA, 17 nt, Homo sapiens
ucuaugccaggcugugc

SEQ ID NO: 2083597 - RNA, 13 nt, Homo sapiens
accuugugccugg

SEQ ID NO: 2083598 - RNA, 21 nt, Homo sapiens
cagugccucucccugcugcuc

SEQ ID NO: 2083599 - RNA, 20 nt, Homo sapiens
ccucuggauagggaugaaga

SEQ ID NO: 2083600 - RNA, 17 nt, Homo sapiens
auguuauaggcacuugc

SEQ ID NO: 2083601 - RNA, 15 nt, Homo sapiens
aaaguacuagcuaaa

SEQ ID NO: 2083602 - RNA, 14 nt, Homo sapiens
acacauaauucagg

SEQ ID NO: 2083603 - RNA, 22 nt, Homo sapiens
guggugucgcgccuucuccccc

SEQ ID NO: 2083604 - RNA, 20 nt, Homo sapiens
cuggaacugcaucagugacu

SEQ ID NO: 2083605 - RNA, 21 nt, Homo sapiens
uuaucuguaauuguaauucca

SEQ ID NO: 2083606 - RNA, 16 nt, Homo sapiens
acugccuccugugacg

SEQ ID NO: 2083607 - RNA, 20 nt, Homo sapiens
cccccguggugccugcacac

SEQ ID NO: 2083608 - RNA, 19 nt, Homo sapiens
aaaaggcuaagaauagugg

SEQ ID NO: 2083609 - RNA, 17 nt, Homo sapiens
cacucugauucaccucu

SEQ ID NO: 2083610 - RNA, 19 nt, Homo sapiens
cuuacuuaaccugaagcua

SEQ ID NO: 2083611 - RNA, 23 nt, Homo sapiens
agauaacauccaacuaacuccag

SEQ ID NO: 2083612 - RNA, 23 nt, Homo sapiens
ugcccagcaguuucccagaauau

SEQ ID NO: 2083613 - RNA, 14 nt, Homo sapiens
gggcucucucauga

SEQ ID NO: 2083614 - RNA, 23 nt, Homo sapiens
ccugcuguguggacuucaucuca

SEQ ID NO: 2083615 - RNA, 18 nt, Homo sapiens
uaagguccgguguucuaa

SEQ ID NO: 2083616 - RNA, 19 nt, Homo sapiens
gaaagcauaucccaccaac

SEQ ID NO: 2083617 - RNA, 19 nt, Homo sapiens
augaaggucuaccugaaaa

SEQ ID NO: 2083618 - RNA, 23 nt, Homo sapiens
auacuagacucauacucaacuca

SEQ ID NO: 2083619 - RNA, 19 nt, Homo sapiens
guguggggauuuucacuga

SEQ ID NO: 2083620 - RNA, 14 nt, Homo sapiens
acuuguauucccuu

SEQ ID NO: 2083621 - RNA, 17 nt, Homo sapiens
caggagaauuacuugaa

SEQ ID NO: 2083622 - RNA, 23 nt, Homo sapiens
ucaucaaggcacugccugaugga

SEQ ID NO: 2083623 - RNA, 12 nt, Homo sapiens
acuaguaucucu

SEQ ID NO: 2083624 - RNA, 14 nt, Homo sapiens
cacucuuguaauaa

SEQ ID NO: 2083625 - RNA, 22 nt, Homo sapiens
ucuugucagacauaaagccaug

SEQ ID NO: 2083626 - RNA, 20 nt, Homo sapiens
auuuaacaugaacacccuua

SEQ ID NO: 2083627 - RNA, 22 nt, Homo sapiens
aucagcaugaaaaugcaguuuc

SEQ ID NO: 2083628 - RNA, 22 nt, Homo sapiens
ccuucaauggaaauuaaaacuc

SEQ ID NO: 2083629 - RNA, 18 nt, Homo sapiens
cauacaugcauacaaaga

SEQ ID NO: 2083630 - RNA, 20 nt, Homo sapiens
uuugcaggcaugcaugugcu

SEQ ID NO: 2083631 - RNA, 23 nt, Homo sapiens
auguuuguuguauacuuccuuau

SEQ ID NO: 2083632 - RNA, 22 nt, Homo sapiens
ugcagacagucuguuaugcacu

SEQ ID NO: 2083633 - RNA, 21 nt, Homo sapiens
aggccaaacggugcaacagaa

SEQ ID NO: 2083634 - RNA, 18 nt, Homo sapiens
cagggaagugacaggacu

SEQ ID NO: 2083635 - RNA, 21 nt, Homo sapiens
auuuaggauacucuuaaucuc

SEQ ID NO: 2083636 - RNA, 14 nt, Homo sapiens
caagguaagagccu

SEQ ID NO: 2083637 - RNA, 18 nt, Homo sapiens
uaaaaaguaauaaaugag

SEQ ID NO: 2083638 - RNA, 23 nt, Homo sapiens
gagaugggcuuguuuucuugcca

SEQ ID NO: 2083639 - RNA, 21 nt, Homo sapiens
cacugcagucugggccccauc

SEQ ID NO: 2083640 - RNA, 19 nt, Homo sapiens
cauugaugaucacugugaa

SEQ ID NO: 2083641 - RNA, 20 nt, Homo sapiens
uuggcaucgaccacaccagc

SEQ ID NO: 2083642 - RNA, 13 nt, Homo sapiens
aaaugcuuacuuc

SEQ ID NO: 2083643 - RNA, 22 nt, Homo sapiens
caaggacaugagucuguaggag

SEQ ID NO: 2083644 - RNA, 17 nt, Homo sapiens
ucuccccugauuacacc

SEQ ID NO: 2083645 - RNA, 16 nt, Homo sapiens
ucuuuagcaguguauu

SEQ ID NO: 2083646 - RNA, 22 nt, Homo sapiens
ccaagcuccuugggaggcccca

SEQ ID NO: 2083647 - RNA, 18 nt, Homo sapiens
uaugcuguucauugauga

SEQ ID NO: 2083648 - RNA, 15 nt, Homo sapiens
cugcuaacuccuagc

SEQ ID NO: 2083649 - RNA, 16 nt, Homo sapiens
ugugaaggggagagac

SEQ ID NO: 2083650 - RNA, 23 nt, Homo sapiens
cgaugggggaucagcagggcagu

SEQ ID NO: 2083651 - RNA, 14 nt, Homo sapiens
guuugucaaaaagu

SEQ ID NO: 2083652 - RNA, 14 nt, Homo sapiens
aauagacaguauga

SEQ ID NO: 2083653 - RNA, 16 nt, Homo sapiens
uaucuuugcuguuauu

SEQ ID NO: 2083654 - RNA, 18 nt, Homo sapiens
ucauguuauuaaacguau

SEQ ID NO: 2083655 - RNA, 12 nt, Homo sapiens
uugcuauauucc

SEQ ID NO: 2083656 - RNA, 19 nt, Homo sapiens
cuaauaugcaauuaugaaa

SEQ ID NO: 2083657 - RNA, 15 nt, Homo sapiens
agaauuaaugacaac

SEQ ID NO: 2083658 - RNA, 21 nt, Homo sapiens
ugugucucaggugugcccuga

SEQ ID NO: 2083659 - RNA, 17 nt, Homo sapiens
gcuaacaugaguaucau

SEQ ID NO: 2083660 - RNA, 21 nt, Homo sapiens
gaagauagaugcacuuaugca

SEQ ID NO: 2083661 - RNA, 14 nt, Homo sapiens
aaugugagguguug

SEQ ID NO: 2083662 - RNA, 21 nt, Homo sapiens
cagcugggugguguacaagca

SEQ ID NO: 2083663 - RNA, 17 nt, Homo sapiens
cuccagggucagaaaca

SEQ ID NO: 2083664 - RNA, 19 nt, Homo sapiens
auagaaagugccagaaagu

SEQ ID NO: 2083665 - RNA, 19 nt, Homo sapiens
gggaaacaaauaauuugaa

SEQ ID NO: 2083666 - RNA, 12 nt, Homo sapiens
gggccaccagcc

SEQ ID NO: 2083667 - RNA, 15 nt, Homo sapiens
acccggacagguggg

SEQ ID NO: 2083668 - RNA, 13 nt, Homo sapiens
ccugacucaggcc

SEQ ID NO: 2083669 - RNA, 21 nt, Homo sapiens
uguaaaugaaguaacuugucu

SEQ ID NO: 2083670 - RNA, 14 nt, Homo sapiens
agacagaaagccuc

SEQ ID NO: 2083671 - RNA, 12 nt, Homo sapiens
agaauggaucac

SEQ ID NO: 2083672 - RNA, 22 nt, Homo sapiens
agaucuaguucacucuccauuu

SEQ ID NO: 2083673 - RNA, 17 nt, Homo sapiens
ugaaggggcugguggag

SEQ ID NO: 2083674 - RNA, 20 nt, Homo sapiens
gaacaaaagaauaacauuuu

SEQ ID NO: 2083675 - RNA, 15 nt, Homo sapiens
ugucggcggcuugau

SEQ ID NO: 2083676 - RNA, 23 nt, Homo sapiens
acuaaacugcugcaaaaguucuc

SEQ ID NO: 2083677 - RNA, 15 nt, Homo sapiens
gcaaaugaaugccuu

SEQ ID NO: 2083678 - RNA, 18 nt, Homo sapiens
gaauuugcacagugauau

SEQ ID NO: 2083679 - RNA, 23 nt, Homo sapiens
auuuggguugacuccugagcaua

SEQ ID NO: 2083680 - RNA, 23 nt, Homo sapiens
ugugcuuuaauucagcuuuagaa

SEQ ID NO: 2083681 - RNA, 13 nt, Homo sapiens
uuccugugaucca

SEQ ID NO: 2083682 - RNA, 13 nt, Homo sapiens
uuugugugauuga

SEQ ID NO: 2083683 - RNA, 15 nt, Homo sapiens
cuccacgucagugcc

SEQ ID NO: 2083684 - RNA, 13 nt, Homo sapiens
cccagggcuaccc

SEQ ID NO: 2083685 - RNA, 15 nt, Homo sapiens
agauuuuuuccucug

SEQ ID NO: 2083686 - RNA, 18 nt, Homo sapiens
cuucagaguuugugugua

SEQ ID NO: 2083687 - RNA, 13 nt, Homo sapiens
uauagccauaaac

SEQ ID NO: 2083688 - RNA, 13 nt, Homo sapiens
ggaagccagguac

SEQ ID NO: 2083689 - RNA, 16 nt, Homo sapiens
accucagccuggccag

SEQ ID NO: 2083690 - RNA, 22 nt, Homo sapiens
caccccuugcucucaacccagg

SEQ ID NO: 2083691 - RNA, 16 nt, Homo sapiens
uucuauacccacccag

SEQ ID NO: 2083692 - RNA, 14 nt, Homo sapiens
agcacggacuguca

SEQ ID NO: 2083693 - RNA, 15 nt, Homo sapiens
cuggaacuuuaguga

SEQ ID NO: 2083694 - RNA, 21 nt, Homo sapiens
ugaauuagccaaaacacuuag

SEQ ID NO: 2083695 - RNA, 18 nt, Homo sapiens
uugcacugaaauggaauu

SEQ ID NO: 2083696 - RNA, 13 nt, Homo sapiens
agaauuguaucau

SEQ ID NO: 2083697 - RNA, 16 nt, Homo sapiens
ugaucuucaacaaauu

SEQ ID NO: 2083698 - RNA, 22 nt, Homo sapiens
cuacaugcugaaaaauauagcc

SEQ ID NO: 2083699 - RNA, 16 nt, Homo sapiens
uggccagaggugucac

SEQ ID NO: 2083700 - RNA, 15 nt, Homo sapiens
uuacugcucugagaa

SEQ ID NO: 2083701 - RNA, 17 nt, Homo sapiens
aauacaacuccuauuca

SEQ ID NO: 2083702 - RNA, 17 nt, Homo sapiens
agcgauugauugaugua

SEQ ID NO: 2083703 - RNA, 22 nt, Homo sapiens
agacucuauuuaagauucccaa

SEQ ID NO: 2083704 - RNA, 20 nt, Homo sapiens
uccgcgugucucauuugcca

SEQ ID NO: 2083705 - RNA, 20 nt, Homo sapiens
ggacuauugcaauacauuuc

SEQ ID NO: 2083706 - RNA, 22 nt, Homo sapiens
gcauucggggaagcugcacaug

SEQ ID NO: 2083707 - RNA, 20 nt, Homo sapiens
ugagcuacuucaaauguggu

SEQ ID NO: 2083708 - RNA, 14 nt, Homo sapiens
gcacuaacacaugc

SEQ ID NO: 2083709 - RNA, 20 nt, Homo sapiens
ugaucuuuguuuaaaugcca

SEQ ID NO: 2083710 - RNA, 22 nt, Homo sapiens
auucaauugaugaaaugcaaaa

SEQ ID NO: 2083711 - RNA, 18 nt, Homo sapiens
uuugguuacugugccaug

SEQ ID NO: 2083712 - RNA, 12 nt, Homo sapiens
auugauguugcu

SEQ ID NO: 2083713 - RNA, 19 nt, Homo sapiens
agacauuucgaagucauca

SEQ ID NO: 2083714 - RNA, 15 nt, Homo sapiens
ccgagugaggccaua

SEQ ID NO: 2083715 - RNA, 14 nt, Homo sapiens
ggagaauugaaaag

SEQ ID NO: 2083716 - RNA, 22 nt, Homo sapiens
ggcaauaggugugaacagggaa

SEQ ID NO: 2083717 - RNA, 13 nt, Homo sapiens
ugaaggacuuuaa

SEQ ID NO: 2083718 - RNA, 13 nt, Homo sapiens
auauggacaguua

SEQ ID NO: 2083719 - RNA, 13 nt, Homo sapiens
aggagaaacacau

SEQ ID NO: 2083720 - RNA, 19 nt, Homo sapiens
cuuuucacaaaucauggua

SEQ ID NO: 2083721 - RNA, 22 nt, Homo sapiens
cucuugagcuggcggugucauc

SEQ ID NO: 2083722 - RNA, 15 nt, Homo sapiens
uuguaugagguccuc

SEQ ID NO: 2083723 - RNA, 13 nt, Homo sapiens
ccagcccaagcac

SEQ ID NO: 2083724 - RNA, 23 nt, Homo sapiens
gaagucuggcuuugcucuauuaa

SEQ ID NO: 2083725 - RNA, 21 nt, Homo sapiens
aaugcauuguaucgauguuau

SEQ ID NO: 2083726 - RNA, 12 nt, Homo sapiens
ggcacacacugu

SEQ ID NO: 2083727 - RNA, 14 nt, Homo sapiens
ccaagcugcugcuu

SEQ ID NO: 2083728 - RNA, 13 nt, Homo sapiens
acuccgugugccu

SEQ ID NO: 2083729 - RNA, 13 nt, Homo sapiens
ggacaauaaucuc

SEQ ID NO: 2083730 - RNA, 18 nt, Homo sapiens
gacagguucccagcagcu

SEQ ID NO: 2083731 - RNA, 17 nt, Homo sapiens
aaggcuuuaucucaggg

SEQ ID NO: 2083732 - RNA, 18 nt, Homo sapiens
gcagggaguuagcacuga

SEQ ID NO: 2083733 - RNA, 13 nt, Homo sapiens
ugacccacaagaa

SEQ ID NO: 2083734 - RNA, 17 nt, Homo sapiens
gccaaaggaaguuuuaa

SEQ ID NO: 2083735 - RNA, 12 nt, Homo sapiens
uaauccaggcac

SEQ ID NO: 2083736 - RNA, 18 nt, Homo sapiens
uguauaaguuugggcuga

SEQ ID NO: 2083737 - RNA, 16 nt, Homo sapiens
aggguagugugguauu

SEQ ID NO: 2083738 - RNA, 16 nt, Homo sapiens
gccuccagucauggua

SEQ ID NO: 2083739 - RNA, 17 nt, Homo sapiens
aaucucguugaggccaa

SEQ ID NO: 2083740 - RNA, 20 nt, Homo sapiens
gcuucugcuuauucaguccu

SEQ ID NO: 2083741 - RNA, 23 nt, Homo sapiens
ucugaaaaggagggguacauugg

SEQ ID NO: 2083742 - RNA, 12 nt, Homo sapiens
auacauacaugu

SEQ ID NO: 2083743 - RNA, 23 nt, Homo sapiens
ugggcuaccaucugcauggggcu

SEQ ID NO: 2083744 - RNA, 23 nt, Homo sapiens
auuuuauaaagaucagaaugaua

SEQ ID NO: 2083745 - RNA, 18 nt, Homo sapiens
caguauuaucuaaaugaa

SEQ ID NO: 2083746 - RNA, 20 nt, Homo sapiens
agcagcaccaaccacagcau

SEQ ID NO: 2083747 - RNA, 21 nt, Homo sapiens
aaauucugaugagcauuacua

SEQ ID NO: 2083748 - RNA, 19 nt, Homo sapiens
gcugccccuugcaagccau

SEQ ID NO: 2083749 - RNA, 21 nt, Homo sapiens
acucaagaagcaggcuacacu

SEQ ID NO: 2083750 - RNA, 13 nt, Homo sapiens
agugccauuucag

SEQ ID NO: 2083751 - RNA, 22 nt, Homo sapiens
ggaccucgccugcuggggaccu

SEQ ID NO: 2083752 - RNA, 19 nt, Homo sapiens
aucugagagaugacaggga

SEQ ID NO: 2083753 - RNA, 21 nt, Homo sapiens
cucagggcagcugccuggcca

SEQ ID NO: 2083754 - RNA, 16 nt, Homo sapiens
uuacuaucauucucag

SEQ ID NO: 2083755 - RNA, 18 nt, Homo sapiens
cuagcuaacuaauucugu

SEQ ID NO: 2083756 - RNA, 22 nt, Homo sapiens
uaaauaacuuuggaaacauggg

SEQ ID NO: 2083757 - RNA, 17 nt, Homo sapiens
ugugacccuacuuccug

SEQ ID NO: 2083758 - RNA, 14 nt, Homo sapiens
uauccaucuuucac

SEQ ID NO: 2083759 - RNA, 14 nt, Homo sapiens
caggacuccuggca

SEQ ID NO: 2083760 - RNA, 13 nt, Homo sapiens
aaacgcugccugc

SEQ ID NO: 2083761 - RNA, 13 nt, Homo sapiens
uaccacacugagu

SEQ ID NO: 2083762 - RNA, 15 nt, Homo sapiens
caacuuuucuagacc

SEQ ID NO: 2083763 - RNA, 23 nt, Homo sapiens
gcacauucuuagaguuaccacac

SEQ ID NO: 2083764 - RNA, 17 nt, Homo sapiens
gauaggaaggucauuuc

SEQ ID NO: 2083765 - RNA, 12 nt, Homo sapiens
augcgcaaauac

SEQ ID NO: 2083766 - RNA, 18 nt, Homo sapiens
agagcagaacccuagucu

SEQ ID NO: 2083767 - RNA, 12 nt, Homo sapiens
agugccaaagag

SEQ ID NO: 2083768 - RNA, 14 nt, Homo sapiens
ggaugagaauguga

SEQ ID NO: 2083769 - RNA, 14 nt, Homo sapiens
acuucacaauguau

SEQ ID NO: 2083770 - RNA, 16 nt, Homo sapiens
uucucgaguugcagca

SEQ ID NO: 2083771 - RNA, 23 nt, Homo sapiens
auuuuauuuuuguaucuuaaaaa

SEQ ID NO: 2083772 - RNA, 16 nt, Homo sapiens
gguccuccugugcuau

SEQ ID NO: 2083773 - RNA, 21 nt, Homo sapiens
auuuccacacuaauguauuau

SEQ ID NO: 2083774 - RNA, 19 nt, Homo sapiens
gucacaucucugccuggaa

SEQ ID NO: 2083775 - RNA, 21 nt, Homo sapiens
gugcuuuccguggcacugcau

SEQ ID NO: 2083776 - RNA, 19 nt, Homo sapiens
uuuguggaaaguuaauguc

SEQ ID NO: 2083777 - RNA, 17 nt, Homo sapiens
ccaauuggcucuaguca

SEQ ID NO: 2083778 - RNA, 19 nt, Homo sapiens
ugucuugaugugucaucua

SEQ ID NO: 2083779 - RNA, 23 nt, Homo sapiens
gggccagccuuuagaacacuguu

SEQ ID NO: 2083780 - RNA, 15 nt, Homo sapiens
ucaaucucaauccug

SEQ ID NO: 2083781 - RNA, 17 nt, Homo sapiens
gaauauuguaagucagc

SEQ ID NO: 2083782 - RNA, 12 nt, Homo sapiens
aaagaugucaau

SEQ ID NO: 2083783 - RNA, 22 nt, Homo sapiens
uccaaaccugucuuggggccac

SEQ ID NO: 2083784 - RNA, 19 nt, Homo sapiens
guuagucaauccugucaua

SEQ ID NO: 2083785 - RNA, 23 nt, Homo sapiens
ugcaugccuggcacaacaucaag

SEQ ID NO: 2083786 - RNA, 15 nt, Homo sapiens
auaaauccaucacua

SEQ ID NO: 2083787 - RNA, 17 nt, Homo sapiens
gauugcacagagcugga

SEQ ID NO: 2083788 - RNA, 14 nt, Homo sapiens
ucugagacucacag

SEQ ID NO: 2083789 - RNA, 19 nt, Homo sapiens
uuguuuuguagcaaccauu

SEQ ID NO: 2083790 - RNA, 12 nt, Homo sapiens
acaagcagauac

SEQ ID NO: 2083791 - RNA, 16 nt, Homo sapiens
ucccaucucagaagau

SEQ ID NO: 2083792 - RNA, 21 nt, Homo sapiens
ugauggagauauuuacaugaa

SEQ ID NO: 2083793 - RNA, 13 nt, Homo sapiens
cagagcaguuuca

SEQ ID NO: 2083794 - RNA, 15 nt, Homo sapiens
acucccuaucuccuu

SEQ ID NO: 2083795 - RNA, 15 nt, Homo sapiens
acccacuaucccauu

SEQ ID NO: 2083796 - RNA, 15 nt, Homo sapiens
uauuuuaaaauuuca

SEQ ID NO: 2083797 - RNA, 16 nt, Homo sapiens
ugacggacguccugcu

SEQ ID NO: 2083798 - RNA, 23 nt, Homo sapiens
ucuguauuuucaaagacugccac

SEQ ID NO: 2083799 - RNA, 19 nt, Homo sapiens
gaauaaaauugcacuuuua

SEQ ID NO: 2083800 - RNA, 20 nt, Homo sapiens
agaaacaugacacugaccuu

SEQ ID NO: 2083801 - RNA, 13 nt, Homo sapiens
ucaucucugugac

SEQ ID NO: 2083802 - RNA, 21 nt, Homo sapiens
uaccuuguuuugccagugaua

SEQ ID NO: 2083803 - RNA, 19 nt, Homo sapiens
aaaaacauuuggcauuccu

SEQ ID NO: 2083804 - RNA, 23 nt, Homo sapiens
uucuuauugaccaauuccugaca

SEQ ID NO: 2083805 - RNA, 21 nt, Homo sapiens
uccauccuugagucaaaaaau

SEQ ID NO: 2083806 - RNA, 21 nt, Homo sapiens
gaaugaagcguugccauugaa

SEQ ID NO: 2083807 - RNA, 21 nt, Homo sapiens
ugagacaggagaaacacuuga

SEQ ID NO: 2083808 - RNA, 15 nt, Homo sapiens
uuuuauacuguacuu

SEQ ID NO: 2083809 - RNA, 20 nt, Homo sapiens
ccagagcccuucacugccau

SEQ ID NO: 2083810 - RNA, 13 nt, Homo sapiens
agccagccaugca

SEQ ID NO: 2083811 - RNA, 13 nt, Homo sapiens
uggcggccuuccg

SEQ ID NO: 2083812 - RNA, 13 nt, Homo sapiens
augcugccagccu

SEQ ID NO: 2083813 - RNA, 18 nt, Homo sapiens
gaaaguaauuucuucuca

SEQ ID NO: 2083814 - RNA, 18 nt, Homo sapiens
uguguucucuauugcugc

SEQ ID NO: 2083815 - RNA, 16 nt, Homo sapiens
aaaaaucucccaguga

SEQ ID NO: 2083816 - RNA, 13 nt, Homo sapiens
cgcgcuccgcgca

SEQ ID NO: 2083817 - RNA, 13 nt, Homo sapiens
acuuccugcagug

SEQ ID NO: 2083818 - RNA, 13 nt, Homo sapiens
cagggacugugaa

SEQ ID NO: 2083819 - RNA, 13 nt, Homo sapiens
cugggacugagaa

SEQ ID NO: 2083820 - RNA, 23 nt, Homo sapiens
ccuccugauuucccuaaggagcc

SEQ ID NO: 2083821 - RNA, 20 nt, Homo sapiens
uuguuggcguaggcuacaga

SEQ ID NO: 2083822 - RNA, 15 nt, Homo sapiens
auaaaggcauggcau

SEQ ID NO: 2083823 - RNA, 19 nt, Homo sapiens
uggggugcauccuccucag

SEQ ID NO: 2083824 - RNA, 16 nt, Homo sapiens
cugcuucucccaggca

SEQ ID NO: 2083825 - RNA, 13 nt, Homo sapiens
gacagaauguguu

SEQ ID NO: 2083826 - RNA, 16 nt, Homo sapiens
aaucccaucucuacaa

SEQ ID NO: 2083827 - RNA, 22 nt, Homo sapiens
ccaccugcaugaacacaguggc

SEQ ID NO: 2083828 - RNA, 16 nt, Homo sapiens
guuuuauaauuugaau

SEQ ID NO: 2083829 - RNA, 19 nt, Homo sapiens
ccuucugguacaauccuuu

SEQ ID NO: 2083830 - RNA, 17 nt, Homo sapiens
ugcugccaggcacuguu

SEQ ID NO: 2083831 - RNA, 20 nt, Homo sapiens
uaauuucuucucaaagggua

SEQ ID NO: 2083832 - RNA, 13 nt, Homo sapiens
uccacucacucca

SEQ ID NO: 2083833 - RNA, 14 nt, Homo sapiens
cuuucuucccauga

SEQ ID NO: 2083834 - RNA, 14 nt, Homo sapiens
gcucaugccccuug

SEQ ID NO: 2083835 - RNA, 22 nt, Homo sapiens
cagcucaaauuccgagugcaga

SEQ ID NO: 2083836 - RNA, 19 nt, Homo sapiens
ugggaaccauuucaagaca

SEQ ID NO: 2083837 - RNA, 12 nt, Homo sapiens
uguuauggugcu

SEQ ID NO: 2083838 - RNA, 22 nt, Homo sapiens
cuguggagguauugccuuguga

SEQ ID NO: 2083839 - RNA, 19 nt, Homo sapiens
gaccccucuccucaaggga

SEQ ID NO: 2083840 - RNA, 17 nt, Homo sapiens
gauacauacaccagcau

SEQ ID NO: 2083841 - RNA, 20 nt, Homo sapiens
aucuguuugauacaguauua

SEQ ID NO: 2083842 - RNA, 15 nt, Homo sapiens
uaucuaaaaucugcu

SEQ ID NO: 2083843 - RNA, 16 nt, Homo sapiens
gagacugucccugaaa

SEQ ID NO: 2083844 - RNA, 22 nt, Homo sapiens
aaguuaucaucucaccacacca

SEQ ID NO: 2083845 - RNA, 16 nt, Homo sapiens
aucuuaguguucaaaa

SEQ ID NO: 2083846 - RNA, 13 nt, Homo sapiens
agcaggggccaga

SEQ ID NO: 2083847 - RNA, 20 nt, Homo sapiens
auucaccuguaaaacuuuau

SEQ ID NO: 2083848 - RNA, 14 nt, Homo sapiens
gugccgcuccugcu

SEQ ID NO: 2083849 - RNA, 20 nt, Homo sapiens
auucuaaugucuucauuuca

SEQ ID NO: 2083850 - RNA, 22 nt, Homo sapiens
uaccuugacuugaaaugcucuu

SEQ ID NO: 2083851 - RNA, 21 nt, Homo sapiens
ugcaguacuuaauguuuguaa

SEQ ID NO: 2083852 - RNA, 18 nt, Homo sapiens
cauuaauuggagugcagc

SEQ ID NO: 2083853 - RNA, 13 nt, Homo sapiens
gucucagcugcug

SEQ ID NO: 2083854 - RNA, 18 nt, Homo sapiens
ucucaauugugcuuugua

SEQ ID NO: 2083855 - RNA, 21 nt, Homo sapiens
cugcaaaaccggcaaccugua

SEQ ID NO: 2083856 - RNA, 21 nt, Homo sapiens
cuuaagagacacuccaaaccu

SEQ ID NO: 2083857 - RNA, 12 nt, Homo sapiens
aaggaaaaccag

SEQ ID NO: 2083858 - RNA, 15 nt, Homo sapiens
aaaguacagaugcag

SEQ ID NO: 2083859 - RNA, 15 nt, Homo sapiens
gaagcagaaauguac

SEQ ID NO: 2083860 - RNA, 16 nt, Homo sapiens
cuaauuuuaguauuca

SEQ ID NO: 2083861 - RNA, 15 nt, Homo sapiens
ccaguuaacuguuaa

SEQ ID NO: 2083862 - RNA, 21 nt, Homo sapiens
ugagaauggaaaccacaacuu

SEQ ID NO: 2083863 - RNA, 20 nt, Homo sapiens
uccacucuacuaaugccucu

SEQ ID NO: 2083864 - RNA, 18 nt, Homo sapiens
ccagaggcuuaaucacac

SEQ ID NO: 2083865 - RNA, 15 nt, Homo sapiens
cccagcuauucagga

SEQ ID NO: 2083866 - RNA, 22 nt, Homo sapiens
guuaauuuuuccuauauugcau

SEQ ID NO: 2083867 - RNA, 22 nt, Homo sapiens
aauuaugaaaacucaugaucaa

SEQ ID NO: 2083868 - RNA, 19 nt, Homo sapiens
ucguuuugaccacauauau

SEQ ID NO: 2083869 - RNA, 16 nt, Homo sapiens
gagccccauacagggc

SEQ ID NO: 2083870 - RNA, 16 nt, Homo sapiens
auccaaccuccuguca

SEQ ID NO: 2083871 - RNA, 21 nt, Homo sapiens
cucucuaagugggcauugcca

SEQ ID NO: 2083872 - RNA, 18 nt, Homo sapiens
aauguaucuacauaccua

SEQ ID NO: 2083873 - RNA, 21 nt, Homo sapiens
ugcauaaaugugguacaagca

SEQ ID NO: 2083874 - RNA, 20 nt, Homo sapiens
agacuaugauauaacaugug

SEQ ID NO: 2083875 - RNA, 16 nt, Homo sapiens
uauguugaccuuugca

SEQ ID NO: 2083876 - RNA, 15 nt, Homo sapiens
uagccacuucacuuu

SEQ ID NO: 2083877 - RNA, 15 nt, Homo sapiens
uguaaauaugcaaau

SEQ ID NO: 2083878 - RNA, 16 nt, Homo sapiens
caaggauuuuuagccc

SEQ ID NO: 2083879 - RNA, 15 nt, Homo sapiens
ugcgcgcaugugcgc

SEQ ID NO: 2083880 - RNA, 23 nt, Homo sapiens
aagcaguuguuauuuagugauau

SEQ ID NO: 2083881 - RNA, 19 nt, Homo sapiens
uuaaacucugcucaggaua

SEQ ID NO: 2083882 - RNA, 21 nt, Homo sapiens
ugcaggagagucgggggacca

SEQ ID NO: 2083883 - RNA, 11 nt, Homo sapiens
cacacuggccu

SEQ ID NO: 2083884 - RNA, 19 nt, Homo sapiens
uaagcuaugaaaaauacaa

SEQ ID NO: 2083885 - RNA, 22 nt, Homo sapiens
cacuguaauuaaaacuauuuag

SEQ ID NO: 2083886 - RNA, 20 nt, Homo sapiens
aaccuuccagagaacacagg

SEQ ID NO: 2083887 - RNA, 13 nt, Homo sapiens
uaagaguuacuua

SEQ ID NO: 2083888 - RNA, 22 nt, Homo sapiens
cagacucauccugaacagcaug

SEQ ID NO: 2083889 - RNA, 16 nt, Homo sapiens
auuguuaccucugagu

SEQ ID NO: 2083890 - RNA, 13 nt, Homo sapiens
gaaaaaauggcaa

SEQ ID NO: 2083891 - RNA, 15 nt, Homo sapiens
caaacccagugagac

SEQ ID NO: 2083892 - RNA, 13 nt, Homo sapiens
agggcaggggugc

SEQ ID NO: 2083893 - RNA, 21 nt, Homo sapiens
ucaugucucacgucucccuaa

SEQ ID NO: 2083894 - RNA, 15 nt, Homo sapiens
gcccuuuccaagcuu

SEQ ID NO: 2083895 - RNA, 16 nt, Homo sapiens
aacucaguuccaaagu

SEQ ID NO: 2083896 - RNA, 16 nt, Homo sapiens
uagaacugcccauuuc

SEQ ID NO: 2083897 - RNA, 23 nt, Homo sapiens
cuuccugaaauaaacacuggugc

SEQ ID NO: 2083898 - RNA, 22 nt, Homo sapiens
gccuugggacuuagaacaccgc

SEQ ID NO: 2083899 - RNA, 21 nt, Homo sapiens
cggccagcccucccagcagug

SEQ ID NO: 2083900 - RNA, 12 nt, Homo sapiens
uccuuguguuua

SEQ ID NO: 2083901 - RNA, 17 nt, Homo sapiens
cuaaauuugaaauauaa

SEQ ID NO: 2083902 - RNA, 21 nt, Homo sapiens
cugacauuaugugguuuuaga

SEQ ID NO: 2083903 - RNA, 16 nt, Homo sapiens
ucaaaacaaguacugg

SEQ ID NO: 2083904 - RNA, 17 nt, Homo sapiens
acaccauuuuccugccu

SEQ ID NO: 2083905 - RNA, 19 nt, Homo sapiens
uuaauagccaaagauuuca

SEQ ID NO: 2083906 - RNA, 13 nt, Homo sapiens
auuguagccucaa

SEQ ID NO: 2083907 - RNA, 16 nt, Homo sapiens
gcaaauucaagagccu

SEQ ID NO: 2083908 - RNA, 23 nt, Homo sapiens
aacuaagguuagaaacauuuuga

SEQ ID NO: 2083909 - RNA, 21 nt, Homo sapiens
cauggcuauaaacaauuacau

SEQ ID NO: 2083910 - RNA, 23 nt, Homo sapiens
uaggaaacuuuuuccaccuuucu

SEQ ID NO: 2083911 - RNA, 17 nt, Homo sapiens
uucuuguuucucaugaa

SEQ ID NO: 2083912 - RNA, 14 nt, Homo sapiens
gcugcaaagccaua

SEQ ID NO: 2083913 - RNA, 20 nt, Homo sapiens
gaaauugguaccuugcacac

SEQ ID NO: 2083914 - RNA, 22 nt, Homo sapiens
gcagaguugaagacagagcuac

SEQ ID NO: 2083915 - RNA, 19 nt, Homo sapiens
cccagacacagacuggcaa

SEQ ID NO: 2083916 - RNA, 21 nt, Homo sapiens
ggauuucacaccccauucuca

SEQ ID NO: 2083917 - RNA, 21 nt, Homo sapiens
auacuuuugcuuucagggaaa

SEQ ID NO: 2083918 - RNA, 21 nt, Homo sapiens
ucccuagauuuaaccauggca

SEQ ID NO: 2083919 - RNA, 11 nt, Homo sapiens
ccaaaugaugc

SEQ ID NO: 2083920 - RNA, 21 nt, Homo sapiens
aagagcaggaggugccugaaa

SEQ ID NO: 2083921 - RNA, 21 nt, Homo sapiens
ccaucugcucaccagaucuca

SEQ ID NO: 2083922 - RNA, 23 nt, Homo sapiens
agaacugucuauuuucucaguca

SEQ ID NO: 2083923 - RNA, 14 nt, Homo sapiens
uauagauuucugca

SEQ ID NO: 2083924 - RNA, 16 nt, Homo sapiens
uugcuggugcaaagau

SEQ ID NO: 2083925 - RNA, 19 nt, Homo sapiens
uagagaaaauaaauuccaa

SEQ ID NO: 2083926 - RNA, 22 nt, Homo sapiens
uguuucugaaaaauaaaaguau

SEQ ID NO: 2083927 - RNA, 13 nt, Homo sapiens
auccuucuacuug

SEQ ID NO: 2083928 - RNA, 24 nt, Homo sapiens
cuuugaaugcaugugugaagauua

SEQ ID NO: 2083929 - RNA, 15 nt, Homo sapiens
cuucugggaccauaa

SEQ ID NO: 2083930 - RNA, 16 nt, Homo sapiens
agccacgaggugcagu

SEQ ID NO: 2083931 - RNA, 21 nt, Homo sapiens
cuguguggacugugaugccac

SEQ ID NO: 2083932 - RNA, 18 nt, Homo sapiens
aucccaaaccuacaagaa

SEQ ID NO: 2083933 - RNA, 19 nt, Homo sapiens
ugagauggucccaucugca

SEQ ID NO: 2083934 - RNA, 16 nt, Homo sapiens
gaaacuucaagcacca

SEQ ID NO: 2083935 - RNA, 22 nt, Homo sapiens
aaagaccuuagacauaaaguaa

SEQ ID NO: 2083936 - RNA, 17 nt, Homo sapiens
ucugcuguacauuauua

SEQ ID NO: 2083937 - RNA, 15 nt, Homo sapiens
cugguccugcacugu

SEQ ID NO: 2083938 - RNA, 16 nt, Homo sapiens
ucucucuaccagucua

SEQ ID NO: 2083939 - RNA, 14 nt, Homo sapiens
caggucaacuucag

SEQ ID NO: 2083940 - RNA, 15 nt, Homo sapiens
acuguucccaacuca

SEQ ID NO: 2083941 - RNA, 13 nt, Homo sapiens
ccccucaggauug

SEQ ID NO: 2083942 - RNA, 19 nt, Homo sapiens
gacuggaccccgcccagca

SEQ ID NO: 2083943 - RNA, 12 nt, Homo sapiens
uaaaagcuauau

SEQ ID NO: 2083944 - RNA, 12 nt, Homo sapiens
caauucuucucg

SEQ ID NO: 2083945 - RNA, 19 nt, Homo sapiens
auauaacauucuauugacu

SEQ ID NO: 2083946 - RNA, 15 nt, Homo sapiens
ucucacuaccuuauu

SEQ ID NO: 2083947 - RNA, 14 nt, Homo sapiens
gccauaaagccauu

SEQ ID NO: 2083948 - RNA, 20 nt, Homo sapiens
aucccaaauucacuuuauua

SEQ ID NO: 2083949 - RNA, 19 nt, Homo sapiens
augcugaaaacacagagaa

SEQ ID NO: 2083950 - RNA, 20 nt, Homo sapiens
cuguaagauuuuauuuucaa

SEQ ID NO: 2083951 - RNA, 13 nt, Homo sapiens
uguggucaauccg

SEQ ID NO: 2083952 - RNA, 17 nt, Homo sapiens
gacuggagcucaucugc

SEQ ID NO: 2083953 - RNA, 23 nt, Homo sapiens
gguccuaacccccuuacugugcg

SEQ ID NO: 2083954 - RNA, 18 nt, Homo sapiens
auuguguauugaugcaau

SEQ ID NO: 2083955 - RNA, 16 nt, Homo sapiens
auauuuuauuaucuua

SEQ ID NO: 2083956 - RNA, 18 nt, Homo sapiens
cuagccccucacuuccag

SEQ ID NO: 2083957 - RNA, 22 nt, Homo sapiens
cgguguuuggaggcugcugccc

SEQ ID NO: 2083958 - RNA, 23 nt, Homo sapiens
uuugguaguggaauagugaauac

SEQ ID NO: 2083959 - RNA, 14 nt, Homo sapiens
cauuuuuuacuuga

SEQ ID NO: 2083960 - RNA, 19 nt, Homo sapiens
caugaacacacauggaugc

SEQ ID NO: 2083961 - RNA, 13 nt, Homo sapiens
aagaucugaguga

SEQ ID NO: 2083962 - RNA, 22 nt, Homo sapiens
agcugucucaaaccuccaaaag

SEQ ID NO: 2083963 - RNA, 21 nt, Homo sapiens
cuaugaaauuucaacuuuucc

SEQ ID NO: 2083964 - RNA, 20 nt, Homo sapiens
uguguaucucacacucaugc

SEQ ID NO: 2083965 - RNA, 15 nt, Homo sapiens
gcauuuuuaaauaca

SEQ ID NO: 2083966 - RNA, 18 nt, Homo sapiens
accugcaguuaacaggau

SEQ ID NO: 2083967 - RNA, 16 nt, Homo sapiens
uagucaaggaggaaag

SEQ ID NO: 2083968 - RNA, 12 nt, Homo sapiens
cagagucucacu

SEQ ID NO: 2083969 - RNA, 22 nt, Homo sapiens
agcuucuuaauauaacugccuu

SEQ ID NO: 2083970 - RNA, 21 nt, Homo sapiens
uugagaggugggggaugcuga

SEQ ID NO: 2083971 - RNA, 22 nt, Homo sapiens
uuccuauuacacggagugugcu

SEQ ID NO: 2083972 - RNA, 18 nt, Homo sapiens
aacucugcccaggugugc

SEQ ID NO: 2083973 - RNA, 23 nt, Homo sapiens
caggaacccagcggcucuagcca

SEQ ID NO: 2083974 - RNA, 18 nt, Homo sapiens
uucauuuuauauugaaaa

SEQ ID NO: 2083975 - RNA, 15 nt, Homo sapiens
ugucucuacaaaaaa

SEQ ID NO: 2083976 - RNA, 16 nt, Homo sapiens
ccuguacggacacugu

SEQ ID NO: 2083977 - RNA, 18 nt, Homo sapiens
gcuuaaugucagucuaca

SEQ ID NO: 2083978 - RNA, 14 nt, Homo sapiens
acuugcaaugggca

SEQ ID NO: 2083979 - RNA, 20 nt, Homo sapiens
auggcaaaggcuugccccaa

SEQ ID NO: 2083980 - RNA, 21 nt, Homo sapiens
augcugggccaguuccuccaa

SEQ ID NO: 2083981 - RNA, 23 nt, Homo sapiens
uguuuugaaaaccuaaaagacag

SEQ ID NO: 2083982 - RNA, 14 nt, Homo sapiens
aaaacucaacauua

SEQ ID NO: 2083983 - RNA, 19 nt, Homo sapiens
ccgccagccuacacugcca

SEQ ID NO: 2083984 - RNA, 16 nt, Homo sapiens
ucuucugguguugacu

SEQ ID NO: 2083985 - RNA, 15 nt, Homo sapiens
uuaaauaugaaugaa

SEQ ID NO: 2083986 - RNA, 19 nt, Homo sapiens
agaggggguagcuagccug

SEQ ID NO: 2083987 - RNA, 14 nt, Homo sapiens
ggaaucaauuacuu

SEQ ID NO: 2083988 - RNA, 13 nt, Homo sapiens
gccuguguagcug

SEQ ID NO: 2083989 - RNA, 17 nt, Homo sapiens
gugucucccaggugcau

SEQ ID NO: 2083990 - RNA, 15 nt, Homo sapiens
accugcacaccuacg

SEQ ID NO: 2083991 - RNA, 16 nt, Homo sapiens
augugauuuuucugca

SEQ ID NO: 2083992 - RNA, 13 nt, Homo sapiens
aguuuauuccugu

SEQ ID NO: 2083993 - RNA, 16 nt, Homo sapiens
aacacaaacaucauuu

SEQ ID NO: 2083994 - RNA, 15 nt, Homo sapiens
aaguacagccuggac

SEQ ID NO: 2083995 - RNA, 15 nt, Homo sapiens
ccugugugugggugg

SEQ ID NO: 2083996 - RNA, 22 nt, Homo sapiens
uuccuuguuccaauuugacaaa

SEQ ID NO: 2083997 - RNA, 14 nt, Homo sapiens
acagcagcuggacu

SEQ ID NO: 2083998 - RNA, 20 nt, Homo sapiens
cacauuuacaaaauuacaca

SEQ ID NO: 2083999 - RNA, 20 nt, Homo sapiens
caaauaaucacaaaaucaca

SEQ ID NO: 2084000 - RNA, 22 nt, Homo sapiens
agccaagcuuguuaucagcuuu

SEQ ID NO: 2084001 - RNA, 12 nt, Homo sapiens
aaagacagugac

SEQ ID NO: 2084002 - RNA, 15 nt, Homo sapiens
ggugacagcugcaag

SEQ ID NO: 2084003 - RNA, 18 nt, Homo sapiens
cugaagucuuacuacaga

SEQ ID NO: 2084004 - RNA, 18 nt, Homo sapiens
cuugauacauguaauucu

SEQ ID NO: 2084005 - RNA, 23 nt, Homo sapiens
acagacugaauuuuaaauguuca

SEQ ID NO: 2084006 - RNA, 14 nt, Homo sapiens
cuauggaaguauua

SEQ ID NO: 2084007 - RNA, 18 nt, Homo sapiens
auaacaagccaaacauuc

SEQ ID NO: 2084008 - RNA, 19 nt, Homo sapiens
ugugaaguuugcuuuguac

SEQ ID NO: 2084009 - RNA, 17 nt, Homo sapiens
ccaggcugcccaucagg

SEQ ID NO: 2084010 - RNA, 13 nt, Homo sapiens
gugcacuucaaga

SEQ ID NO: 2084011 - RNA, 12 nt, Homo sapiens
ucucacuguugu

SEQ ID NO: 2084012 - RNA, 12 nt, Homo sapiens
ucuuacuguugc

SEQ ID NO: 2084013 - RNA, 18 nt, Homo sapiens
guccacuuguggguccug

SEQ ID NO: 2084014 - RNA, 12 nt, Homo sapiens
cccaggaugcau

SEQ ID NO: 2084015 - RNA, 13 nt, Homo sapiens
gagagccaagacg

SEQ ID NO: 2084016 - RNA, 13 nt, Homo sapiens
aggcuccagaaau

SEQ ID NO: 2084017 - RNA, 18 nt, Homo sapiens
uaacaagaauacuacuua

SEQ ID NO: 2084018 - RNA, 13 nt, Homo sapiens
uacaagcaggcac

SEQ ID NO: 2084019 - RNA, 21 nt, Homo sapiens
ucugcucuagggaaucuggau

SEQ ID NO: 2084020 - RNA, 16 nt, Homo sapiens
uucuauuuaccuccua

SEQ ID NO: 2084021 - RNA, 16 nt, Homo sapiens
ccggagcgcaccugcu

SEQ ID NO: 2084022 - RNA, 12 nt, Homo sapiens
gcaagugauauc

SEQ ID NO: 2084023 - RNA, 14 nt, Homo sapiens
cuaugccuugcaca

SEQ ID NO: 2084024 - RNA, 12 nt, Homo sapiens
ccaccaugagcu

SEQ ID NO: 2084025 - RNA, 19 nt, Homo sapiens
auuucagugagaaaauccu

SEQ ID NO: 2084026 - RNA, 18 nt, Homo sapiens
uuuuagccauaaauugcu

SEQ ID NO: 2084027 - RNA, 20 nt, Homo sapiens
caguguaacgaugcacuuug

SEQ ID NO: 2084028 - RNA, 16 nt, Homo sapiens
guugcagccgcagaga

SEQ ID NO: 2084029 - RNA, 14 nt, Homo sapiens
uaagaauagaaaua

SEQ ID NO: 2084030 - RNA, 13 nt, Homo sapiens
guuugaguucaaa

SEQ ID NO: 2084031 - RNA, 22 nt, Homo sapiens
aauuauguuuucauccauuaaa

SEQ ID NO: 2084032 - RNA, 20 nt, Homo sapiens
uugucccagccuggggcucc

SEQ ID NO: 2084033 - RNA, 17 nt, Homo sapiens
ucagagaaccagugcag

SEQ ID NO: 2084034 - RNA, 15 nt, Homo sapiens
gcccaacuaacaguc

SEQ ID NO: 2084035 - RNA, 11 nt, Homo sapiens
acaucuuucag

SEQ ID NO: 2084036 - RNA, 20 nt, Homo sapiens
aagucugaauagaaucugga

SEQ ID NO: 2084037 - RNA, 16 nt, Homo sapiens
agaucucccaugugua

SEQ ID NO: 2084038 - RNA, 21 nt, Homo sapiens
gauccugcugaccucacuguc

SEQ ID NO: 2084039 - RNA, 16 nt, Homo sapiens
uauuuuuaaagcaagu

SEQ ID NO: 2084040 - RNA, 20 nt, Homo sapiens
uuggaaaacacuuucauccg

SEQ ID NO: 2084041 - RNA, 15 nt, Homo sapiens
cagaagcagcagcua

SEQ ID NO: 2084042 - RNA, 14 nt, Homo sapiens
ucccuucaggugcc

SEQ ID NO: 2084043 - RNA, 15 nt, Homo sapiens
cuagaaauauauuca

SEQ ID NO: 2084044 - RNA, 13 nt, Homo sapiens
caggaguacaccc

SEQ ID NO: 2084045 - RNA, 11 nt, Homo sapiens
uggcacuuuga

SEQ ID NO: 2084046 - RNA, 15 nt, Homo sapiens
aauuaaaaaccugau

SEQ ID NO: 2084047 - RNA, 17 nt, Homo sapiens
uccagguguuacuguaa

SEQ ID NO: 2084048 - RNA, 16 nt, Homo sapiens
cuaaauuuucuaauua

SEQ ID NO: 2084049 - RNA, 19 nt, Homo sapiens
gcaguuuuagcagcacuuu

SEQ ID NO: 2084050 - RNA, 12 nt, Homo sapiens
cacagggccuug

SEQ ID NO: 2084051 - RNA, 20 nt, Homo sapiens
augcaaaagucagcgugaca

SEQ ID NO: 2084052 - RNA, 20 nt, Homo sapiens
ugugacaugaacccauccaa

SEQ ID NO: 2084053 - RNA, 22 nt, Homo sapiens
auuguaacucaaaggguggaau

SEQ ID NO: 2084054 - RNA, 22 nt, Homo sapiens
aucaaucauuaaggucauuacu

SEQ ID NO: 2084055 - RNA, 19 nt, Homo sapiens
cuacgccacuccacaaaug

SEQ ID NO: 2084056 - RNA, 16 nt, Homo sapiens
gcacccacaaccagag

SEQ ID NO: 2084057 - RNA, 20 nt, Homo sapiens
uugggcaugauucuacccuu

SEQ ID NO: 2084058 - RNA, 16 nt, Homo sapiens
ugcccaugaugcagag

SEQ ID NO: 2084059 - RNA, 22 nt, Homo sapiens
uaggcauuaaauuuuagcaaag

SEQ ID NO: 2084060 - RNA, 22 nt, Homo sapiens
gccucugccuuugugauccuga

SEQ ID NO: 2084061 - RNA, 14 nt, Homo sapiens
aagaggcauuccca

SEQ ID NO: 2084062 - RNA, 15 nt, Homo sapiens
uaaacauuaguucua

SEQ ID NO: 2084063 - RNA, 21 nt, Homo sapiens
accagguggaauuacuuaaau

SEQ ID NO: 2084064 - RNA, 16 nt, Homo sapiens
aaccaaaugugcauug

SEQ ID NO: 2084065 - RNA, 19 nt, Homo sapiens
gcuucaccccugcacuuca

SEQ ID NO: 2084066 - RNA, 16 nt, Homo sapiens
ugaaacuguguauuau

SEQ ID NO: 2084067 - RNA, 21 nt, Homo sapiens
ggaaacaagaugaaauuccau

SEQ ID NO: 2084068 - RNA, 13 nt, Homo sapiens
agauugugccacu

SEQ ID NO: 2084069 - RNA, 13 nt, Homo sapiens
cgauagugacaca

SEQ ID NO: 2084070 - RNA, 17 nt, Homo sapiens
uuacggauuuauuauau

SEQ ID NO: 2084071 - RNA, 16 nt, Homo sapiens
caaauucuuuuucaca

SEQ ID NO: 2084072 - RNA, 17 nt, Homo sapiens
ccucuccuuccuuaccc

SEQ ID NO: 2084073 - RNA, 14 nt, Homo sapiens
aucaaauaagcuaa

SEQ ID NO: 2084074 - RNA, 13 nt, Homo sapiens
cuugggagcaaaa

SEQ ID NO: 2084075 - RNA, 18 nt, Homo sapiens
acacugcugcuccagugc

SEQ ID NO: 2084076 - RNA, 19 nt, Homo sapiens
ucugagcacccaagccagg

SEQ ID NO: 2084077 - RNA, 22 nt, Homo sapiens
cuguugaaaauuauuuuaaaca

SEQ ID NO: 2084078 - RNA, 14 nt, Homo sapiens
ggggcaggcaguga

SEQ ID NO: 2084079 - RNA, 14 nt, Homo sapiens
gugauuauucugua

SEQ ID NO: 2084080 - RNA, 12 nt, Homo sapiens
caagaccaaaga

SEQ ID NO: 2084081 - RNA, 23 nt, Homo sapiens
aaauuaauugaaauaccuauuca

SEQ ID NO: 2084082 - RNA, 16 nt, Homo sapiens
ggcgcgguggcucaca

SEQ ID NO: 2084083 - RNA, 20 nt, Homo sapiens
ucaacaccaggagagcuucu

SEQ ID NO: 2084084 - RNA, 13 nt, Homo sapiens
caaagccacugag

SEQ ID NO: 2084085 - RNA, 14 nt, Homo sapiens
aacuauaagauaca

SEQ ID NO: 2084086 - RNA, 13 nt, Homo sapiens
agcauuugccacu

SEQ ID NO: 2084087 - RNA, 20 nt, Homo sapiens
uauugcccuuuaacaagacu

SEQ ID NO: 2084088 - RNA, 22 nt, Homo sapiens
ccuucucuguguucccaggguc

SEQ ID NO: 2084089 - RNA, 14 nt, Homo sapiens
augacuuacuguac

SEQ ID NO: 2084090 - RNA, 24 nt, Homo sapiens
aacauuuucagaccaugaaugaau

SEQ ID NO: 2084091 - RNA, 15 nt, Homo sapiens
aaugaaauaauucaa

SEQ ID NO: 2084092 - RNA, 15 nt, Homo sapiens
cugaauccagaucau

SEQ ID NO: 2084093 - RNA, 17 nt, Homo sapiens
uaguucuuacccaguua

SEQ ID NO: 2084094 - RNA, 23 nt, Homo sapiens
caguagcauuuuaauaguuucua

SEQ ID NO: 2084095 - RNA, 17 nt, Homo sapiens
cacaacaccuccugaua

SEQ ID NO: 2084096 - RNA, 16 nt, Homo sapiens
caugugcacagguucu

SEQ ID NO: 2084097 - RNA, 18 nt, Homo sapiens
aaaugauuauauucacag

SEQ ID NO: 2084098 - RNA, 23 nt, Homo sapiens
ccauaggaggugggggaacugga

SEQ ID NO: 2084099 - RNA, 13 nt, Homo sapiens
caggccgggugca

SEQ ID NO: 2084100 - RNA, 19 nt, Homo sapiens
cacaauaaggaagaaauaa

SEQ ID NO: 2084101 - RNA, 20 nt, Homo sapiens
ucaucuacaagcauuugccc

SEQ ID NO: 2084102 - RNA, 19 nt, Homo sapiens
uucagaggagcaacccuau

SEQ ID NO: 2084103 - RNA, 21 nt, Homo sapiens
ucccuuuguuuaaaaugucau

SEQ ID NO: 2084104 - RNA, 14 nt, Homo sapiens
aagaagcugucaga

SEQ ID NO: 2084105 - RNA, 18 nt, Homo sapiens
ugggccagccucagcuca

SEQ ID NO: 2084106 - RNA, 14 nt, Homo sapiens
uccaacuauuuauu

SEQ ID NO: 2084107 - RNA, 12 nt, Homo sapiens
cccaggagucca

SEQ ID NO: 2084108 - RNA, 16 nt, Homo sapiens
cugauggaaaauacca

SEQ ID NO: 2084109 - RNA, 19 nt, Homo sapiens
agggagcaggccggaacca

SEQ ID NO: 2084110 - RNA, 19 nt, Homo sapiens
uucaggaggaauacugaac

SEQ ID NO: 2084111 - RNA, 18 nt, Homo sapiens
uucaggagcugaagccca

SEQ ID NO: 2084112 - RNA, 21 nt, Homo sapiens
gugauguguccugauaagcug

SEQ ID NO: 2084113 - RNA, 17 nt, Homo sapiens
auggagcagccuggaga

SEQ ID NO: 2084114 - RNA, 18 nt, Homo sapiens
aaccacagucuauaccau

SEQ ID NO: 2084115 - RNA, 13 nt, Homo sapiens
cauaaguugcauu

SEQ ID NO: 2084116 - RNA, 13 nt, Homo sapiens
ccuuaguugaaau

SEQ ID NO: 2084117 - RNA, 17 nt, Homo sapiens
ucuugcuagauuuugcu

SEQ ID NO: 2084118 - RNA, 20 nt, Homo sapiens
gguuucaucauguugaccag

SEQ ID NO: 2084119 - RNA, 14 nt, Homo sapiens
agcccugcagugug

SEQ ID NO: 2084120 - RNA, 21 nt, Homo sapiens
augaccuccguguagugucug

SEQ ID NO: 2084121 - RNA, 15 nt, Homo sapiens
auguggaacugcugc

SEQ ID NO: 2084122 - RNA, 14 nt, Homo sapiens
uacccuaaagggag

SEQ ID NO: 2084123 - RNA, 19 nt, Homo sapiens
agaagaaaacgaacuggga

SEQ ID NO: 2084124 - RNA, 21 nt, Homo sapiens
guuacucccuacacugaugca

SEQ ID NO: 2084125 - RNA, 13 nt, Homo sapiens
gaguguagcugua

SEQ ID NO: 2084126 - RNA, 11 nt, Homo sapiens
ggccuggucug

SEQ ID NO: 2084127 - RNA, 17 nt, Homo sapiens
aaguaaaucuaucucua

SEQ ID NO: 2084128 - RNA, 17 nt, Homo sapiens
uguacugugaccuaaga

SEQ ID NO: 2084129 - RNA, 12 nt, Homo sapiens
uuugcucaacau

SEQ ID NO: 2084130 - RNA, 16 nt, Homo sapiens
uuuuaaaaauugucau

SEQ ID NO: 2084131 - RNA, 16 nt, Homo sapiens
aacauuguugauuuca

SEQ ID NO: 2084132 - RNA, 22 nt, Homo sapiens
aaauguacacuggauauguugu

SEQ ID NO: 2084133 - RNA, 19 nt, Homo sapiens
agcuucugcuuuucugccc

SEQ ID NO: 2084134 - RNA, 22 nt, Homo sapiens
uugcaauguucaacauuaacau

SEQ ID NO: 2084135 - RNA, 18 nt, Homo sapiens
acacggcggggucuguag

SEQ ID NO: 2084136 - RNA, 16 nt, Homo sapiens
aauguucauugcacau

SEQ ID NO: 2084137 - RNA, 19 nt, Homo sapiens
uggguuuucuaacuguaaa

SEQ ID NO: 2084138 - RNA, 12 nt, Homo sapiens
agaaugcagcug

SEQ ID NO: 2084139 - RNA, 11 nt, Homo sapiens
cuuuaccuuca

SEQ ID NO: 2084140 - RNA, 19 nt, Homo sapiens
gaacucuuaggcacaucaa

SEQ ID NO: 2084141 - RNA, 15 nt, Homo sapiens
uucacacaacuacuu

SEQ ID NO: 2084142 - RNA, 12 nt, Homo sapiens
uaaaguauguga

SEQ ID NO: 2084143 - RNA, 22 nt, Homo sapiens
gucccgaccccaucccuaucca

SEQ ID NO: 2084144 - RNA, 16 nt, Homo sapiens
ucuugagcugacccaa

SEQ ID NO: 2084145 - RNA, 12 nt, Homo sapiens
agcaggugaccu

SEQ ID NO: 2084146 - RNA, 22 nt, Homo sapiens
aggagcucaagaacgagaagca

SEQ ID NO: 2084147 - RNA, 13 nt, Homo sapiens
caauuugcacauu

SEQ ID NO: 2084148 - RNA, 13 nt, Homo sapiens
cauagugcacuag

SEQ ID NO: 2084149 - RNA, 16 nt, Homo sapiens
aagaaauggcuaugaa

SEQ ID NO: 2084150 - RNA, 22 nt, Homo sapiens
guguggagcuaaggacacagug

SEQ ID NO: 2084151 - RNA, 20 nt, Homo sapiens
caguuacccccaaccugacc

SEQ ID NO: 2084152 - RNA, 17 nt, Homo sapiens
uagacgagacaguccau

SEQ ID NO: 2084153 - RNA, 11 nt, Homo sapiens
aaggagucaaa

SEQ ID NO: 2084154 - RNA, 20 nt, Homo sapiens
gcugaggccuaugcagacau

SEQ ID NO: 2084155 - RNA, 22 nt, Homo sapiens
auugugugaacuuggaagcaca

SEQ ID NO: 2084156 - RNA, 16 nt, Homo sapiens
agagcuuucaaacacu

SEQ ID NO: 2084157 - RNA, 17 nt, Homo sapiens
gagggaacaaauuuuca

SEQ ID NO: 2084158 - RNA, 15 nt, Homo sapiens
ugugugugugcauau

SEQ ID NO: 2084159 - RNA, 15 nt, Homo sapiens
uacauauguaugugu

SEQ ID NO: 2084160 - RNA, 17 nt, Homo sapiens
caguaaagugguucucu

SEQ ID NO: 2084161 - RNA, 14 nt, Homo sapiens
cucuugacauucca

SEQ ID NO: 2084162 - RNA, 17 nt, Homo sapiens
ugaauuuuuaagcaaau

SEQ ID NO: 2084163 - RNA, 14 nt, Homo sapiens
aagcagcaagacaa

SEQ ID NO: 2084164 - RNA, 19 nt, Homo sapiens
cugagcgggcuugugauau

SEQ ID NO: 2084165 - RNA, 16 nt, Homo sapiens
accuaguaagugccug

SEQ ID NO: 2084166 - RNA, 19 nt, Homo sapiens
uacccacucuggagcauuu

SEQ ID NO: 2084167 - RNA, 16 nt, Homo sapiens
uguccugcaguuccca

SEQ ID NO: 2084168 - RNA, 17 nt, Homo sapiens
uuccucccccaguuccu

SEQ ID NO: 2084169 - RNA, 12 nt, Homo sapiens
agugaaggauuu

SEQ ID NO: 2084170 - RNA, 14 nt, Homo sapiens
gaaaguucaaaaag

SEQ ID NO: 2084171 - RNA, 16 nt, Homo sapiens
cauuuaaaauucaauu

SEQ ID NO: 2084172 - RNA, 16 nt, Homo sapiens
gauugugaagauuuca

SEQ ID NO: 2084173 - RNA, 21 nt, Homo sapiens
auauuuaaauguaaagacaaa

SEQ ID NO: 2084174 - RNA, 13 nt, Homo sapiens
uccauuaucuaua

SEQ ID NO: 2084175 - RNA, 16 nt, Homo sapiens
uuuccuccacauucau

SEQ ID NO: 2084176 - RNA, 18 nt, Homo sapiens
caauuucucugaggacac

SEQ ID NO: 2084177 - RNA, 20 nt, Homo sapiens
cugcucccaguccugccuga

SEQ ID NO: 2084178 - RNA, 15 nt, Homo sapiens
aauuuuguaugccaa

SEQ ID NO: 2084179 - RNA, 20 nt, Homo sapiens
gcagggagggggcugggaaa

SEQ ID NO: 2084180 - RNA, 19 nt, Homo sapiens
ccauuuuuuguauuuuaac

SEQ ID NO: 2084181 - RNA, 20 nt, Homo sapiens
agacucccggagucuucucg

SEQ ID NO: 2084182 - RNA, 15 nt, Homo sapiens
aaauguugcuuuaac

SEQ ID NO: 2084183 - RNA, 23 nt, Homo sapiens
aucuuuaggagacuaauggaaau

SEQ ID NO: 2084184 - RNA, 23 nt, Homo sapiens
cagauagguggugccaguggcuu

SEQ ID NO: 2084185 - RNA, 14 nt, Homo sapiens
uuugggcugaagaa

SEQ ID NO: 2084186 - RNA, 16 nt, Homo sapiens
cucccguggccuguag

SEQ ID NO: 2084187 - RNA, 15 nt, Homo sapiens
caaauuuagugcucu

SEQ ID NO: 2084188 - RNA, 17 nt, Homo sapiens
ccuuuuuuauuccauaa

SEQ ID NO: 2084189 - RNA, 17 nt, Homo sapiens
ccaggcuggaguacaau

SEQ ID NO: 2084190 - RNA, 17 nt, Homo sapiens
cgagccuggcuccaaac

SEQ ID NO: 2084191 - RNA, 17 nt, Homo sapiens
aaaguaaaugcuaccuc

SEQ ID NO: 2084192 - RNA, 23 nt, Homo sapiens
aaggacugacugaggcaguuuga

SEQ ID NO: 2084193 - RNA, 20 nt, Homo sapiens
auuauggcaagugauaucac

SEQ ID NO: 2084194 - RNA, 22 nt, Homo sapiens
ccucucucugggaccacugggu

SEQ ID NO: 2084195 - RNA, 14 nt, Homo sapiens
ccaccaugcacugu

SEQ ID NO: 2084196 - RNA, 13 nt, Homo sapiens
acccccauccagc

SEQ ID NO: 2084197 - RNA, 22 nt, Homo sapiens
cacccaaauguaaaaauccuuu

SEQ ID NO: 2084198 - RNA, 12 nt, Homo sapiens
ggggacauucca

SEQ ID NO: 2084199 - RNA, 20 nt, Homo sapiens
agcacagcagccccugcaca

SEQ ID NO: 2084200 - RNA, 19 nt, Homo sapiens
cugaagaugggagccuuua

SEQ ID NO: 2084201 - RNA, 19 nt, Homo sapiens
uuacuuuagaagcacagua

SEQ ID NO: 2084202 - RNA, 18 nt, Homo sapiens
ggagcguguggcugugcc

SEQ ID NO: 2084203 - RNA, 17 nt, Homo sapiens
uuuccuuucaguggcuu

SEQ ID NO: 2084204 - RNA, 16 nt, Homo sapiens
caucugaagcuuuacc

SEQ ID NO: 2084205 - RNA, 13 nt, Homo sapiens
auugcaugacaaa

SEQ ID NO: 2084206 - RNA, 13 nt, Homo sapiens
auuuagaaacuga

SEQ ID NO: 2084207 - RNA, 20 nt, Homo sapiens
ccucucagggccacuggcag

SEQ ID NO: 2084208 - RNA, 15 nt, Homo sapiens
auuuaagcacaaaaa

SEQ ID NO: 2084209 - RNA, 17 nt, Homo sapiens
uguaucauuugaacaac

SEQ ID NO: 2084210 - RNA, 20 nt, Homo sapiens
accaguaaaagauaaccuuu

SEQ ID NO: 2084211 - RNA, 20 nt, Homo sapiens
cgcguggcauccugugaccg

SEQ ID NO: 2084212 - RNA, 14 nt, Homo sapiens
ggcacagaaacucc

SEQ ID NO: 2084213 - RNA, 22 nt, Homo sapiens
aagugaucucugguuguccuca

SEQ ID NO: 2084214 - RNA, 13 nt, Homo sapiens
cuaauaccaaaau

SEQ ID NO: 2084215 - RNA, 12 nt, Homo sapiens
acaguguauauu

SEQ ID NO: 2084216 - RNA, 20 nt, Homo sapiens
ucuuugcaccaaagacauca

SEQ ID NO: 2084217 - RNA, 20 nt, Homo sapiens
acacuccacuccacacucuu

SEQ ID NO: 2084218 - RNA, 18 nt, Homo sapiens
cugagcagaaugccuuau

SEQ ID NO: 2084219 - RNA, 14 nt, Homo sapiens
aguguaagcacuuc

SEQ ID NO: 2084220 - RNA, 14 nt, Homo sapiens
uccaauguccaaaa

SEQ ID NO: 2084221 - RNA, 15 nt, Homo sapiens
uuuuucuaaugagga

SEQ ID NO: 2084222 - RNA, 14 nt, Homo sapiens
accuggaauguguc

SEQ ID NO: 2084223 - RNA, 16 nt, Homo sapiens
aacauguugaagcucu

SEQ ID NO: 2084224 - RNA, 14 nt, Homo sapiens
gugcuuacaggacc

SEQ ID NO: 2084225 - RNA, 12 nt, Homo sapiens
cacccauucaca

SEQ ID NO: 2084226 - RNA, 18 nt, Homo sapiens
uugaccaagaacugcaug

SEQ ID NO: 2084227 - RNA, 17 nt, Homo sapiens
cuacugagcauuugcac

SEQ ID NO: 2084228 - RNA, 13 nt, Homo sapiens
guuaacaguuuuu

SEQ ID NO: 2084229 - RNA, 22 nt, Homo sapiens
aaauauuuucuguguguuccug

SEQ ID NO: 2084230 - RNA, 23 nt, Homo sapiens
uaaucaccgcggggcggggagcg

SEQ ID NO: 2084231 - RNA, 13 nt, Homo sapiens
acauaucuaguau

SEQ ID NO: 2084232 - RNA, 11 nt, Homo sapiens
aauaucuucca

SEQ ID NO: 2084233 - RNA, 21 nt, Homo sapiens
cucgcuggugaagacccagag

SEQ ID NO: 2084234 - RNA, 16 nt, Homo sapiens
auguuaaagcaucaga

SEQ ID NO: 2084235 - RNA, 17 nt, Homo sapiens
cuuccucacaccacaaa

SEQ ID NO: 2084236 - RNA, 14 nt, Homo sapiens
augucuguaaccaa

SEQ ID NO: 2084237 - RNA, 16 nt, Homo sapiens
auaaagcacauuccaa

SEQ ID NO: 2084238 - RNA, 22 nt, Homo sapiens
caguaucagaauacuugcacuc

SEQ ID NO: 2084239 - RNA, 17 nt, Homo sapiens
gagagggacucaaggga

SEQ ID NO: 2084240 - RNA, 20 nt, Homo sapiens
gcuaauugcacguguguauu

SEQ ID NO: 2084241 - RNA, 19 nt, Homo sapiens
cuuugcugcuuaugagcac

SEQ ID NO: 2084242 - RNA, 13 nt, Homo sapiens
cuccaaguacuuu

SEQ ID NO: 2084243 - RNA, 19 nt, Homo sapiens
aacacuccagucugccaua

SEQ ID NO: 2084244 - RNA, 16 nt, Homo sapiens
cuggaucacagcugcu

SEQ ID NO: 2084245 - RNA, 19 nt, Homo sapiens
accuuuacauaauugcaau

SEQ ID NO: 2084246 - RNA, 22 nt, Homo sapiens
guuugccaaauuuuccuuccug

SEQ ID NO: 2084247 - RNA, 21 nt, Homo sapiens
gacugguggccccugccuugg

SEQ ID NO: 2084248 - RNA, 18 nt, Homo sapiens
acugaaucucaccugcug

SEQ ID NO: 2084249 - RNA, 19 nt, Homo sapiens
uuucacuggaagauuuaug

SEQ ID NO: 2084250 - RNA, 21 nt, Homo sapiens
cuuugcccacaaugcuuugcc

SEQ ID NO: 2084251 - RNA, 16 nt, Homo sapiens
aagcagcaacagcaaa

SEQ ID NO: 2084252 - RNA, 23 nt, Homo sapiens
gaagagcccgcagggccaugcag

SEQ ID NO: 2084253 - RNA, 20 nt, Homo sapiens
ucuaacuuaagacagaauuu

SEQ ID NO: 2084254 - RNA, 18 nt, Homo sapiens
cugcauguuaagugccau

SEQ ID NO: 2084255 - RNA, 14 nt, Homo sapiens
auccuuccaaagaa

SEQ ID NO: 2084256 - RNA, 17 nt, Homo sapiens
gccuaugccaccugcag

SEQ ID NO: 2084257 - RNA, 20 nt, Homo sapiens
acacuuugaagcaaauacaa

SEQ ID NO: 2084258 - RNA, 16 nt, Homo sapiens
agcaguagcaaacuuu

SEQ ID NO: 2084259 - RNA, 19 nt, Homo sapiens
cuaggaaacucacacuccc

SEQ ID NO: 2084260 - RNA, 19 nt, Homo sapiens
ccugaucgccaaccuuucc

SEQ ID NO: 2084261 - RNA, 16 nt, Homo sapiens
uucaacagaaaugcau

SEQ ID NO: 2084262 - RNA, 19 nt, Homo sapiens
ugcucaaggcaaccagagg

SEQ ID NO: 2084263 - RNA, 15 nt, Homo sapiens
ugacuuaaccauaua

SEQ ID NO: 2084264 - RNA, 16 nt, Homo sapiens
cuaaaagaauugugac

SEQ ID NO: 2084265 - RNA, 21 nt, Homo sapiens
cauccuagucuagcauucugc

SEQ ID NO: 2084266 - RNA, 19 nt, Homo sapiens
auguauuuuugucauagca

SEQ ID NO: 2084267 - RNA, 23 nt, Homo sapiens
agcggggaggggaggaacaggga

SEQ ID NO: 2084268 - RNA, 19 nt, Homo sapiens
gucaccaggugaccagugg

SEQ ID NO: 2084269 - RNA, 19 nt, Homo sapiens
ucaaaauaagaaaauaacc

SEQ ID NO: 2084270 - RNA, 23 nt, Homo sapiens
agcugggcccaccgaggugcuau

SEQ ID NO: 2084271 - RNA, 13 nt, Homo sapiens
caugucuaaccug

SEQ ID NO: 2084272 - RNA, 13 nt, Homo sapiens
ugcuaaggcagcu

SEQ ID NO: 2084273 - RNA, 18 nt, Homo sapiens
uuccuugacuucuuugag

SEQ ID NO: 2084274 - RNA, 23 nt, Homo sapiens
aaaucaucuuuauuaaguagaug

SEQ ID NO: 2084275 - RNA, 23 nt, Homo sapiens
acuugugugugcgugucaguuac

SEQ ID NO: 2084276 - RNA, 21 nt, Homo sapiens
uuuucuguugccccauccacc

SEQ ID NO: 2084277 - RNA, 15 nt, Homo sapiens
aagcaauaaguucau

SEQ ID NO: 2084278 - RNA, 16 nt, Homo sapiens
aggaaaaaugaguaau

SEQ ID NO: 2084279 - RNA, 15 nt, Homo sapiens
acaccuugacagggc

SEQ ID NO: 2084280 - RNA, 17 nt, Homo sapiens
accuguggggccccaga

SEQ ID NO: 2084281 - RNA, 18 nt, Homo sapiens
uaccaagccccuuggccc

SEQ ID NO: 2084282 - RNA, 20 nt, Homo sapiens
uaacaacaauaacacugucu

SEQ ID NO: 2084283 - RNA, 21 nt, Homo sapiens
ucucccaggccaggcuccuuc

SEQ ID NO: 2084284 - RNA, 12 nt, Homo sapiens
gcugcuguguag

SEQ ID NO: 2084285 - RNA, 12 nt, Homo sapiens
ccagcugucuug

SEQ ID NO: 2084286 - RNA, 12 nt, Homo sapiens
auaauacauuaa

SEQ ID NO: 2084287 - RNA, 15 nt, Homo sapiens
gcuguccacacugaa

SEQ ID NO: 2084288 - RNA, 20 nt, Homo sapiens
uaguguauaaaaaccaugcu

SEQ ID NO: 2084289 - RNA, 14 nt, Homo sapiens
cacagcaucuguag

SEQ ID NO: 2084290 - RNA, 13 nt, Homo sapiens
gccuuccuccuca

SEQ ID NO: 2084291 - RNA, 16 nt, Homo sapiens
cuaagcauuagcuuua

SEQ ID NO: 2084292 - RNA, 12 nt, Homo sapiens
guugggcaauau

SEQ ID NO: 2084293 - RNA, 23 nt, Homo sapiens
auauaggccagaguugcaaagau

SEQ ID NO: 2084294 - RNA, 16 nt, Homo sapiens
gaacaaucaaggcaac

SEQ ID NO: 2084295 - RNA, 15 nt, Homo sapiens
agcagcugggauuac

SEQ ID NO: 2084296 - RNA, 20 nt, Homo sapiens
cagugcuccugugcagggau

SEQ ID NO: 2084297 - RNA, 17 nt, Homo sapiens
aaucuaccaguggugcu

SEQ ID NO: 2084298 - RNA, 13 nt, Homo sapiens
cucccacagcuuc

SEQ ID NO: 2084299 - RNA, 18 nt, Homo sapiens
uaaacuauuuauaucaca

SEQ ID NO: 2084300 - RNA, 21 nt, Homo sapiens
aggcugugacucuucucucaa

SEQ ID NO: 2084301 - RNA, 14 nt, Homo sapiens
uagcuacaucuaaa

SEQ ID NO: 2084302 - RNA, 17 nt, Homo sapiens
acugagguuuacauacg

SEQ ID NO: 2084303 - RNA, 21 nt, Homo sapiens
cugcuggcucccuuacuuuac

SEQ ID NO: 2084304 - RNA, 22 nt, Homo sapiens
agggucaccuagggaagcacuu

SEQ ID NO: 2084305 - RNA, 20 nt, Homo sapiens
caauauuuaguaaagcuuuu

SEQ ID NO: 2084306 - RNA, 22 nt, Homo sapiens
ccaucuuuugugagauguaauu

SEQ ID NO: 2084307 - RNA, 15 nt, Homo sapiens
uguguacaacuuaag

SEQ ID NO: 2084308 - RNA, 19 nt, Homo sapiens
accagcaugguaguggcaa

SEQ ID NO: 2084309 - RNA, 17 nt, Homo sapiens
auauguauauagacaug

SEQ ID NO: 2084310 - RNA, 13 nt, Homo sapiens
accaaagacugca

SEQ ID NO: 2084311 - RNA, 21 nt, Homo sapiens
aaaauuuuuuuuguaacugga

SEQ ID NO: 2084312 - RNA, 21 nt, Homo sapiens
aagaaaauguuacuucucuca

SEQ ID NO: 2084313 - RNA, 22 nt, Homo sapiens
ugggaugcggggcagagccacc

SEQ ID NO: 2084314 - RNA, 13 nt, Homo sapiens
uuucuuacguaca

SEQ ID NO: 2084315 - RNA, 21 nt, Homo sapiens
ggucuuucuacauaguuauuc

SEQ ID NO: 2084316 - RNA, 13 nt, Homo sapiens
uaaaccaacaaua

SEQ ID NO: 2084317 - RNA, 14 nt, Homo sapiens
agccccacagccca

SEQ ID NO: 2084318 - RNA, 14 nt, Homo sapiens
auauuaacauauuc

SEQ ID NO: 2084319 - RNA, 12 nt, Homo sapiens
uaauuaaaucca

SEQ ID NO: 2084320 - RNA, 16 nt, Homo sapiens
acgguccaauccagcc

SEQ ID NO: 2084321 - RNA, 21 nt, Homo sapiens
caagcuggaguacgugaaaug

SEQ ID NO: 2084322 - RNA, 19 nt, Homo sapiens
uggccacagaggacucacu

SEQ ID NO: 2084323 - RNA, 13 nt, Homo sapiens
uugggucuugggg

SEQ ID NO: 2084324 - RNA, 24 nt, Homo sapiens
aucuuauuugucaguguagaucaa

SEQ ID NO: 2084325 - RNA, 17 nt, Homo sapiens
aaagauacagacauuca

SEQ ID NO: 2084326 - RNA, 13 nt, Homo sapiens
uauauaccaagcu

SEQ ID NO: 2084327 - RNA, 13 nt, Homo sapiens
uuucaaccaugaa

SEQ ID NO: 2084328 - RNA, 21 nt, Homo sapiens
acaaaaaaagcauuguaacuu

SEQ ID NO: 2084329 - RNA, 15 nt, Homo sapiens
augucuugagcucua

SEQ ID NO: 2084330 - RNA, 24 nt, Homo sapiens
auaauucagagugguuucauugcc

SEQ ID NO: 2084331 - RNA, 14 nt, Homo sapiens
ccauauacauauau

SEQ ID NO: 2084332 - RNA, 15 nt, Homo sapiens
ggcauacacaugcac

SEQ ID NO: 2084333 - RNA, 17 nt, Homo sapiens
ccgcauuggugacucac

SEQ ID NO: 2084334 - RNA, 20 nt, Homo sapiens
acaggaauagaugugguccu

SEQ ID NO: 2084335 - RNA, 16 nt, Homo sapiens
aagcuaacagggaagg

SEQ ID NO: 2084336 - RNA, 16 nt, Homo sapiens
ucacaaccaccauuca

SEQ ID NO: 2084337 - RNA, 17 nt, Homo sapiens
aaauccagugaccucuc

SEQ ID NO: 2084338 - RNA, 18 nt, Homo sapiens
acauucaguucccaccau

SEQ ID NO: 2084339 - RNA, 17 nt, Homo sapiens
uaaaacagcauuagaua

SEQ ID NO: 2084340 - RNA, 23 nt, Homo sapiens
ugaccaaggacuaacauuuuuaa

SEQ ID NO: 2084341 - RNA, 16 nt, Homo sapiens
cagcccaggcacaacu

SEQ ID NO: 2084342 - RNA, 14 nt, Homo sapiens
caaacauuugccaa

SEQ ID NO: 2084343 - RNA, 9 nt, Homo sapiens
aaaauugca

SEQ ID NO: 2084344 - RNA, 21 nt, Homo sapiens
gggaccucgccugcuggggac

SEQ ID NO: 2084345 - RNA, 14 nt, Homo sapiens
aaaugucaguucau

SEQ ID NO: 2084346 - RNA, 12 nt, Homo sapiens
caagagaacuca

SEQ ID NO: 2084347 - RNA, 22 nt, Homo sapiens
gugucaccaauuccaccaagac

SEQ ID NO: 2084348 - RNA, 20 nt, Homo sapiens
auagcuccucaaagccucaa

SEQ ID NO: 2084349 - RNA, 14 nt, Homo sapiens
ccaaucaacagcag

SEQ ID NO: 2084350 - RNA, 18 nt, Homo sapiens
guccacugccuccaugau

SEQ ID NO: 2084351 - RNA, 16 nt, Homo sapiens
gagcacccaagccagg

SEQ ID NO: 2084352 - RNA, 20 nt, Homo sapiens
ugagaccuccacccacugug

SEQ ID NO: 2084353 - RNA, 20 nt, Homo sapiens
caucauccuaagcuauucag

SEQ ID NO: 2084354 - RNA, 19 nt, Homo sapiens
aucuacauaaggaugaagg

SEQ ID NO: 2084355 - RNA, 21 nt, Homo sapiens
acccagguauuacacaagcca

SEQ ID NO: 2084356 - RNA, 13 nt, Homo sapiens
caguggcacugaa

SEQ ID NO: 2084357 - RNA, 16 nt, Homo sapiens
uuucacccauuuacac

SEQ ID NO: 2084358 - RNA, 15 nt, Homo sapiens
aauaucgaguuccgg

SEQ ID NO: 2084359 - RNA, 15 nt, Homo sapiens
cuuugucugcuccca

SEQ ID NO: 2084360 - RNA, 14 nt, Homo sapiens
guacaugugugaaa

SEQ ID NO: 2084361 - RNA, 14 nt, Homo sapiens
gagggagacugcaa

SEQ ID NO: 2084362 - RNA, 13 nt, Homo sapiens
cucagagcucucu

SEQ ID NO: 2084363 - RNA, 18 nt, Homo sapiens
caccauucgucaucacuc

SEQ ID NO: 2084364 - RNA, 13 nt, Homo sapiens
acacacuggccau

SEQ ID NO: 2084365 - RNA, 19 nt, Homo sapiens
ucagggaccacagcaaggc

SEQ ID NO: 2084366 - RNA, 13 nt, Homo sapiens
agcuacaggacau

SEQ ID NO: 2084367 - RNA, 21 nt, Homo sapiens
aagcccaaguucaugcagcug

SEQ ID NO: 2084368 - RNA, 23 nt, Homo sapiens
auauuugcacaugggauugcuaa

SEQ ID NO: 2084369 - RNA, 18 nt, Homo sapiens
ggcaugggaaugaauguc

SEQ ID NO: 2084370 - RNA, 20 nt, Homo sapiens
aggaccgccugcccugccug

SEQ ID NO: 2084371 - RNA, 15 nt, Homo sapiens
cugacggacuucauu

SEQ ID NO: 2084372 - RNA, 18 nt, Homo sapiens
aaaguaucuaccuggaaa

SEQ ID NO: 2084373 - RNA, 18 nt, Homo sapiens
aagccaucggagcugcua

SEQ ID NO: 2084374 - RNA, 22 nt, Homo sapiens
aagaucaaggaguacaaugccc

SEQ ID NO: 2084375 - RNA, 13 nt, Homo sapiens
ccuugaaaacugc

SEQ ID NO: 2084376 - RNA, 17 nt, Homo sapiens
uauuuugagaagcucug

SEQ ID NO: 2084377 - RNA, 14 nt, Homo sapiens
acaaacugucuaaa

SEQ ID NO: 2084378 - RNA, 14 nt, Homo sapiens
aacauguucacuua

SEQ ID NO: 2084379 - RNA, 14 nt, Homo sapiens
aauaaguucauuaa

SEQ ID NO: 2084380 - RNA, 17 nt, Homo sapiens
gucuccuuucugacugu

SEQ ID NO: 2084381 - RNA, 13 nt, Homo sapiens
gugaacauuuuaa

SEQ ID NO: 2084382 - RNA, 11 nt, Homo sapiens
accaaggugac

SEQ ID NO: 2084383 - RNA, 15 nt, Homo sapiens
uucaggaagcagcuu

SEQ ID NO: 2084384 - RNA, 21 nt, Homo sapiens
ccuaccgcuggcccugccguu

SEQ ID NO: 2084385 - RNA, 12 nt, Homo sapiens
uuuuguuuacuu

SEQ ID NO: 2084386 - RNA, 15 nt, Homo sapiens
agacuacacaggaug

SEQ ID NO: 2084387 - RNA, 21 nt, Homo sapiens
uaacucgaauucucacaagga

SEQ ID NO: 2084388 - RNA, 23 nt, Homo sapiens
uuaacaugauaaaagacacuccc

SEQ ID NO: 2084389 - RNA, 23 nt, Homo sapiens
gaguuggacuucagucuugccua

SEQ ID NO: 2084390 - RNA, 16 nt, Homo sapiens
ccaccacuucuuuuau

SEQ ID NO: 2084391 - RNA, 20 nt, Homo sapiens
cugaucuucccaccucacag

SEQ ID NO: 2084392 - RNA, 18 nt, Homo sapiens
acggagucuugcucuguc

SEQ ID NO: 2084393 - RNA, 12 nt, Homo sapiens
uagcagaaggca

SEQ ID NO: 2084394 - RNA, 13 nt, Homo sapiens
uucuucuuuuugc

SEQ ID NO: 2084395 - RNA, 13 nt, Homo sapiens
acugccuuaccuu

SEQ ID NO: 2084396 - RNA, 14 nt, Homo sapiens
cuacugacuauauu

SEQ ID NO: 2084397 - RNA, 9 nt, Homo sapiens
gcauuucaa

SEQ ID NO: 2084398 - RNA, 23 nt, Homo sapiens
augguucccaauaucaugugauu

SEQ ID NO: 2084399 - RNA, 18 nt, Homo sapiens
aucauuucugcaucagcu

SEQ ID NO: 2084400 - RNA, 21 nt, Homo sapiens
aaagacuguagaagaaagagc

SEQ ID NO: 2084401 - RNA, 11 nt, Homo sapiens
guaaucugcau

SEQ ID NO: 2084402 - RNA, 15 nt, Homo sapiens
ucggauacuugccaa

SEQ ID NO: 2084403 - RNA, 18 nt, Homo sapiens
acagagcuucccugacuc

SEQ ID NO: 2084404 - RNA, 17 nt, Homo sapiens
cccugucuuccacagcc

SEQ ID NO: 2084405 - RNA, 20 nt, Homo sapiens
aggcauuucugggaagcccc

SEQ ID NO: 2084406 - RNA, 16 nt, Homo sapiens
cuuuaauccaguguua

SEQ ID NO: 2084407 - RNA, 16 nt, Homo sapiens
ggcccaggaccagcug

SEQ ID NO: 2084408 - RNA, 13 nt, Homo sapiens
ugcauuugugagg

SEQ ID NO: 2084409 - RNA, 23 nt, Homo sapiens
cagugaauuuuugcaauaaugca

SEQ ID NO: 2084410 - RNA, 13 nt, Homo sapiens
agcacaugcaccu

SEQ ID NO: 2084411 - RNA, 13 nt, Homo sapiens
aucauuuauuuga

SEQ ID NO: 2084412 - RNA, 20 nt, Homo sapiens
gaaaaggagucaagaacaau

SEQ ID NO: 2084413 - RNA, 22 nt, Homo sapiens
cuuaacauuucuaacucugaug

SEQ ID NO: 2084414 - RNA, 21 nt, Homo sapiens
gcucuuggaggugucuguauc

SEQ ID NO: 2084415 - RNA, 13 nt, Homo sapiens
ggagcaacagagg

SEQ ID NO: 2084416 - RNA, 13 nt, Homo sapiens
gcuggaacacugc

SEQ ID NO: 2084417 - RNA, 17 nt, Homo sapiens
cacugggcucacugcag

SEQ ID NO: 2084418 - RNA, 17 nt, Homo sapiens
uuguaaguugaagcaaa

SEQ ID NO: 2084419 - RNA, 15 nt, Homo sapiens
aauaauuauguuuac

SEQ ID NO: 2084420 - RNA, 18 nt, Homo sapiens
auuaagagucuacucuca

SEQ ID NO: 2084421 - RNA, 14 nt, Homo sapiens
uugcauuucuguau

SEQ ID NO: 2084422 - RNA, 17 nt, Homo sapiens
uccucagaaaaaacagg

SEQ ID NO: 2084423 - RNA, 16 nt, Homo sapiens
gagauuucucauugau

SEQ ID NO: 2084424 - RNA, 17 nt, Homo sapiens
uaacuuauaucaucagc

SEQ ID NO: 2084425 - RNA, 17 nt, Homo sapiens
uuuucuguuuauuuugc

SEQ ID NO: 2084426 - RNA, 13 nt, Homo sapiens
ccugagcugccac

SEQ ID NO: 2084427 - RNA, 18 nt, Homo sapiens
cagugcgguacucaguaa

SEQ ID NO: 2084428 - RNA, 17 nt, Homo sapiens
uugucucccagcucagg

SEQ ID NO: 2084429 - RNA, 19 nt, Homo sapiens
ccugagccccucaauccua

SEQ ID NO: 2084430 - RNA, 15 nt, Homo sapiens
auguauguccauuca

SEQ ID NO: 2084431 - RNA, 23 nt, Homo sapiens
agcugcauaugccuacaaagcuc

SEQ ID NO: 2084432 - RNA, 12 nt, Homo sapiens
auacauuuacug

SEQ ID NO: 2084433 - RNA, 19 nt, Homo sapiens
aauggcaucaauauacaua

SEQ ID NO: 2084434 - RNA, 15 nt, Homo sapiens
guggcgcuuucugca

SEQ ID NO: 2084435 - RNA, 13 nt, Homo sapiens
ccuuuuucaauga

SEQ ID NO: 2084436 - RNA, 20 nt, Homo sapiens
auaguugagaugucaagaag

SEQ ID NO: 2084437 - RNA, 18 nt, Homo sapiens
ugugugaacuaacaugca

SEQ ID NO: 2084438 - RNA, 18 nt, Homo sapiens
gcuuucuaaaguuaccug

SEQ ID NO: 2084439 - RNA, 19 nt, Homo sapiens
ggcucaacuccuccuuuau

SEQ ID NO: 2084440 - RNA, 16 nt, Homo sapiens
uagaacugucugugaa

SEQ ID NO: 2084441 - RNA, 18 nt, Homo sapiens
aaagugaugauacuguaa

SEQ ID NO: 2084442 - RNA, 16 nt, Homo sapiens
ucacauuuauuuggua

SEQ ID NO: 2084443 - RNA, 21 nt, Homo sapiens
augcugaggccacccacugac

SEQ ID NO: 2084444 - RNA, 16 nt, Homo sapiens
cuguugaaaugugaau

SEQ ID NO: 2084445 - RNA, 16 nt, Homo sapiens
aaaguggacaaggagu

SEQ ID NO: 2084446 - RNA, 17 nt, Homo sapiens
cacaugucaguaccuuc

SEQ ID NO: 2084447 - RNA, 9 nt, Homo sapiens
cuauacuug

SEQ ID NO: 2084448 - RNA, 15 nt, Homo sapiens
caaaaaugauuuagu

SEQ ID NO: 2084449 - RNA, 23 nt, Homo sapiens
cggaggaggcuggugacaggcca

SEQ ID NO: 2084450 - RNA, 22 nt, Homo sapiens
gaacaccgugggcuguuacuug

SEQ ID NO: 2084451 - RNA, 16 nt, Homo sapiens
aauuuucugugccaaa

SEQ ID NO: 2084452 - RNA, 21 nt, Homo sapiens
aacuugauccauuucuaauua

SEQ ID NO: 2084453 - RNA, 22 nt, Homo sapiens
guguuguaucaaagugugauau

SEQ ID NO: 2084454 - RNA, 16 nt, Homo sapiens
ccuauaaaauugucaa

SEQ ID NO: 2084455 - RNA, 14 nt, Homo sapiens
aagauauccacuua

SEQ ID NO: 2084456 - RNA, 13 nt, Homo sapiens
gcagaggcagcag

SEQ ID NO: 2084457 - RNA, 14 nt, Homo sapiens
aaaucucacucuag

SEQ ID NO: 2084458 - RNA, 21 nt, Homo sapiens
cgaaugcggugcaaaauuucc

SEQ ID NO: 2084459 - RNA, 19 nt, Homo sapiens
cccaacuucauacuggcag

SEQ ID NO: 2084460 - RNA, 20 nt, Homo sapiens
acccugagggcggggugucu

SEQ ID NO: 2084461 - RNA, 23 nt, Homo sapiens
aaauuaaaccggaccaucucucc

SEQ ID NO: 2084462 - RNA, 23 nt, Homo sapiens
gagaugaaauucaaauaaccuaa

SEQ ID NO: 2084463 - RNA, 12 nt, Homo sapiens
ggcuggggaccc

SEQ ID NO: 2084464 - RNA, 13 nt, Homo sapiens
accagaugcugaa

SEQ ID NO: 2084465 - RNA, 18 nt, Homo sapiens
cgaaaucuuagugcccac

SEQ ID NO: 2084466 - RNA, 12 nt, Homo sapiens
gguggcaauaaa

SEQ ID NO: 2084467 - RNA, 20 nt, Homo sapiens
uaucaaaaaguacaauaaua

SEQ ID NO: 2084468 - RNA, 23 nt, Homo sapiens
agccuguucauggcagauguagg

SEQ ID NO: 2084469 - RNA, 23 nt, Homo sapiens
acacaucucccuuuuccaugacu

SEQ ID NO: 2084470 - RNA, 15 nt, Homo sapiens
guaagcauguuguua

SEQ ID NO: 2084471 - RNA, 17 nt, Homo sapiens
aaguauauauucuacac

SEQ ID NO: 2084472 - RNA, 22 nt, Homo sapiens
uaagcacuagaucucccuuaau

SEQ ID NO: 2084473 - RNA, 22 nt, Homo sapiens
augauuuuuguguauccaguau

SEQ ID NO: 2084474 - RNA, 22 nt, Homo sapiens
aacuauugagccuugcauguac

SEQ ID NO: 2084475 - RNA, 21 nt, Homo sapiens
uuccugaaaagcugcauuuaa

SEQ ID NO: 2084476 - RNA, 10 nt, Homo sapiens
cugcccugug

SEQ ID NO: 2084477 - RNA, 18 nt, Homo sapiens
auuaaagguggugccaau

SEQ ID NO: 2084478 - RNA, 23 nt, Homo sapiens
aaauuucagggaaaacagaagca

SEQ ID NO: 2084479 - RNA, 21 nt, Homo sapiens
aacaacccuguugaguauuug

SEQ ID NO: 2084480 - RNA, 17 nt, Homo sapiens
ucauaccuaaguacugu

SEQ ID NO: 2084481 - RNA, 22 nt, Homo sapiens
cuuuuaguucuuagagcacuuu

SEQ ID NO: 2084482 - RNA, 22 nt, Homo sapiens
guauuauuuuacaaucaacaaa

SEQ ID NO: 2084483 - RNA, 21 nt, Homo sapiens
aguuuuuauuaaacucauggg

SEQ ID NO: 2084484 - RNA, 20 nt, Homo sapiens
gagauauggcuaguggcaau

SEQ ID NO: 2084485 - RNA, 13 nt, Homo sapiens
gaacuaaccaaau

SEQ ID NO: 2084486 - RNA, 21 nt, Homo sapiens
auacucuuuuuucauggacac

SEQ ID NO: 2084487 - RNA, 18 nt, Homo sapiens
uucuuaaaaaacauauau

SEQ ID NO: 2084488 - RNA, 17 nt, Homo sapiens
aaauucaguggacauuu

SEQ ID NO: 2084489 - RNA, 15 nt, Homo sapiens
cuucuaacacaaaau

SEQ ID NO: 2084490 - RNA, 19 nt, Homo sapiens
ccucuaguuuuaagacuga

SEQ ID NO: 2084491 - RNA, 19 nt, Homo sapiens
cuuuugcuauggagcaaau

SEQ ID NO: 2084492 - RNA, 14 nt, Homo sapiens
augacccacacugc

SEQ ID NO: 2084493 - RNA, 16 nt, Homo sapiens
gaguguccucuucccu

SEQ ID NO: 2084494 - RNA, 13 nt, Homo sapiens
aguuugauuucau

SEQ ID NO: 2084495 - RNA, 21 nt, Homo sapiens
agcaggacucugcccagacca

SEQ ID NO: 2084496 - RNA, 15 nt, Homo sapiens
gcacacccauucaca

SEQ ID NO: 2084497 - RNA, 20 nt, Homo sapiens
ucuucuagcauuucuuccaa

SEQ ID NO: 2084498 - RNA, 21 nt, Homo sapiens
auucaugcaacuugauucuug

SEQ ID NO: 2084499 - RNA, 20 nt, Homo sapiens
ugggaaauaugccacugacc

SEQ ID NO: 2084500 - RNA, 14 nt, Homo sapiens
ggacuucugcaucu

SEQ ID NO: 2084501 - RNA, 18 nt, Homo sapiens
aaaccugaugcagugcuc

SEQ ID NO: 2084502 - RNA, 22 nt, Homo sapiens
ucugaucauccacugugccaug

SEQ ID NO: 2084503 - RNA, 14 nt, Homo sapiens
acuacagaguguua

SEQ ID NO: 2084504 - RNA, 16 nt, Homo sapiens
aggggucagggaccaa

SEQ ID NO: 2084505 - RNA, 13 nt, Homo sapiens
cuuggaucugcca

SEQ ID NO: 2084506 - RNA, 14 nt, Homo sapiens
cagggcuggucuuu

SEQ ID NO: 2084507 - RNA, 20 nt, Homo sapiens
uaagcaguauauuaguauua

SEQ ID NO: 2084508 - RNA, 10 nt, Homo sapiens
aagcaaaaag

SEQ ID NO: 2084509 - RNA, 19 nt, Homo sapiens
accagucccgucgugcagu

SEQ ID NO: 2084510 - RNA, 14 nt, Homo sapiens
cuuaagcaaaagaa

SEQ ID NO: 2084511 - RNA, 9 nt, Homo sapiens
aggcccaag

SEQ ID NO: 2084512 - RNA, 12 nt, Homo sapiens
gugccacccgca

SEQ ID NO: 2084513 - RNA, 16 nt, Homo sapiens
gaagcuuuaagcaaau

SEQ ID NO: 2084514 - RNA, 21 nt, Homo sapiens
ccugugguggucuguguaaug

SEQ ID NO: 2084515 - RNA, 20 nt, Homo sapiens
guagcaaauuaacuuuacau

SEQ ID NO: 2084516 - RNA, 17 nt, Homo sapiens
aauuuucgguaagucua

SEQ ID NO: 2084517 - RNA, 14 nt, Homo sapiens
aaauguaaagccau

SEQ ID NO: 2084518 - RNA, 14 nt, Homo sapiens
aaaugaaaagccaa

SEQ ID NO: 2084519 - RNA, 18 nt, Homo sapiens
acucuugccaaccuguaa

SEQ ID NO: 2084520 - RNA, 19 nt, Homo sapiens
ugacuccccccuuccaaau

SEQ ID NO: 2084521 - RNA, 21 nt, Homo sapiens
aagcucaguuaaaucccccac

SEQ ID NO: 2084522 - RNA, 16 nt, Homo sapiens
guuuaguuacuauuac

SEQ ID NO: 2084523 - RNA, 12 nt, Homo sapiens
auccaauggauu

SEQ ID NO: 2084524 - RNA, 16 nt, Homo sapiens
uggggcuguucauggc

SEQ ID NO: 2084525 - RNA, 11 nt, Homo sapiens
acaagugucug

SEQ ID NO: 2084526 - RNA, 20 nt, Homo sapiens
uguaaauaaccacacugaaa

SEQ ID NO: 2084527 - RNA, 18 nt, Homo sapiens
agacacuucauggaccaa

SEQ ID NO: 2084528 - RNA, 15 nt, Homo sapiens
gcuuccuacaaagac

SEQ ID NO: 2084529 - RNA, 14 nt, Homo sapiens
gauuuuaccaaagc

SEQ ID NO: 2084530 - RNA, 17 nt, Homo sapiens
gcaaagccuucauugcc

SEQ ID NO: 2084531 - RNA, 15 nt, Homo sapiens
cagcaaccuauaaaa

SEQ ID NO: 2084532 - RNA, 18 nt, Homo sapiens
gaccucagcuugcacaaa

SEQ ID NO: 2084533 - RNA, 19 nt, Homo sapiens
cagcugcugguuuugguuu

SEQ ID NO: 2084534 - RNA, 16 nt, Homo sapiens
uacaugcuggggucaa

SEQ ID NO: 2084535 - RNA, 20 nt, Homo sapiens
uccuuuggguauguuaaccu

SEQ ID NO: 2084536 - RNA, 16 nt, Homo sapiens
caccccgagggcugag

SEQ ID NO: 2084537 - RNA, 22 nt, Homo sapiens
cagccugucucuccuuguugcc

SEQ ID NO: 2084538 - RNA, 16 nt, Homo sapiens
uacauucugcuuucau

SEQ ID NO: 2084539 - RNA, 15 nt, Homo sapiens
uuuugccaacccugu

SEQ ID NO: 2084540 - RNA, 21 nt, Homo sapiens
gaaacuuauuucucauaucaa

SEQ ID NO: 2084541 - RNA, 22 nt, Homo sapiens
agccuucucuguucauuuccuc

SEQ ID NO: 2084542 - RNA, 17 nt, Homo sapiens
gugguccuuccuaccuc

SEQ ID NO: 2084543 - RNA, 16 nt, Homo sapiens
gaccuaggcucaugga

SEQ ID NO: 2084544 - RNA, 16 nt, Homo sapiens
agguugaagaaugaga

SEQ ID NO: 2084545 - RNA, 19 nt, Homo sapiens
agaggcagggaagcucuac

SEQ ID NO: 2084546 - RNA, 15 nt, Homo sapiens
caucauggcagugau

SEQ ID NO: 2084547 - RNA, 16 nt, Homo sapiens
cagugcagcauauaca

SEQ ID NO: 2084548 - RNA, 18 nt, Homo sapiens
aaaagacaaaaaccaagu

SEQ ID NO: 2084549 - RNA, 17 nt, Homo sapiens
cacuucaaaacaguauu

SEQ ID NO: 2084550 - RNA, 13 nt, Homo sapiens
ggagacuaaagau

SEQ ID NO: 2084551 - RNA, 21 nt, Homo sapiens
cuaacaagauuuguaauuaca

SEQ ID NO: 2084552 - RNA, 14 nt, Homo sapiens
ccauguuaaaugac

SEQ ID NO: 2084553 - RNA, 19 nt, Homo sapiens
agaccgaaaaguugcugaa

SEQ ID NO: 2084554 - RNA, 17 nt, Homo sapiens
uuaucgaaauaacaaug

SEQ ID NO: 2084555 - RNA, 17 nt, Homo sapiens
uuaacacucuaagagaa

SEQ ID NO: 2084556 - RNA, 15 nt, Homo sapiens
uaccuuuucuuggga

SEQ ID NO: 2084557 - RNA, 23 nt, Homo sapiens
cuucaggaacuggggcuuugccu

SEQ ID NO: 2084558 - RNA, 22 nt, Homo sapiens
auuauguuuugcauguaugacu

SEQ ID NO: 2084559 - RNA, 12 nt, Homo sapiens
auuguuguguag

SEQ ID NO: 2084560 - RNA, 18 nt, Homo sapiens
aaugugugaaguaugcac

SEQ ID NO: 2084561 - RNA, 17 nt, Homo sapiens
auauucagaaaaugaag

SEQ ID NO: 2084562 - RNA, 20 nt, Homo sapiens
ugccugaucugcacauuuca

SEQ ID NO: 2084563 - RNA, 12 nt, Homo sapiens
gugcagacucaa

SEQ ID NO: 2084564 - RNA, 20 nt, Homo sapiens
ccaguguguuucugaucuga

SEQ ID NO: 2084565 - RNA, 18 nt, Homo sapiens
cugaaauuaaaguaugca

SEQ ID NO: 2084566 - RNA, 13 nt, Homo sapiens
aauacauguucau

SEQ ID NO: 2084567 - RNA, 18 nt, Homo sapiens
uuguuuaaacaaucuuuc

SEQ ID NO: 2084568 - RNA, 18 nt, Homo sapiens
acagaauacaagccacua

SEQ ID NO: 2084569 - RNA, 14 nt, Homo sapiens
cuugcaagccauaa

SEQ ID NO: 2084570 - RNA, 15 nt, Homo sapiens
gaacacagugcuauu

SEQ ID NO: 2084571 - RNA, 18 nt, Homo sapiens
uggcaguggaacaugcaa

SEQ ID NO: 2084572 - RNA, 23 nt, Homo sapiens
uccccuccuugccuccuguguaa

SEQ ID NO: 2084573 - RNA, 21 nt, Homo sapiens
uaugcaaaccucaucuuucuc

SEQ ID NO: 2084574 - RNA, 14 nt, Homo sapiens
uuguauaugcauuc

SEQ ID NO: 2084575 - RNA, 15 nt, Homo sapiens
gcuagagugacucac

SEQ ID NO: 2084576 - RNA, 23 nt, Homo sapiens
cugucacagaguagaaacucaaa

SEQ ID NO: 2084577 - RNA, 18 nt, Homo sapiens
uauaaagaacuuguguag

SEQ ID NO: 2084578 - RNA, 21 nt, Homo sapiens
aauuucuacuucuggaaguca

SEQ ID NO: 2084579 - RNA, 20 nt, Homo sapiens
auucugcaccucuuggcucg

SEQ ID NO: 2084580 - RNA, 16 nt, Homo sapiens
aaccuuaaauacacug

SEQ ID NO: 2084581 - RNA, 22 nt, Homo sapiens
uagucugcauauauuaaagcau

SEQ ID NO: 2084582 - RNA, 16 nt, Homo sapiens
gaagaggccuucccau

SEQ ID NO: 2084583 - RNA, 20 nt, Homo sapiens
cacauacgugucugugugua

SEQ ID NO: 2084584 - RNA, 19 nt, Homo sapiens
augcagagguccacaacac

SEQ ID NO: 2084585 - RNA, 14 nt, Homo sapiens
aucauuugagcuca

SEQ ID NO: 2084586 - RNA, 16 nt, Homo sapiens
cagcacacagggcagu

SEQ ID NO: 2084587 - RNA, 18 nt, Homo sapiens
uaaaaaaauuccaaguga

SEQ ID NO: 2084588 - RNA, 13 nt, Homo sapiens
acucaacaauaaa

SEQ ID NO: 2084589 - RNA, 18 nt, Homo sapiens
uggccaugcuucuugccc

SEQ ID NO: 2084590 - RNA, 20 nt, Homo sapiens
uagugcaaaaacuguaaaag

SEQ ID NO: 2084591 - RNA, 13 nt, Homo sapiens
uuauuaaguaaaa

SEQ ID NO: 2084592 - RNA, 23 nt, Homo sapiens
aaauguuuucauuuuacugguau

SEQ ID NO: 2084593 - RNA, 15 nt, Homo sapiens
cuuuacauaugcuuu

SEQ ID NO: 2084594 - RNA, 19 nt, Homo sapiens
uaagaauuuuugaagugac

SEQ ID NO: 2084595 - RNA, 19 nt, Homo sapiens
cuuucuuaccaucugagcc

SEQ ID NO: 2084596 - RNA, 22 nt, Homo sapiens
uuaaaccacacacacaaggugc

SEQ ID NO: 2084597 - RNA, 19 nt, Homo sapiens
aggacagcuacacgcugac

SEQ ID NO: 2084598 - RNA, 15 nt, Homo sapiens
gauguggagugagaa

SEQ ID NO: 2084599 - RNA, 16 nt, Homo sapiens
gaaaauaaacaucagu

SEQ ID NO: 2084600 - RNA, 20 nt, Homo sapiens
gauuuucuaagaaccaaaaa

SEQ ID NO: 2084601 - RNA, 16 nt, Homo sapiens
gguuaacuuggucaga

SEQ ID NO: 2084602 - RNA, 15 nt, Homo sapiens
agauccggcagcaca

SEQ ID NO: 2084603 - RNA, 17 nt, Homo sapiens
guuucuccaaguacuuu

SEQ ID NO: 2084604 - RNA, 22 nt, Homo sapiens
caugcuccagauuagagccugu

SEQ ID NO: 2084605 - RNA, 12 nt, Homo sapiens
ugaucagacuga

SEQ ID NO: 2084606 - RNA, 22 nt, Homo sapiens
agagaggcacgugccugucuca

SEQ ID NO: 2084607 - RNA, 18 nt, Homo sapiens
gcaauucuucugccucag

SEQ ID NO: 2084608 - RNA, 21 nt, Homo sapiens
aaacuuggauuugcucagugu

SEQ ID NO: 2084609 - RNA, 20 nt, Homo sapiens
gaucuaagccuuuccauaag

SEQ ID NO: 2084610 - RNA, 14 nt, Homo sapiens
ucaacauaccuugg

SEQ ID NO: 2084611 - RNA, 11 nt, Homo sapiens
ccauucucuga

SEQ ID NO: 2084612 - RNA, 15 nt, Homo sapiens
ccacauauauuucca

SEQ ID NO: 2084613 - RNA, 23 nt, Homo sapiens
ccucaggcagcagcuuuuccacc

SEQ ID NO: 2084614 - RNA, 21 nt, Homo sapiens
ccaccuacuuuucuuuccuca

SEQ ID NO: 2084615 - RNA, 20 nt, Homo sapiens
uuaaaaaaagaaaacuuuaa

SEQ ID NO: 2084616 - RNA, 14 nt, Homo sapiens
gguacaauuguaaa

SEQ ID NO: 2084617 - RNA, 15 nt, Homo sapiens
gcauauuaaaaguca

SEQ ID NO: 2084618 - RNA, 15 nt, Homo sapiens
uuaaagacagucaua

SEQ ID NO: 2084619 - RNA, 13 nt, Homo sapiens
cggcucacugcaa

SEQ ID NO: 2084620 - RNA, 20 nt, Homo sapiens
caaaguagccagcuggucuu

SEQ ID NO: 2084621 - RNA, 21 nt, Homo sapiens
aucaguucuacggaucaucaa

SEQ ID NO: 2084622 - RNA, 18 nt, Homo sapiens
uaauccaauauuuugccu

SEQ ID NO: 2084623 - RNA, 23 nt, Homo sapiens
caggccaguuugaagacuacaug

SEQ ID NO: 2084624 - RNA, 12 nt, Homo sapiens
guguuuugccau

SEQ ID NO: 2084625 - RNA, 20 nt, Homo sapiens
ccgggaacagagaagugugg

SEQ ID NO: 2084626 - RNA, 15 nt, Homo sapiens
gugaaagaggcagcu

SEQ ID NO: 2084627 - RNA, 11 nt, Homo sapiens
auaucagggca

SEQ ID NO: 2084628 - RNA, 23 nt, Homo sapiens
aauggguuugcuagaaugugaua

SEQ ID NO: 2084629 - RNA, 16 nt, Homo sapiens
gugcucugaugcaaua

SEQ ID NO: 2084630 - RNA, 17 nt, Homo sapiens
gaacuuuaaaaaauaaa

SEQ ID NO: 2084631 - RNA, 22 nt, Homo sapiens
cccagugcagcucgugauugga

SEQ ID NO: 2084632 - RNA, 18 nt, Homo sapiens
ccaacagcagugaucuca

SEQ ID NO: 2084633 - RNA, 15 nt, Homo sapiens
uuccugauguugaua

SEQ ID NO: 2084634 - RNA, 21 nt, Homo sapiens
caaaaaauauauaucacucua

SEQ ID NO: 2084635 - RNA, 14 nt, Homo sapiens
agaccaucuuggcc

SEQ ID NO: 2084636 - RNA, 14 nt, Homo sapiens
ccugccucugccca

SEQ ID NO: 2084637 - RNA, 22 nt, Homo sapiens
cugugaaaaaccugaugcagug

SEQ ID NO: 2084638 - RNA, 20 nt, Homo sapiens
ucugacccaaagcaaaacau

SEQ ID NO: 2084639 - RNA, 21 nt, Homo sapiens
auuuucuuguauauuuugcua

SEQ ID NO: 2084640 - RNA, 17 nt, Homo sapiens
aagcauuucaggccagu

SEQ ID NO: 2084641 - RNA, 17 nt, Homo sapiens
caugguuuaaagucaca

SEQ ID NO: 2084642 - RNA, 23 nt, Homo sapiens
cagcaccgccggcuuucagggca

SEQ ID NO: 2084643 - RNA, 18 nt, Homo sapiens
cuauuuaucugaucaaga

SEQ ID NO: 2084644 - RNA, 16 nt, Homo sapiens
cuuccuguuacugaga

SEQ ID NO: 2084645 - RNA, 10 nt, Homo sapiens
caagagggug

SEQ ID NO: 2084646 - RNA, 20 nt, Homo sapiens
gaagggacugggaggggaga

SEQ ID NO: 2084647 - RNA, 14 nt, Homo sapiens
aaggucugaucucc

SEQ ID NO: 2084648 - RNA, 19 nt, Homo sapiens
aguugaucuggaacccaga

SEQ ID NO: 2084649 - RNA, 15 nt, Homo sapiens
cuccaacuccagcug

SEQ ID NO: 2084650 - RNA, 18 nt, Homo sapiens
guuccugaacaugaugac

SEQ ID NO: 2084651 - RNA, 20 nt, Homo sapiens
gaugaaggcuugucagcacu

SEQ ID NO: 2084652 - RNA, 17 nt, Homo sapiens
ugcacccucaaccuccu

SEQ ID NO: 2084653 - RNA, 14 nt, Homo sapiens
cgcaucuugccucc

SEQ ID NO: 2084654 - RNA, 23 nt, Homo sapiens
ugauauuucccuccccuggggac

SEQ ID NO: 2084655 - RNA, 20 nt, Homo sapiens
aucaguggggccccaaagcc

SEQ ID NO: 2084656 - RNA, 22 nt, Homo sapiens
ccaggcucccucccucccagau

SEQ ID NO: 2084657 - RNA, 23 nt, Homo sapiens
acagugcauacagccuuugccau

SEQ ID NO: 2084658 - RNA, 13 nt, Homo sapiens
acaggugugaacc

SEQ ID NO: 2084659 - RNA, 22 nt, Homo sapiens
aucaugguacauuuaucacuga

SEQ ID NO: 2084660 - RNA, 18 nt, Homo sapiens
gccccuucuccucugggg

SEQ ID NO: 2084661 - RNA, 19 nt, Homo sapiens
gauaauggugaacauuuua

SEQ ID NO: 2084662 - RNA, 15 nt, Homo sapiens
gccugggauggggcu

SEQ ID NO: 2084663 - RNA, 20 nt, Homo sapiens
uccgaugcugaggccaccca

SEQ ID NO: 2084664 - RNA, 11 nt, Homo sapiens
ggcugcacaga

SEQ ID NO: 2084665 - RNA, 20 nt, Homo sapiens
uaaucagccucgcucuuguc

SEQ ID NO: 2084666 - RNA, 13 nt, Homo sapiens
cauuuuacaagca

SEQ ID NO: 2084667 - RNA, 13 nt, Homo sapiens
auucauaccuguu

SEQ ID NO: 2084668 - RNA, 15 nt, Homo sapiens
gugauugguugcauc

SEQ ID NO: 2084669 - RNA, 19 nt, Homo sapiens
ugguucaggaaaacuacug

SEQ ID NO: 2084670 - RNA, 14 nt, Homo sapiens
auauuaaagugcua

SEQ ID NO: 2084671 - RNA, 20 nt, Homo sapiens
cagccccucuaccuccugga

SEQ ID NO: 2084672 - RNA, 13 nt, Homo sapiens
uuauaaguaacuu

SEQ ID NO: 2084673 - RNA, 17 nt, Homo sapiens
gagguuauguguucuaa

SEQ ID NO: 2084674 - RNA, 21 nt, Homo sapiens
guaccaaauccacaagccauu

SEQ ID NO: 2084675 - RNA, 19 nt, Homo sapiens
cagcgaguacuucccgcug

SEQ ID NO: 2084676 - RNA, 20 nt, Homo sapiens
cugaagucuuuguacagaca

SEQ ID NO: 2084677 - RNA, 14 nt, Homo sapiens
uauauauuccuuac

SEQ ID NO: 2084678 - RNA, 18 nt, Homo sapiens
uggcugugccugcuucug

SEQ ID NO: 2084679 - RNA, 15 nt, Homo sapiens
agcacuugaugccac

SEQ ID NO: 2084680 - RNA, 16 nt, Homo sapiens
gacuaacccaaugccu

SEQ ID NO: 2084681 - RNA, 13 nt, Homo sapiens
acccuggacuucu

SEQ ID NO: 2084682 - RNA, 14 nt, Homo sapiens
agcuggagugcagu

SEQ ID NO: 2084683 - RNA, 16 nt, Homo sapiens
caauaaaaacugucug

SEQ ID NO: 2084684 - RNA, 14 nt, Homo sapiens
caacagguguguuu

SEQ ID NO: 2084685 - RNA, 14 nt, Homo sapiens
uggcuggcacugag

SEQ ID NO: 2084686 - RNA, 23 nt, Homo sapiens
cccaggguuacagcaagagccac

SEQ ID NO: 2084687 - RNA, 22 nt, Homo sapiens
aguguccuggcugugaaugcca

SEQ ID NO: 2084688 - RNA, 15 nt, Homo sapiens
gucucgcagccugaa

SEQ ID NO: 2084689 - RNA, 18 nt, Homo sapiens
gaauagaggggcauucac

SEQ ID NO: 2084690 - RNA, 21 nt, Homo sapiens
gaagagcuccccuccacagcu

SEQ ID NO: 2084691 - RNA, 22 nt, Homo sapiens
uccucaauucaauguggugaug

SEQ ID NO: 2084692 - RNA, 16 nt, Homo sapiens
cuuguuguuucuugcc

SEQ ID NO: 2084693 - RNA, 17 nt, Homo sapiens
cuuggacagcaaggugg

SEQ ID NO: 2084694 - RNA, 21 nt, Homo sapiens
uggaaauauguaaugcuucca

SEQ ID NO: 2084695 - RNA, 21 nt, Homo sapiens
aagugcugccgcgcagugugg

SEQ ID NO: 2084696 - RNA, 19 nt, Homo sapiens
uccuccuggcuuccagggg

SEQ ID NO: 2084697 - RNA, 15 nt, Homo sapiens
acuauaacauucaau

SEQ ID NO: 2084698 - RNA, 15 nt, Homo sapiens
uugucugugugcuac

SEQ ID NO: 2084699 - RNA, 22 nt, Homo sapiens
acuauccaaucugugaugacau

SEQ ID NO: 2084700 - RNA, 18 nt, Homo sapiens
uccuuccuuuucuuugag

SEQ ID NO: 2084701 - RNA, 23 nt, Homo sapiens
ugauuacccagagauaucuauga

SEQ ID NO: 2084702 - RNA, 15 nt, Homo sapiens
gauuugaacuugcuc

SEQ ID NO: 2084703 - RNA, 14 nt, Homo sapiens
acaucaaggcucuu

SEQ ID NO: 2084704 - RNA, 14 nt, Homo sapiens
cucauaggcaaguc

SEQ ID NO: 2084705 - RNA, 16 nt, Homo sapiens
agucuccagauguuaa

SEQ ID NO: 2084706 - RNA, 21 nt, Homo sapiens
gaaguucuuugauucuguaau

SEQ ID NO: 2084707 - RNA, 14 nt, Homo sapiens
agcaggcaccagca

SEQ ID NO: 2084708 - RNA, 19 nt, Homo sapiens
auuguuagaaaucccuguc

SEQ ID NO: 2084709 - RNA, 18 nt, Homo sapiens
acugugcacuuugcucaa

SEQ ID NO: 2084710 - RNA, 16 nt, Homo sapiens
ucugaugucuucuuac

SEQ ID NO: 2084711 - RNA, 13 nt, Homo sapiens
aacaccuccuagc

SEQ ID NO: 2084712 - RNA, 18 nt, Homo sapiens
cccagaaugagacaucca

SEQ ID NO: 2084713 - RNA, 22 nt, Homo sapiens
accaaaugccuuucuagcaauu

SEQ ID NO: 2084714 - RNA, 18 nt, Homo sapiens
aagaaggcucacagauuu

SEQ ID NO: 2084715 - RNA, 14 nt, Homo sapiens
ggauugacucugca

SEQ ID NO: 2084716 - RNA, 19 nt, Homo sapiens
gaaaauuuuugucuuucau

SEQ ID NO: 2084717 - RNA, 23 nt, Homo sapiens
guuugguagacuuggacaucucu

SEQ ID NO: 2084718 - RNA, 15 nt, Homo sapiens
aggugacauuugcuc

SEQ ID NO: 2084719 - RNA, 20 nt, Homo sapiens
ucaucuccccaucauuggua

SEQ ID NO: 2084720 - RNA, 23 nt, Homo sapiens
gagaaaggggcaagaaauucauu

SEQ ID NO: 2084721 - RNA, 18 nt, Homo sapiens
guauauagugaugugcua

SEQ ID NO: 2084722 - RNA, 21 nt, Homo sapiens
caucauaauuacauuccuaac

SEQ ID NO: 2084723 - RNA, 19 nt, Homo sapiens
gcuucagauaccaugcaau

SEQ ID NO: 2084724 - RNA, 15 nt, Homo sapiens
aguuuugacaucagc

SEQ ID NO: 2084725 - RNA, 12 nt, Homo sapiens
auuguacuuaaa

SEQ ID NO: 2084726 - RNA, 19 nt, Homo sapiens
cggugauauugugcaugca

SEQ ID NO: 2084727 - RNA, 22 nt, Homo sapiens
aaccuagucagguuagcugaac

SEQ ID NO: 2084728 - RNA, 16 nt, Homo sapiens
acuuagaaaccaaauu

SEQ ID NO: 2084729 - RNA, 14 nt, Homo sapiens
cuucucaaagcacu

SEQ ID NO: 2084730 - RNA, 18 nt, Homo sapiens
aucaucaccacaccguga

SEQ ID NO: 2084731 - RNA, 15 nt, Homo sapiens
ccaguucugucuuca

SEQ ID NO: 2084732 - RNA, 18 nt, Homo sapiens
aagaguguuuauacagua

SEQ ID NO: 2084733 - RNA, 16 nt, Homo sapiens
accacuuugccucuga

SEQ ID NO: 2084734 - RNA, 22 nt, Homo sapiens
cauuuuacccuuggcucaaucc

SEQ ID NO: 2084735 - RNA, 20 nt, Homo sapiens
ugccggacacagagggggcc

SEQ ID NO: 2084736 - RNA, 18 nt, Homo sapiens
ccugcucuguagccaccu

SEQ ID NO: 2084737 - RNA, 22 nt, Homo sapiens
uuacauguaguaguacuugaaa

SEQ ID NO: 2084738 - RNA, 12 nt, Homo sapiens
gaaacaucugau

SEQ ID NO: 2084739 - RNA, 14 nt, Homo sapiens
acugauguucaaua

SEQ ID NO: 2084740 - RNA, 22 nt, Homo sapiens
uguaaacugaauauaaagcuua

SEQ ID NO: 2084741 - RNA, 19 nt, Homo sapiens
auuugaacucuucaaucuc

SEQ ID NO: 2084742 - RNA, 11 nt, Homo sapiens
ccagcacauuc

SEQ ID NO: 2084743 - RNA, 17 nt, Homo sapiens
auuacagaaacugaugc

SEQ ID NO: 2084744 - RNA, 22 nt, Homo sapiens
ccaguaaaauacuauugccuca

SEQ ID NO: 2084745 - RNA, 23 nt, Homo sapiens
agggcugcgacgcuugcucuguu

SEQ ID NO: 2084746 - RNA, 13 nt, Homo sapiens
uauauuugcugau

SEQ ID NO: 2084747 - RNA, 21 nt, Homo sapiens
uaggugacuuguuuacucauu

SEQ ID NO: 2084748 - RNA, 12 nt, Homo sapiens
ucucuugcuaau

SEQ ID NO: 2084749 - RNA, 18 nt, Homo sapiens
ugcaguggcgugaucucg

SEQ ID NO: 2084750 - RNA, 18 nt, Homo sapiens
cauuucaaaucuguagca

SEQ ID NO: 2084751 - RNA, 15 nt, Homo sapiens
uaugauguaaucucu

SEQ ID NO: 2084752 - RNA, 21 nt, Homo sapiens
acaaggccaguaccacacuca

SEQ ID NO: 2084753 - RNA, 21 nt, Homo sapiens
uaauucugauaaaccugucua

SEQ ID NO: 2084754 - RNA, 19 nt, Homo sapiens
aggacugugccagcacaaa

SEQ ID NO: 2084755 - RNA, 16 nt, Homo sapiens
cuauugaagaugcugc

SEQ ID NO: 2084756 - RNA, 17 nt, Homo sapiens
caggccagugaccucau

SEQ ID NO: 2084757 - RNA, 15 nt, Homo sapiens
aaaugaccucaagga

SEQ ID NO: 2084758 - RNA, 17 nt, Homo sapiens
agaagcacccuaaugca

SEQ ID NO: 2084759 - RNA, 21 nt, Homo sapiens
uaugagaguuuggaauuauug

SEQ ID NO: 2084760 - RNA, 20 nt, Homo sapiens
uucguagguugacuaucuuu

SEQ ID NO: 2084761 - RNA, 23 nt, Homo sapiens
gcaguucagcuccuuccaccaca

SEQ ID NO: 2084762 - RNA, 21 nt, Homo sapiens
ugccacccugccccuugccau

SEQ ID NO: 2084763 - RNA, 15 nt, Homo sapiens
ucuguaguaaacuau

SEQ ID NO: 2084764 - RNA, 22 nt, Homo sapiens
ugagugaccccagccuccugcc

SEQ ID NO: 2084765 - RNA, 19 nt, Homo sapiens
cagcugaagaacaucucga

SEQ ID NO: 2084766 - RNA, 15 nt, Homo sapiens
uccugugaacacugg

SEQ ID NO: 2084767 - RNA, 15 nt, Homo sapiens
ucacuugaaccuggg

SEQ ID NO: 2084768 - RNA, 17 nt, Homo sapiens
ucaccgaggacaugaaa

SEQ ID NO: 2084769 - RNA, 23 nt, Homo sapiens
cuuggaaauagaaagaagccaua

SEQ ID NO: 2084770 - RNA, 21 nt, Homo sapiens
auuuuuuaauaagaacauuaa

SEQ ID NO: 2084771 - RNA, 16 nt, Homo sapiens
aaucccccagcacuuc

SEQ ID NO: 2084772 - RNA, 16 nt, Homo sapiens
cuucuuuuucuggacu

SEQ ID NO: 2084773 - RNA, 20 nt, Homo sapiens
gcaaaggcugagaacacugu

SEQ ID NO: 2084774 - RNA, 23 nt, Homo sapiens
ccaggguggagugcaguggugcg

SEQ ID NO: 2084775 - RNA, 18 nt, Homo sapiens
uuucuuuaaccaaacaau

SEQ ID NO: 2084776 - RNA, 15 nt, Homo sapiens
auaaaauggcaccuu

SEQ ID NO: 2084777 - RNA, 10 nt, Homo sapiens
gcauugcugg

SEQ ID NO: 2084778 - RNA, 12 nt, Homo sapiens
aucaggucuccc

SEQ ID NO: 2084779 - RNA, 16 nt, Homo sapiens
ggaggccuauuccugc

SEQ ID NO: 2084780 - RNA, 20 nt, Homo sapiens
uacucuuucugcuuacaaag

SEQ ID NO: 2084781 - RNA, 21 nt, Homo sapiens
ccauagggacccauucuacac

SEQ ID NO: 2084782 - RNA, 17 nt, Homo sapiens
uauugugaaguacauau

SEQ ID NO: 2084783 - RNA, 23 nt, Homo sapiens
aagugaggugugucacaaugaga

SEQ ID NO: 2084784 - RNA, 18 nt, Homo sapiens
aucacaaauuucacuuau

SEQ ID NO: 2084785 - RNA, 15 nt, Homo sapiens
gggaacagaccagug

SEQ ID NO: 2084786 - RNA, 13 nt, Homo sapiens
gagagggugacaa

SEQ ID NO: 2084787 - RNA, 15 nt, Homo sapiens
ugugcaugugagcac

SEQ ID NO: 2084788 - RNA, 19 nt, Homo sapiens
gaagcaaaaucccuuaauc

SEQ ID NO: 2084789 - RNA, 17 nt, Homo sapiens
uauccccaggccuggca

SEQ ID NO: 2084790 - RNA, 19 nt, Homo sapiens
gcauccaaggggccuggaa

SEQ ID NO: 2084791 - RNA, 14 nt, Homo sapiens
agucagaugaggca

SEQ ID NO: 2084792 - RNA, 22 nt, Homo sapiens
gccaggagccuccugacccugu

SEQ ID NO: 2084793 - RNA, 19 nt, Homo sapiens
aauauugcaaaauacauga

SEQ ID NO: 2084794 - RNA, 12 nt, Homo sapiens
acagaguguccu

SEQ ID NO: 2084795 - RNA, 16 nt, Homo sapiens
uuaggugugaggucca

SEQ ID NO: 2084796 - RNA, 14 nt, Homo sapiens
accaauguccuugu

SEQ ID NO: 2084797 - RNA, 16 nt, Homo sapiens
aaagaugcauuuucac

SEQ ID NO: 2084798 - RNA, 14 nt, Homo sapiens
uagugcaauuccaa

SEQ ID NO: 2084799 - RNA, 17 nt, Homo sapiens
aagccugauuaaagaau

SEQ ID NO: 2084800 - RNA, 11 nt, Homo sapiens
gagaccccagg

SEQ ID NO: 2084801 - RNA, 15 nt, Homo sapiens
gccugggugacagug

SEQ ID NO: 2084802 - RNA, 22 nt, Homo sapiens
auauuauacaaauacuaucucu

SEQ ID NO: 2084803 - RNA, 20 nt, Homo sapiens
aacagcuaucacguugaacc

SEQ ID NO: 2084804 - RNA, 17 nt, Homo sapiens
gaacaugggggaacaau

SEQ ID NO: 2084805 - RNA, 21 nt, Homo sapiens
caacauaaaacaaaaccaagc

SEQ ID NO: 2084806 - RNA, 20 nt, Homo sapiens
cucaccguggggcuggaaga

SEQ ID NO: 2084807 - RNA, 22 nt, Homo sapiens
ucccucagacccagggguccag

SEQ ID NO: 2084808 - RNA, 21 nt, Homo sapiens
ugccgauuuccuaagcuguug

SEQ ID NO: 2084809 - RNA, 13 nt, Homo sapiens
caccagcagccug

SEQ ID NO: 2084810 - RNA, 21 nt, Homo sapiens
gaaccuaauaaauauuuaguc

SEQ ID NO: 2084811 - RNA, 19 nt, Homo sapiens
caaguggguagugucauuu

SEQ ID NO: 2084812 - RNA, 14 nt, Homo sapiens
agcucuuugucuca

SEQ ID NO: 2084813 - RNA, 15 nt, Homo sapiens
gcagcuggugacugg

SEQ ID NO: 2084814 - RNA, 14 nt, Homo sapiens
ucucaggucuucac

SEQ ID NO: 2084815 - RNA, 22 nt, Homo sapiens
acccuccguuccuccucagccu

SEQ ID NO: 2084816 - RNA, 17 nt, Homo sapiens
cucugaauuuacuuccu

SEQ ID NO: 2084817 - RNA, 19 nt, Homo sapiens
ccguguucaaagagcaaua

SEQ ID NO: 2084818 - RNA, 15 nt, Homo sapiens
cauagcuacccaaaa

SEQ ID NO: 2084819 - RNA, 21 nt, Homo sapiens
cucagaguucagacaggucca

SEQ ID NO: 2084820 - RNA, 17 nt, Homo sapiens
agcucucaguugcagcc

SEQ ID NO: 2084821 - RNA, 16 nt, Homo sapiens
uccuggggcccaaaug

SEQ ID NO: 2084822 - RNA, 20 nt, Homo sapiens
ccaaauuugucuaagaacuu

SEQ ID NO: 2084823 - RNA, 18 nt, Homo sapiens
aaaguaggaguggcugac

SEQ ID NO: 2084824 - RNA, 15 nt, Homo sapiens
gcuuuuaccaugccc

SEQ ID NO: 2084825 - RNA, 15 nt, Homo sapiens
aaaugagaacaugaa

SEQ ID NO: 2084826 - RNA, 15 nt, Homo sapiens
caugaaaaccugaag

SEQ ID NO: 2084827 - RNA, 14 nt, Homo sapiens
uagaggaaagggau

SEQ ID NO: 2084828 - RNA, 20 nt, Homo sapiens
cagaccugcuuccugaaaua

SEQ ID NO: 2084829 - RNA, 20 nt, Homo sapiens
aucuguuuugaaggcaaaau

SEQ ID NO: 2084830 - RNA, 20 nt, Homo sapiens
aaccuacuuucauacugaag

SEQ ID NO: 2084831 - RNA, 14 nt, Homo sapiens
augcuucaugugcu

SEQ ID NO: 2084832 - RNA, 14 nt, Homo sapiens
acgaggugcaguaa

SEQ ID NO: 2084833 - RNA, 22 nt, Homo sapiens
caguaaucccagcuacucagga

SEQ ID NO: 2084834 - RNA, 19 nt, Homo sapiens
uuaaaauguauuuuucaca

SEQ ID NO: 2084835 - RNA, 14 nt, Homo sapiens
cauguacauacugu

SEQ ID NO: 2084836 - RNA, 14 nt, Homo sapiens
aaaugggcaagcaa

SEQ ID NO: 2084837 - RNA, 22 nt, Homo sapiens
auugcuuugauuaauccagaau

SEQ ID NO: 2084838 - RNA, 13 nt, Homo sapiens
ucauauugcauca

SEQ ID NO: 2084839 - RNA, 20 nt, Homo sapiens
gcauuaggaagaaaggagcu

SEQ ID NO: 2084840 - RNA, 19 nt, Homo sapiens
cugaauccaccugcaguua

SEQ ID NO: 2084841 - RNA, 17 nt, Homo sapiens
acucauagccacuuuua

SEQ ID NO: 2084842 - RNA, 22 nt, Homo sapiens
uugcuuuugaaaaacaacugca

SEQ ID NO: 2084843 - RNA, 20 nt, Homo sapiens
gcauaugugugugugugcau

SEQ ID NO: 2084844 - RNA, 13 nt, Homo sapiens
cauuuugcucaac

SEQ ID NO: 2084845 - RNA, 13 nt, Homo sapiens
guguaaauugcac

SEQ ID NO: 2084846 - RNA, 18 nt, Homo sapiens
agcaguuuccucagugau

SEQ ID NO: 2084847 - RNA, 22 nt, Homo sapiens
agcauuuguuuaauaagcauac

SEQ ID NO: 2084848 - RNA, 14 nt, Homo sapiens
ucagcggcauuuag

SEQ ID NO: 2084849 - RNA, 16 nt, Homo sapiens
uaucucuaauauaucc

SEQ ID NO: 2084850 - RNA, 21 nt, Homo sapiens
uugccauuucucugcuuaccc

SEQ ID NO: 2084851 - RNA, 15 nt, Homo sapiens
agccucgaauaucuu

SEQ ID NO: 2084852 - RNA, 19 nt, Homo sapiens
cucagaaaagaggccagcu

SEQ ID NO: 2084853 - RNA, 22 nt, Homo sapiens
acaaccaacagaaaacauccca

SEQ ID NO: 2084854 - RNA, 17 nt, Homo sapiens
uaguuuuauaggcagcu

SEQ ID NO: 2084855 - RNA, 15 nt, Homo sapiens
ugcagaaacuuggau

SEQ ID NO: 2084856 - RNA, 15 nt, Homo sapiens
ccucuccuccguggc

SEQ ID NO: 2084857 - RNA, 19 nt, Homo sapiens
auuuucuuguaugcuucuu

SEQ ID NO: 2084858 - RNA, 17 nt, Homo sapiens
cacuggccuugccucca

SEQ ID NO: 2084859 - RNA, 15 nt, Homo sapiens
ucaugugaaaauaau

SEQ ID NO: 2084860 - RNA, 16 nt, Homo sapiens
aauuaaaacuucuuaa

SEQ ID NO: 2084861 - RNA, 16 nt, Homo sapiens
gucugaugccaaagcu

SEQ ID NO: 2084862 - RNA, 13 nt, Homo sapiens
aguaauggcagag

SEQ ID NO: 2084863 - RNA, 20 nt, Homo sapiens
augugguuaauuuugcauau

SEQ ID NO: 2084864 - RNA, 15 nt, Homo sapiens
caucuguguaaagug

SEQ ID NO: 2084865 - RNA, 19 nt, Homo sapiens
ugagaaauggcagucugcc

SEQ ID NO: 2084866 - RNA, 20 nt, Homo sapiens
cuggaccugagcuauucuca

SEQ ID NO: 2084867 - RNA, 21 nt, Homo sapiens
ucagccaggaccauaccgggu

SEQ ID NO: 2084868 - RNA, 13 nt, Homo sapiens
augaugcacuuau

SEQ ID NO: 2084869 - RNA, 13 nt, Homo sapiens
auuuugcacuguu

SEQ ID NO: 2084870 - RNA, 22 nt, Homo sapiens
cauugcaagcuucuuuuaguug

SEQ ID NO: 2084871 - RNA, 16 nt, Homo sapiens
aagugcuguugggaua

SEQ ID NO: 2084872 - RNA, 19 nt, Homo sapiens
cugacaugcucacacauua

SEQ ID NO: 2084873 - RNA, 15 nt, Homo sapiens
aacugaaggcucaga

SEQ ID NO: 2084874 - RNA, 20 nt, Homo sapiens
uuacaggauaucacauugga

SEQ ID NO: 2084875 - RNA, 21 nt, Homo sapiens
gcuaauaaauaaucaucccuc

SEQ ID NO: 2084876 - RNA, 18 nt, Homo sapiens
uugagguuuucugugcuu

SEQ ID NO: 2084877 - RNA, 15 nt, Homo sapiens
cccaggaccucugga

SEQ ID NO: 2084878 - RNA, 22 nt, Homo sapiens
accacuaaccccgcauugcugu

SEQ ID NO: 2084879 - RNA, 19 nt, Homo sapiens
aaucucuuauucuaauaaa

SEQ ID NO: 2084880 - RNA, 21 nt, Homo sapiens
cguauuuuuucuaaugugcau

SEQ ID NO: 2084881 - RNA, 20 nt, Homo sapiens
aaagguaacaucuaaagcuu

SEQ ID NO: 2084882 - RNA, 23 nt, Homo sapiens
uuuccauuaaguacaugugccag

SEQ ID NO: 2084883 - RNA, 20 nt, Homo sapiens
gaauuauuguagacaugccc

SEQ ID NO: 2084884 - RNA, 19 nt, Homo sapiens
guacaggaaugaaccuucu

SEQ ID NO: 2084885 - RNA, 20 nt, Homo sapiens
ucacaugcuuuagccauaca

SEQ ID NO: 2084886 - RNA, 21 nt, Homo sapiens
acccuccacaaagcaaaggca

SEQ ID NO: 2084887 - RNA, 19 nt, Homo sapiens
agcuuuugggaagucucag

SEQ ID NO: 2084888 - RNA, 15 nt, Homo sapiens
ggagccugaggcaug

SEQ ID NO: 2084889 - RNA, 15 nt, Homo sapiens
ggaaaugacccaaac

SEQ ID NO: 2084890 - RNA, 15 nt, Homo sapiens
aaaagcaguggggac

SEQ ID NO: 2084891 - RNA, 15 nt, Homo sapiens
ugaggcuuccaggcu

SEQ ID NO: 2084892 - RNA, 15 nt, Homo sapiens
uguccucccacagac

SEQ ID NO: 2084893 - RNA, 15 nt, Homo sapiens
aauauuuuaggauaa

SEQ ID NO: 2084894 - RNA, 13 nt, Homo sapiens
agaagcaagacac

SEQ ID NO: 2084895 - RNA, 19 nt, Homo sapiens
agcucauguaggugagccu

SEQ ID NO: 2084896 - RNA, 13 nt, Homo sapiens
aaauaaaugccaa

SEQ ID NO: 2084897 - RNA, 20 nt, Homo sapiens
gcuuauucaucuguuuuucu

SEQ ID NO: 2084898 - RNA, 21 nt, Homo sapiens
aggugccugcucaggugcuau

SEQ ID NO: 2084899 - RNA, 16 nt, Homo sapiens
ccaucuccuaucuuuu

SEQ ID NO: 2084900 - RNA, 16 nt, Homo sapiens
ccaucuucuaucuucu

SEQ ID NO: 2084901 - RNA, 14 nt, Homo sapiens
aacugcagugacca

SEQ ID NO: 2084902 - RNA, 19 nt, Homo sapiens
aggccaaaccguacuguau

SEQ ID NO: 2084903 - RNA, 19 nt, Homo sapiens
uagcacugggugugagaau

SEQ ID NO: 2084904 - RNA, 14 nt, Homo sapiens
ccuggggcauccca

SEQ ID NO: 2084905 - RNA, 14 nt, Homo sapiens
acccucccaggaga

SEQ ID NO: 2084906 - RNA, 13 nt, Homo sapiens
aagcguguucuca

SEQ ID NO: 2084907 - RNA, 23 nt, Homo sapiens
ugaaaaguuuccuaggaugucau

SEQ ID NO: 2084908 - RNA, 20 nt, Homo sapiens
ccuuccuaacaguccgcccu

SEQ ID NO: 2084909 - RNA, 13 nt, Homo sapiens
ggagaggggcaca

SEQ ID NO: 2084910 - RNA, 15 nt, Homo sapiens
aaaauauuguuucug

SEQ ID NO: 2084911 - RNA, 23 nt, Homo sapiens
gaagaaaauaguggugugauuug

SEQ ID NO: 2084912 - RNA, 16 nt, Homo sapiens
gcgccuguaauuccag

SEQ ID NO: 2084913 - RNA, 15 nt, Homo sapiens
auuccuuagucucaa

SEQ ID NO: 2084914 - RNA, 15 nt, Homo sapiens
acuuuaaagcccuuu

SEQ ID NO: 2084915 - RNA, 19 nt, Homo sapiens
cauguguuucuguguagua

SEQ ID NO: 2084916 - RNA, 19 nt, Homo sapiens
uuccaucagcccaucucaa

SEQ ID NO: 2084917 - RNA, 22 nt, Homo sapiens
gggccccacuggacaacacuga

SEQ ID NO: 2084918 - RNA, 17 nt, Homo sapiens
agaugcauccuuucaua

SEQ ID NO: 2084919 - RNA, 13 nt, Homo sapiens
uaugaugauuugc

SEQ ID NO: 2084920 - RNA, 12 nt, Homo sapiens
ucugcuugccau

SEQ ID NO: 2084921 - RNA, 15 nt, Homo sapiens
agccaagugcccucu

SEQ ID NO: 2084922 - RNA, 15 nt, Homo sapiens
uccugcgcauggugc

SEQ ID NO: 2084923 - RNA, 20 nt, Homo sapiens
aguagaggacuaaccaugug

SEQ ID NO: 2084924 - RNA, 17 nt, Homo sapiens
ggacuccggaggacuga

SEQ ID NO: 2084925 - RNA, 18 nt, Homo sapiens
gagauggacaacucaaug

SEQ ID NO: 2084926 - RNA, 20 nt, Homo sapiens
acagggucuugcucugucac

SEQ ID NO: 2084927 - RNA, 21 nt, Homo sapiens
cugagaaagagaaugagaaga

SEQ ID NO: 2084928 - RNA, 16 nt, Homo sapiens
aagauucuuaccaaga

SEQ ID NO: 2084929 - RNA, 16 nt, Homo sapiens
uuagaaaugauuucaa

SEQ ID NO: 2084930 - RNA, 23 nt, Homo sapiens
acacuagcuugcagaaaccuaga

SEQ ID NO: 2084931 - RNA, 14 nt, Homo sapiens
uauucuauuuacaa

SEQ ID NO: 2084932 - RNA, 13 nt, Homo sapiens
uaagguacugaag

SEQ ID NO: 2084933 - RNA, 12 nt, Homo sapiens
gguuugacaauu

SEQ ID NO: 2084934 - RNA, 18 nt, Homo sapiens
agaaccaaccacaagcac

SEQ ID NO: 2084935 - RNA, 19 nt, Homo sapiens
cuucugagagcaaagggaa

SEQ ID NO: 2084936 - RNA, 18 nt, Homo sapiens
caacagcgcccaaaggac

SEQ ID NO: 2084937 - RNA, 13 nt, Homo sapiens
gcaaccauauuug

SEQ ID NO: 2084938 - RNA, 16 nt, Homo sapiens
uuccaggaguacuuac

SEQ ID NO: 2084939 - RNA, 18 nt, Homo sapiens
auaagacaaacacugcca

SEQ ID NO: 2084940 - RNA, 22 nt, Homo sapiens
gacagccagagccugucuuuca

SEQ ID NO: 2084941 - RNA, 18 nt, Homo sapiens
aauucaucuuugugccaa

SEQ ID NO: 2084942 - RNA, 23 nt, Homo sapiens
aaaaguaaccugaacuaaucuga

SEQ ID NO: 2084943 - RNA, 22 nt, Homo sapiens
cucuggaccugucucuaccuaa

SEQ ID NO: 2084944 - RNA, 22 nt, Homo sapiens
acacagaggacagcuuccccau

SEQ ID NO: 2084945 - RNA, 22 nt, Homo sapiens
caggcacccaccacaucuggcu

SEQ ID NO: 2084946 - RNA, 23 nt, Homo sapiens
cucaugaauuaauuaaagcaaau

SEQ ID NO: 2084947 - RNA, 19 nt, Homo sapiens
cuuguacuacacagaauug

SEQ ID NO: 2084948 - RNA, 16 nt, Homo sapiens
agcauggggucagccc

SEQ ID NO: 2084949 - RNA, 20 nt, Homo sapiens
caaaucugagggagcugagu

SEQ ID NO: 2084950 - RNA, 15 nt, Homo sapiens
uguuagucaguauuc

SEQ ID NO: 2084951 - RNA, 18 nt, Homo sapiens
ccuuugcuacacugcuga

SEQ ID NO: 2084952 - RNA, 21 nt, Homo sapiens
aaacuagcauaucugccuuua

SEQ ID NO: 2084953 - RNA, 23 nt, Homo sapiens
auguaucugaguugccaagacaa

SEQ ID NO: 2084954 - RNA, 20 nt, Homo sapiens
ucuuucuaaucuuuuuccag

SEQ ID NO: 2084955 - RNA, 16 nt, Homo sapiens
ucugccuuugugcucu

SEQ ID NO: 2084956 - RNA, 19 nt, Homo sapiens
uuuauagucucaaaucaaa

SEQ ID NO: 2084957 - RNA, 17 nt, Homo sapiens
augauccucccuaucaa

SEQ ID NO: 2084958 - RNA, 15 nt, Homo sapiens
accguaaauguccau

SEQ ID NO: 2084959 - RNA, 23 nt, Homo sapiens
guucccagccccuccucccucag

SEQ ID NO: 2084960 - RNA, 13 nt, Homo sapiens
cagcugggagcac

SEQ ID NO: 2084961 - RNA, 14 nt, Homo sapiens
cuguguguccaaaa

SEQ ID NO: 2084962 - RNA, 21 nt, Homo sapiens
acuauggguggggcacuccuu

SEQ ID NO: 2084963 - RNA, 21 nt, Homo sapiens
cuaagaagugaaaaucuacac

SEQ ID NO: 2084964 - RNA, 21 nt, Homo sapiens
ugcucuuagcucuaccgggag

SEQ ID NO: 2084965 - RNA, 15 nt, Homo sapiens
caaaguagaagucuu

SEQ ID NO: 2084966 - RNA, 16 nt, Homo sapiens
cuauaccuuacugaca

SEQ ID NO: 2084967 - RNA, 16 nt, Homo sapiens
acagaagacagcugcu

SEQ ID NO: 2084968 - RNA, 15 nt, Homo sapiens
cugaaccguuuguga

SEQ ID NO: 2084969 - RNA, 14 nt, Homo sapiens
uggcaaacagaaug

SEQ ID NO: 2084970 - RNA, 23 nt, Homo sapiens
cacuuuuaauuuugucagauuca

SEQ ID NO: 2084971 - RNA, 19 nt, Homo sapiens
ucaauaaagauuucaagau

SEQ ID NO: 2084972 - RNA, 14 nt, Homo sapiens
auuuugcaucugac

SEQ ID NO: 2084973 - RNA, 18 nt, Homo sapiens
cccucugcuuuuaacucu

SEQ ID NO: 2084974 - RNA, 12 nt, Homo sapiens
gggcacagggag

SEQ ID NO: 2084975 - RNA, 18 nt, Homo sapiens
auagcuguaaacuuccaa

SEQ ID NO: 2084976 - RNA, 13 nt, Homo sapiens
ugaaaauagccaa

SEQ ID NO: 2084977 - RNA, 12 nt, Homo sapiens
aauccaaaaaga

SEQ ID NO: 2084978 - RNA, 18 nt, Homo sapiens
gccucugcucuccuggga

SEQ ID NO: 2084979 - RNA, 19 nt, Homo sapiens
uuugaaaauuagagaucau

SEQ ID NO: 2084980 - RNA, 22 nt, Homo sapiens
gaggaccagguuugaugccugu

SEQ ID NO: 2084981 - RNA, 14 nt, Homo sapiens
accgcgacguugca

SEQ ID NO: 2084982 - RNA, 15 nt, Homo sapiens
uuucuauagccaaaa

SEQ ID NO: 2084983 - RNA, 19 nt, Homo sapiens
gguugcagugagcugagau

SEQ ID NO: 2084984 - RNA, 12 nt, Homo sapiens
gggacucuccau

SEQ ID NO: 2084985 - RNA, 23 nt, Homo sapiens
uccagaggugaugguaacugcac

SEQ ID NO: 2084986 - RNA, 17 nt, Homo sapiens
cacuucuaacuccacug

SEQ ID NO: 2084987 - RNA, 13 nt, Homo sapiens
cuacuggcauuaa

SEQ ID NO: 2084988 - RNA, 17 nt, Homo sapiens
auauugcuaccaaaaac

SEQ ID NO: 2084989 - RNA, 15 nt, Homo sapiens
uagcaguuucacugc

SEQ ID NO: 2084990 - RNA, 15 nt, Homo sapiens
caggaguuccagugc

SEQ ID NO: 2084991 - RNA, 20 nt, Homo sapiens
aguggaguuuucugugagaa

SEQ ID NO: 2084992 - RNA, 18 nt, Homo sapiens
uccaagaggucuccauca

SEQ ID NO: 2084993 - RNA, 17 nt, Homo sapiens
uguagucccagcacuuu

SEQ ID NO: 2084994 - RNA, 12 nt, Homo sapiens
aaggaaagcuca

SEQ ID NO: 2084995 - RNA, 21 nt, Homo sapiens
uugugaaugugucccaugcau

SEQ ID NO: 2084996 - RNA, 12 nt, Homo sapiens
gucuucuuccaa

SEQ ID NO: 2084997 - RNA, 14 nt, Homo sapiens
aaaugagcuuaaug

SEQ ID NO: 2084998 - RNA, 12 nt, Homo sapiens
aacauccaauaa

SEQ ID NO: 2084999 - RNA, 20 nt, Homo sapiens
uccugcuuaaugucagucua

SEQ ID NO: 2085000 - RNA, 13 nt, Homo sapiens
guugucacuggug

SEQ ID NO: 2085001 - RNA, 16 nt, Homo sapiens
cucaucuuucuuccaa

SEQ ID NO: 2085002 - RNA, 23 nt, Homo sapiens
agcauuacccuccucucucccca

SEQ ID NO: 2085003 - RNA, 15 nt, Homo sapiens
ggaaauuccucagca

SEQ ID NO: 2085004 - RNA, 15 nt, Homo sapiens
gugcugcagccagga

SEQ ID NO: 2085005 - RNA, 17 nt, Homo sapiens
aaaaucucacgcugcca

SEQ ID NO: 2085006 - RNA, 15 nt, Homo sapiens
uuagcaugcacaaag

SEQ ID NO: 2085007 - RNA, 22 nt, Homo sapiens
cugaagacuuacuuauucuucc

SEQ ID NO: 2085008 - RNA, 17 nt, Homo sapiens
cugcaaaggacagaucc

SEQ ID NO: 2085009 - RNA, 17 nt, Homo sapiens
uagaucgaagccaaagc

SEQ ID NO: 2085010 - RNA, 18 nt, Homo sapiens
accugcugagcucugaga

SEQ ID NO: 2085011 - RNA, 17 nt, Homo sapiens
guagagagcaagggaag

SEQ ID NO: 2085012 - RNA, 21 nt, Homo sapiens
aguaucaugcccugugcaacc

SEQ ID NO: 2085013 - RNA, 16 nt, Homo sapiens
uucauaaaguaaugau

SEQ ID NO: 2085014 - RNA, 22 nt, Homo sapiens
cuguguccucuuccaccacaga

SEQ ID NO: 2085015 - RNA, 15 nt, Homo sapiens
guaagacgaaugauu

SEQ ID NO: 2085016 - RNA, 19 nt, Homo sapiens
ucaggcaggguuaaacugc

SEQ ID NO: 2085017 - RNA, 14 nt, Homo sapiens
cuugugagaccauu

SEQ ID NO: 2085018 - RNA, 17 nt, Homo sapiens
uaaaucauauuaguauu

SEQ ID NO: 2085019 - RNA, 17 nt, Homo sapiens
uauaguuaauaaucuau

SEQ ID NO: 2085020 - RNA, 19 nt, Homo sapiens
cucacacgggguauuuuag

SEQ ID NO: 2085021 - RNA, 21 nt, Homo sapiens
gcuccaacuccaacauccacu

SEQ ID NO: 2085022 - RNA, 15 nt, Homo sapiens
auaguuaccuucaaa

SEQ ID NO: 2085023 - RNA, 17 nt, Homo sapiens
gucauaccuacauucaa

SEQ ID NO: 2085024 - RNA, 18 nt, Homo sapiens
uauucuguaguugcagcu

SEQ ID NO: 2085025 - RNA, 21 nt, Homo sapiens
caguuccuuuagaaagcaguu

SEQ ID NO: 2085026 - RNA, 17 nt, Homo sapiens
cauuaggaaaacaucuu

SEQ ID NO: 2085027 - RNA, 21 nt, Homo sapiens
cugaauggaguuaaacuuuag

SEQ ID NO: 2085028 - RNA, 17 nt, Homo sapiens
guuagcucacaggacuu

SEQ ID NO: 2085029 - RNA, 15 nt, Homo sapiens
caucaguccauugcu

SEQ ID NO: 2085030 - RNA, 20 nt, Homo sapiens
auuugagaauuuuguuucaa

SEQ ID NO: 2085031 - RNA, 13 nt, Homo sapiens
ucccucauccuca

SEQ ID NO: 2085032 - RNA, 13 nt, Homo sapiens
cuuaacauuucau

SEQ ID NO: 2085033 - RNA, 19 nt, Homo sapiens
aagggacuaggagcacugu

SEQ ID NO: 2085034 - RNA, 14 nt, Homo sapiens
uaagagaauccaca

SEQ ID NO: 2085035 - RNA, 13 nt, Homo sapiens
ggcuucacauuca

SEQ ID NO: 2085036 - RNA, 20 nt, Homo sapiens
aagaaacugaugaaugauga

SEQ ID NO: 2085037 - RNA, 15 nt, Homo sapiens
cuuccucugcaaaaa

SEQ ID NO: 2085038 - RNA, 14 nt, Homo sapiens
gggcagcacucccc

SEQ ID NO: 2085039 - RNA, 20 nt, Homo sapiens
ugcgcggaagugaccacaga

SEQ ID NO: 2085040 - RNA, 16 nt, Homo sapiens
ccaagugauccuucca

SEQ ID NO: 2085041 - RNA, 12 nt, Homo sapiens
agcaacagucca

SEQ ID NO: 2085042 - RNA, 12 nt, Homo sapiens
acaaacagugaa

SEQ ID NO: 2085043 - RNA, 12 nt, Homo sapiens
acauacagugau

SEQ ID NO: 2085044 - RNA, 19 nt, Homo sapiens
acagcuugguguacuuaau

SEQ ID NO: 2085045 - RNA, 21 nt, Homo sapiens
acugauucauacauuaucuca

SEQ ID NO: 2085046 - RNA, 21 nt, Homo sapiens
uuugccaaagugacacagagc

SEQ ID NO: 2085047 - RNA, 21 nt, Homo sapiens
ucuaaauaaauuugcuuuuau

SEQ ID NO: 2085048 - RNA, 13 nt, Homo sapiens
gcauacauguuca

SEQ ID NO: 2085049 - RNA, 14 nt, Homo sapiens
aggagacaucuucc

SEQ ID NO: 2085050 - RNA, 19 nt, Homo sapiens
uuauagaacuaaaguaucu

SEQ ID NO: 2085051 - RNA, 14 nt, Homo sapiens
gcacaugcaccuac

SEQ ID NO: 2085052 - RNA, 16 nt, Homo sapiens
auguggccuugccuag

SEQ ID NO: 2085053 - RNA, 15 nt, Homo sapiens
ggaagauaugccacu

SEQ ID NO: 2085054 - RNA, 21 nt, Homo sapiens
gaggucuccaucauggcagug

SEQ ID NO: 2085055 - RNA, 15 nt, Homo sapiens
aucaccacucaaaaa

SEQ ID NO: 2085056 - RNA, 17 nt, Homo sapiens
uucuucacucaaucucu

SEQ ID NO: 2085057 - RNA, 12 nt, Homo sapiens
ugauucaaguga

SEQ ID NO: 2085058 - RNA, 14 nt, Homo sapiens
gagacacagggaag

SEQ ID NO: 2085059 - RNA, 18 nt, Homo sapiens
agcaggauagagugggac

SEQ ID NO: 2085060 - RNA, 22 nt, Homo sapiens
ucacauguccuauuacugaugu

SEQ ID NO: 2085061 - RNA, 18 nt, Homo sapiens
cccucacagcacagagaa

SEQ ID NO: 2085062 - RNA, 14 nt, Homo sapiens
aaagaccuaugagc

SEQ ID NO: 2085063 - RNA, 22 nt, Homo sapiens
ugaaucccuuucaguuugucca

SEQ ID NO: 2085064 - RNA, 18 nt, Homo sapiens
uucagcucacacaugaga

SEQ ID NO: 2085065 - RNA, 18 nt, Homo sapiens
aagagcccaucuuuguca

SEQ ID NO: 2085066 - RNA, 22 nt, Homo sapiens
acaccuguacuggagagcaaca

SEQ ID NO: 2085067 - RNA, 19 nt, Homo sapiens
gagggcugcugaccauuug

SEQ ID NO: 2085068 - RNA, 21 nt, Homo sapiens
agccuauguaugccauggagg

SEQ ID NO: 2085069 - RNA, 13 nt, Homo sapiens
ucuacuuugucua

SEQ ID NO: 2085070 - RNA, 12 nt, Homo sapiens
gcuggagugcaa

SEQ ID NO: 2085071 - RNA, 16 nt, Homo sapiens
auuucagggcugggcu

SEQ ID NO: 2085072 - RNA, 17 nt, Homo sapiens
ccuggauuccauuuaug

SEQ ID NO: 2085073 - RNA, 19 nt, Homo sapiens
uuaauuaaguacaaccaac

SEQ ID NO: 2085074 - RNA, 22 nt, Homo sapiens
gcuuguuguuuuuaaguccugu

SEQ ID NO: 2085075 - RNA, 16 nt, Homo sapiens
cccauugcaccgagac

SEQ ID NO: 2085076 - RNA, 19 nt, Homo sapiens
aauaugauaauaaaggcau

SEQ ID NO: 2085077 - RNA, 16 nt, Homo sapiens
aucagcaucaaguaug

SEQ ID NO: 2085078 - RNA, 16 nt, Homo sapiens
aagacaauaguauuac

SEQ ID NO: 2085079 - RNA, 16 nt, Homo sapiens
cuugguguaguugaac

SEQ ID NO: 2085080 - RNA, 17 nt, Homo sapiens
uuuuucacuucuaccua

SEQ ID NO: 2085081 - RNA, 16 nt, Homo sapiens
gcauagcagaccacac

SEQ ID NO: 2085082 - RNA, 16 nt, Homo sapiens
cugaccagacuguggg

SEQ ID NO: 2085083 - RNA, 17 nt, Homo sapiens
ucucaaagaaggcauuu

SEQ ID NO: 2085084 - RNA, 17 nt, Homo sapiens
aaguguaugaugucaca

SEQ ID NO: 2085085 - RNA, 19 nt, Homo sapiens
ucgucagccaccugggaac

SEQ ID NO: 2085086 - RNA, 13 nt, Homo sapiens
ccagggccgugag

SEQ ID NO: 2085087 - RNA, 14 nt, Homo sapiens
uguugccuuuaugg

SEQ ID NO: 2085088 - RNA, 20 nt, Homo sapiens
cuugagaccuaaucucugua

SEQ ID NO: 2085089 - RNA, 20 nt, Homo sapiens
gccagcccucccagcagugg

SEQ ID NO: 2085090 - RNA, 19 nt, Homo sapiens
ucccuuuguugcacacuca

SEQ ID NO: 2085091 - RNA, 18 nt, Homo sapiens
gaaugucaguagugccag

SEQ ID NO: 2085092 - RNA, 12 nt, Homo sapiens
aacaaaauggac

SEQ ID NO: 2085093 - RNA, 23 nt, Homo sapiens
gaccagccuggucaacauaguga

SEQ ID NO: 2085094 - RNA, 20 nt, Homo sapiens
acuucccaucuccagggaag

SEQ ID NO: 2085095 - RNA, 18 nt, Homo sapiens
cugcacccagggucccag

SEQ ID NO: 2085096 - RNA, 15 nt, Homo sapiens
ucaucacuaccuuua

SEQ ID NO: 2085097 - RNA, 14 nt, Homo sapiens
aagcagaagugcaa

SEQ ID NO: 2085098 - RNA, 15 nt, Homo sapiens
gccucugcuacugag

SEQ ID NO: 2085099 - RNA, 18 nt, Homo sapiens
auuugugugugugauaua

SEQ ID NO: 2085100 - RNA, 15 nt, Homo sapiens
ugauuguuuuaacug

SEQ ID NO: 2085101 - RNA, 14 nt, Homo sapiens
agagcuacuuugag

SEQ ID NO: 2085102 - RNA, 23 nt, Homo sapiens
ccccugaccuuccaaaccucaau

SEQ ID NO: 2085103 - RNA, 12 nt, Homo sapiens
cuguaugccaag

SEQ ID NO: 2085104 - RNA, 15 nt, Homo sapiens
ucuuccuuagacuua

SEQ ID NO: 2085105 - RNA, 16 nt, Homo sapiens
cuugucacuugcaugu

SEQ ID NO: 2085106 - RNA, 20 nt, Homo sapiens
acaggucuagaaaaccagcu

SEQ ID NO: 2085107 - RNA, 15 nt, Homo sapiens
ucuauuucaacuuca

SEQ ID NO: 2085108 - RNA, 14 nt, Homo sapiens
aauaaaugaguuag

SEQ ID NO: 2085109 - RNA, 17 nt, Homo sapiens
augccugauugccaagc

SEQ ID NO: 2085110 - RNA, 20 nt, Homo sapiens
gagguagugccaaugacagg

SEQ ID NO: 2085111 - RNA, 17 nt, Homo sapiens
auuagcuggcgcauauu

SEQ ID NO: 2085112 - RNA, 19 nt, Homo sapiens
uuauugaauucauuucacu

SEQ ID NO: 2085113 - RNA, 13 nt, Homo sapiens
gcucccagacaua

SEQ ID NO: 2085114 - RNA, 20 nt, Homo sapiens
aauacagucuuccauuugca

SEQ ID NO: 2085115 - RNA, 14 nt, Homo sapiens
aggaauugcgucau

SEQ ID NO: 2085116 - RNA, 13 nt, Homo sapiens
cauccauggccag

SEQ ID NO: 2085117 - RNA, 21 nt, Homo sapiens
gaaagugucugcaguagggga

SEQ ID NO: 2085118 - RNA, 12 nt, Homo sapiens
aauuucauucau

SEQ ID NO: 2085119 - RNA, 21 nt, Homo sapiens
cuaagagaaugugcucaugca

SEQ ID NO: 2085120 - RNA, 16 nt, Homo sapiens
cagggaggaugccaca

SEQ ID NO: 2085121 - RNA, 20 nt, Homo sapiens
ccaugugugugcaagugugu

SEQ ID NO: 2085122 - RNA, 21 nt, Homo sapiens
cauaaugcuuuggaaaaaugg

SEQ ID NO: 2085123 - RNA, 12 nt, Homo sapiens
uuuaaaauucuc

SEQ ID NO: 2085124 - RNA, 17 nt, Homo sapiens
acuccaucucuacugaa

SEQ ID NO: 2085125 - RNA, 18 nt, Homo sapiens
acccucacaggagcaucu

SEQ ID NO: 2085126 - RNA, 19 nt, Homo sapiens
gagauuuugucgggacaga

SEQ ID NO: 2085127 - RNA, 19 nt, Homo sapiens
auagaacaggcugaaauuu

SEQ ID NO: 2085128 - RNA, 22 nt, Homo sapiens
caggagcgugaaggacuuagcc

SEQ ID NO: 2085129 - RNA, 20 nt, Homo sapiens
cucaguaaaucagugcagua

SEQ ID NO: 2085130 - RNA, 14 nt, Homo sapiens
uaaagccuuugaug

SEQ ID NO: 2085131 - RNA, 19 nt, Homo sapiens
ucaugugcagucagcuuuu

SEQ ID NO: 2085132 - RNA, 17 nt, Homo sapiens
ucagaaauaaaucacag

SEQ ID NO: 2085133 - RNA, 19 nt, Homo sapiens
ucaccagaauuaguccuca

SEQ ID NO: 2085134 - RNA, 23 nt, Homo sapiens
acgacagguggcaacaaugcccc

SEQ ID NO: 2085135 - RNA, 22 nt, Homo sapiens
guugacccagggcugucucccu

SEQ ID NO: 2085136 - RNA, 20 nt, Homo sapiens
auaauagcagauuucuugcu

SEQ ID NO: 2085137 - RNA, 21 nt, Homo sapiens
ugaaauaaaacuacaugguca

SEQ ID NO: 2085138 - RNA, 13 nt, Homo sapiens
uccauccuugacu

SEQ ID NO: 2085139 - RNA, 21 nt, Homo sapiens
acucuuccuuccuaauaggca

SEQ ID NO: 2085140 - RNA, 15 nt, Homo sapiens
cuuuuagucugcaua

SEQ ID NO: 2085141 - RNA, 17 nt, Homo sapiens
acagcuacucuccccac

SEQ ID NO: 2085142 - RNA, 24 nt, Homo sapiens
auuucuaaauguuuggcauguaaa

SEQ ID NO: 2085143 - RNA, 20 nt, Homo sapiens
uguggcaucagauaaugcca

SEQ ID NO: 2085144 - RNA, 20 nt, Homo sapiens
caggggaauguauuuuucaa

SEQ ID NO: 2085145 - RNA, 12 nt, Homo sapiens
gaaaccuuccac

SEQ ID NO: 2085146 - RNA, 17 nt, Homo sapiens
uggagauuggcucccaa

SEQ ID NO: 2085147 - RNA, 16 nt, Homo sapiens
aaaucauacuuucucu

SEQ ID NO: 2085148 - RNA, 22 nt, Homo sapiens
ugaagauuggggacacucauau

SEQ ID NO: 2085149 - RNA, 18 nt, Homo sapiens
auggggugggguagggcu

SEQ ID NO: 2085150 - RNA, 19 nt, Homo sapiens
cgaaccaugccuuccucag

SEQ ID NO: 2085151 - RNA, 15 nt, Homo sapiens
acuagccugugauua

SEQ ID NO: 2085152 - RNA, 15 nt, Homo sapiens
gcaggccccagucuc

SEQ ID NO: 2085153 - RNA, 20 nt, Homo sapiens
aggaaaaugccaugaaaauu

SEQ ID NO: 2085154 - RNA, 20 nt, Homo sapiens
agcuguaacccucacccaca

SEQ ID NO: 2085155 - RNA, 15 nt, Homo sapiens
guauaaaaccuaaaa

SEQ ID NO: 2085156 - RNA, 16 nt, Homo sapiens
gucagccuugcaucaa

SEQ ID NO: 2085157 - RNA, 23 nt, Homo sapiens
accgccuggcccucuguggucac

SEQ ID NO: 2085158 - RNA, 18 nt, Homo sapiens
gucuuuaccgcaaucucu

SEQ ID NO: 2085159 - RNA, 17 nt, Homo sapiens
cagugaaguugcugcuu

SEQ ID NO: 2085160 - RNA, 19 nt, Homo sapiens
cucagagaccgugagcgcc

SEQ ID NO: 2085161 - RNA, 20 nt, Homo sapiens
gauaagccugaaacagccuc

SEQ ID NO: 2085162 - RNA, 18 nt, Homo sapiens
ggaggccauuuguguuua

SEQ ID NO: 2085163 - RNA, 16 nt, Homo sapiens
acccagagccuucucc

SEQ ID NO: 2085164 - RNA, 21 nt, Homo sapiens
caccgugaccccuguccccac

SEQ ID NO: 2085165 - RNA, 19 nt, Homo sapiens
cgugccugcuuaccugcca

SEQ ID NO: 2085166 - RNA, 17 nt, Homo sapiens
agaaaguucaacuucca

SEQ ID NO: 2085167 - RNA, 18 nt, Homo sapiens
cuuccuugccugaugaca

SEQ ID NO: 2085168 - RNA, 20 nt, Homo sapiens
cugcaacuugugaacuccau

SEQ ID NO: 2085169 - RNA, 18 nt, Homo sapiens
uggcagacucaccaccua

SEQ ID NO: 2085170 - RNA, 20 nt, Homo sapiens
aggcuguguauuuacaugaa

SEQ ID NO: 2085171 - RNA, 22 nt, Homo sapiens
gaacccuccccaccaccacuuu

SEQ ID NO: 2085172 - RNA, 14 nt, Homo sapiens
aagagucagcaugg

SEQ ID NO: 2085173 - RNA, 17 nt, Homo sapiens
gaggguuggcaccugca

SEQ ID NO: 2085174 - RNA, 18 nt, Homo sapiens
gggauggggccaucuccu

SEQ ID NO: 2085175 - RNA, 23 nt, Homo sapiens
aggaacuauguucacaagaacaa

SEQ ID NO: 2085176 - RNA, 13 nt, Homo sapiens
gcucugggccuga

SEQ ID NO: 2085177 - RNA, 19 nt, Homo sapiens
ccccagucggcugaacucu

SEQ ID NO: 2085178 - RNA, 17 nt, Homo sapiens
ugaagacaaaacauaca

SEQ ID NO: 2085179 - RNA, 19 nt, Homo sapiens
uguaugcuucauacaggga

SEQ ID NO: 2085180 - RNA, 13 nt, Homo sapiens
gagaaaacugaga

SEQ ID NO: 2085181 - RNA, 17 nt, Homo sapiens
ugugcauauuguacacu

SEQ ID NO: 2085182 - RNA, 15 nt, Homo sapiens
gaaagaggcagugau

SEQ ID NO: 2085183 - RNA, 18 nt, Homo sapiens
gcaguuaguauagcuuua

SEQ ID NO: 2085184 - RNA, 19 nt, Homo sapiens
ugugauuuggaccauggca

SEQ ID NO: 2085185 - RNA, 23 nt, Homo sapiens
aaacugggaugaaacuaaagcaa

SEQ ID NO: 2085186 - RNA, 16 nt, Homo sapiens
ugggggaacacugaga

SEQ ID NO: 2085187 - RNA, 23 nt, Homo sapiens
auuauugaggggacuaggcuaua

SEQ ID NO: 2085188 - RNA, 18 nt, Homo sapiens
uggaaggcuucuccgccc

SEQ ID NO: 2085189 - RNA, 20 nt, Homo sapiens
ucacaggagcuuaaacagcu

SEQ ID NO: 2085190 - RNA, 15 nt, Homo sapiens
aucuuauuuaggaag

SEQ ID NO: 2085191 - RNA, 21 nt, Homo sapiens
guaaucucacagcauuugcca

SEQ ID NO: 2085192 - RNA, 17 nt, Homo sapiens
ccuugagggugggccag

SEQ ID NO: 2085193 - RNA, 16 nt, Homo sapiens
guuuuuuuugcugcua

SEQ ID NO: 2085194 - RNA, 15 nt, Homo sapiens
cagcacuuacaauuu

SEQ ID NO: 2085195 - RNA, 17 nt, Homo sapiens
cugucuugcugagggag

SEQ ID NO: 2085196 - RNA, 20 nt, Homo sapiens
cucagacgacaccuggagac

SEQ ID NO: 2085197 - RNA, 21 nt, Homo sapiens
gauucucuuagacacuuuuau

SEQ ID NO: 2085198 - RNA, 23 nt, Homo sapiens
cagcauggugaaaccucaucucu

SEQ ID NO: 2085199 - RNA, 14 nt, Homo sapiens
ugagaacacuguga

SEQ ID NO: 2085200 - RNA, 16 nt, Homo sapiens
caacuaggcucauacu

SEQ ID NO: 2085201 - RNA, 22 nt, Homo sapiens
aaggagccuugggggugugaug

SEQ ID NO: 2085202 - RNA, 11 nt, Homo sapiens
caaaacaaagc

SEQ ID NO: 2085203 - RNA, 11 nt, Homo sapiens
acgaaacugcu

SEQ ID NO: 2085204 - RNA, 21 nt, Homo sapiens
ugugguccgaagucuuccaua

SEQ ID NO: 2085205 - RNA, 15 nt, Homo sapiens
acaaaauuacuuaca

SEQ ID NO: 2085206 - RNA, 14 nt, Homo sapiens
gucguucaauucau

SEQ ID NO: 2085207 - RNA, 15 nt, Homo sapiens
ccugcuuuuugacau

SEQ ID NO: 2085208 - RNA, 15 nt, Homo sapiens
guaccuugcagccau

SEQ ID NO: 2085209 - RNA, 15 nt, Homo sapiens
uaagcuuaugcuuaa

SEQ ID NO: 2085210 - RNA, 13 nt, Homo sapiens
aauguaacugcug

SEQ ID NO: 2085211 - RNA, 15 nt, Homo sapiens
agcaauaauccagua

SEQ ID NO: 2085212 - RNA, 19 nt, Homo sapiens
auguuuuuaauccaaagaa

SEQ ID NO: 2085213 - RNA, 14 nt, Homo sapiens
caagaaccaaggaa

SEQ ID NO: 2085214 - RNA, 13 nt, Homo sapiens
acaaaacugccaa

SEQ ID NO: 2085215 - RNA, 23 nt, Homo sapiens
aauguacuuuuucuuccagaaaa

SEQ ID NO: 2085216 - RNA, 20 nt, Homo sapiens
ugauugugggauacuauuua

SEQ ID NO: 2085217 - RNA, 23 nt, Homo sapiens
ugaggugggucuaccucaucucu

SEQ ID NO: 2085218 - RNA, 18 nt, Homo sapiens
auuagaaacaacauagca

SEQ ID NO: 2085219 - RNA, 13 nt, Homo sapiens
aucuccugacaga

SEQ ID NO: 2085220 - RNA, 12 nt, Homo sapiens
ggacaguggcag

SEQ ID NO: 2085221 - RNA, 20 nt, Homo sapiens
auccugcagaaguacuccua

SEQ ID NO: 2085222 - RNA, 12 nt, Homo sapiens
agacaucugccu

SEQ ID NO: 2085223 - RNA, 18 nt, Homo sapiens
caaaaugucauagcuuau

SEQ ID NO: 2085224 - RNA, 16 nt, Homo sapiens
ucuucaugaugguggu

SEQ ID NO: 2085225 - RNA, 20 nt, Homo sapiens
auauucagguggccagaaga

SEQ ID NO: 2085226 - RNA, 16 nt, Homo sapiens
ugauggccaccagcuu

SEQ ID NO: 2085227 - RNA, 20 nt, Homo sapiens
agggugcugugauuuugucc

SEQ ID NO: 2085228 - RNA, 19 nt, Homo sapiens
cccugagcccagaaaaaag

SEQ ID NO: 2085229 - RNA, 20 nt, Homo sapiens
acuucuuacccaaagcacau

SEQ ID NO: 2085230 - RNA, 20 nt, Homo sapiens
guacgcugcugcaggacauu

SEQ ID NO: 2085231 - RNA, 20 nt, Homo sapiens
aaaauucuugggaguguugu

SEQ ID NO: 2085232 - RNA, 20 nt, Homo sapiens
auuucauaccuguacacacu

SEQ ID NO: 2085233 - RNA, 23 nt, Homo sapiens
gacaauguugcauuuaugaugca

SEQ ID NO: 2085234 - RNA, 17 nt, Homo sapiens
cuuucuuuugauaaauc

SEQ ID NO: 2085235 - RNA, 18 nt, Homo sapiens
cagguuucuucucuggag

SEQ ID NO: 2085236 - RNA, 18 nt, Homo sapiens
ucugcauuucuacauguu

SEQ ID NO: 2085237 - RNA, 19 nt, Homo sapiens
cccucggcucuggaggcaa

SEQ ID NO: 2085238 - RNA, 18 nt, Homo sapiens
ccccuggaucuaccagca

SEQ ID NO: 2085239 - RNA, 16 nt, Homo sapiens
cauuucaaaaugcuuc

SEQ ID NO: 2085240 - RNA, 17 nt, Homo sapiens
auucaagugagccagga

SEQ ID NO: 2085241 - RNA, 22 nt, Homo sapiens
aaugaaacaagucuagucuucu

SEQ ID NO: 2085242 - RNA, 18 nt, Homo sapiens
ggauggcuuaagccugug

SEQ ID NO: 2085243 - RNA, 16 nt, Homo sapiens
ggccguguucaaagag

SEQ ID NO: 2085244 - RNA, 20 nt, Homo sapiens
guuugguacuuuuaacauaa

SEQ ID NO: 2085245 - RNA, 20 nt, Homo sapiens
ugucccauaauaugcuuuuu

SEQ ID NO: 2085246 - RNA, 21 nt, Homo sapiens
uggaacuuuuauuacuggggu

SEQ ID NO: 2085247 - RNA, 18 nt, Homo sapiens
uuauauauuugaaagaag

SEQ ID NO: 2085248 - RNA, 15 nt, Homo sapiens
uguguacugauucaa

SEQ ID NO: 2085249 - RNA, 22 nt, Homo sapiens
auagcuugcgcauucucaugga

SEQ ID NO: 2085250 - RNA, 22 nt, Homo sapiens
uaguauuuaacuacaucugccu

SEQ ID NO: 2085251 - RNA, 14 nt, Homo sapiens
gaacagacugaccu

SEQ ID NO: 2085252 - RNA, 19 nt, Homo sapiens
caaaauuguggcauuuugu

SEQ ID NO: 2085253 - RNA, 16 nt, Homo sapiens
auuugcugaauaacaa

SEQ ID NO: 2085254 - RNA, 20 nt, Homo sapiens
ucaaaccucugcaucucuga

SEQ ID NO: 2085255 - RNA, 15 nt, Homo sapiens
ucuuucauacuacau

SEQ ID NO: 2085256 - RNA, 20 nt, Homo sapiens
ucuaggacccccagugcuca

SEQ ID NO: 2085257 - RNA, 14 nt, Homo sapiens
uauagcaagaccac

SEQ ID NO: 2085258 - RNA, 14 nt, Homo sapiens
ucuggaagucaucu

SEQ ID NO: 2085259 - RNA, 14 nt, Homo sapiens
agcauccucuuuaa

SEQ ID NO: 2085260 - RNA, 13 nt, Homo sapiens
uuuugaaagucag

SEQ ID NO: 2085261 - RNA, 14 nt, Homo sapiens
ggugauuucuugcu

SEQ ID NO: 2085262 - RNA, 12 nt, Homo sapiens
aaggcugagacc

SEQ ID NO: 2085263 - RNA, 16 nt, Homo sapiens
gaaguauuucugugga

SEQ ID NO: 2085264 - RNA, 17 nt, Homo sapiens
gacucaggaccagaugu

SEQ ID NO: 2085265 - RNA, 21 nt, Homo sapiens
agggcacagggccuggcccau

SEQ ID NO: 2085266 - RNA, 14 nt, Homo sapiens
ggcucugaugcuga

SEQ ID NO: 2085267 - RNA, 13 nt, Homo sapiens
cagugccuugcuc

SEQ ID NO: 2085268 - RNA, 21 nt, Homo sapiens
gagaugcaccaaguacagccu

SEQ ID NO: 2085269 - RNA, 21 nt, Homo sapiens
agacagauuuucggaacacau

SEQ ID NO: 2085270 - RNA, 17 nt, Homo sapiens
ugcaggacaaacagacg

SEQ ID NO: 2085271 - RNA, 19 nt, Homo sapiens
agugguucaagcacacugg

SEQ ID NO: 2085272 - RNA, 17 nt, Homo sapiens
agucauucucaccuaaa

SEQ ID NO: 2085273 - RNA, 21 nt, Homo sapiens
cgaagcugcugugacuguguc

SEQ ID NO: 2085274 - RNA, 19 nt, Homo sapiens
uucuuacuucccuaaugaa

SEQ ID NO: 2085275 - RNA, 22 nt, Homo sapiens
caggccgauuugggaaccaagc

SEQ ID NO: 2085276 - RNA, 16 nt, Homo sapiens
uugcaaauaaaccacu

SEQ ID NO: 2085277 - RNA, 18 nt, Homo sapiens
aaauaauuccacaguccu

SEQ ID NO: 2085278 - RNA, 24 nt, Homo sapiens
cuuaaauuugaaucugagugaauu

SEQ ID NO: 2085279 - RNA, 14 nt, Homo sapiens
ccucagggggccag

SEQ ID NO: 2085280 - RNA, 14 nt, Homo sapiens
ccucugggggccug

SEQ ID NO: 2085281 - RNA, 20 nt, Homo sapiens
acauugugacaaacagcuag

SEQ ID NO: 2085282 - RNA, 22 nt, Homo sapiens
gggcaaaugacaugcacugacc

SEQ ID NO: 2085283 - RNA, 13 nt, Homo sapiens
uguaccaguguga

SEQ ID NO: 2085284 - RNA, 15 nt, Homo sapiens
caauuaacaaucaaa

SEQ ID NO: 2085285 - RNA, 22 nt, Homo sapiens
ugccaagagggucugauggcac

SEQ ID NO: 2085286 - RNA, 10 nt, Homo sapiens
agcugauguc

SEQ ID NO: 2085287 - RNA, 17 nt, Homo sapiens
gccaccaucauagcuca

SEQ ID NO: 2085288 - RNA, 21 nt, Homo sapiens
caggaauuccucuuuugcuua

SEQ ID NO: 2085289 - RNA, 19 nt, Homo sapiens
auucauuuucuagauacaa

SEQ ID NO: 2085290 - RNA, 16 nt, Homo sapiens
gccccugccucgagga

SEQ ID NO: 2085291 - RNA, 12 nt, Homo sapiens
ucuauuaaucaa

SEQ ID NO: 2085292 - RNA, 19 nt, Homo sapiens
aggugguuuuugguuacau

SEQ ID NO: 2085293 - RNA, 20 nt, Homo sapiens
gcaggggaauucccuccccc

SEQ ID NO: 2085294 - RNA, 15 nt, Homo sapiens
cucguuuagugccaa

SEQ ID NO: 2085295 - RNA, 13 nt, Homo sapiens
cauccucaucucu

SEQ ID NO: 2085296 - RNA, 16 nt, Homo sapiens
gcgauggccaccccag

SEQ ID NO: 2085297 - RNA, 15 nt, Homo sapiens
ugaauagcuacuaua

SEQ ID NO: 2085298 - RNA, 14 nt, Homo sapiens
uuggaugguucuca

SEQ ID NO: 2085299 - RNA, 16 nt, Homo sapiens
auucauccugaccaag

SEQ ID NO: 2085300 - RNA, 15 nt, Homo sapiens
uguaaaugaaguaca

SEQ ID NO: 2085301 - RNA, 22 nt, Homo sapiens
cuugagccuauaucagucguuu

SEQ ID NO: 2085302 - RNA, 16 nt, Homo sapiens
ccaagaaguaacaaaa

SEQ ID NO: 2085303 - RNA, 20 nt, Homo sapiens
gcccaggcuggagugcaaug

SEQ ID NO: 2085304 - RNA, 20 nt, Homo sapiens
gcccaggcuagagugcagug

SEQ ID NO: 2085305 - RNA, 14 nt, Homo sapiens
guaacugaagcaua

SEQ ID NO: 2085306 - RNA, 23 nt, Homo sapiens
ugaggaugaaaaaauaacacugu

SEQ ID NO: 2085307 - RNA, 19 nt, Homo sapiens
acagguggcaacaaugccc

SEQ ID NO: 2085308 - RNA, 12 nt, Homo sapiens
caccuugcacuc

SEQ ID NO: 2085309 - RNA, 16 nt, Homo sapiens
aauaucaaaacaagua

SEQ ID NO: 2085310 - RNA, 23 nt, Homo sapiens
aaucuguugccacccaggugaug

SEQ ID NO: 2085311 - RNA, 13 nt, Homo sapiens
cugucucuacuaa

SEQ ID NO: 2085312 - RNA, 18 nt, Homo sapiens
augguuuagucauugcag

SEQ ID NO: 2085313 - RNA, 17 nt, Homo sapiens
uccaucuuucuacagag

SEQ ID NO: 2085314 - RNA, 20 nt, Homo sapiens
gcuaagggggaccaugggga

SEQ ID NO: 2085315 - RNA, 18 nt, Homo sapiens
aacccucacuguguugga

SEQ ID NO: 2085316 - RNA, 20 nt, Homo sapiens
aauuaguucccauucuuuca

SEQ ID NO: 2085317 - RNA, 19 nt, Homo sapiens
caaaaggauaaaugucuuu

SEQ ID NO: 2085318 - RNA, 21 nt, Homo sapiens
ccuguaaucccaacacuuugg

SEQ ID NO: 2085319 - RNA, 21 nt, Homo sapiens
ccuguaaucccagcacuuuga

SEQ ID NO: 2085320 - RNA, 16 nt, Homo sapiens
ccuugggaugggcaca

SEQ ID NO: 2085321 - RNA, 14 nt, Homo sapiens
acguauggcuccac

SEQ ID NO: 2085322 - RNA, 21 nt, Homo sapiens
gcuucaaaaagccacagcaga

SEQ ID NO: 2085323 - RNA, 20 nt, Homo sapiens
aucauagguaagguuuucaa

SEQ ID NO: 2085324 - RNA, 16 nt, Homo sapiens
gccuuuucucauucug

SEQ ID NO: 2085325 - RNA, 15 nt, Homo sapiens
gacugaaaaugaacu

SEQ ID NO: 2085326 - RNA, 14 nt, Homo sapiens
ucuuauuaaucaua

SEQ ID NO: 2085327 - RNA, 18 nt, Homo sapiens
ggcaugguguguggugcu

SEQ ID NO: 2085328 - RNA, 13 nt, Homo sapiens
uguuuucagugaa

SEQ ID NO: 2085329 - RNA, 13 nt, Homo sapiens
gcuguugcucagg

SEQ ID NO: 2085330 - RNA, 18 nt, Homo sapiens
agauagggaaaaggggcu

SEQ ID NO: 2085331 - RNA, 12 nt, Homo sapiens
cuaugacccugu

SEQ ID NO: 2085332 - RNA, 21 nt, Homo sapiens
auuaguauuaauacuacccau

SEQ ID NO: 2085333 - RNA, 17 nt, Homo sapiens
uugcaaacaucacugag

SEQ ID NO: 2085334 - RNA, 13 nt, Homo sapiens
gucugcaggguga

SEQ ID NO: 2085335 - RNA, 21 nt, Homo sapiens
ggaucagaugacucucuccaa

SEQ ID NO: 2085336 - RNA, 16 nt, Homo sapiens
acaugaccccacaggu

SEQ ID NO: 2085337 - RNA, 15 nt, Homo sapiens
acucagacuguugca

SEQ ID NO: 2085338 - RNA, 20 nt, Homo sapiens
agacaaaacgagucuuucau

SEQ ID NO: 2085339 - RNA, 13 nt, Homo sapiens
aaguuauuuacuu

SEQ ID NO: 2085340 - RNA, 19 nt, Homo sapiens
cuagaaagagaaaaagccc

SEQ ID NO: 2085341 - RNA, 19 nt, Homo sapiens
ggaaaaaauaaaagaucuu

SEQ ID NO: 2085342 - RNA, 13 nt, Homo sapiens
ugaucauuugccc

SEQ ID NO: 2085343 - RNA, 11 nt, Homo sapiens
ugaggcccaag

SEQ ID NO: 2085344 - RNA, 22 nt, Homo sapiens
cucagguggaggcaacagggcc

SEQ ID NO: 2085345 - RNA, 20 nt, Homo sapiens
uuaggaaggcagcauuccau

SEQ ID NO: 2085346 - RNA, 18 nt, Homo sapiens
aucauaacuauacuugau

SEQ ID NO: 2085347 - RNA, 21 nt, Homo sapiens
aguucugcuucugaaacugga

SEQ ID NO: 2085348 - RNA, 20 nt, Homo sapiens
aucauguccuauucccuguc

SEQ ID NO: 2085349 - RNA, 22 nt, Homo sapiens
ggucugggcugggcaccugacu

SEQ ID NO: 2085350 - RNA, 22 nt, Homo sapiens
aaagacagucgagaagccaggg

SEQ ID NO: 2085351 - RNA, 22 nt, Homo sapiens
aaauauuuuggcauuguacuaa

SEQ ID NO: 2085352 - RNA, 13 nt, Homo sapiens
aacacaaggucau

SEQ ID NO: 2085353 - RNA, 13 nt, Homo sapiens
gaguccauuugaa

SEQ ID NO: 2085354 - RNA, 22 nt, Homo sapiens
cacaguuauacaugucuaucaa

SEQ ID NO: 2085355 - RNA, 17 nt, Homo sapiens
agaaaaggaacaguugc

SEQ ID NO: 2085356 - RNA, 16 nt, Homo sapiens
aauaaagaacauucua

SEQ ID NO: 2085357 - RNA, 22 nt, Homo sapiens
agaauaauauugugucauagaa

SEQ ID NO: 2085358 - RNA, 14 nt, Homo sapiens
caggaaaccaacac

SEQ ID NO: 2085359 - RNA, 16 nt, Homo sapiens
gucugaucguucaaag

SEQ ID NO: 2085360 - RNA, 11 nt, Homo sapiens
ccagacaggga

SEQ ID NO: 2085361 - RNA, 22 nt, Homo sapiens
gaccguuucuuaacaaucaaau

SEQ ID NO: 2085362 - RNA, 22 nt, Homo sapiens
uggcagagaggaccccacugga

SEQ ID NO: 2085363 - RNA, 19 nt, Homo sapiens
uguccggucccugucccag

SEQ ID NO: 2085364 - RNA, 16 nt, Homo sapiens
acaauuugauacauaa

SEQ ID NO: 2085365 - RNA, 16 nt, Homo sapiens
cuuucuccaggaccaa

SEQ ID NO: 2085366 - RNA, 17 nt, Homo sapiens
gcauggaacagcauuac

SEQ ID NO: 2085367 - RNA, 15 nt, Homo sapiens
cccagcccagggugg

SEQ ID NO: 2085368 - RNA, 17 nt, Homo sapiens
aaugguuucaacaaaga

SEQ ID NO: 2085369 - RNA, 14 nt, Homo sapiens
uuagauucagggga

SEQ ID NO: 2085370 - RNA, 19 nt, Homo sapiens
gcuuugccccugagacaaa

SEQ ID NO: 2085371 - RNA, 14 nt, Homo sapiens
cauaggccauuugg

SEQ ID NO: 2085372 - RNA, 19 nt, Homo sapiens
aauuuucaguucuauuuaa

SEQ ID NO: 2085373 - RNA, 14 nt, Homo sapiens
gcaaauacaaucag

SEQ ID NO: 2085374 - RNA, 21 nt, Homo sapiens
cuuguuagugcacagcacaaa

SEQ ID NO: 2085375 - RNA, 14 nt, Homo sapiens
uguuucuauucuaa

SEQ ID NO: 2085376 - RNA, 23 nt, Homo sapiens
aagugcauuuauugccucuaugu

SEQ ID NO: 2085377 - RNA, 15 nt, Homo sapiens
ccaaggcugaugcag

SEQ ID NO: 2085378 - RNA, 15 nt, Homo sapiens
auguguucauucaag

SEQ ID NO: 2085379 - RNA, 20 nt, Homo sapiens
guaggauuuggggugaauga

SEQ ID NO: 2085380 - RNA, 18 nt, Homo sapiens
uaguuaaauuggcuuguu

SEQ ID NO: 2085381 - RNA, 14 nt, Homo sapiens
cagcacacucccga

SEQ ID NO: 2085382 - RNA, 17 nt, Homo sapiens
uaaauauucuagguuag

SEQ ID NO: 2085383 - RNA, 13 nt, Homo sapiens
agacaaaguucaa

SEQ ID NO: 2085384 - RNA, 16 nt, Homo sapiens
agugagccgagaucac

SEQ ID NO: 2085385 - RNA, 13 nt, Homo sapiens
ccacaacaguccc

SEQ ID NO: 2085386 - RNA, 15 nt, Homo sapiens
ggacagaagcagcuc

SEQ ID NO: 2085387 - RNA, 16 nt, Homo sapiens
aaaaguuuauuggacu

SEQ ID NO: 2085388 - RNA, 16 nt, Homo sapiens
gcuacaggggccagaa

SEQ ID NO: 2085389 - RNA, 16 nt, Homo sapiens
auggaauagcaccugg

SEQ ID NO: 2085390 - RNA, 22 nt, Homo sapiens
agaaacuuuauacauuaguaaa

SEQ ID NO: 2085391 - RNA, 20 nt, Homo sapiens
agaugagcccacagaggcau

SEQ ID NO: 2085392 - RNA, 22 nt, Homo sapiens
acuuguuuguuuuaaccaauaa

SEQ ID NO: 2085393 - RNA, 23 nt, Homo sapiens
caaauuuagaagaaaaaaccacc

SEQ ID NO: 2085394 - RNA, 12 nt, Homo sapiens
uuguuucuuaau

SEQ ID NO: 2085395 - RNA, 12 nt, Homo sapiens
uuaauucuuaga

SEQ ID NO: 2085396 - RNA, 17 nt, Homo sapiens
uagaucccaugucaccu

SEQ ID NO: 2085397 - RNA, 19 nt, Homo sapiens
ugcccucauacccaugcac

SEQ ID NO: 2085398 - RNA, 13 nt, Homo sapiens
ucuaaucuaugca

SEQ ID NO: 2085399 - RNA, 15 nt, Homo sapiens
caacucgaacugcuu

SEQ ID NO: 2085400 - RNA, 18 nt, Homo sapiens
cagcacuagccaaaccuc

SEQ ID NO: 2085401 - RNA, 24 nt, Homo sapiens
ucugcaccuuguccccucauagga

SEQ ID NO: 2085402 - RNA, 17 nt, Homo sapiens
acugacaccucacugag

SEQ ID NO: 2085403 - RNA, 21 nt, Homo sapiens
cucaucuguggagcugccaca

SEQ ID NO: 2085404 - RNA, 16 nt, Homo sapiens
gguuggauuugaagac

SEQ ID NO: 2085405 - RNA, 16 nt, Homo sapiens
auuagaccaagcuugu

SEQ ID NO: 2085406 - RNA, 14 nt, Homo sapiens
caccacucuugacu

SEQ ID NO: 2085407 - RNA, 20 nt, Homo sapiens
uagcauguuccuccuuuucu

SEQ ID NO: 2085408 - RNA, 16 nt, Homo sapiens
caguggcgcaaucuua

SEQ ID NO: 2085409 - RNA, 18 nt, Homo sapiens
auguaggagaaagagccu

SEQ ID NO: 2085410 - RNA, 15 nt, Homo sapiens
acacccagugccagg

SEQ ID NO: 2085411 - RNA, 19 nt, Homo sapiens
ugcauaaauaugcagugau

SEQ ID NO: 2085412 - RNA, 18 nt, Homo sapiens
acaugaucuucuuuauaa

SEQ ID NO: 2085413 - RNA, 17 nt, Homo sapiens
aggacgcacgcucgcug

SEQ ID NO: 2085414 - RNA, 14 nt, Homo sapiens
uacuuuguaaagac

SEQ ID NO: 2085415 - RNA, 23 nt, Homo sapiens
auaauaggggauuuuaaaacucu

SEQ ID NO: 2085416 - RNA, 20 nt, Homo sapiens
cugaauaaauaauucuuccu

SEQ ID NO: 2085417 - RNA, 19 nt, Homo sapiens
ccaaaugagacacauuaaa

SEQ ID NO: 2085418 - RNA, 16 nt, Homo sapiens
gcaagucuuccaugac

SEQ ID NO: 2085419 - RNA, 24 nt, Homo sapiens
auacuacaugagaggacugaugaa

SEQ ID NO: 2085420 - RNA, 12 nt, Homo sapiens
agaaacaugcca

SEQ ID NO: 2085421 - RNA, 20 nt, Homo sapiens
gaccuaagggacucccacaa

SEQ ID NO: 2085422 - RNA, 16 nt, Homo sapiens
cuucccucgacuugac

SEQ ID NO: 2085423 - RNA, 15 nt, Homo sapiens
auagaacacaguuug

SEQ ID NO: 2085424 - RNA, 14 nt, Homo sapiens
aaggauugugaacu

SEQ ID NO: 2085425 - RNA, 15 nt, Homo sapiens
uucagcagucaauac

SEQ ID NO: 2085426 - RNA, 11 nt, Homo sapiens
auuuacuuaac

SEQ ID NO: 2085427 - RNA, 13 nt, Homo sapiens
uucaucacacugg

SEQ ID NO: 2085428 - RNA, 15 nt, Homo sapiens
uagggggaagacaga

SEQ ID NO: 2085429 - RNA, 16 nt, Homo sapiens
gugcacaucugugucu

SEQ ID NO: 2085430 - RNA, 17 nt, Homo sapiens
ccugugcgucccagcug

SEQ ID NO: 2085431 - RNA, 16 nt, Homo sapiens
ggccacuggauccugc

SEQ ID NO: 2085432 - RNA, 22 nt, Homo sapiens
aaaagagaugcuggauucagau

SEQ ID NO: 2085433 - RNA, 13 nt, Homo sapiens
ugguuugccaugu

SEQ ID NO: 2085434 - RNA, 19 nt, Homo sapiens
gacaaggauuagaacacuc

SEQ ID NO: 2085435 - RNA, 15 nt, Homo sapiens
ggguaaccuugauau

SEQ ID NO: 2085436 - RNA, 16 nt, Homo sapiens
aggagaugaugugaug

SEQ ID NO: 2085437 - RNA, 19 nt, Homo sapiens
aguuugccguuuguccuua

SEQ ID NO: 2085438 - RNA, 21 nt, Homo sapiens
uaaaguaguaaucauaaagga

SEQ ID NO: 2085439 - RNA, 12 nt, Homo sapiens
uagaacuugaga

SEQ ID NO: 2085440 - RNA, 16 nt, Homo sapiens
cuuaugccauauacaa

SEQ ID NO: 2085441 - RNA, 24 nt, Homo sapiens
caucaagaauggggaucacagaga

SEQ ID NO: 2085442 - RNA, 18 nt, Homo sapiens
agccaccuggcagggcuc

SEQ ID NO: 2085443 - RNA, 21 nt, Homo sapiens
aguguugaagaagaguuugca

SEQ ID NO: 2085444 - RNA, 18 nt, Homo sapiens
gcacuccagggcaucaca

SEQ ID NO: 2085445 - RNA, 17 nt, Homo sapiens
agaaucucaacaugucu

SEQ ID NO: 2085446 - RNA, 20 nt, Homo sapiens
agccugcacagcuucuugca

SEQ ID NO: 2085447 - RNA, 16 nt, Homo sapiens
aaaggugacaguauua

SEQ ID NO: 2085448 - RNA, 21 nt, Homo sapiens
ucaaaugaugaagaccaaaga

SEQ ID NO: 2085449 - RNA, 23 nt, Homo sapiens
ugagaaggcaaccaaagugcagg

SEQ ID NO: 2085450 - RNA, 20 nt, Homo sapiens
agaaugaacaaauugaacuc

SEQ ID NO: 2085451 - RNA, 19 nt, Homo sapiens
agucuucugccucuuaacu

SEQ ID NO: 2085452 - RNA, 18 nt, Homo sapiens
agagaaugcugucaauau

SEQ ID NO: 2085453 - RNA, 15 nt, Homo sapiens
agcgugaaucuguau

SEQ ID NO: 2085454 - RNA, 22 nt, Homo sapiens
ugcccaauuagggccuagccuu

SEQ ID NO: 2085455 - RNA, 22 nt, Homo sapiens
ucuucacacuaucaacacugca

SEQ ID NO: 2085456 - RNA, 14 nt, Homo sapiens
ccccauggucuuca

SEQ ID NO: 2085457 - RNA, 17 nt, Homo sapiens
ugauauuucucuaguag

SEQ ID NO: 2085458 - RNA, 18 nt, Homo sapiens
gguuuguugcagccaaag

SEQ ID NO: 2085459 - RNA, 15 nt, Homo sapiens
cugggauuacaggca

SEQ ID NO: 2085460 - RNA, 18 nt, Homo sapiens
uuugugaaguauucacaa

SEQ ID NO: 2085461 - RNA, 19 nt, Homo sapiens
aguuaaggauuguuuuaaa

SEQ ID NO: 2085462 - RNA, 13 nt, Homo sapiens
acuucgccagcug

SEQ ID NO: 2085463 - RNA, 19 nt, Homo sapiens
guaaauaaaacaucacuau

SEQ ID NO: 2085464 - RNA, 15 nt, Homo sapiens
aaguaugacaaccuc

SEQ ID NO: 2085465 - RNA, 20 nt, Homo sapiens
aaugagauuuacuuacaccc

SEQ ID NO: 2085466 - RNA, 17 nt, Homo sapiens
uuggcuucugugccuga

SEQ ID NO: 2085467 - RNA, 17 nt, Homo sapiens
cugaacuuuguggucga

SEQ ID NO: 2085468 - RNA, 20 nt, Homo sapiens
gacucuaaagucuguugauu

SEQ ID NO: 2085469 - RNA, 19 nt, Homo sapiens
aacaugauaccuggaucca

SEQ ID NO: 2085470 - RNA, 19 nt, Homo sapiens
cuuaucaaaaaugcaaauu

SEQ ID NO: 2085471 - RNA, 17 nt, Homo sapiens
auuuuauaaaacaaaua

SEQ ID NO: 2085472 - RNA, 20 nt, Homo sapiens
uaugaguaauacaucaaaga

SEQ ID NO: 2085473 - RNA, 14 nt, Homo sapiens
cugaggcugaaauu

SEQ ID NO: 2085474 - RNA, 14 nt, Homo sapiens
agaaauaugagcau

SEQ ID NO: 2085475 - RNA, 13 nt, Homo sapiens
ccaauaaaacuga

SEQ ID NO: 2085476 - RNA, 17 nt, Homo sapiens
aggugucccugccuuca

SEQ ID NO: 2085477 - RNA, 19 nt, Homo sapiens
cagugacacaacucaucca

SEQ ID NO: 2085478 - RNA, 21 nt, Homo sapiens
gagaaguaagcagaguucuuu

SEQ ID NO: 2085479 - RNA, 16 nt, Homo sapiens
cguaauuauacuuaaa

SEQ ID NO: 2085480 - RNA, 22 nt, Homo sapiens
uucuaugguuaugaaagaauau

SEQ ID NO: 2085481 - RNA, 17 nt, Homo sapiens
gagggaaggggacagau

SEQ ID NO: 2085482 - RNA, 18 nt, Homo sapiens
caggccucccuagcaccu

SEQ ID NO: 2085483 - RNA, 21 nt, Homo sapiens
aaacuguaugugcaguuauuu

SEQ ID NO: 2085484 - RNA, 19 nt, Homo sapiens
auaacagcuaccaugacaa

SEQ ID NO: 2085485 - RNA, 21 nt, Homo sapiens
guagaaacugaggcccagaga

SEQ ID NO: 2085486 - RNA, 21 nt, Homo sapiens
ugggcaacucgugacagccuc

SEQ ID NO: 2085487 - RNA, 16 nt, Homo sapiens
uugaggcaaaagaagg

SEQ ID NO: 2085488 - RNA, 16 nt, Homo sapiens
aaaaucaugggccaga

SEQ ID NO: 2085489 - RNA, 20 nt, Homo sapiens
gguucuuuacaaaugguauu

SEQ ID NO: 2085490 - RNA, 14 nt, Homo sapiens
cacagaguuguuac

SEQ ID NO: 2085491 - RNA, 22 nt, Homo sapiens
caucaagaugagagaacuggag

SEQ ID NO: 2085492 - RNA, 15 nt, Homo sapiens
aaacccauuuacuua

SEQ ID NO: 2085493 - RNA, 12 nt, Homo sapiens
ccucugcucagg

SEQ ID NO: 2085494 - RNA, 21 nt, Homo sapiens
ucucaaaauaaaaccagaaag

SEQ ID NO: 2085495 - RNA, 22 nt, Homo sapiens
caguuuuaaaaaaaacaauucc

SEQ ID NO: 2085496 - RNA, 20 nt, Homo sapiens
uacaguuuuuauugcuuguu

SEQ ID NO: 2085497 - RNA, 15 nt, Homo sapiens
ucccuggaugacauu

SEQ ID NO: 2085498 - RNA, 13 nt, Homo sapiens
cauugaacuguac

SEQ ID NO: 2085499 - RNA, 21 nt, Homo sapiens
uauuggacaguaaaauccaca

SEQ ID NO: 2085500 - RNA, 13 nt, Homo sapiens
caaaucacugcau

SEQ ID NO: 2085501 - RNA, 13 nt, Homo sapiens
guuucagcacuag

SEQ ID NO: 2085502 - RNA, 14 nt, Homo sapiens
aaaucagacuauga

SEQ ID NO: 2085503 - RNA, 16 nt, Homo sapiens
aguuacuaccugucaa

SEQ ID NO: 2085504 - RNA, 18 nt, Homo sapiens
ucaaacauauguauacaa

SEQ ID NO: 2085505 - RNA, 13 nt, Homo sapiens
acagccucuugcc

SEQ ID NO: 2085506 - RNA, 17 nt, Homo sapiens
aauauuuuacaguuuuu

SEQ ID NO: 2085507 - RNA, 23 nt, Homo sapiens
cuuuccuuuaaaaauacauagca

SEQ ID NO: 2085508 - RNA, 20 nt, Homo sapiens
gagggugacccauuucagga

SEQ ID NO: 2085509 - RNA, 14 nt, Homo sapiens
aauccacaguauug

SEQ ID NO: 2085510 - RNA, 17 nt, Homo sapiens
guccuuauucuucucau

SEQ ID NO: 2085511 - RNA, 16 nt, Homo sapiens
cuuuguauuucaucuc

SEQ ID NO: 2085512 - RNA, 16 nt, Homo sapiens
acauauucaaaguaua

SEQ ID NO: 2085513 - RNA, 13 nt, Homo sapiens
aaggcagugagcu

SEQ ID NO: 2085514 - RNA, 13 nt, Homo sapiens
acaccacaaaaac

SEQ ID NO: 2085515 - RNA, 23 nt, Homo sapiens
ccuugacauuguagagcuucugg

SEQ ID NO: 2085516 - RNA, 13 nt, Homo sapiens
agcagugccagcu

SEQ ID NO: 2085517 - RNA, 21 nt, Homo sapiens
auuuauauacaagugauaaua

SEQ ID NO: 2085518 - RNA, 22 nt, Homo sapiens
cuguuguaacuaggcucagaga

SEQ ID NO: 2085519 - RNA, 19 nt, Homo sapiens
ucagcaaaaaaguacuuaa

SEQ ID NO: 2085520 - RNA, 18 nt, Homo sapiens
cuuugaaauugaaccuuu

SEQ ID NO: 2085521 - RNA, 18 nt, Homo sapiens
caauguguggcucagugc

SEQ ID NO: 2085522 - RNA, 18 nt, Homo sapiens
cuauuugcuuuaaugaga

SEQ ID NO: 2085523 - RNA, 17 nt, Homo sapiens
cagauggcaccuguggc

SEQ ID NO: 2085524 - RNA, 15 nt, Homo sapiens
cauguucucccaaau

SEQ ID NO: 2085525 - RNA, 16 nt, Homo sapiens
uaaaucguccucccag

SEQ ID NO: 2085526 - RNA, 22 nt, Homo sapiens
ccaggucccuuucauuugcuau

SEQ ID NO: 2085527 - RNA, 17 nt, Homo sapiens
cugggcugagugacaca

SEQ ID NO: 2085528 - RNA, 13 nt, Homo sapiens
gggcuacauugua

SEQ ID NO: 2085529 - RNA, 20 nt, Homo sapiens
cuagccugggaaacauagga

SEQ ID NO: 2085530 - RNA, 19 nt, Homo sapiens
ucauuuaaaacaggcaaag

SEQ ID NO: 2085531 - RNA, 18 nt, Homo sapiens
acucaaccaucaauggaa

SEQ ID NO: 2085532 - RNA, 17 nt, Homo sapiens
uuuaauuucuauggaag

SEQ ID NO: 2085533 - RNA, 15 nt, Homo sapiens
agugggaacugugca

SEQ ID NO: 2085534 - RNA, 18 nt, Homo sapiens
gacuacaauaaaaccaaa

SEQ ID NO: 2085535 - RNA, 16 nt, Homo sapiens
aagggaggguggcaga

SEQ ID NO: 2085536 - RNA, 22 nt, Homo sapiens
gugcugcucuaggcccacaagu

SEQ ID NO: 2085537 - RNA, 16 nt, Homo sapiens
acugauguuacuagcc

SEQ ID NO: 2085538 - RNA, 14 nt, Homo sapiens
acgccaaugcacac

SEQ ID NO: 2085539 - RNA, 16 nt, Homo sapiens
aaucaaaugugcaucc

SEQ ID NO: 2085540 - RNA, 22 nt, Homo sapiens
aaauuuuaauauuccagaagaa

SEQ ID NO: 2085541 - RNA, 18 nt, Homo sapiens
ccugccccuccccaaaag

SEQ ID NO: 2085542 - RNA, 14 nt, Homo sapiens
cuguccacacccag

SEQ ID NO: 2085543 - RNA, 15 nt, Homo sapiens
ugaaggaucuugccu

SEQ ID NO: 2085544 - RNA, 20 nt, Homo sapiens
agugcacacggaugcacaga

SEQ ID NO: 2085545 - RNA, 13 nt, Homo sapiens
cuuugcaaugcaa

SEQ ID NO: 2085546 - RNA, 12 nt, Homo sapiens
ugaggacaaaga

SEQ ID NO: 2085547 - RNA, 14 nt, Homo sapiens
cauguaucuaugca

SEQ ID NO: 2085548 - RNA, 19 nt, Homo sapiens
uuaaacuugacccaggugg

SEQ ID NO: 2085549 - RNA, 20 nt, Homo sapiens
uaaauguaaaauauuugaga

SEQ ID NO: 2085550 - RNA, 16 nt, Homo sapiens
ucccgaguagcuggaa

SEQ ID NO: 2085551 - RNA, 23 nt, Homo sapiens
agccugccagcaguuacugugaa

SEQ ID NO: 2085552 - RNA, 16 nt, Homo sapiens
acuggcaguuuuccau

SEQ ID NO: 2085553 - RNA, 21 nt, Homo sapiens
uugguguugccaguuguccuc

SEQ ID NO: 2085554 - RNA, 18 nt, Homo sapiens
agcucccagauggcccug

SEQ ID NO: 2085555 - RNA, 15 nt, Homo sapiens
gcagaguuugccuuc

SEQ ID NO: 2085556 - RNA, 18 nt, Homo sapiens
caugagggagaugccaug

SEQ ID NO: 2085557 - RNA, 21 nt, Homo sapiens
uagggagcauuuggguuugaa

SEQ ID NO: 2085558 - RNA, 18 nt, Homo sapiens
auuuuccuguucagugag

SEQ ID NO: 2085559 - RNA, 22 nt, Homo sapiens
uguugcacugaaguuugauaaa

SEQ ID NO: 2085560 - RNA, 18 nt, Homo sapiens
gucaucaacaaaagggag

SEQ ID NO: 2085561 - RNA, 15 nt, Homo sapiens
agucaaauaccacau

SEQ ID NO: 2085562 - RNA, 21 nt, Homo sapiens
acuauuguuacauuaugugga

SEQ ID NO: 2085563 - RNA, 23 nt, Homo sapiens
cacuccaguugcagaccaucgca

SEQ ID NO: 2085564 - RNA, 11 nt, Homo sapiens
cuuccaugccc

SEQ ID NO: 2085565 - RNA, 15 nt, Homo sapiens
cuuguaauuguggau

SEQ ID NO: 2085566 - RNA, 17 nt, Homo sapiens
auaaaauaguuguccau

SEQ ID NO: 2085567 - RNA, 18 nt, Homo sapiens
ugacucagaggcugggag

SEQ ID NO: 2085568 - RNA, 23 nt, Homo sapiens
gugcugguuccaugccugcucuc

SEQ ID NO: 2085569 - RNA, 15 nt, Homo sapiens
ugcugcagagcagua

SEQ ID NO: 2085570 - RNA, 18 nt, Homo sapiens
cacugguaccggaugcag

SEQ ID NO: 2085571 - RNA, 14 nt, Homo sapiens
ugauuaaaugacac

SEQ ID NO: 2085572 - RNA, 14 nt, Homo sapiens
aauaaaaacaucag

SEQ ID NO: 2085573 - RNA, 13 nt, Homo sapiens
agucaaauccagu

SEQ ID NO: 2085574 - RNA, 14 nt, Homo sapiens
agaggugcugcuuu

SEQ ID NO: 2085575 - RNA, 16 nt, Homo sapiens
uccucugcaugucuca

SEQ ID NO: 2085576 - RNA, 18 nt, Homo sapiens
guggcugauauuaacugu

SEQ ID NO: 2085577 - RNA, 14 nt, Homo sapiens
cacccugcuuuggc

SEQ ID NO: 2085578 - RNA, 19 nt, Homo sapiens
ugcgcacaaggcugaccaa

SEQ ID NO: 2085579 - RNA, 19 nt, Homo sapiens
gcaauaaaucugacccagu

SEQ ID NO: 2085580 - RNA, 14 nt, Homo sapiens
ugagaggcaaugau

SEQ ID NO: 2085581 - RNA, 21 nt, Homo sapiens
uuuuuuguuauguuugcacuu

SEQ ID NO: 2085582 - RNA, 20 nt, Homo sapiens
gagaaccagugcagacucaa

SEQ ID NO: 2085583 - RNA, 23 nt, Homo sapiens
agguuguguugccugcugagcug

SEQ ID NO: 2085584 - RNA, 19 nt, Homo sapiens
aaauaaugcaccacuuuua

SEQ ID NO: 2085585 - RNA, 17 nt, Homo sapiens
aaucaaugguagcauuu

SEQ ID NO: 2085586 - RNA, 19 nt, Homo sapiens
ucauuugcugacacaucag

SEQ ID NO: 2085587 - RNA, 13 nt, Homo sapiens
gucucauuaucuc

SEQ ID NO: 2085588 - RNA, 17 nt, Homo sapiens
gaauguuuauguucuca

SEQ ID NO: 2085589 - RNA, 21 nt, Homo sapiens
gacuacagccugccccugacu

SEQ ID NO: 2085590 - RNA, 14 nt, Homo sapiens
ccauaaaccucaag

SEQ ID NO: 2085591 - RNA, 23 nt, Homo sapiens
uccaugccuuuaauguugcccac

SEQ ID NO: 2085592 - RNA, 16 nt, Homo sapiens
agccugagccaaagag

SEQ ID NO: 2085593 - RNA, 23 nt, Homo sapiens
ucucuaauauguaaaauuacacu

SEQ ID NO: 2085594 - RNA, 22 nt, Homo sapiens
uugacggaaacaacguugcuau

SEQ ID NO: 2085595 - RNA, 15 nt, Homo sapiens
ucgcacccacuguga

SEQ ID NO: 2085596 - RNA, 12 nt, Homo sapiens
aggaaagugauu

SEQ ID NO: 2085597 - RNA, 13 nt, Homo sapiens
ucaugcauuugca

SEQ ID NO: 2085598 - RNA, 19 nt, Homo sapiens
agcucagggcccaucccuu

SEQ ID NO: 2085599 - RNA, 18 nt, Homo sapiens
cauggguuggcagggugg

SEQ ID NO: 2085600 - RNA, 22 nt, Homo sapiens
ugauaagcaggaaggauggcaa

SEQ ID NO: 2085601 - RNA, 13 nt, Homo sapiens
auguuguuugcug

SEQ ID NO: 2085602 - RNA, 21 nt, Homo sapiens
ccgugggggcaggggaccugg

SEQ ID NO: 2085603 - RNA, 15 nt, Homo sapiens
uaagcuaucagcaau

SEQ ID NO: 2085604 - RNA, 15 nt, Homo sapiens
cagagacacaagccu

SEQ ID NO: 2085605 - RNA, 22 nt, Homo sapiens
auuuuaauaaaaugaaaggguc

SEQ ID NO: 2085606 - RNA, 19 nt, Homo sapiens
aaaaccuuuccccagacac

SEQ ID NO: 2085607 - RNA, 14 nt, Homo sapiens
gacaaugauccagu

SEQ ID NO: 2085608 - RNA, 21 nt, Homo sapiens
acaggcaacugaggcagacag

SEQ ID NO: 2085609 - RNA, 19 nt, Homo sapiens
gaaugcaaccaagucacac

SEQ ID NO: 2085610 - RNA, 22 nt, Homo sapiens
cauccucugauagcuguuucaa

SEQ ID NO: 2085611 - RNA, 21 nt, Homo sapiens
aacuuuaaauucaagcugcuu

SEQ ID NO: 2085612 - RNA, 20 nt, Homo sapiens
ugugauggacacuccaggga

SEQ ID NO: 2085613 - RNA, 17 nt, Homo sapiens
uacccccugugccuugu

SEQ ID NO: 2085614 - RNA, 19 nt, Homo sapiens
auaccuggcuuuuacuuua

SEQ ID NO: 2085615 - RNA, 18 nt, Homo sapiens
ucacagugggagccaggg

SEQ ID NO: 2085616 - RNA, 18 nt, Homo sapiens
gagauuacagagaucuca

SEQ ID NO: 2085617 - RNA, 16 nt, Homo sapiens
aguuuccucaucugca

SEQ ID NO: 2085618 - RNA, 23 nt, Homo sapiens
aacacguguuccgguggcagauu

SEQ ID NO: 2085619 - RNA, 23 nt, Homo sapiens
aacgagauaccaucucacaccag

SEQ ID NO: 2085620 - RNA, 14 nt, Homo sapiens
ugugacuacuaugg

SEQ ID NO: 2085621 - RNA, 20 nt, Homo sapiens
ccaagagucacuucuaauaa

SEQ ID NO: 2085622 - RNA, 22 nt, Homo sapiens
cgcaccauuucugucacucaca

SEQ ID NO: 2085623 - RNA, 15 nt, Homo sapiens
cuggggcaggucacu

SEQ ID NO: 2085624 - RNA, 15 nt, Homo sapiens
cagacaaaugugguu

SEQ ID NO: 2085625 - RNA, 15 nt, Homo sapiens
guuuccagugacaca

SEQ ID NO: 2085626 - RNA, 11 nt, Homo sapiens
uauguguccuu

SEQ ID NO: 2085627 - RNA, 23 nt, Homo sapiens
cuaaggacgaaaaacacagugca

SEQ ID NO: 2085628 - RNA, 12 nt, Homo sapiens
uuguacauuccc

SEQ ID NO: 2085629 - RNA, 18 nt, Homo sapiens
aauucuggucacauucca

SEQ ID NO: 2085630 - RNA, 15 nt, Homo sapiens
ucugcccaauccauc

SEQ ID NO: 2085631 - RNA, 18 nt, Homo sapiens
aggcgauugaaaccauug

SEQ ID NO: 2085632 - RNA, 15 nt, Homo sapiens
ggguggaugaucuca

SEQ ID NO: 2085633 - RNA, 14 nt, Homo sapiens
uucaacauaugaau

SEQ ID NO: 2085634 - RNA, 20 nt, Homo sapiens
uaccauugaaacaugccacu

SEQ ID NO: 2085635 - RNA, 20 nt, Homo sapiens
aaagaaucacaguacuuucc

SEQ ID NO: 2085636 - RNA, 14 nt, Homo sapiens
caaauugcagacug

SEQ ID NO: 2085637 - RNA, 21 nt, Homo sapiens
ugaggagaggaguuuucucca

SEQ ID NO: 2085638 - RNA, 18 nt, Homo sapiens
gugagaacccuugcacua

SEQ ID NO: 2085639 - RNA, 20 nt, Homo sapiens
acaaagaugucuuaaccuca

SEQ ID NO: 2085640 - RNA, 19 nt, Homo sapiens
ugcugugacaggcaguguu

SEQ ID NO: 2085641 - RNA, 17 nt, Homo sapiens
acuuaucugaucagaac

SEQ ID NO: 2085642 - RNA, 17 nt, Homo sapiens
agcagcaaaaacuacau

SEQ ID NO: 2085643 - RNA, 23 nt, Homo sapiens
ucagaugcuguuaguaccuacau

SEQ ID NO: 2085644 - RNA, 16 nt, Homo sapiens
acuuaagugugcaaaa

SEQ ID NO: 2085645 - RNA, 19 nt, Homo sapiens
uuuuaagaugugucuucaa

SEQ ID NO: 2085646 - RNA, 14 nt, Homo sapiens
accacaccaucagg

SEQ ID NO: 2085647 - RNA, 15 nt, Homo sapiens
ccaaagcagaaaaga

SEQ ID NO: 2085648 - RNA, 15 nt, Homo sapiens
gauucccaccuucca

SEQ ID NO: 2085649 - RNA, 20 nt, Homo sapiens
gaaguuuauuuucuauuuua

SEQ ID NO: 2085650 - RNA, 11 nt, Homo sapiens
gcugugcugag

SEQ ID NO: 2085651 - RNA, 15 nt, Homo sapiens
auuugcugcauuuca

SEQ ID NO: 2085652 - RNA, 14 nt, Homo sapiens
gcagaggucuccca

SEQ ID NO: 2085653 - RNA, 24 nt, Homo sapiens
acccagagaguccugugcugaaug

SEQ ID NO: 2085654 - RNA, 17 nt, Homo sapiens
gacuuccaaacaacucu

SEQ ID NO: 2085655 - RNA, 15 nt, Homo sapiens
gaauaugaauggauu

SEQ ID NO: 2085656 - RNA, 20 nt, Homo sapiens
cugccaggcuguuucagcca

SEQ ID NO: 2085657 - RNA, 14 nt, Homo sapiens
auauucuucuacca

SEQ ID NO: 2085658 - RNA, 13 nt, Homo sapiens
ccaacgcacagga

SEQ ID NO: 2085659 - RNA, 16 nt, Homo sapiens
uaacugugcugaaugc

SEQ ID NO: 2085660 - RNA, 22 nt, Homo sapiens
cagaccucggugggcauucaca

SEQ ID NO: 2085661 - RNA, 14 nt, Homo sapiens
ucaugucaugugua

SEQ ID NO: 2085662 - RNA, 17 nt, Homo sapiens
ccuguucaaaguacuaa

SEQ ID NO: 2085663 - RNA, 20 nt, Homo sapiens
acccugaaaggaacacuggc

SEQ ID NO: 2085664 - RNA, 18 nt, Homo sapiens
aguuuuaaggacuucauc

SEQ ID NO: 2085665 - RNA, 17 nt, Homo sapiens
uggucaauaaagcuccu

SEQ ID NO: 2085666 - RNA, 19 nt, Homo sapiens
agggcuuggacucaagcaa

SEQ ID NO: 2085667 - RNA, 18 nt, Homo sapiens
cccagauucaugcacugu

SEQ ID NO: 2085668 - RNA, 18 nt, Homo sapiens
caaaggacaaaaauauaa

SEQ ID NO: 2085669 - RNA, 21 nt, Homo sapiens
cuaauuguauuuagugacaaa

SEQ ID NO: 2085670 - RNA, 17 nt, Homo sapiens
gauuuuucugcacuaau

SEQ ID NO: 2085671 - RNA, 11 nt, Homo sapiens
guccauucucu

SEQ ID NO: 2085672 - RNA, 20 nt, Homo sapiens
uguuagccgggauggucuug

SEQ ID NO: 2085673 - RNA, 20 nt, Homo sapiens
gccuaggggucagggaccaa

SEQ ID NO: 2085674 - RNA, 16 nt, Homo sapiens
aguuccggaaagccuu

SEQ ID NO: 2085675 - RNA, 17 nt, Homo sapiens
guccauggaaugcuuga

SEQ ID NO: 2085676 - RNA, 19 nt, Homo sapiens
cugucuccuuuggucuucu

SEQ ID NO: 2085677 - RNA, 20 nt, Homo sapiens
agcuauuuauguucaucuuc

SEQ ID NO: 2085678 - RNA, 16 nt, Homo sapiens
uacugagauagcuuag

SEQ ID NO: 2085679 - RNA, 16 nt, Homo sapiens
ccaguccaugcuccag

SEQ ID NO: 2085680 - RNA, 19 nt, Homo sapiens
aucuuuuuaccuuucauac

SEQ ID NO: 2085681 - RNA, 21 nt, Homo sapiens
ugccccuuguccugaagccca

SEQ ID NO: 2085682 - RNA, 16 nt, Homo sapiens
ucuuagauauucacua

SEQ ID NO: 2085683 - RNA, 15 nt, Homo sapiens
caagauaagcuucca

SEQ ID NO: 2085684 - RNA, 17 nt, Homo sapiens
uucaggaaggucuucaa

SEQ ID NO: 2085685 - RNA, 14 nt, Homo sapiens
aaacaaaauccuug

SEQ ID NO: 2085686 - RNA, 20 nt, Homo sapiens
gauguuccacuccacuuugu

SEQ ID NO: 2085687 - RNA, 20 nt, Homo sapiens
gacuucugugggccccucaa

SEQ ID NO: 2085688 - RNA, 14 nt, Homo sapiens
ucccgcagggcuga

SEQ ID NO: 2085689 - RNA, 24 nt, Homo sapiens
ccccagagcuuuacagugccacga

SEQ ID NO: 2085690 - RNA, 21 nt, Homo sapiens
gcccacccccacccccagugc

SEQ ID NO: 2085691 - RNA, 23 nt, Homo sapiens
acaaauugcacagaaguccugua

SEQ ID NO: 2085692 - RNA, 22 nt, Homo sapiens
gcacuuaguaguuuuuacaaaa

SEQ ID NO: 2085693 - RNA, 21 nt, Homo sapiens
gccugugguuaacaucucaga

SEQ ID NO: 2085694 - RNA, 15 nt, Homo sapiens
ccccgucacagccuc

SEQ ID NO: 2085695 - RNA, 15 nt, Homo sapiens
uuaaacaaaaacuag

SEQ ID NO: 2085696 - RNA, 13 nt, Homo sapiens
aaccacugggauc

SEQ ID NO: 2085697 - RNA, 19 nt, Homo sapiens
ugugacaucuacaacucca

SEQ ID NO: 2085698 - RNA, 14 nt, Homo sapiens
auaaaaucuuacuu

SEQ ID NO: 2085699 - RNA, 14 nt, Homo sapiens
acacacacucugaa

SEQ ID NO: 2085700 - RNA, 23 nt, Homo sapiens
aauaguguugcuuuaaauugugc

SEQ ID NO: 2085701 - RNA, 15 nt, Homo sapiens
cacagccuagcacag

SEQ ID NO: 2085702 - RNA, 21 nt, Homo sapiens
ccagcacagcuuagauuucau

SEQ ID NO: 2085703 - RNA, 15 nt, Homo sapiens
caacaauaaagacug

SEQ ID NO: 2085704 - RNA, 22 nt, Homo sapiens
ugcagggaagccccacuugaag

SEQ ID NO: 2085705 - RNA, 20 nt, Homo sapiens
cacaaagaagaaguuuaaaa

SEQ ID NO: 2085706 - RNA, 19 nt, Homo sapiens
acuuacauuuacaaacuga

SEQ ID NO: 2085707 - RNA, 13 nt, Homo sapiens
cugcaggccaaga

SEQ ID NO: 2085708 - RNA, 14 nt, Homo sapiens
gcuucuugccucug

SEQ ID NO: 2085709 - RNA, 14 nt, Homo sapiens
uugccucuuuccuc

SEQ ID NO: 2085710 - RNA, 22 nt, Homo sapiens
cuuuucauggucucugcaccca

SEQ ID NO: 2085711 - RNA, 17 nt, Homo sapiens
aaacuggguaaugcaac

SEQ ID NO: 2085712 - RNA, 21 nt, Homo sapiens
uucuaaggccuaggauucuaa

SEQ ID NO: 2085713 - RNA, 20 nt, Homo sapiens
cuuaaaagaaaauguucacu

SEQ ID NO: 2085714 - RNA, 19 nt, Homo sapiens
gaaaggucauuguggcuau

SEQ ID NO: 2085715 - RNA, 20 nt, Homo sapiens
aggucuguacguuaccucuu

SEQ ID NO: 2085716 - RNA, 17 nt, Homo sapiens
uugcaacuaaggacaaa

SEQ ID NO: 2085717 - RNA, 16 nt, Homo sapiens
ugcuaauuaauacauc

SEQ ID NO: 2085718 - RNA, 16 nt, Homo sapiens
uuuggaaguguuaacu

SEQ ID NO: 2085719 - RNA, 19 nt, Homo sapiens
gaguccagacaccaucacc

SEQ ID NO: 2085720 - RNA, 21 nt, Homo sapiens
cccaucugaaccacuuugccu

SEQ ID NO: 2085721 - RNA, 18 nt, Homo sapiens
gaagcauuucagguugug

SEQ ID NO: 2085722 - RNA, 12 nt, Homo sapiens
aaucccagcugg

SEQ ID NO: 2085723 - RNA, 23 nt, Homo sapiens
uaucauuuauuuacaucuaugua

SEQ ID NO: 2085724 - RNA, 14 nt, Homo sapiens
uggcaagugauauu

SEQ ID NO: 2085725 - RNA, 23 nt, Homo sapiens
acugugagaggugacacuguugg

SEQ ID NO: 2085726 - RNA, 19 nt, Homo sapiens
caucucggaguucagacuc

SEQ ID NO: 2085727 - RNA, 18 nt, Homo sapiens
gaaagggauaguccaaag

SEQ ID NO: 2085728 - RNA, 18 nt, Homo sapiens
gccucugugucacuggcu

SEQ ID NO: 2085729 - RNA, 22 nt, Homo sapiens
uggauaggcacauagagaggga

SEQ ID NO: 2085730 - RNA, 17 nt, Homo sapiens
ucacucucaccuuccaa

SEQ ID NO: 2085731 - RNA, 14 nt, Homo sapiens
ucuaggcagcaccu

SEQ ID NO: 2085732 - RNA, 19 nt, Homo sapiens
cugaauaccacuuaccuca

SEQ ID NO: 2085733 - RNA, 13 nt, Homo sapiens
uacauguaucuaa

SEQ ID NO: 2085734 - RNA, 13 nt, Homo sapiens
uucauccaaggaa

SEQ ID NO: 2085735 - RNA, 23 nt, Homo sapiens
aaugggauaugggguuacuucag

SEQ ID NO: 2085736 - RNA, 18 nt, Homo sapiens
cugccggggguucagggu

SEQ ID NO: 2085737 - RNA, 16 nt, Homo sapiens
uuguauuuauggaaga

SEQ ID NO: 2085738 - RNA, 16 nt, Homo sapiens
ggccuuacagucuucu

SEQ ID NO: 2085739 - RNA, 18 nt, Homo sapiens
augaagacccaguguaaa

SEQ ID NO: 2085740 - RNA, 13 nt, Homo sapiens
ucauuuauuucca

SEQ ID NO: 2085741 - RNA, 13 nt, Homo sapiens
agaccaguacugg

SEQ ID NO: 2085742 - RNA, 13 nt, Homo sapiens
gguccagugcagg

SEQ ID NO: 2085743 - RNA, 23 nt, Homo sapiens
gcagcuguuuuaguuaaauuucu

SEQ ID NO: 2085744 - RNA, 19 nt, Homo sapiens
aagucucacauauucauca

SEQ ID NO: 2085745 - RNA, 14 nt, Homo sapiens
auucaaauuguuaa

SEQ ID NO: 2085746 - RNA, 17 nt, Homo sapiens
ucaagcucaucuguuau

SEQ ID NO: 2085747 - RNA, 18 nt, Homo sapiens
uuuaaaugacgcacaaac

SEQ ID NO: 2085748 - RNA, 20 nt, Homo sapiens
ccccagggcccacuagcauc

SEQ ID NO: 2085749 - RNA, 20 nt, Homo sapiens
gaagagaagcugcugaccaa

SEQ ID NO: 2085750 - RNA, 20 nt, Homo sapiens
ugcuauuuuauuuguauuca

SEQ ID NO: 2085751 - RNA, 11 nt, Homo sapiens
aaguugcagcu

SEQ ID NO: 2085752 - RNA, 18 nt, Homo sapiens
aaguagcucuggugaccu

SEQ ID NO: 2085753 - RNA, 17 nt, Homo sapiens
aguguacccaucuuuaa

SEQ ID NO: 2085754 - RNA, 15 nt, Homo sapiens
caaaaugcaaaccaa

SEQ ID NO: 2085755 - RNA, 22 nt, Homo sapiens
ugcaaucucuuuucuacauaca

SEQ ID NO: 2085756 - RNA, 11 nt, Homo sapiens
aacacaucugg

SEQ ID NO: 2085757 - RNA, 21 nt, Homo sapiens
cuaugugggugggaccacaga

SEQ ID NO: 2085758 - RNA, 14 nt, Homo sapiens
augugggucuucca

SEQ ID NO: 2085759 - RNA, 16 nt, Homo sapiens
aguauggaaucagcug

SEQ ID NO: 2085760 - RNA, 23 nt, Homo sapiens
acgugaaauacuucgaugaugau

SEQ ID NO: 2085761 - RNA, 16 nt, Homo sapiens
uuaccaaaauucacua

SEQ ID NO: 2085762 - RNA, 20 nt, Homo sapiens
cauuccguuaggaauaacac

SEQ ID NO: 2085763 - RNA, 12 nt, Homo sapiens
cuggugggacaa

SEQ ID NO: 2085764 - RNA, 18 nt, Homo sapiens
uaagacacacagccuuuc

SEQ ID NO: 2085765 - RNA, 16 nt, Homo sapiens
gagaucugcacaguca

SEQ ID NO: 2085766 - RNA, 15 nt, Homo sapiens
aaaaaucagugaaua

SEQ ID NO: 2085767 - RNA, 14 nt, Homo sapiens
cucagagacauaca

SEQ ID NO: 2085768 - RNA, 20 nt, Homo sapiens
aucaacuggggggaccaaau

SEQ ID NO: 2085769 - RNA, 20 nt, Homo sapiens
ugcucaauaaaggucauauu

SEQ ID NO: 2085770 - RNA, 13 nt, Homo sapiens
uuccuugccuuaa

SEQ ID NO: 2085771 - RNA, 20 nt, Homo sapiens
acagcugggagccuuugcca

SEQ ID NO: 2085772 - RNA, 12 nt, Homo sapiens
acaaaggccaca

SEQ ID NO: 2085773 - RNA, 13 nt, Homo sapiens
auuucacagugug

SEQ ID NO: 2085774 - RNA, 20 nt, Homo sapiens
ucuuuuucagaaacagugag

SEQ ID NO: 2085775 - RNA, 16 nt, Homo sapiens
uccauguauucacaca

SEQ ID NO: 2085776 - RNA, 14 nt, Homo sapiens
uggucagauuugaa

SEQ ID NO: 2085777 - RNA, 22 nt, Homo sapiens
cugcagcacgcggccuugucug

SEQ ID NO: 2085778 - RNA, 16 nt, Homo sapiens
aaaauagacuaacuuc

SEQ ID NO: 2085779 - RNA, 15 nt, Homo sapiens
agcagcccagcauuu

SEQ ID NO: 2085780 - RNA, 14 nt, Homo sapiens
gcccagcucuuugu

SEQ ID NO: 2085781 - RNA, 20 nt, Homo sapiens
acuccaaugucugcugagga

SEQ ID NO: 2085782 - RNA, 14 nt, Homo sapiens
uaaaaguaaauuca

SEQ ID NO: 2085783 - RNA, 14 nt, Homo sapiens
agguucugcacucc

SEQ ID NO: 2085784 - RNA, 14 nt, Homo sapiens
gaggaaaaauggga

SEQ ID NO: 2085785 - RNA, 16 nt, Homo sapiens
auguaucuaugcauuu

SEQ ID NO: 2085786 - RNA, 16 nt, Homo sapiens
auguuguaaugcugca

SEQ ID NO: 2085787 - RNA, 20 nt, Homo sapiens
ggcucauucugcaaugagcc

SEQ ID NO: 2085788 - RNA, 15 nt, Homo sapiens
cgauguguccaaucg

SEQ ID NO: 2085789 - RNA, 21 nt, Homo sapiens
acugugauggggucaucaaau

SEQ ID NO: 2085790 - RNA, 21 nt, Homo sapiens
cuugcccagcagcucaagaag

SEQ ID NO: 2085791 - RNA, 22 nt, Homo sapiens
gggaagugguccagaaacaaaa

SEQ ID NO: 2085792 - RNA, 13 nt, Homo sapiens
aaugccaucagcc

SEQ ID NO: 2085793 - RNA, 17 nt, Homo sapiens
caccaccgacugaagug

SEQ ID NO: 2085794 - RNA, 22 nt, Homo sapiens
gcucuacguggcaaauuaacuu

SEQ ID NO: 2085795 - RNA, 20 nt, Homo sapiens
caaguagcaggacuaggcau

SEQ ID NO: 2085796 - RNA, 21 nt, Homo sapiens
caccccagcugaccugguacu

SEQ ID NO: 2085797 - RNA, 13 nt, Homo sapiens
aguuccuagccac

SEQ ID NO: 2085798 - RNA, 13 nt, Homo sapiens
agaggcaccugcu

SEQ ID NO: 2085799 - RNA, 22 nt, Homo sapiens
ucagccuuggcuggaguagaau

SEQ ID NO: 2085800 - RNA, 14 nt, Homo sapiens
augauacuuacuga

SEQ ID NO: 2085801 - RNA, 17 nt, Homo sapiens
cacaagcuaggccaaug

SEQ ID NO: 2085802 - RNA, 11 nt, Homo sapiens
ugcgugccauc

SEQ ID NO: 2085803 - RNA, 17 nt, Homo sapiens
ugagcuuagauugccuc

SEQ ID NO: 2085804 - RNA, 20 nt, Homo sapiens
cagacuucauagaauacuca

SEQ ID NO: 2085805 - RNA, 19 nt, Homo sapiens
ccuccugaaccgcacagcu

SEQ ID NO: 2085806 - RNA, 21 nt, Homo sapiens
uuuugauuuaauaacauaaca

SEQ ID NO: 2085807 - RNA, 12 nt, Homo sapiens
uaauaauaccuc

SEQ ID NO: 2085808 - RNA, 22 nt, Homo sapiens
acaggauggucucugccaugaa

SEQ ID NO: 2085809 - RNA, 12 nt, Homo sapiens
gggcagccuuuc

SEQ ID NO: 2085810 - RNA, 13 nt, Homo sapiens
ugugaacaaccug

SEQ ID NO: 2085811 - RNA, 17 nt, Homo sapiens
agaaaaggcaagacuug

SEQ ID NO: 2085812 - RNA, 13 nt, Homo sapiens
uguuaaucugaug

SEQ ID NO: 2085813 - RNA, 22 nt, Homo sapiens
ccaguuuuucacauuaucuuug

SEQ ID NO: 2085814 - RNA, 16 nt, Homo sapiens
cccauagaaacauucu

SEQ ID NO: 2085815 - RNA, 19 nt, Homo sapiens
uuacaauucccaaaggcaa

SEQ ID NO: 2085816 - RNA, 16 nt, Homo sapiens
caguacugaagacucu

SEQ ID NO: 2085817 - RNA, 22 nt, Homo sapiens
auccucaagaucauucaguguu

SEQ ID NO: 2085818 - RNA, 21 nt, Homo sapiens
uagagguagguaggaucaucc

SEQ ID NO: 2085819 - RNA, 15 nt, Homo sapiens
acaggagcauguccu

SEQ ID NO: 2085820 - RNA, 20 nt, Homo sapiens
gagaagccacaggccugaga

SEQ ID NO: 2085821 - RNA, 15 nt, Homo sapiens
ccuuuacuagauucu

SEQ ID NO: 2085822 - RNA, 20 nt, Homo sapiens
uggagucuuguacacuuaag

SEQ ID NO: 2085823 - RNA, 21 nt, Homo sapiens
uugaaaaucaagaugagauau

SEQ ID NO: 2085824 - RNA, 15 nt, Homo sapiens
uuccaaacuguguca

SEQ ID NO: 2085825 - RNA, 14 nt, Homo sapiens
ugcacaaugggcaa

SEQ ID NO: 2085826 - RNA, 22 nt, Homo sapiens
agucgccacauuucucugcaaa

SEQ ID NO: 2085827 - RNA, 18 nt, Homo sapiens
ggggaucagaacucuccu

SEQ ID NO: 2085828 - RNA, 15 nt, Homo sapiens
agaacugucuuucau

SEQ ID NO: 2085829 - RNA, 15 nt, Homo sapiens
aguuguuucuaagag

SEQ ID NO: 2085830 - RNA, 14 nt, Homo sapiens
aaucccugucuugc

SEQ ID NO: 2085831 - RNA, 20 nt, Homo sapiens
gaaacauugcuuuagacaaa

SEQ ID NO: 2085832 - RNA, 14 nt, Homo sapiens
accugcugggaccu

SEQ ID NO: 2085833 - RNA, 22 nt, Homo sapiens
uggccuguaaucccagcuacuu

SEQ ID NO: 2085834 - RNA, 23 nt, Homo sapiens
ugccuggguuuucuaacuguaaa

SEQ ID NO: 2085835 - RNA, 19 nt, Homo sapiens
acgagcugcuguccaggaa

SEQ ID NO: 2085836 - RNA, 20 nt, Homo sapiens
aagaggaggugguucugaaa

SEQ ID NO: 2085837 - RNA, 10 nt, Homo sapiens
uugcuuuaac

SEQ ID NO: 2085838 - RNA, 21 nt, Homo sapiens
aaucaacagaugauaguccaa

SEQ ID NO: 2085839 - RNA, 15 nt, Homo sapiens
aauaaaggcauauau

SEQ ID NO: 2085840 - RNA, 17 nt, Homo sapiens
ucauuuuuaacagcaug

SEQ ID NO: 2085841 - RNA, 22 nt, Homo sapiens
gaauacuuaacucaauaauucu

SEQ ID NO: 2085842 - RNA, 13 nt, Homo sapiens
ggucaugugguac

SEQ ID NO: 2085843 - RNA, 13 nt, Homo sapiens
ccuacuguccuca

SEQ ID NO: 2085844 - RNA, 23 nt, Homo sapiens
auuuguucauuaaacgucauuca

SEQ ID NO: 2085845 - RNA, 12 nt, Homo sapiens
uuacuuaucccu

SEQ ID NO: 2085846 - RNA, 14 nt, Homo sapiens
guguucagaauuca

SEQ ID NO: 2085847 - RNA, 23 nt, Homo sapiens
uucuaaaugaauguuuacacucu

SEQ ID NO: 2085848 - RNA, 18 nt, Homo sapiens
gcuuaaauuuuauaucau

SEQ ID NO: 2085849 - RNA, 12 nt, Homo sapiens
ugcaauuuagaa

SEQ ID NO: 2085850 - RNA, 15 nt, Homo sapiens
aacacuuggugagua

SEQ ID NO: 2085851 - RNA, 19 nt, Homo sapiens
ucacucuggguaccaaauu

SEQ ID NO: 2085852 - RNA, 20 nt, Homo sapiens
agcugcagucaacaguucaa

SEQ ID NO: 2085853 - RNA, 16 nt, Homo sapiens
uuacuaauuaaucaca

SEQ ID NO: 2085854 - RNA, 15 nt, Homo sapiens
uucaguacuugugaa

SEQ ID NO: 2085855 - RNA, 13 nt, Homo sapiens
ugggaagcuugcu

SEQ ID NO: 2085856 - RNA, 13 nt, Homo sapiens
uaccccauacccc

SEQ ID NO: 2085857 - RNA, 16 nt, Homo sapiens
cauucugucuugaagg

SEQ ID NO: 2085858 - RNA, 18 nt, Homo sapiens
auuaaacagacuuuagcu

SEQ ID NO: 2085859 - RNA, 20 nt, Homo sapiens
uagaacagccagacccugca

SEQ ID NO: 2085860 - RNA, 18 nt, Homo sapiens
ggcugaccuagaccaguu

SEQ ID NO: 2085861 - RNA, 19 nt, Homo sapiens
gaccacauagaacaugugu

SEQ ID NO: 2085862 - RNA, 21 nt, Homo sapiens
uacacaggacugaaaagggaa

SEQ ID NO: 2085863 - RNA, 16 nt, Homo sapiens
ucagaugaacucuuag

SEQ ID NO: 2085864 - RNA, 15 nt, Homo sapiens
ccaccacgugcucaa

SEQ ID NO: 2085865 - RNA, 13 nt, Homo sapiens
cuuaaguuuagaa

SEQ ID NO: 2085866 - RNA, 18 nt, Homo sapiens
uguuaacauggacaugau

SEQ ID NO: 2085867 - RNA, 21 nt, Homo sapiens
ugcaucauuccccgacacugc

SEQ ID NO: 2085868 - RNA, 23 nt, Homo sapiens
aaaauuaaaaacuuaaguaccaa

SEQ ID NO: 2085869 - RNA, 15 nt, Homo sapiens
gcccgguguucagug

SEQ ID NO: 2085870 - RNA, 20 nt, Homo sapiens
auaaccuuugaaccaacaau

SEQ ID NO: 2085871 - RNA, 20 nt, Homo sapiens
aauagcuccgaccuccauga

SEQ ID NO: 2085872 - RNA, 17 nt, Homo sapiens
cucuggcuuccaugcuc

SEQ ID NO: 2085873 - RNA, 17 nt, Homo sapiens
acuaucccauuugcccu

SEQ ID NO: 2085874 - RNA, 20 nt, Homo sapiens
aauuuacuuuggaaaguaga

SEQ ID NO: 2085875 - RNA, 14 nt, Homo sapiens
uguuuuuucugcaa

SEQ ID NO: 2085876 - RNA, 15 nt, Homo sapiens
gagcugccaugucag

SEQ ID NO: 2085877 - RNA, 15 nt, Homo sapiens
gaauuacgugcucug

SEQ ID NO: 2085878 - RNA, 16 nt, Homo sapiens
ggcaggaacuugcaca

SEQ ID NO: 2085879 - RNA, 15 nt, Homo sapiens
agggcaagaucucag

SEQ ID NO: 2085880 - RNA, 22 nt, Homo sapiens
ggggauuuuuuugaugugccuu

SEQ ID NO: 2085881 - RNA, 22 nt, Homo sapiens
gcagcaaugaagggaagugcau

SEQ ID NO: 2085882 - RNA, 13 nt, Homo sapiens
caugugaacaucc

SEQ ID NO: 2085883 - RNA, 24 nt, Homo sapiens
gucugauucucuuuaacuguguga

SEQ ID NO: 2085884 - RNA, 20 nt, Homo sapiens
uaccaccuuuacugugcuua

SEQ ID NO: 2085885 - RNA, 18 nt, Homo sapiens
caccacuggccaugcuca

SEQ ID NO: 2085886 - RNA, 15 nt, Homo sapiens
gcuauccacagcuua

SEQ ID NO: 2085887 - RNA, 19 nt, Homo sapiens
cgugguaggacuguagaaa

SEQ ID NO: 2085888 - RNA, 22 nt, Homo sapiens
acaccuagaaaggaacugcaau

SEQ ID NO: 2085889 - RNA, 20 nt, Homo sapiens
ugcagucuccgccuccugag

SEQ ID NO: 2085890 - RNA, 21 nt, Homo sapiens
cuucugccucgucauggccag

SEQ ID NO: 2085891 - RNA, 16 nt, Homo sapiens
gccaccacgucugcca

SEQ ID NO: 2085892 - RNA, 21 nt, Homo sapiens
ugcuucaugaaaauccuacca

SEQ ID NO: 2085893 - RNA, 13 nt, Homo sapiens
ccagcccauugcu

SEQ ID NO: 2085894 - RNA, 20 nt, Homo sapiens
aaguaacuucugacuuacug

SEQ ID NO: 2085895 - RNA, 22 nt, Homo sapiens
acuuggcuaacauagcacagua

SEQ ID NO: 2085896 - RNA, 15 nt, Homo sapiens
acugccgaugcccaa

SEQ ID NO: 2085897 - RNA, 15 nt, Homo sapiens
aaagauuucaagaag

SEQ ID NO: 2085898 - RNA, 13 nt, Homo sapiens
uuugauagcacuu

SEQ ID NO: 2085899 - RNA, 19 nt, Homo sapiens
acacacauugcuauuccca

SEQ ID NO: 2085900 - RNA, 18 nt, Homo sapiens
ucacaauagauuucucaa

SEQ ID NO: 2085901 - RNA, 22 nt, Homo sapiens
ccaguggugcucaaugcaaaua

SEQ ID NO: 2085902 - RNA, 17 nt, Homo sapiens
ccagaggcucagcacuu

SEQ ID NO: 2085903 - RNA, 12 nt, Homo sapiens
agcgugcacucc

SEQ ID NO: 2085904 - RNA, 23 nt, Homo sapiens
ucguuuuucagcacccccaccca

SEQ ID NO: 2085905 - RNA, 16 nt, Homo sapiens
ggaaucgaaguguuua

SEQ ID NO: 2085906 - RNA, 15 nt, Homo sapiens
gcccgggaagcaaau

SEQ ID NO: 2085907 - RNA, 21 nt, Homo sapiens
aaagcuucucagccuuccuag

SEQ ID NO: 2085908 - RNA, 23 nt, Homo sapiens
aacaguuuaugcagugcugcuuu

SEQ ID NO: 2085909 - RNA, 21 nt, Homo sapiens
aaugcugagauccucauuuau

SEQ ID NO: 2085910 - RNA, 19 nt, Homo sapiens
gaaaaggaaggcucuucuc

SEQ ID NO: 2085911 - RNA, 22 nt, Homo sapiens
ugaucucggcucacugcaaauc

SEQ ID NO: 2085912 - RNA, 17 nt, Homo sapiens
augcuaaaacaugauga

SEQ ID NO: 2085913 - RNA, 19 nt, Homo sapiens
caggagggcugggcuccac

SEQ ID NO: 2085914 - RNA, 20 nt, Homo sapiens
gcaagcucuucccuugcuca

SEQ ID NO: 2085915 - RNA, 23 nt, Homo sapiens
cacccacgugcauucacauugac

SEQ ID NO: 2085916 - RNA, 23 nt, Homo sapiens
uucucuccugcuuccuccaggga

SEQ ID NO: 2085917 - RNA, 17 nt, Homo sapiens
guguagagcaagccagu

SEQ ID NO: 2085918 - RNA, 15 nt, Homo sapiens
ucugaacauucuccu

SEQ ID NO: 2085919 - RNA, 14 nt, Homo sapiens
gggcagcuugcccc

SEQ ID NO: 2085920 - RNA, 18 nt, Homo sapiens
caacaguuugaugcugag

SEQ ID NO: 2085921 - RNA, 20 nt, Homo sapiens
cuaaccugcacguugugcac

SEQ ID NO: 2085922 - RNA, 18 nt, Homo sapiens
uuucauuugaauaggcaa

SEQ ID NO: 2085923 - RNA, 20 nt, Homo sapiens
cuccugaaccgcacagcuca

SEQ ID NO: 2085924 - RNA, 13 nt, Homo sapiens
gugauacccaagu

SEQ ID NO: 2085925 - RNA, 13 nt, Homo sapiens
ugcagcugucuga

SEQ ID NO: 2085926 - RNA, 19 nt, Homo sapiens
agagguauuccucucuuaa

SEQ ID NO: 2085927 - RNA, 15 nt, Homo sapiens
ugagcacaaaggcaa

SEQ ID NO: 2085928 - RNA, 23 nt, Homo sapiens
agcaagacaaauuagccauuuca

SEQ ID NO: 2085929 - RNA, 13 nt, Homo sapiens
agcuacuuggcag

SEQ ID NO: 2085930 - RNA, 15 nt, Homo sapiens
guccucuucugggcc

SEQ ID NO: 2085931 - RNA, 16 nt, Homo sapiens
cugcugucauaacauc

SEQ ID NO: 2085932 - RNA, 19 nt, Homo sapiens
acugaagcgaacaucuuca

SEQ ID NO: 2085933 - RNA, 21 nt, Homo sapiens
caugugugcgagugugugcau

SEQ ID NO: 2085934 - RNA, 18 nt, Homo sapiens
aauuguucuugggagaaa

SEQ ID NO: 2085935 - RNA, 19 nt, Homo sapiens
acacugcgaacucucagga

SEQ ID NO: 2085936 - RNA, 22 nt, Homo sapiens
uagccuggggcuugaauuugca

SEQ ID NO: 2085937 - RNA, 18 nt, Homo sapiens
gcaaaaugagacuuucua

SEQ ID NO: 2085938 - RNA, 13 nt, Homo sapiens
ugugcaguagcau

SEQ ID NO: 2085939 - RNA, 22 nt, Homo sapiens
gcuagaaagcauccauuaauua

SEQ ID NO: 2085940 - RNA, 20 nt, Homo sapiens
uguggucaauccgaaguaug

SEQ ID NO: 2085941 - RNA, 14 nt, Homo sapiens
uguuccagacucag

SEQ ID NO: 2085942 - RNA, 15 nt, Homo sapiens
uuuguacaacccuga

SEQ ID NO: 2085943 - RNA, 13 nt, Homo sapiens
acaauuauuguau

SEQ ID NO: 2085944 - RNA, 22 nt, Homo sapiens
accccagcuccauccuugcauc

SEQ ID NO: 2085945 - RNA, 14 nt, Homo sapiens
cugcuguccugcaa

SEQ ID NO: 2085946 - RNA, 17 nt, Homo sapiens
cugguuucuaccagcuc

SEQ ID NO: 2085947 - RNA, 18 nt, Homo sapiens
ccauugauccagcucaga

SEQ ID NO: 2085948 - RNA, 18 nt, Homo sapiens
aaaucugugaccugucag

SEQ ID NO: 2085949 - RNA, 18 nt, Homo sapiens
gcaaacuuuccugggcaa

SEQ ID NO: 2085950 - RNA, 14 nt, Homo sapiens
agauuuuacugucu

SEQ ID NO: 2085951 - RNA, 15 nt, Homo sapiens
gagugcuaggauuac

SEQ ID NO: 2085952 - RNA, 15 nt, Homo sapiens
gaccucaccugcugg

SEQ ID NO: 2085953 - RNA, 14 nt, Homo sapiens
gccuuaagcaaauu

SEQ ID NO: 2085954 - RNA, 12 nt, Homo sapiens
aagaaaaccauu

SEQ ID NO: 2085955 - RNA, 19 nt, Homo sapiens
ucccaaauucauugacuua

SEQ ID NO: 2085956 - RNA, 23 nt, Homo sapiens
uaggaacgucugguccuaaccag

SEQ ID NO: 2085957 - RNA, 20 nt, Homo sapiens
uggauaauucuuuuacauau

SEQ ID NO: 2085958 - RNA, 22 nt, Homo sapiens
ccugcugcuguuaucuuuuuaa

SEQ ID NO: 2085959 - RNA, 13 nt, Homo sapiens
uguccucagcauu

SEQ ID NO: 2085960 - RNA, 14 nt, Homo sapiens
cugcaugucuccuc

SEQ ID NO: 2085961 - RNA, 13 nt, Homo sapiens
acucuccugccuc

SEQ ID NO: 2085962 - RNA, 22 nt, Homo sapiens
cuguuaaaauuuuucaguguug

SEQ ID NO: 2085963 - RNA, 23 nt, Homo sapiens
cagagugcuaauuuaguucucag

SEQ ID NO: 2085964 - RNA, 18 nt, Homo sapiens
uccacauauuucagugag

SEQ ID NO: 2085965 - RNA, 17 nt, Homo sapiens
ucuugaguagcugggau

SEQ ID NO: 2085966 - RNA, 11 nt, Homo sapiens
cugaccacaga

SEQ ID NO: 2085967 - RNA, 16 nt, Homo sapiens
gaggcacaagugcccg

SEQ ID NO: 2085968 - RNA, 20 nt, Homo sapiens
ucuugugguaacuugcugcu

SEQ ID NO: 2085969 - RNA, 19 nt, Homo sapiens
ccugaauccaccugcaguu

SEQ ID NO: 2085970 - RNA, 15 nt, Homo sapiens
gauuaucuagagaau

SEQ ID NO: 2085971 - RNA, 16 nt, Homo sapiens
cuuuuuugucccauua

SEQ ID NO: 2085972 - RNA, 15 nt, Homo sapiens
accuuaaaguauaaa

SEQ ID NO: 2085973 - RNA, 19 nt, Homo sapiens
acauccucugcuaccaucu

SEQ ID NO: 2085974 - RNA, 22 nt, Homo sapiens
aagaaguuggggacacauguau

SEQ ID NO: 2085975 - RNA, 15 nt, Homo sapiens
ugcauggggaggcac

SEQ ID NO: 2085976 - RNA, 18 nt, Homo sapiens
gcccagggagaggccaug

SEQ ID NO: 2085977 - RNA, 18 nt, Homo sapiens
gccccaugagacaguccc

SEQ ID NO: 2085978 - RNA, 23 nt, Homo sapiens
uuugugacccugagaaggcaaaa

SEQ ID NO: 2085979 - RNA, 19 nt, Homo sapiens
aauauauauauguauauau

SEQ ID NO: 2085980 - RNA, 18 nt, Homo sapiens
ugggguugguuugugauc

SEQ ID NO: 2085981 - RNA, 17 nt, Homo sapiens
uuacuaaaguacagaca

SEQ ID NO: 2085982 - RNA, 22 nt, Homo sapiens
ggcaguuugaggauuaguuuag

SEQ ID NO: 2085983 - RNA, 21 nt, Homo sapiens
ggauucuaaauuaugugaauu

SEQ ID NO: 2085984 - RNA, 18 nt, Homo sapiens
caggugaggaauuugaag

SEQ ID NO: 2085985 - RNA, 21 nt, Homo sapiens
acucaaaacccaucugggcuc

SEQ ID NO: 2085986 - RNA, 16 nt, Homo sapiens
aaaucuucagcaugau

SEQ ID NO: 2085987 - RNA, 19 nt, Homo sapiens
aaaaugugcuauuugcaaa

SEQ ID NO: 2085988 - RNA, 23 nt, Homo sapiens
aagacuauaaaaaaaugcauuua

SEQ ID NO: 2085989 - RNA, 16 nt, Homo sapiens
cucuuccuaucccauc

SEQ ID NO: 2085990 - RNA, 19 nt, Homo sapiens
gcccccuccuugucugugc

SEQ ID NO: 2085991 - RNA, 14 nt, Homo sapiens
acugaaaccaaaac

SEQ ID NO: 2085992 - RNA, 18 nt, Homo sapiens
uaauaugcaauccuacuu

SEQ ID NO: 2085993 - RNA, 19 nt, Homo sapiens
augugggucaaggaauuaa

SEQ ID NO: 2085994 - RNA, 13 nt, Homo sapiens
acacauaugcacc

SEQ ID NO: 2085995 - RNA, 17 nt, Homo sapiens
gaguacaaggucaucau

SEQ ID NO: 2085996 - RNA, 20 nt, Homo sapiens
agcagaagacucuccacuga

SEQ ID NO: 2085997 - RNA, 13 nt, Homo sapiens
uguucaccagaga

SEQ ID NO: 2085998 - RNA, 12 nt, Homo sapiens
uuccucccaaaa

SEQ ID NO: 2085999 - RNA, 17 nt, Homo sapiens
cugcccgagagcucuua

SEQ ID NO: 2086000 - RNA, 21 nt, Homo sapiens
cccaucagugcucuguaaaac

SEQ ID NO: 2086001 - RNA, 22 nt, Homo sapiens
uuaaacuagcauaucugccuuu

SEQ ID NO: 2086002 - RNA, 19 nt, Homo sapiens
cacaguacacaccagaaga

SEQ ID NO: 2086003 - RNA, 22 nt, Homo sapiens
caguaauacaguacaguacuca

SEQ ID NO: 2086004 - RNA, 16 nt, Homo sapiens
uaugagugcgcagauc

SEQ ID NO: 2086005 - RNA, 22 nt, Homo sapiens
caaauccuucaaaauaaaaagu

SEQ ID NO: 2086006 - RNA, 15 nt, Homo sapiens
cacuuggcaucagcu

SEQ ID NO: 2086007 - RNA, 19 nt, Homo sapiens
ugccugaaaaaacugguau

SEQ ID NO: 2086008 - RNA, 15 nt, Homo sapiens
caaauauaagacauu

SEQ ID NO: 2086009 - RNA, 19 nt, Homo sapiens
auucuggaaagaaaaccau

SEQ ID NO: 2086010 - RNA, 20 nt, Homo sapiens
aaggcagcugguauauucag

SEQ ID NO: 2086011 - RNA, 14 nt, Homo sapiens
ugcagugcacuuug

SEQ ID NO: 2086012 - RNA, 14 nt, Homo sapiens
cucaaaguuucaga

SEQ ID NO: 2086013 - RNA, 17 nt, Homo sapiens
ccuugucugcacccucg

SEQ ID NO: 2086014 - RNA, 14 nt, Homo sapiens
gacaucugacccca

SEQ ID NO: 2086015 - RNA, 20 nt, Homo sapiens
ucuucacucaggacacaaac

SEQ ID NO: 2086016 - RNA, 17 nt, Homo sapiens
ggcacuuuuauuuucau

SEQ ID NO: 2086017 - RNA, 20 nt, Homo sapiens
ggccagagggcaguggcccu

SEQ ID NO: 2086018 - RNA, 22 nt, Homo sapiens
cuguaguugcguggacucugca

SEQ ID NO: 2086019 - RNA, 19 nt, Homo sapiens
agauauuugguaccauggu

SEQ ID NO: 2086020 - RNA, 23 nt, Homo sapiens
uaagcaauucauucucucugaac

SEQ ID NO: 2086021 - RNA, 18 nt, Homo sapiens
ccaauuuuuuaagugaaa

SEQ ID NO: 2086022 - RNA, 15 nt, Homo sapiens
aauguaugugcucuu

SEQ ID NO: 2086023 - RNA, 16 nt, Homo sapiens
ggaacccucuaaggga

SEQ ID NO: 2086024 - RNA, 12 nt, Homo sapiens
aaagucagagac

SEQ ID NO: 2086025 - RNA, 22 nt, Homo sapiens
agaggguguugaguucacugug

SEQ ID NO: 2086026 - RNA, 21 nt, Homo sapiens
ccaccauuccuggaaaccaca

SEQ ID NO: 2086027 - RNA, 13 nt, Homo sapiens
acaucauguaaua

SEQ ID NO: 2086028 - RNA, 14 nt, Homo sapiens
gucuaucaaaggua

SEQ ID NO: 2086029 - RNA, 16 nt, Homo sapiens
uccacacuucugggcc

SEQ ID NO: 2086030 - RNA, 18 nt, Homo sapiens
ccucggccucccaaagug

SEQ ID NO: 2086031 - RNA, 17 nt, Homo sapiens
aaaauugacuucuugcu

SEQ ID NO: 2086032 - RNA, 16 nt, Homo sapiens
ggcucacaguucugca

SEQ ID NO: 2086033 - RNA, 13 nt, Homo sapiens
auuaaauuaggaa

SEQ ID NO: 2086034 - RNA, 21 nt, Homo sapiens
ucucagccuaccaugagaaua

SEQ ID NO: 2086035 - RNA, 14 nt, Homo sapiens
ucugcaguggagcc

SEQ ID NO: 2086036 - RNA, 22 nt, Homo sapiens
uccuuuucuaggaagcacgggg

SEQ ID NO: 2086037 - RNA, 10 nt, Homo sapiens
aggcuuccug

SEQ ID NO: 2086038 - RNA, 15 nt, Homo sapiens
cuaacuuauccuaaa

SEQ ID NO: 2086039 - RNA, 12 nt, Homo sapiens
guagcacugaaa

SEQ ID NO: 2086040 - RNA, 14 nt, Homo sapiens
caaguuauguucuu

SEQ ID NO: 2086041 - RNA, 16 nt, Homo sapiens
gauucuuccaucugau

SEQ ID NO: 2086042 - RNA, 12 nt, Homo sapiens
cccaucugcauu

SEQ ID NO: 2086043 - RNA, 19 nt, Homo sapiens
guuuuccuaaaugcaguga

SEQ ID NO: 2086044 - RNA, 14 nt, Homo sapiens
guguagccaugccu

SEQ ID NO: 2086045 - RNA, 15 nt, Homo sapiens
ccugguucccggaga

SEQ ID NO: 2086046 - RNA, 13 nt, Homo sapiens
accuuccaacacu

SEQ ID NO: 2086047 - RNA, 18 nt, Homo sapiens
gguuaaauaccuguguuc

SEQ ID NO: 2086048 - RNA, 15 nt, Homo sapiens
gugcccccaggagga

SEQ ID NO: 2086049 - RNA, 18 nt, Homo sapiens
ucaucaaaaucugcacag

SEQ ID NO: 2086050 - RNA, 16 nt, Homo sapiens
guccuuuuuaucugau

SEQ ID NO: 2086051 - RNA, 22 nt, Homo sapiens
ugcaccuacugcuuacuguugc

SEQ ID NO: 2086052 - RNA, 15 nt, Homo sapiens
ucacuccauucucag

SEQ ID NO: 2086053 - RNA, 21 nt, Homo sapiens
aacuuagccauuuuucaaagc

SEQ ID NO: 2086054 - RNA, 18 nt, Homo sapiens
aauuguuuaccauagaaa

SEQ ID NO: 2086055 - RNA, 19 nt, Homo sapiens
auuuugguuguaauuaaau

SEQ ID NO: 2086056 - RNA, 23 nt, Homo sapiens
auauacauauguuaauucuaguc

SEQ ID NO: 2086057 - RNA, 17 nt, Homo sapiens
acugccuggccuggcac

SEQ ID NO: 2086058 - RNA, 14 nt, Homo sapiens
ucugaccacagcau

SEQ ID NO: 2086059 - RNA, 20 nt, Homo sapiens
aaaauguuggaaugggaguc

SEQ ID NO: 2086060 - RNA, 16 nt, Homo sapiens
ccgggacccucaggug

SEQ ID NO: 2086061 - RNA, 17 nt, Homo sapiens
cauaaauuuaguauuuu

SEQ ID NO: 2086062 - RNA, 14 nt, Homo sapiens
aaucuaccaagaac

SEQ ID NO: 2086063 - RNA, 22 nt, Homo sapiens
ucugauuccccuccaccaaacc

SEQ ID NO: 2086064 - RNA, 21 nt, Homo sapiens
uaggaaaccuggcauggugcu

SEQ ID NO: 2086065 - RNA, 19 nt, Homo sapiens
cagaauuagcugcuucuau

SEQ ID NO: 2086066 - RNA, 18 nt, Homo sapiens
cuauguuuggaguuuaau

SEQ ID NO: 2086067 - RNA, 15 nt, Homo sapiens
aacugcaaccucaaa

SEQ ID NO: 2086068 - RNA, 18 nt, Homo sapiens
uuccuucagacagauucc

SEQ ID NO: 2086069 - RNA, 13 nt, Homo sapiens
auguguaaagauu

SEQ ID NO: 2086070 - RNA, 16 nt, Homo sapiens
cuagagcuccauuucu

SEQ ID NO: 2086071 - RNA, 14 nt, Homo sapiens
auuuaaacaucagc

SEQ ID NO: 2086072 - RNA, 19 nt, Homo sapiens
gugccacauacugcggacc

SEQ ID NO: 2086073 - RNA, 16 nt, Homo sapiens
cugcaaaaacagaggu

SEQ ID NO: 2086074 - RNA, 17 nt, Homo sapiens
ccauauggucauccaaa

SEQ ID NO: 2086075 - RNA, 20 nt, Homo sapiens
aaugacaauaaaaauuccaa

SEQ ID NO: 2086076 - RNA, 15 nt, Homo sapiens
cuaaggaaugaucca

SEQ ID NO: 2086077 - RNA, 13 nt, Homo sapiens
ugccuggagacau

SEQ ID NO: 2086078 - RNA, 16 nt, Homo sapiens
gcccagcuaaagcaau

SEQ ID NO: 2086079 - RNA, 13 nt, Homo sapiens
caacaugcugccc

SEQ ID NO: 2086080 - RNA, 23 nt, Homo sapiens
cugcagagcaaugacugugcuca

SEQ ID NO: 2086081 - RNA, 16 nt, Homo sapiens
uacguuugauacaaca

SEQ ID NO: 2086082 - RNA, 20 nt, Homo sapiens
uguagucccagcuacuugag

SEQ ID NO: 2086083 - RNA, 18 nt, Homo sapiens
ccuccgcgcuguguaaau

SEQ ID NO: 2086084 - RNA, 18 nt, Homo sapiens
aacaguuggauacaggag

SEQ ID NO: 2086085 - RNA, 16 nt, Homo sapiens
cagccuguauguggug

SEQ ID NO: 2086086 - RNA, 22 nt, Homo sapiens
auauaagaagcuuucaguauua

SEQ ID NO: 2086087 - RNA, 23 nt, Homo sapiens
caaaggagccuuuucaaauccau

SEQ ID NO: 2086088 - RNA, 14 nt, Homo sapiens
cccagcccaaucca

SEQ ID NO: 2086089 - RNA, 23 nt, Homo sapiens
acugacauuccuccauguccuca

SEQ ID NO: 2086090 - RNA, 22 nt, Homo sapiens
agauucugaccuuaaaugcaac

SEQ ID NO: 2086091 - RNA, 14 nt, Homo sapiens
aacauuaguauacg

SEQ ID NO: 2086092 - RNA, 22 nt, Homo sapiens
agaucuuaguucuagauggaga

SEQ ID NO: 2086093 - RNA, 16 nt, Homo sapiens
ucaccauccuggaagg

SEQ ID NO: 2086094 - RNA, 15 nt, Homo sapiens
cacuguugugaaggu

SEQ ID NO: 2086095 - RNA, 15 nt, Homo sapiens
acucagcauugugac

SEQ ID NO: 2086096 - RNA, 18 nt, Homo sapiens
cuaauaaacuguguaguu

SEQ ID NO: 2086097 - RNA, 16 nt, Homo sapiens
aacauuuuacuguugu

SEQ ID NO: 2086098 - RNA, 15 nt, Homo sapiens
auaauaagacuuuuc

SEQ ID NO: 2086099 - RNA, 16 nt, Homo sapiens
ucuucagagcugacac

SEQ ID NO: 2086100 - RNA, 14 nt, Homo sapiens
auuuugcacuagaa

SEQ ID NO: 2086101 - RNA, 22 nt, Homo sapiens
aaucaaggaaaggcucauuuaa

SEQ ID NO: 2086102 - RNA, 17 nt, Homo sapiens
aggauuuuaugcuuuaa

SEQ ID NO: 2086103 - RNA, 16 nt, Homo sapiens
cuuggcugaauagcac

SEQ ID NO: 2086104 - RNA, 16 nt, Homo sapiens
aguguacugugccugg

SEQ ID NO: 2086105 - RNA, 15 nt, Homo sapiens
aacugcugaggaugg

SEQ ID NO: 2086106 - RNA, 14 nt, Homo sapiens
uaaagccuccucau

SEQ ID NO: 2086107 - RNA, 15 nt, Homo sapiens
uaaaauguauaccaa

SEQ ID NO: 2086108 - RNA, 21 nt, Homo sapiens
gacccucccacucccaucucc

SEQ ID NO: 2086109 - RNA, 17 nt, Homo sapiens
ucuguucuaaguccacu

SEQ ID NO: 2086110 - RNA, 20 nt, Homo sapiens
auuugggcaggaacacagac

SEQ ID NO: 2086111 - RNA, 14 nt, Homo sapiens
agggucucacugug

SEQ ID NO: 2086112 - RNA, 17 nt, Homo sapiens
ugccaaauccugggcau

SEQ ID NO: 2086113 - RNA, 19 nt, Homo sapiens
gcuuccuugccugaugaca

SEQ ID NO: 2086114 - RNA, 18 nt, Homo sapiens
gucagcccugcugucaga

SEQ ID NO: 2086115 - RNA, 14 nt, Homo sapiens
aagagaguugcuuu

SEQ ID NO: 2086116 - RNA, 17 nt, Homo sapiens
cuccauaucuccauggc

SEQ ID NO: 2086117 - RNA, 14 nt, Homo sapiens
agucaagugugccu

SEQ ID NO: 2086118 - RNA, 17 nt, Homo sapiens
acucaugcugaaagccc

SEQ ID NO: 2086119 - RNA, 16 nt, Homo sapiens
acauauaccuucucaa

SEQ ID NO: 2086120 - RNA, 15 nt, Homo sapiens
ucccuuuuugaauug

SEQ ID NO: 2086121 - RNA, 16 nt, Homo sapiens
agccucauccugagag

SEQ ID NO: 2086122 - RNA, 20 nt, Homo sapiens
ucagaccugucuuccaagga

SEQ ID NO: 2086123 - RNA, 21 nt, Homo sapiens
uuuucaaaggccucaccuuca

SEQ ID NO: 2086124 - RNA, 20 nt, Homo sapiens
cccgucauguuccucaaaag

SEQ ID NO: 2086125 - RNA, 12 nt, Homo sapiens
uauuauaauuca

SEQ ID NO: 2086126 - RNA, 22 nt, Homo sapiens
uucuucuuuaaucacuuaacau

SEQ ID NO: 2086127 - RNA, 16 nt, Homo sapiens
cacaggucagggguga

SEQ ID NO: 2086128 - RNA, 21 nt, Homo sapiens
gaauaugucagugcugaugua

SEQ ID NO: 2086129 - RNA, 16 nt, Homo sapiens
aaauuaggacuguaua

SEQ ID NO: 2086130 - RNA, 16 nt, Homo sapiens
gucuuuguacagacaa

SEQ ID NO: 2086131 - RNA, 12 nt, Homo sapiens
uaaccucuggcc

SEQ ID NO: 2086132 - RNA, 15 nt, Homo sapiens
agcucugaacaaaag

SEQ ID NO: 2086133 - RNA, 21 nt, Homo sapiens
uagaaggcacaauaugggcac

SEQ ID NO: 2086134 - RNA, 23 nt, Homo sapiens
gcaaaaugaguugugaugaauca

SEQ ID NO: 2086135 - RNA, 17 nt, Homo sapiens
ccccaaacagcaugugc

SEQ ID NO: 2086136 - RNA, 21 nt, Homo sapiens
guccucuccccuccagccuuu

SEQ ID NO: 2086137 - RNA, 17 nt, Homo sapiens
uuacacuuuggaccuua

SEQ ID NO: 2086138 - RNA, 15 nt, Homo sapiens
aauaagaggacacua

SEQ ID NO: 2086139 - RNA, 14 nt, Homo sapiens
cagcccagcccagc

SEQ ID NO: 2086140 - RNA, 20 nt, Homo sapiens
agccacuuugcuaccaugac

SEQ ID NO: 2086141 - RNA, 11 nt, Homo sapiens
ucacauuugcg

SEQ ID NO: 2086142 - RNA, 16 nt, Homo sapiens
aguaaaaauccaaaaa

SEQ ID NO: 2086143 - RNA, 21 nt, Homo sapiens
aaacaaaaugaagcugcccua

SEQ ID NO: 2086144 - RNA, 13 nt, Homo sapiens
uaaucaugaucac

SEQ ID NO: 2086145 - RNA, 17 nt, Homo sapiens
agacacugagcuucuga

SEQ ID NO: 2086146 - RNA, 18 nt, Homo sapiens
uugauuuaugaguaauug

SEQ ID NO: 2086147 - RNA, 19 nt, Homo sapiens
gcaauacggaacacuguca

SEQ ID NO: 2086148 - RNA, 21 nt, Homo sapiens
agugucauuuugaucugcuuu

SEQ ID NO: 2086149 - RNA, 21 nt, Homo sapiens
ugacauauuacaacacuuuaa

SEQ ID NO: 2086150 - RNA, 19 nt, Homo sapiens
aaaacaucuuuaaggggag

SEQ ID NO: 2086151 - RNA, 15 nt, Homo sapiens
caaguguaucuccuu

SEQ ID NO: 2086152 - RNA, 22 nt, Homo sapiens
gcacaauuucccuucauacucc

SEQ ID NO: 2086153 - RNA, 19 nt, Homo sapiens
uaucuguuuucuaccuccu

SEQ ID NO: 2086154 - RNA, 22 nt, Homo sapiens
uggucucaaucuccugacuuca

SEQ ID NO: 2086155 - RNA, 20 nt, Homo sapiens
uguaagauuuugaaaacuac

SEQ ID NO: 2086156 - RNA, 18 nt, Homo sapiens
auaaaaaauaauaauaca

SEQ ID NO: 2086157 - RNA, 15 nt, Homo sapiens
gcuuugaauacuaaa

SEQ ID NO: 2086158 - RNA, 17 nt, Homo sapiens
cugccacacucuccauc

SEQ ID NO: 2086159 - RNA, 17 nt, Homo sapiens
aguccuguuugcaggga

SEQ ID NO: 2086160 - RNA, 16 nt, Homo sapiens
aagcauguagacugug

SEQ ID NO: 2086161 - RNA, 14 nt, Homo sapiens
agcuuuauucuuca

SEQ ID NO: 2086162 - RNA, 13 nt, Homo sapiens
uaaaucccaagaa

SEQ ID NO: 2086163 - RNA, 19 nt, Homo sapiens
uguacaaaaacacaaauac

SEQ ID NO: 2086164 - RNA, 18 nt, Homo sapiens
acaaaucucaaaguguac

SEQ ID NO: 2086165 - RNA, 16 nt, Homo sapiens
gagcccugucaguaga

SEQ ID NO: 2086166 - RNA, 12 nt, Homo sapiens
ggcccagaaaca

SEQ ID NO: 2086167 - RNA, 17 nt, Homo sapiens
guaaaauguacaaguuu

SEQ ID NO: 2086168 - RNA, 16 nt, Homo sapiens
uucaaguuuaguuuga

SEQ ID NO: 2086169 - RNA, 20 nt, Homo sapiens
aguagucauacucccuggug

SEQ ID NO: 2086170 - RNA, 17 nt, Homo sapiens
ugcucaauaaacacuug

SEQ ID NO: 2086171 - RNA, 19 nt, Homo sapiens
auauuaaguccaaauccaa

SEQ ID NO: 2086172 - RNA, 23 nt, Homo sapiens
guaacugcacacaugguuuccaa

SEQ ID NO: 2086173 - RNA, 19 nt, Homo sapiens
ggagucacucuuaugcugu

SEQ ID NO: 2086174 - RNA, 19 nt, Homo sapiens
cugauccauuaucuauuua

SEQ ID NO: 2086175 - RNA, 18 nt, Homo sapiens
acucagggacagagccau

SEQ ID NO: 2086176 - RNA, 18 nt, Homo sapiens
aaaccagguuugcaccua

SEQ ID NO: 2086177 - RNA, 20 nt, Homo sapiens
gccaaugccacagccaagcc

SEQ ID NO: 2086178 - RNA, 13 nt, Homo sapiens
cagaugucccuga

SEQ ID NO: 2086179 - RNA, 14 nt, Homo sapiens
aguuguuagauuaa

SEQ ID NO: 2086180 - RNA, 15 nt, Homo sapiens
cuuuuggacaaaccu

SEQ ID NO: 2086181 - RNA, 22 nt, Homo sapiens
uccaccuuuaaacacggggcuu

SEQ ID NO: 2086182 - RNA, 14 nt, Homo sapiens
acaacacuguguua

SEQ ID NO: 2086183 - RNA, 20 nt, Homo sapiens
caauaggcagcuuucuuaac

SEQ ID NO: 2086184 - RNA, 14 nt, Homo sapiens
ccucagccaugagg

SEQ ID NO: 2086185 - RNA, 23 nt, Homo sapiens
uugcccauggaagucucaaagau

SEQ ID NO: 2086186 - RNA, 23 nt, Homo sapiens
uaauccucaacaacaaaccaaaa

SEQ ID NO: 2086187 - RNA, 19 nt, Homo sapiens
ggcccaugaacacagagag

SEQ ID NO: 2086188 - RNA, 17 nt, Homo sapiens
acaauggcuuacuccag

SEQ ID NO: 2086189 - RNA, 15 nt, Homo sapiens
gacagugccucuucc

SEQ ID NO: 2086190 - RNA, 14 nt, Homo sapiens
accacagggccuug

SEQ ID NO: 2086191 - RNA, 19 nt, Homo sapiens
agucagccuggcugggcuc

SEQ ID NO: 2086192 - RNA, 20 nt, Homo sapiens
uugaaaguuuuccaguauug

SEQ ID NO: 2086193 - RNA, 23 nt, Homo sapiens
uugaacaacuaggcuucagcaua

SEQ ID NO: 2086194 - RNA, 22 nt, Homo sapiens
cagccuggcucccaggacacga

SEQ ID NO: 2086195 - RNA, 15 nt, Homo sapiens
cacagaagacccgcu

SEQ ID NO: 2086196 - RNA, 18 nt, Homo sapiens
cauaaauugguauaauaa

SEQ ID NO: 2086197 - RNA, 17 nt, Homo sapiens
uagcuuguuccacugca

SEQ ID NO: 2086198 - RNA, 12 nt, Homo sapiens
cauccuugugaa

SEQ ID NO: 2086199 - RNA, 18 nt, Homo sapiens
ugugcacacuuccaggcc

SEQ ID NO: 2086200 - RNA, 18 nt, Homo sapiens
cccucagagugcaagccc

SEQ ID NO: 2086201 - RNA, 14 nt, Homo sapiens
aauaggccauguua

SEQ ID NO: 2086202 - RNA, 20 nt, Homo sapiens
aguuuuacuaaaacacugaa

SEQ ID NO: 2086203 - RNA, 16 nt, Homo sapiens
uccuuaauaugaucug

SEQ ID NO: 2086204 - RNA, 18 nt, Homo sapiens
gauuccucuuuguuuauc

SEQ ID NO: 2086205 - RNA, 16 nt, Homo sapiens
aacucaccacaagcca

SEQ ID NO: 2086206 - RNA, 13 nt, Homo sapiens
aauagcaguggua

SEQ ID NO: 2086207 - RNA, 15 nt, Homo sapiens
ccaaggccagcccac

SEQ ID NO: 2086208 - RNA, 15 nt, Homo sapiens
cauacacagaaacca

SEQ ID NO: 2086209 - RNA, 11 nt, Homo sapiens
cuaacacuggc

SEQ ID NO: 2086210 - RNA, 15 nt, Homo sapiens
cauaguuauguaaaa

SEQ ID NO: 2086211 - RNA, 22 nt, Homo sapiens
gucuuucaagugaaaccagcuu

SEQ ID NO: 2086212 - RNA, 17 nt, Homo sapiens
gugccucucucuugcuu

SEQ ID NO: 2086213 - RNA, 15 nt, Homo sapiens
uuuguucacacuccu

SEQ ID NO: 2086214 - RNA, 18 nt, Homo sapiens
ggauaaccuugugccuug

SEQ ID NO: 2086215 - RNA, 14 nt, Homo sapiens
uggcuuugcauuuc

SEQ ID NO: 2086216 - RNA, 15 nt, Homo sapiens
uuugaacaaugaagu

SEQ ID NO: 2086217 - RNA, 22 nt, Homo sapiens
cuuuuuaugugcuaugcaaaau

SEQ ID NO: 2086218 - RNA, 13 nt, Homo sapiens
cugagcaguauua

SEQ ID NO: 2086219 - RNA, 17 nt, Homo sapiens
cauuucugaugucucca

SEQ ID NO: 2086220 - RNA, 22 nt, Homo sapiens
auaacauuuacuuuugcucccu

SEQ ID NO: 2086221 - RNA, 21 nt, Homo sapiens
cccauagcacugggcucugau

SEQ ID NO: 2086222 - RNA, 15 nt, Homo sapiens
uuguuaaagauuuca

SEQ ID NO: 2086223 - RNA, 23 nt, Homo sapiens
uaacuuuuuuuuaguauuugccc

SEQ ID NO: 2086224 - RNA, 17 nt, Homo sapiens
ugccauuacuacuguac

SEQ ID NO: 2086225 - RNA, 20 nt, Homo sapiens
agugucucgaguacuaauau

SEQ ID NO: 2086226 - RNA, 16 nt, Homo sapiens
cugcauuucacucugg

SEQ ID NO: 2086227 - RNA, 20 nt, Homo sapiens
cguggucagggcagggcuca

SEQ ID NO: 2086228 - RNA, 12 nt, Homo sapiens
uccuggcugugc

SEQ ID NO: 2086229 - RNA, 23 nt, Homo sapiens
aagacuuaagcccagugcacuga

SEQ ID NO: 2086230 - RNA, 20 nt, Homo sapiens
cugaaauaaaaggugcuguu

SEQ ID NO: 2086231 - RNA, 12 nt, Homo sapiens
accaucaugccc

SEQ ID NO: 2086232 - RNA, 13 nt, Homo sapiens
cauacauagacau

SEQ ID NO: 2086233 - RNA, 13 nt, Homo sapiens
cucuacagacucc

SEQ ID NO: 2086234 - RNA, 17 nt, Homo sapiens
gcgacccauucagagac

SEQ ID NO: 2086235 - RNA, 15 nt, Homo sapiens
auuuuuuaauaaaga

SEQ ID NO: 2086236 - RNA, 13 nt, Homo sapiens
accugugcugcug

SEQ ID NO: 2086237 - RNA, 12 nt, Homo sapiens
uagcacuugccg

SEQ ID NO: 2086238 - RNA, 13 nt, Homo sapiens
gucaacaugcauu

SEQ ID NO: 2086239 - RNA, 13 nt, Homo sapiens
augacaacauugc

SEQ ID NO: 2086240 - RNA, 13 nt, Homo sapiens
gcaauaaguacca

SEQ ID NO: 2086241 - RNA, 19 nt, Homo sapiens
uggaagaggcugagacauu

SEQ ID NO: 2086242 - RNA, 14 nt, Homo sapiens
ugcuuuuaaaugca

SEQ ID NO: 2086243 - RNA, 23 nt, Homo sapiens
cagucacauucagagucgcugcu

SEQ ID NO: 2086244 - RNA, 19 nt, Homo sapiens
acuguauuuagugauuauu

SEQ ID NO: 2086245 - RNA, 14 nt, Homo sapiens
uauacauaggcauc

SEQ ID NO: 2086246 - RNA, 13 nt, Homo sapiens
ugaaauaccucau

SEQ ID NO: 2086247 - RNA, 18 nt, Homo sapiens
uggggacauacacuugca

SEQ ID NO: 2086248 - RNA, 22 nt, Homo sapiens
ugugcaguguuuuuccugugua

SEQ ID NO: 2086249 - RNA, 15 nt, Homo sapiens
ggccuggcucccuca

SEQ ID NO: 2086250 - RNA, 15 nt, Homo sapiens
auuuccuguacaauc

SEQ ID NO: 2086251 - RNA, 16 nt, Homo sapiens
ugcuccagccugacaa

SEQ ID NO: 2086252 - RNA, 15 nt, Homo sapiens
ucuacaagcauuugc

SEQ ID NO: 2086253 - RNA, 15 nt, Homo sapiens
ccuuuuaucccucac

SEQ ID NO: 2086254 - RNA, 21 nt, Homo sapiens
uguagaacucagcaguugaca

SEQ ID NO: 2086255 - RNA, 18 nt, Homo sapiens
gccugaguuaggaaacaa

SEQ ID NO: 2086256 - RNA, 16 nt, Homo sapiens
aggcaaggggcauuuc

SEQ ID NO: 2086257 - RNA, 16 nt, Homo sapiens
uuguucaguaugcaaa

SEQ ID NO: 2086258 - RNA, 21 nt, Homo sapiens
caagaagugaagaaugcacaa

SEQ ID NO: 2086259 - RNA, 19 nt, Homo sapiens
uaaaaaauguuauuacuga

SEQ ID NO: 2086260 - RNA, 17 nt, Homo sapiens
ucauccucccaccucag

SEQ ID NO: 2086261 - RNA, 16 nt, Homo sapiens
ugcuguacuugaugac

SEQ ID NO: 2086262 - RNA, 12 nt, Homo sapiens
uuccuguugcac

SEQ ID NO: 2086263 - RNA, 12 nt, Homo sapiens
uucuuguugcau

SEQ ID NO: 2086264 - RNA, 24 nt, Homo sapiens
cuccucaucaucacucaucugcca

SEQ ID NO: 2086265 - RNA, 16 nt, Homo sapiens
uccuuggcuuuuacug

SEQ ID NO: 2086266 - RNA, 16 nt, Homo sapiens
gcaccuaaaugaugcc

SEQ ID NO: 2086267 - RNA, 20 nt, Homo sapiens
ucagagcuggauucaauucc

SEQ ID NO: 2086268 - RNA, 17 nt, Homo sapiens
aaauuggugaacagugu

SEQ ID NO: 2086269 - RNA, 14 nt, Homo sapiens
agaggcagugacag

SEQ ID NO: 2086270 - RNA, 14 nt, Homo sapiens
uauacagaugcaag

SEQ ID NO: 2086271 - RNA, 18 nt, Homo sapiens
acucuguugguagcaauu

SEQ ID NO: 2086272 - RNA, 18 nt, Homo sapiens
acaauaaauggccagugc

SEQ ID NO: 2086273 - RNA, 12 nt, Homo sapiens
acgucauucagu

SEQ ID NO: 2086274 - RNA, 12 nt, Homo sapiens
aaaacauuccaa

SEQ ID NO: 2086275 - RNA, 12 nt, Homo sapiens
aaaucauuccau

SEQ ID NO: 2086276 - RNA, 13 nt, Homo sapiens
gaguggucuucaa

SEQ ID NO: 2086277 - RNA, 13 nt, Homo sapiens
uaaugaaugacau

SEQ ID NO: 2086278 - RNA, 22 nt, Homo sapiens
gucacuuccccaagaucugcca

SEQ ID NO: 2086279 - RNA, 13 nt, Homo sapiens
aaugaaagggaaa

SEQ ID NO: 2086280 - RNA, 14 nt, Homo sapiens
aaagaauaguagua

SEQ ID NO: 2086281 - RNA, 15 nt, Homo sapiens
ucuugcuuaccuuga

SEQ ID NO: 2086282 - RNA, 17 nt, Homo sapiens
guacaugguguuugugg

SEQ ID NO: 2086283 - RNA, 17 nt, Homo sapiens
cacacuuuggucauuuc

SEQ ID NO: 2086284 - RNA, 16 nt, Homo sapiens
cuuuugcugaugcuuu

SEQ ID NO: 2086285 - RNA, 20 nt, Homo sapiens
cuuuguugcauuuuggcaac

SEQ ID NO: 2086286 - RNA, 14 nt, Homo sapiens
aaaguaucauuuau

SEQ ID NO: 2086287 - RNA, 18 nt, Homo sapiens
uaaaguugcacugugacu

SEQ ID NO: 2086288 - RNA, 20 nt, Homo sapiens
gacaauacaaauacaaagga

SEQ ID NO: 2086289 - RNA, 15 nt, Homo sapiens
aaugaaaaacaacca

SEQ ID NO: 2086290 - RNA, 15 nt, Homo sapiens
aguucuaagauucua

SEQ ID NO: 2086291 - RNA, 18 nt, Homo sapiens
cagcacuaguaaaggagg

SEQ ID NO: 2086292 - RNA, 18 nt, Homo sapiens
uuagaauauccaugaccu

SEQ ID NO: 2086293 - RNA, 20 nt, Homo sapiens
ccugggcuuuuguuuugcuu

SEQ ID NO: 2086294 - RNA, 23 nt, Homo sapiens
ugugacuauucauggcuaccuca

SEQ ID NO: 2086295 - RNA, 15 nt, Homo sapiens
cuuccauuccacaca

SEQ ID NO: 2086296 - RNA, 18 nt, Homo sapiens
cagacugcaagugagcaa

SEQ ID NO: 2086297 - RNA, 16 nt, Homo sapiens
guacugauggacuuaa

SEQ ID NO: 2086298 - RNA, 21 nt, Homo sapiens
uguccuuuuggcacugagaua

SEQ ID NO: 2086299 - RNA, 15 nt, Homo sapiens
uaaagggacuugaag

SEQ ID NO: 2086300 - RNA, 22 nt, Homo sapiens
aggcuuggcacacugccagugu

SEQ ID NO: 2086301 - RNA, 13 nt, Homo sapiens
ugucugccuuaaa

SEQ ID NO: 2086302 - RNA, 21 nt, Homo sapiens
uggucacaccccugugugaua

SEQ ID NO: 2086303 - RNA, 23 nt, Homo sapiens
aaaccuguagaugcagaaaaaga

SEQ ID NO: 2086304 - RNA, 22 nt, Homo sapiens
acaugcugggccauugugauug

SEQ ID NO: 2086305 - RNA, 19 nt, Homo sapiens
uuguaauuuugcaaaacau

SEQ ID NO: 2086306 - RNA, 13 nt, Homo sapiens
acugccucagguu

SEQ ID NO: 2086307 - RNA, 12 nt, Homo sapiens
aacuacauguaa

SEQ ID NO: 2086308 - RNA, 13 nt, Homo sapiens
ccuuccucagcag

SEQ ID NO: 2086309 - RNA, 17 nt, Homo sapiens
caaccuguggggucuga

SEQ ID NO: 2086310 - RNA, 11 nt, Homo sapiens
uagaaaugcaa

SEQ ID NO: 2086311 - RNA, 13 nt, Homo sapiens
gccugacucugug

SEQ ID NO: 2086312 - RNA, 20 nt, Homo sapiens
cuggccuaaaaucuuggaag

SEQ ID NO: 2086313 - RNA, 16 nt, Homo sapiens
caaugggaggcuguga

SEQ ID NO: 2086314 - RNA, 23 nt, Homo sapiens
ugcccaauuucacagaguacaaa

SEQ ID NO: 2086315 - RNA, 20 nt, Homo sapiens
acuguugguuaaaugacaau

SEQ ID NO: 2086316 - RNA, 12 nt, Homo sapiens
caggcacaaaau

SEQ ID NO: 2086317 - RNA, 20 nt, Homo sapiens
cugaagagcaggugagcaaa

SEQ ID NO: 2086318 - RNA, 20 nt, Homo sapiens
cugcaccugauuaguugaaa

SEQ ID NO: 2086319 - RNA, 11 nt, Homo sapiens
aacauuugcca

SEQ ID NO: 2086320 - RNA, 18 nt, Homo sapiens
ugcauaaccgcacagaca

SEQ ID NO: 2086321 - RNA, 23 nt, Homo sapiens
caaguucacaccacugccauuuc

SEQ ID NO: 2086322 - RNA, 17 nt, Homo sapiens
augcccugugcaugcca

SEQ ID NO: 2086323 - RNA, 16 nt, Homo sapiens
cuuaaugauagucuua

SEQ ID NO: 2086324 - RNA, 17 nt, Homo sapiens
cugaauucuggaaucac

SEQ ID NO: 2086325 - RNA, 16 nt, Homo sapiens
cacuggagcguguacu

SEQ ID NO: 2086326 - RNA, 17 nt, Homo sapiens
gauaacauacuucuuac

SEQ ID NO: 2086327 - RNA, 22 nt, Homo sapiens
gguucacaaagcucggaccugc

SEQ ID NO: 2086328 - RNA, 21 nt, Homo sapiens
cuuuugguuuaaaaaguuuca

SEQ ID NO: 2086329 - RNA, 18 nt, Homo sapiens
aacucacggaccacucga

SEQ ID NO: 2086330 - RNA, 14 nt, Homo sapiens
cuagacuggcugaa

SEQ ID NO: 2086331 - RNA, 16 nt, Homo sapiens
gugaaacuccaucuca

SEQ ID NO: 2086332 - RNA, 14 nt, Homo sapiens
gcaccacugcacuc

SEQ ID NO: 2086333 - RNA, 11 nt, Homo sapiens
gccacagccau

SEQ ID NO: 2086334 - RNA, 21 nt, Homo sapiens
gaaaaaacuuucucuuugcca

SEQ ID NO: 2086335 - RNA, 18 nt, Homo sapiens
aguggcaucuucuuugca

SEQ ID NO: 2086336 - RNA, 21 nt, Homo sapiens
uaaggaguauaccaugagaug

SEQ ID NO: 2086337 - RNA, 18 nt, Homo sapiens
gaccaacuguguuguauu

SEQ ID NO: 2086338 - RNA, 15 nt, Homo sapiens
aaugccagaaacagu

SEQ ID NO: 2086339 - RNA, 14 nt, Homo sapiens
ugggaucuggcaca

SEQ ID NO: 2086340 - RNA, 20 nt, Homo sapiens
aggaaauucuccacugugca

SEQ ID NO: 2086341 - RNA, 13 nt, Homo sapiens
aaaugguauguca

SEQ ID NO: 2086342 - RNA, 15 nt, Homo sapiens
aaaaagaaucugcau

SEQ ID NO: 2086343 - RNA, 21 nt, Homo sapiens
cucugcauuuauaaagaccgu

SEQ ID NO: 2086344 - RNA, 16 nt, Homo sapiens
ugccccuggccuuuga

SEQ ID NO: 2086345 - RNA, 14 nt, Homo sapiens
caggagaacaucuu

SEQ ID NO: 2086346 - RNA, 19 nt, Homo sapiens
acucuggggugcagcuuca

SEQ ID NO: 2086347 - RNA, 17 nt, Homo sapiens
caaugucagaugaaguc

SEQ ID NO: 2086348 - RNA, 13 nt, Homo sapiens
uggaagucucaaa

SEQ ID NO: 2086349 - RNA, 14 nt, Homo sapiens
ccuacauuaucuca

SEQ ID NO: 2086350 - RNA, 14 nt, Homo sapiens
auucugcuuaccuu

SEQ ID NO: 2086351 - RNA, 18 nt, Homo sapiens
ggaucaaucugcaaaaaa

SEQ ID NO: 2086352 - RNA, 18 nt, Homo sapiens
gcugcuacuacuccugua

SEQ ID NO: 2086353 - RNA, 16 nt, Homo sapiens
cuggcuugggccugag

SEQ ID NO: 2086354 - RNA, 14 nt, Homo sapiens
caaacuucugugua

SEQ ID NO: 2086355 - RNA, 16 nt, Homo sapiens
acuuuuaaucagugaa

SEQ ID NO: 2086356 - RNA, 16 nt, Homo sapiens
cuucugaggagcuguu

SEQ ID NO: 2086357 - RNA, 16 nt, Homo sapiens
auuuccacuacaguga

SEQ ID NO: 2086358 - RNA, 22 nt, Homo sapiens
ucaaauguguuuugguccugga

SEQ ID NO: 2086359 - RNA, 22 nt, Homo sapiens
ucccugcccuccccugcuccca

SEQ ID NO: 2086360 - RNA, 22 nt, Homo sapiens
ucaaaaucauuuagucuaacaa

SEQ ID NO: 2086361 - RNA, 20 nt, Homo sapiens
cugugcagcgaaaucuguac

SEQ ID NO: 2086362 - RNA, 22 nt, Homo sapiens
auagccacuugcucagccauaa

SEQ ID NO: 2086363 - RNA, 15 nt, Homo sapiens
ccgucaccagaauua

SEQ ID NO: 2086364 - RNA, 23 nt, Homo sapiens
cacaggccuguguagcugugacc

SEQ ID NO: 2086365 - RNA, 15 nt, Homo sapiens
agucccacacugugc

SEQ ID NO: 2086366 - RNA, 16 nt, Homo sapiens
uuuguagcaguguacc

SEQ ID NO: 2086367 - RNA, 16 nt, Homo sapiens
uaacaaagaacaagca

SEQ ID NO: 2086368 - RNA, 14 nt, Homo sapiens
gugcaucaaccagg

SEQ ID NO: 2086369 - RNA, 22 nt, Homo sapiens
agaucagccugaccaacauggu

SEQ ID NO: 2086370 - RNA, 22 nt, Homo sapiens
ugcagucauuaugagaggcaau

SEQ ID NO: 2086371 - RNA, 23 nt, Homo sapiens
cuagguuucaccucccaaaccca

SEQ ID NO: 2086372 - RNA, 22 nt, Homo sapiens
uauaacuaaacaugauauauca

SEQ ID NO: 2086373 - RNA, 22 nt, Homo sapiens
cugcccgggaaggucaccagca

SEQ ID NO: 2086374 - RNA, 15 nt, Homo sapiens
ucaagggaaaggcaa

SEQ ID NO: 2086375 - RNA, 13 nt, Homo sapiens
aagguaaagggag

SEQ ID NO: 2086376 - RNA, 20 nt, Homo sapiens
uucgcuauucgccagcagac

SEQ ID NO: 2086377 - RNA, 14 nt, Homo sapiens
gaaacgaagcacca

SEQ ID NO: 2086378 - RNA, 14 nt, Homo sapiens
aaaauaaaacacug

SEQ ID NO: 2086379 - RNA, 14 nt, Homo sapiens
uucccucuuuccau

SEQ ID NO: 2086380 - RNA, 14 nt, Homo sapiens
acccaucuaccccu

SEQ ID NO: 2086381 - RNA, 14 nt, Homo sapiens
ccaucucuccauau

SEQ ID NO: 2086382 - RNA, 23 nt, Homo sapiens
acccuugcgcuuuugcuggucac

SEQ ID NO: 2086383 - RNA, 12 nt, Homo sapiens
cuucacaguacc

SEQ ID NO: 2086384 - RNA, 21 nt, Homo sapiens
agggggugucuggaagcugag

SEQ ID NO: 2086385 - RNA, 16 nt, Homo sapiens
gugaugguuguuguua

SEQ ID NO: 2086386 - RNA, 14 nt, Homo sapiens
cugauggcuugaca

SEQ ID NO: 2086387 - RNA, 14 nt, Homo sapiens
cucuuggcuucuca

SEQ ID NO: 2086388 - RNA, 14 nt, Homo sapiens
uccagugcaauugu

SEQ ID NO: 2086389 - RNA, 22 nt, Homo sapiens
cuccuuggcuucuuuacuuagu

SEQ ID NO: 2086390 - RNA, 22 nt, Homo sapiens
ggcucacgaggcuuggaccugg

SEQ ID NO: 2086391 - RNA, 21 nt, Homo sapiens
ugguuguacuacaguauacuu

SEQ ID NO: 2086392 - RNA, 14 nt, Homo sapiens
cgucgcacagucuc

SEQ ID NO: 2086393 - RNA, 18 nt, Homo sapiens
uugaggaccucauccaaa

SEQ ID NO: 2086394 - RNA, 23 nt, Homo sapiens
gcugggacccuuaggauggggcu

SEQ ID NO: 2086395 - RNA, 15 nt, Homo sapiens
ggauggggguacuca

SEQ ID NO: 2086396 - RNA, 15 nt, Homo sapiens
aaguaacauuugccu

SEQ ID NO: 2086397 - RNA, 22 nt, Homo sapiens
uggcuguggcaggccagcugug

SEQ ID NO: 2086398 - RNA, 12 nt, Homo sapiens
gccauaugcccu

SEQ ID NO: 2086399 - RNA, 17 nt, Homo sapiens
ccuacgugacaacacaa

SEQ ID NO: 2086400 - RNA, 19 nt, Homo sapiens
uccagcugauacacaccug

SEQ ID NO: 2086401 - RNA, 20 nt, Homo sapiens
agugaacucucaaauccaaa

SEQ ID NO: 2086402 - RNA, 16 nt, Homo sapiens
ccagaguugcaaagau

SEQ ID NO: 2086403 - RNA, 17 nt, Homo sapiens
gcucacugcagccucaa

SEQ ID NO: 2086404 - RNA, 13 nt, Homo sapiens
cccagcacugagg

SEQ ID NO: 2086405 - RNA, 15 nt, Homo sapiens
uguaacaagccagau

SEQ ID NO: 2086406 - RNA, 17 nt, Homo sapiens
guaugacuuugugccau

SEQ ID NO: 2086407 - RNA, 22 nt, Homo sapiens
ggauacuuuuaugcaaccauaa

SEQ ID NO: 2086408 - RNA, 16 nt, Homo sapiens
uaaaguuuugcaacaa

SEQ ID NO: 2086409 - RNA, 16 nt, Homo sapiens
ugaaacauuacaguua

SEQ ID NO: 2086410 - RNA, 23 nt, Homo sapiens
cugcuauaauucuauacuguuga

SEQ ID NO: 2086411 - RNA, 16 nt, Homo sapiens
agcguuugcauuugca

SEQ ID NO: 2086412 - RNA, 22 nt, Homo sapiens
aggaaucaacaauaguaacucu

SEQ ID NO: 2086413 - RNA, 18 nt, Homo sapiens
acuccagaaguggggcuc

SEQ ID NO: 2086414 - RNA, 15 nt, Homo sapiens
aauuucucugcacac

SEQ ID NO: 2086415 - RNA, 16 nt, Homo sapiens
aacagaaacacaaacg

SEQ ID NO: 2086416 - RNA, 15 nt, Homo sapiens
cagccucauccugag

SEQ ID NO: 2086417 - RNA, 15 nt, Homo sapiens
gaccccccuugccca

SEQ ID NO: 2086418 - RNA, 17 nt, Homo sapiens
uagaaacacacauuucu

SEQ ID NO: 2086419 - RNA, 15 nt, Homo sapiens
ucuguuguccaucau

SEQ ID NO: 2086420 - RNA, 24 nt, Homo sapiens
ggcauaggcugacuuuugcagaug

SEQ ID NO: 2086421 - RNA, 21 nt, Homo sapiens
gagguauggcagaggugcaag

SEQ ID NO: 2086422 - RNA, 18 nt, Homo sapiens
ugagcaaacugaagccca

SEQ ID NO: 2086423 - RNA, 21 nt, Homo sapiens
cuccaucaguuagagcugaca

SEQ ID NO: 2086424 - RNA, 14 nt, Homo sapiens
aggaaguucagucu

SEQ ID NO: 2086425 - RNA, 16 nt, Homo sapiens
aggccugccaaugcca

SEQ ID NO: 2086426 - RNA, 20 nt, Homo sapiens
auucugcguaugagucccau

SEQ ID NO: 2086427 - RNA, 18 nt, Homo sapiens
acauuugcccaauuccag

SEQ ID NO: 2086428 - RNA, 15 nt, Homo sapiens
uucacccuguccaaa

SEQ ID NO: 2086429 - RNA, 17 nt, Homo sapiens
uuccuuugaacuuugaa

SEQ ID NO: 2086430 - RNA, 14 nt, Homo sapiens
gauaacacuggcuu

SEQ ID NO: 2086431 - RNA, 17 nt, Homo sapiens
gcuggcccuacaguacc

SEQ ID NO: 2086432 - RNA, 23 nt, Homo sapiens
caauucugggugcgagugugaga

SEQ ID NO: 2086433 - RNA, 20 nt, Homo sapiens
uggcucuuuuaccaguauga

SEQ ID NO: 2086434 - RNA, 17 nt, Homo sapiens
agacaggacccugggac

SEQ ID NO: 2086435 - RNA, 14 nt, Homo sapiens
cagacuuuaccacu

SEQ ID NO: 2086436 - RNA, 16 nt, Homo sapiens
ccaguacgugcuaaca

SEQ ID NO: 2086437 - RNA, 20 nt, Homo sapiens
gcagagccucguuucugcuu

SEQ ID NO: 2086438 - RNA, 15 nt, Homo sapiens
ggccaugauggccuu

SEQ ID NO: 2086439 - RNA, 21 nt, Homo sapiens
caacugcugcaugucccugug

SEQ ID NO: 2086440 - RNA, 16 nt, Homo sapiens
uucgaaugacacuguu

SEQ ID NO: 2086441 - RNA, 16 nt, Homo sapiens
uuauaauagcauucau

SEQ ID NO: 2086442 - RNA, 15 nt, Homo sapiens
agugcuuggcugcug

SEQ ID NO: 2086443 - RNA, 21 nt, Homo sapiens
augcucuuuugcacaaggaaa

SEQ ID NO: 2086444 - RNA, 22 nt, Homo sapiens
uucuccuugccuugcuucuccc

SEQ ID NO: 2086445 - RNA, 16 nt, Homo sapiens
acucuggagcauuucu

SEQ ID NO: 2086446 - RNA, 18 nt, Homo sapiens
acugacugagcaggcugu

SEQ ID NO: 2086447 - RNA, 23 nt, Homo sapiens
uugcuuucccugaagcccuagua

SEQ ID NO: 2086448 - RNA, 17 nt, Homo sapiens
acaucccugauucucuc

SEQ ID NO: 2086449 - RNA, 23 nt, Homo sapiens
cggacugugugcagguugcagag

SEQ ID NO: 2086450 - RNA, 20 nt, Homo sapiens
ugcucacugaccugccugua

SEQ ID NO: 2086451 - RNA, 18 nt, Homo sapiens
uguuuaucucugagacag

SEQ ID NO: 2086452 - RNA, 18 nt, Homo sapiens
ucacccaggcaaucuugc

SEQ ID NO: 2086453 - RNA, 19 nt, Homo sapiens
gaauguauuaguacaaacu

SEQ ID NO: 2086454 - RNA, 12 nt, Homo sapiens
ccaacacuuugg

SEQ ID NO: 2086455 - RNA, 14 nt, Homo sapiens
aaauuccuaucuca

SEQ ID NO: 2086456 - RNA, 22 nt, Homo sapiens
aauuuggauuuacgacugaaga

SEQ ID NO: 2086457 - RNA, 18 nt, Homo sapiens
accugucacuugcacaga

SEQ ID NO: 2086458 - RNA, 18 nt, Homo sapiens
ccuggcugggaguggcau

SEQ ID NO: 2086459 - RNA, 17 nt, Homo sapiens
gcauauagaaaacaaag

SEQ ID NO: 2086460 - RNA, 13 nt, Homo sapiens
auucccuccauuu

SEQ ID NO: 2086461 - RNA, 15 nt, Homo sapiens
aggaaaaacagggaa

SEQ ID NO: 2086462 - RNA, 20 nt, Homo sapiens
cuaccaucucacggugggga

SEQ ID NO: 2086463 - RNA, 15 nt, Homo sapiens
agugaggcauugcac

SEQ ID NO: 2086464 - RNA, 14 nt, Homo sapiens
aggacacagauuau

SEQ ID NO: 2086465 - RNA, 16 nt, Homo sapiens
uucaaaccucauagca

SEQ ID NO: 2086466 - RNA, 13 nt, Homo sapiens
uuaugccaugauu

SEQ ID NO: 2086467 - RNA, 16 nt, Homo sapiens
cagccacgaggugcaa

SEQ ID NO: 2086468 - RNA, 18 nt, Homo sapiens
acuguugauccaucucag

SEQ ID NO: 2086469 - RNA, 21 nt, Homo sapiens
gauaaaaaagaaaacauucca

SEQ ID NO: 2086470 - RNA, 21 nt, Homo sapiens
accugguguuaggugugcaaa

SEQ ID NO: 2086471 - RNA, 16 nt, Homo sapiens
acggaccaaagcaaga

SEQ ID NO: 2086472 - RNA, 19 nt, Homo sapiens
agccugagaaugaccugcc

SEQ ID NO: 2086473 - RNA, 18 nt, Homo sapiens
ucuuucucuucccaugca

SEQ ID NO: 2086474 - RNA, 18 nt, Homo sapiens
cagcccuggaaacauaca

SEQ ID NO: 2086475 - RNA, 13 nt, Homo sapiens
gaaaaguuaguca

SEQ ID NO: 2086476 - RNA, 22 nt, Homo sapiens
ccacccucggggauguguccug

SEQ ID NO: 2086477 - RNA, 13 nt, Homo sapiens
ucuuggagacaau

SEQ ID NO: 2086478 - RNA, 14 nt, Homo sapiens
ucacagcgugcuaa

SEQ ID NO: 2086479 - RNA, 14 nt, Homo sapiens
cauccugcuuccug

SEQ ID NO: 2086480 - RNA, 22 nt, Homo sapiens
caaguuaaugcaaaugacuguc

SEQ ID NO: 2086481 - RNA, 13 nt, Homo sapiens
acagauggcucaa

SEQ ID NO: 2086482 - RNA, 18 nt, Homo sapiens
uauacugacaaaccagag

SEQ ID NO: 2086483 - RNA, 20 nt, Homo sapiens
gaacaauaaaaugucuucuc

SEQ ID NO: 2086484 - RNA, 20 nt, Homo sapiens
guuaaccuuucuaaccuuca

SEQ ID NO: 2086485 - RNA, 18 nt, Homo sapiens
uguauguugugaauuaug

SEQ ID NO: 2086486 - RNA, 23 nt, Homo sapiens
guuugcaccuuucuaguugaaaa

SEQ ID NO: 2086487 - RNA, 19 nt, Homo sapiens
acccuccuuccacauguac

SEQ ID NO: 2086488 - RNA, 18 nt, Homo sapiens
ucucagccccucagagaa

SEQ ID NO: 2086489 - RNA, 23 nt, Homo sapiens
gcaggggcggguggaucaccuga

SEQ ID NO: 2086490 - RNA, 21 nt, Homo sapiens
uagagguguaacacuugucaa

SEQ ID NO: 2086491 - RNA, 21 nt, Homo sapiens
ugcaaaagaagugaaacuaua

SEQ ID NO: 2086492 - RNA, 13 nt, Homo sapiens
acugcagauuucu

SEQ ID NO: 2086493 - RNA, 19 nt, Homo sapiens
uucuaaguaaaaccacagc

SEQ ID NO: 2086494 - RNA, 13 nt, Homo sapiens
uauggaaagggug

SEQ ID NO: 2086495 - RNA, 15 nt, Homo sapiens
aucuguccuguuaca

SEQ ID NO: 2086496 - RNA, 15 nt, Homo sapiens
agcuguacuuuuacc

SEQ ID NO: 2086497 - RNA, 14 nt, Homo sapiens
uaaaccaaggacug

SEQ ID NO: 2086498 - RNA, 21 nt, Homo sapiens
aggaaaucuuugguggccaaa

SEQ ID NO: 2086499 - RNA, 16 nt, Homo sapiens
gucugagaacaaauac

SEQ ID NO: 2086500 - RNA, 16 nt, Homo sapiens
cuguugauucuuucaa

SEQ ID NO: 2086501 - RNA, 14 nt, Homo sapiens
agagcugagcacuu

SEQ ID NO: 2086502 - RNA, 14 nt, Homo sapiens
caauaaaacugaug

SEQ ID NO: 2086503 - RNA, 21 nt, Homo sapiens
agaguuugcuauuagagcauu

SEQ ID NO: 2086504 - RNA, 19 nt, Homo sapiens
caccaagaucaagcagaga

SEQ ID NO: 2086505 - RNA, 18 nt, Homo sapiens
gcaauucuccugccuuag

SEQ ID NO: 2086506 - RNA, 12 nt, Homo sapiens
gagaugcagcug

SEQ ID NO: 2086507 - RNA, 19 nt, Homo sapiens
ggcagcccagugcugccac

SEQ ID NO: 2086508 - RNA, 14 nt, Homo sapiens
guugcagaaaaaga

SEQ ID NO: 2086509 - RNA, 18 nt, Homo sapiens
cagagcgagacugucuca

SEQ ID NO: 2086510 - RNA, 21 nt, Homo sapiens
uuagucauuaugaggggcaca

SEQ ID NO: 2086511 - RNA, 20 nt, Homo sapiens
cuguuuguuuuuguacauuu

SEQ ID NO: 2086512 - RNA, 17 nt, Homo sapiens
gucugaaggcauuugca

SEQ ID NO: 2086513 - RNA, 12 nt, Homo sapiens
acuucuggauau

SEQ ID NO: 2086514 - RNA, 24 nt, Homo sapiens
aaaaccaauguucucucuucucca

SEQ ID NO: 2086515 - RNA, 15 nt, Homo sapiens
gcacagcacagccag

SEQ ID NO: 2086516 - RNA, 15 nt, Homo sapiens
gguuacucauuuuau

SEQ ID NO: 2086517 - RNA, 21 nt, Homo sapiens
agguuguuuuuaaaaccacua

SEQ ID NO: 2086518 - RNA, 20 nt, Homo sapiens
cacagaugcauauagacaca

SEQ ID NO: 2086519 - RNA, 17 nt, Homo sapiens
uaauuccgaaacauaca

SEQ ID NO: 2086520 - RNA, 20 nt, Homo sapiens
gaggcaggagaaucacuuga

SEQ ID NO: 2086521 - RNA, 23 nt, Homo sapiens
agaucaugucauugaugaacugc

SEQ ID NO: 2086522 - RNA, 18 nt, Homo sapiens
acaguccgcccuacuucc

SEQ ID NO: 2086523 - RNA, 15 nt, Homo sapiens
acaggggacacugaa

SEQ ID NO: 2086524 - RNA, 17 nt, Homo sapiens
uuauguaaacaaucaga

SEQ ID NO: 2086525 - RNA, 13 nt, Homo sapiens
uacaaaggugcua

SEQ ID NO: 2086526 - RNA, 14 nt, Homo sapiens
acaguaucucaggg

SEQ ID NO: 2086527 - RNA, 23 nt, Homo sapiens
ugccccaaaucucaacuucucag

SEQ ID NO: 2086528 - RNA, 15 nt, Homo sapiens
acgcccccaccagcu

SEQ ID NO: 2086529 - RNA, 20 nt, Homo sapiens
aaugucauaaauuacuguuu

SEQ ID NO: 2086530 - RNA, 13 nt, Homo sapiens
aaaagucuaccug

SEQ ID NO: 2086531 - RNA, 16 nt, Homo sapiens
cucuugaagaugcuga

SEQ ID NO: 2086532 - RNA, 18 nt, Homo sapiens
ucaugccuuaaucccagc

SEQ ID NO: 2086533 - RNA, 20 nt, Homo sapiens
ccaggaugcuggggcacuuu

SEQ ID NO: 2086534 - RNA, 13 nt, Homo sapiens
uccaucaauaaau

SEQ ID NO: 2086535 - RNA, 12 nt, Homo sapiens
cuuccuucacau

SEQ ID NO: 2086536 - RNA, 18 nt, Homo sapiens
agcccuugaagauaucuu

SEQ ID NO: 2086537 - RNA, 14 nt, Homo sapiens
auaaucaacugggc

SEQ ID NO: 2086538 - RNA, 14 nt, Homo sapiens
caucaguauuuccu

SEQ ID NO: 2086539 - RNA, 13 nt, Homo sapiens
cugaggacugugg

SEQ ID NO: 2086540 - RNA, 15 nt, Homo sapiens
aaaggaccaguaugc

SEQ ID NO: 2086541 - RNA, 23 nt, Homo sapiens
acugaggcccagggaggugaccc

SEQ ID NO: 2086542 - RNA, 18 nt, Homo sapiens
agagacagauaccuccaa

SEQ ID NO: 2086543 - RNA, 16 nt, Homo sapiens
auagcuacccaaaaga

SEQ ID NO: 2086544 - RNA, 18 nt, Homo sapiens
cgccaacugcugaucaau

SEQ ID NO: 2086545 - RNA, 14 nt, Homo sapiens
cuuagggggcccug

SEQ ID NO: 2086546 - RNA, 20 nt, Homo sapiens
uguccuaacucuccucgcug

SEQ ID NO: 2086547 - RNA, 23 nt, Homo sapiens
aggacuacacaucagggcuugau

SEQ ID NO: 2086548 - RNA, 18 nt, Homo sapiens
agcaggacuccaucucuu

SEQ ID NO: 2086549 - RNA, 15 nt, Homo sapiens
cccaguaugaaaugg

SEQ ID NO: 2086550 - RNA, 16 nt, Homo sapiens
guauuaugcuggaauu

SEQ ID NO: 2086551 - RNA, 20 nt, Homo sapiens
ggacugggugcggugacuca

SEQ ID NO: 2086552 - RNA, 13 nt, Homo sapiens
gcccccagcagag

SEQ ID NO: 2086553 - RNA, 14 nt, Homo sapiens
ccucuggacagcuu

SEQ ID NO: 2086554 - RNA, 15 nt, Homo sapiens
gaugaaacauuaacu

SEQ ID NO: 2086555 - RNA, 14 nt, Homo sapiens
aaacuccuacuaaa

SEQ ID NO: 2086556 - RNA, 20 nt, Homo sapiens
ugaauccuuaaaggugagcc

SEQ ID NO: 2086557 - RNA, 20 nt, Homo sapiens
ucagaaaaagcuagcacuaa

SEQ ID NO: 2086558 - RNA, 16 nt, Homo sapiens
agcucuuugucaggga

SEQ ID NO: 2086559 - RNA, 17 nt, Homo sapiens
cagggcaaaugcuugau

SEQ ID NO: 2086560 - RNA, 15 nt, Homo sapiens
uucucucuguucccu

SEQ ID NO: 2086561 - RNA, 12 nt, Homo sapiens
guagacuuugcu

SEQ ID NO: 2086562 - RNA, 22 nt, Homo sapiens
aagaagguguguccuaaaucca

SEQ ID NO: 2086563 - RNA, 21 nt, Homo sapiens
auuuaucaugguccugaaugu

SEQ ID NO: 2086564 - RNA, 13 nt, Homo sapiens
caacuacuaauag

SEQ ID NO: 2086565 - RNA, 17 nt, Homo sapiens
ccuaugcuuucacuucc

SEQ ID NO: 2086566 - RNA, 20 nt, Homo sapiens
uuucuauagaaaaaguaaaa

SEQ ID NO: 2086567 - RNA, 15 nt, Homo sapiens
aucaaaaccuacccu

SEQ ID NO: 2086568 - RNA, 17 nt, Homo sapiens
gaagaaucuguuuccca

SEQ ID NO: 2086569 - RNA, 17 nt, Homo sapiens
ugacugaugcugagauu

SEQ ID NO: 2086570 - RNA, 14 nt, Homo sapiens
agccaacaaccaca

SEQ ID NO: 2086571 - RNA, 22 nt, Homo sapiens
aauauuccagagacugggacua

SEQ ID NO: 2086572 - RNA, 21 nt, Homo sapiens
acuuccagagaggaccuaucc

SEQ ID NO: 2086573 - RNA, 20 nt, Homo sapiens
auguguuauuugucacaaau

SEQ ID NO: 2086574 - RNA, 16 nt, Homo sapiens
auuacauggcaguguu

SEQ ID NO: 2086575 - RNA, 16 nt, Homo sapiens
aagagaguaaacagac

SEQ ID NO: 2086576 - RNA, 15 nt, Homo sapiens
ucuugaaguggauuu

SEQ ID NO: 2086577 - RNA, 24 nt, Homo sapiens
cauguguuuauucauccagcagug

SEQ ID NO: 2086578 - RNA, 16 nt, Homo sapiens
aaaggucaaaacugaa

SEQ ID NO: 2086579 - RNA, 21 nt, Homo sapiens
auccagugugagauacugugu

SEQ ID NO: 2086580 - RNA, 15 nt, Homo sapiens
gccagcugacaucuu

SEQ ID NO: 2086581 - RNA, 19 nt, Homo sapiens
cugccgcuuugucugucca

SEQ ID NO: 2086582 - RNA, 20 nt, Homo sapiens
caggggauucuguguuuuca

SEQ ID NO: 2086583 - RNA, 18 nt, Homo sapiens
uauugcaggauucuguaa

SEQ ID NO: 2086584 - RNA, 12 nt, Homo sapiens
acugccaagugg

SEQ ID NO: 2086585 - RNA, 12 nt, Homo sapiens
uuagaugcaguu

SEQ ID NO: 2086586 - RNA, 21 nt, Homo sapiens
cauacuauuaaacaugcugua

SEQ ID NO: 2086587 - RNA, 23 nt, Homo sapiens
acagaacuaaaaauuaaaaccuc

SEQ ID NO: 2086588 - RNA, 15 nt, Homo sapiens
caauguucauagcaa

SEQ ID NO: 2086589 - RNA, 16 nt, Homo sapiens
ugauuuaacacuaucc

SEQ ID NO: 2086590 - RNA, 23 nt, Homo sapiens
auagucuugaaaugaaagggaaa

SEQ ID NO: 2086591 - RNA, 14 nt, Homo sapiens
gagacucugucuca

SEQ ID NO: 2086592 - RNA, 20 nt, Homo sapiens
ggaagcuuguuuuccagucu

SEQ ID NO: 2086593 - RNA, 20 nt, Homo sapiens
auacauugauucaugucuca

SEQ ID NO: 2086594 - RNA, 17 nt, Homo sapiens
gcagcaguuccaugaag

SEQ ID NO: 2086595 - RNA, 19 nt, Homo sapiens
gacauuggcaccuaaucca

SEQ ID NO: 2086596 - RNA, 15 nt, Homo sapiens
cuagcauuucuucca

SEQ ID NO: 2086597 - RNA, 15 nt, Homo sapiens
agcauaaagaauuug

SEQ ID NO: 2086598 - RNA, 21 nt, Homo sapiens
aaaugccaaaggaaguuuuaa

SEQ ID NO: 2086599 - RNA, 23 nt, Homo sapiens
gaacuucccaaccuuguuugaag

SEQ ID NO: 2086600 - RNA, 14 nt, Homo sapiens
cagagcaguuucau

SEQ ID NO: 2086601 - RNA, 16 nt, Homo sapiens
gcuuuuaccugugcac

SEQ ID NO: 2086602 - RNA, 10 nt, Homo sapiens
uguacugcaa

SEQ ID NO: 2086603 - RNA, 23 nt, Homo sapiens
uggaaauuugugugcuucacaca

SEQ ID NO: 2086604 - RNA, 23 nt, Homo sapiens
cacucacacagccaggugccuug

SEQ ID NO: 2086605 - RNA, 15 nt, Homo sapiens
ucugggcagcuccug

SEQ ID NO: 2086606 - RNA, 21 nt, Homo sapiens
gaaaauuccuagaaauugaac

SEQ ID NO: 2086607 - RNA, 21 nt, Homo sapiens
ggaguccuugaccgcucucug

SEQ ID NO: 2086608 - RNA, 13 nt, Homo sapiens
agccaauggugca

SEQ ID NO: 2086609 - RNA, 19 nt, Homo sapiens
aggacccagggaaugccag

SEQ ID NO: 2086610 - RNA, 20 nt, Homo sapiens
aagaacgagaagcagcauuu

SEQ ID NO: 2086611 - RNA, 20 nt, Homo sapiens
acuugccuaucugacuucau

SEQ ID NO: 2086612 - RNA, 23 nt, Homo sapiens
accacuuuucuauauugcagugu

SEQ ID NO: 2086613 - RNA, 15 nt, Homo sapiens
gaacacacagacuuu

SEQ ID NO: 2086614 - RNA, 15 nt, Homo sapiens
gaauucacagauauu

SEQ ID NO: 2086615 - RNA, 21 nt, Homo sapiens
ucuaugaaacugcacauuggu

SEQ ID NO: 2086616 - RNA, 23 nt, Homo sapiens
uacaauaccagaucacucaaaaa

SEQ ID NO: 2086617 - RNA, 18 nt, Homo sapiens
agccagcaaccagcacau

SEQ ID NO: 2086618 - RNA, 20 nt, Homo sapiens
cucacucuguugccauuaaa

SEQ ID NO: 2086619 - RNA, 18 nt, Homo sapiens
augcuucuuuccuguaua

SEQ ID NO: 2086620 - RNA, 13 nt, Homo sapiens
uaaucuuuucaca

SEQ ID NO: 2086621 - RNA, 16 nt, Homo sapiens
aaucccucauccugac

SEQ ID NO: 2086622 - RNA, 11 nt, Homo sapiens
aucacuuccac

SEQ ID NO: 2086623 - RNA, 14 nt, Homo sapiens
cuguccagccagcu

SEQ ID NO: 2086624 - RNA, 20 nt, Homo sapiens
cugggauuacaggugugcac

SEQ ID NO: 2086625 - RNA, 20 nt, Homo sapiens
cacagaaagacugagcucaa

SEQ ID NO: 2086626 - RNA, 17 nt, Homo sapiens
cagucgaccgcacuuau

SEQ ID NO: 2086627 - RNA, 12 nt, Homo sapiens
cagaauugugca

SEQ ID NO: 2086628 - RNA, 21 nt, Homo sapiens
uucagccuagccgaccucagc

SEQ ID NO: 2086629 - RNA, 16 nt, Homo sapiens
agccugcaauaaggga

SEQ ID NO: 2086630 - RNA, 12 nt, Homo sapiens
aaauugauucau

SEQ ID NO: 2086631 - RNA, 17 nt, Homo sapiens
cagagcugugccugcuc

SEQ ID NO: 2086632 - RNA, 17 nt, Homo sapiens
ugccugggaucaguggg

SEQ ID NO: 2086633 - RNA, 13 nt, Homo sapiens
uacugaaugcacc

SEQ ID NO: 2086634 - RNA, 17 nt, Homo sapiens
gucucuuccuggucuga

SEQ ID NO: 2086635 - RNA, 20 nt, Homo sapiens
ggccaguacuacugcucuca

SEQ ID NO: 2086636 - RNA, 18 nt, Homo sapiens
ggcaggacacacauggug

SEQ ID NO: 2086637 - RNA, 16 nt, Homo sapiens
auagccacuugcucag

SEQ ID NO: 2086638 - RNA, 15 nt, Homo sapiens
aucuuuuaagcccau

SEQ ID NO: 2086639 - RNA, 22 nt, Homo sapiens
gaucuggcugugaggcccucag

SEQ ID NO: 2086640 - RNA, 19 nt, Homo sapiens
uauauuuauuuauguagga

SEQ ID NO: 2086641 - RNA, 20 nt, Homo sapiens
uuacuuaaagauuuaucaaa

SEQ ID NO: 2086642 - RNA, 15 nt, Homo sapiens
ucacaacagugaaaa

SEQ ID NO: 2086643 - RNA, 12 nt, Homo sapiens
caucuuugccuc

SEQ ID NO: 2086644 - RNA, 12 nt, Homo sapiens
cacauuugccca

SEQ ID NO: 2086645 - RNA, 16 nt, Homo sapiens
gcaugccuguagucuc

SEQ ID NO: 2086646 - RNA, 21 nt, Homo sapiens
cuuucucauaagcaccuaaaa

SEQ ID NO: 2086647 - RNA, 17 nt, Homo sapiens
uuuuaaaaacucuucag

SEQ ID NO: 2086648 - RNA, 22 nt, Homo sapiens
ugaaaccgaagggacuggaucu

SEQ ID NO: 2086649 - RNA, 17 nt, Homo sapiens
aagggacuaggaaauuc

SEQ ID NO: 2086650 - RNA, 14 nt, Homo sapiens
gucuuuguucuucu

SEQ ID NO: 2086651 - RNA, 21 nt, Homo sapiens
uguucucucugugcucuugca

SEQ ID NO: 2086652 - RNA, 21 nt, Homo sapiens
agaggagagagacuccagcug

SEQ ID NO: 2086653 - RNA, 19 nt, Homo sapiens
ggcuuggccugcugugauu

SEQ ID NO: 2086654 - RNA, 13 nt, Homo sapiens
uuaauuugcacag

SEQ ID NO: 2086655 - RNA, 16 nt, Homo sapiens
ucuuuuuguaucucau

SEQ ID NO: 2086656 - RNA, 16 nt, Homo sapiens
agcacagcuacucaga

SEQ ID NO: 2086657 - RNA, 20 nt, Homo sapiens
ucccuggcuuccccuucaga

SEQ ID NO: 2086658 - RNA, 23 nt, Homo sapiens
cagauauggaaacagaagacaaa

SEQ ID NO: 2086659 - RNA, 19 nt, Homo sapiens
guacaucuugugcaugcaa

SEQ ID NO: 2086660 - RNA, 14 nt, Homo sapiens
agagguuucuugaa

SEQ ID NO: 2086661 - RNA, 15 nt, Homo sapiens
uuguguccugaugaa

SEQ ID NO: 2086662 - RNA, 18 nt, Homo sapiens
ccuugauugguguugcca

SEQ ID NO: 2086663 - RNA, 16 nt, Homo sapiens
uaugcugcuccugaua

SEQ ID NO: 2086664 - RNA, 21 nt, Homo sapiens
aucccacuuaucaaaucauuc

SEQ ID NO: 2086665 - RNA, 21 nt, Homo sapiens
ucucucugaacacacauugcu

SEQ ID NO: 2086666 - RNA, 22 nt, Homo sapiens
cucagggccuggcaggccagug

SEQ ID NO: 2086667 - RNA, 18 nt, Homo sapiens
ccagggaugauucaagcc

SEQ ID NO: 2086668 - RNA, 23 nt, Homo sapiens
agucaauaaaccugggcaaguga

SEQ ID NO: 2086669 - RNA, 15 nt, Homo sapiens
ucaccucuuccucug

SEQ ID NO: 2086670 - RNA, 18 nt, Homo sapiens
cuaggaucuucacugucu

SEQ ID NO: 2086671 - RNA, 22 nt, Homo sapiens
ugaagugcucacuacucaguga

SEQ ID NO: 2086672 - RNA, 19 nt, Homo sapiens
gccacacaaacguuuacuu

SEQ ID NO: 2086673 - RNA, 20 nt, Homo sapiens
gaucuuuguuuaaaugccaa

SEQ ID NO: 2086674 - RNA, 12 nt, Homo sapiens
uucaccaugcag

SEQ ID NO: 2086675 - RNA, 15 nt, Homo sapiens
gccagcucuucucaa

SEQ ID NO: 2086676 - RNA, 12 nt, Homo sapiens
cccugccaaaaa

SEQ ID NO: 2086677 - RNA, 19 nt, Homo sapiens
ugacagagguuuugaaaug

SEQ ID NO: 2086678 - RNA, 21 nt, Homo sapiens
uuguacauagugaggagcuuu

SEQ ID NO: 2086679 - RNA, 18 nt, Homo sapiens
gcccuuccaugugccuuu

SEQ ID NO: 2086680 - RNA, 19 nt, Homo sapiens
acauuauucuucacuuaaa

SEQ ID NO: 2086681 - RNA, 22 nt, Homo sapiens
auacacguaugguuaauguuca

SEQ ID NO: 2086682 - RNA, 24 nt, Homo sapiens
gagaugaacccuggcauuuggccu

SEQ ID NO: 2086683 - RNA, 11 nt, Homo sapiens
cuaacauauau

SEQ ID NO: 2086684 - RNA, 21 nt, Homo sapiens
cgguugaacucacuccacugu

SEQ ID NO: 2086685 - RNA, 14 nt, Homo sapiens
ggcaccuguagucc

SEQ ID NO: 2086686 - RNA, 12 nt, Homo sapiens
aaacaugaauua

SEQ ID NO: 2086687 - RNA, 17 nt, Homo sapiens
cccccgagccccagucu

SEQ ID NO: 2086688 - RNA, 13 nt, Homo sapiens
ucagccuuucuaa

SEQ ID NO: 2086689 - RNA, 21 nt, Homo sapiens
ugaguacauacucaagagcau

SEQ ID NO: 2086690 - RNA, 18 nt, Homo sapiens
gcccgacaggcaugcacc

SEQ ID NO: 2086691 - RNA, 15 nt, Homo sapiens
cugauuguccugcca

SEQ ID NO: 2086692 - RNA, 12 nt, Homo sapiens
uugcugcacuuu

SEQ ID NO: 2086693 - RNA, 16 nt, Homo sapiens
agugcugguucuccaa

SEQ ID NO: 2086694 - RNA, 14 nt, Homo sapiens
aagugguuacuuug

SEQ ID NO: 2086695 - RNA, 19 nt, Homo sapiens
uguguaaaggaacaacuga

SEQ ID NO: 2086696 - RNA, 16 nt, Homo sapiens
aauuuggauuuuccac

SEQ ID NO: 2086697 - RNA, 12 nt, Homo sapiens
ccguuaaucucu

SEQ ID NO: 2086698 - RNA, 18 nt, Homo sapiens
gaugggcagcagcuugga

SEQ ID NO: 2086699 - RNA, 22 nt, Homo sapiens
uuuuauuuacagcugugcucca

SEQ ID NO: 2086700 - RNA, 16 nt, Homo sapiens
cucugcacuacugaca

SEQ ID NO: 2086701 - RNA, 21 nt, Homo sapiens
acugcauuagaaaccaugaaa

SEQ ID NO: 2086702 - RNA, 21 nt, Homo sapiens
uauccuccccuuuuaccacuc

SEQ ID NO: 2086703 - RNA, 17 nt, Homo sapiens
cguugcccagcacuguc

SEQ ID NO: 2086704 - RNA, 18 nt, Homo sapiens
ugggguccccacucccug

SEQ ID NO: 2086705 - RNA, 21 nt, Homo sapiens
acggagccccugaaagccuca

SEQ ID NO: 2086706 - RNA, 16 nt, Homo sapiens
gaacugcaacacugga

SEQ ID NO: 2086707 - RNA, 20 nt, Homo sapiens
ggacaauuaugauagcuuau

SEQ ID NO: 2086708 - RNA, 22 nt, Homo sapiens
cuggaacaccagcagcacugga

SEQ ID NO: 2086709 - RNA, 16 nt, Homo sapiens
aggcaggugccuccag

SEQ ID NO: 2086710 - RNA, 22 nt, Homo sapiens
caucccgagcaacccucugaag

SEQ ID NO: 2086711 - RNA, 20 nt, Homo sapiens
auguaaagauuugcuuccau

SEQ ID NO: 2086712 - RNA, 15 nt, Homo sapiens
ucaaagguucuaggu

SEQ ID NO: 2086713 - RNA, 14 nt, Homo sapiens
auacguacauuccu

SEQ ID NO: 2086714 - RNA, 17 nt, Homo sapiens
auauuacaauccuugac

SEQ ID NO: 2086715 - RNA, 13 nt, Homo sapiens
aaaaagaacugua

SEQ ID NO: 2086716 - RNA, 14 nt, Homo sapiens
gagacagugcacau

SEQ ID NO: 2086717 - RNA, 20 nt, Homo sapiens
agggucuuuucaucugggaa

SEQ ID NO: 2086718 - RNA, 16 nt, Homo sapiens
aaauaagcugaugucc

SEQ ID NO: 2086719 - RNA, 19 nt, Homo sapiens
aagguaaauauucauuugc

SEQ ID NO: 2086720 - RNA, 15 nt, Homo sapiens
cacagagauaugcac

SEQ ID NO: 2086721 - RNA, 18 nt, Homo sapiens
gucagugguggucuucaa

SEQ ID NO: 2086722 - RNA, 18 nt, Homo sapiens
guucaggcccaucagcua

SEQ ID NO: 2086723 - RNA, 22 nt, Homo sapiens
uaguagagacaggguuucacca

SEQ ID NO: 2086724 - RNA, 22 nt, Homo sapiens
accuuuugaggagccccagcua

SEQ ID NO: 2086725 - RNA, 23 nt, Homo sapiens
ccauauaacaauucaguaacaaa

SEQ ID NO: 2086726 - RNA, 19 nt, Homo sapiens
auugaucaaauauuucaac

SEQ ID NO: 2086727 - RNA, 22 nt, Homo sapiens
uggagacuuccucuguucucag

SEQ ID NO: 2086728 - RNA, 18 nt, Homo sapiens
cuuggccucccaaagugc

SEQ ID NO: 2086729 - RNA, 11 nt, Homo sapiens
aauaaaacuga

SEQ ID NO: 2086730 - RNA, 15 nt, Homo sapiens
ugaaagaagcaagac

SEQ ID NO: 2086731 - RNA, 20 nt, Homo sapiens
uuccccuuagaaacacugca

SEQ ID NO: 2086732 - RNA, 20 nt, Homo sapiens
auuugcuuuaaugagugcac

SEQ ID NO: 2086733 - RNA, 18 nt, Homo sapiens
gagugcuaagcauuagcu

SEQ ID NO: 2086734 - RNA, 18 nt, Homo sapiens
ccucuuuucucugugcuu

SEQ ID NO: 2086735 - RNA, 16 nt, Homo sapiens
ggauuuucaaggucau

SEQ ID NO: 2086736 - RNA, 12 nt, Homo sapiens
agaaguaggggu

SEQ ID NO: 2086737 - RNA, 12 nt, Homo sapiens
ugcgacugcucu

SEQ ID NO: 2086738 - RNA, 13 nt, Homo sapiens
ugcuguucuuaca

SEQ ID NO: 2086739 - RNA, 16 nt, Homo sapiens
acacagggugguggca

SEQ ID NO: 2086740 - RNA, 15 nt, Homo sapiens
acagucuggcucaug

SEQ ID NO: 2086741 - RNA, 14 nt, Homo sapiens
aguugucugucuga

SEQ ID NO: 2086742 - RNA, 20 nt, Homo sapiens
ggagaugaauagaagaaaga

SEQ ID NO: 2086743 - RNA, 18 nt, Homo sapiens
auaguuacuuacugccuu

SEQ ID NO: 2086744 - RNA, 19 nt, Homo sapiens
uccuguucgugcuuguaau

SEQ ID NO: 2086745 - RNA, 17 nt, Homo sapiens
ucaugcccagcuuggag

SEQ ID NO: 2086746 - RNA, 14 nt, Homo sapiens
uaauacauauagca

SEQ ID NO: 2086747 - RNA, 15 nt, Homo sapiens
ucgcauccagacagu

SEQ ID NO: 2086748 - RNA, 21 nt, Homo sapiens
cguuuucuugcucaaagggaa

SEQ ID NO: 2086749 - RNA, 16 nt, Homo sapiens
caauaaagugaucugu

SEQ ID NO: 2086750 - RNA, 21 nt, Homo sapiens
uucuuauuacuagacugccac

SEQ ID NO: 2086751 - RNA, 15 nt, Homo sapiens
guaccccauggagcu

SEQ ID NO: 2086752 - RNA, 22 nt, Homo sapiens
uguguguuugcuuuguaucuaa

SEQ ID NO: 2086753 - RNA, 11 nt, Homo sapiens
uaaaagacagc

SEQ ID NO: 2086754 - RNA, 13 nt, Homo sapiens
uuuagggcagcuu

SEQ ID NO: 2086755 - RNA, 14 nt, Homo sapiens
cagccuacagccag

SEQ ID NO: 2086756 - RNA, 17 nt, Homo sapiens
guucagaggugcagcug

SEQ ID NO: 2086757 - RNA, 20 nt, Homo sapiens
ggggauacuggcaaagcaga

SEQ ID NO: 2086758 - RNA, 13 nt, Homo sapiens
uuucagcauaaau

SEQ ID NO: 2086759 - RNA, 20 nt, Homo sapiens
auuguacauauuuguggaau

SEQ ID NO: 2086760 - RNA, 23 nt, Homo sapiens
caguguuuuuccuuggaucccau

SEQ ID NO: 2086761 - RNA, 16 nt, Homo sapiens
cugguauuguucucac

SEQ ID NO: 2086762 - RNA, 13 nt, Homo sapiens
uccuguugcacug

SEQ ID NO: 2086763 - RNA, 17 nt, Homo sapiens
uccagaugagaguacac

SEQ ID NO: 2086764 - RNA, 17 nt, Homo sapiens
auuccagccugggcaac

SEQ ID NO: 2086765 - RNA, 15 nt, Homo sapiens
acccccuccacaaag

SEQ ID NO: 2086766 - RNA, 15 nt, Homo sapiens
aacgcuccucugaaa

SEQ ID NO: 2086767 - RNA, 11 nt, Homo sapiens
ccuugaugaau

SEQ ID NO: 2086768 - RNA, 15 nt, Homo sapiens
ugagugaauguuaac

SEQ ID NO: 2086769 - RNA, 21 nt, Homo sapiens
acucccuuuccccucuucccu

SEQ ID NO: 2086770 - RNA, 23 nt, Homo sapiens
gcccugcauaauguuaagcuuua

SEQ ID NO: 2086771 - RNA, 16 nt, Homo sapiens
uuauguauaaacauaa

SEQ ID NO: 2086772 - RNA, 23 nt, Homo sapiens
aggaauaaaaugaaauacuaaau

SEQ ID NO: 2086773 - RNA, 16 nt, Homo sapiens
uaaggaccaauagcau

SEQ ID NO: 2086774 - RNA, 17 nt, Homo sapiens
cagaugaccuuuuggaa

SEQ ID NO: 2086775 - RNA, 18 nt, Homo sapiens
caacagauaccucucagu

SEQ ID NO: 2086776 - RNA, 19 nt, Homo sapiens
aguaccauaaucuuagaga

SEQ ID NO: 2086777 - RNA, 18 nt, Homo sapiens
gcccugaccuucugggac

SEQ ID NO: 2086778 - RNA, 19 nt, Homo sapiens
uugacuuuuauaaagcaug

SEQ ID NO: 2086779 - RNA, 21 nt, Homo sapiens
ggaccacuaaaucuccaagac

SEQ ID NO: 2086780 - RNA, 19 nt, Homo sapiens
caugcuguugcugcuacug

SEQ ID NO: 2086781 - RNA, 20 nt, Homo sapiens
augugaagaugcauuguagu

SEQ ID NO: 2086782 - RNA, 18 nt, Homo sapiens
aaauaauaaaagaaucau

SEQ ID NO: 2086783 - RNA, 14 nt, Homo sapiens
caaugcuuugucca

SEQ ID NO: 2086784 - RNA, 13 nt, Homo sapiens
caggagaaucacu

SEQ ID NO: 2086785 - RNA, 19 nt, Homo sapiens
augguugauggguucuaau

SEQ ID NO: 2086786 - RNA, 19 nt, Homo sapiens
uuaagcuuccgccgucuca

SEQ ID NO: 2086787 - RNA, 13 nt, Homo sapiens
uguggcuucuuaa

SEQ ID NO: 2086788 - RNA, 17 nt, Homo sapiens
auccaggauucugggag

SEQ ID NO: 2086789 - RNA, 16 nt, Homo sapiens
cugaugacacugagaa

SEQ ID NO: 2086790 - RNA, 17 nt, Homo sapiens
auuagacagaacaccua

SEQ ID NO: 2086791 - RNA, 22 nt, Homo sapiens
gcacccgcccuuuccuugccuu

SEQ ID NO: 2086792 - RNA, 13 nt, Homo sapiens
uaugaggggaccc

SEQ ID NO: 2086793 - RNA, 14 nt, Homo sapiens
auuuuauauaaaga

SEQ ID NO: 2086794 - RNA, 17 nt, Homo sapiens
guaaaagccuaugugcc

SEQ ID NO: 2086795 - RNA, 21 nt, Homo sapiens
ucaauauaagcuuuucuuuuc

SEQ ID NO: 2086796 - RNA, 16 nt, Homo sapiens
ggagucagcuguuucu

SEQ ID NO: 2086797 - RNA, 14 nt, Homo sapiens
cccuugaugaagaa

SEQ ID NO: 2086798 - RNA, 18 nt, Homo sapiens
gcuccaggagcagcgugc

SEQ ID NO: 2086799 - RNA, 16 nt, Homo sapiens
ugaaagagaguaccau

SEQ ID NO: 2086800 - RNA, 15 nt, Homo sapiens
cacagggacacaaag

SEQ ID NO: 2086801 - RNA, 16 nt, Homo sapiens
cagaaauccugcaaug

SEQ ID NO: 2086802 - RNA, 21 nt, Homo sapiens
aaacugaggaauuucaccugu

SEQ ID NO: 2086803 - RNA, 19 nt, Homo sapiens
cuuaauaaauuguguuucc

SEQ ID NO: 2086804 - RNA, 19 nt, Homo sapiens
aaaaauaacugacaaacca

SEQ ID NO: 2086805 - RNA, 23 nt, Homo sapiens
aaugucagucuacaggccuuuca

SEQ ID NO: 2086806 - RNA, 18 nt, Homo sapiens
cuggaaaacucaugaaua

SEQ ID NO: 2086807 - RNA, 15 nt, Homo sapiens
ugaacccuugugcuu

SEQ ID NO: 2086808 - RNA, 20 nt, Homo sapiens
auauguauaaacuuacauca

SEQ ID NO: 2086809 - RNA, 18 nt, Homo sapiens
gaagcccaccacuggcca

SEQ ID NO: 2086810 - RNA, 14 nt, Homo sapiens
guuaaaugugcuau

SEQ ID NO: 2086811 - RNA, 22 nt, Homo sapiens
uuucuaaaccuugugauucugc

SEQ ID NO: 2086812 - RNA, 10 nt, Homo sapiens
uugugcaaac

SEQ ID NO: 2086813 - RNA, 22 nt, Homo sapiens
ggaccccugccaguucucugug

SEQ ID NO: 2086814 - RNA, 23 nt, Homo sapiens
auugcugcaccaaugcacugagu

SEQ ID NO: 2086815 - RNA, 21 nt, Homo sapiens
uguuguuuuaggaauacauaa

SEQ ID NO: 2086816 - RNA, 15 nt, Homo sapiens
ccugacuucuggaau

SEQ ID NO: 2086817 - RNA, 21 nt, Homo sapiens
cgcccagacaccaugugcaau

SEQ ID NO: 2086818 - RNA, 17 nt, Homo sapiens
aguguugccuaaguauu

SEQ ID NO: 2086819 - RNA, 16 nt, Homo sapiens
caagaggcuguuccca

SEQ ID NO: 2086820 - RNA, 19 nt, Homo sapiens
acuuguggccucaagcaau

SEQ ID NO: 2086821 - RNA, 24 nt, Homo sapiens
ucucuuaccagggagauuugcuca

SEQ ID NO: 2086822 - RNA, 22 nt, Homo sapiens
cguggacagucaggguucacuu

SEQ ID NO: 2086823 - RNA, 18 nt, Homo sapiens
aguauucuuaguuguuca

SEQ ID NO: 2086824 - RNA, 22 nt, Homo sapiens
uucugcagauaaacaguaguga

SEQ ID NO: 2086825 - RNA, 20 nt, Homo sapiens
ugaggagagaaggacaugug

SEQ ID NO: 2086826 - RNA, 14 nt, Homo sapiens
acuuccugcacuga

SEQ ID NO: 2086827 - RNA, 18 nt, Homo sapiens
uaacauacugcauuucac

SEQ ID NO: 2086828 - RNA, 20 nt, Homo sapiens
uaaaaucacccugacugugg

SEQ ID NO: 2086829 - RNA, 16 nt, Homo sapiens
aaaugucaguccuuga

SEQ ID NO: 2086830 - RNA, 12 nt, Homo sapiens
ugcuuugcccaa

SEQ ID NO: 2086831 - RNA, 21 nt, Homo sapiens
uaaauaaauguaauagccaaa

SEQ ID NO: 2086832 - RNA, 15 nt, Homo sapiens
aguucugcaaaauac

SEQ ID NO: 2086833 - RNA, 15 nt, Homo sapiens
ggaugcuagugcugu

SEQ ID NO: 2086834 - RNA, 15 nt, Homo sapiens
aagaugaugauguua

SEQ ID NO: 2086835 - RNA, 19 nt, Homo sapiens
aguaccacacauauugcac

SEQ ID NO: 2086836 - RNA, 23 nt, Homo sapiens
uuugaaaaaugagagcuguaacu

SEQ ID NO: 2086837 - RNA, 20 nt, Homo sapiens
aagugcuucuccagccucag

SEQ ID NO: 2086838 - RNA, 17 nt, Homo sapiens
auguaaacaaaccacag

SEQ ID NO: 2086839 - RNA, 16 nt, Homo sapiens
ugugugcaugugcugu

SEQ ID NO: 2086840 - RNA, 22 nt, Homo sapiens
caagaaccaaggaaucauguca

SEQ ID NO: 2086841 - RNA, 14 nt, Homo sapiens
auuuuaaggacugc

SEQ ID NO: 2086842 - RNA, 18 nt, Homo sapiens
ucugccuacaaaaccuca

SEQ ID NO: 2086843 - RNA, 12 nt, Homo sapiens
uauccuguucua

SEQ ID NO: 2086844 - RNA, 17 nt, Homo sapiens
acaauacaucaacaaga

SEQ ID NO: 2086845 - RNA, 15 nt, Homo sapiens
agccuaccucugucu

SEQ ID NO: 2086846 - RNA, 20 nt, Homo sapiens
cccucuaagcacauuccaaa

SEQ ID NO: 2086847 - RNA, 18 nt, Homo sapiens
ggcuucccaucuuccaca

SEQ ID NO: 2086848 - RNA, 23 nt, Homo sapiens
aggaacaaagacaaccacuggga

SEQ ID NO: 2086849 - RNA, 13 nt, Homo sapiens
agcauacuuuaua

SEQ ID NO: 2086850 - RNA, 17 nt, Homo sapiens
ugaagacaaaccacugu

SEQ ID NO: 2086851 - RNA, 19 nt, Homo sapiens
acagacagaaaaaacugag

SEQ ID NO: 2086852 - RNA, 13 nt, Homo sapiens
agagagagcaaga

SEQ ID NO: 2086853 - RNA, 18 nt, Homo sapiens
cuacauguauugcacauu

SEQ ID NO: 2086854 - RNA, 21 nt, Homo sapiens
cuuggaaauagaaagaagcca

SEQ ID NO: 2086855 - RNA, 20 nt, Homo sapiens
aaaaaugcuauuguugcaau

SEQ ID NO: 2086856 - RNA, 15 nt, Homo sapiens
gaagaguuggaguga

SEQ ID NO: 2086857 - RNA, 13 nt, Homo sapiens
cccuuagugaauu

SEQ ID NO: 2086858 - RNA, 21 nt, Homo sapiens
cacucagggucugggaugaag

SEQ ID NO: 2086859 - RNA, 21 nt, Homo sapiens
gucucauaugauugugcacau

SEQ ID NO: 2086860 - RNA, 20 nt, Homo sapiens
auauaguaccuuugcucuug

SEQ ID NO: 2086861 - RNA, 12 nt, Homo sapiens
ugucagccugac

SEQ ID NO: 2086862 - RNA, 11 nt, Homo sapiens
uacacaauggg

SEQ ID NO: 2086863 - RNA, 15 nt, Homo sapiens
caacaagcaagaucu

SEQ ID NO: 2086864 - RNA, 18 nt, Homo sapiens
agcacaggcacugcagga

SEQ ID NO: 2086865 - RNA, 14 nt, Homo sapiens
accuacgugccacu

SEQ ID NO: 2086866 - RNA, 16 nt, Homo sapiens
uauuauauauuuacag

SEQ ID NO: 2086867 - RNA, 20 nt, Homo sapiens
ugcccucuuguggugcauug

SEQ ID NO: 2086868 - RNA, 14 nt, Homo sapiens
auucauuuccugcc

SEQ ID NO: 2086869 - RNA, 17 nt, Homo sapiens
gaauugaccccuuccuc

SEQ ID NO: 2086870 - RNA, 22 nt, Homo sapiens
ccugugugcugacaggagaccc

SEQ ID NO: 2086871 - RNA, 20 nt, Homo sapiens
agccauaagaaagcacuauu

SEQ ID NO: 2086872 - RNA, 14 nt, Homo sapiens
agcauaaacaauau

SEQ ID NO: 2086873 - RNA, 15 nt, Homo sapiens
aaggggauggaguga

SEQ ID NO: 2086874 - RNA, 13 nt, Homo sapiens
gggagggagcuga

SEQ ID NO: 2086875 - RNA, 16 nt, Homo sapiens
ccaggcugagugcaua

SEQ ID NO: 2086876 - RNA, 21 nt, Homo sapiens
uccaaguuccccaucccuguc

SEQ ID NO: 2086877 - RNA, 15 nt, Homo sapiens
augggacuuaacucc

SEQ ID NO: 2086878 - RNA, 14 nt, Homo sapiens
aaaagccuaccuaa

SEQ ID NO: 2086879 - RNA, 16 nt, Homo sapiens
ccaagauacucuuugu

SEQ ID NO: 2086880 - RNA, 14 nt, Homo sapiens
aauaaagucaaauc

SEQ ID NO: 2086881 - RNA, 20 nt, Homo sapiens
gggauucuguacaugcauug

SEQ ID NO: 2086882 - RNA, 22 nt, Homo sapiens
gcauaacgucugccuucuuucc

SEQ ID NO: 2086883 - RNA, 17 nt, Homo sapiens
acauccuguuuugcaaa

SEQ ID NO: 2086884 - RNA, 20 nt, Homo sapiens
agucaugcaaaggcugggac

SEQ ID NO: 2086885 - RNA, 18 nt, Homo sapiens
gaacaaucuuugcuguau

SEQ ID NO: 2086886 - RNA, 20 nt, Homo sapiens
guucauacuuuggcugugau

SEQ ID NO: 2086887 - RNA, 21 nt, Homo sapiens
ccugaacuacauaacuuccua

SEQ ID NO: 2086888 - RNA, 13 nt, Homo sapiens
cgcagcgcaggac

SEQ ID NO: 2086889 - RNA, 24 nt, Homo sapiens
uaaacuaagagaaacuguguauag

SEQ ID NO: 2086890 - RNA, 18 nt, Homo sapiens
auggccaacucaacuuuc

SEQ ID NO: 2086891 - RNA, 18 nt, Homo sapiens
uuuacucauaaguaaaag

SEQ ID NO: 2086892 - RNA, 22 nt, Homo sapiens
agauagugccagguggcucagu

SEQ ID NO: 2086893 - RNA, 16 nt, Homo sapiens
caugaacacacaugga

SEQ ID NO: 2086894 - RNA, 19 nt, Homo sapiens
gaugcugugaaauucccaa

SEQ ID NO: 2086895 - RNA, 12 nt, Homo sapiens
gcuuuagcuuca

SEQ ID NO: 2086896 - RNA, 23 nt, Homo sapiens
aagaagcaaccucaguaauuuag

SEQ ID NO: 2086897 - RNA, 19 nt, Homo sapiens
caucuguuugauacaguau

SEQ ID NO: 2086898 - RNA, 21 nt, Homo sapiens
caagcggaugcuccauuucaa

SEQ ID NO: 2086899 - RNA, 12 nt, Homo sapiens
agacucaccuca

SEQ ID NO: 2086900 - RNA, 15 nt, Homo sapiens
cuuuuuguaucucau

SEQ ID NO: 2086901 - RNA, 20 nt, Homo sapiens
auggaagaaacacagaaagg

SEQ ID NO: 2086902 - RNA, 19 nt, Homo sapiens
uacagugacaauacaaaua

SEQ ID NO: 2086903 - RNA, 16 nt, Homo sapiens
cagcaaggggacaucu

SEQ ID NO: 2086904 - RNA, 20 nt, Homo sapiens
aaagaauuccugaagccaga

SEQ ID NO: 2086905 - RNA, 21 nt, Homo sapiens
acuuucauccugguuuccacu

SEQ ID NO: 2086906 - RNA, 14 nt, Homo sapiens
cagaauugcacauc

SEQ ID NO: 2086907 - RNA, 17 nt, Homo sapiens
agcacuacaccuugccu

SEQ ID NO: 2086908 - RNA, 13 nt, Homo sapiens
augaauacaaauu

SEQ ID NO: 2086909 - RNA, 15 nt, Homo sapiens
cuggcaacucaaggc

SEQ ID NO: 2086910 - RNA, 16 nt, Homo sapiens
cagucaggguucacuu

SEQ ID NO: 2086911 - RNA, 13 nt, Homo sapiens
ugaacacugugac

SEQ ID NO: 2086912 - RNA, 14 nt, Homo sapiens
uacaucuccaaaua

SEQ ID NO: 2086913 - RNA, 20 nt, Homo sapiens
agacugggucucgcuuuguu

SEQ ID NO: 2086914 - RNA, 16 nt, Homo sapiens
aacuaaucaccauauu

SEQ ID NO: 2086915 - RNA, 15 nt, Homo sapiens
ucauggggugaugcu

SEQ ID NO: 2086916 - RNA, 23 nt, Homo sapiens
uuugacuuugguuguguuuaaau

SEQ ID NO: 2086917 - RNA, 22 nt, Homo sapiens
uaauguguggaaugugcagauu

SEQ ID NO: 2086918 - RNA, 20 nt, Homo sapiens
ccaccaucaaaggaauauaa

SEQ ID NO: 2086919 - RNA, 22 nt, Homo sapiens
agaugauuucaauagcuuugua

SEQ ID NO: 2086920 - RNA, 23 nt, Homo sapiens
agaucucccuucucaucucccca

SEQ ID NO: 2086921 - RNA, 21 nt, Homo sapiens
uuuacaagaaguuuauucuca

SEQ ID NO: 2086922 - RNA, 15 nt, Homo sapiens
uuuaucucacacaca

SEQ ID NO: 2086923 - RNA, 15 nt, Homo sapiens
auaaagucucucuga

SEQ ID NO: 2086924 - RNA, 18 nt, Homo sapiens
aacuuacuaaauaucaua

SEQ ID NO: 2086925 - RNA, 13 nt, Homo sapiens
cagcaucauucag

SEQ ID NO: 2086926 - RNA, 20 nt, Homo sapiens
aauuuaaccagcaacauuga

SEQ ID NO: 2086927 - RNA, 15 nt, Homo sapiens
ggucccaauuaagaa

SEQ ID NO: 2086928 - RNA, 20 nt, Homo sapiens
gucaagaucagccugggcaa

SEQ ID NO: 2086929 - RNA, 21 nt, Homo sapiens
gcccagccuccaagcuccauc

SEQ ID NO: 2086930 - RNA, 17 nt, Homo sapiens
cccacagucccauuccu

SEQ ID NO: 2086931 - RNA, 21 nt, Homo sapiens
ucaucuuccuguguccugaaa

SEQ ID NO: 2086932 - RNA, 20 nt, Homo sapiens
uuaaaugaaaguauuggcau

SEQ ID NO: 2086933 - RNA, 11 nt, Homo sapiens
ugcagccaggc

SEQ ID NO: 2086934 - RNA, 17 nt, Homo sapiens
aaauauauagcuugaaa

SEQ ID NO: 2086935 - RNA, 14 nt, Homo sapiens
augagaucagguca

SEQ ID NO: 2086936 - RNA, 15 nt, Homo sapiens
agaaugaaauacucu

SEQ ID NO: 2086937 - RNA, 20 nt, Homo sapiens
ugaugaaugacaacauugca

SEQ ID NO: 2086938 - RNA, 17 nt, Homo sapiens
acucuaccucauaucag

SEQ ID NO: 2086939 - RNA, 18 nt, Homo sapiens
cagacauagacugcaaaa

SEQ ID NO: 2086940 - RNA, 19 nt, Homo sapiens
aaccuuauauuuacaauaa

SEQ ID NO: 2086941 - RNA, 20 nt, Homo sapiens
augaagcgaaacacagagaa

SEQ ID NO: 2086942 - RNA, 15 nt, Homo sapiens
ugcuguugugaagcu

SEQ ID NO: 2086943 - RNA, 13 nt, Homo sapiens
ugguaugaugcug

SEQ ID NO: 2086944 - RNA, 15 nt, Homo sapiens
uaaugagacaugaau

SEQ ID NO: 2086945 - RNA, 22 nt, Homo sapiens
cauucuuaaaggaaaagucaac

SEQ ID NO: 2086946 - RNA, 17 nt, Homo sapiens
uguucgcucgugcagua

SEQ ID NO: 2086947 - RNA, 22 nt, Homo sapiens
aggcuguacauaguccuuuuau

SEQ ID NO: 2086948 - RNA, 21 nt, Homo sapiens
ucuucaucugacuaugacaua

SEQ ID NO: 2086949 - RNA, 18 nt, Homo sapiens
acagucauguaugcaagu

SEQ ID NO: 2086950 - RNA, 16 nt, Homo sapiens
ccugaaaacuuuagca

SEQ ID NO: 2086951 - RNA, 12 nt, Homo sapiens
aaagaagucaaa

SEQ ID NO: 2086952 - RNA, 12 nt, Homo sapiens
acaggugugagc

SEQ ID NO: 2086953 - RNA, 21 nt, Homo sapiens
auucuacacauauauguauau

SEQ ID NO: 2086954 - RNA, 22 nt, Homo sapiens
cacuuuuuaguucccuaaacuu

SEQ ID NO: 2086955 - RNA, 18 nt, Homo sapiens
ccagcaaagucugcaucu

SEQ ID NO: 2086956 - RNA, 15 nt, Homo sapiens
cccuuccuguuucag

SEQ ID NO: 2086957 - RNA, 15 nt, Homo sapiens
uguaguggcaaaaaa

SEQ ID NO: 2086958 - RNA, 20 nt, Homo sapiens
uaaaaucauccuauuacuua

SEQ ID NO: 2086959 - RNA, 19 nt, Homo sapiens
gaacgagaagcagcauuug

SEQ ID NO: 2086960 - RNA, 13 nt, Homo sapiens
gccuucugggaac

SEQ ID NO: 2086961 - RNA, 15 nt, Homo sapiens
agugcugaugccugu

SEQ ID NO: 2086962 - RNA, 21 nt, Homo sapiens
gggcgcuguuccacagugacu

SEQ ID NO: 2086963 - RNA, 19 nt, Homo sapiens
agaggcucuaauguacaau

SEQ ID NO: 2086964 - RNA, 22 nt, Homo sapiens
agagaccugggagcaggggcaa

SEQ ID NO: 2086965 - RNA, 16 nt, Homo sapiens
ccacacacauuaucau

SEQ ID NO: 2086966 - RNA, 11 nt, Homo sapiens
ggaggggcccc

SEQ ID NO: 2086967 - RNA, 16 nt, Homo sapiens
acuuauuuccauggau

SEQ ID NO: 2086968 - RNA, 16 nt, Homo sapiens
cauuucauugcagaua

SEQ ID NO: 2086969 - RNA, 16 nt, Homo sapiens
ugcaauauaacauucu

SEQ ID NO: 2086970 - RNA, 14 nt, Homo sapiens
caggugcugacaau

SEQ ID NO: 2086971 - RNA, 16 nt, Homo sapiens
aggcgcgguggcucuu

SEQ ID NO: 2086972 - RNA, 17 nt, Homo sapiens
ugugagaauaaacuaga

SEQ ID NO: 2086973 - RNA, 21 nt, Homo sapiens
caaugcaguacaggacauaua

SEQ ID NO: 2086974 - RNA, 17 nt, Homo sapiens
agauuugcaccuagaca

SEQ ID NO: 2086975 - RNA, 15 nt, Homo sapiens
aaucuaacaguaaca

SEQ ID NO: 2086976 - RNA, 17 nt, Homo sapiens
cccuggauaagucacuu

SEQ ID NO: 2086977 - RNA, 20 nt, Homo sapiens
cucggggggguuuucaucua

SEQ ID NO: 2086978 - RNA, 16 nt, Homo sapiens
ccacgcucaaucucag

SEQ ID NO: 2086979 - RNA, 15 nt, Homo sapiens
ggccuuuuuccugcg

SEQ ID NO: 2086980 - RNA, 17 nt, Homo sapiens
ucacugcuuguugacau

SEQ ID NO: 2086981 - RNA, 15 nt, Homo sapiens
accgaugguccucac

SEQ ID NO: 2086982 - RNA, 15 nt, Homo sapiens
uccacauuugucaca

SEQ ID NO: 2086983 - RNA, 17 nt, Homo sapiens
caaaugccuucaugaau

SEQ ID NO: 2086984 - RNA, 22 nt, Homo sapiens
uguggauaaggcuuaggugcca

SEQ ID NO: 2086985 - RNA, 16 nt, Homo sapiens
auaagaaagugcgagu

SEQ ID NO: 2086986 - RNA, 23 nt, Homo sapiens
uaauuuuuccuuccucuguaaga

SEQ ID NO: 2086987 - RNA, 18 nt, Homo sapiens
guaaacagaaauugcaau

SEQ ID NO: 2086988 - RNA, 18 nt, Homo sapiens
agcgggugggaaccaaac

SEQ ID NO: 2086989 - RNA, 19 nt, Homo sapiens
augguccaucacuauucaa

SEQ ID NO: 2086990 - RNA, 17 nt, Homo sapiens
uuaauucuuaagcaaga

SEQ ID NO: 2086991 - RNA, 20 nt, Homo sapiens
aaaucugagggagcugagua

SEQ ID NO: 2086992 - RNA, 20 nt, Homo sapiens
agcuaagaucacaucacugc

SEQ ID NO: 2086993 - RNA, 17 nt, Homo sapiens
gcauuuaugaugcaguu

SEQ ID NO: 2086994 - RNA, 11 nt, Homo sapiens
caaauguccua

SEQ ID NO: 2086995 - RNA, 13 nt, Homo sapiens
gcaaauacaauca

SEQ ID NO: 2086996 - RNA, 15 nt, Homo sapiens
gcaggggaagaccaa

SEQ ID NO: 2086997 - RNA, 15 nt, Homo sapiens
ggaguccuguucuca

SEQ ID NO: 2086998 - RNA, 16 nt, Homo sapiens
ugaggcaggagaauug

SEQ ID NO: 2086999 - RNA, 15 nt, Homo sapiens
cauuuucuuucaugg

SEQ ID NO: 2087000 - RNA, 18 nt, Homo sapiens
acuggaacucagugugac

SEQ ID NO: 2087001 - RNA, 13 nt, Homo sapiens
agaaugcaucuca

SEQ ID NO: 2087002 - RNA, 18 nt, Homo sapiens
ucacacuaucaacacugc

SEQ ID NO: 2087003 - RNA, 21 nt, Homo sapiens
gaugauucuggauucuaaaca

SEQ ID NO: 2087004 - RNA, 23 nt, Homo sapiens
ggaguuuucuguguggucuccag

SEQ ID NO: 2087005 - RNA, 18 nt, Homo sapiens
agaccagaaugugaagac

SEQ ID NO: 2087006 - RNA, 14 nt, Homo sapiens
cucucuaauucagu

SEQ ID NO: 2087007 - RNA, 17 nt, Homo sapiens
caaauccacaagccauu

SEQ ID NO: 2087008 - RNA, 19 nt, Homo sapiens
gcacuuuagcagauguggu

SEQ ID NO: 2087009 - RNA, 19 nt, Homo sapiens
gccgagaccccaucuucca

SEQ ID NO: 2087010 - RNA, 15 nt, Homo sapiens
cucucauguacuuuu

SEQ ID NO: 2087011 - RNA, 22 nt, Homo sapiens
aauaguacagacagaaggugcu

SEQ ID NO: 2087012 - RNA, 14 nt, Homo sapiens
ugugaugaagccga

SEQ ID NO: 2087013 - RNA, 20 nt, Homo sapiens
aaugguaggauaucuuggcu

SEQ ID NO: 2087014 - RNA, 13 nt, Homo sapiens
auugaaggugcug

SEQ ID NO: 2087015 - RNA, 20 nt, Homo sapiens
cacauccauuacuauacauu

SEQ ID NO: 2087016 - RNA, 20 nt, Homo sapiens
ucuauuuugagaucauugca

SEQ ID NO: 2087017 - RNA, 19 nt, Homo sapiens
ugagagacauggcuuucag

SEQ ID NO: 2087018 - RNA, 18 nt, Homo sapiens
aauuaauauucauauuau

SEQ ID NO: 2087019 - RNA, 23 nt, Homo sapiens
cucccuaugucugcaaagugauu

SEQ ID NO: 2087020 - RNA, 22 nt, Homo sapiens
aagguagagucuuacaaucaaa

SEQ ID NO: 2087021 - RNA, 18 nt, Homo sapiens
gucuucgcagccuagaua

SEQ ID NO: 2087022 - RNA, 16 nt, Homo sapiens
uuuauccucacauaaa

SEQ ID NO: 2087023 - RNA, 21 nt, Homo sapiens
cucucaauuuuugguugaaua

SEQ ID NO: 2087024 - RNA, 16 nt, Homo sapiens
gguuuuaacaauuucc

SEQ ID NO: 2087025 - RNA, 21 nt, Homo sapiens
uaacaauucccccauccuuca

SEQ ID NO: 2087026 - RNA, 21 nt, Homo sapiens
aauuuaaaacacagagaugcu

SEQ ID NO: 2087027 - RNA, 21 nt, Homo sapiens
cuugaaaagcuaguguaccuc

SEQ ID NO: 2087028 - RNA, 21 nt, Homo sapiens
gcuguuggacagcugcuugug

SEQ ID NO: 2087029 - RNA, 14 nt, Homo sapiens
acuuuuaaugaacu

SEQ ID NO: 2087030 - RNA, 15 nt, Homo sapiens
aacuggcacccagag

SEQ ID NO: 2087031 - RNA, 13 nt, Homo sapiens
caacuggacucau

SEQ ID NO: 2087032 - RNA, 13 nt, Homo sapiens
auaucauuaaaca

SEQ ID NO: 2087033 - RNA, 17 nt, Homo sapiens
gcauguuaagugccauu

SEQ ID NO: 2087034 - RNA, 14 nt, Homo sapiens
ugucacaccugaaa

SEQ ID NO: 2087035 - RNA, 19 nt, Homo sapiens
ccuaaaauccacaccaaag

SEQ ID NO: 2087036 - RNA, 23 nt, Homo sapiens
agcuccaggaaggggaguucugg

SEQ ID NO: 2087037 - RNA, 15 nt, Homo sapiens
cugacugugcccaag

SEQ ID NO: 2087038 - RNA, 23 nt, Homo sapiens
gcaucagauaaugccaccaaagg

SEQ ID NO: 2087039 - RNA, 22 nt, Homo sapiens
ugguccaguuucuagagggcac

SEQ ID NO: 2087040 - RNA, 17 nt, Homo sapiens
guugagauuucagcauu

SEQ ID NO: 2087041 - RNA, 18 nt, Homo sapiens
cacuacauugugcaauug

SEQ ID NO: 2087042 - RNA, 15 nt, Homo sapiens
uagacaguauugcca

SEQ ID NO: 2087043 - RNA, 14 nt, Homo sapiens
cacccuccacucuc

SEQ ID NO: 2087044 - RNA, 14 nt, Homo sapiens
acuuuucccacucc

SEQ ID NO: 2087045 - RNA, 13 nt, Homo sapiens
aaugcaaccauuu

SEQ ID NO: 2087046 - RNA, 22 nt, Homo sapiens
cugugcccagcuuccaugcuga

SEQ ID NO: 2087047 - RNA, 18 nt, Homo sapiens
uguggguuugguccuuga

SEQ ID NO: 2087048 - RNA, 20 nt, Homo sapiens
gggaaguaucaaacuacugc

SEQ ID NO: 2087049 - RNA, 14 nt, Homo sapiens
cccccaccucaggu

SEQ ID NO: 2087050 - RNA, 19 nt, Homo sapiens
uagaacucugaaaugaaga

SEQ ID NO: 2087051 - RNA, 13 nt, Homo sapiens
cucuagccaaaug

SEQ ID NO: 2087052 - RNA, 17 nt, Homo sapiens
caaucaaccugcacuuc

SEQ ID NO: 2087053 - RNA, 18 nt, Homo sapiens
ucuauucuagccugcauu

SEQ ID NO: 2087054 - RNA, 15 nt, Homo sapiens
ccuaagggagugucu

SEQ ID NO: 2087055 - RNA, 17 nt, Homo sapiens
gagaagggggcucugcc

SEQ ID NO: 2087056 - RNA, 17 nt, Homo sapiens
uugcucagcuucuccaa

SEQ ID NO: 2087057 - RNA, 23 nt, Homo sapiens
uacacauacauguaaaauauguc

SEQ ID NO: 2087058 - RNA, 23 nt, Homo sapiens
uucaaauccuuauuguucagagu

SEQ ID NO: 2087059 - RNA, 12 nt, Homo sapiens
uuguuugggcca

SEQ ID NO: 2087060 - RNA, 14 nt, Homo sapiens
uccacagauuauca

SEQ ID NO: 2087061 - RNA, 18 nt, Homo sapiens
aguuuaauuacaacagca

SEQ ID NO: 2087062 - RNA, 20 nt, Homo sapiens
ugucaccaugacuuccucac

SEQ ID NO: 2087063 - RNA, 11 nt, Homo sapiens
ccaugaaguca

SEQ ID NO: 2087064 - RNA, 23 nt, Homo sapiens
uauauguauauuaaaacugcacu

SEQ ID NO: 2087065 - RNA, 23 nt, Homo sapiens
agaauaaagccucugugcugcac

SEQ ID NO: 2087066 - RNA, 19 nt, Homo sapiens
agcugcucugcaagcagaa

SEQ ID NO: 2087067 - RNA, 17 nt, Homo sapiens
gaugaccccaucaaccc

SEQ ID NO: 2087068 - RNA, 17 nt, Homo sapiens
ucaguaugucacucugg

SEQ ID NO: 2087069 - RNA, 18 nt, Homo sapiens
uugaccauauagauuuua

SEQ ID NO: 2087070 - RNA, 16 nt, Homo sapiens
aaaugauuuuaucugu

SEQ ID NO: 2087071 - RNA, 13 nt, Homo sapiens
gcuucacugacca

SEQ ID NO: 2087072 - RNA, 21 nt, Homo sapiens
uauccaccucccuaccaaaaa

SEQ ID NO: 2087073 - RNA, 17 nt, Homo sapiens
acagauggcagugccau

SEQ ID NO: 2087074 - RNA, 23 nt, Homo sapiens
uguacauacuggccucugugauu

SEQ ID NO: 2087075 - RNA, 13 nt, Homo sapiens
ccucaguauauuu

SEQ ID NO: 2087076 - RNA, 16 nt, Homo sapiens
cugcagccccccagag

SEQ ID NO: 2087077 - RNA, 15 nt, Homo sapiens
agccuucuccaggac

SEQ ID NO: 2087078 - RNA, 15 nt, Homo sapiens
augcauacacucuca

SEQ ID NO: 2087079 - RNA, 19 nt, Homo sapiens
aagaccugagaauguaucc

SEQ ID NO: 2087080 - RNA, 14 nt, Homo sapiens
ccuaacaucuccau

SEQ ID NO: 2087081 - RNA, 21 nt, Homo sapiens
cagucacuuguuuguguuuga

SEQ ID NO: 2087082 - RNA, 19 nt, Homo sapiens
ucucaaaugauacagucag

SEQ ID NO: 2087083 - RNA, 14 nt, Homo sapiens
ccccagcccagaga

SEQ ID NO: 2087084 - RNA, 20 nt, Homo sapiens
cucucauuuccaaaccauca

SEQ ID NO: 2087085 - RNA, 20 nt, Homo sapiens
accaaguccauuuugaauga

SEQ ID NO: 2087086 - RNA, 19 nt, Homo sapiens
gacacagcaccgugccaac

SEQ ID NO: 2087087 - RNA, 15 nt, Homo sapiens
auuuucagguuucuu

SEQ ID NO: 2087088 - RNA, 20 nt, Homo sapiens
aggcuggagugcaguggcau

SEQ ID NO: 2087089 - RNA, 20 nt, Homo sapiens
aggcuggaguguaguggcac

SEQ ID NO: 2087090 - RNA, 21 nt, Homo sapiens
gagaggauguggaaagcacuu

SEQ ID NO: 2087091 - RNA, 20 nt, Homo sapiens
ucccgccaacgcaucacugg

SEQ ID NO: 2087092 - RNA, 22 nt, Homo sapiens
cucuguuacacacuaacaucaa

SEQ ID NO: 2087093 - RNA, 11 nt, Homo sapiens
uugcaaucaaa

SEQ ID NO: 2087094 - RNA, 14 nt, Homo sapiens
gcauagucuguucc

SEQ ID NO: 2087095 - RNA, 13 nt, Homo sapiens
cugggcucaguga

SEQ ID NO: 2087096 - RNA, 15 nt, Homo sapiens
cauuaucaguugaca

SEQ ID NO: 2087097 - RNA, 22 nt, Homo sapiens
ucagccuugcaaauaaucacag

SEQ ID NO: 2087098 - RNA, 23 nt, Homo sapiens
guugauacaaaccacugugaaca

SEQ ID NO: 2087099 - RNA, 15 nt, Homo sapiens
cucaaaauaagccau

SEQ ID NO: 2087100 - RNA, 19 nt, Homo sapiens
ggcacagggucugcucuuu

SEQ ID NO: 2087101 - RNA, 12 nt, Homo sapiens
uaauugugugaa

SEQ ID NO: 2087102 - RNA, 16 nt, Homo sapiens
ggaaagucaccuacag

SEQ ID NO: 2087103 - RNA, 14 nt, Homo sapiens
aaacauuuguucua

SEQ ID NO: 2087104 - RNA, 23 nt, Homo sapiens
acaaggaauuucccuguguggau

SEQ ID NO: 2087105 - RNA, 17 nt, Homo sapiens
agaacaggagcaagaac

SEQ ID NO: 2087106 - RNA, 14 nt, Homo sapiens
cacugcaauuggca

SEQ ID NO: 2087107 - RNA, 19 nt, Homo sapiens
ggaacacaggcccagauga

SEQ ID NO: 2087108 - RNA, 20 nt, Homo sapiens
augcauguuuuccagcuccu

SEQ ID NO: 2087109 - RNA, 15 nt, Homo sapiens
uugcaagacauagaa

SEQ ID NO: 2087110 - RNA, 17 nt, Homo sapiens
ccucuuaccuauguccc

SEQ ID NO: 2087111 - RNA, 23 nt, Homo sapiens
ucgggaagagaggaguucaauga

SEQ ID NO: 2087112 - RNA, 18 nt, Homo sapiens
caaaacuucagaugacaa

SEQ ID NO: 2087113 - RNA, 20 nt, Homo sapiens
accaagaucaucaagacaga

SEQ ID NO: 2087114 - RNA, 15 nt, Homo sapiens
gaucuauaccaccuu

SEQ ID NO: 2087115 - RNA, 20 nt, Homo sapiens
ucuuuuuaauaaaaaggcac

SEQ ID NO: 2087116 - RNA, 18 nt, Homo sapiens
cuaaaacuaugguuccca

SEQ ID NO: 2087117 - RNA, 18 nt, Homo sapiens
cuccccaucuguccagcu

SEQ ID NO: 2087118 - RNA, 21 nt, Homo sapiens
caagagugauucuugcugcua

SEQ ID NO: 2087119 - RNA, 16 nt, Homo sapiens
augucauagccaaagc

SEQ ID NO: 2087120 - RNA, 15 nt, Homo sapiens
ucaagugauccuccc

SEQ ID NO: 2087121 - RNA, 20 nt, Homo sapiens
agaacuaccaugagaugguu

SEQ ID NO: 2087122 - RNA, 17 nt, Homo sapiens
ugaacaauucucucuua

SEQ ID NO: 2087123 - RNA, 15 nt, Homo sapiens
uaacaaaacacucgg

SEQ ID NO: 2087124 - RNA, 17 nt, Homo sapiens
agccugugggcaggcag

SEQ ID NO: 2087125 - RNA, 14 nt, Homo sapiens
agguacauccauga

SEQ ID NO: 2087126 - RNA, 13 nt, Homo sapiens
acaugucuuucag

SEQ ID NO: 2087127 - RNA, 14 nt, Homo sapiens
uguguugucccauc

SEQ ID NO: 2087128 - RNA, 19 nt, Homo sapiens
gagcuuccaaaugugucag

SEQ ID NO: 2087129 - RNA, 15 nt, Homo sapiens
uuaaugcaaugagca

SEQ ID NO: 2087130 - RNA, 14 nt, Homo sapiens
aacaaacaaugaaa

SEQ ID NO: 2087131 - RNA, 14 nt, Homo sapiens
cagugucacucugu

SEQ ID NO: 2087132 - RNA, 22 nt, Homo sapiens
ucacccauuuacacauauccac

SEQ ID NO: 2087133 - RNA, 14 nt, Homo sapiens
cuugccaaccugua

SEQ ID NO: 2087134 - RNA, 13 nt, Homo sapiens
caaaguugcucac

SEQ ID NO: 2087135 - RNA, 15 nt, Homo sapiens
cauauauacauacgc

SEQ ID NO: 2087136 - RNA, 12 nt, Homo sapiens
aagggaauuugg

SEQ ID NO: 2087137 - RNA, 14 nt, Homo sapiens
acaguaaucugcau

SEQ ID NO: 2087138 - RNA, 13 nt, Homo sapiens
gcccacauacugu

SEQ ID NO: 2087139 - RNA, 16 nt, Homo sapiens
caaaucuccugccuca

SEQ ID NO: 2087140 - RNA, 14 nt, Homo sapiens
gggcugacaucaag

SEQ ID NO: 2087141 - RNA, 17 nt, Homo sapiens
ccccaucuucgggacca

SEQ ID NO: 2087142 - RNA, 17 nt, Homo sapiens
guccuguacccaguguu

SEQ ID NO: 2087143 - RNA, 15 nt, Homo sapiens
uuauaugaaugccua

SEQ ID NO: 2087144 - RNA, 13 nt, Homo sapiens
cccacugccagca

SEQ ID NO: 2087145 - RNA, 17 nt, Homo sapiens
guccaagguauugagac

SEQ ID NO: 2087146 - RNA, 12 nt, Homo sapiens
aacuacuauuca

SEQ ID NO: 2087147 - RNA, 23 nt, Homo sapiens
uguugacagcaaaauguugaaga

SEQ ID NO: 2087148 - RNA, 12 nt, Homo sapiens
uaaugcucugaa

SEQ ID NO: 2087149 - RNA, 18 nt, Homo sapiens
cuggccauggagaaagcu

SEQ ID NO: 2087150 - RNA, 19 nt, Homo sapiens
aacggcccaggccaggugc

SEQ ID NO: 2087151 - RNA, 15 nt, Homo sapiens
cuccagccugaguga

SEQ ID NO: 2087152 - RNA, 21 nt, Homo sapiens
ucaguguaugauauacuuuau

SEQ ID NO: 2087153 - RNA, 20 nt, Homo sapiens
aguccuuaucaccagccuca

SEQ ID NO: 2087154 - RNA, 13 nt, Homo sapiens
ucuccugcugcag

SEQ ID NO: 2087155 - RNA, 12 nt, Homo sapiens
gucuacauuucu

SEQ ID NO: 2087156 - RNA, 15 nt, Homo sapiens
cgucagcugggacac

SEQ ID NO: 2087157 - RNA, 18 nt, Homo sapiens
cuuacacuuuaugcacaa

SEQ ID NO: 2087158 - RNA, 13 nt, Homo sapiens
gccuggguuugua

SEQ ID NO: 2087159 - RNA, 20 nt, Homo sapiens
ugcaacagccacuacauuac

SEQ ID NO: 2087160 - RNA, 22 nt, Homo sapiens
aguuugccuuuguaccauauaa

SEQ ID NO: 2087161 - RNA, 18 nt, Homo sapiens
guugucaccauugcacaa

SEQ ID NO: 2087162 - RNA, 14 nt, Homo sapiens
agcgaguaccccag

SEQ ID NO: 2087163 - RNA, 20 nt, Homo sapiens
caguagggaggucagugcuu

SEQ ID NO: 2087164 - RNA, 17 nt, Homo sapiens
aucacauucaggcaugc

SEQ ID NO: 2087165 - RNA, 14 nt, Homo sapiens
accuagggcacuuu

SEQ ID NO: 2087166 - RNA, 20 nt, Homo sapiens
cuuaaacccauacaauguau

SEQ ID NO: 2087167 - RNA, 20 nt, Homo sapiens
ugaagaagcaaacaugacua

SEQ ID NO: 2087168 - RNA, 18 nt, Homo sapiens
guuauuucuuaaaauuca

SEQ ID NO: 2087169 - RNA, 22 nt, Homo sapiens
uaaaaauaaauucaaauuauuc

SEQ ID NO: 2087170 - RNA, 18 nt, Homo sapiens
aaaaguuuaaaaagcuca

SEQ ID NO: 2087171 - RNA, 16 nt, Homo sapiens
uccuuguggucuuugc

SEQ ID NO: 2087172 - RNA, 14 nt, Homo sapiens
auugauaaguucau

SEQ ID NO: 2087173 - RNA, 17 nt, Homo sapiens
ucaucaaaaacuuugga

SEQ ID NO: 2087174 - RNA, 17 nt, Homo sapiens
uccccaggugugugcuu

SEQ ID NO: 2087175 - RNA, 22 nt, Homo sapiens
aaucaacucagugggacauagc

SEQ ID NO: 2087176 - RNA, 14 nt, Homo sapiens
agauauaaagccau

SEQ ID NO: 2087177 - RNA, 14 nt, Homo sapiens
agaaugaugcacau

SEQ ID NO: 2087178 - RNA, 21 nt, Homo sapiens
uagaccuuucucccuccuucc

SEQ ID NO: 2087179 - RNA, 14 nt, Homo sapiens
uacuagcacuuuga

SEQ ID NO: 2087180 - RNA, 15 nt, Homo sapiens
cugaacuacuaaagu

SEQ ID NO: 2087181 - RNA, 15 nt, Homo sapiens
ccuaccagacacugc

SEQ ID NO: 2087182 - RNA, 18 nt, Homo sapiens
cucaugcccccucaguga

SEQ ID NO: 2087183 - RNA, 18 nt, Homo sapiens
caauuggcccaacacugu

SEQ ID NO: 2087184 - RNA, 11 nt, Homo sapiens
ucaaaccaaga

SEQ ID NO: 2087185 - RNA, 15 nt, Homo sapiens
agggcacuucacaga

SEQ ID NO: 2087186 - RNA, 15 nt, Homo sapiens
ccuccccuuuugccc

SEQ ID NO: 2087187 - RNA, 19 nt, Homo sapiens
ucccgccuuccuccuccac

SEQ ID NO: 2087188 - RNA, 16 nt, Homo sapiens
ugaaggaaaaacacaa

SEQ ID NO: 2087189 - RNA, 23 nt, Homo sapiens
ugggcuagguaguggggaccaag

SEQ ID NO: 2087190 - RNA, 22 nt, Homo sapiens
ccugcuggggaccucaccugcu

SEQ ID NO: 2087191 - RNA, 21 nt, Homo sapiens
cugaaucuguuucuaugucca

SEQ ID NO: 2087192 - RNA, 16 nt, Homo sapiens
aauuuuguugcuacau

SEQ ID NO: 2087193 - RNA, 17 nt, Homo sapiens
uaaaaucugauuuacac

SEQ ID NO: 2087194 - RNA, 15 nt, Homo sapiens
agauggauugauaau

SEQ ID NO: 2087195 - RNA, 15 nt, Homo sapiens
ugaauuaagcccaau

SEQ ID NO: 2087196 - RNA, 20 nt, Homo sapiens
guaguuuacgcggagcacuu

SEQ ID NO: 2087197 - RNA, 23 nt, Homo sapiens
cugcaggagagaaugcccaguga

SEQ ID NO: 2087198 - RNA, 21 nt, Homo sapiens
auaaaauugaaaguucuggaa

SEQ ID NO: 2087199 - RNA, 20 nt, Homo sapiens
caaaguccguguccuaccuc

SEQ ID NO: 2087200 - RNA, 22 nt, Homo sapiens
gaacucaguuaaaucuuugaag

SEQ ID NO: 2087201 - RNA, 23 nt, Homo sapiens
ucuugccuaaggugcguagucca

SEQ ID NO: 2087202 - RNA, 22 nt, Homo sapiens
caccuccuagaggugggcagcu

SEQ ID NO: 2087203 - RNA, 22 nt, Homo sapiens
uaaugcuuugaaauugaaccuu

SEQ ID NO: 2087204 - RNA, 18 nt, Homo sapiens
acaccaguguuagcuuaa

SEQ ID NO: 2087205 - RNA, 23 nt, Homo sapiens
uccagugguaccagcucacuccc

SEQ ID NO: 2087206 - RNA, 21 nt, Homo sapiens
acgcccuugagcuacuucaaa

SEQ ID NO: 2087207 - RNA, 19 nt, Homo sapiens
accugacguacucugguua

SEQ ID NO: 2087208 - RNA, 12 nt, Homo sapiens
aacucuggugcu

SEQ ID NO: 2087209 - RNA, 16 nt, Homo sapiens
cauuauuaugcaaaau

SEQ ID NO: 2087210 - RNA, 15 nt, Homo sapiens
ccaguccauuuccaa

SEQ ID NO: 2087211 - RNA, 15 nt, Homo sapiens
gaaaauuaugagucu

SEQ ID NO: 2087212 - RNA, 14 nt, Homo sapiens
gcaaccaggcagcu

SEQ ID NO: 2087213 - RNA, 19 nt, Homo sapiens
uguggggaaugggaagaag

SEQ ID NO: 2087214 - RNA, 18 nt, Homo sapiens
ugaagguaacugagagca

SEQ ID NO: 2087215 - RNA, 15 nt, Homo sapiens
ugcaucauccuugca

SEQ ID NO: 2087216 - RNA, 23 nt, Homo sapiens
agcacauuuuaaaagugccauua

SEQ ID NO: 2087217 - RNA, 16 nt, Homo sapiens
cuggguucacaccauu

SEQ ID NO: 2087218 - RNA, 22 nt, Homo sapiens
acaaagccuguuugguagucuc

SEQ ID NO: 2087219 - RNA, 18 nt, Homo sapiens
cccuuaacugcauccagc

SEQ ID NO: 2087220 - RNA, 14 nt, Homo sapiens
auaugaagcacuuu

SEQ ID NO: 2087221 - RNA, 14 nt, Homo sapiens
aaaauaagcucagu

SEQ ID NO: 2087222 - RNA, 22 nt, Homo sapiens
ucaauggagcaugugugcaaaa

SEQ ID NO: 2087223 - RNA, 17 nt, Homo sapiens
ugacaucgguucaggag

SEQ ID NO: 2087224 - RNA, 14 nt, Homo sapiens
aucugacauucuca

SEQ ID NO: 2087225 - RNA, 18 nt, Homo sapiens
agaggucagacuaagaaa

SEQ ID NO: 2087226 - RNA, 16 nt, Homo sapiens
cuggugaaaaaagcca

SEQ ID NO: 2087227 - RNA, 24 nt, Homo sapiens
uaugaggggguuuggcaccaagcu

SEQ ID NO: 2087228 - RNA, 16 nt, Homo sapiens
cuaaauuuaaugcugc

SEQ ID NO: 2087229 - RNA, 17 nt, Homo sapiens
gcuccauucaaagugag

SEQ ID NO: 2087230 - RNA, 22 nt, Homo sapiens
ggggacuguuccuuauuucucu

SEQ ID NO: 2087231 - RNA, 21 nt, Homo sapiens
gcacuguggcucugcaugaca

SEQ ID NO: 2087232 - RNA, 12 nt, Homo sapiens
uggcgaugucac

SEQ ID NO: 2087233 - RNA, 22 nt, Homo sapiens
gcucugcaaugggcacugggau

SEQ ID NO: 2087234 - RNA, 14 nt, Homo sapiens
gauucaguguuaaa

SEQ ID NO: 2087235 - RNA, 16 nt, Homo sapiens
caaauguuuacauuuu

SEQ ID NO: 2087236 - RNA, 21 nt, Homo sapiens
cccauuguuccugcgcugcaa

SEQ ID NO: 2087237 - RNA, 15 nt, Homo sapiens
gacuagccaucucaa

SEQ ID NO: 2087238 - RNA, 14 nt, Homo sapiens
acuucccacggcuc

SEQ ID NO: 2087239 - RNA, 14 nt, Homo sapiens
caaauauacaucag

SEQ ID NO: 2087240 - RNA, 20 nt, Homo sapiens
uuccugcauuucucuucuca

SEQ ID NO: 2087241 - RNA, 14 nt, Homo sapiens
ggagaggacucugc

SEQ ID NO: 2087242 - RNA, 19 nt, Homo sapiens
accuuuuuuuuuuuuccaa

SEQ ID NO: 2087243 - RNA, 14 nt, Homo sapiens
auccaauuagcuua

SEQ ID NO: 2087244 - RNA, 17 nt, Homo sapiens
uuccucagggcccagca

SEQ ID NO: 2087245 - RNA, 16 nt, Homo sapiens
uuaugauaaccaagaa

SEQ ID NO: 2087246 - RNA, 20 nt, Homo sapiens
agucacaggaaacuacuuca

SEQ ID NO: 2087247 - RNA, 14 nt, Homo sapiens
cuggcagcuuugaa

SEQ ID NO: 2087248 - RNA, 23 nt, Homo sapiens
caaaacauaaacugagaaaaagu

SEQ ID NO: 2087249 - RNA, 17 nt, Homo sapiens
auuccaggaaaacuggg

SEQ ID NO: 2087250 - RNA, 15 nt, Homo sapiens
ugacggcuggcaugg

SEQ ID NO: 2087251 - RNA, 18 nt, Homo sapiens
aaggcaccucucuggguu

SEQ ID NO: 2087252 - RNA, 14 nt, Homo sapiens
gggaacucauuugg

SEQ ID NO: 2087253 - RNA, 18 nt, Homo sapiens
accuuaccaacuuucugu

SEQ ID NO: 2087254 - RNA, 15 nt, Homo sapiens
ugcuuuaucagggga

SEQ ID NO: 2087255 - RNA, 11 nt, Homo sapiens
augaccacugc

SEQ ID NO: 2087256 - RNA, 13 nt, Homo sapiens
agagaccaaauaa

SEQ ID NO: 2087257 - RNA, 23 nt, Homo sapiens
cuauuauuuggagccugccaaga

SEQ ID NO: 2087258 - RNA, 19 nt, Homo sapiens
aauauuuauuguauuuuag

SEQ ID NO: 2087259 - RNA, 13 nt, Homo sapiens
cugucucugaggg

SEQ ID NO: 2087260 - RNA, 22 nt, Homo sapiens
ggcagagaaucucuugggaguc

SEQ ID NO: 2087261 - RNA, 17 nt, Homo sapiens
cccugugccagaccuca

SEQ ID NO: 2087262 - RNA, 20 nt, Homo sapiens
cguuaucacccaggccugau

SEQ ID NO: 2087263 - RNA, 22 nt, Homo sapiens
acuugucuuugauuaugacagu

SEQ ID NO: 2087264 - RNA, 15 nt, Homo sapiens
cuaugaaccugaaaa

SEQ ID NO: 2087265 - RNA, 15 nt, Homo sapiens
guccucccaggccag

SEQ ID NO: 2087266 - RNA, 16 nt, Homo sapiens
aaaagacuaagccaga

SEQ ID NO: 2087267 - RNA, 18 nt, Homo sapiens
gaggcuuuaaaaagaaaa

SEQ ID NO: 2087268 - RNA, 20 nt, Homo sapiens
cauguggcugacuaggucaa

SEQ ID NO: 2087269 - RNA, 10 nt, Homo sapiens
aacucaggga

SEQ ID NO: 2087270 - RNA, 23 nt, Homo sapiens
cagaacuggaggcaguccaucua

SEQ ID NO: 2087271 - RNA, 19 nt, Homo sapiens
ccaauuaaggcaucaucag

SEQ ID NO: 2087272 - RNA, 20 nt, Homo sapiens
acgugcacacaccugcacac

SEQ ID NO: 2087273 - RNA, 13 nt, Homo sapiens
aggucucccggga

SEQ ID NO: 2087274 - RNA, 19 nt, Homo sapiens
cauuuggagauauaccuaa

SEQ ID NO: 2087275 - RNA, 16 nt, Homo sapiens
cuaaaaaucaaucacu

SEQ ID NO: 2087276 - RNA, 22 nt, Homo sapiens
aaguacuguaauaauaccucaa

SEQ ID NO: 2087277 - RNA, 19 nt, Homo sapiens
ccaauagggcugagcucuc

SEQ ID NO: 2087278 - RNA, 17 nt, Homo sapiens
auugcuacauaguccaa

SEQ ID NO: 2087279 - RNA, 15 nt, Homo sapiens
acagugagacuucau

SEQ ID NO: 2087280 - RNA, 20 nt, Homo sapiens
cggggaggggcgcucgcuuc

SEQ ID NO: 2087281 - RNA, 12 nt, Homo sapiens
uccuucugauga

SEQ ID NO: 2087282 - RNA, 15 nt, Homo sapiens
guagugaaauuauac

SEQ ID NO: 2087283 - RNA, 13 nt, Homo sapiens
auguugcuaacag

SEQ ID NO: 2087284 - RNA, 13 nt, Homo sapiens
acauauccacaaa

SEQ ID NO: 2087285 - RNA, 23 nt, Homo sapiens
aacuuuaccaaaugaaaugccaa

SEQ ID NO: 2087286 - RNA, 16 nt, Homo sapiens
cucggaguccaaaggg

SEQ ID NO: 2087287 - RNA, 16 nt, Homo sapiens
augccugauugccaag

SEQ ID NO: 2087288 - RNA, 16 nt, Homo sapiens
uagaauagaagaaaga

SEQ ID NO: 2087289 - RNA, 17 nt, Homo sapiens
ccuuccuaauaugcuuu

SEQ ID NO: 2087290 - RNA, 23 nt, Homo sapiens
gcagucuucucuucugccuuuau

SEQ ID NO: 2087291 - RNA, 15 nt, Homo sapiens
aucagcaucugacag

SEQ ID NO: 2087292 - RNA, 12 nt, Homo sapiens
gauuccuggaag

SEQ ID NO: 2087293 - RNA, 17 nt, Homo sapiens
guucccuccccagcucc

SEQ ID NO: 2087294 - RNA, 21 nt, Homo sapiens
auuguaucagaggccuauaau

SEQ ID NO: 2087295 - RNA, 22 nt, Homo sapiens
ccacuggcauuaaagugcugua

SEQ ID NO: 2087296 - RNA, 18 nt, Homo sapiens
ccagcagggccucaaagu

SEQ ID NO: 2087297 - RNA, 16 nt, Homo sapiens
aagcauuggacauuua

SEQ ID NO: 2087298 - RNA, 16 nt, Homo sapiens
auuuauccaagaccug

SEQ ID NO: 2087299 - RNA, 18 nt, Homo sapiens
uggcccacacgugcauag

SEQ ID NO: 2087300 - RNA, 17 nt, Homo sapiens
ccucagagccuuggaau

SEQ ID NO: 2087301 - RNA, 17 nt, Homo sapiens
uccuggagccccagaac

SEQ ID NO: 2087302 - RNA, 15 nt, Homo sapiens
gcaagucccaucuca

SEQ ID NO: 2087303 - RNA, 12 nt, Homo sapiens
cuuagugacuua

SEQ ID NO: 2087304 - RNA, 16 nt, Homo sapiens
uucuggagguuuccaa

SEQ ID NO: 2087305 - RNA, 13 nt, Homo sapiens
auuguugugcuua

SEQ ID NO: 2087306 - RNA, 18 nt, Homo sapiens
acagaugucuucuugcaa

SEQ ID NO: 2087307 - RNA, 19 nt, Homo sapiens
gggucuuguuaagugcagu

SEQ ID NO: 2087308 - RNA, 17 nt, Homo sapiens
ugggggugccgcugucu

SEQ ID NO: 2087309 - RNA, 14 nt, Homo sapiens
guacaauacaaugu

SEQ ID NO: 2087310 - RNA, 16 nt, Homo sapiens
ugccaaaccaagcaaa

SEQ ID NO: 2087311 - RNA, 20 nt, Homo sapiens
uccauauagcucgagcaaaa

SEQ ID NO: 2087312 - RNA, 20 nt, Homo sapiens
ugauguccuguaaacacuca

SEQ ID NO: 2087313 - RNA, 15 nt, Homo sapiens
uacgucaaagcagua

SEQ ID NO: 2087314 - RNA, 15 nt, Homo sapiens
ccccuaauagccuuu

SEQ ID NO: 2087315 - RNA, 17 nt, Homo sapiens
uaucuucucaaguucua

SEQ ID NO: 2087316 - RNA, 15 nt, Homo sapiens
cacagguauuucagg

SEQ ID NO: 2087317 - RNA, 17 nt, Homo sapiens
uuuucugugcacuguag

SEQ ID NO: 2087318 - RNA, 18 nt, Homo sapiens
augaaacagggcacccca

SEQ ID NO: 2087319 - RNA, 15 nt, Homo sapiens
uggcaauaggacaaa

SEQ ID NO: 2087320 - RNA, 19 nt, Homo sapiens
uauucagaaucaaaccuuu

SEQ ID NO: 2087321 - RNA, 20 nt, Homo sapiens
caaaagaggagcacuuccaa

SEQ ID NO: 2087322 - RNA, 19 nt, Homo sapiens
gcguuacugcuugaccaaa

SEQ ID NO: 2087323 - RNA, 20 nt, Homo sapiens
uggaaaagaaaagaaaugaa

SEQ ID NO: 2087324 - RNA, 17 nt, Homo sapiens
acuguuuuccuuaccua

SEQ ID NO: 2087325 - RNA, 12 nt, Homo sapiens
aauuaauggaca

SEQ ID NO: 2087326 - RNA, 14 nt, Homo sapiens
cugcuaccaucuca

SEQ ID NO: 2087327 - RNA, 13 nt, Homo sapiens
uuugauagaaaga

SEQ ID NO: 2087328 - RNA, 12 nt, Homo sapiens
ugccaugaucug

SEQ ID NO: 2087329 - RNA, 12 nt, Homo sapiens
agagagugaaua

SEQ ID NO: 2087330 - RNA, 17 nt, Homo sapiens
cugccugucugaagcca

SEQ ID NO: 2087331 - RNA, 20 nt, Homo sapiens
ucacuacagaucucccagua

SEQ ID NO: 2087332 - RNA, 22 nt, Homo sapiens
uaaguuuuauacuugauuguau

SEQ ID NO: 2087333 - RNA, 18 nt, Homo sapiens
gcuccagaagauagcuuc

SEQ ID NO: 2087334 - RNA, 23 nt, Homo sapiens
caguggccuacaaaucaguaauu

SEQ ID NO: 2087335 - RNA, 16 nt, Homo sapiens
ucaaguuauacaucuu

SEQ ID NO: 2087336 - RNA, 20 nt, Homo sapiens
acccaccucucuggcuucca

SEQ ID NO: 2087337 - RNA, 18 nt, Homo sapiens
gcaaaauagacauauuaa

SEQ ID NO: 2087338 - RNA, 14 nt, Homo sapiens
aguaacacacuucc

SEQ ID NO: 2087339 - RNA, 13 nt, Homo sapiens
guaaagugccuua

SEQ ID NO: 2087340 - RNA, 13 nt, Homo sapiens
gacugauggugaa

SEQ ID NO: 2087341 - RNA, 17 nt, Homo sapiens
gaaguucuccagcuuca

SEQ ID NO: 2087342 - RNA, 20 nt, Homo sapiens
uccccaguugccgucuagga

SEQ ID NO: 2087343 - RNA, 14 nt, Homo sapiens
cacugcugcugcag

SEQ ID NO: 2087344 - RNA, 16 nt, Homo sapiens
uacuuaauaaacugug

SEQ ID NO: 2087345 - RNA, 12 nt, Homo sapiens
cucuugaugcca

SEQ ID NO: 2087346 - RNA, 15 nt, Homo sapiens
cuaauugucacauca

SEQ ID NO: 2087347 - RNA, 18 nt, Homo sapiens
aucaaugaaaugcuuguu

SEQ ID NO: 2087348 - RNA, 22 nt, Homo sapiens
gcugauguuuauaaacugagag

SEQ ID NO: 2087349 - RNA, 15 nt, Homo sapiens
ccuguauacuuuucc

SEQ ID NO: 2087350 - RNA, 23 nt, Homo sapiens
acaugcugaaaaauauagccuuu

SEQ ID NO: 2087351 - RNA, 16 nt, Homo sapiens
augaccauaaccacug

SEQ ID NO: 2087352 - RNA, 15 nt, Homo sapiens
acucaucauuuccau

SEQ ID NO: 2087353 - RNA, 14 nt, Homo sapiens
aaggcaaaaaaauc

SEQ ID NO: 2087354 - RNA, 14 nt, Homo sapiens
gcggcccugacacg

SEQ ID NO: 2087355 - RNA, 14 nt, Homo sapiens
cccucacugagccu

SEQ ID NO: 2087356 - RNA, 16 nt, Homo sapiens
ugaggcggagaauugc

SEQ ID NO: 2087357 - RNA, 20 nt, Homo sapiens
ccucccugugugaaauguau

SEQ ID NO: 2087358 - RNA, 17 nt, Homo sapiens
acuucagcuuuguguau

SEQ ID NO: 2087359 - RNA, 16 nt, Homo sapiens
uuucugucacaucagc

SEQ ID NO: 2087360 - RNA, 16 nt, Homo sapiens
caaaaacaaagugcaa

SEQ ID NO: 2087361 - RNA, 16 nt, Homo sapiens
auuucaguucacuguu

SEQ ID NO: 2087362 - RNA, 18 nt, Homo sapiens
acugucacauaaugcuca

SEQ ID NO: 2087363 - RNA, 19 nt, Homo sapiens
aacagcaauagugaaugaa

SEQ ID NO: 2087364 - RNA, 19 nt, Homo sapiens
ccuccuaaccuagagauug

SEQ ID NO: 2087365 - RNA, 18 nt, Homo sapiens
ccaggccugggaauggau

SEQ ID NO: 2087366 - RNA, 19 nt, Homo sapiens
caaucucaucugauaugca

SEQ ID NO: 2087367 - RNA, 17 nt, Homo sapiens
uguaaggaugauuuuaa

SEQ ID NO: 2087368 - RNA, 18 nt, Homo sapiens
agauuccugguugauaca

SEQ ID NO: 2087369 - RNA, 18 nt, Homo sapiens
agggugucggcugugagg

SEQ ID NO: 2087370 - RNA, 14 nt, Homo sapiens
uucagaugucuuaa

SEQ ID NO: 2087371 - RNA, 19 nt, Homo sapiens
agaaguuguuugaggcaaa

SEQ ID NO: 2087372 - RNA, 16 nt, Homo sapiens
uuggccgugaggacac

SEQ ID NO: 2087373 - RNA, 15 nt, Homo sapiens
gccuggcaucugugc

SEQ ID NO: 2087374 - RNA, 19 nt, Homo sapiens
aaacuugugagguguuugc

SEQ ID NO: 2087375 - RNA, 14 nt, Homo sapiens
aucuuucauccuug

SEQ ID NO: 2087376 - RNA, 16 nt, Homo sapiens
uugggcaccagcuucu

SEQ ID NO: 2087377 - RNA, 17 nt, Homo sapiens
acuccacuccacacucu

SEQ ID NO: 2087378 - RNA, 12 nt, Homo sapiens
uaaaaccuuuca

SEQ ID NO: 2087379 - RNA, 15 nt, Homo sapiens
uugauggagccugaa

SEQ ID NO: 2087380 - RNA, 20 nt, Homo sapiens
cguagacugauggaacagaa

SEQ ID NO: 2087381 - RNA, 18 nt, Homo sapiens
uugcauuuguacuggcaa

SEQ ID NO: 2087382 - RNA, 22 nt, Homo sapiens
ugccuaaggugucugaguuucu

SEQ ID NO: 2087383 - RNA, 12 nt, Homo sapiens
aacugugccaug

SEQ ID NO: 2087384 - RNA, 23 nt, Homo sapiens
gaacuguacacuuguuuggugcu

SEQ ID NO: 2087385 - RNA, 19 nt, Homo sapiens
cacuaauugacccaaaacg

SEQ ID NO: 2087386 - RNA, 12 nt, Homo sapiens
aauucauuguga

SEQ ID NO: 2087387 - RNA, 13 nt, Homo sapiens
cuucgaugacugg

SEQ ID NO: 2087388 - RNA, 22 nt, Homo sapiens
gaugaaaaauaugugcuugaaa

SEQ ID NO: 2087389 - RNA, 16 nt, Homo sapiens
uguuauccaacuauua

SEQ ID NO: 2087390 - RNA, 21 nt, Homo sapiens
cauggucuuugcuaggccucu

SEQ ID NO: 2087391 - RNA, 15 nt, Homo sapiens
ugggggcuggcagag

SEQ ID NO: 2087392 - RNA, 18 nt, Homo sapiens
ccuagggccugguccaug

SEQ ID NO: 2087393 - RNA, 18 nt, Homo sapiens
ugagaacugguucuugcc

SEQ ID NO: 2087394 - RNA, 23 nt, Homo sapiens
agcuuuuauuuaacagugcaaaa

SEQ ID NO: 2087395 - RNA, 22 nt, Homo sapiens
cuuuuugaaaucagcauacuca

SEQ ID NO: 2087396 - RNA, 21 nt, Homo sapiens
cagaagagccuccuucagcag

SEQ ID NO: 2087397 - RNA, 15 nt, Homo sapiens
ccugugccuccauca

SEQ ID NO: 2087398 - RNA, 18 nt, Homo sapiens
uaaaaguauuuaguugau

SEQ ID NO: 2087399 - RNA, 15 nt, Homo sapiens
cuaaaggucccaagg

SEQ ID NO: 2087400 - RNA, 16 nt, Homo sapiens
guagcacucucagagu

SEQ ID NO: 2087401 - RNA, 15 nt, Homo sapiens
uucuuuugcaauaau

SEQ ID NO: 2087402 - RNA, 16 nt, Homo sapiens
acugaauacagucuca

SEQ ID NO: 2087403 - RNA, 12 nt, Homo sapiens
aucgaccuggag

SEQ ID NO: 2087404 - RNA, 17 nt, Homo sapiens
auacaaguauccaguca

SEQ ID NO: 2087405 - RNA, 23 nt, Homo sapiens
guuuucagcugcucagaauucau

SEQ ID NO: 2087406 - RNA, 12 nt, Homo sapiens
uggaugaucccc

SEQ ID NO: 2087407 - RNA, 12 nt, Homo sapiens
cugaugacaaua

SEQ ID NO: 2087408 - RNA, 16 nt, Homo sapiens
ucacauaggcucucag

SEQ ID NO: 2087409 - RNA, 17 nt, Homo sapiens
aaugcuauggacugcac

SEQ ID NO: 2087410 - RNA, 18 nt, Homo sapiens
uccccaguucgccuggag

SEQ ID NO: 2087411 - RNA, 22 nt, Homo sapiens
uucuuguaucaaauucaauaau

SEQ ID NO: 2087412 - RNA, 20 nt, Homo sapiens
aggggcaaagaaaagccaga

SEQ ID NO: 2087413 - RNA, 15 nt, Homo sapiens
caaaauaaauuguga

SEQ ID NO: 2087414 - RNA, 12 nt, Homo sapiens
caucaaagccuu

SEQ ID NO: 2087415 - RNA, 17 nt, Homo sapiens
aaacaaaucauuuugau

SEQ ID NO: 2087416 - RNA, 18 nt, Homo sapiens
agccugccuguccuccag

SEQ ID NO: 2087417 - RNA, 18 nt, Homo sapiens
guuauguuugcacuuugu

SEQ ID NO: 2087418 - RNA, 22 nt, Homo sapiens
cacgguuuuguugaguuuucac

SEQ ID NO: 2087419 - RNA, 16 nt, Homo sapiens
gacuuccccgcauucc

SEQ ID NO: 2087420 - RNA, 17 nt, Homo sapiens
ugccuuagcaugugacu

SEQ ID NO: 2087421 - RNA, 18 nt, Homo sapiens
ccuggucccuuggagaca

SEQ ID NO: 2087422 - RNA, 14 nt, Homo sapiens
acggacauggucug

SEQ ID NO: 2087423 - RNA, 14 nt, Homo sapiens
uucaauugacaaau

SEQ ID NO: 2087424 - RNA, 22 nt, Homo sapiens
aaguuuaagugugcagccauag

SEQ ID NO: 2087425 - RNA, 17 nt, Homo sapiens
aauuaguuugacacugc

SEQ ID NO: 2087426 - RNA, 14 nt, Homo sapiens
acagggccugcuau

SEQ ID NO: 2087427 - RNA, 19 nt, Homo sapiens
accgggaggacagcugccu

SEQ ID NO: 2087428 - RNA, 19 nt, Homo sapiens
uugucuuaaucguccugcu

SEQ ID NO: 2087429 - RNA, 16 nt, Homo sapiens
aucagcccaucucaac

SEQ ID NO: 2087430 - RNA, 16 nt, Homo sapiens
cugaccaucugugacu

SEQ ID NO: 2087431 - RNA, 16 nt, Homo sapiens
uaaauucacuuucaau

SEQ ID NO: 2087432 - RNA, 14 nt, Homo sapiens
acuagccugugauu

SEQ ID NO: 2087433 - RNA, 17 nt, Homo sapiens
aggcacccucagagaag

SEQ ID NO: 2087434 - RNA, 13 nt, Homo sapiens
gacaaucauuuga

SEQ ID NO: 2087435 - RNA, 23 nt, Homo sapiens
cugacagaugguaucugccaguc

SEQ ID NO: 2087436 - RNA, 16 nt, Homo sapiens
cucccgaugcugcuau

SEQ ID NO: 2087437 - RNA, 15 nt, Homo sapiens
uuaauggucacaaua

SEQ ID NO: 2087438 - RNA, 12 nt, Homo sapiens
acccagcucuca

SEQ ID NO: 2087439 - RNA, 16 nt, Homo sapiens
cuaaaugucagcuguu

SEQ ID NO: 2087440 - RNA, 21 nt, Homo sapiens
accucccucgccccaagguuc

SEQ ID NO: 2087441 - RNA, 22 nt, Homo sapiens
cacaucauucauucacuguaua

SEQ ID NO: 2087442 - RNA, 24 nt, Homo sapiens
gcagcaaggagaaggcaggaacau

SEQ ID NO: 2087443 - RNA, 13 nt, Homo sapiens
guggagguugcua

SEQ ID NO: 2087444 - RNA, 23 nt, Homo sapiens
agucucaauguuccauucagucu

SEQ ID NO: 2087445 - RNA, 18 nt, Homo sapiens
aggcacagcuaaccacuu

SEQ ID NO: 2087446 - RNA, 15 nt, Homo sapiens
caauuggcauuaaca

SEQ ID NO: 2087447 - RNA, 12 nt, Homo sapiens
cuaauggaauau

SEQ ID NO: 2087448 - RNA, 21 nt, Homo sapiens
ggcuggugcucacagcuguaa

SEQ ID NO: 2087449 - RNA, 14 nt, Homo sapiens
agauaaaugcuuua

SEQ ID NO: 2087450 - RNA, 20 nt, Homo sapiens
cauugugcaauacaguuuca

SEQ ID NO: 2087451 - RNA, 17 nt, Homo sapiens
gaauuacacugugccuu

SEQ ID NO: 2087452 - RNA, 14 nt, Homo sapiens
ucauuagcugugau

SEQ ID NO: 2087453 - RNA, 15 nt, Homo sapiens
agcacaucucuucau

SEQ ID NO: 2087454 - RNA, 14 nt, Homo sapiens
gcuccaaaugcagc

SEQ ID NO: 2087455 - RNA, 12 nt, Homo sapiens
uauaaacacaua

SEQ ID NO: 2087456 - RNA, 11 nt, Homo sapiens
guuugccaagc

SEQ ID NO: 2087457 - RNA, 16 nt, Homo sapiens
agaacccgggcugugu

SEQ ID NO: 2087458 - RNA, 14 nt, Homo sapiens
accaggguggacca

SEQ ID NO: 2087459 - RNA, 19 nt, Homo sapiens
aggguucuauauuuacugu

SEQ ID NO: 2087460 - RNA, 16 nt, Homo sapiens
ccaacugcuaaugcaa

SEQ ID NO: 2087461 - RNA, 21 nt, Homo sapiens
aacuuaccuuguuaagacaaa

SEQ ID NO: 2087462 - RNA, 20 nt, Homo sapiens
uaaucuguugacagugccaa

SEQ ID NO: 2087463 - RNA, 10 nt, Homo sapiens
acaacaaaga

SEQ ID NO: 2087464 - RNA, 23 nt, Homo sapiens
guguucuccugcugcucccucag

SEQ ID NO: 2087465 - RNA, 16 nt, Homo sapiens
cugauguucaguguaa

SEQ ID NO: 2087466 - RNA, 21 nt, Homo sapiens
aggucaggggugacacagacu

SEQ ID NO: 2087467 - RNA, 23 nt, Homo sapiens
gcuguucacagccagacuggcac

SEQ ID NO: 2087468 - RNA, 20 nt, Homo sapiens
accaagugaggccauagcaa

SEQ ID NO: 2087469 - RNA, 12 nt, Homo sapiens
agugaugcaguu

SEQ ID NO: 2087470 - RNA, 12 nt, Homo sapiens
cuguaugccugg

SEQ ID NO: 2087471 - RNA, 19 nt, Homo sapiens
cugucacuugcauuccacu

SEQ ID NO: 2087472 - RNA, 18 nt, Homo sapiens
cagcucugaggacugcac

SEQ ID NO: 2087473 - RNA, 19 nt, Homo sapiens
uugcugaauucucugcuca

SEQ ID NO: 2087474 - RNA, 18 nt, Homo sapiens
ugcccacucgggucugca

SEQ ID NO: 2087475 - RNA, 15 nt, Homo sapiens
uuucaagaacuauau

SEQ ID NO: 2087476 - RNA, 17 nt, Homo sapiens
ccggcugguugugggca

SEQ ID NO: 2087477 - RNA, 20 nt, Homo sapiens
gcuuaacuggacugaauuca

SEQ ID NO: 2087478 - RNA, 22 nt, Homo sapiens
cacagacccacacauguuuaca

SEQ ID NO: 2087479 - RNA, 20 nt, Homo sapiens
aaaguucaacuuccaaaggg

SEQ ID NO: 2087480 - RNA, 23 nt, Homo sapiens
auccucauccgcuacuacaucaa

SEQ ID NO: 2087481 - RNA, 22 nt, Homo sapiens
uccacauaaaaagaaaugugaa

SEQ ID NO: 2087482 - RNA, 20 nt, Homo sapiens
uggugcuguggccaggguga

SEQ ID NO: 2087483 - RNA, 16 nt, Homo sapiens
cacacccuacagcaga

SEQ ID NO: 2087484 - RNA, 20 nt, Homo sapiens
gaggccaaggugggcggauc

SEQ ID NO: 2087485 - RNA, 18 nt, Homo sapiens
uccuuuuauuucuucacc

SEQ ID NO: 2087486 - RNA, 13 nt, Homo sapiens
gagaaucccacau

SEQ ID NO: 2087487 - RNA, 15 nt, Homo sapiens
ccaccaccugcucac

SEQ ID NO: 2087488 - RNA, 23 nt, Homo sapiens
caucugucuugccagccagaagc

SEQ ID NO: 2087489 - RNA, 19 nt, Homo sapiens
acuguuacuaggcuauuaa

SEQ ID NO: 2087490 - RNA, 18 nt, Homo sapiens
uccugaaccgcacagcuc

SEQ ID NO: 2087491 - RNA, 14 nt, Homo sapiens
uauguccuaauaau

SEQ ID NO: 2087492 - RNA, 22 nt, Homo sapiens
aauuagccacauguacacuaca

SEQ ID NO: 2087493 - RNA, 22 nt, Homo sapiens
uugccagcgauuuuaguucaau

SEQ ID NO: 2087494 - RNA, 15 nt, Homo sapiens
cuauaaacuacugua

SEQ ID NO: 2087495 - RNA, 15 nt, Homo sapiens
uuaaauuccacagau

SEQ ID NO: 2087496 - RNA, 22 nt, Homo sapiens
uacagcaaaauuaaauacauaa

SEQ ID NO: 2087497 - RNA, 15 nt, Homo sapiens
gagugcaaguaucau

SEQ ID NO: 2087498 - RNA, 15 nt, Homo sapiens
gaagccaagugggau

SEQ ID NO: 2087499 - RNA, 13 nt, Homo sapiens
aucuacaggacaa

SEQ ID NO: 2087500 - RNA, 16 nt, Homo sapiens
ucccuucgacauugag

SEQ ID NO: 2087501 - RNA, 20 nt, Homo sapiens
cucauaugauguacauguac

SEQ ID NO: 2087502 - RNA, 23 nt, Homo sapiens
caccgggggagagggacacuccu

SEQ ID NO: 2087503 - RNA, 14 nt, Homo sapiens
ccagggaucacugg

SEQ ID NO: 2087504 - RNA, 16 nt, Homo sapiens
gagccacguauguuuu

SEQ ID NO: 2087505 - RNA, 17 nt, Homo sapiens
ucccaccucccauucac

SEQ ID NO: 2087506 - RNA, 16 nt, Homo sapiens
acccuugucaucucuc

SEQ ID NO: 2087507 - RNA, 23 nt, Homo sapiens
gugaacaaacuuagaaagggaag

SEQ ID NO: 2087508 - RNA, 13 nt, Homo sapiens
auauuuggaagaa

SEQ ID NO: 2087509 - RNA, 13 nt, Homo sapiens
aauaaagcaaagu

SEQ ID NO: 2087510 - RNA, 22 nt, Homo sapiens
uugaugaugaaguauugcuaau

SEQ ID NO: 2087511 - RNA, 14 nt, Homo sapiens
ugacuuuauacaga

SEQ ID NO: 2087512 - RNA, 19 nt, Homo sapiens
gaaaccccacuuccauugu

SEQ ID NO: 2087513 - RNA, 23 nt, Homo sapiens
gaugaccccuccccuaaugccug

SEQ ID NO: 2087514 - RNA, 23 nt, Homo sapiens
aaugcaugucuuaaaugcucaua

SEQ ID NO: 2087515 - RNA, 17 nt, Homo sapiens
uauguuauuugcucuaa

SEQ ID NO: 2087516 - RNA, 15 nt, Homo sapiens
uccuauguaacugca

SEQ ID NO: 2087517 - RNA, 22 nt, Homo sapiens
gauacuguaucaugacaaagac

SEQ ID NO: 2087518 - RNA, 19 nt, Homo sapiens
cauccguccagccaagagc

SEQ ID NO: 2087519 - RNA, 22 nt, Homo sapiens
acauucuguuuaucaagccaua

SEQ ID NO: 2087520 - RNA, 20 nt, Homo sapiens
gacauccugagcagugccag

SEQ ID NO: 2087521 - RNA, 22 nt, Homo sapiens
cuuuaaucacuuaacauuccua

SEQ ID NO: 2087522 - RNA, 9 nt, Homo sapiens
aaaccuggg

SEQ ID NO: 2087523 - RNA, 23 nt, Homo sapiens
augcaggugacauucuaccauga

SEQ ID NO: 2087524 - RNA, 20 nt, Homo sapiens
agagcccugcucccagacau

SEQ ID NO: 2087525 - RNA, 23 nt, Homo sapiens
cuguccccagaccaacccuggga

SEQ ID NO: 2087526 - RNA, 13 nt, Homo sapiens
cagccggggagcu

SEQ ID NO: 2087527 - RNA, 18 nt, Homo sapiens
ccuguguccgaugcugga

SEQ ID NO: 2087528 - RNA, 14 nt, Homo sapiens
uccaggcuuccaca

SEQ ID NO: 2087529 - RNA, 22 nt, Homo sapiens
uccugugugucgcuuaugucua

SEQ ID NO: 2087530 - RNA, 20 nt, Homo sapiens
ugaaagauugauuaaugaac

SEQ ID NO: 2087531 - RNA, 17 nt, Homo sapiens
aaguaugcacuuggccu

SEQ ID NO: 2087532 - RNA, 14 nt, Homo sapiens
aacaaacauuugaa

SEQ ID NO: 2087533 - RNA, 21 nt, Homo sapiens
ucacucauuaaugaaucacau

SEQ ID NO: 2087534 - RNA, 20 nt, Homo sapiens
agcuaccucacuaugcugcu

SEQ ID NO: 2087535 - RNA, 17 nt, Homo sapiens
aacuaguaaacauaugu

SEQ ID NO: 2087536 - RNA, 23 nt, Homo sapiens
ccauuuuuuuuaccucacaccca

SEQ ID NO: 2087537 - RNA, 19 nt, Homo sapiens
agauccccaacugcuccag

SEQ ID NO: 2087538 - RNA, 19 nt, Homo sapiens
ccacucaugacugcaugac

SEQ ID NO: 2087539 - RNA, 15 nt, Homo sapiens
aaugauccuuccuac

SEQ ID NO: 2087540 - RNA, 19 nt, Homo sapiens
gugauguugguugaggcag

SEQ ID NO: 2087541 - RNA, 13 nt, Homo sapiens
cagaacccuccac

SEQ ID NO: 2087542 - RNA, 19 nt, Homo sapiens
gggcccagccaggagcaga

SEQ ID NO: 2087543 - RNA, 16 nt, Homo sapiens
uccagugcauacugua

SEQ ID NO: 2087544 - RNA, 21 nt, Homo sapiens
uggucacacagagauacgcaa

SEQ ID NO: 2087545 - RNA, 18 nt, Homo sapiens
gaagggaguuggugugcu

SEQ ID NO: 2087546 - RNA, 19 nt, Homo sapiens
gaaaaacauuccaggaaac

SEQ ID NO: 2087547 - RNA, 12 nt, Homo sapiens
gcaaagucucca

SEQ ID NO: 2087548 - RNA, 20 nt, Homo sapiens
uuacuuuuaaaaucagugau

SEQ ID NO: 2087549 - RNA, 14 nt, Homo sapiens
ucacgauuccuucc

SEQ ID NO: 2087550 - RNA, 22 nt, Homo sapiens
auacucaggacuccucuccgca

SEQ ID NO: 2087551 - RNA, 17 nt, Homo sapiens
ugggugugcaacuugag

SEQ ID NO: 2087552 - RNA, 21 nt, Homo sapiens
ucaaauaaucacaaaaucaca

SEQ ID NO: 2087553 - RNA, 22 nt, Homo sapiens
acauuuguauuuugugaugaau

SEQ ID NO: 2087554 - RNA, 21 nt, Homo sapiens
ugcauguaccauuugcauggc

SEQ ID NO: 2087555 - RNA, 22 nt, Homo sapiens
cuucauaagguaauucauggca

SEQ ID NO: 2087556 - RNA, 21 nt, Homo sapiens
accccaagcggccuuuuccaa

SEQ ID NO: 2087557 - RNA, 18 nt, Homo sapiens
uagagugugguuaugaac

SEQ ID NO: 2087558 - RNA, 17 nt, Homo sapiens
uagaaaggaacugcaau

SEQ ID NO: 2087559 - RNA, 14 nt, Homo sapiens
cgaguacucuugaa

SEQ ID NO: 2087560 - RNA, 15 nt, Homo sapiens
aaauuccuaucucau

SEQ ID NO: 2087561 - RNA, 22 nt, Homo sapiens
cgcauaauaaggggaagacuuu

SEQ ID NO: 2087562 - RNA, 22 nt, Homo sapiens
cucaagugauucuccugccuca

SEQ ID NO: 2087563 - RNA, 20 nt, Homo sapiens
gcucuuuagaaggacucagu

SEQ ID NO: 2087564 - RNA, 14 nt, Homo sapiens
acugacucuguuau

SEQ ID NO: 2087565 - RNA, 17 nt, Homo sapiens
ugucagaguagaagauu

SEQ ID NO: 2087566 - RNA, 22 nt, Homo sapiens
guugauggaaaauaaacaucag

SEQ ID NO: 2087567 - RNA, 18 nt, Homo sapiens
uuaagaauuuuuuccuaa

SEQ ID NO: 2087568 - RNA, 23 nt, Homo sapiens
gcuuaguccaauuccuugcacau

SEQ ID NO: 2087569 - RNA, 16 nt, Homo sapiens
auaacaaagauaucuu

SEQ ID NO: 2087570 - RNA, 14 nt, Homo sapiens
cugccuugaugaag

SEQ ID NO: 2087571 - RNA, 19 nt, Homo sapiens
acccagggaggaagacugu

SEQ ID NO: 2087572 - RNA, 16 nt, Homo sapiens
uaucauggcauauaac

SEQ ID NO: 2087573 - RNA, 18 nt, Homo sapiens
ccgggcuggcccugugca

SEQ ID NO: 2087574 - RNA, 18 nt, Homo sapiens
accuuaaugacaacacuu

SEQ ID NO: 2087575 - RNA, 22 nt, Homo sapiens
aaucuaccauuuauugaaugca

SEQ ID NO: 2087576 - RNA, 20 nt, Homo sapiens
gcauuuuacugucuguaaga

SEQ ID NO: 2087577 - RNA, 11 nt, Homo sapiens
aaaugcaaaau

SEQ ID NO: 2087578 - RNA, 12 nt, Homo sapiens
ccuucucaggga

SEQ ID NO: 2087579 - RNA, 18 nt, Homo sapiens
agacuacacaagaggaaa

SEQ ID NO: 2087580 - RNA, 18 nt, Homo sapiens
accuguaucaaacugcuu

SEQ ID NO: 2087581 - RNA, 18 nt, Homo sapiens
uccacugucuauguacaa

SEQ ID NO: 2087582 - RNA, 17 nt, Homo sapiens
ccuggaucuaccagcau

SEQ ID NO: 2087583 - RNA, 14 nt, Homo sapiens
ugggauuugagaua

SEQ ID NO: 2087584 - RNA, 18 nt, Homo sapiens
uggccaggccggucucaa

SEQ ID NO: 2087585 - RNA, 19 nt, Homo sapiens
uaacaaacccaacuaaagu

SEQ ID NO: 2087586 - RNA, 21 nt, Homo sapiens
aggcugagauaggaggaucac

SEQ ID NO: 2087587 - RNA, 20 nt, Homo sapiens
accgagcgcuuucuggaaaa

SEQ ID NO: 2087588 - RNA, 22 nt, Homo sapiens
uugaaacggaugauuucuaugc

SEQ ID NO: 2087589 - RNA, 19 nt, Homo sapiens
uaaccaugaaaauagccaa

SEQ ID NO: 2087590 - RNA, 20 nt, Homo sapiens
cuuaugccuauaccugaaua

SEQ ID NO: 2087591 - RNA, 15 nt, Homo sapiens
gcuggccacacagca

SEQ ID NO: 2087592 - RNA, 16 nt, Homo sapiens
guccucccagcugcca

SEQ ID NO: 2087593 - RNA, 19 nt, Homo sapiens
uaaaguauaugugcagucu

SEQ ID NO: 2087594 - RNA, 18 nt, Homo sapiens
ucaaaugggcugcugcuu

SEQ ID NO: 2087595 - RNA, 17 nt, Homo sapiens
uuuguauuuuuccucuu

SEQ ID NO: 2087596 - RNA, 23 nt, Homo sapiens
uucuaugcuguuuguagugaaau

SEQ ID NO: 2087597 - RNA, 18 nt, Homo sapiens
gugcugugggcagcaccc

SEQ ID NO: 2087598 - RNA, 23 nt, Homo sapiens
uuaguuuuauuuucuaaaguacu

SEQ ID NO: 2087599 - RNA, 15 nt, Homo sapiens
gcuagcagcugugau

SEQ ID NO: 2087600 - RNA, 16 nt, Homo sapiens
gccucugggaucugcc

SEQ ID NO: 2087601 - RNA, 19 nt, Homo sapiens
aaucucuuggaugcagcuu

SEQ ID NO: 2087602 - RNA, 14 nt, Homo sapiens
aaagacagcuuuaa

SEQ ID NO: 2087603 - RNA, 17 nt, Homo sapiens
aaccccgucugcuccuc

SEQ ID NO: 2087604 - RNA, 19 nt, Homo sapiens
aucuaagggaaaaagccuu

SEQ ID NO: 2087605 - RNA, 20 nt, Homo sapiens
cuuugugugcgucacuguga

SEQ ID NO: 2087606 - RNA, 21 nt, Homo sapiens
acuccaagugccccaccacuc

SEQ ID NO: 2087607 - RNA, 18 nt, Homo sapiens
uuuuuaauauaaagccug

SEQ ID NO: 2087608 - RNA, 14 nt, Homo sapiens
ugcccgaaaagcau

SEQ ID NO: 2087609 - RNA, 22 nt, Homo sapiens
aagcuaaaauuagaugaacuca

SEQ ID NO: 2087610 - RNA, 21 nt, Homo sapiens
cagcuucucuacagacuccaa

SEQ ID NO: 2087611 - RNA, 15 nt, Homo sapiens
cauacagauuugcaa

SEQ ID NO: 2087612 - RNA, 21 nt, Homo sapiens
guuucugucaagcuggugcua

SEQ ID NO: 2087613 - RNA, 22 nt, Homo sapiens
caaccaguuaaagccacagaug

SEQ ID NO: 2087614 - RNA, 10 nt, Homo sapiens
aacugacaca

SEQ ID NO: 2087615 - RNA, 15 nt, Homo sapiens
cugaguggugccaaa

SEQ ID NO: 2087616 - RNA, 16 nt, Homo sapiens
uucauccaacuggaag

SEQ ID NO: 2087617 - RNA, 17 nt, Homo sapiens
accaucacaugaccaca

SEQ ID NO: 2087618 - RNA, 17 nt, Homo sapiens
ugacauugcguuugacc

SEQ ID NO: 2087619 - RNA, 22 nt, Homo sapiens
agggcaaggugugguagcucac

SEQ ID NO: 2087620 - RNA, 18 nt, Homo sapiens
ggccauggcucagggugg

SEQ ID NO: 2087621 - RNA, 13 nt, Homo sapiens
ccucaaagcacac

SEQ ID NO: 2087622 - RNA, 21 nt, Homo sapiens
augguggguacaaaaagucaa

SEQ ID NO: 2087623 - RNA, 16 nt, Homo sapiens
auaaaccucaucuagg

SEQ ID NO: 2087624 - RNA, 15 nt, Homo sapiens
aacuuugaaccauaa

SEQ ID NO: 2087625 - RNA, 20 nt, Homo sapiens
agguagcccagcacugugaa

SEQ ID NO: 2087626 - RNA, 15 nt, Homo sapiens
uccuucauaagccau

SEQ ID NO: 2087627 - RNA, 15 nt, Homo sapiens
guaucaggacccaga

SEQ ID NO: 2087628 - RNA, 22 nt, Homo sapiens
uuucaaacaagaaacauuucag

SEQ ID NO: 2087629 - RNA, 17 nt, Homo sapiens
guccacgauucacucau

SEQ ID NO: 2087630 - RNA, 21 nt, Homo sapiens
gauuuccuugacuucuuugag

SEQ ID NO: 2087631 - RNA, 17 nt, Homo sapiens
aucuuuguuagauauua

SEQ ID NO: 2087632 - RNA, 15 nt, Homo sapiens
aucccugcagcucaa

SEQ ID NO: 2087633 - RNA, 19 nt, Homo sapiens
ccagcaggguagcuauuac

SEQ ID NO: 2087634 - RNA, 15 nt, Homo sapiens
uguggauucuauauu

SEQ ID NO: 2087635 - RNA, 21 nt, Homo sapiens
ggcgcugccugcguugcaaac

SEQ ID NO: 2087636 - RNA, 22 nt, Homo sapiens
aacauuucauuaugaggucaga

SEQ ID NO: 2087637 - RNA, 15 nt, Homo sapiens
auucagaccagugaa

SEQ ID NO: 2087638 - RNA, 22 nt, Homo sapiens
aauuaucaugcguuuuauaucu

SEQ ID NO: 2087639 - RNA, 15 nt, Homo sapiens
caaaccauugcucuu

SEQ ID NO: 2087640 - RNA, 22 nt, Homo sapiens
acauugcuuccuaaacuuucaa

SEQ ID NO: 2087641 - RNA, 21 nt, Homo sapiens
cuggcacaccagaagugccau

SEQ ID NO: 2087642 - RNA, 18 nt, Homo sapiens
auuauggaaaacauuuca

SEQ ID NO: 2087643 - RNA, 18 nt, Homo sapiens
agcuagcacuaacucgug

SEQ ID NO: 2087644 - RNA, 16 nt, Homo sapiens
gcgagucuggagacca

SEQ ID NO: 2087645 - RNA, 23 nt, Homo sapiens
ccaucaugggcuggacauuggac

SEQ ID NO: 2087646 - RNA, 20 nt, Homo sapiens
ugguuuugacucaccugaaa

SEQ ID NO: 2087647 - RNA, 17 nt, Homo sapiens
aaacuacagacaaagag

SEQ ID NO: 2087648 - RNA, 15 nt, Homo sapiens
ccaaucugcauuucu

SEQ ID NO: 2087649 - RNA, 11 nt, Homo sapiens
cuguugccaca

SEQ ID NO: 2087650 - RNA, 21 nt, Homo sapiens
aucuucugugcccagcacagu

SEQ ID NO: 2087651 - RNA, 17 nt, Homo sapiens
uaaaugggacuggaguc

SEQ ID NO: 2087652 - RNA, 14 nt, Homo sapiens
uauuucaauacuua

SEQ ID NO: 2087653 - RNA, 20 nt, Homo sapiens
ugauuucucuacuugucaua

SEQ ID NO: 2087654 - RNA, 20 nt, Homo sapiens
gugguugcauccuaacucca

SEQ ID NO: 2087655 - RNA, 13 nt, Homo sapiens
auuaagaacacua

SEQ ID NO: 2087656 - RNA, 20 nt, Homo sapiens
uauuuacuggaaaccuguua

SEQ ID NO: 2087657 - RNA, 15 nt, Homo sapiens
ccaagaaaugaacuu

SEQ ID NO: 2087658 - RNA, 22 nt, Homo sapiens
cucugacaacugugaagccacc

SEQ ID NO: 2087659 - RNA, 12 nt, Homo sapiens
cugauggugcau

SEQ ID NO: 2087660 - RNA, 21 nt, Homo sapiens
agaugaucacugaucuuguca

SEQ ID NO: 2087661 - RNA, 12 nt, Homo sapiens
aaacaaugccau

SEQ ID NO: 2087662 - RNA, 21 nt, Homo sapiens
ugauuuuauacauagucacaa

SEQ ID NO: 2087663 - RNA, 20 nt, Homo sapiens
ccuugggucauugaccucuc

SEQ ID NO: 2087664 - RNA, 14 nt, Homo sapiens
acgaaaugcuugcu

SEQ ID NO: 2087665 - RNA, 23 nt, Homo sapiens
aacuguguacgacaaagcaucau

SEQ ID NO: 2087666 - RNA, 12 nt, Homo sapiens
augccuuacucu

SEQ ID NO: 2087667 - RNA, 17 nt, Homo sapiens
ugagacuccucagcacc

SEQ ID NO: 2087668 - RNA, 19 nt, Homo sapiens
gagaaauaagauaguugau

SEQ ID NO: 2087669 - RNA, 12 nt, Homo sapiens
ucucaauacagc

SEQ ID NO: 2087670 - RNA, 20 nt, Homo sapiens
gucaaaacccaccaaaacca

SEQ ID NO: 2087671 - RNA, 22 nt, Homo sapiens
ggcagcaggggcugcugugaug

SEQ ID NO: 2087672 - RNA, 19 nt, Homo sapiens
uuagagcaagaacauucaa

SEQ ID NO: 2087673 - RNA, 13 nt, Homo sapiens
gaaauauaauucu

SEQ ID NO: 2087674 - RNA, 17 nt, Homo sapiens
aguauguuacaugcauu

SEQ ID NO: 2087675 - RNA, 15 nt, Homo sapiens
aagugcaagacugaa

SEQ ID NO: 2087676 - RNA, 19 nt, Homo sapiens
gaggaggccguugauucac

SEQ ID NO: 2087677 - RNA, 22 nt, Homo sapiens
gcuaaaaugaaaaauagugugu

SEQ ID NO: 2087678 - RNA, 14 nt, Homo sapiens
ucuagaucucagcc

SEQ ID NO: 2087679 - RNA, 18 nt, Homo sapiens
gaaacacacauuucuuug

SEQ ID NO: 2087680 - RNA, 13 nt, Homo sapiens
cuuugaagucuga

SEQ ID NO: 2087681 - RNA, 17 nt, Homo sapiens
uuacuaaugauacuuac

SEQ ID NO: 2087682 - RNA, 22 nt, Homo sapiens
uuccucugccacucccugcugu

SEQ ID NO: 2087683 - RNA, 18 nt, Homo sapiens
cagauguuaugcuccugc

SEQ ID NO: 2087684 - RNA, 18 nt, Homo sapiens
ucaagucagaacagccag

SEQ ID NO: 2087685 - RNA, 19 nt, Homo sapiens
gggacccccguggugggga

SEQ ID NO: 2087686 - RNA, 15 nt, Homo sapiens
caaauaaaugagccc

SEQ ID NO: 2087687 - RNA, 17 nt, Homo sapiens
cacuggcuccacaucca

SEQ ID NO: 2087688 - RNA, 13 nt, Homo sapiens
uguuucuguuauu

SEQ ID NO: 2087689 - RNA, 20 nt, Homo sapiens
ggcgaugugcaaguguaugc

SEQ ID NO: 2087690 - RNA, 16 nt, Homo sapiens
gaaagaguagugcauu

SEQ ID NO: 2087691 - RNA, 22 nt, Homo sapiens
auuuacuuuaaacuacauuagg

SEQ ID NO: 2087692 - RNA, 13 nt, Homo sapiens
uuucuaauaauca

SEQ ID NO: 2087693 - RNA, 17 nt, Homo sapiens
cuccacauccuguguca

SEQ ID NO: 2087694 - RNA, 18 nt, Homo sapiens
uuaauacaaaacugugaa

SEQ ID NO: 2087695 - RNA, 13 nt, Homo sapiens
cucaaacauuuau

SEQ ID NO: 2087696 - RNA, 22 nt, Homo sapiens
augaaucucaagauucaguaga

SEQ ID NO: 2087697 - RNA, 17 nt, Homo sapiens
ugagucuucacauuuag

SEQ ID NO: 2087698 - RNA, 16 nt, Homo sapiens
gccccuccucccucag

SEQ ID NO: 2087699 - RNA, 14 nt, Homo sapiens
agggugacugaagu

SEQ ID NO: 2087700 - RNA, 16 nt, Homo sapiens
auauacucuucaagga

SEQ ID NO: 2087701 - RNA, 21 nt, Homo sapiens
uggccacugucuccacucaca

SEQ ID NO: 2087702 - RNA, 21 nt, Homo sapiens
aggcugggccauguccaaaga

SEQ ID NO: 2087703 - RNA, 22 nt, Homo sapiens
gaugccacuucccagaggcaga

SEQ ID NO: 2087704 - RNA, 16 nt, Homo sapiens
aggcugcagugcaaug

SEQ ID NO: 2087705 - RNA, 15 nt, Homo sapiens
ucguuaaagcaaagc

SEQ ID NO: 2087706 - RNA, 19 nt, Homo sapiens
gcuacagagaaaaucaaag

SEQ ID NO: 2087707 - RNA, 22 nt, Homo sapiens
cuaauuucugaaaugugcagcu

SEQ ID NO: 2087708 - RNA, 15 nt, Homo sapiens
cuccccccagacccc

SEQ ID NO: 2087709 - RNA, 18 nt, Homo sapiens
cugcgcuucccugcaguc

SEQ ID NO: 2087710 - RNA, 14 nt, Homo sapiens
gcacauaccuucau

SEQ ID NO: 2087711 - RNA, 15 nt, Homo sapiens
aggaguuccaccaug

SEQ ID NO: 2087712 - RNA, 21 nt, Homo sapiens
guagccgcugggguguuaaug

SEQ ID NO: 2087713 - RNA, 17 nt, Homo sapiens
agaguuggagacucagc

SEQ ID NO: 2087714 - RNA, 17 nt, Homo sapiens
ccacauguacagacaua

SEQ ID NO: 2087715 - RNA, 16 nt, Homo sapiens
aucauuuuuguacagu

SEQ ID NO: 2087716 - RNA, 11 nt, Homo sapiens
ugaacauucca

SEQ ID NO: 2087717 - RNA, 19 nt, Homo sapiens
ugccuggagucaguagcca

SEQ ID NO: 2087718 - RNA, 20 nt, Homo sapiens
cuaagcugccgguucuuaaa

SEQ ID NO: 2087719 - RNA, 22 nt, Homo sapiens
uuuccauauaguuuguuuucuu

SEQ ID NO: 2087720 - RNA, 22 nt, Homo sapiens
ucuucaggggucaccuccucca

SEQ ID NO: 2087721 - RNA, 14 nt, Homo sapiens
gugaugucauuuga

SEQ ID NO: 2087722 - RNA, 14 nt, Homo sapiens
cguguggcuuacaa

SEQ ID NO: 2087723 - RNA, 19 nt, Homo sapiens
auaccuguguuucuugccu

SEQ ID NO: 2087724 - RNA, 17 nt, Homo sapiens
uguauauuuguacaaaa

SEQ ID NO: 2087725 - RNA, 17 nt, Homo sapiens
aguguuuaugugcuauu

SEQ ID NO: 2087726 - RNA, 13 nt, Homo sapiens
cccuuaugaauug

SEQ ID NO: 2087727 - RNA, 20 nt, Homo sapiens
cacuuaguauugcagccaaa

SEQ ID NO: 2087728 - RNA, 19 nt, Homo sapiens
uggaauacacaugcaggac

SEQ ID NO: 2087729 - RNA, 23 nt, Homo sapiens
uuaagacuucuggucauuuccaa

SEQ ID NO: 2087730 - RNA, 23 nt, Homo sapiens
aggcuccuguggcugucuuguca

SEQ ID NO: 2087731 - RNA, 18 nt, Homo sapiens
caugggucucuguagaaa

SEQ ID NO: 2087732 - RNA, 22 nt, Homo sapiens
ucuuaacuauaaauauguacaa

SEQ ID NO: 2087733 - RNA, 23 nt, Homo sapiens
uggagcucacacuccaguggcag

SEQ ID NO: 2087734 - RNA, 15 nt, Homo sapiens
accuccacauaccug

SEQ ID NO: 2087735 - RNA, 23 nt, Homo sapiens
cuucuagugagccugggccagga

SEQ ID NO: 2087736 - RNA, 18 nt, Homo sapiens
ccaagaauauugcaaaau

SEQ ID NO: 2087737 - RNA, 19 nt, Homo sapiens
gaaucugugggucugggag

SEQ ID NO: 2087738 - RNA, 23 nt, Homo sapiens
cagcuaaaauuuucgacuugacu

SEQ ID NO: 2087739 - RNA, 20 nt, Homo sapiens
gacacaugcugaacaucaca

SEQ ID NO: 2087740 - RNA, 22 nt, Homo sapiens
cuuccaagaccauuuguaguga

SEQ ID NO: 2087741 - RNA, 18 nt, Homo sapiens
uggugaauauuacauugc

SEQ ID NO: 2087742 - RNA, 23 nt, Homo sapiens
aaagcuauucuuaugcuguaaca

SEQ ID NO: 2087743 - RNA, 15 nt, Homo sapiens
cacacaccacacaua

SEQ ID NO: 2087744 - RNA, 22 nt, Homo sapiens
cugagcaguuguuauauucauu

SEQ ID NO: 2087745 - RNA, 17 nt, Homo sapiens
ccuccagagacacugag

SEQ ID NO: 2087746 - RNA, 23 nt, Homo sapiens
uuucccauuuaaaaauaucugaa

SEQ ID NO: 2087747 - RNA, 22 nt, Homo sapiens
ucuggguggaagugugugccaa

SEQ ID NO: 2087748 - RNA, 14 nt, Homo sapiens
ucugcccuuguucc

SEQ ID NO: 2087749 - RNA, 13 nt, Homo sapiens
aucugagugaaau

SEQ ID NO: 2087750 - RNA, 15 nt, Homo sapiens
aucgcaccacugcac

SEQ ID NO: 2087751 - RNA, 15 nt, Homo sapiens
uucuuaacucuuuaa

SEQ ID NO: 2087752 - RNA, 17 nt, Homo sapiens
gaauuugcuuagccuuu

SEQ ID NO: 2087753 - RNA, 18 nt, Homo sapiens
cugcugaccuccacagcu

SEQ ID NO: 2087754 - RNA, 15 nt, Homo sapiens
auggggugcaccugu

SEQ ID NO: 2087755 - RNA, 19 nt, Homo sapiens
aaaguggaguguauuuaca

SEQ ID NO: 2087756 - RNA, 11 nt, Homo sapiens
ugaaugugauu

SEQ ID NO: 2087757 - RNA, 16 nt, Homo sapiens
gccaugcccuccaugu

SEQ ID NO: 2087758 - RNA, 18 nt, Homo sapiens
cauggaggccaagaacuu

SEQ ID NO: 2087759 - RNA, 21 nt, Homo sapiens
auacccaucuugaaaaacacu

SEQ ID NO: 2087760 - RNA, 15 nt, Homo sapiens
aaacaagugcacuug

SEQ ID NO: 2087761 - RNA, 17 nt, Homo sapiens
uuuuucccagacuacua

SEQ ID NO: 2087762 - RNA, 16 nt, Homo sapiens
uuuuauaagcauuuaa

SEQ ID NO: 2087763 - RNA, 14 nt, Homo sapiens
cgaucccaucuuga

SEQ ID NO: 2087764 - RNA, 12 nt, Homo sapiens
aauacaugucua

SEQ ID NO: 2087765 - RNA, 20 nt, Homo sapiens
gaacacguuggcucaguccu

SEQ ID NO: 2087766 - RNA, 21 nt, Homo sapiens
aaucacagaugaguuaucuaa

SEQ ID NO: 2087767 - RNA, 15 nt, Homo sapiens
gcauccucacugggc

SEQ ID NO: 2087768 - RNA, 17 nt, Homo sapiens
auugcuucaugagcuaa

SEQ ID NO: 2087769 - RNA, 14 nt, Homo sapiens
caucugcauuugau

SEQ ID NO: 2087770 - RNA, 20 nt, Homo sapiens
ccucuaguaaauuuaagucc

SEQ ID NO: 2087771 - RNA, 20 nt, Homo sapiens
aacacugcagcccucuccac

SEQ ID NO: 2087772 - RNA, 19 nt, Homo sapiens
ugaguaucuguauguauau

SEQ ID NO: 2087773 - RNA, 14 nt, Homo sapiens
caagauuuauggaa

SEQ ID NO: 2087774 - RNA, 13 nt, Homo sapiens
cucaaacaaaagu

SEQ ID NO: 2087775 - RNA, 15 nt, Homo sapiens
aaugcuauuugccaa

SEQ ID NO: 2087776 - RNA, 13 nt, Homo sapiens
cgugacagcacuu

SEQ ID NO: 2087777 - RNA, 22 nt, Homo sapiens
auacacacacacagacauauau

SEQ ID NO: 2087778 - RNA, 14 nt, Homo sapiens
ccuaagagauuuau

SEQ ID NO: 2087779 - RNA, 19 nt, Homo sapiens
agggaaaaauaugagaaaa

SEQ ID NO: 2087780 - RNA, 13 nt, Homo sapiens
ugaauagcuuaug

SEQ ID NO: 2087781 - RNA, 14 nt, Homo sapiens
caaagccacacucu

SEQ ID NO: 2087782 - RNA, 17 nt, Homo sapiens
auuaagaguugaaagaa

SEQ ID NO: 2087783 - RNA, 19 nt, Homo sapiens
gcuacacugacacugguau

SEQ ID NO: 2087784 - RNA, 21 nt, Homo sapiens
ugccagugccuuauuacccag

SEQ ID NO: 2087785 - RNA, 17 nt, Homo sapiens
ucaaguuuacacuucau

SEQ ID NO: 2087786 - RNA, 18 nt, Homo sapiens
aagcauccaaguauauau

SEQ ID NO: 2087787 - RNA, 15 nt, Homo sapiens
ugcuugucaucugca

SEQ ID NO: 2087788 - RNA, 19 nt, Homo sapiens
caggcuccccaucuucucc

SEQ ID NO: 2087789 - RNA, 13 nt, Homo sapiens
acuuaacuaugag

SEQ ID NO: 2087790 - RNA, 23 nt, Homo sapiens
ggauugaaaaaaagggcacucug

SEQ ID NO: 2087791 - RNA, 16 nt, Homo sapiens
cacugguaaucccaag

SEQ ID NO: 2087792 - RNA, 22 nt, Homo sapiens
cugaggagcaggugucccugag

SEQ ID NO: 2087793 - RNA, 19 nt, Homo sapiens
cauuuauuucaugauucaa

SEQ ID NO: 2087794 - RNA, 15 nt, Homo sapiens
cuuagaugaucuuca

SEQ ID NO: 2087795 - RNA, 19 nt, Homo sapiens
cugauguaccugaugcuau

SEQ ID NO: 2087796 - RNA, 21 nt, Homo sapiens
ucuuagcagcuuccagauuga

SEQ ID NO: 2087797 - RNA, 16 nt, Homo sapiens
ugauguguccucaggg

SEQ ID NO: 2087798 - RNA, 17 nt, Homo sapiens
acugagcagagucuugc

SEQ ID NO: 2087799 - RNA, 13 nt, Homo sapiens
cagugccucuggu

SEQ ID NO: 2087800 - RNA, 12 nt, Homo sapiens
ccagcugucacu

SEQ ID NO: 2087801 - RNA, 12 nt, Homo sapiens
cgccugcuccuc

SEQ ID NO: 2087802 - RNA, 18 nt, Homo sapiens
guuucuuuaucuacuaau

SEQ ID NO: 2087803 - RNA, 15 nt, Homo sapiens
uaacauggugugcuu

SEQ ID NO: 2087804 - RNA, 13 nt, Homo sapiens
ucuaacagcucag

SEQ ID NO: 2087805 - RNA, 15 nt, Homo sapiens
auugccaagugccau

SEQ ID NO: 2087806 - RNA, 16 nt, Homo sapiens
gaaacucaaaaauauu

SEQ ID NO: 2087807 - RNA, 13 nt, Homo sapiens
uuuccaagcugcg

SEQ ID NO: 2087808 - RNA, 16 nt, Homo sapiens
cagugacaaggcccug

SEQ ID NO: 2087809 - RNA, 20 nt, Homo sapiens
uguacagaccaccuuucaca

SEQ ID NO: 2087810 - RNA, 23 nt, Homo sapiens
caagauguugauuuuuacugugu

SEQ ID NO: 2087811 - RNA, 20 nt, Homo sapiens
uauuacugggacugugcuca

SEQ ID NO: 2087812 - RNA, 20 nt, Homo sapiens
uaauacuuuugcugaugcuu

SEQ ID NO: 2087813 - RNA, 22 nt, Homo sapiens
cuagugcucccuuccuccucaa

SEQ ID NO: 2087814 - RNA, 23 nt, Homo sapiens
accaaaucauacuuuuucuuuga

SEQ ID NO: 2087815 - RNA, 15 nt, Homo sapiens
caggcuuauuaggaa

SEQ ID NO: 2087816 - RNA, 18 nt, Homo sapiens
ucucucuaccugugacaa

SEQ ID NO: 2087817 - RNA, 13 nt, Homo sapiens
uaugaucuugaua

SEQ ID NO: 2087818 - RNA, 16 nt, Homo sapiens
ccuuuggaaagccauu

SEQ ID NO: 2087819 - RNA, 22 nt, Homo sapiens
auuccauucuggaagugacuuu

SEQ ID NO: 2087820 - RNA, 14 nt, Homo sapiens
gcaccauuuuguca

SEQ ID NO: 2087821 - RNA, 19 nt, Homo sapiens
gaaaagguucuucaucccu

SEQ ID NO: 2087822 - RNA, 17 nt, Homo sapiens
gaugucagcaguugcug

SEQ ID NO: 2087823 - RNA, 17 nt, Homo sapiens
cucacccccuacacaca

SEQ ID NO: 2087824 - RNA, 20 nt, Homo sapiens
cugauuaacugaggcaucca

SEQ ID NO: 2087825 - RNA, 15 nt, Homo sapiens
aggacacagaugaaa

SEQ ID NO: 2087826 - RNA, 18 nt, Homo sapiens
ggcugggccugagccuaa

SEQ ID NO: 2087827 - RNA, 21 nt, Homo sapiens
ccaguggcuggaucugugagg

SEQ ID NO: 2087828 - RNA, 23 nt, Homo sapiens
acauucccuuggauguagucuga

SEQ ID NO: 2087829 - RNA, 16 nt, Homo sapiens
aucugcaccaccaugc

SEQ ID NO: 2087830 - RNA, 19 nt, Homo sapiens
acuauuucuugugguuaua

SEQ ID NO: 2087831 - RNA, 14 nt, Homo sapiens
uagaagucauaugu

SEQ ID NO: 2087832 - RNA, 22 nt, Homo sapiens
ucugaagccuuuuccugagguc

SEQ ID NO: 2087833 - RNA, 14 nt, Homo sapiens
ccacugccuuugac

SEQ ID NO: 2087834 - RNA, 18 nt, Homo sapiens
ucugugugugauuugcua

SEQ ID NO: 2087835 - RNA, 12 nt, Homo sapiens
gcugaguacuca

SEQ ID NO: 2087836 - RNA, 19 nt, Homo sapiens
ggccugccuucuucuugug

SEQ ID NO: 2087837 - RNA, 17 nt, Homo sapiens
agccuggggcuugaauu

SEQ ID NO: 2087838 - RNA, 16 nt, Homo sapiens
gcacguucauaaccaa

SEQ ID NO: 2087839 - RNA, 23 nt, Homo sapiens
gaaucuuuaaaagaugcuuuuaa

SEQ ID NO: 2087840 - RNA, 20 nt, Homo sapiens
cucuaagcacauuccaaacu

SEQ ID NO: 2087841 - RNA, 14 nt, Homo sapiens
uccaguucaucuau

SEQ ID NO: 2087842 - RNA, 15 nt, Homo sapiens
aauguuguccaggaa

SEQ ID NO: 2087843 - RNA, 17 nt, Homo sapiens
uccccauucagugacau

SEQ ID NO: 2087844 - RNA, 13 nt, Homo sapiens
uuuauaaaaucaa

SEQ ID NO: 2087845 - RNA, 17 nt, Homo sapiens
gugguguuuauugcaau

SEQ ID NO: 2087846 - RNA, 14 nt, Homo sapiens
ggaguccacuccca

SEQ ID NO: 2087847 - RNA, 19 nt, Homo sapiens
aaaaguuguucaacuauuu

SEQ ID NO: 2087848 - RNA, 16 nt, Homo sapiens
ugacagaccacaucuu

SEQ ID NO: 2087849 - RNA, 14 nt, Homo sapiens
ccagacacauucac

SEQ ID NO: 2087850 - RNA, 14 nt, Homo sapiens
ccagcuacauuccu

SEQ ID NO: 2087851 - RNA, 12 nt, Homo sapiens
uuuggaagcacu

SEQ ID NO: 2087852 - RNA, 20 nt, Homo sapiens
aguuaaugaaggugugcuac

SEQ ID NO: 2087853 - RNA, 13 nt, Homo sapiens
aaugaaagccaaa

SEQ ID NO: 2087854 - RNA, 13 nt, Homo sapiens
ccaacaagaaugc

SEQ ID NO: 2087855 - RNA, 22 nt, Homo sapiens
cauuagugagacauauuuacaa

SEQ ID NO: 2087856 - RNA, 16 nt, Homo sapiens
auguaaguacuuccac

SEQ ID NO: 2087857 - RNA, 15 nt, Homo sapiens
ugaaguuuacaauca

SEQ ID NO: 2087858 - RNA, 21 nt, Homo sapiens
ccccauugagaucuuccugcu

SEQ ID NO: 2087859 - RNA, 15 nt, Homo sapiens
uuuaaaaacaaacaa

SEQ ID NO: 2087860 - RNA, 19 nt, Homo sapiens
cccugcuugcacuuuguaa

SEQ ID NO: 2087861 - RNA, 21 nt, Homo sapiens
cuucgggagugcuuacacuua

SEQ ID NO: 2087862 - RNA, 11 nt, Homo sapiens
ugguccagauu

SEQ ID NO: 2087863 - RNA, 11 nt, Homo sapiens
auuuccagugg

SEQ ID NO: 2087864 - RNA, 20 nt, Homo sapiens
ucaccaauuccacuuccugc

SEQ ID NO: 2087865 - RNA, 18 nt, Homo sapiens
cucaugugacucuuucca

SEQ ID NO: 2087866 - RNA, 14 nt, Homo sapiens
cugucucucugucu

SEQ ID NO: 2087867 - RNA, 14 nt, Homo sapiens
cagugccucagugc

SEQ ID NO: 2087868 - RNA, 21 nt, Homo sapiens
cucacuucagguauaccucac

SEQ ID NO: 2087869 - RNA, 14 nt, Homo sapiens
gggaaacugggaaa

SEQ ID NO: 2087870 - RNA, 14 nt, Homo sapiens
uguauacuuguaua

SEQ ID NO: 2087871 - RNA, 14 nt, Homo sapiens
guaucacuguauca

SEQ ID NO: 2087872 - RNA, 14 nt, Homo sapiens
gcagggcugcaggg

SEQ ID NO: 2087873 - RNA, 17 nt, Homo sapiens
ggagggagagguggcag

SEQ ID NO: 2087874 - RNA, 22 nt, Homo sapiens
agguaccccagcucugcuugcc

SEQ ID NO: 2087875 - RNA, 19 nt, Homo sapiens
aaaauaccccuaacauacu

SEQ ID NO: 2087876 - RNA, 20 nt, Homo sapiens
gcugauggggguuugcucag

SEQ ID NO: 2087877 - RNA, 20 nt, Homo sapiens
auuuaauguauuaaucuguu

SEQ ID NO: 2087878 - RNA, 19 nt, Homo sapiens
aguuugugagaaacaucuc

SEQ ID NO: 2087879 - RNA, 14 nt, Homo sapiens
uuaugcuacacaga

SEQ ID NO: 2087880 - RNA, 17 nt, Homo sapiens
auguggcuuuuggauuu

SEQ ID NO: 2087881 - RNA, 16 nt, Homo sapiens
aguuuaaccugaugca

SEQ ID NO: 2087882 - RNA, 16 nt, Homo sapiens
ucucuuugugcucuaa

SEQ ID NO: 2087883 - RNA, 15 nt, Homo sapiens
aaccaccauagugaa

SEQ ID NO: 2087884 - RNA, 13 nt, Homo sapiens
uccuuaacacuga

SEQ ID NO: 2087885 - RNA, 22 nt, Homo sapiens
gcggguaaaaagagaaggcaag

SEQ ID NO: 2087886 - RNA, 19 nt, Homo sapiens
gacauuugcucauggaauu

SEQ ID NO: 2087887 - RNA, 12 nt, Homo sapiens
cucugcaguuuu

SEQ ID NO: 2087888 - RNA, 14 nt, Homo sapiens
ccuacucuguguaa

SEQ ID NO: 2087889 - RNA, 13 nt, Homo sapiens
ugaauucacuuaa

SEQ ID NO: 2087890 - RNA, 11 nt, Homo sapiens
ugaucuugccu

SEQ ID NO: 2087891 - RNA, 20 nt, Homo sapiens
aauacagugagcucuagcaa

SEQ ID NO: 2087892 - RNA, 20 nt, Homo sapiens
uugaaugaguuuauauggaa

SEQ ID NO: 2087893 - RNA, 19 nt, Homo sapiens
agcaaaaaaguacaaaguu

SEQ ID NO: 2087894 - RNA, 16 nt, Homo sapiens
ucagaacacucaaagg

SEQ ID NO: 2087895 - RNA, 15 nt, Homo sapiens
guccucuugcucaaa

SEQ ID NO: 2087896 - RNA, 18 nt, Homo sapiens
ccacacguaaacacuuga

SEQ ID NO: 2087897 - RNA, 16 nt, Homo sapiens
aguuaguaauggugcu

SEQ ID NO: 2087898 - RNA, 16 nt, Homo sapiens
uuuguuuuuacaaaau

SEQ ID NO: 2087899 - RNA, 20 nt, Homo sapiens
auccugaauaaaccaguauc

SEQ ID NO: 2087900 - RNA, 22 nt, Homo sapiens
ugagcaaauaaacuuacagauc

SEQ ID NO: 2087901 - RNA, 19 nt, Homo sapiens
cuuaaugucuuuaaaagua

SEQ ID NO: 2087902 - RNA, 19 nt, Homo sapiens
cuaccaaauucauuugacu

SEQ ID NO: 2087903 - RNA, 14 nt, Homo sapiens
aaggaaaugguggc

SEQ ID NO: 2087904 - RNA, 21 nt, Homo sapiens
ugcaacuucuuacuucccuaa

SEQ ID NO: 2087905 - RNA, 22 nt, Homo sapiens
ugcccugcuaaagacagugcgg

SEQ ID NO: 2087906 - RNA, 21 nt, Homo sapiens
caccuggaugucugggugacc

SEQ ID NO: 2087907 - RNA, 11 nt, Homo sapiens
augccacugcu

SEQ ID NO: 2087908 - RNA, 13 nt, Homo sapiens
cacagaggcugcc

SEQ ID NO: 2087909 - RNA, 20 nt, Homo sapiens
cugcauugagaacugcauau

SEQ ID NO: 2087910 - RNA, 16 nt, Homo sapiens
cccagcuccucuuccu

SEQ ID NO: 2087911 - RNA, 20 nt, Homo sapiens
guuggugacugaaacauuca

SEQ ID NO: 2087912 - RNA, 15 nt, Homo sapiens
cuuaccugugagaua

SEQ ID NO: 2087913 - RNA, 13 nt, Homo sapiens
cugcacagcccaa

SEQ ID NO: 2087914 - RNA, 18 nt, Homo sapiens
uaaauauaucuaccccag

SEQ ID NO: 2087915 - RNA, 15 nt, Homo sapiens
acaauguauuuguca

SEQ ID NO: 2087916 - RNA, 15 nt, Homo sapiens
aaggaggccugggga

SEQ ID NO: 2087917 - RNA, 11 nt, Homo sapiens
cccaucugcag

SEQ ID NO: 2087918 - RNA, 13 nt, Homo sapiens
cucaaauguuuuc

SEQ ID NO: 2087919 - RNA, 20 nt, Homo sapiens
auguguguuguccuucagca

SEQ ID NO: 2087920 - RNA, 14 nt, Homo sapiens
agggcgcucagacg

SEQ ID NO: 2087921 - RNA, 13 nt, Homo sapiens
ugugaauggauug

SEQ ID NO: 2087922 - RNA, 23 nt, Homo sapiens
caguagaagugucacagccauag

SEQ ID NO: 2087923 - RNA, 12 nt, Homo sapiens
cugaacuccaua

SEQ ID NO: 2087924 - RNA, 14 nt, Homo sapiens
uuugugucugugaa

SEQ ID NO: 2087925 - RNA, 22 nt, Homo sapiens
uccuccaacaccaagcacagca

SEQ ID NO: 2087926 - RNA, 18 nt, Homo sapiens
gggaaggcuaucagagac

SEQ ID NO: 2087927 - RNA, 18 nt, Homo sapiens
gaggccaaggagggugga

SEQ ID NO: 2087928 - RNA, 13 nt, Homo sapiens
ccaagcacuucac

SEQ ID NO: 2087929 - RNA, 14 nt, Homo sapiens
ucaaaauaugucaa

SEQ ID NO: 2087930 - RNA, 22 nt, Homo sapiens
agcauaggaggggucuggacau

SEQ ID NO: 2087931 - RNA, 12 nt, Homo sapiens
uguuuaccuaaa

SEQ ID NO: 2087932 - RNA, 12 nt, Homo sapiens
uauuuaccugaa

SEQ ID NO: 2087933 - RNA, 13 nt, Homo sapiens
cucaugugcagua

SEQ ID NO: 2087934 - RNA, 15 nt, Homo sapiens
caugugcugugacca

SEQ ID NO: 2087935 - RNA, 13 nt, Homo sapiens
cggaacacuguca

SEQ ID NO: 2087936 - RNA, 16 nt, Homo sapiens
ucaacccccuaccccg

SEQ ID NO: 2087937 - RNA, 20 nt, Homo sapiens
gugaaggugcaucuuucccu

SEQ ID NO: 2087938 - RNA, 15 nt, Homo sapiens
uaaucuguaaucaca

SEQ ID NO: 2087939 - RNA, 14 nt, Homo sapiens
agcuaauaagugcu

SEQ ID NO: 2087940 - RNA, 19 nt, Homo sapiens
aggaaaauaggugaauaau

SEQ ID NO: 2087941 - RNA, 14 nt, Homo sapiens
cauaaaucugugaa

SEQ ID NO: 2087942 - RNA, 15 nt, Homo sapiens
cugggaaucaagaca

SEQ ID NO: 2087943 - RNA, 18 nt, Homo sapiens
ggcugcuccccaacaccu

SEQ ID NO: 2087944 - RNA, 23 nt, Homo sapiens
aucacuugaacccgggaggcaga

SEQ ID NO: 2087945 - RNA, 14 nt, Homo sapiens
cacuggugccaacc

SEQ ID NO: 2087946 - RNA, 15 nt, Homo sapiens
uagggaaaacuuaau

SEQ ID NO: 2087947 - RNA, 14 nt, Homo sapiens
gccaaaaccuuuca

SEQ ID NO: 2087948 - RNA, 15 nt, Homo sapiens
gcucagaauaaggca

SEQ ID NO: 2087949 - RNA, 16 nt, Homo sapiens
ugcauaauuuugccaa

SEQ ID NO: 2087950 - RNA, 11 nt, Homo sapiens
auuuaacuuaa

SEQ ID NO: 2087951 - RNA, 14 nt, Homo sapiens
ccgaugguccucac

SEQ ID NO: 2087952 - RNA, 19 nt, Homo sapiens
ugauucccagaaauacaac

SEQ ID NO: 2087953 - RNA, 16 nt, Homo sapiens
aggaacuucugaacuu

SEQ ID NO: 2087954 - RNA, 19 nt, Homo sapiens
gccuccaccaccacuggcc

SEQ ID NO: 2087955 - RNA, 17 nt, Homo sapiens
ucaccaaugagccuuag

SEQ ID NO: 2087956 - RNA, 19 nt, Homo sapiens
auacaauuagucaaaccac

SEQ ID NO: 2087957 - RNA, 19 nt, Homo sapiens
uuauauacuguuauuucac

SEQ ID NO: 2087958 - RNA, 12 nt, Homo sapiens
gaccuucuagga

SEQ ID NO: 2087959 - RNA, 22 nt, Homo sapiens
gaugugaauuauugacacugaa

SEQ ID NO: 2087960 - RNA, 16 nt, Homo sapiens
cucacagcaaaccucu

SEQ ID NO: 2087961 - RNA, 18 nt, Homo sapiens
auguagagagauaccauc

SEQ ID NO: 2087962 - RNA, 15 nt, Homo sapiens
acccaaugucuccca

SEQ ID NO: 2087963 - RNA, 15 nt, Homo sapiens
aguagagaaguaucc

SEQ ID NO: 2087964 - RNA, 16 nt, Homo sapiens
cucuguuucuuccuuu

SEQ ID NO: 2087965 - RNA, 20 nt, Homo sapiens
aagugagacccccaucucua

SEQ ID NO: 2087966 - RNA, 20 nt, Homo sapiens
ucagaaguauauuuuugcag

SEQ ID NO: 2087967 - RNA, 19 nt, Homo sapiens
ggaggccccugguggcaug

SEQ ID NO: 2087968 - RNA, 23 nt, Homo sapiens
cucugcuccccagugcuaccucu

SEQ ID NO: 2087969 - RNA, 18 nt, Homo sapiens
uggaagcugucauaaaaa

SEQ ID NO: 2087970 - RNA, 21 nt, Homo sapiens
uuaucuagcaagaagauucua

SEQ ID NO: 2087971 - RNA, 18 nt, Homo sapiens
uaguaauacgaaggugag

SEQ ID NO: 2087972 - RNA, 13 nt, Homo sapiens
gcucagggaccau

SEQ ID NO: 2087973 - RNA, 19 nt, Homo sapiens
aacuucucguagaugcugc

SEQ ID NO: 2087974 - RNA, 18 nt, Homo sapiens
cguguuucugacucugag

SEQ ID NO: 2087975 - RNA, 15 nt, Homo sapiens
uggcucaugccugua

SEQ ID NO: 2087976 - RNA, 20 nt, Homo sapiens
aucuguccguucacaugugu

SEQ ID NO: 2087977 - RNA, 18 nt, Homo sapiens
gauguuccuuccaguguc

SEQ ID NO: 2087978 - RNA, 18 nt, Homo sapiens
agauuuugcaccuguaaa

SEQ ID NO: 2087979 - RNA, 20 nt, Homo sapiens
auugccauuuuuaauucauu

SEQ ID NO: 2087980 - RNA, 18 nt, Homo sapiens
guaauaauggaagccaaa

SEQ ID NO: 2087981 - RNA, 23 nt, Homo sapiens
aauauuuuuguauuucucuauuu

SEQ ID NO: 2087982 - RNA, 17 nt, Homo sapiens
cacaccccuaaguacaa

SEQ ID NO: 2087983 - RNA, 17 nt, Homo sapiens
cugaaagugacagagac

SEQ ID NO: 2087984 - RNA, 13 nt, Homo sapiens
uggaaagguuuca

SEQ ID NO: 2087985 - RNA, 13 nt, Homo sapiens
agaugaacugaga

SEQ ID NO: 2087986 - RNA, 16 nt, Homo sapiens
gcauagcuugcacaac

SEQ ID NO: 2087987 - RNA, 23 nt, Homo sapiens
cucagaacuuucuaguugcccuc

SEQ ID NO: 2087988 - RNA, 21 nt, Homo sapiens
ucacauauacaaguagcuucc

SEQ ID NO: 2087989 - RNA, 15 nt, Homo sapiens
gcgagcccucaggug

SEQ ID NO: 2087990 - RNA, 17 nt, Homo sapiens
aaaggugcuauuuaaca

SEQ ID NO: 2087991 - RNA, 20 nt, Homo sapiens
uaaaauaacuuauaucauca

SEQ ID NO: 2087992 - RNA, 20 nt, Homo sapiens
auuuguaacacagucauucu

SEQ ID NO: 2087993 - RNA, 16 nt, Homo sapiens
acucacugcugugagu

SEQ ID NO: 2087994 - RNA, 21 nt, Homo sapiens
aggcugcccugacccuuccac

SEQ ID NO: 2087995 - RNA, 23 nt, Homo sapiens
aaccauccuuuggggcagcauuc

SEQ ID NO: 2087996 - RNA, 21 nt, Homo sapiens
ucucuaucggggucacuugca

SEQ ID NO: 2087997 - RNA, 12 nt, Homo sapiens
aaccuuuacacu

SEQ ID NO: 2087998 - RNA, 23 nt, Homo sapiens
cacuaaaacuuuccugacuuaca

SEQ ID NO: 2087999 - RNA, 23 nt, Homo sapiens
acgucccgggcacugucaugccc

SEQ ID NO: 2088000 - RNA, 21 nt, Homo sapiens
gaauugauauguauguuguga

SEQ ID NO: 2088001 - RNA, 17 nt, Homo sapiens
caauuguuaaucaaaga

SEQ ID NO: 2088002 - RNA, 17 nt, Homo sapiens
uuguggccucauucagc

SEQ ID NO: 2088003 - RNA, 15 nt, Homo sapiens
acugaggguggagca

SEQ ID NO: 2088004 - RNA, 19 nt, Homo sapiens
cucucuggaaaggauuuuc

SEQ ID NO: 2088005 - RNA, 22 nt, Homo sapiens
ugugauuccuuugaagaggaaa

SEQ ID NO: 2088006 - RNA, 12 nt, Homo sapiens
ucuauacauucc

SEQ ID NO: 2088007 - RNA, 20 nt, Homo sapiens
acaagagaccacuuccuuaa

SEQ ID NO: 2088008 - RNA, 15 nt, Homo sapiens
ccagguuccucaaaa

SEQ ID NO: 2088009 - RNA, 11 nt, Homo sapiens
caccaccacug

SEQ ID NO: 2088010 - RNA, 17 nt, Homo sapiens
ccuggaccccagccuca

SEQ ID NO: 2088011 - RNA, 13 nt, Homo sapiens
cauucugcaauga

SEQ ID NO: 2088012 - RNA, 18 nt, Homo sapiens
ucacuuuuuauuuugcca

SEQ ID NO: 2088013 - RNA, 22 nt, Homo sapiens
acugguagaacguaaccacgga

SEQ ID NO: 2088014 - RNA, 19 nt, Homo sapiens
auccuagagaaaacuugaa

SEQ ID NO: 2088015 - RNA, 17 nt, Homo sapiens
acugaauauauaaacac

SEQ ID NO: 2088016 - RNA, 15 nt, Homo sapiens
ucacucuucaaggag

SEQ ID NO: 2088017 - RNA, 15 nt, Homo sapiens
ugguuccaaagacac

SEQ ID NO: 2088018 - RNA, 15 nt, Homo sapiens
uguuccuaaauauau

SEQ ID NO: 2088019 - RNA, 18 nt, Homo sapiens
gacaaccucauccaggcu

SEQ ID NO: 2088020 - RNA, 22 nt, Homo sapiens
aguuuaagcaaauaaacuguaa

SEQ ID NO: 2088021 - RNA, 24 nt, Homo sapiens
gauuuuguuggugaguagucucau

SEQ ID NO: 2088022 - RNA, 13 nt, Homo sapiens
gcacugcccuccg

SEQ ID NO: 2088023 - RNA, 19 nt, Homo sapiens
uccccagcugguggcccug

SEQ ID NO: 2088024 - RNA, 16 nt, Homo sapiens
gacaucaggugaucca

SEQ ID NO: 2088025 - RNA, 13 nt, Homo sapiens
gucaccuagcuca

SEQ ID NO: 2088026 - RNA, 23 nt, Homo sapiens
uaaaaauuuuuuugcauuuucac

SEQ ID NO: 2088027 - RNA, 21 nt, Homo sapiens
cucaugaaagcagugaagcaa

SEQ ID NO: 2088028 - RNA, 16 nt, Homo sapiens
uaagaaaaacauguca

SEQ ID NO: 2088029 - RNA, 19 nt, Homo sapiens
cuagggagacgccauguga

SEQ ID NO: 2088030 - RNA, 16 nt, Homo sapiens
aacuuugcaaacaaca

SEQ ID NO: 2088031 - RNA, 19 nt, Homo sapiens
gcaugcccagagacccagc

SEQ ID NO: 2088032 - RNA, 16 nt, Homo sapiens
accguaggacccaagc

SEQ ID NO: 2088033 - RNA, 17 nt, Homo sapiens
uaugcauucacauuuag

SEQ ID NO: 2088034 - RNA, 20 nt, Homo sapiens
gggggucuugcuauguugcc

SEQ ID NO: 2088035 - RNA, 20 nt, Homo sapiens
aaagccuuauuuuucaaaag

SEQ ID NO: 2088036 - RNA, 20 nt, Homo sapiens
cgcuccuccuucccagggac

SEQ ID NO: 2088037 - RNA, 22 nt, Homo sapiens
ucgcugacaucuggggcuuuga

SEQ ID NO: 2088038 - RNA, 21 nt, Homo sapiens
gaauauuuuauuuuuuuggca

SEQ ID NO: 2088039 - RNA, 15 nt, Homo sapiens
caaaguagcaccaaa

SEQ ID NO: 2088040 - RNA, 18 nt, Homo sapiens
gccagguugggggcagug

SEQ ID NO: 2088041 - RNA, 19 nt, Homo sapiens
auuguccccuuuuuaguuu

SEQ ID NO: 2088042 - RNA, 14 nt, Homo sapiens
accauuucucagca

SEQ ID NO: 2088043 - RNA, 12 nt, Homo sapiens
ucauccuggcac

SEQ ID NO: 2088044 - RNA, 12 nt, Homo sapiens
cugaugaucauu

SEQ ID NO: 2088045 - RNA, 16 nt, Homo sapiens
ugacaacaucgcaaua

SEQ ID NO: 2088046 - RNA, 15 nt, Homo sapiens
ucacagcccugggga

SEQ ID NO: 2088047 - RNA, 19 nt, Homo sapiens
accaugaauucuggucaca

SEQ ID NO: 2088048 - RNA, 18 nt, Homo sapiens
uauacgugacagaauugu

SEQ ID NO: 2088049 - RNA, 21 nt, Homo sapiens
gagcuagaacccucuguuccu

SEQ ID NO: 2088050 - RNA, 13 nt, Homo sapiens
cauaaagccucug

SEQ ID NO: 2088051 - RNA, 18 nt, Homo sapiens
auuguacaugguacgaau

SEQ ID NO: 2088052 - RNA, 12 nt, Homo sapiens
ccucugcuaaau

SEQ ID NO: 2088053 - RNA, 15 nt, Homo sapiens
cccaggacagccaca

SEQ ID NO: 2088054 - RNA, 15 nt, Homo sapiens
gcccagagcaggguc

SEQ ID NO: 2088055 - RNA, 17 nt, Homo sapiens
uaaaauuuugcaugugc

SEQ ID NO: 2088056 - RNA, 19 nt, Homo sapiens
acacagagcaggacugcac

SEQ ID NO: 2088057 - RNA, 12 nt, Homo sapiens
aaacaauucuga

SEQ ID NO: 2088058 - RNA, 12 nt, Homo sapiens
aagcaauucuaa

SEQ ID NO: 2088059 - RNA, 16 nt, Homo sapiens
uguacauaguguaaug

SEQ ID NO: 2088060 - RNA, 17 nt, Homo sapiens
ggcucuuaggcaaucac

SEQ ID NO: 2088061 - RNA, 16 nt, Homo sapiens
uaacaggugccuuccc

SEQ ID NO: 2088062 - RNA, 22 nt, Homo sapiens
cgaauaugaaugucacauuuga

SEQ ID NO: 2088063 - RNA, 19 nt, Homo sapiens
auaaaaugcaaaugaauca

SEQ ID NO: 2088064 - RNA, 20 nt, Homo sapiens
cacucgccgguuaagacagg

SEQ ID NO: 2088065 - RNA, 17 nt, Homo sapiens
uugcuugucuugauuaa

SEQ ID NO: 2088066 - RNA, 13 nt, Homo sapiens
ccagaggacaaag

SEQ ID NO: 2088067 - RNA, 17 nt, Homo sapiens
uccaugacugcauuuua

SEQ ID NO: 2088068 - RNA, 21 nt, Homo sapiens
uuucucugcaggccacuuacc

SEQ ID NO: 2088069 - RNA, 22 nt, Homo sapiens
cugugaaaugcuggcauuugca

SEQ ID NO: 2088070 - RNA, 17 nt, Homo sapiens
cuauuuuaaguauguga

SEQ ID NO: 2088071 - RNA, 21 nt, Homo sapiens
guacauuucccugugcugacg

SEQ ID NO: 2088072 - RNA, 21 nt, Homo sapiens
gccugauggugcugcucaggc

SEQ ID NO: 2088073 - RNA, 19 nt, Homo sapiens
ugaauuuccccaucugcca

SEQ ID NO: 2088074 - RNA, 12 nt, Homo sapiens
gcauuucuugcg

SEQ ID NO: 2088075 - RNA, 22 nt, Homo sapiens
cguuuccgcugcaguaagccau

SEQ ID NO: 2088076 - RNA, 14 nt, Homo sapiens
gaaagucaaauuca

SEQ ID NO: 2088077 - RNA, 13 nt, Homo sapiens
aagcuucuagagg

SEQ ID NO: 2088078 - RNA, 18 nt, Homo sapiens
cauaaaaaggucuuuaaa

SEQ ID NO: 2088079 - RNA, 15 nt, Homo sapiens
ugagucugcaucuua

SEQ ID NO: 2088080 - RNA, 17 nt, Homo sapiens
aagugucucugccuuga

SEQ ID NO: 2088081 - RNA, 14 nt, Homo sapiens
gaagugcaaugaua

SEQ ID NO: 2088082 - RNA, 18 nt, Homo sapiens
aaggacagugucuucuuu

SEQ ID NO: 2088083 - RNA, 15 nt, Homo sapiens
gcacacuggccucca

SEQ ID NO: 2088084 - RNA, 20 nt, Homo sapiens
ugccacauuuuaaauaaaga

SEQ ID NO: 2088085 - RNA, 18 nt, Homo sapiens
aagagaaguacuaucuuu

SEQ ID NO: 2088086 - RNA, 14 nt, Homo sapiens
cugguguccugacc

SEQ ID NO: 2088087 - RNA, 14 nt, Homo sapiens
guauaugcaguaug

SEQ ID NO: 2088088 - RNA, 22 nt, Homo sapiens
accccagugggaacugugcaaa

SEQ ID NO: 2088089 - RNA, 17 nt, Homo sapiens
uagaugcaugacuugug

SEQ ID NO: 2088090 - RNA, 14 nt, Homo sapiens
gaguauugcugauc

SEQ ID NO: 2088091 - RNA, 23 nt, Homo sapiens
uaaaaagaaagugagcaguguua

SEQ ID NO: 2088092 - RNA, 13 nt, Homo sapiens
cagaaaaccaaag

SEQ ID NO: 2088093 - RNA, 14 nt, Homo sapiens
ugcaucguggagac

SEQ ID NO: 2088094 - RNA, 13 nt, Homo sapiens
agucuucacauuu

SEQ ID NO: 2088095 - RNA, 17 nt, Homo sapiens
gggccugauggugcuca

SEQ ID NO: 2088096 - RNA, 18 nt, Homo sapiens
ccagcaugguugcagaua

SEQ ID NO: 2088097 - RNA, 22 nt, Homo sapiens
gauuccaggaggaguuagccaa

SEQ ID NO: 2088098 - RNA, 20 nt, Homo sapiens
cauggacuuucuugcaugaa

SEQ ID NO: 2088099 - RNA, 12 nt, Homo sapiens
accaaucucuaa

SEQ ID NO: 2088100 - RNA, 14 nt, Homo sapiens
uuauguaaugcaaa

SEQ ID NO: 2088101 - RNA, 22 nt, Homo sapiens
guauaucuagguuuaugacagu

SEQ ID NO: 2088102 - RNA, 19 nt, Homo sapiens
ugaaucuaacagugacuuc

SEQ ID NO: 2088103 - RNA, 15 nt, Homo sapiens
cauacgugucugugu

SEQ ID NO: 2088104 - RNA, 18 nt, Homo sapiens
accuuccaaaccucaaua

SEQ ID NO: 2088105 - RNA, 18 nt, Homo sapiens
aggaguaaguguacaauu

SEQ ID NO: 2088106 - RNA, 20 nt, Homo sapiens
gauagaagauuguuggugaa

SEQ ID NO: 2088107 - RNA, 12 nt, Homo sapiens
aaaagugcacau

SEQ ID NO: 2088108 - RNA, 12 nt, Homo sapiens
caaagugcccau

SEQ ID NO: 2088109 - RNA, 16 nt, Homo sapiens
ccaugaucacuuauca

SEQ ID NO: 2088110 - RNA, 23 nt, Homo sapiens
uuacuuagagaugcuacugucag

SEQ ID NO: 2088111 - RNA, 16 nt, Homo sapiens
gcaccccagcugaccu

SEQ ID NO: 2088112 - RNA, 21 nt, Homo sapiens
gacaugaaaucugaggaaggu

SEQ ID NO: 2088113 - RNA, 22 nt, Homo sapiens
cagcauuuuuauaaacuaccaa

SEQ ID NO: 2088114 - RNA, 16 nt, Homo sapiens
caaucuggagauacua

SEQ ID NO: 2088115 - RNA, 20 nt, Homo sapiens
gagcugggcaccacaggcug

SEQ ID NO: 2088116 - RNA, 18 nt, Homo sapiens
augaaucucguucccaaa

SEQ ID NO: 2088117 - RNA, 21 nt, Homo sapiens
ccacgaggagcuuccagugca

SEQ ID NO: 2088118 - RNA, 16 nt, Homo sapiens
caagucacacgcuuuu

SEQ ID NO: 2088119 - RNA, 21 nt, Homo sapiens
acaauacccaccucuguggau

SEQ ID NO: 2088120 - RNA, 16 nt, Homo sapiens
guauaugcuauucaau

SEQ ID NO: 2088121 - RNA, 16 nt, Homo sapiens
guugcuuuuacuucuc

SEQ ID NO: 2088122 - RNA, 12 nt, Homo sapiens
aaaugcacugua

SEQ ID NO: 2088123 - RNA, 22 nt, Homo sapiens
aacuugauggcuaacuuacaaa

SEQ ID NO: 2088124 - RNA, 18 nt, Homo sapiens
cacuagcugucucaggag

SEQ ID NO: 2088125 - RNA, 12 nt, Homo sapiens
uaaaugggaccc

SEQ ID NO: 2088126 - RNA, 21 nt, Homo sapiens
cacugucuauuuaagugcaau

SEQ ID NO: 2088127 - RNA, 17 nt, Homo sapiens
uacgaggcuucucuaac

SEQ ID NO: 2088128 - RNA, 17 nt, Homo sapiens
gguuucucucccuccuu

SEQ ID NO: 2088129 - RNA, 15 nt, Homo sapiens
gguucgagacuccau

SEQ ID NO: 2088130 - RNA, 22 nt, Homo sapiens
cccugcugaccucccagugacc

SEQ ID NO: 2088131 - RNA, 17 nt, Homo sapiens
agugagugugugugcuu

SEQ ID NO: 2088132 - RNA, 14 nt, Homo sapiens
caaauacaauucaa

SEQ ID NO: 2088133 - RNA, 23 nt, Homo sapiens
caggggcugucccggaggcggug

SEQ ID NO: 2088134 - RNA, 15 nt, Homo sapiens
gaccauucauaccca

SEQ ID NO: 2088135 - RNA, 16 nt, Homo sapiens
ucccacuccugcugca

SEQ ID NO: 2088136 - RNA, 22 nt, Homo sapiens
guccccuuuucuuuucuacccu

SEQ ID NO: 2088137 - RNA, 20 nt, Homo sapiens
uaagcagcaaauaaacaacu

SEQ ID NO: 2088138 - RNA, 15 nt, Homo sapiens
aaggauaugauuaau

SEQ ID NO: 2088139 - RNA, 18 nt, Homo sapiens
augaaucaacaaaccaca

SEQ ID NO: 2088140 - RNA, 19 nt, Homo sapiens
aggaguguccucuucccuc

SEQ ID NO: 2088141 - RNA, 16 nt, Homo sapiens
aaggcccacuguccag

SEQ ID NO: 2088142 - RNA, 19 nt, Homo sapiens
auggcguggucaagcacuc

SEQ ID NO: 2088143 - RNA, 15 nt, Homo sapiens
ggaucccuacugcca

SEQ ID NO: 2088144 - RNA, 12 nt, Homo sapiens
guaagugcugcu

SEQ ID NO: 2088145 - RNA, 13 nt, Homo sapiens
cauggugccccua

SEQ ID NO: 2088146 - RNA, 14 nt, Homo sapiens
guaaucuaaguaua

SEQ ID NO: 2088147 - RNA, 12 nt, Homo sapiens
agauguauuaaa

SEQ ID NO: 2088148 - RNA, 20 nt, Homo sapiens
guccuggacccuggccuaaa

SEQ ID NO: 2088149 - RNA, 17 nt, Homo sapiens
ugaauauccccucccag

SEQ ID NO: 2088150 - RNA, 22 nt, Homo sapiens
gagagggugugggugcccuguu

SEQ ID NO: 2088151 - RNA, 15 nt, Homo sapiens
uaguagaauuuacaa

SEQ ID NO: 2088152 - RNA, 17 nt, Homo sapiens
ugaucucucuagcuuug

SEQ ID NO: 2088153 - RNA, 22 nt, Homo sapiens
acaaacauaucaaacauaugua

SEQ ID NO: 2088154 - RNA, 21 nt, Homo sapiens
cuagucacuaccuucaugcau

SEQ ID NO: 2088155 - RNA, 21 nt, Homo sapiens
gggacaucaaaaacagcagaa

SEQ ID NO: 2088156 - RNA, 18 nt, Homo sapiens
gaaacuauauguauucac

SEQ ID NO: 2088157 - RNA, 17 nt, Homo sapiens
uggcuaaaagacaugca

SEQ ID NO: 2088158 - RNA, 13 nt, Homo sapiens
cuguuccacagug

SEQ ID NO: 2088159 - RNA, 21 nt, Homo sapiens
cuagggcuggagggacaggga

SEQ ID NO: 2088160 - RNA, 19 nt, Homo sapiens
ggacuauuuaugaaggcaa

SEQ ID NO: 2088161 - RNA, 13 nt, Homo sapiens
ccaaaucuugcca

SEQ ID NO: 2088162 - RNA, 20 nt, Homo sapiens
aaaguugugaucuguuguaa

SEQ ID NO: 2088163 - RNA, 17 nt, Homo sapiens
uaccaguauaagcaucu

SEQ ID NO: 2088164 - RNA, 20 nt, Homo sapiens
gccuugauugguguugccag

SEQ ID NO: 2088165 - RNA, 19 nt, Homo sapiens
augaacacacauggaugca

SEQ ID NO: 2088166 - RNA, 15 nt, Homo sapiens
ugcuggucauggaau

SEQ ID NO: 2088167 - RNA, 12 nt, Homo sapiens
uguuuccaggag

SEQ ID NO: 2088168 - RNA, 12 nt, Homo sapiens
augucacugcuu

SEQ ID NO: 2088169 - RNA, 23 nt, Homo sapiens
aucuuuggggaaacuaacaauau

SEQ ID NO: 2088170 - RNA, 10 nt, Homo sapiens
ucaacugagg

SEQ ID NO: 2088171 - RNA, 17 nt, Homo sapiens
acuucuccccucaagaa

SEQ ID NO: 2088172 - RNA, 19 nt, Homo sapiens
cagcuggacccauuugcca

SEQ ID NO: 2088173 - RNA, 19 nt, Homo sapiens
ccauggugagcucugggaa

SEQ ID NO: 2088174 - RNA, 13 nt, Homo sapiens
auuuuagacuuuu

SEQ ID NO: 2088175 - RNA, 17 nt, Homo sapiens
agugugggcauagcauu

SEQ ID NO: 2088176 - RNA, 14 nt, Homo sapiens
augaguuacuugaa

SEQ ID NO: 2088177 - RNA, 14 nt, Homo sapiens
uugagguuuccaca

SEQ ID NO: 2088178 - RNA, 20 nt, Homo sapiens
uaaugucacaauuaugugca

SEQ ID NO: 2088179 - RNA, 16 nt, Homo sapiens
uaaaugaguaguuugu

SEQ ID NO: 2088180 - RNA, 22 nt, Homo sapiens
cacccucccccgccacuccuga

SEQ ID NO: 2088181 - RNA, 20 nt, Homo sapiens
aaaguguuaaggaauaggga

SEQ ID NO: 2088182 - RNA, 15 nt, Homo sapiens
gcgccuccagagguc

SEQ ID NO: 2088183 - RNA, 15 nt, Homo sapiens
gggccaucacaggau

SEQ ID NO: 2088184 - RNA, 11 nt, Homo sapiens
cccacauucua

SEQ ID NO: 2088185 - RNA, 16 nt, Homo sapiens
uuagcuugcacaugaa

SEQ ID NO: 2088186 - RNA, 16 nt, Homo sapiens
agcucccauuucuacu

SEQ ID NO: 2088187 - RNA, 19 nt, Homo sapiens
caggaaggaaaaugugaac

SEQ ID NO: 2088188 - RNA, 19 nt, Homo sapiens
uauauuuauauauauccag

SEQ ID NO: 2088189 - RNA, 21 nt, Homo sapiens
guucuuguaaauccaacacaa

SEQ ID NO: 2088190 - RNA, 14 nt, Homo sapiens
uguucggagcucuu

SEQ ID NO: 2088191 - RNA, 21 nt, Homo sapiens
ucccaccauuccugccuuuaa

SEQ ID NO: 2088192 - RNA, 16 nt, Homo sapiens
aagcugaccccaaaga

SEQ ID NO: 2088193 - RNA, 17 nt, Homo sapiens
ucacuguguuacugcuu

SEQ ID NO: 2088194 - RNA, 18 nt, Homo sapiens
uaaaguaauuuugugaaa

SEQ ID NO: 2088195 - RNA, 22 nt, Homo sapiens
cagcauaccaauuacccauaaa

SEQ ID NO: 2088196 - RNA, 15 nt, Homo sapiens
agauguuaaugggga

SEQ ID NO: 2088197 - RNA, 13 nt, Homo sapiens
gcacaaucucagc

SEQ ID NO: 2088198 - RNA, 15 nt, Homo sapiens
ccucuucccaugacu

SEQ ID NO: 2088199 - RNA, 15 nt, Homo sapiens
ucagaguugugcaca

SEQ ID NO: 2088200 - RNA, 21 nt, Homo sapiens
uuuuauauauuaugucauuca

SEQ ID NO: 2088201 - RNA, 22 nt, Homo sapiens
ucaucccaugggcgaccagggc

SEQ ID NO: 2088202 - RNA, 16 nt, Homo sapiens
ugcuuccaguccugag

SEQ ID NO: 2088203 - RNA, 20 nt, Homo sapiens
gauuacaggugcgcacuacc

SEQ ID NO: 2088204 - RNA, 20 nt, Homo sapiens
ugcuuccugucccacuacug

SEQ ID NO: 2088205 - RNA, 23 nt, Homo sapiens
cgaggcccuuggcgggcacgggu

SEQ ID NO: 2088206 - RNA, 14 nt, Homo sapiens
aucauagguacaau

SEQ ID NO: 2088207 - RNA, 20 nt, Homo sapiens
uuaaacuguguggacuguga

SEQ ID NO: 2088208 - RNA, 20 nt, Homo sapiens
ggaaaaucuuuauaugcagu

SEQ ID NO: 2088209 - RNA, 20 nt, Homo sapiens
gucuggggcagcagagccau

SEQ ID NO: 2088210 - RNA, 19 nt, Homo sapiens
auuucccaccgcuuuguga

SEQ ID NO: 2088211 - RNA, 17 nt, Homo sapiens
ugagaguuuacuuuuau

SEQ ID NO: 2088212 - RNA, 19 nt, Homo sapiens
ucacguucuggaacauucu

SEQ ID NO: 2088213 - RNA, 19 nt, Homo sapiens
uucagcuucuaugcauuaa

SEQ ID NO: 2088214 - RNA, 22 nt, Homo sapiens
uucuguagcuuguucccugucu

SEQ ID NO: 2088215 - RNA, 13 nt, Homo sapiens
uaacaucaaagau

SEQ ID NO: 2088216 - RNA, 13 nt, Homo sapiens
augcaucauuaau

SEQ ID NO: 2088217 - RNA, 20 nt, Homo sapiens
acauuuuugucuuuaucuca

SEQ ID NO: 2088218 - RNA, 14 nt, Homo sapiens
acaggcgaggaccc

SEQ ID NO: 2088219 - RNA, 16 nt, Homo sapiens
aucuacauacaaacaa

SEQ ID NO: 2088220 - RNA, 19 nt, Homo sapiens
ccuccagccaauaggcagc

SEQ ID NO: 2088221 - RNA, 23 nt, Homo sapiens
gcaggggcugggcagaggggaga

SEQ ID NO: 2088222 - RNA, 16 nt, Homo sapiens
uggacugauaaucucu

SEQ ID NO: 2088223 - RNA, 18 nt, Homo sapiens
uaagaguagauugauuca

SEQ ID NO: 2088224 - RNA, 17 nt, Homo sapiens
ccaggggagacaucgca

SEQ ID NO: 2088225 - RNA, 15 nt, Homo sapiens
gcacagauuaaacuu

SEQ ID NO: 2088226 - RNA, 18 nt, Homo sapiens
uuagguugucuccaggcc

SEQ ID NO: 2088227 - RNA, 16 nt, Homo sapiens
ccugcugccccagcug

SEQ ID NO: 2088228 - RNA, 22 nt, Homo sapiens
cagaugugucugggagagccug

SEQ ID NO: 2088229 - RNA, 11 nt, Homo sapiens
gcagguugcuu

SEQ ID NO: 2088230 - RNA, 16 nt, Homo sapiens
cugagacacaugggug

SEQ ID NO: 2088231 - RNA, 20 nt, Homo sapiens
uacuucaugagcauucauaa

SEQ ID NO: 2088232 - RNA, 19 nt, Homo sapiens
cugaccuuccaaaccucaa

SEQ ID NO: 2088233 - RNA, 14 nt, Homo sapiens
aaacuuauuucaag

SEQ ID NO: 2088234 - RNA, 17 nt, Homo sapiens
uuuuuaauuuaguguga

SEQ ID NO: 2088235 - RNA, 18 nt, Homo sapiens
uacaggccuccucgggag

SEQ ID NO: 2088236 - RNA, 13 nt, Homo sapiens
cuauucuauugca

SEQ ID NO: 2088237 - RNA, 13 nt, Homo sapiens
ggcugugccaacc

SEQ ID NO: 2088238 - RNA, 22 nt, Homo sapiens
uugauaagagggcacacacugu

SEQ ID NO: 2088239 - RNA, 17 nt, Homo sapiens
ccaaacagaacuaugga

SEQ ID NO: 2088240 - RNA, 19 nt, Homo sapiens
ugaaaagggaugauguggu

SEQ ID NO: 2088241 - RNA, 14 nt, Homo sapiens
cuagaaaguaauac

SEQ ID NO: 2088242 - RNA, 21 nt, Homo sapiens
cauuuuaggcaaauguuuaaa

SEQ ID NO: 2088243 - RNA, 18 nt, Homo sapiens
uauuucauauuaugaaag

SEQ ID NO: 2088244 - RNA, 23 nt, Homo sapiens
cugagcgugaugaucuagccucc

SEQ ID NO: 2088245 - RNA, 17 nt, Homo sapiens
auugaaugauaauucag

SEQ ID NO: 2088246 - RNA, 12 nt, Homo sapiens
uauuaagauaug

SEQ ID NO: 2088247 - RNA, 21 nt, Homo sapiens
cgugcagcagcaacacaaugu

SEQ ID NO: 2088248 - RNA, 14 nt, Homo sapiens
cuuguuuugccagu

SEQ ID NO: 2088249 - RNA, 20 nt, Homo sapiens
agcaaucgguuccccagauu

SEQ ID NO: 2088250 - RNA, 20 nt, Homo sapiens
cuccaaccccugcccuuccu

SEQ ID NO: 2088251 - RNA, 20 nt, Homo sapiens
ugguuccauuguuuggagac

SEQ ID NO: 2088252 - RNA, 18 nt, Homo sapiens
acugacggaguccugugu

SEQ ID NO: 2088253 - RNA, 19 nt, Homo sapiens
uaggcaugugcaauuuguc

SEQ ID NO: 2088254 - RNA, 15 nt, Homo sapiens
agucaaugucaauga

SEQ ID NO: 2088255 - RNA, 16 nt, Homo sapiens
aguucuaagauucuga

SEQ ID NO: 2088256 - RNA, 16 nt, Homo sapiens
agugcagugaugcaau

SEQ ID NO: 2088257 - RNA, 23 nt, Homo sapiens
accacugguuaaaauaaagccua

SEQ ID NO: 2088258 - RNA, 18 nt, Homo sapiens
auggacaucuugucauuu

SEQ ID NO: 2088259 - RNA, 14 nt, Homo sapiens
gagggcaaacccaa

SEQ ID NO: 2088260 - RNA, 17 nt, Homo sapiens
uaaaguuguugcauucc

SEQ ID NO: 2088261 - RNA, 15 nt, Homo sapiens
uaggagcuuacugaa

SEQ ID NO: 2088262 - RNA, 19 nt, Homo sapiens
acugaaggagaaggugccc

SEQ ID NO: 2088263 - RNA, 21 nt, Homo sapiens
cugcugugcccucccauagca

SEQ ID NO: 2088264 - RNA, 17 nt, Homo sapiens
acacacuuuccaucucu

SEQ ID NO: 2088265 - RNA, 17 nt, Homo sapiens
ugccagcaggaggaaug

SEQ ID NO: 2088266 - RNA, 19 nt, Homo sapiens
cagucuucugucagcagua

SEQ ID NO: 2088267 - RNA, 17 nt, Homo sapiens
ccuuuugaacuugucac

SEQ ID NO: 2088268 - RNA, 16 nt, Homo sapiens
gaggcaggaccaggca

SEQ ID NO: 2088269 - RNA, 21 nt, Homo sapiens
ucuguaucagaaaugaaacag

SEQ ID NO: 2088270 - RNA, 17 nt, Homo sapiens
uuccaucauguccccaa

SEQ ID NO: 2088271 - RNA, 15 nt, Homo sapiens
cccaggcugggugca

SEQ ID NO: 2088272 - RNA, 17 nt, Homo sapiens
ugcuguuuauacuugag

SEQ ID NO: 2088273 - RNA, 15 nt, Homo sapiens
guuguacaaucaaaa

SEQ ID NO: 2088274 - RNA, 14 nt, Homo sapiens
ugaacuaacugaca

SEQ ID NO: 2088275 - RNA, 17 nt, Homo sapiens
auaagaaagaucaaaga

SEQ ID NO: 2088276 - RNA, 23 nt, Homo sapiens
ugacuuuucaccuuaaugcauau

SEQ ID NO: 2088277 - RNA, 22 nt, Homo sapiens
ugaagaggccaaaggaaugucc

SEQ ID NO: 2088278 - RNA, 17 nt, Homo sapiens
uaauauuaauuuccacu

SEQ ID NO: 2088279 - RNA, 22 nt, Homo sapiens
augauaaaauaaguaacauaua

SEQ ID NO: 2088280 - RNA, 20 nt, Homo sapiens
uaacauugggaaaucuuaua

SEQ ID NO: 2088281 - RNA, 22 nt, Homo sapiens
caaaucugucuccccagaagac

SEQ ID NO: 2088282 - RNA, 21 nt, Homo sapiens
uucugaggguccacuacucaa

SEQ ID NO: 2088283 - RNA, 19 nt, Homo sapiens
ucuuggccucaaguucaau

SEQ ID NO: 2088284 - RNA, 23 nt, Homo sapiens
gaaggaccuccugagcgaugacu

SEQ ID NO: 2088285 - RNA, 21 nt, Homo sapiens
gucuuacuguugcauaacuau

SEQ ID NO: 2088286 - RNA, 18 nt, Homo sapiens
accuacuuacaugcauua

SEQ ID NO: 2088287 - RNA, 20 nt, Homo sapiens
gaaaaaugcugcuucuccuc

SEQ ID NO: 2088288 - RNA, 16 nt, Homo sapiens
agugguaguaauuucc

SEQ ID NO: 2088289 - RNA, 19 nt, Homo sapiens
gacaugaaaggacccugug

SEQ ID NO: 2088290 - RNA, 18 nt, Homo sapiens
uuccucuccacugcugga

SEQ ID NO: 2088291 - RNA, 23 nt, Homo sapiens
cuucucacucccuucuccuugau

SEQ ID NO: 2088292 - RNA, 18 nt, Homo sapiens
cuaguggccgaaccagaa

SEQ ID NO: 2088293 - RNA, 15 nt, Homo sapiens
caagucaacacucuu

SEQ ID NO: 2088294 - RNA, 16 nt, Homo sapiens
cuugcugaugaaaugg

SEQ ID NO: 2088295 - RNA, 17 nt, Homo sapiens
gaauauauaugaugaaa

SEQ ID NO: 2088296 - RNA, 17 nt, Homo sapiens
caggcacacaggucuca

SEQ ID NO: 2088297 - RNA, 19 nt, Homo sapiens
ccgcgcaucagacugugaa

SEQ ID NO: 2088298 - RNA, 14 nt, Homo sapiens
ugagugccacaaaa

SEQ ID NO: 2088299 - RNA, 13 nt, Homo sapiens
gucaauggaagaa

SEQ ID NO: 2088300 - RNA, 16 nt, Homo sapiens
auugggaguccaggca

SEQ ID NO: 2088301 - RNA, 15 nt, Homo sapiens
cgggaggcugagaca

SEQ ID NO: 2088302 - RNA, 21 nt, Homo sapiens
acacucuugaaaaaugcaugu

SEQ ID NO: 2088303 - RNA, 17 nt, Homo sapiens
caaaagaugccauucau

SEQ ID NO: 2088304 - RNA, 13 nt, Homo sapiens
ugugagcaaaaau

SEQ ID NO: 2088305 - RNA, 21 nt, Homo sapiens
gcccgugcccccgccugccac

SEQ ID NO: 2088306 - RNA, 15 nt, Homo sapiens
uccucugcagccuga

SEQ ID NO: 2088307 - RNA, 21 nt, Homo sapiens
agaaaucacaauuuuccugug

SEQ ID NO: 2088308 - RNA, 20 nt, Homo sapiens
uuugaugauuaauucaccuu

SEQ ID NO: 2088309 - RNA, 13 nt, Homo sapiens
cuuuuccuuugaa

SEQ ID NO: 2088310 - RNA, 22 nt, Homo sapiens
aaagcaauuauauuguccuccc

SEQ ID NO: 2088311 - RNA, 20 nt, Homo sapiens
gguaccaagcugcugggugc

SEQ ID NO: 2088312 - RNA, 12 nt, Homo sapiens
ucacuguacugc

SEQ ID NO: 2088313 - RNA, 13 nt, Homo sapiens
gagacaacaguac

SEQ ID NO: 2088314 - RNA, 17 nt, Homo sapiens
gcccuugucagauucac

SEQ ID NO: 2088315 - RNA, 21 nt, Homo sapiens
cuauguuuccccccuuuucag

SEQ ID NO: 2088316 - RNA, 23 nt, Homo sapiens
cuuugccccugagacaaauggag

SEQ ID NO: 2088317 - RNA, 16 nt, Homo sapiens
cauuugguugcuacug

SEQ ID NO: 2088318 - RNA, 13 nt, Homo sapiens
agaacccuuccug

SEQ ID NO: 2088319 - RNA, 17 nt, Homo sapiens
cauuucuggacaugacg

SEQ ID NO: 2088320 - RNA, 19 nt, Homo sapiens
ucugagacccuuuucucag

SEQ ID NO: 2088321 - RNA, 17 nt, Homo sapiens
acuucuaauuauuccaa

SEQ ID NO: 2088322 - RNA, 21 nt, Homo sapiens
ggggaaaacagaccgugaaca

SEQ ID NO: 2088323 - RNA, 17 nt, Homo sapiens
cugccugucccagagag

SEQ ID NO: 2088324 - RNA, 17 nt, Homo sapiens
gcaccuuaguugcauga

SEQ ID NO: 2088325 - RNA, 13 nt, Homo sapiens
uuuucacacugau

SEQ ID NO: 2088326 - RNA, 14 nt, Homo sapiens
gcacagcaucucag

SEQ ID NO: 2088327 - RNA, 21 nt, Homo sapiens
cggcgcccaccacccccucaa

SEQ ID NO: 2088328 - RNA, 14 nt, Homo sapiens
acuucuugucagac

SEQ ID NO: 2088329 - RNA, 11 nt, Homo sapiens
gcucauuucag

SEQ ID NO: 2088330 - RNA, 19 nt, Homo sapiens
aauuaagacuugugcauga

SEQ ID NO: 2088331 - RNA, 15 nt, Homo sapiens
aaaauaaauguacau

SEQ ID NO: 2088332 - RNA, 18 nt, Homo sapiens
aauguuaagauuuaucug

SEQ ID NO: 2088333 - RNA, 21 nt, Homo sapiens
uuuacauacguuuguguggug

SEQ ID NO: 2088334 - RNA, 23 nt, Homo sapiens
gcuuuaaugagugcaccugccuc

SEQ ID NO: 2088335 - RNA, 18 nt, Homo sapiens
auuaguugucuuuccaug

SEQ ID NO: 2088336 - RNA, 13 nt, Homo sapiens
aucccuuacucca

SEQ ID NO: 2088337 - RNA, 21 nt, Homo sapiens
auccaaggaaauaaugugaau

SEQ ID NO: 2088338 - RNA, 20 nt, Homo sapiens
uuuacuuuuaccacuauuua

SEQ ID NO: 2088339 - RNA, 17 nt, Homo sapiens
agggcugcuuaggucuc

SEQ ID NO: 2088340 - RNA, 18 nt, Homo sapiens
cugucauuuuuaacagca

SEQ ID NO: 2088341 - RNA, 16 nt, Homo sapiens
ucugugaaauucucag

SEQ ID NO: 2088342 - RNA, 18 nt, Homo sapiens
cugcuuuuaacucuagaa

SEQ ID NO: 2088343 - RNA, 11 nt, Homo sapiens
agaacugccau

SEQ ID NO: 2088344 - RNA, 12 nt, Homo sapiens
cuggauggggca

SEQ ID NO: 2088345 - RNA, 17 nt, Homo sapiens
ccaggcucccugaccac

SEQ ID NO: 2088346 - RNA, 16 nt, Homo sapiens
cccucaccagccuugg

SEQ ID NO: 2088347 - RNA, 22 nt, Homo sapiens
ccugagagggagagacugcaau

SEQ ID NO: 2088348 - RNA, 13 nt, Homo sapiens
ugcugaaugcagg

SEQ ID NO: 2088349 - RNA, 20 nt, Homo sapiens
aggaacccuccuccugucaa

SEQ ID NO: 2088350 - RNA, 17 nt, Homo sapiens
cacagagcuacauggug

SEQ ID NO: 2088351 - RNA, 16 nt, Homo sapiens
cugggggcagcugucc

SEQ ID NO: 2088352 - RNA, 14 nt, Homo sapiens
aaugauuagcacuu

SEQ ID NO: 2088353 - RNA, 14 nt, Homo sapiens
ucucaggguucuga

SEQ ID NO: 2088354 - RNA, 17 nt, Homo sapiens
uaccuguccaagacagg

SEQ ID NO: 2088355 - RNA, 17 nt, Homo sapiens
aauuuggaucuauuuau

SEQ ID NO: 2088356 - RNA, 14 nt, Homo sapiens
ccucagugacauca

SEQ ID NO: 2088357 - RNA, 22 nt, Homo sapiens
uauauggacuuucuugcaagca

SEQ ID NO: 2088358 - RNA, 12 nt, Homo sapiens
ucugguacaaag

SEQ ID NO: 2088359 - RNA, 21 nt, Homo sapiens
uaaucuccacccaaugaauga

SEQ ID NO: 2088360 - RNA, 18 nt, Homo sapiens
gagccuggggcacuccuc

SEQ ID NO: 2088361 - RNA, 17 nt, Homo sapiens
uaaugaaaaacuauguc

SEQ ID NO: 2088362 - RNA, 19 nt, Homo sapiens
agauggcagguuugcaauc

SEQ ID NO: 2088363 - RNA, 15 nt, Homo sapiens
ggccagcacuuccau

SEQ ID NO: 2088364 - RNA, 20 nt, Homo sapiens
agaaaaggaaauaugaucca

SEQ ID NO: 2088365 - RNA, 17 nt, Homo sapiens
gucacucacauugagag

SEQ ID NO: 2088366 - RNA, 16 nt, Homo sapiens
caccacagucccucac

SEQ ID NO: 2088367 - RNA, 13 nt, Homo sapiens
cagggcauugcuc

SEQ ID NO: 2088368 - RNA, 20 nt, Homo sapiens
aaaauagcuuugcagugaaa

SEQ ID NO: 2088369 - RNA, 17 nt, Homo sapiens
ugaaagaaccaaaagag

SEQ ID NO: 2088370 - RNA, 23 nt, Homo sapiens
guggguaacgugagaagauagaa

SEQ ID NO: 2088371 - RNA, 21 nt, Homo sapiens
uuuucacugcuggcugccuua

SEQ ID NO: 2088372 - RNA, 20 nt, Homo sapiens
ugcaggauccuugccuccaa

SEQ ID NO: 2088373 - RNA, 15 nt, Homo sapiens
gaaaacccacaccca

SEQ ID NO: 2088374 - RNA, 22 nt, Homo sapiens
aucaucuauaaagaagaacuug

SEQ ID NO: 2088375 - RNA, 19 nt, Homo sapiens
cacacacgaugcauuuaau

SEQ ID NO: 2088376 - RNA, 23 nt, Homo sapiens
aaugccgguguuuuaaguggaaa

SEQ ID NO: 2088377 - RNA, 16 nt, Homo sapiens
cuuauggcuucacuua

SEQ ID NO: 2088378 - RNA, 16 nt, Homo sapiens
cuuacugcuucaugua

SEQ ID NO: 2088379 - RNA, 18 nt, Homo sapiens
uauuuuuaaaaguauaca

SEQ ID NO: 2088380 - RNA, 14 nt, Homo sapiens
agagcuucccugac

SEQ ID NO: 2088381 - RNA, 21 nt, Homo sapiens
augucaauaaaaccacuguac

SEQ ID NO: 2088382 - RNA, 22 nt, Homo sapiens
uuuaaauguuauauacaucuca

SEQ ID NO: 2088383 - RNA, 17 nt, Homo sapiens
gguuaauucauuggaau

SEQ ID NO: 2088384 - RNA, 22 nt, Homo sapiens
auuuuuagcucuguacuccuaa

SEQ ID NO: 2088385 - RNA, 23 nt, Homo sapiens
aucuguuugugcaaacauaauac

SEQ ID NO: 2088386 - RNA, 18 nt, Homo sapiens
gacaaucuagcucuccau

SEQ ID NO: 2088387 - RNA, 19 nt, Homo sapiens
accuuaaaaauuagaacuu

SEQ ID NO: 2088388 - RNA, 18 nt, Homo sapiens
auuggaauuaaccuggug

SEQ ID NO: 2088389 - RNA, 18 nt, Homo sapiens
uauuauagucuguacuuc

SEQ ID NO: 2088390 - RNA, 18 nt, Homo sapiens
ucagaaaguaauuucuuc

SEQ ID NO: 2088391 - RNA, 19 nt, Homo sapiens
uugcaagacccucccaugg

SEQ ID NO: 2088392 - RNA, 14 nt, Homo sapiens
guccagucugugau

SEQ ID NO: 2088393 - RNA, 21 nt, Homo sapiens
gggaacccaacagucaugacc

SEQ ID NO: 2088394 - RNA, 23 nt, Homo sapiens
caaugacuuuuaauuuucacuuu

SEQ ID NO: 2088395 - RNA, 14 nt, Homo sapiens
ugggaaauuacuua

SEQ ID NO: 2088396 - RNA, 19 nt, Homo sapiens
aaugauuggaauauuacaa

SEQ ID NO: 2088397 - RNA, 21 nt, Homo sapiens
uauaggugcuacaaaaacaca

SEQ ID NO: 2088398 - RNA, 16 nt, Homo sapiens
acaggagucuuuguaa

SEQ ID NO: 2088399 - RNA, 20 nt, Homo sapiens
aagcagagugauucaggggc

SEQ ID NO: 2088400 - RNA, 14 nt, Homo sapiens
ugaaucaccuggcu

SEQ ID NO: 2088401 - RNA, 16 nt, Homo sapiens
uccccaacgaaaagca

SEQ ID NO: 2088402 - RNA, 16 nt, Homo sapiens
gaguacucacuuuuca

SEQ ID NO: 2088403 - RNA, 16 nt, Homo sapiens
agggguguguguaugu

SEQ ID NO: 2088404 - RNA, 18 nt, Homo sapiens
cuuaaaaccugcuuuuca

SEQ ID NO: 2088405 - RNA, 18 nt, Homo sapiens
cagaaauuaaucuuacaa

SEQ ID NO: 2088406 - RNA, 16 nt, Homo sapiens
auucauuuauuugaca

SEQ ID NO: 2088407 - RNA, 22 nt, Homo sapiens
aacuuuuuuuuaguauuugccc

SEQ ID NO: 2088408 - RNA, 10 nt, Homo sapiens
ccaaagggac

SEQ ID NO: 2088409 - RNA, 17 nt, Homo sapiens
aauuuuaagcuguacac

SEQ ID NO: 2088410 - RNA, 17 nt, Homo sapiens
cauggcugccaucucac

SEQ ID NO: 2088411 - RNA, 19 nt, Homo sapiens
gcuauguuuccaucuucag

SEQ ID NO: 2088412 - RNA, 23 nt, Homo sapiens
acguggugaccucacacaccucu

SEQ ID NO: 2088413 - RNA, 22 nt, Homo sapiens
gggcuacgguuccauguucacc

SEQ ID NO: 2088414 - RNA, 22 nt, Homo sapiens
uaaguaaaauccccuucgcuga

SEQ ID NO: 2088415 - RNA, 15 nt, Homo sapiens
gaguguuauugcaug

SEQ ID NO: 2088416 - RNA, 18 nt, Homo sapiens
guaaugcgugcaguuccu

SEQ ID NO: 2088417 - RNA, 17 nt, Homo sapiens
agucacucacuauugca

SEQ ID NO: 2088418 - RNA, 22 nt, Homo sapiens
cuguuccuggaggucagcauuu

SEQ ID NO: 2088419 - RNA, 17 nt, Homo sapiens
agauugugaauauuucc

SEQ ID NO: 2088420 - RNA, 20 nt, Homo sapiens
ccaaguccuauccuaaauaa

SEQ ID NO: 2088421 - RNA, 15 nt, Homo sapiens
aucacaccuaaucuu

SEQ ID NO: 2088422 - RNA, 22 nt, Homo sapiens
agucuggcaaugggacucugag

SEQ ID NO: 2088423 - RNA, 15 nt, Homo sapiens
guucccucacagcaa

SEQ ID NO: 2088424 - RNA, 19 nt, Homo sapiens
agaguguuaucagucauaa

SEQ ID NO: 2088425 - RNA, 15 nt, Homo sapiens
caagcuucccaagua

SEQ ID NO: 2088426 - RNA, 22 nt, Homo sapiens
gagccaagucauuaaaauggaa

SEQ ID NO: 2088427 - RNA, 19 nt, Homo sapiens
ccacagacgggcacacaga

SEQ ID NO: 2088428 - RNA, 20 nt, Homo sapiens
gucauagaauagcauguugu

SEQ ID NO: 2088429 - RNA, 16 nt, Homo sapiens
cccaaccuucuuguca

SEQ ID NO: 2088430 - RNA, 20 nt, Homo sapiens
cgccccccccuccccaugca

SEQ ID NO: 2088431 - RNA, 15 nt, Homo sapiens
ucagggccaguccuc

SEQ ID NO: 2088432 - RNA, 15 nt, Homo sapiens
cguacuagaauucaa

SEQ ID NO: 2088433 - RNA, 16 nt, Homo sapiens
auggggacugggugca

SEQ ID NO: 2088434 - RNA, 16 nt, Homo sapiens
ugggggaaauggugcc

SEQ ID NO: 2088435 - RNA, 16 nt, Homo sapiens
uuucccaacaccucuu

SEQ ID NO: 2088436 - RNA, 17 nt, Homo sapiens
ccaucagcccaucucaa

SEQ ID NO: 2088437 - RNA, 18 nt, Homo sapiens
uuuauacuucaaauguca

SEQ ID NO: 2088438 - RNA, 21 nt, Homo sapiens
aggauuugaaccaugaaguca

SEQ ID NO: 2088439 - RNA, 16 nt, Homo sapiens
aauccacuauuuccau

SEQ ID NO: 2088440 - RNA, 22 nt, Homo sapiens
aucccagcuacucagguggcua

SEQ ID NO: 2088441 - RNA, 13 nt, Homo sapiens
uauuauuguggaa

SEQ ID NO: 2088442 - RNA, 20 nt, Homo sapiens
aguauguccuucagcugacu

SEQ ID NO: 2088443 - RNA, 22 nt, Homo sapiens
cagggaacggaaagaagagaga

SEQ ID NO: 2088444 - RNA, 17 nt, Homo sapiens
uaaucaacauggcuacu

SEQ ID NO: 2088445 - RNA, 16 nt, Homo sapiens
uccuacuaaaucccuc

SEQ ID NO: 2088446 - RNA, 19 nt, Homo sapiens
ugauauaacacuuuccagc

SEQ ID NO: 2088447 - RNA, 18 nt, Homo sapiens
caugcaccuguagucuca

SEQ ID NO: 2088448 - RNA, 14 nt, Homo sapiens
cugaccuguguucc

SEQ ID NO: 2088449 - RNA, 18 nt, Homo sapiens
agaugaggcuuuccaugg

SEQ ID NO: 2088450 - RNA, 20 nt, Homo sapiens
aaacuccugaccucagguga

SEQ ID NO: 2088451 - RNA, 13 nt, Homo sapiens
gucaugggguccc

SEQ ID NO: 2088452 - RNA, 20 nt, Homo sapiens
cagugcauguugccaugagg

SEQ ID NO: 2088453 - RNA, 14 nt, Homo sapiens
gccuggagcuaccu

SEQ ID NO: 2088454 - RNA, 17 nt, Homo sapiens
ccagcaauuuagacaaa

SEQ ID NO: 2088455 - RNA, 17 nt, Homo sapiens
aaaaauauguagcaaug

SEQ ID NO: 2088456 - RNA, 15 nt, Homo sapiens
gcucccugcucagga

SEQ ID NO: 2088457 - RNA, 21 nt, Homo sapiens
caggcgcccgggauccagcuc

SEQ ID NO: 2088458 - RNA, 14 nt, Homo sapiens
ccacguucagggag

SEQ ID NO: 2088459 - RNA, 15 nt, Homo sapiens
auauuuauacuguau

SEQ ID NO: 2088460 - RNA, 16 nt, Homo sapiens
ucugcagguacuuccu

SEQ ID NO: 2088461 - RNA, 17 nt, Homo sapiens
cuuuauccagcaguauu

SEQ ID NO: 2088462 - RNA, 16 nt, Homo sapiens
ggaaaacccaggguga

SEQ ID NO: 2088463 - RNA, 21 nt, Homo sapiens
uggccuccgcagugucuccac

SEQ ID NO: 2088464 - RNA, 14 nt, Homo sapiens
ucagagaugaacau

SEQ ID NO: 2088465 - RNA, 19 nt, Homo sapiens
aaggaaucaaauuuugcca

SEQ ID NO: 2088466 - RNA, 18 nt, Homo sapiens
cacaaaggcugacauuca

SEQ ID NO: 2088467 - RNA, 20 nt, Homo sapiens
ccuuuaauaggcuuguguaa

SEQ ID NO: 2088468 - RNA, 12 nt, Homo sapiens
acauuuguucca

SEQ ID NO: 2088469 - RNA, 20 nt, Homo sapiens
gcuaaauaggaaaguuuuga

SEQ ID NO: 2088470 - RNA, 15 nt, Homo sapiens
aaucuauuuaucuuc

SEQ ID NO: 2088471 - RNA, 21 nt, Homo sapiens
gagaaaggauggcagccucag

SEQ ID NO: 2088472 - RNA, 22 nt, Homo sapiens
cagagcugccucucgguggcca

SEQ ID NO: 2088473 - RNA, 18 nt, Homo sapiens
uuccuucaaugugcauaa

SEQ ID NO: 2088474 - RNA, 22 nt, Homo sapiens
aacauagucagcucugaucaca

SEQ ID NO: 2088475 - RNA, 15 nt, Homo sapiens
gauaguuacauuuau

SEQ ID NO: 2088476 - RNA, 19 nt, Homo sapiens
uauauguguguauacauau

SEQ ID NO: 2088477 - RNA, 16 nt, Homo sapiens
aagcuccacugucacc

SEQ ID NO: 2088478 - RNA, 20 nt, Homo sapiens
uacgcagaacuaccaggugg

SEQ ID NO: 2088479 - RNA, 12 nt, Homo sapiens
agaaaacuaauc

SEQ ID NO: 2088480 - RNA, 19 nt, Homo sapiens
uccccgugggccauggcaa

SEQ ID NO: 2088481 - RNA, 15 nt, Homo sapiens
cugagcgacagugag

SEQ ID NO: 2088482 - RNA, 19 nt, Homo sapiens
auaugguguacauucuucc

SEQ ID NO: 2088483 - RNA, 15 nt, Homo sapiens
caguugggagugagu

SEQ ID NO: 2088484 - RNA, 22 nt, Homo sapiens
uggggagggcagguccagcucu

SEQ ID NO: 2088485 - RNA, 11 nt, Homo sapiens
aaaucuugcca

SEQ ID NO: 2088486 - RNA, 20 nt, Homo sapiens
uggacucccacucuuugaau

SEQ ID NO: 2088487 - RNA, 17 nt, Homo sapiens
cgacuaauuucaaaaug

SEQ ID NO: 2088488 - RNA, 11 nt, Homo sapiens
uuucaaaacaa

SEQ ID NO: 2088489 - RNA, 12 nt, Homo sapiens
cccucaguuuuu

SEQ ID NO: 2088490 - RNA, 12 nt, Homo sapiens
cccacaguuuua

SEQ ID NO: 2088491 - RNA, 18 nt, Homo sapiens
uguuugccuuuaggcagg

SEQ ID NO: 2088492 - RNA, 11 nt, Homo sapiens
uauaugcucug

SEQ ID NO: 2088493 - RNA, 13 nt, Homo sapiens
ucucuacugguag

SEQ ID NO: 2088494 - RNA, 12 nt, Homo sapiens
guggagaacaaa

SEQ ID NO: 2088495 - RNA, 11 nt, Homo sapiens
gaccuguguuu

SEQ ID NO: 2088496 - RNA, 22 nt, Homo sapiens
acaaucacacaacaaauaauua

SEQ ID NO: 2088497 - RNA, 13 nt, Homo sapiens
ucuuccaugaccc

SEQ ID NO: 2088498 - RNA, 17 nt, Homo sapiens
cauuugcuuccucccaa

SEQ ID NO: 2088499 - RNA, 20 nt, Homo sapiens
uuuguaccucuaaguacaua

SEQ ID NO: 2088500 - RNA, 21 nt, Homo sapiens
ugucaacaccccuguguggau

SEQ ID NO: 2088501 - RNA, 22 nt, Homo sapiens
ccaugagagaaggaggggagca

SEQ ID NO: 2088502 - RNA, 21 nt, Homo sapiens
uaaaggauucuguaugccaag

SEQ ID NO: 2088503 - RNA, 17 nt, Homo sapiens
caaaaugugaacugacu

SEQ ID NO: 2088504 - RNA, 17 nt, Homo sapiens
guauggcuaauaccugu

SEQ ID NO: 2088505 - RNA, 19 nt, Homo sapiens
cagguucucuccugugagc

SEQ ID NO: 2088506 - RNA, 23 nt, Homo sapiens
auuaucaggaaauguuuucuuaa

SEQ ID NO: 2088507 - RNA, 20 nt, Homo sapiens
auuuguugcugcugcugcuc

SEQ ID NO: 2088508 - RNA, 15 nt, Homo sapiens
aaaugucugcacuga

SEQ ID NO: 2088509 - RNA, 17 nt, Homo sapiens
aauauugugacucuggg

SEQ ID NO: 2088510 - RNA, 23 nt, Homo sapiens
gaguguagaucagagcagcagug

SEQ ID NO: 2088511 - RNA, 18 nt, Homo sapiens
uuuauacucuuauagaca

SEQ ID NO: 2088512 - RNA, 16 nt, Homo sapiens
agaggcugugguggcu

SEQ ID NO: 2088513 - RNA, 22 nt, Homo sapiens
acaucuauuuuggauuguauau

SEQ ID NO: 2088514 - RNA, 21 nt, Homo sapiens
aggagccuuuuuaaaacacau

SEQ ID NO: 2088515 - RNA, 19 nt, Homo sapiens
agucucagugaagacuaug

SEQ ID NO: 2088516 - RNA, 19 nt, Homo sapiens
aaccucaguauuuauguaa

SEQ ID NO: 2088517 - RNA, 13 nt, Homo sapiens
aaaaauaagaaau

SEQ ID NO: 2088518 - RNA, 21 nt, Homo sapiens
gaaaugcggaccaaacuacuu

SEQ ID NO: 2088519 - RNA, 18 nt, Homo sapiens
ugagaaccaaccaaugaa

SEQ ID NO: 2088520 - RNA, 23 nt, Homo sapiens
caugaccaaaugcuuuuccucaa

SEQ ID NO: 2088521 - RNA, 16 nt, Homo sapiens
caacaaagauugagaa

SEQ ID NO: 2088522 - RNA, 17 nt, Homo sapiens
acucaucugacucauuc

SEQ ID NO: 2088523 - RNA, 20 nt, Homo sapiens
agcaagucuuagacaucaua

SEQ ID NO: 2088524 - RNA, 13 nt, Homo sapiens
guuuugggccaga

SEQ ID NO: 2088525 - RNA, 23 nt, Homo sapiens
acccuucuccuuagaaguggaag

SEQ ID NO: 2088526 - RNA, 22 nt, Homo sapiens
uuugaaauuuuccauuacauga

SEQ ID NO: 2088527 - RNA, 16 nt, Homo sapiens
gcccaggguguuugca

SEQ ID NO: 2088528 - RNA, 16 nt, Homo sapiens
uuggggcagaccccag

SEQ ID NO: 2088529 - RNA, 23 nt, Homo sapiens
cuauuuauuauaaauuaugagau

SEQ ID NO: 2088530 - RNA, 14 nt, Homo sapiens
ccgagugaggccau

SEQ ID NO: 2088531 - RNA, 14 nt, Homo sapiens
aaggccugcacaca

SEQ ID NO: 2088532 - RNA, 12 nt, Homo sapiens
ucaugacacugu

SEQ ID NO: 2088533 - RNA, 22 nt, Homo sapiens
acugucuuuaaaagucauucaa

SEQ ID NO: 2088534 - RNA, 22 nt, Homo sapiens
ccagauuggauauggacucuuu

SEQ ID NO: 2088535 - RNA, 22 nt, Homo sapiens
uuguccugauguuuuucugugu

SEQ ID NO: 2088536 - RNA, 22 nt, Homo sapiens
gaauaaaacuuuucugcugaua

SEQ ID NO: 2088537 - RNA, 14 nt, Homo sapiens
acacagauaugcac

SEQ ID NO: 2088538 - RNA, 16 nt, Homo sapiens
aaaccagccuggccaa

SEQ ID NO: 2088539 - RNA, 16 nt, Homo sapiens
caccauguucccagcu

SEQ ID NO: 2088540 - RNA, 13 nt, Homo sapiens
ccagaauuucaaa

SEQ ID NO: 2088541 - RNA, 13 nt, Homo sapiens
uuuacauucuugc

SEQ ID NO: 2088542 - RNA, 18 nt, Homo sapiens
ccuuacuauggaaagcag

SEQ ID NO: 2088543 - RNA, 12 nt, Homo sapiens
aaggaugaauga

SEQ ID NO: 2088544 - RNA, 17 nt, Homo sapiens
augccuguaaucucagc

SEQ ID NO: 2088545 - RNA, 18 nt, Homo sapiens
uccaaagcccucccuacc

SEQ ID NO: 2088546 - RNA, 14 nt, Homo sapiens
cugguccaucucau

SEQ ID NO: 2088547 - RNA, 16 nt, Homo sapiens
acuucccauuuacucu

SEQ ID NO: 2088548 - RNA, 19 nt, Homo sapiens
uugcguuuguauauccaaa

SEQ ID NO: 2088549 - RNA, 20 nt, Homo sapiens
cuuaaugccaaguaacaaug

SEQ ID NO: 2088550 - RNA, 20 nt, Homo sapiens
aaauuacacccaugcacaga

SEQ ID NO: 2088551 - RNA, 12 nt, Homo sapiens
caagcucaagug

SEQ ID NO: 2088552 - RNA, 19 nt, Homo sapiens
aggccaguugaucugcucu

SEQ ID NO: 2088553 - RNA, 17 nt, Homo sapiens
acuuaaaaauuuguuca

SEQ ID NO: 2088554 - RNA, 14 nt, Homo sapiens
ccuucuacauguaa

SEQ ID NO: 2088555 - RNA, 16 nt, Homo sapiens
agaugcuggguuggug

SEQ ID NO: 2088556 - RNA, 22 nt, Homo sapiens
agcucacagcacauuuguuaau

SEQ ID NO: 2088557 - RNA, 22 nt, Homo sapiens
uguccaggagaaaccucacaaa

SEQ ID NO: 2088558 - RNA, 15 nt, Homo sapiens
cccagccucaucucu

SEQ ID NO: 2088559 - RNA, 19 nt, Homo sapiens
cagcccccaccuccgcccc

SEQ ID NO: 2088560 - RNA, 16 nt, Homo sapiens
cuggcuguguugucag

SEQ ID NO: 2088561 - RNA, 18 nt, Homo sapiens
gacugaccuucggcagug

SEQ ID NO: 2088562 - RNA, 18 nt, Homo sapiens
aguuauucauuguuaaua

SEQ ID NO: 2088563 - RNA, 22 nt, Homo sapiens
uucuuggugcucuguguuccca

SEQ ID NO: 2088564 - RNA, 16 nt, Homo sapiens
guuaauaaaaauaaga

SEQ ID NO: 2088565 - RNA, 21 nt, Homo sapiens
agguuuuaaccgcacaugcac

SEQ ID NO: 2088566 - RNA, 23 nt, Homo sapiens
uauauaaggucauagauucuuga

SEQ ID NO: 2088567 - RNA, 15 nt, Homo sapiens
aaauaggauugcuuc

SEQ ID NO: 2088568 - RNA, 12 nt, Homo sapiens
caccuuugccac

SEQ ID NO: 2088569 - RNA, 23 nt, Homo sapiens
ccgccugucaauaaauguugaaa

SEQ ID NO: 2088570 - RNA, 20 nt, Homo sapiens
auguaguccgugcugacagc

SEQ ID NO: 2088571 - RNA, 15 nt, Homo sapiens
agggcuggucagggu

SEQ ID NO: 2088572 - RNA, 22 nt, Homo sapiens
aacugcaggcccuggccucccc

SEQ ID NO: 2088573 - RNA, 21 nt, Homo sapiens
acaagagaugggaugcuccga

SEQ ID NO: 2088574 - RNA, 17 nt, Homo sapiens
ucccacagccuggcuau

SEQ ID NO: 2088575 - RNA, 21 nt, Homo sapiens
acauugucuggauaccagaua

SEQ ID NO: 2088576 - RNA, 21 nt, Homo sapiens
ccuggguucugggacuuuuaa

SEQ ID NO: 2088577 - RNA, 20 nt, Homo sapiens
uuauuguccuucuaccuuga

SEQ ID NO: 2088578 - RNA, 19 nt, Homo sapiens
cagagaugccuccaccgcu

SEQ ID NO: 2088579 - RNA, 22 nt, Homo sapiens
ugcugucacuugugauuugccc

SEQ ID NO: 2088580 - RNA, 14 nt, Homo sapiens
gcugcugugcacau

SEQ ID NO: 2088581 - RNA, 15 nt, Homo sapiens
gcaugucucugcuuc

SEQ ID NO: 2088582 - RNA, 15 nt, Homo sapiens
uucucugaucuccau

SEQ ID NO: 2088583 - RNA, 18 nt, Homo sapiens
ccuaaaaauaaagcacaa

SEQ ID NO: 2088584 - RNA, 20 nt, Homo sapiens
aucuucucccaagacugcuc

SEQ ID NO: 2088585 - RNA, 12 nt, Homo sapiens
agggggccucau

SEQ ID NO: 2088586 - RNA, 14 nt, Homo sapiens
gcaucaccuacccc

SEQ ID NO: 2088587 - RNA, 18 nt, Homo sapiens
aagauaaaauuugauaca

SEQ ID NO: 2088588 - RNA, 23 nt, Homo sapiens
auggaagguuagagguuugucaa

SEQ ID NO: 2088589 - RNA, 12 nt, Homo sapiens
caauuagaacuc

SEQ ID NO: 2088590 - RNA, 21 nt, Homo sapiens
ugacuuuuuaacuuaacucau

SEQ ID NO: 2088591 - RNA, 14 nt, Homo sapiens
aacaauaugcuuua

SEQ ID NO: 2088592 - RNA, 15 nt, Homo sapiens
gaaucuguaugauuc

SEQ ID NO: 2088593 - RNA, 23 nt, Homo sapiens
aaagagacagagacuggcauuuu

SEQ ID NO: 2088594 - RNA, 21 nt, Homo sapiens
gcacaguaauaugaaagccac

SEQ ID NO: 2088595 - RNA, 20 nt, Homo sapiens
gacuuuuugaaaaaaguaua

SEQ ID NO: 2088596 - RNA, 13 nt, Homo sapiens
gagacuugcaguu

SEQ ID NO: 2088597 - RNA, 13 nt, Homo sapiens
gcgcaggccaugc

SEQ ID NO: 2088598 - RNA, 18 nt, Homo sapiens
guguuuuaaaacauucac

SEQ ID NO: 2088599 - RNA, 20 nt, Homo sapiens
acacaaacuuucaaguauua

SEQ ID NO: 2088600 - RNA, 11 nt, Homo sapiens
uggauggggcu

SEQ ID NO: 2088601 - RNA, 22 nt, Homo sapiens
ucaaccauaaaagaaguuucag

SEQ ID NO: 2088602 - RNA, 21 nt, Homo sapiens
cuucuuccuuauuucacugaa

SEQ ID NO: 2088603 - RNA, 20 nt, Homo sapiens
cugggcccucucuucucacc

SEQ ID NO: 2088604 - RNA, 18 nt, Homo sapiens
auaccaugcaauaauaca

SEQ ID NO: 2088605 - RNA, 16 nt, Homo sapiens
ccuuuccccucucugc

SEQ ID NO: 2088606 - RNA, 20 nt, Homo sapiens
uuuaagacuuaguuauuucu

SEQ ID NO: 2088607 - RNA, 19 nt, Homo sapiens
aacccauuugucucuacuu

SEQ ID NO: 2088608 - RNA, 20 nt, Homo sapiens
auccagauguuaugcuccug

SEQ ID NO: 2088609 - RNA, 15 nt, Homo sapiens
agcauuugcuuuccu

SEQ ID NO: 2088610 - RNA, 14 nt, Homo sapiens
gaagacaacucugc

SEQ ID NO: 2088611 - RNA, 16 nt, Homo sapiens
uaucaguuaccaaaca

SEQ ID NO: 2088612 - RNA, 16 nt, Homo sapiens
aacucccucccauccu

SEQ ID NO: 2088613 - RNA, 20 nt, Homo sapiens
ccugaaucuaacagugacuu

SEQ ID NO: 2088614 - RNA, 21 nt, Homo sapiens
gagacagcacaggcagcccca

SEQ ID NO: 2088615 - RNA, 15 nt, Homo sapiens
agucucccuuccuau

SEQ ID NO: 2088616 - RNA, 23 nt, Homo sapiens
uguuuguuuauaucacugucuag

SEQ ID NO: 2088617 - RNA, 13 nt, Homo sapiens
ccaggagccucac

SEQ ID NO: 2088618 - RNA, 19 nt, Homo sapiens
cuaugcaggguagcacugg

SEQ ID NO: 2088619 - RNA, 17 nt, Homo sapiens
agacuaaggggcagcuc

SEQ ID NO: 2088620 - RNA, 16 nt, Homo sapiens
accaaaccauuauuca

SEQ ID NO: 2088621 - RNA, 16 nt, Homo sapiens
gcccccccuuccacuu

SEQ ID NO: 2088622 - RNA, 15 nt, Homo sapiens
cggauuuauucccuu

SEQ ID NO: 2088623 - RNA, 18 nt, Homo sapiens
caggcaaagacugcagua

SEQ ID NO: 2088624 - RNA, 16 nt, Homo sapiens
gagggcagcagccagc

SEQ ID NO: 2088625 - RNA, 14 nt, Homo sapiens
uguccugaccaccc

SEQ ID NO: 2088626 - RNA, 15 nt, Homo sapiens
auugcaugacaaacc

SEQ ID NO: 2088627 - RNA, 17 nt, Homo sapiens
aagauccugaagcaguu

SEQ ID NO: 2088628 - RNA, 14 nt, Homo sapiens
augugcagcaaaag

SEQ ID NO: 2088629 - RNA, 14 nt, Homo sapiens
uaauuaguuccuca

SEQ ID NO: 2088630 - RNA, 11 nt, Homo sapiens
ucaugcacuuu

SEQ ID NO: 2088631 - RNA, 14 nt, Homo sapiens
ccagcuucagguga

SEQ ID NO: 2088632 - RNA, 17 nt, Homo sapiens
cuacauaugaucugucu

SEQ ID NO: 2088633 - RNA, 15 nt, Homo sapiens
caccauuaggucacu

SEQ ID NO: 2088634 - RNA, 17 nt, Homo sapiens
aguuagcagacagaagu

SEQ ID NO: 2088635 - RNA, 19 nt, Homo sapiens
ugcccacccugggagacag

SEQ ID NO: 2088636 - RNA, 12 nt, Homo sapiens
uuaccaaagcaa

SEQ ID NO: 2088637 - RNA, 18 nt, Homo sapiens
cgaugucacucagccccu

SEQ ID NO: 2088638 - RNA, 14 nt, Homo sapiens
caguaacuuuaugu

SEQ ID NO: 2088639 - RNA, 16 nt, Homo sapiens
agggaggccgaagcua

SEQ ID NO: 2088640 - RNA, 13 nt, Homo sapiens
aaagcagugcaug

SEQ ID NO: 2088641 - RNA, 14 nt, Homo sapiens
cacagccucgggga

SEQ ID NO: 2088642 - RNA, 20 nt, Homo sapiens
ugaggaauaucacacucguc

SEQ ID NO: 2088643 - RNA, 16 nt, Homo sapiens
gcuccuccuccaugcu

SEQ ID NO: 2088644 - RNA, 12 nt, Homo sapiens
uauuucagugac

SEQ ID NO: 2088645 - RNA, 21 nt, Homo sapiens
aguaucaggucucccacgugg

SEQ ID NO: 2088646 - RNA, 19 nt, Homo sapiens
uuuugugucuaugauguug

SEQ ID NO: 2088647 - RNA, 18 nt, Homo sapiens
ucuucagaacuugucagg

SEQ ID NO: 2088648 - RNA, 13 nt, Homo sapiens
ccaugcucaauga

SEQ ID NO: 2088649 - RNA, 20 nt, Homo sapiens
gcaucuauuuccucugugca

SEQ ID NO: 2088650 - RNA, 15 nt, Homo sapiens
uuggaaaccacuaaa

SEQ ID NO: 2088651 - RNA, 14 nt, Homo sapiens
uagaacaacauaaa

SEQ ID NO: 2088652 - RNA, 22 nt, Homo sapiens
uuccuuuaaccuuugcuguagu

SEQ ID NO: 2088653 - RNA, 21 nt, Homo sapiens
acaaaugugaaguuaugcaug

SEQ ID NO: 2088654 - RNA, 16 nt, Homo sapiens
gauuuaugaucacuug

SEQ ID NO: 2088655 - RNA, 16 nt, Homo sapiens
ggcauuuucacuuuug

SEQ ID NO: 2088656 - RNA, 22 nt, Homo sapiens
ccucuacggaccucacauccau

SEQ ID NO: 2088657 - RNA, 13 nt, Homo sapiens
ugacaauggugcc

SEQ ID NO: 2088658 - RNA, 22 nt, Homo sapiens
agcuuuuacaggggauuaugau

SEQ ID NO: 2088659 - RNA, 20 nt, Homo sapiens
caaaaagauuuauuaauuaa

SEQ ID NO: 2088660 - RNA, 17 nt, Homo sapiens
agccuaauaacgugaaa

SEQ ID NO: 2088661 - RNA, 21 nt, Homo sapiens
gccaaggggaugcucugugca

SEQ ID NO: 2088662 - RNA, 18 nt, Homo sapiens
agacaauaaagaacugaa

SEQ ID NO: 2088663 - RNA, 16 nt, Homo sapiens
ucugacuuugccaaaa

SEQ ID NO: 2088664 - RNA, 16 nt, Homo sapiens
auagaacuuuucuuac

SEQ ID NO: 2088665 - RNA, 17 nt, Homo sapiens
uguaauaaauaugagug

SEQ ID NO: 2088666 - RNA, 15 nt, Homo sapiens
cuuuccccauucauu

SEQ ID NO: 2088667 - RNA, 17 nt, Homo sapiens
ccaccuuggcucaaguc

SEQ ID NO: 2088668 - RNA, 15 nt, Homo sapiens
uccuccccuguucau

SEQ ID NO: 2088669 - RNA, 21 nt, Homo sapiens
ugguauaaggaaauaucauaa

SEQ ID NO: 2088670 - RNA, 20 nt, Homo sapiens
cuguuucccuuucacuggca

SEQ ID NO: 2088671 - RNA, 22 nt, Homo sapiens
agccaccuccacccccaagaaa

SEQ ID NO: 2088672 - RNA, 21 nt, Homo sapiens
augucaggaaacauucaguga

SEQ ID NO: 2088673 - RNA, 14 nt, Homo sapiens
aauuuuauaucuug

SEQ ID NO: 2088674 - RNA, 20 nt, Homo sapiens
cuaacaagucaccaaaagac

SEQ ID NO: 2088675 - RNA, 16 nt, Homo sapiens
ugcuaccucacugggg

SEQ ID NO: 2088676 - RNA, 13 nt, Homo sapiens
acuugaccugaga

SEQ ID NO: 2088677 - RNA, 18 nt, Homo sapiens
cacuaucugggugcauga

SEQ ID NO: 2088678 - RNA, 21 nt, Homo sapiens
gagacacccucuggggguccu

SEQ ID NO: 2088679 - RNA, 17 nt, Homo sapiens
uggagccccagugccaa

SEQ ID NO: 2088680 - RNA, 16 nt, Homo sapiens
uucagugccaaaaaca

SEQ ID NO: 2088681 - RNA, 20 nt, Homo sapiens
ucuuauuucauuucuuugag

SEQ ID NO: 2088682 - RNA, 14 nt, Homo sapiens
aagugucuaccugg

SEQ ID NO: 2088683 - RNA, 20 nt, Homo sapiens
gacgguagagagaaacagcu

SEQ ID NO: 2088684 - RNA, 16 nt, Homo sapiens
agagcgugcuuucaag

SEQ ID NO: 2088685 - RNA, 21 nt, Homo sapiens
ugccauaucuucaggccaugg

SEQ ID NO: 2088686 - RNA, 17 nt, Homo sapiens
auucucccuuucacuaa

SEQ ID NO: 2088687 - RNA, 22 nt, Homo sapiens
caggaccaugaggccuccugcc

SEQ ID NO: 2088688 - RNA, 18 nt, Homo sapiens
cuaaacuuuccaaaaccu

SEQ ID NO: 2088689 - RNA, 17 nt, Homo sapiens
uauauaggcaugagcca

SEQ ID NO: 2088690 - RNA, 18 nt, Homo sapiens
cuuucaaagcuaaauucc

SEQ ID NO: 2088691 - RNA, 19 nt, Homo sapiens
accuauuauaaaaucuuac

SEQ ID NO: 2088692 - RNA, 15 nt, Homo sapiens
ccuagacaaugccac

SEQ ID NO: 2088693 - RNA, 23 nt, Homo sapiens
cagaggguggagaugucagucug

SEQ ID NO: 2088694 - RNA, 13 nt, Homo sapiens
ucacagaauguga

SEQ ID NO: 2088695 - RNA, 15 nt, Homo sapiens
cucagguguugccaa

SEQ ID NO: 2088696 - RNA, 21 nt, Homo sapiens
gugaccugacagcccaagggu

SEQ ID NO: 2088697 - RNA, 16 nt, Homo sapiens
caaucagcccagugca

SEQ ID NO: 2088698 - RNA, 20 nt, Homo sapiens
aaaucugcaccccacuucag

SEQ ID NO: 2088699 - RNA, 16 nt, Homo sapiens
ucuccaggggaucaca

SEQ ID NO: 2088700 - RNA, 15 nt, Homo sapiens
acccaguguccuucc

SEQ ID NO: 2088701 - RNA, 13 nt, Homo sapiens
aguugcaguauug

SEQ ID NO: 2088702 - RNA, 13 nt, Homo sapiens
aaugccagugugc

SEQ ID NO: 2088703 - RNA, 12 nt, Homo sapiens
gccguaucuccg

SEQ ID NO: 2088704 - RNA, 23 nt, Homo sapiens
aaacauugauuauaagcauguau

SEQ ID NO: 2088705 - RNA, 19 nt, Homo sapiens
guucauuacuuuuucauau

SEQ ID NO: 2088706 - RNA, 23 nt, Homo sapiens
cuucuaaugcaagggucucacac

SEQ ID NO: 2088707 - RNA, 16 nt, Homo sapiens
ccaauggaaaccucac

SEQ ID NO: 2088708 - RNA, 18 nt, Homo sapiens
cucccucuagaggcugcc

SEQ ID NO: 2088709 - RNA, 17 nt, Homo sapiens
ccugaucacuaugcauu

SEQ ID NO: 2088710 - RNA, 15 nt, Homo sapiens
augaaacccuaucuc

SEQ ID NO: 2088711 - RNA, 14 nt, Homo sapiens
uguauucgugcauu

SEQ ID NO: 2088712 - RNA, 20 nt, Homo sapiens
gcagcaccaccacacaguca

SEQ ID NO: 2088713 - RNA, 18 nt, Homo sapiens
aaagaccaucuccuguaa

SEQ ID NO: 2088714 - RNA, 13 nt, Homo sapiens
aacgugugucacc

SEQ ID NO: 2088715 - RNA, 18 nt, Homo sapiens
guuaaaugguuauccaau

SEQ ID NO: 2088716 - RNA, 15 nt, Homo sapiens
aauauaaaacuuaca

SEQ ID NO: 2088717 - RNA, 19 nt, Homo sapiens
agagaaggcugugagccaa

SEQ ID NO: 2088718 - RNA, 15 nt, Homo sapiens
gaaaucaagcauaaa

SEQ ID NO: 2088719 - RNA, 13 nt, Homo sapiens
acauuuuacagua

SEQ ID NO: 2088720 - RNA, 20 nt, Homo sapiens
ccaagaguguguccacugag

SEQ ID NO: 2088721 - RNA, 21 nt, Homo sapiens
aaaucauggcaacauaauuca

SEQ ID NO: 2088722 - RNA, 15 nt, Homo sapiens
gagggcaguccaaga

SEQ ID NO: 2088723 - RNA, 12 nt, Homo sapiens
uuacgacgugau

SEQ ID NO: 2088724 - RNA, 13 nt, Homo sapiens
gcaagcuccugca

SEQ ID NO: 2088725 - RNA, 11 nt, Homo sapiens
aauuuaccucu

SEQ ID NO: 2088726 - RNA, 14 nt, Homo sapiens
agauaauacugucu

SEQ ID NO: 2088727 - RNA, 20 nt, Homo sapiens
augagcaaggacaaccugcc

SEQ ID NO: 2088728 - RNA, 13 nt, Homo sapiens
cuccuaagcaaaa

SEQ ID NO: 2088729 - RNA, 16 nt, Homo sapiens
guauguuaugaacaug

SEQ ID NO: 2088730 - RNA, 20 nt, Homo sapiens
auauuucuuaagauagcccu

SEQ ID NO: 2088731 - RNA, 20 nt, Homo sapiens
gauugugccagugcacuccg

SEQ ID NO: 2088732 - RNA, 14 nt, Homo sapiens
caguggaaccaaaa

SEQ ID NO: 2088733 - RNA, 22 nt, Homo sapiens
aauggugacugauuucaaauca

SEQ ID NO: 2088734 - RNA, 16 nt, Homo sapiens
uacaaaaaaguaaccu

SEQ ID NO: 2088735 - RNA, 19 nt, Homo sapiens
augcccugcagagcaauaa

SEQ ID NO: 2088736 - RNA, 15 nt, Homo sapiens
cauggucacaguccu

SEQ ID NO: 2088737 - RNA, 14 nt, Homo sapiens
cugagaaaggcuca

SEQ ID NO: 2088738 - RNA, 22 nt, Homo sapiens
ccccagccucccaaagugcuaa

SEQ ID NO: 2088739 - RNA, 22 nt, Homo sapiens
uuuccuccucccagugccuucu

SEQ ID NO: 2088740 - RNA, 22 nt, Homo sapiens
ucuagacugacucacauugccu

SEQ ID NO: 2088741 - RNA, 17 nt, Homo sapiens
cuuuauuccuucauuuc

SEQ ID NO: 2088742 - RNA, 18 nt, Homo sapiens
gacucuaguacugugaau

SEQ ID NO: 2088743 - RNA, 17 nt, Homo sapiens
uacauccagaaagaagg

SEQ ID NO: 2088744 - RNA, 20 nt, Homo sapiens
acuccuuccugccaccugcu

SEQ ID NO: 2088745 - RNA, 17 nt, Homo sapiens
guuauaaaucaauguca

SEQ ID NO: 2088746 - RNA, 14 nt, Homo sapiens
ugaagacuacauga

SEQ ID NO: 2088747 - RNA, 19 nt, Homo sapiens
aauggaagauuugcccauu

SEQ ID NO: 2088748 - RNA, 16 nt, Homo sapiens
gaaguacuccuauugc

SEQ ID NO: 2088749 - RNA, 19 nt, Homo sapiens
gccuccaccgagccagcuu

SEQ ID NO: 2088750 - RNA, 17 nt, Homo sapiens
ccaagggccacgggaac

SEQ ID NO: 2088751 - RNA, 16 nt, Homo sapiens
acacucugaauuccaa

SEQ ID NO: 2088752 - RNA, 19 nt, Homo sapiens
uuaguuccccuacuacacu

SEQ ID NO: 2088753 - RNA, 18 nt, Homo sapiens
aauaccuuggucucaccu

SEQ ID NO: 2088754 - RNA, 22 nt, Homo sapiens
auggacucuucccccacuccuc

SEQ ID NO: 2088755 - RNA, 16 nt, Homo sapiens
auugaggaugaacuca

SEQ ID NO: 2088756 - RNA, 22 nt, Homo sapiens
gaagaacacagcaugugccaag

SEQ ID NO: 2088757 - RNA, 19 nt, Homo sapiens
aucuuaauauaaauucacu

SEQ ID NO: 2088758 - RNA, 21 nt, Homo sapiens
uuuguuccacuuguuugcacu

SEQ ID NO: 2088759 - RNA, 16 nt, Homo sapiens
uuaaggcaacauuccu

SEQ ID NO: 2088760 - RNA, 17 nt, Homo sapiens
ugaugaaugagauguaa

SEQ ID NO: 2088761 - RNA, 22 nt, Homo sapiens
gagaauggggguggggaggcaa

SEQ ID NO: 2088762 - RNA, 21 nt, Homo sapiens
accugcagcccauggugagcu

SEQ ID NO: 2088763 - RNA, 21 nt, Homo sapiens
ugucccaccacagucccucac

SEQ ID NO: 2088764 - RNA, 13 nt, Homo sapiens
cuaauaaacagac

SEQ ID NO: 2088765 - RNA, 13 nt, Homo sapiens
uuauaugcuauuu

SEQ ID NO: 2088766 - RNA, 19 nt, Homo sapiens
cuucaaguuaaagugaaua

SEQ ID NO: 2088767 - RNA, 21 nt, Homo sapiens
cucagaauaaaagaugauuuc

SEQ ID NO: 2088768 - RNA, 23 nt, Homo sapiens
uuguucgccgcguggaaugugag

SEQ ID NO: 2088769 - RNA, 13 nt, Homo sapiens
gaaugcagugaca

SEQ ID NO: 2088770 - RNA, 19 nt, Homo sapiens
cuuugucggcggcuugaua

SEQ ID NO: 2088771 - RNA, 12 nt, Homo sapiens
cuguccaaagac

SEQ ID NO: 2088772 - RNA, 19 nt, Homo sapiens
uccuuugacuuucugugua

SEQ ID NO: 2088773 - RNA, 14 nt, Homo sapiens
gaagcucuugacca

SEQ ID NO: 2088774 - RNA, 16 nt, Homo sapiens
ucuuuaaaacaaaaca

SEQ ID NO: 2088775 - RNA, 22 nt, Homo sapiens
aaucauuuauuuacaugugauu

SEQ ID NO: 2088776 - RNA, 20 nt, Homo sapiens
cccaaguagcugcuaccuuc

SEQ ID NO: 2088777 - RNA, 13 nt, Homo sapiens
aauuaaugcagau

SEQ ID NO: 2088778 - RNA, 22 nt, Homo sapiens
aaugcuccauuaauccagggaa

SEQ ID NO: 2088779 - RNA, 16 nt, Homo sapiens
guggcuuuuuguucag

SEQ ID NO: 2088780 - RNA, 20 nt, Homo sapiens
uaguauuuaacgaagccuag

SEQ ID NO: 2088781 - RNA, 13 nt, Homo sapiens
agcugggggucaa

SEQ ID NO: 2088782 - RNA, 19 nt, Homo sapiens
auuucugcuugugccuuua

SEQ ID NO: 2088783 - RNA, 15 nt, Homo sapiens
guguugauuguauaa

SEQ ID NO: 2088784 - RNA, 23 nt, Homo sapiens
cacaaauugaaaacacacucaaa

SEQ ID NO: 2088785 - RNA, 19 nt, Homo sapiens
cugauucugauugcuauca

SEQ ID NO: 2088786 - RNA, 19 nt, Homo sapiens
uccucuaacucacugccua

SEQ ID NO: 2088787 - RNA, 15 nt, Homo sapiens
aacagggcaaccaau

SEQ ID NO: 2088788 - RNA, 12 nt, Homo sapiens
aucaauauacau

SEQ ID NO: 2088789 - RNA, 19 nt, Homo sapiens
cacagaaggaauaagguca

SEQ ID NO: 2088790 - RNA, 23 nt, Homo sapiens
gauuucucacccucuguccuucc

SEQ ID NO: 2088791 - RNA, 17 nt, Homo sapiens
ucagaucacuacugcag

SEQ ID NO: 2088792 - RNA, 19 nt, Homo sapiens
gggaugacuggcuuugaga

SEQ ID NO: 2088793 - RNA, 22 nt, Homo sapiens
uagcuucugcuuuucugcccug

SEQ ID NO: 2088794 - RNA, 17 nt, Homo sapiens
ugcacuuuuaaaccucu

SEQ ID NO: 2088795 - RNA, 22 nt, Homo sapiens
cacccaucagugcucuguaaaa

SEQ ID NO: 2088796 - RNA, 13 nt, Homo sapiens
uaugucauagaaa

SEQ ID NO: 2088797 - RNA, 14 nt, Homo sapiens
uaaacauccuucaa

SEQ ID NO: 2088798 - RNA, 16 nt, Homo sapiens
agcaauguuccaggaa

SEQ ID NO: 2088799 - RNA, 16 nt, Homo sapiens
cuuauuuuuauaauua

SEQ ID NO: 2088800 - RNA, 14 nt, Homo sapiens
auauaccaugacau

SEQ ID NO: 2088801 - RNA, 20 nt, Homo sapiens
ucuagcaaauaugcuguuau

SEQ ID NO: 2088802 - RNA, 21 nt, Homo sapiens
gugucugcugacuguuucauu

SEQ ID NO: 2088803 - RNA, 11 nt, Homo sapiens
aaaagaccaag

SEQ ID NO: 2088804 - RNA, 18 nt, Homo sapiens
uuuaaaucguacuacaga

SEQ ID NO: 2088805 - RNA, 23 nt, Homo sapiens
aagucccuaauaaaaacuugcug

SEQ ID NO: 2088806 - RNA, 23 nt, Homo sapiens
cugcagggguugagagcuuucug

SEQ ID NO: 2088807 - RNA, 12 nt, Homo sapiens
acuguacagggg

SEQ ID NO: 2088808 - RNA, 19 nt, Homo sapiens
uuuuggcagcaaaguguca

SEQ ID NO: 2088809 - RNA, 15 nt, Homo sapiens
agccagggccagugg

SEQ ID NO: 2088810 - RNA, 23 nt, Homo sapiens
caaaccacuguuauuaacagaua

SEQ ID NO: 2088811 - RNA, 15 nt, Homo sapiens
uacuggccaguguca

SEQ ID NO: 2088812 - RNA, 21 nt, Homo sapiens
aucagggaaaaggaguaggga

SEQ ID NO: 2088813 - RNA, 18 nt, Homo sapiens
acucaacuaggcucauac

SEQ ID NO: 2088814 - RNA, 22 nt, Homo sapiens
aaaauauuuguaucacaaaucu

SEQ ID NO: 2088815 - RNA, 20 nt, Homo sapiens
acagaauuuccacuguaauu

SEQ ID NO: 2088816 - RNA, 18 nt, Homo sapiens
ugcucugccuaauuacga

SEQ ID NO: 2088817 - RNA, 16 nt, Homo sapiens
guguuccccagcugau

SEQ ID NO: 2088818 - RNA, 16 nt, Homo sapiens
gaucauuugagcucau

SEQ ID NO: 2088819 - RNA, 12 nt, Homo sapiens
cgaagucuuccc

SEQ ID NO: 2088820 - RNA, 15 nt, Homo sapiens
cagcauacugacucc

SEQ ID NO: 2088821 - RNA, 17 nt, Homo sapiens
uccauucccaucacugc

SEQ ID NO: 2088822 - RNA, 12 nt, Homo sapiens
acaagugccuga

SEQ ID NO: 2088823 - RNA, 23 nt, Homo sapiens
caggccuugcugggguccagggc

SEQ ID NO: 2088824 - RNA, 20 nt, Homo sapiens
aaguguaguaugcuguauga

SEQ ID NO: 2088825 - RNA, 22 nt, Homo sapiens
caaugcccugccuugcugccuu

SEQ ID NO: 2088826 - RNA, 15 nt, Homo sapiens
gccuaaauauaauua

SEQ ID NO: 2088827 - RNA, 18 nt, Homo sapiens
cugggcccucuuaucuca

SEQ ID NO: 2088828 - RNA, 22 nt, Homo sapiens
cagacaccauucauuccauguc

SEQ ID NO: 2088829 - RNA, 16 nt, Homo sapiens
cuugaucagacauuca

SEQ ID NO: 2088830 - RNA, 15 nt, Homo sapiens
guucauugaugcugc

SEQ ID NO: 2088831 - RNA, 19 nt, Homo sapiens
augaugacugcuuaacucc

SEQ ID NO: 2088832 - RNA, 15 nt, Homo sapiens
cuugcauguacuuga

SEQ ID NO: 2088833 - RNA, 22 nt, Homo sapiens
aaaugucuauguuuucuacucc

SEQ ID NO: 2088834 - RNA, 16 nt, Homo sapiens
uguaaaucuaaacaua

SEQ ID NO: 2088835 - RNA, 19 nt, Homo sapiens
agugaguggccccaccugu

SEQ ID NO: 2088836 - RNA, 20 nt, Homo sapiens
ugaaaauguuguuaugcuau

SEQ ID NO: 2088837 - RNA, 18 nt, Homo sapiens
ugucuuuuuaagcuuauu

SEQ ID NO: 2088838 - RNA, 23 nt, Homo sapiens
gccaggggugcuccugugcucac

SEQ ID NO: 2088839 - RNA, 22 nt, Homo sapiens
cuaaaagcguuggauguagcau

SEQ ID NO: 2088840 - RNA, 18 nt, Homo sapiens
auccuucuggcuguagau

SEQ ID NO: 2088841 - RNA, 15 nt, Homo sapiens
auaacucuucuaaca

SEQ ID NO: 2088842 - RNA, 20 nt, Homo sapiens
uaagcaaaaugugauaugua

SEQ ID NO: 2088843 - RNA, 12 nt, Homo sapiens
aauauuacuuua

SEQ ID NO: 2088844 - RNA, 12 nt, Homo sapiens
aucuuuacuacu

SEQ ID NO: 2088845 - RNA, 17 nt, Homo sapiens
uuggcuccacuguaaau

SEQ ID NO: 2088846 - RNA, 20 nt, Homo sapiens
cuacuacaaacuucaaagag

SEQ ID NO: 2088847 - RNA, 17 nt, Homo sapiens
ccuacugccaaccugga

SEQ ID NO: 2088848 - RNA, 15 nt, Homo sapiens
accuugaaugcugcc

SEQ ID NO: 2088849 - RNA, 21 nt, Homo sapiens
gcauauuuuguggcauuugaa

SEQ ID NO: 2088850 - RNA, 18 nt, Homo sapiens
cagaccuaagaaauagca

SEQ ID NO: 2088851 - RNA, 21 nt, Homo sapiens
gacuggccagcguaaaugacc

SEQ ID NO: 2088852 - RNA, 13 nt, Homo sapiens
aaaugacaagcaa

SEQ ID NO: 2088853 - RNA, 19 nt, Homo sapiens
guaaauuuaaguccaccuc

SEQ ID NO: 2088854 - RNA, 23 nt, Homo sapiens
auguauuucugauguguucucug

SEQ ID NO: 2088855 - RNA, 18 nt, Homo sapiens
uauaaauauauacagaua

SEQ ID NO: 2088856 - RNA, 17 nt, Homo sapiens
ucuuuacaauaaacaua

SEQ ID NO: 2088857 - RNA, 19 nt, Homo sapiens
aaauuucacuucaggagaa

SEQ ID NO: 2088858 - RNA, 15 nt, Homo sapiens
cucgaucauauuucc

SEQ ID NO: 2088859 - RNA, 14 nt, Homo sapiens
gggccagggcucca

SEQ ID NO: 2088860 - RNA, 17 nt, Homo sapiens
aauguaucaaauacauu

SEQ ID NO: 2088861 - RNA, 17 nt, Homo sapiens
aaauuugauaaugacac

SEQ ID NO: 2088862 - RNA, 18 nt, Homo sapiens
ucuuuuaugauuggugca

SEQ ID NO: 2088863 - RNA, 22 nt, Homo sapiens
ugcauuaauaauagcuaauaau

SEQ ID NO: 2088864 - RNA, 15 nt, Homo sapiens
gcauggguccagggc

SEQ ID NO: 2088865 - RNA, 15 nt, Homo sapiens
ucaaaagcaaauggg

SEQ ID NO: 2088866 - RNA, 19 nt, Homo sapiens
ugaaggacagaacauugcc

SEQ ID NO: 2088867 - RNA, 15 nt, Homo sapiens
guuggcgacugucau

SEQ ID NO: 2088868 - RNA, 15 nt, Homo sapiens
auuuuucagaccuuu

SEQ ID NO: 2088869 - RNA, 13 nt, Homo sapiens
augauuaacuaau

SEQ ID NO: 2088870 - RNA, 13 nt, Homo sapiens
cuaaauaaaugaa

SEQ ID NO: 2088871 - RNA, 13 nt, Homo sapiens
caaacuaaaagac

SEQ ID NO: 2088872 - RNA, 19 nt, Homo sapiens
ucuuuaacccucacuggga

SEQ ID NO: 2088873 - RNA, 17 nt, Homo sapiens
cagagacauacuugaag

SEQ ID NO: 2088874 - RNA, 22 nt, Homo sapiens
agaacuccccuugaaaacugcu

SEQ ID NO: 2088875 - RNA, 11 nt, Homo sapiens
gccuaccucuc

SEQ ID NO: 2088876 - RNA, 18 nt, Homo sapiens
gagcaaauguggcuccug

SEQ ID NO: 2088877 - RNA, 17 nt, Homo sapiens
ucccagcuuccagauga

SEQ ID NO: 2088878 - RNA, 18 nt, Homo sapiens
auaugacacucuagucaa

SEQ ID NO: 2088879 - RNA, 18 nt, Homo sapiens
uccccaacaccccacuga

SEQ ID NO: 2088880 - RNA, 16 nt, Homo sapiens
gaaacaguuucuugcu

SEQ ID NO: 2088881 - RNA, 19 nt, Homo sapiens
agugguugggcugugccug

SEQ ID NO: 2088882 - RNA, 21 nt, Homo sapiens
auuacaaggcuuuaucucagg

SEQ ID NO: 2088883 - RNA, 18 nt, Homo sapiens
acuuuuuauuugcaacuu

SEQ ID NO: 2088884 - RNA, 17 nt, Homo sapiens
aguaauuguguuuacau

SEQ ID NO: 2088885 - RNA, 23 nt, Homo sapiens
aaaaaauugaaacuugcauuuua

SEQ ID NO: 2088886 - RNA, 18 nt, Homo sapiens
caaguuacucugccuuuc

SEQ ID NO: 2088887 - RNA, 14 nt, Homo sapiens
ccccagcauuucca

SEQ ID NO: 2088888 - RNA, 17 nt, Homo sapiens
gugauugcagcuuuaug

SEQ ID NO: 2088889 - RNA, 13 nt, Homo sapiens
uuuaaaaggcaag

SEQ ID NO: 2088890 - RNA, 18 nt, Homo sapiens
caauuauacuaaaccuca

SEQ ID NO: 2088891 - RNA, 19 nt, Homo sapiens
acgaggcaaugacugugag

SEQ ID NO: 2088892 - RNA, 19 nt, Homo sapiens
ugcugaaauaaaaugauaa

SEQ ID NO: 2088893 - RNA, 17 nt, Homo sapiens
uagaagcuucuugcucc

SEQ ID NO: 2088894 - RNA, 12 nt, Homo sapiens
ugugauguuugg

SEQ ID NO: 2088895 - RNA, 20 nt, Homo sapiens
ccugguccccuccuucccaa

SEQ ID NO: 2088896 - RNA, 16 nt, Homo sapiens
cugucucgaugcaaug

SEQ ID NO: 2088897 - RNA, 14 nt, Homo sapiens
agaaauucuggccc

SEQ ID NO: 2088898 - RNA, 19 nt, Homo sapiens
gccucuucuuugugccuuu

SEQ ID NO: 2088899 - RNA, 23 nt, Homo sapiens
agcugccaaggaaacccccagug

SEQ ID NO: 2088900 - RNA, 23 nt, Homo sapiens
gcucauauuucccaugauuucau

SEQ ID NO: 2088901 - RNA, 16 nt, Homo sapiens
gagccugcauucugca

SEQ ID NO: 2088902 - RNA, 18 nt, Homo sapiens
uacugaaccacuuguaga

SEQ ID NO: 2088903 - RNA, 15 nt, Homo sapiens
gccaggacacugccu

SEQ ID NO: 2088904 - RNA, 16 nt, Homo sapiens
acuuaaaaauauccau

SEQ ID NO: 2088905 - RNA, 19 nt, Homo sapiens
cauauuauuuuagugugua

SEQ ID NO: 2088906 - RNA, 15 nt, Homo sapiens
ggucaagaaacagcc

SEQ ID NO: 2088907 - RNA, 23 nt, Homo sapiens
ggcagcccagcccuccucuguca

SEQ ID NO: 2088908 - RNA, 18 nt, Homo sapiens
ggaugugccuguggcaug

SEQ ID NO: 2088909 - RNA, 22 nt, Homo sapiens
acacagcugcagagacagagag

SEQ ID NO: 2088910 - RNA, 18 nt, Homo sapiens
ggugccgggcucccccau

SEQ ID NO: 2088911 - RNA, 15 nt, Homo sapiens
ucauccacuuuccaa

SEQ ID NO: 2088912 - RNA, 17 nt, Homo sapiens
aggggagucccuguggu

SEQ ID NO: 2088913 - RNA, 16 nt, Homo sapiens
ucauacccaugcacag

SEQ ID NO: 2088914 - RNA, 19 nt, Homo sapiens
gaugcugguggcucuucag

SEQ ID NO: 2088915 - RNA, 18 nt, Homo sapiens
aggcuggcuccagaugca

SEQ ID NO: 2088916 - RNA, 13 nt, Homo sapiens
agaaacacuuucu

SEQ ID NO: 2088917 - RNA, 16 nt, Homo sapiens
cuauaugguaguuuaa

SEQ ID NO: 2088918 - RNA, 18 nt, Homo sapiens
gaaaauauagacauucuc

SEQ ID NO: 2088919 - RNA, 20 nt, Homo sapiens
gcucucuuuuucuccagggu

SEQ ID NO: 2088920 - RNA, 17 nt, Homo sapiens
ugagcaaauggaacaau

SEQ ID NO: 2088921 - RNA, 15 nt, Homo sapiens
cugcuguaugauauu

SEQ ID NO: 2088922 - RNA, 23 nt, Homo sapiens
ugcacugucugagaauuuccaaa

SEQ ID NO: 2088923 - RNA, 13 nt, Homo sapiens
gcuauaagugcuc

SEQ ID NO: 2088924 - RNA, 21 nt, Homo sapiens
agugacagcuuucugggaugu

SEQ ID NO: 2088925 - RNA, 19 nt, Homo sapiens
aggugcuacaacaugugag

SEQ ID NO: 2088926 - RNA, 22 nt, Homo sapiens
gaggagcgggaccuguggcucu

SEQ ID NO: 2088927 - RNA, 18 nt, Homo sapiens
uccuauucuguugccaau

SEQ ID NO: 2088928 - RNA, 13 nt, Homo sapiens
aagcagacuggau

SEQ ID NO: 2088929 - RNA, 16 nt, Homo sapiens
ggucuccucugcagcu

SEQ ID NO: 2088930 - RNA, 16 nt, Homo sapiens
ggggagcacuugucca

SEQ ID NO: 2088931 - RNA, 15 nt, Homo sapiens
uaaacugacuuuauc

SEQ ID NO: 2088932 - RNA, 15 nt, Homo sapiens
acgggacucaggugu

SEQ ID NO: 2088933 - RNA, 14 nt, Homo sapiens
cacgucauguuucu

SEQ ID NO: 2088934 - RNA, 20 nt, Homo sapiens
uauaugauuugcauguguaa

SEQ ID NO: 2088935 - RNA, 15 nt, Homo sapiens
gaaagaacacuuccc

SEQ ID NO: 2088936 - RNA, 14 nt, Homo sapiens
gccacacucuccau

SEQ ID NO: 2088937 - RNA, 19 nt, Homo sapiens
uuagaauguugaaacugac

SEQ ID NO: 2088938 - RNA, 15 nt, Homo sapiens
uuucaccauguuggc

SEQ ID NO: 2088939 - RNA, 19 nt, Homo sapiens
aauuauccauuacgugcau

SEQ ID NO: 2088940 - RNA, 21 nt, Homo sapiens
ucaauguuuugagucagugca

SEQ ID NO: 2088941 - RNA, 22 nt, Homo sapiens
caagugauguguuuacauuuac

SEQ ID NO: 2088942 - RNA, 17 nt, Homo sapiens
ggccccuuugagucuga

SEQ ID NO: 2088943 - RNA, 14 nt, Homo sapiens
agagaguucucaca

SEQ ID NO: 2088944 - RNA, 22 nt, Homo sapiens
cagagucugccccacauguggc

SEQ ID NO: 2088945 - RNA, 16 nt, Homo sapiens
ucuaggguauucugua

SEQ ID NO: 2088946 - RNA, 18 nt, Homo sapiens
acucccaaagagcugccu

SEQ ID NO: 2088947 - RNA, 23 nt, Homo sapiens
auuuuacuauuggaaucugauau

SEQ ID NO: 2088948 - RNA, 22 nt, Homo sapiens
guggcucacaccuguaauccca

SEQ ID NO: 2088949 - RNA, 19 nt, Homo sapiens
ugcagucaucuugaccaag

SEQ ID NO: 2088950 - RNA, 23 nt, Homo sapiens
gaagucuucauggucucuuccag

SEQ ID NO: 2088951 - RNA, 16 nt, Homo sapiens
ucacauuacauuaaca

SEQ ID NO: 2088952 - RNA, 19 nt, Homo sapiens
ccaggcugaccacagcaca

SEQ ID NO: 2088953 - RNA, 16 nt, Homo sapiens
cauucgcuacuaugau

SEQ ID NO: 2088954 - RNA, 19 nt, Homo sapiens
caaguggcccccacccuca

SEQ ID NO: 2088955 - RNA, 19 nt, Homo sapiens
ccaugauugaaaucaaaua

SEQ ID NO: 2088956 - RNA, 15 nt, Homo sapiens
gggagacaugugaca

SEQ ID NO: 2088957 - RNA, 22 nt, Homo sapiens
gaaggggcuagggaggaccaaa

SEQ ID NO: 2088958 - RNA, 16 nt, Homo sapiens
aaacucauuuuugcca

SEQ ID NO: 2088959 - RNA, 14 nt, Homo sapiens
augucagagccagg

SEQ ID NO: 2088960 - RNA, 14 nt, Homo sapiens
gugccccucuucuu

SEQ ID NO: 2088961 - RNA, 14 nt, Homo sapiens
ccuaaaucccaaga

SEQ ID NO: 2088962 - RNA, 16 nt, Homo sapiens
cauuuucucucaggug

SEQ ID NO: 2088963 - RNA, 14 nt, Homo sapiens
agcuagccagcugu

SEQ ID NO: 2088964 - RNA, 15 nt, Homo sapiens
uagagcagugcacau

SEQ ID NO: 2088965 - RNA, 12 nt, Homo sapiens
uggugaggaccu

SEQ ID NO: 2088966 - RNA, 13 nt, Homo sapiens
uguguaugugcca

SEQ ID NO: 2088967 - RNA, 21 nt, Homo sapiens
accaaaauguauaaauguuau

SEQ ID NO: 2088968 - RNA, 18 nt, Homo sapiens
aaucaaaugguuagcuua

SEQ ID NO: 2088969 - RNA, 23 nt, Homo sapiens
ugaagugguuggcaacaggccaa

SEQ ID NO: 2088970 - RNA, 18 nt, Homo sapiens
gagccacugcaccgggcc

SEQ ID NO: 2088971 - RNA, 14 nt, Homo sapiens
gucaucugugcacu

SEQ ID NO: 2088972 - RNA, 22 nt, Homo sapiens
cuuugauuuuuugcccagagag

SEQ ID NO: 2088973 - RNA, 19 nt, Homo sapiens
aacuuccagauccuggaaa

SEQ ID NO: 2088974 - RNA, 18 nt, Homo sapiens
gacaugaaaggacccugu

SEQ ID NO: 2088975 - RNA, 16 nt, Homo sapiens
accagugugacaucua

SEQ ID NO: 2088976 - RNA, 14 nt, Homo sapiens
gcaaggucuggccu

SEQ ID NO: 2088977 - RNA, 18 nt, Homo sapiens
aagggaagccuuuugcaa

SEQ ID NO: 2088978 - RNA, 16 nt, Homo sapiens
caaaaacguaucuccu

SEQ ID NO: 2088979 - RNA, 11 nt, Homo sapiens
ugcacuggccu

SEQ ID NO: 2088980 - RNA, 15 nt, Homo sapiens
ccaucucuauuaaaa

SEQ ID NO: 2088981 - RNA, 11 nt, Homo sapiens
uuacacuccag

SEQ ID NO: 2088982 - RNA, 11 nt, Homo sapiens
cugcacucuaa

SEQ ID NO: 2088983 - RNA, 20 nt, Homo sapiens
cccgugcaacggaagccagg

SEQ ID NO: 2088984 - RNA, 14 nt, Homo sapiens
ccucagccacugaa

SEQ ID NO: 2088985 - RNA, 17 nt, Homo sapiens
ucccagguaauuuaaau

SEQ ID NO: 2088986 - RNA, 13 nt, Homo sapiens
uuagggaauaauu

SEQ ID NO: 2088987 - RNA, 21 nt, Homo sapiens
cagauuuacaucccagacaca

SEQ ID NO: 2088988 - RNA, 17 nt, Homo sapiens
gcacucccucccagaga

SEQ ID NO: 2088989 - RNA, 13 nt, Homo sapiens
ugcugucuuccaa

SEQ ID NO: 2088990 - RNA, 14 nt, Homo sapiens
ggcagccucagagg

SEQ ID NO: 2088991 - RNA, 22 nt, Homo sapiens
gcuuuaugauuuucauaacuua

SEQ ID NO: 2088992 - RNA, 20 nt, Homo sapiens
uuuccacuucuucauucucu

SEQ ID NO: 2088993 - RNA, 20 nt, Homo sapiens
gcuaggguggcccuugcagu

SEQ ID NO: 2088994 - RNA, 15 nt, Homo sapiens
gaauugugucugcag

SEQ ID NO: 2088995 - RNA, 21 nt, Homo sapiens
aauguauuuugaaaacacuua

SEQ ID NO: 2088996 - RNA, 18 nt, Homo sapiens
uaugacauuucuuaaaac

SEQ ID NO: 2088997 - RNA, 14 nt, Homo sapiens
cgaagaguggacaa

SEQ ID NO: 2088998 - RNA, 17 nt, Homo sapiens
ccaagcucaguucaaug

SEQ ID NO: 2088999 - RNA, 18 nt, Homo sapiens
cucugcuaccaucucauu

SEQ ID NO: 2089000 - RNA, 23 nt, Homo sapiens
uaauauguuuaguuuuacauuuu

SEQ ID NO: 2089001 - RNA, 21 nt, Homo sapiens
agugccauaaccaugagcacu

SEQ ID NO: 2089002 - RNA, 21 nt, Homo sapiens
caggacgaggcagaaaagcac

SEQ ID NO: 2089003 - RNA, 17 nt, Homo sapiens
gcauuucucuuccuaaa

SEQ ID NO: 2089004 - RNA, 22 nt, Homo sapiens
gcccuccugagggguauccucc

SEQ ID NO: 2089005 - RNA, 22 nt, Homo sapiens
accagucuauuuccacugaaca

SEQ ID NO: 2089006 - RNA, 20 nt, Homo sapiens
aagcauugccagcucuucca

SEQ ID NO: 2089007 - RNA, 19 nt, Homo sapiens
gucuauggcucaugucuga

SEQ ID NO: 2089008 - RNA, 15 nt, Homo sapiens
augcccuaccugccu

SEQ ID NO: 2089009 - RNA, 19 nt, Homo sapiens
auaacagccgcuccagagu

SEQ ID NO: 2089010 - RNA, 20 nt, Homo sapiens
uacuggcuuucauagcuuuu

SEQ ID NO: 2089011 - RNA, 15 nt, Homo sapiens
ccacagacaagguag

SEQ ID NO: 2089012 - RNA, 18 nt, Homo sapiens
acauuuagacaauggcua

SEQ ID NO: 2089013 - RNA, 19 nt, Homo sapiens
uguguuauuuaaugaguca

SEQ ID NO: 2089014 - RNA, 17 nt, Homo sapiens
uccuuaccauugugauu

SEQ ID NO: 2089015 - RNA, 18 nt, Homo sapiens
caggaguagcugagcuca

SEQ ID NO: 2089016 - RNA, 15 nt, Homo sapiens
ugugacaucacaggg

SEQ ID NO: 2089017 - RNA, 19 nt, Homo sapiens
ggaaaacacggcccuccug

SEQ ID NO: 2089018 - RNA, 21 nt, Homo sapiens
augagcuuucuuugcacuuaa

SEQ ID NO: 2089019 - RNA, 20 nt, Homo sapiens
acaaugcuuauggaaagcca

SEQ ID NO: 2089020 - RNA, 15 nt, Homo sapiens
aauagugaaaugcca

SEQ ID NO: 2089021 - RNA, 24 nt, Homo sapiens
uccacaggauauuaaacguguaaa

SEQ ID NO: 2089022 - RNA, 11 nt, Homo sapiens
uggcacugugg

SEQ ID NO: 2089023 - RNA, 12 nt, Homo sapiens
gacaucaucaag

SEQ ID NO: 2089024 - RNA, 23 nt, Homo sapiens
cugcucuugugauguuugcucag

SEQ ID NO: 2089025 - RNA, 22 nt, Homo sapiens
aaaaguuuuuuuuuuguuuguu

SEQ ID NO: 2089026 - RNA, 18 nt, Homo sapiens
cugugguuguaaagcagu

SEQ ID NO: 2089027 - RNA, 17 nt, Homo sapiens
uucagucaaaacuuuaa

SEQ ID NO: 2089028 - RNA, 10 nt, Homo sapiens
gcucagagau

SEQ ID NO: 2089029 - RNA, 18 nt, Homo sapiens
guucauuucacacaguga

SEQ ID NO: 2089030 - RNA, 16 nt, Homo sapiens
gaacaugagugcugau

SEQ ID NO: 2089031 - RNA, 23 nt, Homo sapiens
acaugauggggaaggaguacaaa

SEQ ID NO: 2089032 - RNA, 22 nt, Homo sapiens
cuuccaggagccaccuugccac

SEQ ID NO: 2089033 - RNA, 19 nt, Homo sapiens
ucaagugucaccuccuucc

SEQ ID NO: 2089034 - RNA, 16 nt, Homo sapiens
ugacccaaaaaaguca

SEQ ID NO: 2089035 - RNA, 17 nt, Homo sapiens
acugagcucugccucaa

SEQ ID NO: 2089036 - RNA, 17 nt, Homo sapiens
ccacuauccuucgugaa

SEQ ID NO: 2089037 - RNA, 19 nt, Homo sapiens
ucgcugcauaaacuguugu

SEQ ID NO: 2089038 - RNA, 22 nt, Homo sapiens
agccaggacaugaagaaaagga

SEQ ID NO: 2089039 - RNA, 20 nt, Homo sapiens
accugcgcuguggacacuga

SEQ ID NO: 2089040 - RNA, 21 nt, Homo sapiens
cagggaccacguugcugccug

SEQ ID NO: 2089041 - RNA, 23 nt, Homo sapiens
aucagaaaauaaaauauucacuc

SEQ ID NO: 2089042 - RNA, 17 nt, Homo sapiens
accauguggaugcagca

SEQ ID NO: 2089043 - RNA, 21 nt, Homo sapiens
gcaggccaaaccguacuguau

SEQ ID NO: 2089044 - RNA, 18 nt, Homo sapiens
cacgugcacacaccugca

SEQ ID NO: 2089045 - RNA, 19 nt, Homo sapiens
agcaauucaugguucaagu

SEQ ID NO: 2089046 - RNA, 17 nt, Homo sapiens
ugccuguuguuaugggu

SEQ ID NO: 2089047 - RNA, 18 nt, Homo sapiens
agacuggcaauaaacucc

SEQ ID NO: 2089048 - RNA, 18 nt, Homo sapiens
ucuauuaaaucuugcaac

SEQ ID NO: 2089049 - RNA, 12 nt, Homo sapiens
aaaacuuccuuu

SEQ ID NO: 2089050 - RNA, 14 nt, Homo sapiens
uuauaauacuguuu

SEQ ID NO: 2089051 - RNA, 22 nt, Homo sapiens
augaagacagggucaucgacca

SEQ ID NO: 2089052 - RNA, 17 nt, Homo sapiens
ugcaggcagaaccugaa

SEQ ID NO: 2089053 - RNA, 19 nt, Homo sapiens
aaguucucaagcugccuau

SEQ ID NO: 2089054 - RNA, 17 nt, Homo sapiens
cuuaucuaccaguuuau

SEQ ID NO: 2089055 - RNA, 10 nt, Homo sapiens
ucucuaauaa

SEQ ID NO: 2089056 - RNA, 22 nt, Homo sapiens
auagucuucuuucuuagauucu

SEQ ID NO: 2089057 - RNA, 20 nt, Homo sapiens
caucaagggagacaccagug

SEQ ID NO: 2089058 - RNA, 14 nt, Homo sapiens
aaauauacccauuu

SEQ ID NO: 2089059 - RNA, 17 nt, Homo sapiens
uuauuuagcaccaggga

SEQ ID NO: 2089060 - RNA, 17 nt, Homo sapiens
gccggggcugaagccac

SEQ ID NO: 2089061 - RNA, 13 nt, Homo sapiens
gccaagcacugcu

SEQ ID NO: 2089062 - RNA, 19 nt, Homo sapiens
auuaucuaaaaucugcuag

SEQ ID NO: 2089063 - RNA, 15 nt, Homo sapiens
cuuugaaagcuguau

SEQ ID NO: 2089064 - RNA, 14 nt, Homo sapiens
gaacaaaucuuccu

SEQ ID NO: 2089065 - RNA, 22 nt, Homo sapiens
accccaugcuggccuugccaca

SEQ ID NO: 2089066 - RNA, 18 nt, Homo sapiens
cuuuguccccacacagcc

SEQ ID NO: 2089067 - RNA, 15 nt, Homo sapiens
caugcugugugcugg

SEQ ID NO: 2089068 - RNA, 18 nt, Homo sapiens
ccuauguugauccaucca

SEQ ID NO: 2089069 - RNA, 13 nt, Homo sapiens
uuuuuauuuuugc

SEQ ID NO: 2089070 - RNA, 19 nt, Homo sapiens
agauagccaaggccaaagg

SEQ ID NO: 2089071 - RNA, 15 nt, Homo sapiens
ccaacuugccaaaau

SEQ ID NO: 2089072 - RNA, 20 nt, Homo sapiens
uucucuuaguuauugcugaa

SEQ ID NO: 2089073 - RNA, 20 nt, Homo sapiens
agauccuaagucucuuacaa

SEQ ID NO: 2089074 - RNA, 18 nt, Homo sapiens
acacuggcguuacugcuu

SEQ ID NO: 2089075 - RNA, 20 nt, Homo sapiens
agcuggacccauuugccagg

SEQ ID NO: 2089076 - RNA, 17 nt, Homo sapiens
gaguuuccacuauccca

SEQ ID NO: 2089077 - RNA, 17 nt, Homo sapiens
auaaaaauaacaucauu

SEQ ID NO: 2089078 - RNA, 16 nt, Homo sapiens
agaguagagggcacug

SEQ ID NO: 2089079 - RNA, 19 nt, Homo sapiens
augcaauuggcauuaacaa

SEQ ID NO: 2089080 - RNA, 14 nt, Homo sapiens
acuuugggacucac

SEQ ID NO: 2089081 - RNA, 19 nt, Homo sapiens
cacuuuacagaugaggaaa

SEQ ID NO: 2089082 - RNA, 19 nt, Homo sapiens
ccugauuuaggagaagcca

SEQ ID NO: 2089083 - RNA, 15 nt, Homo sapiens
caaggagaauaugau

SEQ ID NO: 2089084 - RNA, 22 nt, Homo sapiens
gagcauuugguacacacuugac

SEQ ID NO: 2089085 - RNA, 18 nt, Homo sapiens
uaugaaacugcacauugg

SEQ ID NO: 2089086 - RNA, 11 nt, Homo sapiens
gaacuggccac

SEQ ID NO: 2089087 - RNA, 23 nt, Homo sapiens
auaauuuuacucacucacucuga

SEQ ID NO: 2089088 - RNA, 18 nt, Homo sapiens
uacaggauauuccaaaau

SEQ ID NO: 2089089 - RNA, 17 nt, Homo sapiens
aauacaguaagcauagu

SEQ ID NO: 2089090 - RNA, 15 nt, Homo sapiens
ccaaauuuaauuaaa

SEQ ID NO: 2089091 - RNA, 21 nt, Homo sapiens
uaagcuuaugcuuaaauucaa

SEQ ID NO: 2089092 - RNA, 16 nt, Homo sapiens
ucaucaggugugcuca

SEQ ID NO: 2089093 - RNA, 15 nt, Homo sapiens
aucugugccugagaa

SEQ ID NO: 2089094 - RNA, 17 nt, Homo sapiens
ucugaaacuaaugaaag

SEQ ID NO: 2089095 - RNA, 20 nt, Homo sapiens
uaucuuguagcuuuaucaaa

SEQ ID NO: 2089096 - RNA, 20 nt, Homo sapiens
caaauauuguaaaacuuugg

SEQ ID NO: 2089097 - RNA, 12 nt, Homo sapiens
gccccacuggac

SEQ ID NO: 2089098 - RNA, 15 nt, Homo sapiens
cuucuuagcugucac

SEQ ID NO: 2089099 - RNA, 19 nt, Homo sapiens
acucagcucuuggcuccac

SEQ ID NO: 2089100 - RNA, 23 nt, Homo sapiens
auuuugggggguaaucagcauua

SEQ ID NO: 2089101 - RNA, 11 nt, Homo sapiens
aguuugcuaag

SEQ ID NO: 2089102 - RNA, 15 nt, Homo sapiens
aauuuuaccauucag

SEQ ID NO: 2089103 - RNA, 18 nt, Homo sapiens
aaaaauuuugcauuucau

SEQ ID NO: 2089104 - RNA, 16 nt, Homo sapiens
ggauggugggguacca

SEQ ID NO: 2089105 - RNA, 13 nt, Homo sapiens
acagaaacuggau

SEQ ID NO: 2089106 - RNA, 17 nt, Homo sapiens
uggaguggaugccucag

SEQ ID NO: 2089107 - RNA, 13 nt, Homo sapiens
uuugguugcaauu

SEQ ID NO: 2089108 - RNA, 16 nt, Homo sapiens
cuggccucaagcaauc

SEQ ID NO: 2089109 - RNA, 20 nt, Homo sapiens
ucaucugccaacuguccuac

SEQ ID NO: 2089110 - RNA, 18 nt, Homo sapiens
accgccggccacacuggu

SEQ ID NO: 2089111 - RNA, 20 nt, Homo sapiens
aauaaagaauuaacagagau

SEQ ID NO: 2089112 - RNA, 14 nt, Homo sapiens
ugacgcuugcuuag

SEQ ID NO: 2089113 - RNA, 20 nt, Homo sapiens
ccauaugaacagcuguucag

SEQ ID NO: 2089114 - RNA, 18 nt, Homo sapiens
acugaugacaaacccagg

SEQ ID NO: 2089115 - RNA, 16 nt, Homo sapiens
cccugccucucugcag

SEQ ID NO: 2089116 - RNA, 16 nt, Homo sapiens
guaauuuuauuuacau

SEQ ID NO: 2089117 - RNA, 19 nt, Homo sapiens
accuuuuuauauuuuauac

SEQ ID NO: 2089118 - RNA, 22 nt, Homo sapiens
gucuguaaaaccagcauacagu

SEQ ID NO: 2089119 - RNA, 16 nt, Homo sapiens
ugagaaacugauuuau

SEQ ID NO: 2089120 - RNA, 20 nt, Homo sapiens
uccucgaggcccuagcauuu

SEQ ID NO: 2089121 - RNA, 16 nt, Homo sapiens
ccucccuaccaaaaau

SEQ ID NO: 2089122 - RNA, 18 nt, Homo sapiens
cuuccacaaacaccaucu

SEQ ID NO: 2089123 - RNA, 18 nt, Homo sapiens
aggacaguugauuuccaa

SEQ ID NO: 2089124 - RNA, 20 nt, Homo sapiens
ccagggagcacccugcccac

SEQ ID NO: 2089125 - RNA, 13 nt, Homo sapiens
aucuguugcuugu

SEQ ID NO: 2089126 - RNA, 17 nt, Homo sapiens
caacccaugagugcuaa

SEQ ID NO: 2089127 - RNA, 18 nt, Homo sapiens
ccucuaauccagcaaagu

SEQ ID NO: 2089128 - RNA, 12 nt, Homo sapiens
cugaaggugccc

SEQ ID NO: 2089129 - RNA, 18 nt, Homo sapiens
caggagucccugccauca

SEQ ID NO: 2089130 - RNA, 19 nt, Homo sapiens
gugcaacugcuacugacca

SEQ ID NO: 2089131 - RNA, 17 nt, Homo sapiens
gcuacauuccucagcug

SEQ ID NO: 2089132 - RNA, 15 nt, Homo sapiens
auuuugauccaagcu

SEQ ID NO: 2089133 - RNA, 21 nt, Homo sapiens
cccuuaacucaaaccaugcaa

SEQ ID NO: 2089134 - RNA, 13 nt, Homo sapiens
aaaaaacuauuaa

SEQ ID NO: 2089135 - RNA, 20 nt, Homo sapiens
ggccucuggcucucaugggg

SEQ ID NO: 2089136 - RNA, 16 nt, Homo sapiens
aacuggaaacaucuga

SEQ ID NO: 2089137 - RNA, 13 nt, Homo sapiens
aaacuccacaggg

SEQ ID NO: 2089138 - RNA, 21 nt, Homo sapiens
accaaaagaucucuugcuaga

SEQ ID NO: 2089139 - RNA, 16 nt, Homo sapiens
guucgagaccaaccug

SEQ ID NO: 2089140 - RNA, 13 nt, Homo sapiens
accauaaccacug

SEQ ID NO: 2089141 - RNA, 22 nt, Homo sapiens
acccuucauuuaacaaguaaga

SEQ ID NO: 2089142 - RNA, 19 nt, Homo sapiens
caauuuguucagucuuuca

SEQ ID NO: 2089143 - RNA, 18 nt, Homo sapiens
guuggaaaaugugcaaua

SEQ ID NO: 2089144 - RNA, 23 nt, Homo sapiens
auucacuggggcaugagauuuug

SEQ ID NO: 2089145 - RNA, 16 nt, Homo sapiens
gggagcccagugaagc

SEQ ID NO: 2089146 - RNA, 17 nt, Homo sapiens
uaguuuuuucuccucau

SEQ ID NO: 2089147 - RNA, 19 nt, Homo sapiens
cguaguuuuuucuccucau

SEQ ID NO: 2089148 - RNA, 16 nt, Homo sapiens
uuagccauaaauugcu

SEQ ID NO: 2089149 - RNA, 23 nt, Homo sapiens
ucuaaaggaaagaugauggugac

SEQ ID NO: 2089150 - RNA, 22 nt, Homo sapiens
gcucugauggcugcuccacugg

SEQ ID NO: 2089151 - RNA, 17 nt, Homo sapiens
cuucuuuaggcauuaaa

SEQ ID NO: 2089152 - RNA, 13 nt, Homo sapiens
cguuguguuguug

SEQ ID NO: 2089153 - RNA, 20 nt, Homo sapiens
uuccugacacucaauaaaca

SEQ ID NO: 2089154 - RNA, 21 nt, Homo sapiens
ccucagccuuccaacuagcug

SEQ ID NO: 2089155 - RNA, 17 nt, Homo sapiens
uccagccugggcaacag

SEQ ID NO: 2089156 - RNA, 19 nt, Homo sapiens
uuugcaaauucaagagccu

SEQ ID NO: 2089157 - RNA, 14 nt, Homo sapiens
agaagagacugcua

SEQ ID NO: 2089158 - RNA, 22 nt, Homo sapiens
uguauaucauacauuguuuuca

SEQ ID NO: 2089159 - RNA, 21 nt, Homo sapiens
augccaaguggcccucagauu

SEQ ID NO: 2089160 - RNA, 19 nt, Homo sapiens
cagaggaaggcuacuugag

SEQ ID NO: 2089161 - RNA, 23 nt, Homo sapiens
acugcgacgcagguguaccuccc

SEQ ID NO: 2089162 - RNA, 14 nt, Homo sapiens
cuuccccauggcag

SEQ ID NO: 2089163 - RNA, 16 nt, Homo sapiens
agccugaaaauuccaa

SEQ ID NO: 2089164 - RNA, 21 nt, Homo sapiens
ccugcucacccgccucuugcc

SEQ ID NO: 2089165 - RNA, 12 nt, Homo sapiens
ugauaugacccc

SEQ ID NO: 2089166 - RNA, 17 nt, Homo sapiens
guauuucaagucucuca

SEQ ID NO: 2089167 - RNA, 15 nt, Homo sapiens
acauauucaucagca

SEQ ID NO: 2089168 - RNA, 17 nt, Homo sapiens
uuauuuuguauuguggu

SEQ ID NO: 2089169 - RNA, 14 nt, Homo sapiens
gaaugaauccauua

SEQ ID NO: 2089170 - RNA, 17 nt, Homo sapiens
gcgggaggucugccagg

SEQ ID NO: 2089171 - RNA, 19 nt, Homo sapiens
agcaggacuuugaggcaag

SEQ ID NO: 2089172 - RNA, 14 nt, Homo sapiens
aagucucuagccuc

SEQ ID NO: 2089173 - RNA, 15 nt, Homo sapiens
auaccaucugguacu

SEQ ID NO: 2089174 - RNA, 17 nt, Homo sapiens
aauuauauuuuguugcu

SEQ ID NO: 2089175 - RNA, 13 nt, Homo sapiens
cuuagguuuuaac

SEQ ID NO: 2089176 - RNA, 21 nt, Homo sapiens
cugcuguuuuuaugauucagg

SEQ ID NO: 2089177 - RNA, 16 nt, Homo sapiens
cuggugcccagcacau

SEQ ID NO: 2089178 - RNA, 15 nt, Homo sapiens
ugaaauaaaacauuc

SEQ ID NO: 2089179 - RNA, 18 nt, Homo sapiens
acccaauuccacucugau

SEQ ID NO: 2089180 - RNA, 16 nt, Homo sapiens
cacccaccuccaccca

SEQ ID NO: 2089181 - RNA, 12 nt, Homo sapiens
aaccccacuucc

SEQ ID NO: 2089182 - RNA, 19 nt, Homo sapiens
ucacauuucaccccaggcu

SEQ ID NO: 2089183 - RNA, 19 nt, Homo sapiens
ucccagacaguggauauga

SEQ ID NO: 2089184 - RNA, 13 nt, Homo sapiens
ugcucagugcaaa

SEQ ID NO: 2089185 - RNA, 21 nt, Homo sapiens
augcaucugcuacugugucag

SEQ ID NO: 2089186 - RNA, 13 nt, Homo sapiens
cagcuggcacuga

SEQ ID NO: 2089187 - RNA, 21 nt, Homo sapiens
cucaugcauucuuuugcacac

SEQ ID NO: 2089188 - RNA, 19 nt, Homo sapiens
gacuuugcccccuugccca

SEQ ID NO: 2089189 - RNA, 16 nt, Homo sapiens
ccaggucuugacucau

SEQ ID NO: 2089190 - RNA, 23 nt, Homo sapiens
ugccuugaugaagccugugccac

SEQ ID NO: 2089191 - RNA, 16 nt, Homo sapiens
cuugaagaauauuguu

SEQ ID NO: 2089192 - RNA, 21 nt, Homo sapiens
cuuaagaacugcuucauguga

SEQ ID NO: 2089193 - RNA, 15 nt, Homo sapiens
ucugcagucucuaua

SEQ ID NO: 2089194 - RNA, 17 nt, Homo sapiens
ugaugauuaauucaccu

SEQ ID NO: 2089195 - RNA, 16 nt, Homo sapiens
gcuuguccaagacagg

SEQ ID NO: 2089196 - RNA, 15 nt, Homo sapiens
agaagggacauggga

SEQ ID NO: 2089197 - RNA, 16 nt, Homo sapiens
acaaauuacguacuaa

SEQ ID NO: 2089198 - RNA, 16 nt, Homo sapiens
cauuuguaccucgagu

SEQ ID NO: 2089199 - RNA, 15 nt, Homo sapiens
aggcuucauaaucau

SEQ ID NO: 2089200 - RNA, 15 nt, Homo sapiens
aaacuucauggucau

SEQ ID NO: 2089201 - RNA, 16 nt, Homo sapiens
gccuucaagugccaaa

SEQ ID NO: 2089202 - RNA, 16 nt, Homo sapiens
auucacaguugauaca

SEQ ID NO: 2089203 - RNA, 22 nt, Homo sapiens
cuuaaugcagacucuucuuaag

SEQ ID NO: 2089204 - RNA, 20 nt, Homo sapiens
cugaggugcuaugaagccaa

SEQ ID NO: 2089205 - RNA, 17 nt, Homo sapiens
agccugggccaucucuu

SEQ ID NO: 2089206 - RNA, 20 nt, Homo sapiens
uuucaaagaaaaggugucau

SEQ ID NO: 2089207 - RNA, 17 nt, Homo sapiens
uuaaaaaucagaaagac

SEQ ID NO: 2089208 - RNA, 17 nt, Homo sapiens
cuuuguaugcacuuugu

SEQ ID NO: 2089209 - RNA, 18 nt, Homo sapiens
gaguauguucauugccac

SEQ ID NO: 2089210 - RNA, 15 nt, Homo sapiens
ucagcucacugcaac

SEQ ID NO: 2089211 - RNA, 17 nt, Homo sapiens
caccaccccaguuuccu

SEQ ID NO: 2089212 - RNA, 17 nt, Homo sapiens
uacuucuuuagcauuuu

SEQ ID NO: 2089213 - RNA, 23 nt, Homo sapiens
gcaugacagcuguuccacagggg

SEQ ID NO: 2089214 - RNA, 23 nt, Homo sapiens
gaacacuggggacuuggccucuc

SEQ ID NO: 2089215 - RNA, 13 nt, Homo sapiens
uggccugacacaa

SEQ ID NO: 2089216 - RNA, 20 nt, Homo sapiens
acaaaaucuguacaugucuc

SEQ ID NO: 2089217 - RNA, 19 nt, Homo sapiens
gcccaugugcccacugucu

SEQ ID NO: 2089218 - RNA, 14 nt, Homo sapiens
cuauagugaacucu

SEQ ID NO: 2089219 - RNA, 13 nt, Homo sapiens
gccgcgugacgga

SEQ ID NO: 2089220 - RNA, 17 nt, Homo sapiens
gugucucaggcugccug

SEQ ID NO: 2089221 - RNA, 18 nt, Homo sapiens
ccucaauggaaccaaaua

SEQ ID NO: 2089222 - RNA, 16 nt, Homo sapiens
cuauuccaguguccau

SEQ ID NO: 2089223 - RNA, 17 nt, Homo sapiens
uguuguacauacagagg

SEQ ID NO: 2089224 - RNA, 22 nt, Homo sapiens
auaauuuauaguuaauguuaaa

SEQ ID NO: 2089225 - RNA, 18 nt, Homo sapiens
caacuccuaccgcgauac

SEQ ID NO: 2089226 - RNA, 17 nt, Homo sapiens
agauuuugucgggacag

SEQ ID NO: 2089227 - RNA, 13 nt, Homo sapiens
gcagcuauggaca

SEQ ID NO: 2089228 - RNA, 14 nt, Homo sapiens
cuucugugccucag

SEQ ID NO: 2089229 - RNA, 17 nt, Homo sapiens
gcuauuuuagaaagcua

SEQ ID NO: 2089230 - RNA, 18 nt, Homo sapiens
gguagagagaaacagcuu

SEQ ID NO: 2089231 - RNA, 16 nt, Homo sapiens
auuuguaucaguauca

SEQ ID NO: 2089232 - RNA, 18 nt, Homo sapiens
uauucaagaaagauaucu

SEQ ID NO: 2089233 - RNA, 22 nt, Homo sapiens
cuucugaugucucuaaagcacu

SEQ ID NO: 2089234 - RNA, 17 nt, Homo sapiens
aauuagguguacuguac

SEQ ID NO: 2089235 - RNA, 18 nt, Homo sapiens
guuacuuuggacugaguu

SEQ ID NO: 2089236 - RNA, 17 nt, Homo sapiens
uggucuuugaaagaaau

SEQ ID NO: 2089237 - RNA, 20 nt, Homo sapiens
guucgcauggucacacacug

SEQ ID NO: 2089238 - RNA, 20 nt, Homo sapiens
gucaccggggcaacugccug

SEQ ID NO: 2089239 - RNA, 20 nt, Homo sapiens
uuccuggcuccaacacugcu

SEQ ID NO: 2089240 - RNA, 18 nt, Homo sapiens
aguucuccagacaggguu

SEQ ID NO: 2089241 - RNA, 16 nt, Homo sapiens
auucuacacagagcag

SEQ ID NO: 2089242 - RNA, 13 nt, Homo sapiens
cuagaccauguca

SEQ ID NO: 2089243 - RNA, 22 nt, Homo sapiens
ucucauaugauugugcacauac

SEQ ID NO: 2089244 - RNA, 14 nt, Homo sapiens
gggcccuccuugcc

SEQ ID NO: 2089245 - RNA, 23 nt, Homo sapiens
aguuacugguaucugucacugac

SEQ ID NO: 2089246 - RNA, 19 nt, Homo sapiens
aaucuagagcuaugcacac

SEQ ID NO: 2089247 - RNA, 14 nt, Homo sapiens
acaaggugcacaga

SEQ ID NO: 2089248 - RNA, 14 nt, Homo sapiens
ccauggugaacuga

SEQ ID NO: 2089249 - RNA, 17 nt, Homo sapiens
auuccuacuugcaguac

SEQ ID NO: 2089250 - RNA, 13 nt, Homo sapiens
guaauugcauuau

SEQ ID NO: 2089251 - RNA, 21 nt, Homo sapiens
aaucagaaucuuuaaagagga

SEQ ID NO: 2089252 - RNA, 17 nt, Homo sapiens
auaaugguuuacugcug

SEQ ID NO: 2089253 - RNA, 16 nt, Homo sapiens
uuuauuuaacuauuca

SEQ ID NO: 2089254 - RNA, 14 nt, Homo sapiens
guagaagaagugaa

SEQ ID NO: 2089255 - RNA, 21 nt, Homo sapiens
ugcacacucaugcacacagau

SEQ ID NO: 2089256 - RNA, 21 nt, Homo sapiens
uuuagaaucuagaaauguuca

SEQ ID NO: 2089257 - RNA, 14 nt, Homo sapiens
ugaagcagaugugg

SEQ ID NO: 2089258 - RNA, 12 nt, Homo sapiens
cacuaacacugg

SEQ ID NO: 2089259 - RNA, 12 nt, Homo sapiens
cuggaacacacu

SEQ ID NO: 2089260 - RNA, 12 nt, Homo sapiens
cauuuucaccuc

SEQ ID NO: 2089261 - RNA, 16 nt, Homo sapiens
uccugggaaugaagca

SEQ ID NO: 2089262 - RNA, 19 nt, Homo sapiens
auugcugccaggcacuguu

SEQ ID NO: 2089263 - RNA, 15 nt, Homo sapiens
gaaaagucuuugcua

SEQ ID NO: 2089264 - RNA, 15 nt, Homo sapiens
ugagcuaacgugcug

SEQ ID NO: 2089265 - RNA, 23 nt, Homo sapiens
uugugagaugauuuguacuugga

SEQ ID NO: 2089266 - RNA, 21 nt, Homo sapiens
aagaguuugccuguacucuua

SEQ ID NO: 2089267 - RNA, 20 nt, Homo sapiens
auuauuuauaaugcuuggaa

SEQ ID NO: 2089268 - RNA, 22 nt, Homo sapiens
uccuacagcccuuuguacuuca

SEQ ID NO: 2089269 - RNA, 14 nt, Homo sapiens
accacaucugccag

SEQ ID NO: 2089270 - RNA, 16 nt, Homo sapiens
caauaaaagaaacugu

SEQ ID NO: 2089271 - RNA, 15 nt, Homo sapiens
ccuagccgaccucag

SEQ ID NO: 2089272 - RNA, 21 nt, Homo sapiens
acuugugcagacgccacaguc

SEQ ID NO: 2089273 - RNA, 13 nt, Homo sapiens
cacacacagaugc

SEQ ID NO: 2089274 - RNA, 18 nt, Homo sapiens
uaaucuuggauagcuaau

SEQ ID NO: 2089275 - RNA, 14 nt, Homo sapiens
acuuugauacaaau

SEQ ID NO: 2089276 - RNA, 14 nt, Homo sapiens
accacccaccaguu

SEQ ID NO: 2089277 - RNA, 15 nt, Homo sapiens
cucauguucauucag

SEQ ID NO: 2089278 - RNA, 15 nt, Homo sapiens
gauuuagauaugcaa

SEQ ID NO: 2089279 - RNA, 16 nt, Homo sapiens
acaaaccacugugaac

SEQ ID NO: 2089280 - RNA, 13 nt, Homo sapiens
cccuucagucuuc

SEQ ID NO: 2089281 - RNA, 21 nt, Homo sapiens
acucuaucugucauacauccu

SEQ ID NO: 2089282 - RNA, 17 nt, Homo sapiens
cagguucccagcagcug

SEQ ID NO: 2089283 - RNA, 22 nt, Homo sapiens
gcgugugccaggcagauccucu

SEQ ID NO: 2089284 - RNA, 19 nt, Homo sapiens
uucaugacacaaccuuuca

SEQ ID NO: 2089285 - RNA, 20 nt, Homo sapiens
uuuuaacaaacgcauuaaga

SEQ ID NO: 2089286 - RNA, 16 nt, Homo sapiens
guucuccuccuauuca

SEQ ID NO: 2089287 - RNA, 23 nt, Homo sapiens
cuuuugaugaaauaaaauaucaa

SEQ ID NO: 2089288 - RNA, 22 nt, Homo sapiens
uaaacuugaguuggaguacuau

SEQ ID NO: 2089289 - RNA, 19 nt, Homo sapiens
gcucagaaggaauggugcg

SEQ ID NO: 2089290 - RNA, 21 nt, Homo sapiens
uccucugccacucccugcugu

SEQ ID NO: 2089291 - RNA, 18 nt, Homo sapiens
aauaaauagcaucuagua

SEQ ID NO: 2089292 - RNA, 20 nt, Homo sapiens
agggucccuggaucaggguu

SEQ ID NO: 2089293 - RNA, 21 nt, Homo sapiens
uuagaaugaugcacauuucau

SEQ ID NO: 2089294 - RNA, 14 nt, Homo sapiens
agauuucuauggua

SEQ ID NO: 2089295 - RNA, 20 nt, Homo sapiens
cagaacuucccuccauccac

SEQ ID NO: 2089296 - RNA, 18 nt, Homo sapiens
ccuuuuaaaaggagcaca

SEQ ID NO: 2089297 - RNA, 15 nt, Homo sapiens
caauagaauaccucc

SEQ ID NO: 2089298 - RNA, 19 nt, Homo sapiens
gccaggauucaggccucug

SEQ ID NO: 2089299 - RNA, 22 nt, Homo sapiens
uuuuaggaagcuagacuagcug

SEQ ID NO: 2089300 - RNA, 22 nt, Homo sapiens
gagcaguaaacuuucucugcaa

SEQ ID NO: 2089301 - RNA, 19 nt, Homo sapiens
gaaauaaaggaugugauug

SEQ ID NO: 2089302 - RNA, 14 nt, Homo sapiens
gaguguccggcuga

SEQ ID NO: 2089303 - RNA, 22 nt, Homo sapiens
agaagggggccuaggguggucu

SEQ ID NO: 2089304 - RNA, 13 nt, Homo sapiens
ucaagucaaggaa

SEQ ID NO: 2089305 - RNA, 16 nt, Homo sapiens
uuuccccucugugucc

SEQ ID NO: 2089306 - RNA, 23 nt, Homo sapiens
agcccugggugcaggacacuggu

SEQ ID NO: 2089307 - RNA, 14 nt, Homo sapiens
cugggccaugucca

SEQ ID NO: 2089308 - RNA, 18 nt, Homo sapiens
ccugagcccuaaacacac

SEQ ID NO: 2089309 - RNA, 19 nt, Homo sapiens
ugagauaaaugagugauuc

SEQ ID NO: 2089310 - RNA, 13 nt, Homo sapiens
aauacuuuugcug

SEQ ID NO: 2089311 - RNA, 16 nt, Homo sapiens
acuuugugcaauauga

SEQ ID NO: 2089312 - RNA, 17 nt, Homo sapiens
gccccugauccugugaa

SEQ ID NO: 2089313 - RNA, 22 nt, Homo sapiens
ugagagcaggccauuggcuacu

SEQ ID NO: 2089314 - RNA, 21 nt, Homo sapiens
guccugcuugaacugcugcca

SEQ ID NO: 2089315 - RNA, 15 nt, Homo sapiens
aagccuuaagcaaau

SEQ ID NO: 2089316 - RNA, 22 nt, Homo sapiens
ucagacaucuccagugugccag

SEQ ID NO: 2089317 - RNA, 19 nt, Homo sapiens
ccuaaugaaagugaugaca

SEQ ID NO: 2089318 - RNA, 23 nt, Homo sapiens
acaaauuugggagggugagacac

SEQ ID NO: 2089319 - RNA, 17 nt, Homo sapiens
acauugggacaacacuu

SEQ ID NO: 2089320 - RNA, 22 nt, Homo sapiens
aggaacugggccaacucaccug

SEQ ID NO: 2089321 - RNA, 17 nt, Homo sapiens
ucacagggguacagaaa

SEQ ID NO: 2089322 - RNA, 15 nt, Homo sapiens
aacccagauugaagc

SEQ ID NO: 2089323 - RNA, 19 nt, Homo sapiens
aaaauaaaaggauuaugua

SEQ ID NO: 2089324 - RNA, 22 nt, Homo sapiens
auucuuauuauuuuugagacag

SEQ ID NO: 2089325 - RNA, 12 nt, Homo sapiens
auucagcacuua

SEQ ID NO: 2089326 - RNA, 12 nt, Homo sapiens
auacuacuguaa

SEQ ID NO: 2089327 - RNA, 17 nt, Homo sapiens
uuaugagacacaggaug

SEQ ID NO: 2089328 - RNA, 23 nt, Homo sapiens
uaaaaugcaacauguguacuuaa

SEQ ID NO: 2089329 - RNA, 15 nt, Homo sapiens
uaccacucuaaucaa

SEQ ID NO: 2089330 - RNA, 16 nt, Homo sapiens
ucccacgggaccuggg

SEQ ID NO: 2089331 - RNA, 11 nt, Homo sapiens
aagugcuguuu

SEQ ID NO: 2089332 - RNA, 12 nt, Homo sapiens
cuggacugacca

SEQ ID NO: 2089333 - RNA, 17 nt, Homo sapiens
ucuggaccugguacaaa

SEQ ID NO: 2089334 - RNA, 19 nt, Homo sapiens
agguucuaauguguggaau

SEQ ID NO: 2089335 - RNA, 22 nt, Homo sapiens
uuucagagagcuucuuacugga

SEQ ID NO: 2089336 - RNA, 14 nt, Homo sapiens
aaaguuacuacuga

SEQ ID NO: 2089337 - RNA, 22 nt, Homo sapiens
aauauauagcauuuaugguaau

SEQ ID NO: 2089338 - RNA, 17 nt, Homo sapiens
caagccccauuuccuca

SEQ ID NO: 2089339 - RNA, 16 nt, Homo sapiens
aacauaaaaaccaaac

SEQ ID NO: 2089340 - RNA, 18 nt, Homo sapiens
uagaggauagggagaaua

SEQ ID NO: 2089341 - RNA, 16 nt, Homo sapiens
guaaauuccccuuccc

SEQ ID NO: 2089342 - RNA, 17 nt, Homo sapiens
aaugcuggccuguggug

SEQ ID NO: 2089343 - RNA, 20 nt, Homo sapiens
uaccuagagcaggcacuuga

SEQ ID NO: 2089344 - RNA, 17 nt, Homo sapiens
auuuguaaaucugccac

SEQ ID NO: 2089345 - RNA, 12 nt, Homo sapiens
acuauuuuccag

SEQ ID NO: 2089346 - RNA, 12 nt, Homo sapiens
uagucccagaaa

SEQ ID NO: 2089347 - RNA, 22 nt, Homo sapiens
aaccugggguuuugacuugcca

SEQ ID NO: 2089348 - RNA, 20 nt, Homo sapiens
ugugauguaccaguuugucc

SEQ ID NO: 2089349 - RNA, 14 nt, Homo sapiens
ccacacugcuacac

SEQ ID NO: 2089350 - RNA, 15 nt, Homo sapiens
ucaccucauucugaa

SEQ ID NO: 2089351 - RNA, 19 nt, Homo sapiens
ccgcuuucaugaacacagc

SEQ ID NO: 2089352 - RNA, 13 nt, Homo sapiens
uggccucugugau

SEQ ID NO: 2089353 - RNA, 14 nt, Homo sapiens
ucaaugaccuguau

SEQ ID NO: 2089354 - RNA, 23 nt, Homo sapiens
cgagguauggcagaggugcaaga

SEQ ID NO: 2089355 - RNA, 13 nt, Homo sapiens
ugaccccaggaag

SEQ ID NO: 2089356 - RNA, 13 nt, Homo sapiens
ugcccccaggcag

SEQ ID NO: 2089357 - RNA, 14 nt, Homo sapiens
ucaggugcuacaca

SEQ ID NO: 2089358 - RNA, 19 nt, Homo sapiens
uaugacuguaucuugauau

SEQ ID NO: 2089359 - RNA, 16 nt, Homo sapiens
cuugcuugcaauaggu

SEQ ID NO: 2089360 - RNA, 14 nt, Homo sapiens
gcuuacagugacug

SEQ ID NO: 2089361 - RNA, 22 nt, Homo sapiens
gauuacaagcgugagccacugc

SEQ ID NO: 2089362 - RNA, 12 nt, Homo sapiens
caucaaagcccu

SEQ ID NO: 2089363 - RNA, 14 nt, Homo sapiens
uggcuccacuggga

SEQ ID NO: 2089364 - RNA, 12 nt, Homo sapiens
acauagcugugc

SEQ ID NO: 2089365 - RNA, 21 nt, Homo sapiens
caagugauuugggggugcaau

SEQ ID NO: 2089366 - RNA, 16 nt, Homo sapiens
gucuguuacacuggag

SEQ ID NO: 2089367 - RNA, 18 nt, Homo sapiens
agaagcacugggugacca

SEQ ID NO: 2089368 - RNA, 20 nt, Homo sapiens
uccaucaccugaaacacugg

SEQ ID NO: 2089369 - RNA, 18 nt, Homo sapiens
cugaguggcaggggacag

SEQ ID NO: 2089370 - RNA, 18 nt, Homo sapiens
cccauuuguaauuuguaa

SEQ ID NO: 2089371 - RNA, 20 nt, Homo sapiens
cucaugucugaaaaaugccu

SEQ ID NO: 2089372 - RNA, 23 nt, Homo sapiens
aagaaauucugcaagcuuuucaa

SEQ ID NO: 2089373 - RNA, 18 nt, Homo sapiens
agugcaguggcaucaucu

SEQ ID NO: 2089374 - RNA, 15 nt, Homo sapiens
gucccaaucuuacca

SEQ ID NO: 2089375 - RNA, 20 nt, Homo sapiens
aaucuaaaccuuacaugugu

SEQ ID NO: 2089376 - RNA, 20 nt, Homo sapiens
aaagucugcauuacauuccu

SEQ ID NO: 2089377 - RNA, 23 nt, Homo sapiens
agcacagagagggacacaugccc

SEQ ID NO: 2089378 - RNA, 16 nt, Homo sapiens
cugaaccaaauugcac

SEQ ID NO: 2089379 - RNA, 15 nt, Homo sapiens
acagacucugugaga

SEQ ID NO: 2089380 - RNA, 13 nt, Homo sapiens
ccauaaaguguaa

SEQ ID NO: 2089381 - RNA, 13 nt, Homo sapiens
gaagagaaaagac

SEQ ID NO: 2089382 - RNA, 20 nt, Homo sapiens
aaaaugcugcuucuccuccc

SEQ ID NO: 2089383 - RNA, 18 nt, Homo sapiens
auugcagcaggugguaau

SEQ ID NO: 2089384 - RNA, 24 nt, Homo sapiens
gcgcgcagcgcgugcacagcgcgg

SEQ ID NO: 2089385 - RNA, 20 nt, Homo sapiens
cuugcuugacucuacuauua

SEQ ID NO: 2089386 - RNA, 11 nt, Homo sapiens
auuacuuugau

SEQ ID NO: 2089387 - RNA, 11 nt, Homo sapiens
aucacuuugac

SEQ ID NO: 2089388 - RNA, 22 nt, Homo sapiens
accacuucagaaauauaugcag

SEQ ID NO: 2089389 - RNA, 15 nt, Homo sapiens
auacaaaaauuccuu

SEQ ID NO: 2089390 - RNA, 20 nt, Homo sapiens
accaaccuuuucccaaccau

SEQ ID NO: 2089391 - RNA, 23 nt, Homo sapiens
cagugauauaugccuauaauaua

SEQ ID NO: 2089392 - RNA, 22 nt, Homo sapiens
guuuuauaauuaaucagcucgu

SEQ ID NO: 2089393 - RNA, 17 nt, Homo sapiens
aagauccuucgggugcu

SEQ ID NO: 2089394 - RNA, 23 nt, Homo sapiens
caugcagaaacuuggaugucacu

SEQ ID NO: 2089395 - RNA, 16 nt, Homo sapiens
uccaagucaacacucu

SEQ ID NO: 2089396 - RNA, 14 nt, Homo sapiens
uguuguuauggcaa

SEQ ID NO: 2089397 - RNA, 14 nt, Homo sapiens
gacugauccaaaaa

SEQ ID NO: 2089398 - RNA, 23 nt, Homo sapiens
uauuagcucacugaaucuucacg

SEQ ID NO: 2089399 - RNA, 20 nt, Homo sapiens
auguguagggaaaguuaaaa

SEQ ID NO: 2089400 - RNA, 18 nt, Homo sapiens
aaguauuuaguuauauca

SEQ ID NO: 2089401 - RNA, 20 nt, Homo sapiens
guauucccacaccaggucuu

SEQ ID NO: 2089402 - RNA, 13 nt, Homo sapiens
cagucuucugacu

SEQ ID NO: 2089403 - RNA, 12 nt, Homo sapiens
acucaaaccaaa

SEQ ID NO: 2089404 - RNA, 18 nt, Homo sapiens
ucauuuuuguaucuacau

SEQ ID NO: 2089405 - RNA, 18 nt, Homo sapiens
uuagagggacccuuccaa

SEQ ID NO: 2089406 - RNA, 13 nt, Homo sapiens
uuaacuugccaca

SEQ ID NO: 2089407 - RNA, 13 nt, Homo sapiens
cuuuuugccauuu

SEQ ID NO: 2089408 - RNA, 19 nt, Homo sapiens
ccauaggcacuugggaugu

SEQ ID NO: 2089409 - RNA, 19 nt, Homo sapiens
aaagugccaggugaucucc

SEQ ID NO: 2089410 - RNA, 20 nt, Homo sapiens
caggugugagccacugcacc

SEQ ID NO: 2089411 - RNA, 22 nt, Homo sapiens
gcuucuuaaucuuuucacaaau

SEQ ID NO: 2089412 - RNA, 23 nt, Homo sapiens
cuuaguucugguugauucacuca

SEQ ID NO: 2089413 - RNA, 19 nt, Homo sapiens
cacauguaucuaugcauuu

SEQ ID NO: 2089414 - RNA, 12 nt, Homo sapiens
aucccugagauc

SEQ ID NO: 2089415 - RNA, 18 nt, Homo sapiens
cggccaccagaugcugaa

SEQ ID NO: 2089416 - RNA, 20 nt, Homo sapiens
agcggugguuuguaauuccu

SEQ ID NO: 2089417 - RNA, 23 nt, Homo sapiens
acaccgaguggcccuucauguac

SEQ ID NO: 2089418 - RNA, 21 nt, Homo sapiens
cacaguuuugguugcuuuaau

SEQ ID NO: 2089419 - RNA, 17 nt, Homo sapiens
aggaacucacauacuga

SEQ ID NO: 2089420 - RNA, 13 nt, Homo sapiens
gggaccugugauc

SEQ ID NO: 2089421 - RNA, 17 nt, Homo sapiens
ccauccaauucuuugaa

SEQ ID NO: 2089422 - RNA, 12 nt, Homo sapiens
gcacaaaccuua

SEQ ID NO: 2089423 - RNA, 13 nt, Homo sapiens
guugcagcuguca

SEQ ID NO: 2089424 - RNA, 14 nt, Homo sapiens
caaguauugcgaau

SEQ ID NO: 2089425 - RNA, 17 nt, Homo sapiens
cuuugcaccaaagacau

SEQ ID NO: 2089426 - RNA, 15 nt, Homo sapiens
aaugcaucucaucaa

SEQ ID NO: 2089427 - RNA, 22 nt, Homo sapiens
cuaggauaaaccaaucaucuua

SEQ ID NO: 2089428 - RNA, 15 nt, Homo sapiens
uagcauugggaggaa

SEQ ID NO: 2089429 - RNA, 17 nt, Homo sapiens
auucuuuggaguuguca

SEQ ID NO: 2089430 - RNA, 22 nt, Homo sapiens
ucuccuguuuguugagugcacu

SEQ ID NO: 2089431 - RNA, 17 nt, Homo sapiens
gaggacacacagucuca

SEQ ID NO: 2089432 - RNA, 21 nt, Homo sapiens
cagcgagcugugcaacguggg

SEQ ID NO: 2089433 - RNA, 20 nt, Homo sapiens
agucucugaauacacaguau

SEQ ID NO: 2089434 - RNA, 17 nt, Homo sapiens
uucacucugcucucagg

SEQ ID NO: 2089435 - RNA, 16 nt, Homo sapiens
ccaaggacucuuccac

SEQ ID NO: 2089436 - RNA, 19 nt, Homo sapiens
gagcccggcaacucuagua

SEQ ID NO: 2089437 - RNA, 23 nt, Homo sapiens
gugauggggaggggcauugcuga

SEQ ID NO: 2089438 - RNA, 15 nt, Homo sapiens
aacauauuugcacaa

SEQ ID NO: 2089439 - RNA, 18 nt, Homo sapiens
ugcuuuguagaacagagc

SEQ ID NO: 2089440 - RNA, 21 nt, Homo sapiens
gaaaaggucugaggacugagc

SEQ ID NO: 2089441 - RNA, 16 nt, Homo sapiens
ucuaaaagauccuuuu

SEQ ID NO: 2089442 - RNA, 16 nt, Homo sapiens
augagaaacucuugag

SEQ ID NO: 2089443 - RNA, 19 nt, Homo sapiens
cccacugagcuguggaugg

SEQ ID NO: 2089444 - RNA, 20 nt, Homo sapiens
uucuagugcuuuucagugau

SEQ ID NO: 2089445 - RNA, 20 nt, Homo sapiens
gggaaucucauccaucacag

SEQ ID NO: 2089446 - RNA, 19 nt, Homo sapiens
cuauacuuaaucuaagaaa

SEQ ID NO: 2089447 - RNA, 13 nt, Homo sapiens
accagacacugcc

SEQ ID NO: 2089448 - RNA, 13 nt, Homo sapiens
ugugucaccauca

SEQ ID NO: 2089449 - RNA, 13 nt, Homo sapiens
uguugcuagggag

SEQ ID NO: 2089450 - RNA, 14 nt, Homo sapiens
cuaaaauauuucau

SEQ ID NO: 2089451 - RNA, 14 nt, Homo sapiens
ugcagacaggccau

SEQ ID NO: 2089452 - RNA, 16 nt, Homo sapiens
uuccaugaguuacacu

SEQ ID NO: 2089453 - RNA, 21 nt, Homo sapiens
guuugaucauuucuugugaug

SEQ ID NO: 2089454 - RNA, 14 nt, Homo sapiens
acugugagacugua

SEQ ID NO: 2089455 - RNA, 20 nt, Homo sapiens
ucugaaucagccagucucag

SEQ ID NO: 2089456 - RNA, 18 nt, Homo sapiens
cagugguaaaaguauuug

SEQ ID NO: 2089457 - RNA, 15 nt, Homo sapiens
gcacacacagugauu

SEQ ID NO: 2089458 - RNA, 13 nt, Homo sapiens
aaagaaaacucua

SEQ ID NO: 2089459 - RNA, 21 nt, Homo sapiens
gagauguggcaaagugcugua

SEQ ID NO: 2089460 - RNA, 17 nt, Homo sapiens
ucagacaaauucauucc

SEQ ID NO: 2089461 - RNA, 14 nt, Homo sapiens
augcacacugagaa

SEQ ID NO: 2089462 - RNA, 16 nt, Homo sapiens
ccaaggcaguguuccu

SEQ ID NO: 2089463 - RNA, 22 nt, Homo sapiens
uguccauuuacagcccucagca

SEQ ID NO: 2089464 - RNA, 15 nt, Homo sapiens
uucuuuaaaggcauc

SEQ ID NO: 2089465 - RNA, 23 nt, Homo sapiens
ucccagggcuggcucugcacuaa

SEQ ID NO: 2089466 - RNA, 14 nt, Homo sapiens
uuugggcagugcca

SEQ ID NO: 2089467 - RNA, 23 nt, Homo sapiens
ccgugguuucucaugagcugugu

SEQ ID NO: 2089468 - RNA, 23 nt, Homo sapiens
aaaaaugcugagccagccaucuu

SEQ ID NO: 2089469 - RNA, 15 nt, Homo sapiens
augaaauacugagau

SEQ ID NO: 2089470 - RNA, 21 nt, Homo sapiens
cauggauuuauugagugccaa

SEQ ID NO: 2089471 - RNA, 17 nt, Homo sapiens
caaucacuugaaaguga

SEQ ID NO: 2089472 - RNA, 14 nt, Homo sapiens
gggcugagggaugg

SEQ ID NO: 2089473 - RNA, 16 nt, Homo sapiens
auugagcuguacaugc

SEQ ID NO: 2089474 - RNA, 20 nt, Homo sapiens
ugacugggaccugaaugacc

SEQ ID NO: 2089475 - RNA, 14 nt, Homo sapiens
uuggaggccuuccc

SEQ ID NO: 2089476 - RNA, 14 nt, Homo sapiens
augugcaaguuuau

SEQ ID NO: 2089477 - RNA, 16 nt, Homo sapiens
cagaucauauuucaca

SEQ ID NO: 2089478 - RNA, 20 nt, Homo sapiens
ccagaaguucgagacuagcc

SEQ ID NO: 2089479 - RNA, 14 nt, Homo sapiens
acuauaaauauaca

SEQ ID NO: 2089480 - RNA, 13 nt, Homo sapiens
uaauaagugcuuu

SEQ ID NO: 2089481 - RNA, 22 nt, Homo sapiens
cagagugccugcauucccagga

SEQ ID NO: 2089482 - RNA, 16 nt, Homo sapiens
caguggcugugccacc

SEQ ID NO: 2089483 - RNA, 16 nt, Homo sapiens
gacucgguuucuccaa

SEQ ID NO: 2089484 - RNA, 17 nt, Homo sapiens
ugcaagaauuaaaacug

SEQ ID NO: 2089485 - RNA, 22 nt, Homo sapiens
caggauuguuucucggcaccag

SEQ ID NO: 2089486 - RNA, 12 nt, Homo sapiens
uaaaauucauuu

SEQ ID NO: 2089487 - RNA, 15 nt, Homo sapiens
auuauuucaauguga

SEQ ID NO: 2089488 - RNA, 16 nt, Homo sapiens
acucuuaucuacauaa

SEQ ID NO: 2089489 - RNA, 20 nt, Homo sapiens
ccuguucuuugaaguggcac

SEQ ID NO: 2089490 - RNA, 15 nt, Homo sapiens
ucauucacucaacaa

SEQ ID NO: 2089491 - RNA, 23 nt, Homo sapiens
agaagugggugggcacacugaac

SEQ ID NO: 2089492 - RNA, 22 nt, Homo sapiens
accacaaagcacaguuugaaca

SEQ ID NO: 2089493 - RNA, 19 nt, Homo sapiens
caaguauguugauaaauga

SEQ ID NO: 2089494 - RNA, 15 nt, Homo sapiens
uuguuugcaucugaa

SEQ ID NO: 2089495 - RNA, 23 nt, Homo sapiens
cacuauucuuggaccaugccaga

SEQ ID NO: 2089496 - RNA, 16 nt, Homo sapiens
acauguucaucuggaa

SEQ ID NO: 2089497 - RNA, 16 nt, Homo sapiens
caagggagacugacca

SEQ ID NO: 2089498 - RNA, 19 nt, Homo sapiens
ccagguugcugugggugca

SEQ ID NO: 2089499 - RNA, 17 nt, Homo sapiens
gucucacagaggcagua

SEQ ID NO: 2089500 - RNA, 19 nt, Homo sapiens
ggccuguacccaguagaug

SEQ ID NO: 2089501 - RNA, 16 nt, Homo sapiens
cuuugaaacuaucuca

SEQ ID NO: 2089502 - RNA, 20 nt, Homo sapiens
uagauuaaauaaaacuuaaa

SEQ ID NO: 2089503 - RNA, 17 nt, Homo sapiens
uauggaggcaagccagu

SEQ ID NO: 2089504 - RNA, 18 nt, Homo sapiens
caacugcagugaccaggg

SEQ ID NO: 2089505 - RNA, 22 nt, Homo sapiens
ucccacaacuacuagugugacu

SEQ ID NO: 2089506 - RNA, 13 nt, Homo sapiens
aagggcacuccca

SEQ ID NO: 2089507 - RNA, 19 nt, Homo sapiens
ugaacccagagucaggaag

SEQ ID NO: 2089508 - RNA, 18 nt, Homo sapiens
ucuuuugagggcuaaaaa

SEQ ID NO: 2089509 - RNA, 19 nt, Homo sapiens
ucuguauuuuauuuagaca

SEQ ID NO: 2089510 - RNA, 20 nt, Homo sapiens
acagcuguucugaauugucu

SEQ ID NO: 2089511 - RNA, 20 nt, Homo sapiens
caaccauaaaauugucauaa

SEQ ID NO: 2089512 - RNA, 19 nt, Homo sapiens
acugcuuuuaaaagugcac

SEQ ID NO: 2089513 - RNA, 16 nt, Homo sapiens
cugucuuccacuguac

SEQ ID NO: 2089514 - RNA, 17 nt, Homo sapiens
agucuauguauguguaa

SEQ ID NO: 2089515 - RNA, 13 nt, Homo sapiens
uccagucauacca

SEQ ID NO: 2089516 - RNA, 16 nt, Homo sapiens
uugagacagaguuuca

SEQ ID NO: 2089517 - RNA, 23 nt, Homo sapiens
acuugucauuuuuguuucugaaa

SEQ ID NO: 2089518 - RNA, 16 nt, Homo sapiens
augucaucauacauga

SEQ ID NO: 2089519 - RNA, 16 nt, Homo sapiens
augguggcucaugccu

SEQ ID NO: 2089520 - RNA, 12 nt, Homo sapiens
uuaacauucaca

SEQ ID NO: 2089521 - RNA, 14 nt, Homo sapiens
gacugggaccugaa

SEQ ID NO: 2089522 - RNA, 21 nt, Homo sapiens
uuugaaaugaaauuuaaacau

SEQ ID NO: 2089523 - RNA, 18 nt, Homo sapiens
acaagaauguaacuccag

SEQ ID NO: 2089524 - RNA, 21 nt, Homo sapiens
gcuguccagggcagaggccau

SEQ ID NO: 2089525 - RNA, 15 nt, Homo sapiens
ucagagaaauaaaga

SEQ ID NO: 2089526 - RNA, 18 nt, Homo sapiens
gaguguccuggcugugaa

SEQ ID NO: 2089527 - RNA, 17 nt, Homo sapiens
uuaacuaugugauguua

SEQ ID NO: 2089528 - RNA, 18 nt, Homo sapiens
cucuuaaaagaugccuua

SEQ ID NO: 2089529 - RNA, 13 nt, Homo sapiens
acugugcaguuuu

SEQ ID NO: 2089530 - RNA, 12 nt, Homo sapiens
ucuuugcuacaa

SEQ ID NO: 2089531 - RNA, 20 nt, Homo sapiens
aucacuaccuuuauagcuca

SEQ ID NO: 2089532 - RNA, 21 nt, Homo sapiens
auaauccuaaacauaugaauu

SEQ ID NO: 2089533 - RNA, 12 nt, Homo sapiens
cccaggaguaca

SEQ ID NO: 2089534 - RNA, 19 nt, Homo sapiens
ccagacaccaugugcaaua

SEQ ID NO: 2089535 - RNA, 14 nt, Homo sapiens
agauagaccuguga

SEQ ID NO: 2089536 - RNA, 20 nt, Homo sapiens
agccuuaauuugcacagugu

SEQ ID NO: 2089537 - RNA, 22 nt, Homo sapiens
uaugcuggacucuggaccauau

SEQ ID NO: 2089538 - RNA, 19 nt, Homo sapiens
ugccagcaaugacaucuca

SEQ ID NO: 2089539 - RNA, 15 nt, Homo sapiens
cacaccuuccagggc

SEQ ID NO: 2089540 - RNA, 23 nt, Homo sapiens
uagccaagugcagggccuguaau

SEQ ID NO: 2089541 - RNA, 22 nt, Homo sapiens
caguaccccugguaaaccaagc

SEQ ID NO: 2089542 - RNA, 20 nt, Homo sapiens
uuauugucuauuuuauaucu

SEQ ID NO: 2089543 - RNA, 16 nt, Homo sapiens
acuacccgagcccagc

SEQ ID NO: 2089544 - RNA, 22 nt, Homo sapiens
acaauagauaagguuuccugcu

SEQ ID NO: 2089545 - RNA, 16 nt, Homo sapiens
cacucaggcuggagua

SEQ ID NO: 2089546 - RNA, 22 nt, Homo sapiens
cccagcagugccuugugcaaug

SEQ ID NO: 2089547 - RNA, 20 nt, Homo sapiens
uugcacauuaaucagauuag

SEQ ID NO: 2089548 - RNA, 13 nt, Homo sapiens
ucucagagcauuu

SEQ ID NO: 2089549 - RNA, 15 nt, Homo sapiens
cuauaaacauaugca

SEQ ID NO: 2089550 - RNA, 13 nt, Homo sapiens
ucuuuauacagcu

SEQ ID NO: 2089551 - RNA, 15 nt, Homo sapiens
ugcagaacguauuua

SEQ ID NO: 2089552 - RNA, 13 nt, Homo sapiens
agcaggacuccag

SEQ ID NO: 2089553 - RNA, 13 nt, Homo sapiens
acggggacugggg

SEQ ID NO: 2089554 - RNA, 15 nt, Homo sapiens
augcugcucaucccc

SEQ ID NO: 2089555 - RNA, 13 nt, Homo sapiens
ccucagggaccaa

SEQ ID NO: 2089556 - RNA, 18 nt, Homo sapiens
uaaccaaaaaaguuacaa

SEQ ID NO: 2089557 - RNA, 21 nt, Homo sapiens
uacugaagaacaguacuccac

SEQ ID NO: 2089558 - RNA, 16 nt, Homo sapiens
accauguauucaucca

SEQ ID NO: 2089559 - RNA, 23 nt, Homo sapiens
cccagagcgaggaaaggauuuua

SEQ ID NO: 2089560 - RNA, 17 nt, Homo sapiens
uaccaucuuaaucuuua

SEQ ID NO: 2089561 - RNA, 12 nt, Homo sapiens
auaucagaaaag

SEQ ID NO: 2089562 - RNA, 13 nt, Homo sapiens
cuuuuguacugaa

SEQ ID NO: 2089563 - RNA, 23 nt, Homo sapiens
agagauguguguguguguaggua

SEQ ID NO: 2089564 - RNA, 21 nt, Homo sapiens
gaccccaagaguuuugggagu

SEQ ID NO: 2089565 - RNA, 18 nt, Homo sapiens
augggagccucagacuca

SEQ ID NO: 2089566 - RNA, 16 nt, Homo sapiens
aaacauagucagcucu

SEQ ID NO: 2089567 - RNA, 13 nt, Homo sapiens
cccacagccauag

SEQ ID NO: 2089568 - RNA, 13 nt, Homo sapiens
aaccagagaggcu

SEQ ID NO: 2089569 - RNA, 18 nt, Homo sapiens
aacauuaggaguaacuuu

SEQ ID NO: 2089570 - RNA, 16 nt, Homo sapiens
aguggaaccguugcca

SEQ ID NO: 2089571 - RNA, 23 nt, Homo sapiens
aaacauuuucuugaauggcaugc

SEQ ID NO: 2089572 - RNA, 20 nt, Homo sapiens
cauaccuguuguacacuugg

SEQ ID NO: 2089573 - RNA, 22 nt, Homo sapiens
cuccuugggaggccccacuggg

SEQ ID NO: 2089574 - RNA, 22 nt, Homo sapiens
gaaauagugcacuccaagaaac

SEQ ID NO: 2089575 - RNA, 19 nt, Homo sapiens
cuacugagggcaguucuga

SEQ ID NO: 2089576 - RNA, 23 nt, Homo sapiens
uaagggaguggccucauuucacu

SEQ ID NO: 2089577 - RNA, 12 nt, Homo sapiens
auguacuugaag

SEQ ID NO: 2089578 - RNA, 14 nt, Homo sapiens
uaauaccuuucuaa

SEQ ID NO: 2089579 - RNA, 16 nt, Homo sapiens
gaauuaacacaugauc

SEQ ID NO: 2089580 - RNA, 19 nt, Homo sapiens
uucuaagagcagcagcaua

SEQ ID NO: 2089581 - RNA, 23 nt, Homo sapiens
aucacucuaauucggauuugcca

SEQ ID NO: 2089582 - RNA, 20 nt, Homo sapiens
uuucuccuguuggcucacag

SEQ ID NO: 2089583 - RNA, 14 nt, Homo sapiens
gccugccccugacu

SEQ ID NO: 2089584 - RNA, 19 nt, Homo sapiens
gucccucuucucuccucag

SEQ ID NO: 2089585 - RNA, 14 nt, Homo sapiens
aaaguaauugagug

SEQ ID NO: 2089586 - RNA, 15 nt, Homo sapiens
uaaaugaagugcaaa

SEQ ID NO: 2089587 - RNA, 12 nt, Homo sapiens
uuuagcucugag

SEQ ID NO: 2089588 - RNA, 13 nt, Homo sapiens
ggccaugccucag

SEQ ID NO: 2089589 - RNA, 19 nt, Homo sapiens
cagagagccuagaacaucc

SEQ ID NO: 2089590 - RNA, 18 nt, Homo sapiens
cccuagauuuaaccaugg

SEQ ID NO: 2089591 - RNA, 22 nt, Homo sapiens
uaaacaagaaucagucuaucca

SEQ ID NO: 2089592 - RNA, 15 nt, Homo sapiens
uguggccccuuuuac

SEQ ID NO: 2089593 - RNA, 17 nt, Homo sapiens
cugccugggacacugcg

SEQ ID NO: 2089594 - RNA, 16 nt, Homo sapiens
agaucauaaacuucag

SEQ ID NO: 2089595 - RNA, 20 nt, Homo sapiens
uuugaauuuagcaaccuaga

SEQ ID NO: 2089596 - RNA, 24 nt, Homo sapiens
ucuauauauauagggagcacuuua

SEQ ID NO: 2089597 - RNA, 15 nt, Homo sapiens
caugggcaaagccau

SEQ ID NO: 2089598 - RNA, 15 nt, Homo sapiens
accagugcagacuca

SEQ ID NO: 2089599 - RNA, 17 nt, Homo sapiens
uuucaucugcugcugaa

SEQ ID NO: 2089600 - RNA, 13 nt, Homo sapiens
cuucuuggaguua

SEQ ID NO: 2089601 - RNA, 16 nt, Homo sapiens
uuucaggcaagcuuau

SEQ ID NO: 2089602 - RNA, 16 nt, Homo sapiens
aucucucauggugaaa

SEQ ID NO: 2089603 - RNA, 17 nt, Homo sapiens
ucaauguccuacugaga

SEQ ID NO: 2089604 - RNA, 20 nt, Homo sapiens
ugccacagaugauacuucca

SEQ ID NO: 2089605 - RNA, 18 nt, Homo sapiens
auaagugcucaguauuga

SEQ ID NO: 2089606 - RNA, 20 nt, Homo sapiens
acugcaccgggccacagaga

SEQ ID NO: 2089607 - RNA, 19 nt, Homo sapiens
cggugucuuguucugucac

SEQ ID NO: 2089608 - RNA, 16 nt, Homo sapiens
aaugguuuacugcugu

SEQ ID NO: 2089609 - RNA, 23 nt, Homo sapiens
ggccucgaaaaccaucacaugac

SEQ ID NO: 2089610 - RNA, 15 nt, Homo sapiens
cacagcagacaccau

SEQ ID NO: 2089611 - RNA, 22 nt, Homo sapiens
uaacguggggcuaggacacuga

SEQ ID NO: 2089612 - RNA, 18 nt, Homo sapiens
ucccuaugcuuucacuuc

SEQ ID NO: 2089613 - RNA, 16 nt, Homo sapiens
cauuuagcuguauuca

SEQ ID NO: 2089614 - RNA, 16 nt, Homo sapiens
gugugugugcauaugu

SEQ ID NO: 2089615 - RNA, 23 nt, Homo sapiens
auggggugaagcugugaugugcc

SEQ ID NO: 2089616 - RNA, 21 nt, Homo sapiens
uacggagaagaauagaggucc

SEQ ID NO: 2089617 - RNA, 12 nt, Homo sapiens
gggucaaaguac

SEQ ID NO: 2089618 - RNA, 19 nt, Homo sapiens
agguccaccauauuugaau

SEQ ID NO: 2089619 - RNA, 15 nt, Homo sapiens
aaaacaagaugagau

SEQ ID NO: 2089620 - RNA, 23 nt, Homo sapiens
cccacuggagcguguacuacccc

SEQ ID NO: 2089621 - RNA, 14 nt, Homo sapiens
uaauguaagcucua

SEQ ID NO: 2089622 - RNA, 16 nt, Homo sapiens
gcauggugcagugccg

SEQ ID NO: 2089623 - RNA, 13 nt, Homo sapiens
uaauagaaaacug

SEQ ID NO: 2089624 - RNA, 21 nt, Homo sapiens
cugccuauaaauuuacucugu

SEQ ID NO: 2089625 - RNA, 14 nt, Homo sapiens
accagcucaugcca

SEQ ID NO: 2089626 - RNA, 22 nt, Homo sapiens
agcugucuuagagugggaccaa

SEQ ID NO: 2089627 - RNA, 23 nt, Homo sapiens
guucuugugacagauuauacaga

SEQ ID NO: 2089628 - RNA, 14 nt, Homo sapiens
aaagaguaucauca

SEQ ID NO: 2089629 - RNA, 16 nt, Homo sapiens
guugcuuaucauuuga

SEQ ID NO: 2089630 - RNA, 21 nt, Homo sapiens
agauggggucucacaguguug

SEQ ID NO: 2089631 - RNA, 16 nt, Homo sapiens
auaacauagaauugca

SEQ ID NO: 2089632 - RNA, 21 nt, Homo sapiens
aaacacagcaacaaugacuua

SEQ ID NO: 2089633 - RNA, 13 nt, Homo sapiens
cuucuuuauacuc

SEQ ID NO: 2089634 - RNA, 23 nt, Homo sapiens
auuguugaauaaauguaucugaa

SEQ ID NO: 2089635 - RNA, 14 nt, Homo sapiens
uguugcacacucac

SEQ ID NO: 2089636 - RNA, 21 nt, Homo sapiens
cugagcccugguguguuucca

SEQ ID NO: 2089637 - RNA, 23 nt, Homo sapiens
gcaguuguaaaauuguuaguaaa

SEQ ID NO: 2089638 - RNA, 19 nt, Homo sapiens
cguguuuuccaucccacau

SEQ ID NO: 2089639 - RNA, 20 nt, Homo sapiens
ugcuacuauaaucaaaugau

SEQ ID NO: 2089640 - RNA, 15 nt, Homo sapiens
aaggaaaaccaguga

SEQ ID NO: 2089641 - RNA, 14 nt, Homo sapiens
uugccucauauugu

SEQ ID NO: 2089642 - RNA, 15 nt, Homo sapiens
caauaaaaugcacug

SEQ ID NO: 2089643 - RNA, 16 nt, Homo sapiens
aauaaaauacauuuau

SEQ ID NO: 2089644 - RNA, 23 nt, Homo sapiens
uacuuuacaauuaaacucaaagc

SEQ ID NO: 2089645 - RNA, 17 nt, Homo sapiens
ggcaguucuguguccuc

SEQ ID NO: 2089646 - RNA, 12 nt, Homo sapiens
aaaacucagaga

SEQ ID NO: 2089647 - RNA, 19 nt, Homo sapiens
caaauucacguucuaguga

SEQ ID NO: 2089648 - RNA, 10 nt, Homo sapiens
aaagagcaau

SEQ ID NO: 2089649 - RNA, 13 nt, Homo sapiens
gaaaauaugauau

SEQ ID NO: 2089650 - RNA, 15 nt, Homo sapiens
uuuucuuaaccccua

SEQ ID NO: 2089651 - RNA, 13 nt, Homo sapiens
aaacuuauaauca

SEQ ID NO: 2089652 - RNA, 23 nt, Homo sapiens
gagggacgguucacaaggcuugg

SEQ ID NO: 2089653 - RNA, 15 nt, Homo sapiens
aauucaaauauucuu

SEQ ID NO: 2089654 - RNA, 18 nt, Homo sapiens
aagccagauuuuccugaa

SEQ ID NO: 2089655 - RNA, 14 nt, Homo sapiens
uaauuaaacugaug

SEQ ID NO: 2089656 - RNA, 19 nt, Homo sapiens
gucucaaaaaaagggcaau

SEQ ID NO: 2089657 - RNA, 22 nt, Homo sapiens
uauccaacaagccagaaucagc

SEQ ID NO: 2089658 - RNA, 14 nt, Homo sapiens
cugaguacuggaau

SEQ ID NO: 2089659 - RNA, 21 nt, Homo sapiens
cccccaaugacacccaugcca

SEQ ID NO: 2089660 - RNA, 18 nt, Homo sapiens
ggucauuauuuuuuacaa

SEQ ID NO: 2089661 - RNA, 20 nt, Homo sapiens
ucgugcuucauaggugccac

SEQ ID NO: 2089662 - RNA, 14 nt, Homo sapiens
cccaccagugccuc

SEQ ID NO: 2089663 - RNA, 19 nt, Homo sapiens
cagcgaacccaauggguaa

SEQ ID NO: 2089664 - RNA, 16 nt, Homo sapiens
ccaggguccacaggaa

SEQ ID NO: 2089665 - RNA, 15 nt, Homo sapiens
cagcaauauuuugua

SEQ ID NO: 2089666 - RNA, 15 nt, Homo sapiens
cacguguuguuccac

SEQ ID NO: 2089667 - RNA, 17 nt, Homo sapiens
uugccuauaagccaaaa

SEQ ID NO: 2089668 - RNA, 17 nt, Homo sapiens
aaugcucuuuugcacaa

SEQ ID NO: 2089669 - RNA, 21 nt, Homo sapiens
aaaaaacauacuuacauuuca

SEQ ID NO: 2089670 - RNA, 20 nt, Homo sapiens
uauuuguguaaggacuuugg

SEQ ID NO: 2089671 - RNA, 14 nt, Homo sapiens
aggaagcuuggcuu

SEQ ID NO: 2089672 - RNA, 21 nt, Homo sapiens
ugcaagaccgagauugaggga

SEQ ID NO: 2089673 - RNA, 18 nt, Homo sapiens
aucaguuuguuguucaga

SEQ ID NO: 2089674 - RNA, 16 nt, Homo sapiens
ucccuuaauaaacuca

SEQ ID NO: 2089675 - RNA, 17 nt, Homo sapiens
ugcaacuaauucaauaa

SEQ ID NO: 2089676 - RNA, 14 nt, Homo sapiens
ccuguguggaccau

SEQ ID NO: 2089677 - RNA, 21 nt, Homo sapiens
gcccccaggcagccaccagug

SEQ ID NO: 2089678 - RNA, 15 nt, Homo sapiens
uguuggccaguguga

SEQ ID NO: 2089679 - RNA, 23 nt, Homo sapiens
gcuugauugcguggaauugugcu

SEQ ID NO: 2089680 - RNA, 21 nt, Homo sapiens
ugguugugccuucccuucucu

SEQ ID NO: 2089681 - RNA, 13 nt, Homo sapiens
auacuguacugag

SEQ ID NO: 2089682 - RNA, 16 nt, Homo sapiens
auaaauuccaauacaa

SEQ ID NO: 2089683 - RNA, 14 nt, Homo sapiens
gccuuuguugcuca

SEQ ID NO: 2089684 - RNA, 14 nt, Homo sapiens
ugcucagugccuuu

SEQ ID NO: 2089685 - RNA, 11 nt, Homo sapiens
cauaugucacg

SEQ ID NO: 2089686 - RNA, 22 nt, Homo sapiens
uccauaugagggaaaacccaau

SEQ ID NO: 2089687 - RNA, 22 nt, Homo sapiens
guugaucuggaacccagacuca

SEQ ID NO: 2089688 - RNA, 16 nt, Homo sapiens
ccuguuagcauugcca

SEQ ID NO: 2089689 - RNA, 17 nt, Homo sapiens
gcugagaacaccccagc

SEQ ID NO: 2089690 - RNA, 20 nt, Homo sapiens
uaugccuuuaaaucugugau

SEQ ID NO: 2089691 - RNA, 19 nt, Homo sapiens
accagauagcucaauacuc

SEQ ID NO: 2089692 - RNA, 16 nt, Homo sapiens
ucucacagcacaugcu

SEQ ID NO: 2089693 - RNA, 14 nt, Homo sapiens
acaucaauguucau

SEQ ID NO: 2089694 - RNA, 17 nt, Homo sapiens
agcugaagaccauggau

SEQ ID NO: 2089695 - RNA, 16 nt, Homo sapiens
cuaggucacuucucac

SEQ ID NO: 2089696 - RNA, 23 nt, Homo sapiens
acuucauucaagaggaauuccag

SEQ ID NO: 2089697 - RNA, 23 nt, Homo sapiens
ucccacacgcacugcacugccau

SEQ ID NO: 2089698 - RNA, 14 nt, Homo sapiens
gugugguggugcac

SEQ ID NO: 2089699 - RNA, 22 nt, Homo sapiens
guaauuacauauuugacucuuu

SEQ ID NO: 2089700 - RNA, 19 nt, Homo sapiens
cuguagauguugucuuggc

SEQ ID NO: 2089701 - RNA, 18 nt, Homo sapiens
ccgugagccaggcaaagg

SEQ ID NO: 2089702 - RNA, 13 nt, Homo sapiens
gcggugcacucac

SEQ ID NO: 2089703 - RNA, 20 nt, Homo sapiens
uaauaaagaagcuacuauuu

SEQ ID NO: 2089704 - RNA, 21 nt, Homo sapiens
uaauuaaacaagugcacuuga

SEQ ID NO: 2089705 - RNA, 14 nt, Homo sapiens
ucuguaaccaccuc

SEQ ID NO: 2089706 - RNA, 14 nt, Homo sapiens
uacccaacccugcc

SEQ ID NO: 2089707 - RNA, 15 nt, Homo sapiens
ccuguaggaaacaga

SEQ ID NO: 2089708 - RNA, 21 nt, Homo sapiens
uccuugguugggucaaggaca

SEQ ID NO: 2089709 - RNA, 13 nt, Homo sapiens
caucuuugcuuau

SEQ ID NO: 2089710 - RNA, 22 nt, Homo sapiens
gucuggcuagguuaaaggccag

SEQ ID NO: 2089711 - RNA, 21 nt, Homo sapiens
ugugacguuuuuccaguucac

SEQ ID NO: 2089712 - RNA, 20 nt, Homo sapiens
caagagcaucaugccucuga

SEQ ID NO: 2089713 - RNA, 16 nt, Homo sapiens
cuuacaggagccagcc

SEQ ID NO: 2089714 - RNA, 21 nt, Homo sapiens
aauucucuuuaguucugucag

SEQ ID NO: 2089715 - RNA, 12 nt, Homo sapiens
aggcucuucucc

SEQ ID NO: 2089716 - RNA, 22 nt, Homo sapiens
cauaauccacgcucaucuugca

SEQ ID NO: 2089717 - RNA, 16 nt, Homo sapiens
ccagccuuguuucuga

SEQ ID NO: 2089718 - RNA, 22 nt, Homo sapiens
agaaagaacuaucuucaucuga

SEQ ID NO: 2089719 - RNA, 16 nt, Homo sapiens
uccaaaccuccacugc

SEQ ID NO: 2089720 - RNA, 20 nt, Homo sapiens
ggucucgaacuccugaccuc

SEQ ID NO: 2089721 - RNA, 23 nt, Homo sapiens
agcacagcucuccuccuccaucu

SEQ ID NO: 2089722 - RNA, 21 nt, Homo sapiens
cuuccugucccacuacuguag

SEQ ID NO: 2089723 - RNA, 16 nt, Homo sapiens
uccaacucuguauuua

SEQ ID NO: 2089724 - RNA, 14 nt, Homo sapiens
aaucgaauagggaa

SEQ ID NO: 2089725 - RNA, 18 nt, Homo sapiens
cccauccccuucuagccu

SEQ ID NO: 2089726 - RNA, 14 nt, Homo sapiens
guacauuucucagg

SEQ ID NO: 2089727 - RNA, 20 nt, Homo sapiens
uggggaaaauggccaugcag

SEQ ID NO: 2089728 - RNA, 23 nt, Homo sapiens
cuucaaaagcuuuuuacucaaag

SEQ ID NO: 2089729 - RNA, 16 nt, Homo sapiens
augcacucaguuuacu

SEQ ID NO: 2089730 - RNA, 18 nt, Homo sapiens
ccugacaucaggugaucc

SEQ ID NO: 2089731 - RNA, 22 nt, Homo sapiens
uccuguucgugcuuguaaugcu

SEQ ID NO: 2089732 - RNA, 15 nt, Homo sapiens
uaaaucuugcaacug

SEQ ID NO: 2089733 - RNA, 19 nt, Homo sapiens
ugccacugguaauggguaa

SEQ ID NO: 2089734 - RNA, 15 nt, Homo sapiens
cuguaacacaagcca

SEQ ID NO: 2089735 - RNA, 16 nt, Homo sapiens
ugaauuguuccucaga

SEQ ID NO: 2089736 - RNA, 21 nt, Homo sapiens
ucaggucccaguugcugucac

SEQ ID NO: 2089737 - RNA, 16 nt, Homo sapiens
guggagccaaagccga

SEQ ID NO: 2089738 - RNA, 16 nt, Homo sapiens
uucucagucuccuuaa

SEQ ID NO: 2089739 - RNA, 14 nt, Homo sapiens
cugagucccaaagc

SEQ ID NO: 2089740 - RNA, 18 nt, Homo sapiens
cuagucuucccuuaccuc

SEQ ID NO: 2089741 - RNA, 14 nt, Homo sapiens
gcauaaccuuuaca

SEQ ID NO: 2089742 - RNA, 17 nt, Homo sapiens
cuaagcacaaagcccau

SEQ ID NO: 2089743 - RNA, 13 nt, Homo sapiens
cacagacucccuc

SEQ ID NO: 2089744 - RNA, 13 nt, Homo sapiens
cacacacucccug

SEQ ID NO: 2089745 - RNA, 15 nt, Homo sapiens
auuuggcagugauau

SEQ ID NO: 2089746 - RNA, 21 nt, Homo sapiens
uuccugccaggagcucuccac

SEQ ID NO: 2089747 - RNA, 14 nt, Homo sapiens
aguuuauaguuaaa

SEQ ID NO: 2089748 - RNA, 20 nt, Homo sapiens
uugcuuccugauuaccaguc

SEQ ID NO: 2089749 - RNA, 17 nt, Homo sapiens
aauguguuaagugcagg

SEQ ID NO: 2089750 - RNA, 16 nt, Homo sapiens
ccacuuugucucugag

SEQ ID NO: 2089751 - RNA, 21 nt, Homo sapiens
cauuuuuacggguaacaguga

SEQ ID NO: 2089752 - RNA, 18 nt, Homo sapiens
cacaaugauuuuuugcaa

SEQ ID NO: 2089753 - RNA, 21 nt, Homo sapiens
cgagcaugccuggauggggcu

SEQ ID NO: 2089754 - RNA, 17 nt, Homo sapiens
cacugggccugucacug

SEQ ID NO: 2089755 - RNA, 13 nt, Homo sapiens
uauuuuugcacaa

SEQ ID NO: 2089756 - RNA, 16 nt, Homo sapiens
uaagugcgcaaugcua

SEQ ID NO: 2089757 - RNA, 14 nt, Homo sapiens
agauggcuuuuccu

SEQ ID NO: 2089758 - RNA, 14 nt, Homo sapiens
uuucccucuacuaa

SEQ ID NO: 2089759 - RNA, 20 nt, Homo sapiens
uaaggucacauugugccuuu

SEQ ID NO: 2089760 - RNA, 21 nt, Homo sapiens
aaaaagccccagcccauuccu

SEQ ID NO: 2089761 - RNA, 19 nt, Homo sapiens
ugcacaggguccucagcuc

SEQ ID NO: 2089762 - RNA, 13 nt, Homo sapiens
gcuggcccugccg

SEQ ID NO: 2089763 - RNA, 22 nt, Homo sapiens
aaaugggaacuggagagugugg

SEQ ID NO: 2089764 - RNA, 21 nt, Homo sapiens
ccugcagaagcagaagugcaa

SEQ ID NO: 2089765 - RNA, 15 nt, Homo sapiens
aguagucaucaaugc

SEQ ID NO: 2089766 - RNA, 18 nt, Homo sapiens
gaagaagagaugacaaac

SEQ ID NO: 2089767 - RNA, 21 nt, Homo sapiens
aaagacuuugauccauguaug

SEQ ID NO: 2089768 - RNA, 21 nt, Homo sapiens
cuuuucgcaggauucuuccuc

SEQ ID NO: 2089769 - RNA, 18 nt, Homo sapiens
accagagcgugcacuugu

SEQ ID NO: 2089770 - RNA, 20 nt, Homo sapiens
uucucuauucuuuccaugac

SEQ ID NO: 2089771 - RNA, 22 nt, Homo sapiens
ugaaaaaguuuggaagcacuga

SEQ ID NO: 2089772 - RNA, 18 nt, Homo sapiens
cuggaauuuugcuuuauc

SEQ ID NO: 2089773 - RNA, 12 nt, Homo sapiens
ccagcugugcug

SEQ ID NO: 2089774 - RNA, 16 nt, Homo sapiens
uguaauacuucaccuc

SEQ ID NO: 2089775 - RNA, 14 nt, Homo sapiens
aguugaggaauaug

SEQ ID NO: 2089776 - RNA, 14 nt, Homo sapiens
uuuauuuuugacug

SEQ ID NO: 2089777 - RNA, 21 nt, Homo sapiens
gggcucccuucccaccucucu

SEQ ID NO: 2089778 - RNA, 20 nt, Homo sapiens
cccugucagcaugaauuugu

SEQ ID NO: 2089779 - RNA, 22 nt, Homo sapiens
ucccauuacuuugauaucugau

SEQ ID NO: 2089780 - RNA, 20 nt, Homo sapiens
cugaacuccugccauagucu

SEQ ID NO: 2089781 - RNA, 15 nt, Homo sapiens
aggaggguuggagug

SEQ ID NO: 2089782 - RNA, 14 nt, Homo sapiens
uugaagaagauaug

SEQ ID NO: 2089783 - RNA, 13 nt, Homo sapiens
augaggcauuugu

SEQ ID NO: 2089784 - RNA, 16 nt, Homo sapiens
uaaugucagcacaugu

SEQ ID NO: 2089785 - RNA, 15 nt, Homo sapiens
caacauaccaagacc

SEQ ID NO: 2089786 - RNA, 24 nt, Homo sapiens
augucagggguuugcuuacaguga

SEQ ID NO: 2089787 - RNA, 21 nt, Homo sapiens
acagagcaaugguagcaaaac

SEQ ID NO: 2089788 - RNA, 12 nt, Homo sapiens
aaaauaauauua

SEQ ID NO: 2089789 - RNA, 19 nt, Homo sapiens
caggcgcugcccaccugcc

SEQ ID NO: 2089790 - RNA, 18 nt, Homo sapiens
auuuaacaaaccugaaug

SEQ ID NO: 2089791 - RNA, 17 nt, Homo sapiens
gaaaacauaacugauac

SEQ ID NO: 2089792 - RNA, 20 nt, Homo sapiens
aagcuucuagaaggugcuua

SEQ ID NO: 2089793 - RNA, 15 nt, Homo sapiens
cccacuuugaagggc

SEQ ID NO: 2089794 - RNA, 17 nt, Homo sapiens
aaaaucacaauucucug

SEQ ID NO: 2089795 - RNA, 21 nt, Homo sapiens
ugccaaauaaaauauauugau

SEQ ID NO: 2089796 - RNA, 14 nt, Homo sapiens
ucauucuuauaaca

SEQ ID NO: 2089797 - RNA, 16 nt, Homo sapiens
uccagcacgucugugu

SEQ ID NO: 2089798 - RNA, 15 nt, Homo sapiens
uucauucacauucag

SEQ ID NO: 2089799 - RNA, 15 nt, Homo sapiens
acacucacauuuauu

SEQ ID NO: 2089800 - RNA, 20 nt, Homo sapiens
caaagugaccuccagagcug

SEQ ID NO: 2089801 - RNA, 15 nt, Homo sapiens
cauuucugauuucag

SEQ ID NO: 2089802 - RNA, 13 nt, Homo sapiens
uggcaaacccucc

SEQ ID NO: 2089803 - RNA, 17 nt, Homo sapiens
cucuccuggcccuggaa

SEQ ID NO: 2089804 - RNA, 18 nt, Homo sapiens
ucaaauguaaauuuacug

SEQ ID NO: 2089805 - RNA, 16 nt, Homo sapiens
cuuauaaaaaucuuaa

SEQ ID NO: 2089806 - RNA, 19 nt, Homo sapiens
cagcaggcugccagugccu

SEQ ID NO: 2089807 - RNA, 24 nt, Homo sapiens
cacgugcaauacggaacacuguca

SEQ ID NO: 2089808 - RNA, 21 nt, Homo sapiens
cuccugcuuuaaccaccccau

SEQ ID NO: 2089809 - RNA, 15 nt, Homo sapiens
uaauuuuauuauagu

SEQ ID NO: 2089810 - RNA, 15 nt, Homo sapiens
uagaaugugccugug

SEQ ID NO: 2089811 - RNA, 14 nt, Homo sapiens
aaucagaaaucaua

SEQ ID NO: 2089812 - RNA, 16 nt, Homo sapiens
uuuguaaccauaugau

SEQ ID NO: 2089813 - RNA, 14 nt, Homo sapiens
gcccgagccaggaa

SEQ ID NO: 2089814 - RNA, 13 nt, Homo sapiens
agugcugguggcc

SEQ ID NO: 2089815 - RNA, 17 nt, Homo sapiens
aggaauaugggagaaau

SEQ ID NO: 2089816 - RNA, 17 nt, Homo sapiens
aagagacagagaaucuu

SEQ ID NO: 2089817 - RNA, 22 nt, Homo sapiens
gcaccaucuggaaggacaucua

SEQ ID NO: 2089818 - RNA, 21 nt, Homo sapiens
ccagagguaagaauagaauuu

SEQ ID NO: 2089819 - RNA, 12 nt, Homo sapiens
cagaugacaaga

SEQ ID NO: 2089820 - RNA, 14 nt, Homo sapiens
cauuuacuuguuga

SEQ ID NO: 2089821 - RNA, 20 nt, Homo sapiens
acccuaaagucucaggugac

SEQ ID NO: 2089822 - RNA, 13 nt, Homo sapiens
acugaauucacuc

SEQ ID NO: 2089823 - RNA, 13 nt, Homo sapiens
uccucguagccau

SEQ ID NO: 2089824 - RNA, 13 nt, Homo sapiens
gaauauggacaua

SEQ ID NO: 2089825 - RNA, 19 nt, Homo sapiens
uccugugacaacacucauc

SEQ ID NO: 2089826 - RNA, 21 nt, Homo sapiens
gaaucuaacgggcauucacaa

SEQ ID NO: 2089827 - RNA, 20 nt, Homo sapiens
caggagguugagaaugcagu

SEQ ID NO: 2089828 - RNA, 14 nt, Homo sapiens
accccacuacacag

SEQ ID NO: 2089829 - RNA, 13 nt, Homo sapiens
uuauaaucaauga

SEQ ID NO: 2089830 - RNA, 21 nt, Homo sapiens
uacagugcccaccgcccuccu

SEQ ID NO: 2089831 - RNA, 15 nt, Homo sapiens
aauauggacuuaaau

SEQ ID NO: 2089832 - RNA, 13 nt, Homo sapiens
ccauggcacugac

SEQ ID NO: 2089833 - RNA, 16 nt, Homo sapiens
uugaagaucaggcaca

SEQ ID NO: 2089834 - RNA, 12 nt, Homo sapiens
aaaaacuaguua

SEQ ID NO: 2089835 - RNA, 19 nt, Homo sapiens
aaggaugaucuaggaagac

SEQ ID NO: 2089836 - RNA, 13 nt, Homo sapiens
uaucuucuagcca

SEQ ID NO: 2089837 - RNA, 18 nt, Homo sapiens
gauuccaaaaagcacaua

SEQ ID NO: 2089838 - RNA, 21 nt, Homo sapiens
agcuguuuuuauuagcaguag

SEQ ID NO: 2089839 - RNA, 20 nt, Homo sapiens
gaauguuuccuguggaaaua

SEQ ID NO: 2089840 - RNA, 11 nt, Homo sapiens
cgguagcuuga

SEQ ID NO: 2089841 - RNA, 19 nt, Homo sapiens
acggagguccuuuggacag

SEQ ID NO: 2089842 - RNA, 18 nt, Homo sapiens
ugagcuggggaugucucu

SEQ ID NO: 2089843 - RNA, 15 nt, Homo sapiens
gagacaggcagguga

SEQ ID NO: 2089844 - RNA, 14 nt, Homo sapiens
ucuauuuccacuga

SEQ ID NO: 2089845 - RNA, 24 nt, Homo sapiens
aaaaugaacugaaguuucacauga

SEQ ID NO: 2089846 - RNA, 15 nt, Homo sapiens
caauaaaucaacucc

SEQ ID NO: 2089847 - RNA, 16 nt, Homo sapiens
accucaccugaccuca

SEQ ID NO: 2089848 - RNA, 16 nt, Homo sapiens
caggaguugugucuag

SEQ ID NO: 2089849 - RNA, 22 nt, Homo sapiens
gaccucaggugauccacccacc

SEQ ID NO: 2089850 - RNA, 22 nt, Homo sapiens
uguacugagcacugaaccacau

SEQ ID NO: 2089851 - RNA, 16 nt, Homo sapiens
agcagggacugugaac

SEQ ID NO: 2089852 - RNA, 17 nt, Homo sapiens
gcaacagccaaguggaa

SEQ ID NO: 2089853 - RNA, 22 nt, Homo sapiens
gccucauugugccaagccuucu

SEQ ID NO: 2089854 - RNA, 21 nt, Homo sapiens
cacugccaaagaacuuggaaa

SEQ ID NO: 2089855 - RNA, 18 nt, Homo sapiens
acuuggucuuucacagug

SEQ ID NO: 2089856 - RNA, 21 nt, Homo sapiens
ucgcacaaucuacacugccuu

SEQ ID NO: 2089857 - RNA, 22 nt, Homo sapiens
ccaugacucaggauuuuaucuc

SEQ ID NO: 2089858 - RNA, 22 nt, Homo sapiens
aaaagacuuuuuuuuaacacuu

SEQ ID NO: 2089859 - RNA, 17 nt, Homo sapiens
gaaagcaaucugagaga

SEQ ID NO: 2089860 - RNA, 13 nt, Homo sapiens
uaucaagccauaa

SEQ ID NO: 2089861 - RNA, 14 nt, Homo sapiens
cgugugugaacaaa

SEQ ID NO: 2089862 - RNA, 14 nt, Homo sapiens
cuccuccuagccac

SEQ ID NO: 2089863 - RNA, 19 nt, Homo sapiens
agaggaugcugggcucugu

SEQ ID NO: 2089864 - RNA, 14 nt, Homo sapiens
gauuuuucucuuca

SEQ ID NO: 2089865 - RNA, 21 nt, Homo sapiens
ccagugggccugguagcacau

SEQ ID NO: 2089866 - RNA, 20 nt, Homo sapiens
gaccaauucuaacagcaaau

SEQ ID NO: 2089867 - RNA, 17 nt, Homo sapiens
guauagcugacaucucc

SEQ ID NO: 2089868 - RNA, 20 nt, Homo sapiens
accgagccacgcagugccug

SEQ ID NO: 2089869 - RNA, 18 nt, Homo sapiens
uuaagcauggauuuuccc

SEQ ID NO: 2089870 - RNA, 13 nt, Homo sapiens
ucaggugauccac

SEQ ID NO: 2089871 - RNA, 16 nt, Homo sapiens
gcaagacuccaucuca

SEQ ID NO: 2089872 - RNA, 16 nt, Homo sapiens
gcgagacuccgucuca

SEQ ID NO: 2089873 - RNA, 18 nt, Homo sapiens
ucucagagcuccacagaa

SEQ ID NO: 2089874 - RNA, 22 nt, Homo sapiens
guuuauguguuaugaacaucca

SEQ ID NO: 2089875 - RNA, 22 nt, Homo sapiens
gaaguuuugaguuucucuccac

SEQ ID NO: 2089876 - RNA, 13 nt, Homo sapiens
agucugcaaaaug

SEQ ID NO: 2089877 - RNA, 16 nt, Homo sapiens
agccccagucuuccuu

SEQ ID NO: 2089878 - RNA, 17 nt, Homo sapiens
agugagccgagaucaug

SEQ ID NO: 2089879 - RNA, 17 nt, Homo sapiens
agugagcuaagaucaca

SEQ ID NO: 2089880 - RNA, 15 nt, Homo sapiens
ugggaggccaaacac

SEQ ID NO: 2089881 - RNA, 22 nt, Homo sapiens
uaaaccagggaugucuguugaa

SEQ ID NO: 2089882 - RNA, 21 nt, Homo sapiens
acacaggcccggcuccaggcu

SEQ ID NO: 2089883 - RNA, 15 nt, Homo sapiens
ugagaagaaaugaca

SEQ ID NO: 2089884 - RNA, 15 nt, Homo sapiens
auacuauccaguuac

SEQ ID NO: 2089885 - RNA, 18 nt, Homo sapiens
aaguauguaaacaggaga

SEQ ID NO: 2089886 - RNA, 16 nt, Homo sapiens
ccccaaccugcugaag

SEQ ID NO: 2089887 - RNA, 20 nt, Homo sapiens
ugccaccauguauucaucca

SEQ ID NO: 2089888 - RNA, 14 nt, Homo sapiens
uuccuucaggguga

SEQ ID NO: 2089889 - RNA, 17 nt, Homo sapiens
ggaagaguguacugggg

SEQ ID NO: 2089890 - RNA, 11 nt, Homo sapiens
agagacagggu

SEQ ID NO: 2089891 - RNA, 18 nt, Homo sapiens
ugaguagagcuuguaaua

SEQ ID NO: 2089892 - RNA, 18 nt, Homo sapiens
aauaguaggacugcugac

SEQ ID NO: 2089893 - RNA, 17 nt, Homo sapiens
cagcugccaagugcucu

SEQ ID NO: 2089894 - RNA, 17 nt, Homo sapiens
guggcagccgucccagg

SEQ ID NO: 2089895 - RNA, 22 nt, Homo sapiens
augauucagaaauuuucauuca

SEQ ID NO: 2089896 - RNA, 19 nt, Homo sapiens
cuuuugauuuuagccaugc

SEQ ID NO: 2089897 - RNA, 19 nt, Homo sapiens
uagaucccaugucaccuca

SEQ ID NO: 2089898 - RNA, 22 nt, Homo sapiens
cugggcccgagccugaacugag

SEQ ID NO: 2089899 - RNA, 15 nt, Homo sapiens
acaggaagacuggag

SEQ ID NO: 2089900 - RNA, 13 nt, Homo sapiens
auccuccaaaguc

SEQ ID NO: 2089901 - RNA, 18 nt, Homo sapiens
uuagucuaccaaaaacaa

SEQ ID NO: 2089902 - RNA, 18 nt, Homo sapiens
ugauaagcauugacuugc

SEQ ID NO: 2089903 - RNA, 21 nt, Homo sapiens
cuuaacacacuggccauucuu

SEQ ID NO: 2089904 - RNA, 21 nt, Homo sapiens
uaaucaaaacccaacaugacu

SEQ ID NO: 2089905 - RNA, 15 nt, Homo sapiens
caccugggacaggga

SEQ ID NO: 2089906 - RNA, 24 nt, Homo sapiens
ugaagaaucucgacucucgugaua

SEQ ID NO: 2089907 - RNA, 12 nt, Homo sapiens
ggcaccauucag

SEQ ID NO: 2089908 - RNA, 19 nt, Homo sapiens
uccucuuuuuucuugucau

SEQ ID NO: 2089909 - RNA, 17 nt, Homo sapiens
acggugucucgcugcau

SEQ ID NO: 2089910 - RNA, 18 nt, Homo sapiens
agucugcuuucacuguga

SEQ ID NO: 2089911 - RNA, 19 nt, Homo sapiens
gguuugaagcugcugucuc

SEQ ID NO: 2089912 - RNA, 17 nt, Homo sapiens
gcaauaaauauuauuug

SEQ ID NO: 2089913 - RNA, 15 nt, Homo sapiens
gugucaugauucacc

SEQ ID NO: 2089914 - RNA, 13 nt, Homo sapiens
cugacuuccucug

SEQ ID NO: 2089915 - RNA, 18 nt, Homo sapiens
aguggcauaauucagggg

SEQ ID NO: 2089916 - RNA, 15 nt, Homo sapiens
uaaugaucaacaauu

SEQ ID NO: 2089917 - RNA, 19 nt, Homo sapiens
auccaccaagaacauaaga

SEQ ID NO: 2089918 - RNA, 13 nt, Homo sapiens
gaccuaaagggac

SEQ ID NO: 2089919 - RNA, 20 nt, Homo sapiens
cuccuacaggugcuguucag

SEQ ID NO: 2089920 - RNA, 15 nt, Homo sapiens
ugccucuaugugcaa

SEQ ID NO: 2089921 - RNA, 14 nt, Homo sapiens
caauccaccuggag

SEQ ID NO: 2089922 - RNA, 20 nt, Homo sapiens
cuggaaaccuguuaugccaa

SEQ ID NO: 2089923 - RNA, 14 nt, Homo sapiens
ccucuugaaccaga

SEQ ID NO: 2089924 - RNA, 22 nt, Homo sapiens
ugccagaggcugaugucaagca

SEQ ID NO: 2089925 - RNA, 16 nt, Homo sapiens
caccugcagauguucu

SEQ ID NO: 2089926 - RNA, 23 nt, Homo sapiens
cacuuccagagccagaaagggug

SEQ ID NO: 2089927 - RNA, 15 nt, Homo sapiens
ucuuauguugaauau

SEQ ID NO: 2089928 - RNA, 23 nt, Homo sapiens
ccuuaggcuuuguaugacaguga

SEQ ID NO: 2089929 - RNA, 21 nt, Homo sapiens
uuuaaaugugugagugcaugu

SEQ ID NO: 2089930 - RNA, 18 nt, Homo sapiens
acaaagauuauuugcacg

SEQ ID NO: 2089931 - RNA, 19 nt, Homo sapiens
ugcucuaacuggacaugaa

SEQ ID NO: 2089932 - RNA, 22 nt, Homo sapiens
uaagaaaguaauuuaauuugua

SEQ ID NO: 2089933 - RNA, 23 nt, Homo sapiens
agcgcugugugguaacucagugu

SEQ ID NO: 2089934 - RNA, 14 nt, Homo sapiens
cuuaccgcucuguu

SEQ ID NO: 2089935 - RNA, 20 nt, Homo sapiens
agccaacacccugucuaaaa

SEQ ID NO: 2089936 - RNA, 13 nt, Homo sapiens
ggccuaguggcuu

SEQ ID NO: 2089937 - RNA, 16 nt, Homo sapiens
acagggucucacugug

SEQ ID NO: 2089938 - RNA, 18 nt, Homo sapiens
ccuguggaaauaugcaac

SEQ ID NO: 2089939 - RNA, 18 nt, Homo sapiens
cccacaaaacuucagugu

SEQ ID NO: 2089940 - RNA, 21 nt, Homo sapiens
ugguuuuaccuguagacugug

SEQ ID NO: 2089941 - RNA, 20 nt, Homo sapiens
cuauaguuauacaucuucau

SEQ ID NO: 2089942 - RNA, 20 nt, Homo sapiens
ccccuuguuguaaaaagccc

SEQ ID NO: 2089943 - RNA, 18 nt, Homo sapiens
ccugauucauacuccuuu

SEQ ID NO: 2089944 - RNA, 22 nt, Homo sapiens
caggaaauuagauaaauaaaaa

SEQ ID NO: 2089945 - RNA, 16 nt, Homo sapiens
gauucagagcuuucaa

SEQ ID NO: 2089946 - RNA, 19 nt, Homo sapiens
uauuugcaguucaccugca

SEQ ID NO: 2089947 - RNA, 13 nt, Homo sapiens
ugagaaacagcuc

SEQ ID NO: 2089948 - RNA, 15 nt, Homo sapiens
uuuggacuucacuua

SEQ ID NO: 2089949 - RNA, 18 nt, Homo sapiens
uagcuuauuauugaagga

SEQ ID NO: 2089950 - RNA, 19 nt, Homo sapiens
uaauaggcaccucuucaau

SEQ ID NO: 2089951 - RNA, 12 nt, Homo sapiens
ccaguuaaauau

SEQ ID NO: 2089952 - RNA, 17 nt, Homo sapiens
ucgggaggcugagacag

SEQ ID NO: 2089953 - RNA, 15 nt, Homo sapiens
gcauguuugccuaga

SEQ ID NO: 2089954 - RNA, 18 nt, Homo sapiens
auccaucuuuccauccau

SEQ ID NO: 2089955 - RNA, 18 nt, Homo sapiens
gucugggagucacacagu

SEQ ID NO: 2089956 - RNA, 19 nt, Homo sapiens
agccaugacgucaauagca

SEQ ID NO: 2089957 - RNA, 13 nt, Homo sapiens
guucucauuugau

SEQ ID NO: 2089958 - RNA, 12 nt, Homo sapiens
gaagacaacucu

SEQ ID NO: 2089959 - RNA, 22 nt, Homo sapiens
uguaauuucuuugccuguucag

SEQ ID NO: 2089960 - RNA, 22 nt, Homo sapiens
uaaaauaauuauauaacuguau

SEQ ID NO: 2089961 - RNA, 17 nt, Homo sapiens
augugccaggcuugccu

SEQ ID NO: 2089962 - RNA, 18 nt, Homo sapiens
gaaagaugaucauuugua

SEQ ID NO: 2089963 - RNA, 13 nt, Homo sapiens
uuccgcagugugg

SEQ ID NO: 2089964 - RNA, 20 nt, Homo sapiens
accugaagggugacauccca

SEQ ID NO: 2089965 - RNA, 22 nt, Homo sapiens
cuuuuaaugucauuuguuaaaa

SEQ ID NO: 2089966 - RNA, 13 nt, Homo sapiens
ccacuuuucauug

SEQ ID NO: 2089967 - RNA, 15 nt, Homo sapiens
gaaacauguugccaa

SEQ ID NO: 2089968 - RNA, 22 nt, Homo sapiens
agauaaccuuaaacucugacca

SEQ ID NO: 2089969 - RNA, 21 nt, Homo sapiens
aauccuugaugauugacaaca

SEQ ID NO: 2089970 - RNA, 15 nt, Homo sapiens
uuuccuccccuuuga

SEQ ID NO: 2089971 - RNA, 18 nt, Homo sapiens
aucuacauuauaccgcag

SEQ ID NO: 2089972 - RNA, 17 nt, Homo sapiens
cuccccccaacacaauc

SEQ ID NO: 2089973 - RNA, 21 nt, Homo sapiens
cuuacugcaaccuuugccucc

SEQ ID NO: 2089974 - RNA, 18 nt, Homo sapiens
cuggggaagacuuaugcc

SEQ ID NO: 2089975 - RNA, 14 nt, Homo sapiens
gcaagagcaccugg

SEQ ID NO: 2089976 - RNA, 17 nt, Homo sapiens
aaucuuagaggcuugau

SEQ ID NO: 2089977 - RNA, 22 nt, Homo sapiens
caagugcuaaccuuuucaccuc

SEQ ID NO: 2089978 - RNA, 15 nt, Homo sapiens
acaguggcaguauug

SEQ ID NO: 2089979 - RNA, 22 nt, Homo sapiens
acacucccagggacaagggaag

SEQ ID NO: 2089980 - RNA, 17 nt, Homo sapiens
uaacuucagauacuugu

SEQ ID NO: 2089981 - RNA, 19 nt, Homo sapiens
cuguaauguaaauaaacua

SEQ ID NO: 2089982 - RNA, 13 nt, Homo sapiens
ucauccccuguga

SEQ ID NO: 2089983 - RNA, 17 nt, Homo sapiens
cuauauuguacacaccu

SEQ ID NO: 2089984 - RNA, 20 nt, Homo sapiens
agacacacacacaccuugca

SEQ ID NO: 2089985 - RNA, 22 nt, Homo sapiens
uuuccuccagguagaguuuucu

SEQ ID NO: 2089986 - RNA, 17 nt, Homo sapiens
uggccaggggacacugu

SEQ ID NO: 2089987 - RNA, 19 nt, Homo sapiens
aauuugacucaugaacuau

SEQ ID NO: 2089988 - RNA, 20 nt, Homo sapiens
uucuauggccauuacuaaca

SEQ ID NO: 2089989 - RNA, 23 nt, Homo sapiens
ucucuuuuucuuguaaaccugga

SEQ ID NO: 2089990 - RNA, 12 nt, Homo sapiens
gcucagggcuga

SEQ ID NO: 2089991 - RNA, 22 nt, Homo sapiens
cucacuaguuuuuccugugcaa

SEQ ID NO: 2089992 - RNA, 22 nt, Homo sapiens
agccaaggccaaaggaagcaca

SEQ ID NO: 2089993 - RNA, 23 nt, Homo sapiens
aucauuaaaauuaacaugugcca

SEQ ID NO: 2089994 - RNA, 20 nt, Homo sapiens
aacucaauauuuuccaugaa

SEQ ID NO: 2089995 - RNA, 14 nt, Homo sapiens
aguaguguguugua

SEQ ID NO: 2089996 - RNA, 21 nt, Homo sapiens
uccuuuccccggaguaccuau

SEQ ID NO: 2089997 - RNA, 22 nt, Homo sapiens
gaccaggccaagacucaagccu

SEQ ID NO: 2089998 - RNA, 13 nt, Homo sapiens
cugagugagcugg

SEQ ID NO: 2089999 - RNA, 20 nt, Homo sapiens
ugugauauauaaguguacau

SEQ ID NO: 2090000 - RNA, 14 nt, Homo sapiens
uuuguuagcaaaga

SEQ ID NO: 2090001 - RNA, 13 nt, Homo sapiens
uaacuuacauuug

SEQ ID NO: 2090002 - RNA, 18 nt, Homo sapiens
caucucaagcuugcucuu

SEQ ID NO: 2090003 - RNA, 16 nt, Homo sapiens
auacagcagcaagaaa

SEQ ID NO: 2090004 - RNA, 24 nt, Homo sapiens
ccugggccuggagggggagcacca

SEQ ID NO: 2090005 - RNA, 17 nt, Homo sapiens
aacccagcaacccagga

SEQ ID NO: 2090006 - RNA, 14 nt, Homo sapiens
auuauaacuguaaa

SEQ ID NO: 2090007 - RNA, 14 nt, Homo sapiens
augauaacuggaaa

SEQ ID NO: 2090008 - RNA, 16 nt, Homo sapiens
cuuacuuaaacccagc

SEQ ID NO: 2090009 - RNA, 16 nt, Homo sapiens
aaugcaaugucuuaaa

SEQ ID NO: 2090010 - RNA, 14 nt, Homo sapiens
cggcuacucuggaa

SEQ ID NO: 2090011 - RNA, 22 nt, Homo sapiens
agucuuuugugucagugucuua

SEQ ID NO: 2090012 - RNA, 15 nt, Homo sapiens
ucuggaugcugugaa

SEQ ID NO: 2090013 - RNA, 19 nt, Homo sapiens
ggcaggacugaagauuuca

SEQ ID NO: 2090014 - RNA, 15 nt, Homo sapiens
aaaaacuuacuuugg

SEQ ID NO: 2090015 - RNA, 23 nt, Homo sapiens
cauaagggcacugagcccuuccc

SEQ ID NO: 2090016 - RNA, 23 nt, Homo sapiens
cucuucucuuccuguaacacaag

SEQ ID NO: 2090017 - RNA, 13 nt, Homo sapiens
auacgugucugug

SEQ ID NO: 2090018 - RNA, 14 nt, Homo sapiens
auccaucaugcaaa

SEQ ID NO: 2090019 - RNA, 15 nt, Homo sapiens
guaaguuucugugac

SEQ ID NO: 2090020 - RNA, 13 nt, Homo sapiens
caaaacuuaggca

SEQ ID NO: 2090021 - RNA, 18 nt, Homo sapiens
aaugucuggucuguccac

SEQ ID NO: 2090022 - RNA, 18 nt, Homo sapiens
aaugaaguugaaaaucau

SEQ ID NO: 2090023 - RNA, 22 nt, Homo sapiens
uauuuauugucuuccuguaaga

SEQ ID NO: 2090024 - RNA, 17 nt, Homo sapiens
cagaguggccugugagc

SEQ ID NO: 2090025 - RNA, 15 nt, Homo sapiens
agcucugacugaagg

SEQ ID NO: 2090026 - RNA, 13 nt, Homo sapiens
cuuaaucuuuuca

SEQ ID NO: 2090027 - RNA, 16 nt, Homo sapiens
cagugauauggcagaa

SEQ ID NO: 2090028 - RNA, 13 nt, Homo sapiens
cauguguacagaa

SEQ ID NO: 2090029 - RNA, 14 nt, Homo sapiens
gcacacacugugcu

SEQ ID NO: 2090030 - RNA, 21 nt, Homo sapiens
auccuccuucuccuguuccau

SEQ ID NO: 2090031 - RNA, 15 nt, Homo sapiens
acuguaaacaguucu

SEQ ID NO: 2090032 - RNA, 20 nt, Homo sapiens
acaccguacaucugcaauau

SEQ ID NO: 2090033 - RNA, 22 nt, Homo sapiens
caauuugucuuuggaaaauuca

SEQ ID NO: 2090034 - RNA, 18 nt, Homo sapiens
aaaggauuuuggagauuc

SEQ ID NO: 2090035 - RNA, 18 nt, Homo sapiens
cuaaaaguuguacuucau

SEQ ID NO: 2090036 - RNA, 19 nt, Homo sapiens
auauuuuuuaaaaaucuau

SEQ ID NO: 2090037 - RNA, 22 nt, Homo sapiens
aaucaaaggaaaauaguaaugu

SEQ ID NO: 2090038 - RNA, 15 nt, Homo sapiens
aacuucaauuuacuu

SEQ ID NO: 2090039 - RNA, 11 nt, Homo sapiens
uauaccaaagc

SEQ ID NO: 2090040 - RNA, 13 nt, Homo sapiens
cuuccugccaagc

SEQ ID NO: 2090041 - RNA, 15 nt, Homo sapiens
cacuaaauugcaguu

SEQ ID NO: 2090042 - RNA, 22 nt, Homo sapiens
auguaguuuuacuugguguuua

SEQ ID NO: 2090043 - RNA, 16 nt, Homo sapiens
cugccacaaugugaua

SEQ ID NO: 2090044 - RNA, 18 nt, Homo sapiens
ccagugccuagaugcaug

SEQ ID NO: 2090045 - RNA, 17 nt, Homo sapiens
ccucugaacuugccuua

SEQ ID NO: 2090046 - RNA, 13 nt, Homo sapiens
uuaugcaacauca

SEQ ID NO: 2090047 - RNA, 20 nt, Homo sapiens
cuaaaauucagguauuacug

SEQ ID NO: 2090048 - RNA, 17 nt, Homo sapiens
uucuaccuauaugcagu

SEQ ID NO: 2090049 - RNA, 23 nt, Homo sapiens
auccugcccccagccauggugag

SEQ ID NO: 2090050 - RNA, 19 nt, Homo sapiens
aauaagaacagaucaggaa

SEQ ID NO: 2090051 - RNA, 21 nt, Homo sapiens
auacggcccaugcaauuuuau

SEQ ID NO: 2090052 - RNA, 20 nt, Homo sapiens
gugaacacuggagucuugca

SEQ ID NO: 2090053 - RNA, 19 nt, Homo sapiens
auguugagaggaacaagaa

SEQ ID NO: 2090054 - RNA, 14 nt, Homo sapiens
gguugaucaccuga

SEQ ID NO: 2090055 - RNA, 18 nt, Homo sapiens
acuuuggaaaacuacuuu

SEQ ID NO: 2090056 - RNA, 18 nt, Homo sapiens
agcugacacaggaugaag

SEQ ID NO: 2090057 - RNA, 22 nt, Homo sapiens
uaauguauuugugcacauguac

SEQ ID NO: 2090058 - RNA, 13 nt, Homo sapiens
uaauuuuugcaaa

SEQ ID NO: 2090059 - RNA, 14 nt, Homo sapiens
ugaaagagccagac

SEQ ID NO: 2090060 - RNA, 17 nt, Homo sapiens
auauauguauauacaca

SEQ ID NO: 2090061 - RNA, 20 nt, Homo sapiens
auaaaugaggaaacuccaaa

SEQ ID NO: 2090062 - RNA, 15 nt, Homo sapiens
ugcuuugcacuuuuc

SEQ ID NO: 2090063 - RNA, 15 nt, Homo sapiens
agccuugcucucuuc

SEQ ID NO: 2090064 - RNA, 15 nt, Homo sapiens
aaacugaagccgugu

SEQ ID NO: 2090065 - RNA, 13 nt, Homo sapiens
cugagucucugaa

SEQ ID NO: 2090066 - RNA, 13 nt, Homo sapiens
agaaaucuagaag

SEQ ID NO: 2090067 - RNA, 13 nt, Homo sapiens
ccaaaucuccaag

SEQ ID NO: 2090068 - RNA, 23 nt, Homo sapiens
aacagcugaggucucuugaggga

SEQ ID NO: 2090069 - RNA, 18 nt, Homo sapiens
gacccacagcucugggcc

SEQ ID NO: 2090070 - RNA, 13 nt, Homo sapiens
cuuaaaucaggaa

SEQ ID NO: 2090071 - RNA, 17 nt, Homo sapiens
gaacagcuguaaucuau

SEQ ID NO: 2090072 - RNA, 13 nt, Homo sapiens
ugggccagggucu

SEQ ID NO: 2090073 - RNA, 20 nt, Homo sapiens
gggugugguggcaugugccu

SEQ ID NO: 2090074 - RNA, 23 nt, Homo sapiens
gcugggaccacaagugugcauua

SEQ ID NO: 2090075 - RNA, 18 nt, Homo sapiens
aggucauggucugagugg

SEQ ID NO: 2090076 - RNA, 15 nt, Homo sapiens
uguuaaauacaggaa

SEQ ID NO: 2090077 - RNA, 16 nt, Homo sapiens
aaauucuuuauucuuc

SEQ ID NO: 2090078 - RNA, 11 nt, Homo sapiens
gaagucucuuu

SEQ ID NO: 2090079 - RNA, 20 nt, Homo sapiens
auuuuaaaaaaucaaucaau

SEQ ID NO: 2090080 - RNA, 16 nt, Homo sapiens
gaauaaaguccaaagu

SEQ ID NO: 2090081 - RNA, 22 nt, Homo sapiens
cucuugauucauaaugacuuaa

SEQ ID NO: 2090082 - RNA, 21 nt, Homo sapiens
aauuacaggcgugagccacca

SEQ ID NO: 2090083 - RNA, 17 nt, Homo sapiens
acgucaagugaucugcc

SEQ ID NO: 2090084 - RNA, 15 nt, Homo sapiens
ucucauccauuccuc

SEQ ID NO: 2090085 - RNA, 16 nt, Homo sapiens
agagugcuaugaagac

SEQ ID NO: 2090086 - RNA, 20 nt, Homo sapiens
aguguauuuuauaaaauuaa

SEQ ID NO: 2090087 - RNA, 12 nt, Homo sapiens
auuuucauccca

SEQ ID NO: 2090088 - RNA, 14 nt, Homo sapiens
caaacaguccaauc

SEQ ID NO: 2090089 - RNA, 18 nt, Homo sapiens
aagcauuacccauagguc

SEQ ID NO: 2090090 - RNA, 17 nt, Homo sapiens
gcaaaguguaugugacc

SEQ ID NO: 2090091 - RNA, 14 nt, Homo sapiens
aguuuagauuuuaa

SEQ ID NO: 2090092 - RNA, 22 nt, Homo sapiens
gacguuugacaccagggccagu

SEQ ID NO: 2090093 - RNA, 15 nt, Homo sapiens
gcuuaguaacuagug

SEQ ID NO: 2090094 - RNA, 16 nt, Homo sapiens
aagcaaaaugcuuaca

SEQ ID NO: 2090095 - RNA, 19 nt, Homo sapiens
auugcuuguuuguggucac

SEQ ID NO: 2090096 - RNA, 22 nt, Homo sapiens
gccauuccacuccacucagguu

SEQ ID NO: 2090097 - RNA, 14 nt, Homo sapiens
cauccauauugcac

SEQ ID NO: 2090098 - RNA, 20 nt, Homo sapiens
uccuggaugucugaacuuug

SEQ ID NO: 2090099 - RNA, 12 nt, Homo sapiens
aacuugcaauuu

SEQ ID NO: 2090100 - RNA, 21 nt, Homo sapiens
agaaagacucugagaugugga

SEQ ID NO: 2090101 - RNA, 21 nt, Homo sapiens
cuuaaaaagucugcauuacau

SEQ ID NO: 2090102 - RNA, 19 nt, Homo sapiens
ugaugccacagagaauaag

SEQ ID NO: 2090103 - RNA, 13 nt, Homo sapiens
auaauacuuccaa

SEQ ID NO: 2090104 - RNA, 22 nt, Homo sapiens
aaagucacggcugcgcacugug

SEQ ID NO: 2090105 - RNA, 14 nt, Homo sapiens
uggaaaaaaaccac

SEQ ID NO: 2090106 - RNA, 14 nt, Homo sapiens
guaccaacacaugc

SEQ ID NO: 2090107 - RNA, 20 nt, Homo sapiens
uuuggagacagggucucgcu

SEQ ID NO: 2090108 - RNA, 18 nt, Homo sapiens
aaacuagaauuucauuua

SEQ ID NO: 2090109 - RNA, 13 nt, Homo sapiens
aagacugugcugu

SEQ ID NO: 2090110 - RNA, 23 nt, Homo sapiens
uagccgagcacgguggugcaugc

SEQ ID NO: 2090111 - RNA, 15 nt, Homo sapiens
cgccaaacacuccac

SEQ ID NO: 2090112 - RNA, 22 nt, Homo sapiens
agccugacgccuacuggggcag

SEQ ID NO: 2090113 - RNA, 19 nt, Homo sapiens
cagccccugauccugugaa

SEQ ID NO: 2090114 - RNA, 23 nt, Homo sapiens
caaauccauacccccugccccag

SEQ ID NO: 2090115 - RNA, 14 nt, Homo sapiens
acccccagccaggc

SEQ ID NO: 2090116 - RNA, 14 nt, Homo sapiens
auaccugcccugac

SEQ ID NO: 2090117 - RNA, 19 nt, Homo sapiens
acauugaucuuuugcuaau

SEQ ID NO: 2090118 - RNA, 14 nt, Homo sapiens
acugaguucuauca

SEQ ID NO: 2090119 - RNA, 17 nt, Homo sapiens
gagacccaagcugccuc

SEQ ID NO: 2090120 - RNA, 15 nt, Homo sapiens
cuuaaaugcuacuga

SEQ ID NO: 2090121 - RNA, 23 nt, Homo sapiens
guauugaaucauguaguaucaaa

SEQ ID NO: 2090122 - RNA, 20 nt, Homo sapiens
ucauaugagaaggaacuuug

SEQ ID NO: 2090123 - RNA, 16 nt, Homo sapiens
ggccacugcaacccau

SEQ ID NO: 2090124 - RNA, 19 nt, Homo sapiens
cacagaaaucacagucaau

SEQ ID NO: 2090125 - RNA, 17 nt, Homo sapiens
cgggagccuaggaccac

SEQ ID NO: 2090126 - RNA, 15 nt, Homo sapiens
cccaucccaucccau

SEQ ID NO: 2090127 - RNA, 21 nt, Homo sapiens
aggugccccucuuccaaaggc

SEQ ID NO: 2090128 - RNA, 18 nt, Homo sapiens
cagaacaaauuguuuaca

SEQ ID NO: 2090129 - RNA, 15 nt, Homo sapiens
ucuggcccacugugc

SEQ ID NO: 2090130 - RNA, 22 nt, Homo sapiens
uauaauuaguuaugacagccau

SEQ ID NO: 2090131 - RNA, 21 nt, Homo sapiens
uaucccauggaaccacuaaaa

SEQ ID NO: 2090132 - RNA, 17 nt, Homo sapiens
cuacacagaggacccag

SEQ ID NO: 2090133 - RNA, 14 nt, Homo sapiens
ccgcucuggaccaa

SEQ ID NO: 2090134 - RNA, 18 nt, Homo sapiens
uauaacuucuguacagua

SEQ ID NO: 2090135 - RNA, 17 nt, Homo sapiens
gcuggagggguggccca

SEQ ID NO: 2090136 - RNA, 17 nt, Homo sapiens
uacuuugguagcuggga

SEQ ID NO: 2090137 - RNA, 17 nt, Homo sapiens
aggcggggugcuguggu

SEQ ID NO: 2090138 - RNA, 23 nt, Homo sapiens
acucacacggacacucaaaagcu

SEQ ID NO: 2090139 - RNA, 19 nt, Homo sapiens
auggcaguuugaagucaaa

SEQ ID NO: 2090140 - RNA, 17 nt, Homo sapiens
gcacucagggagcauuu

SEQ ID NO: 2090141 - RNA, 15 nt, Homo sapiens
caguauuguacaaag

SEQ ID NO: 2090142 - RNA, 15 nt, Homo sapiens
cugucagucugcuua

SEQ ID NO: 2090143 - RNA, 22 nt, Homo sapiens
augcucaguuggugcugcuuuc

SEQ ID NO: 2090144 - RNA, 14 nt, Homo sapiens
auucucaguaucca

SEQ ID NO: 2090145 - RNA, 18 nt, Homo sapiens
ucaccaauuccaccaaga

SEQ ID NO: 2090146 - RNA, 20 nt, Homo sapiens
cagcuauuuugugaagccau

SEQ ID NO: 2090147 - RNA, 12 nt, Homo sapiens
ccacagcaguug

SEQ ID NO: 2090148 - RNA, 21 nt, Homo sapiens
aggaggaaauaaauugcagag

SEQ ID NO: 2090149 - RNA, 15 nt, Homo sapiens
cugccaguguggaac

SEQ ID NO: 2090150 - RNA, 13 nt, Homo sapiens
uuucugugucuua

SEQ ID NO: 2090151 - RNA, 17 nt, Homo sapiens
aauuacggaaaaugccu

SEQ ID NO: 2090152 - RNA, 14 nt, Homo sapiens
auguaaccacugca

SEQ ID NO: 2090153 - RNA, 14 nt, Homo sapiens
uaggggaguucagu

SEQ ID NO: 2090154 - RNA, 20 nt, Homo sapiens
aaagcaugaaacauuucaga

SEQ ID NO: 2090155 - RNA, 19 nt, Homo sapiens
ucacgaauauuaugcccag

SEQ ID NO: 2090156 - RNA, 15 nt, Homo sapiens
agccuggacugcuac

SEQ ID NO: 2090157 - RNA, 18 nt, Homo sapiens
ucaaaaccgaguugccag

SEQ ID NO: 2090158 - RNA, 14 nt, Homo sapiens
aaccuccacauguu

SEQ ID NO: 2090159 - RNA, 12 nt, Homo sapiens
cuugagcccaaa

SEQ ID NO: 2090160 - RNA, 21 nt, Homo sapiens
aucagcuggcgucaugcaaag

SEQ ID NO: 2090161 - RNA, 15 nt, Homo sapiens
agccuuaauuugcac

SEQ ID NO: 2090162 - RNA, 16 nt, Homo sapiens
ccucuauaccuguguc

SEQ ID NO: 2090163 - RNA, 16 nt, Homo sapiens
cucuucaguuaauucu

SEQ ID NO: 2090164 - RNA, 14 nt, Homo sapiens
auaaugcaaauguc

SEQ ID NO: 2090165 - RNA, 14 nt, Homo sapiens
uagcauggauuuau

SEQ ID NO: 2090166 - RNA, 22 nt, Homo sapiens
ccugucucuugggaagcaguuu

SEQ ID NO: 2090167 - RNA, 18 nt, Homo sapiens
caagacuuauuuucacau

SEQ ID NO: 2090168 - RNA, 22 nt, Homo sapiens
uccagugggaggugagaccacc

SEQ ID NO: 2090169 - RNA, 23 nt, Homo sapiens
caguuucuccuuuauugcuccug

SEQ ID NO: 2090170 - RNA, 14 nt, Homo sapiens
gccugacauucacu

SEQ ID NO: 2090171 - RNA, 21 nt, Homo sapiens
aguucuuuauaacaaaacagg

SEQ ID NO: 2090172 - RNA, 19 nt, Homo sapiens
ucagcugcugaaauuugga

SEQ ID NO: 2090173 - RNA, 21 nt, Homo sapiens
cagugagcucuggaugaagcu

SEQ ID NO: 2090174 - RNA, 13 nt, Homo sapiens
acagcuuggcacu

SEQ ID NO: 2090175 - RNA, 15 nt, Homo sapiens
uuucagaaacugaag

SEQ ID NO: 2090176 - RNA, 11 nt, Homo sapiens
gagugcaguga

SEQ ID NO: 2090177 - RNA, 11 nt, Homo sapiens
gaaugcagugg

SEQ ID NO: 2090178 - RNA, 17 nt, Homo sapiens
ugauccguuccauugca

SEQ ID NO: 2090179 - RNA, 15 nt, Homo sapiens
ugaaggacugugaca

SEQ ID NO: 2090180 - RNA, 19 nt, Homo sapiens
uggcuuguuugauuucaac

SEQ ID NO: 2090181 - RNA, 14 nt, Homo sapiens
uccaucuccaucca

SEQ ID NO: 2090182 - RNA, 21 nt, Homo sapiens
uccaguaggaaaucaggcagu

SEQ ID NO: 2090183 - RNA, 18 nt, Homo sapiens
guauauauguauaugugc

SEQ ID NO: 2090184 - RNA, 16 nt, Homo sapiens
acugcaggaccuccag

SEQ ID NO: 2090185 - RNA, 21 nt, Homo sapiens
ucuccccacucuaggggucag

SEQ ID NO: 2090186 - RNA, 15 nt, Homo sapiens
auuuagaucucauaa

SEQ ID NO: 2090187 - RNA, 14 nt, Homo sapiens
gaaagaacauuuaa

SEQ ID NO: 2090188 - RNA, 21 nt, Homo sapiens
uacugggacugugcucagaga

SEQ ID NO: 2090189 - RNA, 12 nt, Homo sapiens
aacuagccaaac

SEQ ID NO: 2090190 - RNA, 22 nt, Homo sapiens
aaagcauccauguguggacuca

SEQ ID NO: 2090191 - RNA, 12 nt, Homo sapiens
aauccuugagau

SEQ ID NO: 2090192 - RNA, 17 nt, Homo sapiens
ccuugagcaaauuaccc

SEQ ID NO: 2090193 - RNA, 16 nt, Homo sapiens
ugcuuucuugcucuca

SEQ ID NO: 2090194 - RNA, 16 nt, Homo sapiens
gcaggaucacagcuca

SEQ ID NO: 2090195 - RNA, 17 nt, Homo sapiens
auucagcaaagaacaag

SEQ ID NO: 2090196 - RNA, 15 nt, Homo sapiens
gaccaucuacauaca

SEQ ID NO: 2090197 - RNA, 16 nt, Homo sapiens
gcaagccugucuucag

SEQ ID NO: 2090198 - RNA, 16 nt, Homo sapiens
acucaggcccaaagcc

SEQ ID NO: 2090199 - RNA, 23 nt, Homo sapiens
uggcaacaggccaaugcuacuuu

SEQ ID NO: 2090200 - RNA, 21 nt, Homo sapiens
uugucuccccgaaagggacac

SEQ ID NO: 2090201 - RNA, 18 nt, Homo sapiens
agcauuuuuaauuuucac

SEQ ID NO: 2090202 - RNA, 17 nt, Homo sapiens
auggcuacuaccggggc

SEQ ID NO: 2090203 - RNA, 14 nt, Homo sapiens
agccucguccaagg

SEQ ID NO: 2090204 - RNA, 16 nt, Homo sapiens
uugucaaaugucauua

SEQ ID NO: 2090205 - RNA, 21 nt, Homo sapiens
caaacuggggccucccugguc

SEQ ID NO: 2090206 - RNA, 21 nt, Homo sapiens
gcauguugucuaagaaauuga

SEQ ID NO: 2090207 - RNA, 18 nt, Homo sapiens
agcugugcagcacgucuc

SEQ ID NO: 2090208 - RNA, 20 nt, Homo sapiens
ucacagauaccucucuugua

SEQ ID NO: 2090209 - RNA, 19 nt, Homo sapiens
agggaggaggccaccucuc

SEQ ID NO: 2090210 - RNA, 23 nt, Homo sapiens
cuaaaccagauucuuuguggaua

SEQ ID NO: 2090211 - RNA, 20 nt, Homo sapiens
gcucagccuuggcuggagua

SEQ ID NO: 2090212 - RNA, 16 nt, Homo sapiens
aucuuccuccuuguga

SEQ ID NO: 2090213 - RNA, 15 nt, Homo sapiens
caucauucaugacaa

SEQ ID NO: 2090214 - RNA, 22 nt, Homo sapiens
gcaaccaguuugcccauucucu

SEQ ID NO: 2090215 - RNA, 21 nt, Homo sapiens
uggaagguuagguuugucaac

SEQ ID NO: 2090216 - RNA, 17 nt, Homo sapiens
gccagacaucaacagau

SEQ ID NO: 2090217 - RNA, 19 nt, Homo sapiens
aaccaaaugcugucuccau

SEQ ID NO: 2090218 - RNA, 18 nt, Homo sapiens
uggagcaauaaaagacaa

SEQ ID NO: 2090219 - RNA, 22 nt, Homo sapiens
gggagccagccuucuaacagcu

SEQ ID NO: 2090220 - RNA, 21 nt, Homo sapiens
gauagcuuuauaaagcaguua

SEQ ID NO: 2090221 - RNA, 13 nt, Homo sapiens
agaaacacugggc

SEQ ID NO: 2090222 - RNA, 17 nt, Homo sapiens
uugcagcugcucuugca

SEQ ID NO: 2090223 - RNA, 22 nt, Homo sapiens
uguuacugguagaaaggcaguu

SEQ ID NO: 2090224 - RNA, 17 nt, Homo sapiens
ucuaucuuuuccuucag

SEQ ID NO: 2090225 - RNA, 19 nt, Homo sapiens
aggaaaagaauucucagca

SEQ ID NO: 2090226 - RNA, 21 nt, Homo sapiens
cagagacccgagggcugcuuu

SEQ ID NO: 2090227 - RNA, 16 nt, Homo sapiens
uagaauggaaaacugc

SEQ ID NO: 2090228 - RNA, 20 nt, Homo sapiens
uuucacaacuuaccuuguua

SEQ ID NO: 2090229 - RNA, 16 nt, Homo sapiens
ggucuguaacugccca

SEQ ID NO: 2090230 - RNA, 15 nt, Homo sapiens
aaguaucuuuccagc

SEQ ID NO: 2090231 - RNA, 13 nt, Homo sapiens
gagaguccagcua

SEQ ID NO: 2090232 - RNA, 23 nt, Homo sapiens
ugccaguccaucucaagugccau

SEQ ID NO: 2090233 - RNA, 19 nt, Homo sapiens
ccaucuguuuuggcaagac

SEQ ID NO: 2090234 - RNA, 15 nt, Homo sapiens
auucaagaaugccag

SEQ ID NO: 2090235 - RNA, 19 nt, Homo sapiens
gaggaauucugaagccauu

SEQ ID NO: 2090236 - RNA, 22 nt, Homo sapiens
aggcauggucugcccucugcau

SEQ ID NO: 2090237 - RNA, 22 nt, Homo sapiens
ugcaauaguaggacugcugaca

SEQ ID NO: 2090238 - RNA, 21 nt, Homo sapiens
caacacaguugggacccaaaa

SEQ ID NO: 2090239 - RNA, 18 nt, Homo sapiens
agaugcugacauccaggu

SEQ ID NO: 2090240 - RNA, 22 nt, Homo sapiens
aaaugucuucaaggcuucaguc

SEQ ID NO: 2090241 - RNA, 13 nt, Homo sapiens
uccauuaucuuau

SEQ ID NO: 2090242 - RNA, 16 nt, Homo sapiens
uuguguuugugccaua

SEQ ID NO: 2090243 - RNA, 15 nt, Homo sapiens
aagagauaaacuaca

SEQ ID NO: 2090244 - RNA, 19 nt, Homo sapiens
caagcaauccuccuaccuc

SEQ ID NO: 2090245 - RNA, 16 nt, Homo sapiens
ugaugaaaauggcagu

SEQ ID NO: 2090246 - RNA, 15 nt, Homo sapiens
cugguauuuccuggc

SEQ ID NO: 2090247 - RNA, 19 nt, Homo sapiens
cuuuuuuaaaccaguuuaa

SEQ ID NO: 2090248 - RNA, 22 nt, Homo sapiens
aaucuucuugauccacuucucu

SEQ ID NO: 2090249 - RNA, 15 nt, Homo sapiens
agagccagcagguca

SEQ ID NO: 2090250 - RNA, 13 nt, Homo sapiens
ucagaaagggauu

SEQ ID NO: 2090251 - RNA, 13 nt, Homo sapiens
ucugaaaggguuu

SEQ ID NO: 2090252 - RNA, 15 nt, Homo sapiens
uacuuaaacuuccac

SEQ ID NO: 2090253 - RNA, 16 nt, Homo sapiens
caggacucugccccuu

SEQ ID NO: 2090254 - RNA, 13 nt, Homo sapiens
auaccaagcuugu

SEQ ID NO: 2090255 - RNA, 15 nt, Homo sapiens
auaaaggcagcugcc

SEQ ID NO: 2090256 - RNA, 15 nt, Homo sapiens
cuuccugagcuuucu

SEQ ID NO: 2090257 - RNA, 20 nt, Homo sapiens
uccuggaagcaggugcuaca

SEQ ID NO: 2090258 - RNA, 17 nt, Homo sapiens
aggaucucaaacuugau

SEQ ID NO: 2090259 - RNA, 23 nt, Homo sapiens
aagugcugggauuacagguguga

SEQ ID NO: 2090260 - RNA, 14 nt, Homo sapiens
aaaugauucucuaa

SEQ ID NO: 2090261 - RNA, 17 nt, Homo sapiens
gauuuaguguuaagugu

SEQ ID NO: 2090262 - RNA, 13 nt, Homo sapiens
cuuuccuuccuaa

SEQ ID NO: 2090263 - RNA, 15 nt, Homo sapiens
uguuagcuuccuuaa

SEQ ID NO: 2090264 - RNA, 17 nt, Homo sapiens
uguccuucccuguucuc

SEQ ID NO: 2090265 - RNA, 21 nt, Homo sapiens
ccccuccuccagagccugggc

SEQ ID NO: 2090266 - RNA, 14 nt, Homo sapiens
ugggaacugugcaa

SEQ ID NO: 2090267 - RNA, 18 nt, Homo sapiens
ugucaauucuugccaaau

SEQ ID NO: 2090268 - RNA, 17 nt, Homo sapiens
cugcggcacugugccua

SEQ ID NO: 2090269 - RNA, 20 nt, Homo sapiens
ccagcagaagcaggguaccc

SEQ ID NO: 2090270 - RNA, 16 nt, Homo sapiens
cccuacgaaagcacag

SEQ ID NO: 2090271 - RNA, 24 nt, Homo sapiens
auacauggguagcuucugaccuca

SEQ ID NO: 2090272 - RNA, 15 nt, Homo sapiens
cuucucuacagacuc

SEQ ID NO: 2090273 - RNA, 17 nt, Homo sapiens
cucuugacucuugccug

SEQ ID NO: 2090274 - RNA, 15 nt, Homo sapiens
ugucuuuuguucucu

SEQ ID NO: 2090275 - RNA, 20 nt, Homo sapiens
augucuauguuuucuacucc

SEQ ID NO: 2090276 - RNA, 15 nt, Homo sapiens
auacuggggcuuccu

SEQ ID NO: 2090277 - RNA, 21 nt, Homo sapiens
gccagggcuauagcucaggac

SEQ ID NO: 2090278 - RNA, 14 nt, Homo sapiens
ucuucacagcacau

SEQ ID NO: 2090279 - RNA, 22 nt, Homo sapiens
cguauguaaacaaaaacaacug

SEQ ID NO: 2090280 - RNA, 13 nt, Homo sapiens
uaaugacauacuu

SEQ ID NO: 2090281 - RNA, 17 nt, Homo sapiens
gagcacuggagugcagg

SEQ ID NO: 2090282 - RNA, 18 nt, Homo sapiens
aucccuguacucugaccc

SEQ ID NO: 2090283 - RNA, 17 nt, Homo sapiens
uuuccuuuuaauucuac

SEQ ID NO: 2090284 - RNA, 19 nt, Homo sapiens
uccugugguuuuauuacaa

SEQ ID NO: 2090285 - RNA, 18 nt, Homo sapiens
cuggccccugagaucucu

SEQ ID NO: 2090286 - RNA, 19 nt, Homo sapiens
guacaggugucaccaucau

SEQ ID NO: 2090287 - RNA, 15 nt, Homo sapiens
cccccagcacugagg

SEQ ID NO: 2090288 - RNA, 23 nt, Homo sapiens
cauguauccuuucacacauuugc

SEQ ID NO: 2090289 - RNA, 13 nt, Homo sapiens
uauaaaaacugcc

SEQ ID NO: 2090290 - RNA, 12 nt, Homo sapiens
uagaaaggacgu

SEQ ID NO: 2090291 - RNA, 20 nt, Homo sapiens
caaagggaggaggugcacag

SEQ ID NO: 2090292 - RNA, 17 nt, Homo sapiens
cauggguggaaagugcu

SEQ ID NO: 2090293 - RNA, 22 nt, Homo sapiens
uuaaauauauuuuaaagcacuu

SEQ ID NO: 2090294 - RNA, 22 nt, Homo sapiens
cucuagucaaugacaugaauuu

SEQ ID NO: 2090295 - RNA, 18 nt, Homo sapiens
guccuccugcugccagua

SEQ ID NO: 2090296 - RNA, 15 nt, Homo sapiens
augagaacaaucuca

SEQ ID NO: 2090297 - RNA, 20 nt, Homo sapiens
gcaguucauccgcacuguaa

SEQ ID NO: 2090298 - RNA, 15 nt, Homo sapiens
cauccagcaguguug

SEQ ID NO: 2090299 - RNA, 22 nt, Homo sapiens
acaagaaagucauuagacggua

SEQ ID NO: 2090300 - RNA, 11 nt, Homo sapiens
accauucugaa

SEQ ID NO: 2090301 - RNA, 21 nt, Homo sapiens
caauggcaccuucauucuccg

SEQ ID NO: 2090302 - RNA, 17 nt, Homo sapiens
uaaagacccuccuauuc

SEQ ID NO: 2090303 - RNA, 19 nt, Homo sapiens
cuaccuggccuuccugcca

SEQ ID NO: 2090304 - RNA, 16 nt, Homo sapiens
acaguucuauuugcua

SEQ ID NO: 2090305 - RNA, 17 nt, Homo sapiens
ggcugcuggagugcagu

SEQ ID NO: 2090306 - RNA, 14 nt, Homo sapiens
aauacugcagcuug

SEQ ID NO: 2090307 - RNA, 15 nt, Homo sapiens
gagagccaagcccug

SEQ ID NO: 2090308 - RNA, 13 nt, Homo sapiens
ggccuccguccug

SEQ ID NO: 2090309 - RNA, 13 nt, Homo sapiens
gguugccgucucu

SEQ ID NO: 2090310 - RNA, 22 nt, Homo sapiens
gcuccuguaucagcacuccuca

SEQ ID NO: 2090311 - RNA, 16 nt, Homo sapiens
uaaauuauauuuaccu

SEQ ID NO: 2090312 - RNA, 16 nt, Homo sapiens
cugcacgccggcacca

SEQ ID NO: 2090313 - RNA, 21 nt, Homo sapiens
ugaauucauugucucagugaa

SEQ ID NO: 2090314 - RNA, 18 nt, Homo sapiens
aauaaaauuccuaucuca

SEQ ID NO: 2090315 - RNA, 17 nt, Homo sapiens
aacugguccaggccagg

SEQ ID NO: 2090316 - RNA, 18 nt, Homo sapiens
agcccugagagucagggu

SEQ ID NO: 2090317 - RNA, 22 nt, Homo sapiens
cagaaugcacuugauucaggag

SEQ ID NO: 2090318 - RNA, 19 nt, Homo sapiens
uucagcaauccaugagaua

SEQ ID NO: 2090319 - RNA, 22 nt, Homo sapiens
gcaacaucaguuuaaacaaagg

SEQ ID NO: 2090320 - RNA, 22 nt, Homo sapiens
gcucaguaaacgggaacaugcc

SEQ ID NO: 2090321 - RNA, 19 nt, Homo sapiens
aaaaugugcuauacugcau

SEQ ID NO: 2090322 - RNA, 23 nt, Homo sapiens
gauauuuaacuuuuugccaaaua

SEQ ID NO: 2090323 - RNA, 13 nt, Homo sapiens
uaaaucugccaca

SEQ ID NO: 2090324 - RNA, 12 nt, Homo sapiens
uuaauguaucuu

SEQ ID NO: 2090325 - RNA, 17 nt, Homo sapiens
caggcuggcuugaguga

SEQ ID NO: 2090326 - RNA, 13 nt, Homo sapiens
caggcguucucuc

SEQ ID NO: 2090327 - RNA, 19 nt, Homo sapiens
acugguuuggucaguuaca

SEQ ID NO: 2090328 - RNA, 17 nt, Homo sapiens
aucugucuuuaugauuu

SEQ ID NO: 2090329 - RNA, 16 nt, Homo sapiens
guuucuuaacuauaaa

SEQ ID NO: 2090330 - RNA, 19 nt, Homo sapiens
accuuuggaagucaugagc

SEQ ID NO: 2090331 - RNA, 15 nt, Homo sapiens
gaaauaaaacauuca

SEQ ID NO: 2090332 - RNA, 17 nt, Homo sapiens
cagcugggauuugaacc

SEQ ID NO: 2090333 - RNA, 22 nt, Homo sapiens
agucgcucucaugaagcccuua

SEQ ID NO: 2090334 - RNA, 21 nt, Homo sapiens
gauacccauagcuuccaugag

SEQ ID NO: 2090335 - RNA, 23 nt, Homo sapiens
cuccggagaugaauaugagcuca

SEQ ID NO: 2090336 - RNA, 21 nt, Homo sapiens
aagucacuuaaacucaucuau

SEQ ID NO: 2090337 - RNA, 19 nt, Homo sapiens
agacucaccuguucucacu

SEQ ID NO: 2090338 - RNA, 15 nt, Homo sapiens
gcugcugacccucuc

SEQ ID NO: 2090339 - RNA, 17 nt, Homo sapiens
ccaagaaagaaaccaga

SEQ ID NO: 2090340 - RNA, 19 nt, Homo sapiens
agucuguagaaucuagcca

SEQ ID NO: 2090341 - RNA, 13 nt, Homo sapiens
caugugccuuuag

SEQ ID NO: 2090342 - RNA, 19 nt, Homo sapiens
aaaccuugugcucuuuuca

SEQ ID NO: 2090343 - RNA, 15 nt, Homo sapiens
auguggacuuuuaca

SEQ ID NO: 2090344 - RNA, 15 nt, Homo sapiens
uucagucugugccua

SEQ ID NO: 2090345 - RNA, 22 nt, Homo sapiens
augcaaccuuuggaugcacuuu

SEQ ID NO: 2090346 - RNA, 13 nt, Homo sapiens
gcacacacaguga

SEQ ID NO: 2090347 - RNA, 18 nt, Homo sapiens
caaaaagaggcuauguga

SEQ ID NO: 2090348 - RNA, 19 nt, Homo sapiens
aauggccauuguguuggga

SEQ ID NO: 2090349 - RNA, 15 nt, Homo sapiens
cgaguacugggacaa

SEQ ID NO: 2090350 - RNA, 15 nt, Homo sapiens
uugacaaaaucuuuu

SEQ ID NO: 2090351 - RNA, 17 nt, Homo sapiens
cagccugcagacucacu

SEQ ID NO: 2090352 - RNA, 15 nt, Homo sapiens
agcuccuccagugaa

SEQ ID NO: 2090353 - RNA, 16 nt, Homo sapiens
gaaucugggccucuua

SEQ ID NO: 2090354 - RNA, 16 nt, Homo sapiens
cacaaagaccaaaaug

SEQ ID NO: 2090355 - RNA, 24 nt, Homo sapiens
uaauucaggggcugacacuucaag

SEQ ID NO: 2090356 - RNA, 20 nt, Homo sapiens
gaugggcggacggcugugga

SEQ ID NO: 2090357 - RNA, 16 nt, Homo sapiens
uuaaucaccacucaaa

SEQ ID NO: 2090358 - RNA, 18 nt, Homo sapiens
ggugaccaguugcacuug

SEQ ID NO: 2090359 - RNA, 24 nt, Homo sapiens
ucauuauagaucccccagacuuua

SEQ ID NO: 2090360 - RNA, 17 nt, Homo sapiens
uuacacucuugauucua

SEQ ID NO: 2090361 - RNA, 17 nt, Homo sapiens
uuuaaggauucugagau

SEQ ID NO: 2090362 - RNA, 14 nt, Homo sapiens
caggcgaagggugg

SEQ ID NO: 2090363 - RNA, 19 nt, Homo sapiens
cucauaacucugugaucuu

SEQ ID NO: 2090364 - RNA, 13 nt, Homo sapiens
cagugacccaucu

SEQ ID NO: 2090365 - RNA, 23 nt, Homo sapiens
cuguuggaaugauuucuaugaac

SEQ ID NO: 2090366 - RNA, 18 nt, Homo sapiens
ccguuuucauuguucacu

SEQ ID NO: 2090367 - RNA, 15 nt, Homo sapiens
auuucugggugaccc

SEQ ID NO: 2090368 - RNA, 16 nt, Homo sapiens
auaauuauuuauguga

SEQ ID NO: 2090369 - RNA, 23 nt, Homo sapiens
ucccaaaggacagccgccuggag

SEQ ID NO: 2090370 - RNA, 18 nt, Homo sapiens
ugaccucccaacucuaaa

SEQ ID NO: 2090371 - RNA, 24 nt, Homo sapiens
cuugggcucccacauaagcacuag

SEQ ID NO: 2090372 - RNA, 20 nt, Homo sapiens
agaugaacccuggcauuugg

SEQ ID NO: 2090373 - RNA, 16 nt, Homo sapiens
aaaucuaagugauaua

SEQ ID NO: 2090374 - RNA, 10 nt, Homo sapiens
cccuccaaag

SEQ ID NO: 2090375 - RNA, 15 nt, Homo sapiens
cacccuauggccacu

SEQ ID NO: 2090376 - RNA, 14 nt, Homo sapiens
cagccucccagugu

SEQ ID NO: 2090377 - RNA, 21 nt, Homo sapiens
ugcgacccugggggcacagga

SEQ ID NO: 2090378 - RNA, 20 nt, Homo sapiens
uaaauccuugggagucauua

SEQ ID NO: 2090379 - RNA, 18 nt, Homo sapiens
ccaggcgugguggcucac

SEQ ID NO: 2090380 - RNA, 22 nt, Homo sapiens
accagacagacgcauguggcaa

SEQ ID NO: 2090381 - RNA, 18 nt, Homo sapiens
cuggggaggccaguguug

SEQ ID NO: 2090382 - RNA, 14 nt, Homo sapiens
ugaauguaaugaga

SEQ ID NO: 2090383 - RNA, 18 nt, Homo sapiens
gcccugccuggaggaccu

SEQ ID NO: 2090384 - RNA, 16 nt, Homo sapiens
cccugaggcugugagc

SEQ ID NO: 2090385 - RNA, 19 nt, Homo sapiens
ucaaauuuagcaaccuaga

SEQ ID NO: 2090386 - RNA, 19 nt, Homo sapiens
uggccucagggccaggaag

SEQ ID NO: 2090387 - RNA, 18 nt, Homo sapiens
ucugcaaauaguuucaaa

SEQ ID NO: 2090388 - RNA, 22 nt, Homo sapiens
guacucaucugacuugaacucu

SEQ ID NO: 2090389 - RNA, 19 nt, Homo sapiens
cagaaauuuucugaucuca

SEQ ID NO: 2090390 - RNA, 19 nt, Homo sapiens
auucaugcaacuugauucu

SEQ ID NO: 2090391 - RNA, 13 nt, Homo sapiens
ugugugugccaug

SEQ ID NO: 2090392 - RNA, 14 nt, Homo sapiens
aaccacugugccac

SEQ ID NO: 2090393 - RNA, 14 nt, Homo sapiens
uguaucugaauauc

SEQ ID NO: 2090394 - RNA, 21 nt, Homo sapiens
guacuuagcagcuaucucuca

SEQ ID NO: 2090395 - RNA, 15 nt, Homo sapiens
cugucucucaugaac

SEQ ID NO: 2090396 - RNA, 15 nt, Homo sapiens
aaguauuuauugcau

SEQ ID NO: 2090397 - RNA, 11 nt, Homo sapiens
aaugauuagaa

SEQ ID NO: 2090398 - RNA, 15 nt, Homo sapiens
ucuguacaacuaccu

SEQ ID NO: 2090399 - RNA, 17 nt, Homo sapiens
gagccccgcagaccucc

SEQ ID NO: 2090400 - RNA, 17 nt, Homo sapiens
agagcaugauacaaauu

SEQ ID NO: 2090401 - RNA, 20 nt, Homo sapiens
uccacucugagcccccugac

SEQ ID NO: 2090402 - RNA, 20 nt, Homo sapiens
gaccccaccgccaccgugug

SEQ ID NO: 2090403 - RNA, 14 nt, Homo sapiens
auuuauucccuuga

SEQ ID NO: 2090404 - RNA, 17 nt, Homo sapiens
aaccagagccugagugu

SEQ ID NO: 2090405 - RNA, 13 nt, Homo sapiens
cugugggggaaac

SEQ ID NO: 2090406 - RNA, 13 nt, Homo sapiens
ugcaaacuuuuau

SEQ ID NO: 2090407 - RNA, 19 nt, Homo sapiens
cauucauaacagaacaaga

SEQ ID NO: 2090408 - RNA, 15 nt, Homo sapiens
acucccuaaagcccu

SEQ ID NO: 2090409 - RNA, 20 nt, Homo sapiens
agggucccuuaaagauuuuc

SEQ ID NO: 2090410 - RNA, 20 nt, Homo sapiens
acucccaagccacuagccca

SEQ ID NO: 2090411 - RNA, 22 nt, Homo sapiens
ccagccaagagggcugcaaaag

SEQ ID NO: 2090412 - RNA, 20 nt, Homo sapiens
ccaccuaugccuguggugaa

SEQ ID NO: 2090413 - RNA, 13 nt, Homo sapiens
acaaagaccauga

SEQ ID NO: 2090414 - RNA, 21 nt, Homo sapiens
cccccaucuucgggaccagga

SEQ ID NO: 2090415 - RNA, 22 nt, Homo sapiens
uauuuguuauggcagaugacaa

SEQ ID NO: 2090416 - RNA, 19 nt, Homo sapiens
aggaugggaaucaggcaug

SEQ ID NO: 2090417 - RNA, 12 nt, Homo sapiens
cugugcucccuc

SEQ ID NO: 2090418 - RNA, 11 nt, Homo sapiens
cugcacaggcu

SEQ ID NO: 2090419 - RNA, 13 nt, Homo sapiens
auuaaaaacauuu

SEQ ID NO: 2090420 - RNA, 11 nt, Homo sapiens
gcacugaccug

SEQ ID NO: 2090421 - RNA, 12 nt, Homo sapiens
ucuauucuugga

SEQ ID NO: 2090422 - RNA, 21 nt, Homo sapiens
cuucuuuugucuuugauuaaa

SEQ ID NO: 2090423 - RNA, 16 nt, Homo sapiens
agcaguagacaagcaa

SEQ ID NO: 2090424 - RNA, 12 nt, Homo sapiens
guucuguagaag

SEQ ID NO: 2090425 - RNA, 18 nt, Homo sapiens
gagaugagaaacaacaga

SEQ ID NO: 2090426 - RNA, 13 nt, Homo sapiens
agauucuaccaca

SEQ ID NO: 2090427 - RNA, 19 nt, Homo sapiens
aucuuccagaagugugauu

SEQ ID NO: 2090428 - RNA, 12 nt, Homo sapiens
cucaaaagacaa

SEQ ID NO: 2090429 - RNA, 21 nt, Homo sapiens
auaaggaacaugaaaagcaaa

SEQ ID NO: 2090430 - RNA, 20 nt, Homo sapiens
cucuuguccuucacaucacc

SEQ ID NO: 2090431 - RNA, 21 nt, Homo sapiens
ugaaaggcaaacauuugaagg

SEQ ID NO: 2090432 - RNA, 19 nt, Homo sapiens
uucuacguggauguucucc

SEQ ID NO: 2090433 - RNA, 22 nt, Homo sapiens
cucuauaaucugcagugaugca

SEQ ID NO: 2090434 - RNA, 22 nt, Homo sapiens
cagagaaggaaugucuuugguc

SEQ ID NO: 2090435 - RNA, 16 nt, Homo sapiens
aauuacaaccauugua

SEQ ID NO: 2090436 - RNA, 16 nt, Homo sapiens
gccccacccuaacuga

SEQ ID NO: 2090437 - RNA, 14 nt, Homo sapiens
gugcaugugcaguc

SEQ ID NO: 2090438 - RNA, 19 nt, Homo sapiens
cccaggccgggguggagca

SEQ ID NO: 2090439 - RNA, 18 nt, Homo sapiens
cgguucccuccccagcuc

SEQ ID NO: 2090440 - RNA, 14 nt, Homo sapiens
uaaaagacagcuag

SEQ ID NO: 2090441 - RNA, 14 nt, Homo sapiens
uaaugaacagcaga

SEQ ID NO: 2090442 - RNA, 23 nt, Homo sapiens
ucccuggugccucugugcacagu

SEQ ID NO: 2090443 - RNA, 17 nt, Homo sapiens
ucucucugccuauuuau

SEQ ID NO: 2090444 - RNA, 19 nt, Homo sapiens
uggacgcuguccugagaug

SEQ ID NO: 2090445 - RNA, 13 nt, Homo sapiens
ccgugacugcaag

SEQ ID NO: 2090446 - RNA, 14 nt, Homo sapiens
agcuugcacaaaga

SEQ ID NO: 2090447 - RNA, 17 nt, Homo sapiens
cagauuuguggggaccu

SEQ ID NO: 2090448 - RNA, 20 nt, Homo sapiens
agcaaagcuagguagccauu

SEQ ID NO: 2090449 - RNA, 12 nt, Homo sapiens
uccucacugggc

SEQ ID NO: 2090450 - RNA, 21 nt, Homo sapiens
cuuggcccacacugaggcuua

SEQ ID NO: 2090451 - RNA, 12 nt, Homo sapiens
ugaacugccaaa

SEQ ID NO: 2090452 - RNA, 20 nt, Homo sapiens
agcaaauaaaugccuuccac

SEQ ID NO: 2090453 - RNA, 22 nt, Homo sapiens
agcacagaaaacuagaauuuca

SEQ ID NO: 2090454 - RNA, 18 nt, Homo sapiens
cuggagugguaacagcuc

SEQ ID NO: 2090455 - RNA, 14 nt, Homo sapiens
aaacuuucaccuca

SEQ ID NO: 2090456 - RNA, 19 nt, Homo sapiens
accaggauagagacuggaa

SEQ ID NO: 2090457 - RNA, 18 nt, Homo sapiens
ugccuucuccagacaaac

SEQ ID NO: 2090458 - RNA, 20 nt, Homo sapiens
cuguuuugcauggaguauua

SEQ ID NO: 2090459 - RNA, 13 nt, Homo sapiens
agugccugagaca

SEQ ID NO: 2090460 - RNA, 21 nt, Homo sapiens
aaucucuguuauguacuguac

SEQ ID NO: 2090461 - RNA, 21 nt, Homo sapiens
aggaagaugcugacauccagg

SEQ ID NO: 2090462 - RNA, 17 nt, Homo sapiens
uugggaaggaaggcagu

SEQ ID NO: 2090463 - RNA, 17 nt, Homo sapiens
acuaauagagacacaga

SEQ ID NO: 2090464 - RNA, 21 nt, Homo sapiens
cuauaaaaugagggacuuccc

SEQ ID NO: 2090465 - RNA, 12 nt, Homo sapiens
ugauacuugguc

SEQ ID NO: 2090466 - RNA, 13 nt, Homo sapiens
uugguggauguga

SEQ ID NO: 2090467 - RNA, 19 nt, Homo sapiens
ucaucuccuuuauugcagu

SEQ ID NO: 2090468 - RNA, 18 nt, Homo sapiens
auacuaaauaugagacag

SEQ ID NO: 2090469 - RNA, 17 nt, Homo sapiens
augcucauuccaugacu

SEQ ID NO: 2090470 - RNA, 19 nt, Homo sapiens
cagaaauacuacuguguaa

SEQ ID NO: 2090471 - RNA, 14 nt, Homo sapiens
aucagacucuguaa

SEQ ID NO: 2090472 - RNA, 19 nt, Homo sapiens
ucuuaccagugacgcugcu

SEQ ID NO: 2090473 - RNA, 20 nt, Homo sapiens
acuucugagaccuuguuuca

SEQ ID NO: 2090474 - RNA, 16 nt, Homo sapiens
uccuaaugugcugugu

SEQ ID NO: 2090475 - RNA, 16 nt, Homo sapiens
uagagagagaacuuuu

SEQ ID NO: 2090476 - RNA, 14 nt, Homo sapiens
augcuugucuggca

SEQ ID NO: 2090477 - RNA, 17 nt, Homo sapiens
uuuaaagcuugcucaca

SEQ ID NO: 2090478 - RNA, 17 nt, Homo sapiens
uuaccaugcucaaugaa

SEQ ID NO: 2090479 - RNA, 21 nt, Homo sapiens
uaaauguuuguuuauaucacu

SEQ ID NO: 2090480 - RNA, 18 nt, Homo sapiens
uguagcuguuacugcaag

SEQ ID NO: 2090481 - RNA, 21 nt, Homo sapiens
uacacaauauacgaaaagcca

SEQ ID NO: 2090482 - RNA, 17 nt, Homo sapiens
uugcuucauuaaaacaa

SEQ ID NO: 2090483 - RNA, 19 nt, Homo sapiens
auauagcuuugccaugugg

SEQ ID NO: 2090484 - RNA, 11 nt, Homo sapiens
caucaagagaa

SEQ ID NO: 2090485 - RNA, 17 nt, Homo sapiens
gacaccaguccagguag

SEQ ID NO: 2090486 - RNA, 13 nt, Homo sapiens
uuuuaugcauuga

SEQ ID NO: 2090487 - RNA, 23 nt, Homo sapiens
aaauuuaagaaaacaaguauaua

SEQ ID NO: 2090488 - RNA, 19 nt, Homo sapiens
ugguuauccugugcuacag

SEQ ID NO: 2090489 - RNA, 12 nt, Homo sapiens
agaaugcauuga

SEQ ID NO: 2090490 - RNA, 14 nt, Homo sapiens
aaugacugcauuug

SEQ ID NO: 2090491 - RNA, 17 nt, Homo sapiens
auucagcauuauuccuc

SEQ ID NO: 2090492 - RNA, 14 nt, Homo sapiens
cucugacuggaguc

SEQ ID NO: 2090493 - RNA, 15 nt, Homo sapiens
gauuguuucugguga

SEQ ID NO: 2090494 - RNA, 20 nt, Homo sapiens
uuaggauuucuguauuugcc

SEQ ID NO: 2090495 - RNA, 22 nt, Homo sapiens
gaagugggcaggggcacccaag

SEQ ID NO: 2090496 - RNA, 18 nt, Homo sapiens
guuucuggaagacugcuc

SEQ ID NO: 2090497 - RNA, 12 nt, Homo sapiens
caccccaacagc

SEQ ID NO: 2090498 - RNA, 12 nt, Homo sapiens
aggcccaaagcc

SEQ ID NO: 2090499 - RNA, 15 nt, Homo sapiens
uaggaaaaucacuug

SEQ ID NO: 2090500 - RNA, 13 nt, Homo sapiens
caugcgggugcac

SEQ ID NO: 2090501 - RNA, 22 nt, Homo sapiens
agacagucuucuaauuccucau

SEQ ID NO: 2090502 - RNA, 22 nt, Homo sapiens
caguguuuuaggagcaugagug

SEQ ID NO: 2090503 - RNA, 15 nt, Homo sapiens
ucuggcucuuccagg

SEQ ID NO: 2090504 - RNA, 15 nt, Homo sapiens
auugucuuagucaaa

SEQ ID NO: 2090505 - RNA, 21 nt, Homo sapiens
aauuugggcuguuuuucagau

SEQ ID NO: 2090506 - RNA, 16 nt, Homo sapiens
gauucaaauugcugcu

SEQ ID NO: 2090507 - RNA, 21 nt, Homo sapiens
uguggagucaccccaacucug

SEQ ID NO: 2090508 - RNA, 20 nt, Homo sapiens
aggcuuuaaaaagaaaauca

SEQ ID NO: 2090509 - RNA, 11 nt, Homo sapiens
ggguguugcua

SEQ ID NO: 2090510 - RNA, 23 nt, Homo sapiens
agcacaaaggaaaacucuuggcc

SEQ ID NO: 2090511 - RNA, 15 nt, Homo sapiens
ggaaauuaagacuuu

SEQ ID NO: 2090512 - RNA, 22 nt, Homo sapiens
aagccauagagccccuccuggu

SEQ ID NO: 2090513 - RNA, 14 nt, Homo sapiens
uacaaguauuacaa

SEQ ID NO: 2090514 - RNA, 15 nt, Homo sapiens
ggagcaagcuugccc

SEQ ID NO: 2090515 - RNA, 15 nt, Homo sapiens
auuucccaauacaua

SEQ ID NO: 2090516 - RNA, 14 nt, Homo sapiens
cuaauauauccaug

SEQ ID NO: 2090517 - RNA, 14 nt, Homo sapiens
uucaaguaccaaaa

SEQ ID NO: 2090518 - RNA, 22 nt, Homo sapiens
gccaaccagcccgacagugcca

SEQ ID NO: 2090519 - RNA, 23 nt, Homo sapiens
ucauuuuuuucacuggaguuaca

SEQ ID NO: 2090520 - RNA, 15 nt, Homo sapiens
ccaugaauacacaac

SEQ ID NO: 2090521 - RNA, 16 nt, Homo sapiens
gagcucacaaggcagc

SEQ ID NO: 2090522 - RNA, 15 nt, Homo sapiens
guuacuucagcccau

SEQ ID NO: 2090523 - RNA, 14 nt, Homo sapiens
gacucgcuagucag

SEQ ID NO: 2090524 - RNA, 18 nt, Homo sapiens
ucccggggcuccacugaa

SEQ ID NO: 2090525 - RNA, 23 nt, Homo sapiens
cuuacagugagggcuauacaugg

SEQ ID NO: 2090526 - RNA, 19 nt, Homo sapiens
accauuuuugaaaccaaac

SEQ ID NO: 2090527 - RNA, 18 nt, Homo sapiens
cacagcccugaaucagau

SEQ ID NO: 2090528 - RNA, 23 nt, Homo sapiens
cagucccugguuccuagaugugu

SEQ ID NO: 2090529 - RNA, 21 nt, Homo sapiens
caaguaacaaugcaugcuuug

SEQ ID NO: 2090530 - RNA, 21 nt, Homo sapiens
uauagauguuagcccaagaca

SEQ ID NO: 2090531 - RNA, 14 nt, Homo sapiens
guccugcuacccag

SEQ ID NO: 2090532 - RNA, 14 nt, Homo sapiens
cugucuugagaaaa

SEQ ID NO: 2090533 - RNA, 18 nt, Homo sapiens
aucauaauucagcacuua

SEQ ID NO: 2090534 - RNA, 20 nt, Homo sapiens
ucaaccccuccccuccaucc

SEQ ID NO: 2090535 - RNA, 20 nt, Homo sapiens
ccuauagucccagcuacuca

SEQ ID NO: 2090536 - RNA, 21 nt, Homo sapiens
ccuggccaucccuucauuuaa

SEQ ID NO: 2090537 - RNA, 20 nt, Homo sapiens
cgcucuaggauaacuggcac

SEQ ID NO: 2090538 - RNA, 22 nt, Homo sapiens
caaggcccauaucugugaaaug

SEQ ID NO: 2090539 - RNA, 18 nt, Homo sapiens
gagugagagacauuaacu

SEQ ID NO: 2090540 - RNA, 12 nt, Homo sapiens
uuuuucuaguau

SEQ ID NO: 2090541 - RNA, 21 nt, Homo sapiens
gguuaaacagcagcacuuuuu

SEQ ID NO: 2090542 - RNA, 17 nt, Homo sapiens
ugacaguccuccaucca

SEQ ID NO: 2090543 - RNA, 19 nt, Homo sapiens
acuuccuguaagauugcuu

SEQ ID NO: 2090544 - RNA, 21 nt, Homo sapiens
auuacaggcgugauccaccac

SEQ ID NO: 2090545 - RNA, 17 nt, Homo sapiens
cccccaaaguucacaau

SEQ ID NO: 2090546 - RNA, 21 nt, Homo sapiens
ucugcuguacauuauuaaaag

SEQ ID NO: 2090547 - RNA, 20 nt, Homo sapiens
uuuguuauagagaucucagc

SEQ ID NO: 2090548 - RNA, 15 nt, Homo sapiens
caauacuacuguaaa

SEQ ID NO: 2090549 - RNA, 15 nt, Homo sapiens
uuugcugcuuuccag

SEQ ID NO: 2090550 - RNA, 18 nt, Homo sapiens
aggcaggcucauuucacu

SEQ ID NO: 2090551 - RNA, 17 nt, Homo sapiens
auauaguaugaaugcag

SEQ ID NO: 2090552 - RNA, 17 nt, Homo sapiens
aauaacacuguacugca

SEQ ID NO: 2090553 - RNA, 16 nt, Homo sapiens
aguucuuuugucuuag

SEQ ID NO: 2090554 - RNA, 23 nt, Homo sapiens
aaauuugauuugaaaaguauuau

SEQ ID NO: 2090555 - RNA, 13 nt, Homo sapiens
ucacacagccugu

SEQ ID NO: 2090556 - RNA, 22 nt, Homo sapiens
cuuuuagcuacaccccuuuguc

SEQ ID NO: 2090557 - RNA, 12 nt, Homo sapiens
cuaccacuguau

SEQ ID NO: 2090558 - RNA, 12 nt, Homo sapiens
cuaucacuguac

SEQ ID NO: 2090559 - RNA, 18 nt, Homo sapiens
ugaguuuuacauuacaaa

SEQ ID NO: 2090560 - RNA, 20 nt, Homo sapiens
ugagagaggaccuccaugcc

SEQ ID NO: 2090561 - RNA, 22 nt, Homo sapiens
uagaacauaaagcaaauagaca

SEQ ID NO: 2090562 - RNA, 13 nt, Homo sapiens
aacacacaauauu

SEQ ID NO: 2090563 - RNA, 22 nt, Homo sapiens
cagccccugggcccuugugcuc

SEQ ID NO: 2090564 - RNA, 15 nt, Homo sapiens
gccaacaacucugau

SEQ ID NO: 2090565 - RNA, 15 nt, Homo sapiens
aucaaacaugcacac

SEQ ID NO: 2090566 - RNA, 20 nt, Homo sapiens
cugccucagccuccugagca

SEQ ID NO: 2090567 - RNA, 23 nt, Homo sapiens
uuauugaaaggggacaccuguac

SEQ ID NO: 2090568 - RNA, 18 nt, Homo sapiens
ugggguuggaagugcaga

SEQ ID NO: 2090569 - RNA, 14 nt, Homo sapiens
acaggcacaaguca

SEQ ID NO: 2090570 - RNA, 19 nt, Homo sapiens
gcacgugcacacaccugca

SEQ ID NO: 2090571 - RNA, 16 nt, Homo sapiens
uuaaaggucucccaca

SEQ ID NO: 2090572 - RNA, 19 nt, Homo sapiens
agccauacuuccagcgaaa

SEQ ID NO: 2090573 - RNA, 20 nt, Homo sapiens
gaccacuggcccuggggcca

SEQ ID NO: 2090574 - RNA, 14 nt, Homo sapiens
aacaccacagacac

SEQ ID NO: 2090575 - RNA, 23 nt, Homo sapiens
cggccuccuagccucuccgccca

SEQ ID NO: 2090576 - RNA, 15 nt, Homo sapiens
ugauaugcaacugca

SEQ ID NO: 2090577 - RNA, 18 nt, Homo sapiens
uuagauauuaggucccau

SEQ ID NO: 2090578 - RNA, 23 nt, Homo sapiens
ggucacugggggacacuguggca

SEQ ID NO: 2090579 - RNA, 20 nt, Homo sapiens
gugcuuaaaagcuguucuca

SEQ ID NO: 2090580 - RNA, 18 nt, Homo sapiens
agcugcagagagcaccug

SEQ ID NO: 2090581 - RNA, 12 nt, Homo sapiens
agcccaugggua

SEQ ID NO: 2090582 - RNA, 18 nt, Homo sapiens
cagccacagguacagagc

SEQ ID NO: 2090583 - RNA, 20 nt, Homo sapiens
ugauuaccuagaagugcaag

SEQ ID NO: 2090584 - RNA, 19 nt, Homo sapiens
aaucuuacacaucugccac

SEQ ID NO: 2090585 - RNA, 17 nt, Homo sapiens
uggagaucuuaagauuc

SEQ ID NO: 2090586 - RNA, 16 nt, Homo sapiens
acaaauaaaacauggc

SEQ ID NO: 2090587 - RNA, 14 nt, Homo sapiens
gugcagaaggcaau

SEQ ID NO: 2090588 - RNA, 22 nt, Homo sapiens
guucuuugauuuguaccauucc

SEQ ID NO: 2090589 - RNA, 12 nt, Homo sapiens
gacacacuggcu

SEQ ID NO: 2090590 - RNA, 18 nt, Homo sapiens
cacaccauugcaugaauu

SEQ ID NO: 2090591 - RNA, 12 nt, Homo sapiens
gaaucacuggaa

SEQ ID NO: 2090592 - RNA, 16 nt, Homo sapiens
aauaugggaggaacaa

SEQ ID NO: 2090593 - RNA, 18 nt, Homo sapiens
ucuuuagaaacaucaguu

SEQ ID NO: 2090594 - RNA, 19 nt, Homo sapiens
aauaaaggcaccuccccca

SEQ ID NO: 2090595 - RNA, 23 nt, Homo sapiens
gaaucgguuguucuuuccucaca

SEQ ID NO: 2090596 - RNA, 21 nt, Homo sapiens
auuuguauaacgguuuaauuc

SEQ ID NO: 2090597 - RNA, 20 nt, Homo sapiens
ccuaucuuuuauuucauuca

SEQ ID NO: 2090598 - RNA, 16 nt, Homo sapiens
cucagacuagcuuuca

SEQ ID NO: 2090599 - RNA, 18 nt, Homo sapiens
gcucccuuuuaagccagg

SEQ ID NO: 2090600 - RNA, 16 nt, Homo sapiens
gaucccaacacugcca

SEQ ID NO: 2090601 - RNA, 17 nt, Homo sapiens
aguguuuuuucugucau

SEQ ID NO: 2090602 - RNA, 12 nt, Homo sapiens
cugugcuaauaa

SEQ ID NO: 2090603 - RNA, 14 nt, Homo sapiens
caguccuccagacc

SEQ ID NO: 2090604 - RNA, 22 nt, Homo sapiens
aagaaauuccauacuucucuca

SEQ ID NO: 2090605 - RNA, 12 nt, Homo sapiens
caacucacauua

SEQ ID NO: 2090606 - RNA, 17 nt, Homo sapiens
aggcuucuccaaaggga

SEQ ID NO: 2090607 - RNA, 15 nt, Homo sapiens
augugaaucugggug

SEQ ID NO: 2090608 - RNA, 14 nt, Homo sapiens
ugcacaaacagagg

SEQ ID NO: 2090609 - RNA, 13 nt, Homo sapiens
aggugcuuaccuc

SEQ ID NO: 2090610 - RNA, 14 nt, Homo sapiens
cagcugccaaggaa

SEQ ID NO: 2090611 - RNA, 14 nt, Homo sapiens
caacagcacccucu

SEQ ID NO: 2090612 - RNA, 13 nt, Homo sapiens
guaaauacaugua

SEQ ID NO: 2090613 - RNA, 13 nt, Homo sapiens
uccuauuacuuau

SEQ ID NO: 2090614 - RNA, 17 nt, Homo sapiens
ucacaaccagauuugag

SEQ ID NO: 2090615 - RNA, 14 nt, Homo sapiens
uaggcaccuaccac

SEQ ID NO: 2090616 - RNA, 14 nt, Homo sapiens
cugauaccacugca

SEQ ID NO: 2090617 - RNA, 20 nt, Homo sapiens
guaggcuacagagaagccuu

SEQ ID NO: 2090618 - RNA, 15 nt, Homo sapiens
gaacaaaaaaaccac

SEQ ID NO: 2090619 - RNA, 15 nt, Homo sapiens
agccccaaggccacc

SEQ ID NO: 2090620 - RNA, 14 nt, Homo sapiens
uaugauuauacaaa

SEQ ID NO: 2090621 - RNA, 20 nt, Homo sapiens
accauagccaaccuguaguu

SEQ ID NO: 2090622 - RNA, 17 nt, Homo sapiens
ugcccagcacagugccu

SEQ ID NO: 2090623 - RNA, 21 nt, Homo sapiens
ggagccuuuuuaaaacacaug

SEQ ID NO: 2090624 - RNA, 20 nt, Homo sapiens
uguuaggcgggagcucuccu

SEQ ID NO: 2090625 - RNA, 14 nt, Homo sapiens
acaguuucuuccau

SEQ ID NO: 2090626 - RNA, 23 nt, Homo sapiens
uaauuugagaucguccacuguca

SEQ ID NO: 2090627 - RNA, 17 nt, Homo sapiens
cuguugaaccaccugug

SEQ ID NO: 2090628 - RNA, 14 nt, Homo sapiens
ccauggacacucca

SEQ ID NO: 2090629 - RNA, 21 nt, Homo sapiens
gaaggucuguacuaacaaagc

SEQ ID NO: 2090630 - RNA, 23 nt, Homo sapiens
agcuaaccugcacguugugcaca

SEQ ID NO: 2090631 - RNA, 21 nt, Homo sapiens
acccaaggaugucugccacac

SEQ ID NO: 2090632 - RNA, 20 nt, Homo sapiens
uaaauggcccggacaugucu

SEQ ID NO: 2090633 - RNA, 15 nt, Homo sapiens
caaauagaucaugca

SEQ ID NO: 2090634 - RNA, 17 nt, Homo sapiens
gaaacgggcuccuuccc

SEQ ID NO: 2090635 - RNA, 14 nt, Homo sapiens
ucagaaauguacaa

SEQ ID NO: 2090636 - RNA, 14 nt, Homo sapiens
cugaaucuagagaa

SEQ ID NO: 2090637 - RNA, 15 nt, Homo sapiens
uucaucagaccacuc

SEQ ID NO: 2090638 - RNA, 13 nt, Homo sapiens
auaaaccauucca

SEQ ID NO: 2090639 - RNA, 15 nt, Homo sapiens
gcacauccaggcaau

SEQ ID NO: 2090640 - RNA, 17 nt, Homo sapiens
augcuuggcuaacuaua

SEQ ID NO: 2090641 - RNA, 16 nt, Homo sapiens
uaaaaauacauagcau

SEQ ID NO: 2090642 - RNA, 14 nt, Homo sapiens
acaugucuugacug

SEQ ID NO: 2090643 - RNA, 12 nt, Homo sapiens
guuuaccaucug

SEQ ID NO: 2090644 - RNA, 14 nt, Homo sapiens
aaggugacugggau

SEQ ID NO: 2090645 - RNA, 18 nt, Homo sapiens
uucaagaaagcauugcca

SEQ ID NO: 2090646 - RNA, 15 nt, Homo sapiens
cugacagcagccugu

SEQ ID NO: 2090647 - RNA, 17 nt, Homo sapiens
agacaaagugaagccgc

SEQ ID NO: 2090648 - RNA, 21 nt, Homo sapiens
gguaaauaaagccacuuuccu

SEQ ID NO: 2090649 - RNA, 19 nt, Homo sapiens
gcuccuugaagaaucucuc

SEQ ID NO: 2090650 - RNA, 22 nt, Homo sapiens
uagagcucaguauacuaaugcc

SEQ ID NO: 2090651 - RNA, 16 nt, Homo sapiens
gagcuagaaccuggag

SEQ ID NO: 2090652 - RNA, 14 nt, Homo sapiens
agucguggaaucaa

SEQ ID NO: 2090653 - RNA, 19 nt, Homo sapiens
ccgcaaaagacaagucuuu

SEQ ID NO: 2090654 - RNA, 18 nt, Homo sapiens
aguuucuccaaguacuuu

SEQ ID NO: 2090655 - RNA, 13 nt, Homo sapiens
cgccucgcuucac

SEQ ID NO: 2090656 - RNA, 19 nt, Homo sapiens
acucuuaacuuacgaucuc

SEQ ID NO: 2090657 - RNA, 21 nt, Homo sapiens
gaacuuaccgugagcgacaaa

SEQ ID NO: 2090658 - RNA, 15 nt, Homo sapiens
uauagaaaauucuug

SEQ ID NO: 2090659 - RNA, 18 nt, Homo sapiens
uccucugcaguguggcaa

SEQ ID NO: 2090660 - RNA, 14 nt, Homo sapiens
aaccucauugacaa

SEQ ID NO: 2090661 - RNA, 18 nt, Homo sapiens
uagcccuuccccucugca

SEQ ID NO: 2090662 - RNA, 15 nt, Homo sapiens
uaauugugcagauau

SEQ ID NO: 2090663 - RNA, 23 nt, Homo sapiens
guuuuguugagcaugacagccug

SEQ ID NO: 2090664 - RNA, 12 nt, Homo sapiens
ccugaccaaagg

SEQ ID NO: 2090665 - RNA, 15 nt, Homo sapiens
uacguaucugcuacu

SEQ ID NO: 2090666 - RNA, 20 nt, Homo sapiens
cuagagaucuaugggcauuu

SEQ ID NO: 2090667 - RNA, 12 nt, Homo sapiens
ccgaaacauaca

SEQ ID NO: 2090668 - RNA, 22 nt, Homo sapiens
uuaguagagaugggguuucacc

SEQ ID NO: 2090669 - RNA, 18 nt, Homo sapiens
uauauaggauauugcuaa

SEQ ID NO: 2090670 - RNA, 19 nt, Homo sapiens
uaacugcaccaacgagcug

SEQ ID NO: 2090671 - RNA, 20 nt, Homo sapiens
gugugcaugagaaugucauu

SEQ ID NO: 2090672 - RNA, 14 nt, Homo sapiens
cagaaaugacaaca

SEQ ID NO: 2090673 - RNA, 22 nt, Homo sapiens
uuggcucugcuuuuaacuuuau

SEQ ID NO: 2090674 - RNA, 17 nt, Homo sapiens
uuaccucuucuaugcaa

SEQ ID NO: 2090675 - RNA, 21 nt, Homo sapiens
guuacuugaaauaccagugaa

SEQ ID NO: 2090676 - RNA, 17 nt, Homo sapiens
agaauuguccaugugcu

SEQ ID NO: 2090677 - RNA, 15 nt, Homo sapiens
acagguuaaccugca

SEQ ID NO: 2090678 - RNA, 19 nt, Homo sapiens
cuuauuaaccaugucuguu

SEQ ID NO: 2090679 - RNA, 14 nt, Homo sapiens
uggaauucuacugg

SEQ ID NO: 2090680 - RNA, 15 nt, Homo sapiens
guauauguugcaaaa

SEQ ID NO: 2090681 - RNA, 22 nt, Homo sapiens
ggucuuccagcgaggugggaga

SEQ ID NO: 2090682 - RNA, 16 nt, Homo sapiens
uuugguaugugacaug

SEQ ID NO: 2090683 - RNA, 21 nt, Homo sapiens
uuaaaugacugcugaaugaca

SEQ ID NO: 2090684 - RNA, 19 nt, Homo sapiens
acauagcugggauuugaac

SEQ ID NO: 2090685 - RNA, 13 nt, Homo sapiens
ucagcacucaggu

SEQ ID NO: 2090686 - RNA, 12 nt, Homo sapiens
uuuuauauagca

SEQ ID NO: 2090687 - RNA, 21 nt, Homo sapiens
gcuggaguuagggacugacca

SEQ ID NO: 2090688 - RNA, 23 nt, Homo sapiens
cauggugcuggggagccaaaggc

SEQ ID NO: 2090689 - RNA, 19 nt, Homo sapiens
caaucaguauguauucuuu

SEQ ID NO: 2090690 - RNA, 14 nt, Homo sapiens
augucuugcuaaca

SEQ ID NO: 2090691 - RNA, 17 nt, Homo sapiens
guuuuucccucagugaa

SEQ ID NO: 2090692 - RNA, 17 nt, Homo sapiens
cgaacuccugaccucag

SEQ ID NO: 2090693 - RNA, 12 nt, Homo sapiens
gccuccaugccc

SEQ ID NO: 2090694 - RNA, 12 nt, Homo sapiens
cccuccaucccc

SEQ ID NO: 2090695 - RNA, 22 nt, Homo sapiens
aauuaguaggcucauuuacugu

SEQ ID NO: 2090696 - RNA, 21 nt, Homo sapiens
auguccuccucugugaaacug

SEQ ID NO: 2090697 - RNA, 15 nt, Homo sapiens
cugucuguaccuaaa

SEQ ID NO: 2090698 - RNA, 17 nt, Homo sapiens
gguuguuguuaaugaau

SEQ ID NO: 2090699 - RNA, 21 nt, Homo sapiens
uuccgaggccccugucucagg

SEQ ID NO: 2090700 - RNA, 19 nt, Homo sapiens
ugggagaccggccugccag

SEQ ID NO: 2090701 - RNA, 13 nt, Homo sapiens
cuuugugccucaa

SEQ ID NO: 2090702 - RNA, 21 nt, Homo sapiens
uugaaccuugguaaauuguaa

SEQ ID NO: 2090703 - RNA, 14 nt, Homo sapiens
guucauacauauuu

SEQ ID NO: 2090704 - RNA, 21 nt, Homo sapiens
ucaccgacccgacacucucac

SEQ ID NO: 2090705 - RNA, 12 nt, Homo sapiens
uuuccagaauug

SEQ ID NO: 2090706 - RNA, 19 nt, Homo sapiens
aaacuggaaugagcagcuu

SEQ ID NO: 2090707 - RNA, 13 nt, Homo sapiens
ugugacauuccug

SEQ ID NO: 2090708 - RNA, 22 nt, Homo sapiens
ucauugaagacccucaaugcca

SEQ ID NO: 2090709 - RNA, 21 nt, Homo sapiens
acuccucugucauaugcagaa

SEQ ID NO: 2090710 - RNA, 19 nt, Homo sapiens
cuuucuugcacuauuccac

SEQ ID NO: 2090711 - RNA, 19 nt, Homo sapiens
acaccgucccucagugaua

SEQ ID NO: 2090712 - RNA, 14 nt, Homo sapiens
uucaggccagugug

SEQ ID NO: 2090713 - RNA, 14 nt, Homo sapiens
acauaaaagacaca

SEQ ID NO: 2090714 - RNA, 21 nt, Homo sapiens
acccugcucauccacucuacu

SEQ ID NO: 2090715 - RNA, 20 nt, Homo sapiens
ucgagguccuccuggccuga

SEQ ID NO: 2090716 - RNA, 20 nt, Homo sapiens
ccuacagcuacauugagaua

SEQ ID NO: 2090717 - RNA, 15 nt, Homo sapiens
cagagagggggccac

SEQ ID NO: 2090718 - RNA, 13 nt, Homo sapiens
ucugaaacagaaa

SEQ ID NO: 2090719 - RNA, 13 nt, Homo sapiens
ucaguaacaguau

SEQ ID NO: 2090720 - RNA, 20 nt, Homo sapiens
gaaaacaaauauuucacuua

SEQ ID NO: 2090721 - RNA, 20 nt, Homo sapiens
caguucucuguggaagcaag

SEQ ID NO: 2090722 - RNA, 18 nt, Homo sapiens
uugucccugugccuaaca

SEQ ID NO: 2090723 - RNA, 14 nt, Homo sapiens
agugccagcaauga

SEQ ID NO: 2090724 - RNA, 20 nt, Homo sapiens
uggaugaaaguugcaggaag

SEQ ID NO: 2090725 - RNA, 23 nt, Homo sapiens
aaacuuuuguuuagagcccuccc

SEQ ID NO: 2090726 - RNA, 15 nt, Homo sapiens
uguuggggggaugag

SEQ ID NO: 2090727 - RNA, 21 nt, Homo sapiens
accucccccugaacacuguga

SEQ ID NO: 2090728 - RNA, 16 nt, Homo sapiens
ccagcugaucauguca

SEQ ID NO: 2090729 - RNA, 15 nt, Homo sapiens
ugaaugauaaacucu

SEQ ID NO: 2090730 - RNA, 18 nt, Homo sapiens
aaugcaauaacucuggga

SEQ ID NO: 2090731 - RNA, 19 nt, Homo sapiens
ucaacaaaaagacauggaa

SEQ ID NO: 2090732 - RNA, 21 nt, Homo sapiens
ucaccucacuuguggcagcuu

SEQ ID NO: 2090733 - RNA, 17 nt, Homo sapiens
ugaaguccuccagacaa

SEQ ID NO: 2090734 - RNA, 17 nt, Homo sapiens
cuugaaaugaaagggaa

SEQ ID NO: 2090735 - RNA, 20 nt, Homo sapiens
cugucuacaguagcugcuac

SEQ ID NO: 2090736 - RNA, 22 nt, Homo sapiens
aauuacugccuuacuguacaua

SEQ ID NO: 2090737 - RNA, 21 nt, Homo sapiens
uuggaugggagugggcaccuc

SEQ ID NO: 2090738 - RNA, 16 nt, Homo sapiens
acucaggguucaucug

SEQ ID NO: 2090739 - RNA, 13 nt, Homo sapiens
cacucagggugau

SEQ ID NO: 2090740 - RNA, 14 nt, Homo sapiens
aauaucaaaugcag

SEQ ID NO: 2090741 - RNA, 11 nt, Homo sapiens
ucacuaccucc

SEQ ID NO: 2090742 - RNA, 13 nt, Homo sapiens
ccacccucaauaa

SEQ ID NO: 2090743 - RNA, 20 nt, Homo sapiens
uucuugcuuucaauuacaaa

SEQ ID NO: 2090744 - RNA, 20 nt, Homo sapiens
uguaugugggaguacucuca

SEQ ID NO: 2090745 - RNA, 20 nt, Homo sapiens
ccuucagggagugagggauu

SEQ ID NO: 2090746 - RNA, 17 nt, Homo sapiens
aguuuugacaucaauga

SEQ ID NO: 2090747 - RNA, 17 nt, Homo sapiens
uaggauauugaauguga

SEQ ID NO: 2090748 - RNA, 16 nt, Homo sapiens
cuguggaauucaguga

SEQ ID NO: 2090749 - RNA, 17 nt, Homo sapiens
aaagcagcaacuauuca

SEQ ID NO: 2090750 - RNA, 16 nt, Homo sapiens
acaggagccacaggga

SEQ ID NO: 2090751 - RNA, 13 nt, Homo sapiens
ccuuuuauacuga

SEQ ID NO: 2090752 - RNA, 21 nt, Homo sapiens
ccaggaagaggggcgcugccc

SEQ ID NO: 2090753 - RNA, 18 nt, Homo sapiens
cagugaccccugaccuca

SEQ ID NO: 2090754 - RNA, 16 nt, Homo sapiens
gugcaauagcagggau

SEQ ID NO: 2090755 - RNA, 22 nt, Homo sapiens
cccagggucauaaguggggaga

SEQ ID NO: 2090756 - RNA, 13 nt, Homo sapiens
aucgcaagagcca

SEQ ID NO: 2090757 - RNA, 18 nt, Homo sapiens
aaagauguguuguugguu

SEQ ID NO: 2090758 - RNA, 23 nt, Homo sapiens
uaaagaugguccaaaaauaguca

SEQ ID NO: 2090759 - RNA, 21 nt, Homo sapiens
uacaaaauuucugaugagauu

SEQ ID NO: 2090760 - RNA, 19 nt, Homo sapiens
ugcggugugagauggugcc

SEQ ID NO: 2090761 - RNA, 20 nt, Homo sapiens
gaagucagagagggugacaa

SEQ ID NO: 2090762 - RNA, 14 nt, Homo sapiens
uuuaaaaugcauaa

SEQ ID NO: 2090763 - RNA, 21 nt, Homo sapiens
acuuucccuauacuuaggcau

SEQ ID NO: 2090764 - RNA, 16 nt, Homo sapiens
caugucccuccaaggc

SEQ ID NO: 2090765 - RNA, 16 nt, Homo sapiens
uuagcacuaccauugu

SEQ ID NO: 2090766 - RNA, 19 nt, Homo sapiens
uaaacuaggauugacauuc

SEQ ID NO: 2090767 - RNA, 18 nt, Homo sapiens
acugacccaaaaugugaa

SEQ ID NO: 2090768 - RNA, 12 nt, Homo sapiens
ccaggugcacag

SEQ ID NO: 2090769 - RNA, 12 nt, Homo sapiens
cgucgugcaguc

SEQ ID NO: 2090770 - RNA, 13 nt, Homo sapiens
acacagugcagua

SEQ ID NO: 2090771 - RNA, 18 nt, Homo sapiens
gcucugagggucugaaaa

SEQ ID NO: 2090772 - RNA, 18 nt, Homo sapiens
ccugcauagcuugcacaa

SEQ ID NO: 2090773 - RNA, 16 nt, Homo sapiens
caggcacuaagacuaa

SEQ ID NO: 2090774 - RNA, 15 nt, Homo sapiens
agccccugguccuga

SEQ ID NO: 2090775 - RNA, 17 nt, Homo sapiens
gugcuuuuugggaccau

SEQ ID NO: 2090776 - RNA, 17 nt, Homo sapiens
auugggaaaacauuugc

SEQ ID NO: 2090777 - RNA, 17 nt, Homo sapiens
gccacauggcugggauu

SEQ ID NO: 2090778 - RNA, 16 nt, Homo sapiens
gcagcagccagcacca

SEQ ID NO: 2090779 - RNA, 15 nt, Homo sapiens
acccacggcucucgu

SEQ ID NO: 2090780 - RNA, 23 nt, Homo sapiens
uuuggauuccuaaauauuuucaa

SEQ ID NO: 2090781 - RNA, 15 nt, Homo sapiens
cuucuagacagaguu

SEQ ID NO: 2090782 - RNA, 20 nt, Homo sapiens
cacugagcuccccagaucuc

SEQ ID NO: 2090783 - RNA, 20 nt, Homo sapiens
gcaauugucuuguaccuuga

SEQ ID NO: 2090784 - RNA, 16 nt, Homo sapiens
auaggccuuagcagua

SEQ ID NO: 2090785 - RNA, 12 nt, Homo sapiens
caggugagcugg

SEQ ID NO: 2090786 - RNA, 19 nt, Homo sapiens
accucagccucccaaagug

SEQ ID NO: 2090787 - RNA, 13 nt, Homo sapiens
caaagggugggca

SEQ ID NO: 2090788 - RNA, 19 nt, Homo sapiens
cagccucuuagaugcaguu

SEQ ID NO: 2090789 - RNA, 14 nt, Homo sapiens
acgguauccucccu

SEQ ID NO: 2090790 - RNA, 18 nt, Homo sapiens
ugacuuugccaaagugua

SEQ ID NO: 2090791 - RNA, 21 nt, Homo sapiens
caccaaagaauuguaggcagu

SEQ ID NO: 2090792 - RNA, 14 nt, Homo sapiens
gaccuucuccuuca

SEQ ID NO: 2090793 - RNA, 16 nt, Homo sapiens
auuucuggguucucaa

SEQ ID NO: 2090794 - RNA, 17 nt, Homo sapiens
uuuugagcuaaucuuca

SEQ ID NO: 2090795 - RNA, 19 nt, Homo sapiens
auagccuuugucauuuuau

SEQ ID NO: 2090796 - RNA, 17 nt, Homo sapiens
uauucccacagcacuaa

SEQ ID NO: 2090797 - RNA, 19 nt, Homo sapiens
cacaugucuuguacaugug

SEQ ID NO: 2090798 - RNA, 21 nt, Homo sapiens
gccaucaucucuuuaccuggg

SEQ ID NO: 2090799 - RNA, 19 nt, Homo sapiens
guauucugcaacagccugu

SEQ ID NO: 2090800 - RNA, 23 nt, Homo sapiens
cagcauguuucucccauuuagaa

SEQ ID NO: 2090801 - RNA, 17 nt, Homo sapiens
uugaaucacaugaauua

SEQ ID NO: 2090802 - RNA, 20 nt, Homo sapiens
aucagcaucucuucuucccu

SEQ ID NO: 2090803 - RNA, 10 nt, Homo sapiens
aagacauuuu

SEQ ID NO: 2090804 - RNA, 15 nt, Homo sapiens
cauucugacauccac

SEQ ID NO: 2090805 - RNA, 16 nt, Homo sapiens
gucuuaauuuucuaaa

SEQ ID NO: 2090806 - RNA, 15 nt, Homo sapiens
cucccucacucucag

SEQ ID NO: 2090807 - RNA, 17 nt, Homo sapiens
cucugaagagcugagua

SEQ ID NO: 2090808 - RNA, 19 nt, Homo sapiens
gagcacauaccaugugcca

SEQ ID NO: 2090809 - RNA, 19 nt, Homo sapiens
caccacccuugccauggag

SEQ ID NO: 2090810 - RNA, 12 nt, Homo sapiens
aaaugacugcug

SEQ ID NO: 2090811 - RNA, 18 nt, Homo sapiens
uaaguccacaucuucuca

SEQ ID NO: 2090812 - RNA, 23 nt, Homo sapiens
aaguuuucagaaccucuucccca

SEQ ID NO: 2090813 - RNA, 15 nt, Homo sapiens
gcgaacugugcaguu

SEQ ID NO: 2090814 - RNA, 23 nt, Homo sapiens
agggcucucuuuccuucuugccu

SEQ ID NO: 2090815 - RNA, 17 nt, Homo sapiens
agucaaagagcacugga

SEQ ID NO: 2090816 - RNA, 18 nt, Homo sapiens
gacuuccuuggaaaucaa

SEQ ID NO: 2090817 - RNA, 15 nt, Homo sapiens
uggguagaugugcaa

SEQ ID NO: 2090818 - RNA, 15 nt, Homo sapiens
auuuuagaaugucaa

SEQ ID NO: 2090819 - RNA, 15 nt, Homo sapiens
auugcuggucuugua

SEQ ID NO: 2090820 - RNA, 23 nt, Homo sapiens
cuuuggggcauagaucagaagac

SEQ ID NO: 2090821 - RNA, 18 nt, Homo sapiens
uaucuggucaaccuccug

SEQ ID NO: 2090822 - RNA, 20 nt, Homo sapiens
uccugccaccagcauccaca

SEQ ID NO: 2090823 - RNA, 14 nt, Homo sapiens
auccccacaaucug

SEQ ID NO: 2090824 - RNA, 21 nt, Homo sapiens
ccagccuggucucaaacuccc

SEQ ID NO: 2090825 - RNA, 19 nt, Homo sapiens
aucccccgcugguggcaga

SEQ ID NO: 2090826 - RNA, 16 nt, Homo sapiens
ggaggugggagacaag

SEQ ID NO: 2090827 - RNA, 20 nt, Homo sapiens
aaugcauuuaaacucauuug

SEQ ID NO: 2090828 - RNA, 12 nt, Homo sapiens
caaaaaccaaaa

SEQ ID NO: 2090829 - RNA, 12 nt, Homo sapiens
ccagaaccacag

SEQ ID NO: 2090830 - RNA, 19 nt, Homo sapiens
ccuuaucaagugucuucca

SEQ ID NO: 2090831 - RNA, 12 nt, Homo sapiens
aacagggaaaaa

SEQ ID NO: 2090832 - RNA, 16 nt, Homo sapiens
uuauauuuucuauuac

SEQ ID NO: 2090833 - RNA, 18 nt, Homo sapiens
auaaacacuguauuguaa

SEQ ID NO: 2090834 - RNA, 18 nt, Homo sapiens
ucuaauuaaaauugugca

SEQ ID NO: 2090835 - RNA, 21 nt, Homo sapiens
ccauaguaguaugaugauaca

SEQ ID NO: 2090836 - RNA, 17 nt, Homo sapiens
uaaucucacuucaucaa

SEQ ID NO: 2090837 - RNA, 13 nt, Homo sapiens
aaccagccacaca

SEQ ID NO: 2090838 - RNA, 13 nt, Homo sapiens
acccagccaaaca

SEQ ID NO: 2090839 - RNA, 17 nt, Homo sapiens
aguuuauaccaagagau

SEQ ID NO: 2090840 - RNA, 15 nt, Homo sapiens
caggcgugaccugcc

SEQ ID NO: 2090841 - RNA, 12 nt, Homo sapiens
ucccuuccugac

SEQ ID NO: 2090842 - RNA, 17 nt, Homo sapiens
accugcccaaggaugcu

SEQ ID NO: 2090843 - RNA, 17 nt, Homo sapiens
cuggagucuggcuuuac

SEQ ID NO: 2090844 - RNA, 18 nt, Homo sapiens
caucugaaauguuacaaa

SEQ ID NO: 2090845 - RNA, 15 nt, Homo sapiens
gcccauggaucagcu

SEQ ID NO: 2090846 - RNA, 11 nt, Homo sapiens
aaccuaauaaa

SEQ ID NO: 2090847 - RNA, 19 nt, Homo sapiens
ucccuguuggauuuacuuc

SEQ ID NO: 2090848 - RNA, 18 nt, Homo sapiens
aggcauacacacagcagu

SEQ ID NO: 2090849 - RNA, 14 nt, Homo sapiens
acaugaauccauau

SEQ ID NO: 2090850 - RNA, 18 nt, Homo sapiens
aggacaagacacugagga

SEQ ID NO: 2090851 - RNA, 18 nt, Homo sapiens
aauacuccacacauaaaa

SEQ ID NO: 2090852 - RNA, 21 nt, Homo sapiens
uuccuugccuaaggugucuga

SEQ ID NO: 2090853 - RNA, 24 nt, Homo sapiens
gaacuauauuuaagagacuuugua

SEQ ID NO: 2090854 - RNA, 13 nt, Homo sapiens
gcacaaccugcau

SEQ ID NO: 2090855 - RNA, 23 nt, Homo sapiens
cucuaaaaccuucugcugcccaa

SEQ ID NO: 2090856 - RNA, 21 nt, Homo sapiens
gaaaugacuuugaaaaccugg

SEQ ID NO: 2090857 - RNA, 15 nt, Homo sapiens
uagaacaaagggcac

SEQ ID NO: 2090858 - RNA, 17 nt, Homo sapiens
cuuccuuuuaacugcca

SEQ ID NO: 2090859 - RNA, 20 nt, Homo sapiens
ugagguaauucuagccuuuu

SEQ ID NO: 2090860 - RNA, 21 nt, Homo sapiens
gcauucaccugcccugugcau

SEQ ID NO: 2090861 - RNA, 17 nt, Homo sapiens
gagggggccaggcggug

SEQ ID NO: 2090862 - RNA, 21 nt, Homo sapiens
uuacuggaauucuucugcaac

SEQ ID NO: 2090863 - RNA, 16 nt, Homo sapiens
ugcagaggaaguacaa

SEQ ID NO: 2090864 - RNA, 16 nt, Homo sapiens
aaaacagcugcgacaa

SEQ ID NO: 2090865 - RNA, 23 nt, Homo sapiens
caauauuucccccuuacuacuuc

SEQ ID NO: 2090866 - RNA, 15 nt, Homo sapiens
uacucuuacauguau

SEQ ID NO: 2090867 - RNA, 16 nt, Homo sapiens
acagaucaaaugugaa

SEQ ID NO: 2090868 - RNA, 21 nt, Homo sapiens
ggcuaagaugagauuugccag

SEQ ID NO: 2090869 - RNA, 14 nt, Homo sapiens
agaagagacaggag

SEQ ID NO: 2090870 - RNA, 23 nt, Homo sapiens
uucaguggugugaucuuggcuca

SEQ ID NO: 2090871 - RNA, 14 nt, Homo sapiens
ccuugcugacucuc

SEQ ID NO: 2090872 - RNA, 14 nt, Homo sapiens
aaugguuucacuug

SEQ ID NO: 2090873 - RNA, 18 nt, Homo sapiens
uccccauaaucacugacc

SEQ ID NO: 2090874 - RNA, 16 nt, Homo sapiens
aauaaaaaggcaauca

SEQ ID NO: 2090875 - RNA, 20 nt, Homo sapiens
ugcauuuuucacuuugcucu

SEQ ID NO: 2090876 - RNA, 20 nt, Homo sapiens
agguaccuuuccacccagac

SEQ ID NO: 2090877 - RNA, 15 nt, Homo sapiens
aagaccaaaaugaca

SEQ ID NO: 2090878 - RNA, 14 nt, Homo sapiens
gaugguugcaauug

SEQ ID NO: 2090879 - RNA, 15 nt, Homo sapiens
aucuccucuguaaug

SEQ ID NO: 2090880 - RNA, 13 nt, Homo sapiens
uuaaaacacagcu

SEQ ID NO: 2090881 - RNA, 16 nt, Homo sapiens
uuucgggauucuuuga

SEQ ID NO: 2090882 - RNA, 16 nt, Homo sapiens
uacugucuuaucugcu

SEQ ID NO: 2090883 - RNA, 13 nt, Homo sapiens
uucuuucuuccac

SEQ ID NO: 2090884 - RNA, 13 nt, Homo sapiens
cacccaugcaagc

SEQ ID NO: 2090885 - RNA, 14 nt, Homo sapiens
ucauuaacugcuaa

SEQ ID NO: 2090886 - RNA, 17 nt, Homo sapiens
uucaacugcucugcaua

SEQ ID NO: 2090887 - RNA, 21 nt, Homo sapiens
ugaaccaucuucguacaugaa

SEQ ID NO: 2090888 - RNA, 21 nt, Homo sapiens
aaguaacugaaccauuccaac

SEQ ID NO: 2090889 - RNA, 17 nt, Homo sapiens
auguaaaaagugcagua

SEQ ID NO: 2090890 - RNA, 13 nt, Homo sapiens
uccugauguuugu

SEQ ID NO: 2090891 - RNA, 20 nt, Homo sapiens
gugugggggaggcgcacagu

SEQ ID NO: 2090892 - RNA, 16 nt, Homo sapiens
gaucaaugaccccugu

SEQ ID NO: 2090893 - RNA, 21 nt, Homo sapiens
ugccugcucuucagacuuaaa

SEQ ID NO: 2090894 - RNA, 19 nt, Homo sapiens
gucuguaaaaaauggagcu

SEQ ID NO: 2090895 - RNA, 13 nt, Homo sapiens
aaaaugugcaaua

SEQ ID NO: 2090896 - RNA, 22 nt, Homo sapiens
caucccauacuagacucauacu

SEQ ID NO: 2090897 - RNA, 17 nt, Homo sapiens
gagaagaauagaggucc

SEQ ID NO: 2090898 - RNA, 15 nt, Homo sapiens
ggcaggcacuguggc

SEQ ID NO: 2090899 - RNA, 20 nt, Homo sapiens
uaacacacacacacauacac

SEQ ID NO: 2090900 - RNA, 13 nt, Homo sapiens
ucccaucagguca

SEQ ID NO: 2090901 - RNA, 16 nt, Homo sapiens
uuauucugauuccacu

SEQ ID NO: 2090902 - RNA, 14 nt, Homo sapiens
aggaucacugggcu

SEQ ID NO: 2090903 - RNA, 16 nt, Homo sapiens
agguggcucaugccug

SEQ ID NO: 2090904 - RNA, 22 nt, Homo sapiens
aguacugcacccagcaguguca

SEQ ID NO: 2090905 - RNA, 14 nt, Homo sapiens
aguauuuucccaau

SEQ ID NO: 2090906 - RNA, 19 nt, Homo sapiens
ccacugggaccaacccugg

SEQ ID NO: 2090907 - RNA, 19 nt, Homo sapiens
gcugaacccucagccuuga

SEQ ID NO: 2090908 - RNA, 18 nt, Homo sapiens
cugaaguagccugaucuu

SEQ ID NO: 2090909 - RNA, 11 nt, Homo sapiens
gcaaccacugc

SEQ ID NO: 2090910 - RNA, 17 nt, Homo sapiens
aaggcugagagcucucu

SEQ ID NO: 2090911 - RNA, 19 nt, Homo sapiens
cuauuccuugguucuguca

SEQ ID NO: 2090912 - RNA, 12 nt, Homo sapiens
caagaaggugag

SEQ ID NO: 2090913 - RNA, 22 nt, Homo sapiens
cccguaggcagccucucugcua

SEQ ID NO: 2090914 - RNA, 14 nt, Homo sapiens
auuugcucauggaa

SEQ ID NO: 2090915 - RNA, 20 nt, Homo sapiens
acuuucagguacuaaauacc

SEQ ID NO: 2090916 - RNA, 13 nt, Homo sapiens
augucugugcugu

SEQ ID NO: 2090917 - RNA, 18 nt, Homo sapiens
cuauauuuauugauuuca

SEQ ID NO: 2090918 - RNA, 16 nt, Homo sapiens
aauauguaaaauuaca

SEQ ID NO: 2090919 - RNA, 16 nt, Homo sapiens
auuuuaauaacauauc

SEQ ID NO: 2090920 - RNA, 19 nt, Homo sapiens
uguaagccuaguugcugaa

SEQ ID NO: 2090921 - RNA, 13 nt, Homo sapiens
ucaggcagcucaa

SEQ ID NO: 2090922 - RNA, 14 nt, Homo sapiens
agcuauaacauauu

SEQ ID NO: 2090923 - RNA, 21 nt, Homo sapiens
guucccacucagcagugagag

SEQ ID NO: 2090924 - RNA, 17 nt, Homo sapiens
gccaagcauaaugacag

SEQ ID NO: 2090925 - RNA, 12 nt, Homo sapiens
guacucaaugga

SEQ ID NO: 2090926 - RNA, 18 nt, Homo sapiens
gcgagggccugcguucaa

SEQ ID NO: 2090927 - RNA, 18 nt, Homo sapiens
acacgauugagaacugac

SEQ ID NO: 2090928 - RNA, 18 nt, Homo sapiens
cagcagugguauuaauac

SEQ ID NO: 2090929 - RNA, 13 nt, Homo sapiens
auauacuuauaga

SEQ ID NO: 2090930 - RNA, 13 nt, Homo sapiens
cuuaauugccacc

SEQ ID NO: 2090931 - RNA, 20 nt, Homo sapiens
ucccugugugugugugugcu

SEQ ID NO: 2090932 - RNA, 20 nt, Homo sapiens
aaugcucuuuacuucaugga

SEQ ID NO: 2090933 - RNA, 21 nt, Homo sapiens
ucgacccuggggcgugcagca

SEQ ID NO: 2090934 - RNA, 23 nt, Homo sapiens
acuucugaacuuggaaaggggaa

SEQ ID NO: 2090935 - RNA, 12 nt, Homo sapiens
ugucaguugcca

SEQ ID NO: 2090936 - RNA, 20 nt, Homo sapiens
uacaccagagccucagugag

SEQ ID NO: 2090937 - RNA, 14 nt, Homo sapiens
caagaaggggacag

SEQ ID NO: 2090938 - RNA, 20 nt, Homo sapiens
cucacucuugccaaccugua

SEQ ID NO: 2090939 - RNA, 13 nt, Homo sapiens
aagucacucccaa

SEQ ID NO: 2090940 - RNA, 19 nt, Homo sapiens
aaguuuaugcauacaguaa

SEQ ID NO: 2090941 - RNA, 17 nt, Homo sapiens
aaucuuucagcacucag

SEQ ID NO: 2090942 - RNA, 17 nt, Homo sapiens
accacauauacagcagg

SEQ ID NO: 2090943 - RNA, 21 nt, Homo sapiens
ccauaauugcuuugccaaaau

SEQ ID NO: 2090944 - RNA, 19 nt, Homo sapiens
ucaacagaauuaaaauguc

SEQ ID NO: 2090945 - RNA, 13 nt, Homo sapiens
uaacuacuuucug

SEQ ID NO: 2090946 - RNA, 14 nt, Homo sapiens
cuguguacugccuu

SEQ ID NO: 2090947 - RNA, 18 nt, Homo sapiens
gucuuauaugcuuagcau

SEQ ID NO: 2090948 - RNA, 20 nt, Homo sapiens
uuuguauucucagacacuga

SEQ ID NO: 2090949 - RNA, 18 nt, Homo sapiens
gauuucugugaagcaaaa

SEQ ID NO: 2090950 - RNA, 14 nt, Homo sapiens
gcuuggggaccuga

SEQ ID NO: 2090951 - RNA, 13 nt, Homo sapiens
uagaagucagcca

SEQ ID NO: 2090952 - RNA, 15 nt, Homo sapiens
cugaggcaagccaug

SEQ ID NO: 2090953 - RNA, 16 nt, Homo sapiens
ugccaaccaguuugaa

SEQ ID NO: 2090954 - RNA, 20 nt, Homo sapiens
cugccuggcccccaaccuca

SEQ ID NO: 2090955 - RNA, 20 nt, Homo sapiens
ccucaaacucuggggcucaa

SEQ ID NO: 2090956 - RNA, 19 nt, Homo sapiens
agauuauauugagacaaaa

SEQ ID NO: 2090957 - RNA, 16 nt, Homo sapiens
uucuauuuucucugau

SEQ ID NO: 2090958 - RNA, 19 nt, Homo sapiens
uaagaaaggcaaccaauaa

SEQ ID NO: 2090959 - RNA, 19 nt, Homo sapiens
accugacacaaucccuaca

SEQ ID NO: 2090960 - RNA, 18 nt, Homo sapiens
uauggugcucagcccuga

SEQ ID NO: 2090961 - RNA, 17 nt, Homo sapiens
auuaugugacuugcaau

SEQ ID NO: 2090962 - RNA, 16 nt, Homo sapiens
cauguuuccucucaau

SEQ ID NO: 2090963 - RNA, 19 nt, Homo sapiens
uccaaaaagacaagugcuc

SEQ ID NO: 2090964 - RNA, 20 nt, Homo sapiens
uagucaacauauacuauuua

SEQ ID NO: 2090965 - RNA, 15 nt, Homo sapiens
aaaccauuauuucag

SEQ ID NO: 2090966 - RNA, 16 nt, Homo sapiens
auuucacuauguuaca

SEQ ID NO: 2090967 - RNA, 16 nt, Homo sapiens
gccaagaucacagugg

SEQ ID NO: 2090968 - RNA, 21 nt, Homo sapiens
cacggcaaaaugucauuguuc

SEQ ID NO: 2090969 - RNA, 22 nt, Homo sapiens
ugggaauagggagacaggguag

SEQ ID NO: 2090970 - RNA, 13 nt, Homo sapiens
caagacaugauua

SEQ ID NO: 2090971 - RNA, 22 nt, Homo sapiens
uagaacaaaggacagaguauga

SEQ ID NO: 2090972 - RNA, 19 nt, Homo sapiens
agucuaccccugcuaagga

SEQ ID NO: 2090973 - RNA, 14 nt, Homo sapiens
aaagaguaucaaag

SEQ ID NO: 2090974 - RNA, 21 nt, Homo sapiens
uccccugaggucaugcauugu

SEQ ID NO: 2090975 - RNA, 23 nt, Homo sapiens
aagcuggggccccugcaaccucg

SEQ ID NO: 2090976 - RNA, 17 nt, Homo sapiens
uaagcacuagaucuccc

SEQ ID NO: 2090977 - RNA, 16 nt, Homo sapiens
aaguccuuugugaaua

SEQ ID NO: 2090978 - RNA, 15 nt, Homo sapiens
uaaauccaacucuga

SEQ ID NO: 2090979 - RNA, 18 nt, Homo sapiens
aguuauacccaaccccag

SEQ ID NO: 2090980 - RNA, 19 nt, Homo sapiens
ugagauagcauugugaacu

SEQ ID NO: 2090981 - RNA, 18 nt, Homo sapiens
gaaaaauguaacuuagag

SEQ ID NO: 2090982 - RNA, 20 nt, Homo sapiens
aacaaucuaagggucucuca

SEQ ID NO: 2090983 - RNA, 23 nt, Homo sapiens
acuuaagguuaccuuuguuccca

SEQ ID NO: 2090984 - RNA, 16 nt, Homo sapiens
aagcaagggaccuuca

SEQ ID NO: 2090985 - RNA, 15 nt, Homo sapiens
ugcccccaacacucc

SEQ ID NO: 2090986 - RNA, 17 nt, Homo sapiens
aauacuacuacuguuau

SEQ ID NO: 2090987 - RNA, 19 nt, Homo sapiens
uaucagcaucuguccucau

SEQ ID NO: 2090988 - RNA, 23 nt, Homo sapiens
ucuuccagaagugugauugggaa

SEQ ID NO: 2090989 - RNA, 16 nt, Homo sapiens
cuccgcaacagccaag

SEQ ID NO: 2090990 - RNA, 23 nt, Homo sapiens
ccgucagccaaauguaauugaau

SEQ ID NO: 2090991 - RNA, 16 nt, Homo sapiens
ugaugucugaggauac

SEQ ID NO: 2090992 - RNA, 20 nt, Homo sapiens
ccugaugugacgcacuguau

SEQ ID NO: 2090993 - RNA, 22 nt, Homo sapiens
ccuuugcagcucagaaccacag

SEQ ID NO: 2090994 - RNA, 16 nt, Homo sapiens
gauaagagaauaccuu

SEQ ID NO: 2090995 - RNA, 15 nt, Homo sapiens
aauccaugugcugcu

SEQ ID NO: 2090996 - RNA, 20 nt, Homo sapiens
uguuuaugacacaaugacac

SEQ ID NO: 2090997 - RNA, 18 nt, Homo sapiens
cccgcaguugugccaaag

SEQ ID NO: 2090998 - RNA, 12 nt, Homo sapiens
uguuaguuaaga

SEQ ID NO: 2090999 - RNA, 17 nt, Homo sapiens
caggagcugccauguca

SEQ ID NO: 2091000 - RNA, 14 nt, Homo sapiens
uuguuaauguuugc

SEQ ID NO: 2091001 - RNA, 15 nt, Homo sapiens
agugggucuucccuc

SEQ ID NO: 2091002 - RNA, 14 nt, Homo sapiens
aaagacuugcacaa

SEQ ID NO: 2091003 - RNA, 20 nt, Homo sapiens
cagcuaccacgggucugcca

SEQ ID NO: 2091004 - RNA, 15 nt, Homo sapiens
caucagaugacaaga

SEQ ID NO: 2091005 - RNA, 15 nt, Homo sapiens
accaugcaaugccuc

SEQ ID NO: 2091006 - RNA, 12 nt, Homo sapiens
aaaauugcacaa

SEQ ID NO: 2091007 - RNA, 18 nt, Homo sapiens
ucauuuuuuucacuggag

SEQ ID NO: 2091008 - RNA, 22 nt, Homo sapiens
agccuguaaacuuuaucacuua

SEQ ID NO: 2091009 - RNA, 21 nt, Homo sapiens
cuuugacugaagccgugccug

SEQ ID NO: 2091010 - RNA, 21 nt, Homo sapiens
gugcacauuucauaguuucaa

SEQ ID NO: 2091011 - RNA, 21 nt, Homo sapiens
auuauuacaguccuucaagau

SEQ ID NO: 2091012 - RNA, 14 nt, Homo sapiens
gacagggcuucucc

SEQ ID NO: 2091013 - RNA, 19 nt, Homo sapiens
cugaaagacuucacuaaaa

SEQ ID NO: 2091014 - RNA, 17 nt, Homo sapiens
gacaacauuucauauca

SEQ ID NO: 2091015 - RNA, 14 nt, Homo sapiens
uaauuagggugaaa

SEQ ID NO: 2091016 - RNA, 16 nt, Homo sapiens
cuggcagaaagcaaau

SEQ ID NO: 2091017 - RNA, 21 nt, Homo sapiens
cagaacaguaucuuugcacuc

SEQ ID NO: 2091018 - RNA, 15 nt, Homo sapiens
augaaagugaugaca

SEQ ID NO: 2091019 - RNA, 14 nt, Homo sapiens
aagccuuuugcaaa

SEQ ID NO: 2091020 - RNA, 15 nt, Homo sapiens
cagcccccacuccag

SEQ ID NO: 2091021 - RNA, 16 nt, Homo sapiens
auggaggaacccaaga

SEQ ID NO: 2091022 - RNA, 18 nt, Homo sapiens
aaggucuaucuuaagaag

SEQ ID NO: 2091023 - RNA, 21 nt, Homo sapiens
gaacuguuagguucugaugac

SEQ ID NO: 2091024 - RNA, 15 nt, Homo sapiens
ggguaccuggcuaug

SEQ ID NO: 2091025 - RNA, 20 nt, Homo sapiens
auaugaaauaaaauuacaca

SEQ ID NO: 2091026 - RNA, 14 nt, Homo sapiens
uguugauggugcua

SEQ ID NO: 2091027 - RNA, 21 nt, Homo sapiens
gaacacuaaugaggaaacugc

SEQ ID NO: 2091028 - RNA, 21 nt, Homo sapiens
ugacgcucaguaaccaugcaa

SEQ ID NO: 2091029 - RNA, 23 nt, Homo sapiens
accaucuccccaggcuaugccau

SEQ ID NO: 2091030 - RNA, 15 nt, Homo sapiens
cccugccccagucag

SEQ ID NO: 2091031 - RNA, 17 nt, Homo sapiens
cccaggaauaguggaca

SEQ ID NO: 2091032 - RNA, 15 nt, Homo sapiens
cugcucuuaggugcu

SEQ ID NO: 2091033 - RNA, 19 nt, Homo sapiens
acccuguagguucuugaua

SEQ ID NO: 2091034 - RNA, 23 nt, Homo sapiens
aaacauugccuuugaauguuaau

SEQ ID NO: 2091035 - RNA, 14 nt, Homo sapiens
ucccaacccagaca

SEQ ID NO: 2091036 - RNA, 17 nt, Homo sapiens
uuucauguuaugcauuu

SEQ ID NO: 2091037 - RNA, 15 nt, Homo sapiens
auugguguacugugu

SEQ ID NO: 2091038 - RNA, 14 nt, Homo sapiens
aauauaaaacagga

SEQ ID NO: 2091039 - RNA, 13 nt, Homo sapiens
aaugcacugugac

SEQ ID NO: 2091040 - RNA, 23 nt, Homo sapiens
auuggagucacugccaagucaua

SEQ ID NO: 2091041 - RNA, 17 nt, Homo sapiens
gucccuuucccuaccuu

SEQ ID NO: 2091042 - RNA, 23 nt, Homo sapiens
ucaacucacugcaaccuccgccu

SEQ ID NO: 2091043 - RNA, 17 nt, Homo sapiens
uuuaaguccucuaaaca

SEQ ID NO: 2091044 - RNA, 13 nt, Homo sapiens
auuguuuuuggau

SEQ ID NO: 2091045 - RNA, 12 nt, Homo sapiens
cagacaaaaaga

SEQ ID NO: 2091046 - RNA, 21 nt, Homo sapiens
uguuucuugggaaaauaucac

SEQ ID NO: 2091047 - RNA, 22 nt, Homo sapiens
ucaagcaaaaugcuuacagggc

SEQ ID NO: 2091048 - RNA, 21 nt, Homo sapiens
gugagucugguggaggagcug

SEQ ID NO: 2091049 - RNA, 22 nt, Homo sapiens
gaccagcauaccaguucuugca

SEQ ID NO: 2091050 - RNA, 22 nt, Homo sapiens
cacuaagccaugaaaccagaga

SEQ ID NO: 2091051 - RNA, 19 nt, Homo sapiens
cuagagccugugcuaaaga

SEQ ID NO: 2091052 - RNA, 19 nt, Homo sapiens
cacagcugauugggcaccu

SEQ ID NO: 2091053 - RNA, 18 nt, Homo sapiens
aagaaacccucugucauu

SEQ ID NO: 2091054 - RNA, 22 nt, Homo sapiens
auuuaguugcaguccagcucuu

SEQ ID NO: 2091055 - RNA, 20 nt, Homo sapiens
cccccucuugagagggguga

SEQ ID NO: 2091056 - RNA, 20 nt, Homo sapiens
uaagcccggauagacuuauu

SEQ ID NO: 2091057 - RNA, 20 nt, Homo sapiens
cuuacguccuuccacuucca

SEQ ID NO: 2091058 - RNA, 15 nt, Homo sapiens
cauuccaauuugcac

SEQ ID NO: 2091059 - RNA, 22 nt, Homo sapiens
auuaaugaucagcuauauacua

SEQ ID NO: 2091060 - RNA, 23 nt, Homo sapiens
ugcaauauguuuaucaacucaag

SEQ ID NO: 2091061 - RNA, 18 nt, Homo sapiens
ucucugcucagugaucuc

SEQ ID NO: 2091062 - RNA, 22 nt, Homo sapiens
ugagacagauugggagguguau

SEQ ID NO: 2091063 - RNA, 15 nt, Homo sapiens
acacugucuucugau

SEQ ID NO: 2091064 - RNA, 11 nt, Homo sapiens
aagaauucugu

SEQ ID NO: 2091065 - RNA, 18 nt, Homo sapiens
aaaccuuuuuucuugcua

SEQ ID NO: 2091066 - RNA, 21 nt, Homo sapiens
uccucaaagggugccuucuag

SEQ ID NO: 2091067 - RNA, 16 nt, Homo sapiens
augauccuugcugaua

SEQ ID NO: 2091068 - RNA, 14 nt, Homo sapiens
aggugccaucaucu

SEQ ID NO: 2091069 - RNA, 23 nt, Homo sapiens
ugaacauacaaaugcaucuuuga

SEQ ID NO: 2091070 - RNA, 18 nt, Homo sapiens
ucauucuguuagauacua

SEQ ID NO: 2091071 - RNA, 23 nt, Homo sapiens
cugcuuucuccuguagcacaaag

SEQ ID NO: 2091072 - RNA, 17 nt, Homo sapiens
gcuucucuucugaccca

SEQ ID NO: 2091073 - RNA, 12 nt, Homo sapiens
uuguauccuuuu

SEQ ID NO: 2091074 - RNA, 20 nt, Homo sapiens
ggcagauugaacaagagcuu

SEQ ID NO: 2091075 - RNA, 20 nt, Homo sapiens
aagaucauaacaaugucuca

SEQ ID NO: 2091076 - RNA, 17 nt, Homo sapiens
ucauuguagaaacacag

SEQ ID NO: 2091077 - RNA, 17 nt, Homo sapiens
aagaauaaauucuaccu

SEQ ID NO: 2091078 - RNA, 19 nt, Homo sapiens
accaagagugggcuuugug

SEQ ID NO: 2091079 - RNA, 21 nt, Homo sapiens
cuuagauagaagaugggaaaa

SEQ ID NO: 2091080 - RNA, 12 nt, Homo sapiens
uuguccucaggu

SEQ ID NO: 2091081 - RNA, 22 nt, Homo sapiens
gacugagauaagaaaagccuga

SEQ ID NO: 2091082 - RNA, 21 nt, Homo sapiens
gucaaaacacuguggaacuaa

SEQ ID NO: 2091083 - RNA, 16 nt, Homo sapiens
gcuaucuguagaauua

SEQ ID NO: 2091084 - RNA, 15 nt, Homo sapiens
cggccaacacuuugu

SEQ ID NO: 2091085 - RNA, 13 nt, Homo sapiens
agcauccaugugu

SEQ ID NO: 2091086 - RNA, 15 nt, Homo sapiens
cucuaaaacuaucag

SEQ ID NO: 2091087 - RNA, 18 nt, Homo sapiens
aacuccaggaaaacuguu

SEQ ID NO: 2091088 - RNA, 14 nt, Homo sapiens
cuccgucugacccu

SEQ ID NO: 2091089 - RNA, 16 nt, Homo sapiens
aauauucuguaacuau

SEQ ID NO: 2091090 - RNA, 12 nt, Homo sapiens
cuugacauuuau

SEQ ID NO: 2091091 - RNA, 15 nt, Homo sapiens
aaauccuucuaaucu

SEQ ID NO: 2091092 - RNA, 22 nt, Homo sapiens
uccucaaauuuuuugacuuuuu

SEQ ID NO: 2091093 - RNA, 17 nt, Homo sapiens
aaccagcagaagccaga

SEQ ID NO: 2091094 - RNA, 21 nt, Homo sapiens
gcuucagggagcucgcauucu

SEQ ID NO: 2091095 - RNA, 22 nt, Homo sapiens
caaauccaggacuuuguuaacu

SEQ ID NO: 2091096 - RNA, 15 nt, Homo sapiens
uuuugaaaacacuua

SEQ ID NO: 2091097 - RNA, 17 nt, Homo sapiens
aaaaguguuuucacaac

SEQ ID NO: 2091098 - RNA, 18 nt, Homo sapiens
acaauguuaaaugcaauu

SEQ ID NO: 2091099 - RNA, 16 nt, Homo sapiens
cccucagucuucucau

SEQ ID NO: 2091100 - RNA, 16 nt, Homo sapiens
cucugggcagcuguca

SEQ ID NO: 2091101 - RNA, 16 nt, Homo sapiens
uacuggcuguggacca

SEQ ID NO: 2091102 - RNA, 15 nt, Homo sapiens
cacgaccuacauuaa

SEQ ID NO: 2091103 - RNA, 12 nt, Homo sapiens
aacagugccaaa

SEQ ID NO: 2091104 - RNA, 14 nt, Homo sapiens
aacuccuacaugau

SEQ ID NO: 2091105 - RNA, 23 nt, Homo sapiens
ggaguaauaguaaacacagggaa

SEQ ID NO: 2091106 - RNA, 20 nt, Homo sapiens
uagagugugguuaugaacuu

SEQ ID NO: 2091107 - RNA, 23 nt, Homo sapiens
auuuccugcuacacaaaagccaa

SEQ ID NO: 2091108 - RNA, 16 nt, Homo sapiens
ugaauaccacuuaccu

SEQ ID NO: 2091109 - RNA, 16 nt, Homo sapiens
gcuugcagccaggaga

SEQ ID NO: 2091110 - RNA, 21 nt, Homo sapiens
acucacgaauauuaugcccag

SEQ ID NO: 2091111 - RNA, 21 nt, Homo sapiens
gucaucccagugcacauggca

SEQ ID NO: 2091112 - RNA, 23 nt, Homo sapiens
cucaaucucccgugggcaucuca

SEQ ID NO: 2091113 - RNA, 14 nt, Homo sapiens
aaugacaagcacua

SEQ ID NO: 2091114 - RNA, 13 nt, Homo sapiens
aagguagagaugu

SEQ ID NO: 2091115 - RNA, 13 nt, Homo sapiens
uguugcuuugaaa

SEQ ID NO: 2091116 - RNA, 23 nt, Homo sapiens
ccacauuguagccuaauauucau

SEQ ID NO: 2091117 - RNA, 13 nt, Homo sapiens
uaacggcacugug

SEQ ID NO: 2091118 - RNA, 21 nt, Homo sapiens
aaagacaaauucggauguaug

SEQ ID NO: 2091119 - RNA, 14 nt, Homo sapiens
cugcauaguuccca

SEQ ID NO: 2091120 - RNA, 15 nt, Homo sapiens
guuuucuaauaucuu

SEQ ID NO: 2091121 - RNA, 18 nt, Homo sapiens
cagacacacccacagaag

SEQ ID NO: 2091122 - RNA, 16 nt, Homo sapiens
aguauaagucugggca

SEQ ID NO: 2091123 - RNA, 15 nt, Homo sapiens
agccugaguccaguu

SEQ ID NO: 2091124 - RNA, 22 nt, Homo sapiens
ggaaaacuguguugccacagua

SEQ ID NO: 2091125 - RNA, 13 nt, Homo sapiens
uaugaauaucauu

SEQ ID NO: 2091126 - RNA, 17 nt, Homo sapiens
aggaaugugaagccaga

SEQ ID NO: 2091127 - RNA, 14 nt, Homo sapiens
cuucaguuaugauu

SEQ ID NO: 2091128 - RNA, 15 nt, Homo sapiens
guggccaguugacau

SEQ ID NO: 2091129 - RNA, 19 nt, Homo sapiens
auacuacagcaauacuaca

SEQ ID NO: 2091130 - RNA, 13 nt, Homo sapiens
caucucugucaca

SEQ ID NO: 2091131 - RNA, 17 nt, Homo sapiens
auuccauuuauggaacu

SEQ ID NO: 2091132 - RNA, 16 nt, Homo sapiens
acaaugaaaugcucuc

SEQ ID NO: 2091133 - RNA, 17 nt, Homo sapiens
ugauuuuuucuuaccuu

SEQ ID NO: 2091134 - RNA, 22 nt, Homo sapiens
uguaagugaaguaaaacuuaag

SEQ ID NO: 2091135 - RNA, 12 nt, Homo sapiens
agagaucuauaa

SEQ ID NO: 2091136 - RNA, 15 nt, Homo sapiens
uaagugguuugauca

SEQ ID NO: 2091137 - RNA, 18 nt, Homo sapiens
gcuggucucaaacuccug

SEQ ID NO: 2091138 - RNA, 12 nt, Homo sapiens
ucugcaauauua

SEQ ID NO: 2091139 - RNA, 16 nt, Homo sapiens
cugacugacacaggcc

SEQ ID NO: 2091140 - RNA, 21 nt, Homo sapiens
gcuuguuuucuacuuugccac

SEQ ID NO: 2091141 - RNA, 15 nt, Homo sapiens
uguauaccagccuac

SEQ ID NO: 2091142 - RNA, 22 nt, Homo sapiens
cacuuggccucagcuggcugua

SEQ ID NO: 2091143 - RNA, 19 nt, Homo sapiens
aaacugauuacguuuacau

SEQ ID NO: 2091144 - RNA, 21 nt, Homo sapiens
uuugaagcgagcagucagcau

SEQ ID NO: 2091145 - RNA, 19 nt, Homo sapiens
agagauauuuugauucuca

SEQ ID NO: 2091146 - RNA, 20 nt, Homo sapiens
cagguaaacacauaaaugaa

SEQ ID NO: 2091147 - RNA, 14 nt, Homo sapiens
gcucacaguuauua

SEQ ID NO: 2091148 - RNA, 14 nt, Homo sapiens
gcacacugcacugu

SEQ ID NO: 2091149 - RNA, 20 nt, Homo sapiens
cugggaccucccacugcccc

SEQ ID NO: 2091150 - RNA, 17 nt, Homo sapiens
gauacuuuagccaucau

SEQ ID NO: 2091151 - RNA, 14 nt, Homo sapiens
acaagcuaagaguu

SEQ ID NO: 2091152 - RNA, 12 nt, Homo sapiens
uggggugccuga

SEQ ID NO: 2091153 - RNA, 15 nt, Homo sapiens
uuuugccaguauuau

SEQ ID NO: 2091154 - RNA, 16 nt, Homo sapiens
aggauuugaauuuguc

SEQ ID NO: 2091155 - RNA, 20 nt, Homo sapiens
augauggaaauuagccacau

SEQ ID NO: 2091156 - RNA, 14 nt, Homo sapiens
gaaaauuacaguau

SEQ ID NO: 2091157 - RNA, 21 nt, Homo sapiens
gacgagauccuguuucagcua

SEQ ID NO: 2091158 - RNA, 17 nt, Homo sapiens
cacaucacuacaguaca

SEQ ID NO: 2091159 - RNA, 23 nt, Homo sapiens
uuuccacauaaggaaacuggguu

SEQ ID NO: 2091160 - RNA, 21 nt, Homo sapiens
cugagacggcagagaccccag

SEQ ID NO: 2091161 - RNA, 23 nt, Homo sapiens
ccugaaucaaaugguuagcuuaa

SEQ ID NO: 2091162 - RNA, 15 nt, Homo sapiens
aaggaaggagccagc

SEQ ID NO: 2091163 - RNA, 13 nt, Homo sapiens
aguaaaaauccaa

SEQ ID NO: 2091164 - RNA, 22 nt, Homo sapiens
aacucacaagugcucaucuguu

SEQ ID NO: 2091165 - RNA, 16 nt, Homo sapiens
auaaacugcagaaagg

SEQ ID NO: 2091166 - RNA, 15 nt, Homo sapiens
ugagugagccacaga

SEQ ID NO: 2091167 - RNA, 15 nt, Homo sapiens
ugaagaaaagcacuu

SEQ ID NO: 2091168 - RNA, 21 nt, Homo sapiens
cacacacgcuuucuuaugcaa

SEQ ID NO: 2091169 - RNA, 11 nt, Homo sapiens
uuaaucaccaa

SEQ ID NO: 2091170 - RNA, 15 nt, Homo sapiens
gcuguuugacaccuc

SEQ ID NO: 2091171 - RNA, 22 nt, Homo sapiens
aagugcuggcccacccagucca

SEQ ID NO: 2091172 - RNA, 17 nt, Homo sapiens
acauggcaacaaaggau

SEQ ID NO: 2091173 - RNA, 17 nt, Homo sapiens
uugugauguuugcucag

SEQ ID NO: 2091174 - RNA, 14 nt, Homo sapiens
gcucaacauugugu

SEQ ID NO: 2091175 - RNA, 16 nt, Homo sapiens
acacgaccggggccag

SEQ ID NO: 2091176 - RNA, 22 nt, Homo sapiens
uggagguggaaaagcaacauuc

SEQ ID NO: 2091177 - RNA, 14 nt, Homo sapiens
caaauaaugaccau

SEQ ID NO: 2091178 - RNA, 16 nt, Homo sapiens
ugcuauugaaaggcaa

SEQ ID NO: 2091179 - RNA, 18 nt, Homo sapiens
gucuccaagggcaucacu

SEQ ID NO: 2091180 - RNA, 21 nt, Homo sapiens
gcccuuuuccuugacuauuac

SEQ ID NO: 2091181 - RNA, 23 nt, Homo sapiens
cauuacaauccugcauuguuuca

SEQ ID NO: 2091182 - RNA, 20 nt, Homo sapiens
cuaacguuuucuacuuugaa

SEQ ID NO: 2091183 - RNA, 20 nt, Homo sapiens
guucuuucagaaagcuuuga

SEQ ID NO: 2091184 - RNA, 19 nt, Homo sapiens
acaacacccaagaugaauu

SEQ ID NO: 2091185 - RNA, 19 nt, Homo sapiens
gaccaccucucaauauuca

SEQ ID NO: 2091186 - RNA, 20 nt, Homo sapiens
ggcaaaacuuuggcacuggg

SEQ ID NO: 2091187 - RNA, 14 nt, Homo sapiens
acuacuguguuaug

SEQ ID NO: 2091188 - RNA, 21 nt, Homo sapiens
ugaagauggauguuugucaaa

SEQ ID NO: 2091189 - RNA, 20 nt, Homo sapiens
agcuccuaccucugugccag

SEQ ID NO: 2091190 - RNA, 19 nt, Homo sapiens
aagauagcaucccaucuca

SEQ ID NO: 2091191 - RNA, 22 nt, Homo sapiens
uuaaaagucuauuuuauuauga

SEQ ID NO: 2091192 - RNA, 20 nt, Homo sapiens
aaauuccauagcucaauaaa

SEQ ID NO: 2091193 - RNA, 15 nt, Homo sapiens
gagggagggucagug

SEQ ID NO: 2091194 - RNA, 16 nt, Homo sapiens
gaggccuauuguugaa

SEQ ID NO: 2091195 - RNA, 13 nt, Homo sapiens
aauggaaccaaau

SEQ ID NO: 2091196 - RNA, 13 nt, Homo sapiens
ccuguaacacaag

SEQ ID NO: 2091197 - RNA, 17 nt, Homo sapiens
cugaccaacauggugaa

SEQ ID NO: 2091198 - RNA, 22 nt, Homo sapiens
auuacugaaauuuaagaaaaag

SEQ ID NO: 2091199 - RNA, 21 nt, Homo sapiens
uucugaaauaaacuucacuga

SEQ ID NO: 2091200 - RNA, 21 nt, Homo sapiens
ucacagugaacauaacuguaa

SEQ ID NO: 2091201 - RNA, 18 nt, Homo sapiens
auaaguaucacacuguau

SEQ ID NO: 2091202 - RNA, 15 nt, Homo sapiens
uguucagaugugcau

SEQ ID NO: 2091203 - RNA, 18 nt, Homo sapiens
augcuggauucagauaua

SEQ ID NO: 2091204 - RNA, 23 nt, Homo sapiens
cuuguuuguuuuauucaccauca

SEQ ID NO: 2091205 - RNA, 15 nt, Homo sapiens
uuucauuuccauuua

SEQ ID NO: 2091206 - RNA, 13 nt, Homo sapiens
ugauaaacauuaa

SEQ ID NO: 2091207 - RNA, 23 nt, Homo sapiens
gaacucuccccuugucugcacug

SEQ ID NO: 2091208 - RNA, 15 nt, Homo sapiens
aagcacaaguacuuu

SEQ ID NO: 2091209 - RNA, 13 nt, Homo sapiens
cucuuuuguggac

SEQ ID NO: 2091210 - RNA, 17 nt, Homo sapiens
aauucuuaaaucugccu

SEQ ID NO: 2091211 - RNA, 19 nt, Homo sapiens
ugcaggagccgcugcugag

SEQ ID NO: 2091212 - RNA, 15 nt, Homo sapiens
aggcugacuuuugca

SEQ ID NO: 2091213 - RNA, 17 nt, Homo sapiens
acacauugacaaugaca

SEQ ID NO: 2091214 - RNA, 21 nt, Homo sapiens
cuagucuugaccucuccagca

SEQ ID NO: 2091215 - RNA, 23 nt, Homo sapiens
uucuggucuucacugccaugccu

SEQ ID NO: 2091216 - RNA, 15 nt, Homo sapiens
aagugaaaccagcuu

SEQ ID NO: 2091217 - RNA, 15 nt, Homo sapiens
uccugagaaguaccu

SEQ ID NO: 2091218 - RNA, 17 nt, Homo sapiens
acuguucuugacaauca

SEQ ID NO: 2091219 - RNA, 13 nt, Homo sapiens
uguaaaagcacau

SEQ ID NO: 2091220 - RNA, 18 nt, Homo sapiens
uaacagacauagacugca

SEQ ID NO: 2091221 - RNA, 11 nt, Homo sapiens
gacggugccaa

SEQ ID NO: 2091222 - RNA, 18 nt, Homo sapiens
gaaggcgacugagccaug

SEQ ID NO: 2091223 - RNA, 15 nt, Homo sapiens
guagauaggccaugg

SEQ ID NO: 2091224 - RNA, 17 nt, Homo sapiens
ucugaaccauuacugua

SEQ ID NO: 2091225 - RNA, 18 nt, Homo sapiens
uuaguaucacaaaaccac

SEQ ID NO: 2091226 - RNA, 17 nt, Homo sapiens
ucaaucuccuaaccuug

SEQ ID NO: 2091227 - RNA, 12 nt, Homo sapiens
uugcacacucac

SEQ ID NO: 2091228 - RNA, 18 nt, Homo sapiens
cuguaacucagacauucc

SEQ ID NO: 2091229 - RNA, 14 nt, Homo sapiens
uggcaagaaagcuu

SEQ ID NO: 2091230 - RNA, 19 nt, Homo sapiens
ccugagcagaauacugguc

SEQ ID NO: 2091231 - RNA, 23 nt, Homo sapiens
gcuaccugcucagcccugcacca

SEQ ID NO: 2091232 - RNA, 16 nt, Homo sapiens
gagcuagaacauucca

SEQ ID NO: 2091233 - RNA, 17 nt, Homo sapiens
cauaacuugcugaauuu

SEQ ID NO: 2091234 - RNA, 18 nt, Homo sapiens
ccaagaagccagcaccac

SEQ ID NO: 2091235 - RNA, 14 nt, Homo sapiens
ucccugcacuucau

SEQ ID NO: 2091236 - RNA, 14 nt, Homo sapiens
cuccugcaucucau

SEQ ID NO: 2091237 - RNA, 23 nt, Homo sapiens
cugauuuuuuuuuuaacuugaaa

SEQ ID NO: 2091238 - RNA, 18 nt, Homo sapiens
agggcugcacauugccug

SEQ ID NO: 2091239 - RNA, 17 nt, Homo sapiens
aaggaaaaaauccucac

SEQ ID NO: 2091240 - RNA, 19 nt, Homo sapiens
aagcaugucucugcuucca

SEQ ID NO: 2091241 - RNA, 19 nt, Homo sapiens
agugggccugguagcacau

SEQ ID NO: 2091242 - RNA, 18 nt, Homo sapiens
uaaaauaaggcuccuuca

SEQ ID NO: 2091243 - RNA, 20 nt, Homo sapiens
agccucuccccugauuacac

SEQ ID NO: 2091244 - RNA, 15 nt, Homo sapiens
ucaaauaaauuucug

SEQ ID NO: 2091245 - RNA, 15 nt, Homo sapiens
cucuaaaagggggcu

SEQ ID NO: 2091246 - RNA, 13 nt, Homo sapiens
uuggauuccucac

SEQ ID NO: 2091247 - RNA, 14 nt, Homo sapiens
caggcgucugccac

SEQ ID NO: 2091248 - RNA, 16 nt, Homo sapiens
ccaaggagaugaagca

SEQ ID NO: 2091249 - RNA, 15 nt, Homo sapiens
acagugggcugcuag

SEQ ID NO: 2091250 - RNA, 21 nt, Homo sapiens
gcagaguguuuaccuggugcu

SEQ ID NO: 2091251 - RNA, 15 nt, Homo sapiens
aacgccacggagcuc

SEQ ID NO: 2091252 - RNA, 20 nt, Homo sapiens
aguucuuaucucuagcucag

SEQ ID NO: 2091253 - RNA, 14 nt, Homo sapiens
gaagauacaugucu

SEQ ID NO: 2091254 - RNA, 18 nt, Homo sapiens
ccaaccagguugcaguag

SEQ ID NO: 2091255 - RNA, 15 nt, Homo sapiens
ccacuccccaacccc

SEQ ID NO: 2091256 - RNA, 23 nt, Homo sapiens
cggauuugcucaggccugggaau

SEQ ID NO: 2091257 - RNA, 12 nt, Homo sapiens
gcacccauucca

SEQ ID NO: 2091258 - RNA, 19 nt, Homo sapiens
uggugggagagacugugag

SEQ ID NO: 2091259 - RNA, 23 nt, Homo sapiens
uggggaacucaaaggacugaccu

SEQ ID NO: 2091260 - RNA, 17 nt, Homo sapiens
gaaaaguugggcuuuca

SEQ ID NO: 2091261 - RNA, 12 nt, Homo sapiens
gaaggcuuuaaa

SEQ ID NO: 2091262 - RNA, 16 nt, Homo sapiens
uccccuccucuugccu

SEQ ID NO: 2091263 - RNA, 15 nt, Homo sapiens
cccaaugcacagggc

SEQ ID NO: 2091264 - RNA, 16 nt, Homo sapiens
uaaaguacaaccauag

SEQ ID NO: 2091265 - RNA, 19 nt, Homo sapiens
gauaacccuacacccagac

SEQ ID NO: 2091266 - RNA, 17 nt, Homo sapiens
agcccaggagccucacu

SEQ ID NO: 2091267 - RNA, 21 nt, Homo sapiens
cccagaccuggccucugccau

SEQ ID NO: 2091268 - RNA, 14 nt, Homo sapiens
ucucugaacugcaa

SEQ ID NO: 2091269 - RNA, 20 nt, Homo sapiens
gugugucucugcauguguaa

SEQ ID NO: 2091270 - RNA, 16 nt, Homo sapiens
aauugcuccugcaugc

SEQ ID NO: 2091271 - RNA, 14 nt, Homo sapiens
aaacagcuugaugc

SEQ ID NO: 2091272 - RNA, 14 nt, Homo sapiens
uaaauaucacaaag

SEQ ID NO: 2091273 - RNA, 14 nt, Homo sapiens
uccggggcuuguac

SEQ ID NO: 2091274 - RNA, 21 nt, Homo sapiens
cucacaugcacaggggcccau

SEQ ID NO: 2091275 - RNA, 15 nt, Homo sapiens
auguugccuuuaugg

SEQ ID NO: 2091276 - RNA, 14 nt, Homo sapiens
gaauuuucagucau

SEQ ID NO: 2091277 - RNA, 15 nt, Homo sapiens
agcgagucccuuugc

SEQ ID NO: 2091278 - RNA, 14 nt, Homo sapiens
cauauguacauaaa

SEQ ID NO: 2091279 - RNA, 16 nt, Homo sapiens
cucuggagugugcauu

SEQ ID NO: 2091280 - RNA, 14 nt, Homo sapiens
cauguuaaucacau

SEQ ID NO: 2091281 - RNA, 23 nt, Homo sapiens
gccuuaaucccagcacuuuggga

SEQ ID NO: 2091282 - RNA, 14 nt, Homo sapiens
cucgacaagaccac

SEQ ID NO: 2091283 - RNA, 17 nt, Homo sapiens
gucauggccacacugug

SEQ ID NO: 2091284 - RNA, 17 nt, Homo sapiens
aacccuaucuccugaca

SEQ ID NO: 2091285 - RNA, 14 nt, Homo sapiens
uccugacaccucca

SEQ ID NO: 2091286 - RNA, 14 nt, Homo sapiens
uucugccacuuccc

SEQ ID NO: 2091287 - RNA, 20 nt, Homo sapiens
uauuaaaauaaauguuguuu

SEQ ID NO: 2091288 - RNA, 12 nt, Homo sapiens
ugggguggaauu

SEQ ID NO: 2091289 - RNA, 21 nt, Homo sapiens
gguguuccuagaaugcagcug

SEQ ID NO: 2091290 - RNA, 16 nt, Homo sapiens
guuaaugugccaaaau

SEQ ID NO: 2091291 - RNA, 16 nt, Homo sapiens
aaacucaaaacaccca

SEQ ID NO: 2091292 - RNA, 21 nt, Homo sapiens
uacauauuucuuugccuuuau

SEQ ID NO: 2091293 - RNA, 18 nt, Homo sapiens
cucuguccccggguuuca

SEQ ID NO: 2091294 - RNA, 22 nt, Homo sapiens
gcagauuuugcccuugacaaag

SEQ ID NO: 2091295 - RNA, 14 nt, Homo sapiens
guaaaugaacugau

SEQ ID NO: 2091296 - RNA, 18 nt, Homo sapiens
acaagaguugucuugucc

SEQ ID NO: 2091297 - RNA, 20 nt, Homo sapiens
agaaacuaguaucucuggcc

SEQ ID NO: 2091298 - RNA, 12 nt, Homo sapiens
ucuccucagggu

SEQ ID NO: 2091299 - RNA, 15 nt, Homo sapiens
auguucguauuacaa

SEQ ID NO: 2091300 - RNA, 15 nt, Homo sapiens
ccagugcaacagcac

SEQ ID NO: 2091301 - RNA, 16 nt, Homo sapiens
aaaacuggaagcacag

SEQ ID NO: 2091302 - RNA, 13 nt, Homo sapiens
ucuccucugucag

SEQ ID NO: 2091303 - RNA, 19 nt, Homo sapiens
cacaccugugccuccucag

SEQ ID NO: 2091304 - RNA, 21 nt, Homo sapiens
ccaggauuccucucucagguc

SEQ ID NO: 2091305 - RNA, 18 nt, Homo sapiens
aaaguauuuuugauuaac

SEQ ID NO: 2091306 - RNA, 20 nt, Homo sapiens
aggcuggugguaacuuuuga

SEQ ID NO: 2091307 - RNA, 12 nt, Homo sapiens
gggacugugaac

SEQ ID NO: 2091308 - RNA, 22 nt, Homo sapiens
agcaucucagcucaucuucacu

SEQ ID NO: 2091309 - RNA, 21 nt, Homo sapiens
caaaaugaaccuugcuaucaa

SEQ ID NO: 2091310 - RNA, 17 nt, Homo sapiens
gcccacccccggcagca

SEQ ID NO: 2091311 - RNA, 14 nt, Homo sapiens
uaaugacaagugac

SEQ ID NO: 2091312 - RNA, 18 nt, Homo sapiens
cacaggacaacuuuacaa

SEQ ID NO: 2091313 - RNA, 21 nt, Homo sapiens
aaagugucauauuuacugguc

SEQ ID NO: 2091314 - RNA, 13 nt, Homo sapiens
acuuccuugcucu

SEQ ID NO: 2091315 - RNA, 12 nt, Homo sapiens
agaguugacaug

SEQ ID NO: 2091316 - RNA, 20 nt, Homo sapiens
gaaagauguuuguacaauga

SEQ ID NO: 2091317 - RNA, 17 nt, Homo sapiens
agaauauuuacaauaaa

SEQ ID NO: 2091318 - RNA, 22 nt, Homo sapiens
aagauguagaggagaaacugga

SEQ ID NO: 2091319 - RNA, 21 nt, Homo sapiens
uuaaguauaacuaauuugcuc

SEQ ID NO: 2091320 - RNA, 18 nt, Homo sapiens
ccacagacggaaggguaa

SEQ ID NO: 2091321 - RNA, 13 nt, Homo sapiens
uaucauagguaca

SEQ ID NO: 2091322 - RNA, 15 nt, Homo sapiens
cagaaagcugaggaa

SEQ ID NO: 2091323 - RNA, 18 nt, Homo sapiens
gagcucugguggagacaa

SEQ ID NO: 2091324 - RNA, 15 nt, Homo sapiens
uaaaagaugauuucu

SEQ ID NO: 2091325 - RNA, 21 nt, Homo sapiens
ucugagggaggaggccaccuc

SEQ ID NO: 2091326 - RNA, 18 nt, Homo sapiens
uaacguuuucuacuuuga

SEQ ID NO: 2091327 - RNA, 16 nt, Homo sapiens
gaaaaaaacaucagaa

SEQ ID NO: 2091328 - RNA, 21 nt, Homo sapiens
augcaaaguucuucauaucau

SEQ ID NO: 2091329 - RNA, 20 nt, Homo sapiens
cagaauaauuggcaugucuc

SEQ ID NO: 2091330 - RNA, 15 nt, Homo sapiens
agccagcugugcacu

SEQ ID NO: 2091331 - RNA, 17 nt, Homo sapiens
auaaauuuuauaaucau

SEQ ID NO: 2091332 - RNA, 23 nt, Homo sapiens
uggggugggaguuuugcucucug

SEQ ID NO: 2091333 - RNA, 15 nt, Homo sapiens
uggaaugcuggguau

SEQ ID NO: 2091334 - RNA, 14 nt, Homo sapiens
gcuaacauggagcu

SEQ ID NO: 2091335 - RNA, 16 nt, Homo sapiens
cagccuaagaaacacu

SEQ ID NO: 2091336 - RNA, 18 nt, Homo sapiens
aacugaaugaacaaccuc

SEQ ID NO: 2091337 - RNA, 13 nt, Homo sapiens
uagacaaccagag

SEQ ID NO: 2091338 - RNA, 14 nt, Homo sapiens
cucccaaacccagc

SEQ ID NO: 2091339 - RNA, 16 nt, Homo sapiens
auauacugagcugcua

SEQ ID NO: 2091340 - RNA, 17 nt, Homo sapiens
cacgaagcuuaguauaa

SEQ ID NO: 2091341 - RNA, 19 nt, Homo sapiens
ccuucccaaucagcacuga

SEQ ID NO: 2091342 - RNA, 17 nt, Homo sapiens
ugccauggaaccuuccc

SEQ ID NO: 2091343 - RNA, 13 nt, Homo sapiens
ccuagcauuucaa

SEQ ID NO: 2091344 - RNA, 15 nt, Homo sapiens
uacauauauauaucc

SEQ ID NO: 2091345 - RNA, 15 nt, Homo sapiens
agcauccaaguauau

SEQ ID NO: 2091346 - RNA, 13 nt, Homo sapiens
gacuguugcucaa

SEQ ID NO: 2091347 - RNA, 14 nt, Homo sapiens
aauauguuuuauuc

SEQ ID NO: 2091348 - RNA, 21 nt, Homo sapiens
ugauggguccccuccagguua

SEQ ID NO: 2091349 - RNA, 18 nt, Homo sapiens
uaaaaugaaauacuaaau

SEQ ID NO: 2091350 - RNA, 22 nt, Homo sapiens
aucugcacagucacuggcccaa

SEQ ID NO: 2091351 - RNA, 16 nt, Homo sapiens
aauccuuuacauucaa

SEQ ID NO: 2091352 - RNA, 14 nt, Homo sapiens
cucuuccaaaggca

SEQ ID NO: 2091353 - RNA, 16 nt, Homo sapiens
auaaacccaucuguaa

SEQ ID NO: 2091354 - RNA, 21 nt, Homo sapiens
acccauaggcccacacacagg

SEQ ID NO: 2091355 - RNA, 23 nt, Homo sapiens
ggccaguaucuauauauguguau

SEQ ID NO: 2091356 - RNA, 10 nt, Homo sapiens
aggcccuccc

SEQ ID NO: 2091357 - RNA, 20 nt, Homo sapiens
cuaccugaacugaaaggacu

SEQ ID NO: 2091358 - RNA, 15 nt, Homo sapiens
cgagagaggugggca

SEQ ID NO: 2091359 - RNA, 15 nt, Homo sapiens
uacuugaugcacuua

SEQ ID NO: 2091360 - RNA, 14 nt, Homo sapiens
aauggggccuguua

SEQ ID NO: 2091361 - RNA, 19 nt, Homo sapiens
cuaacaaguagcacacuga

SEQ ID NO: 2091362 - RNA, 16 nt, Homo sapiens
caguauugacuucuuu

SEQ ID NO: 2091363 - RNA, 14 nt, Homo sapiens
gaauuuauaucuaa

SEQ ID NO: 2091364 - RNA, 23 nt, Homo sapiens
uugugaaagaaggagcaagagaa

SEQ ID NO: 2091365 - RNA, 20 nt, Homo sapiens
cucuucaugcgcagucccca

SEQ ID NO: 2091366 - RNA, 19 nt, Homo sapiens
uguucuaaucaauguacaa

SEQ ID NO: 2091367 - RNA, 12 nt, Homo sapiens
gauggugccugc

SEQ ID NO: 2091368 - RNA, 15 nt, Homo sapiens
uguaaacaaaccaca

SEQ ID NO: 2091369 - RNA, 17 nt, Homo sapiens
uagcauuuagaucuaca

SEQ ID NO: 2091370 - RNA, 17 nt, Homo sapiens
gccaccagaugugacag

SEQ ID NO: 2091371 - RNA, 13 nt, Homo sapiens
uaccacagaguuu

SEQ ID NO: 2091372 - RNA, 21 nt, Homo sapiens
agaacucgaugcacugaccug

SEQ ID NO: 2091373 - RNA, 14 nt, Homo sapiens
gacaacauguggaa

SEQ ID NO: 2091374 - RNA, 19 nt, Homo sapiens
uauaaguguguacaagcau

SEQ ID NO: 2091375 - RNA, 22 nt, Homo sapiens
auuaguuguauuuugugcaagc

SEQ ID NO: 2091376 - RNA, 21 nt, Homo sapiens
gcugcuucuguguguggugag

SEQ ID NO: 2091377 - RNA, 13 nt, Homo sapiens
ucccuuuacauau

SEQ ID NO: 2091378 - RNA, 16 nt, Homo sapiens
agcagaacaccugagg

SEQ ID NO: 2091379 - RNA, 20 nt, Homo sapiens
ucccuuuuggggcaagacag

SEQ ID NO: 2091380 - RNA, 19 nt, Homo sapiens
ugcuauggggacauuccaa

SEQ ID NO: 2091381 - RNA, 21 nt, Homo sapiens
caaagaacuucuccuacugua

SEQ ID NO: 2091382 - RNA, 12 nt, Homo sapiens
accugagcaaau

SEQ ID NO: 2091383 - RNA, 19 nt, Homo sapiens
cuaaaagagaaugaugcug

SEQ ID NO: 2091384 - RNA, 21 nt, Homo sapiens
gcccgcacacccucacucugc

SEQ ID NO: 2091385 - RNA, 12 nt, Homo sapiens
auuaugauagcu

SEQ ID NO: 2091386 - RNA, 18 nt, Homo sapiens
gggaguauugaauggugg

SEQ ID NO: 2091387 - RNA, 16 nt, Homo sapiens
cuggagauugugcucu

SEQ ID NO: 2091388 - RNA, 16 nt, Homo sapiens
ggcaaggaugauccag

SEQ ID NO: 2091389 - RNA, 20 nt, Homo sapiens
cauuggguggcaacauuugg

SEQ ID NO: 2091390 - RNA, 14 nt, Homo sapiens
uugagaaaagagug

SEQ ID NO: 2091391 - RNA, 21 nt, Homo sapiens
uggucauaacucagcccuuug

SEQ ID NO: 2091392 - RNA, 17 nt, Homo sapiens
cuucuacacagcaauac

SEQ ID NO: 2091393 - RNA, 17 nt, Homo sapiens
caggauuuguuguucug

SEQ ID NO: 2091394 - RNA, 20 nt, Homo sapiens
accaagaggaaagcuuuuac

SEQ ID NO: 2091395 - RNA, 20 nt, Homo sapiens
augugccuguguacuggaca

SEQ ID NO: 2091396 - RNA, 22 nt, Homo sapiens
auucaguaguggaaaugaguga

SEQ ID NO: 2091397 - RNA, 17 nt, Homo sapiens
cagcccccaccucaggu

SEQ ID NO: 2091398 - RNA, 22 nt, Homo sapiens
auuuuucacugccccagacaca

SEQ ID NO: 2091399 - RNA, 22 nt, Homo sapiens
aauuuucuaguaugucuugaaa

SEQ ID NO: 2091400 - RNA, 18 nt, Homo sapiens
uagcauacgguaugauau

SEQ ID NO: 2091401 - RNA, 15 nt, Homo sapiens
cuauucugagugaaa

SEQ ID NO: 2091402 - RNA, 15 nt, Homo sapiens
aaauauaaacuugug

SEQ ID NO: 2091403 - RNA, 15 nt, Homo sapiens
uauaguuaauccuuc

SEQ ID NO: 2091404 - RNA, 18 nt, Homo sapiens
ugucucacuucacagccc

SEQ ID NO: 2091405 - RNA, 13 nt, Homo sapiens
cccugaaauccag

SEQ ID NO: 2091406 - RNA, 21 nt, Homo sapiens
ccuauuaucagaaggugacaa

SEQ ID NO: 2091407 - RNA, 20 nt, Homo sapiens
aucugugcaggauauuugca

SEQ ID NO: 2091408 - RNA, 16 nt, Homo sapiens
acuaaaaguacauuaa

SEQ ID NO: 2091409 - RNA, 20 nt, Homo sapiens
acuaguucagacacuuugga

SEQ ID NO: 2091410 - RNA, 14 nt, Homo sapiens
uaaaagcacacucc

SEQ ID NO: 2091411 - RNA, 22 nt, Homo sapiens
cauccuggcuggcuguguccuc

SEQ ID NO: 2091412 - RNA, 20 nt, Homo sapiens
ugaaagaguaaaggaaauga

SEQ ID NO: 2091413 - RNA, 20 nt, Homo sapiens
uagaguagagguauaauugu

SEQ ID NO: 2091414 - RNA, 19 nt, Homo sapiens
aggaauacaauauauagcu

SEQ ID NO: 2091415 - RNA, 20 nt, Homo sapiens
uuauauugauaacagcacug

SEQ ID NO: 2091416 - RNA, 18 nt, Homo sapiens
guuuuaaguuguuugcau

SEQ ID NO: 2091417 - RNA, 19 nt, Homo sapiens
ugcuuuaaaaaacacaguc

SEQ ID NO: 2091418 - RNA, 23 nt, Homo sapiens
uggcagaugcaguagacugcagu

SEQ ID NO: 2091419 - RNA, 19 nt, Homo sapiens
cugauugcauccacuagcu

SEQ ID NO: 2091420 - RNA, 15 nt, Homo sapiens
gauaauaugcuaaau

SEQ ID NO: 2091421 - RNA, 13 nt, Homo sapiens
aaucccucuaccu

SEQ ID NO: 2091422 - RNA, 18 nt, Homo sapiens
aacauggcuaaauacaau

SEQ ID NO: 2091423 - RNA, 14 nt, Homo sapiens
agaaaugucucaag

SEQ ID NO: 2091424 - RNA, 22 nt, Homo sapiens
uauuuauugaaaugauuucaca

SEQ ID NO: 2091425 - RNA, 15 nt, Homo sapiens
agguggccacuccag

SEQ ID NO: 2091426 - RNA, 14 nt, Homo sapiens
agaaguaacuuauu

SEQ ID NO: 2091427 - RNA, 21 nt, Homo sapiens
aaaaaccaucaaguugugcca

SEQ ID NO: 2091428 - RNA, 19 nt, Homo sapiens
uggaugucuuuguggugau

SEQ ID NO: 2091429 - RNA, 18 nt, Homo sapiens
cacagauuuguccaggcu

SEQ ID NO: 2091430 - RNA, 13 nt, Homo sapiens
ugacaacaaagau

SEQ ID NO: 2091431 - RNA, 15 nt, Homo sapiens
aagugucaccuccuu

SEQ ID NO: 2091432 - RNA, 20 nt, Homo sapiens
gauuguaacguugcuguggg

SEQ ID NO: 2091433 - RNA, 19 nt, Homo sapiens
agagugcugccaguccucu

SEQ ID NO: 2091434 - RNA, 21 nt, Homo sapiens
cugcguccuccucaccucaug

SEQ ID NO: 2091435 - RNA, 23 nt, Homo sapiens
auuuuccuacaucggaauccaag

SEQ ID NO: 2091436 - RNA, 23 nt, Homo sapiens
ccagauguguaucagauguuuca

SEQ ID NO: 2091437 - RNA, 18 nt, Homo sapiens
gcuugucugcagucaccc

SEQ ID NO: 2091438 - RNA, 15 nt, Homo sapiens
cugugugugaugugc

SEQ ID NO: 2091439 - RNA, 18 nt, Homo sapiens
cgaauugacaacccaaac

SEQ ID NO: 2091440 - RNA, 13 nt, Homo sapiens
ccuccgucaggag

SEQ ID NO: 2091441 - RNA, 16 nt, Homo sapiens
ugcaaaggaaauacca

SEQ ID NO: 2091442 - RNA, 17 nt, Homo sapiens
gugaauaacuaugccag

SEQ ID NO: 2091443 - RNA, 13 nt, Homo sapiens
aggaguccaggcc

SEQ ID NO: 2091444 - RNA, 19 nt, Homo sapiens
gaauuuucuggccuuucau

SEQ ID NO: 2091445 - RNA, 15 nt, Homo sapiens
agguaaaaacccagc

SEQ ID NO: 2091446 - RNA, 20 nt, Homo sapiens
caccuagcucuaagagcaau

SEQ ID NO: 2091447 - RNA, 21 nt, Homo sapiens
aaagcauuuucucucauaggc

SEQ ID NO: 2091448 - RNA, 20 nt, Homo sapiens
auuuuguccauucaucucau

SEQ ID NO: 2091449 - RNA, 18 nt, Homo sapiens
agucacaauuugcaaauu

SEQ ID NO: 2091450 - RNA, 17 nt, Homo sapiens
ucaacuccuuucucauc

SEQ ID NO: 2091451 - RNA, 13 nt, Homo sapiens
agugacauuucua

SEQ ID NO: 2091452 - RNA, 14 nt, Homo sapiens
cagcaguguucuca

SEQ ID NO: 2091453 - RNA, 17 nt, Homo sapiens
auuaaagucuacacugc

SEQ ID NO: 2091454 - RNA, 12 nt, Homo sapiens
aucugccuggag

SEQ ID NO: 2091455 - RNA, 21 nt, Homo sapiens
aggcacggugguucaugccug

SEQ ID NO: 2091456 - RNA, 23 nt, Homo sapiens
acauguauaguauacucuugccu

SEQ ID NO: 2091457 - RNA, 15 nt, Homo sapiens
uucugaaaaaguauc

SEQ ID NO: 2091458 - RNA, 22 nt, Homo sapiens
guaucucuugcugggaacacag

SEQ ID NO: 2091459 - RNA, 14 nt, Homo sapiens
uaacacacuuuaua

SEQ ID NO: 2091460 - RNA, 20 nt, Homo sapiens
ugcuuugaaaacaugacuca

SEQ ID NO: 2091461 - RNA, 19 nt, Homo sapiens
uuagucaauccugucauau

SEQ ID NO: 2091462 - RNA, 18 nt, Homo sapiens
caucuucacagcacauuu

SEQ ID NO: 2091463 - RNA, 21 nt, Homo sapiens
agcuggaauuacaggcacaua

SEQ ID NO: 2091464 - RNA, 18 nt, Homo sapiens
aggagauaacauuucaac

SEQ ID NO: 2091465 - RNA, 14 nt, Homo sapiens
uccuaaaacucugc

SEQ ID NO: 2091466 - RNA, 14 nt, Homo sapiens
ucccgaaacuccac

SEQ ID NO: 2091467 - RNA, 14 nt, Homo sapiens
uuaugcaaccauaa

SEQ ID NO: 2091468 - RNA, 17 nt, Homo sapiens
ucacaaaaaaaguaauu

SEQ ID NO: 2091469 - RNA, 13 nt, Homo sapiens
caaacagcaagaa

SEQ ID NO: 2091470 - RNA, 20 nt, Homo sapiens
ugcgaagacccucuugccca

SEQ ID NO: 2091471 - RNA, 16 nt, Homo sapiens
ucaugcaauccuucca

SEQ ID NO: 2091472 - RNA, 23 nt, Homo sapiens
cccauagcaaagaggcuguuaua

SEQ ID NO: 2091473 - RNA, 21 nt, Homo sapiens
augucaucaaauauuaccaaa

SEQ ID NO: 2091474 - RNA, 12 nt, Homo sapiens
gagaaggugcuu

SEQ ID NO: 2091475 - RNA, 22 nt, Homo sapiens
ucccggcuggacuuuugcagcu

SEQ ID NO: 2091476 - RNA, 14 nt, Homo sapiens
aguagaggcauuua

SEQ ID NO: 2091477 - RNA, 20 nt, Homo sapiens
acgaguguagucccggaggc

SEQ ID NO: 2091478 - RNA, 19 nt, Homo sapiens
uacccaccgcccuugccga

SEQ ID NO: 2091479 - RNA, 18 nt, Homo sapiens
gcuagccagcuguguuca

SEQ ID NO: 2091480 - RNA, 18 nt, Homo sapiens
aacacagaacugaucuca

SEQ ID NO: 2091481 - RNA, 18 nt, Homo sapiens
cauuuaaaaagguuuaaa

SEQ ID NO: 2091482 - RNA, 14 nt, Homo sapiens
augauacuucccac

SEQ ID NO: 2091483 - RNA, 14 nt, Homo sapiens
augaaaugcauauu

SEQ ID NO: 2091484 - RNA, 13 nt, Homo sapiens
aagcaagcucuuc

SEQ ID NO: 2091485 - RNA, 18 nt, Homo sapiens
uguacauuuucuaacaaa

SEQ ID NO: 2091486 - RNA, 20 nt, Homo sapiens
ucaaacaugaaaacauugau

SEQ ID NO: 2091487 - RNA, 23 nt, Homo sapiens
guccaaaauaagaugaaucacuu

SEQ ID NO: 2091488 - RNA, 21 nt, Homo sapiens
acauagccaccugucaccucu

SEQ ID NO: 2091489 - RNA, 16 nt, Homo sapiens
uuuacuuuucugccaa

SEQ ID NO: 2091490 - RNA, 18 nt, Homo sapiens
aaaugacuggcuccugac

SEQ ID NO: 2091491 - RNA, 16 nt, Homo sapiens
cauguucaugugauua

SEQ ID NO: 2091492 - RNA, 20 nt, Homo sapiens
uccgacuucucuagacaucu

SEQ ID NO: 2091493 - RNA, 22 nt, Homo sapiens
uugcuuuagcacaggacaacuu

SEQ ID NO: 2091494 - RNA, 16 nt, Homo sapiens
aacuucaauuuacuua

SEQ ID NO: 2091495 - RNA, 18 nt, Homo sapiens
gaucuggaaccucagccu

SEQ ID NO: 2091496 - RNA, 21 nt, Homo sapiens
acgcaccaccgcgccuaccuu

SEQ ID NO: 2091497 - RNA, 15 nt, Homo sapiens
auuacaggcuugaaa

SEQ ID NO: 2091498 - RNA, 16 nt, Homo sapiens
gcuguuugaaaugcca

SEQ ID NO: 2091499 - RNA, 20 nt, Homo sapiens
cagggagaggucaccagcug

SEQ ID NO: 2091500 - RNA, 20 nt, Homo sapiens
ucuuagagagaagaucacug

SEQ ID NO: 2091501 - RNA, 16 nt, Homo sapiens
ccugggugacgguccu

SEQ ID NO: 2091502 - RNA, 18 nt, Homo sapiens
uccagggaaacagccucu

SEQ ID NO: 2091503 - RNA, 23 nt, Homo sapiens
uguauacugaguuggaagugauu

SEQ ID NO: 2091504 - RNA, 15 nt, Homo sapiens
gacggauacugggga

SEQ ID NO: 2091505 - RNA, 19 nt, Homo sapiens
caggacaguugauggagcc

SEQ ID NO: 2091506 - RNA, 23 nt, Homo sapiens
aaaaucuuuccucuucucauuac

SEQ ID NO: 2091507 - RNA, 21 nt, Homo sapiens
uuuugcacaaaguaagccuca

SEQ ID NO: 2091508 - RNA, 14 nt, Homo sapiens
cauuugaaagaaag

SEQ ID NO: 2091509 - RNA, 15 nt, Homo sapiens
agcagcucugugacu

SEQ ID NO: 2091510 - RNA, 15 nt, Homo sapiens
uccaacccacuggcc

SEQ ID NO: 2091511 - RNA, 16 nt, Homo sapiens
cucuuagaagugacau

SEQ ID NO: 2091512 - RNA, 13 nt, Homo sapiens
cuauccacagaga

SEQ ID NO: 2091513 - RNA, 13 nt, Homo sapiens
ggguggguggugg

SEQ ID NO: 2091514 - RNA, 17 nt, Homo sapiens
ucagccugucucuucca

SEQ ID NO: 2091515 - RNA, 19 nt, Homo sapiens
aggcugugccaucagcucc

SEQ ID NO: 2091516 - RNA, 19 nt, Homo sapiens
ugccagagauaaacuaaug

SEQ ID NO: 2091517 - RNA, 20 nt, Homo sapiens
cuaugaaguuggcacauuuc

SEQ ID NO: 2091518 - RNA, 21 nt, Homo sapiens
uacaaugauguaaauauuuca

SEQ ID NO: 2091519 - RNA, 22 nt, Homo sapiens
ugaacuaaguuuuuuacuucca

SEQ ID NO: 2091520 - RNA, 18 nt, Homo sapiens
uuucuuagguaaccuuau

SEQ ID NO: 2091521 - RNA, 23 nt, Homo sapiens
acucaaauagcaguccccaguga

SEQ ID NO: 2091522 - RNA, 13 nt, Homo sapiens
agaaaaguauugu

SEQ ID NO: 2091523 - RNA, 13 nt, Homo sapiens
uuuuuaacaugua

SEQ ID NO: 2091524 - RNA, 13 nt, Homo sapiens
auuguaacuugga

SEQ ID NO: 2091525 - RNA, 15 nt, Homo sapiens
cuauauaccaaagca

SEQ ID NO: 2091526 - RNA, 20 nt, Homo sapiens
cacuucucaggacacaggcc

SEQ ID NO: 2091527 - RNA, 9 nt, Homo sapiens
uugagacag

SEQ ID NO: 2091528 - RNA, 15 nt, Homo sapiens
gcucccaguccugcc

SEQ ID NO: 2091529 - RNA, 19 nt, Homo sapiens
ucaguuuuccuagucuuug

SEQ ID NO: 2091530 - RNA, 21 nt, Homo sapiens
guuggagagcuagaaccugga

SEQ ID NO: 2091531 - RNA, 22 nt, Homo sapiens
caggauuccucuuuucucugcc

SEQ ID NO: 2091532 - RNA, 17 nt, Homo sapiens
cagcuaggaugugcauu

SEQ ID NO: 2091533 - RNA, 19 nt, Homo sapiens
guuugugcucuacggguga

SEQ ID NO: 2091534 - RNA, 15 nt, Homo sapiens
caccaaaaccaagau

SEQ ID NO: 2091535 - RNA, 22 nt, Homo sapiens
uucccccuccuccgggggccaa

SEQ ID NO: 2091536 - RNA, 21 nt, Homo sapiens
gccacaucuccuguggucucu

SEQ ID NO: 2091537 - RNA, 15 nt, Homo sapiens
acgugaaacagagug

SEQ ID NO: 2091538 - RNA, 18 nt, Homo sapiens
augcugcccgcucugcag

SEQ ID NO: 2091539 - RNA, 20 nt, Homo sapiens
cuuauagacacuugcuccca

SEQ ID NO: 2091540 - RNA, 14 nt, Homo sapiens
cuuuugaauugcac

SEQ ID NO: 2091541 - RNA, 20 nt, Homo sapiens
cugccuggagugcugugcug

SEQ ID NO: 2091542 - RNA, 14 nt, Homo sapiens
cuuccuugauaaua

SEQ ID NO: 2091543 - RNA, 14 nt, Homo sapiens
aauacuugcaacua

SEQ ID NO: 2091544 - RNA, 19 nt, Homo sapiens
guucccuuccuauuccaag

SEQ ID NO: 2091545 - RNA, 15 nt, Homo sapiens
aggccaaugggcuag

SEQ ID NO: 2091546 - RNA, 19 nt, Homo sapiens
cucaccugucgcuuccuag

SEQ ID NO: 2091547 - RNA, 15 nt, Homo sapiens
ggaaagccucacuga

SEQ ID NO: 2091548 - RNA, 20 nt, Homo sapiens
ugaauauggaacauaugcac

SEQ ID NO: 2091549 - RNA, 11 nt, Homo sapiens
ugguuuugcuc

SEQ ID NO: 2091550 - RNA, 15 nt, Homo sapiens
ggcaccagcaggcac

SEQ ID NO: 2091551 - RNA, 13 nt, Homo sapiens
cuuugccuucaaa

SEQ ID NO: 2091552 - RNA, 23 nt, Homo sapiens
uacacucuuuuauacaagagugu

SEQ ID NO: 2091553 - RNA, 13 nt, Homo sapiens
auuugucaugaca

SEQ ID NO: 2091554 - RNA, 22 nt, Homo sapiens
aucaauuggaaaucaauccugu

SEQ ID NO: 2091555 - RNA, 19 nt, Homo sapiens
cugauggagcucagaauuc

SEQ ID NO: 2091556 - RNA, 21 nt, Homo sapiens
accaauucaugaagugaauua

SEQ ID NO: 2091557 - RNA, 17 nt, Homo sapiens
caccaguguuccugaag

SEQ ID NO: 2091558 - RNA, 12 nt, Homo sapiens
cccugcuuagaa

SEQ ID NO: 2091559 - RNA, 16 nt, Homo sapiens
gugaugauguuuugau

SEQ ID NO: 2091560 - RNA, 16 nt, Homo sapiens
gugaucccguuuuccc

SEQ ID NO: 2091561 - RNA, 23 nt, Homo sapiens
auagaagaaaaaagaaugucaga

SEQ ID NO: 2091562 - RNA, 14 nt, Homo sapiens
gcuguccugucagu

SEQ ID NO: 2091563 - RNA, 21 nt, Homo sapiens
auacaggagucugucucugcu

SEQ ID NO: 2091564 - RNA, 13 nt, Homo sapiens
aaugcacuuuguu

SEQ ID NO: 2091565 - RNA, 17 nt, Homo sapiens
ccgcauugauggccuca

SEQ ID NO: 2091566 - RNA, 20 nt, Homo sapiens
uacauauaguuuuugcaggg

SEQ ID NO: 2091567 - RNA, 16 nt, Homo sapiens
gucuauacauuccuga

SEQ ID NO: 2091568 - RNA, 17 nt, Homo sapiens
aacucuucuacuuucau

SEQ ID NO: 2091569 - RNA, 17 nt, Homo sapiens
cugaccucaugauccac

SEQ ID NO: 2091570 - RNA, 20 nt, Homo sapiens
caacaggagcugggauccua

SEQ ID NO: 2091571 - RNA, 22 nt, Homo sapiens
aauguauuuuagacuuccugua

SEQ ID NO: 2091572 - RNA, 13 nt, Homo sapiens
caugguggcacac

SEQ ID NO: 2091573 - RNA, 14 nt, Homo sapiens
cuuguaaauguguu

SEQ ID NO: 2091574 - RNA, 20 nt, Homo sapiens
auaaggggaaagauaauauu

SEQ ID NO: 2091575 - RNA, 16 nt, Homo sapiens
gagaaggaggggagca

SEQ ID NO: 2091576 - RNA, 18 nt, Homo sapiens
gccauuaugcaaauggag

SEQ ID NO: 2091577 - RNA, 13 nt, Homo sapiens
aaacacauuucca

SEQ ID NO: 2091578 - RNA, 22 nt, Homo sapiens
uugaucuggaacccagacucag

SEQ ID NO: 2091579 - RNA, 21 nt, Homo sapiens
agcucgccccaccuccaccug

SEQ ID NO: 2091580 - RNA, 13 nt, Homo sapiens
auuguauaagauu

SEQ ID NO: 2091581 - RNA, 16 nt, Homo sapiens
aggagagaacagggau

SEQ ID NO: 2091582 - RNA, 16 nt, Homo sapiens
gaaauaaccugugaau

SEQ ID NO: 2091583 - RNA, 18 nt, Homo sapiens
cagcuucagauaccaugc

SEQ ID NO: 2091584 - RNA, 23 nt, Homo sapiens
gguaugccaacuuaaguauuuac

SEQ ID NO: 2091585 - RNA, 20 nt, Homo sapiens
ggaggccaagccugcagcuu

SEQ ID NO: 2091586 - RNA, 18 nt, Homo sapiens
ugccaaguaacaaugcau

SEQ ID NO: 2091587 - RNA, 17 nt, Homo sapiens
cuuuaccaaacagcaaa

SEQ ID NO: 2091588 - RNA, 17 nt, Homo sapiens
ccucauggagaccucau

SEQ ID NO: 2091589 - RNA, 23 nt, Homo sapiens
auuuauaaaugagcaaauggaac

SEQ ID NO: 2091590 - RNA, 20 nt, Homo sapiens
aagaacagagucucaggaca

SEQ ID NO: 2091591 - RNA, 14 nt, Homo sapiens
aaggacacagugau

SEQ ID NO: 2091592 - RNA, 19 nt, Homo sapiens
ugggucaccuuccugggca

SEQ ID NO: 2091593 - RNA, 15 nt, Homo sapiens
auucugaccauuuca

SEQ ID NO: 2091594 - RNA, 17 nt, Homo sapiens
cgacguccccaaaccua

SEQ ID NO: 2091595 - RNA, 14 nt, Homo sapiens
uagguaucauucaa

SEQ ID NO: 2091596 - RNA, 16 nt, Homo sapiens
ucauuucuuaucacau

SEQ ID NO: 2091597 - RNA, 20 nt, Homo sapiens
ggguaggcugucugugccau

SEQ ID NO: 2091598 - RNA, 23 nt, Homo sapiens
uugaucagaccaaacagugcugu

SEQ ID NO: 2091599 - RNA, 16 nt, Homo sapiens
uuaaaaucacugucaa

SEQ ID NO: 2091600 - RNA, 20 nt, Homo sapiens
aguugcugaauguugcauua

SEQ ID NO: 2091601 - RNA, 17 nt, Homo sapiens
agacaugccuuggugcc

SEQ ID NO: 2091602 - RNA, 17 nt, Homo sapiens
ucugcaaccccagguau

SEQ ID NO: 2091603 - RNA, 17 nt, Homo sapiens
agcucucuauaccaaag

SEQ ID NO: 2091604 - RNA, 18 nt, Homo sapiens
cugcaggcuggagacugg

SEQ ID NO: 2091605 - RNA, 22 nt, Homo sapiens
uaaacacuccacaguguuuaua

SEQ ID NO: 2091606 - RNA, 22 nt, Homo sapiens
uaaugugcucuguaccugucaa

SEQ ID NO: 2091607 - RNA, 21 nt, Homo sapiens
aagaaaagccugaacuauuua

SEQ ID NO: 2091608 - RNA, 11 nt, Homo sapiens
aagaguuuaaa

SEQ ID NO: 2091609 - RNA, 15 nt, Homo sapiens
ucaaugccccugaau

SEQ ID NO: 2091610 - RNA, 14 nt, Homo sapiens
auauucuauuccau

SEQ ID NO: 2091611 - RNA, 17 nt, Homo sapiens
gugccuccuguggucuc

SEQ ID NO: 2091612 - RNA, 19 nt, Homo sapiens
cuuuaagggcaugccuugu

SEQ ID NO: 2091613 - RNA, 21 nt, Homo sapiens
acugcaacaacgccuggugcc

SEQ ID NO: 2091614 - RNA, 14 nt, Homo sapiens
cuccauaauugcaa

SEQ ID NO: 2091615 - RNA, 15 nt, Homo sapiens
ccccaugugccugca

SEQ ID NO: 2091616 - RNA, 24 nt, Homo sapiens
caaaaaaauacugccagaugcuga

SEQ ID NO: 2091617 - RNA, 18 nt, Homo sapiens
ggacacccucaccaccca

SEQ ID NO: 2091618 - RNA, 21 nt, Homo sapiens
uaauacaguuuucuauucuug

SEQ ID NO: 2091619 - RNA, 20 nt, Homo sapiens
aagaauuuuguuuuacuuuu

SEQ ID NO: 2091620 - RNA, 20 nt, Homo sapiens
ccagcuccaaccugcaaaga

SEQ ID NO: 2091621 - RNA, 18 nt, Homo sapiens
uauuuuguuuauugcacu

SEQ ID NO: 2091622 - RNA, 15 nt, Homo sapiens
uuucauauucucaga

SEQ ID NO: 2091623 - RNA, 14 nt, Homo sapiens
ccugugcacagcca

SEQ ID NO: 2091624 - RNA, 16 nt, Homo sapiens
acgcauccagcaagaa

SEQ ID NO: 2091625 - RNA, 16 nt, Homo sapiens
uucgauggcauccugc

SEQ ID NO: 2091626 - RNA, 13 nt, Homo sapiens
caguccccaguga

SEQ ID NO: 2091627 - RNA, 16 nt, Homo sapiens
uaaaauagaaacuacc

SEQ ID NO: 2091628 - RNA, 16 nt, Homo sapiens
cugacaccaugugcaa

SEQ ID NO: 2091629 - RNA, 23 nt, Homo sapiens
aucaugaauuauauaauuuucca

SEQ ID NO: 2091630 - RNA, 20 nt, Homo sapiens
uugcucaccgacucaccugc

SEQ ID NO: 2091631 - RNA, 15 nt, Homo sapiens
ucgccauuguucacc

SEQ ID NO: 2091632 - RNA, 19 nt, Homo sapiens
ucagggaaaaggguccagg

SEQ ID NO: 2091633 - RNA, 20 nt, Homo sapiens
gcagucagcgccagcacugu

SEQ ID NO: 2091634 - RNA, 14 nt, Homo sapiens
gcagcccuuggcca

SEQ ID NO: 2091635 - RNA, 19 nt, Homo sapiens
augaccuuuuucacugugg

SEQ ID NO: 2091636 - RNA, 21 nt, Homo sapiens
acaacauguaccuguauuaaa

SEQ ID NO: 2091637 - RNA, 15 nt, Homo sapiens
aaccucauuaucagu

SEQ ID NO: 2091638 - RNA, 17 nt, Homo sapiens
aacugguuuagcacaau

SEQ ID NO: 2091639 - RNA, 23 nt, Homo sapiens
uggccacugggucucacuccuga

SEQ ID NO: 2091640 - RNA, 21 nt, Homo sapiens
accacucuuccugaguucagu

SEQ ID NO: 2091641 - RNA, 17 nt, Homo sapiens
cauuccuaaacuaucuu

SEQ ID NO: 2091642 - RNA, 19 nt, Homo sapiens
gagggugucggcugugagg

SEQ ID NO: 2091643 - RNA, 12 nt, Homo sapiens
guucuucagggc

SEQ ID NO: 2091644 - RNA, 23 nt, Homo sapiens
cugacccaagagguggggaccaa

SEQ ID NO: 2091645 - RNA, 14 nt, Homo sapiens
ucgacguuugacua

SEQ ID NO: 2091646 - RNA, 23 nt, Homo sapiens
agacuccugcucucuauccaaaa

SEQ ID NO: 2091647 - RNA, 22 nt, Homo sapiens
gugauauuguguggucugguuc

SEQ ID NO: 2091648 - RNA, 13 nt, Homo sapiens
auaauucugggaa

SEQ ID NO: 2091649 - RNA, 23 nt, Homo sapiens
cuuugcucuuacuacacugagga

SEQ ID NO: 2091650 - RNA, 22 nt, Homo sapiens
ucggggcuaacagagacuggag

SEQ ID NO: 2091651 - RNA, 20 nt, Homo sapiens
uuucgagaagcugcucugga

SEQ ID NO: 2091652 - RNA, 16 nt, Homo sapiens
uugcuccuaacuccac

SEQ ID NO: 2091653 - RNA, 13 nt, Homo sapiens
cauacggcacuga

SEQ ID NO: 2091654 - RNA, 17 nt, Homo sapiens
ccuuuccuuaugucucc

SEQ ID NO: 2091655 - RNA, 21 nt, Homo sapiens
ucccauggaaugcagcaguaa

SEQ ID NO: 2091656 - RNA, 19 nt, Homo sapiens
uguggcuaucugcauuuau

SEQ ID NO: 2091657 - RNA, 18 nt, Homo sapiens
gccaguuacuugcuuuac

SEQ ID NO: 2091658 - RNA, 10 nt, Homo sapiens
uaauugagau

SEQ ID NO: 2091659 - RNA, 15 nt, Homo sapiens
augcaguaugugcag

SEQ ID NO: 2091660 - RNA, 19 nt, Homo sapiens
ggcucacuguagucucgac

SEQ ID NO: 2091661 - RNA, 18 nt, Homo sapiens
aacaaguuuuucugucaa

SEQ ID NO: 2091662 - RNA, 18 nt, Homo sapiens
uccauugcauucauguac

SEQ ID NO: 2091663 - RNA, 19 nt, Homo sapiens
cagauccgcaagaguaaag

SEQ ID NO: 2091664 - RNA, 22 nt, Homo sapiens
cccagugauggcauuacucugc

SEQ ID NO: 2091665 - RNA, 13 nt, Homo sapiens
cugugacauuucc

SEQ ID NO: 2091666 - RNA, 13 nt, Homo sapiens
cggauagcauuug

SEQ ID NO: 2091667 - RNA, 18 nt, Homo sapiens
aguguguacaagcauuca

SEQ ID NO: 2091668 - RNA, 19 nt, Homo sapiens
agaagcaaugggucacuca

SEQ ID NO: 2091669 - RNA, 19 nt, Homo sapiens
ccccugcacucuuauugga

SEQ ID NO: 2091670 - RNA, 21 nt, Homo sapiens
auuccauuaauaacugaauaa

SEQ ID NO: 2091671 - RNA, 20 nt, Homo sapiens
augagccauaggaaggcacu

SEQ ID NO: 2091672 - RNA, 21 nt, Homo sapiens
uuacuuugagacuaaagacug

SEQ ID NO: 2091673 - RNA, 13 nt, Homo sapiens
aggcauguccuag

SEQ ID NO: 2091674 - RNA, 21 nt, Homo sapiens
ucucauuuggucugccagaau

SEQ ID NO: 2091675 - RNA, 16 nt, Homo sapiens
cagccaaguagccucu

SEQ ID NO: 2091676 - RNA, 21 nt, Homo sapiens
ggcugacccagauucccuucc

SEQ ID NO: 2091677 - RNA, 18 nt, Homo sapiens
cugcuuuaaacugcauuu

SEQ ID NO: 2091678 - RNA, 21 nt, Homo sapiens
uuuuggggaguaccuguccaa

SEQ ID NO: 2091679 - RNA, 15 nt, Homo sapiens
aagggagacugacca

SEQ ID NO: 2091680 - RNA, 13 nt, Homo sapiens
gcaaauaucuuga

SEQ ID NO: 2091681 - RNA, 20 nt, Homo sapiens
uguacauaguuauguaaaaa

SEQ ID NO: 2091682 - RNA, 16 nt, Homo sapiens
uggccuuacacugaaa

SEQ ID NO: 2091683 - RNA, 21 nt, Homo sapiens
agauuuuugagcaaacacuug

SEQ ID NO: 2091684 - RNA, 20 nt, Homo sapiens
agauuagaagacaacaggca

SEQ ID NO: 2091685 - RNA, 16 nt, Homo sapiens
ucaaugaucaucucac

SEQ ID NO: 2091686 - RNA, 19 nt, Homo sapiens
cuguaucacagacuggcaa

SEQ ID NO: 2091687 - RNA, 13 nt, Homo sapiens
uuaauagccauuu

SEQ ID NO: 2091688 - RNA, 17 nt, Homo sapiens
auauucugguucuugaa

SEQ ID NO: 2091689 - RNA, 18 nt, Homo sapiens
agcugccauccagggaug

SEQ ID NO: 2091690 - RNA, 13 nt, Homo sapiens
aaaugaucuuuac

SEQ ID NO: 2091691 - RNA, 19 nt, Homo sapiens
agccgaggucaugccacug

SEQ ID NO: 2091692 - RNA, 21 nt, Homo sapiens
cacacacauauauuauuugca

SEQ ID NO: 2091693 - RNA, 19 nt, Homo sapiens
uccaugaccuaguuuucca

SEQ ID NO: 2091694 - RNA, 22 nt, Homo sapiens
ucaccucaauauuuacuauuuc

SEQ ID NO: 2091695 - RNA, 17 nt, Homo sapiens
caggcauagaggcuucu

SEQ ID NO: 2091696 - RNA, 15 nt, Homo sapiens
uauaaaucagccuaa

SEQ ID NO: 2091697 - RNA, 16 nt, Homo sapiens
ucauguccagugagca

SEQ ID NO: 2091698 - RNA, 12 nt, Homo sapiens
ucagaugggcag

SEQ ID NO: 2091699 - RNA, 21 nt, Homo sapiens
gacaagugacuguaucugugu

SEQ ID NO: 2091700 - RNA, 22 nt, Homo sapiens
accuguaaucccagcuacucga

SEQ ID NO: 2091701 - RNA, 18 nt, Homo sapiens
auggugcuggggagccaa

SEQ ID NO: 2091702 - RNA, 13 nt, Homo sapiens
uaaucauuaucuc

SEQ ID NO: 2091703 - RNA, 18 nt, Homo sapiens
aaggcugugcucuuccuc

SEQ ID NO: 2091704 - RNA, 18 nt, Homo sapiens
caagcugaauuugaaaua

SEQ ID NO: 2091705 - RNA, 18 nt, Homo sapiens
uacuuuucuguucaucac

SEQ ID NO: 2091706 - RNA, 13 nt, Homo sapiens
aggaaccaaagcg

SEQ ID NO: 2091707 - RNA, 20 nt, Homo sapiens
agcccuugagucugucacac

SEQ ID NO: 2091708 - RNA, 23 nt, Homo sapiens
cauguuaagugccauuacuacug

SEQ ID NO: 2091709 - RNA, 23 nt, Homo sapiens
cuuaaaaauuuguucacauuaca

SEQ ID NO: 2091710 - RNA, 15 nt, Homo sapiens
cauggacauguguac

SEQ ID NO: 2091711 - RNA, 17 nt, Homo sapiens
gaagcccccacuacuaa

SEQ ID NO: 2091712 - RNA, 14 nt, Homo sapiens
uaucaaaucauuca

SEQ ID NO: 2091713 - RNA, 14 nt, Homo sapiens
uaaauuggcuuauu

SEQ ID NO: 2091714 - RNA, 22 nt, Homo sapiens
caacauacacaccccggacucc

SEQ ID NO: 2091715 - RNA, 20 nt, Homo sapiens
ugcacuucaaauucaaauaa

SEQ ID NO: 2091716 - RNA, 16 nt, Homo sapiens
uuuucagacugcaaua

SEQ ID NO: 2091717 - RNA, 16 nt, Homo sapiens
gaccaaauugggagau

SEQ ID NO: 2091718 - RNA, 13 nt, Homo sapiens
uuuuauaugaugu

SEQ ID NO: 2091719 - RNA, 15 nt, Homo sapiens
guuuagaacagguuu

SEQ ID NO: 2091720 - RNA, 23 nt, Homo sapiens
uuguugaaagcugaaaagcauac

SEQ ID NO: 2091721 - RNA, 14 nt, Homo sapiens
gagugaggagccca

SEQ ID NO: 2091722 - RNA, 21 nt, Homo sapiens
cauggaacucauuccugccug

SEQ ID NO: 2091723 - RNA, 15 nt, Homo sapiens
uacuuccuacuguag

SEQ ID NO: 2091724 - RNA, 19 nt, Homo sapiens
uauauuugugauagcacuu

SEQ ID NO: 2091725 - RNA, 13 nt, Homo sapiens
accucuuugcuca

SEQ ID NO: 2091726 - RNA, 20 nt, Homo sapiens
aacauaauaccaccauuuaa

SEQ ID NO: 2091727 - RNA, 21 nt, Homo sapiens
uauuuugauauaauuguacug

SEQ ID NO: 2091728 - RNA, 20 nt, Homo sapiens
ccuccaggcccagcugagga

SEQ ID NO: 2091729 - RNA, 15 nt, Homo sapiens
aggucuugccugaau

SEQ ID NO: 2091730 - RNA, 17 nt, Homo sapiens
guagguaggauuacuuu

SEQ ID NO: 2091731 - RNA, 13 nt, Homo sapiens
cauccaguaucuu

SEQ ID NO: 2091732 - RNA, 20 nt, Homo sapiens
ucagcuaagggaagacauuu

SEQ ID NO: 2091733 - RNA, 19 nt, Homo sapiens
ggccaacauaauguuuuca

SEQ ID NO: 2091734 - RNA, 21 nt, Homo sapiens
augaucucuuaggaagccuuu

SEQ ID NO: 2091735 - RNA, 22 nt, Homo sapiens
uaaaugcucaucugguaacuca

SEQ ID NO: 2091736 - RNA, 19 nt, Homo sapiens
gcugcgugccaucacucaa

SEQ ID NO: 2091737 - RNA, 16 nt, Homo sapiens
cagcagggaugcccug

SEQ ID NO: 2091738 - RNA, 16 nt, Homo sapiens
aguuaucuggcuucaa

SEQ ID NO: 2091739 - RNA, 18 nt, Homo sapiens
aaauucucuccuaaugau

SEQ ID NO: 2091740 - RNA, 21 nt, Homo sapiens
ugccucacuggacuuguccaa

SEQ ID NO: 2091741 - RNA, 13 nt, Homo sapiens
caccuagucugua

SEQ ID NO: 2091742 - RNA, 13 nt, Homo sapiens
cagcaagucucuu

SEQ ID NO: 2091743 - RNA, 16 nt, Homo sapiens
auuuaagggugcaugu

SEQ ID NO: 2091744 - RNA, 19 nt, Homo sapiens
cugaccuuaggugauccac

SEQ ID NO: 2091745 - RNA, 20 nt, Homo sapiens
agccaguguggucaguauuc

SEQ ID NO: 2091746 - RNA, 14 nt, Homo sapiens
agcaaguuaagugu

SEQ ID NO: 2091747 - RNA, 14 nt, Homo sapiens
augcugcuugccuc

SEQ ID NO: 2091748 - RNA, 19 nt, Homo sapiens
auggugaaaccucaucucu

SEQ ID NO: 2091749 - RNA, 21 nt, Homo sapiens
agagugcaggugcaguuucau

SEQ ID NO: 2091750 - RNA, 17 nt, Homo sapiens
uccaacgccccuguggc

SEQ ID NO: 2091751 - RNA, 17 nt, Homo sapiens
cagcuucauaauuucca

SEQ ID NO: 2091752 - RNA, 21 nt, Homo sapiens
cuucauguaacuucccugaaa

SEQ ID NO: 2091753 - RNA, 19 nt, Homo sapiens
uguccuaaucauacaccag

SEQ ID NO: 2091754 - RNA, 17 nt, Homo sapiens
cauuagaaaccaugaaa

SEQ ID NO: 2091755 - RNA, 19 nt, Homo sapiens
gggaacacaggcccagaug

SEQ ID NO: 2091756 - RNA, 14 nt, Homo sapiens
uauucagacaagca

SEQ ID NO: 2091757 - RNA, 14 nt, Homo sapiens
acauggagauguaa

SEQ ID NO: 2091758 - RNA, 16 nt, Homo sapiens
caauguugugugcaug

SEQ ID NO: 2091759 - RNA, 17 nt, Homo sapiens
caaaaguauucaagaga

SEQ ID NO: 2091760 - RNA, 13 nt, Homo sapiens
gcgggaagggugg

SEQ ID NO: 2091761 - RNA, 13 nt, Homo sapiens
cucuuaauguuuc

SEQ ID NO: 2091762 - RNA, 17 nt, Homo sapiens
ugcacauuugguaaugu

SEQ ID NO: 2091763 - RNA, 15 nt, Homo sapiens
uggucauugugaaua

SEQ ID NO: 2091764 - RNA, 15 nt, Homo sapiens
aauaaauaugcucag

SEQ ID NO: 2091765 - RNA, 21 nt, Homo sapiens
uaccccuggcuguacugcuca

SEQ ID NO: 2091766 - RNA, 21 nt, Homo sapiens
agcuucuucaucuucaccaga

SEQ ID NO: 2091767 - RNA, 13 nt, Homo sapiens
cagggaugccauc

SEQ ID NO: 2091768 - RNA, 21 nt, Homo sapiens
ugguaauuguacuaaagccaa

SEQ ID NO: 2091769 - RNA, 18 nt, Homo sapiens
cuggaaaacucaggauuc

SEQ ID NO: 2091770 - RNA, 23 nt, Homo sapiens
ugaugauuucuuauuuguaaaau

SEQ ID NO: 2091771 - RNA, 17 nt, Homo sapiens
cuugaaguuacacauaa

SEQ ID NO: 2091772 - RNA, 12 nt, Homo sapiens
ccccuucauccg

SEQ ID NO: 2091773 - RNA, 13 nt, Homo sapiens
uccagcauguugc

SEQ ID NO: 2091774 - RNA, 14 nt, Homo sapiens
guccuaaaagcaaa

SEQ ID NO: 2091775 - RNA, 17 nt, Homo sapiens
ugaaagauucagugacg

SEQ ID NO: 2091776 - RNA, 18 nt, Homo sapiens
auacuaaggaaccaacaa

SEQ ID NO: 2091777 - RNA, 15 nt, Homo sapiens
ucgaggggcucucag

SEQ ID NO: 2091778 - RNA, 13 nt, Homo sapiens
acauauauaccac

SEQ ID NO: 2091779 - RNA, 23 nt, Homo sapiens
uccacguaucuuuccuaggcaga

SEQ ID NO: 2091780 - RNA, 13 nt, Homo sapiens
ucugauguggaau

SEQ ID NO: 2091781 - RNA, 15 nt, Homo sapiens
gcucuuuguagcuaa

SEQ ID NO: 2091782 - RNA, 18 nt, Homo sapiens
aggcauuugcaggguccu

SEQ ID NO: 2091783 - RNA, 12 nt, Homo sapiens
gcuuacauugaa

SEQ ID NO: 2091784 - RNA, 21 nt, Homo sapiens
aacugcucauuucaugaagca

SEQ ID NO: 2091785 - RNA, 18 nt, Homo sapiens
cugaccucccagccuuuc

SEQ ID NO: 2091786 - RNA, 20 nt, Homo sapiens
cucccaaagugcugagauua

SEQ ID NO: 2091787 - RNA, 20 nt, Homo sapiens
cugugagaauaaagcauuuc

SEQ ID NO: 2091788 - RNA, 15 nt, Homo sapiens
cccagcccugcugca

SEQ ID NO: 2091789 - RNA, 12 nt, Homo sapiens
aagaagguuuac

SEQ ID NO: 2091790 - RNA, 16 nt, Homo sapiens
cuaacuguacauuuca

SEQ ID NO: 2091791 - RNA, 23 nt, Homo sapiens
cuguauuuguaucucugaagcau

SEQ ID NO: 2091792 - RNA, 16 nt, Homo sapiens
agaaauuuaaucagug

SEQ ID NO: 2091793 - RNA, 17 nt, Homo sapiens
ucccucaaagcacacgu

SEQ ID NO: 2091794 - RNA, 16 nt, Homo sapiens
gcuggacugaccaaag

SEQ ID NO: 2091795 - RNA, 22 nt, Homo sapiens
caauauuuuuauaucaugcaaa

SEQ ID NO: 2091796 - RNA, 16 nt, Homo sapiens
ugcgaugggggucacc

SEQ ID NO: 2091797 - RNA, 14 nt, Homo sapiens
ugcuuaaaauagca

SEQ ID NO: 2091798 - RNA, 14 nt, Homo sapiens
accagacuuuucuc

SEQ ID NO: 2091799 - RNA, 21 nt, Homo sapiens
gcuugagaauccucuccuuuc

SEQ ID NO: 2091800 - RNA, 21 nt, Homo sapiens
ucauucucagugggacucuga

SEQ ID NO: 2091801 - RNA, 16 nt, Homo sapiens
caaauguuuacuguau

SEQ ID NO: 2091802 - RNA, 19 nt, Homo sapiens
agauuacuuuucuuacucu

SEQ ID NO: 2091803 - RNA, 11 nt, Homo sapiens
ugcacauugua

SEQ ID NO: 2091804 - RNA, 17 nt, Homo sapiens
ccuuacagaggaccaug

SEQ ID NO: 2091805 - RNA, 21 nt, Homo sapiens
acccgguuaccuuggccguga

SEQ ID NO: 2091806 - RNA, 17 nt, Homo sapiens
ggacacucgggcccaug

SEQ ID NO: 2091807 - RNA, 17 nt, Homo sapiens
caguuaguauagcuuua

SEQ ID NO: 2091808 - RNA, 22 nt, Homo sapiens
ugccuaaaauauauuccugaga

SEQ ID NO: 2091809 - RNA, 22 nt, Homo sapiens
uaucuucccuuuauuacaagaa

SEQ ID NO: 2091810 - RNA, 19 nt, Homo sapiens
acuuccucgagaccauaca

SEQ ID NO: 2091811 - RNA, 18 nt, Homo sapiens
gccuuccgacaccacugg

SEQ ID NO: 2091812 - RNA, 23 nt, Homo sapiens
gauguuaagcaaaggaaaccaaa

SEQ ID NO: 2091813 - RNA, 16 nt, Homo sapiens
uaguuuuaaguauguc

SEQ ID NO: 2091814 - RNA, 14 nt, Homo sapiens
ucccaugaacuaua

SEQ ID NO: 2091815 - RNA, 16 nt, Homo sapiens
aggugucauaugacug

SEQ ID NO: 2091816 - RNA, 20 nt, Homo sapiens
gguaugucugugccauuucu

SEQ ID NO: 2091817 - RNA, 15 nt, Homo sapiens
aguucauucaugcca

SEQ ID NO: 2091818 - RNA, 17 nt, Homo sapiens
agauugugucccauucc

SEQ ID NO: 2091819 - RNA, 14 nt, Homo sapiens
cccuuguaaugcca

SEQ ID NO: 2091820 - RNA, 18 nt, Homo sapiens
uaucaaagaaagaugaaa

SEQ ID NO: 2091821 - RNA, 21 nt, Homo sapiens
aucacgacagauuuaaccucu

SEQ ID NO: 2091822 - RNA, 18 nt, Homo sapiens
uucaugugcugccugcaa

SEQ ID NO: 2091823 - RNA, 13 nt, Homo sapiens
gaaacagcuucau

SEQ ID NO: 2091824 - RNA, 20 nt, Homo sapiens
caaauaagaagggauggauu

SEQ ID NO: 2091825 - RNA, 23 nt, Homo sapiens
auuuugagauggagucuugcucu

SEQ ID NO: 2091826 - RNA, 23 nt, Homo sapiens
augguuuuaaugcaaugagcaau

SEQ ID NO: 2091827 - RNA, 16 nt, Homo sapiens
auccagggcugccagg

SEQ ID NO: 2091828 - RNA, 16 nt, Homo sapiens
augccauucuccaguu

SEQ ID NO: 2091829 - RNA, 21 nt, Homo sapiens
cuaagggggugaccaugcaau

SEQ ID NO: 2091830 - RNA, 22 nt, Homo sapiens
gauccuuauuuaaagcuuucaa

SEQ ID NO: 2091831 - RNA, 17 nt, Homo sapiens
acagcucaccacugugc

SEQ ID NO: 2091832 - RNA, 15 nt, Homo sapiens
uggccgggagccuga

SEQ ID NO: 2091833 - RNA, 15 nt, Homo sapiens
cuuuguauguauuuc

SEQ ID NO: 2091834 - RNA, 18 nt, Homo sapiens
uuacagacaugagccucc

SEQ ID NO: 2091835 - RNA, 21 nt, Homo sapiens
uaucaucacauugagcugaua

SEQ ID NO: 2091836 - RNA, 19 nt, Homo sapiens
acucugguauggccaaaga

SEQ ID NO: 2091837 - RNA, 15 nt, Homo sapiens
gaggagugccagcuc

SEQ ID NO: 2091838 - RNA, 22 nt, Homo sapiens
aguccagcuccuuaaacugacg

SEQ ID NO: 2091839 - RNA, 12 nt, Homo sapiens
gcacacuggccu

SEQ ID NO: 2091840 - RNA, 12 nt, Homo sapiens
uaccacuguaau

SEQ ID NO: 2091841 - RNA, 17 nt, Homo sapiens
aaguacaguaacaaucu

SEQ ID NO: 2091842 - RNA, 18 nt, Homo sapiens
cugaaggcuaaaaagcaa

SEQ ID NO: 2091843 - RNA, 20 nt, Homo sapiens
uagaaagugaggcucagauu

SEQ ID NO: 2091844 - RNA, 22 nt, Homo sapiens
guguccaugugcacccggccug

SEQ ID NO: 2091845 - RNA, 15 nt, Homo sapiens
uguauacauacaugu

SEQ ID NO: 2091846 - RNA, 21 nt, Homo sapiens
ugacaucauucagcgcaugca

SEQ ID NO: 2091847 - RNA, 14 nt, Homo sapiens
uuuccucuauugau

SEQ ID NO: 2091848 - RNA, 14 nt, Homo sapiens
aaauagccccagac

SEQ ID NO: 2091849 - RNA, 15 nt, Homo sapiens
auugagaacugcaua

SEQ ID NO: 2091850 - RNA, 16 nt, Homo sapiens
aauuucuaccuagaaa

SEQ ID NO: 2091851 - RNA, 15 nt, Homo sapiens
caaggaagaccggcu

SEQ ID NO: 2091852 - RNA, 19 nt, Homo sapiens
agcccaagggcaucauccu

SEQ ID NO: 2091853 - RNA, 23 nt, Homo sapiens
ccuuccucaagauccugucuugc

SEQ ID NO: 2091854 - RNA, 17 nt, Homo sapiens
acucauuugaaugcuua

SEQ ID NO: 2091855 - RNA, 14 nt, Homo sapiens
ucacgaaugauuaa

SEQ ID NO: 2091856 - RNA, 19 nt, Homo sapiens
caccaugauggccaggcug

SEQ ID NO: 2091857 - RNA, 18 nt, Homo sapiens
gccacacguuugccaaau

SEQ ID NO: 2091858 - RNA, 23 nt, Homo sapiens
cugacaagagaggcgucugcugu

SEQ ID NO: 2091859 - RNA, 22 nt, Homo sapiens
cguggaucucccccucauccaa

SEQ ID NO: 2091860 - RNA, 15 nt, Homo sapiens
uaggcauacacugua

SEQ ID NO: 2091861 - RNA, 18 nt, Homo sapiens
cccgagcuguuaccauuc

SEQ ID NO: 2091862 - RNA, 11 nt, Homo sapiens
acauuuugcca

SEQ ID NO: 2091863 - RNA, 11 nt, Homo sapiens
auauuuugcua

SEQ ID NO: 2091864 - RNA, 16 nt, Homo sapiens
ccauuuugaugguguc

SEQ ID NO: 2091865 - RNA, 22 nt, Homo sapiens
uucagcaagcuagaacuggaag

SEQ ID NO: 2091866 - RNA, 18 nt, Homo sapiens
aguucauaauucaccaaa

SEQ ID NO: 2091867 - RNA, 17 nt, Homo sapiens
cguucccaccucugagg

SEQ ID NO: 2091868 - RNA, 14 nt, Homo sapiens
ggccaucuucuuuc

SEQ ID NO: 2091869 - RNA, 14 nt, Homo sapiens
ucucaauauauuca

SEQ ID NO: 2091870 - RNA, 16 nt, Homo sapiens
ucaccagaaccaguua

SEQ ID NO: 2091871 - RNA, 21 nt, Homo sapiens
uuccaugggauguuaagcaaa

SEQ ID NO: 2091872 - RNA, 16 nt, Homo sapiens
uccugaagcugcuuaa

SEQ ID NO: 2091873 - RNA, 13 nt, Homo sapiens
aacauguacaaaa

SEQ ID NO: 2091874 - RNA, 17 nt, Homo sapiens
cagacugaugagcacau

SEQ ID NO: 2091875 - RNA, 18 nt, Homo sapiens
uguuugacacaauuggaa

SEQ ID NO: 2091876 - RNA, 17 nt, Homo sapiens
cauaaaguaugugcaua

SEQ ID NO: 2091877 - RNA, 14 nt, Homo sapiens
uuguuauuuacacu

SEQ ID NO: 2091878 - RNA, 16 nt, Homo sapiens
uccagucccaugaccu

SEQ ID NO: 2091879 - RNA, 19 nt, Homo sapiens
cugacagccacaccguggc

SEQ ID NO: 2091880 - RNA, 14 nt, Homo sapiens
aauuugcugccaaa

SEQ ID NO: 2091881 - RNA, 22 nt, Homo sapiens
ccaagcaaccuggguccaaaua

SEQ ID NO: 2091882 - RNA, 14 nt, Homo sapiens
uccagaggaauuga

SEQ ID NO: 2091883 - RNA, 13 nt, Homo sapiens
cagauaccuccaa

SEQ ID NO: 2091884 - RNA, 18 nt, Homo sapiens
uuuucuuauuuaacuuaa

SEQ ID NO: 2091885 - RNA, 22 nt, Homo sapiens
aaaccuucaucauuuugugauu

SEQ ID NO: 2091886 - RNA, 18 nt, Homo sapiens
caucugcuccuguucaca

SEQ ID NO: 2091887 - RNA, 12 nt, Homo sapiens
aggagaccucca

SEQ ID NO: 2091888 - RNA, 19 nt, Homo sapiens
uggagggaaugcucagaaa

SEQ ID NO: 2091889 - RNA, 15 nt, Homo sapiens
ccagcccauugcugc

SEQ ID NO: 2091890 - RNA, 22 nt, Homo sapiens
aaaguuaaacuuuaucucacag

SEQ ID NO: 2091891 - RNA, 20 nt, Homo sapiens
accacugcccuggagguggc

SEQ ID NO: 2091892 - RNA, 18 nt, Homo sapiens
gcagguacuuccucaguc

SEQ ID NO: 2091893 - RNA, 14 nt, Homo sapiens
ucuaagaacuucau

SEQ ID NO: 2091894 - RNA, 13 nt, Homo sapiens
uuaaaauguaauu

SEQ ID NO: 2091895 - RNA, 17 nt, Homo sapiens
cagucaaaggcauuuug

SEQ ID NO: 2091896 - RNA, 13 nt, Homo sapiens
cauuaaagagcca

SEQ ID NO: 2091897 - RNA, 22 nt, Homo sapiens
uaaaagaaggaacauugcagag

SEQ ID NO: 2091898 - RNA, 17 nt, Homo sapiens
uggauaugggcuggaua

SEQ ID NO: 2091899 - RNA, 13 nt, Homo sapiens
uugaaccauguau

SEQ ID NO: 2091900 - RNA, 16 nt, Homo sapiens
aaaccacccugagggu

SEQ ID NO: 2091901 - RNA, 21 nt, Homo sapiens
ccuuuccuguucaugacagcu

SEQ ID NO: 2091902 - RNA, 16 nt, Homo sapiens
accuaaccacuuagca

SEQ ID NO: 2091903 - RNA, 12 nt, Homo sapiens
auuucuuucauc

SEQ ID NO: 2091904 - RNA, 18 nt, Homo sapiens
ucucccacagggugcugg

SEQ ID NO: 2091905 - RNA, 19 nt, Homo sapiens
gcuucucugugacugaugu

SEQ ID NO: 2091906 - RNA, 16 nt, Homo sapiens
uuuaaaccagcagaaa

SEQ ID NO: 2091907 - RNA, 22 nt, Homo sapiens
aggaaacuggguuccugcaaug

SEQ ID NO: 2091908 - RNA, 15 nt, Homo sapiens
cauccgcuccgugac

SEQ ID NO: 2091909 - RNA, 16 nt, Homo sapiens
augcagcagauguuga

SEQ ID NO: 2091910 - RNA, 22 nt, Homo sapiens
cacuuccuugcccccauuucac

SEQ ID NO: 2091911 - RNA, 15 nt, Homo sapiens
cggccuuuguugcuc

SEQ ID NO: 2091912 - RNA, 15 nt, Homo sapiens
agauaugaguucuuc

SEQ ID NO: 2091913 - RNA, 14 nt, Homo sapiens
cuaauaucuuuaaa

SEQ ID NO: 2091914 - RNA, 16 nt, Homo sapiens
cagacucaaagggaaa

SEQ ID NO: 2091915 - RNA, 18 nt, Homo sapiens
accgggcucacuugcuca

SEQ ID NO: 2091916 - RNA, 20 nt, Homo sapiens
agagaauauuucaaaugaac

SEQ ID NO: 2091917 - RNA, 18 nt, Homo sapiens
cagagacuuuagucuuug

SEQ ID NO: 2091918 - RNA, 16 nt, Homo sapiens
ugaaggagaaggugcc

SEQ ID NO: 2091919 - RNA, 23 nt, Homo sapiens
cagggaauggagcucagguccca

SEQ ID NO: 2091920 - RNA, 23 nt, Homo sapiens
cugccucucuuucacacaaugcc

SEQ ID NO: 2091921 - RNA, 22 nt, Homo sapiens
gaucugucugugcacaugccuc

SEQ ID NO: 2091922 - RNA, 12 nt, Homo sapiens
auuucagauauc

SEQ ID NO: 2091923 - RNA, 21 nt, Homo sapiens
uagguccagaaguccuuaugu

SEQ ID NO: 2091924 - RNA, 14 nt, Homo sapiens
gccaauuagggggu

SEQ ID NO: 2091925 - RNA, 21 nt, Homo sapiens
guccuacaacagccugaauca

SEQ ID NO: 2091926 - RNA, 21 nt, Homo sapiens
cuagcugggcacaguggcuca

SEQ ID NO: 2091927 - RNA, 16 nt, Homo sapiens
aaugaauaaacugaau

SEQ ID NO: 2091928 - RNA, 18 nt, Homo sapiens
ggagcucuucugugcccu

SEQ ID NO: 2091929 - RNA, 17 nt, Homo sapiens
gcuucccccacauuggg

SEQ ID NO: 2091930 - RNA, 23 nt, Homo sapiens
uggaaagugauuuguaauaugau

SEQ ID NO: 2091931 - RNA, 20 nt, Homo sapiens
uaaccaaauaaaacauaaua

SEQ ID NO: 2091932 - RNA, 22 nt, Homo sapiens
augucuccaucucugucucaaa

SEQ ID NO: 2091933 - RNA, 21 nt, Homo sapiens
ccaguguguguuuaacauuca

SEQ ID NO: 2091934 - RNA, 18 nt, Homo sapiens
ccuguaguugacaauucu

SEQ ID NO: 2091935 - RNA, 14 nt, Homo sapiens
ccuccuggguucaa

SEQ ID NO: 2091936 - RNA, 16 nt, Homo sapiens
uugaguagccagauga

SEQ ID NO: 2091937 - RNA, 21 nt, Homo sapiens
gagcggcgcccuggacuuggu

SEQ ID NO: 2091938 - RNA, 22 nt, Homo sapiens
agaaauugcauuuccugacaga

SEQ ID NO: 2091939 - RNA, 13 nt, Homo sapiens
uugcuguugucca

SEQ ID NO: 2091940 - RNA, 15 nt, Homo sapiens
uaaagucucagguga

SEQ ID NO: 2091941 - RNA, 12 nt, Homo sapiens
ugucuuccauaa

SEQ ID NO: 2091942 - RNA, 17 nt, Homo sapiens
cucagccccuuucccuu

SEQ ID NO: 2091943 - RNA, 19 nt, Homo sapiens
gacagcaaagauccacuuu

SEQ ID NO: 2091944 - RNA, 15 nt, Homo sapiens
cugcuaacaagucac

SEQ ID NO: 2091945 - RNA, 15 nt, Homo sapiens
augaagaagacaccu

SEQ ID NO: 2091946 - RNA, 19 nt, Homo sapiens
uaagccucaaauuugaaca

SEQ ID NO: 2091947 - RNA, 13 nt, Homo sapiens
uaaaugacuuaga

SEQ ID NO: 2091948 - RNA, 12 nt, Homo sapiens
aguucuguagaa

SEQ ID NO: 2091949 - RNA, 12 nt, Homo sapiens
gcuucugugcaa

SEQ ID NO: 2091950 - RNA, 17 nt, Homo sapiens
ugauucugaaucugaaa

SEQ ID NO: 2091951 - RNA, 24 nt, Homo sapiens
ucccggaagcucacagugacauua

SEQ ID NO: 2091952 - RNA, 13 nt, Homo sapiens
caucccuaccacu

SEQ ID NO: 2091953 - RNA, 18 nt, Homo sapiens
auucccuuuugcugccuc

SEQ ID NO: 2091954 - RNA, 15 nt, Homo sapiens
uaaauaaaacugaau

SEQ ID NO: 2091955 - RNA, 15 nt, Homo sapiens
cacgcucaucuugca

SEQ ID NO: 2091956 - RNA, 15 nt, Homo sapiens
acagugacaccugca

SEQ ID NO: 2091957 - RNA, 17 nt, Homo sapiens
acucagucuagugaaga

SEQ ID NO: 2091958 - RNA, 11 nt, Homo sapiens
agaaagcaagg

SEQ ID NO: 2091959 - RNA, 16 nt, Homo sapiens
cagcucccagcccacu

SEQ ID NO: 2091960 - RNA, 20 nt, Homo sapiens
uugaagggcaagaaauggcg

SEQ ID NO: 2091961 - RNA, 18 nt, Homo sapiens
aggagauggaauaucaau

SEQ ID NO: 2091962 - RNA, 23 nt, Homo sapiens
ccucccuggggaccaggagcuag

SEQ ID NO: 2091963 - RNA, 14 nt, Homo sapiens
caggagcagcauca

SEQ ID NO: 2091964 - RNA, 19 nt, Homo sapiens
ccccucagagaaugaucac

SEQ ID NO: 2091965 - RNA, 19 nt, Homo sapiens
ugccccagagccugggaag

SEQ ID NO: 2091966 - RNA, 16 nt, Homo sapiens
gcauuugcugcauuuc

SEQ ID NO: 2091967 - RNA, 19 nt, Homo sapiens
agaagacacugaugggcaa

SEQ ID NO: 2091968 - RNA, 15 nt, Homo sapiens
cgagaugagcccaca

SEQ ID NO: 2091969 - RNA, 16 nt, Homo sapiens
caucugcuacaagaac

SEQ ID NO: 2091970 - RNA, 20 nt, Homo sapiens
auauguuuaucaacucaaga

SEQ ID NO: 2091971 - RNA, 14 nt, Homo sapiens
uaauaacuacuucc

SEQ ID NO: 2091972 - RNA, 14 nt, Homo sapiens
uggugagacugucc

SEQ ID NO: 2091973 - RNA, 15 nt, Homo sapiens
gucucuauacuacau

SEQ ID NO: 2091974 - RNA, 15 nt, Homo sapiens
ugauuccaaaccaac

SEQ ID NO: 2091975 - RNA, 17 nt, Homo sapiens
uaauaucagugaacaca

SEQ ID NO: 2091976 - RNA, 11 nt, Homo sapiens
agccauaccag

SEQ ID NO: 2091977 - RNA, 13 nt, Homo sapiens
uaaauuguuguaa

SEQ ID NO: 2091978 - RNA, 13 nt, Homo sapiens
gaggcagugacag

SEQ ID NO: 2091979 - RNA, 18 nt, Homo sapiens
cccgaugcugcuauggaa

SEQ ID NO: 2091980 - RNA, 15 nt, Homo sapiens
agggacagagcauug

SEQ ID NO: 2091981 - RNA, 16 nt, Homo sapiens
acagagucucacucuc

SEQ ID NO: 2091982 - RNA, 21 nt, Homo sapiens
caaaauaaugcaccacuuuua

SEQ ID NO: 2091983 - RNA, 15 nt, Homo sapiens
aaucauuuuaaauuc

SEQ ID NO: 2091984 - RNA, 15 nt, Homo sapiens
ggcagggcugugcuu

SEQ ID NO: 2091985 - RNA, 12 nt, Homo sapiens
uaggaacaagca

SEQ ID NO: 2091986 - RNA, 23 nt, Homo sapiens
caguucugcacccagccaaacac

SEQ ID NO: 2091987 - RNA, 12 nt, Homo sapiens
uuuuuacauuga

SEQ ID NO: 2091988 - RNA, 15 nt, Homo sapiens
gaagaaugagcaaga

SEQ ID NO: 2091989 - RNA, 13 nt, Homo sapiens
ugcuuacuuugca

SEQ ID NO: 2091990 - RNA, 22 nt, Homo sapiens
uauaauauuuguguguucacua

SEQ ID NO: 2091991 - RNA, 21 nt, Homo sapiens
gggcuaaaaagguccuguaag

SEQ ID NO: 2091992 - RNA, 18 nt, Homo sapiens
ggagauaaaauaaaaaga

SEQ ID NO: 2091993 - RNA, 15 nt, Homo sapiens
aagguuuucaaggug

SEQ ID NO: 2091994 - RNA, 20 nt, Homo sapiens
uacauacgcaauuguauaua

SEQ ID NO: 2091995 - RNA, 23 nt, Homo sapiens
ucuugcacuggccuucugaugaa

SEQ ID NO: 2091996 - RNA, 14 nt, Homo sapiens
aaugcuuauggaaa

SEQ ID NO: 2091997 - RNA, 19 nt, Homo sapiens
gcaaauaucauacuguuca

SEQ ID NO: 2091998 - RNA, 16 nt, Homo sapiens
uuuucuucuugggaua

SEQ ID NO: 2091999 - RNA, 22 nt, Homo sapiens
cauugaagaauguuagaguaau

SEQ ID NO: 2092000 - RNA, 22 nt, Homo sapiens
agaaauaggaccuuccacacag

SEQ ID NO: 2092001 - RNA, 12 nt, Homo sapiens
aaguaagcccuu

SEQ ID NO: 2092002 - RNA, 22 nt, Homo sapiens
aucuaaaccauaugaacauaua

SEQ ID NO: 2092003 - RNA, 17 nt, Homo sapiens
ggacuggaaccagggag

SEQ ID NO: 2092004 - RNA, 18 nt, Homo sapiens
uuuguaagugcugcuaua

SEQ ID NO: 2092005 - RNA, 18 nt, Homo sapiens
ccugggaucuggugguca

SEQ ID NO: 2092006 - RNA, 19 nt, Homo sapiens
cugaaauuaguguuuucau

SEQ ID NO: 2092007 - RNA, 13 nt, Homo sapiens
cacgucugcuaac

SEQ ID NO: 2092008 - RNA, 16 nt, Homo sapiens
aucuggggauggagaa

SEQ ID NO: 2092009 - RNA, 18 nt, Homo sapiens
agucaccauucugcauuu

SEQ ID NO: 2092010 - RNA, 18 nt, Homo sapiens
gcaaaaggauauucacuu

SEQ ID NO: 2092011 - RNA, 14 nt, Homo sapiens
guccccuuccuucc

SEQ ID NO: 2092012 - RNA, 12 nt, Homo sapiens
cuggccuggucc

SEQ ID NO: 2092013 - RNA, 16 nt, Homo sapiens
gaaauaaauaacuuug

SEQ ID NO: 2092014 - RNA, 16 nt, Homo sapiens
gaucuaagcaguugca

SEQ ID NO: 2092015 - RNA, 17 nt, Homo sapiens
ucuuguuauguacaaac

SEQ ID NO: 2092016 - RNA, 20 nt, Homo sapiens
cagggcuugcuccugccaac

SEQ ID NO: 2092017 - RNA, 13 nt, Homo sapiens
ugaauuuguccaa

SEQ ID NO: 2092018 - RNA, 14 nt, Homo sapiens
uucacuaaugacga

SEQ ID NO: 2092019 - RNA, 17 nt, Homo sapiens
uucacuccacuuggaca

SEQ ID NO: 2092020 - RNA, 18 nt, Homo sapiens
cagagaugaaacuauggc

SEQ ID NO: 2092021 - RNA, 19 nt, Homo sapiens
agagugcaacccagucaca

SEQ ID NO: 2092022 - RNA, 17 nt, Homo sapiens
gcccgagggauggugcc

SEQ ID NO: 2092023 - RNA, 14 nt, Homo sapiens
gcagcucaucucug

SEQ ID NO: 2092024 - RNA, 20 nt, Homo sapiens
ugguucccaauaucauguga

SEQ ID NO: 2092025 - RNA, 14 nt, Homo sapiens
uucaccucuaucca

SEQ ID NO: 2092026 - RNA, 23 nt, Homo sapiens
uauacaagcuuuuaguauccaca

SEQ ID NO: 2092027 - RNA, 13 nt, Homo sapiens
caaugugcacuga

SEQ ID NO: 2092028 - RNA, 13 nt, Homo sapiens
ccaggugcaauua

SEQ ID NO: 2092029 - RNA, 21 nt, Homo sapiens
uuuaaaacuuuuaggaccaua

SEQ ID NO: 2092030 - RNA, 15 nt, Homo sapiens
gauuugugcugugua

SEQ ID NO: 2092031 - RNA, 15 nt, Homo sapiens
auuacccaaacccau

SEQ ID NO: 2092032 - RNA, 20 nt, Homo sapiens
gaaaauuauugaguaugagu

SEQ ID NO: 2092033 - RNA, 17 nt, Homo sapiens
uauggcuuuugugcauu

SEQ ID NO: 2092034 - RNA, 13 nt, Homo sapiens
augaaagaggcau

SEQ ID NO: 2092035 - RNA, 15 nt, Homo sapiens
cacucugugggucug

SEQ ID NO: 2092036 - RNA, 15 nt, Homo sapiens
gggcagaucaccaga

SEQ ID NO: 2092037 - RNA, 13 nt, Homo sapiens
aaggagauuuaca

SEQ ID NO: 2092038 - RNA, 23 nt, Homo sapiens
aucccuggggcugugcauuccca

SEQ ID NO: 2092039 - RNA, 22 nt, Homo sapiens
caaaugauuuacacugacuguu

SEQ ID NO: 2092040 - RNA, 15 nt, Homo sapiens
agcccggcagggaag

SEQ ID NO: 2092041 - RNA, 15 nt, Homo sapiens
ucuuaaugugcagca

SEQ ID NO: 2092042 - RNA, 16 nt, Homo sapiens
agagagggucacuggg

SEQ ID NO: 2092043 - RNA, 16 nt, Homo sapiens
acacacucugagucuc

SEQ ID NO: 2092044 - RNA, 19 nt, Homo sapiens
agcauauuuuaaugcaguu

SEQ ID NO: 2092045 - RNA, 22 nt, Homo sapiens
uugcaaccucgcuggacucuca

SEQ ID NO: 2092046 - RNA, 22 nt, Homo sapiens
aaaacacacacaaagcacauug

SEQ ID NO: 2092047 - RNA, 19 nt, Homo sapiens
cugccagaagauccccuca

SEQ ID NO: 2092048 - RNA, 17 nt, Homo sapiens
uagcaacacaucuacca

SEQ ID NO: 2092049 - RNA, 15 nt, Homo sapiens
gguaaaaguuacuua

SEQ ID NO: 2092050 - RNA, 12 nt, Homo sapiens
caccgacugccc

SEQ ID NO: 2092051 - RNA, 23 nt, Homo sapiens
acugcagggguccacugugagag

SEQ ID NO: 2092052 - RNA, 23 nt, Homo sapiens
caaaaguagccaucauuccuuua

SEQ ID NO: 2092053 - RNA, 17 nt, Homo sapiens
ucuucugugugaccaug

SEQ ID NO: 2092054 - RNA, 14 nt, Homo sapiens
gaggugugccagaa

SEQ ID NO: 2092055 - RNA, 17 nt, Homo sapiens
aagugagggcucacuca

SEQ ID NO: 2092056 - RNA, 13 nt, Homo sapiens
cuaccacaguguc

SEQ ID NO: 2092057 - RNA, 19 nt, Homo sapiens
gccgucccgccugcagagg

SEQ ID NO: 2092058 - RNA, 18 nt, Homo sapiens
aauguacaguugagcuca

SEQ ID NO: 2092059 - RNA, 15 nt, Homo sapiens
gcauuagaaauaagu

SEQ ID NO: 2092060 - RNA, 23 nt, Homo sapiens
gcuccuguguucuagaccucugg

SEQ ID NO: 2092061 - RNA, 15 nt, Homo sapiens
ugacuauucuugaug

SEQ ID NO: 2092062 - RNA, 12 nt, Homo sapiens
cccugcuugcac

SEQ ID NO: 2092063 - RNA, 21 nt, Homo sapiens
cucaggccacaucuuuuccaa

SEQ ID NO: 2092064 - RNA, 23 nt, Homo sapiens
aggaugaggugguggaguggagu

SEQ ID NO: 2092065 - RNA, 23 nt, Homo sapiens
uccuuuuucugauuagcuuugug

SEQ ID NO: 2092066 - RNA, 11 nt, Homo sapiens
agagggacaac

SEQ ID NO: 2092067 - RNA, 21 nt, Homo sapiens
cacccugggcuuccugagcca

SEQ ID NO: 2092068 - RNA, 18 nt, Homo sapiens
aaggaguaaucuguguac

SEQ ID NO: 2092069 - RNA, 23 nt, Homo sapiens
uccucaugaaagcagcacacauu

SEQ ID NO: 2092070 - RNA, 13 nt, Homo sapiens
cccaccggugcca

SEQ ID NO: 2092071 - RNA, 23 nt, Homo sapiens
ggugugacuugauaaugauuucc

SEQ ID NO: 2092072 - RNA, 15 nt, Homo sapiens
auguauagcuuaaga

SEQ ID NO: 2092073 - RNA, 19 nt, Homo sapiens
ucacccagacuggagugca

SEQ ID NO: 2092074 - RNA, 19 nt, Homo sapiens
ucacccaggcuggaguaca

SEQ ID NO: 2092075 - RNA, 14 nt, Homo sapiens
gucugucugcacug

SEQ ID NO: 2092076 - RNA, 19 nt, Homo sapiens
auuguguugugcagcauua

SEQ ID NO: 2092077 - RNA, 13 nt, Homo sapiens
uuauugcaguuua

SEQ ID NO: 2092078 - RNA, 23 nt, Homo sapiens
uagcucaccaggccuggccucug

SEQ ID NO: 2092079 - RNA, 16 nt, Homo sapiens
uaauuccuucuaccuu

SEQ ID NO: 2092080 - RNA, 19 nt, Homo sapiens
ucugcaccaacucaccugg

SEQ ID NO: 2092081 - RNA, 20 nt, Homo sapiens
cauaaacacuucuccuuaac

SEQ ID NO: 2092082 - RNA, 17 nt, Homo sapiens
auauuguauaggggcaa

SEQ ID NO: 2092083 - RNA, 12 nt, Homo sapiens
acagaagguccu

SEQ ID NO: 2092084 - RNA, 17 nt, Homo sapiens
ucuugcaauucaauaca

SEQ ID NO: 2092085 - RNA, 17 nt, Homo sapiens
ucccacaaucugggacu

SEQ ID NO: 2092086 - RNA, 21 nt, Homo sapiens
ggagugaagugguacaaucug

SEQ ID NO: 2092087 - RNA, 12 nt, Homo sapiens
agagagggacuc

SEQ ID NO: 2092088 - RNA, 13 nt, Homo sapiens
aggucaccaaaca

SEQ ID NO: 2092089 - RNA, 21 nt, Homo sapiens
acuuagguaaucauuccaggu

SEQ ID NO: 2092090 - RNA, 21 nt, Homo sapiens
gcaggaacuugcacaaaauca

SEQ ID NO: 2092091 - RNA, 14 nt, Homo sapiens
uuuuuguaacugga

SEQ ID NO: 2092092 - RNA, 15 nt, Homo sapiens
guuugacucaucuua

SEQ ID NO: 2092093 - RNA, 16 nt, Homo sapiens
uuuccucucucacaaa

SEQ ID NO: 2092094 - RNA, 18 nt, Homo sapiens
caaggcuggguaauguga

SEQ ID NO: 2092095 - RNA, 21 nt, Homo sapiens
uguuucuugucccucuguaua

SEQ ID NO: 2092096 - RNA, 16 nt, Homo sapiens
aauaaaaugcauuuaa

SEQ ID NO: 2092097 - RNA, 18 nt, Homo sapiens
ucuacucuuaagccaucu

SEQ ID NO: 2092098 - RNA, 15 nt, Homo sapiens
cugcccuugcagggu

SEQ ID NO: 2092099 - RNA, 20 nt, Homo sapiens
auuuacauaaagacugugcu

SEQ ID NO: 2092100 - RNA, 14 nt, Homo sapiens
cucagcuucuuaau

SEQ ID NO: 2092101 - RNA, 14 nt, Homo sapiens
ccuguucaccuggg

SEQ ID NO: 2092102 - RNA, 14 nt, Homo sapiens
gcugggcagcuguu

SEQ ID NO: 2092103 - RNA, 14 nt, Homo sapiens
guguggcaguguuu

SEQ ID NO: 2092104 - RNA, 16 nt, Homo sapiens
cccauuugaggggugg

SEQ ID NO: 2092105 - RNA, 12 nt, Homo sapiens
ggugucaugcca

SEQ ID NO: 2092106 - RNA, 18 nt, Homo sapiens
uuaaaugaaagaauaucu

SEQ ID NO: 2092107 - RNA, 17 nt, Homo sapiens
gucuggaaaagcacuuu

SEQ ID NO: 2092108 - RNA, 13 nt, Homo sapiens
gugauguacugua

SEQ ID NO: 2092109 - RNA, 19 nt, Homo sapiens
uaggcaaggaugaaagaca

SEQ ID NO: 2092110 - RNA, 15 nt, Homo sapiens
cuccaucacugagag

SEQ ID NO: 2092111 - RNA, 16 nt, Homo sapiens
cuugugagaacacagc

SEQ ID NO: 2092112 - RNA, 16 nt, Homo sapiens
ccagauucuaccacac

SEQ ID NO: 2092113 - RNA, 18 nt, Homo sapiens
aaaucugcagcacauuga

SEQ ID NO: 2092114 - RNA, 16 nt, Homo sapiens
gaagaccugcugaggg

SEQ ID NO: 2092115 - RNA, 15 nt, Homo sapiens
augugcacccggccu

SEQ ID NO: 2092116 - RNA, 13 nt, Homo sapiens
ucucaaggaucca

SEQ ID NO: 2092117 - RNA, 18 nt, Homo sapiens
ggucccgaauggagucca

SEQ ID NO: 2092118 - RNA, 18 nt, Homo sapiens
ucacaacacaaucaaaag

SEQ ID NO: 2092119 - RNA, 22 nt, Homo sapiens
ccucaaaguuggggcaggcugg

SEQ ID NO: 2092120 - RNA, 22 nt, Homo sapiens
ugagauagucacuggaucaaga

SEQ ID NO: 2092121 - RNA, 13 nt, Homo sapiens
gucuuccugugua

SEQ ID NO: 2092122 - RNA, 20 nt, Homo sapiens
ugucaccucugugaccccuc

SEQ ID NO: 2092123 - RNA, 17 nt, Homo sapiens
ccucagggacucaggug

SEQ ID NO: 2092124 - RNA, 17 nt, Homo sapiens
caaacaugaaaacauug

SEQ ID NO: 2092125 - RNA, 18 nt, Homo sapiens
caucagaacagcuguuga

SEQ ID NO: 2092126 - RNA, 13 nt, Homo sapiens
guacuuuuaagac

SEQ ID NO: 2092127 - RNA, 21 nt, Homo sapiens
ccugaugugacgcacuguauu

SEQ ID NO: 2092128 - RNA, 13 nt, Homo sapiens
agucuuccuguag

SEQ ID NO: 2092129 - RNA, 13 nt, Homo sapiens
ucaucucaaggaa

SEQ ID NO: 2092130 - RNA, 14 nt, Homo sapiens
ucuaggcagaagaa

SEQ ID NO: 2092131 - RNA, 20 nt, Homo sapiens
aacaaccugccaccaaaaga

SEQ ID NO: 2092132 - RNA, 19 nt, Homo sapiens
gagagaggcucagccacac

SEQ ID NO: 2092133 - RNA, 13 nt, Homo sapiens
aagaaacuacccu

SEQ ID NO: 2092134 - RNA, 19 nt, Homo sapiens
guccuagaugccaaagggg

SEQ ID NO: 2092135 - RNA, 22 nt, Homo sapiens
gaggcuccgccccagcccucag

SEQ ID NO: 2092136 - RNA, 17 nt, Homo sapiens
ccugcuugcaaauccac

SEQ ID NO: 2092137 - RNA, 19 nt, Homo sapiens
ucauaugaaaggugccaug

SEQ ID NO: 2092138 - RNA, 18 nt, Homo sapiens
gauuccuggcagagccau

SEQ ID NO: 2092139 - RNA, 21 nt, Homo sapiens
cuucuauuaaggacauuuagc

SEQ ID NO: 2092140 - RNA, 17 nt, Homo sapiens
cauugcacuaaaaguga

SEQ ID NO: 2092141 - RNA, 23 nt, Homo sapiens
gggcugugucccagaugggccac

SEQ ID NO: 2092142 - RNA, 21 nt, Homo sapiens
aagggguuggauugcaauauc

SEQ ID NO: 2092143 - RNA, 15 nt, Homo sapiens
gagucgaugcucaau

SEQ ID NO: 2092144 - RNA, 19 nt, Homo sapiens
ccccuggaacugucucuca

SEQ ID NO: 2092145 - RNA, 14 nt, Homo sapiens
uuuuuuccuaagga

SEQ ID NO: 2092146 - RNA, 18 nt, Homo sapiens
agccuggacgcagccaca

SEQ ID NO: 2092147 - RNA, 20 nt, Homo sapiens
aucagagacaguaucucuag

SEQ ID NO: 2092148 - RNA, 14 nt, Homo sapiens
aguucuucauuugg

SEQ ID NO: 2092149 - RNA, 13 nt, Homo sapiens
acagcaguggagu

SEQ ID NO: 2092150 - RNA, 18 nt, Homo sapiens
cucuacagauugucauuu

SEQ ID NO: 2092151 - RNA, 19 nt, Homo sapiens
caaaauauuuggaaugaag

SEQ ID NO: 2092152 - RNA, 22 nt, Homo sapiens
acagaagcuuuagcaagugugc

SEQ ID NO: 2092153 - RNA, 22 nt, Homo sapiens
uucgggagccuugucagugugu

SEQ ID NO: 2092154 - RNA, 19 nt, Homo sapiens
gaggacaugcgugugucag

SEQ ID NO: 2092155 - RNA, 16 nt, Homo sapiens
cccacaagaaauucau

SEQ ID NO: 2092156 - RNA, 20 nt, Homo sapiens
caaaaguuuuguaccuaagu

SEQ ID NO: 2092157 - RNA, 17 nt, Homo sapiens
ugucucuaucuugcauc

SEQ ID NO: 2092158 - RNA, 20 nt, Homo sapiens
uaaucugaccguucuauugu

SEQ ID NO: 2092159 - RNA, 21 nt, Homo sapiens
uccucuugcaguuguucuuua

SEQ ID NO: 2092160 - RNA, 20 nt, Homo sapiens
agagacacucccagggacaa

SEQ ID NO: 2092161 - RNA, 23 nt, Homo sapiens
gccuagacuucccaacagccuua

SEQ ID NO: 2092162 - RNA, 23 nt, Homo sapiens
cugaagacauucaaaacgugaug

SEQ ID NO: 2092163 - RNA, 21 nt, Homo sapiens
aggugcuauguucuuagugga

SEQ ID NO: 2092164 - RNA, 11 nt, Homo sapiens
uuuucuuuaaa

SEQ ID NO: 2092165 - RNA, 17 nt, Homo sapiens
caggagccucacugggg

SEQ ID NO: 2092166 - RNA, 18 nt, Homo sapiens
acucuuuaguugauuuaa

SEQ ID NO: 2092167 - RNA, 19 nt, Homo sapiens
acugcagcaggccacuggg

SEQ ID NO: 2092168 - RNA, 20 nt, Homo sapiens
gccuccgggguucagccucc

SEQ ID NO: 2092169 - RNA, 14 nt, Homo sapiens
cuguccuaagcacu

SEQ ID NO: 2092170 - RNA, 22 nt, Homo sapiens
uauauugggugugaguucaggu

SEQ ID NO: 2092171 - RNA, 22 nt, Homo sapiens
uacaaagcuggguuugauucaa

SEQ ID NO: 2092172 - RNA, 23 nt, Homo sapiens
gauucaggccucugaggagccca

SEQ ID NO: 2092173 - RNA, 20 nt, Homo sapiens
uuuuuggaacuaaagcaaau

SEQ ID NO: 2092174 - RNA, 21 nt, Homo sapiens
ccauauauuuaauaugucaaa

SEQ ID NO: 2092175 - RNA, 15 nt, Homo sapiens
agucacagccauaca

SEQ ID NO: 2092176 - RNA, 20 nt, Homo sapiens
ucagauauuuuuucagaaau

SEQ ID NO: 2092177 - RNA, 20 nt, Homo sapiens
cauugaaaucagcaugacaa

SEQ ID NO: 2092178 - RNA, 20 nt, Homo sapiens
accaagcuuucaaacauguu

SEQ ID NO: 2092179 - RNA, 15 nt, Homo sapiens
agguuugccugugua

SEQ ID NO: 2092180 - RNA, 18 nt, Homo sapiens
caccagcugcugcuggag

SEQ ID NO: 2092181 - RNA, 17 nt, Homo sapiens
uagcaagugcuauuuca

SEQ ID NO: 2092182 - RNA, 20 nt, Homo sapiens
aggcaggaggauugcuugag

SEQ ID NO: 2092183 - RNA, 16 nt, Homo sapiens
gcacagaccaguuuca

SEQ ID NO: 2092184 - RNA, 18 nt, Homo sapiens
uccaagguuuuguggaaa

SEQ ID NO: 2092185 - RNA, 17 nt, Homo sapiens
uauuugaaagugccuuu

SEQ ID NO: 2092186 - RNA, 20 nt, Homo sapiens
gcacugcacauaauuugcau

SEQ ID NO: 2092187 - RNA, 18 nt, Homo sapiens
gcccugcagggaguaccg

SEQ ID NO: 2092188 - RNA, 17 nt, Homo sapiens
ucugagcagagagcagc

SEQ ID NO: 2092189 - RNA, 16 nt, Homo sapiens
aaccacauucagggaa

SEQ ID NO: 2092190 - RNA, 19 nt, Homo sapiens
aacuucuuuccucuggaga

SEQ ID NO: 2092191 - RNA, 20 nt, Homo sapiens
gcagaaauuuaaacucugaa

SEQ ID NO: 2092192 - RNA, 21 nt, Homo sapiens
gucuauuuccaagaaccuaua

SEQ ID NO: 2092193 - RNA, 16 nt, Homo sapiens
ucacuucccugggaac

SEQ ID NO: 2092194 - RNA, 22 nt, Homo sapiens
auuuuggaaaaaugucacugaa

SEQ ID NO: 2092195 - RNA, 14 nt, Homo sapiens
ggagagaacugaau

SEQ ID NO: 2092196 - RNA, 20 nt, Homo sapiens
gacagcuccuggaccaggcc

SEQ ID NO: 2092197 - RNA, 22 nt, Homo sapiens
gcugagcuugucuuuucugcug

SEQ ID NO: 2092198 - RNA, 17 nt, Homo sapiens
uguugguuguaccaaaa

SEQ ID NO: 2092199 - RNA, 20 nt, Homo sapiens
ccacagggcuuguuuuccaa

SEQ ID NO: 2092200 - RNA, 19 nt, Homo sapiens
ccaaugguguagcuguccu

SEQ ID NO: 2092201 - RNA, 17 nt, Homo sapiens
gaauaacuugcuacuca

SEQ ID NO: 2092202 - RNA, 18 nt, Homo sapiens
uucauauugcuaccaaaa

SEQ ID NO: 2092203 - RNA, 19 nt, Homo sapiens
ggauacugcaaaggcuugu

SEQ ID NO: 2092204 - RNA, 21 nt, Homo sapiens
auggauauguuuucacuguau

SEQ ID NO: 2092205 - RNA, 22 nt, Homo sapiens
gaguuucuccuuuugaccaaau

SEQ ID NO: 2092206 - RNA, 21 nt, Homo sapiens
agucauggacauucaugcuca

SEQ ID NO: 2092207 - RNA, 14 nt, Homo sapiens
aacuaaacuuucac

SEQ ID NO: 2092208 - RNA, 22 nt, Homo sapiens
aacuaugagcuugcucauuaau

SEQ ID NO: 2092209 - RNA, 23 nt, Homo sapiens
cuggcuaaagauaauugcuauuu

SEQ ID NO: 2092210 - RNA, 15 nt, Homo sapiens
ccugcccucccccac

SEQ ID NO: 2092211 - RNA, 18 nt, Homo sapiens
uugucauucaagccugug

SEQ ID NO: 2092212 - RNA, 22 nt, Homo sapiens
agggucuugggaaauaugaaug

SEQ ID NO: 2092213 - RNA, 14 nt, Homo sapiens
uaauuacuauguca

SEQ ID NO: 2092214 - RNA, 10 nt, Homo sapiens
gccugucauu

SEQ ID NO: 2092215 - RNA, 10 nt, Homo sapiens
uccugucagu

SEQ ID NO: 2092216 - RNA, 19 nt, Homo sapiens
uggcccuugcuuaccucuc

SEQ ID NO: 2092217 - RNA, 13 nt, Homo sapiens
auauggacacugu

SEQ ID NO: 2092218 - RNA, 15 nt, Homo sapiens
uuguaacuauaccuc

SEQ ID NO: 2092219 - RNA, 14 nt, Homo sapiens
aucuuugcuguaua

SEQ ID NO: 2092220 - RNA, 22 nt, Homo sapiens
caucugaaucccgggcuaagaa

SEQ ID NO: 2092221 - RNA, 18 nt, Homo sapiens
accauaaguaaugaagga

SEQ ID NO: 2092222 - RNA, 18 nt, Homo sapiens
guuucugaaccauuacug

SEQ ID NO: 2092223 - RNA, 12 nt, Homo sapiens
agagcugucacu

SEQ ID NO: 2092224 - RNA, 23 nt, Homo sapiens
cagauaaccuaauaauuguaucu

SEQ ID NO: 2092225 - RNA, 20 nt, Homo sapiens
gcaccacugcacuccagccu

SEQ ID NO: 2092226 - RNA, 23 nt, Homo sapiens
uucuuagcccuugggcacugcac

SEQ ID NO: 2092227 - RNA, 13 nt, Homo sapiens
uaaaagucauuca

SEQ ID NO: 2092228 - RNA, 20 nt, Homo sapiens
ugaacuguggggugugcaca

SEQ ID NO: 2092229 - RNA, 19 nt, Homo sapiens
uggcugaaccgagcuggag

SEQ ID NO: 2092230 - RNA, 20 nt, Homo sapiens
ucuuccuccagucuguucuc

SEQ ID NO: 2092231 - RNA, 16 nt, Homo sapiens
aggccgaguggcugcc

SEQ ID NO: 2092232 - RNA, 23 nt, Homo sapiens
uuucuuucaaaaguagagcaaaa

SEQ ID NO: 2092233 - RNA, 17 nt, Homo sapiens
aauaucaaaaaggagcu

SEQ ID NO: 2092234 - RNA, 22 nt, Homo sapiens
accaguguccuccccucaagga

SEQ ID NO: 2092235 - RNA, 20 nt, Homo sapiens
cacgucaauguccuaugcag

SEQ ID NO: 2092236 - RNA, 15 nt, Homo sapiens
gaacuguccagagag

SEQ ID NO: 2092237 - RNA, 13 nt, Homo sapiens
auauccccaggga

SEQ ID NO: 2092238 - RNA, 13 nt, Homo sapiens
guuccugacuguu

SEQ ID NO: 2092239 - RNA, 18 nt, Homo sapiens
caggagaccuggcacugg

SEQ ID NO: 2092240 - RNA, 15 nt, Homo sapiens
gggaguguggcuccu

SEQ ID NO: 2092241 - RNA, 14 nt, Homo sapiens
acggccacagucau

SEQ ID NO: 2092242 - RNA, 14 nt, Homo sapiens
acagacacaauuua

SEQ ID NO: 2092243 - RNA, 16 nt, Homo sapiens
gaacuuucaaaauaua

SEQ ID NO: 2092244 - RNA, 23 nt, Homo sapiens
aucaugacagucagcaacaugau

SEQ ID NO: 2092245 - RNA, 15 nt, Homo sapiens
gcauguuaacuuuau

SEQ ID NO: 2092246 - RNA, 13 nt, Homo sapiens
acauccauuccca

SEQ ID NO: 2092247 - RNA, 17 nt, Homo sapiens
ucuacauaaguaauuca

SEQ ID NO: 2092248 - RNA, 23 nt, Homo sapiens
gcagacguccauagcuccucucc

SEQ ID NO: 2092249 - RNA, 14 nt, Homo sapiens
uaaagucuugccuu

SEQ ID NO: 2092250 - RNA, 17 nt, Homo sapiens
aauaaaugaaucuuacu

SEQ ID NO: 2092251 - RNA, 15 nt, Homo sapiens
cucugccauguguuu

SEQ ID NO: 2092252 - RNA, 13 nt, Homo sapiens
aaaacaagccaug

SEQ ID NO: 2092253 - RNA, 18 nt, Homo sapiens
gcucuccugugcauugua

SEQ ID NO: 2092254 - RNA, 18 nt, Homo sapiens
uccuggcccaggugaguc

SEQ ID NO: 2092255 - RNA, 21 nt, Homo sapiens
aacugucagaauaaagaacau

SEQ ID NO: 2092256 - RNA, 19 nt, Homo sapiens
uacaaugcauucugaggua

SEQ ID NO: 2092257 - RNA, 22 nt, Homo sapiens
gcauucuuguugguagcaugua

SEQ ID NO: 2092258 - RNA, 20 nt, Homo sapiens
auuuacuuaauggguacaau

SEQ ID NO: 2092259 - RNA, 14 nt, Homo sapiens
ucccauaucauaua

SEQ ID NO: 2092260 - RNA, 16 nt, Homo sapiens
aagaaucugcucugaa

SEQ ID NO: 2092261 - RNA, 18 nt, Homo sapiens
aaggcuaagcaucuucaa

SEQ ID NO: 2092262 - RNA, 23 nt, Homo sapiens
cucccaagucacacccacucccu

SEQ ID NO: 2092263 - RNA, 18 nt, Homo sapiens
aauguagaaagugaucca

SEQ ID NO: 2092264 - RNA, 23 nt, Homo sapiens
uaggaagugcccucgagcacuga

SEQ ID NO: 2092265 - RNA, 22 nt, Homo sapiens
ggacuaggcuauaugcauuugc

SEQ ID NO: 2092266 - RNA, 19 nt, Homo sapiens
aaauaaguugcagaacaga

SEQ ID NO: 2092267 - RNA, 19 nt, Homo sapiens
ggucucugggcacaguggg

SEQ ID NO: 2092268 - RNA, 13 nt, Homo sapiens
acacuacagauca

SEQ ID NO: 2092269 - RNA, 14 nt, Homo sapiens
aggaaggacuauga

SEQ ID NO: 2092270 - RNA, 19 nt, Homo sapiens
gcuucugauacguguauga

SEQ ID NO: 2092271 - RNA, 19 nt, Homo sapiens
gguauguagcaguaucuca

SEQ ID NO: 2092272 - RNA, 16 nt, Homo sapiens
uacugccaaccagagc

SEQ ID NO: 2092273 - RNA, 14 nt, Homo sapiens
gggcucuguauaua

SEQ ID NO: 2092274 - RNA, 18 nt, Homo sapiens
aaaauguucuauuuaaca

SEQ ID NO: 2092275 - RNA, 20 nt, Homo sapiens
uccuuugaagaaaaagacac

SEQ ID NO: 2092276 - RNA, 15 nt, Homo sapiens
cauagacuccuuugc

SEQ ID NO: 2092277 - RNA, 20 nt, Homo sapiens
cuuccugagcuucaagguga

SEQ ID NO: 2092278 - RNA, 17 nt, Homo sapiens
gcauuuggagagucuca

SEQ ID NO: 2092279 - RNA, 11 nt, Homo sapiens
aagguccaaaa

SEQ ID NO: 2092280 - RNA, 22 nt, Homo sapiens
gacgugauucaauucaacacuc

SEQ ID NO: 2092281 - RNA, 19 nt, Homo sapiens
acauugacccagacauauu

SEQ ID NO: 2092282 - RNA, 19 nt, Homo sapiens
aauaaagugaggcaggaaa

SEQ ID NO: 2092283 - RNA, 16 nt, Homo sapiens
ugagcucuuugcacua

SEQ ID NO: 2092284 - RNA, 19 nt, Homo sapiens
ugcuggaagaacugcaugg

SEQ ID NO: 2092285 - RNA, 18 nt, Homo sapiens
guagugauuaacugugaa

SEQ ID NO: 2092286 - RNA, 15 nt, Homo sapiens
uauaaaggggcaaga

SEQ ID NO: 2092287 - RNA, 23 nt, Homo sapiens
agcuccuucucucuuacauugaa

SEQ ID NO: 2092288 - RNA, 22 nt, Homo sapiens
gaaugcaaaguagcaauuucca

SEQ ID NO: 2092289 - RNA, 23 nt, Homo sapiens
cugugugaccucaggccagugug

SEQ ID NO: 2092290 - RNA, 12 nt, Homo sapiens
gcccucaaucca

SEQ ID NO: 2092291 - RNA, 17 nt, Homo sapiens
auuggcuugaauuccau

SEQ ID NO: 2092292 - RNA, 17 nt, Homo sapiens
cacuaccguaaaugucc

SEQ ID NO: 2092293 - RNA, 16 nt, Homo sapiens
cacauauugcggaguc

SEQ ID NO: 2092294 - RNA, 15 nt, Homo sapiens
cagggacccacuuca

SEQ ID NO: 2092295 - RNA, 19 nt, Homo sapiens
agcagugggguaggcugcu

SEQ ID NO: 2092296 - RNA, 22 nt, Homo sapiens
cccauaauaacccugccagugc

SEQ ID NO: 2092297 - RNA, 14 nt, Homo sapiens
aaaaaauauaugua

SEQ ID NO: 2092298 - RNA, 21 nt, Homo sapiens
caaaaacgaaacuccaucuca

SEQ ID NO: 2092299 - RNA, 15 nt, Homo sapiens
aggaauuucugcucu

SEQ ID NO: 2092300 - RNA, 16 nt, Homo sapiens
caaagccaagaccuca

SEQ ID NO: 2092301 - RNA, 22 nt, Homo sapiens
gucuagaggccuuuaguuauaa

SEQ ID NO: 2092302 - RNA, 16 nt, Homo sapiens
ucuaacucagaauuau

SEQ ID NO: 2092303 - RNA, 14 nt, Homo sapiens
ucagcaggcaaaga

SEQ ID NO: 2092304 - RNA, 14 nt, Homo sapiens
uaauuauguagcuc

SEQ ID NO: 2092305 - RNA, 15 nt, Homo sapiens
caaaauaaugaaguu

SEQ ID NO: 2092306 - RNA, 19 nt, Homo sapiens
aauugcucaaugcaugaau

SEQ ID NO: 2092307 - RNA, 15 nt, Homo sapiens
ccacagguacagagc

SEQ ID NO: 2092308 - RNA, 16 nt, Homo sapiens
ccagcaaucugcauuu

SEQ ID NO: 2092309 - RNA, 19 nt, Homo sapiens
cauccugaccuugcacaaa

SEQ ID NO: 2092310 - RNA, 17 nt, Homo sapiens
ccaggauggagugcagu

SEQ ID NO: 2092311 - RNA, 13 nt, Homo sapiens
aaaaaggacucug

SEQ ID NO: 2092312 - RNA, 17 nt, Homo sapiens
acccacgugcuguucca

SEQ ID NO: 2092313 - RNA, 15 nt, Homo sapiens
agaauaaaugaaucu

SEQ ID NO: 2092314 - RNA, 22 nt, Homo sapiens
gaucgucugguuagaaaacaua

SEQ ID NO: 2092315 - RNA, 23 nt, Homo sapiens
auuuacagaaaagacucugacca

SEQ ID NO: 2092316 - RNA, 22 nt, Homo sapiens
ugucgccuggaugcacuuccug

SEQ ID NO: 2092317 - RNA, 21 nt, Homo sapiens
uugcccacccccaccaugcag

SEQ ID NO: 2092318 - RNA, 12 nt, Homo sapiens
agagccagugaa

SEQ ID NO: 2092319 - RNA, 12 nt, Homo sapiens
ucaaccagacag

SEQ ID NO: 2092320 - RNA, 22 nt, Homo sapiens
uagauaaaacacgccacagccu

SEQ ID NO: 2092321 - RNA, 15 nt, Homo sapiens
ugccaguuguggcag

SEQ ID NO: 2092322 - RNA, 19 nt, Homo sapiens
acugcugugcugugcccaa

SEQ ID NO: 2092323 - RNA, 14 nt, Homo sapiens
gcaggguucuagaa

SEQ ID NO: 2092324 - RNA, 22 nt, Homo sapiens
aagggacuuuggaauucugcuu

SEQ ID NO: 2092325 - RNA, 18 nt, Homo sapiens
uugaaauuugccuugagu

SEQ ID NO: 2092326 - RNA, 18 nt, Homo sapiens
cuauuuagagaaacauuu

SEQ ID NO: 2092327 - RNA, 17 nt, Homo sapiens
aggcugaagucagcuca

SEQ ID NO: 2092328 - RNA, 23 nt, Homo sapiens
agcuucccugaacacucaucccc

SEQ ID NO: 2092329 - RNA, 13 nt, Homo sapiens
aagcuaggauggu

SEQ ID NO: 2092330 - RNA, 16 nt, Homo sapiens
cccagccagggcucaa

SEQ ID NO: 2092331 - RNA, 23 nt, Homo sapiens
uggcuuugguccccagcauugca

SEQ ID NO: 2092332 - RNA, 23 nt, Homo sapiens
auccucuguaaaaagaucccuga

SEQ ID NO: 2092333 - RNA, 15 nt, Homo sapiens
ugcagccucucuggc

SEQ ID NO: 2092334 - RNA, 19 nt, Homo sapiens
caggcaaguccccguccaa

SEQ ID NO: 2092335 - RNA, 15 nt, Homo sapiens
ggacagaccacagag

SEQ ID NO: 2092336 - RNA, 19 nt, Homo sapiens
cagaauuguuccaguacua

SEQ ID NO: 2092337 - RNA, 19 nt, Homo sapiens
ccagcucauucucaccaau

SEQ ID NO: 2092338 - RNA, 22 nt, Homo sapiens
ugccucuaaucucagcacuuug

SEQ ID NO: 2092339 - RNA, 18 nt, Homo sapiens
agaaggaguucugacauu

SEQ ID NO: 2092340 - RNA, 18 nt, Homo sapiens
ucaacacugcagcauuuu

SEQ ID NO: 2092341 - RNA, 17 nt, Homo sapiens
uccugguccucagggga

SEQ ID NO: 2092342 - RNA, 17 nt, Homo sapiens
aacgcaccagacacuca

SEQ ID NO: 2092343 - RNA, 19 nt, Homo sapiens
cugcccucacaucuuccac

SEQ ID NO: 2092344 - RNA, 21 nt, Homo sapiens
aagaagauaggcucucaguaa

SEQ ID NO: 2092345 - RNA, 15 nt, Homo sapiens
cacuuuuguucugcu

SEQ ID NO: 2092346 - RNA, 20 nt, Homo sapiens
aucccgauaacuuugugaug

SEQ ID NO: 2092347 - RNA, 13 nt, Homo sapiens
caguaaaaaucca

SEQ ID NO: 2092348 - RNA, 17 nt, Homo sapiens
gauaccagauauuugaa

SEQ ID NO: 2092349 - RNA, 22 nt, Homo sapiens
uugggaccuugcgugaagagca

SEQ ID NO: 2092350 - RNA, 21 nt, Homo sapiens
cuuucagaaagcuuugaauac

SEQ ID NO: 2092351 - RNA, 16 nt, Homo sapiens
guuuuguucauaauac

SEQ ID NO: 2092352 - RNA, 15 nt, Homo sapiens
cguguauuuucauua

SEQ ID NO: 2092353 - RNA, 12 nt, Homo sapiens
uaaaaagucugu

SEQ ID NO: 2092354 - RNA, 22 nt, Homo sapiens
agguguuuuguucaccauuaua

SEQ ID NO: 2092355 - RNA, 17 nt, Homo sapiens
ucuuuaaccacuccuca

SEQ ID NO: 2092356 - RNA, 21 nt, Homo sapiens
uacuagccagcacaaaaggca

SEQ ID NO: 2092357 - RNA, 22 nt, Homo sapiens
ccaaggcagcucuucuggaguu

SEQ ID NO: 2092358 - RNA, 15 nt, Homo sapiens
aaggguguugcagag

SEQ ID NO: 2092359 - RNA, 13 nt, Homo sapiens
ugaaacccaguca

SEQ ID NO: 2092360 - RNA, 22 nt, Homo sapiens
uucuucuucagaagacacugca

SEQ ID NO: 2092361 - RNA, 19 nt, Homo sapiens
aguuauguaguuucuuguc

SEQ ID NO: 2092362 - RNA, 17 nt, Homo sapiens
cuaguucuaauucccua

SEQ ID NO: 2092363 - RNA, 19 nt, Homo sapiens
aaccaucugaagaaacuuc

SEQ ID NO: 2092364 - RNA, 21 nt, Homo sapiens
cucugggaauuuggagugacc

SEQ ID NO: 2092365 - RNA, 18 nt, Homo sapiens
cuuuguggucgacaucaa

SEQ ID NO: 2092366 - RNA, 14 nt, Homo sapiens
acuggcagcuccuc

SEQ ID NO: 2092367 - RNA, 17 nt, Homo sapiens
ggaucucacaagcacuu

SEQ ID NO: 2092368 - RNA, 13 nt, Homo sapiens
agcaccaaccucc

SEQ ID NO: 2092369 - RNA, 16 nt, Homo sapiens
ugugaugaaauaugaa

SEQ ID NO: 2092370 - RNA, 18 nt, Homo sapiens
caaauauugaaugccuua

SEQ ID NO: 2092371 - RNA, 23 nt, Homo sapiens
ccccgccugagucagugcucuca

SEQ ID NO: 2092372 - RNA, 15 nt, Homo sapiens
gaaguuucccuuccu

SEQ ID NO: 2092373 - RNA, 22 nt, Homo sapiens
auccaccugcuuaugcauuuau

SEQ ID NO: 2092374 - RNA, 23 nt, Homo sapiens
aaauuagaggacacuauugagag

SEQ ID NO: 2092375 - RNA, 17 nt, Homo sapiens
uuucugaagugcuugua

SEQ ID NO: 2092376 - RNA, 13 nt, Homo sapiens
uugcuuaaacccu

SEQ ID NO: 2092377 - RNA, 23 nt, Homo sapiens
ccccuucccuguccuugcccuuu

SEQ ID NO: 2092378 - RNA, 20 nt, Homo sapiens
gauagauauaugcucugcau

SEQ ID NO: 2092379 - RNA, 19 nt, Homo sapiens
auacuaacauuuucauuga

SEQ ID NO: 2092380 - RNA, 21 nt, Homo sapiens
gugauuuuggacuagccacuu

SEQ ID NO: 2092381 - RNA, 16 nt, Homo sapiens
ggaaggccguaaaaug

SEQ ID NO: 2092382 - RNA, 13 nt, Homo sapiens
cuccuugugagug

SEQ ID NO: 2092383 - RNA, 20 nt, Homo sapiens
ugagaugauuuccaagccuc

SEQ ID NO: 2092384 - RNA, 15 nt, Homo sapiens
acucuuaugaucaau

SEQ ID NO: 2092385 - RNA, 13 nt, Homo sapiens
uuccagugcugcu

SEQ ID NO: 2092386 - RNA, 16 nt, Homo sapiens
caguucacaugccaca

SEQ ID NO: 2092387 - RNA, 22 nt, Homo sapiens
cagacaccagauuuuuagcucu

SEQ ID NO: 2092388 - RNA, 13 nt, Homo sapiens
cuccgcaacagcc

SEQ ID NO: 2092389 - RNA, 16 nt, Homo sapiens
agaaguugagauucaa

SEQ ID NO: 2092390 - RNA, 19 nt, Homo sapiens
agcuggagggaccuugucu

SEQ ID NO: 2092391 - RNA, 15 nt, Homo sapiens
gucaacucacaccug

SEQ ID NO: 2092392 - RNA, 20 nt, Homo sapiens
gcuggucuggaguugcugaa

SEQ ID NO: 2092393 - RNA, 21 nt, Homo sapiens
aacauuuuucaguuugcaaau

SEQ ID NO: 2092394 - RNA, 12 nt, Homo sapiens
ugggucagggag

SEQ ID NO: 2092395 - RNA, 23 nt, Homo sapiens
ccacauccuccacguucugcuca

SEQ ID NO: 2092396 - RNA, 12 nt, Homo sapiens
ugaucacaguga

SEQ ID NO: 2092397 - RNA, 22 nt, Homo sapiens
cagaugcccuuuggaaagccau

SEQ ID NO: 2092398 - RNA, 17 nt, Homo sapiens
cucaagugaauuugaau

SEQ ID NO: 2092399 - RNA, 22 nt, Homo sapiens
ccacagaaggaggaaguggaag

SEQ ID NO: 2092400 - RNA, 19 nt, Homo sapiens
guauuaaacuuuucauuac

SEQ ID NO: 2092401 - RNA, 15 nt, Homo sapiens
ccaaaaccauguaau

SEQ ID NO: 2092402 - RNA, 15 nt, Homo sapiens
ugucccuaagagaug

SEQ ID NO: 2092403 - RNA, 21 nt, Homo sapiens
uucagccaggugaacuggaau

SEQ ID NO: 2092404 - RNA, 19 nt, Homo sapiens
cuguaaucccaacacuuug

SEQ ID NO: 2092405 - RNA, 14 nt, Homo sapiens
auaggagacuugua

SEQ ID NO: 2092406 - RNA, 14 nt, Homo sapiens
cucacuguucugca

SEQ ID NO: 2092407 - RNA, 22 nt, Homo sapiens
caggaaggggaaacacagcuga

SEQ ID NO: 2092408 - RNA, 16 nt, Homo sapiens
ugaaaauaauguugua

SEQ ID NO: 2092409 - RNA, 20 nt, Homo sapiens
cgcaccauucuccugccuca

SEQ ID NO: 2092410 - RNA, 17 nt, Homo sapiens
cuggagccccacugccc

SEQ ID NO: 2092411 - RNA, 20 nt, Homo sapiens
acuacauaccucaucucuug

SEQ ID NO: 2092412 - RNA, 13 nt, Homo sapiens
uugcuguguaaaa

SEQ ID NO: 2092413 - RNA, 18 nt, Homo sapiens
cugggaaggccagccuug

SEQ ID NO: 2092414 - RNA, 12 nt, Homo sapiens
aaggguuagaca

SEQ ID NO: 2092415 - RNA, 18 nt, Homo sapiens
gaaacccgacagagggaa

SEQ ID NO: 2092416 - RNA, 18 nt, Homo sapiens
ucagaacuagaauuugau

SEQ ID NO: 2092417 - RNA, 19 nt, Homo sapiens
uuagaauuuguuucaucua

SEQ ID NO: 2092418 - RNA, 23 nt, Homo sapiens
gggacccccucgccagcuuggcu

SEQ ID NO: 2092419 - RNA, 23 nt, Homo sapiens
gcacaagaauugaguaucacuuu

SEQ ID NO: 2092420 - RNA, 18 nt, Homo sapiens
ccagcaggcucucaggcc

SEQ ID NO: 2092421 - RNA, 15 nt, Homo sapiens
gacauucacugcuga

SEQ ID NO: 2092422 - RNA, 14 nt, Homo sapiens
cucuuacugcaaau

SEQ ID NO: 2092423 - RNA, 14 nt, Homo sapiens
acacccaagcagag

SEQ ID NO: 2092424 - RNA, 22 nt, Homo sapiens
gcccaugaacaaguuaguuucu

SEQ ID NO: 2092425 - RNA, 16 nt, Homo sapiens
ucugcuuuuccugucu

SEQ ID NO: 2092426 - RNA, 23 nt, Homo sapiens
gauucuccuguauuucaggugaa

SEQ ID NO: 2092427 - RNA, 19 nt, Homo sapiens
ggcaaguuugcagauguca

SEQ ID NO: 2092428 - RNA, 20 nt, Homo sapiens
cucccgggagaggagaucag

SEQ ID NO: 2092429 - RNA, 20 nt, Homo sapiens
caucaggagcugcucaggcu

SEQ ID NO: 2092430 - RNA, 17 nt, Homo sapiens
cuucauuuccaccaggc

SEQ ID NO: 2092431 - RNA, 13 nt, Homo sapiens
acacugaugauuu

SEQ ID NO: 2092432 - RNA, 19 nt, Homo sapiens
gacuaguaucaaguguucu

SEQ ID NO: 2092433 - RNA, 19 nt, Homo sapiens
aaccaugaaaacaaugccu

SEQ ID NO: 2092434 - RNA, 20 nt, Homo sapiens
ugggacccaaaacacaggaa

SEQ ID NO: 2092435 - RNA, 13 nt, Homo sapiens
ccuccucauggca

SEQ ID NO: 2092436 - RNA, 18 nt, Homo sapiens
cuagugagcagucaggaa

SEQ ID NO: 2092437 - RNA, 14 nt, Homo sapiens
cuccccccacaagu

SEQ ID NO: 2092438 - RNA, 17 nt, Homo sapiens
gcugcuuucuccuuuca

SEQ ID NO: 2092439 - RNA, 19 nt, Homo sapiens
ugcucaguaccuguguuga

SEQ ID NO: 2092440 - RNA, 23 nt, Homo sapiens
cagcaugaaggcagccacagaca

SEQ ID NO: 2092441 - RNA, 16 nt, Homo sapiens
gaagauacgugcauga

SEQ ID NO: 2092442 - RNA, 20 nt, Homo sapiens
auucuucagauacaaacugc

SEQ ID NO: 2092443 - RNA, 17 nt, Homo sapiens
aguuaggcugagccaca

SEQ ID NO: 2092444 - RNA, 17 nt, Homo sapiens
cagugcagcaugggaaa

SEQ ID NO: 2092445 - RNA, 22 nt, Homo sapiens
gauuuuuuuuaauuaccaugcu

SEQ ID NO: 2092446 - RNA, 23 nt, Homo sapiens
gggccaaaaugugaggguggugg

SEQ ID NO: 2092447 - RNA, 19 nt, Homo sapiens
uagugcccucuuuagccag

SEQ ID NO: 2092448 - RNA, 14 nt, Homo sapiens
gaaauauagagcau

SEQ ID NO: 2092449 - RNA, 21 nt, Homo sapiens
agugcagagaaagaaagggaa

SEQ ID NO: 2092450 - RNA, 21 nt, Homo sapiens
ggucguggagagcuaggagca

SEQ ID NO: 2092451 - RNA, 19 nt, Homo sapiens
guagcugagacuacaggca

SEQ ID NO: 2092452 - RNA, 15 nt, Homo sapiens
gcaaucaugagcaag

SEQ ID NO: 2092453 - RNA, 20 nt, Homo sapiens
aggaggacaauucaugaacu

SEQ ID NO: 2092454 - RNA, 18 nt, Homo sapiens
gaagagugaagagcauuu

SEQ ID NO: 2092455 - RNA, 20 nt, Homo sapiens
auuuggagcuaucagugcuu

SEQ ID NO: 2092456 - RNA, 22 nt, Homo sapiens
guaaguaaauugccugauuugu

SEQ ID NO: 2092457 - RNA, 17 nt, Homo sapiens
uaugugggggucugugu

SEQ ID NO: 2092458 - RNA, 17 nt, Homo sapiens
gaagaaggggacaaugg

SEQ ID NO: 2092459 - RNA, 16 nt, Homo sapiens
gcauuuaguacaucca

SEQ ID NO: 2092460 - RNA, 18 nt, Homo sapiens
aauuuacugugacuuuau

SEQ ID NO: 2092461 - RNA, 16 nt, Homo sapiens
aaugaagcagcuuuaa

SEQ ID NO: 2092462 - RNA, 19 nt, Homo sapiens
guguaugguucugugccaa

SEQ ID NO: 2092463 - RNA, 16 nt, Homo sapiens
ucuuuguaucuuccau

SEQ ID NO: 2092464 - RNA, 15 nt, Homo sapiens
ucucuggguuuacaa

SEQ ID NO: 2092465 - RNA, 15 nt, Homo sapiens
aggcccuuagaggga

SEQ ID NO: 2092466 - RNA, 22 nt, Homo sapiens
accuugugaaggaaaaacaugc

SEQ ID NO: 2092467 - RNA, 15 nt, Homo sapiens
uucuccccaggguag

SEQ ID NO: 2092468 - RNA, 20 nt, Homo sapiens
caagaagguggaaggcagug

SEQ ID NO: 2092469 - RNA, 16 nt, Homo sapiens
agcaucaccucaggcc

SEQ ID NO: 2092470 - RNA, 20 nt, Homo sapiens
gucagaggcuaauucugcag

SEQ ID NO: 2092471 - RNA, 16 nt, Homo sapiens
aauaugcuaauucuca

SEQ ID NO: 2092472 - RNA, 23 nt, Homo sapiens
auuggcaaagugacaaagcaauu

SEQ ID NO: 2092473 - RNA, 14 nt, Homo sapiens
uucaucucugccaa

SEQ ID NO: 2092474 - RNA, 14 nt, Homo sapiens
uuccucucugcaaa

SEQ ID NO: 2092475 - RNA, 17 nt, Homo sapiens
ucauguacauccauggu

SEQ ID NO: 2092476 - RNA, 13 nt, Homo sapiens
uuagaaaggggug

SEQ ID NO: 2092477 - RNA, 23 nt, Homo sapiens
acuacagcuggggugcagggaug

SEQ ID NO: 2092478 - RNA, 14 nt, Homo sapiens
caugcuucuucuca

SEQ ID NO: 2092479 - RNA, 19 nt, Homo sapiens
gaccccauccagccagggg

SEQ ID NO: 2092480 - RNA, 18 nt, Homo sapiens
augcuguggucacagggg

SEQ ID NO: 2092481 - RNA, 13 nt, Homo sapiens
agcuuaagaauuu

SEQ ID NO: 2092482 - RNA, 16 nt, Homo sapiens
ucaaaaauauuugcug

SEQ ID NO: 2092483 - RNA, 16 nt, Homo sapiens
ucaugaguucugcuga

SEQ ID NO: 2092484 - RNA, 16 nt, Homo sapiens
gucagaccuucuucca

SEQ ID NO: 2092485 - RNA, 22 nt, Homo sapiens
ggguuuauuuucauucugccaa

SEQ ID NO: 2092486 - RNA, 14 nt, Homo sapiens
ccaacacauuucac

SEQ ID NO: 2092487 - RNA, 14 nt, Homo sapiens
cccucuuugaggga

SEQ ID NO: 2092488 - RNA, 15 nt, Homo sapiens
ugaguguaaguguga

SEQ ID NO: 2092489 - RNA, 17 nt, Homo sapiens
aggggaaaaaugggaaa

SEQ ID NO: 2092490 - RNA, 16 nt, Homo sapiens
guucaauaugaaccaa

SEQ ID NO: 2092491 - RNA, 15 nt, Homo sapiens
caucugcuacugugu

SEQ ID NO: 2092492 - RNA, 14 nt, Homo sapiens
aauccauuccucuu

SEQ ID NO: 2092493 - RNA, 15 nt, Homo sapiens
ugagaucaugccacu

SEQ ID NO: 2092494 - RNA, 18 nt, Homo sapiens
ccaauccuuaaacugcca

SEQ ID NO: 2092495 - RNA, 20 nt, Homo sapiens
uuucuaaacguaagcacugu

SEQ ID NO: 2092496 - RNA, 20 nt, Homo sapiens
ugcugcaacaaaauguagaa

SEQ ID NO: 2092497 - RNA, 19 nt, Homo sapiens
uuccacgugggguggaauu

SEQ ID NO: 2092498 - RNA, 13 nt, Homo sapiens
aauuuuaugucau

SEQ ID NO: 2092499 - RNA, 19 nt, Homo sapiens
aguccgccaaacacuccac

SEQ ID NO: 2092500 - RNA, 19 nt, Homo sapiens
cuggauugcagacucauga

SEQ ID NO: 2092501 - RNA, 16 nt, Homo sapiens
cuacuuuucauccuag

SEQ ID NO: 2092502 - RNA, 12 nt, Homo sapiens
guaucacagugu

SEQ ID NO: 2092503 - RNA, 20 nt, Homo sapiens
gcucaauaaggcagugcagu

SEQ ID NO: 2092504 - RNA, 21 nt, Homo sapiens
agaucucuuucuaaagacagg

SEQ ID NO: 2092505 - RNA, 16 nt, Homo sapiens
agaagaaaauuugcca

SEQ ID NO: 2092506 - RNA, 16 nt, Homo sapiens
uggaugucauaucuuc

SEQ ID NO: 2092507 - RNA, 14 nt, Homo sapiens
gauuuguauuacac

SEQ ID NO: 2092508 - RNA, 18 nt, Homo sapiens
ggggccgggcgcgguggc

SEQ ID NO: 2092509 - RNA, 23 nt, Homo sapiens
uucuucccccacuuccccuccaa

SEQ ID NO: 2092510 - RNA, 17 nt, Homo sapiens
acucuaagcugugugca

SEQ ID NO: 2092511 - RNA, 11 nt, Homo sapiens
ggaagcacuug

SEQ ID NO: 2092512 - RNA, 21 nt, Homo sapiens
auccuggccaacauggugaaa

SEQ ID NO: 2092513 - RNA, 14 nt, Homo sapiens
aaacgucuaggaaa

SEQ ID NO: 2092514 - RNA, 20 nt, Homo sapiens
uuuacccuauacauccacag

SEQ ID NO: 2092515 - RNA, 19 nt, Homo sapiens
aauuaguuuauauuacucu

SEQ ID NO: 2092516 - RNA, 22 nt, Homo sapiens
ucagaugaacaauuaugaacau

SEQ ID NO: 2092517 - RNA, 22 nt, Homo sapiens
ggcucccuaacacacacagcgg

SEQ ID NO: 2092518 - RNA, 20 nt, Homo sapiens
aguggcacaaucucggcuca

SEQ ID NO: 2092519 - RNA, 18 nt, Homo sapiens
uaagguccuaaauucuua

SEQ ID NO: 2092520 - RNA, 15 nt, Homo sapiens
uacucgauagccuga

SEQ ID NO: 2092521 - RNA, 20 nt, Homo sapiens
ucaacuuugaauaaagaaua

SEQ ID NO: 2092522 - RNA, 19 nt, Homo sapiens
ucugcccuggguucuucca

SEQ ID NO: 2092523 - RNA, 17 nt, Homo sapiens
uaggaaaagaccaucug

SEQ ID NO: 2092524 - RNA, 15 nt, Homo sapiens
auggcuaaauacaau

SEQ ID NO: 2092525 - RNA, 14 nt, Homo sapiens
uccaauaugacuca

SEQ ID NO: 2092526 - RNA, 15 nt, Homo sapiens
auugugccucuggcu

SEQ ID NO: 2092527 - RNA, 13 nt, Homo sapiens
agcacaugcacac

SEQ ID NO: 2092528 - RNA, 15 nt, Homo sapiens
uaaaaaaucaugcca

SEQ ID NO: 2092529 - RNA, 17 nt, Homo sapiens
ugcauuaucuaugauau

SEQ ID NO: 2092530 - RNA, 14 nt, Homo sapiens
gcuccuccgugcuu

SEQ ID NO: 2092531 - RNA, 23 nt, Homo sapiens
guuaaaagcaauccaugugacuc

SEQ ID NO: 2092532 - RNA, 20 nt, Homo sapiens
gccuguggaaugagugugca

SEQ ID NO: 2092533 - RNA, 18 nt, Homo sapiens
cuugcaccugagccuguu

SEQ ID NO: 2092534 - RNA, 19 nt, Homo sapiens
aauaaacaugucacaauac

SEQ ID NO: 2092535 - RNA, 17 nt, Homo sapiens
cugguaggcauuccagc

SEQ ID NO: 2092536 - RNA, 16 nt, Homo sapiens
cugccauguuuaguga

SEQ ID NO: 2092537 - RNA, 16 nt, Homo sapiens
ggagcgaagcagagag

SEQ ID NO: 2092538 - RNA, 18 nt, Homo sapiens
gcaaugcuaauucaaugc

SEQ ID NO: 2092539 - RNA, 20 nt, Homo sapiens
ugcugugugacccugggcaa

SEQ ID NO: 2092540 - RNA, 21 nt, Homo sapiens
ggugggaggggaaugcuauac

SEQ ID NO: 2092541 - RNA, 22 nt, Homo sapiens
ugggucuaccucaucucugaaa

SEQ ID NO: 2092542 - RNA, 20 nt, Homo sapiens
agugugcucuuagcucuacc

SEQ ID NO: 2092543 - RNA, 22 nt, Homo sapiens
uccaugcuccucaccugucuag

SEQ ID NO: 2092544 - RNA, 22 nt, Homo sapiens
gucucauuuucaucuucuucca

SEQ ID NO: 2092545 - RNA, 15 nt, Homo sapiens
gagaccaggggacca

SEQ ID NO: 2092546 - RNA, 15 nt, Homo sapiens
uaugugcgugugugc

SEQ ID NO: 2092547 - RNA, 20 nt, Homo sapiens
acaauguucuuuauauacaa

SEQ ID NO: 2092548 - RNA, 18 nt, Homo sapiens
guaccuggucccuucuag

SEQ ID NO: 2092549 - RNA, 16 nt, Homo sapiens
cacaauucauuuaccc

SEQ ID NO: 2092550 - RNA, 13 nt, Homo sapiens
aaaucucccaaag

SEQ ID NO: 2092551 - RNA, 21 nt, Homo sapiens
aguaauaucaaagcauuuuau

SEQ ID NO: 2092552 - RNA, 22 nt, Homo sapiens
ucagagcccaggaauucucaca

SEQ ID NO: 2092553 - RNA, 22 nt, Homo sapiens
gagcuuccagugcauguugcca

SEQ ID NO: 2092554 - RNA, 14 nt, Homo sapiens
agauucuguuaacu

SEQ ID NO: 2092555 - RNA, 15 nt, Homo sapiens
ccaucugauguuuca

SEQ ID NO: 2092556 - RNA, 17 nt, Homo sapiens
accccaagcgacagagu

SEQ ID NO: 2092557 - RNA, 20 nt, Homo sapiens
cagacugugcaauacuuaga

SEQ ID NO: 2092558 - RNA, 20 nt, Homo sapiens
ugauaauagcacuaaugcuu

SEQ ID NO: 2092559 - RNA, 14 nt, Homo sapiens
gacugaacuguaau

SEQ ID NO: 2092560 - RNA, 15 nt, Homo sapiens
gagacaggaggucag

SEQ ID NO: 2092561 - RNA, 13 nt, Homo sapiens
cccaucugcauuu

SEQ ID NO: 2092562 - RNA, 19 nt, Homo sapiens
acaaaauuaugcugcauuu

SEQ ID NO: 2092563 - RNA, 12 nt, Homo sapiens
ugauauucucau

SEQ ID NO: 2092564 - RNA, 12 nt, Homo sapiens
ucuaauucugua

SEQ ID NO: 2092565 - RNA, 22 nt, Homo sapiens
agauucauuuucuagauacaau

SEQ ID NO: 2092566 - RNA, 21 nt, Homo sapiens
ugaucaguuaagaaauuucac

SEQ ID NO: 2092567 - RNA, 12 nt, Homo sapiens
gucaucuucccu

SEQ ID NO: 2092568 - RNA, 16 nt, Homo sapiens
aaggaugaaagacaaa

SEQ ID NO: 2092569 - RNA, 11 nt, Homo sapiens
aaacuuucuaa

SEQ ID NO: 2092570 - RNA, 20 nt, Homo sapiens
gcaauucauaacuaaugaau

SEQ ID NO: 2092571 - RNA, 12 nt, Homo sapiens
uaggcauacucu

SEQ ID NO: 2092572 - RNA, 19 nt, Homo sapiens
agucacuuguuucuacuca

SEQ ID NO: 2092573 - RNA, 14 nt, Homo sapiens
uaagccacucuucc

SEQ ID NO: 2092574 - RNA, 22 nt, Homo sapiens
uucagcugugcuuuuugcaaaa

SEQ ID NO: 2092575 - RNA, 14 nt, Homo sapiens
aaagauacggccca

SEQ ID NO: 2092576 - RNA, 19 nt, Homo sapiens
gccugcgccccccagugga

SEQ ID NO: 2092577 - RNA, 15 nt, Homo sapiens
uugcucccuaccuga

SEQ ID NO: 2092578 - RNA, 19 nt, Homo sapiens
uccagacgucaaccaggaa

SEQ ID NO: 2092579 - RNA, 13 nt, Homo sapiens
cugccuagauuca

SEQ ID NO: 2092580 - RNA, 15 nt, Homo sapiens
auagaaaacuugaca

SEQ ID NO: 2092581 - RNA, 17 nt, Homo sapiens
ucuaauauuucuaguau

SEQ ID NO: 2092582 - RNA, 13 nt, Homo sapiens
cuguuaaaaugca

SEQ ID NO: 2092583 - RNA, 13 nt, Homo sapiens
gcagaaugaaucu

SEQ ID NO: 2092584 - RNA, 18 nt, Homo sapiens
agggagaggucaccagcu

SEQ ID NO: 2092585 - RNA, 13 nt, Homo sapiens
gaaguuggggaaa

SEQ ID NO: 2092586 - RNA, 22 nt, Homo sapiens
gaaaaaggacucugcuucaguc

SEQ ID NO: 2092587 - RNA, 18 nt, Homo sapiens
aauaaacauuuggcauag

SEQ ID NO: 2092588 - RNA, 20 nt, Homo sapiens
aagguaccuaucaguuugua

SEQ ID NO: 2092589 - RNA, 17 nt, Homo sapiens
cucaaccucuacagggu

SEQ ID NO: 2092590 - RNA, 17 nt, Homo sapiens
ggcagaaaauugcacaa

SEQ ID NO: 2092591 - RNA, 14 nt, Homo sapiens
aaaucaugauuucc

SEQ ID NO: 2092592 - RNA, 23 nt, Homo sapiens
aggcugaugucuuaacugucacc

SEQ ID NO: 2092593 - RNA, 13 nt, Homo sapiens
caucuagcccuuu

SEQ ID NO: 2092594 - RNA, 15 nt, Homo sapiens
cuccaucccaacagc

SEQ ID NO: 2092595 - RNA, 23 nt, Homo sapiens
uguuucucccccuuuccaaaaac

SEQ ID NO: 2092596 - RNA, 21 nt, Homo sapiens
uccaguuacuuuccaauucuc

SEQ ID NO: 2092597 - RNA, 14 nt, Homo sapiens
ucaaacuguaaaaa

SEQ ID NO: 2092598 - RNA, 14 nt, Homo sapiens
aacuccugaccuca

SEQ ID NO: 2092599 - RNA, 18 nt, Homo sapiens
augugggugggaccacag

SEQ ID NO: 2092600 - RNA, 17 nt, Homo sapiens
uccucucucacaaauca

SEQ ID NO: 2092601 - RNA, 21 nt, Homo sapiens
ugacucuggcaaagcuuuuag

SEQ ID NO: 2092602 - RNA, 16 nt, Homo sapiens
uggaaaacucaggauu

SEQ ID NO: 2092603 - RNA, 20 nt, Homo sapiens
uaagccuggcuuagaaggca

SEQ ID NO: 2092604 - RNA, 15 nt, Homo sapiens
aaugagacacauaca

SEQ ID NO: 2092605 - RNA, 19 nt, Homo sapiens
ggggaaacgagcuguguag

SEQ ID NO: 2092606 - RNA, 17 nt, Homo sapiens
aaggggugccugggaac

SEQ ID NO: 2092607 - RNA, 20 nt, Homo sapiens
cuuuccgacacauuuaccaa

SEQ ID NO: 2092608 - RNA, 12 nt, Homo sapiens
caaagcacuuaa

SEQ ID NO: 2092609 - RNA, 16 nt, Homo sapiens
cuagggucuugggggu

SEQ ID NO: 2092610 - RNA, 16 nt, Homo sapiens
uaauucacacaaagac

SEQ ID NO: 2092611 - RNA, 18 nt, Homo sapiens
uagagggcuccucucaga

SEQ ID NO: 2092612 - RNA, 12 nt, Homo sapiens
guauuacugcuu

SEQ ID NO: 2092613 - RNA, 12 nt, Homo sapiens
uuuauacuucaa

SEQ ID NO: 2092614 - RNA, 22 nt, Homo sapiens
acucccuucccccauccuccag

SEQ ID NO: 2092615 - RNA, 18 nt, Homo sapiens
acaauccugaggcuucau

SEQ ID NO: 2092616 - RNA, 17 nt, Homo sapiens
aacuauauguauucaca

SEQ ID NO: 2092617 - RNA, 22 nt, Homo sapiens
uaugggugggaauaaaauuucu

SEQ ID NO: 2092618 - RNA, 21 nt, Homo sapiens
aagaaucuaaaccuuacaugu

SEQ ID NO: 2092619 - RNA, 21 nt, Homo sapiens
uuugguauucaauuugauucu

SEQ ID NO: 2092620 - RNA, 16 nt, Homo sapiens
cuugucucacuugugc

SEQ ID NO: 2092621 - RNA, 20 nt, Homo sapiens
ccagcaucagccccaauguc

SEQ ID NO: 2092622 - RNA, 23 nt, Homo sapiens
ucuaaaugcauauccugagccau

SEQ ID NO: 2092623 - RNA, 22 nt, Homo sapiens
gucauuuuuauaaaacuuugaa

SEQ ID NO: 2092624 - RNA, 13 nt, Homo sapiens
ucccuugaaauuu

SEQ ID NO: 2092625 - RNA, 16 nt, Homo sapiens
ugcucuaugucugccu

SEQ ID NO: 2092626 - RNA, 17 nt, Homo sapiens
uaacauuucauuguaca

SEQ ID NO: 2092627 - RNA, 19 nt, Homo sapiens
aagcuacccaucugccaga

SEQ ID NO: 2092628 - RNA, 18 nt, Homo sapiens
cacucaggaauguuugcu

SEQ ID NO: 2092629 - RNA, 23 nt, Homo sapiens
uaaauaaacuucaacacucuuua

SEQ ID NO: 2092630 - RNA, 13 nt, Homo sapiens
gaauuccuagcug

SEQ ID NO: 2092631 - RNA, 14 nt, Homo sapiens
aagccauucugccu

SEQ ID NO: 2092632 - RNA, 14 nt, Homo sapiens
acagaugcuaauaa

SEQ ID NO: 2092633 - RNA, 19 nt, Homo sapiens
uccaagacagccauacuuc

SEQ ID NO: 2092634 - RNA, 23 nt, Homo sapiens
gagaaggcuauguaaacaaacca

SEQ ID NO: 2092635 - RNA, 23 nt, Homo sapiens
uuagcuuugcagugagugcugcu

SEQ ID NO: 2092636 - RNA, 23 nt, Homo sapiens
aguggaggugcugcauugccugc

SEQ ID NO: 2092637 - RNA, 14 nt, Homo sapiens
acagcuguauuuau

SEQ ID NO: 2092638 - RNA, 20 nt, Homo sapiens
guaaauuaguuugacacugc

SEQ ID NO: 2092639 - RNA, 21 nt, Homo sapiens
gugauacugagauugucuguu

SEQ ID NO: 2092640 - RNA, 18 nt, Homo sapiens
aggauauacugcagcuuu

SEQ ID NO: 2092641 - RNA, 20 nt, Homo sapiens
acauguggcccaacacaauu

SEQ ID NO: 2092642 - RNA, 16 nt, Homo sapiens
cuuuaauuaccaguuu

SEQ ID NO: 2092643 - RNA, 20 nt, Homo sapiens
uguaauuuuguccucucugu

SEQ ID NO: 2092644 - RNA, 14 nt, Homo sapiens
cagaacuaaacuca

SEQ ID NO: 2092645 - RNA, 17 nt, Homo sapiens
aguaaaaacacuaccuc

SEQ ID NO: 2092646 - RNA, 13 nt, Homo sapiens
aauauuuguauac

SEQ ID NO: 2092647 - RNA, 23 nt, Homo sapiens
ucuucccuguaugauuccuugau

SEQ ID NO: 2092648 - RNA, 17 nt, Homo sapiens
acuguaggaacaagcau

SEQ ID NO: 2092649 - RNA, 20 nt, Homo sapiens
caggaauggggauccaguua

SEQ ID NO: 2092650 - RNA, 19 nt, Homo sapiens
cuggcuuauuuuaauguga

SEQ ID NO: 2092651 - RNA, 11 nt, Homo sapiens
cacaacauuua

SEQ ID NO: 2092652 - RNA, 18 nt, Homo sapiens
uggggguggggcugcauc

SEQ ID NO: 2092653 - RNA, 18 nt, Homo sapiens
uuauccccucagaacacg

SEQ ID NO: 2092654 - RNA, 16 nt, Homo sapiens
agaauuuaacaugacu

SEQ ID NO: 2092655 - RNA, 17 nt, Homo sapiens
aguauuuaggaaauggg

SEQ ID NO: 2092656 - RNA, 23 nt, Homo sapiens
agggccaagagaucuguguggcu

SEQ ID NO: 2092657 - RNA, 13 nt, Homo sapiens
ggaagccaaacaa

SEQ ID NO: 2092658 - RNA, 18 nt, Homo sapiens
uucagucuuuucucugaa

SEQ ID NO: 2092659 - RNA, 19 nt, Homo sapiens
uuggaccgauaagugugcu

SEQ ID NO: 2092660 - RNA, 19 nt, Homo sapiens
acuucaaggcucaaugcua

SEQ ID NO: 2092661 - RNA, 21 nt, Homo sapiens
acuacaugugacuggcaguau

SEQ ID NO: 2092662 - RNA, 20 nt, Homo sapiens
uaucaccccuugaagccuuu

SEQ ID NO: 2092663 - RNA, 20 nt, Homo sapiens
gucagcaggaagcaacgaag

SEQ ID NO: 2092664 - RNA, 20 nt, Homo sapiens
uaacaggcuuugugucaggu

SEQ ID NO: 2092665 - RNA, 14 nt, Homo sapiens
cagaaacacugccu

SEQ ID NO: 2092666 - RNA, 18 nt, Homo sapiens
auuaagucaucaucucca

SEQ ID NO: 2092667 - RNA, 15 nt, Homo sapiens
agugcauccaaaggu

SEQ ID NO: 2092668 - RNA, 19 nt, Homo sapiens
ugaacuaaucugauguuaa

SEQ ID NO: 2092669 - RNA, 17 nt, Homo sapiens
ccaugcccuccaugugu

SEQ ID NO: 2092670 - RNA, 19 nt, Homo sapiens
uuuuuauggcugcauagua

SEQ ID NO: 2092671 - RNA, 19 nt, Homo sapiens
gggaaggcgauguggugac

SEQ ID NO: 2092672 - RNA, 19 nt, Homo sapiens
cuauacaugguagccaguu

SEQ ID NO: 2092673 - RNA, 15 nt, Homo sapiens
uaaaaccugagccau

SEQ ID NO: 2092674 - RNA, 17 nt, Homo sapiens
ccccacagugacaguca

SEQ ID NO: 2092675 - RNA, 15 nt, Homo sapiens
uaaauaugagugcca

SEQ ID NO: 2092676 - RNA, 22 nt, Homo sapiens
uuaaaacccacaaaaguacaau

SEQ ID NO: 2092677 - RNA, 16 nt, Homo sapiens
ggcugcugguggcgcu

SEQ ID NO: 2092678 - RNA, 18 nt, Homo sapiens
gcuauuuaaaaagcucuu

SEQ ID NO: 2092679 - RNA, 23 nt, Homo sapiens
acucacuaugaagguaaagggag

SEQ ID NO: 2092680 - RNA, 15 nt, Homo sapiens
ccugacagcacuccu

SEQ ID NO: 2092681 - RNA, 20 nt, Homo sapiens
uuuuauaagacuacuauaca

SEQ ID NO: 2092682 - RNA, 14 nt, Homo sapiens
guauuacaucccug

SEQ ID NO: 2092683 - RNA, 19 nt, Homo sapiens
cuuuuccaagcugccacug

SEQ ID NO: 2092684 - RNA, 16 nt, Homo sapiens
ccagauguuagaucag

SEQ ID NO: 2092685 - RNA, 16 nt, Homo sapiens
ugcagucgcuugccaa

SEQ ID NO: 2092686 - RNA, 18 nt, Homo sapiens
gugcaauaugaggccaaa

SEQ ID NO: 2092687 - RNA, 20 nt, Homo sapiens
ggacucucuuaguucuuacc

SEQ ID NO: 2092688 - RNA, 22 nt, Homo sapiens
ccaguguuccugaagcugcugu

SEQ ID NO: 2092689 - RNA, 22 nt, Homo sapiens
uccaaaccuucacacacagacu

SEQ ID NO: 2092690 - RNA, 11 nt, Homo sapiens
cgcgaucucag

SEQ ID NO: 2092691 - RNA, 12 nt, Homo sapiens
acagguguaaau

SEQ ID NO: 2092692 - RNA, 22 nt, Homo sapiens
ccuucuaggucacuucucacaa

SEQ ID NO: 2092693 - RNA, 15 nt, Homo sapiens
acuccaguacucugu

SEQ ID NO: 2092694 - RNA, 21 nt, Homo sapiens
aaauaucacaguauuaucugu

SEQ ID NO: 2092695 - RNA, 17 nt, Homo sapiens
gaaaauuuaauuauuug

SEQ ID NO: 2092696 - RNA, 16 nt, Homo sapiens
acccugccgucaccac

SEQ ID NO: 2092697 - RNA, 20 nt, Homo sapiens
cauggcauauuuuucacaua

SEQ ID NO: 2092698 - RNA, 17 nt, Homo sapiens
aaucuccaccagucauu

SEQ ID NO: 2092699 - RNA, 20 nt, Homo sapiens
guauguccagcaaacucuug

SEQ ID NO: 2092700 - RNA, 14 nt, Homo sapiens
caguggauucucau

SEQ ID NO: 2092701 - RNA, 14 nt, Homo sapiens
gcacaguaauauga

SEQ ID NO: 2092702 - RNA, 20 nt, Homo sapiens
cuauuugagauugaugacaa

SEQ ID NO: 2092703 - RNA, 16 nt, Homo sapiens
agaggcaccuguccca

SEQ ID NO: 2092704 - RNA, 11 nt, Homo sapiens
uguaauacugg

SEQ ID NO: 2092705 - RNA, 14 nt, Homo sapiens
gaucucaguucucu

SEQ ID NO: 2092706 - RNA, 22 nt, Homo sapiens
ccuagagcacucucaccccaag

SEQ ID NO: 2092707 - RNA, 13 nt, Homo sapiens
uauuuaugaaggc

SEQ ID NO: 2092708 - RNA, 20 nt, Homo sapiens
gucuguauccccagugcccg

SEQ ID NO: 2092709 - RNA, 18 nt, Homo sapiens
gaucuuuuugcagacuag

SEQ ID NO: 2092710 - RNA, 12 nt, Homo sapiens
ccacacuccacu

SEQ ID NO: 2092711 - RNA, 22 nt, Homo sapiens
caucaaagagauggugcuaaac

SEQ ID NO: 2092712 - RNA, 22 nt, Homo sapiens
ccacaggcaccagcaaaacaac

SEQ ID NO: 2092713 - RNA, 18 nt, Homo sapiens
aaacugucuuuaaaagag

SEQ ID NO: 2092714 - RNA, 19 nt, Homo sapiens
ugagcucuugcuaucucuc

SEQ ID NO: 2092715 - RNA, 20 nt, Homo sapiens
aauacaagccacuaccuucu

SEQ ID NO: 2092716 - RNA, 22 nt, Homo sapiens
cuucaaucucguuuagugccaa

SEQ ID NO: 2092717 - RNA, 20 nt, Homo sapiens
ugauccugccuugcugugaa

SEQ ID NO: 2092718 - RNA, 14 nt, Homo sapiens
agauagccagacac

SEQ ID NO: 2092719 - RNA, 15 nt, Homo sapiens
uggggagugagggga

SEQ ID NO: 2092720 - RNA, 17 nt, Homo sapiens
ucaccagugccacguca

SEQ ID NO: 2092721 - RNA, 15 nt, Homo sapiens
cuacaccaacugcuc

SEQ ID NO: 2092722 - RNA, 18 nt, Homo sapiens
augaaaagauuaugaucu

SEQ ID NO: 2092723 - RNA, 14 nt, Homo sapiens
gaggcagggguccu

SEQ ID NO: 2092724 - RNA, 18 nt, Homo sapiens
uaacccaagacaugacau

SEQ ID NO: 2092725 - RNA, 22 nt, Homo sapiens
uugcuguaacucagacauucca

SEQ ID NO: 2092726 - RNA, 19 nt, Homo sapiens
acuaauuauaccaguuuuu

SEQ ID NO: 2092727 - RNA, 22 nt, Homo sapiens
agacccacugaaaugaccaaga

SEQ ID NO: 2092728 - RNA, 23 nt, Homo sapiens
guuuuccuucuucccaauagaag

SEQ ID NO: 2092729 - RNA, 22 nt, Homo sapiens
caggggccccuccucugugcuc

SEQ ID NO: 2092730 - RNA, 22 nt, Homo sapiens
uucguuguucccacugaaaugg

SEQ ID NO: 2092731 - RNA, 20 nt, Homo sapiens
cagcauacauuuucuggugg

SEQ ID NO: 2092732 - RNA, 15 nt, Homo sapiens
aucuguucuugcuac

SEQ ID NO: 2092733 - RNA, 21 nt, Homo sapiens
aggccugcacucuuauuucac

SEQ ID NO: 2092734 - RNA, 20 nt, Homo sapiens
gaaagcuuaggcugcuuauu

SEQ ID NO: 2092735 - RNA, 18 nt, Homo sapiens
gauuauaaguuugacaca

SEQ ID NO: 2092736 - RNA, 21 nt, Homo sapiens
auaugaguuacugaaggugau

SEQ ID NO: 2092737 - RNA, 22 nt, Homo sapiens
auguuggaaaugugcaaccacu

SEQ ID NO: 2092738 - RNA, 16 nt, Homo sapiens
cugugcucuaagugaa

SEQ ID NO: 2092739 - RNA, 18 nt, Homo sapiens
accucuucccaugacugc

SEQ ID NO: 2092740 - RNA, 17 nt, Homo sapiens
uccugcgaggcuaugag

SEQ ID NO: 2092741 - RNA, 18 nt, Homo sapiens
cagggucuugcucuguca

SEQ ID NO: 2092742 - RNA, 19 nt, Homo sapiens
uucacuguacugcauguga

SEQ ID NO: 2092743 - RNA, 16 nt, Homo sapiens
cauaugacaugccacc

SEQ ID NO: 2092744 - RNA, 17 nt, Homo sapiens
gaaucucauccaucaca

SEQ ID NO: 2092745 - RNA, 19 nt, Homo sapiens
ggcccaaacucaucuugau

SEQ ID NO: 2092746 - RNA, 22 nt, Homo sapiens
auggaauucguguuaugaaucu

SEQ ID NO: 2092747 - RNA, 12 nt, Homo sapiens
aguggugguaug

SEQ ID NO: 2092748 - RNA, 21 nt, Homo sapiens
accauaagggacugugccaga

SEQ ID NO: 2092749 - RNA, 19 nt, Homo sapiens
uaucauaacuauacuugau

SEQ ID NO: 2092750 - RNA, 13 nt, Homo sapiens
acuaaaggcaucc

SEQ ID NO: 2092751 - RNA, 21 nt, Homo sapiens
uaaauccuuuucccauaaaua

SEQ ID NO: 2092752 - RNA, 15 nt, Homo sapiens
aacuuuaaaaggcaa

SEQ ID NO: 2092753 - RNA, 16 nt, Homo sapiens
ggcucaauuuggugcu

SEQ ID NO: 2092754 - RNA, 18 nt, Homo sapiens
gagagcuagagggacaaa

SEQ ID NO: 2092755 - RNA, 17 nt, Homo sapiens
uggagggucuugagggg

SEQ ID NO: 2092756 - RNA, 16 nt, Homo sapiens
cugcacagcugguguc

SEQ ID NO: 2092757 - RNA, 16 nt, Homo sapiens
ugcuagaggugcucau

SEQ ID NO: 2092758 - RNA, 13 nt, Homo sapiens
uaaaauuucaaca

SEQ ID NO: 2092759 - RNA, 17 nt, Homo sapiens
agccauugaucauaaac

SEQ ID NO: 2092760 - RNA, 17 nt, Homo sapiens
ugcaguaaagucuuguc

SEQ ID NO: 2092761 - RNA, 15 nt, Homo sapiens
uuaauaguacuauua

SEQ ID NO: 2092762 - RNA, 14 nt, Homo sapiens
cucaagagugcuga

SEQ ID NO: 2092763 - RNA, 22 nt, Homo sapiens
aucuggacagaacauuuauauc

SEQ ID NO: 2092764 - RNA, 14 nt, Homo sapiens
auaaaacaguuggc

SEQ ID NO: 2092765 - RNA, 15 nt, Homo sapiens
accacacagccaagg

SEQ ID NO: 2092766 - RNA, 16 nt, Homo sapiens
aaacauauucaaagca

SEQ ID NO: 2092767 - RNA, 18 nt, Homo sapiens
ugagcacccccucauucc

SEQ ID NO: 2092768 - RNA, 21 nt, Homo sapiens
cuuuuacaauaaaaaugcugc

SEQ ID NO: 2092769 - RNA, 12 nt, Homo sapiens
ccacaguuauua

SEQ ID NO: 2092770 - RNA, 18 nt, Homo sapiens
gaagcaaguuuucuucca

SEQ ID NO: 2092771 - RNA, 14 nt, Homo sapiens
agaagcccauauca

SEQ ID NO: 2092772 - RNA, 17 nt, Homo sapiens
uaaccuaauaucacuua

SEQ ID NO: 2092773 - RNA, 13 nt, Homo sapiens
ccagaaacuguuc

SEQ ID NO: 2092774 - RNA, 23 nt, Homo sapiens
acuguaacguuuucuuucacaca

SEQ ID NO: 2092775 - RNA, 20 nt, Homo sapiens
uaucucauacugucugggau

SEQ ID NO: 2092776 - RNA, 18 nt, Homo sapiens
ugauuguaaaguagcugu

SEQ ID NO: 2092777 - RNA, 17 nt, Homo sapiens
ugauaacuuuaagauca

SEQ ID NO: 2092778 - RNA, 21 nt, Homo sapiens
ugaagcacaaccacuguagca

SEQ ID NO: 2092779 - RNA, 18 nt, Homo sapiens
ugcccagugaccagucac

SEQ ID NO: 2092780 - RNA, 17 nt, Homo sapiens
guuccaaguauuuugcc

SEQ ID NO: 2092781 - RNA, 13 nt, Homo sapiens
ggcagagcauuca

SEQ ID NO: 2092782 - RNA, 20 nt, Homo sapiens
acccaacgcuccaaagucau

SEQ ID NO: 2092783 - RNA, 15 nt, Homo sapiens
guuauccaacuauua

SEQ ID NO: 2092784 - RNA, 13 nt, Homo sapiens
uccccaagcaccu

SEQ ID NO: 2092785 - RNA, 20 nt, Homo sapiens
acacauuuuuuaaaugcacc

SEQ ID NO: 2092786 - RNA, 15 nt, Homo sapiens
guguuguggccuuaa

SEQ ID NO: 2092787 - RNA, 20 nt, Homo sapiens
uuucuauauuaggauaucag

SEQ ID NO: 2092788 - RNA, 20 nt, Homo sapiens
aggaagggugaagccuuauu

SEQ ID NO: 2092789 - RNA, 18 nt, Homo sapiens
caucagucuccaacaugu

SEQ ID NO: 2092790 - RNA, 13 nt, Homo sapiens
auaucaacucuga

SEQ ID NO: 2092791 - RNA, 19 nt, Homo sapiens
uguuugacagucugcucaa

SEQ ID NO: 2092792 - RNA, 16 nt, Homo sapiens
cuguuguugaaauuga

SEQ ID NO: 2092793 - RNA, 18 nt, Homo sapiens
guagaauugagucuucca

SEQ ID NO: 2092794 - RNA, 21 nt, Homo sapiens
cagacuuuuuuuaaaaagaua

SEQ ID NO: 2092795 - RNA, 21 nt, Homo sapiens
acuagcuuuugccaguauuau

SEQ ID NO: 2092796 - RNA, 22 nt, Homo sapiens
uguaagaaauguauaugcuacu

SEQ ID NO: 2092797 - RNA, 22 nt, Homo sapiens
ggcauuucacgaacuguucaca

SEQ ID NO: 2092798 - RNA, 13 nt, Homo sapiens
uucauggccccag

SEQ ID NO: 2092799 - RNA, 17 nt, Homo sapiens
auaucugacuucuagga

SEQ ID NO: 2092800 - RNA, 22 nt, Homo sapiens
uuaaaggcugugguaguacucc

SEQ ID NO: 2092801 - RNA, 21 nt, Homo sapiens
cucuuauaaaaucaauaagag

SEQ ID NO: 2092802 - RNA, 24 nt, Homo sapiens
uggacacuguccaugaagcacuga

SEQ ID NO: 2092803 - RNA, 16 nt, Homo sapiens
cagucuguguuuacag

SEQ ID NO: 2092804 - RNA, 14 nt, Homo sapiens
aauguaaacugugc

SEQ ID NO: 2092805 - RNA, 17 nt, Homo sapiens
ccuuucauuuacugugg

SEQ ID NO: 2092806 - RNA, 14 nt, Homo sapiens
aaacaucccccaau

SEQ ID NO: 2092807 - RNA, 14 nt, Homo sapiens
gaauuggugauucu

SEQ ID NO: 2092808 - RNA, 20 nt, Homo sapiens
cauuuuauaagcuacauguu

SEQ ID NO: 2092809 - RNA, 13 nt, Homo sapiens
ugacacagucuug

SEQ ID NO: 2092810 - RNA, 19 nt, Homo sapiens
acucacacuuacugcaaag

SEQ ID NO: 2092811 - RNA, 20 nt, Homo sapiens
gccugugagguaacugggau

SEQ ID NO: 2092812 - RNA, 19 nt, Homo sapiens
acccaguugugacaauuaa

SEQ ID NO: 2092813 - RNA, 18 nt, Homo sapiens
cagcucaggaacuagacu

SEQ ID NO: 2092814 - RNA, 17 nt, Homo sapiens
caugaaauguacauggc

SEQ ID NO: 2092815 - RNA, 22 nt, Homo sapiens
uccuuguaauguagacagacuu

SEQ ID NO: 2092816 - RNA, 22 nt, Homo sapiens
caguuugugaucuguccuucca

SEQ ID NO: 2092817 - RNA, 13 nt, Homo sapiens
agaagaggagaaa

SEQ ID NO: 2092818 - RNA, 20 nt, Homo sapiens
uugacacggugaaauccagg

SEQ ID NO: 2092819 - RNA, 20 nt, Homo sapiens
aaucuaaauggaaccacucu

SEQ ID NO: 2092820 - RNA, 21 nt, Homo sapiens
aucagaaaacaggguccagga

SEQ ID NO: 2092821 - RNA, 22 nt, Homo sapiens
guggcaagcugugacuucucca

SEQ ID NO: 2092822 - RNA, 18 nt, Homo sapiens
aauugagcaccuacugug

SEQ ID NO: 2092823 - RNA, 17 nt, Homo sapiens
aauuuuacaguagaaua

SEQ ID NO: 2092824 - RNA, 16 nt, Homo sapiens
cuggugggcggggcca

SEQ ID NO: 2092825 - RNA, 23 nt, Homo sapiens
uagauugcuuucuucuuaaccua

SEQ ID NO: 2092826 - RNA, 23 nt, Homo sapiens
augagguccuucuguagugccau

SEQ ID NO: 2092827 - RNA, 14 nt, Homo sapiens
ccuuaucaccugcc

SEQ ID NO: 2092828 - RNA, 15 nt, Homo sapiens
ucgguguucuguccc

SEQ ID NO: 2092829 - RNA, 14 nt, Homo sapiens
gaguuguguuguuc

SEQ ID NO: 2092830 - RNA, 17 nt, Homo sapiens
acccugaggguuuccac

SEQ ID NO: 2092831 - RNA, 18 nt, Homo sapiens
cagggagugcagacaccu

SEQ ID NO: 2092832 - RNA, 22 nt, Homo sapiens
uguaucugucuuuccacucugg

SEQ ID NO: 2092833 - RNA, 14 nt, Homo sapiens
gcuguggacuauua

SEQ ID NO: 2092834 - RNA, 12 nt, Homo sapiens
gggaacagcagg

SEQ ID NO: 2092835 - RNA, 14 nt, Homo sapiens
acucugcucuugca

SEQ ID NO: 2092836 - RNA, 17 nt, Homo sapiens
ugaauguauaaagacac

SEQ ID NO: 2092837 - RNA, 15 nt, Homo sapiens
caaacaggguuugau

SEQ ID NO: 2092838 - RNA, 13 nt, Homo sapiens
aauaccacaugau

SEQ ID NO: 2092839 - RNA, 21 nt, Homo sapiens
aauggagaaguucaggaaggu

SEQ ID NO: 2092840 - RNA, 17 nt, Homo sapiens
aguggcucacaccugua

SEQ ID NO: 2092841 - RNA, 13 nt, Homo sapiens
agucaucaucuca

SEQ ID NO: 2092842 - RNA, 16 nt, Homo sapiens
acugugaggaagugug

SEQ ID NO: 2092843 - RNA, 14 nt, Homo sapiens
uauuugugaugaca

SEQ ID NO: 2092844 - RNA, 15 nt, Homo sapiens
uaaaauuucacuuaa

SEQ ID NO: 2092845 - RNA, 17 nt, Homo sapiens
cacagagugugcugcua

SEQ ID NO: 2092846 - RNA, 22 nt, Homo sapiens
agauaaccccaagacagucuuu

SEQ ID NO: 2092847 - RNA, 23 nt, Homo sapiens
cuagagucacugauacacagaau

SEQ ID NO: 2092848 - RNA, 19 nt, Homo sapiens
uaaaauauuuaaugugaca

SEQ ID NO: 2092849 - RNA, 18 nt, Homo sapiens
ucaacauuuacauguauu

SEQ ID NO: 2092850 - RNA, 20 nt, Homo sapiens
agcgccugacccuggugggc

SEQ ID NO: 2092851 - RNA, 13 nt, Homo sapiens
uguagaaaucuca

SEQ ID NO: 2092852 - RNA, 16 nt, Homo sapiens
cugucccuguagcuca

SEQ ID NO: 2092853 - RNA, 19 nt, Homo sapiens
agcugguccuccacuuugc

SEQ ID NO: 2092854 - RNA, 15 nt, Homo sapiens
gugccaucaucucuu

SEQ ID NO: 2092855 - RNA, 14 nt, Homo sapiens
uaacaagauuugua

SEQ ID NO: 2092856 - RNA, 21 nt, Homo sapiens
ugaagaagguggaccuuuuaa

SEQ ID NO: 2092857 - RNA, 14 nt, Homo sapiens
cuggguccuccaaa

SEQ ID NO: 2092858 - RNA, 23 nt, Homo sapiens
cccaaauacucaauuuacuaauu

SEQ ID NO: 2092859 - RNA, 16 nt, Homo sapiens
ugagaauaaagcauuu

SEQ ID NO: 2092860 - RNA, 20 nt, Homo sapiens
acccuuuagacuguagccug

SEQ ID NO: 2092861 - RNA, 21 nt, Homo sapiens
agugaccuggaaucagugaag

SEQ ID NO: 2092862 - RNA, 12 nt, Homo sapiens
agggagucucag

SEQ ID NO: 2092863 - RNA, 12 nt, Homo sapiens
ccagcacaccaa

SEQ ID NO: 2092864 - RNA, 12 nt, Homo sapiens
ugugcacaugua

SEQ ID NO: 2092865 - RNA, 18 nt, Homo sapiens
aacuguucagcuguccuc

SEQ ID NO: 2092866 - RNA, 19 nt, Homo sapiens
guaaguacccgacuaaagu

SEQ ID NO: 2092867 - RNA, 20 nt, Homo sapiens
aggcccaguucacccugauu

SEQ ID NO: 2092868 - RNA, 14 nt, Homo sapiens
uaucagucauaacu

SEQ ID NO: 2092869 - RNA, 15 nt, Homo sapiens
ggccgacccaaggga

SEQ ID NO: 2092870 - RNA, 23 nt, Homo sapiens
uaagaauucucucuucuggaauc

SEQ ID NO: 2092871 - RNA, 18 nt, Homo sapiens
aggcuggagcccagcauu

SEQ ID NO: 2092872 - RNA, 20 nt, Homo sapiens
agcaauuauuuuaagcacuu

SEQ ID NO: 2092873 - RNA, 18 nt, Homo sapiens
gaaagacuuaugucuugg

SEQ ID NO: 2092874 - RNA, 23 nt, Homo sapiens
uggccucagcaucucauaacuca

SEQ ID NO: 2092875 - RNA, 12 nt, Homo sapiens
guuacaccagaa

SEQ ID NO: 2092876 - RNA, 13 nt, Homo sapiens
aucucugccauau

SEQ ID NO: 2092877 - RNA, 14 nt, Homo sapiens
aucagugugcaaua

SEQ ID NO: 2092878 - RNA, 18 nt, Homo sapiens
ugagaguugcuuccaguc

SEQ ID NO: 2092879 - RNA, 21 nt, Homo sapiens
uuugagaauaugaucauguaa

SEQ ID NO: 2092880 - RNA, 21 nt, Homo sapiens
ucccuggaucacgacgcugca

SEQ ID NO: 2092881 - RNA, 14 nt, Homo sapiens
agcccagacuuccu

SEQ ID NO: 2092882 - RNA, 13 nt, Homo sapiens
gcaagacaucugc

SEQ ID NO: 2092883 - RNA, 18 nt, Homo sapiens
acccaauaguuguugauu

SEQ ID NO: 2092884 - RNA, 17 nt, Homo sapiens
aguuccucugcaguuuu

SEQ ID NO: 2092885 - RNA, 21 nt, Homo sapiens
aaugcaaaauacaugaugauu

SEQ ID NO: 2092886 - RNA, 15 nt, Homo sapiens
auuacaaaagcaauu

SEQ ID NO: 2092887 - RNA, 15 nt, Homo sapiens
agcccauaauucaua

SEQ ID NO: 2092888 - RNA, 13 nt, Homo sapiens
aaucagaaguaua

SEQ ID NO: 2092889 - RNA, 22 nt, Homo sapiens
ucccugcacagugacuucugag

SEQ ID NO: 2092890 - RNA, 13 nt, Homo sapiens
aaacuuccaguca

SEQ ID NO: 2092891 - RNA, 16 nt, Homo sapiens
gauuauauagcacaua

SEQ ID NO: 2092892 - RNA, 19 nt, Homo sapiens
caaagaaauccuccaauca

SEQ ID NO: 2092893 - RNA, 13 nt, Homo sapiens
caagauucagcua

SEQ ID NO: 2092894 - RNA, 17 nt, Homo sapiens
aauuguucaucgcugcu

SEQ ID NO: 2092895 - RNA, 21 nt, Homo sapiens
ccugguucccaccauucccug

SEQ ID NO: 2092896 - RNA, 21 nt, Homo sapiens
auauuguggguaacgugagaa

SEQ ID NO: 2092897 - RNA, 14 nt, Homo sapiens
ucuuguucacugca

SEQ ID NO: 2092898 - RNA, 16 nt, Homo sapiens
auauagguugugcaaa

SEQ ID NO: 2092899 - RNA, 18 nt, Homo sapiens
augcuuucucaugucuca

SEQ ID NO: 2092900 - RNA, 17 nt, Homo sapiens
aaguuucuguugaauua

SEQ ID NO: 2092901 - RNA, 14 nt, Homo sapiens
aauucccaagcuuu

SEQ ID NO: 2092902 - RNA, 20 nt, Homo sapiens
gccuuggccucccaaagugc

SEQ ID NO: 2092903 - RNA, 18 nt, Homo sapiens
ugcacagugugugacuua

SEQ ID NO: 2092904 - RNA, 16 nt, Homo sapiens
gaaaaucucugugaaa

SEQ ID NO: 2092905 - RNA, 19 nt, Homo sapiens
uacccauuuacaaauaaga

SEQ ID NO: 2092906 - RNA, 19 nt, Homo sapiens
gacugugaggcggcagcug

SEQ ID NO: 2092907 - RNA, 16 nt, Homo sapiens
ccagugccauuucaga

SEQ ID NO: 2092908 - RNA, 16 nt, Homo sapiens
aauuuauccauucaau

SEQ ID NO: 2092909 - RNA, 22 nt, Homo sapiens
ccacucgagugcccaaggagcc

SEQ ID NO: 2092910 - RNA, 14 nt, Homo sapiens
cagcgcggggagcc

SEQ ID NO: 2092911 - RNA, 19 nt, Homo sapiens
auuugacaacaauccaaaa

SEQ ID NO: 2092912 - RNA, 18 nt, Homo sapiens
gucuuggacacuguacaa

SEQ ID NO: 2092913 - RNA, 21 nt, Homo sapiens
aagggaguggggcuggggaaa

SEQ ID NO: 2092914 - RNA, 19 nt, Homo sapiens
ugaagacagagcagaucag

SEQ ID NO: 2092915 - RNA, 14 nt, Homo sapiens
aguguaaaccaaau

SEQ ID NO: 2092916 - RNA, 22 nt, Homo sapiens
guuuuaugagaaaugccagugu

SEQ ID NO: 2092917 - RNA, 23 nt, Homo sapiens
auggaauagggauccacuucucu

SEQ ID NO: 2092918 - RNA, 13 nt, Homo sapiens
ucuguguguuccu

SEQ ID NO: 2092919 - RNA, 12 nt, Homo sapiens
agcacaagaagc

SEQ ID NO: 2092920 - RNA, 23 nt, Homo sapiens
gaaauaagaauucagacaucuga

SEQ ID NO: 2092921 - RNA, 16 nt, Homo sapiens
ccgagagagauggaau

SEQ ID NO: 2092922 - RNA, 22 nt, Homo sapiens
agaaguguuugauggugccaga

SEQ ID NO: 2092923 - RNA, 10 nt, Homo sapiens
acacagugaa

SEQ ID NO: 2092924 - RNA, 22 nt, Homo sapiens
auaucuuugaguucaaccuuua

SEQ ID NO: 2092925 - RNA, 16 nt, Homo sapiens
cggucucauuucuucu

SEQ ID NO: 2092926 - RNA, 15 nt, Homo sapiens
aaucuaauguugucu

SEQ ID NO: 2092927 - RNA, 14 nt, Homo sapiens
aaauucacuuucau

SEQ ID NO: 2092928 - RNA, 13 nt, Homo sapiens
acuuucuuuacau

SEQ ID NO: 2092929 - RNA, 21 nt, Homo sapiens
uuaguagagacgggguuucac

SEQ ID NO: 2092930 - RNA, 17 nt, Homo sapiens
aucuaucaccugucauc

SEQ ID NO: 2092931 - RNA, 12 nt, Homo sapiens
aggcuacagaga

SEQ ID NO: 2092932 - RNA, 20 nt, Homo sapiens
ggcagggccaggccucugcu

SEQ ID NO: 2092933 - RNA, 12 nt, Homo sapiens
ucaacagaauuu

SEQ ID NO: 2092934 - RNA, 18 nt, Homo sapiens
ucaaaacccaacaugacu

SEQ ID NO: 2092935 - RNA, 13 nt, Homo sapiens
agaaauccuagug

SEQ ID NO: 2092936 - RNA, 13 nt, Homo sapiens
aaguguccugaaa

SEQ ID NO: 2092937 - RNA, 15 nt, Homo sapiens
gauuuuaugcuuuaa

SEQ ID NO: 2092938 - RNA, 17 nt, Homo sapiens
caggcaaagugcugcug

SEQ ID NO: 2092939 - RNA, 15 nt, Homo sapiens
guaauggacuaugca

SEQ ID NO: 2092940 - RNA, 16 nt, Homo sapiens
ucugguuuacuucaaa

SEQ ID NO: 2092941 - RNA, 21 nt, Homo sapiens
cugauggcacuaacacugggu

SEQ ID NO: 2092942 - RNA, 21 nt, Homo sapiens
ucucuugccagcauuuucaca

SEQ ID NO: 2092943 - RNA, 17 nt, Homo sapiens
ucaugucaaauugcaau

SEQ ID NO: 2092944 - RNA, 23 nt, Homo sapiens
gagucaggcuuacuaaugcugcc

SEQ ID NO: 2092945 - RNA, 14 nt, Homo sapiens
ucccaccauucccu

SEQ ID NO: 2092946 - RNA, 16 nt, Homo sapiens
auugggccuuuuggau

SEQ ID NO: 2092947 - RNA, 20 nt, Homo sapiens
augaagacccuggaguucaa

SEQ ID NO: 2092948 - RNA, 17 nt, Homo sapiens
cgucagaccaguacugg

SEQ ID NO: 2092949 - RNA, 14 nt, Homo sapiens
uucauaauaccuca

SEQ ID NO: 2092950 - RNA, 23 nt, Homo sapiens
caguagauugcagaaaauucugu

SEQ ID NO: 2092951 - RNA, 11 nt, Homo sapiens
ggcugcaguuu

SEQ ID NO: 2092952 - RNA, 22 nt, Homo sapiens
uuggaugugcauuucugugaug

SEQ ID NO: 2092953 - RNA, 21 nt, Homo sapiens
uggaugccauccaaguuguau

SEQ ID NO: 2092954 - RNA, 14 nt, Homo sapiens
aacgcaccagacac

SEQ ID NO: 2092955 - RNA, 22 nt, Homo sapiens
gaagcugaggauccucacagga

SEQ ID NO: 2092956 - RNA, 15 nt, Homo sapiens
cuccugcugccagua

SEQ ID NO: 2092957 - RNA, 13 nt, Homo sapiens
caaacagauucuu

SEQ ID NO: 2092958 - RNA, 18 nt, Homo sapiens
caaggcccccacugccug

SEQ ID NO: 2092959 - RNA, 19 nt, Homo sapiens
auucuuuauacaacagugc

SEQ ID NO: 2092960 - RNA, 19 nt, Homo sapiens
uuguguguauuuguauuaa

SEQ ID NO: 2092961 - RNA, 15 nt, Homo sapiens
uagaaauaaugguca

SEQ ID NO: 2092962 - RNA, 18 nt, Homo sapiens
auuguccuuugauuccaa

SEQ ID NO: 2092963 - RNA, 14 nt, Homo sapiens
aagucucuggguca

SEQ ID NO: 2092964 - RNA, 21 nt, Homo sapiens
gguugcggaccuaggaccauu

SEQ ID NO: 2092965 - RNA, 21 nt, Homo sapiens
cauacucccuauuuucauucc

SEQ ID NO: 2092966 - RNA, 20 nt, Homo sapiens
ugucauuguuagaaaucccu

SEQ ID NO: 2092967 - RNA, 14 nt, Homo sapiens
cuugcagggccguu

SEQ ID NO: 2092968 - RNA, 18 nt, Homo sapiens
gcaagagaggaugacaca

SEQ ID NO: 2092969 - RNA, 18 nt, Homo sapiens
ugcacacccacucagcuc

SEQ ID NO: 2092970 - RNA, 22 nt, Homo sapiens
cuagcacggccaccucucaggg

SEQ ID NO: 2092971 - RNA, 15 nt, Homo sapiens
agugcuuccaaggca

SEQ ID NO: 2092972 - RNA, 12 nt, Homo sapiens
gaaggaaagcua

SEQ ID NO: 2092973 - RNA, 16 nt, Homo sapiens
acauguacuguucucu

SEQ ID NO: 2092974 - RNA, 14 nt, Homo sapiens
ucuaugacacaugc

SEQ ID NO: 2092975 - RNA, 23 nt, Homo sapiens
ucauguuuuugcuuuucaacaca

SEQ ID NO: 2092976 - RNA, 20 nt, Homo sapiens
aacuuccuccucucucgcuu

SEQ ID NO: 2092977 - RNA, 15 nt, Homo sapiens
cacccacgggugcua

SEQ ID NO: 2092978 - RNA, 18 nt, Homo sapiens
uagcuuagcugucucaga

SEQ ID NO: 2092979 - RNA, 21 nt, Homo sapiens
ugcauuauguacuacaugaca

SEQ ID NO: 2092980 - RNA, 22 nt, Homo sapiens
ugcagccacacucuucuaugac

SEQ ID NO: 2092981 - RNA, 22 nt, Homo sapiens
caagauucccaggaguucugcu

SEQ ID NO: 2092982 - RNA, 14 nt, Homo sapiens
agccugagccuuag

SEQ ID NO: 2092983 - RNA, 17 nt, Homo sapiens
ccucaggcaggugggau

SEQ ID NO: 2092984 - RNA, 18 nt, Homo sapiens
gcaaaaucuguucuaaca

SEQ ID NO: 2092985 - RNA, 13 nt, Homo sapiens
guaaaaagggaaa

SEQ ID NO: 2092986 - RNA, 13 nt, Homo sapiens
agcuuccauucca

SEQ ID NO: 2092987 - RNA, 21 nt, Homo sapiens
ccagggaggcgcagggacaug

SEQ ID NO: 2092988 - RNA, 14 nt, Homo sapiens
ccuuaugauauucu

SEQ ID NO: 2092989 - RNA, 24 nt, Homo sapiens
cuuauuuuguaauaaacucucuag

SEQ ID NO: 2092990 - RNA, 22 nt, Homo sapiens
aaauguuaacuguucuuggaaa

SEQ ID NO: 2092991 - RNA, 22 nt, Homo sapiens
uccaaaugccauccagaugugu

SEQ ID NO: 2092992 - RNA, 14 nt, Homo sapiens
ucauaccauccauc

SEQ ID NO: 2092993 - RNA, 13 nt, Homo sapiens
guaguuuguuuua

SEQ ID NO: 2092994 - RNA, 21 nt, Homo sapiens
uuccaacaccacagacacaca

SEQ ID NO: 2092995 - RNA, 21 nt, Homo sapiens
cuugugaaccccaaagugucc

SEQ ID NO: 2092996 - RNA, 15 nt, Homo sapiens
aguauucagugauau

SEQ ID NO: 2092997 - RNA, 19 nt, Homo sapiens
uauauaggaaacauuguua

SEQ ID NO: 2092998 - RNA, 19 nt, Homo sapiens
cagauucuucacuguguuu

SEQ ID NO: 2092999 - RNA, 15 nt, Homo sapiens
aacccuguguucaca

SEQ ID NO: 2093000 - RNA, 23 nt, Homo sapiens
ucaaacggccucacuaggcuucu

SEQ ID NO: 2093001 - RNA, 16 nt, Homo sapiens
acuucauuucugaugu

SEQ ID NO: 2093002 - RNA, 22 nt, Homo sapiens
gccagagccuggggcaucccag

SEQ ID NO: 2093003 - RNA, 15 nt, Homo sapiens
uggauuugucuuugg

SEQ ID NO: 2093004 - RNA, 14 nt, Homo sapiens
ccuuaacugcaucc

SEQ ID NO: 2093005 - RNA, 16 nt, Homo sapiens
uugucuuacuguugca

SEQ ID NO: 2093006 - RNA, 9 nt, Homo sapiens
ucuuuccau

SEQ ID NO: 2093007 - RNA, 11 nt, Homo sapiens
uuuauaugcac

SEQ ID NO: 2093008 - RNA, 17 nt, Homo sapiens
aggaguucaaugaucua

SEQ ID NO: 2093009 - RNA, 19 nt, Homo sapiens
uucccucuggcacuccaga

SEQ ID NO: 2093010 - RNA, 19 nt, Homo sapiens
ccaggaauuagagaagcug

SEQ ID NO: 2093011 - RNA, 17 nt, Homo sapiens
acuuagcgucaagacau

SEQ ID NO: 2093012 - RNA, 12 nt, Homo sapiens
cuugauuccagu

SEQ ID NO: 2093013 - RNA, 12 nt, Homo sapiens
ucugcugaucuc

SEQ ID NO: 2093014 - RNA, 17 nt, Homo sapiens
aaggucucacacuccuc

SEQ ID NO: 2093015 - RNA, 14 nt, Homo sapiens
aggcacagcacagg

SEQ ID NO: 2093016 - RNA, 13 nt, Homo sapiens
agggagagacuaa

SEQ ID NO: 2093017 - RNA, 20 nt, Homo sapiens
ucagggcuaacgaccacagg

SEQ ID NO: 2093018 - RNA, 14 nt, Homo sapiens
uauauuuacaacac

SEQ ID NO: 2093019 - RNA, 20 nt, Homo sapiens
caucuggagcugaagcguua

SEQ ID NO: 2093020 - RNA, 20 nt, Homo sapiens
agcucaagaacacaugugca

SEQ ID NO: 2093021 - RNA, 15 nt, Homo sapiens
cuagcaaugccugag

SEQ ID NO: 2093022 - RNA, 21 nt, Homo sapiens
ggcucccccaggccugagcug

SEQ ID NO: 2093023 - RNA, 22 nt, Homo sapiens
gaucucagcucaccucaaccuc

SEQ ID NO: 2093024 - RNA, 22 nt, Homo sapiens
aagauaaaaucuucaacuaauu

SEQ ID NO: 2093025 - RNA, 19 nt, Homo sapiens
agucaucaacaaugauuaa

SEQ ID NO: 2093026 - RNA, 18 nt, Homo sapiens
gaaggugcaggugacaga

SEQ ID NO: 2093027 - RNA, 20 nt, Homo sapiens
cuacaggaagcaccccaugc

SEQ ID NO: 2093028 - RNA, 13 nt, Homo sapiens
agugccugggaau

SEQ ID NO: 2093029 - RNA, 22 nt, Homo sapiens
acacagguagcacagauuuuga

SEQ ID NO: 2093030 - RNA, 16 nt, Homo sapiens
gauaagcacuagaucu

SEQ ID NO: 2093031 - RNA, 23 nt, Homo sapiens
aaguccccgagggcgaaggccau

SEQ ID NO: 2093032 - RNA, 10 nt, Homo sapiens
acugccauua

SEQ ID NO: 2093033 - RNA, 17 nt, Homo sapiens
ugccuuuuuaaugaaca

SEQ ID NO: 2093034 - RNA, 23 nt, Homo sapiens
ugaagaagagacucuuugcauau

SEQ ID NO: 2093035 - RNA, 21 nt, Homo sapiens
auuccuuaaaugaacuacugc

SEQ ID NO: 2093036 - RNA, 17 nt, Homo sapiens
uaaaauuauacugugug

SEQ ID NO: 2093037 - RNA, 18 nt, Homo sapiens
aaaaggaaaaugaaacua

SEQ ID NO: 2093038 - RNA, 13 nt, Homo sapiens
agacagagucuca

SEQ ID NO: 2093039 - RNA, 15 nt, Homo sapiens
acuuucagaguuuga

SEQ ID NO: 2093040 - RNA, 24 nt, Homo sapiens
gacaucgguucauauuaagacaua

SEQ ID NO: 2093041 - RNA, 21 nt, Homo sapiens
ugcagacauuuuauuaggggg

SEQ ID NO: 2093042 - RNA, 22 nt, Homo sapiens
cuagauuuaaccauggcacuga

SEQ ID NO: 2093043 - RNA, 12 nt, Homo sapiens
auuucucaaggg

SEQ ID NO: 2093044 - RNA, 17 nt, Homo sapiens
aacccagcaguucucug

SEQ ID NO: 2093045 - RNA, 15 nt, Homo sapiens
uucuuaaacucagaa

SEQ ID NO: 2093046 - RNA, 14 nt, Homo sapiens
gaugcuuuaacuga

SEQ ID NO: 2093047 - RNA, 15 nt, Homo sapiens
uguucuaaguauuug

SEQ ID NO: 2093048 - RNA, 22 nt, Homo sapiens
ucagugaagaugcuguaaauag

SEQ ID NO: 2093049 - RNA, 21 nt, Homo sapiens
agucaugauggauggaaauau

SEQ ID NO: 2093050 - RNA, 16 nt, Homo sapiens
uauuaacccuaccugu

SEQ ID NO: 2093051 - RNA, 14 nt, Homo sapiens
gacuacugcuccug

SEQ ID NO: 2093052 - RNA, 17 nt, Homo sapiens
gcaguaauaaucaucga

SEQ ID NO: 2093053 - RNA, 16 nt, Homo sapiens
acaguugguuuugcau

SEQ ID NO: 2093054 - RNA, 18 nt, Homo sapiens
ucagaauauauucacuuu

SEQ ID NO: 2093055 - RNA, 19 nt, Homo sapiens
aguuacuggguauuugaua

SEQ ID NO: 2093056 - RNA, 20 nt, Homo sapiens
cauguacucaaguaccacca

SEQ ID NO: 2093057 - RNA, 13 nt, Homo sapiens
cagggacaccagc

SEQ ID NO: 2093058 - RNA, 22 nt, Homo sapiens
gccuugaaaccagaaaucuaau

SEQ ID NO: 2093059 - RNA, 19 nt, Homo sapiens
cagauguuucaucaaugca

SEQ ID NO: 2093060 - RNA, 19 nt, Homo sapiens
caagucacacgcuuuugaa

SEQ ID NO: 2093061 - RNA, 21 nt, Homo sapiens
acauaaagaaaucauacuuug

SEQ ID NO: 2093062 - RNA, 16 nt, Homo sapiens
uaacacagugcagugc

SEQ ID NO: 2093063 - RNA, 17 nt, Homo sapiens
uugcaauacauuucaau

SEQ ID NO: 2093064 - RNA, 14 nt, Homo sapiens
ugagagugcacugc

SEQ ID NO: 2093065 - RNA, 12 nt, Homo sapiens
uacuugaaccau

SEQ ID NO: 2093066 - RNA, 18 nt, Homo sapiens
gcccuacaguacccccau

SEQ ID NO: 2093067 - RNA, 18 nt, Homo sapiens
ucuucagcaccaaauaca

SEQ ID NO: 2093068 - RNA, 18 nt, Homo sapiens
guuuuggagaguuugccu

SEQ ID NO: 2093069 - RNA, 21 nt, Homo sapiens
ugauaagcaagaaagauuuca

SEQ ID NO: 2093070 - RNA, 17 nt, Homo sapiens
ugcaauaucaacaacaa

SEQ ID NO: 2093071 - RNA, 23 nt, Homo sapiens
ucacauuugggguuuguguuuga

SEQ ID NO: 2093072 - RNA, 16 nt, Homo sapiens
gaugccgagcacuuuc

SEQ ID NO: 2093073 - RNA, 13 nt, Homo sapiens
uuuccauucuggg

SEQ ID NO: 2093074 - RNA, 17 nt, Homo sapiens
aggauuuuguauugcca

SEQ ID NO: 2093075 - RNA, 17 nt, Homo sapiens
guauuaaaauguaugca

SEQ ID NO: 2093076 - RNA, 15 nt, Homo sapiens
auggugaauggauuu

SEQ ID NO: 2093077 - RNA, 21 nt, Homo sapiens
accuuguaaaagacaguguau

SEQ ID NO: 2093078 - RNA, 21 nt, Homo sapiens
gacagucucaccuccugccau

SEQ ID NO: 2093079 - RNA, 19 nt, Homo sapiens
uugcacagagcacacuuau

SEQ ID NO: 2093080 - RNA, 16 nt, Homo sapiens
ugucaggaggcagaag

SEQ ID NO: 2093081 - RNA, 15 nt, Homo sapiens
guuugauuacuguuu

SEQ ID NO: 2093082 - RNA, 19 nt, Homo sapiens
accuccuccaagaagcccu

SEQ ID NO: 2093083 - RNA, 13 nt, Homo sapiens
uaugaacuuuaua

SEQ ID NO: 2093084 - RNA, 14 nt, Homo sapiens
ugcuucuacuguga

SEQ ID NO: 2093085 - RNA, 20 nt, Homo sapiens
ccuugucucucacugcauuu

SEQ ID NO: 2093086 - RNA, 16 nt, Homo sapiens
aaagaauucucagcag

SEQ ID NO: 2093087 - RNA, 20 nt, Homo sapiens
aucaaagauugaacacugcg

SEQ ID NO: 2093088 - RNA, 14 nt, Homo sapiens
uacuugccaagaaa

SEQ ID NO: 2093089 - RNA, 16 nt, Homo sapiens
ugauuuagugaucaaa

SEQ ID NO: 2093090 - RNA, 11 nt, Homo sapiens
ggaagaagcaa

SEQ ID NO: 2093091 - RNA, 16 nt, Homo sapiens
uaaaaauaugucauca

SEQ ID NO: 2093092 - RNA, 18 nt, Homo sapiens
gauuucaauagcuuugua

SEQ ID NO: 2093093 - RNA, 18 nt, Homo sapiens
gcgugauuguggcauuua

SEQ ID NO: 2093094 - RNA, 20 nt, Homo sapiens
uccuauaucuguuuguauau

SEQ ID NO: 2093095 - RNA, 23 nt, Homo sapiens
agucauugccuugggccugggaa

SEQ ID NO: 2093096 - RNA, 15 nt, Homo sapiens
cccucacugagccuc

SEQ ID NO: 2093097 - RNA, 15 nt, Homo sapiens
aggaacuagaaagaa

SEQ ID NO: 2093098 - RNA, 18 nt, Homo sapiens
gaaaaauaugagaaaaau

SEQ ID NO: 2093099 - RNA, 19 nt, Homo sapiens
ucuugggaagaccagcuuu

SEQ ID NO: 2093100 - RNA, 13 nt, Homo sapiens
auguaacacuggc

SEQ ID NO: 2093101 - RNA, 17 nt, Homo sapiens
acccaguccucugccuc

SEQ ID NO: 2093102 - RNA, 22 nt, Homo sapiens
cacuguaauauguacacaacuu

SEQ ID NO: 2093103 - RNA, 18 nt, Homo sapiens
ccucccaaggagaacaaa

SEQ ID NO: 2093104 - RNA, 14 nt, Homo sapiens
acaugaaaacagaa

SEQ ID NO: 2093105 - RNA, 14 nt, Homo sapiens
aaggagaaaagugg

SEQ ID NO: 2093106 - RNA, 20 nt, Homo sapiens
ucuaagaaauggcuuuccac

SEQ ID NO: 2093107 - RNA, 14 nt, Homo sapiens
auguuuaaagauca

SEQ ID NO: 2093108 - RNA, 18 nt, Homo sapiens
gaacaaaugaagacaaaa

SEQ ID NO: 2093109 - RNA, 14 nt, Homo sapiens
ucuacacugccuuu

SEQ ID NO: 2093110 - RNA, 15 nt, Homo sapiens
ucguucucugccuca

SEQ ID NO: 2093111 - RNA, 23 nt, Homo sapiens
gccgagcguucccagcaggggga

SEQ ID NO: 2093112 - RNA, 19 nt, Homo sapiens
ggggccacgugugcugugg

SEQ ID NO: 2093113 - RNA, 17 nt, Homo sapiens
uccgggaaugaugcaac

SEQ ID NO: 2093114 - RNA, 21 nt, Homo sapiens
caacuagggagugagugcaaa

SEQ ID NO: 2093115 - RNA, 18 nt, Homo sapiens
ucuucaccccccacucac

SEQ ID NO: 2093116 - RNA, 13 nt, Homo sapiens
uacuuacaugcau

SEQ ID NO: 2093117 - RNA, 20 nt, Homo sapiens
auuuacaguacuugucuuca

SEQ ID NO: 2093118 - RNA, 17 nt, Homo sapiens
uggugcaguaaccauuu

SEQ ID NO: 2093119 - RNA, 15 nt, Homo sapiens
gcagcuacucagagg

SEQ ID NO: 2093120 - RNA, 14 nt, Homo sapiens
gccccuaaguuauu

SEQ ID NO: 2093121 - RNA, 20 nt, Homo sapiens
ugggcuuaaguuuuacuuga

SEQ ID NO: 2093122 - RNA, 12 nt, Homo sapiens
cacuuccagugc

SEQ ID NO: 2093123 - RNA, 23 nt, Homo sapiens
uuauacagauagaguuccauaua

SEQ ID NO: 2093124 - RNA, 18 nt, Homo sapiens
cuuuaauaaagaaguauu

SEQ ID NO: 2093125 - RNA, 17 nt, Homo sapiens
aaagaagccucagcucc

SEQ ID NO: 2093126 - RNA, 12 nt, Homo sapiens
ucgaaucacuca

SEQ ID NO: 2093127 - RNA, 21 nt, Homo sapiens
ggcaacccucagcugccucau

SEQ ID NO: 2093128 - RNA, 18 nt, Homo sapiens
aaaacagagccugccuaa

SEQ ID NO: 2093129 - RNA, 19 nt, Homo sapiens
gucgucaaugaugaguccu

SEQ ID NO: 2093130 - RNA, 15 nt, Homo sapiens
agucaguaguauucu

SEQ ID NO: 2093131 - RNA, 23 nt, Homo sapiens
gaaaaauaagaugggcccaaagg

SEQ ID NO: 2093132 - RNA, 22 nt, Homo sapiens
cacuggacagucauuguggaua

SEQ ID NO: 2093133 - RNA, 12 nt, Homo sapiens
acuuaaguagaa

SEQ ID NO: 2093134 - RNA, 19 nt, Homo sapiens
agcaaaacgacacugcgca

SEQ ID NO: 2093135 - RNA, 13 nt, Homo sapiens
ucccaccauuccc

SEQ ID NO: 2093136 - RNA, 21 nt, Homo sapiens
aguaccaggggcugggcuccc

SEQ ID NO: 2093137 - RNA, 21 nt, Homo sapiens
acagauuguucuaaaguaaaa

SEQ ID NO: 2093138 - RNA, 15 nt, Homo sapiens
auguucacuguggca

SEQ ID NO: 2093139 - RNA, 20 nt, Homo sapiens
agugccauuacuacuguaca

SEQ ID NO: 2093140 - RNA, 15 nt, Homo sapiens
ccccuuccuggacac

SEQ ID NO: 2093141 - RNA, 17 nt, Homo sapiens
aagauuggauuuuacag

SEQ ID NO: 2093142 - RNA, 14 nt, Homo sapiens
auucucacuccuac

SEQ ID NO: 2093143 - RNA, 20 nt, Homo sapiens
gggugugggucaaaccaaga

SEQ ID NO: 2093144 - RNA, 13 nt, Homo sapiens
uuccagguaacag

SEQ ID NO: 2093145 - RNA, 20 nt, Homo sapiens
gcagagccagggcagggcga

SEQ ID NO: 2093146 - RNA, 21 nt, Homo sapiens
auguuaaagguucacaggggu

SEQ ID NO: 2093147 - RNA, 16 nt, Homo sapiens
auccgggucaagugaa

SEQ ID NO: 2093148 - RNA, 14 nt, Homo sapiens
ucuuaaccuaccug

SEQ ID NO: 2093149 - RNA, 13 nt, Homo sapiens
gaggauccuguau

SEQ ID NO: 2093150 - RNA, 19 nt, Homo sapiens
ggcugcaagcugcagggaa

SEQ ID NO: 2093151 - RNA, 17 nt, Homo sapiens
aauauuuuagauuacag

SEQ ID NO: 2093152 - RNA, 20 nt, Homo sapiens
gauuauaauaugugccuuaa

SEQ ID NO: 2093153 - RNA, 12 nt, Homo sapiens
guccugcagugu

SEQ ID NO: 2093154 - RNA, 12 nt, Homo sapiens
uuguugcauucc

SEQ ID NO: 2093155 - RNA, 19 nt, Homo sapiens
cuacacacccugcauauca

SEQ ID NO: 2093156 - RNA, 22 nt, Homo sapiens
gauucaaauaacccugaaucag

SEQ ID NO: 2093157 - RNA, 13 nt, Homo sapiens
agggcagcuguga

SEQ ID NO: 2093158 - RNA, 11 nt, Homo sapiens
ucuaagauauu

SEQ ID NO: 2093159 - RNA, 22 nt, Homo sapiens
acugacucuggaaaaggcauau

SEQ ID NO: 2093160 - RNA, 19 nt, Homo sapiens
ugcaugaccuaccaggaca

SEQ ID NO: 2093161 - RNA, 13 nt, Homo sapiens
agggguacauucu

SEQ ID NO: 2093162 - RNA, 14 nt, Homo sapiens
gccucagugccacu

SEQ ID NO: 2093163 - RNA, 14 nt, Homo sapiens
aaugucauugcuaa

SEQ ID NO: 2093164 - RNA, 16 nt, Homo sapiens
cccaggccucccugca

SEQ ID NO: 2093165 - RNA, 14 nt, Homo sapiens
aaagguugccugaa

SEQ ID NO: 2093166 - RNA, 15 nt, Homo sapiens
uauaaaugcuuuuaa

SEQ ID NO: 2093167 - RNA, 13 nt, Homo sapiens
cauagucaauauu

SEQ ID NO: 2093168 - RNA, 13 nt, Homo sapiens
auuuuucacaaag

SEQ ID NO: 2093169 - RNA, 14 nt, Homo sapiens
uaguuucaggcaag

SEQ ID NO: 2093170 - RNA, 17 nt, Homo sapiens
cagauguggacaugcac

SEQ ID NO: 2093171 - RNA, 15 nt, Homo sapiens
cugccucuggcuucc

SEQ ID NO: 2093172 - RNA, 14 nt, Homo sapiens
cugcucuuccucag

SEQ ID NO: 2093173 - RNA, 12 nt, Homo sapiens
cucuucugcaag

SEQ ID NO: 2093174 - RNA, 14 nt, Homo sapiens
auuacugcauaaaa

SEQ ID NO: 2093175 - RNA, 19 nt, Homo sapiens
uucauguuagucuuaccga

SEQ ID NO: 2093176 - RNA, 16 nt, Homo sapiens
ugugaggcugggucca

SEQ ID NO: 2093177 - RNA, 12 nt, Homo sapiens
guugcauuuuac

SEQ ID NO: 2093178 - RNA, 21 nt, Homo sapiens
ucucuuucuagaggugcuaca

SEQ ID NO: 2093179 - RNA, 16 nt, Homo sapiens
ugaggucaccuggaau

SEQ ID NO: 2093180 - RNA, 22 nt, Homo sapiens
aguuucuuuccuaaaccauuca

SEQ ID NO: 2093181 - RNA, 19 nt, Homo sapiens
auuuaaugaauacuugcua

SEQ ID NO: 2093182 - RNA, 13 nt, Homo sapiens
aaucacaucucca

SEQ ID NO: 2093183 - RNA, 11 nt, Homo sapiens
uccuuccucuc

SEQ ID NO: 2093184 - RNA, 21 nt, Homo sapiens
uaccacaaggaaaauaguuua

SEQ ID NO: 2093185 - RNA, 13 nt, Homo sapiens
gucucugugagac

SEQ ID NO: 2093186 - RNA, 17 nt, Homo sapiens
uauucgauguacuuuaa

SEQ ID NO: 2093187 - RNA, 17 nt, Homo sapiens
cauaagccaaaacugag

SEQ ID NO: 2093188 - RNA, 15 nt, Homo sapiens
acauucauccucaca

SEQ ID NO: 2093189 - RNA, 15 nt, Homo sapiens
ccauauuuacucuuu

SEQ ID NO: 2093190 - RNA, 14 nt, Homo sapiens
acaggugcaagcca

SEQ ID NO: 2093191 - RNA, 13 nt, Homo sapiens
acuuggcacuuuu

SEQ ID NO: 2093192 - RNA, 13 nt, Homo sapiens
ccuuugcaauuug

SEQ ID NO: 2093193 - RNA, 16 nt, Homo sapiens
uauggcucacacagcu

SEQ ID NO: 2093194 - RNA, 16 nt, Homo sapiens
ucuccuucaaaacacu

SEQ ID NO: 2093195 - RNA, 22 nt, Homo sapiens
uauaaguaauacuucaguaaua

SEQ ID NO: 2093196 - RNA, 20 nt, Homo sapiens
ccgagagagauggaauaaag

SEQ ID NO: 2093197 - RNA, 22 nt, Homo sapiens
ggcugagggauggacugaugcu

SEQ ID NO: 2093198 - RNA, 16 nt, Homo sapiens
ugacguuuacauauau

SEQ ID NO: 2093199 - RNA, 16 nt, Homo sapiens
agucuucaucuguccg

SEQ ID NO: 2093200 - RNA, 20 nt, Homo sapiens
uauggccaauaacuuuucac

SEQ ID NO: 2093201 - RNA, 21 nt, Homo sapiens
cuucaacaugacauccagaga

SEQ ID NO: 2093202 - RNA, 22 nt, Homo sapiens
acuaccacuuauuucuaaaucc

SEQ ID NO: 2093203 - RNA, 14 nt, Homo sapiens
cacaaaauugggaa

SEQ ID NO: 2093204 - RNA, 17 nt, Homo sapiens
uauuggaagcauacaaa

SEQ ID NO: 2093205 - RNA, 23 nt, Homo sapiens
gcaaugguuugugucaaaacugg

SEQ ID NO: 2093206 - RNA, 18 nt, Homo sapiens
gaggggucaaguuauuaa

SEQ ID NO: 2093207 - RNA, 22 nt, Homo sapiens
agaucacugccacacucuccau

SEQ ID NO: 2093208 - RNA, 14 nt, Homo sapiens
gauuuccuuggcuu

SEQ ID NO: 2093209 - RNA, 21 nt, Homo sapiens
gacaugcagcucugaugagag

SEQ ID NO: 2093210 - RNA, 22 nt, Homo sapiens
aaauggcccuguuuacggccua

SEQ ID NO: 2093211 - RNA, 15 nt, Homo sapiens
uggaaagacuugaau

SEQ ID NO: 2093212 - RNA, 18 nt, Homo sapiens
cucggcaccuccccggcc

SEQ ID NO: 2093213 - RNA, 16 nt, Homo sapiens
aaccaggcugggcuca

SEQ ID NO: 2093214 - RNA, 13 nt, Homo sapiens
caacugagccaaa

SEQ ID NO: 2093215 - RNA, 13 nt, Homo sapiens
caaaugagccaca

SEQ ID NO: 2093216 - RNA, 20 nt, Homo sapiens
acuggucccaagguguaaag

SEQ ID NO: 2093217 - RNA, 17 nt, Homo sapiens
aaauaaaaugcagacag

SEQ ID NO: 2093218 - RNA, 16 nt, Homo sapiens
ugacuguugcauagaa

SEQ ID NO: 2093219 - RNA, 20 nt, Homo sapiens
aaggagaggggaccaugcaa

SEQ ID NO: 2093220 - RNA, 14 nt, Homo sapiens
ucacgccuacuuaa

SEQ ID NO: 2093221 - RNA, 23 nt, Homo sapiens
ugaauacaggagcccucuccuca

SEQ ID NO: 2093222 - RNA, 18 nt, Homo sapiens
acaaugaugcuauuugca

SEQ ID NO: 2093223 - RNA, 13 nt, Homo sapiens
cugucucagcuca

SEQ ID NO: 2093224 - RNA, 21 nt, Homo sapiens
uuucaacaaauuucauugcac

SEQ ID NO: 2093225 - RNA, 20 nt, Homo sapiens
aaacugacagaugcuuuugc

SEQ ID NO: 2093226 - RNA, 11 nt, Homo sapiens
ggccagugucu

SEQ ID NO: 2093227 - RNA, 12 nt, Homo sapiens
uaauucuacuaa

SEQ ID NO: 2093228 - RNA, 18 nt, Homo sapiens
accugcuuugagauuucc

SEQ ID NO: 2093229 - RNA, 16 nt, Homo sapiens
agaacauacacuguga

SEQ ID NO: 2093230 - RNA, 21 nt, Homo sapiens
gcaaaugacaugcacugaccc

SEQ ID NO: 2093231 - RNA, 13 nt, Homo sapiens
caucuaagcccau

SEQ ID NO: 2093232 - RNA, 19 nt, Homo sapiens
agagaucgagaccauccug

SEQ ID NO: 2093233 - RNA, 15 nt, Homo sapiens
ugucuuagacacugu

SEQ ID NO: 2093234 - RNA, 15 nt, Homo sapiens
uuauuacuguuccca

SEQ ID NO: 2093235 - RNA, 17 nt, Homo sapiens
acauccaaaauaguuaa

SEQ ID NO: 2093236 - RNA, 16 nt, Homo sapiens
ugguaccuauuugacu

SEQ ID NO: 2093237 - RNA, 13 nt, Homo sapiens
gaaacuaauaaaa

SEQ ID NO: 2093238 - RNA, 11 nt, Homo sapiens
ggucacagcua

SEQ ID NO: 2093239 - RNA, 16 nt, Homo sapiens
auguauuugaacacuu

SEQ ID NO: 2093240 - RNA, 20 nt, Homo sapiens
cccuggagcccauccagucu

SEQ ID NO: 2093241 - RNA, 13 nt, Homo sapiens
guugucaaaaagu

SEQ ID NO: 2093242 - RNA, 15 nt, Homo sapiens
uuuaauaacauauua

SEQ ID NO: 2093243 - RNA, 16 nt, Homo sapiens
ccauucuggacaccag

SEQ ID NO: 2093244 - RNA, 15 nt, Homo sapiens
aacuggcgaagccug

SEQ ID NO: 2093245 - RNA, 18 nt, Homo sapiens
accaguggcccccacuca

SEQ ID NO: 2093246 - RNA, 14 nt, Homo sapiens
auuuaaaucacuca

SEQ ID NO: 2093247 - RNA, 14 nt, Homo sapiens
acccucccagugag

SEQ ID NO: 2093248 - RNA, 16 nt, Homo sapiens
uuuuuauacagugaag

SEQ ID NO: 2093249 - RNA, 12 nt, Homo sapiens
uggaucugugug

SEQ ID NO: 2093250 - RNA, 19 nt, Homo sapiens
uccccaccuuccuuaccuc

SEQ ID NO: 2093251 - RNA, 18 nt, Homo sapiens
aauccaaagaaagauuaa

SEQ ID NO: 2093252 - RNA, 14 nt, Homo sapiens
aaccuaaacauaga

SEQ ID NO: 2093253 - RNA, 16 nt, Homo sapiens
gguguauguaugagua

SEQ ID NO: 2093254 - RNA, 17 nt, Homo sapiens
cuaaaacuggcccuguu

SEQ ID NO: 2093255 - RNA, 17 nt, Homo sapiens
cgcacaaugcaugugcu

SEQ ID NO: 2093256 - RNA, 15 nt, Homo sapiens
aggcugcugccaggc

SEQ ID NO: 2093257 - RNA, 16 nt, Homo sapiens
aacugcagaccucacu

SEQ ID NO: 2093258 - RNA, 21 nt, Homo sapiens
cacuucucaccaaacuucaug

SEQ ID NO: 2093259 - RNA, 17 nt, Homo sapiens
auauuaguugcuuuguu

SEQ ID NO: 2093260 - RNA, 21 nt, Homo sapiens
ugacucaugaacuauuuacau

SEQ ID NO: 2093261 - RNA, 22 nt, Homo sapiens
ucggaucucacaggcugagaac

SEQ ID NO: 2093262 - RNA, 23 nt, Homo sapiens
uuccccggggucuucuaccucag

SEQ ID NO: 2093263 - RNA, 14 nt, Homo sapiens
accuuuugucucac

SEQ ID NO: 2093264 - RNA, 22 nt, Homo sapiens
gcacaugccucucucaggccaa

SEQ ID NO: 2093265 - RNA, 13 nt, Homo sapiens
cagcacuccugua

SEQ ID NO: 2093266 - RNA, 13 nt, Homo sapiens
cgcucaggugauc

SEQ ID NO: 2093267 - RNA, 20 nt, Homo sapiens
gcuguuugcuuguaguugaa

SEQ ID NO: 2093268 - RNA, 19 nt, Homo sapiens
aaauuuuucuuaagacaga

SEQ ID NO: 2093269 - RNA, 22 nt, Homo sapiens
uucucacacacaacuguccaua

SEQ ID NO: 2093270 - RNA, 20 nt, Homo sapiens
uaaacugauggauaucccua

SEQ ID NO: 2093271 - RNA, 16 nt, Homo sapiens
aaggaaauagacuuug

SEQ ID NO: 2093272 - RNA, 12 nt, Homo sapiens
cacacacaggcc

SEQ ID NO: 2093273 - RNA, 22 nt, Homo sapiens
cuucauuagcuuugggugccuu

SEQ ID NO: 2093274 - RNA, 19 nt, Homo sapiens
ccauucccaagaugccuga

SEQ ID NO: 2093275 - RNA, 14 nt, Homo sapiens
cugggccacuggca

SEQ ID NO: 2093276 - RNA, 18 nt, Homo sapiens
uucagauuugccauucaa

SEQ ID NO: 2093277 - RNA, 18 nt, Homo sapiens
uaccaaaucugacauauu

SEQ ID NO: 2093278 - RNA, 20 nt, Homo sapiens
ugaauacauuuccaaaaugg

SEQ ID NO: 2093279 - RNA, 19 nt, Homo sapiens
ggacugugccucaggccag

SEQ ID NO: 2093280 - RNA, 19 nt, Homo sapiens
uaccagagauuuuccucuc

SEQ ID NO: 2093281 - RNA, 17 nt, Homo sapiens
uaauggacuccacugaa

SEQ ID NO: 2093282 - RNA, 18 nt, Homo sapiens
auuuuuuaagcagacuca

SEQ ID NO: 2093283 - RNA, 19 nt, Homo sapiens
gagauauuaaugcccagac

SEQ ID NO: 2093284 - RNA, 17 nt, Homo sapiens
ggcugcaaucacacuga

SEQ ID NO: 2093285 - RNA, 24 nt, Homo sapiens
uaucuucaucugugaaauggggau

SEQ ID NO: 2093286 - RNA, 17 nt, Homo sapiens
gggcgugggcgcuugca

SEQ ID NO: 2093287 - RNA, 19 nt, Homo sapiens
accaacaggcguucucagc

SEQ ID NO: 2093288 - RNA, 18 nt, Homo sapiens
uaaaagacaguaguuuau

SEQ ID NO: 2093289 - RNA, 11 nt, Homo sapiens
cagcucaggga

SEQ ID NO: 2093290 - RNA, 17 nt, Homo sapiens
uuaaugcagacaaacaa

SEQ ID NO: 2093291 - RNA, 16 nt, Homo sapiens
accuccgccaaugcac

SEQ ID NO: 2093292 - RNA, 21 nt, Homo sapiens
agcaggaaagaucccaaguca

SEQ ID NO: 2093293 - RNA, 23 nt, Homo sapiens
cuuucccucucccaguccauuuc

SEQ ID NO: 2093294 - RNA, 20 nt, Homo sapiens
guuggaauuucauuauaugu

SEQ ID NO: 2093295 - RNA, 13 nt, Homo sapiens
uucaccuuucuag

SEQ ID NO: 2093296 - RNA, 22 nt, Homo sapiens
gaacacaauaaacuauuuugaa

SEQ ID NO: 2093297 - RNA, 20 nt, Homo sapiens
uguacugauacuauucaaug

SEQ ID NO: 2093298 - RNA, 20 nt, Homo sapiens
cagccuccugaguagcugga

SEQ ID NO: 2093299 - RNA, 16 nt, Homo sapiens
cacagcccccuccuca

SEQ ID NO: 2093300 - RNA, 18 nt, Homo sapiens
aagcagaacuuccaaaga

SEQ ID NO: 2093301 - RNA, 21 nt, Homo sapiens
aaaagacuucccuaacacuua

SEQ ID NO: 2093302 - RNA, 13 nt, Homo sapiens
ggucuccaagacc

SEQ ID NO: 2093303 - RNA, 20 nt, Homo sapiens
gcucagcaugcauccuuugc

SEQ ID NO: 2093304 - RNA, 16 nt, Homo sapiens
cgggccccauccucau

SEQ ID NO: 2093305 - RNA, 22 nt, Homo sapiens
aacucuucagccucauucacug

SEQ ID NO: 2093306 - RNA, 19 nt, Homo sapiens
uaguccagugguccaacua

SEQ ID NO: 2093307 - RNA, 19 nt, Homo sapiens
ugcugcuuugcuucuucaa

SEQ ID NO: 2093308 - RNA, 19 nt, Homo sapiens
uauccauuaucauguguaa

SEQ ID NO: 2093309 - RNA, 17 nt, Homo sapiens
ccugcacguugugcaca

SEQ ID NO: 2093310 - RNA, 14 nt, Homo sapiens
auuucaaagggaaa

SEQ ID NO: 2093311 - RNA, 16 nt, Homo sapiens
gaagcccccacuacua

SEQ ID NO: 2093312 - RNA, 20 nt, Homo sapiens
acugauuuuuagcuuuacaa

SEQ ID NO: 2093313 - RNA, 14 nt, Homo sapiens
ggcuccacuguaaa

SEQ ID NO: 2093314 - RNA, 16 nt, Homo sapiens
agaaucucagcacuuu

SEQ ID NO: 2093315 - RNA, 24 nt, Homo sapiens
ugccucuggucgccgcacuucuga

SEQ ID NO: 2093316 - RNA, 23 nt, Homo sapiens
auuuccugugucuuuuuucacua

SEQ ID NO: 2093317 - RNA, 17 nt, Homo sapiens
acugugcuugcuccuaa

SEQ ID NO: 2093318 - RNA, 21 nt, Homo sapiens
ucaaaccugcauauugugauu

SEQ ID NO: 2093319 - RNA, 18 nt, Homo sapiens
agaguuucaaaacauaca

SEQ ID NO: 2093320 - RNA, 22 nt, Homo sapiens
acuucauacgauuugagccuga

SEQ ID NO: 2093321 - RNA, 15 nt, Homo sapiens
guuuucuacuuugaa

SEQ ID NO: 2093322 - RNA, 13 nt, Homo sapiens
uggacagacacug

SEQ ID NO: 2093323 - RNA, 18 nt, Homo sapiens
ggaauagcccgaggaccg

SEQ ID NO: 2093324 - RNA, 22 nt, Homo sapiens
cuucacugcagaauguaaaggu

SEQ ID NO: 2093325 - RNA, 20 nt, Homo sapiens
ugacauuuaucaccucugau

SEQ ID NO: 2093326 - RNA, 20 nt, Homo sapiens
uauuauuuggcaugcuuaaa

SEQ ID NO: 2093327 - RNA, 15 nt, Homo sapiens
agcuaugaaaccacu

SEQ ID NO: 2093328 - RNA, 16 nt, Homo sapiens
gcaccaauaaagccuu

SEQ ID NO: 2093329 - RNA, 20 nt, Homo sapiens
cucagcgccagcucuaccag

SEQ ID NO: 2093330 - RNA, 14 nt, Homo sapiens
ccauuucucaggga

SEQ ID NO: 2093331 - RNA, 20 nt, Homo sapiens
uaaacugauguauagcuuua

SEQ ID NO: 2093332 - RNA, 19 nt, Homo sapiens
uucaaggccuucaguuuau

SEQ ID NO: 2093333 - RNA, 16 nt, Homo sapiens
aaagaauuccaaagca

SEQ ID NO: 2093334 - RNA, 16 nt, Homo sapiens
ccuaaauaaaugagcu

SEQ ID NO: 2093335 - RNA, 17 nt, Homo sapiens
aauuuuagugugccuuc

SEQ ID NO: 2093336 - RNA, 15 nt, Homo sapiens
auuucacucuggcau

SEQ ID NO: 2093337 - RNA, 19 nt, Homo sapiens
cugcggaagccaaaggcag

SEQ ID NO: 2093338 - RNA, 16 nt, Homo sapiens
aagagcuuacaagacc

SEQ ID NO: 2093339 - RNA, 13 nt, Homo sapiens
uaucaggucccau

SEQ ID NO: 2093340 - RNA, 21 nt, Homo sapiens
agccuugggguuggacaucuc

SEQ ID NO: 2093341 - RNA, 14 nt, Homo sapiens
uaacacugaugaua

SEQ ID NO: 2093342 - RNA, 22 nt, Homo sapiens
auauacuugacucuaauaugau

SEQ ID NO: 2093343 - RNA, 18 nt, Homo sapiens
aucagaggaaaagggcaa

SEQ ID NO: 2093344 - RNA, 20 nt, Homo sapiens
gugagcauggaacacuucga

SEQ ID NO: 2093345 - RNA, 20 nt, Homo sapiens
accucaaaauaagccaugcu

SEQ ID NO: 2093346 - RNA, 22 nt, Homo sapiens
ggaccucggaugaccauacuca

SEQ ID NO: 2093347 - RNA, 15 nt, Homo sapiens
acauggccugagcau

SEQ ID NO: 2093348 - RNA, 13 nt, Homo sapiens
aucucucaucacu

SEQ ID NO: 2093349 - RNA, 15 nt, Homo sapiens
cagcaccucucagga

SEQ ID NO: 2093350 - RNA, 23 nt, Homo sapiens
agguauaauucacauuguauuca

SEQ ID NO: 2093351 - RNA, 12 nt, Homo sapiens
aagugugcaaaa

SEQ ID NO: 2093352 - RNA, 17 nt, Homo sapiens
ggaucucucuccucucu

SEQ ID NO: 2093353 - RNA, 23 nt, Homo sapiens
uauacaaugaguaaaaucacaga

SEQ ID NO: 2093354 - RNA, 12 nt, Homo sapiens
gacgugcucccc

SEQ ID NO: 2093355 - RNA, 15 nt, Homo sapiens
ccuggaagguggaag

SEQ ID NO: 2093356 - RNA, 22 nt, Homo sapiens
ugaaaucaguaaacacugugua

SEQ ID NO: 2093357 - RNA, 17 nt, Homo sapiens
agcacaccccacagcca

SEQ ID NO: 2093358 - RNA, 17 nt, Homo sapiens
gcuaucagaaacaguau

SEQ ID NO: 2093359 - RNA, 18 nt, Homo sapiens
aggggucagagcacuccc

SEQ ID NO: 2093360 - RNA, 18 nt, Homo sapiens
acuuaauucuguuacaca

SEQ ID NO: 2093361 - RNA, 11 nt, Homo sapiens
ccuuuucauag

SEQ ID NO: 2093362 - RNA, 15 nt, Homo sapiens
uggcucaagucugca

SEQ ID NO: 2093363 - RNA, 14 nt, Homo sapiens
aacuuuaugaacuc

SEQ ID NO: 2093364 - RNA, 16 nt, Homo sapiens
uaacaauaaaguguga

SEQ ID NO: 2093365 - RNA, 15 nt, Homo sapiens
caaaacccaccaaaa

SEQ ID NO: 2093366 - RNA, 22 nt, Homo sapiens
uacugugaccuaagaacaaaac

SEQ ID NO: 2093367 - RNA, 15 nt, Homo sapiens
aaccaaaacaugucu

SEQ ID NO: 2093368 - RNA, 15 nt, Homo sapiens
cucccagcagcucaa

SEQ ID NO: 2093369 - RNA, 13 nt, Homo sapiens
aaaguagugcuua

SEQ ID NO: 2093370 - RNA, 22 nt, Homo sapiens
ccacacgccucuguguacaugu

SEQ ID NO: 2093371 - RNA, 21 nt, Homo sapiens
ugcuugcuggaaaacugccac

SEQ ID NO: 2093372 - RNA, 13 nt, Homo sapiens
ucaaguuguuuaa

SEQ ID NO: 2093373 - RNA, 19 nt, Homo sapiens
acccagguuggagugcagu

SEQ ID NO: 2093374 - RNA, 23 nt, Homo sapiens
gcccaugggauaugugguguaua

SEQ ID NO: 2093375 - RNA, 18 nt, Homo sapiens
auaucauccacacaugaa

SEQ ID NO: 2093376 - RNA, 19 nt, Homo sapiens
acucaucuugaucaaccaa

SEQ ID NO: 2093377 - RNA, 21 nt, Homo sapiens
cucuccaggccccaggucauc

SEQ ID NO: 2093378 - RNA, 17 nt, Homo sapiens
ugugcccccagccucag

SEQ ID NO: 2093379 - RNA, 20 nt, Homo sapiens
agccugcguggcugaccccc

SEQ ID NO: 2093380 - RNA, 19 nt, Homo sapiens
ucuccagaugagaguacac

SEQ ID NO: 2093381 - RNA, 13 nt, Homo sapiens
uguaaauguacug

SEQ ID NO: 2093382 - RNA, 20 nt, Homo sapiens
ugaaugagccaaagaacaaa

SEQ ID NO: 2093383 - RNA, 12 nt, Homo sapiens
uugauggugaua

SEQ ID NO: 2093384 - RNA, 16 nt, Homo sapiens
auaaacuaguaugaaa

SEQ ID NO: 2093385 - RNA, 19 nt, Homo sapiens
acucaucccuguuccucaa

SEQ ID NO: 2093386 - RNA, 18 nt, Homo sapiens
cuaaaugagauacacuga

SEQ ID NO: 2093387 - RNA, 15 nt, Homo sapiens
acaugcgcacucuca

SEQ ID NO: 2093388 - RNA, 18 nt, Homo sapiens
agcaucugcaacaaaaag

SEQ ID NO: 2093389 - RNA, 19 nt, Homo sapiens
cgagcuugaguucugcacu

SEQ ID NO: 2093390 - RNA, 13 nt, Homo sapiens
ucaccccugacau

SEQ ID NO: 2093391 - RNA, 20 nt, Homo sapiens
ugcuccagacucacuugcca

SEQ ID NO: 2093392 - RNA, 20 nt, Homo sapiens
auaguaaaauucuacuguau

SEQ ID NO: 2093393 - RNA, 17 nt, Homo sapiens
agcuuccuucaggaccc

SEQ ID NO: 2093394 - RNA, 16 nt, Homo sapiens
uggagaagaggaagac

SEQ ID NO: 2093395 - RNA, 11 nt, Homo sapiens
cuuugcauuca

SEQ ID NO: 2093396 - RNA, 22 nt, Homo sapiens
acaaaugcaucaugaguugcaa

SEQ ID NO: 2093397 - RNA, 19 nt, Homo sapiens
uccuguguaacaucugcca

SEQ ID NO: 2093398 - RNA, 11 nt, Homo sapiens
ucugcauuuac

SEQ ID NO: 2093399 - RNA, 17 nt, Homo sapiens
ugaacuguaguacaugg

SEQ ID NO: 2093400 - RNA, 22 nt, Homo sapiens
guuaccucaugccgcugugucu

SEQ ID NO: 2093401 - RNA, 15 nt, Homo sapiens
gaaagaaaauuuaau

SEQ ID NO: 2093402 - RNA, 21 nt, Homo sapiens
agacaagcucaaguguucaca

SEQ ID NO: 2093403 - RNA, 18 nt, Homo sapiens
cucagccucccaaagugc

SEQ ID NO: 2093404 - RNA, 16 nt, Homo sapiens
gacaugcagcucugau

SEQ ID NO: 2093405 - RNA, 22 nt, Homo sapiens
cuguauuuuuauuuuugcacaa

SEQ ID NO: 2093406 - RNA, 14 nt, Homo sapiens
gaaggccagcugaa

SEQ ID NO: 2093407 - RNA, 19 nt, Homo sapiens
aaguuagggaugacuguga

SEQ ID NO: 2093408 - RNA, 17 nt, Homo sapiens
uccuuuuauguggucuc

SEQ ID NO: 2093409 - RNA, 16 nt, Homo sapiens
gugaaacucaucucau

SEQ ID NO: 2093410 - RNA, 20 nt, Homo sapiens
accacuggagaucaccagug

SEQ ID NO: 2093411 - RNA, 16 nt, Homo sapiens
cagaaucccguaacac

SEQ ID NO: 2093412 - RNA, 19 nt, Homo sapiens
acgguucaaaccugugaag

SEQ ID NO: 2093413 - RNA, 21 nt, Homo sapiens
gaaccugcccugcucccacag

SEQ ID NO: 2093414 - RNA, 23 nt, Homo sapiens
uagacucugguauggccaaagau

SEQ ID NO: 2093415 - RNA, 16 nt, Homo sapiens
acauuuugacacaaaa

SEQ ID NO: 2093416 - RNA, 17 nt, Homo sapiens
cuuuauuggcugagaua

SEQ ID NO: 2093417 - RNA, 23 nt, Homo sapiens
cuugucaccaguuaaaagcauuu

SEQ ID NO: 2093418 - RNA, 15 nt, Homo sapiens
caaauaguaaucugu

SEQ ID NO: 2093419 - RNA, 21 nt, Homo sapiens
cuuggugguuaugucccauga

SEQ ID NO: 2093420 - RNA, 19 nt, Homo sapiens
ccucagaagugcaucugga

SEQ ID NO: 2093421 - RNA, 19 nt, Homo sapiens
ugaaucugcuuuuccucug

SEQ ID NO: 2093422 - RNA, 12 nt, Homo sapiens
cauauuauaugu

SEQ ID NO: 2093423 - RNA, 12 nt, Homo sapiens
uucauccaggga

SEQ ID NO: 2093424 - RNA, 23 nt, Homo sapiens
auaauaugugaugauuaauacaa

SEQ ID NO: 2093425 - RNA, 16 nt, Homo sapiens
agaaauuccaauauaa

SEQ ID NO: 2093426 - RNA, 18 nt, Homo sapiens
gccaugggccuccugugu

SEQ ID NO: 2093427 - RNA, 16 nt, Homo sapiens
agggacaggcacucca

SEQ ID NO: 2093428 - RNA, 17 nt, Homo sapiens
uauuugcuuuaaugaga

SEQ ID NO: 2093429 - RNA, 17 nt, Homo sapiens
gaaaacucauacagugg

SEQ ID NO: 2093430 - RNA, 16 nt, Homo sapiens
ucucaagcuagccaga

SEQ ID NO: 2093431 - RNA, 13 nt, Homo sapiens
gagacuggugaca

SEQ ID NO: 2093432 - RNA, 14 nt, Homo sapiens
ugacugccacccac

SEQ ID NO: 2093433 - RNA, 14 nt, Homo sapiens
uccagaggcccuag

SEQ ID NO: 2093434 - RNA, 14 nt, Homo sapiens
uccuggggcccaaa

SEQ ID NO: 2093435 - RNA, 17 nt, Homo sapiens
auuuuaguuaacuauga

SEQ ID NO: 2093436 - RNA, 15 nt, Homo sapiens
aaacugaaugaacaa

SEQ ID NO: 2093437 - RNA, 15 nt, Homo sapiens
uuaaaguuacuuugu

SEQ ID NO: 2093438 - RNA, 15 nt, Homo sapiens
cgucaagugaucugc

SEQ ID NO: 2093439 - RNA, 16 nt, Homo sapiens
cucaaccaccuuucag

SEQ ID NO: 2093440 - RNA, 13 nt, Homo sapiens
cacgccugcaaac

SEQ ID NO: 2093441 - RNA, 19 nt, Homo sapiens
cuucugccguugcugccag

SEQ ID NO: 2093442 - RNA, 15 nt, Homo sapiens
ccuucccucugcauu

SEQ ID NO: 2093443 - RNA, 16 nt, Homo sapiens
aaaaugccugcugcug

SEQ ID NO: 2093444 - RNA, 19 nt, Homo sapiens
uagcaaaaauguuuuccaa

SEQ ID NO: 2093445 - RNA, 13 nt, Homo sapiens
cggcuccucaggg

SEQ ID NO: 2093446 - RNA, 20 nt, Homo sapiens
gacuccgucucaaaaacaaa

SEQ ID NO: 2093447 - RNA, 11 nt, Homo sapiens
aucuaccugcc

SEQ ID NO: 2093448 - RNA, 17 nt, Homo sapiens
gaccagcccagccaaca

SEQ ID NO: 2093449 - RNA, 23 nt, Homo sapiens
uucaugugguucagugccuuccu

SEQ ID NO: 2093450 - RNA, 16 nt, Homo sapiens
ucugacccuccuucua

SEQ ID NO: 2093451 - RNA, 22 nt, Homo sapiens
caaauguauugauuacaaauaa

SEQ ID NO: 2093452 - RNA, 23 nt, Homo sapiens
cauaaucauggcucuuagaaacu

SEQ ID NO: 2093453 - RNA, 19 nt, Homo sapiens
ugaccggcagaauguucug

SEQ ID NO: 2093454 - RNA, 18 nt, Homo sapiens
acuaggcuauaugcauuu

SEQ ID NO: 2093455 - RNA, 15 nt, Homo sapiens
gaauuacugcaaagg

SEQ ID NO: 2093456 - RNA, 17 nt, Homo sapiens
uggaacacucaugucug

SEQ ID NO: 2093457 - RNA, 12 nt, Homo sapiens
acagacuuuguu

SEQ ID NO: 2093458 - RNA, 22 nt, Homo sapiens
ugcauccacgcacacauggaca

SEQ ID NO: 2093459 - RNA, 19 nt, Homo sapiens
ucugcugggccaccagcca

SEQ ID NO: 2093460 - RNA, 17 nt, Homo sapiens
cucuuuucuacacacuc

SEQ ID NO: 2093461 - RNA, 21 nt, Homo sapiens
gaggauuccgucuucucucau

SEQ ID NO: 2093462 - RNA, 18 nt, Homo sapiens
auaagaaucuauaguuca

SEQ ID NO: 2093463 - RNA, 22 nt, Homo sapiens
auuucuuuuagaaaaggccaau

SEQ ID NO: 2093464 - RNA, 13 nt, Homo sapiens
agaguuugcucaa

SEQ ID NO: 2093465 - RNA, 16 nt, Homo sapiens
gauggacuccugacca

SEQ ID NO: 2093466 - RNA, 12 nt, Homo sapiens
uuguuucuguca

SEQ ID NO: 2093467 - RNA, 14 nt, Homo sapiens
caauuaugugcaaa

SEQ ID NO: 2093468 - RNA, 19 nt, Homo sapiens
cucugcacuauagccauuu

SEQ ID NO: 2093469 - RNA, 15 nt, Homo sapiens
cuacuuuguggcaau

SEQ ID NO: 2093470 - RNA, 18 nt, Homo sapiens
gccccagucgaacugggg

SEQ ID NO: 2093471 - RNA, 17 nt, Homo sapiens
gaucuuggggugcagca

SEQ ID NO: 2093472 - RNA, 16 nt, Homo sapiens
caaaaagucacaguua

SEQ ID NO: 2093473 - RNA, 15 nt, Homo sapiens
acuugcaaaauggag

SEQ ID NO: 2093474 - RNA, 16 nt, Homo sapiens
uuccugauuuucuggu

SEQ ID NO: 2093475 - RNA, 14 nt, Homo sapiens
gagagaguggcuuu

SEQ ID NO: 2093476 - RNA, 18 nt, Homo sapiens
uacauaauaaccaaacau

SEQ ID NO: 2093477 - RNA, 13 nt, Homo sapiens
uggagaaguucag

SEQ ID NO: 2093478 - RNA, 17 nt, Homo sapiens
guccaacgccgccuugg

SEQ ID NO: 2093479 - RNA, 17 nt, Homo sapiens
uacacuggguucugcua

SEQ ID NO: 2093480 - RNA, 16 nt, Homo sapiens
ccccuaagaggcagug

SEQ ID NO: 2093481 - RNA, 19 nt, Homo sapiens
gcagaucauguaaggaagg

SEQ ID NO: 2093482 - RNA, 16 nt, Homo sapiens
aagguuguauguguca

SEQ ID NO: 2093483 - RNA, 16 nt, Homo sapiens
guggugcgagugcgug

SEQ ID NO: 2093484 - RNA, 14 nt, Homo sapiens
gcuuaugcauuuau

SEQ ID NO: 2093485 - RNA, 14 nt, Homo sapiens
cccaaauccagugu

SEQ ID NO: 2093486 - RNA, 22 nt, Homo sapiens
ugggcagggucuguuuggacug

SEQ ID NO: 2093487 - RNA, 22 nt, Homo sapiens
cagcuaacaaguagcacacuga

SEQ ID NO: 2093488 - RNA, 21 nt, Homo sapiens
cuugguucagguuucuuugaa

SEQ ID NO: 2093489 - RNA, 14 nt, Homo sapiens
cuccaggaaugccu

SEQ ID NO: 2093490 - RNA, 15 nt, Homo sapiens
gaucuuucuuuccuu

SEQ ID NO: 2093491 - RNA, 23 nt, Homo sapiens
auuucucauuugaguauuacaau

SEQ ID NO: 2093492 - RNA, 19 nt, Homo sapiens
agucuauccuagucuucac

SEQ ID NO: 2093493 - RNA, 20 nt, Homo sapiens
uucgacccuuucucugagag

SEQ ID NO: 2093494 - RNA, 12 nt, Homo sapiens
gacccagugcag

SEQ ID NO: 2093495 - RNA, 13 nt, Homo sapiens
uacccuuccugcc

SEQ ID NO: 2093496 - RNA, 15 nt, Homo sapiens
ccccacccuagcccu

SEQ ID NO: 2093497 - RNA, 21 nt, Homo sapiens
cgggccuggagaacuagagaa

SEQ ID NO: 2093498 - RNA, 13 nt, Homo sapiens
uuaagugcugcag

SEQ ID NO: 2093499 - RNA, 17 nt, Homo sapiens
uguuguaagaaagacaa

SEQ ID NO: 2093500 - RNA, 23 nt, Homo sapiens
gcuucucaccgugcagagcugca

SEQ ID NO: 2093501 - RNA, 16 nt, Homo sapiens
auauuaucaugucuau

SEQ ID NO: 2093502 - RNA, 23 nt, Homo sapiens
uacgagccccacagagcaggaag

SEQ ID NO: 2093503 - RNA, 22 nt, Homo sapiens
uuaaacaguaaaacaaaaauuc

SEQ ID NO: 2093504 - RNA, 21 nt, Homo sapiens
ugaaugccaguccagaugugc

SEQ ID NO: 2093505 - RNA, 13 nt, Homo sapiens
cuucgacugugac

SEQ ID NO: 2093506 - RNA, 14 nt, Homo sapiens
uucuucagggccag

SEQ ID NO: 2093507 - RNA, 22 nt, Homo sapiens
uauagcacauagaugucuguaa

SEQ ID NO: 2093508 - RNA, 17 nt, Homo sapiens
aaacaugugccccugcc

SEQ ID NO: 2093509 - RNA, 19 nt, Homo sapiens
gaauguuugugucuguggu

SEQ ID NO: 2093510 - RNA, 11 nt, Homo sapiens
aacaucacuug

SEQ ID NO: 2093511 - RNA, 14 nt, Homo sapiens
uguucuuugucuca

SEQ ID NO: 2093512 - RNA, 21 nt, Homo sapiens
aauccaugugcugcuguggca

SEQ ID NO: 2093513 - RNA, 15 nt, Homo sapiens
aauaacugaaccaaa

SEQ ID NO: 2093514 - RNA, 17 nt, Homo sapiens
gucaagaauagcauugu

SEQ ID NO: 2093515 - RNA, 17 nt, Homo sapiens
ccauggaccugcacuug

SEQ ID NO: 2093516 - RNA, 19 nt, Homo sapiens
ugaugccaauacuagucac

SEQ ID NO: 2093517 - RNA, 16 nt, Homo sapiens
augggagagguucugu

SEQ ID NO: 2093518 - RNA, 20 nt, Homo sapiens
cagucacuggcccaaccaga

SEQ ID NO: 2093519 - RNA, 23 nt, Homo sapiens
agggagccaucccuucccugucc

SEQ ID NO: 2093520 - RNA, 23 nt, Homo sapiens
uuguagaugaaaaagcauguaca

SEQ ID NO: 2093521 - RNA, 12 nt, Homo sapiens
uucuugucuuua

SEQ ID NO: 2093522 - RNA, 21 nt, Homo sapiens
ccuaggaauucccagcccaaa

SEQ ID NO: 2093523 - RNA, 19 nt, Homo sapiens
cuugauaggaauucaucuu

SEQ ID NO: 2093524 - RNA, 19 nt, Homo sapiens
gauuucugguugauuugua

SEQ ID NO: 2093525 - RNA, 21 nt, Homo sapiens
guaugcaaaccucaucuuucu

SEQ ID NO: 2093526 - RNA, 20 nt, Homo sapiens
cagggaagcccugacugugu

SEQ ID NO: 2093527 - RNA, 22 nt, Homo sapiens
gccugaggaggaggacacagca

SEQ ID NO: 2093528 - RNA, 17 nt, Homo sapiens
cagacaaaguaauuccu

SEQ ID NO: 2093529 - RNA, 19 nt, Homo sapiens
uugauauaaauaaaacauu

SEQ ID NO: 2093530 - RNA, 23 nt, Homo sapiens
gccuucuuuucaaaacugcuaaa

SEQ ID NO: 2093531 - RNA, 14 nt, Homo sapiens
uuugauuuacauau

SEQ ID NO: 2093532 - RNA, 23 nt, Homo sapiens
ucuguaaaauagucucauugcca

SEQ ID NO: 2093533 - RNA, 13 nt, Homo sapiens
cacaagaccaucu

SEQ ID NO: 2093534 - RNA, 13 nt, Homo sapiens
ucacacaccagca

SEQ ID NO: 2093535 - RNA, 19 nt, Homo sapiens
ucugugcucugaaugggag

SEQ ID NO: 2093536 - RNA, 21 nt, Homo sapiens
ccgccauugccaccaggagaa

SEQ ID NO: 2093537 - RNA, 17 nt, Homo sapiens
cccugucacacacugga

SEQ ID NO: 2093538 - RNA, 15 nt, Homo sapiens
aauauucuggaguca

SEQ ID NO: 2093539 - RNA, 21 nt, Homo sapiens
cagcugugaccacagcaguuu

SEQ ID NO: 2093540 - RNA, 13 nt, Homo sapiens
cacaaacccaagg

SEQ ID NO: 2093541 - RNA, 18 nt, Homo sapiens
ucugagggcccguguaaa

SEQ ID NO: 2093542 - RNA, 16 nt, Homo sapiens
uuugaauagcaauuag

SEQ ID NO: 2093543 - RNA, 23 nt, Homo sapiens
guccuuuccuucucgucuuccuc

SEQ ID NO: 2093544 - RNA, 22 nt, Homo sapiens
auucagacaacauuaugaucua

SEQ ID NO: 2093545 - RNA, 13 nt, Homo sapiens
acuccauuacugu

SEQ ID NO: 2093546 - RNA, 21 nt, Homo sapiens
ucacagcaauauuuaacaauu

SEQ ID NO: 2093547 - RNA, 17 nt, Homo sapiens
acauuuccucagucaag

SEQ ID NO: 2093548 - RNA, 16 nt, Homo sapiens
ucugaaucaaggugau

SEQ ID NO: 2093549 - RNA, 15 nt, Homo sapiens
cagcuguguucacac

SEQ ID NO: 2093550 - RNA, 17 nt, Homo sapiens
uguccauuuugugaagc

SEQ ID NO: 2093551 - RNA, 16 nt, Homo sapiens
gggccuguuaugucaa

SEQ ID NO: 2093552 - RNA, 13 nt, Homo sapiens
auuucuaucaaaa

SEQ ID NO: 2093553 - RNA, 16 nt, Homo sapiens
gcagcaggugaccucc

SEQ ID NO: 2093554 - RNA, 20 nt, Homo sapiens
cauacagggaugguguucaa

SEQ ID NO: 2093555 - RNA, 23 nt, Homo sapiens
aggcuuccucuucagcaugcccc

SEQ ID NO: 2093556 - RNA, 23 nt, Homo sapiens
cagaaacagugggagcccugacc

SEQ ID NO: 2093557 - RNA, 16 nt, Homo sapiens
uagaugguuugagccu

SEQ ID NO: 2093558 - RNA, 22 nt, Homo sapiens
cuguguggacugugaugccaca

SEQ ID NO: 2093559 - RNA, 16 nt, Homo sapiens
cuucagcaaugaauug

SEQ ID NO: 2093560 - RNA, 13 nt, Homo sapiens
augacauuauuaa

SEQ ID NO: 2093561 - RNA, 14 nt, Homo sapiens
auaguccuuuacaa

SEQ ID NO: 2093562 - RNA, 16 nt, Homo sapiens
ucaccugguaccugga

SEQ ID NO: 2093563 - RNA, 19 nt, Homo sapiens
uaucuugggauaguuccca

SEQ ID NO: 2093564 - RNA, 21 nt, Homo sapiens
caugggaaggguccaucucag

SEQ ID NO: 2093565 - RNA, 16 nt, Homo sapiens
cccagcccacccugcu

SEQ ID NO: 2093566 - RNA, 20 nt, Homo sapiens
agaucauaauuuuauguuca

SEQ ID NO: 2093567 - RNA, 16 nt, Homo sapiens
aauggaaacaccacug

SEQ ID NO: 2093568 - RNA, 21 nt, Homo sapiens
ucugccacgcuuuaugcccuu

SEQ ID NO: 2093569 - RNA, 16 nt, Homo sapiens
uccuggaaacagcaug

SEQ ID NO: 2093570 - RNA, 19 nt, Homo sapiens
uuggacaugaaggaugugg

SEQ ID NO: 2093571 - RNA, 20 nt, Homo sapiens
uguucugggccaggucccag

SEQ ID NO: 2093572 - RNA, 15 nt, Homo sapiens
ugguuagguagcaac

SEQ ID NO: 2093573 - RNA, 19 nt, Homo sapiens
aaagaaucucuugagacau

SEQ ID NO: 2093574 - RNA, 22 nt, Homo sapiens
caguacuguucccaacucagcu

SEQ ID NO: 2093575 - RNA, 17 nt, Homo sapiens
uuuugugcaaagccaaa

SEQ ID NO: 2093576 - RNA, 17 nt, Homo sapiens
gcuggccccaaaggaaa

SEQ ID NO: 2093577 - RNA, 15 nt, Homo sapiens
gccaccacugagucc

SEQ ID NO: 2093578 - RNA, 21 nt, Homo sapiens
cucuucccauaccacccaaug

SEQ ID NO: 2093579 - RNA, 21 nt, Homo sapiens
uuuccauaaagguaacaaagg

SEQ ID NO: 2093580 - RNA, 19 nt, Homo sapiens
cacaucucguauaauauuc

SEQ ID NO: 2093581 - RNA, 18 nt, Homo sapiens
agaaauccuaguaugcca

SEQ ID NO: 2093582 - RNA, 19 nt, Homo sapiens
ucaagcuguugaagucuca

SEQ ID NO: 2093583 - RNA, 13 nt, Homo sapiens
uuuaaaaugcaua

SEQ ID NO: 2093584 - RNA, 23 nt, Homo sapiens
guuaggcuuccaugauguuacau

SEQ ID NO: 2093585 - RNA, 16 nt, Homo sapiens
ccaggccagagugcag

SEQ ID NO: 2093586 - RNA, 23 nt, Homo sapiens
uuaaugagauguuauuacuguuu

SEQ ID NO: 2093587 - RNA, 16 nt, Homo sapiens
cgugauuuccagugag

SEQ ID NO: 2093588 - RNA, 16 nt, Homo sapiens
ugaucuauugcagaua

SEQ ID NO: 2093589 - RNA, 21 nt, Homo sapiens
agcucccaggaccacaggcuc

SEQ ID NO: 2093590 - RNA, 15 nt, Homo sapiens
ucugagcccccugac

SEQ ID NO: 2093591 - RNA, 20 nt, Homo sapiens
auaaauuacuaucuguugaa

SEQ ID NO: 2093592 - RNA, 15 nt, Homo sapiens
cagguaaaacagggc

SEQ ID NO: 2093593 - RNA, 20 nt, Homo sapiens
auuguucucccuccuaccug

SEQ ID NO: 2093594 - RNA, 22 nt, Homo sapiens
ucaauaaagaaagauggaagga

SEQ ID NO: 2093595 - RNA, 18 nt, Homo sapiens
aggcucacacugugcuca

SEQ ID NO: 2093596 - RNA, 18 nt, Homo sapiens
gggugacccugaagugag

SEQ ID NO: 2093597 - RNA, 18 nt, Homo sapiens
uagagaucuauguacugu

SEQ ID NO: 2093598 - RNA, 22 nt, Homo sapiens
cuuuucugccacuccauauuaa

SEQ ID NO: 2093599 - RNA, 14 nt, Homo sapiens
gacccuaaaucuga

SEQ ID NO: 2093600 - RNA, 13 nt, Homo sapiens
uuguauuguggaa

SEQ ID NO: 2093601 - RNA, 13 nt, Homo sapiens
uuguuuuguggau

SEQ ID NO: 2093602 - RNA, 19 nt, Homo sapiens
agcuuccaaaugugucaga

SEQ ID NO: 2093603 - RNA, 21 nt, Homo sapiens
uagaaacugaggcccagagag

SEQ ID NO: 2093604 - RNA, 19 nt, Homo sapiens
uacuauaaauauacauaua

SEQ ID NO: 2093605 - RNA, 14 nt, Homo sapiens
gccugccuucucag

SEQ ID NO: 2093606 - RNA, 16 nt, Homo sapiens
acuugaagccaucuaa

SEQ ID NO: 2093607 - RNA, 11 nt, Homo sapiens
aagccaaaggc

SEQ ID NO: 2093608 - RNA, 21 nt, Homo sapiens
uuacauguguuuauucaucca

SEQ ID NO: 2093609 - RNA, 12 nt, Homo sapiens
auuaaaauccag

SEQ ID NO: 2093610 - RNA, 19 nt, Homo sapiens
uguuuguaaauaagagauu

SEQ ID NO: 2093611 - RNA, 19 nt, Homo sapiens
ccucagcuucaaauaaagu

SEQ ID NO: 2093612 - RNA, 21 nt, Homo sapiens
aagaucaggucauacuaucua

SEQ ID NO: 2093613 - RNA, 20 nt, Homo sapiens
caaagggccagcagucuacc

SEQ ID NO: 2093614 - RNA, 15 nt, Homo sapiens
guuaucaacaugcac

SEQ ID NO: 2093615 - RNA, 20 nt, Homo sapiens
cuugggaaacuauucaugaa

SEQ ID NO: 2093616 - RNA, 15 nt, Homo sapiens
ucagcaacaugauac

SEQ ID NO: 2093617 - RNA, 22 nt, Homo sapiens
agauggaagucaccuuucuggg

SEQ ID NO: 2093618 - RNA, 20 nt, Homo sapiens
uggagagggaaaaucuucac

SEQ ID NO: 2093619 - RNA, 20 nt, Homo sapiens
uagcucuccauacuuugaac

SEQ ID NO: 2093620 - RNA, 13 nt, Homo sapiens
agcugagugcuga

SEQ ID NO: 2093621 - RNA, 23 nt, Homo sapiens
aagguuuggugcaaaguauugua

SEQ ID NO: 2093622 - RNA, 20 nt, Homo sapiens
gacuuaaccuugaaauggaa

SEQ ID NO: 2093623 - RNA, 21 nt, Homo sapiens
cauuuguucucacaccaacag

SEQ ID NO: 2093624 - RNA, 21 nt, Homo sapiens
ucagcucccuuauacccccau

SEQ ID NO: 2093625 - RNA, 17 nt, Homo sapiens
cugagaaaagccucucc

SEQ ID NO: 2093626 - RNA, 21 nt, Homo sapiens
auccaaauaaaaauaacauca

SEQ ID NO: 2093627 - RNA, 19 nt, Homo sapiens
gccugagcaggggcgggga

SEQ ID NO: 2093628 - RNA, 21 nt, Homo sapiens
cugaguuagaagcaaggcaca

SEQ ID NO: 2093629 - RNA, 19 nt, Homo sapiens
uucagaaaauucccaugag

SEQ ID NO: 2093630 - RNA, 12 nt, Homo sapiens
auauacuguuau

SEQ ID NO: 2093631 - RNA, 12 nt, Homo sapiens
agccacugugcc

SEQ ID NO: 2093632 - RNA, 16 nt, Homo sapiens
cuaucaaaacauauca

SEQ ID NO: 2093633 - RNA, 22 nt, Homo sapiens
guuuggauugauaucgugaaau

SEQ ID NO: 2093634 - RNA, 16 nt, Homo sapiens
uaaagccacgcugugu

SEQ ID NO: 2093635 - RNA, 22 nt, Homo sapiens
ucuccaucagaggacaccugua

SEQ ID NO: 2093636 - RNA, 17 nt, Homo sapiens
ugguuauggagucuugu

SEQ ID NO: 2093637 - RNA, 21 nt, Homo sapiens
gacucagaacaccaacuuaag

SEQ ID NO: 2093638 - RNA, 21 nt, Homo sapiens
gcacuuauauagcaccuuuca

SEQ ID NO: 2093639 - RNA, 14 nt, Homo sapiens
uggcugaagaauga

SEQ ID NO: 2093640 - RNA, 22 nt, Homo sapiens
aggugauauauaaucauaucca

SEQ ID NO: 2093641 - RNA, 17 nt, Homo sapiens
acaguucuuugggccag

SEQ ID NO: 2093642 - RNA, 11 nt, Homo sapiens
cagagcucagg

SEQ ID NO: 2093643 - RNA, 19 nt, Homo sapiens
ugacucaauuauuugcaua

SEQ ID NO: 2093644 - RNA, 14 nt, Homo sapiens
agaugguugccaag

SEQ ID NO: 2093645 - RNA, 18 nt, Homo sapiens
aauaugcugcucaucccc

SEQ ID NO: 2093646 - RNA, 19 nt, Homo sapiens
acacguaaaucuguucaag

SEQ ID NO: 2093647 - RNA, 15 nt, Homo sapiens
caucuucuccaucug

SEQ ID NO: 2093648 - RNA, 14 nt, Homo sapiens
gcaggcccagugac

SEQ ID NO: 2093649 - RNA, 11 nt, Homo sapiens
caccaggguuu

SEQ ID NO: 2093650 - RNA, 13 nt, Homo sapiens
cagucaccaccca

SEQ ID NO: 2093651 - RNA, 15 nt, Homo sapiens
gcagcacccauccac

SEQ ID NO: 2093652 - RNA, 23 nt, Homo sapiens
aguauacaauaaagucuuaccuc

SEQ ID NO: 2093653 - RNA, 13 nt, Homo sapiens
caguucugaagaa

SEQ ID NO: 2093654 - RNA, 22 nt, Homo sapiens
gggucacugaaggccuggccca

SEQ ID NO: 2093655 - RNA, 13 nt, Homo sapiens
gccccauguaucu

SEQ ID NO: 2093656 - RNA, 15 nt, Homo sapiens
uucccaaguguaauu

SEQ ID NO: 2093657 - RNA, 13 nt, Homo sapiens
cgucuaugcugcu

SEQ ID NO: 2093658 - RNA, 13 nt, Homo sapiens
uugaaauguguaa

SEQ ID NO: 2093659 - RNA, 13 nt, Homo sapiens
aggaaaugauuaa

SEQ ID NO: 2093660 - RNA, 14 nt, Homo sapiens
cacaucagugcaca

SEQ ID NO: 2093661 - RNA, 21 nt, Homo sapiens
aucuccuuuaaugacauugau

SEQ ID NO: 2093662 - RNA, 16 nt, Homo sapiens
gcugcgcacugugucc

SEQ ID NO: 2093663 - RNA, 21 nt, Homo sapiens
aggagcugcuggcuugcagug

SEQ ID NO: 2093664 - RNA, 22 nt, Homo sapiens
ggccauccugucccaccaugca

SEQ ID NO: 2093665 - RNA, 18 nt, Homo sapiens
uuacauguuuuuucauuu

SEQ ID NO: 2093666 - RNA, 17 nt, Homo sapiens
cucuugagacuacuuca

SEQ ID NO: 2093667 - RNA, 17 nt, Homo sapiens
ugggacuguuuacaaau

SEQ ID NO: 2093668 - RNA, 20 nt, Homo sapiens
uuuagcgguuugcaaacaaa

SEQ ID NO: 2093669 - RNA, 22 nt, Homo sapiens
agaaaauauuauguguuuccau

SEQ ID NO: 2093670 - RNA, 18 nt, Homo sapiens
gagggacccuuccaaggu

SEQ ID NO: 2093671 - RNA, 18 nt, Homo sapiens
uuuucaguagcaggaccu

SEQ ID NO: 2093672 - RNA, 12 nt, Homo sapiens
caacaaucuucc

SEQ ID NO: 2093673 - RNA, 19 nt, Homo sapiens
aguagcugcccuuccugcc

SEQ ID NO: 2093674 - RNA, 18 nt, Homo sapiens
aaagggcgcaaagggcau

SEQ ID NO: 2093675 - RNA, 18 nt, Homo sapiens
gaccucaaguguccugaa

SEQ ID NO: 2093676 - RNA, 22 nt, Homo sapiens
cuucuuucaaaguguaagcacu

SEQ ID NO: 2093677 - RNA, 15 nt, Homo sapiens
cuggguaagagcaca

SEQ ID NO: 2093678 - RNA, 18 nt, Homo sapiens
auccaguguauaaaucca

SEQ ID NO: 2093679 - RNA, 22 nt, Homo sapiens
cuuuaauuucaugaaaagauua

SEQ ID NO: 2093680 - RNA, 17 nt, Homo sapiens
uacacauacauacacau

SEQ ID NO: 2093681 - RNA, 15 nt, Homo sapiens
uugaccuuugcacga

SEQ ID NO: 2093682 - RNA, 14 nt, Homo sapiens
gauugcucuggaag

SEQ ID NO: 2093683 - RNA, 21 nt, Homo sapiens
aucagccagacgagguccuca

SEQ ID NO: 2093684 - RNA, 11 nt, Homo sapiens
caaagugcuuu

SEQ ID NO: 2093685 - RNA, 21 nt, Homo sapiens
guguccuucuuccucaagucu

SEQ ID NO: 2093686 - RNA, 22 nt, Homo sapiens
cuauuucauguuuuugaucaaa

SEQ ID NO: 2093687 - RNA, 13 nt, Homo sapiens
agcgaaucucugc

SEQ ID NO: 2093688 - RNA, 20 nt, Homo sapiens
ugaauguuuucaaaaccaag

SEQ ID NO: 2093689 - RNA, 12 nt, Homo sapiens
ugucaucugcca

SEQ ID NO: 2093690 - RNA, 22 nt, Homo sapiens
cuucuuaaccauucuacugugu

SEQ ID NO: 2093691 - RNA, 11 nt, Homo sapiens
gguacauuucu

SEQ ID NO: 2093692 - RNA, 19 nt, Homo sapiens
agggcaacuugaggucuga

SEQ ID NO: 2093693 - RNA, 16 nt, Homo sapiens
gaauuggauccagggg

SEQ ID NO: 2093694 - RNA, 18 nt, Homo sapiens
uaaagaaggauaaauugu

SEQ ID NO: 2093695 - RNA, 21 nt, Homo sapiens
ccuccucagcgagaggcagca

SEQ ID NO: 2093696 - RNA, 11 nt, Homo sapiens
uccaugcaugu

SEQ ID NO: 2093697 - RNA, 18 nt, Homo sapiens
uuucuucuuuguggucuu

SEQ ID NO: 2093698 - RNA, 18 nt, Homo sapiens
uucuaaggaaugcacaaa

SEQ ID NO: 2093699 - RNA, 16 nt, Homo sapiens
cuguacagagacucua

SEQ ID NO: 2093700 - RNA, 12 nt, Homo sapiens
auaaugccuuau

SEQ ID NO: 2093701 - RNA, 22 nt, Homo sapiens
agcgggagccucccugccucag

SEQ ID NO: 2093702 - RNA, 20 nt, Homo sapiens
acugaccauauugugcuuca

SEQ ID NO: 2093703 - RNA, 17 nt, Homo sapiens
acuugcccuucagcuca

SEQ ID NO: 2093704 - RNA, 21 nt, Homo sapiens
aaaccuugaugugccugugaa

SEQ ID NO: 2093705 - RNA, 16 nt, Homo sapiens
acuuaguauugcaaag

SEQ ID NO: 2093706 - RNA, 16 nt, Homo sapiens
cuuuuacuacagugac

SEQ ID NO: 2093707 - RNA, 14 nt, Homo sapiens
aaucuagugaucuc

SEQ ID NO: 2093708 - RNA, 19 nt, Homo sapiens
acuugcccugaccaugcau

SEQ ID NO: 2093709 - RNA, 21 nt, Homo sapiens
agggaagauggagacacccuc

SEQ ID NO: 2093710 - RNA, 14 nt, Homo sapiens
gucuuugaacccuu

SEQ ID NO: 2093711 - RNA, 22 nt, Homo sapiens
aggaugcacgguuucuguucug

SEQ ID NO: 2093712 - RNA, 13 nt, Homo sapiens
acaguuguuuucc

SEQ ID NO: 2093713 - RNA, 19 nt, Homo sapiens
ggcuuugccucuucuuugu

SEQ ID NO: 2093714 - RNA, 14 nt, Homo sapiens
uaggcauaccuccu

SEQ ID NO: 2093715 - RNA, 20 nt, Homo sapiens
aucucaggcaggaaagcccc

SEQ ID NO: 2093716 - RNA, 12 nt, Homo sapiens
aaccuccagugu

SEQ ID NO: 2093717 - RNA, 12 nt, Homo sapiens
aaugaugaugac

SEQ ID NO: 2093718 - RNA, 22 nt, Homo sapiens
aaaacugccccccuccuuucca

SEQ ID NO: 2093719 - RNA, 15 nt, Homo sapiens
ccaguucacauuuau

SEQ ID NO: 2093720 - RNA, 23 nt, Homo sapiens
uaaccuccagcagacuccugcuc

SEQ ID NO: 2093721 - RNA, 18 nt, Homo sapiens
ccuacagcacuacugggu

SEQ ID NO: 2093722 - RNA, 21 nt, Homo sapiens
ccugaaaaaugcucaaucuca

SEQ ID NO: 2093723 - RNA, 21 nt, Homo sapiens
gacacagacuuggggaccugg

SEQ ID NO: 2093724 - RNA, 18 nt, Homo sapiens
guaguccagguguucucc

SEQ ID NO: 2093725 - RNA, 17 nt, Homo sapiens
augaguucaaauacuuu

SEQ ID NO: 2093726 - RNA, 13 nt, Homo sapiens
gaaaauugaauuu

SEQ ID NO: 2093727 - RNA, 12 nt, Homo sapiens
guguacugugga

SEQ ID NO: 2093728 - RNA, 16 nt, Homo sapiens
cuuuauguauuuguua

SEQ ID NO: 2093729 - RNA, 21 nt, Homo sapiens
ggcuccauucccaucacugcu

SEQ ID NO: 2093730 - RNA, 17 nt, Homo sapiens
uccagagaccccaggaa

SEQ ID NO: 2093731 - RNA, 19 nt, Homo sapiens
uauauguucagcagugugc

SEQ ID NO: 2093732 - RNA, 16 nt, Homo sapiens
cauacacuuauuggaa

SEQ ID NO: 2093733 - RNA, 19 nt, Homo sapiens
gccacccucccacugccaa

SEQ ID NO: 2093734 - RNA, 19 nt, Homo sapiens
gccucaaucucccaucugu

SEQ ID NO: 2093735 - RNA, 12 nt, Homo sapiens
gcaggugucaua

SEQ ID NO: 2093736 - RNA, 19 nt, Homo sapiens
aagucugaaucucccaagg

SEQ ID NO: 2093737 - RNA, 18 nt, Homo sapiens
uugccuaacuaacuggca

SEQ ID NO: 2093738 - RNA, 18 nt, Homo sapiens
uguuacuuuuaguucuau

SEQ ID NO: 2093739 - RNA, 18 nt, Homo sapiens
gaucggcuuucauguaau

SEQ ID NO: 2093740 - RNA, 19 nt, Homo sapiens
cugagauacauacagaauu

SEQ ID NO: 2093741 - RNA, 17 nt, Homo sapiens
caucgcucugagcauau

SEQ ID NO: 2093742 - RNA, 12 nt, Homo sapiens
cgguacccgggg

SEQ ID NO: 2093743 - RNA, 22 nt, Homo sapiens
auuucaaauauuuacaguacuu

SEQ ID NO: 2093744 - RNA, 21 nt, Homo sapiens
aaugaucuagguuuaacucag

SEQ ID NO: 2093745 - RNA, 17 nt, Homo sapiens
gcaagaugaaacagggc

SEQ ID NO: 2093746 - RNA, 15 nt, Homo sapiens
cugauaccaaagaga

SEQ ID NO: 2093747 - RNA, 23 nt, Homo sapiens
aggucucuuucuuuacucugggu

SEQ ID NO: 2093748 - RNA, 15 nt, Homo sapiens
uucccccgcaaugug

SEQ ID NO: 2093749 - RNA, 22 nt, Homo sapiens
gaggccgaaggugccucagacu

SEQ ID NO: 2093750 - RNA, 20 nt, Homo sapiens
caaugaauaacagccucauu

SEQ ID NO: 2093751 - RNA, 21 nt, Homo sapiens
uuucugauguguucucugauc

SEQ ID NO: 2093752 - RNA, 13 nt, Homo sapiens
accgccacugggc

SEQ ID NO: 2093753 - RNA, 18 nt, Homo sapiens
gugaggaugucacucaga

SEQ ID NO: 2093754 - RNA, 23 nt, Homo sapiens
caguguuuuagagagagaacuuu

SEQ ID NO: 2093755 - RNA, 17 nt, Homo sapiens
agaggagaaacuggaac

SEQ ID NO: 2093756 - RNA, 20 nt, Homo sapiens
cugugacccucucacuuugg

SEQ ID NO: 2093757 - RNA, 14 nt, Homo sapiens
guggcugacccccc

SEQ ID NO: 2093758 - RNA, 17 nt, Homo sapiens
ugauuguuauguaaaac

SEQ ID NO: 2093759 - RNA, 22 nt, Homo sapiens
ccauugucgucuuuauguccgc

SEQ ID NO: 2093760 - RNA, 23 nt, Homo sapiens
aucuagaggcuuccuucauuucc

SEQ ID NO: 2093761 - RNA, 22 nt, Homo sapiens
uggcuguggagagggucaagga

SEQ ID NO: 2093762 - RNA, 13 nt, Homo sapiens
uccucccugacuc

SEQ ID NO: 2093763 - RNA, 15 nt, Homo sapiens
ggcgucugucuucaa

SEQ ID NO: 2093764 - RNA, 10 nt, Homo sapiens
uuuugccaaa

SEQ ID NO: 2093765 - RNA, 22 nt, Homo sapiens
uuauuagggauuaccguuuccu

SEQ ID NO: 2093766 - RNA, 14 nt, Homo sapiens
aaugaauucuucaa

SEQ ID NO: 2093767 - RNA, 15 nt, Homo sapiens
cuguucuguguacau

SEQ ID NO: 2093768 - RNA, 19 nt, Homo sapiens
uguaacaauuauguuuuca

SEQ ID NO: 2093769 - RNA, 19 nt, Homo sapiens
cuguacuaacccagucuuu

SEQ ID NO: 2093770 - RNA, 17 nt, Homo sapiens
uaaccucaaagugacua

SEQ ID NO: 2093771 - RNA, 16 nt, Homo sapiens
aagaagccaggugcaa

SEQ ID NO: 2093772 - RNA, 12 nt, Homo sapiens
gcuaaccucucu

SEQ ID NO: 2093773 - RNA, 17 nt, Homo sapiens
acuggaaaacagaacac

SEQ ID NO: 2093774 - RNA, 19 nt, Homo sapiens
aaucucucuuagaguccag

SEQ ID NO: 2093775 - RNA, 11 nt, Homo sapiens
acuuuagucuc

SEQ ID NO: 2093776 - RNA, 17 nt, Homo sapiens
acggucaggaaaacugu

SEQ ID NO: 2093777 - RNA, 19 nt, Homo sapiens
ccucaugccgcugugucua

SEQ ID NO: 2093778 - RNA, 13 nt, Homo sapiens
uaguuucaggcaa

SEQ ID NO: 2093779 - RNA, 16 nt, Homo sapiens
ugacuuccucugccac

SEQ ID NO: 2093780 - RNA, 13 nt, Homo sapiens
uggcaugaucucg

SEQ ID NO: 2093781 - RNA, 14 nt, Homo sapiens
cuccaaagggcagu

SEQ ID NO: 2093782 - RNA, 15 nt, Homo sapiens
cuacggguaggucua

SEQ ID NO: 2093783 - RNA, 14 nt, Homo sapiens
caaagcauuugacu

SEQ ID NO: 2093784 - RNA, 12 nt, Homo sapiens
aauauauuugau

SEQ ID NO: 2093785 - RNA, 18 nt, Homo sapiens
accucagguuccaaauuc

SEQ ID NO: 2093786 - RNA, 19 nt, Homo sapiens
gcacuuuauaaaagcaaaa

SEQ ID NO: 2093787 - RNA, 17 nt, Homo sapiens
ggaugguggagggccac

SEQ ID NO: 2093788 - RNA, 17 nt, Homo sapiens
accagccguauuuuaca

SEQ ID NO: 2093789 - RNA, 22 nt, Homo sapiens
uuuuuggacuagccagaauucu

SEQ ID NO: 2093790 - RNA, 14 nt, Homo sapiens
aagccugugcaaug

SEQ ID NO: 2093791 - RNA, 14 nt, Homo sapiens
uccacacugcacaa

SEQ ID NO: 2093792 - RNA, 22 nt, Homo sapiens
cauuuuccugugcccuguggua

SEQ ID NO: 2093793 - RNA, 23 nt, Homo sapiens
uggcauuuuauaggcauaccucc

SEQ ID NO: 2093794 - RNA, 14 nt, Homo sapiens
ucguuggacucauu

SEQ ID NO: 2093795 - RNA, 19 nt, Homo sapiens
gccuugucucucacugcau

SEQ ID NO: 2093796 - RNA, 19 nt, Homo sapiens
cucccuaguagcugggauu

SEQ ID NO: 2093797 - RNA, 16 nt, Homo sapiens
gaaauagugcacucca

SEQ ID NO: 2093798 - RNA, 20 nt, Homo sapiens
agacucccaccccagggauu

SEQ ID NO: 2093799 - RNA, 17 nt, Homo sapiens
guacguuuuauuacuua

SEQ ID NO: 2093800 - RNA, 19 nt, Homo sapiens
aaaaaacugaaaauacuua

SEQ ID NO: 2093801 - RNA, 21 nt, Homo sapiens
ucuuugugccugaguggccug

SEQ ID NO: 2093802 - RNA, 16 nt, Homo sapiens
uuuccaaucauacaaa

SEQ ID NO: 2093803 - RNA, 16 nt, Homo sapiens
cugauuuuuagcuuua

SEQ ID NO: 2093804 - RNA, 13 nt, Homo sapiens
ugagacauuugcc

SEQ ID NO: 2093805 - RNA, 13 nt, Homo sapiens
ugugggucuucca

SEQ ID NO: 2093806 - RNA, 23 nt, Homo sapiens
cuuugcugaaugucauuauuuga

SEQ ID NO: 2093807 - RNA, 20 nt, Homo sapiens
cagugagcugagaucaugcc

SEQ ID NO: 2093808 - RNA, 21 nt, Homo sapiens
ccaaacuuccaaagguuuaaa

SEQ ID NO: 2093809 - RNA, 18 nt, Homo sapiens
auggaagacaaauacaca

SEQ ID NO: 2093810 - RNA, 18 nt, Homo sapiens
auaaacgaccaaacucag

SEQ ID NO: 2093811 - RNA, 16 nt, Homo sapiens
gaucagcuaccaggca

SEQ ID NO: 2093812 - RNA, 14 nt, Homo sapiens
gguaagaagggugg

SEQ ID NO: 2093813 - RNA, 19 nt, Homo sapiens
accuugggggaagacuuua

SEQ ID NO: 2093814 - RNA, 14 nt, Homo sapiens
aauaucauaaugua

SEQ ID NO: 2093815 - RNA, 19 nt, Homo sapiens
auccacuuugcucugaaug

SEQ ID NO: 2093816 - RNA, 23 nt, Homo sapiens
cuuguucccuaggggacacuucc

SEQ ID NO: 2093817 - RNA, 19 nt, Homo sapiens
ucaccuuggaggccuuccc

SEQ ID NO: 2093818 - RNA, 21 nt, Homo sapiens
cauuuguauuguucauaauau

SEQ ID NO: 2093819 - RNA, 13 nt, Homo sapiens
caugauacuauuc

SEQ ID NO: 2093820 - RNA, 16 nt, Homo sapiens
uggaguaaguauuuag

SEQ ID NO: 2093821 - RNA, 16 nt, Homo sapiens
acaauuuuuaagcauu

SEQ ID NO: 2093822 - RNA, 16 nt, Homo sapiens
aggugcgcaguggcau

SEQ ID NO: 2093823 - RNA, 19 nt, Homo sapiens
ccuccgcuccccuuuccca

SEQ ID NO: 2093824 - RNA, 13 nt, Homo sapiens
ccuuacuauucau

SEQ ID NO: 2093825 - RNA, 20 nt, Homo sapiens
agcaggaaggucucaugccu

SEQ ID NO: 2093826 - RNA, 13 nt, Homo sapiens
gcaaaaaguauug

SEQ ID NO: 2093827 - RNA, 19 nt, Homo sapiens
ggacagaaaaauugaacua

SEQ ID NO: 2093828 - RNA, 22 nt, Homo sapiens
agugucaccaauuccaccaaga

SEQ ID NO: 2093829 - RNA, 12 nt, Homo sapiens
uuuaagaccaag

SEQ ID NO: 2093830 - RNA, 21 nt, Homo sapiens
uucugaccuugugaacaucag

SEQ ID NO: 2093831 - RNA, 17 nt, Homo sapiens
gccccucugacucccaa

SEQ ID NO: 2093832 - RNA, 17 nt, Homo sapiens
ugcucaagucuacccug

SEQ ID NO: 2093833 - RNA, 22 nt, Homo sapiens
ggccucccaccagagacuggga

SEQ ID NO: 2093834 - RNA, 16 nt, Homo sapiens
gucugacuucaaggaa

SEQ ID NO: 2093835 - RNA, 15 nt, Homo sapiens
gaucuuuacucuuga

SEQ ID NO: 2093836 - RNA, 22 nt, Homo sapiens
gccugugacugaggcggagccc

SEQ ID NO: 2093837 - RNA, 16 nt, Homo sapiens
uccuuuucccaaagca

SEQ ID NO: 2093838 - RNA, 18 nt, Homo sapiens
caacccaugccccugaca

SEQ ID NO: 2093839 - RNA, 15 nt, Homo sapiens
ucagcaaaaguuaau

SEQ ID NO: 2093840 - RNA, 15 nt, Homo sapiens
cagaaguaauuugaa

SEQ ID NO: 2093841 - RNA, 15 nt, Homo sapiens
aaaaaucaauaugca

SEQ ID NO: 2093842 - RNA, 18 nt, Homo sapiens
auaaagucacuuccagug

SEQ ID NO: 2093843 - RNA, 11 nt, Homo sapiens
ucccacucugg

SEQ ID NO: 2093844 - RNA, 15 nt, Homo sapiens
acagggagugcacau

SEQ ID NO: 2093845 - RNA, 22 nt, Homo sapiens
ccuugacguuucuucuuucuag

SEQ ID NO: 2093846 - RNA, 17 nt, Homo sapiens
uuccuguucccaugaga

SEQ ID NO: 2093847 - RNA, 15 nt, Homo sapiens
gaaauuguacauauu

SEQ ID NO: 2093848 - RNA, 15 nt, Homo sapiens
auaagaggaggagaa

SEQ ID NO: 2093849 - RNA, 22 nt, Homo sapiens
ugaaggcugggggcauuuugcu

SEQ ID NO: 2093850 - RNA, 15 nt, Homo sapiens
ugaaguaugucuuca

SEQ ID NO: 2093851 - RNA, 15 nt, Homo sapiens
ugaaucaugucugua

SEQ ID NO: 2093852 - RNA, 17 nt, Homo sapiens
uuaaagcgugugugaac

SEQ ID NO: 2093853 - RNA, 17 nt, Homo sapiens
cuugauuccuguugaau

SEQ ID NO: 2093854 - RNA, 20 nt, Homo sapiens
uuaccccucacaauccuugc

SEQ ID NO: 2093855 - RNA, 16 nt, Homo sapiens
cuauuuaaugcuucca

SEQ ID NO: 2093856 - RNA, 17 nt, Homo sapiens
auaugaaugucaguagu

SEQ ID NO: 2093857 - RNA, 23 nt, Homo sapiens
agggcauuugugggucugugugg

SEQ ID NO: 2093858 - RNA, 21 nt, Homo sapiens
uaauuuagccaggaccugcca

SEQ ID NO: 2093859 - RNA, 15 nt, Homo sapiens
aguuuguagccaggu

SEQ ID NO: 2093860 - RNA, 20 nt, Homo sapiens
cccagccaaucuagaggcaa

SEQ ID NO: 2093861 - RNA, 16 nt, Homo sapiens
cccugggccucagugu

SEQ ID NO: 2093862 - RNA, 18 nt, Homo sapiens
uugucccucuuugaggga

SEQ ID NO: 2093863 - RNA, 22 nt, Homo sapiens
uuuguaaaaacaaagugcuaaa

SEQ ID NO: 2093864 - RNA, 12 nt, Homo sapiens
gaggacaaguua

SEQ ID NO: 2093865 - RNA, 15 nt, Homo sapiens
aguagaaaggccuuu

SEQ ID NO: 2093866 - RNA, 22 nt, Homo sapiens
ccuccccaccugcucaccaauu

SEQ ID NO: 2093867 - RNA, 17 nt, Homo sapiens
caaggucacacagugau

SEQ ID NO: 2093868 - RNA, 19 nt, Homo sapiens
gauuuuuuaauuguuuaaa

SEQ ID NO: 2093869 - RNA, 15 nt, Homo sapiens
uuugcaacugucucu

SEQ ID NO: 2093870 - RNA, 21 nt, Homo sapiens
gaaaagaaaaaaaaaagaaga

SEQ ID NO: 2093871 - RNA, 14 nt, Homo sapiens
uauugaugugcaaa

SEQ ID NO: 2093872 - RNA, 16 nt, Homo sapiens
agugagguggaauuau

SEQ ID NO: 2093873 - RNA, 14 nt, Homo sapiens
ucuggucuaccuga

SEQ ID NO: 2093874 - RNA, 18 nt, Homo sapiens
agauguauaaaucuuucu

SEQ ID NO: 2093875 - RNA, 21 nt, Homo sapiens
gagcaagucuuagacaucaua

SEQ ID NO: 2093876 - RNA, 23 nt, Homo sapiens
guguauauaugucaaauugucag

SEQ ID NO: 2093877 - RNA, 22 nt, Homo sapiens
caaauggcuacuaagcacauga

SEQ ID NO: 2093878 - RNA, 22 nt, Homo sapiens
uauaucucccccacuccacuac

SEQ ID NO: 2093879 - RNA, 24 nt, Homo sapiens
guacauguuccuuuguaauugaca

SEQ ID NO: 2093880 - RNA, 18 nt, Homo sapiens
acagcccaucaccucuaa

SEQ ID NO: 2093881 - RNA, 15 nt, Homo sapiens
caaaguguauacaug

SEQ ID NO: 2093882 - RNA, 17 nt, Homo sapiens
agagggccucaucucag

SEQ ID NO: 2093883 - RNA, 21 nt, Homo sapiens
caaguuagaaaacauaaucuu

SEQ ID NO: 2093884 - RNA, 18 nt, Homo sapiens
gguucaggcccaucagcu

SEQ ID NO: 2093885 - RNA, 21 nt, Homo sapiens
gccaagcuuauuuaagaucac

SEQ ID NO: 2093886 - RNA, 20 nt, Homo sapiens
augaacuaguuuaaugugga

SEQ ID NO: 2093887 - RNA, 22 nt, Homo sapiens
aacacggagcagggagagcuca

SEQ ID NO: 2093888 - RNA, 20 nt, Homo sapiens
ugcauauauuaucaucaaau

SEQ ID NO: 2093889 - RNA, 18 nt, Homo sapiens
ucacugaaaccucugccu

SEQ ID NO: 2093890 - RNA, 15 nt, Homo sapiens
agcauauucacuggu

SEQ ID NO: 2093891 - RNA, 15 nt, Homo sapiens
aguuugaucauagaa

SEQ ID NO: 2093892 - RNA, 12 nt, Homo sapiens
ucgccagugacu

SEQ ID NO: 2093893 - RNA, 13 nt, Homo sapiens
uggaauugugcug

SEQ ID NO: 2093894 - RNA, 23 nt, Homo sapiens
ccaugggaaggguccaucucaga

SEQ ID NO: 2093895 - RNA, 15 nt, Homo sapiens
aggcugcacagcuca

SEQ ID NO: 2093896 - RNA, 20 nt, Homo sapiens
ucggcuccccauguguccug

SEQ ID NO: 2093897 - RNA, 16 nt, Homo sapiens
auuaggaaucauucug

SEQ ID NO: 2093898 - RNA, 17 nt, Homo sapiens
ccaagccccugccucca

SEQ ID NO: 2093899 - RNA, 14 nt, Homo sapiens
aguacagauaugaa

SEQ ID NO: 2093900 - RNA, 22 nt, Homo sapiens
uggacucucauguggccaagca

SEQ ID NO: 2093901 - RNA, 22 nt, Homo sapiens
aaguuacauugcuggucuugua

SEQ ID NO: 2093902 - RNA, 21 nt, Homo sapiens
ccaggccucaccaaagcccac

SEQ ID NO: 2093903 - RNA, 16 nt, Homo sapiens
auccagccucauaaag

SEQ ID NO: 2093904 - RNA, 17 nt, Homo sapiens
cagauggcaauuucacu

SEQ ID NO: 2093905 - RNA, 22 nt, Homo sapiens
gucuucaucuguccgacaaguu

SEQ ID NO: 2093906 - RNA, 17 nt, Homo sapiens
cauauaaagcacuauac

SEQ ID NO: 2093907 - RNA, 15 nt, Homo sapiens
gcagcauuugauaau

SEQ ID NO: 2093908 - RNA, 13 nt, Homo sapiens
aagaggugucaug

SEQ ID NO: 2093909 - RNA, 14 nt, Homo sapiens
cuuucaaaagccuu

SEQ ID NO: 2093910 - RNA, 15 nt, Homo sapiens
uuaaacaaguauaaa

SEQ ID NO: 2093911 - RNA, 22 nt, Homo sapiens
acucucaggggagaccaagaac

SEQ ID NO: 2093912 - RNA, 16 nt, Homo sapiens
ucucagcacuaugaca

SEQ ID NO: 2093913 - RNA, 21 nt, Homo sapiens
ugggcaccuuccuaauaugcu

SEQ ID NO: 2093914 - RNA, 16 nt, Homo sapiens
uacagcaguagacauu

SEQ ID NO: 2093915 - RNA, 13 nt, Homo sapiens
ugaaaccaggugg

SEQ ID NO: 2093916 - RNA, 17 nt, Homo sapiens
gaaucacuugaaccugg

SEQ ID NO: 2093917 - RNA, 17 nt, Homo sapiens
gucuuguucugugauga

SEQ ID NO: 2093918 - RNA, 20 nt, Homo sapiens
aaaauuuaaaggguguacuu

SEQ ID NO: 2093919 - RNA, 16 nt, Homo sapiens
augugcaguacuuaau

SEQ ID NO: 2093920 - RNA, 19 nt, Homo sapiens
uccugcgcauggugcagug

SEQ ID NO: 2093921 - RNA, 22 nt, Homo sapiens
cauguaaucaacauggcuacuu

SEQ ID NO: 2093922 - RNA, 22 nt, Homo sapiens
caacccugugauacuauuacca

SEQ ID NO: 2093923 - RNA, 20 nt, Homo sapiens
aaauguuuaauuuugcagug

SEQ ID NO: 2093924 - RNA, 20 nt, Homo sapiens
uggggcggguggggccauaa

SEQ ID NO: 2093925 - RNA, 17 nt, Homo sapiens
uagcucuaagagcaauu

SEQ ID NO: 2093926 - RNA, 15 nt, Homo sapiens
uuuucucuguauaac

SEQ ID NO: 2093927 - RNA, 17 nt, Homo sapiens
uagauguagucuugacg

SEQ ID NO: 2093928 - RNA, 14 nt, Homo sapiens
aaauugguacauag

SEQ ID NO: 2093929 - RNA, 15 nt, Homo sapiens
ucagaaagauuugau

SEQ ID NO: 2093930 - RNA, 15 nt, Homo sapiens
uuuuagagacagggu

SEQ ID NO: 2093931 - RNA, 16 nt, Homo sapiens
auucaaacugcuccaa

SEQ ID NO: 2093932 - RNA, 22 nt, Homo sapiens
uguaaauagagcaaccuauaua

SEQ ID NO: 2093933 - RNA, 18 nt, Homo sapiens
aggggagcucaguuuuca

SEQ ID NO: 2093934 - RNA, 23 nt, Homo sapiens
cgugagauccggcagcacaagcu

SEQ ID NO: 2093935 - RNA, 23 nt, Homo sapiens
uggaaaccuugcugcuaugcugu

SEQ ID NO: 2093936 - RNA, 15 nt, Homo sapiens
guccuuuccaggggc

SEQ ID NO: 2093937 - RNA, 18 nt, Homo sapiens
gacaaauaguaggcaaga

SEQ ID NO: 2093938 - RNA, 16 nt, Homo sapiens
cugaaucaguuauuau

SEQ ID NO: 2093939 - RNA, 19 nt, Homo sapiens
ucauccucuuauaugugcc

SEQ ID NO: 2093940 - RNA, 16 nt, Homo sapiens
uucagugcuucgcaga

SEQ ID NO: 2093941 - RNA, 15 nt, Homo sapiens
ggaggcacaaagggc

SEQ ID NO: 2093942 - RNA, 20 nt, Homo sapiens
gaagcagaaauauagugcaa

SEQ ID NO: 2093943 - RNA, 22 nt, Homo sapiens
uuucaauaaaguacugcaaaau

SEQ ID NO: 2093944 - RNA, 13 nt, Homo sapiens
auguuuuguacuu

SEQ ID NO: 2093945 - RNA, 23 nt, Homo sapiens
uccuguaagaagcggcauagcac

SEQ ID NO: 2093946 - RNA, 23 nt, Homo sapiens
auguaauaaguaucacacuguau

SEQ ID NO: 2093947 - RNA, 23 nt, Homo sapiens
uccaggggcuucacccaugaaau

SEQ ID NO: 2093948 - RNA, 16 nt, Homo sapiens
auaaacuuagcauuua

SEQ ID NO: 2093949 - RNA, 20 nt, Homo sapiens
accaaguucuggaaaccacg

SEQ ID NO: 2093950 - RNA, 21 nt, Homo sapiens
aauauagcuaauaacauguga

SEQ ID NO: 2093951 - RNA, 22 nt, Homo sapiens
uuuccuagcgcagccaugugau

SEQ ID NO: 2093952 - RNA, 13 nt, Homo sapiens
cuaacauacugca

SEQ ID NO: 2093953 - RNA, 21 nt, Homo sapiens
guccacuuuucuuuacauuuu

SEQ ID NO: 2093954 - RNA, 12 nt, Homo sapiens
gucuucauuaag

SEQ ID NO: 2093955 - RNA, 17 nt, Homo sapiens
aggagacaccaagcuca

SEQ ID NO: 2093956 - RNA, 20 nt, Homo sapiens
uccccugaugggcccugacu

SEQ ID NO: 2093957 - RNA, 16 nt, Homo sapiens
ucuuggguucccaaau

SEQ ID NO: 2093958 - RNA, 20 nt, Homo sapiens
ggaccuccaagccacugagc

SEQ ID NO: 2093959 - RNA, 17 nt, Homo sapiens
aauuugaaacacaagaa

SEQ ID NO: 2093960 - RNA, 16 nt, Homo sapiens
accaaacaucuuucag

SEQ ID NO: 2093961 - RNA, 15 nt, Homo sapiens
ccaacaguucaugga

SEQ ID NO: 2093962 - RNA, 21 nt, Homo sapiens
cuugcagaaggcaaggcccug

SEQ ID NO: 2093963 - RNA, 21 nt, Homo sapiens
ucccuuuucuuuccuuuucau

SEQ ID NO: 2093964 - RNA, 15 nt, Homo sapiens
uccugauuucaggga

SEQ ID NO: 2093965 - RNA, 15 nt, Homo sapiens
aacucguuaaagcaa

SEQ ID NO: 2093966 - RNA, 15 nt, Homo sapiens
uaguuccuaauggau

SEQ ID NO: 2093967 - RNA, 20 nt, Homo sapiens
uacaguugggaaaauauguc

SEQ ID NO: 2093968 - RNA, 14 nt, Homo sapiens
uaguagacacacua

SEQ ID NO: 2093969 - RNA, 13 nt, Homo sapiens
augcaagcacaaa

SEQ ID NO: 2093970 - RNA, 18 nt, Homo sapiens
agggauuuguuuugucaa

SEQ ID NO: 2093971 - RNA, 12 nt, Homo sapiens
gauugaacucca

SEQ ID NO: 2093972 - RNA, 13 nt, Homo sapiens
uauccacuacucc

SEQ ID NO: 2093973 - RNA, 19 nt, Homo sapiens
aagccaaauuuauaugcca

SEQ ID NO: 2093974 - RNA, 15 nt, Homo sapiens
cagugcaaaccacuu

SEQ ID NO: 2093975 - RNA, 15 nt, Homo sapiens
gacaguaaagaccau

SEQ ID NO: 2093976 - RNA, 21 nt, Homo sapiens
uggcaacagagcgagauucca

SEQ ID NO: 2093977 - RNA, 21 nt, Homo sapiens
gccuggaacugcaucagugac

SEQ ID NO: 2093978 - RNA, 18 nt, Homo sapiens
cagcuagcaaaauuacua

SEQ ID NO: 2093979 - RNA, 19 nt, Homo sapiens
gugcacuccccguguucau

SEQ ID NO: 2093980 - RNA, 20 nt, Homo sapiens
ucugaaaaacauuccaggaa

SEQ ID NO: 2093981 - RNA, 23 nt, Homo sapiens
ggaugcccccuguggaugcugcu

SEQ ID NO: 2093982 - RNA, 14 nt, Homo sapiens
cauaaauuacuguu

SEQ ID NO: 2093983 - RNA, 15 nt, Homo sapiens
ugaaucugcucacuu

SEQ ID NO: 2093984 - RNA, 18 nt, Homo sapiens
ucacauggccuaugcaca

SEQ ID NO: 2093985 - RNA, 16 nt, Homo sapiens
ugccuaaccugggacc

SEQ ID NO: 2093986 - RNA, 15 nt, Homo sapiens
gcagcauacacagau

SEQ ID NO: 2093987 - RNA, 14 nt, Homo sapiens
ggacccaguggcag

SEQ ID NO: 2093988 - RNA, 14 nt, Homo sapiens
accauauaaaugaa

SEQ ID NO: 2093989 - RNA, 16 nt, Homo sapiens
cugggcucaagcuuuc

SEQ ID NO: 2093990 - RNA, 18 nt, Homo sapiens
aagaaacuacuaaucuca

SEQ ID NO: 2093991 - RNA, 15 nt, Homo sapiens
accugggcccuaggc

SEQ ID NO: 2093992 - RNA, 17 nt, Homo sapiens
gucuaagauaaaagcuu

SEQ ID NO: 2093993 - RNA, 13 nt, Homo sapiens
uguucuuccucag

SEQ ID NO: 2093994 - RNA, 16 nt, Homo sapiens
aaaauaaaagaucuug

SEQ ID NO: 2093995 - RNA, 13 nt, Homo sapiens
cuuuguacacgaa

SEQ ID NO: 2093996 - RNA, 21 nt, Homo sapiens
ucacacacacagcugggcaaa

SEQ ID NO: 2093997 - RNA, 15 nt, Homo sapiens
augagugaguucuca

SEQ ID NO: 2093998 - RNA, 12 nt, Homo sapiens
guuguaccaaaa

SEQ ID NO: 2093999 - RNA, 13 nt, Homo sapiens
caaguggcucauc

SEQ ID NO: 2094000 - RNA, 13 nt, Homo sapiens
acaggagugggaa

SEQ ID NO: 2094001 - RNA, 13 nt, Homo sapiens
acaguaucugcug

SEQ ID NO: 2094002 - RNA, 16 nt, Homo sapiens
auucuaggcagcaccu

SEQ ID NO: 2094003 - RNA, 17 nt, Homo sapiens
aauaauuggcuuugcag

SEQ ID NO: 2094004 - RNA, 18 nt, Homo sapiens
ugaagacgagcauccccc

SEQ ID NO: 2094005 - RNA, 19 nt, Homo sapiens
uauuaggucgguacuaaga

SEQ ID NO: 2094006 - RNA, 22 nt, Homo sapiens
gccagcugcugcuggaucacag

SEQ ID NO: 2094007 - RNA, 21 nt, Homo sapiens
uguccuuuaaucacugcauuu

SEQ ID NO: 2094008 - RNA, 13 nt, Homo sapiens
ucugcuugucaaa

SEQ ID NO: 2094009 - RNA, 21 nt, Homo sapiens
cacuuuuuuuuuuaaucucca

SEQ ID NO: 2094010 - RNA, 16 nt, Homo sapiens
cuaaucugcaguggau

SEQ ID NO: 2094011 - RNA, 20 nt, Homo sapiens
cacccuuggagcucugaguu

SEQ ID NO: 2094012 - RNA, 20 nt, Homo sapiens
gaaucucuuuuugcuuucga

SEQ ID NO: 2094013 - RNA, 13 nt, Homo sapiens
acuguugcccagg

SEQ ID NO: 2094014 - RNA, 13 nt, Homo sapiens
gcauuacugggaa

SEQ ID NO: 2094015 - RNA, 14 nt, Homo sapiens
auagcaagugaaag

SEQ ID NO: 2094016 - RNA, 17 nt, Homo sapiens
agaauaugaaguucuau

SEQ ID NO: 2094017 - RNA, 12 nt, Homo sapiens
uguugguugaga

SEQ ID NO: 2094018 - RNA, 22 nt, Homo sapiens
auuaaagugccauuuccugucu

SEQ ID NO: 2094019 - RNA, 22 nt, Homo sapiens
ugcuaaugaggugcacacaaua

SEQ ID NO: 2094020 - RNA, 23 nt, Homo sapiens
ugucaugucucugguggugcugg

SEQ ID NO: 2094021 - RNA, 13 nt, Homo sapiens
uauuaaaccuuca

SEQ ID NO: 2094022 - RNA, 19 nt, Homo sapiens
cgagauugcaccacugcac

SEQ ID NO: 2094023 - RNA, 13 nt, Homo sapiens
auacacaagcaau

SEQ ID NO: 2094024 - RNA, 15 nt, Homo sapiens
uggacugucauagaa

SEQ ID NO: 2094025 - RNA, 22 nt, Homo sapiens
ucacugcuuuuuccuuagcuua

SEQ ID NO: 2094026 - RNA, 20 nt, Homo sapiens
caagaagaaaucaugauaua

SEQ ID NO: 2094027 - RNA, 19 nt, Homo sapiens
ugugaugugucacagguua

SEQ ID NO: 2094028 - RNA, 22 nt, Homo sapiens
aaguugcagaacagacacuuua

SEQ ID NO: 2094029 - RNA, 23 nt, Homo sapiens
caaugaaauacuccagcaccugu

SEQ ID NO: 2094030 - RNA, 21 nt, Homo sapiens
ugagacuuccuauuaauuuau

SEQ ID NO: 2094031 - RNA, 21 nt, Homo sapiens
ucaauauugguguacuguaau

SEQ ID NO: 2094032 - RNA, 14 nt, Homo sapiens
gccagcucucagga

SEQ ID NO: 2094033 - RNA, 22 nt, Homo sapiens
uucagcagagaagguaaggugu

SEQ ID NO: 2094034 - RNA, 16 nt, Homo sapiens
gugugaaggucuugcc

SEQ ID NO: 2094035 - RNA, 20 nt, Homo sapiens
gaccaaaccucauaugugaa

SEQ ID NO: 2094036 - RNA, 14 nt, Homo sapiens
gggagcuacagggg

SEQ ID NO: 2094037 - RNA, 23 nt, Homo sapiens
guaaucuaccaguggugcucaau

SEQ ID NO: 2094038 - RNA, 21 nt, Homo sapiens
augauuuuuaacauuaugaga

SEQ ID NO: 2094039 - RNA, 14 nt, Homo sapiens
gccauuugccauca

SEQ ID NO: 2094040 - RNA, 22 nt, Homo sapiens
ucucaggggugauaacucagga

SEQ ID NO: 2094041 - RNA, 18 nt, Homo sapiens
aaaaguagucauggauaa

SEQ ID NO: 2094042 - RNA, 17 nt, Homo sapiens
cuggagugcaguggcau

SEQ ID NO: 2094043 - RNA, 18 nt, Homo sapiens
agaaauuaugucagcuua

SEQ ID NO: 2094044 - RNA, 13 nt, Homo sapiens
ggcugaguacagu

SEQ ID NO: 2094045 - RNA, 17 nt, Homo sapiens
uccaguugccacuuucc

SEQ ID NO: 2094046 - RNA, 19 nt, Homo sapiens
cugagcccaacccuucuaa

SEQ ID NO: 2094047 - RNA, 18 nt, Homo sapiens
cagaguuguacacugugu

SEQ ID NO: 2094048 - RNA, 23 nt, Homo sapiens
acuaaaucaaucugcaguuuaac

SEQ ID NO: 2094049 - RNA, 18 nt, Homo sapiens
accugccugcgucuuccg

SEQ ID NO: 2094050 - RNA, 15 nt, Homo sapiens
guugcugcugcugcu

SEQ ID NO: 2094051 - RNA, 21 nt, Homo sapiens
uucaaggccccgagcuguuac

SEQ ID NO: 2094052 - RNA, 19 nt, Homo sapiens
ggcuccccucgacagcucu

SEQ ID NO: 2094053 - RNA, 16 nt, Homo sapiens
cuggaaggugcuguua

SEQ ID NO: 2094054 - RNA, 20 nt, Homo sapiens
gaggagauuaacacacugaa

SEQ ID NO: 2094055 - RNA, 14 nt, Homo sapiens
augucagcuuaaaa

SEQ ID NO: 2094056 - RNA, 18 nt, Homo sapiens
gccaagacucuaugcucu

SEQ ID NO: 2094057 - RNA, 13 nt, Homo sapiens
ucgcaucucagcc

SEQ ID NO: 2094058 - RNA, 17 nt, Homo sapiens
ucccaggagggcuuugu

SEQ ID NO: 2094059 - RNA, 22 nt, Homo sapiens
ucauucuuacccagggugcgcu

SEQ ID NO: 2094060 - RNA, 13 nt, Homo sapiens
aguccaugcauga

SEQ ID NO: 2094061 - RNA, 16 nt, Homo sapiens
cagcagccagucucag

SEQ ID NO: 2094062 - RNA, 11 nt, Homo sapiens
gcuuccaugau

SEQ ID NO: 2094063 - RNA, 17 nt, Homo sapiens
ucaagguucccagagau

SEQ ID NO: 2094064 - RNA, 13 nt, Homo sapiens
aauuccgcauuua

SEQ ID NO: 2094065 - RNA, 14 nt, Homo sapiens
agcuccauacuucu

SEQ ID NO: 2094066 - RNA, 14 nt, Homo sapiens
auagucuuugccag

SEQ ID NO: 2094067 - RNA, 18 nt, Homo sapiens
acacugcacacagugacu

SEQ ID NO: 2094068 - RNA, 14 nt, Homo sapiens
aucugcaauucaaa

SEQ ID NO: 2094069 - RNA, 20 nt, Homo sapiens
ugugauuuauuuauuucuac

SEQ ID NO: 2094070 - RNA, 20 nt, Homo sapiens
ccaaagauaauguuauacau

SEQ ID NO: 2094071 - RNA, 18 nt, Homo sapiens
gcuuuauaauaaacuguu

SEQ ID NO: 2094072 - RNA, 23 nt, Homo sapiens
auuguccagugcaaccacacacc

SEQ ID NO: 2094073 - RNA, 22 nt, Homo sapiens
gacaggguuucuccauguuggu

SEQ ID NO: 2094074 - RNA, 13 nt, Homo sapiens
caugagccagcuc

SEQ ID NO: 2094075 - RNA, 22 nt, Homo sapiens
ccagcuugcgaauaacaguccc

SEQ ID NO: 2094076 - RNA, 17 nt, Homo sapiens
agggacaaaacacugug

SEQ ID NO: 2094077 - RNA, 22 nt, Homo sapiens
cacagccccugcuuuuucccuu

SEQ ID NO: 2094078 - RNA, 18 nt, Homo sapiens
cuuccaguuugcuugaua

SEQ ID NO: 2094079 - RNA, 17 nt, Homo sapiens
cauaaaaguuaacauua

SEQ ID NO: 2094080 - RNA, 21 nt, Homo sapiens
auccuacaacuuccacuccaa

SEQ ID NO: 2094081 - RNA, 14 nt, Homo sapiens
uguguacucagggc

SEQ ID NO: 2094082 - RNA, 23 nt, Homo sapiens
aaagaguauuaagagcaauucaa

SEQ ID NO: 2094083 - RNA, 13 nt, Homo sapiens
uggauugccacag

SEQ ID NO: 2094084 - RNA, 17 nt, Homo sapiens
cucugggcucaagcaau

SEQ ID NO: 2094085 - RNA, 15 nt, Homo sapiens
ccugagcucuugcua

SEQ ID NO: 2094086 - RNA, 15 nt, Homo sapiens
cgccagugugcuguc

SEQ ID NO: 2094087 - RNA, 19 nt, Homo sapiens
augcggaauuccaccugga

SEQ ID NO: 2094088 - RNA, 21 nt, Homo sapiens
ccuaauucucuucgcugugau

SEQ ID NO: 2094089 - RNA, 22 nt, Homo sapiens
cugucuauuaauauucagggua

SEQ ID NO: 2094090 - RNA, 21 nt, Homo sapiens
gggaagccugugccagcaccu

SEQ ID NO: 2094091 - RNA, 18 nt, Homo sapiens
ccuuucagggccagggcu

SEQ ID NO: 2094092 - RNA, 20 nt, Homo sapiens
cugacgucagcgcaccaaaa

SEQ ID NO: 2094093 - RNA, 15 nt, Homo sapiens
cuugguguaauuuga

SEQ ID NO: 2094094 - RNA, 22 nt, Homo sapiens
ccagaguguccccagagacaug

SEQ ID NO: 2094095 - RNA, 16 nt, Homo sapiens
ugaugagauucacuua

SEQ ID NO: 2094096 - RNA, 18 nt, Homo sapiens
uccuucaugaucaucaca

SEQ ID NO: 2094097 - RNA, 22 nt, Homo sapiens
cugggcugagccaaagccagag

SEQ ID NO: 2094098 - RNA, 19 nt, Homo sapiens
ucaguauuuuccagccuua

SEQ ID NO: 2094099 - RNA, 21 nt, Homo sapiens
caaacaagaaagcuauuccaa

SEQ ID NO: 2094100 - RNA, 21 nt, Homo sapiens
acucacuuucccaaauugaau

SEQ ID NO: 2094101 - RNA, 22 nt, Homo sapiens
ccuuuagauuaggucacauuac

SEQ ID NO: 2094102 - RNA, 13 nt, Homo sapiens
aaaggauuuuaca

SEQ ID NO: 2094103 - RNA, 21 nt, Homo sapiens
cacaucucguauaauauucac

SEQ ID NO: 2094104 - RNA, 20 nt, Homo sapiens
uauuuugggaaaaugaaggu

SEQ ID NO: 2094105 - RNA, 16 nt, Homo sapiens
acaagaaucaccucaa

SEQ ID NO: 2094106 - RNA, 16 nt, Homo sapiens
cugcagccucauacuc

SEQ ID NO: 2094107 - RNA, 22 nt, Homo sapiens
aggauuaauaaagauggcacuu

SEQ ID NO: 2094108 - RNA, 15 nt, Homo sapiens
ugaggggauguucuc

SEQ ID NO: 2094109 - RNA, 15 nt, Homo sapiens
gagaguagagggcac

SEQ ID NO: 2094110 - RNA, 19 nt, Homo sapiens
uaggccccugauucacugc

SEQ ID NO: 2094111 - RNA, 13 nt, Homo sapiens
acuggccaucucc

SEQ ID NO: 2094112 - RNA, 14 nt, Homo sapiens
uauccucuguauuu

SEQ ID NO: 2094113 - RNA, 18 nt, Homo sapiens
uaaaucaagaccaaagag

SEQ ID NO: 2094114 - RNA, 23 nt, Homo sapiens
aucccugugccucuucccaucuc

SEQ ID NO: 2094115 - RNA, 14 nt, Homo sapiens
uaccuaagagggca

SEQ ID NO: 2094116 - RNA, 19 nt, Homo sapiens
aaacauuaaucaccaaagu

SEQ ID NO: 2094117 - RNA, 19 nt, Homo sapiens
caaccaguuugaaccaaga

SEQ ID NO: 2094118 - RNA, 18 nt, Homo sapiens
aacaguguuuccagugac

SEQ ID NO: 2094119 - RNA, 22 nt, Homo sapiens
auggaagguuagagguuuguca

SEQ ID NO: 2094120 - RNA, 13 nt, Homo sapiens
aacuaagagcucu

SEQ ID NO: 2094121 - RNA, 14 nt, Homo sapiens
acugcuuaauucaa

SEQ ID NO: 2094122 - RNA, 14 nt, Homo sapiens
uggugggauuugcu

SEQ ID NO: 2094123 - RNA, 21 nt, Homo sapiens
uacauuugaaaauauuugcac

SEQ ID NO: 2094124 - RNA, 14 nt, Homo sapiens
acaggacacaguca

SEQ ID NO: 2094125 - RNA, 21 nt, Homo sapiens
augugcuaugcaaaauagaca

SEQ ID NO: 2094126 - RNA, 23 nt, Homo sapiens
gucguguaauuggcccaagucau

SEQ ID NO: 2094127 - RNA, 14 nt, Homo sapiens
aggugauccaugua

SEQ ID NO: 2094128 - RNA, 16 nt, Homo sapiens
ucuaacaggacuugaa

SEQ ID NO: 2094129 - RNA, 21 nt, Homo sapiens
uacacacacacaaaaacagaa

SEQ ID NO: 2094130 - RNA, 16 nt, Homo sapiens
aaacaugcacuuccuu

SEQ ID NO: 2094131 - RNA, 17 nt, Homo sapiens
auagagaaaggucuaug

SEQ ID NO: 2094132 - RNA, 17 nt, Homo sapiens
uaauaauacagccaaag

SEQ ID NO: 2094133 - RNA, 16 nt, Homo sapiens
auauuuuuauaugugg

SEQ ID NO: 2094134 - RNA, 17 nt, Homo sapiens
aucuccagggcuccaaa

SEQ ID NO: 2094135 - RNA, 23 nt, Homo sapiens
aauaacuaccuuccacucuggaa

SEQ ID NO: 2094136 - RNA, 14 nt, Homo sapiens
cuggugucuucagg

SEQ ID NO: 2094137 - RNA, 19 nt, Homo sapiens
agaauacuuuuaauuucac

SEQ ID NO: 2094138 - RNA, 14 nt, Homo sapiens
acuaaggcauuuga

SEQ ID NO: 2094139 - RNA, 12 nt, Homo sapiens
gacuguguuucc

SEQ ID NO: 2094140 - RNA, 17 nt, Homo sapiens
cuaaauaaaaauaugua

SEQ ID NO: 2094141 - RNA, 15 nt, Homo sapiens
auaaaguuuguugaa

SEQ ID NO: 2094142 - RNA, 13 nt, Homo sapiens
uacaacagaauuu

SEQ ID NO: 2094143 - RNA, 15 nt, Homo sapiens
ucaaugcuagcacaa

SEQ ID NO: 2094144 - RNA, 14 nt, Homo sapiens
cucaagugucuuag

SEQ ID NO: 2094145 - RNA, 15 nt, Homo sapiens
agcaguguucucaca

SEQ ID NO: 2094146 - RNA, 23 nt, Homo sapiens
gcccugacacgugauggaccaaa

SEQ ID NO: 2094147 - RNA, 12 nt, Homo sapiens
uugguuuccuca

SEQ ID NO: 2094148 - RNA, 21 nt, Homo sapiens
uugauuucccugggagcuguu

SEQ ID NO: 2094149 - RNA, 14 nt, Homo sapiens
cauuuaucccucaa

SEQ ID NO: 2094150 - RNA, 18 nt, Homo sapiens
cccccucaaaagccaaaa

SEQ ID NO: 2094151 - RNA, 18 nt, Homo sapiens
cauaauacauuaauacuu

SEQ ID NO: 2094152 - RNA, 21 nt, Homo sapiens
cauaguaugguggcuggguug

SEQ ID NO: 2094153 - RNA, 20 nt, Homo sapiens
cuauuuuuuaaagacuguga

SEQ ID NO: 2094154 - RNA, 13 nt, Homo sapiens
cuuaccccaguca

SEQ ID NO: 2094155 - RNA, 15 nt, Homo sapiens
cucccuuuccuauau

SEQ ID NO: 2094156 - RNA, 19 nt, Homo sapiens
uucuuaauauaacugccuu

SEQ ID NO: 2094157 - RNA, 17 nt, Homo sapiens
auguauucacacuuuaa

SEQ ID NO: 2094158 - RNA, 17 nt, Homo sapiens
gccuaugucuggcagau

SEQ ID NO: 2094159 - RNA, 19 nt, Homo sapiens
gucuguaaauacuggugca

SEQ ID NO: 2094160 - RNA, 15 nt, Homo sapiens
ugggaugggcuccca

SEQ ID NO: 2094161 - RNA, 13 nt, Homo sapiens
gaagccuucugac

SEQ ID NO: 2094162 - RNA, 22 nt, Homo sapiens
uauccaaucuuguuuccaaaaa

SEQ ID NO: 2094163 - RNA, 17 nt, Homo sapiens
caugauguacuaaagua

SEQ ID NO: 2094164 - RNA, 12 nt, Homo sapiens
aacuaacucacu

SEQ ID NO: 2094165 - RNA, 15 nt, Homo sapiens
cauugcaauuugcag

SEQ ID NO: 2094166 - RNA, 19 nt, Homo sapiens
caugugugagugugugcaa

SEQ ID NO: 2094167 - RNA, 22 nt, Homo sapiens
guauguguuuuuauacuuuuag

SEQ ID NO: 2094168 - RNA, 19 nt, Homo sapiens
acauuugugccgacacugu

SEQ ID NO: 2094169 - RNA, 16 nt, Homo sapiens
uaucugguuucucuag

SEQ ID NO: 2094170 - RNA, 15 nt, Homo sapiens
agauacagccugcaa

SEQ ID NO: 2094171 - RNA, 17 nt, Homo sapiens
acuuccucccacugucu

SEQ ID NO: 2094172 - RNA, 18 nt, Homo sapiens
gguauggcguaaguacag

SEQ ID NO: 2094173 - RNA, 19 nt, Homo sapiens
aaaacaaaccuuauaaguc

SEQ ID NO: 2094174 - RNA, 23 nt, Homo sapiens
uacaguuuauuauguacuauuca

SEQ ID NO: 2094175 - RNA, 21 nt, Homo sapiens
ugggaagacuguugugcucca

SEQ ID NO: 2094176 - RNA, 17 nt, Homo sapiens
aaucccagcccuacccu

SEQ ID NO: 2094177 - RNA, 16 nt, Homo sapiens
ugcauucuacuagcag

SEQ ID NO: 2094178 - RNA, 22 nt, Homo sapiens
agaauugaauuuacauauagcu

SEQ ID NO: 2094179 - RNA, 14 nt, Homo sapiens
caaucuauucugua

SEQ ID NO: 2094180 - RNA, 19 nt, Homo sapiens
uccagaaauacuacugugu

SEQ ID NO: 2094181 - RNA, 23 nt, Homo sapiens
uucucccagggagugagcagcua

SEQ ID NO: 2094182 - RNA, 17 nt, Homo sapiens
uugacucuacucccagc

SEQ ID NO: 2094183 - RNA, 16 nt, Homo sapiens
gucuguccuuucccac

SEQ ID NO: 2094184 - RNA, 18 nt, Homo sapiens
gcagccagaggcaccuca

SEQ ID NO: 2094185 - RNA, 20 nt, Homo sapiens
ugagguguauugguguugca

SEQ ID NO: 2094186 - RNA, 20 nt, Homo sapiens
cugaccacuaauagcauugu

SEQ ID NO: 2094187 - RNA, 19 nt, Homo sapiens
ucugcuggccuggaucucc

SEQ ID NO: 2094188 - RNA, 21 nt, Homo sapiens
uuccacccacguggagacagc

SEQ ID NO: 2094189 - RNA, 13 nt, Homo sapiens
ugcauuaugcaau

SEQ ID NO: 2094190 - RNA, 21 nt, Homo sapiens
acuguauuggcucugugaaaa

SEQ ID NO: 2094191 - RNA, 23 nt, Homo sapiens
auggucucagcuugagaccauuu

SEQ ID NO: 2094192 - RNA, 21 nt, Homo sapiens
cuguugacaaaugacagaucu

SEQ ID NO: 2094193 - RNA, 21 nt, Homo sapiens
uguaaaaaguguuuaucuuca

SEQ ID NO: 2094194 - RNA, 18 nt, Homo sapiens
ucuuugauuauuugcaug

SEQ ID NO: 2094195 - RNA, 13 nt, Homo sapiens
cucugguccaguc

SEQ ID NO: 2094196 - RNA, 23 nt, Homo sapiens
ucuuggugccuuuugugugaugc

SEQ ID NO: 2094197 - RNA, 18 nt, Homo sapiens
cugugguuacagugcaga

SEQ ID NO: 2094198 - RNA, 21 nt, Homo sapiens
acaccuuugaauuacagcagu

SEQ ID NO: 2094199 - RNA, 14 nt, Homo sapiens
gccccucuggccac

SEQ ID NO: 2094200 - RNA, 15 nt, Homo sapiens
cuuuuaagccaauau

SEQ ID NO: 2094201 - RNA, 15 nt, Homo sapiens
ccuuagaaguggaag

SEQ ID NO: 2094202 - RNA, 22 nt, Homo sapiens
cuaggaaauccagggugguggu

SEQ ID NO: 2094203 - RNA, 23 nt, Homo sapiens
caguaaaagucuucucccaacuc

SEQ ID NO: 2094204 - RNA, 21 nt, Homo sapiens
gucugucucgaugccugauuc

SEQ ID NO: 2094205 - RNA, 17 nt, Homo sapiens
cguggcacacacugacc

SEQ ID NO: 2094206 - RNA, 15 nt, Homo sapiens
augcaaaguaaaaaa

SEQ ID NO: 2094207 - RNA, 14 nt, Homo sapiens
ugacaggcaaugcu

SEQ ID NO: 2094208 - RNA, 17 nt, Homo sapiens
cacuuugcaaagacagu

SEQ ID NO: 2094209 - RNA, 15 nt, Homo sapiens
uacuucccacuguau

SEQ ID NO: 2094210 - RNA, 13 nt, Homo sapiens
aggaaaaauugau

SEQ ID NO: 2094211 - RNA, 19 nt, Homo sapiens
agccucgcuuuuucauccu

SEQ ID NO: 2094212 - RNA, 16 nt, Homo sapiens
augucaaccagugagg

SEQ ID NO: 2094213 - RNA, 18 nt, Homo sapiens
gucuguggcuuucagccu

SEQ ID NO: 2094214 - RNA, 11 nt, Homo sapiens
ugagcauuuag

SEQ ID NO: 2094215 - RNA, 15 nt, Homo sapiens
ucuugaggccaggag

SEQ ID NO: 2094216 - RNA, 18 nt, Homo sapiens
cugccccuuccccaugaa

SEQ ID NO: 2094217 - RNA, 14 nt, Homo sapiens
ucuccccuccagcc

SEQ ID NO: 2094218 - RNA, 11 nt, Homo sapiens
ugcuguugcug

SEQ ID NO: 2094219 - RNA, 15 nt, Homo sapiens
gcugaaugucauuuu

SEQ ID NO: 2094220 - RNA, 21 nt, Homo sapiens
aaucaccuaggggucuuguua

SEQ ID NO: 2094221 - RNA, 20 nt, Homo sapiens
cugcacccuguauggagcua

SEQ ID NO: 2094222 - RNA, 21 nt, Homo sapiens
agcaauuuuuccaaaagccag

SEQ ID NO: 2094223 - RNA, 13 nt, Homo sapiens
ucugcagaguucu

SEQ ID NO: 2094224 - RNA, 20 nt, Homo sapiens
uguuggggaggggaauggga

SEQ ID NO: 2094225 - RNA, 20 nt, Homo sapiens
ucuuagacuucugcuuucca

SEQ ID NO: 2094226 - RNA, 13 nt, Homo sapiens
cauaaacaauuca

SEQ ID NO: 2094227 - RNA, 15 nt, Homo sapiens
uuuccuuggauguga

SEQ ID NO: 2094228 - RNA, 18 nt, Homo sapiens
aaccaaaucauacuuucu

SEQ ID NO: 2094229 - RNA, 13 nt, Homo sapiens
guuauuguuugau

SEQ ID NO: 2094230 - RNA, 23 nt, Homo sapiens
auacagaugccauauaguguuau

SEQ ID NO: 2094231 - RNA, 20 nt, Homo sapiens
aaagcaaaugggguuucaca

SEQ ID NO: 2094232 - RNA, 16 nt, Homo sapiens
cuuucagcagacugau

SEQ ID NO: 2094233 - RNA, 13 nt, Homo sapiens
acgcaccagacac

SEQ ID NO: 2094234 - RNA, 22 nt, Homo sapiens
gaguuccucagggaguuugacg

SEQ ID NO: 2094235 - RNA, 14 nt, Homo sapiens
agaaaaaugcuguu

SEQ ID NO: 2094236 - RNA, 14 nt, Homo sapiens
uuaaggauguugcc

SEQ ID NO: 2094237 - RNA, 23 nt, Homo sapiens
ugaagaaaaaauggcaagagauc

SEQ ID NO: 2094238 - RNA, 19 nt, Homo sapiens
ucccccagcgucaguuuca

SEQ ID NO: 2094239 - RNA, 22 nt, Homo sapiens
cucucaacauuaccaaaaucau

SEQ ID NO: 2094240 - RNA, 21 nt, Homo sapiens
ccuggcucgcagggugcagga

SEQ ID NO: 2094241 - RNA, 13 nt, Homo sapiens
gccacuguguacu

SEQ ID NO: 2094242 - RNA, 15 nt, Homo sapiens
uugagggguggaccc

SEQ ID NO: 2094243 - RNA, 13 nt, Homo sapiens
acuaugcugcuau

SEQ ID NO: 2094244 - RNA, 23 nt, Homo sapiens
cuuuccugucuuccuugaccaaa

SEQ ID NO: 2094245 - RNA, 22 nt, Homo sapiens
agcugugcucgggugcugccag

SEQ ID NO: 2094246 - RNA, 18 nt, Homo sapiens
ccuuuagaguugcaugac

SEQ ID NO: 2094247 - RNA, 16 nt, Homo sapiens
uuacucuaugaugauu

SEQ ID NO: 2094248 - RNA, 17 nt, Homo sapiens
gcacauacgcaccacau

SEQ ID NO: 2094249 - RNA, 23 nt, Homo sapiens
uccauacccccugccccagagaa

SEQ ID NO: 2094250 - RNA, 23 nt, Homo sapiens
gucugcugacuguuucauucacu

SEQ ID NO: 2094251 - RNA, 22 nt, Homo sapiens
auucugucacucaccacuacau

SEQ ID NO: 2094252 - RNA, 17 nt, Homo sapiens
aaugcaaaguacaugua

SEQ ID NO: 2094253 - RNA, 18 nt, Homo sapiens
acuuuaucauggaauuua

SEQ ID NO: 2094254 - RNA, 22 nt, Homo sapiens
cugaggacuguccucccacaga

SEQ ID NO: 2094255 - RNA, 17 nt, Homo sapiens
auggagaaacaagacag

SEQ ID NO: 2094256 - RNA, 11 nt, Homo sapiens
uaacuuugaac

SEQ ID NO: 2094257 - RNA, 13 nt, Homo sapiens
uagggaccugcug

SEQ ID NO: 2094258 - RNA, 18 nt, Homo sapiens
ucauuaagguuaugcacu

SEQ ID NO: 2094259 - RNA, 13 nt, Homo sapiens
agauuacaggugu

SEQ ID NO: 2094260 - RNA, 15 nt, Homo sapiens
aaagacuggauccaa

SEQ ID NO: 2094261 - RNA, 21 nt, Homo sapiens
ggcguuuugucuguguugcug

SEQ ID NO: 2094262 - RNA, 14 nt, Homo sapiens
aagucucacugugu

SEQ ID NO: 2094263 - RNA, 18 nt, Homo sapiens
caauuugucaaauacuua

SEQ ID NO: 2094264 - RNA, 18 nt, Homo sapiens
acccagaaaaucugaauu

SEQ ID NO: 2094265 - RNA, 15 nt, Homo sapiens
ucaagaccauaguga

SEQ ID NO: 2094266 - RNA, 20 nt, Homo sapiens
ugagagaaggaugggucccc

SEQ ID NO: 2094267 - RNA, 16 nt, Homo sapiens
aguggggauccugccc

SEQ ID NO: 2094268 - RNA, 16 nt, Homo sapiens
cauguaaaugcucauu

SEQ ID NO: 2094269 - RNA, 18 nt, Homo sapiens
aaguacugagcaguauua

SEQ ID NO: 2094270 - RNA, 20 nt, Homo sapiens
cuucccagcuagaauucacu

SEQ ID NO: 2094271 - RNA, 20 nt, Homo sapiens
cacuauuucccucuacugag

SEQ ID NO: 2094272 - RNA, 15 nt, Homo sapiens
ugcaaagcauuugag

SEQ ID NO: 2094273 - RNA, 17 nt, Homo sapiens
gacccuguaaaauggag

SEQ ID NO: 2094274 - RNA, 16 nt, Homo sapiens
ucuuugacaacgccaa

SEQ ID NO: 2094275 - RNA, 19 nt, Homo sapiens
agauaauuuuauguguuau

SEQ ID NO: 2094276 - RNA, 16 nt, Homo sapiens
agacaccaaaguucua

SEQ ID NO: 2094277 - RNA, 13 nt, Homo sapiens
aggaaacuugaaa

SEQ ID NO: 2094278 - RNA, 15 nt, Homo sapiens
acagcagugaucuca

SEQ ID NO: 2094279 - RNA, 12 nt, Homo sapiens
aaaauccuucua

SEQ ID NO: 2094280 - RNA, 12 nt, Homo sapiens
gcugaaaacccg

SEQ ID NO: 2094281 - RNA, 11 nt, Homo sapiens
ggccacagggc

SEQ ID NO: 2094282 - RNA, 12 nt, Homo sapiens
acucagcacaag

SEQ ID NO: 2094283 - RNA, 22 nt, Homo sapiens
gcauuuuggaaagcuccuagca

SEQ ID NO: 2094284 - RNA, 16 nt, Homo sapiens
aacauggcacauguau

SEQ ID NO: 2094285 - RNA, 20 nt, Homo sapiens
ugcagaagcagaagugcaau

SEQ ID NO: 2094286 - RNA, 20 nt, Homo sapiens
uccuguaagucaaaugugug

SEQ ID NO: 2094287 - RNA, 20 nt, Homo sapiens
cuaaguauauuuaauucacu

SEQ ID NO: 2094288 - RNA, 17 nt, Homo sapiens
uguaugugugugcaugu

SEQ ID NO: 2094289 - RNA, 17 nt, Homo sapiens
aaaaugcaaaagcacau

SEQ ID NO: 2094290 - RNA, 18 nt, Homo sapiens
gcccggggugguccaaug

SEQ ID NO: 2094291 - RNA, 14 nt, Homo sapiens
ugcacacaaaacaa

SEQ ID NO: 2094292 - RNA, 14 nt, Homo sapiens
caacacaaauauca

SEQ ID NO: 2094293 - RNA, 22 nt, Homo sapiens
guauaacuggauugcagacugu

SEQ ID NO: 2094294 - RNA, 16 nt, Homo sapiens
cagccuguaacugucc

SEQ ID NO: 2094295 - RNA, 15 nt, Homo sapiens
ccacucccaucuccu

SEQ ID NO: 2094296 - RNA, 14 nt, Homo sapiens
cagaggcucuaaug

SEQ ID NO: 2094297 - RNA, 21 nt, Homo sapiens
cugaagcuuauuaaugcuaag

SEQ ID NO: 2094298 - RNA, 16 nt, Homo sapiens
cccuucacugucacca

SEQ ID NO: 2094299 - RNA, 15 nt, Homo sapiens
gcaguauucuugcac

SEQ ID NO: 2094300 - RNA, 16 nt, Homo sapiens
aaccugggcauggugg

SEQ ID NO: 2094301 - RNA, 14 nt, Homo sapiens
augaagguaauauu

SEQ ID NO: 2094302 - RNA, 18 nt, Homo sapiens
gagucgggagcacagcug

SEQ ID NO: 2094303 - RNA, 21 nt, Homo sapiens
ucaguguacucugaguccuca

SEQ ID NO: 2094304 - RNA, 16 nt, Homo sapiens
guucaaguuauuucag

SEQ ID NO: 2094305 - RNA, 10 nt, Homo sapiens
ccuguuaaau

SEQ ID NO: 2094306 - RNA, 19 nt, Homo sapiens
gccccuccaggaacauucc

SEQ ID NO: 2094307 - RNA, 21 nt, Homo sapiens
acugcugaauucaccugugga

SEQ ID NO: 2094308 - RNA, 20 nt, Homo sapiens
uucugggauuucuucucaca

SEQ ID NO: 2094309 - RNA, 14 nt, Homo sapiens
uucaccuaucccau

SEQ ID NO: 2094310 - RNA, 18 nt, Homo sapiens
uggggggcucucagggaa

SEQ ID NO: 2094311 - RNA, 17 nt, Homo sapiens
agaacguggauugugaa

SEQ ID NO: 2094312 - RNA, 20 nt, Homo sapiens
auuggcuuuugaaucaaaga

SEQ ID NO: 2094313 - RNA, 14 nt, Homo sapiens
agacccagccaugc

SEQ ID NO: 2094314 - RNA, 18 nt, Homo sapiens
agaauacccuaaaguaua

SEQ ID NO: 2094315 - RNA, 23 nt, Homo sapiens
ugacuccuguugccauggauuca

SEQ ID NO: 2094316 - RNA, 12 nt, Homo sapiens
guaaauuuugga

SEQ ID NO: 2094317 - RNA, 19 nt, Homo sapiens
ccuggguacugaggugcua

SEQ ID NO: 2094318 - RNA, 18 nt, Homo sapiens
auaauggcugaagccaaa

SEQ ID NO: 2094319 - RNA, 19 nt, Homo sapiens
ugacuucuccaggucucac

SEQ ID NO: 2094320 - RNA, 17 nt, Homo sapiens
gccuggcaggggaucca

SEQ ID NO: 2094321 - RNA, 15 nt, Homo sapiens
gagaacugucuuuca

SEQ ID NO: 2094322 - RNA, 15 nt, Homo sapiens
gaacuuuauuuccaa

SEQ ID NO: 2094323 - RNA, 13 nt, Homo sapiens
gcccccccuucca

SEQ ID NO: 2094324 - RNA, 21 nt, Homo sapiens
auuggguagaaagauggggca

SEQ ID NO: 2094325 - RNA, 17 nt, Homo sapiens
aggaauaugcaucccac

SEQ ID NO: 2094326 - RNA, 14 nt, Homo sapiens
gccaugaccuuccu

SEQ ID NO: 2094327 - RNA, 16 nt, Homo sapiens
aacuaaggcauuugau

SEQ ID NO: 2094328 - RNA, 14 nt, Homo sapiens
cuucccugccccug

SEQ ID NO: 2094329 - RNA, 18 nt, Homo sapiens
uaaugacguauugugaaa

SEQ ID NO: 2094330 - RNA, 16 nt, Homo sapiens
aaagaagacuggaagc

SEQ ID NO: 2094331 - RNA, 19 nt, Homo sapiens
cugguuagguccaccugcu

SEQ ID NO: 2094332 - RNA, 15 nt, Homo sapiens
cauauccugagccau

SEQ ID NO: 2094333 - RNA, 22 nt, Homo sapiens
uacuuuuuccuggcucaucucu

SEQ ID NO: 2094334 - RNA, 19 nt, Homo sapiens
gcuguuuguuccaggcuca

SEQ ID NO: 2094335 - RNA, 13 nt, Homo sapiens
agugaucuuguuc

SEQ ID NO: 2094336 - RNA, 21 nt, Homo sapiens
auccgucuaguuaacauuuca

SEQ ID NO: 2094337 - RNA, 13 nt, Homo sapiens
guuaauucuugcc

SEQ ID NO: 2094338 - RNA, 22 nt, Homo sapiens
gagggacgacaccucugguuuu

SEQ ID NO: 2094339 - RNA, 14 nt, Homo sapiens
agcuacuucaggac

SEQ ID NO: 2094340 - RNA, 23 nt, Homo sapiens
ucccuuucaucacauuuguuuga

SEQ ID NO: 2094341 - RNA, 19 nt, Homo sapiens
agacacaaagagacaaagc

SEQ ID NO: 2094342 - RNA, 20 nt, Homo sapiens
ccacugggcucuggaccuca

SEQ ID NO: 2094343 - RNA, 19 nt, Homo sapiens
ugugcauuuguucagcucc

SEQ ID NO: 2094344 - RNA, 12 nt, Homo sapiens
guugacauucag

SEQ ID NO: 2094345 - RNA, 19 nt, Homo sapiens
uuuaucacuucauucacau

SEQ ID NO: 2094346 - RNA, 15 nt, Homo sapiens
acucaaguaccacca

SEQ ID NO: 2094347 - RNA, 12 nt, Homo sapiens
uggaagauuucu

SEQ ID NO: 2094348 - RNA, 14 nt, Homo sapiens
aguggccaucauuu

SEQ ID NO: 2094349 - RNA, 17 nt, Homo sapiens
caggaguuguugaacua

SEQ ID NO: 2094350 - RNA, 13 nt, Homo sapiens
accacugucucca

SEQ ID NO: 2094351 - RNA, 15 nt, Homo sapiens
caaggacaugcggcc

SEQ ID NO: 2094352 - RNA, 15 nt, Homo sapiens
ugauucaacacuuaa

SEQ ID NO: 2094353 - RNA, 13 nt, Homo sapiens
cugcccagugcaa

SEQ ID NO: 2094354 - RNA, 23 nt, Homo sapiens
agucugguaauaaaugugacuca

SEQ ID NO: 2094355 - RNA, 14 nt, Homo sapiens
gcgcuucaucucau

SEQ ID NO: 2094356 - RNA, 14 nt, Homo sapiens
caauuucaaacuuu

SEQ ID NO: 2094357 - RNA, 22 nt, Homo sapiens
agccugggugcacaguagcugc

SEQ ID NO: 2094358 - RNA, 20 nt, Homo sapiens
acacuuuuggaaccaugccu

SEQ ID NO: 2094359 - RNA, 14 nt, Homo sapiens
gucccugcccuccc

SEQ ID NO: 2094360 - RNA, 14 nt, Homo sapiens
ucagacagcuugaa

SEQ ID NO: 2094361 - RNA, 22 nt, Homo sapiens
gcagaacucuugacuuccugcc

SEQ ID NO: 2094362 - RNA, 14 nt, Homo sapiens
cauaagggcacuga

SEQ ID NO: 2094363 - RNA, 14 nt, Homo sapiens
uuaugugugccuuu

SEQ ID NO: 2094364 - RNA, 17 nt, Homo sapiens
ccagaaaaaucaaucau

SEQ ID NO: 2094365 - RNA, 18 nt, Homo sapiens
cucagagguagcaguaaa

SEQ ID NO: 2094366 - RNA, 12 nt, Homo sapiens
uagaaacauauc

SEQ ID NO: 2094367 - RNA, 18 nt, Homo sapiens
uaaauauuuaagugcagu

SEQ ID NO: 2094368 - RNA, 20 nt, Homo sapiens
uuugucaugccauuaagcuc

SEQ ID NO: 2094369 - RNA, 17 nt, Homo sapiens
aucccuucuuccauccu

SEQ ID NO: 2094370 - RNA, 19 nt, Homo sapiens
ccuguaauccuagcacuuu

SEQ ID NO: 2094371 - RNA, 17 nt, Homo sapiens
guaaucccagcuacuca

SEQ ID NO: 2094372 - RNA, 15 nt, Homo sapiens
acagguucuaugauu

SEQ ID NO: 2094373 - RNA, 22 nt, Homo sapiens
gaauucuacuauuuaugugauc

SEQ ID NO: 2094374 - RNA, 14 nt, Homo sapiens
agccucacaguccu

SEQ ID NO: 2094375 - RNA, 19 nt, Homo sapiens
ugacaacuucuaauugcca

SEQ ID NO: 2094376 - RNA, 19 nt, Homo sapiens
ccucaucugcaaaauggga

SEQ ID NO: 2094377 - RNA, 14 nt, Homo sapiens
cacauugacagugg

SEQ ID NO: 2094378 - RNA, 20 nt, Homo sapiens
agcacuugaugccacccaga

SEQ ID NO: 2094379 - RNA, 16 nt, Homo sapiens
gcaaaagaaagaacca

SEQ ID NO: 2094380 - RNA, 18 nt, Homo sapiens
ucuuuucuacccuagcca

SEQ ID NO: 2094381 - RNA, 18 nt, Homo sapiens
caaaugguauuuugauag

SEQ ID NO: 2094382 - RNA, 14 nt, Homo sapiens
caaccuaaauggag

SEQ ID NO: 2094383 - RNA, 13 nt, Homo sapiens
aggagauggcaua

SEQ ID NO: 2094384 - RNA, 18 nt, Homo sapiens
uaaagucaacauaugcaa

SEQ ID NO: 2094385 - RNA, 21 nt, Homo sapiens
cuuauuuggaauugacauucu

SEQ ID NO: 2094386 - RNA, 23 nt, Homo sapiens
aaaugcaaggugaacaccacuuu

SEQ ID NO: 2094387 - RNA, 15 nt, Homo sapiens
ucauucucauucuca

SEQ ID NO: 2094388 - RNA, 15 nt, Homo sapiens
auucccucucaucca

SEQ ID NO: 2094389 - RNA, 15 nt, Homo sapiens
cugaggagcuguuga

SEQ ID NO: 2094390 - RNA, 13 nt, Homo sapiens
aaacaaaccuugc

SEQ ID NO: 2094391 - RNA, 16 nt, Homo sapiens
gcagugauuagcacuu

SEQ ID NO: 2094392 - RNA, 18 nt, Homo sapiens
gauggaaaggagccuagg

SEQ ID NO: 2094393 - RNA, 15 nt, Homo sapiens
ucaaagguacuugga

SEQ ID NO: 2094394 - RNA, 15 nt, Homo sapiens
accacuccacuggcc

SEQ ID NO: 2094395 - RNA, 19 nt, Homo sapiens
guaugugguacuacuguaa

SEQ ID NO: 2094396 - RNA, 15 nt, Homo sapiens
gaggugggauccucc

SEQ ID NO: 2094397 - RNA, 14 nt, Homo sapiens
aaaguaucugagau

SEQ ID NO: 2094398 - RNA, 22 nt, Homo sapiens
uacuugggaggcugagccagga

SEQ ID NO: 2094399 - RNA, 13 nt, Homo sapiens
aguaaccaaaaca

SEQ ID NO: 2094400 - RNA, 20 nt, Homo sapiens
uugaggauuguggaaaacca

SEQ ID NO: 2094401 - RNA, 13 nt, Homo sapiens
uuuuaacauguau

SEQ ID NO: 2094402 - RNA, 13 nt, Homo sapiens
ggaaaacaguauu

SEQ ID NO: 2094403 - RNA, 18 nt, Homo sapiens
uacagguagugggcucac

SEQ ID NO: 2094404 - RNA, 18 nt, Homo sapiens
ugggaucagcuucuugca

SEQ ID NO: 2094405 - RNA, 21 nt, Homo sapiens
uguuguuagcuuuucaguucc

SEQ ID NO: 2094406 - RNA, 13 nt, Homo sapiens
acauugaugcuga

SEQ ID NO: 2094407 - RNA, 19 nt, Homo sapiens
gugcugagauuacaggugu

SEQ ID NO: 2094408 - RNA, 16 nt, Homo sapiens
uucucaccauuugagu

SEQ ID NO: 2094409 - RNA, 19 nt, Homo sapiens
uuugagaagaaaacaucua

SEQ ID NO: 2094410 - RNA, 21 nt, Homo sapiens
uucugucugugucuucaggag

SEQ ID NO: 2094411 - RNA, 15 nt, Homo sapiens
agaauguugcuuucu

SEQ ID NO: 2094412 - RNA, 14 nt, Homo sapiens
caacuccauacucc

SEQ ID NO: 2094413 - RNA, 19 nt, Homo sapiens
cuuguggucucgaugcugc

SEQ ID NO: 2094414 - RNA, 19 nt, Homo sapiens
cuauagauugauuuaccuu

SEQ ID NO: 2094415 - RNA, 13 nt, Homo sapiens
ccuaugcuuaaua

SEQ ID NO: 2094416 - RNA, 17 nt, Homo sapiens
accauggcacugacaau

SEQ ID NO: 2094417 - RNA, 13 nt, Homo sapiens
augacaugaauuu

SEQ ID NO: 2094418 - RNA, 22 nt, Homo sapiens
ucugguuccuccagccaccuca

SEQ ID NO: 2094419 - RNA, 15 nt, Homo sapiens
ccccuccuccaggga

SEQ ID NO: 2094420 - RNA, 13 nt, Homo sapiens
uggaggggggagc

SEQ ID NO: 2094421 - RNA, 21 nt, Homo sapiens
gauuaguauucaggcacugag

SEQ ID NO: 2094422 - RNA, 20 nt, Homo sapiens
agacuugaauagacacuuca

SEQ ID NO: 2094423 - RNA, 12 nt, Homo sapiens
gaaagugauauc

SEQ ID NO: 2094424 - RNA, 19 nt, Homo sapiens
aaccaaguggaaaggcaag

SEQ ID NO: 2094425 - RNA, 13 nt, Homo sapiens
agguuccaaauuc

SEQ ID NO: 2094426 - RNA, 15 nt, Homo sapiens
caagaaauagguuau

SEQ ID NO: 2094427 - RNA, 17 nt, Homo sapiens
gguccugaaaguaacuc

SEQ ID NO: 2094428 - RNA, 14 nt, Homo sapiens
cagaaucagaauca

SEQ ID NO: 2094429 - RNA, 14 nt, Homo sapiens
gaaacucacaguaa

SEQ ID NO: 2094430 - RNA, 19 nt, Homo sapiens
gugaaguuuaauugucuca

SEQ ID NO: 2094431 - RNA, 13 nt, Homo sapiens
uacugaguuugau

SEQ ID NO: 2094432 - RNA, 13 nt, Homo sapiens
ugcuaacaucuca

SEQ ID NO: 2094433 - RNA, 16 nt, Homo sapiens
aaucaauacugcacac

SEQ ID NO: 2094434 - RNA, 21 nt, Homo sapiens
gcuuaagggaauaugcauugu

SEQ ID NO: 2094435 - RNA, 16 nt, Homo sapiens
cauggaauuggagcuc

SEQ ID NO: 2094436 - RNA, 21 nt, Homo sapiens
agccaggcuaugguugccacc

SEQ ID NO: 2094437 - RNA, 22 nt, Homo sapiens
gcauggcguagagggugcugcc

SEQ ID NO: 2094438 - RNA, 15 nt, Homo sapiens
gauauaaguaaguga

SEQ ID NO: 2094439 - RNA, 17 nt, Homo sapiens
cacacggcugaccucau

SEQ ID NO: 2094440 - RNA, 16 nt, Homo sapiens
aacucaggacuccagc

SEQ ID NO: 2094441 - RNA, 14 nt, Homo sapiens
auauaauacuguau

SEQ ID NO: 2094442 - RNA, 12 nt, Homo sapiens
caagacugcuga

SEQ ID NO: 2094443 - RNA, 18 nt, Homo sapiens
aagaaugugugugcagaa

SEQ ID NO: 2094444 - RNA, 16 nt, Homo sapiens
uccagccaacauuuaa

SEQ ID NO: 2094445 - RNA, 19 nt, Homo sapiens
aguuccuaauggauucaau

SEQ ID NO: 2094446 - RNA, 21 nt, Homo sapiens
guuauuguaggcaaccuuccc

SEQ ID NO: 2094447 - RNA, 14 nt, Homo sapiens
aacaccuucaucca

SEQ ID NO: 2094448 - RNA, 20 nt, Homo sapiens
ucagagcacaggcauauuau

SEQ ID NO: 2094449 - RNA, 23 nt, Homo sapiens
cacgguggcucacgccuguaauu

SEQ ID NO: 2094450 - RNA, 16 nt, Homo sapiens
uauuccaaaccaaauu

SEQ ID NO: 2094451 - RNA, 12 nt, Homo sapiens
ggaggggguccu

SEQ ID NO: 2094452 - RNA, 20 nt, Homo sapiens
ugccccgugggcugugccaa

SEQ ID NO: 2094453 - RNA, 14 nt, Homo sapiens
ugccuccucugggg

SEQ ID NO: 2094454 - RNA, 15 nt, Homo sapiens
uguuccccucaccca

SEQ ID NO: 2094455 - RNA, 22 nt, Homo sapiens
guacugucuuuacaaguagcua

SEQ ID NO: 2094456 - RNA, 19 nt, Homo sapiens
cacugagaagauugugaau

SEQ ID NO: 2094457 - RNA, 19 nt, Homo sapiens
ccaaugccugcauggauac

SEQ ID NO: 2094458 - RNA, 18 nt, Homo sapiens
gacgaggaggagugcaug

SEQ ID NO: 2094459 - RNA, 14 nt, Homo sapiens
auaacauuuacuuu

SEQ ID NO: 2094460 - RNA, 16 nt, Homo sapiens
cuuccacucagggcuu

SEQ ID NO: 2094461 - RNA, 15 nt, Homo sapiens
acuuauaauuacaau

SEQ ID NO: 2094462 - RNA, 20 nt, Homo sapiens
gcgggaaaauaaaccacugg

SEQ ID NO: 2094463 - RNA, 17 nt, Homo sapiens
gaagagaaaggacucag

SEQ ID NO: 2094464 - RNA, 22 nt, Homo sapiens
ugguuggccgugguccagcucu

SEQ ID NO: 2094465 - RNA, 13 nt, Homo sapiens
cuaguacuaguac

SEQ ID NO: 2094466 - RNA, 20 nt, Homo sapiens
ugaaggugcugacaaagaug

SEQ ID NO: 2094467 - RNA, 12 nt, Homo sapiens
acucauugcucu

SEQ ID NO: 2094468 - RNA, 17 nt, Homo sapiens
gcccaucagcuaccccu

SEQ ID NO: 2094469 - RNA, 22 nt, Homo sapiens
aggcaugagggaucacagggcc

SEQ ID NO: 2094470 - RNA, 15 nt, Homo sapiens
gaguuuaguuuuaua

SEQ ID NO: 2094471 - RNA, 14 nt, Homo sapiens
gacaugcaagucau

SEQ ID NO: 2094472 - RNA, 15 nt, Homo sapiens
gcugacggaagccaa

SEQ ID NO: 2094473 - RNA, 14 nt, Homo sapiens
aucuuagcuuuuaa

SEQ ID NO: 2094474 - RNA, 19 nt, Homo sapiens
agugcaaaacugugucaca

SEQ ID NO: 2094475 - RNA, 18 nt, Homo sapiens
acccccgccccugggcua

SEQ ID NO: 2094476 - RNA, 20 nt, Homo sapiens
caagaugacacaacugcacu

SEQ ID NO: 2094477 - RNA, 16 nt, Homo sapiens
cauguuuaauugugau

SEQ ID NO: 2094478 - RNA, 19 nt, Homo sapiens
ugaacuuuuuaacaaaugu

SEQ ID NO: 2094479 - RNA, 14 nt, Homo sapiens
ggaguagaauacca

SEQ ID NO: 2094480 - RNA, 15 nt, Homo sapiens
uggcauugaucuuaa

SEQ ID NO: 2094481 - RNA, 13 nt, Homo sapiens
guugauguugaua

SEQ ID NO: 2094482 - RNA, 15 nt, Homo sapiens
aucuucccacagugg

SEQ ID NO: 2094483 - RNA, 22 nt, Homo sapiens
cacaggaaaccaacacccaaag

SEQ ID NO: 2094484 - RNA, 15 nt, Homo sapiens
ggcccgcaccgcugg

SEQ ID NO: 2094485 - RNA, 21 nt, Homo sapiens
caagcuuuccugcugucuucu

SEQ ID NO: 2094486 - RNA, 20 nt, Homo sapiens
ggcaacauaguaagacccca

SEQ ID NO: 2094487 - RNA, 13 nt, Homo sapiens
auucuaguacuug

SEQ ID NO: 2094488 - RNA, 13 nt, Homo sapiens
aggcagcugaaaa

SEQ ID NO: 2094489 - RNA, 21 nt, Homo sapiens
guccccccucaagaguacaga

SEQ ID NO: 2094490 - RNA, 18 nt, Homo sapiens
uaccauuuaguaagaaua

SEQ ID NO: 2094491 - RNA, 12 nt, Homo sapiens
gacaauuacuuu

SEQ ID NO: 2094492 - RNA, 18 nt, Homo sapiens
aucaauucuuagaauauc

SEQ ID NO: 2094493 - RNA, 14 nt, Homo sapiens
ugggccucauucua

SEQ ID NO: 2094494 - RNA, 20 nt, Homo sapiens
gcuucucaucuaaauauuuc

SEQ ID NO: 2094495 - RNA, 14 nt, Homo sapiens
gagaaaccucggaa

SEQ ID NO: 2094496 - RNA, 22 nt, Homo sapiens
uggagccaauguguggcucagu

SEQ ID NO: 2094497 - RNA, 13 nt, Homo sapiens
ggaagacugacag

SEQ ID NO: 2094498 - RNA, 22 nt, Homo sapiens
uccuuucccuacuccaugggcu

SEQ ID NO: 2094499 - RNA, 19 nt, Homo sapiens
cagacuuuuuuaaacauca

SEQ ID NO: 2094500 - RNA, 17 nt, Homo sapiens
cucagagagggugggag

SEQ ID NO: 2094501 - RNA, 22 nt, Homo sapiens
ccaacuuuuuccaaguccuuua

SEQ ID NO: 2094502 - RNA, 22 nt, Homo sapiens
caccuaauguuuaugagccaga

SEQ ID NO: 2094503 - RNA, 14 nt, Homo sapiens
uggauggaaaggga

SEQ ID NO: 2094504 - RNA, 18 nt, Homo sapiens
ugcaaucagcuaccauuc

SEQ ID NO: 2094505 - RNA, 12 nt, Homo sapiens
agccccacagac

SEQ ID NO: 2094506 - RNA, 15 nt, Homo sapiens
auaccugauauauuc

SEQ ID NO: 2094507 - RNA, 21 nt, Homo sapiens
guaauagauuguuuugccacu

SEQ ID NO: 2094508 - RNA, 22 nt, Homo sapiens
ccagccccucccccaucuccca

SEQ ID NO: 2094509 - RNA, 20 nt, Homo sapiens
cuuaaagcauuccccaaaga

SEQ ID NO: 2094510 - RNA, 19 nt, Homo sapiens
auguugguuucacugagag

SEQ ID NO: 2094511 - RNA, 18 nt, Homo sapiens
augaaacuauuacuccua

SEQ ID NO: 2094512 - RNA, 18 nt, Homo sapiens
cugaagcugacagcacua

SEQ ID NO: 2094513 - RNA, 14 nt, Homo sapiens
ucuuugucuuuauu

SEQ ID NO: 2094514 - RNA, 20 nt, Homo sapiens
cuggcucugcccccuccccc

SEQ ID NO: 2094515 - RNA, 15 nt, Homo sapiens
cuuugaaaacacuac

SEQ ID NO: 2094516 - RNA, 23 nt, Homo sapiens
ucggggccauacuucuguuucca

SEQ ID NO: 2094517 - RNA, 13 nt, Homo sapiens
aauacagucuucc

SEQ ID NO: 2094518 - RNA, 17 nt, Homo sapiens
uauuaugaauucacaga

SEQ ID NO: 2094519 - RNA, 15 nt, Homo sapiens
gcauuuucauuucac

SEQ ID NO: 2094520 - RNA, 20 nt, Homo sapiens
ucuaaaagggggcuauuccc

SEQ ID NO: 2094521 - RNA, 11 nt, Homo sapiens
uguauguauag

SEQ ID NO: 2094522 - RNA, 18 nt, Homo sapiens
gcuuaccuacauacgugu

SEQ ID NO: 2094523 - RNA, 18 nt, Homo sapiens
gauauaggaaaauacauu

SEQ ID NO: 2094524 - RNA, 20 nt, Homo sapiens
ccaacauaugcccucagaaa

SEQ ID NO: 2094525 - RNA, 18 nt, Homo sapiens
aggagacccacagguaug

SEQ ID NO: 2094526 - RNA, 16 nt, Homo sapiens
uaugcaagagcugguu

SEQ ID NO: 2094527 - RNA, 21 nt, Homo sapiens
uuggagacugggguggccuca

SEQ ID NO: 2094528 - RNA, 22 nt, Homo sapiens
ggccaucugguuaggauggcag

SEQ ID NO: 2094529 - RNA, 15 nt, Homo sapiens
agaaguuacuaagua

SEQ ID NO: 2094530 - RNA, 19 nt, Homo sapiens
caguuaugauaaccaagaa

SEQ ID NO: 2094531 - RNA, 16 nt, Homo sapiens
aagagguucugcacuc

SEQ ID NO: 2094532 - RNA, 23 nt, Homo sapiens
ugagugcaccugccuccaccagc

SEQ ID NO: 2094533 - RNA, 14 nt, Homo sapiens
uuguuuaacccaaa

SEQ ID NO: 2094534 - RNA, 17 nt, Homo sapiens
cuuguaaucaagccuuu

SEQ ID NO: 2094535 - RNA, 13 nt, Homo sapiens
uuaccaauuccaa

SEQ ID NO: 2094536 - RNA, 17 nt, Homo sapiens
uuggaaaauaaaucaau

SEQ ID NO: 2094537 - RNA, 14 nt, Homo sapiens
ugggauuacaggug

SEQ ID NO: 2094538 - RNA, 14 nt, Homo sapiens
uauccuuucacucu

SEQ ID NO: 2094539 - RNA, 17 nt, Homo sapiens
gagcauagguagcuugu

SEQ ID NO: 2094540 - RNA, 15 nt, Homo sapiens
aauccaaauucccuc

SEQ ID NO: 2094541 - RNA, 13 nt, Homo sapiens
ggacacccuccug

SEQ ID NO: 2094542 - RNA, 19 nt, Homo sapiens
uuacuuuauguacaacuga

SEQ ID NO: 2094543 - RNA, 15 nt, Homo sapiens
auuuaauaaagauga

SEQ ID NO: 2094544 - RNA, 14 nt, Homo sapiens
ccuucucugcuccu

SEQ ID NO: 2094545 - RNA, 20 nt, Homo sapiens
cauagcccugccucaagcua

SEQ ID NO: 2094546 - RNA, 14 nt, Homo sapiens
aaccaggugcaauu

SEQ ID NO: 2094547 - RNA, 19 nt, Homo sapiens
ggaauguccagacuguggg

SEQ ID NO: 2094548 - RNA, 16 nt, Homo sapiens
agguggccuccuggcc

SEQ ID NO: 2094549 - RNA, 15 nt, Homo sapiens
aaaaaggaauacauu

SEQ ID NO: 2094550 - RNA, 17 nt, Homo sapiens
caaagugcugggauuac

SEQ ID NO: 2094551 - RNA, 16 nt, Homo sapiens
uauuuugccagacuua

SEQ ID NO: 2094552 - RNA, 23 nt, Homo sapiens
ccuuccccuccucucuccaggga

SEQ ID NO: 2094553 - RNA, 21 nt, Homo sapiens
uacacaucagccaucaacuaa

SEQ ID NO: 2094554 - RNA, 19 nt, Homo sapiens
aaugucuugagcucuauua

SEQ ID NO: 2094555 - RNA, 18 nt, Homo sapiens
uuuggagaacucauuuca

SEQ ID NO: 2094556 - RNA, 17 nt, Homo sapiens
cugaaauaacauggccu

SEQ ID NO: 2094557 - RNA, 17 nt, Homo sapiens
gaguuccucugcaguuu

SEQ ID NO: 2094558 - RNA, 16 nt, Homo sapiens
uucacugcaaugucaa

SEQ ID NO: 2094559 - RNA, 14 nt, Homo sapiens
ugcuugccuuccuc

SEQ ID NO: 2094560 - RNA, 21 nt, Homo sapiens
aggagggauguuccaguggau

SEQ ID NO: 2094561 - RNA, 17 nt, Homo sapiens
auauagguuugauucaa

SEQ ID NO: 2094562 - RNA, 16 nt, Homo sapiens
aacaguagcagggaau

SEQ ID NO: 2094563 - RNA, 14 nt, Homo sapiens
gaaauuuugcacca

SEQ ID NO: 2094564 - RNA, 15 nt, Homo sapiens
guugcugauguuuau

SEQ ID NO: 2094565 - RNA, 11 nt, Homo sapiens
cccauccagcc

SEQ ID NO: 2094566 - RNA, 16 nt, Homo sapiens
aaaaugcugcuuuguc

SEQ ID NO: 2094567 - RNA, 22 nt, Homo sapiens
ucaugucucagccuccucagua

SEQ ID NO: 2094568 - RNA, 17 nt, Homo sapiens
cauugucaccacacccu

SEQ ID NO: 2094569 - RNA, 19 nt, Homo sapiens
caaaauccagaaguuuaaa

SEQ ID NO: 2094570 - RNA, 14 nt, Homo sapiens
cugcacgugcacac

SEQ ID NO: 2094571 - RNA, 19 nt, Homo sapiens
uacauuauuggacuuccau

SEQ ID NO: 2094572 - RNA, 18 nt, Homo sapiens
aagcccagccugcaucua

SEQ ID NO: 2094573 - RNA, 15 nt, Homo sapiens
ugaccuaccaggaca

SEQ ID NO: 2094574 - RNA, 15 nt, Homo sapiens
auucagaggucacuu

SEQ ID NO: 2094575 - RNA, 17 nt, Homo sapiens
cugaagugaacuaugaa

SEQ ID NO: 2094576 - RNA, 13 nt, Homo sapiens
ucugcauuuugcu

SEQ ID NO: 2094577 - RNA, 19 nt, Homo sapiens
cgagaucacgccacugcac

SEQ ID NO: 2094578 - RNA, 19 nt, Homo sapiens
augaguauaaugaacacuc

SEQ ID NO: 2094579 - RNA, 13 nt, Homo sapiens
augaccuggaaau

SEQ ID NO: 2094580 - RNA, 10 nt, Homo sapiens
aucagugcca

SEQ ID NO: 2094581 - RNA, 21 nt, Homo sapiens
ugggcauuccuugggacucag

SEQ ID NO: 2094582 - RNA, 19 nt, Homo sapiens
cuguggauggcaucaaaca

SEQ ID NO: 2094583 - RNA, 20 nt, Homo sapiens
ccugagcaaaaagaccagcc

SEQ ID NO: 2094584 - RNA, 15 nt, Homo sapiens
gaaauagugccuuac

SEQ ID NO: 2094585 - RNA, 19 nt, Homo sapiens
guuaacuugccuccaucuu

SEQ ID NO: 2094586 - RNA, 16 nt, Homo sapiens
uaguagagcauaccac

SEQ ID NO: 2094587 - RNA, 12 nt, Homo sapiens
auuuagacucau

SEQ ID NO: 2094588 - RNA, 13 nt, Homo sapiens
aggagcuuucuca

SEQ ID NO: 2094589 - RNA, 19 nt, Homo sapiens
gcucuuccaggagccaccu

SEQ ID NO: 2094590 - RNA, 15 nt, Homo sapiens
uguggaagacaaguc

SEQ ID NO: 2094591 - RNA, 17 nt, Homo sapiens
cuguuuauauguucaca

SEQ ID NO: 2094592 - RNA, 15 nt, Homo sapiens
ccagacucugucuca

SEQ ID NO: 2094593 - RNA, 15 nt, Homo sapiens
caucccuccaucuca

SEQ ID NO: 2094594 - RNA, 22 nt, Homo sapiens
cucucagaccaagcagcaggaa

SEQ ID NO: 2094595 - RNA, 23 nt, Homo sapiens
ccccuuagccaguuguauauuau

SEQ ID NO: 2094596 - RNA, 18 nt, Homo sapiens
uccccagaaacagugugc

SEQ ID NO: 2094597 - RNA, 18 nt, Homo sapiens
guuagaauuuuccuaaaa

SEQ ID NO: 2094598 - RNA, 14 nt, Homo sapiens
cuuuauugaagucu

SEQ ID NO: 2094599 - RNA, 23 nt, Homo sapiens
acaaagcaaaaagagaugcugga

SEQ ID NO: 2094600 - RNA, 16 nt, Homo sapiens
cucaauaaacagucac

SEQ ID NO: 2094601 - RNA, 22 nt, Homo sapiens
aucugcuuccauuaaaagcaua

SEQ ID NO: 2094602 - RNA, 15 nt, Homo sapiens
cagagcccacuucca

SEQ ID NO: 2094603 - RNA, 14 nt, Homo sapiens
uccuuucaccacau

SEQ ID NO: 2094604 - RNA, 14 nt, Homo sapiens
ucuguaccuuucua

SEQ ID NO: 2094605 - RNA, 19 nt, Homo sapiens
auggugaaaccccaucucu

SEQ ID NO: 2094606 - RNA, 17 nt, Homo sapiens
uauuucaaccgcuugcc

SEQ ID NO: 2094607 - RNA, 17 nt, Homo sapiens
aaacaguguggauguaa

SEQ ID NO: 2094608 - RNA, 13 nt, Homo sapiens
cucauuccaccuu

SEQ ID NO: 2094609 - RNA, 13 nt, Homo sapiens
ugguaagcauugu

SEQ ID NO: 2094610 - RNA, 19 nt, Homo sapiens
cccauuagcccacugccug

SEQ ID NO: 2094611 - RNA, 18 nt, Homo sapiens
guuuucauaauaccucac

SEQ ID NO: 2094612 - RNA, 23 nt, Homo sapiens
auaauccuauuacauaguuugaa

SEQ ID NO: 2094613 - RNA, 17 nt, Homo sapiens
acuugucuucuaguuua

SEQ ID NO: 2094614 - RNA, 22 nt, Homo sapiens
auaauucacccaccagacuuuu

SEQ ID NO: 2094615 - RNA, 19 nt, Homo sapiens
auuccacuuuuuguuacau

SEQ ID NO: 2094616 - RNA, 13 nt, Homo sapiens
gagaaccauuccc

SEQ ID NO: 2094617 - RNA, 21 nt, Homo sapiens
ggcgagcacugugagcaccug

SEQ ID NO: 2094618 - RNA, 13 nt, Homo sapiens
aauaauuugccau

SEQ ID NO: 2094619 - RNA, 23 nt, Homo sapiens
auuuccuauagcuacauguucuu

SEQ ID NO: 2094620 - RNA, 18 nt, Homo sapiens
gggucuccgaaaugcugu

SEQ ID NO: 2094621 - RNA, 18 nt, Homo sapiens
acuccggcugugcuggga

SEQ ID NO: 2094622 - RNA, 20 nt, Homo sapiens
uaaccaaagguuuugcagcc

SEQ ID NO: 2094623 - RNA, 23 nt, Homo sapiens
uaaauaagcuuuuaaacaaguca

SEQ ID NO: 2094624 - RNA, 17 nt, Homo sapiens
uacagcaaauguuauag

SEQ ID NO: 2094625 - RNA, 24 nt, Homo sapiens
accacacccacacucagauccucc

SEQ ID NO: 2094626 - RNA, 19 nt, Homo sapiens
gacagguaaugaagcuauu

SEQ ID NO: 2094627 - RNA, 22 nt, Homo sapiens
gaguuauggugaacccacaacu

SEQ ID NO: 2094628 - RNA, 14 nt, Homo sapiens
guuaacuacauauu

SEQ ID NO: 2094629 - RNA, 21 nt, Homo sapiens
guuccacauauauuuccacuu

SEQ ID NO: 2094630 - RNA, 22 nt, Homo sapiens
guccugcagaagcagaagugca

SEQ ID NO: 2094631 - RNA, 20 nt, Homo sapiens
cuccuggcuuuacagacaaa

SEQ ID NO: 2094632 - RNA, 11 nt, Homo sapiens
uacgugcaaac

SEQ ID NO: 2094633 - RNA, 23 nt, Homo sapiens
uaguuccagaaggauccaagaca

SEQ ID NO: 2094634 - RNA, 19 nt, Homo sapiens
guagguaauauugcaaggc

SEQ ID NO: 2094635 - RNA, 16 nt, Homo sapiens
guucaucaacagugag

SEQ ID NO: 2094636 - RNA, 21 nt, Homo sapiens
gcaauugagggcuaaauccca

SEQ ID NO: 2094637 - RNA, 22 nt, Homo sapiens
ucacccagggcgucccugacag

SEQ ID NO: 2094638 - RNA, 16 nt, Homo sapiens
cugcaaugucuguccc

SEQ ID NO: 2094639 - RNA, 18 nt, Homo sapiens
ucaugagccugcuggaag

SEQ ID NO: 2094640 - RNA, 17 nt, Homo sapiens
uccuugcuuucaucacu

SEQ ID NO: 2094641 - RNA, 14 nt, Homo sapiens
gaacuaugcagugu

SEQ ID NO: 2094642 - RNA, 16 nt, Homo sapiens
cagauagacagugcug

SEQ ID NO: 2094643 - RNA, 21 nt, Homo sapiens
ggaacacaaagaucaaaugaa

SEQ ID NO: 2094644 - RNA, 16 nt, Homo sapiens
ucuguacuaaaguauu

SEQ ID NO: 2094645 - RNA, 23 nt, Homo sapiens
cagugcaggacaacaucagcuca

SEQ ID NO: 2094646 - RNA, 17 nt, Homo sapiens
cuagcaugaacuugugg

SEQ ID NO: 2094647 - RNA, 19 nt, Homo sapiens
gagagauuuguggaaaaau

SEQ ID NO: 2094648 - RNA, 13 nt, Homo sapiens
uugucuugauuaa

SEQ ID NO: 2094649 - RNA, 21 nt, Homo sapiens
ugugacaccaccacugugucc

SEQ ID NO: 2094650 - RNA, 14 nt, Homo sapiens
aacuggcaucugac

SEQ ID NO: 2094651 - RNA, 14 nt, Homo sapiens
gcucagcagccagu

SEQ ID NO: 2094652 - RNA, 16 nt, Homo sapiens
cuuucagcugugaaca

SEQ ID NO: 2094653 - RNA, 21 nt, Homo sapiens
ucaguaacaguguaguacuca

SEQ ID NO: 2094654 - RNA, 12 nt, Homo sapiens
ccauaccacagc

SEQ ID NO: 2094655 - RNA, 13 nt, Homo sapiens
caugccugaugaa

SEQ ID NO: 2094656 - RNA, 23 nt, Homo sapiens
cagaagaugugaugaauuauccu

SEQ ID NO: 2094657 - RNA, 16 nt, Homo sapiens
caggcugucucauuua

SEQ ID NO: 2094658 - RNA, 22 nt, Homo sapiens
accuauugccaggaauguuuca

SEQ ID NO: 2094659 - RNA, 14 nt, Homo sapiens
caucccacacugua

SEQ ID NO: 2094660 - RNA, 14 nt, Homo sapiens
aauccaacccuguc

SEQ ID NO: 2094661 - RNA, 22 nt, Homo sapiens
ccaauuccacuuccugccccaa

SEQ ID NO: 2094662 - RNA, 19 nt, Homo sapiens
gccugaauaaaccaagaca

SEQ ID NO: 2094663 - RNA, 14 nt, Homo sapiens
gcuguccauugcca

SEQ ID NO: 2094664 - RNA, 23 nt, Homo sapiens
gaaacaaaaaugauccucagugc

SEQ ID NO: 2094665 - RNA, 19 nt, Homo sapiens
cuuuuauguagcacauaaa

SEQ ID NO: 2094666 - RNA, 16 nt, Homo sapiens
acuaacuagacuaaga

SEQ ID NO: 2094667 - RNA, 18 nt, Homo sapiens
uggagguucuaaggccua

SEQ ID NO: 2094668 - RNA, 23 nt, Homo sapiens
uaauguaccaaugaugaauuuau

SEQ ID NO: 2094669 - RNA, 18 nt, Homo sapiens
agguuaauaaagaugauu

SEQ ID NO: 2094670 - RNA, 23 nt, Homo sapiens
gaaguagguauaagaaguccuau

SEQ ID NO: 2094671 - RNA, 20 nt, Homo sapiens
cuauuaaucaccucucugua

SEQ ID NO: 2094672 - RNA, 12 nt, Homo sapiens
acacagcacaag

SEQ ID NO: 2094673 - RNA, 13 nt, Homo sapiens
aaacuuuauucaa

SEQ ID NO: 2094674 - RNA, 16 nt, Homo sapiens
cagccccuccaaaggu

SEQ ID NO: 2094675 - RNA, 12 nt, Homo sapiens
ccugguacugag

SEQ ID NO: 2094676 - RNA, 22 nt, Homo sapiens
ccagaggggugcgcagagcuga

SEQ ID NO: 2094677 - RNA, 12 nt, Homo sapiens
gcuuuccaugag

SEQ ID NO: 2094678 - RNA, 13 nt, Homo sapiens
uagcccagccuuu

SEQ ID NO: 2094679 - RNA, 21 nt, Homo sapiens
aauccagccugcugccugcuu

SEQ ID NO: 2094680 - RNA, 13 nt, Homo sapiens
cagauccuccuca

SEQ ID NO: 2094681 - RNA, 19 nt, Homo sapiens
gauggcuggaaggggucca

SEQ ID NO: 2094682 - RNA, 13 nt, Homo sapiens
gcuuuuuccuuag

SEQ ID NO: 2094683 - RNA, 23 nt, Homo sapiens
augaagauuuuuaggagugauua

SEQ ID NO: 2094684 - RNA, 23 nt, Homo sapiens
uaguuuuugaucaagaaugcaau

SEQ ID NO: 2094685 - RNA, 15 nt, Homo sapiens
auuuucggaacacau

SEQ ID NO: 2094686 - RNA, 15 nt, Homo sapiens
uucaucgguauucau

SEQ ID NO: 2094687 - RNA, 18 nt, Homo sapiens
uuuggaaauccucuagga

SEQ ID NO: 2094688 - RNA, 23 nt, Homo sapiens
aagaauugauucauguucaucaa

SEQ ID NO: 2094689 - RNA, 18 nt, Homo sapiens
cuaauuaaaaucuggaaa

SEQ ID NO: 2094690 - RNA, 12 nt, Homo sapiens
gcucuacaaaua

SEQ ID NO: 2094691 - RNA, 14 nt, Homo sapiens
ggagcuacucagga

SEQ ID NO: 2094692 - RNA, 23 nt, Homo sapiens
caauuuacuugccauuacucaau

SEQ ID NO: 2094693 - RNA, 12 nt, Homo sapiens
ucccaugaagcc

SEQ ID NO: 2094694 - RNA, 21 nt, Homo sapiens
aaacucuuucauucuucucac

SEQ ID NO: 2094695 - RNA, 20 nt, Homo sapiens
acccucgcaugacuguuaca

SEQ ID NO: 2094696 - RNA, 16 nt, Homo sapiens
caauaaaguaucuaca

SEQ ID NO: 2094697 - RNA, 16 nt, Homo sapiens
uccaaaauaaauggac

SEQ ID NO: 2094698 - RNA, 15 nt, Homo sapiens
acagagucucacuuu

SEQ ID NO: 2094699 - RNA, 15 nt, Homo sapiens
aucguuucuuccagu

SEQ ID NO: 2094700 - RNA, 17 nt, Homo sapiens
agcuugguaugagacag

SEQ ID NO: 2094701 - RNA, 13 nt, Homo sapiens
uuauaccaaagau

SEQ ID NO: 2094702 - RNA, 21 nt, Homo sapiens
uagagugcaauggcaccaucu

SEQ ID NO: 2094703 - RNA, 13 nt, Homo sapiens
aguggaaugggua

SEQ ID NO: 2094704 - RNA, 15 nt, Homo sapiens
ugaaaacagucccag

SEQ ID NO: 2094705 - RNA, 17 nt, Homo sapiens
aucacaccugcccuaaa

SEQ ID NO: 2094706 - RNA, 13 nt, Homo sapiens
cccagagagucca

SEQ ID NO: 2094707 - RNA, 17 nt, Homo sapiens
augcacauuucuggauu

SEQ ID NO: 2094708 - RNA, 19 nt, Homo sapiens
ggauaucacuuccaugaca

SEQ ID NO: 2094709 - RNA, 16 nt, Homo sapiens
cuauuacgugcaauac

SEQ ID NO: 2094710 - RNA, 15 nt, Homo sapiens
cguugaacgucacau

SEQ ID NO: 2094711 - RNA, 10 nt, Homo sapiens
ucccuggucg

SEQ ID NO: 2094712 - RNA, 12 nt, Homo sapiens
ggucucaucucc

SEQ ID NO: 2094713 - RNA, 12 nt, Homo sapiens
agcauguuucau

SEQ ID NO: 2094714 - RNA, 12 nt, Homo sapiens
acaauguuugcu

SEQ ID NO: 2094715 - RNA, 19 nt, Homo sapiens
uccuaccuauauuacacaa

SEQ ID NO: 2094716 - RNA, 11 nt, Homo sapiens
agucuugccuu

SEQ ID NO: 2094717 - RNA, 15 nt, Homo sapiens
caggggccacaucca

SEQ ID NO: 2094718 - RNA, 21 nt, Homo sapiens
caaaucaguauauuuucugua

SEQ ID NO: 2094719 - RNA, 14 nt, Homo sapiens
ugaugugucuucaa

SEQ ID NO: 2094720 - RNA, 19 nt, Homo sapiens
aaacauuaaaugucuuaua

SEQ ID NO: 2094721 - RNA, 14 nt, Homo sapiens
gagugugcucuccc

SEQ ID NO: 2094722 - RNA, 22 nt, Homo sapiens
ucuucuuauucaugcuuucucc

SEQ ID NO: 2094723 - RNA, 15 nt, Homo sapiens
aggcaguuccauuuc

SEQ ID NO: 2094724 - RNA, 17 nt, Homo sapiens
ugucccacuaucugggu

SEQ ID NO: 2094725 - RNA, 20 nt, Homo sapiens
ugcacacacacacaucucau

SEQ ID NO: 2094726 - RNA, 17 nt, Homo sapiens
aaaaguaaucacuuaaa

SEQ ID NO: 2094727 - RNA, 15 nt, Homo sapiens
uccauuuauauauga

SEQ ID NO: 2094728 - RNA, 13 nt, Homo sapiens
uccauccauguac

SEQ ID NO: 2094729 - RNA, 22 nt, Homo sapiens
cuuacauuuuucagacuucauc

SEQ ID NO: 2094730 - RNA, 17 nt, Homo sapiens
agacacaggcccggcuc

SEQ ID NO: 2094731 - RNA, 14 nt, Homo sapiens
ccacgaaagcacac

SEQ ID NO: 2094732 - RNA, 15 nt, Homo sapiens
ccagcucugcccaag

SEQ ID NO: 2094733 - RNA, 22 nt, Homo sapiens
uacuuacuucuggcauaacuaa

SEQ ID NO: 2094734 - RNA, 17 nt, Homo sapiens
aagaaggccaaaccucu

SEQ ID NO: 2094735 - RNA, 21 nt, Homo sapiens
uuagcugcacuguuuauggaa

SEQ ID NO: 2094736 - RNA, 14 nt, Homo sapiens
caauagaaauccaa

SEQ ID NO: 2094737 - RNA, 17 nt, Homo sapiens
cuacagccugccccuga

SEQ ID NO: 2094738 - RNA, 17 nt, Homo sapiens
aggcaaagaaagcucua

SEQ ID NO: 2094739 - RNA, 15 nt, Homo sapiens
ugcaauaaaauaaca

SEQ ID NO: 2094740 - RNA, 15 nt, Homo sapiens
uauauuaaagcauca

SEQ ID NO: 2094741 - RNA, 22 nt, Homo sapiens
gccaagacccaacaggugcuga

SEQ ID NO: 2094742 - RNA, 23 nt, Homo sapiens
uuuccaucagacugaacuuacac

SEQ ID NO: 2094743 - RNA, 15 nt, Homo sapiens
aggagacuuucaugc

SEQ ID NO: 2094744 - RNA, 12 nt, Homo sapiens
cucuauggugug

SEQ ID NO: 2094745 - RNA, 12 nt, Homo sapiens
cccuucugggca

SEQ ID NO: 2094746 - RNA, 18 nt, Homo sapiens
aagaguuugacuuagaau

SEQ ID NO: 2094747 - RNA, 15 nt, Homo sapiens
ucuuugguacaaguu

SEQ ID NO: 2094748 - RNA, 22 nt, Homo sapiens
gcuuucucccucacccaaguuu

SEQ ID NO: 2094749 - RNA, 14 nt, Homo sapiens
aacccaaaccauga

SEQ ID NO: 2094750 - RNA, 23 nt, Homo sapiens
ucuccaaccccccagcacugagg

SEQ ID NO: 2094751 - RNA, 15 nt, Homo sapiens
ugcuuuuaacucuag

SEQ ID NO: 2094752 - RNA, 14 nt, Homo sapiens
gggacuugagccag

SEQ ID NO: 2094753 - RNA, 10 nt, Homo sapiens
ucucucugcu

SEQ ID NO: 2094754 - RNA, 15 nt, Homo sapiens
cacugugccccacaa

SEQ ID NO: 2094755 - RNA, 20 nt, Homo sapiens
auuuccucuuccuagcuuaa

SEQ ID NO: 2094756 - RNA, 19 nt, Homo sapiens
accugugacaaaggaugaa

SEQ ID NO: 2094757 - RNA, 19 nt, Homo sapiens
ugaaagcagggacuugaac

SEQ ID NO: 2094758 - RNA, 15 nt, Homo sapiens
acauaguuauguaaa

SEQ ID NO: 2094759 - RNA, 18 nt, Homo sapiens
ugagcacagcugcauuaa

SEQ ID NO: 2094760 - RNA, 14 nt, Homo sapiens
aagacuaaacuggu

SEQ ID NO: 2094761 - RNA, 14 nt, Homo sapiens
acaaagaugugcaa

SEQ ID NO: 2094762 - RNA, 21 nt, Homo sapiens
cuggagcguguacuaccccag

SEQ ID NO: 2094763 - RNA, 22 nt, Homo sapiens
agauuaggucuugcuggaagac

SEQ ID NO: 2094764 - RNA, 14 nt, Homo sapiens
agccagggcugcca

SEQ ID NO: 2094765 - RNA, 20 nt, Homo sapiens
uagucagggcaugcuuuauu

SEQ ID NO: 2094766 - RNA, 20 nt, Homo sapiens
gcugugcuuuauuugugaaa

SEQ ID NO: 2094767 - RNA, 21 nt, Homo sapiens
acauucuuccugauuauuuuc

SEQ ID NO: 2094768 - RNA, 14 nt, Homo sapiens
cacaagaauugaau

SEQ ID NO: 2094769 - RNA, 15 nt, Homo sapiens
agaggacagugcuga

SEQ ID NO: 2094770 - RNA, 18 nt, Homo sapiens
uacucaucagagcagcua

SEQ ID NO: 2094771 - RNA, 22 nt, Homo sapiens
auucugccuccauucugaccau

SEQ ID NO: 2094772 - RNA, 11 nt, Homo sapiens
aaacauuuccc

SEQ ID NO: 2094773 - RNA, 21 nt, Homo sapiens
cauggcucacaaacaguuguu

SEQ ID NO: 2094774 - RNA, 19 nt, Homo sapiens
acuaaaacaaagccacuuu

SEQ ID NO: 2094775 - RNA, 13 nt, Homo sapiens
aauaauuauuuca

SEQ ID NO: 2094776 - RNA, 14 nt, Homo sapiens
agguagacaguaua

SEQ ID NO: 2094777 - RNA, 15 nt, Homo sapiens
ucaaaagauggcuua

SEQ ID NO: 2094778 - RNA, 20 nt, Homo sapiens
uggaggugggcaaagggaag

SEQ ID NO: 2094779 - RNA, 21 nt, Homo sapiens
aguccacaccacuguugccuu

SEQ ID NO: 2094780 - RNA, 22 nt, Homo sapiens
aauccugauuccucucuaagug

SEQ ID NO: 2094781 - RNA, 13 nt, Homo sapiens
aacaucgucuaaa

SEQ ID NO: 2094782 - RNA, 17 nt, Homo sapiens
caaauuuugccagagaa

SEQ ID NO: 2094783 - RNA, 15 nt, Homo sapiens
uccuauaugcacuua

SEQ ID NO: 2094784 - RNA, 19 nt, Homo sapiens
uguaacuuauguagauauu

SEQ ID NO: 2094785 - RNA, 18 nt, Homo sapiens
gcuaauucagugucacau

SEQ ID NO: 2094786 - RNA, 17 nt, Homo sapiens
ucgcccuuugcugcaug

SEQ ID NO: 2094787 - RNA, 20 nt, Homo sapiens
acguauggaaugcuucuuaa

SEQ ID NO: 2094788 - RNA, 17 nt, Homo sapiens
cacucaggccacagugg

SEQ ID NO: 2094789 - RNA, 23 nt, Homo sapiens
aucuuccccaacgaaaagcacau

SEQ ID NO: 2094790 - RNA, 18 nt, Homo sapiens
ugagcuuucuuugcacuu

SEQ ID NO: 2094791 - RNA, 12 nt, Homo sapiens
aggaaggauuuu

SEQ ID NO: 2094792 - RNA, 11 nt, Homo sapiens
cuuaaauaucc

SEQ ID NO: 2094793 - RNA, 22 nt, Homo sapiens
ugaagaacauguccuacaacag

SEQ ID NO: 2094794 - RNA, 12 nt, Homo sapiens
caaaauuugcaa

SEQ ID NO: 2094795 - RNA, 21 nt, Homo sapiens
gcuuugguucucugauuugua

SEQ ID NO: 2094796 - RNA, 13 nt, Homo sapiens
caagaaauuggaa

SEQ ID NO: 2094797 - RNA, 15 nt, Homo sapiens
cggaucuagccaugg

SEQ ID NO: 2094798 - RNA, 22 nt, Homo sapiens
ucguucaacuccacucacugaa

SEQ ID NO: 2094799 - RNA, 19 nt, Homo sapiens
uucagccuuugucaauaaa

SEQ ID NO: 2094800 - RNA, 15 nt, Homo sapiens
aucuuuagcuaauaa

SEQ ID NO: 2094801 - RNA, 14 nt, Homo sapiens
gaauacauuuccaa

SEQ ID NO: 2094802 - RNA, 20 nt, Homo sapiens
ugcauacagccuuugccauc

SEQ ID NO: 2094803 - RNA, 17 nt, Homo sapiens
ggccagcuucgugcugg

SEQ ID NO: 2094804 - RNA, 14 nt, Homo sapiens
ugccacaucugugu

SEQ ID NO: 2094805 - RNA, 20 nt, Homo sapiens
acugcauaccaaccugggca

SEQ ID NO: 2094806 - RNA, 14 nt, Homo sapiens
aaugaaggccauca

SEQ ID NO: 2094807 - RNA, 17 nt, Homo sapiens
ucaaaacagagauguga

SEQ ID NO: 2094808 - RNA, 16 nt, Homo sapiens
agauagcuugagcugg

SEQ ID NO: 2094809 - RNA, 19 nt, Homo sapiens
auccucuucccuuauucua

SEQ ID NO: 2094810 - RNA, 13 nt, Homo sapiens
ugccaaccuguaa

SEQ ID NO: 2094811 - RNA, 14 nt, Homo sapiens
gggauccugggaga

SEQ ID NO: 2094812 - RNA, 14 nt, Homo sapiens
ccuguccuccugga

SEQ ID NO: 2094813 - RNA, 19 nt, Homo sapiens
gauaauuuauuguaccaaa

SEQ ID NO: 2094814 - RNA, 13 nt, Homo sapiens
agcagaacccaga

SEQ ID NO: 2094815 - RNA, 15 nt, Homo sapiens
gcuccaugcucuucc

SEQ ID NO: 2094816 - RNA, 23 nt, Homo sapiens
cuuguguguguguguugauccca

SEQ ID NO: 2094817 - RNA, 18 nt, Homo sapiens
auagguuccagugaugaa

SEQ ID NO: 2094818 - RNA, 23 nt, Homo sapiens
aaaagcaucauuacaauacagua

SEQ ID NO: 2094819 - RNA, 20 nt, Homo sapiens
aucucaccuucagucaagaa

SEQ ID NO: 2094820 - RNA, 17 nt, Homo sapiens
cgaggcgaggcugccuc

SEQ ID NO: 2094821 - RNA, 13 nt, Homo sapiens
cuuaaagcuugau

SEQ ID NO: 2094822 - RNA, 16 nt, Homo sapiens
uuguaacuucaaauau

SEQ ID NO: 2094823 - RNA, 16 nt, Homo sapiens
uuuaauugauuauucu

SEQ ID NO: 2094824 - RNA, 22 nt, Homo sapiens
caaaacacugucugcauaucca

SEQ ID NO: 2094825 - RNA, 16 nt, Homo sapiens
cagcuguuacuuucuu

SEQ ID NO: 2094826 - RNA, 17 nt, Homo sapiens
ucugcaguccuccgggg

SEQ ID NO: 2094827 - RNA, 12 nt, Homo sapiens
ccauucuuugcu

SEQ ID NO: 2094828 - RNA, 22 nt, Homo sapiens
uaccaggccgccccagccucug

SEQ ID NO: 2094829 - RNA, 15 nt, Homo sapiens
cacagcaguacuugc

SEQ ID NO: 2094830 - RNA, 17 nt, Homo sapiens
cuaccugaggccuaucu

SEQ ID NO: 2094831 - RNA, 16 nt, Homo sapiens
gucuaaagagcuuuag

SEQ ID NO: 2094832 - RNA, 18 nt, Homo sapiens
aucuuccaaggguacuaa

SEQ ID NO: 2094833 - RNA, 17 nt, Homo sapiens
ucccaccccacuccagc

SEQ ID NO: 2094834 - RNA, 16 nt, Homo sapiens
uucauuuguggugaua

SEQ ID NO: 2094835 - RNA, 11 nt, Homo sapiens
gaccugcaaac

SEQ ID NO: 2094836 - RNA, 15 nt, Homo sapiens
uccagccugggcaac

SEQ ID NO: 2094837 - RNA, 13 nt, Homo sapiens
ucuuauacaacag

SEQ ID NO: 2094838 - RNA, 21 nt, Homo sapiens
gggugacagaacgagacucca

SEQ ID NO: 2094839 - RNA, 14 nt, Homo sapiens
uagggagaaaccaa

SEQ ID NO: 2094840 - RNA, 21 nt, Homo sapiens
caauaaauauuuuugcuguag

SEQ ID NO: 2094841 - RNA, 19 nt, Homo sapiens
agucugugaauaaagccac

SEQ ID NO: 2094842 - RNA, 19 nt, Homo sapiens
cagugguggucuucaagac

SEQ ID NO: 2094843 - RNA, 22 nt, Homo sapiens
ugucacgaauauggacauauca

SEQ ID NO: 2094844 - RNA, 14 nt, Homo sapiens
aagucaaccugccu

SEQ ID NO: 2094845 - RNA, 16 nt, Homo sapiens
aguauucaugacuaug

SEQ ID NO: 2094846 - RNA, 18 nt, Homo sapiens
ucaaaaaagauagaucua

SEQ ID NO: 2094847 - RNA, 22 nt, Homo sapiens
auguuguguuuuuaacauguca

SEQ ID NO: 2094848 - RNA, 12 nt, Homo sapiens
ugggacaaagau

SEQ ID NO: 2094849 - RNA, 24 nt, Homo sapiens
cauauauguauauauaugcacaua

SEQ ID NO: 2094850 - RNA, 22 nt, Homo sapiens
gagucucccacugcaacuugug

SEQ ID NO: 2094851 - RNA, 15 nt, Homo sapiens
uugucaacacaaaga

SEQ ID NO: 2094852 - RNA, 24 nt, Homo sapiens
gucccaaccugaucccacgaggga

SEQ ID NO: 2094853 - RNA, 15 nt, Homo sapiens
acggagucucagucu

SEQ ID NO: 2094854 - RNA, 13 nt, Homo sapiens
uuuguaaauuccc

SEQ ID NO: 2094855 - RNA, 17 nt, Homo sapiens
aagcggugccagccacg

SEQ ID NO: 2094856 - RNA, 16 nt, Homo sapiens
uauguacaauuguggg

SEQ ID NO: 2094857 - RNA, 16 nt, Homo sapiens
cugagagacaggacua

SEQ ID NO: 2094858 - RNA, 17 nt, Homo sapiens
caugagaucuaggugag

SEQ ID NO: 2094859 - RNA, 22 nt, Homo sapiens
cacaaaugguggguacaaaaag

SEQ ID NO: 2094860 - RNA, 17 nt, Homo sapiens
cagccaaaaaggacuuu

SEQ ID NO: 2094861 - RNA, 15 nt, Homo sapiens
gagcccaagcacaca

SEQ ID NO: 2094862 - RNA, 20 nt, Homo sapiens
agugcaauggcacgaucuca

SEQ ID NO: 2094863 - RNA, 16 nt, Homo sapiens
caguguuugcaauggu

SEQ ID NO: 2094864 - RNA, 20 nt, Homo sapiens
guuugaaaggaaacugcuau

SEQ ID NO: 2094865 - RNA, 20 nt, Homo sapiens
cuuaaauccaguggggaaaa

SEQ ID NO: 2094866 - RNA, 22 nt, Homo sapiens
cagagaugguguguucugcaau

SEQ ID NO: 2094867 - RNA, 22 nt, Homo sapiens
uauuacuagacugccacaagga

SEQ ID NO: 2094868 - RNA, 13 nt, Homo sapiens
caggacucccacc

SEQ ID NO: 2094869 - RNA, 17 nt, Homo sapiens
acuggcaauaaacuccu

SEQ ID NO: 2094870 - RNA, 23 nt, Homo sapiens
uccuucccacuguccuuucucca

SEQ ID NO: 2094871 - RNA, 22 nt, Homo sapiens
aaccuguuaugccaaacaguug

SEQ ID NO: 2094872 - RNA, 14 nt, Homo sapiens
ucagccagcaagag

SEQ ID NO: 2094873 - RNA, 23 nt, Homo sapiens
ccugaaucugcugagaggcacca

SEQ ID NO: 2094874 - RNA, 17 nt, Homo sapiens
ccugggucaugggccug

SEQ ID NO: 2094875 - RNA, 23 nt, Homo sapiens
gcaggacaggaggcggcccggcc

SEQ ID NO: 2094876 - RNA, 22 nt, Homo sapiens
cuaaguacccuugggguggugc

SEQ ID NO: 2094877 - RNA, 22 nt, Homo sapiens
caagcagugccugccuaugaaa

SEQ ID NO: 2094878 - RNA, 21 nt, Homo sapiens
uucuuuagaauuuuuacccaa

SEQ ID NO: 2094879 - RNA, 12 nt, Homo sapiens
cuucucagucuu

SEQ ID NO: 2094880 - RNA, 23 nt, Homo sapiens
augugcacuucaagaagucacug

SEQ ID NO: 2094881 - RNA, 15 nt, Homo sapiens
gacgaggcucaaaaa

SEQ ID NO: 2094882 - RNA, 10 nt, Homo sapiens
cgcuaugugc

SEQ ID NO: 2094883 - RNA, 15 nt, Homo sapiens
aagcauuuacuuuga

SEQ ID NO: 2094884 - RNA, 18 nt, Homo sapiens
gaaaaaaaauaauagaaa

SEQ ID NO: 2094885 - RNA, 18 nt, Homo sapiens
cccccaugugccugucac

SEQ ID NO: 2094886 - RNA, 20 nt, Homo sapiens
cauuuuugucagagugcaca

SEQ ID NO: 2094887 - RNA, 21 nt, Homo sapiens
gauguggccccacccuuuccu

SEQ ID NO: 2094888 - RNA, 20 nt, Homo sapiens
ugcuaucucgcuagccauau

SEQ ID NO: 2094889 - RNA, 15 nt, Homo sapiens
aagcaaaaaugcuaa

SEQ ID NO: 2094890 - RNA, 19 nt, Homo sapiens
ugaaaaugguccaggagaa

SEQ ID NO: 2094891 - RNA, 19 nt, Homo sapiens
uuuaauuuugacacuauau

SEQ ID NO: 2094892 - RNA, 14 nt, Homo sapiens
agugaaguugugca

SEQ ID NO: 2094893 - RNA, 17 nt, Homo sapiens
ggccaggaccacacagu

SEQ ID NO: 2094894 - RNA, 22 nt, Homo sapiens
gacacaauuggaauugucuuua

SEQ ID NO: 2094895 - RNA, 19 nt, Homo sapiens
uaaaugacuugcagaugaa

SEQ ID NO: 2094896 - RNA, 17 nt, Homo sapiens
uugauuuuccucucuca

SEQ ID NO: 2094897 - RNA, 14 nt, Homo sapiens
ucuuguauagcuga

SEQ ID NO: 2094898 - RNA, 17 nt, Homo sapiens
ggccagaugcacauccc

SEQ ID NO: 2094899 - RNA, 14 nt, Homo sapiens
gacagagcuugaag

SEQ ID NO: 2094900 - RNA, 20 nt, Homo sapiens
uuauagaaguagcaaaaagu

SEQ ID NO: 2094901 - RNA, 16 nt, Homo sapiens
gugagcuaugcaaaca

SEQ ID NO: 2094902 - RNA, 17 nt, Homo sapiens
aaacugccauugugauc

SEQ ID NO: 2094903 - RNA, 21 nt, Homo sapiens
cuaaaauucagguauuacuga

SEQ ID NO: 2094904 - RNA, 20 nt, Homo sapiens
cagaagaaagauugcuauaa

SEQ ID NO: 2094905 - RNA, 23 nt, Homo sapiens
cuuucauuggacccugacuguau

SEQ ID NO: 2094906 - RNA, 20 nt, Homo sapiens
gcaugaauuggaacugcaau

SEQ ID NO: 2094907 - RNA, 23 nt, Homo sapiens
gugauauacugguucacauccua

SEQ ID NO: 2094908 - RNA, 13 nt, Homo sapiens
guggcacgaucuc

SEQ ID NO: 2094909 - RNA, 13 nt, Homo sapiens
ucagugcagugaa

SEQ ID NO: 2094910 - RNA, 19 nt, Homo sapiens
agucuaagaaaaugaucuu

SEQ ID NO: 2094911 - RNA, 23 nt, Homo sapiens
ucacuguccuccacacaagggaa

SEQ ID NO: 2094912 - RNA, 12 nt, Homo sapiens
aauaacauaaca

SEQ ID NO: 2094913 - RNA, 12 nt, Homo sapiens
uuuuacauuucu

SEQ ID NO: 2094914 - RNA, 16 nt, Homo sapiens
gacaacagauuuacau

SEQ ID NO: 2094915 - RNA, 15 nt, Homo sapiens
gcuucccuacuccua

SEQ ID NO: 2094916 - RNA, 15 nt, Homo sapiens
cucaucacuaaacag

SEQ ID NO: 2094917 - RNA, 23 nt, Homo sapiens
caagugaccauaaaggcauggca

SEQ ID NO: 2094918 - RNA, 13 nt, Homo sapiens
ugcucauaaacuu

SEQ ID NO: 2094919 - RNA, 18 nt, Homo sapiens
ucaggggcgggugcauug

SEQ ID NO: 2094920 - RNA, 16 nt, Homo sapiens
agcugcacagcaaaag

SEQ ID NO: 2094921 - RNA, 20 nt, Homo sapiens
gaagcuugguccacuugcuu

SEQ ID NO: 2094922 - RNA, 14 nt, Homo sapiens
ucacuaguaugugu

SEQ ID NO: 2094923 - RNA, 15 nt, Homo sapiens
uugacagcaucauaa

SEQ ID NO: 2094924 - RNA, 17 nt, Homo sapiens
agauaaucgaagcaaaa

SEQ ID NO: 2094925 - RNA, 14 nt, Homo sapiens
cccagcccaagcac

SEQ ID NO: 2094926 - RNA, 23 nt, Homo sapiens
guauaacuggauugcagacuguu

SEQ ID NO: 2094927 - RNA, 20 nt, Homo sapiens
caauggaauacagucauucc

SEQ ID NO: 2094928 - RNA, 17 nt, Homo sapiens
cuugugugaggcucugu

SEQ ID NO: 2094929 - RNA, 15 nt, Homo sapiens
auauugauuccucac

SEQ ID NO: 2094930 - RNA, 17 nt, Homo sapiens
acucugucuuguucacu

SEQ ID NO: 2094931 - RNA, 18 nt, Homo sapiens
cuugcaguuaaggguuag

SEQ ID NO: 2094932 - RNA, 14 nt, Homo sapiens
ggcugagaugcgca

SEQ ID NO: 2094933 - RNA, 21 nt, Homo sapiens
cacuuauaagugagaacaugc

SEQ ID NO: 2094934 - RNA, 17 nt, Homo sapiens
aauucuuaacauagcca

SEQ ID NO: 2094935 - RNA, 20 nt, Homo sapiens
ugcaucucuuuagauccaaa

SEQ ID NO: 2094936 - RNA, 20 nt, Homo sapiens
cagugagcugagaucgugcc

SEQ ID NO: 2094937 - RNA, 19 nt, Homo sapiens
caaguuucauaccaaauau

SEQ ID NO: 2094938 - RNA, 22 nt, Homo sapiens
aacaagacuuuuuguacugaaa

SEQ ID NO: 2094939 - RNA, 21 nt, Homo sapiens
uuagaacaaaagaauaacauu

SEQ ID NO: 2094940 - RNA, 16 nt, Homo sapiens
gcaagucaaauaccac

SEQ ID NO: 2094941 - RNA, 15 nt, Homo sapiens
caaaccacaacugac

SEQ ID NO: 2094942 - RNA, 13 nt, Homo sapiens
accucagcugcuu

SEQ ID NO: 2094943 - RNA, 21 nt, Homo sapiens
gggcaggaggaggccaacuca

SEQ ID NO: 2094944 - RNA, 14 nt, Homo sapiens
uaaaccucaaguua

SEQ ID NO: 2094945 - RNA, 15 nt, Homo sapiens
aggauccaucuuugu

SEQ ID NO: 2094946 - RNA, 14 nt, Homo sapiens
ggaaacuacuucac

SEQ ID NO: 2094947 - RNA, 23 nt, Homo sapiens
gagaaaugcugcuagaaggaauu

SEQ ID NO: 2094948 - RNA, 14 nt, Homo sapiens
agcacuggguguga

SEQ ID NO: 2094949 - RNA, 18 nt, Homo sapiens
caagagauaagucuuuca

SEQ ID NO: 2094950 - RNA, 21 nt, Homo sapiens
cagaugccucagccuacuuuc

SEQ ID NO: 2094951 - RNA, 15 nt, Homo sapiens
gcucccaaacucagg

SEQ ID NO: 2094952 - RNA, 21 nt, Homo sapiens
uuagugguaaaugucacauug

SEQ ID NO: 2094953 - RNA, 23 nt, Homo sapiens
uugcucaggggaaccauggggcu

SEQ ID NO: 2094954 - RNA, 20 nt, Homo sapiens
ucucaaaccgccggccacac

SEQ ID NO: 2094955 - RNA, 14 nt, Homo sapiens
auucaagacaagag

SEQ ID NO: 2094956 - RNA, 20 nt, Homo sapiens
aucuauuugugggugugcua

SEQ ID NO: 2094957 - RNA, 22 nt, Homo sapiens
gauuuaucugcugaaagcucag

SEQ ID NO: 2094958 - RNA, 23 nt, Homo sapiens
ucaacaagaguaaauauugucac

SEQ ID NO: 2094959 - RNA, 18 nt, Homo sapiens
gagcuuucugaacagcug

SEQ ID NO: 2094960 - RNA, 16 nt, Homo sapiens
uggcagccauggccau

SEQ ID NO: 2094961 - RNA, 20 nt, Homo sapiens
aagcagccuuuuucaccaug

SEQ ID NO: 2094962 - RNA, 16 nt, Homo sapiens
agcaccaccaggucuc

SEQ ID NO: 2094963 - RNA, 13 nt, Homo sapiens
gggaaagccagug

SEQ ID NO: 2094964 - RNA, 16 nt, Homo sapiens
aguccagguccauuua

SEQ ID NO: 2094965 - RNA, 14 nt, Homo sapiens
gccccucugaccug

SEQ ID NO: 2094966 - RNA, 19 nt, Homo sapiens
gaagggaugcugcaaugua

SEQ ID NO: 2094967 - RNA, 21 nt, Homo sapiens
uaaacugauguauagcuuuaa

SEQ ID NO: 2094968 - RNA, 19 nt, Homo sapiens
uccagcccugggacagggc

SEQ ID NO: 2094969 - RNA, 15 nt, Homo sapiens
ccagccuccaaugua

SEQ ID NO: 2094970 - RNA, 18 nt, Homo sapiens
auuuaaaacaucauuacu

SEQ ID NO: 2094971 - RNA, 23 nt, Homo sapiens
accuccagcuguacuagugccau

SEQ ID NO: 2094972 - RNA, 19 nt, Homo sapiens
ugugccacacaccuugaca

SEQ ID NO: 2094973 - RNA, 12 nt, Homo sapiens
ucuacauuugaa

SEQ ID NO: 2094974 - RNA, 13 nt, Homo sapiens
uccaacccaugca

SEQ ID NO: 2094975 - RNA, 24 nt, Homo sapiens
ucaguaaauuguuuuuacugauga

SEQ ID NO: 2094976 - RNA, 23 nt, Homo sapiens
guuuccuauguuucacugugcaa

SEQ ID NO: 2094977 - RNA, 21 nt, Homo sapiens
aaggcauuucuuuucugcaug

SEQ ID NO: 2094978 - RNA, 14 nt, Homo sapiens
uucuagucauauau

SEQ ID NO: 2094979 - RNA, 18 nt, Homo sapiens
cuuugccaauccccgugc

SEQ ID NO: 2094980 - RNA, 18 nt, Homo sapiens
guuuaagaaaaguauuuu

SEQ ID NO: 2094981 - RNA, 16 nt, Homo sapiens
aaucaucauaucuacu

SEQ ID NO: 2094982 - RNA, 22 nt, Homo sapiens
gacaauaaaauggaaagguccu

SEQ ID NO: 2094983 - RNA, 15 nt, Homo sapiens
ggcagaaagcaaaug

SEQ ID NO: 2094984 - RNA, 23 nt, Homo sapiens
gcuuaagguggaaaguguucauu

SEQ ID NO: 2094985 - RNA, 14 nt, Homo sapiens
ucuggaugguggug

SEQ ID NO: 2094986 - RNA, 22 nt, Homo sapiens
gaucugcuuucuguucaucucu

SEQ ID NO: 2094987 - RNA, 22 nt, Homo sapiens
uggaaacauggaggaacaguau

SEQ ID NO: 2094988 - RNA, 21 nt, Homo sapiens
uagugugcaucauguuccuua

SEQ ID NO: 2094989 - RNA, 22 nt, Homo sapiens
acuugaguuguugcuuauacug

SEQ ID NO: 2094990 - RNA, 23 nt, Homo sapiens
uguuuccccccuuuucagaauag

SEQ ID NO: 2094991 - RNA, 18 nt, Homo sapiens
ucuccuaaugcuuuaucc

SEQ ID NO: 2094992 - RNA, 18 nt, Homo sapiens
auaagagugccguaacaa

SEQ ID NO: 2094993 - RNA, 14 nt, Homo sapiens
aggccacagugggg

SEQ ID NO: 2094994 - RNA, 22 nt, Homo sapiens
cacuccauaaaaagaaagcuaa

SEQ ID NO: 2094995 - RNA, 18 nt, Homo sapiens
uaauuuuuuuaaccaaag

SEQ ID NO: 2094996 - RNA, 13 nt, Homo sapiens
ugguuuaugucau

SEQ ID NO: 2094997 - RNA, 21 nt, Homo sapiens
gcauuugaagaggagaacaaa

SEQ ID NO: 2094998 - RNA, 22 nt, Homo sapiens
auccuguaacuacaaugauggu

SEQ ID NO: 2094999 - RNA, 20 nt, Homo sapiens
caacccugagcacucuuauc

SEQ ID NO: 2095000 - RNA, 21 nt, Homo sapiens
caauccguucccuucugccac

SEQ ID NO: 2095001 - RNA, 23 nt, Homo sapiens
gugauucuaaggcaggaauuuga

SEQ ID NO: 2095002 - RNA, 22 nt, Homo sapiens
agcaguggcuggugcccaugaa

SEQ ID NO: 2095003 - RNA, 16 nt, Homo sapiens
ccccucccucgugggc

SEQ ID NO: 2095004 - RNA, 18 nt, Homo sapiens
ccugcuuuacuuugccca

SEQ ID NO: 2095005 - RNA, 22 nt, Homo sapiens
gcagagcccggccccaccuccc

SEQ ID NO: 2095006 - RNA, 18 nt, Homo sapiens
caaaauuacacaguuaau

SEQ ID NO: 2095007 - RNA, 14 nt, Homo sapiens
uaguucaauagucu

SEQ ID NO: 2095008 - RNA, 14 nt, Homo sapiens
agcaucaaagcacu

SEQ ID NO: 2095009 - RNA, 12 nt, Homo sapiens
aaauaugcagug

SEQ ID NO: 2095010 - RNA, 11 nt, Homo sapiens
augcucuccaa

SEQ ID NO: 2095011 - RNA, 20 nt, Homo sapiens
gagucuguacuaaacaguaa

SEQ ID NO: 2095012 - RNA, 13 nt, Homo sapiens
uuccugauacauu

SEQ ID NO: 2095013 - RNA, 23 nt, Homo sapiens
uuacuaaguggacuggugucaua

SEQ ID NO: 2095014 - RNA, 16 nt, Homo sapiens
acucuacgccaaagug

SEQ ID NO: 2095015 - RNA, 20 nt, Homo sapiens
aauaugacggaagaacauag

SEQ ID NO: 2095016 - RNA, 19 nt, Homo sapiens
aaaggaaagauuugccaau

SEQ ID NO: 2095017 - RNA, 16 nt, Homo sapiens
uugaacugauucacau

SEQ ID NO: 2095018 - RNA, 16 nt, Homo sapiens
gaaacgacucaaaaug

SEQ ID NO: 2095019 - RNA, 15 nt, Homo sapiens
auucaguaaggcagu

SEQ ID NO: 2095020 - RNA, 19 nt, Homo sapiens
agcuacuguaguugucaca

SEQ ID NO: 2095021 - RNA, 17 nt, Homo sapiens
aacaaacaauaccugaa

SEQ ID NO: 2095022 - RNA, 14 nt, Homo sapiens
ggcuggccucccaa

SEQ ID NO: 2095023 - RNA, 18 nt, Homo sapiens
agcuccuaguaugcccug

SEQ ID NO: 2095024 - RNA, 19 nt, Homo sapiens
uugcaccuaucucagccau

SEQ ID NO: 2095025 - RNA, 16 nt, Homo sapiens
agccccgccugucaca

SEQ ID NO: 2095026 - RNA, 21 nt, Homo sapiens
ccagccugggacucccaguga

SEQ ID NO: 2095027 - RNA, 21 nt, Homo sapiens
guaaccaguagucaccucugg

SEQ ID NO: 2095028 - RNA, 20 nt, Homo sapiens
ccauccaucuuuccauccau

SEQ ID NO: 2095029 - RNA, 20 nt, Homo sapiens
cauucauccuuccauccauc

SEQ ID NO: 2095030 - RNA, 15 nt, Homo sapiens
ugcaagggucucaca

SEQ ID NO: 2095031 - RNA, 18 nt, Homo sapiens
ccuacagagggauuuauu

SEQ ID NO: 2095032 - RNA, 18 nt, Homo sapiens
gagauaaugucaaaauca

SEQ ID NO: 2095033 - RNA, 12 nt, Homo sapiens
cgugcuguaaau

SEQ ID NO: 2095034 - RNA, 16 nt, Homo sapiens
ugucuguucauggaga

SEQ ID NO: 2095035 - RNA, 20 nt, Homo sapiens
ugcccaggcuggaguacaau

SEQ ID NO: 2095036 - RNA, 14 nt, Homo sapiens
guuuucacuuguau

SEQ ID NO: 2095037 - RNA, 21 nt, Homo sapiens
uccaggaauuuugugugauug

SEQ ID NO: 2095038 - RNA, 12 nt, Homo sapiens
uucaacauuuca

SEQ ID NO: 2095039 - RNA, 12 nt, Homo sapiens
acauacauacau

SEQ ID NO: 2095040 - RNA, 12 nt, Homo sapiens
gggggaagggag

SEQ ID NO: 2095041 - RNA, 17 nt, Homo sapiens
ugcaagaccuagugcuc

SEQ ID NO: 2095042 - RNA, 19 nt, Homo sapiens
ccuuguugacacggccaug

SEQ ID NO: 2095043 - RNA, 16 nt, Homo sapiens
cccaugcaggcccuuu

SEQ ID NO: 2095044 - RNA, 19 nt, Homo sapiens
cuagacuucccaacagccu

SEQ ID NO: 2095045 - RNA, 17 nt, Homo sapiens
augacagagaugugcau

SEQ ID NO: 2095046 - RNA, 12 nt, Homo sapiens
caaugcugaggu

SEQ ID NO: 2095047 - RNA, 19 nt, Homo sapiens
ucucugaagcauguuucau

SEQ ID NO: 2095048 - RNA, 14 nt, Homo sapiens
ugguauacuauaga

SEQ ID NO: 2095049 - RNA, 20 nt, Homo sapiens
caccaaggaacucuacuuca

SEQ ID NO: 2095050 - RNA, 20 nt, Homo sapiens
ucuaaauuuugugauucuau

SEQ ID NO: 2095051 - RNA, 18 nt, Homo sapiens
ggucaugugggucuucca

SEQ ID NO: 2095052 - RNA, 19 nt, Homo sapiens
gcucugagcaguuguuaua

SEQ ID NO: 2095053 - RNA, 18 nt, Homo sapiens
uccgugccaggcauucaa

SEQ ID NO: 2095054 - RNA, 14 nt, Homo sapiens
cucagcagauuuca

SEQ ID NO: 2095055 - RNA, 16 nt, Homo sapiens
cuuucauaaaaaccaa

SEQ ID NO: 2095056 - RNA, 13 nt, Homo sapiens
cgugcaugugcac

SEQ ID NO: 2095057 - RNA, 14 nt, Homo sapiens
gucuucuguauuca

SEQ ID NO: 2095058 - RNA, 18 nt, Homo sapiens
cuacagcugucuucacau

SEQ ID NO: 2095059 - RNA, 13 nt, Homo sapiens
aguccacaggcuc

SEQ ID NO: 2095060 - RNA, 18 nt, Homo sapiens
uaaaauaaucauacaguu

SEQ ID NO: 2095061 - RNA, 20 nt, Homo sapiens
gagagggucacugggggaca

SEQ ID NO: 2095062 - RNA, 14 nt, Homo sapiens
cagugagcccagau

SEQ ID NO: 2095063 - RNA, 20 nt, Homo sapiens
cagcaaauuaauguguaaaa

SEQ ID NO: 2095064 - RNA, 23 nt, Homo sapiens
guaacccucccuguucaucccau

SEQ ID NO: 2095065 - RNA, 23 nt, Homo sapiens
aagaaugucucggucacaucagg

SEQ ID NO: 2095066 - RNA, 15 nt, Homo sapiens
agcacacgaaaagac

SEQ ID NO: 2095067 - RNA, 15 nt, Homo sapiens
uacuguggugaucug

SEQ ID NO: 2095068 - RNA, 23 nt, Homo sapiens
ugccuaucugacuucauacaucc

SEQ ID NO: 2095069 - RNA, 19 nt, Homo sapiens
gagacaggaugcuccagau

SEQ ID NO: 2095070 - RNA, 21 nt, Homo sapiens
ggcuucuugcuuacaggaaug

SEQ ID NO: 2095071 - RNA, 22 nt, Homo sapiens
gacaaguuuaaaggcuguguca

SEQ ID NO: 2095072 - RNA, 21 nt, Homo sapiens
aucggggggugggagggaugg

SEQ ID NO: 2095073 - RNA, 17 nt, Homo sapiens
ccuucuggcaagccugu

SEQ ID NO: 2095074 - RNA, 19 nt, Homo sapiens
acauugagaucacuacuca

SEQ ID NO: 2095075 - RNA, 20 nt, Homo sapiens
cucuuuuuaucgccauucca

SEQ ID NO: 2095076 - RNA, 15 nt, Homo sapiens
gaauuagguaaugga

SEQ ID NO: 2095077 - RNA, 14 nt, Homo sapiens
acauaaagccaugu

SEQ ID NO: 2095078 - RNA, 15 nt, Homo sapiens
uucaauguacuguau

SEQ ID NO: 2095079 - RNA, 15 nt, Homo sapiens
agcagugucuuccau

SEQ ID NO: 2095080 - RNA, 15 nt, Homo sapiens
aauggaaaacauuua

SEQ ID NO: 2095081 - RNA, 19 nt, Homo sapiens
acccucccccgccacuccu

SEQ ID NO: 2095082 - RNA, 14 nt, Homo sapiens
accacuguacauau

SEQ ID NO: 2095083 - RNA, 20 nt, Homo sapiens
uuugauuuuuugcccagaga

SEQ ID NO: 2095084 - RNA, 17 nt, Homo sapiens
uacuccaagaauggagg

SEQ ID NO: 2095085 - RNA, 13 nt, Homo sapiens
accuugcaucuca

SEQ ID NO: 2095086 - RNA, 13 nt, Homo sapiens
gccuuuacuauau

SEQ ID NO: 2095087 - RNA, 19 nt, Homo sapiens
guugacuuauaguacauga

SEQ ID NO: 2095088 - RNA, 16 nt, Homo sapiens
cugggaggcccuggca

SEQ ID NO: 2095089 - RNA, 14 nt, Homo sapiens
acuugaaaugcucu

SEQ ID NO: 2095090 - RNA, 21 nt, Homo sapiens
cugugguggccuggugcacag

SEQ ID NO: 2095091 - RNA, 13 nt, Homo sapiens
cuguucaaaaagg

SEQ ID NO: 2095092 - RNA, 20 nt, Homo sapiens
ggcccggccaaaauaaugca

SEQ ID NO: 2095093 - RNA, 17 nt, Homo sapiens
cuuucaggcuaccuuuu

SEQ ID NO: 2095094 - RNA, 20 nt, Homo sapiens
aacccugugaucuauaccac

SEQ ID NO: 2095095 - RNA, 22 nt, Homo sapiens
ggggaccugggcucauucuucu

SEQ ID NO: 2095096 - RNA, 15 nt, Homo sapiens
augcucauacuugga

SEQ ID NO: 2095097 - RNA, 19 nt, Homo sapiens
agccuuuuauuaacauaua

SEQ ID NO: 2095098 - RNA, 23 nt, Homo sapiens
cauguaguagccuuuccugauga

SEQ ID NO: 2095099 - RNA, 19 nt, Homo sapiens
uuccugaaauaaugcaagc

SEQ ID NO: 2095100 - RNA, 19 nt, Homo sapiens
ugguuuugcaugucugcau

SEQ ID NO: 2095101 - RNA, 16 nt, Homo sapiens
gucuuacuguugcaua

SEQ ID NO: 2095102 - RNA, 22 nt, Homo sapiens
auugagaagaucggaacagcuc

SEQ ID NO: 2095103 - RNA, 14 nt, Homo sapiens
ucuuaaagcaaaua

SEQ ID NO: 2095104 - RNA, 22 nt, Homo sapiens
auucagacuguuuuucagggag

SEQ ID NO: 2095105 - RNA, 20 nt, Homo sapiens
gcaaauuaauuggcagcaga

SEQ ID NO: 2095106 - RNA, 16 nt, Homo sapiens
uauuaauucagguuuu

SEQ ID NO: 2095107 - RNA, 13 nt, Homo sapiens
gagaagccaaaag

SEQ ID NO: 2095108 - RNA, 21 nt, Homo sapiens
agcugauguccaguugccacu

SEQ ID NO: 2095109 - RNA, 23 nt, Homo sapiens
caaagacuguacuggccaguguc

SEQ ID NO: 2095110 - RNA, 16 nt, Homo sapiens
gacacaguauugacuu

SEQ ID NO: 2095111 - RNA, 15 nt, Homo sapiens
cuaaugaauugaaau

SEQ ID NO: 2095112 - RNA, 13 nt, Homo sapiens
caguggauucuca

SEQ ID NO: 2095113 - RNA, 17 nt, Homo sapiens
uccugagcacccagaac

SEQ ID NO: 2095114 - RNA, 17 nt, Homo sapiens
guuuagugcaucuuugc

SEQ ID NO: 2095115 - RNA, 21 nt, Homo sapiens
gucucuacuaaaaaugcaaaa

SEQ ID NO: 2095116 - RNA, 21 nt, Homo sapiens
gcacccugcgccuccagaggu

SEQ ID NO: 2095117 - RNA, 21 nt, Homo sapiens
ugucccagaaugccuccugca

SEQ ID NO: 2095118 - RNA, 16 nt, Homo sapiens
augagauaauacucuu

SEQ ID NO: 2095119 - RNA, 20 nt, Homo sapiens
uauaaauucauaacugguag

SEQ ID NO: 2095120 - RNA, 17 nt, Homo sapiens
uuuaaagaaagaaugca

SEQ ID NO: 2095121 - RNA, 15 nt, Homo sapiens
cugguaacauagguu

SEQ ID NO: 2095122 - RNA, 15 nt, Homo sapiens
agacagcuuacugca

SEQ ID NO: 2095123 - RNA, 20 nt, Homo sapiens
ucuaaccgaauauucaugga

SEQ ID NO: 2095124 - RNA, 21 nt, Homo sapiens
aagaggccaguacuuugccau

SEQ ID NO: 2095125 - RNA, 18 nt, Homo sapiens
guuuuauuucaaagggaa

SEQ ID NO: 2095126 - RNA, 21 nt, Homo sapiens
agauagaacacaaaacuugaa

SEQ ID NO: 2095127 - RNA, 23 nt, Homo sapiens
acagcugcuuucuguugucauug

SEQ ID NO: 2095128 - RNA, 13 nt, Homo sapiens
ccucagauuccac

SEQ ID NO: 2095129 - RNA, 22 nt, Homo sapiens
aaagaggcugccccucucacca

SEQ ID NO: 2095130 - RNA, 18 nt, Homo sapiens
cuuaccugggaccucaca

SEQ ID NO: 2095131 - RNA, 14 nt, Homo sapiens
aagaggacuugaac

SEQ ID NO: 2095132 - RNA, 21 nt, Homo sapiens
acucuuuggguccauucagau

SEQ ID NO: 2095133 - RNA, 15 nt, Homo sapiens
gggagagacacagau

SEQ ID NO: 2095134 - RNA, 13 nt, Homo sapiens
aaugaucacucca

SEQ ID NO: 2095135 - RNA, 14 nt, Homo sapiens
aaagaaaauuagua

SEQ ID NO: 2095136 - RNA, 15 nt, Homo sapiens
acaacuccuauucac

SEQ ID NO: 2095137 - RNA, 17 nt, Homo sapiens
cagaccaugaaguaaau

SEQ ID NO: 2095138 - RNA, 15 nt, Homo sapiens
cauuaagcucacaau

SEQ ID NO: 2095139 - RNA, 13 nt, Homo sapiens
ugccugguuuuau

SEQ ID NO: 2095140 - RNA, 11 nt, Homo sapiens
uguaacuauug

SEQ ID NO: 2095141 - RNA, 14 nt, Homo sapiens
cguaauuuugccaa

SEQ ID NO: 2095142 - RNA, 20 nt, Homo sapiens
auaguuugggggaacuugua

SEQ ID NO: 2095143 - RNA, 19 nt, Homo sapiens
ugaauccaagacagccaca

SEQ ID NO: 2095144 - RNA, 22 nt, Homo sapiens
auguagcggugaagaguacaga

SEQ ID NO: 2095145 - RNA, 15 nt, Homo sapiens
ccuuaaaaagcacac

SEQ ID NO: 2095146 - RNA, 21 nt, Homo sapiens
cugcauaccaaccugggcaau

SEQ ID NO: 2095147 - RNA, 20 nt, Homo sapiens
ugacacacaguuguugaaug

SEQ ID NO: 2095148 - RNA, 17 nt, Homo sapiens
gacagagaccuccugcc

SEQ ID NO: 2095149 - RNA, 12 nt, Homo sapiens
aaugguagcucu

SEQ ID NO: 2095150 - RNA, 20 nt, Homo sapiens
ugacuccugggcaucugugc

SEQ ID NO: 2095151 - RNA, 20 nt, Homo sapiens
acugccaacugaucuguuau

SEQ ID NO: 2095152 - RNA, 15 nt, Homo sapiens
ucuaaacaggauucu

SEQ ID NO: 2095153 - RNA, 13 nt, Homo sapiens
gaugaucacugau

SEQ ID NO: 2095154 - RNA, 13 nt, Homo sapiens
cugcuguuuccag

SEQ ID NO: 2095155 - RNA, 18 nt, Homo sapiens
gcagauggccacugcucu

SEQ ID NO: 2095156 - RNA, 22 nt, Homo sapiens
uccaagugggucaauuccuuag

SEQ ID NO: 2095157 - RNA, 13 nt, Homo sapiens
auacauaugcaga

SEQ ID NO: 2095158 - RNA, 17 nt, Homo sapiens
acaacucauuccagauc

SEQ ID NO: 2095159 - RNA, 19 nt, Homo sapiens
uguuaugagaaauuaguca

SEQ ID NO: 2095160 - RNA, 22 nt, Homo sapiens
uguuucccaagcuagacugugu

SEQ ID NO: 2095161 - RNA, 19 nt, Homo sapiens
cugauacuuugacaguguu

SEQ ID NO: 2095162 - RNA, 21 nt, Homo sapiens
uucguuuuuuuaaaucacaag

SEQ ID NO: 2095163 - RNA, 13 nt, Homo sapiens
cuagugggcaggu

SEQ ID NO: 2095164 - RNA, 17 nt, Homo sapiens
uguacgaaucaucauaa

SEQ ID NO: 2095165 - RNA, 21 nt, Homo sapiens
ugacccagaggaagccucuau

SEQ ID NO: 2095166 - RNA, 22 nt, Homo sapiens
auaaagcugggaggccaaacac

SEQ ID NO: 2095167 - RNA, 18 nt, Homo sapiens
cugaauuucccucucuca

SEQ ID NO: 2095168 - RNA, 22 nt, Homo sapiens
gugaccucagugagauauuugg

SEQ ID NO: 2095169 - RNA, 23 nt, Homo sapiens
aaagguuucauguucacugugag

SEQ ID NO: 2095170 - RNA, 13 nt, Homo sapiens
agugugggccagg

SEQ ID NO: 2095171 - RNA, 14 nt, Homo sapiens
ccagggugugaaca

SEQ ID NO: 2095172 - RNA, 20 nt, Homo sapiens
uucagaaccaagaugccaac

SEQ ID NO: 2095173 - RNA, 21 nt, Homo sapiens
gcugcccaaucauuugcaaug

SEQ ID NO: 2095174 - RNA, 13 nt, Homo sapiens
cuccuuaugaugc

SEQ ID NO: 2095175 - RNA, 18 nt, Homo sapiens
guucucggggcucaggag

SEQ ID NO: 2095176 - RNA, 20 nt, Homo sapiens
augagccuguuuauugccau

SEQ ID NO: 2095177 - RNA, 17 nt, Homo sapiens
acuagccagacacucug

SEQ ID NO: 2095178 - RNA, 14 nt, Homo sapiens
guaaggaaauggaa

SEQ ID NO: 2095179 - RNA, 14 nt, Homo sapiens
ugaaaugaacuuug

SEQ ID NO: 2095180 - RNA, 15 nt, Homo sapiens
gacacggccaugacc

SEQ ID NO: 2095181 - RNA, 13 nt, Homo sapiens
auggagacuugag

SEQ ID NO: 2095182 - RNA, 18 nt, Homo sapiens
ggaaggagcacauacuac

SEQ ID NO: 2095183 - RNA, 20 nt, Homo sapiens
guuuaaaauaaaaguaccua

SEQ ID NO: 2095184 - RNA, 17 nt, Homo sapiens
ccacuauccucacuccc

SEQ ID NO: 2095185 - RNA, 20 nt, Homo sapiens
uacaggcacccaccacaucu

SEQ ID NO: 2095186 - RNA, 23 nt, Homo sapiens
cucagagcacagccaaucuccag

SEQ ID NO: 2095187 - RNA, 15 nt, Homo sapiens
ugacacuuccauugu

SEQ ID NO: 2095188 - RNA, 15 nt, Homo sapiens
cucccuucucggggu

SEQ ID NO: 2095189 - RNA, 17 nt, Homo sapiens
ucauaaaucuucuuauu

SEQ ID NO: 2095190 - RNA, 22 nt, Homo sapiens
cgggucucaacuuuaagauaga

SEQ ID NO: 2095191 - RNA, 15 nt, Homo sapiens
aauauuucaagcucu

SEQ ID NO: 2095192 - RNA, 19 nt, Homo sapiens
accaacuuuuucauucccu

SEQ ID NO: 2095193 - RNA, 21 nt, Homo sapiens
cacgcuggacagcacucugcc

SEQ ID NO: 2095194 - RNA, 22 nt, Homo sapiens
ggacagcguguggcaguguuua

SEQ ID NO: 2095195 - RNA, 12 nt, Homo sapiens
ugaaauacucuu

SEQ ID NO: 2095196 - RNA, 22 nt, Homo sapiens
auaaaucucuucuuugcugcag

SEQ ID NO: 2095197 - RNA, 17 nt, Homo sapiens
aucagaugcuccaagau

SEQ ID NO: 2095198 - RNA, 14 nt, Homo sapiens
gggagccucuggaa

SEQ ID NO: 2095199 - RNA, 23 nt, Homo sapiens
gaaaugauugguaggaaauagaa

SEQ ID NO: 2095200 - RNA, 19 nt, Homo sapiens
uggaggacacacagucuca

SEQ ID NO: 2095201 - RNA, 18 nt, Homo sapiens
gaaacagggcaccccagc

SEQ ID NO: 2095202 - RNA, 17 nt, Homo sapiens
uagaauaggcuguguau

SEQ ID NO: 2095203 - RNA, 14 nt, Homo sapiens
cauaaaaacagugc

SEQ ID NO: 2095204 - RNA, 19 nt, Homo sapiens
acuccuuugcauuccauga

SEQ ID NO: 2095205 - RNA, 23 nt, Homo sapiens
gcaacagagcaagacccaucuca

SEQ ID NO: 2095206 - RNA, 19 nt, Homo sapiens
uaaaagaugguaaaccaga

SEQ ID NO: 2095207 - RNA, 23 nt, Homo sapiens
ucucccaacaugggagggaucag

SEQ ID NO: 2095208 - RNA, 19 nt, Homo sapiens
guuuuauuuucaaaucugg

SEQ ID NO: 2095209 - RNA, 17 nt, Homo sapiens
ucccaguuacucaggag

SEQ ID NO: 2095210 - RNA, 16 nt, Homo sapiens
cuaccucaccugggca

SEQ ID NO: 2095211 - RNA, 21 nt, Homo sapiens
gacccuacuucuuuugcucuu

SEQ ID NO: 2095212 - RNA, 14 nt, Homo sapiens
gccacagugcaauu

SEQ ID NO: 2095213 - RNA, 18 nt, Homo sapiens
uauauguguuuuucacau

SEQ ID NO: 2095214 - RNA, 22 nt, Homo sapiens
ccacaguuuuaguuggugcuga

SEQ ID NO: 2095215 - RNA, 19 nt, Homo sapiens
aaggggaaacacagcugau

SEQ ID NO: 2095216 - RNA, 18 nt, Homo sapiens
guuugagguccacacuga

SEQ ID NO: 2095217 - RNA, 18 nt, Homo sapiens
accaagggcccucacuca

SEQ ID NO: 2095218 - RNA, 12 nt, Homo sapiens
uucuuaagcaag

SEQ ID NO: 2095219 - RNA, 21 nt, Homo sapiens
uuaauuggcccuguacaguuu

SEQ ID NO: 2095220 - RNA, 13 nt, Homo sapiens
cuguagugccaug

SEQ ID NO: 2095221 - RNA, 22 nt, Homo sapiens
uucaguauuaaauuagauaucu

SEQ ID NO: 2095222 - RNA, 18 nt, Homo sapiens
acuccugacuccuaccug

SEQ ID NO: 2095223 - RNA, 17 nt, Homo sapiens
gguccugcccuuccuga

SEQ ID NO: 2095224 - RNA, 16 nt, Homo sapiens
uguuuuaugcccuucu

SEQ ID NO: 2095225 - RNA, 22 nt, Homo sapiens
aggccagacuugguccuaagca

SEQ ID NO: 2095226 - RNA, 14 nt, Homo sapiens
gucuugucauucca

SEQ ID NO: 2095227 - RNA, 17 nt, Homo sapiens
aacuggaagaaagcaac

SEQ ID NO: 2095228 - RNA, 22 nt, Homo sapiens
aucagaggccuauaaugaagcu

SEQ ID NO: 2095229 - RNA, 21 nt, Homo sapiens
aauguauuugugcacauguac

SEQ ID NO: 2095230 - RNA, 21 nt, Homo sapiens
ugggcuccccaggaagcccac

SEQ ID NO: 2095231 - RNA, 14 nt, Homo sapiens
aauguaaauacuca

SEQ ID NO: 2095232 - RNA, 14 nt, Homo sapiens
guggcuguuucauc

SEQ ID NO: 2095233 - RNA, 21 nt, Homo sapiens
uggucucaucuccuuugcuag

SEQ ID NO: 2095234 - RNA, 15 nt, Homo sapiens
acagggcucacaggg

SEQ ID NO: 2095235 - RNA, 17 nt, Homo sapiens
gaacucuacaucuagca

SEQ ID NO: 2095236 - RNA, 16 nt, Homo sapiens
uggagaaucacaggcu

SEQ ID NO: 2095237 - RNA, 19 nt, Homo sapiens
cauuccuguucccaugaga

SEQ ID NO: 2095238 - RNA, 12 nt, Homo sapiens
ggacaguggcac

SEQ ID NO: 2095239 - RNA, 12 nt, Homo sapiens
agaaagugacaa

SEQ ID NO: 2095240 - RNA, 21 nt, Homo sapiens
aaguuaauaaaaaucucccaa

SEQ ID NO: 2095241 - RNA, 14 nt, Homo sapiens
cuaugucuuucacc

SEQ ID NO: 2095242 - RNA, 12 nt, Homo sapiens
uaaaaacuugua

SEQ ID NO: 2095243 - RNA, 23 nt, Homo sapiens
uuaaaaggaaagcagauggugga

SEQ ID NO: 2095244 - RNA, 14 nt, Homo sapiens
acaauggaaacuga

SEQ ID NO: 2095245 - RNA, 13 nt, Homo sapiens
uuucuaagagaag

SEQ ID NO: 2095246 - RNA, 20 nt, Homo sapiens
accauuaaccagaucuaguc

SEQ ID NO: 2095247 - RNA, 20 nt, Homo sapiens
uagccauuuuguaacugccu

SEQ ID NO: 2095248 - RNA, 17 nt, Homo sapiens
acucgaguccccaugau

SEQ ID NO: 2095249 - RNA, 14 nt, Homo sapiens
agcaccauuaacuc

SEQ ID NO: 2095250 - RNA, 17 nt, Homo sapiens
cccucucguguuugauu

SEQ ID NO: 2095251 - RNA, 13 nt, Homo sapiens
ugggcuggcacag

SEQ ID NO: 2095252 - RNA, 14 nt, Homo sapiens
uaauuuuuacaugg

SEQ ID NO: 2095253 - RNA, 19 nt, Homo sapiens
uaacauucaguacuuuaug

SEQ ID NO: 2095254 - RNA, 20 nt, Homo sapiens
guugauuucuucuucauucc

SEQ ID NO: 2095255 - RNA, 17 nt, Homo sapiens
ugcucagcaugauucuu

SEQ ID NO: 2095256 - RNA, 19 nt, Homo sapiens
agaaauguacuacuaaaga

SEQ ID NO: 2095257 - RNA, 16 nt, Homo sapiens
ucuuauugacucauac

SEQ ID NO: 2095258 - RNA, 20 nt, Homo sapiens
uaagcaccaggacgcccucg

SEQ ID NO: 2095259 - RNA, 19 nt, Homo sapiens
acuuauugucuaggccaga

SEQ ID NO: 2095260 - RNA, 13 nt, Homo sapiens
aaguugugcaacg

SEQ ID NO: 2095261 - RNA, 17 nt, Homo sapiens
uuagagucuucuccaau

SEQ ID NO: 2095262 - RNA, 17 nt, Homo sapiens
gaacagcauaugcaaag

SEQ ID NO: 2095263 - RNA, 9 nt, Homo sapiens
aguaguccu

SEQ ID NO: 2095264 - RNA, 16 nt, Homo sapiens
aguauccaggcuuugu

SEQ ID NO: 2095265 - RNA, 20 nt, Homo sapiens
agccugggccuccuccuagc

SEQ ID NO: 2095266 - RNA, 17 nt, Homo sapiens
cauuauuugaaaacacu

SEQ ID NO: 2095267 - RNA, 16 nt, Homo sapiens
auugaaggaugcuguc

SEQ ID NO: 2095268 - RNA, 13 nt, Homo sapiens
aucugaacuccuu

SEQ ID NO: 2095269 - RNA, 14 nt, Homo sapiens
uucaaagucucaau

SEQ ID NO: 2095270 - RNA, 22 nt, Homo sapiens
acaaaaaugaaagcaugucuca

SEQ ID NO: 2095271 - RNA, 13 nt, Homo sapiens
aaauggcugagau

SEQ ID NO: 2095272 - RNA, 13 nt, Homo sapiens
cacucuagaauaa

SEQ ID NO: 2095273 - RNA, 23 nt, Homo sapiens
aguauuguaaagagauuguucua

SEQ ID NO: 2095274 - RNA, 22 nt, Homo sapiens
gcagcagaggcaggaccagaag

SEQ ID NO: 2095275 - RNA, 15 nt, Homo sapiens
caguuguccaugaca

SEQ ID NO: 2095276 - RNA, 14 nt, Homo sapiens
augugugugcuuug

SEQ ID NO: 2095277 - RNA, 14 nt, Homo sapiens
gccauaacagacca

SEQ ID NO: 2095278 - RNA, 23 nt, Homo sapiens
agccauguaccacauaacaacau

SEQ ID NO: 2095279 - RNA, 14 nt, Homo sapiens
ugauaccauggcac

SEQ ID NO: 2095280 - RNA, 14 nt, Homo sapiens
uaucaacccagaaa

SEQ ID NO: 2095281 - RNA, 16 nt, Homo sapiens
acaaugauuaaucagc

SEQ ID NO: 2095282 - RNA, 21 nt, Homo sapiens
uuaguauaauugaccuacuuu

SEQ ID NO: 2095283 - RNA, 19 nt, Homo sapiens
uugauuuaauaucugagaa

SEQ ID NO: 2095284 - RNA, 22 nt, Homo sapiens
uccuuucagaaaauucccauga

SEQ ID NO: 2095285 - RNA, 22 nt, Homo sapiens
ugaagucaugcguuuaaucaca

SEQ ID NO: 2095286 - RNA, 13 nt, Homo sapiens
agcugcugucacu

SEQ ID NO: 2095287 - RNA, 13 nt, Homo sapiens
uuuuaggaagcua

SEQ ID NO: 2095288 - RNA, 23 nt, Homo sapiens
acaaauguuuagugaaacauuug

SEQ ID NO: 2095289 - RNA, 18 nt, Homo sapiens
accucuuugcucccugag

SEQ ID NO: 2095290 - RNA, 13 nt, Homo sapiens
cagcccugagguu

SEQ ID NO: 2095291 - RNA, 14 nt, Homo sapiens
uucaguagaauuac

SEQ ID NO: 2095292 - RNA, 12 nt, Homo sapiens
ccuuucuugucu

SEQ ID NO: 2095293 - RNA, 20 nt, Homo sapiens
ugauauaaagaaauaccuga

SEQ ID NO: 2095294 - RNA, 22 nt, Homo sapiens
aagagucuuaauauauauaucc

SEQ ID NO: 2095295 - RNA, 20 nt, Homo sapiens
aucuaaaguaaaaagggaau

SEQ ID NO: 2095296 - RNA, 19 nt, Homo sapiens
uaaaaauauaaauuguaca

SEQ ID NO: 2095297 - RNA, 21 nt, Homo sapiens
aacugaacagaaccacaaaaa

SEQ ID NO: 2095298 - RNA, 20 nt, Homo sapiens
accccugggggaggcuucca

SEQ ID NO: 2095299 - RNA, 15 nt, Homo sapiens
acccagauuguauca

SEQ ID NO: 2095300 - RNA, 23 nt, Homo sapiens
cucugaagucacaucacaggaca

SEQ ID NO: 2095301 - RNA, 13 nt, Homo sapiens
auugaaaugcauu

SEQ ID NO: 2095302 - RNA, 22 nt, Homo sapiens
auaaguuuuauguucugcucac

SEQ ID NO: 2095303 - RNA, 23 nt, Homo sapiens
aacuaccucaaaacacuuuccca

SEQ ID NO: 2095304 - RNA, 14 nt, Homo sapiens
gcagugugcagugg

SEQ ID NO: 2095305 - RNA, 23 nt, Homo sapiens
ucuaaccauagcugaccuuugua

SEQ ID NO: 2095306 - RNA, 22 nt, Homo sapiens
agaccugagcuuuccgcgucag

SEQ ID NO: 2095307 - RNA, 21 nt, Homo sapiens
gugaaagcccagccaucauga

SEQ ID NO: 2095308 - RNA, 22 nt, Homo sapiens
caagcaaagaacccauuugcca

SEQ ID NO: 2095309 - RNA, 16 nt, Homo sapiens
augaaauaucaugcuc

SEQ ID NO: 2095310 - RNA, 13 nt, Homo sapiens
gagauugcaguga

SEQ ID NO: 2095311 - RNA, 14 nt, Homo sapiens
ugcagaguguuuac

SEQ ID NO: 2095312 - RNA, 15 nt, Homo sapiens
ccccuccaggaauga

SEQ ID NO: 2095313 - RNA, 14 nt, Homo sapiens
uggaacaacagaug

SEQ ID NO: 2095314 - RNA, 22 nt, Homo sapiens
auuuuucuaaacguaagcacug

SEQ ID NO: 2095315 - RNA, 20 nt, Homo sapiens
cccuuguguuugaacagggc

SEQ ID NO: 2095316 - RNA, 12 nt, Homo sapiens
uguaauccaugu

SEQ ID NO: 2095317 - RNA, 14 nt, Homo sapiens
uagguaaagcuaua

SEQ ID NO: 2095318 - RNA, 13 nt, Homo sapiens
acacaugugcugg

SEQ ID NO: 2095319 - RNA, 20 nt, Homo sapiens
agggggacccuggugcucau

SEQ ID NO: 2095320 - RNA, 23 nt, Homo sapiens
uuuagaagaaaaguuauuggcau

SEQ ID NO: 2095321 - RNA, 13 nt, Homo sapiens
gccuucaccaagc

SEQ ID NO: 2095322 - RNA, 15 nt, Homo sapiens
gcuucccccacuuca

SEQ ID NO: 2095323 - RNA, 17 nt, Homo sapiens
aaagcugauuacuguca

SEQ ID NO: 2095324 - RNA, 20 nt, Homo sapiens
aguggacccuggaccauucc

SEQ ID NO: 2095325 - RNA, 20 nt, Homo sapiens
aaaggaguagaauaccaaau

SEQ ID NO: 2095326 - RNA, 18 nt, Homo sapiens
auggaaaaauugacaaaa

SEQ ID NO: 2095327 - RNA, 20 nt, Homo sapiens
uugaaagcagaagaagacag

SEQ ID NO: 2095328 - RNA, 17 nt, Homo sapiens
cuggaucuauguguaug

SEQ ID NO: 2095329 - RNA, 14 nt, Homo sapiens
cuggcacauaaaga

SEQ ID NO: 2095330 - RNA, 20 nt, Homo sapiens
ucauucagguauuuguaaua

SEQ ID NO: 2095331 - RNA, 16 nt, Homo sapiens
cauucccucuccugcc

SEQ ID NO: 2095332 - RNA, 18 nt, Homo sapiens
auauaccuuuuguuacca

SEQ ID NO: 2095333 - RNA, 14 nt, Homo sapiens
auggcccaggucuc

SEQ ID NO: 2095334 - RNA, 14 nt, Homo sapiens
aaauauauaucuaa

SEQ ID NO: 2095335 - RNA, 16 nt, Homo sapiens
gaggaugcugugccuc

SEQ ID NO: 2095336 - RNA, 21 nt, Homo sapiens
gauccugcaccccagcauucc

SEQ ID NO: 2095337 - RNA, 15 nt, Homo sapiens
augucagagcacuuu

SEQ ID NO: 2095338 - RNA, 17 nt, Homo sapiens
gaaauugugugugcaag

SEQ ID NO: 2095339 - RNA, 20 nt, Homo sapiens
augaucuauacacauaagca

SEQ ID NO: 2095340 - RNA, 13 nt, Homo sapiens
ucaaaugauuuca

SEQ ID NO: 2095341 - RNA, 20 nt, Homo sapiens
ggaaacaaggaaggacauuu

SEQ ID NO: 2095342 - RNA, 13 nt, Homo sapiens
uguuuuagcuccu

SEQ ID NO: 2095343 - RNA, 16 nt, Homo sapiens
ccuugcaccggcccuu

SEQ ID NO: 2095344 - RNA, 19 nt, Homo sapiens
ugguccuggcugcacucuu

SEQ ID NO: 2095345 - RNA, 23 nt, Homo sapiens
guguauuuuuauuuuccugugac

SEQ ID NO: 2095346 - RNA, 14 nt, Homo sapiens
aaaaaucugagaaa

SEQ ID NO: 2095347 - RNA, 16 nt, Homo sapiens
uggcagccaagagcca

SEQ ID NO: 2095348 - RNA, 23 nt, Homo sapiens
gacugacugggcgugguggcuca

SEQ ID NO: 2095349 - RNA, 17 nt, Homo sapiens
gugcccucccauagcac

SEQ ID NO: 2095350 - RNA, 15 nt, Homo sapiens
aaucagccuggccau

SEQ ID NO: 2095351 - RNA, 19 nt, Homo sapiens
ccaaggucccgaccccauc

SEQ ID NO: 2095352 - RNA, 21 nt, Homo sapiens
cuucugccucccacuccauac

SEQ ID NO: 2095353 - RNA, 17 nt, Homo sapiens
ccugaaaauuaugaguc

SEQ ID NO: 2095354 - RNA, 20 nt, Homo sapiens
uagaaagaaacugcucuaau

SEQ ID NO: 2095355 - RNA, 22 nt, Homo sapiens
ugagaaagagcacuuaagagaa

SEQ ID NO: 2095356 - RNA, 18 nt, Homo sapiens
ugcuuucaucacuaccuu

SEQ ID NO: 2095357 - RNA, 18 nt, Homo sapiens
uaauguggcuucuggaau

SEQ ID NO: 2095358 - RNA, 12 nt, Homo sapiens
ucucacuaugcu

SEQ ID NO: 2095359 - RNA, 12 nt, Homo sapiens
uggaaacugccc

SEQ ID NO: 2095360 - RNA, 22 nt, Homo sapiens
gacucugcuagacuccucagga

SEQ ID NO: 2095361 - RNA, 23 nt, Homo sapiens
uccccugucacgugugggcaaug

SEQ ID NO: 2095362 - RNA, 22 nt, Homo sapiens
ugacauaugcuaacccccaaau

SEQ ID NO: 2095363 - RNA, 19 nt, Homo sapiens
uuuauuuuuguagagccag

SEQ ID NO: 2095364 - RNA, 14 nt, Homo sapiens
aacuuugacuuucu

SEQ ID NO: 2095365 - RNA, 22 nt, Homo sapiens
aucccggcccauguugagccau

SEQ ID NO: 2095366 - RNA, 16 nt, Homo sapiens
agucacagccauuuca

SEQ ID NO: 2095367 - RNA, 14 nt, Homo sapiens
cugucuacauuucu

SEQ ID NO: 2095368 - RNA, 18 nt, Homo sapiens
ucagcgggggccuugaag

SEQ ID NO: 2095369 - RNA, 23 nt, Homo sapiens
cuccccuccaucccuggcccccu

SEQ ID NO: 2095370 - RNA, 22 nt, Homo sapiens
agcauagucuuauuaaccaugu

SEQ ID NO: 2095371 - RNA, 16 nt, Homo sapiens
caccugaccaaucaga

SEQ ID NO: 2095372 - RNA, 20 nt, Homo sapiens
gcucuacuggaauuuucaua

SEQ ID NO: 2095373 - RNA, 13 nt, Homo sapiens
ccagguagacuuu

SEQ ID NO: 2095374 - RNA, 14 nt, Homo sapiens
uucauggcaguaau

SEQ ID NO: 2095375 - RNA, 17 nt, Homo sapiens
uuucaagaagacuggca

SEQ ID NO: 2095376 - RNA, 13 nt, Homo sapiens
agugguuucagca

SEQ ID NO: 2095377 - RNA, 19 nt, Homo sapiens
gaauuagaagaaaauggau

SEQ ID NO: 2095378 - RNA, 19 nt, Homo sapiens
guagcaaacaccaccaagu

SEQ ID NO: 2095379 - RNA, 16 nt, Homo sapiens
aaauacuacuuucuca

SEQ ID NO: 2095380 - RNA, 18 nt, Homo sapiens
uuugguuccacaaucucu

SEQ ID NO: 2095381 - RNA, 18 nt, Homo sapiens
acugcagugaccacuuau

SEQ ID NO: 2095382 - RNA, 21 nt, Homo sapiens
ucugagcauauguuccaugcc

SEQ ID NO: 2095383 - RNA, 23 nt, Homo sapiens
ugguaacacaaauuuucaccugc

SEQ ID NO: 2095384 - RNA, 12 nt, Homo sapiens
gaauauuugaau

SEQ ID NO: 2095385 - RNA, 17 nt, Homo sapiens
cauuuuccuaaccacaa

SEQ ID NO: 2095386 - RNA, 24 nt, Homo sapiens
aaaccaggguagaauuguuuggca

SEQ ID NO: 2095387 - RNA, 18 nt, Homo sapiens
gagaaguggcuugacaau

SEQ ID NO: 2095388 - RNA, 18 nt, Homo sapiens
aggacagugcugacccca

SEQ ID NO: 2095389 - RNA, 15 nt, Homo sapiens
accccugucccaugc

SEQ ID NO: 2095390 - RNA, 18 nt, Homo sapiens
ggcucaacacugugacau

SEQ ID NO: 2095391 - RNA, 22 nt, Homo sapiens
caguuuucggaaacacugacuu

SEQ ID NO: 2095392 - RNA, 21 nt, Homo sapiens
ggcaaggaugaaagacaaaga

SEQ ID NO: 2095393 - RNA, 20 nt, Homo sapiens
auuuauuggggaucugcauu

SEQ ID NO: 2095394 - RNA, 15 nt, Homo sapiens
aggccacacuacaca

SEQ ID NO: 2095395 - RNA, 18 nt, Homo sapiens
caugaggccaccaguaaa

SEQ ID NO: 2095396 - RNA, 18 nt, Homo sapiens
ucauuuccagaaaggcuc

SEQ ID NO: 2095397 - RNA, 12 nt, Homo sapiens
uuagcuacaaau

SEQ ID NO: 2095398 - RNA, 21 nt, Homo sapiens
aaaauguaggccuccaguuca

SEQ ID NO: 2095399 - RNA, 20 nt, Homo sapiens
uaauuuuuaaaagacuuuga

SEQ ID NO: 2095400 - RNA, 18 nt, Homo sapiens
uagcuggccauucaggua

SEQ ID NO: 2095401 - RNA, 13 nt, Homo sapiens
uauaacaauugau

SEQ ID NO: 2095402 - RNA, 21 nt, Homo sapiens
cuguauuugaaagugccuuug

SEQ ID NO: 2095403 - RNA, 23 nt, Homo sapiens
aaauuuucuuuuuauacuauuaa

SEQ ID NO: 2095404 - RNA, 14 nt, Homo sapiens
gaauauguucacau

SEQ ID NO: 2095405 - RNA, 19 nt, Homo sapiens
uaauggcagagcagucuaa

SEQ ID NO: 2095406 - RNA, 21 nt, Homo sapiens
aagcuggauuauuuagaucua

SEQ ID NO: 2095407 - RNA, 17 nt, Homo sapiens
gucccugccaguguuua

SEQ ID NO: 2095408 - RNA, 20 nt, Homo sapiens
ucuaaaggcuuuugcccuac

SEQ ID NO: 2095409 - RNA, 18 nt, Homo sapiens
ucagggauccucucucca

SEQ ID NO: 2095410 - RNA, 17 nt, Homo sapiens
aggaggggaacacugcc

SEQ ID NO: 2095411 - RNA, 22 nt, Homo sapiens
cugcacccagccaaacacauaa

SEQ ID NO: 2095412 - RNA, 14 nt, Homo sapiens
aggcugucuaccug

SEQ ID NO: 2095413 - RNA, 14 nt, Homo sapiens
aaguccucugcucc

SEQ ID NO: 2095414 - RNA, 16 nt, Homo sapiens
uggagggcagagacaa

SEQ ID NO: 2095415 - RNA, 15 nt, Homo sapiens
gaagggauaucuacu

SEQ ID NO: 2095416 - RNA, 20 nt, Homo sapiens
uuacaguuaaagaagcaauc

SEQ ID NO: 2095417 - RNA, 15 nt, Homo sapiens
aaggauauuuacaga

SEQ ID NO: 2095418 - RNA, 14 nt, Homo sapiens
auccuaggcauuug

SEQ ID NO: 2095419 - RNA, 17 nt, Homo sapiens
ccucuuugagugaagcu

SEQ ID NO: 2095420 - RNA, 15 nt, Homo sapiens
cuccacucugaaguc

SEQ ID NO: 2095421 - RNA, 15 nt, Homo sapiens
cuguccccacacuga

SEQ ID NO: 2095422 - RNA, 14 nt, Homo sapiens
ccagacuuaaucuu

SEQ ID NO: 2095423 - RNA, 18 nt, Homo sapiens
uuuccgggauagagucuu

SEQ ID NO: 2095424 - RNA, 17 nt, Homo sapiens
gcuggaaggcagcuugu

SEQ ID NO: 2095425 - RNA, 15 nt, Homo sapiens
cagcucuaagucuca

SEQ ID NO: 2095426 - RNA, 17 nt, Homo sapiens
caauugggcagaugugu

SEQ ID NO: 2095427 - RNA, 21 nt, Homo sapiens
ugucuagagccucuuggggaa

SEQ ID NO: 2095428 - RNA, 16 nt, Homo sapiens
ggaauuccagugccag

SEQ ID NO: 2095429 - RNA, 22 nt, Homo sapiens
cugaacuauuuuaaauaaaaua

SEQ ID NO: 2095430 - RNA, 14 nt, Homo sapiens
cgauauuuacguaa

SEQ ID NO: 2095431 - RNA, 19 nt, Homo sapiens
uaggaaaucuagaaguagu

SEQ ID NO: 2095432 - RNA, 21 nt, Homo sapiens
gcuuaugacagagguuuugaa

SEQ ID NO: 2095433 - RNA, 14 nt, Homo sapiens
gcauggaguauuau

SEQ ID NO: 2095434 - RNA, 18 nt, Homo sapiens
ugguuaguguacuuugaa

SEQ ID NO: 2095435 - RNA, 13 nt, Homo sapiens
ucaacaaaccaca

SEQ ID NO: 2095436 - RNA, 18 nt, Homo sapiens
acauaaaaucgcuuucaa

SEQ ID NO: 2095437 - RNA, 23 nt, Homo sapiens
agucuggcuagguuaaaggccag

SEQ ID NO: 2095438 - RNA, 17 nt, Homo sapiens
acagacccacacacuua

SEQ ID NO: 2095439 - RNA, 17 nt, Homo sapiens
cuugaagacucccugau

SEQ ID NO: 2095440 - RNA, 16 nt, Homo sapiens
acaggccauccauuca

SEQ ID NO: 2095441 - RNA, 20 nt, Homo sapiens
cauaucagggguacauucua

SEQ ID NO: 2095442 - RNA, 18 nt, Homo sapiens
caaaaaauagcacacuuu

SEQ ID NO: 2095443 - RNA, 15 nt, Homo sapiens
uuuaaaaaaucucaa

SEQ ID NO: 2095444 - RNA, 21 nt, Homo sapiens
caaauguaauuaugaggugaa

SEQ ID NO: 2095445 - RNA, 17 nt, Homo sapiens
caaagguugcagugcug

SEQ ID NO: 2095446 - RNA, 13 nt, Homo sapiens
cuaacaauuguga

SEQ ID NO: 2095447 - RNA, 13 nt, Homo sapiens
cuucacagugacc

SEQ ID NO: 2095448 - RNA, 15 nt, Homo sapiens
ucaggugugcccuga

SEQ ID NO: 2095449 - RNA, 18 nt, Homo sapiens
aggccugggaauccgcug

SEQ ID NO: 2095450 - RNA, 14 nt, Homo sapiens
uuccuauuggaaaa

SEQ ID NO: 2095451 - RNA, 17 nt, Homo sapiens
caaaggaaaauugcacu

SEQ ID NO: 2095452 - RNA, 14 nt, Homo sapiens
ugauaauacuugac

SEQ ID NO: 2095453 - RNA, 15 nt, Homo sapiens
aggccagugaccuca

SEQ ID NO: 2095454 - RNA, 17 nt, Homo sapiens
cagagaaagggacaaug

SEQ ID NO: 2095455 - RNA, 16 nt, Homo sapiens
cugugguggucugugu

SEQ ID NO: 2095456 - RNA, 16 nt, Homo sapiens
uaugccugccucuuuc

SEQ ID NO: 2095457 - RNA, 16 nt, Homo sapiens
ucauaacuauacuuga

SEQ ID NO: 2095458 - RNA, 11 nt, Homo sapiens
gcacuugccug

SEQ ID NO: 2095459 - RNA, 15 nt, Homo sapiens
caaaugucuacugaa

SEQ ID NO: 2095460 - RNA, 14 nt, Homo sapiens
cacauuccaugacg

SEQ ID NO: 2095461 - RNA, 16 nt, Homo sapiens
uucccaagagcaucau

SEQ ID NO: 2095462 - RNA, 17 nt, Homo sapiens
uugguuggauaagcuau

SEQ ID NO: 2095463 - RNA, 19 nt, Homo sapiens
aacauucuuuccuaaauau

SEQ ID NO: 2095464 - RNA, 12 nt, Homo sapiens
ugagguaaccuc

SEQ ID NO: 2095465 - RNA, 20 nt, Homo sapiens
ucaguaauaaaacaucuuuc

SEQ ID NO: 2095466 - RNA, 23 nt, Homo sapiens
acuucagccaggugaacuggaau

SEQ ID NO: 2095467 - RNA, 23 nt, Homo sapiens
aaucuaucacccaggaaucucaa

SEQ ID NO: 2095468 - RNA, 16 nt, Homo sapiens
aaacaaaaaagacuug

SEQ ID NO: 2095469 - RNA, 14 nt, Homo sapiens
cacuaucaccuauu

SEQ ID NO: 2095470 - RNA, 20 nt, Homo sapiens
auuuuucuuagugugccaag

SEQ ID NO: 2095471 - RNA, 19 nt, Homo sapiens
ucagacacuacaugaugac

SEQ ID NO: 2095472 - RNA, 20 nt, Homo sapiens
agugaccucuagaaaaaaga

SEQ ID NO: 2095473 - RNA, 13 nt, Homo sapiens
auuaauauuugcu

SEQ ID NO: 2095474 - RNA, 11 nt, Homo sapiens
ugacaugaccc

SEQ ID NO: 2095475 - RNA, 15 nt, Homo sapiens
acaugcggcugccca

SEQ ID NO: 2095476 - RNA, 15 nt, Homo sapiens
cugcgaggacaucaa

SEQ ID NO: 2095477 - RNA, 14 nt, Homo sapiens
aaauugcaguaaca

SEQ ID NO: 2095478 - RNA, 13 nt, Homo sapiens
ugaagaauguaga

SEQ ID NO: 2095479 - RNA, 20 nt, Homo sapiens
ugcccugagaagcugcucca

SEQ ID NO: 2095480 - RNA, 17 nt, Homo sapiens
acacagcaaugacauuu

SEQ ID NO: 2095481 - RNA, 22 nt, Homo sapiens
ugugugaacguguauguaccua

SEQ ID NO: 2095482 - RNA, 14 nt, Homo sapiens
caccagccaugugc

SEQ ID NO: 2095483 - RNA, 11 nt, Homo sapiens
uguucacaugg

SEQ ID NO: 2095484 - RNA, 23 nt, Homo sapiens
aaauaccacaugauuuuacucau

SEQ ID NO: 2095485 - RNA, 22 nt, Homo sapiens
cuaaacuguuuauuugcacuau

SEQ ID NO: 2095486 - RNA, 12 nt, Homo sapiens
uauuacacauca

SEQ ID NO: 2095487 - RNA, 15 nt, Homo sapiens
gcaaaaucaguuuuc

SEQ ID NO: 2095488 - RNA, 14 nt, Homo sapiens
aaguuauuguacaa

SEQ ID NO: 2095489 - RNA, 20 nt, Homo sapiens
cagacuucaucauugugcua

SEQ ID NO: 2095490 - RNA, 18 nt, Homo sapiens
uauuuuaaguaucagagg

SEQ ID NO: 2095491 - RNA, 19 nt, Homo sapiens
gucaacaaaaagacaugga

SEQ ID NO: 2095492 - RNA, 18 nt, Homo sapiens
uucaaccacagauuuaua

SEQ ID NO: 2095493 - RNA, 15 nt, Homo sapiens
cauugccaugaauuu

SEQ ID NO: 2095494 - RNA, 22 nt, Homo sapiens
cuagggaaagggauauggaguu

SEQ ID NO: 2095495 - RNA, 14 nt, Homo sapiens
cacccccaccucaa

SEQ ID NO: 2095496 - RNA, 15 nt, Homo sapiens
caaauaaaaacccaa

SEQ ID NO: 2095497 - RNA, 14 nt, Homo sapiens
ccucaccacaccca

SEQ ID NO: 2095498 - RNA, 20 nt, Homo sapiens
acauaaaacaaaaccaagcc

SEQ ID NO: 2095499 - RNA, 18 nt, Homo sapiens
aaccccuucucugugacc

SEQ ID NO: 2095500 - RNA, 22 nt, Homo sapiens
accagacagacaacacugggaa

SEQ ID NO: 2095501 - RNA, 14 nt, Homo sapiens
aagcauuuggugcc

SEQ ID NO: 2095502 - RNA, 21 nt, Homo sapiens
cugccuagaaacaacacugua

SEQ ID NO: 2095503 - RNA, 14 nt, Homo sapiens
aauauaaugaugcu

SEQ ID NO: 2095504 - RNA, 12 nt, Homo sapiens
uaggauguggaa

SEQ ID NO: 2095505 - RNA, 21 nt, Homo sapiens
uaaugcccagacaaaaagcua

SEQ ID NO: 2095506 - RNA, 20 nt, Homo sapiens
uugccuauuugcugaccaca

SEQ ID NO: 2095507 - RNA, 23 nt, Homo sapiens
gagucaggaguuuuacugccugu

SEQ ID NO: 2095508 - RNA, 12 nt, Homo sapiens
ucaacacuuaag

SEQ ID NO: 2095509 - RNA, 19 nt, Homo sapiens
ugucuauuaaaauucugau

SEQ ID NO: 2095510 - RNA, 21 nt, Homo sapiens
aguggcaaaaaagaacagugu

SEQ ID NO: 2095511 - RNA, 17 nt, Homo sapiens
gucacauggccuaugca

SEQ ID NO: 2095512 - RNA, 20 nt, Homo sapiens
ugucaccggucagugccuuu

SEQ ID NO: 2095513 - RNA, 17 nt, Homo sapiens
aauaggaagaacaguac

SEQ ID NO: 2095514 - RNA, 18 nt, Homo sapiens
cuuuaguauuauauuaau

SEQ ID NO: 2095515 - RNA, 22 nt, Homo sapiens
aggcaacuggaaaauacauguc

SEQ ID NO: 2095516 - RNA, 18 nt, Homo sapiens
uccauaaaaguccuguca

SEQ ID NO: 2095517 - RNA, 22 nt, Homo sapiens
aguacucaguaacagugcagua

SEQ ID NO: 2095518 - RNA, 13 nt, Homo sapiens
agggaagccaaaa

SEQ ID NO: 2095519 - RNA, 21 nt, Homo sapiens
cuucaccgugacauuccagca

SEQ ID NO: 2095520 - RNA, 20 nt, Homo sapiens
accaggcgcccgggauccag

SEQ ID NO: 2095521 - RNA, 13 nt, Homo sapiens
ucuucuccuugau

SEQ ID NO: 2095522 - RNA, 21 nt, Homo sapiens
cucgcaguacauguuacuugu

SEQ ID NO: 2095523 - RNA, 19 nt, Homo sapiens
aagugaucaaacuacauau

SEQ ID NO: 2095524 - RNA, 19 nt, Homo sapiens
gcucccugguucugaugau

SEQ ID NO: 2095525 - RNA, 16 nt, Homo sapiens
ugaggggcacucgccg

SEQ ID NO: 2095526 - RNA, 13 nt, Homo sapiens
cuagauauagcuu

SEQ ID NO: 2095527 - RNA, 20 nt, Homo sapiens
ugcaacuucuaaacacaaau

SEQ ID NO: 2095528 - RNA, 19 nt, Homo sapiens
ugaucuuuuaggccaagga

SEQ ID NO: 2095529 - RNA, 12 nt, Homo sapiens
uguagaaaguga

SEQ ID NO: 2095530 - RNA, 14 nt, Homo sapiens
ucccauccaucagc

SEQ ID NO: 2095531 - RNA, 17 nt, Homo sapiens
aaaacauccugacuuca

SEQ ID NO: 2095532 - RNA, 22 nt, Homo sapiens
gaugacuaccucagaacauaaa

SEQ ID NO: 2095533 - RNA, 23 nt, Homo sapiens
cacacugggugcccaagcucaga

SEQ ID NO: 2095534 - RNA, 13 nt, Homo sapiens
aagaucucugcag

SEQ ID NO: 2095535 - RNA, 14 nt, Homo sapiens
acgaaaagccagcu

SEQ ID NO: 2095536 - RNA, 23 nt, Homo sapiens
gcugaccaacgcacaacaggaaa

SEQ ID NO: 2095537 - RNA, 19 nt, Homo sapiens
cuuuggacagaagcagcuc

SEQ ID NO: 2095538 - RNA, 12 nt, Homo sapiens
gacacacuguua

SEQ ID NO: 2095539 - RNA, 20 nt, Homo sapiens
aauauuuucuguguguuccu

SEQ ID NO: 2095540 - RNA, 16 nt, Homo sapiens
ccagagggaauugcag

SEQ ID NO: 2095541 - RNA, 14 nt, Homo sapiens
cucucucaaagugc

SEQ ID NO: 2095542 - RNA, 13 nt, Homo sapiens
augugacuacuga

SEQ ID NO: 2095543 - RNA, 19 nt, Homo sapiens
uggaaauccuguuacuuaa

SEQ ID NO: 2095544 - RNA, 12 nt, Homo sapiens
acaaauaugcaa

SEQ ID NO: 2095545 - RNA, 21 nt, Homo sapiens
agaauauucucccauaaacac

SEQ ID NO: 2095546 - RNA, 15 nt, Homo sapiens
aaaauaagcacugug

SEQ ID NO: 2095547 - RNA, 24 nt, Homo sapiens
ugucacuuuccucuuccacuuuga

SEQ ID NO: 2095548 - RNA, 19 nt, Homo sapiens
cgcggcccgcgcagcugcc

SEQ ID NO: 2095549 - RNA, 20 nt, Homo sapiens
uuuuucucagaucugguuuc

SEQ ID NO: 2095550 - RNA, 15 nt, Homo sapiens
uacucccagcacuuu

SEQ ID NO: 2095551 - RNA, 14 nt, Homo sapiens
gugaugaacuacau

SEQ ID NO: 2095552 - RNA, 13 nt, Homo sapiens
ucuaaaacauucc

SEQ ID NO: 2095553 - RNA, 24 nt, Homo sapiens
uguugccacuggcaaauguaacug

SEQ ID NO: 2095554 - RNA, 12 nt, Homo sapiens
gaaauccaaacu

SEQ ID NO: 2095555 - RNA, 12 nt, Homo sapiens
ggcuuccaagaa

SEQ ID NO: 2095556 - RNA, 12 nt, Homo sapiens
cuuucaguauua

SEQ ID NO: 2095557 - RNA, 18 nt, Homo sapiens
aggauguguuuucagucu

SEQ ID NO: 2095558 - RNA, 19 nt, Homo sapiens
acagaugcaaugugcuacu

SEQ ID NO: 2095559 - RNA, 12 nt, Homo sapiens
uuaaauguaguu

SEQ ID NO: 2095560 - RNA, 17 nt, Homo sapiens
cuugcaaaacagggauu

SEQ ID NO: 2095561 - RNA, 17 nt, Homo sapiens
cuucagaagacacugca

SEQ ID NO: 2095562 - RNA, 18 nt, Homo sapiens
cacaugacagaaccaauu

SEQ ID NO: 2095563 - RNA, 14 nt, Homo sapiens
gauucgaaacucca

SEQ ID NO: 2095564 - RNA, 14 nt, Homo sapiens
caguuucaccaucu

SEQ ID NO: 2095565 - RNA, 23 nt, Homo sapiens
ucuaucuugaauuucaugcuuuc

SEQ ID NO: 2095566 - RNA, 14 nt, Homo sapiens
cuucugcaaaaaac

SEQ ID NO: 2095567 - RNA, 19 nt, Homo sapiens
cuggguugagggaugcugg

SEQ ID NO: 2095568 - RNA, 17 nt, Homo sapiens
caaagaguguagaucag

SEQ ID NO: 2095569 - RNA, 18 nt, Homo sapiens
ucaauccaggcuacaauc

SEQ ID NO: 2095570 - RNA, 14 nt, Homo sapiens
aaucugaccaaaac

SEQ ID NO: 2095571 - RNA, 21 nt, Homo sapiens
auuuguauuuccccaaugacu

SEQ ID NO: 2095572 - RNA, 20 nt, Homo sapiens
accaaugugugaaguaugca

SEQ ID NO: 2095573 - RNA, 20 nt, Homo sapiens
cagccaaaccuuuccuguaa

SEQ ID NO: 2095574 - RNA, 23 nt, Homo sapiens
cagaaggaaaaaaacaugaauuu

SEQ ID NO: 2095575 - RNA, 15 nt, Homo sapiens
uauuaaaacacagcu

SEQ ID NO: 2095576 - RNA, 18 nt, Homo sapiens
gcugugauuugcugugua

SEQ ID NO: 2095577 - RNA, 14 nt, Homo sapiens
aaugacaguagcau

SEQ ID NO: 2095578 - RNA, 22 nt, Homo sapiens
uacugguuuguaugauguauua

SEQ ID NO: 2095579 - RNA, 17 nt, Homo sapiens
acucaaacagucuuucu

SEQ ID NO: 2095580 - RNA, 17 nt, Homo sapiens
acucuaucugucauaca

SEQ ID NO: 2095581 - RNA, 21 nt, Homo sapiens
aaguguauaauguuggugugg

SEQ ID NO: 2095582 - RNA, 16 nt, Homo sapiens
gauggacaucuuguca

SEQ ID NO: 2095583 - RNA, 12 nt, Homo sapiens
acacaaagugaa

SEQ ID NO: 2095584 - RNA, 12 nt, Homo sapiens
acuucagcagua

SEQ ID NO: 2095585 - RNA, 20 nt, Homo sapiens
cauaacucauaauccagaga

SEQ ID NO: 2095586 - RNA, 23 nt, Homo sapiens
gugcaagccacuauguccagcua

SEQ ID NO: 2095587 - RNA, 17 nt, Homo sapiens
acuacaggcaccugcca

SEQ ID NO: 2095588 - RNA, 20 nt, Homo sapiens
uacacgaagaccauccaucc

SEQ ID NO: 2095589 - RNA, 23 nt, Homo sapiens
ccaucugugaggugauaggcaag

SEQ ID NO: 2095590 - RNA, 12 nt, Homo sapiens
cugccaaacuga

SEQ ID NO: 2095591 - RNA, 12 nt, Homo sapiens
aauacaaaaauc

SEQ ID NO: 2095592 - RNA, 16 nt, Homo sapiens
uaggaguucauagaag

SEQ ID NO: 2095593 - RNA, 17 nt, Homo sapiens
ugguacacugcaucuca

SEQ ID NO: 2095594 - RNA, 22 nt, Homo sapiens
uuccuuccaaggucacucuugg

SEQ ID NO: 2095595 - RNA, 14 nt, Homo sapiens
uauuuugacuguga

SEQ ID NO: 2095596 - RNA, 14 nt, Homo sapiens
ggcagcggugggcu

SEQ ID NO: 2095597 - RNA, 15 nt, Homo sapiens
caggccgugggaccc

SEQ ID NO: 2095598 - RNA, 13 nt, Homo sapiens
aaaacugccaaaa

SEQ ID NO: 2095599 - RNA, 22 nt, Homo sapiens
agcugucgucugacucuggguu

SEQ ID NO: 2095600 - RNA, 18 nt, Homo sapiens
acaaggcuccaagaccua

SEQ ID NO: 2095601 - RNA, 17 nt, Homo sapiens
ggaggcacccaugccau

SEQ ID NO: 2095602 - RNA, 23 nt, Homo sapiens
cagauuuguggggaccucagccu

SEQ ID NO: 2095603 - RNA, 14 nt, Homo sapiens
uaaagcaaauuuau

SEQ ID NO: 2095604 - RNA, 19 nt, Homo sapiens
auguauauauauauaugca

SEQ ID NO: 2095605 - RNA, 18 nt, Homo sapiens
gaagcaggguacccuuug

SEQ ID NO: 2095606 - RNA, 18 nt, Homo sapiens
gaauugcaugccaucucc

SEQ ID NO: 2095607 - RNA, 16 nt, Homo sapiens
acgcgacuuccacaaa

SEQ ID NO: 2095608 - RNA, 18 nt, Homo sapiens
uuucugauuacuguccag

SEQ ID NO: 2095609 - RNA, 19 nt, Homo sapiens
gaauuaguuuuuucuuccu

SEQ ID NO: 2095610 - RNA, 19 nt, Homo sapiens
aauaugugaucagcuuuca

SEQ ID NO: 2095611 - RNA, 21 nt, Homo sapiens
uccacugaaguagugugcagu

SEQ ID NO: 2095612 - RNA, 22 nt, Homo sapiens
gcagugccuuucuucucuccag

SEQ ID NO: 2095613 - RNA, 17 nt, Homo sapiens
caccguuaggauucagg

SEQ ID NO: 2095614 - RNA, 13 nt, Homo sapiens
aauuugggggaaa

SEQ ID NO: 2095615 - RNA, 12 nt, Homo sapiens
gagaaacugugu

SEQ ID NO: 2095616 - RNA, 16 nt, Homo sapiens
cauauuaagcacuuua

SEQ ID NO: 2095617 - RNA, 19 nt, Homo sapiens
caccccucaguuaauugca

SEQ ID NO: 2095618 - RNA, 13 nt, Homo sapiens
gggaccaaugagg

SEQ ID NO: 2095619 - RNA, 18 nt, Homo sapiens
gacuuuccccaccagaug

SEQ ID NO: 2095620 - RNA, 19 nt, Homo sapiens
uccccugaagaauccccca

SEQ ID NO: 2095621 - RNA, 18 nt, Homo sapiens
uauuuccuauacgugugu

SEQ ID NO: 2095622 - RNA, 12 nt, Homo sapiens
aggaugcacagu

SEQ ID NO: 2095623 - RNA, 14 nt, Homo sapiens
cuauauaguaucua

SEQ ID NO: 2095624 - RNA, 15 nt, Homo sapiens
ccaaaaugacuuuau

SEQ ID NO: 2095625 - RNA, 18 nt, Homo sapiens
cauuuaacugaacuguga

SEQ ID NO: 2095626 - RNA, 15 nt, Homo sapiens
agcggagagagccaa

SEQ ID NO: 2095627 - RNA, 18 nt, Homo sapiens
acugccaaagaacuugga

SEQ ID NO: 2095628 - RNA, 16 nt, Homo sapiens
gccgagaugugcaaca

SEQ ID NO: 2095629 - RNA, 19 nt, Homo sapiens
aaaccuuucaaauuucaca

SEQ ID NO: 2095630 - RNA, 16 nt, Homo sapiens
uguaauuccucuagcu

SEQ ID NO: 2095631 - RNA, 20 nt, Homo sapiens
ccccugugcccugcacguau

SEQ ID NO: 2095632 - RNA, 20 nt, Homo sapiens
ugguuggccgugguccagcu

SEQ ID NO: 2095633 - RNA, 17 nt, Homo sapiens
cauuaucugaguugcau

SEQ ID NO: 2095634 - RNA, 11 nt, Homo sapiens
aucuaccacau

SEQ ID NO: 2095635 - RNA, 20 nt, Homo sapiens
ugaucuccauaaacaugaaa

SEQ ID NO: 2095636 - RNA, 14 nt, Homo sapiens
uauaaaaucuagau

SEQ ID NO: 2095637 - RNA, 14 nt, Homo sapiens
gugauaucaccucu

SEQ ID NO: 2095638 - RNA, 14 nt, Homo sapiens
ugugucacaaagcu

SEQ ID NO: 2095639 - RNA, 15 nt, Homo sapiens
ugacauuugguggua

SEQ ID NO: 2095640 - RNA, 17 nt, Homo sapiens
ugcauagcagcugcuac

SEQ ID NO: 2095641 - RNA, 18 nt, Homo sapiens
cugacccucccagucuca

SEQ ID NO: 2095642 - RNA, 15 nt, Homo sapiens
acuguagucucagga

SEQ ID NO: 2095643 - RNA, 18 nt, Homo sapiens
agagacuacagagucaaa

SEQ ID NO: 2095644 - RNA, 22 nt, Homo sapiens
cuccucgagaucccaacacugc

SEQ ID NO: 2095645 - RNA, 15 nt, Homo sapiens
aagggauaguccaaa

SEQ ID NO: 2095646 - RNA, 13 nt, Homo sapiens
cuucucugcucca

SEQ ID NO: 2095647 - RNA, 19 nt, Homo sapiens
cauuucuuuucuuuuuaca

SEQ ID NO: 2095648 - RNA, 21 nt, Homo sapiens
agccuuuggauggcuauggag

SEQ ID NO: 2095649 - RNA, 16 nt, Homo sapiens
uguaaguuucugugac

SEQ ID NO: 2095650 - RNA, 23 nt, Homo sapiens
acugagcgaggaaaaacaacaaa

SEQ ID NO: 2095651 - RNA, 20 nt, Homo sapiens
agcucuuugucucaccagcu

SEQ ID NO: 2095652 - RNA, 14 nt, Homo sapiens
aucgcaaaucacaa

SEQ ID NO: 2095653 - RNA, 15 nt, Homo sapiens
acugguacucaagcc

SEQ ID NO: 2095654 - RNA, 16 nt, Homo sapiens
cauacuaggugccuuu

SEQ ID NO: 2095655 - RNA, 13 nt, Homo sapiens
aauauuuaguaaa

SEQ ID NO: 2095656 - RNA, 16 nt, Homo sapiens
guaacauagaguauau

SEQ ID NO: 2095657 - RNA, 20 nt, Homo sapiens
accuccuuccccccaccaga

SEQ ID NO: 2095658 - RNA, 20 nt, Homo sapiens
acaaugcuccuccugaugac

SEQ ID NO: 2095659 - RNA, 20 nt, Homo sapiens
ggauugugcugauguaguga

SEQ ID NO: 2095660 - RNA, 22 nt, Homo sapiens
cucuugaaccccaaaugcucuc

SEQ ID NO: 2095661 - RNA, 19 nt, Homo sapiens
caccuuaaugcauauuccc

SEQ ID NO: 2095662 - RNA, 23 nt, Homo sapiens
uaccaugaugcugagcccggaaa

SEQ ID NO: 2095663 - RNA, 22 nt, Homo sapiens
ccuccccagggaagacccugac

SEQ ID NO: 2095664 - RNA, 14 nt, Homo sapiens
acuguagaaaggaa

SEQ ID NO: 2095665 - RNA, 20 nt, Homo sapiens
aacugagggcugaucuuuaa

SEQ ID NO: 2095666 - RNA, 14 nt, Homo sapiens
cuucagaucucugg

SEQ ID NO: 2095667 - RNA, 13 nt, Homo sapiens
gcagaagugcaug

SEQ ID NO: 2095668 - RNA, 14 nt, Homo sapiens
caacuucauuugac

SEQ ID NO: 2095669 - RNA, 13 nt, Homo sapiens
aacaaaaggcuuu

SEQ ID NO: 2095670 - RNA, 13 nt, Homo sapiens
uauauaaaaaugg

SEQ ID NO: 2095671 - RNA, 19 nt, Homo sapiens
ucuguccuaaauaucucaa

SEQ ID NO: 2095672 - RNA, 17 nt, Homo sapiens
ucgcccaggauggagug

SEQ ID NO: 2095673 - RNA, 20 nt, Homo sapiens
cauaagagagccuugguuca

SEQ ID NO: 2095674 - RNA, 21 nt, Homo sapiens
guuuuacacuaaaaaaaugca

SEQ ID NO: 2095675 - RNA, 16 nt, Homo sapiens
cuucuuaaccauucua

SEQ ID NO: 2095676 - RNA, 15 nt, Homo sapiens
agccaagauugcacc

SEQ ID NO: 2095677 - RNA, 17 nt, Homo sapiens
cagacgguucaccagcc

SEQ ID NO: 2095678 - RNA, 15 nt, Homo sapiens
aacuucuacugagca

SEQ ID NO: 2095679 - RNA, 21 nt, Homo sapiens
acugucugugaacagagagac

SEQ ID NO: 2095680 - RNA, 22 nt, Homo sapiens
caaggagaucgguaucuuugua

SEQ ID NO: 2095681 - RNA, 22 nt, Homo sapiens
cuccaguuuacccuucagguug

SEQ ID NO: 2095682 - RNA, 22 nt, Homo sapiens
ugccucuuuuaaugucaucucu

SEQ ID NO: 2095683 - RNA, 13 nt, Homo sapiens
uauguauucacag

SEQ ID NO: 2095684 - RNA, 21 nt, Homo sapiens
ucaaguaacuauuuguaaaag

SEQ ID NO: 2095685 - RNA, 16 nt, Homo sapiens
uucaauucugauucca

SEQ ID NO: 2095686 - RNA, 16 nt, Homo sapiens
auucaguacuuuauga

SEQ ID NO: 2095687 - RNA, 16 nt, Homo sapiens
agauuguaauugccau

SEQ ID NO: 2095688 - RNA, 23 nt, Homo sapiens
caccuggccugguugugugcaca

SEQ ID NO: 2095689 - RNA, 22 nt, Homo sapiens
agcauccugauuaaaugucuga

SEQ ID NO: 2095690 - RNA, 15 nt, Homo sapiens
caacauaaagagcaa

SEQ ID NO: 2095691 - RNA, 16 nt, Homo sapiens
gauaacagccucuugc

SEQ ID NO: 2095692 - RNA, 13 nt, Homo sapiens
gugaaacuggcac

SEQ ID NO: 2095693 - RNA, 23 nt, Homo sapiens
ggggucuuugaacacaccucucu

SEQ ID NO: 2095694 - RNA, 12 nt, Homo sapiens
acagcagcaucu

SEQ ID NO: 2095695 - RNA, 13 nt, Homo sapiens
uaaaggauaucaa

SEQ ID NO: 2095696 - RNA, 15 nt, Homo sapiens
ugcuucugcccaccc

SEQ ID NO: 2095697 - RNA, 19 nt, Homo sapiens
acaaguagcacacugaguu

SEQ ID NO: 2095698 - RNA, 21 nt, Homo sapiens
gcuucugguugaugccuguga

SEQ ID NO: 2095699 - RNA, 15 nt, Homo sapiens
ucagagaacuuuccc

SEQ ID NO: 2095700 - RNA, 22 nt, Homo sapiens
gccaccacauuuagaacuuugg

SEQ ID NO: 2095701 - RNA, 20 nt, Homo sapiens
cuuauuaauacaaacacaaa

SEQ ID NO: 2095702 - RNA, 13 nt, Homo sapiens
cccaggacuguug

SEQ ID NO: 2095703 - RNA, 12 nt, Homo sapiens
guugacuuuccu

SEQ ID NO: 2095704 - RNA, 16 nt, Homo sapiens
ggaguggcauguauga

SEQ ID NO: 2095705 - RNA, 19 nt, Homo sapiens
ucagagacccuggugcugc

SEQ ID NO: 2095706 - RNA, 11 nt, Homo sapiens
uugauugcuaa

SEQ ID NO: 2095707 - RNA, 23 nt, Homo sapiens
caauauuuuuguauauacuuuua

SEQ ID NO: 2095708 - RNA, 15 nt, Homo sapiens
uaggauauaagaggg

SEQ ID NO: 2095709 - RNA, 21 nt, Homo sapiens
ucauuaaggucauuacucuca

SEQ ID NO: 2095710 - RNA, 13 nt, Homo sapiens
acucuaccaaaua

SEQ ID NO: 2095711 - RNA, 13 nt, Homo sapiens
gccagcguggcaa

SEQ ID NO: 2095712 - RNA, 12 nt, Homo sapiens
ccugacuguaua

SEQ ID NO: 2095713 - RNA, 14 nt, Homo sapiens
aauugaacugcuua

SEQ ID NO: 2095714 - RNA, 14 nt, Homo sapiens
auuuuagaugccug

SEQ ID NO: 2095715 - RNA, 19 nt, Homo sapiens
uugcaauuggaauaaucac

SEQ ID NO: 2095716 - RNA, 14 nt, Homo sapiens
agguggcacuaccc

SEQ ID NO: 2095717 - RNA, 13 nt, Homo sapiens
guguuuuuacaua

SEQ ID NO: 2095718 - RNA, 20 nt, Homo sapiens
ggugguggaaggguagagag

SEQ ID NO: 2095719 - RNA, 19 nt, Homo sapiens
uagaauuuugaguauucca

SEQ ID NO: 2095720 - RNA, 16 nt, Homo sapiens
aaagguucacucucaa

SEQ ID NO: 2095721 - RNA, 13 nt, Homo sapiens
cuacugaugcugu

SEQ ID NO: 2095722 - RNA, 17 nt, Homo sapiens
uuuuaacggaugguuga

SEQ ID NO: 2095723 - RNA, 19 nt, Homo sapiens
uugccgccccgugccugua

SEQ ID NO: 2095724 - RNA, 14 nt, Homo sapiens
augagccuuugcac

SEQ ID NO: 2095725 - RNA, 16 nt, Homo sapiens
ggucaaaguucauaga

SEQ ID NO: 2095726 - RNA, 18 nt, Homo sapiens
aguuuguuauagauuuag

SEQ ID NO: 2095727 - RNA, 21 nt, Homo sapiens
cagacuuuguguucauuucau

SEQ ID NO: 2095728 - RNA, 20 nt, Homo sapiens
ggagggucacuggggcccaa

SEQ ID NO: 2095729 - RNA, 22 nt, Homo sapiens
cugugaaagcuagacugaacca

SEQ ID NO: 2095730 - RNA, 17 nt, Homo sapiens
gucucgcuuuguugccc

SEQ ID NO: 2095731 - RNA, 22 nt, Homo sapiens
caacgcuuuuuuggaucagcuc

SEQ ID NO: 2095732 - RNA, 16 nt, Homo sapiens
ccuaauaacgugaaac

SEQ ID NO: 2095733 - RNA, 14 nt, Homo sapiens
auucccauaacaua

SEQ ID NO: 2095734 - RNA, 22 nt, Homo sapiens
uagugguauagaguacugcaga

SEQ ID NO: 2095735 - RNA, 20 nt, Homo sapiens
gcacuuuauaaacacuguau

SEQ ID NO: 2095736 - RNA, 15 nt, Homo sapiens
uaggacagcauauaa

SEQ ID NO: 2095737 - RNA, 18 nt, Homo sapiens
gaucacuuuugcacauuc

SEQ ID NO: 2095738 - RNA, 22 nt, Homo sapiens
cugugaagagacuuuauugccu

SEQ ID NO: 2095739 - RNA, 15 nt, Homo sapiens
uccaucucaaaaaau

SEQ ID NO: 2095740 - RNA, 13 nt, Homo sapiens
guaccugugcacg

SEQ ID NO: 2095741 - RNA, 17 nt, Homo sapiens
gcgucugugugugccug

SEQ ID NO: 2095742 - RNA, 16 nt, Homo sapiens
guguguaguaaaguau

SEQ ID NO: 2095743 - RNA, 14 nt, Homo sapiens
cagggaacugaccc

SEQ ID NO: 2095744 - RNA, 15 nt, Homo sapiens
agcauuccacacugc

SEQ ID NO: 2095745 - RNA, 17 nt, Homo sapiens
gaugaacuguggugcca

SEQ ID NO: 2095746 - RNA, 23 nt, Homo sapiens
ccucagcuuggcacucaggugcu

SEQ ID NO: 2095747 - RNA, 23 nt, Homo sapiens
augccuguaaucccagcacuuug

SEQ ID NO: 2095748 - RNA, 15 nt, Homo sapiens
ugacaagauggaaaa

SEQ ID NO: 2095749 - RNA, 12 nt, Homo sapiens
gacaaccaaaag

SEQ ID NO: 2095750 - RNA, 14 nt, Homo sapiens
gugccuugccacau

SEQ ID NO: 2095751 - RNA, 19 nt, Homo sapiens
ucugccacccacucaggau

SEQ ID NO: 2095752 - RNA, 21 nt, Homo sapiens
cucugugggugcuacacagaa

SEQ ID NO: 2095753 - RNA, 13 nt, Homo sapiens
gcaugcauucuag

SEQ ID NO: 2095754 - RNA, 16 nt, Homo sapiens
ccaggcgugauggcag

SEQ ID NO: 2095755 - RNA, 19 nt, Homo sapiens
agauuuuuuuuggacuguu

SEQ ID NO: 2095756 - RNA, 15 nt, Homo sapiens
auggcagucccaaag

SEQ ID NO: 2095757 - RNA, 14 nt, Homo sapiens
uauuuagacaugua

SEQ ID NO: 2095758 - RNA, 18 nt, Homo sapiens
caccccgauagugacaca

SEQ ID NO: 2095759 - RNA, 22 nt, Homo sapiens
ccaucuucacucuucacuugag

SEQ ID NO: 2095760 - RNA, 22 nt, Homo sapiens
ugcucacuaccuccucagggau

SEQ ID NO: 2095761 - RNA, 23 nt, Homo sapiens
caaccuguucuuccuaccaaaua

SEQ ID NO: 2095762 - RNA, 16 nt, Homo sapiens
cccagcacugauguug

SEQ ID NO: 2095763 - RNA, 13 nt, Homo sapiens
auuuaaaacauuu

SEQ ID NO: 2095764 - RNA, 11 nt, Homo sapiens
ugcugacaaag

SEQ ID NO: 2095765 - RNA, 15 nt, Homo sapiens
agguagugaguaauu

SEQ ID NO: 2095766 - RNA, 22 nt, Homo sapiens
acccgagcccagcuacauuccu

SEQ ID NO: 2095767 - RNA, 16 nt, Homo sapiens
guaagcagaauggagu

SEQ ID NO: 2095768 - RNA, 16 nt, Homo sapiens
caaauuuugauccuaa

SEQ ID NO: 2095769 - RNA, 20 nt, Homo sapiens
ucccggcgucccuaccuccu

SEQ ID NO: 2095770 - RNA, 10 nt, Homo sapiens
uccuuuuugu

SEQ ID NO: 2095771 - RNA, 15 nt, Homo sapiens
gaggacagcuucccc

SEQ ID NO: 2095772 - RNA, 18 nt, Homo sapiens
guuaugcauuuuuuacca

SEQ ID NO: 2095773 - RNA, 14 nt, Homo sapiens
aggaaucugccauu

SEQ ID NO: 2095774 - RNA, 18 nt, Homo sapiens
gagcugagccaggcuagc

SEQ ID NO: 2095775 - RNA, 21 nt, Homo sapiens
gccaugcagaccucaugccca

SEQ ID NO: 2095776 - RNA, 20 nt, Homo sapiens
ccuugugaugucauacagag

SEQ ID NO: 2095777 - RNA, 14 nt, Homo sapiens
gauuuggacugcau

SEQ ID NO: 2095778 - RNA, 21 nt, Homo sapiens
acgaggccaaggcugaaacca

SEQ ID NO: 2095779 - RNA, 19 nt, Homo sapiens
uccuagccaacaucgugaa

SEQ ID NO: 2095780 - RNA, 14 nt, Homo sapiens
gcgcucgcccagca

SEQ ID NO: 2095781 - RNA, 22 nt, Homo sapiens
uucuuaaccccaguaagccacu

SEQ ID NO: 2095782 - RNA, 15 nt, Homo sapiens
aaaacuauauucuca

SEQ ID NO: 2095783 - RNA, 20 nt, Homo sapiens
gaugguuucaauaaaccuaa

SEQ ID NO: 2095784 - RNA, 12 nt, Homo sapiens
ucaaaucuccag

SEQ ID NO: 2095785 - RNA, 12 nt, Homo sapiens
uuuuuuccacaa

SEQ ID NO: 2095786 - RNA, 19 nt, Homo sapiens
gugcaucacaucugcacac

SEQ ID NO: 2095787 - RNA, 14 nt, Homo sapiens
gaugaacacaggca

SEQ ID NO: 2095788 - RNA, 22 nt, Homo sapiens
cuccacccugcauuuuccucuu

SEQ ID NO: 2095789 - RNA, 18 nt, Homo sapiens
ccaggcccacucaggggu

SEQ ID NO: 2095790 - RNA, 14 nt, Homo sapiens
ccuguauauuccau

SEQ ID NO: 2095791 - RNA, 16 nt, Homo sapiens
cugacauucacugagu

SEQ ID NO: 2095792 - RNA, 17 nt, Homo sapiens
caagguuacuuaauuca

SEQ ID NO: 2095793 - RNA, 18 nt, Homo sapiens
uuagcaaagcaugccaau

SEQ ID NO: 2095794 - RNA, 15 nt, Homo sapiens
uuauugcgcugcuac

SEQ ID NO: 2095795 - RNA, 14 nt, Homo sapiens
guaggggcagggag

SEQ ID NO: 2095796 - RNA, 21 nt, Homo sapiens
ccagacuggacaggcaaagac

SEQ ID NO: 2095797 - RNA, 20 nt, Homo sapiens
cugaguagcugggauuacag

SEQ ID NO: 2095798 - RNA, 16 nt, Homo sapiens
aaaaucccuccaccuu

SEQ ID NO: 2095799 - RNA, 13 nt, Homo sapiens
ugcacacuuugcc

SEQ ID NO: 2095800 - RNA, 13 nt, Homo sapiens
gucccacugggac

SEQ ID NO: 2095801 - RNA, 14 nt, Homo sapiens
gccaaacacauuaa

SEQ ID NO: 2095802 - RNA, 20 nt, Homo sapiens
augaguuggacuucagucuu

SEQ ID NO: 2095803 - RNA, 21 nt, Homo sapiens
cuguguugcccugacuggagu

SEQ ID NO: 2095804 - RNA, 14 nt, Homo sapiens
cucuauagagccaa

SEQ ID NO: 2095805 - RNA, 15 nt, Homo sapiens
aagauucugucuuau

SEQ ID NO: 2095806 - RNA, 17 nt, Homo sapiens
gguccaaauucuuuauu

SEQ ID NO: 2095807 - RNA, 20 nt, Homo sapiens
cacuucuuacaauaauucua

SEQ ID NO: 2095808 - RNA, 20 nt, Homo sapiens
cauuaguaucacaaaaccac

SEQ ID NO: 2095809 - RNA, 23 nt, Homo sapiens
auagaaggcugucuuagugcaaa

SEQ ID NO: 2095810 - RNA, 15 nt, Homo sapiens
agaaguguucacaug

SEQ ID NO: 2095811 - RNA, 23 nt, Homo sapiens
acugaagauaacaagagauuuaa

SEQ ID NO: 2095812 - RNA, 16 nt, Homo sapiens
ggucucgaacuccuga

SEQ ID NO: 2095813 - RNA, 14 nt, Homo sapiens
uugauuuccaacau

SEQ ID NO: 2095814 - RNA, 19 nt, Homo sapiens
aaagcacaugguucaaauc

SEQ ID NO: 2095815 - RNA, 16 nt, Homo sapiens
ggacagcaucaaagag

SEQ ID NO: 2095816 - RNA, 21 nt, Homo sapiens
aaugcaaaaaagccaagcccu

SEQ ID NO: 2095817 - RNA, 15 nt, Homo sapiens
acaacauuaugaucu

SEQ ID NO: 2095818 - RNA, 18 nt, Homo sapiens
acaguuauacauaccucu

SEQ ID NO: 2095819 - RNA, 16 nt, Homo sapiens
ggagcucuucugugcc

SEQ ID NO: 2095820 - RNA, 18 nt, Homo sapiens
acuguaaaggcaagccag

SEQ ID NO: 2095821 - RNA, 22 nt, Homo sapiens
gaccuccucuucccccuuccaa

SEQ ID NO: 2095822 - RNA, 16 nt, Homo sapiens
cugcuucugcacuuca

SEQ ID NO: 2095823 - RNA, 22 nt, Homo sapiens
agcucaggugucccugcacuug

SEQ ID NO: 2095824 - RNA, 21 nt, Homo sapiens
gggcagugucacugaguccuu

SEQ ID NO: 2095825 - RNA, 18 nt, Homo sapiens
aaguguugauuacauaau

SEQ ID NO: 2095826 - RNA, 19 nt, Homo sapiens
augacaaaaaggugcagaa

SEQ ID NO: 2095827 - RNA, 19 nt, Homo sapiens
uucauggcugaagucaccu

SEQ ID NO: 2095828 - RNA, 18 nt, Homo sapiens
aacagcuugaaaacugga

SEQ ID NO: 2095829 - RNA, 20 nt, Homo sapiens
ucuucuccuaaaacuuuaaa

SEQ ID NO: 2095830 - RNA, 14 nt, Homo sapiens
auuagccauuugac

SEQ ID NO: 2095831 - RNA, 21 nt, Homo sapiens
ugcugcccucagggacugcac

SEQ ID NO: 2095832 - RNA, 13 nt, Homo sapiens
aaauuagcuugag

SEQ ID NO: 2095833 - RNA, 23 nt, Homo sapiens
cugaggcaugaaaauuguguuac

SEQ ID NO: 2095834 - RNA, 22 nt, Homo sapiens
uaguuugcauuccugauaugau

SEQ ID NO: 2095835 - RNA, 22 nt, Homo sapiens
agaguguaacauccagcucuau

SEQ ID NO: 2095836 - RNA, 16 nt, Homo sapiens
gccuuuccucggucuc

SEQ ID NO: 2095837 - RNA, 14 nt, Homo sapiens
cacuguccugacca

SEQ ID NO: 2095838 - RNA, 15 nt, Homo sapiens
cacaucccuuugaaa

SEQ ID NO: 2095839 - RNA, 15 nt, Homo sapiens
ugcacuguccugacc

SEQ ID NO: 2095840 - RNA, 23 nt, Homo sapiens
ggauagugggcaccccacugcaa

SEQ ID NO: 2095841 - RNA, 15 nt, Homo sapiens
ggcacaucauuggaa

SEQ ID NO: 2095842 - RNA, 22 nt, Homo sapiens
ucagggcugccacuaaccugua

SEQ ID NO: 2095843 - RNA, 18 nt, Homo sapiens
cugugggaagcucccaga

SEQ ID NO: 2095844 - RNA, 14 nt, Homo sapiens
guucuccaggugau

SEQ ID NO: 2095845 - RNA, 12 nt, Homo sapiens
ggaaugcaaaaa

SEQ ID NO: 2095846 - RNA, 18 nt, Homo sapiens
gucuccuggacucagggu

SEQ ID NO: 2095847 - RNA, 23 nt, Homo sapiens
auagauugaguuauuaacuguau

SEQ ID NO: 2095848 - RNA, 13 nt, Homo sapiens
cuguaaacauauu

SEQ ID NO: 2095849 - RNA, 11 nt, Homo sapiens
uaagcugugau

SEQ ID NO: 2095850 - RNA, 16 nt, Homo sapiens
aagcaagaaugcagua

SEQ ID NO: 2095851 - RNA, 20 nt, Homo sapiens
aggccaggugcaguggcuca

SEQ ID NO: 2095852 - RNA, 23 nt, Homo sapiens
cucuagaacagccagacccugca

SEQ ID NO: 2095853 - RNA, 15 nt, Homo sapiens
agcugauucacuaug

SEQ ID NO: 2095854 - RNA, 16 nt, Homo sapiens
ccacugugcguuuuag

SEQ ID NO: 2095855 - RNA, 21 nt, Homo sapiens
gcucacguuaccuugacacau

SEQ ID NO: 2095856 - RNA, 14 nt, Homo sapiens
ccagcaucccgcgc

SEQ ID NO: 2095857 - RNA, 19 nt, Homo sapiens
gucuggccuuuucuuguaa

SEQ ID NO: 2095858 - RNA, 20 nt, Homo sapiens
aauaaugcacugaguaugca

SEQ ID NO: 2095859 - RNA, 14 nt, Homo sapiens
ugagaaauggcagu

SEQ ID NO: 2095860 - RNA, 13 nt, Homo sapiens
agcaaggcugcua

SEQ ID NO: 2095861 - RNA, 18 nt, Homo sapiens
gaagacuuuuguuaugag

SEQ ID NO: 2095862 - RNA, 16 nt, Homo sapiens
auagucuuuugccaga

SEQ ID NO: 2095863 - RNA, 22 nt, Homo sapiens
aggaagaaauucagguacagaa

SEQ ID NO: 2095864 - RNA, 20 nt, Homo sapiens
ugcacaguugccacauuuag

SEQ ID NO: 2095865 - RNA, 19 nt, Homo sapiens
ugguucugcaaugacugca

SEQ ID NO: 2095866 - RNA, 18 nt, Homo sapiens
uaacuuuugguaucuacu

SEQ ID NO: 2095867 - RNA, 13 nt, Homo sapiens
gacuuugugccau

SEQ ID NO: 2095868 - RNA, 20 nt, Homo sapiens
cuucagaagacacugcaaag

SEQ ID NO: 2095869 - RNA, 14 nt, Homo sapiens
acacuguuugccca

SEQ ID NO: 2095870 - RNA, 15 nt, Homo sapiens
ugccuccaccaccac

SEQ ID NO: 2095871 - RNA, 20 nt, Homo sapiens
accccgacuaucccugcaca

SEQ ID NO: 2095872 - RNA, 20 nt, Homo sapiens
cagagguugcagugagccga

SEQ ID NO: 2095873 - RNA, 22 nt, Homo sapiens
aaugggacaaaauaaauuguga

SEQ ID NO: 2095874 - RNA, 15 nt, Homo sapiens
agcgucaagacauuu

SEQ ID NO: 2095875 - RNA, 20 nt, Homo sapiens
gcccuggacaagccacagcc

SEQ ID NO: 2095876 - RNA, 21 nt, Homo sapiens
cccaugguagacugugacaca

SEQ ID NO: 2095877 - RNA, 15 nt, Homo sapiens
gcucgcccacuuccu

SEQ ID NO: 2095878 - RNA, 17 nt, Homo sapiens
auucuucagucuggacu

SEQ ID NO: 2095879 - RNA, 23 nt, Homo sapiens
ccacuuaccuagauucuacauau

SEQ ID NO: 2095880 - RNA, 15 nt, Homo sapiens
gacccuugcugugaa

SEQ ID NO: 2095881 - RNA, 22 nt, Homo sapiens
gacagaguguccuuccucuguc

SEQ ID NO: 2095882 - RNA, 18 nt, Homo sapiens
uucaaucuguaaacugug

SEQ ID NO: 2095883 - RNA, 16 nt, Homo sapiens
uuacagggaaugccug

SEQ ID NO: 2095884 - RNA, 14 nt, Homo sapiens
ugugcagacugugg

SEQ ID NO: 2095885 - RNA, 14 nt, Homo sapiens
uccucauccaugca

SEQ ID NO: 2095886 - RNA, 14 nt, Homo sapiens
auucaccaauauca

SEQ ID NO: 2095887 - RNA, 16 nt, Homo sapiens
gcugcuuaugagcaca

SEQ ID NO: 2095888 - RNA, 19 nt, Homo sapiens
acgcucaguaaccaugcaa

SEQ ID NO: 2095889 - RNA, 16 nt, Homo sapiens
acccuaagccaagacc

SEQ ID NO: 2095890 - RNA, 15 nt, Homo sapiens
cauuucuuugaauuu

SEQ ID NO: 2095891 - RNA, 23 nt, Homo sapiens
uugcucccugauuaaagugccuu

SEQ ID NO: 2095892 - RNA, 20 nt, Homo sapiens
aagaauuuuaauauugccau

SEQ ID NO: 2095893 - RNA, 18 nt, Homo sapiens
uccagcuugggugauaaa

SEQ ID NO: 2095894 - RNA, 19 nt, Homo sapiens
ugcaacuuuuaauuacugu

SEQ ID NO: 2095895 - RNA, 15 nt, Homo sapiens
gaagaaagacacaaa

SEQ ID NO: 2095896 - RNA, 18 nt, Homo sapiens
ggcacauuggcagugugu

SEQ ID NO: 2095897 - RNA, 17 nt, Homo sapiens
gcaacccucacuguguu

SEQ ID NO: 2095898 - RNA, 14 nt, Homo sapiens
cacagaagcugaaa

SEQ ID NO: 2095899 - RNA, 21 nt, Homo sapiens
ccauggggcugauuguauuua

SEQ ID NO: 2095900 - RNA, 20 nt, Homo sapiens
caggggcgugaggucccagg

SEQ ID NO: 2095901 - RNA, 16 nt, Homo sapiens
ucaauacuuaccuaau

SEQ ID NO: 2095902 - RNA, 20 nt, Homo sapiens
gaccccagcuuuucuugcca

SEQ ID NO: 2095903 - RNA, 17 nt, Homo sapiens
ucccagcugaaggcagu

SEQ ID NO: 2095904 - RNA, 20 nt, Homo sapiens
ggcacaaauuguacauuuga

SEQ ID NO: 2095905 - RNA, 14 nt, Homo sapiens
accaagcuauucaa

SEQ ID NO: 2095906 - RNA, 16 nt, Homo sapiens
ugucguccugcagugu

SEQ ID NO: 2095907 - RNA, 13 nt, Homo sapiens
aggaaauguggaa

SEQ ID NO: 2095908 - RNA, 13 nt, Homo sapiens
agaugaugugaug

SEQ ID NO: 2095909 - RNA, 19 nt, Homo sapiens
ccaaaacaucaauguuuau

SEQ ID NO: 2095910 - RNA, 16 nt, Homo sapiens
caggagucagugucug

SEQ ID NO: 2095911 - RNA, 15 nt, Homo sapiens
caccuuugccauuga

SEQ ID NO: 2095912 - RNA, 21 nt, Homo sapiens
cuucaaucuucauuuuggagg

SEQ ID NO: 2095913 - RNA, 17 nt, Homo sapiens
gcugcagucacaucaca

SEQ ID NO: 2095914 - RNA, 13 nt, Homo sapiens
agaacaagccacc

SEQ ID NO: 2095915 - RNA, 22 nt, Homo sapiens
uugaagacaauuugauacauaa

SEQ ID NO: 2095916 - RNA, 14 nt, Homo sapiens
cauauguaugacuc

SEQ ID NO: 2095917 - RNA, 17 nt, Homo sapiens
gcucucguucuccuucc

SEQ ID NO: 2095918 - RNA, 22 nt, Homo sapiens
cugcaugacaaacacacaucca

SEQ ID NO: 2095919 - RNA, 21 nt, Homo sapiens
uucgcacaaucuacacugccu

SEQ ID NO: 2095920 - RNA, 14 nt, Homo sapiens
cuugucagauguau

SEQ ID NO: 2095921 - RNA, 17 nt, Homo sapiens
agcagccuggagaccca

SEQ ID NO: 2095922 - RNA, 12 nt, Homo sapiens
cuguauaugcau

SEQ ID NO: 2095923 - RNA, 15 nt, Homo sapiens
ugauuguauuuaccu

SEQ ID NO: 2095924 - RNA, 14 nt, Homo sapiens
ggaagguucucugu

SEQ ID NO: 2095925 - RNA, 15 nt, Homo sapiens
gcaucccggccaggu

SEQ ID NO: 2095926 - RNA, 21 nt, Homo sapiens
agauuccagaaaucugcugca

SEQ ID NO: 2095927 - RNA, 20 nt, Homo sapiens
ggaaagcuuaaaacccaaua

SEQ ID NO: 2095928 - RNA, 21 nt, Homo sapiens
gaggguuucauugucugugaa

SEQ ID NO: 2095929 - RNA, 15 nt, Homo sapiens
cagcugaagggugac

SEQ ID NO: 2095930 - RNA, 19 nt, Homo sapiens
auaaauauuuugcauauaa

SEQ ID NO: 2095931 - RNA, 13 nt, Homo sapiens
cugcgacugauga

SEQ ID NO: 2095932 - RNA, 13 nt, Homo sapiens
uaugcuguuuccu

SEQ ID NO: 2095933 - RNA, 17 nt, Homo sapiens
uauaauguuguauuuaa

SEQ ID NO: 2095934 - RNA, 16 nt, Homo sapiens
cugaguaguaaucuca

SEQ ID NO: 2095935 - RNA, 21 nt, Homo sapiens
caguguaugcucauacuugga

SEQ ID NO: 2095936 - RNA, 16 nt, Homo sapiens
uggggaaggguuugaa

SEQ ID NO: 2095937 - RNA, 11 nt, Homo sapiens
gacuuccugua

SEQ ID NO: 2095938 - RNA, 23 nt, Homo sapiens
aagcaguuggggcccucuugcca

SEQ ID NO: 2095939 - RNA, 10 nt, Homo sapiens
ggagccagcu

SEQ ID NO: 2095940 - RNA, 17 nt, Homo sapiens
gauuuuuguauguuaug

SEQ ID NO: 2095941 - RNA, 12 nt, Homo sapiens
accucacaguga

SEQ ID NO: 2095942 - RNA, 23 nt, Homo sapiens
agauaguuguguuuuuauuguua

SEQ ID NO: 2095943 - RNA, 15 nt, Homo sapiens
uuuucagccaugugg

SEQ ID NO: 2095944 - RNA, 19 nt, Homo sapiens
uuagauuuuaaaacuucau

SEQ ID NO: 2095945 - RNA, 16 nt, Homo sapiens
cagggcagaaaacaca

SEQ ID NO: 2095946 - RNA, 17 nt, Homo sapiens
ugaacucuuucuggccu

SEQ ID NO: 2095947 - RNA, 18 nt, Homo sapiens
aauuaguuaacaguuuuu

SEQ ID NO: 2095948 - RNA, 16 nt, Homo sapiens
aauguagcugucuccu

SEQ ID NO: 2095949 - RNA, 12 nt, Homo sapiens
aaacacuugaac

SEQ ID NO: 2095950 - RNA, 14 nt, Homo sapiens
gguuucaccugggc

SEQ ID NO: 2095951 - RNA, 19 nt, Homo sapiens
agggcucuuucacagcugg

SEQ ID NO: 2095952 - RNA, 23 nt, Homo sapiens
guuuucuuucucacccaggcaau

SEQ ID NO: 2095953 - RNA, 14 nt, Homo sapiens
agcuuuuguagaag

SEQ ID NO: 2095954 - RNA, 20 nt, Homo sapiens
uuaauccaguguuacugugu

SEQ ID NO: 2095955 - RNA, 11 nt, Homo sapiens
auaccaggugc

SEQ ID NO: 2095956 - RNA, 18 nt, Homo sapiens
auccugagugugaugaac

SEQ ID NO: 2095957 - RNA, 22 nt, Homo sapiens
guccacagaccuacugcacuga

SEQ ID NO: 2095958 - RNA, 13 nt, Homo sapiens
cccugugggucaa

SEQ ID NO: 2095959 - RNA, 18 nt, Homo sapiens
ucuuaguauaugaaagga

SEQ ID NO: 2095960 - RNA, 19 nt, Homo sapiens
ugcuaccuuugucucacga

SEQ ID NO: 2095961 - RNA, 16 nt, Homo sapiens
gaaaaaucauaacuca

SEQ ID NO: 2095962 - RNA, 14 nt, Homo sapiens
caggacucagugau

SEQ ID NO: 2095963 - RNA, 23 nt, Homo sapiens
ccuccugggacugugacugcuuu

SEQ ID NO: 2095964 - RNA, 18 nt, Homo sapiens
ccaugacaccugccauac

SEQ ID NO: 2095965 - RNA, 15 nt, Homo sapiens
cuuccuuucuugucu

SEQ ID NO: 2095966 - RNA, 15 nt, Homo sapiens
aaggccuuaagcuuu

SEQ ID NO: 2095967 - RNA, 12 nt, Homo sapiens
ucuccagcauca

SEQ ID NO: 2095968 - RNA, 17 nt, Homo sapiens
cguuccccgcuagguca

SEQ ID NO: 2095969 - RNA, 16 nt, Homo sapiens
ggucucuacuguggca

SEQ ID NO: 2095970 - RNA, 17 nt, Homo sapiens
ggggacaagggauuuga

SEQ ID NO: 2095971 - RNA, 17 nt, Homo sapiens
auuaauaguuugucuau

SEQ ID NO: 2095972 - RNA, 16 nt, Homo sapiens
guaagacuaaaucugu

SEQ ID NO: 2095973 - RNA, 20 nt, Homo sapiens
uucauaucucucccuucuuu

SEQ ID NO: 2095974 - RNA, 21 nt, Homo sapiens
ucaauaaaaugaaccugauca

SEQ ID NO: 2095975 - RNA, 13 nt, Homo sapiens
cacuguccagggc

SEQ ID NO: 2095976 - RNA, 20 nt, Homo sapiens
acaguguaggcauuuaacuc

SEQ ID NO: 2095977 - RNA, 20 nt, Homo sapiens
ggucucaggagaagggauag

SEQ ID NO: 2095978 - RNA, 17 nt, Homo sapiens
acagcauucuugucaca

SEQ ID NO: 2095979 - RNA, 20 nt, Homo sapiens
cucacaaguggguaccccca

SEQ ID NO: 2095980 - RNA, 19 nt, Homo sapiens
guagcagauaaagacagcu

SEQ ID NO: 2095981 - RNA, 19 nt, Homo sapiens
auuacuugaaguauccaca

SEQ ID NO: 2095982 - RNA, 23 nt, Homo sapiens
agagggguggaguuuuaacugua

SEQ ID NO: 2095983 - RNA, 20 nt, Homo sapiens
ugccacccaguugugacaau

SEQ ID NO: 2095984 - RNA, 13 nt, Homo sapiens
cggcccugaccaa

SEQ ID NO: 2095985 - RNA, 20 nt, Homo sapiens
acccuauuuguuucauuaaa

SEQ ID NO: 2095986 - RNA, 16 nt, Homo sapiens
gucugcccuagggaga

SEQ ID NO: 2095987 - RNA, 17 nt, Homo sapiens
aauaacuauuuuuccuc

SEQ ID NO: 2095988 - RNA, 23 nt, Homo sapiens
auauuaauuuguuuuucuuaucc

SEQ ID NO: 2095989 - RNA, 19 nt, Homo sapiens
cacuaaaaaggcauguaau

SEQ ID NO: 2095990 - RNA, 22 nt, Homo sapiens
cuauaacuugaugcaugugguu

SEQ ID NO: 2095991 - RNA, 12 nt, Homo sapiens
gccaagcaguuu

SEQ ID NO: 2095992 - RNA, 16 nt, Homo sapiens
augacugaugacauau

SEQ ID NO: 2095993 - RNA, 22 nt, Homo sapiens
acaguucagccuuuaucaagcu

SEQ ID NO: 2095994 - RNA, 14 nt, Homo sapiens
uagugucauccuca

SEQ ID NO: 2095995 - RNA, 16 nt, Homo sapiens
auucacacaacuacuu

SEQ ID NO: 2095996 - RNA, 17 nt, Homo sapiens
gcuccaggccugcagca

SEQ ID NO: 2095997 - RNA, 21 nt, Homo sapiens
aaaagcuuuaaaugucugcau

SEQ ID NO: 2095998 - RNA, 19 nt, Homo sapiens
uuaauuuuuauaaauaugu

SEQ ID NO: 2095999 - RNA, 19 nt, Homo sapiens
auaaauuaugaauauuaaa

SEQ ID NO: 2096000 - RNA, 13 nt, Homo sapiens
accuccuucccca

SEQ ID NO: 2096001 - RNA, 23 nt, Homo sapiens
cuucugcccuuaccccacacaca

SEQ ID NO: 2096002 - RNA, 14 nt, Homo sapiens
cuuacuguugcaua

SEQ ID NO: 2096003 - RNA, 22 nt, Homo sapiens
accugcccacaacucccuugca

SEQ ID NO: 2096004 - RNA, 23 nt, Homo sapiens
aacuuagccauuuuucaaagcaa

SEQ ID NO: 2096005 - RNA, 11 nt, Homo sapiens
gaagaaagccu

SEQ ID NO: 2096006 - RNA, 22 nt, Homo sapiens
augacagaauuugugaauauau

SEQ ID NO: 2096007 - RNA, 17 nt, Homo sapiens
ucucaagaacugccaua

SEQ ID NO: 2096008 - RNA, 14 nt, Homo sapiens
uguggugaggggcu

SEQ ID NO: 2096009 - RNA, 14 nt, Homo sapiens
ccacucugccauuc

SEQ ID NO: 2096010 - RNA, 14 nt, Homo sapiens
ucuuaaugucucaa

SEQ ID NO: 2096011 - RNA, 17 nt, Homo sapiens
ggaagucagcaugccuc

SEQ ID NO: 2096012 - RNA, 23 nt, Homo sapiens
ucugagcuguaauuucgccuuaa

SEQ ID NO: 2096013 - RNA, 20 nt, Homo sapiens
ggagggugguucaacaaaga

SEQ ID NO: 2096014 - RNA, 16 nt, Homo sapiens
aagaugcgcauucuaa

SEQ ID NO: 2096015 - RNA, 17 nt, Homo sapiens
augauuguuauguguau

SEQ ID NO: 2096016 - RNA, 16 nt, Homo sapiens
ggcacucacaugccgc

SEQ ID NO: 2096017 - RNA, 20 nt, Homo sapiens
guuaauaagugguaucugac

SEQ ID NO: 2096018 - RNA, 16 nt, Homo sapiens
uccucucccucaucaa

SEQ ID NO: 2096019 - RNA, 13 nt, Homo sapiens
auauuauacuugu

SEQ ID NO: 2096020 - RNA, 18 nt, Homo sapiens
gccucugccuuaucucau

SEQ ID NO: 2096021 - RNA, 21 nt, Homo sapiens
ccaaagacagucuucuaauuc

SEQ ID NO: 2096022 - RNA, 20 nt, Homo sapiens
aguuguuccuuaagucagaa

SEQ ID NO: 2096023 - RNA, 22 nt, Homo sapiens
cacuaugaggaauaauuauuua

SEQ ID NO: 2096024 - RNA, 16 nt, Homo sapiens
uuccaaacacauacag

SEQ ID NO: 2096025 - RNA, 15 nt, Homo sapiens
ucuaucuacagcuua

SEQ ID NO: 2096026 - RNA, 19 nt, Homo sapiens
ucuacucuuuugaaguguu

SEQ ID NO: 2096027 - RNA, 17 nt, Homo sapiens
cgagcugugcucgggug

SEQ ID NO: 2096028 - RNA, 21 nt, Homo sapiens
ucagcccccaccacaaacaca

SEQ ID NO: 2096029 - RNA, 13 nt, Homo sapiens
aaaacugcagugu

SEQ ID NO: 2096030 - RNA, 22 nt, Homo sapiens
uaaguagggacuucugucuuca

SEQ ID NO: 2096031 - RNA, 19 nt, Homo sapiens
cauggacaucuacccagau

SEQ ID NO: 2096032 - RNA, 18 nt, Homo sapiens
uucugaugagacugcagc

SEQ ID NO: 2096033 - RNA, 12 nt, Homo sapiens
gguuccauccac

SEQ ID NO: 2096034 - RNA, 21 nt, Homo sapiens
uguuuaugaauaguuuccaaa

SEQ ID NO: 2096035 - RNA, 15 nt, Homo sapiens
accucugguccacac

SEQ ID NO: 2096036 - RNA, 20 nt, Homo sapiens
auuuuuuuuuccaaaacaau

SEQ ID NO: 2096037 - RNA, 13 nt, Homo sapiens
aucuggugccucu

SEQ ID NO: 2096038 - RNA, 17 nt, Homo sapiens
ucaaaacaaguacuggu

SEQ ID NO: 2096039 - RNA, 20 nt, Homo sapiens
ugcacaaaaagaugcaucua

SEQ ID NO: 2096040 - RNA, 15 nt, Homo sapiens
acucagagacuucac

SEQ ID NO: 2096041 - RNA, 23 nt, Homo sapiens
uugauguauauaucuauuauuca

SEQ ID NO: 2096042 - RNA, 23 nt, Homo sapiens
uuugauugaggagcugcacugau

SEQ ID NO: 2096043 - RNA, 18 nt, Homo sapiens
guuugucuguuuguuuca

SEQ ID NO: 2096044 - RNA, 12 nt, Homo sapiens
cuggagcccacu

SEQ ID NO: 2096045 - RNA, 21 nt, Homo sapiens
aaucaacuugucacaaaguga

SEQ ID NO: 2096046 - RNA, 15 nt, Homo sapiens
uaugccucugagcag

SEQ ID NO: 2096047 - RNA, 13 nt, Homo sapiens
aaauaacacugua

SEQ ID NO: 2096048 - RNA, 23 nt, Homo sapiens
ccccuuacugagcgcaagccaca

SEQ ID NO: 2096049 - RNA, 13 nt, Homo sapiens
gaacaggggccaa

SEQ ID NO: 2096050 - RNA, 21 nt, Homo sapiens
cuucaaggaacucaguuuaau

SEQ ID NO: 2096051 - RNA, 15 nt, Homo sapiens
agacuuucucugugu

SEQ ID NO: 2096052 - RNA, 18 nt, Homo sapiens
cauacgcaauuguauaua

SEQ ID NO: 2096053 - RNA, 13 nt, Homo sapiens
auaaauaagcaaa

SEQ ID NO: 2096054 - RNA, 20 nt, Homo sapiens
gaaccugugcucauuuugca

SEQ ID NO: 2096055 - RNA, 20 nt, Homo sapiens
caaaauguuguccuuucccc

SEQ ID NO: 2096056 - RNA, 15 nt, Homo sapiens
ccaucucuuguuuaa

SEQ ID NO: 2096057 - RNA, 14 nt, Homo sapiens
aagaacugcaucug

SEQ ID NO: 2096058 - RNA, 15 nt, Homo sapiens
aacuguuaccaguug

SEQ ID NO: 2096059 - RNA, 13 nt, Homo sapiens
aacagcaaauaac

SEQ ID NO: 2096060 - RNA, 20 nt, Homo sapiens
auucuugccuuguaccucaa

SEQ ID NO: 2096061 - RNA, 16 nt, Homo sapiens
agacuuaaagcacuga

SEQ ID NO: 2096062 - RNA, 11 nt, Homo sapiens
gguacacuggu

SEQ ID NO: 2096063 - RNA, 11 nt, Homo sapiens
gagacacugag

SEQ ID NO: 2096064 - RNA, 15 nt, Homo sapiens
acuuuaucaaugugu

SEQ ID NO: 2096065 - RNA, 15 nt, Homo sapiens
gaaucuguacauguu

SEQ ID NO: 2096066 - RNA, 16 nt, Homo sapiens
ugaucuguaacagggu

SEQ ID NO: 2096067 - RNA, 21 nt, Homo sapiens
acuuauaagugagaacaugca

SEQ ID NO: 2096068 - RNA, 18 nt, Homo sapiens
cugccuugaagccacuga

SEQ ID NO: 2096069 - RNA, 16 nt, Homo sapiens
auacccacacauucca

SEQ ID NO: 2096070 - RNA, 19 nt, Homo sapiens
aagcauuuuaaaugucagu

SEQ ID NO: 2096071 - RNA, 19 nt, Homo sapiens
agacccuguucuaacucuu

SEQ ID NO: 2096072 - RNA, 16 nt, Homo sapiens
uacacucuagugccau

SEQ ID NO: 2096073 - RNA, 19 nt, Homo sapiens
cuuucaagggaccucucca

SEQ ID NO: 2096074 - RNA, 17 nt, Homo sapiens
uagaagccaugggaccu

SEQ ID NO: 2096075 - RNA, 14 nt, Homo sapiens
cucuccagaccuga

SEQ ID NO: 2096076 - RNA, 17 nt, Homo sapiens
ccuccugggaccaugga

SEQ ID NO: 2096077 - RNA, 12 nt, Homo sapiens
auacacuugaag

SEQ ID NO: 2096078 - RNA, 12 nt, Homo sapiens
aagcacuugugg

SEQ ID NO: 2096079 - RNA, 20 nt, Homo sapiens
cuauuuaaaaaaaaagucag

SEQ ID NO: 2096080 - RNA, 21 nt, Homo sapiens
ucuggacaaagacuaccugag

SEQ ID NO: 2096081 - RNA, 14 nt, Homo sapiens
cucuagaaugagca

SEQ ID NO: 2096082 - RNA, 14 nt, Homo sapiens
ugaaacuccaucuc

SEQ ID NO: 2096083 - RNA, 15 nt, Homo sapiens
uaguaaucacaguug

SEQ ID NO: 2096084 - RNA, 19 nt, Homo sapiens
ccuaggauuucagccaugc

SEQ ID NO: 2096085 - RNA, 21 nt, Homo sapiens
uagugcuguaauauuguaaau

SEQ ID NO: 2096086 - RNA, 16 nt, Homo sapiens
aaauuugagagacaaa

SEQ ID NO: 2096087 - RNA, 22 nt, Homo sapiens
uugaugucauucagcagucagu

SEQ ID NO: 2096088 - RNA, 18 nt, Homo sapiens
gaugugcaagucuuguca

SEQ ID NO: 2096089 - RNA, 21 nt, Homo sapiens
aucuaacuauauguacagcuc

SEQ ID NO: 2096090 - RNA, 18 nt, Homo sapiens
aggccugacccacggggc

SEQ ID NO: 2096091 - RNA, 15 nt, Homo sapiens
acaguggaugcugcu

SEQ ID NO: 2096092 - RNA, 23 nt, Homo sapiens
guauaugauggggcaugugccau

SEQ ID NO: 2096093 - RNA, 16 nt, Homo sapiens
agacuguuaucaggac

SEQ ID NO: 2096094 - RNA, 15 nt, Homo sapiens
ugggauguaccuuuc

SEQ ID NO: 2096095 - RNA, 22 nt, Homo sapiens
agguuuugcuugggaaacucaa

SEQ ID NO: 2096096 - RNA, 16 nt, Homo sapiens
aauauuuuguaauauu

SEQ ID NO: 2096097 - RNA, 13 nt, Homo sapiens
uuggagacggcca

SEQ ID NO: 2096098 - RNA, 14 nt, Homo sapiens
uucaaguugagaac

SEQ ID NO: 2096099 - RNA, 16 nt, Homo sapiens
acuguucacucacucu

SEQ ID NO: 2096100 - RNA, 23 nt, Homo sapiens
auuacuaauaaauugacauaacc

SEQ ID NO: 2096101 - RNA, 16 nt, Homo sapiens
cuauagcaucacuuaa

SEQ ID NO: 2096102 - RNA, 16 nt, Homo sapiens
acgugaagccacagga

SEQ ID NO: 2096103 - RNA, 14 nt, Homo sapiens
aauaauuaaugugu

SEQ ID NO: 2096104 - RNA, 17 nt, Homo sapiens
aacauuacauugccauu

SEQ ID NO: 2096105 - RNA, 16 nt, Homo sapiens
ucccacgucacuugac

SEQ ID NO: 2096106 - RNA, 23 nt, Homo sapiens
uccccuucccacuagccuagguc

SEQ ID NO: 2096107 - RNA, 21 nt, Homo sapiens
cagccaggcuaugguugccac

SEQ ID NO: 2096108 - RNA, 18 nt, Homo sapiens
cugcccacuccacuccuc

SEQ ID NO: 2096109 - RNA, 14 nt, Homo sapiens
caauucguucucug

SEQ ID NO: 2096110 - RNA, 18 nt, Homo sapiens
uuagaccaggcaggcaaa

SEQ ID NO: 2096111 - RNA, 19 nt, Homo sapiens
ugaaccaugugacuguauu

SEQ ID NO: 2096112 - RNA, 14 nt, Homo sapiens
ugcuccagugcagg

SEQ ID NO: 2096113 - RNA, 12 nt, Homo sapiens
gaguucagggag

SEQ ID NO: 2096114 - RNA, 15 nt, Homo sapiens
cugguccuuaccaga

SEQ ID NO: 2096115 - RNA, 21 nt, Homo sapiens
uuccauauauuggcacugcua

SEQ ID NO: 2096116 - RNA, 15 nt, Homo sapiens
uauuuucuccugaua

SEQ ID NO: 2096117 - RNA, 12 nt, Homo sapiens
guaacuguucuu

SEQ ID NO: 2096118 - RNA, 23 nt, Homo sapiens
uuaaaaaaucccuuccugaguaa

SEQ ID NO: 2096119 - RNA, 18 nt, Homo sapiens
acaaaccgagugcaauga

SEQ ID NO: 2096120 - RNA, 14 nt, Homo sapiens
acccaaaguguucu

SEQ ID NO: 2096121 - RNA, 17 nt, Homo sapiens
acccucacgaggugucu

SEQ ID NO: 2096122 - RNA, 16 nt, Homo sapiens
uguacauuuaauaaua

SEQ ID NO: 2096123 - RNA, 23 nt, Homo sapiens
gcuuuuucacagucacugaugua

SEQ ID NO: 2096124 - RNA, 17 nt, Homo sapiens
uacucauuuuauucacu

SEQ ID NO: 2096125 - RNA, 17 nt, Homo sapiens
uucuuaaaaugugcuau

SEQ ID NO: 2096126 - RNA, 23 nt, Homo sapiens
ugauaaguucuuaugccauguua

SEQ ID NO: 2096127 - RNA, 13 nt, Homo sapiens
uggaugcagcucu

SEQ ID NO: 2096128 - RNA, 19 nt, Homo sapiens
accaccucccucaccaaca

SEQ ID NO: 2096129 - RNA, 15 nt, Homo sapiens
cuuuagcugucacuu

SEQ ID NO: 2096130 - RNA, 15 nt, Homo sapiens
cagccgauucaccug

SEQ ID NO: 2096131 - RNA, 12 nt, Homo sapiens
ucucagccucug

SEQ ID NO: 2096132 - RNA, 20 nt, Homo sapiens
caagcugagugacuguaggc

SEQ ID NO: 2096133 - RNA, 21 nt, Homo sapiens
guuuaaucaaugaucaucuca

SEQ ID NO: 2096134 - RNA, 15 nt, Homo sapiens
aacuucaaguucucu

SEQ ID NO: 2096135 - RNA, 18 nt, Homo sapiens
gaauuggaacugcaauga

SEQ ID NO: 2096136 - RNA, 12 nt, Homo sapiens
uggcugccuuug

SEQ ID NO: 2096137 - RNA, 15 nt, Homo sapiens
ucacaagcaauccau

SEQ ID NO: 2096138 - RNA, 18 nt, Homo sapiens
cuucgacccuuucucuga

SEQ ID NO: 2096139 - RNA, 15 nt, Homo sapiens
auguucuauuguggg

SEQ ID NO: 2096140 - RNA, 15 nt, Homo sapiens
agcagggucaucugu

SEQ ID NO: 2096141 - RNA, 15 nt, Homo sapiens
agcccagugcugcug

SEQ ID NO: 2096142 - RNA, 12 nt, Homo sapiens
aaacuagcuuug

SEQ ID NO: 2096143 - RNA, 18 nt, Homo sapiens
uuuuuuaaaaaagcuuaa

SEQ ID NO: 2096144 - RNA, 18 nt, Homo sapiens
gaccuugaaggguaaaga

SEQ ID NO: 2096145 - RNA, 11 nt, Homo sapiens
agacacuugcu

SEQ ID NO: 2096146 - RNA, 12 nt, Homo sapiens
caacuuuccuca

SEQ ID NO: 2096147 - RNA, 22 nt, Homo sapiens
cucggccuccaaggggcuuugu

SEQ ID NO: 2096148 - RNA, 14 nt, Homo sapiens
cauggagaacagca

SEQ ID NO: 2096149 - RNA, 15 nt, Homo sapiens
accaugcaacuuccu

SEQ ID NO: 2096150 - RNA, 21 nt, Homo sapiens
gccagaagaugaacagacuga

SEQ ID NO: 2096151 - RNA, 23 nt, Homo sapiens
uagccagaggcucuaauguacaa

SEQ ID NO: 2096152 - RNA, 22 nt, Homo sapiens
ggauguuuggaaaaaacucuga

SEQ ID NO: 2096153 - RNA, 15 nt, Homo sapiens
ccaugcuuccuugcc

SEQ ID NO: 2096154 - RNA, 22 nt, Homo sapiens
ccccaaugacacccaugccaga

SEQ ID NO: 2096155 - RNA, 14 nt, Homo sapiens
uacucaaacauguu

SEQ ID NO: 2096156 - RNA, 13 nt, Homo sapiens
cacgccuacuuaa

SEQ ID NO: 2096157 - RNA, 17 nt, Homo sapiens
ugacuuucuaaguagga

SEQ ID NO: 2096158 - RNA, 16 nt, Homo sapiens
ccagcggggcuucugg

SEQ ID NO: 2096159 - RNA, 17 nt, Homo sapiens
gcucaaaggcacaguga

SEQ ID NO: 2096160 - RNA, 14 nt, Homo sapiens
gaagauucgaacag

SEQ ID NO: 2096161 - RNA, 20 nt, Homo sapiens
ccagacguggugcuucucac

SEQ ID NO: 2096162 - RNA, 13 nt, Homo sapiens
agcaauugcauaa

SEQ ID NO: 2096163 - RNA, 15 nt, Homo sapiens
gaauggggcaauaac

SEQ ID NO: 2096164 - RNA, 16 nt, Homo sapiens
uauuucuauuccuuau

SEQ ID NO: 2096165 - RNA, 20 nt, Homo sapiens
guaaucuuuaacugaacucu

SEQ ID NO: 2096166 - RNA, 18 nt, Homo sapiens
ucaaaauuaauagcuuuu

SEQ ID NO: 2096167 - RNA, 22 nt, Homo sapiens
ucaacaacaaaacauuugcucu

SEQ ID NO: 2096168 - RNA, 18 nt, Homo sapiens
aauuggcuaaucaguaua

SEQ ID NO: 2096169 - RNA, 20 nt, Homo sapiens
acucagaggaggacauuugg

SEQ ID NO: 2096170 - RNA, 19 nt, Homo sapiens
auaauaaaauucauuccau

SEQ ID NO: 2096171 - RNA, 20 nt, Homo sapiens
auuuuuuaguauaaguacau

SEQ ID NO: 2096172 - RNA, 15 nt, Homo sapiens
uggacucaaucccua

SEQ ID NO: 2096173 - RNA, 21 nt, Homo sapiens
aucaggaguucugccagguuu

SEQ ID NO: 2096174 - RNA, 14 nt, Homo sapiens
ucuagcaguaaaag

SEQ ID NO: 2096175 - RNA, 15 nt, Homo sapiens
agaacuucagaaaga

SEQ ID NO: 2096176 - RNA, 15 nt, Homo sapiens
cauggaaauucccuu

SEQ ID NO: 2096177 - RNA, 23 nt, Homo sapiens
uguggucauaucuagucacuugu

SEQ ID NO: 2096178 - RNA, 19 nt, Homo sapiens
gcagcugguggaagaccug

SEQ ID NO: 2096179 - RNA, 18 nt, Homo sapiens
cuagaauagucucacugu

SEQ ID NO: 2096180 - RNA, 22 nt, Homo sapiens
ugccaugugcuaguaauuggaa

SEQ ID NO: 2096181 - RNA, 16 nt, Homo sapiens
cugauuugcauauuca

SEQ ID NO: 2096182 - RNA, 13 nt, Homo sapiens
aaugacacuucuu

SEQ ID NO: 2096183 - RNA, 18 nt, Homo sapiens
caggcauaugagugcgca

SEQ ID NO: 2096184 - RNA, 15 nt, Homo sapiens
cuggagcccuguugg

SEQ ID NO: 2096185 - RNA, 15 nt, Homo sapiens
acuguagcacuuaac

SEQ ID NO: 2096186 - RNA, 14 nt, Homo sapiens
cucagccccuagga

SEQ ID NO: 2096187 - RNA, 18 nt, Homo sapiens
cugcuguucuguguacau

SEQ ID NO: 2096188 - RNA, 17 nt, Homo sapiens
auccuagggcacuucua

SEQ ID NO: 2096189 - RNA, 20 nt, Homo sapiens
uccucauuuguaaucuaguu

SEQ ID NO: 2096190 - RNA, 12 nt, Homo sapiens
gcagaacaguga

SEQ ID NO: 2096191 - RNA, 18 nt, Homo sapiens
uagguguacuguacugaa

SEQ ID NO: 2096192 - RNA, 20 nt, Homo sapiens
aaaagcuucuuaauuaauuu

SEQ ID NO: 2096193 - RNA, 18 nt, Homo sapiens
cugagaugugaacacauc

SEQ ID NO: 2096194 - RNA, 18 nt, Homo sapiens
gaauguuuccuguggaaa

SEQ ID NO: 2096195 - RNA, 23 nt, Homo sapiens
agucagguccaugugcacugcaa

SEQ ID NO: 2096196 - RNA, 19 nt, Homo sapiens
aagcagagcuaguaaugcu

SEQ ID NO: 2096197 - RNA, 18 nt, Homo sapiens
aucauuuaggauacucuu

SEQ ID NO: 2096198 - RNA, 20 nt, Homo sapiens
gauuuuaaaaagucuucacu

SEQ ID NO: 2096199 - RNA, 20 nt, Homo sapiens
aggaggacauuuggugggcu

SEQ ID NO: 2096200 - RNA, 18 nt, Homo sapiens
agugggcccaaugcacuu

SEQ ID NO: 2096201 - RNA, 16 nt, Homo sapiens
agauaagaaaagccug

SEQ ID NO: 2096202 - RNA, 11 nt, Homo sapiens
agcagccucag

SEQ ID NO: 2096203 - RNA, 18 nt, Homo sapiens
uaguaaugugcuuguuag

SEQ ID NO: 2096204 - RNA, 22 nt, Homo sapiens
guuacuaaaauuuacacaucuu

SEQ ID NO: 2096205 - RNA, 16 nt, Homo sapiens
aaggcgugagucuuca

SEQ ID NO: 2096206 - RNA, 12 nt, Homo sapiens
uaggagcaagaa

SEQ ID NO: 2096207 - RNA, 20 nt, Homo sapiens
cuccaggccgagaugugcaa

SEQ ID NO: 2096208 - RNA, 23 nt, Homo sapiens
cauccuaagaaauaugugagauu

SEQ ID NO: 2096209 - RNA, 14 nt, Homo sapiens
acuuuuggaaucau

SEQ ID NO: 2096210 - RNA, 22 nt, Homo sapiens
gauuauuuaauaacauuaccuu

SEQ ID NO: 2096211 - RNA, 12 nt, Homo sapiens
aauauagccaug

SEQ ID NO: 2096212 - RNA, 21 nt, Homo sapiens
ugaauaaauuuucuucuuggu

SEQ ID NO: 2096213 - RNA, 19 nt, Homo sapiens
gccucacuacucgagccca

SEQ ID NO: 2096214 - RNA, 15 nt, Homo sapiens
ccagacccacugaaa

SEQ ID NO: 2096215 - RNA, 21 nt, Homo sapiens
ucguggugggugcucaagacu

SEQ ID NO: 2096216 - RNA, 18 nt, Homo sapiens
ugcagcuguaaacauauu

SEQ ID NO: 2096217 - RNA, 16 nt, Homo sapiens
ugcaugugauuggcag

SEQ ID NO: 2096218 - RNA, 9 nt, Homo sapiens
aaagcagag

SEQ ID NO: 2096219 - RNA, 19 nt, Homo sapiens
uggaauuuaaaucacucaa

SEQ ID NO: 2096220 - RNA, 17 nt, Homo sapiens
auccuggggaacauaga

SEQ ID NO: 2096221 - RNA, 17 nt, Homo sapiens
agcaaaacaucucugca

SEQ ID NO: 2096222 - RNA, 19 nt, Homo sapiens
uggucccagaguggcugca

SEQ ID NO: 2096223 - RNA, 16 nt, Homo sapiens
gcuggcuccuagggga

SEQ ID NO: 2096224 - RNA, 13 nt, Homo sapiens
gccuuagguugcu

SEQ ID NO: 2096225 - RNA, 13 nt, Homo sapiens
aaaagcuuuccug

SEQ ID NO: 2096226 - RNA, 20 nt, Homo sapiens
uacccuccuuccacauguac

SEQ ID NO: 2096227 - RNA, 17 nt, Homo sapiens
uccuggccagaugucgc

SEQ ID NO: 2096228 - RNA, 15 nt, Homo sapiens
caacaagaccaccac

SEQ ID NO: 2096229 - RNA, 14 nt, Homo sapiens
aucuaugguaauau

SEQ ID NO: 2096230 - RNA, 19 nt, Homo sapiens
guuauugcuggugcaaaga

SEQ ID NO: 2096231 - RNA, 15 nt, Homo sapiens
acagaggaccaugcu

SEQ ID NO: 2096232 - RNA, 15 nt, Homo sapiens
cagaauguaaagguu

SEQ ID NO: 2096233 - RNA, 23 nt, Homo sapiens
cauggauuggauuucaguucaau

SEQ ID NO: 2096234 - RNA, 20 nt, Homo sapiens
augguguaaugcacaauuua

SEQ ID NO: 2096235 - RNA, 17 nt, Homo sapiens
aaauguucucaugaacu

SEQ ID NO: 2096236 - RNA, 13 nt, Homo sapiens
guuagcaggaaau

SEQ ID NO: 2096237 - RNA, 23 nt, Homo sapiens
ggccugggugugaccugacaccu

SEQ ID NO: 2096238 - RNA, 21 nt, Homo sapiens
ugaugucauucagcagucagu

SEQ ID NO: 2096239 - RNA, 17 nt, Homo sapiens
ugaggcuuagcuuugcu

SEQ ID NO: 2096240 - RNA, 17 nt, Homo sapiens
aauucuguuagcugcuc

SEQ ID NO: 2096241 - RNA, 20 nt, Homo sapiens
gugaaugacacuaaacucca

SEQ ID NO: 2096242 - RNA, 14 nt, Homo sapiens
ggaaggacaugggu

SEQ ID NO: 2096243 - RNA, 19 nt, Homo sapiens
ccuaagaaagacaucacau

SEQ ID NO: 2096244 - RNA, 15 nt, Homo sapiens
aaggccacaugucac

SEQ ID NO: 2096245 - RNA, 22 nt, Homo sapiens
ucuaccugaccaacaguuccuu

SEQ ID NO: 2096246 - RNA, 21 nt, Homo sapiens
uugcccaggcuggagugcagu

SEQ ID NO: 2096247 - RNA, 21 nt, Homo sapiens
uugcccaggcuagagugcaau

SEQ ID NO: 2096248 - RNA, 15 nt, Homo sapiens
uuccccagacccaga

SEQ ID NO: 2096249 - RNA, 19 nt, Homo sapiens
uuguauaguucacuuacuc

SEQ ID NO: 2096250 - RNA, 22 nt, Homo sapiens
cucagagauauugugaggacaa

SEQ ID NO: 2096251 - RNA, 20 nt, Homo sapiens
aucuuuguguugcagccuca

SEQ ID NO: 2096252 - RNA, 18 nt, Homo sapiens
aaagcacuggccuugccu

SEQ ID NO: 2096253 - RNA, 14 nt, Homo sapiens
aaugacccugucaa

SEQ ID NO: 2096254 - RNA, 23 nt, Homo sapiens
ccugcacauucuccugauuugag

SEQ ID NO: 2096255 - RNA, 17 nt, Homo sapiens
ggcuguuaacccacugc

SEQ ID NO: 2096256 - RNA, 23 nt, Homo sapiens
cugugugccauuuuaagaguuac

SEQ ID NO: 2096257 - RNA, 19 nt, Homo sapiens
cuggagagugcacaugccc

SEQ ID NO: 2096258 - RNA, 18 nt, Homo sapiens
ucucagguguugccaaau

SEQ ID NO: 2096259 - RNA, 18 nt, Homo sapiens
gcuuaucuuagaagcacu

SEQ ID NO: 2096260 - RNA, 20 nt, Homo sapiens
cacuauucuuaagcacuuug

SEQ ID NO: 2096261 - RNA, 15 nt, Homo sapiens
uggaacuaugcagug

SEQ ID NO: 2096262 - RNA, 13 nt, Homo sapiens
cuucuccaaaggg

SEQ ID NO: 2096263 - RNA, 23 nt, Homo sapiens
uacucaggcugguggagaacucu

SEQ ID NO: 2096264 - RNA, 17 nt, Homo sapiens
aaaguugcuccauacaa

SEQ ID NO: 2096265 - RNA, 12 nt, Homo sapiens
cuaacacaaaau

SEQ ID NO: 2096266 - RNA, 15 nt, Homo sapiens
aaguuuucaugugcu

SEQ ID NO: 2096267 - RNA, 13 nt, Homo sapiens
ugaaugucauuau

SEQ ID NO: 2096268 - RNA, 14 nt, Homo sapiens
guacaaaugaaauu

SEQ ID NO: 2096269 - RNA, 17 nt, Homo sapiens
agagacaugaauggaga

SEQ ID NO: 2096270 - RNA, 20 nt, Homo sapiens
auguacugauuacugccuau

SEQ ID NO: 2096271 - RNA, 21 nt, Homo sapiens
gaauuaguuuuauaugcuucu

SEQ ID NO: 2096272 - RNA, 15 nt, Homo sapiens
gcagugaugcuggau

SEQ ID NO: 2096273 - RNA, 12 nt, Homo sapiens
uuacucuuguaa

SEQ ID NO: 2096274 - RNA, 20 nt, Homo sapiens
gauggcgcuauugcacucca

SEQ ID NO: 2096275 - RNA, 17 nt, Homo sapiens
agggagacugcaucuca

SEQ ID NO: 2096276 - RNA, 16 nt, Homo sapiens
uggggucuccuauacu

SEQ ID NO: 2096277 - RNA, 16 nt, Homo sapiens
acagcucgacuuuaaa

SEQ ID NO: 2096278 - RNA, 20 nt, Homo sapiens
gagacggguuucaccauguu

SEQ ID NO: 2096279 - RNA, 13 nt, Homo sapiens
cuccugcagggau

SEQ ID NO: 2096280 - RNA, 20 nt, Homo sapiens
aggcauucuaagucacagga

SEQ ID NO: 2096281 - RNA, 13 nt, Homo sapiens
ucucaacaucacu

SEQ ID NO: 2096282 - RNA, 22 nt, Homo sapiens
aagaauucuggauaucucagga

SEQ ID NO: 2096283 - RNA, 19 nt, Homo sapiens
ugauaaaacugguuuuaga

SEQ ID NO: 2096284 - RNA, 14 nt, Homo sapiens
cccccuucagugcc

SEQ ID NO: 2096285 - RNA, 16 nt, Homo sapiens
cagaagaugccagcuu

SEQ ID NO: 2096286 - RNA, 16 nt, Homo sapiens
aauccugucaccauca

SEQ ID NO: 2096287 - RNA, 15 nt, Homo sapiens
gcccccucaccucuc

SEQ ID NO: 2096288 - RNA, 21 nt, Homo sapiens
aggcaaaaccgugcucuuuau

SEQ ID NO: 2096289 - RNA, 17 nt, Homo sapiens
auuucuucuacaacuca

SEQ ID NO: 2096290 - RNA, 16 nt, Homo sapiens
aagcuggagugcagug

SEQ ID NO: 2096291 - RNA, 17 nt, Homo sapiens
auuuccaugauacaaag

SEQ ID NO: 2096292 - RNA, 19 nt, Homo sapiens
uaaaaaaauaaaaaagauc

SEQ ID NO: 2096293 - RNA, 16 nt, Homo sapiens
cuggcaagaugcuuua

SEQ ID NO: 2096294 - RNA, 12 nt, Homo sapiens
cuggcaggcacc

SEQ ID NO: 2096295 - RNA, 20 nt, Homo sapiens
cagaauauuagccaguacca

SEQ ID NO: 2096296 - RNA, 16 nt, Homo sapiens
ucgaaaagaaauuguc

SEQ ID NO: 2096297 - RNA, 15 nt, Homo sapiens
cauaccuugucauag

SEQ ID NO: 2096298 - RNA, 18 nt, Homo sapiens
aaucaaugaucaucucac

SEQ ID NO: 2096299 - RNA, 16 nt, Homo sapiens
uaagacuuaguacuau

SEQ ID NO: 2096300 - RNA, 13 nt, Homo sapiens
uuucugugcaugg

SEQ ID NO: 2096301 - RNA, 23 nt, Homo sapiens
gaggucgucgaaaggugcagcug

SEQ ID NO: 2096302 - RNA, 16 nt, Homo sapiens
aggccagggucacuga

SEQ ID NO: 2096303 - RNA, 13 nt, Homo sapiens
uaguaaaguuugu

SEQ ID NO: 2096304 - RNA, 21 nt, Homo sapiens
ggaggaucauuugagcucaug

SEQ ID NO: 2096305 - RNA, 21 nt, Homo sapiens
ccucccgaguagcuggcacua

SEQ ID NO: 2096306 - RNA, 16 nt, Homo sapiens
cacaguacuguuucaa

SEQ ID NO: 2096307 - RNA, 14 nt, Homo sapiens
gcccacggggauca

SEQ ID NO: 2096308 - RNA, 14 nt, Homo sapiens
uugccagaaccaaa

SEQ ID NO: 2096309 - RNA, 18 nt, Homo sapiens
uugcaccguucucuguau

SEQ ID NO: 2096310 - RNA, 17 nt, Homo sapiens
agguugaaaagacaaua

SEQ ID NO: 2096311 - RNA, 21 nt, Homo sapiens
ggucucgucaggaggugccug

SEQ ID NO: 2096312 - RNA, 19 nt, Homo sapiens
auucuauacauguauaucu

SEQ ID NO: 2096313 - RNA, 19 nt, Homo sapiens
caacagagaugccaugaua

SEQ ID NO: 2096314 - RNA, 18 nt, Homo sapiens
uuugcauauuucaauguc

SEQ ID NO: 2096315 - RNA, 21 nt, Homo sapiens
caaaguguaacggccaacacu

SEQ ID NO: 2096316 - RNA, 12 nt, Homo sapiens
gccagcccuguu

SEQ ID NO: 2096317 - RNA, 14 nt, Homo sapiens
uaaaaaagcuauaa

SEQ ID NO: 2096318 - RNA, 14 nt, Homo sapiens
caaaaaaguuauaa

SEQ ID NO: 2096319 - RNA, 19 nt, Homo sapiens
cacuguagcuacauuuuca

SEQ ID NO: 2096320 - RNA, 23 nt, Homo sapiens
ggucccuaauucucuucgcugug

SEQ ID NO: 2096321 - RNA, 20 nt, Homo sapiens
gccuccuggcuucacgccau

SEQ ID NO: 2096322 - RNA, 19 nt, Homo sapiens
aagcugguuaaaguggaug

SEQ ID NO: 2096323 - RNA, 13 nt, Homo sapiens
auucacugccuau

SEQ ID NO: 2096324 - RNA, 19 nt, Homo sapiens
caaguaaaacaaaugaaau

SEQ ID NO: 2096325 - RNA, 18 nt, Homo sapiens
acacugucacuagucuca

SEQ ID NO: 2096326 - RNA, 23 nt, Homo sapiens
ucgucacgagcacaauggucuua

SEQ ID NO: 2096327 - RNA, 13 nt, Homo sapiens
agcaaagcaaaag

SEQ ID NO: 2096328 - RNA, 16 nt, Homo sapiens
auacacacgcugccuu

SEQ ID NO: 2096329 - RNA, 18 nt, Homo sapiens
gaaauaguucugugacua

SEQ ID NO: 2096330 - RNA, 20 nt, Homo sapiens
cugcaggggccgagccauuu

SEQ ID NO: 2096331 - RNA, 14 nt, Homo sapiens
ccaaaugcagggag

SEQ ID NO: 2096332 - RNA, 13 nt, Homo sapiens
gugcaugccccug

SEQ ID NO: 2096333 - RNA, 17 nt, Homo sapiens
uaaacaaaggaauuaug

SEQ ID NO: 2096334 - RNA, 15 nt, Homo sapiens
ccaggcugggcucag

SEQ ID NO: 2096335 - RNA, 14 nt, Homo sapiens
ugaaaaccuacaua

SEQ ID NO: 2096336 - RNA, 16 nt, Homo sapiens
gccucugaaaugccuc

SEQ ID NO: 2096337 - RNA, 17 nt, Homo sapiens
aggccuauuuauuaaua

SEQ ID NO: 2096338 - RNA, 13 nt, Homo sapiens
acucaggccagug

SEQ ID NO: 2096339 - RNA, 22 nt, Homo sapiens
ccucuguucaguaacagggccu

SEQ ID NO: 2096340 - RNA, 13 nt, Homo sapiens
ccuccaaaacaca

SEQ ID NO: 2096341 - RNA, 19 nt, Homo sapiens
ggcacccggccccugcugg

SEQ ID NO: 2096342 - RNA, 12 nt, Homo sapiens
aauuagccaaaa

SEQ ID NO: 2096343 - RNA, 18 nt, Homo sapiens
uuuaaaagucucacaaag

SEQ ID NO: 2096344 - RNA, 13 nt, Homo sapiens
acuuucuguuacu

SEQ ID NO: 2096345 - RNA, 14 nt, Homo sapiens
ucagagugacucca

SEQ ID NO: 2096346 - RNA, 22 nt, Homo sapiens
acugcauaaccuuuacacuccu

SEQ ID NO: 2096347 - RNA, 13 nt, Homo sapiens
cgaucacucuggu

SEQ ID NO: 2096348 - RNA, 23 nt, Homo sapiens
ugccuauuuaugaauaaauauua

SEQ ID NO: 2096349 - RNA, 14 nt, Homo sapiens
augcagagccacag

SEQ ID NO: 2096350 - RNA, 17 nt, Homo sapiens
aauuugguguggcugua

SEQ ID NO: 2096351 - RNA, 13 nt, Homo sapiens
cccucaucaggag

SEQ ID NO: 2096352 - RNA, 21 nt, Homo sapiens
uuaaaaaguaccacauuccau

SEQ ID NO: 2096353 - RNA, 19 nt, Homo sapiens
ucaaagagguauauuugaa

SEQ ID NO: 2096354 - RNA, 22 nt, Homo sapiens
cacuaacauuucccccgagcuc

SEQ ID NO: 2096355 - RNA, 13 nt, Homo sapiens
aaagguguguuga

SEQ ID NO: 2096356 - RNA, 13 nt, Homo sapiens
auaauacuugacc

SEQ ID NO: 2096357 - RNA, 14 nt, Homo sapiens
uucugcucugccau

SEQ ID NO: 2096358 - RNA, 12 nt, Homo sapiens
uauuuccuugcc

SEQ ID NO: 2096359 - RNA, 19 nt, Homo sapiens
guagauuucagggagacaa

SEQ ID NO: 2096360 - RNA, 21 nt, Homo sapiens
cuggcugugcuaccugagcca

SEQ ID NO: 2096361 - RNA, 20 nt, Homo sapiens
guaauuuuaguagagacagg

SEQ ID NO: 2096362 - RNA, 17 nt, Homo sapiens
uucuucucuuaauuuca

SEQ ID NO: 2096363 - RNA, 20 nt, Homo sapiens
ggugaaaaaagccagccaga

SEQ ID NO: 2096364 - RNA, 22 nt, Homo sapiens
cuuccuuucuccaggaccaaua

SEQ ID NO: 2096365 - RNA, 19 nt, Homo sapiens
ugccugauccuccaacagc

SEQ ID NO: 2096366 - RNA, 17 nt, Homo sapiens
caugacugcaacuguau

SEQ ID NO: 2096367 - RNA, 15 nt, Homo sapiens
aucuuagguaagaca

SEQ ID NO: 2096368 - RNA, 19 nt, Homo sapiens
cucaggcucagagggaccu

SEQ ID NO: 2096369 - RNA, 11 nt, Homo sapiens
ccacuccaguu

SEQ ID NO: 2096370 - RNA, 16 nt, Homo sapiens
aaacauguaugugcau

SEQ ID NO: 2096371 - RNA, 20 nt, Homo sapiens
caggcccuccagugggcuga

SEQ ID NO: 2096372 - RNA, 19 nt, Homo sapiens
cacuaauuugucacuggaa

SEQ ID NO: 2096373 - RNA, 16 nt, Homo sapiens
ucccgucuuccgguca

SEQ ID NO: 2096374 - RNA, 12 nt, Homo sapiens
uugugaacugga

SEQ ID NO: 2096375 - RNA, 16 nt, Homo sapiens
ccugcuaaagacagug

SEQ ID NO: 2096376 - RNA, 14 nt, Homo sapiens
acauggcuaaauac

SEQ ID NO: 2096377 - RNA, 20 nt, Homo sapiens
caacaaaaacaaacaaaagc

SEQ ID NO: 2096378 - RNA, 19 nt, Homo sapiens
uuaaugaguuucacagugu

SEQ ID NO: 2096379 - RNA, 21 nt, Homo sapiens
aggcuuuucaaguaccuauau

SEQ ID NO: 2096380 - RNA, 19 nt, Homo sapiens
aguacagauguaaaugcca

SEQ ID NO: 2096381 - RNA, 13 nt, Homo sapiens
acauagagaucua

SEQ ID NO: 2096382 - RNA, 23 nt, Homo sapiens
caaaaaaaauacggcuuuuccaa

SEQ ID NO: 2096383 - RNA, 23 nt, Homo sapiens
gucaggcccugaucuagugcagu

SEQ ID NO: 2096384 - RNA, 18 nt, Homo sapiens
cagcccauggcccccaau

SEQ ID NO: 2096385 - RNA, 15 nt, Homo sapiens
uugacaacugguuua

SEQ ID NO: 2096386 - RNA, 15 nt, Homo sapiens
gccaccgcugcugcu

SEQ ID NO: 2096387 - RNA, 21 nt, Homo sapiens
aguucaaagagucugucuuga

SEQ ID NO: 2096388 - RNA, 23 nt, Homo sapiens
ugauggauauguuuucacuguau

SEQ ID NO: 2096389 - RNA, 22 nt, Homo sapiens
auuuagaauauauuuguguaca

SEQ ID NO: 2096390 - RNA, 14 nt, Homo sapiens
uauuauuuaacucu

SEQ ID NO: 2096391 - RNA, 22 nt, Homo sapiens
aggagucuuauaucccagguga

SEQ ID NO: 2096392 - RNA, 15 nt, Homo sapiens
caccaucugcugucu

SEQ ID NO: 2096393 - RNA, 11 nt, Homo sapiens
cagauuccaca

SEQ ID NO: 2096394 - RNA, 21 nt, Homo sapiens
uacuuugaacacaaagccugu

SEQ ID NO: 2096395 - RNA, 13 nt, Homo sapiens
augagucuuguaa

SEQ ID NO: 2096396 - RNA, 19 nt, Homo sapiens
auauuuuucacauaucuag

SEQ ID NO: 2096397 - RNA, 22 nt, Homo sapiens
agaagggauaucuacugugguc

SEQ ID NO: 2096398 - RNA, 22 nt, Homo sapiens
aaugcugcuuugguuaaucucu

SEQ ID NO: 2096399 - RNA, 14 nt, Homo sapiens
auaaaaaguucuca

SEQ ID NO: 2096400 - RNA, 13 nt, Homo sapiens
ccuuugccuucca

SEQ ID NO: 2096401 - RNA, 14 nt, Homo sapiens
aagagaugucaaaa

SEQ ID NO: 2096402 - RNA, 17 nt, Homo sapiens
aaccaaacuuguucauu

SEQ ID NO: 2096403 - RNA, 20 nt, Homo sapiens
auauacaaaagcaagacuuc

SEQ ID NO: 2096404 - RNA, 13 nt, Homo sapiens
uauggcaagugau

SEQ ID NO: 2096405 - RNA, 15 nt, Homo sapiens
uccccugcuccauuu

SEQ ID NO: 2096406 - RNA, 13 nt, Homo sapiens
guaagacaaucca

SEQ ID NO: 2096407 - RNA, 15 nt, Homo sapiens
uaacacguccacuuu

SEQ ID NO: 2096408 - RNA, 22 nt, Homo sapiens
uuucuuuuuuuuuuaauuguga

SEQ ID NO: 2096409 - RNA, 23 nt, Homo sapiens
acauaguuauguaaaaagagauu

SEQ ID NO: 2096410 - RNA, 20 nt, Homo sapiens
uuuaucugaacagagagaua

SEQ ID NO: 2096411 - RNA, 16 nt, Homo sapiens
ucacagucacaugccc

SEQ ID NO: 2096412 - RNA, 14 nt, Homo sapiens
gugcuucauagaaa

SEQ ID NO: 2096413 - RNA, 15 nt, Homo sapiens
ugagccacagcacuc

SEQ ID NO: 2096414 - RNA, 20 nt, Homo sapiens
uauccuguuacugaauuugc

SEQ ID NO: 2096415 - RNA, 15 nt, Homo sapiens
accccuccauuggcu

SEQ ID NO: 2096416 - RNA, 21 nt, Homo sapiens
cacuugcagacucuacagagg

SEQ ID NO: 2096417 - RNA, 14 nt, Homo sapiens
agacgcugcacuug

SEQ ID NO: 2096418 - RNA, 21 nt, Homo sapiens
cauauuucauaagcacaucca

SEQ ID NO: 2096419 - RNA, 22 nt, Homo sapiens
uagcagauacagggaugaggca

SEQ ID NO: 2096420 - RNA, 18 nt, Homo sapiens
caaaaugagacuuucuaa

SEQ ID NO: 2096421 - RNA, 19 nt, Homo sapiens
ccuaaugauuagcacuuaa

SEQ ID NO: 2096422 - RNA, 14 nt, Homo sapiens
ugcagaggagccca

SEQ ID NO: 2096423 - RNA, 15 nt, Homo sapiens
gcagacaccagcagc

SEQ ID NO: 2096424 - RNA, 22 nt, Homo sapiens
uugagauguugaaauuacauua

SEQ ID NO: 2096425 - RNA, 17 nt, Homo sapiens
ucugcugggccaccagc

SEQ ID NO: 2096426 - RNA, 21 nt, Homo sapiens
caugaauauaaaugggaaauc

SEQ ID NO: 2096427 - RNA, 21 nt, Homo sapiens
uccuguacuuuuuccagacac

SEQ ID NO: 2096428 - RNA, 16 nt, Homo sapiens
ucccuccuucccaaaa

SEQ ID NO: 2096429 - RNA, 12 nt, Homo sapiens
ucauaaugcaau

SEQ ID NO: 2096430 - RNA, 16 nt, Homo sapiens
gcuauaaguuuuagaa

SEQ ID NO: 2096431 - RNA, 18 nt, Homo sapiens
cacaugccucucucaggc

SEQ ID NO: 2096432 - RNA, 14 nt, Homo sapiens
auggccagcugcca

SEQ ID NO: 2096433 - RNA, 16 nt, Homo sapiens
cuguaccucaaaugaa

SEQ ID NO: 2096434 - RNA, 20 nt, Homo sapiens
ccuaggugggucaacuccaa

SEQ ID NO: 2096435 - RNA, 22 nt, Homo sapiens
cauggcagaaggcaaagcaaag

SEQ ID NO: 2096436 - RNA, 13 nt, Homo sapiens
aacuguacugaau

SEQ ID NO: 2096437 - RNA, 19 nt, Homo sapiens
ucacaccuguaauuccagc

SEQ ID NO: 2096438 - RNA, 18 nt, Homo sapiens
aguuucuugaaguccagu

SEQ ID NO: 2096439 - RNA, 14 nt, Homo sapiens
guccauccauucag

SEQ ID NO: 2096440 - RNA, 20 nt, Homo sapiens
ugcagaacaucgauauguau

SEQ ID NO: 2096441 - RNA, 13 nt, Homo sapiens
guucaggguccuu

SEQ ID NO: 2096442 - RNA, 21 nt, Homo sapiens
cuguauucuuguuuuacauuu

SEQ ID NO: 2096443 - RNA, 18 nt, Homo sapiens
uaccgccugucucuuuaa

SEQ ID NO: 2096444 - RNA, 15 nt, Homo sapiens
ucugcccucauuacu

SEQ ID NO: 2096445 - RNA, 22 nt, Homo sapiens
cacugagaaauagugcacucca

SEQ ID NO: 2096446 - RNA, 20 nt, Homo sapiens
agccccuccuaguucuucau

SEQ ID NO: 2096447 - RNA, 17 nt, Homo sapiens
gacauggaauuaccuua

SEQ ID NO: 2096448 - RNA, 16 nt, Homo sapiens
aucugagcuaacuuau

SEQ ID NO: 2096449 - RNA, 17 nt, Homo sapiens
agugauucuugcugcua

SEQ ID NO: 2096450 - RNA, 15 nt, Homo sapiens
auuauauaaggacag

SEQ ID NO: 2096451 - RNA, 15 nt, Homo sapiens
gccaccucacugcag

SEQ ID NO: 2096452 - RNA, 14 nt, Homo sapiens
uagcagcauuuaca

SEQ ID NO: 2096453 - RNA, 20 nt, Homo sapiens
acagcagcagcaaacaaaua

SEQ ID NO: 2096454 - RNA, 20 nt, Homo sapiens
acugcagcagaaaacaaaca

SEQ ID NO: 2096455 - RNA, 21 nt, Homo sapiens
gucacaugcuuuagccauaca

SEQ ID NO: 2096456 - RNA, 17 nt, Homo sapiens
uccaccaagugucuaga

SEQ ID NO: 2096457 - RNA, 13 nt, Homo sapiens
gaccaaaucucag

SEQ ID NO: 2096458 - RNA, 22 nt, Homo sapiens
accugggcugggagaaggugcu

SEQ ID NO: 2096459 - RNA, 18 nt, Homo sapiens
agcucaaggucaaugaca

SEQ ID NO: 2096460 - RNA, 20 nt, Homo sapiens
ugcacccaucagcacucugu

SEQ ID NO: 2096461 - RNA, 16 nt, Homo sapiens
cuucuccaaaugagau

SEQ ID NO: 2096462 - RNA, 21 nt, Homo sapiens
gaagaaccgauacacuuggca

SEQ ID NO: 2096463 - RNA, 16 nt, Homo sapiens
gcagugugaauagccu

SEQ ID NO: 2096464 - RNA, 11 nt, Homo sapiens
cccaacacuuu

SEQ ID NO: 2096465 - RNA, 10 nt, Homo sapiens
aucuguguuc

SEQ ID NO: 2096466 - RNA, 15 nt, Homo sapiens
acucugcuccaaagu

SEQ ID NO: 2096467 - RNA, 19 nt, Homo sapiens
aggccuuagccaugaucug

SEQ ID NO: 2096468 - RNA, 17 nt, Homo sapiens
uuuaaauuuucaccugu

SEQ ID NO: 2096469 - RNA, 16 nt, Homo sapiens
auuaaaaaaagacaua

SEQ ID NO: 2096470 - RNA, 17 nt, Homo sapiens
aagcccagcgguucaca

SEQ ID NO: 2096471 - RNA, 16 nt, Homo sapiens
aaauacauauuuccaa

SEQ ID NO: 2096472 - RNA, 16 nt, Homo sapiens
cuaaauauuaugccuu

SEQ ID NO: 2096473 - RNA, 20 nt, Homo sapiens
caccucagagacauacaccu

SEQ ID NO: 2096474 - RNA, 21 nt, Homo sapiens
cccagauagcuggcugggugg

SEQ ID NO: 2096475 - RNA, 21 nt, Homo sapiens
uacagauacauaucuguguau

SEQ ID NO: 2096476 - RNA, 12 nt, Homo sapiens
uacugcacugag

SEQ ID NO: 2096477 - RNA, 14 nt, Homo sapiens
uuaacacaucucaa

SEQ ID NO: 2096478 - RNA, 19 nt, Homo sapiens
ucccaacgugcaaagccaa

SEQ ID NO: 2096479 - RNA, 16 nt, Homo sapiens
aucaccuccuguguug

SEQ ID NO: 2096480 - RNA, 21 nt, Homo sapiens
gcuauuuugagaacuccagcu

SEQ ID NO: 2096481 - RNA, 20 nt, Homo sapiens
uguuagggagaugaguugca

SEQ ID NO: 2096482 - RNA, 16 nt, Homo sapiens
cugaaggacugugaca

SEQ ID NO: 2096483 - RNA, 20 nt, Homo sapiens
cucaguuggugcugcuuucu

SEQ ID NO: 2096484 - RNA, 23 nt, Homo sapiens
acugaaaaaaaaaaaaaucccaa

SEQ ID NO: 2096485 - RNA, 23 nt, Homo sapiens
aagguguaaaauaucuaccugcc

SEQ ID NO: 2096486 - RNA, 16 nt, Homo sapiens
cacccagggacacucc

SEQ ID NO: 2096487 - RNA, 16 nt, Homo sapiens
uaauuuauguaugcau

SEQ ID NO: 2096488 - RNA, 13 nt, Homo sapiens
cuauuuaugcaac

SEQ ID NO: 2096489 - RNA, 13 nt, Homo sapiens
uaauaguguuaau

SEQ ID NO: 2096490 - RNA, 13 nt, Homo sapiens
cccucgugccagu

SEQ ID NO: 2096491 - RNA, 20 nt, Homo sapiens
acuguuuagaugaaugucag

SEQ ID NO: 2096492 - RNA, 19 nt, Homo sapiens
cagaaggaucuucaucuga

SEQ ID NO: 2096493 - RNA, 15 nt, Homo sapiens
ggcugggagaaggug

SEQ ID NO: 2096494 - RNA, 20 nt, Homo sapiens
cucaggguauugcuugccac

SEQ ID NO: 2096495 - RNA, 16 nt, Homo sapiens
aaggcagcugccucug

SEQ ID NO: 2096496 - RNA, 19 nt, Homo sapiens
cuucacaucucccccauag

SEQ ID NO: 2096497 - RNA, 21 nt, Homo sapiens
ccuacaaaauuucaccugcaa

SEQ ID NO: 2096498 - RNA, 17 nt, Homo sapiens
caucuaauuaaauguag

SEQ ID NO: 2096499 - RNA, 12 nt, Homo sapiens
cacaagcaaaac

SEQ ID NO: 2096500 - RNA, 15 nt, Homo sapiens
uugcugccuuugucc

SEQ ID NO: 2096501 - RNA, 16 nt, Homo sapiens
cuccugccagcucuuc

SEQ ID NO: 2096502 - RNA, 12 nt, Homo sapiens
uauuuucacugg

SEQ ID NO: 2096503 - RNA, 14 nt, Homo sapiens
gagccuuucuucca

SEQ ID NO: 2096504 - RNA, 21 nt, Homo sapiens
acagagggaggaaugugugcc

SEQ ID NO: 2096505 - RNA, 21 nt, Homo sapiens
aaagcaguaaauuugcuagca

SEQ ID NO: 2096506 - RNA, 18 nt, Homo sapiens
uuucccgcuccaagagaa

SEQ ID NO: 2096507 - RNA, 20 nt, Homo sapiens
uccgugguuugaacacgaaa

SEQ ID NO: 2096508 - RNA, 14 nt, Homo sapiens
gacugaaauugcau

SEQ ID NO: 2096509 - RNA, 15 nt, Homo sapiens
uuaaggcugaggcug

SEQ ID NO: 2096510 - RNA, 18 nt, Homo sapiens
gcugagguaaaaacugaa

SEQ ID NO: 2096511 - RNA, 18 nt, Homo sapiens
uguaguguauuaaucucu

SEQ ID NO: 2096512 - RNA, 14 nt, Homo sapiens
cugaauaagcacuu

SEQ ID NO: 2096513 - RNA, 20 nt, Homo sapiens
aucuaccaguuuauuccugu

SEQ ID NO: 2096514 - RNA, 23 nt, Homo sapiens
uucuauauugugccaagcgaaaa

SEQ ID NO: 2096515 - RNA, 18 nt, Homo sapiens
cgucagugcugugcugug

SEQ ID NO: 2096516 - RNA, 19 nt, Homo sapiens
augaaaaggauauuaucua

SEQ ID NO: 2096517 - RNA, 19 nt, Homo sapiens
gaaaaaagcaacugguuag

SEQ ID NO: 2096518 - RNA, 20 nt, Homo sapiens
agcgcagugccucaugccug

SEQ ID NO: 2096519 - RNA, 13 nt, Homo sapiens
uauguagcugucg

SEQ ID NO: 2096520 - RNA, 17 nt, Homo sapiens
auuggcuaugaugguga

SEQ ID NO: 2096521 - RNA, 22 nt, Homo sapiens
aaaugcugcuuccacucagggc

SEQ ID NO: 2096522 - RNA, 15 nt, Homo sapiens
cuccccucccagucc

SEQ ID NO: 2096523 - RNA, 17 nt, Homo sapiens
uaguucaauacagugaa

SEQ ID NO: 2096524 - RNA, 19 nt, Homo sapiens
acaagcccaggacacugcc

SEQ ID NO: 2096525 - RNA, 21 nt, Homo sapiens
uccacuucacuccagcaucaa

SEQ ID NO: 2096526 - RNA, 21 nt, Homo sapiens
cuacuuuauaauaagacauuu

SEQ ID NO: 2096527 - RNA, 21 nt, Homo sapiens
gggagaccccuuguugcacug

SEQ ID NO: 2096528 - RNA, 16 nt, Homo sapiens
cuuucauguucuugga

SEQ ID NO: 2096529 - RNA, 21 nt, Homo sapiens
gagcucacaugggacugggau

SEQ ID NO: 2096530 - RNA, 20 nt, Homo sapiens
uucucaacuccaaacugacu

SEQ ID NO: 2096531 - RNA, 20 nt, Homo sapiens
uaaagguuaugaaacauauc

SEQ ID NO: 2096532 - RNA, 18 nt, Homo sapiens
cagagcugccaccugccu

SEQ ID NO: 2096533 - RNA, 14 nt, Homo sapiens
uuguuguaauugca

SEQ ID NO: 2096534 - RNA, 20 nt, Homo sapiens
acaguucggugagcuacaaa

SEQ ID NO: 2096535 - RNA, 13 nt, Homo sapiens
cuugaugggguga

SEQ ID NO: 2096536 - RNA, 17 nt, Homo sapiens
aacugaaaugccugcuu

SEQ ID NO: 2096537 - RNA, 19 nt, Homo sapiens
uauaauuuagacuuggauu

SEQ ID NO: 2096538 - RNA, 16 nt, Homo sapiens
gucuuccuaucaaaaa

SEQ ID NO: 2096539 - RNA, 21 nt, Homo sapiens
uauuagauugcugaauuaagg

SEQ ID NO: 2096540 - RNA, 20 nt, Homo sapiens
acauuuuuauuuaguugaaa

SEQ ID NO: 2096541 - RNA, 17 nt, Homo sapiens
uauauuuccacuucuuc

SEQ ID NO: 2096542 - RNA, 14 nt, Homo sapiens
acuuuagguucaca

SEQ ID NO: 2096543 - RNA, 14 nt, Homo sapiens
cucacccaguucag

SEQ ID NO: 2096544 - RNA, 20 nt, Homo sapiens
aggcugcagcgagcuaugau

SEQ ID NO: 2096545 - RNA, 19 nt, Homo sapiens
auaauuggagaagauuuau

SEQ ID NO: 2096546 - RNA, 17 nt, Homo sapiens
ggaauaaaaacauuucu

SEQ ID NO: 2096547 - RNA, 17 nt, Homo sapiens
cuggggaauacuggcca

SEQ ID NO: 2096548 - RNA, 13 nt, Homo sapiens
ccugaaaggcaac

SEQ ID NO: 2096549 - RNA, 21 nt, Homo sapiens
ugcauuguuaaucauccauca

SEQ ID NO: 2096550 - RNA, 19 nt, Homo sapiens
gauggacccucagucuucu

SEQ ID NO: 2096551 - RNA, 20 nt, Homo sapiens
ucaugaaagcagcacacauu

SEQ ID NO: 2096552 - RNA, 13 nt, Homo sapiens
ccuuaaaccugca

SEQ ID NO: 2096553 - RNA, 15 nt, Homo sapiens
acaaagacaguauuu

SEQ ID NO: 2096554 - RNA, 23 nt, Homo sapiens
cucaaacuccugaccuugugauu

SEQ ID NO: 2096555 - RNA, 20 nt, Homo sapiens
ggaggagcucugcagccucc

SEQ ID NO: 2096556 - RNA, 16 nt, Homo sapiens
agccugggccuaugga

SEQ ID NO: 2096557 - RNA, 14 nt, Homo sapiens
ggagcugcuuccag

SEQ ID NO: 2096558 - RNA, 23 nt, Homo sapiens
uucaguaccacaugggugaacac

SEQ ID NO: 2096559 - RNA, 16 nt, Homo sapiens
ccucagggcagggaua

SEQ ID NO: 2096560 - RNA, 17 nt, Homo sapiens
ugugugcaagugugugc

SEQ ID NO: 2096561 - RNA, 13 nt, Homo sapiens
acaacuucuuugu

SEQ ID NO: 2096562 - RNA, 20 nt, Homo sapiens
guaucucuuuugaauccaug

SEQ ID NO: 2096563 - RNA, 18 nt, Homo sapiens
cugaguaagaaaugcugc

SEQ ID NO: 2096564 - RNA, 14 nt, Homo sapiens
gaaauaaacuuugg

SEQ ID NO: 2096565 - RNA, 23 nt, Homo sapiens
aaaaggaucguuuuuuuuugcuu

SEQ ID NO: 2096566 - RNA, 17 nt, Homo sapiens
gcagggugaucgcacaa

SEQ ID NO: 2096567 - RNA, 23 nt, Homo sapiens
cucccacugggguccagggagca

SEQ ID NO: 2096568 - RNA, 13 nt, Homo sapiens
aagaagcuugaau

SEQ ID NO: 2096569 - RNA, 18 nt, Homo sapiens
uaaaagagaagcaucauu

SEQ ID NO: 2096570 - RNA, 21 nt, Homo sapiens
caacaaagauugagaagccau

SEQ ID NO: 2096571 - RNA, 13 nt, Homo sapiens
uagcuaugugacc

SEQ ID NO: 2096572 - RNA, 23 nt, Homo sapiens
uccuucuuucacaggcaucagga

SEQ ID NO: 2096573 - RNA, 15 nt, Homo sapiens
gccaugcaaugccaa

SEQ ID NO: 2096574 - RNA, 11 nt, Homo sapiens
cuuuccaagcu

SEQ ID NO: 2096575 - RNA, 11 nt, Homo sapiens
cucuccaagcc

SEQ ID NO: 2096576 - RNA, 20 nt, Homo sapiens
cauauggacucugcacauga

SEQ ID NO: 2096577 - RNA, 21 nt, Homo sapiens
uuccaauacaaguuacauaca

SEQ ID NO: 2096578 - RNA, 23 nt, Homo sapiens
cucaucccuggucgucuauccca

SEQ ID NO: 2096579 - RNA, 19 nt, Homo sapiens
uaucaugaagcacaucaau

SEQ ID NO: 2096580 - RNA, 16 nt, Homo sapiens
cucuaagaucuugccu

SEQ ID NO: 2096581 - RNA, 13 nt, Homo sapiens
ucacuguccuguu

SEQ ID NO: 2096582 - RNA, 22 nt, Homo sapiens
uaaaugcuccagcacucaauaa

SEQ ID NO: 2096583 - RNA, 20 nt, Homo sapiens
aacgaggcaaugacugugag

SEQ ID NO: 2096584 - RNA, 19 nt, Homo sapiens
agcgaacuuguauacuuau

SEQ ID NO: 2096585 - RNA, 20 nt, Homo sapiens
aggugguaguaaaacacaga

SEQ ID NO: 2096586 - RNA, 17 nt, Homo sapiens
guaaggagccuuuccag

SEQ ID NO: 2096587 - RNA, 15 nt, Homo sapiens
agaggucaccagcug

SEQ ID NO: 2096588 - RNA, 20 nt, Homo sapiens
aagaucuugaauagucucau

SEQ ID NO: 2096589 - RNA, 12 nt, Homo sapiens
uacaaacccaaa

SEQ ID NO: 2096590 - RNA, 14 nt, Homo sapiens
aacaauuucaauaa

SEQ ID NO: 2096591 - RNA, 21 nt, Homo sapiens
cucucugcuggguuuccacac

SEQ ID NO: 2096592 - RNA, 22 nt, Homo sapiens
aauccuacagcauaaagcacau

SEQ ID NO: 2096593 - RNA, 15 nt, Homo sapiens
guauccucuauaauu

SEQ ID NO: 2096594 - RNA, 15 nt, Homo sapiens
gacauagcauccaag

SEQ ID NO: 2096595 - RNA, 16 nt, Homo sapiens
uuaugaaaaguacuaa

SEQ ID NO: 2096596 - RNA, 11 nt, Homo sapiens
cacagccagaa

SEQ ID NO: 2096597 - RNA, 16 nt, Homo sapiens
gagacuccgucucaaa

SEQ ID NO: 2096598 - RNA, 20 nt, Homo sapiens
aacuuccagugcaacacuga

SEQ ID NO: 2096599 - RNA, 15 nt, Homo sapiens
cgcaccaagaucucc

SEQ ID NO: 2096600 - RNA, 21 nt, Homo sapiens
uucuucaccucacuuguggca

SEQ ID NO: 2096601 - RNA, 13 nt, Homo sapiens
cagcaugccugaa

SEQ ID NO: 2096602 - RNA, 18 nt, Homo sapiens
ucaugugaccacucuguc

SEQ ID NO: 2096603 - RNA, 21 nt, Homo sapiens
guggauauuaaaaaucuguaa

SEQ ID NO: 2096604 - RNA, 19 nt, Homo sapiens
ccaguugaucaaugaauaa

SEQ ID NO: 2096605 - RNA, 22 nt, Homo sapiens
cagcuaagcccccuacugagaa

SEQ ID NO: 2096606 - RNA, 13 nt, Homo sapiens
uuccagacauucu

SEQ ID NO: 2096607 - RNA, 23 nt, Homo sapiens
auguacagacuuuuuucuuguca

SEQ ID NO: 2096608 - RNA, 13 nt, Homo sapiens
cucccacacaaga

SEQ ID NO: 2096609 - RNA, 17 nt, Homo sapiens
acccuagaugugcucgu

SEQ ID NO: 2096610 - RNA, 18 nt, Homo sapiens
aaauuaacaaagugucac

SEQ ID NO: 2096611 - RNA, 20 nt, Homo sapiens
uaauggaagagaaaucucau

SEQ ID NO: 2096612 - RNA, 16 nt, Homo sapiens
auggagcaacccaaua

SEQ ID NO: 2096613 - RNA, 22 nt, Homo sapiens
cccauggcccccaauaaaggca

SEQ ID NO: 2096614 - RNA, 16 nt, Homo sapiens
gggccucuuuuugccc

SEQ ID NO: 2096615 - RNA, 19 nt, Homo sapiens
ucgacucagccucagggac

SEQ ID NO: 2096616 - RNA, 22 nt, Homo sapiens
uuccagaaacuuuaagaacaaa

SEQ ID NO: 2096617 - RNA, 19 nt, Homo sapiens
agagaacuugauagccuga

SEQ ID NO: 2096618 - RNA, 21 nt, Homo sapiens
acuuuuuccuggcucaucucu

SEQ ID NO: 2096619 - RNA, 22 nt, Homo sapiens
acauugaucauuuuuauaugaa

SEQ ID NO: 2096620 - RNA, 20 nt, Homo sapiens
agaacuccuguguguggaag

SEQ ID NO: 2096621 - RNA, 14 nt, Homo sapiens
guagcuugcucccu

SEQ ID NO: 2096622 - RNA, 15 nt, Homo sapiens
cugcgaguggcuuag

SEQ ID NO: 2096623 - RNA, 17 nt, Homo sapiens
ucagaggagcgcaggca

SEQ ID NO: 2096624 - RNA, 15 nt, Homo sapiens
uucuuucaucauuca

SEQ ID NO: 2096625 - RNA, 14 nt, Homo sapiens
caagugggugaaug

SEQ ID NO: 2096626 - RNA, 16 nt, Homo sapiens
ugugugugugugcaca

SEQ ID NO: 2096627 - RNA, 19 nt, Homo sapiens
agcaggccucugggaccca

SEQ ID NO: 2096628 - RNA, 19 nt, Homo sapiens
agcucuuguuccgugccag

SEQ ID NO: 2096629 - RNA, 14 nt, Homo sapiens
aaaaccauguugau

SEQ ID NO: 2096630 - RNA, 21 nt, Homo sapiens
cugccgaguggucacugucag

SEQ ID NO: 2096631 - RNA, 19 nt, Homo sapiens
aaugcuuuuugaauguuau

SEQ ID NO: 2096632 - RNA, 22 nt, Homo sapiens
ccagcuccuaggucucagagaa

SEQ ID NO: 2096633 - RNA, 21 nt, Homo sapiens
ggagcuugaaauagugucuga

SEQ ID NO: 2096634 - RNA, 14 nt, Homo sapiens
uauacuacaugaga

SEQ ID NO: 2096635 - RNA, 17 nt, Homo sapiens
agauucgaacagcuuau

SEQ ID NO: 2096636 - RNA, 21 nt, Homo sapiens
cucagcauucgagaucuugag

SEQ ID NO: 2096637 - RNA, 15 nt, Homo sapiens
aggcaauauggccac

SEQ ID NO: 2096638 - RNA, 23 nt, Homo sapiens
ucuugcccugagcuuuccgggga

SEQ ID NO: 2096639 - RNA, 13 nt, Homo sapiens
gugagugugacag

SEQ ID NO: 2096640 - RNA, 17 nt, Homo sapiens
guaggaauuuucuugaa

SEQ ID NO: 2096641 - RNA, 24 nt, Homo sapiens
acaugcccauauuuuacuuggaaa

SEQ ID NO: 2096642 - RNA, 23 nt, Homo sapiens
ggaagugaagagggagaagggau

SEQ ID NO: 2096643 - RNA, 15 nt, Homo sapiens
auugucauugauaca

SEQ ID NO: 2096644 - RNA, 11 nt, Homo sapiens
ggaccaggugc

SEQ ID NO: 2096645 - RNA, 21 nt, Homo sapiens
cagugaugcuggaugcuccuu

SEQ ID NO: 2096646 - RNA, 19 nt, Homo sapiens
gaggccaaggaaugaucca

SEQ ID NO: 2096647 - RNA, 19 nt, Homo sapiens
ucucauggguggcacucag

SEQ ID NO: 2096648 - RNA, 13 nt, Homo sapiens
ucccucauguucu

SEQ ID NO: 2096649 - RNA, 22 nt, Homo sapiens
ugggaacaguaaagaaagcaga

SEQ ID NO: 2096650 - RNA, 23 nt, Homo sapiens
aggcucuuaagcagcauggaaaa

SEQ ID NO: 2096651 - RNA, 18 nt, Homo sapiens
gugaggugcugaugagug

SEQ ID NO: 2096652 - RNA, 21 nt, Homo sapiens
auaggaauuugcguaacuaac

SEQ ID NO: 2096653 - RNA, 14 nt, Homo sapiens
accaugcuucacaa

SEQ ID NO: 2096654 - RNA, 16 nt, Homo sapiens
aaugaguauuugguaa

SEQ ID NO: 2096655 - RNA, 13 nt, Homo sapiens
gaaauauucacaa

SEQ ID NO: 2096656 - RNA, 13 nt, Homo sapiens
ugccuuugccagg

SEQ ID NO: 2096657 - RNA, 21 nt, Homo sapiens
guugcagaacagacacuuuaa

SEQ ID NO: 2096658 - RNA, 16 nt, Homo sapiens
cuuuuccgaagcagaa

SEQ ID NO: 2096659 - RNA, 17 nt, Homo sapiens
auucuugacaugagaaa

SEQ ID NO: 2096660 - RNA, 19 nt, Homo sapiens
agacgucucacucaaagac

SEQ ID NO: 2096661 - RNA, 22 nt, Homo sapiens
agggagccacacagagaugucc

SEQ ID NO: 2096662 - RNA, 12 nt, Homo sapiens
aaaccugaugca

SEQ ID NO: 2096663 - RNA, 17 nt, Homo sapiens
cuuguugguugucacuc

SEQ ID NO: 2096664 - RNA, 18 nt, Homo sapiens
agaucccccagacuuuac

SEQ ID NO: 2096665 - RNA, 15 nt, Homo sapiens
ugaggaggaugcuaa

SEQ ID NO: 2096666 - RNA, 15 nt, Homo sapiens
uaucugauacuguau

SEQ ID NO: 2096667 - RNA, 15 nt, Homo sapiens
aaacuauuucaguga

SEQ ID NO: 2096668 - RNA, 14 nt, Homo sapiens
cugaucuuugcccc

SEQ ID NO: 2096669 - RNA, 19 nt, Homo sapiens
caccaggcuggagugcagu

SEQ ID NO: 2096670 - RNA, 14 nt, Homo sapiens
uagagucaucucca

SEQ ID NO: 2096671 - RNA, 13 nt, Homo sapiens
auugcacuagaga

SEQ ID NO: 2096672 - RNA, 17 nt, Homo sapiens
ugagucccuguccccac

SEQ ID NO: 2096673 - RNA, 17 nt, Homo sapiens
cauguguguaagugugu

SEQ ID NO: 2096674 - RNA, 20 nt, Homo sapiens
ccugcagccuccuccugacc

SEQ ID NO: 2096675 - RNA, 16 nt, Homo sapiens
uggugauggaaaaagc

SEQ ID NO: 2096676 - RNA, 17 nt, Homo sapiens
cugagaugaagcuaauu

SEQ ID NO: 2096677 - RNA, 13 nt, Homo sapiens
uuaucugugcaaa

SEQ ID NO: 2096678 - RNA, 13 nt, Homo sapiens
auguuguguaaca

SEQ ID NO: 2096679 - RNA, 22 nt, Homo sapiens
agacaagcccuugagaagccaa

SEQ ID NO: 2096680 - RNA, 19 nt, Homo sapiens
uagaaagcugacauugcca

SEQ ID NO: 2096681 - RNA, 19 nt, Homo sapiens
ugcuacccaugacuuuaua

SEQ ID NO: 2096682 - RNA, 16 nt, Homo sapiens
cuuggucaccagcucc

SEQ ID NO: 2096683 - RNA, 18 nt, Homo sapiens
ucaggccaacaagccaac

SEQ ID NO: 2096684 - RNA, 19 nt, Homo sapiens
cucaaggcucagcugguuu

SEQ ID NO: 2096685 - RNA, 22 nt, Homo sapiens
gugugguccagguccuuuccac

SEQ ID NO: 2096686 - RNA, 23 nt, Homo sapiens
ccacaggugcgggaccaucugau

SEQ ID NO: 2096687 - RNA, 13 nt, Homo sapiens
gacauagccuuug

SEQ ID NO: 2096688 - RNA, 14 nt, Homo sapiens
ugugcgcacacaca

SEQ ID NO: 2096689 - RNA, 15 nt, Homo sapiens
cucuggcacagugua

SEQ ID NO: 2096690 - RNA, 19 nt, Homo sapiens
ugacaaguagggcacaaaa

SEQ ID NO: 2096691 - RNA, 16 nt, Homo sapiens
cagcuggccuugugag

SEQ ID NO: 2096692 - RNA, 20 nt, Homo sapiens
cauugcuucauuaaaacaag

SEQ ID NO: 2096693 - RNA, 14 nt, Homo sapiens
ccagacucucaggu

SEQ ID NO: 2096694 - RNA, 20 nt, Homo sapiens
auucucuuaugauacuugag

SEQ ID NO: 2096695 - RNA, 13 nt, Homo sapiens
uuaaccugcaaaa

SEQ ID NO: 2096696 - RNA, 20 nt, Homo sapiens
aggcucuuagcagcuuccag

SEQ ID NO: 2096697 - RNA, 18 nt, Homo sapiens
cuguugugcuccauagag

SEQ ID NO: 2096698 - RNA, 18 nt, Homo sapiens
cauacuggccuggacugu

SEQ ID NO: 2096699 - RNA, 21 nt, Homo sapiens
aagaccuaccuagaugcuccu

SEQ ID NO: 2096700 - RNA, 11 nt, Homo sapiens
cuuuaugcaaa

SEQ ID NO: 2096701 - RNA, 22 nt, Homo sapiens
uaucagccugucucuuccauau

SEQ ID NO: 2096702 - RNA, 13 nt, Homo sapiens
aagccacuugaaa

SEQ ID NO: 2096703 - RNA, 17 nt, Homo sapiens
ggaauuuucauuuucau

SEQ ID NO: 2096704 - RNA, 14 nt, Homo sapiens
aaaaagucauccaa

SEQ ID NO: 2096705 - RNA, 21 nt, Homo sapiens
agagcuguucaacaucacuga

SEQ ID NO: 2096706 - RNA, 15 nt, Homo sapiens
cuaaggaaugcacaa

SEQ ID NO: 2096707 - RNA, 20 nt, Homo sapiens
gcagcauugccauaccauuc

SEQ ID NO: 2096708 - RNA, 16 nt, Homo sapiens
uuuucuuuccuuuuca

SEQ ID NO: 2096709 - RNA, 17 nt, Homo sapiens
aaauccugagcaaacaa

SEQ ID NO: 2096710 - RNA, 13 nt, Homo sapiens
caaggcugugcuc

SEQ ID NO: 2096711 - RNA, 13 nt, Homo sapiens
gcgcaugugccag

SEQ ID NO: 2096712 - RNA, 16 nt, Homo sapiens
agggcagccugucacc

SEQ ID NO: 2096713 - RNA, 19 nt, Homo sapiens
augcauggaaaaguggccu

SEQ ID NO: 2096714 - RNA, 16 nt, Homo sapiens
caagaaucaccucaaa

SEQ ID NO: 2096715 - RNA, 14 nt, Homo sapiens
ugauauaaaugcaa

SEQ ID NO: 2096716 - RNA, 22 nt, Homo sapiens
auacaaaugggaauucacucac

SEQ ID NO: 2096717 - RNA, 12 nt, Homo sapiens
cuuaaacaacac

SEQ ID NO: 2096718 - RNA, 21 nt, Homo sapiens
cugagaagcccgaggucauca

SEQ ID NO: 2096719 - RNA, 14 nt, Homo sapiens
uauauuuguacaaa

SEQ ID NO: 2096720 - RNA, 20 nt, Homo sapiens
uauuuugugcaacauaacaa

SEQ ID NO: 2096721 - RNA, 23 nt, Homo sapiens
gacuagcacugacugaacuguaa

SEQ ID NO: 2096722 - RNA, 18 nt, Homo sapiens
cuguucuuuuugacugau

SEQ ID NO: 2096723 - RNA, 15 nt, Homo sapiens
cacaucucagggaac

SEQ ID NO: 2096724 - RNA, 15 nt, Homo sapiens
gcagugcacauuuca

SEQ ID NO: 2096725 - RNA, 17 nt, Homo sapiens
aauacuuuuuaaaaggu

SEQ ID NO: 2096726 - RNA, 18 nt, Homo sapiens
uauucugcaagcaaucaa

SEQ ID NO: 2096727 - RNA, 18 nt, Homo sapiens
uagccggggguggugaca

SEQ ID NO: 2096728 - RNA, 12 nt, Homo sapiens
gccugugcaaug

SEQ ID NO: 2096729 - RNA, 23 nt, Homo sapiens
cuccucuucuagcauuucuucca

SEQ ID NO: 2096730 - RNA, 16 nt, Homo sapiens
gcacuugggcauuuau

SEQ ID NO: 2096731 - RNA, 17 nt, Homo sapiens
ccauauguccacuguuc

SEQ ID NO: 2096732 - RNA, 12 nt, Homo sapiens
uuuuuuguggau

SEQ ID NO: 2096733 - RNA, 22 nt, Homo sapiens
uaaauucucucuaacauaacaa

SEQ ID NO: 2096734 - RNA, 13 nt, Homo sapiens
aagcugucagaag

SEQ ID NO: 2096735 - RNA, 18 nt, Homo sapiens
acuuugugaauuaacaca

SEQ ID NO: 2096736 - RNA, 16 nt, Homo sapiens
guggcggcagggccag

SEQ ID NO: 2096737 - RNA, 13 nt, Homo sapiens
auaucaagauguu

SEQ ID NO: 2096738 - RNA, 14 nt, Homo sapiens
auaagcaugguguc

SEQ ID NO: 2096739 - RNA, 20 nt, Homo sapiens
ugcaggaucccuacugccaa

SEQ ID NO: 2096740 - RNA, 20 nt, Homo sapiens
cauacaugcauacacucuca

SEQ ID NO: 2096741 - RNA, 17 nt, Homo sapiens
aguaagggcguggcucu

SEQ ID NO: 2096742 - RNA, 22 nt, Homo sapiens
uuguuccugcuuucucuuucag

SEQ ID NO: 2096743 - RNA, 23 nt, Homo sapiens
uuccaauacuucauuaauuucaa

SEQ ID NO: 2096744 - RNA, 23 nt, Homo sapiens
uacuguaggcacacuuugcacug

SEQ ID NO: 2096745 - RNA, 21 nt, Homo sapiens
ugauacauaacuaaauuugau

SEQ ID NO: 2096746 - RNA, 16 nt, Homo sapiens
acagugcagugcucag

SEQ ID NO: 2096747 - RNA, 23 nt, Homo sapiens
acugcauaaaugaauaaauucag

SEQ ID NO: 2096748 - RNA, 21 nt, Homo sapiens
uagcuaauaauaaaugcauag

SEQ ID NO: 2096749 - RNA, 13 nt, Homo sapiens
cacuuuucaaugu

SEQ ID NO: 2096750 - RNA, 17 nt, Homo sapiens
uaacaggagugccacuu

SEQ ID NO: 2096751 - RNA, 24 nt, Homo sapiens
uaagaguagcaaguucuagagaag

SEQ ID NO: 2096752 - RNA, 20 nt, Homo sapiens
aacaucuugaauacucugcc

SEQ ID NO: 2096753 - RNA, 21 nt, Homo sapiens
guaguuuuuuuggugcuauaa

SEQ ID NO: 2096754 - RNA, 20 nt, Homo sapiens
acuucuuuaaaaaaacacau

SEQ ID NO: 2096755 - RNA, 19 nt, Homo sapiens
uucucaugaauaaauuccu

SEQ ID NO: 2096756 - RNA, 14 nt, Homo sapiens
agguuguucuuggc

SEQ ID NO: 2096757 - RNA, 23 nt, Homo sapiens
cauuacgcuaguuaucaugcaug

SEQ ID NO: 2096758 - RNA, 15 nt, Homo sapiens
ugaauccaagccuug

SEQ ID NO: 2096759 - RNA, 16 nt, Homo sapiens
agguagcucggcacca

SEQ ID NO: 2096760 - RNA, 22 nt, Homo sapiens
ccagaaaauguaaggcaaugcu

SEQ ID NO: 2096761 - RNA, 18 nt, Homo sapiens
ggagcugcuggguggcag

SEQ ID NO: 2096762 - RNA, 18 nt, Homo sapiens
cuccuacacaaguguuuc

SEQ ID NO: 2096763 - RNA, 14 nt, Homo sapiens
auugacuugugaaa

SEQ ID NO: 2096764 - RNA, 13 nt, Homo sapiens
acccugugccugu

SEQ ID NO: 2096765 - RNA, 23 nt, Homo sapiens
ugggagagaaggagaucagggca

SEQ ID NO: 2096766 - RNA, 16 nt, Homo sapiens
auucgacuucuuucca

SEQ ID NO: 2096767 - RNA, 20 nt, Homo sapiens
ucccugcuguaucuuccaga

SEQ ID NO: 2096768 - RNA, 12 nt, Homo sapiens
ugaucugagaag

SEQ ID NO: 2096769 - RNA, 17 nt, Homo sapiens
auuuccaguugcccaua

SEQ ID NO: 2096770 - RNA, 23 nt, Homo sapiens
aauucagagugguuucauugccu

SEQ ID NO: 2096771 - RNA, 13 nt, Homo sapiens
cuaaguaaauaca

SEQ ID NO: 2096772 - RNA, 19 nt, Homo sapiens
ugccuuccuccuuauccua

SEQ ID NO: 2096773 - RNA, 16 nt, Homo sapiens
ugcuuuuccuuugaau

SEQ ID NO: 2096774 - RNA, 18 nt, Homo sapiens
caaucuccccuugcacua

SEQ ID NO: 2096775 - RNA, 17 nt, Homo sapiens
auuuugguacugugaug

SEQ ID NO: 2096776 - RNA, 16 nt, Homo sapiens
ccagagggacuuugcc

SEQ ID NO: 2096777 - RNA, 18 nt, Homo sapiens
cagaaaauuauagucaau

SEQ ID NO: 2096778 - RNA, 18 nt, Homo sapiens
aauaaaaggaaucuuccu

SEQ ID NO: 2096779 - RNA, 20 nt, Homo sapiens
aauguccugaaacaugaacc

SEQ ID NO: 2096780 - RNA, 23 nt, Homo sapiens
aagagaaacaaauaaacuagucu

SEQ ID NO: 2096781 - RNA, 21 nt, Homo sapiens
gauaaucuuucuaaaaauuca

SEQ ID NO: 2096782 - RNA, 19 nt, Homo sapiens
gauguaugaauacagcagc

SEQ ID NO: 2096783 - RNA, 21 nt, Homo sapiens
uaauuuugauauaaucuuuca

SEQ ID NO: 2096784 - RNA, 15 nt, Homo sapiens
cugagugcaccacuu

SEQ ID NO: 2096785 - RNA, 21 nt, Homo sapiens
aaaugcuacuuaacaaaguaa

SEQ ID NO: 2096786 - RNA, 18 nt, Homo sapiens
cuucauuccuuccacuaa

SEQ ID NO: 2096787 - RNA, 16 nt, Homo sapiens
gcaauuugaucaguau

SEQ ID NO: 2096788 - RNA, 13 nt, Homo sapiens
cuucuauuagcca

SEQ ID NO: 2096789 - RNA, 23 nt, Homo sapiens
gcaacuauuuccaccuccuccca

SEQ ID NO: 2096790 - RNA, 14 nt, Homo sapiens
aaacuaccugugag

SEQ ID NO: 2096791 - RNA, 17 nt, Homo sapiens
uuaaaauauucuacaga

SEQ ID NO: 2096792 - RNA, 21 nt, Homo sapiens
aaggagccaaacauccuacaa

SEQ ID NO: 2096793 - RNA, 22 nt, Homo sapiens
gacagaaagcaguucugaugcu

SEQ ID NO: 2096794 - RNA, 16 nt, Homo sapiens
auacauccuagugaau

SEQ ID NO: 2096795 - RNA, 14 nt, Homo sapiens
gcugcaucggaggc

SEQ ID NO: 2096796 - RNA, 17 nt, Homo sapiens
ccagcuccgaccucucu

SEQ ID NO: 2096797 - RNA, 23 nt, Homo sapiens
cuugaguuguuuaaacagucaaa

SEQ ID NO: 2096798 - RNA, 14 nt, Homo sapiens
cuuguuucuacuca

SEQ ID NO: 2096799 - RNA, 19 nt, Homo sapiens
aagaaaaaaaaagucuuug

SEQ ID NO: 2096800 - RNA, 12 nt, Homo sapiens
guauugguggcu

SEQ ID NO: 2096801 - RNA, 19 nt, Homo sapiens
gcacaccuaagcccaaaua

SEQ ID NO: 2096802 - RNA, 20 nt, Homo sapiens
aagaagaguuucuccuuuug

SEQ ID NO: 2096803 - RNA, 22 nt, Homo sapiens
ccucaacauugcauggugcuag

SEQ ID NO: 2096804 - RNA, 14 nt, Homo sapiens
ccugugccaucacc

SEQ ID NO: 2096805 - RNA, 20 nt, Homo sapiens
uaaaugcuugauggaauuuu

SEQ ID NO: 2096806 - RNA, 16 nt, Homo sapiens
uccugucccucuucca

SEQ ID NO: 2096807 - RNA, 15 nt, Homo sapiens
agcggugggcacugu

SEQ ID NO: 2096808 - RNA, 15 nt, Homo sapiens
uccuaaaacuuuuaa

SEQ ID NO: 2096809 - RNA, 23 nt, Homo sapiens
cacagagugcauugugaggguua

SEQ ID NO: 2096810 - RNA, 11 nt, Homo sapiens
agggacacaau

SEQ ID NO: 2096811 - RNA, 18 nt, Homo sapiens
guuggucagucuacaaac

SEQ ID NO: 2096812 - RNA, 15 nt, Homo sapiens
ugaaaaacaaaaugg

SEQ ID NO: 2096813 - RNA, 22 nt, Homo sapiens
acuauuucugggucuuuugcua

SEQ ID NO: 2096814 - RNA, 17 nt, Homo sapiens
gacaauauggucccaaa

SEQ ID NO: 2096815 - RNA, 20 nt, Homo sapiens
ccaagaagauaaucuccaaa

SEQ ID NO: 2096816 - RNA, 15 nt, Homo sapiens
aaugaagauccaagc

SEQ ID NO: 2096817 - RNA, 19 nt, Homo sapiens
agucccuauacagaggucc

SEQ ID NO: 2096818 - RNA, 13 nt, Homo sapiens
ugaaauuuauuca

SEQ ID NO: 2096819 - RNA, 16 nt, Homo sapiens
uccccaauuacagggu

SEQ ID NO: 2096820 - RNA, 13 nt, Homo sapiens
uugcuaagcauau

SEQ ID NO: 2096821 - RNA, 17 nt, Homo sapiens
gccagcugugcacuuuc

SEQ ID NO: 2096822 - RNA, 15 nt, Homo sapiens
cacagcuacucagug

SEQ ID NO: 2096823 - RNA, 13 nt, Homo sapiens
aacagaacacuug

SEQ ID NO: 2096824 - RNA, 21 nt, Homo sapiens
aauaauuuuccugugacacuu

SEQ ID NO: 2096825 - RNA, 19 nt, Homo sapiens
ugcuuacccuucaccuuug

SEQ ID NO: 2096826 - RNA, 13 nt, Homo sapiens
cugacccccaugu

SEQ ID NO: 2096827 - RNA, 20 nt, Homo sapiens
cagccuggccaacauaguga

SEQ ID NO: 2096828 - RNA, 17 nt, Homo sapiens
agcaugugucaugcaug

SEQ ID NO: 2096829 - RNA, 13 nt, Homo sapiens
acugagaaagcca

SEQ ID NO: 2096830 - RNA, 21 nt, Homo sapiens
ccucugggccaagucaaagac

SEQ ID NO: 2096831 - RNA, 16 nt, Homo sapiens
uggcuuggcauuuucu

SEQ ID NO: 2096832 - RNA, 20 nt, Homo sapiens
aucagaguuccuccuacuua

SEQ ID NO: 2096833 - RNA, 18 nt, Homo sapiens
gcucuggaaaaugugacc

SEQ ID NO: 2096834 - RNA, 18 nt, Homo sapiens
gaauguagcaucugagaa

SEQ ID NO: 2096835 - RNA, 15 nt, Homo sapiens
guuugcuguuugcaa

SEQ ID NO: 2096836 - RNA, 19 nt, Homo sapiens
aucuuaagagaauccacau

SEQ ID NO: 2096837 - RNA, 13 nt, Homo sapiens
auauaaaugccaa

SEQ ID NO: 2096838 - RNA, 22 nt, Homo sapiens
ccaaaauccccuucucaucacu

SEQ ID NO: 2096839 - RNA, 22 nt, Homo sapiens
acugucaauuuggcagugauau

SEQ ID NO: 2096840 - RNA, 12 nt, Homo sapiens
ccgacacauuua

SEQ ID NO: 2096841 - RNA, 22 nt, Homo sapiens
aauaagauuuuguuagccaaca

SEQ ID NO: 2096842 - RNA, 22 nt, Homo sapiens
uuccacgugggccucacauucc

SEQ ID NO: 2096843 - RNA, 13 nt, Homo sapiens
caagaccaaagca

SEQ ID NO: 2096844 - RNA, 21 nt, Homo sapiens
cagcauuuagacccugcauuu

SEQ ID NO: 2096845 - RNA, 16 nt, Homo sapiens
auuucuuagagauuaa

SEQ ID NO: 2096846 - RNA, 19 nt, Homo sapiens
uuauauugcaagcuccauc

SEQ ID NO: 2096847 - RNA, 17 nt, Homo sapiens
uuugguacaaaaccacu

SEQ ID NO: 2096848 - RNA, 15 nt, Homo sapiens
uggacacucuauaug

SEQ ID NO: 2096849 - RNA, 14 nt, Homo sapiens
uugccuaaguauuc

SEQ ID NO: 2096850 - RNA, 19 nt, Homo sapiens
ggaagcaucugucuuguca

SEQ ID NO: 2096851 - RNA, 18 nt, Homo sapiens
acaggaaggaaccagaag

SEQ ID NO: 2096852 - RNA, 18 nt, Homo sapiens
uuucuauauuccuccagc

SEQ ID NO: 2096853 - RNA, 19 nt, Homo sapiens
cucacuggggucugugugg

SEQ ID NO: 2096854 - RNA, 22 nt, Homo sapiens
cucuggguagguguugaaaaug

SEQ ID NO: 2096855 - RNA, 20 nt, Homo sapiens
ugccaucagccccugcugcu

SEQ ID NO: 2096856 - RNA, 19 nt, Homo sapiens
ugaaaccccaaacagugac

SEQ ID NO: 2096857 - RNA, 16 nt, Homo sapiens
cccaggucacuguuaa

SEQ ID NO: 2096858 - RNA, 19 nt, Homo sapiens
caaagugcuaggauuacag

SEQ ID NO: 2096859 - RNA, 14 nt, Homo sapiens
uuaaguaauugcau

SEQ ID NO: 2096860 - RNA, 14 nt, Homo sapiens
cugugccacuuuga

SEQ ID NO: 2096861 - RNA, 18 nt, Homo sapiens
cacagaugcacacacaga

SEQ ID NO: 2096862 - RNA, 20 nt, Homo sapiens
aaagcauggacuaaccccaa

SEQ ID NO: 2096863 - RNA, 21 nt, Homo sapiens
aaagaauuuuccugagacaaa

SEQ ID NO: 2096864 - RNA, 15 nt, Homo sapiens
aauugaccucaaaag

SEQ ID NO: 2096865 - RNA, 20 nt, Homo sapiens
gaaaaccccaucucuacuaa

SEQ ID NO: 2096866 - RNA, 21 nt, Homo sapiens
ugccuuguccaggaacugccu

SEQ ID NO: 2096867 - RNA, 15 nt, Homo sapiens
aucaugguauuugac

SEQ ID NO: 2096868 - RNA, 16 nt, Homo sapiens
auuccugagccagugu

SEQ ID NO: 2096869 - RNA, 13 nt, Homo sapiens
cgcugccuggggc

SEQ ID NO: 2096870 - RNA, 16 nt, Homo sapiens
gaguaauucauuauua

SEQ ID NO: 2096871 - RNA, 21 nt, Homo sapiens
uagucacuuguuucuacucaa

SEQ ID NO: 2096872 - RNA, 16 nt, Homo sapiens
aaggcccugcugaguc

SEQ ID NO: 2096873 - RNA, 18 nt, Homo sapiens
aguugauagguuguuaaa

SEQ ID NO: 2096874 - RNA, 23 nt, Homo sapiens
gaacccuaaaaaugaauaagcua

SEQ ID NO: 2096875 - RNA, 13 nt, Homo sapiens
cagcaacaaugac

SEQ ID NO: 2096876 - RNA, 13 nt, Homo sapiens
aagaaacacugcc

SEQ ID NO: 2096877 - RNA, 17 nt, Homo sapiens
agccaaguggggugcug

SEQ ID NO: 2096878 - RNA, 18 nt, Homo sapiens
uauauccacaucuaagaa

SEQ ID NO: 2096879 - RNA, 14 nt, Homo sapiens
ccuugaggucucag

SEQ ID NO: 2096880 - RNA, 18 nt, Homo sapiens
caugaaggagaggauuug

SEQ ID NO: 2096881 - RNA, 19 nt, Homo sapiens
acaucuguccuacacuuga

SEQ ID NO: 2096882 - RNA, 14 nt, Homo sapiens
aauuuuaguuguca

SEQ ID NO: 2096883 - RNA, 13 nt, Homo sapiens
cuguuaguauuaa

SEQ ID NO: 2096884 - RNA, 12 nt, Homo sapiens
uagccaucucaa

SEQ ID NO: 2096885 - RNA, 19 nt, Homo sapiens
gccaaagaaaugaacauuc

SEQ ID NO: 2096886 - RNA, 13 nt, Homo sapiens
aagcaauugucug

SEQ ID NO: 2096887 - RNA, 23 nt, Homo sapiens
ccucgguucaaaaccuugcacag

SEQ ID NO: 2096888 - RNA, 14 nt, Homo sapiens
ucauaacuuuccaa

SEQ ID NO: 2096889 - RNA, 19 nt, Homo sapiens
aaaaauuguauuguauaua

SEQ ID NO: 2096890 - RNA, 18 nt, Homo sapiens
aguuauuccccaucuucc

SEQ ID NO: 2096891 - RNA, 17 nt, Homo sapiens
gauucugccuuugccag

SEQ ID NO: 2096892 - RNA, 20 nt, Homo sapiens
gauauuuccuucaccaccuc

SEQ ID NO: 2096893 - RNA, 17 nt, Homo sapiens
auggaauauacauguaa

SEQ ID NO: 2096894 - RNA, 22 nt, Homo sapiens
gagacaaaccugggcaaugugg

SEQ ID NO: 2096895 - RNA, 16 nt, Homo sapiens
aauaucauacuguuca

SEQ ID NO: 2096896 - RNA, 20 nt, Homo sapiens
uuaaugaaugccuaaauaua

SEQ ID NO: 2096897 - RNA, 16 nt, Homo sapiens
gcccgagcuguuguau

SEQ ID NO: 2096898 - RNA, 23 nt, Homo sapiens
ccagagacaaucuagcacuuuaa

SEQ ID NO: 2096899 - RNA, 16 nt, Homo sapiens
caagggggugacugga

SEQ ID NO: 2096900 - RNA, 16 nt, Homo sapiens
guuggugacaccucac

SEQ ID NO: 2096901 - RNA, 14 nt, Homo sapiens
caaagacugcagua

SEQ ID NO: 2096902 - RNA, 20 nt, Homo sapiens
agaucuaaaaauaacuguaa

SEQ ID NO: 2096903 - RNA, 18 nt, Homo sapiens
auggaggaaagugauauc

SEQ ID NO: 2096904 - RNA, 16 nt, Homo sapiens
gaacacaggcccagau

SEQ ID NO: 2096905 - RNA, 13 nt, Homo sapiens
caagcaucagcaa

SEQ ID NO: 2096906 - RNA, 21 nt, Homo sapiens
uagccacagcugcuguucuca

SEQ ID NO: 2096907 - RNA, 20 nt, Homo sapiens
aaaagguuaaauauugucau

SEQ ID NO: 2096908 - RNA, 18 nt, Homo sapiens
gugguuuucuuuugccau

SEQ ID NO: 2096909 - RNA, 13 nt, Homo sapiens
caucuagugacaa

SEQ ID NO: 2096910 - RNA, 22 nt, Homo sapiens
gcauacacacauauaauggaag

SEQ ID NO: 2096911 - RNA, 17 nt, Homo sapiens
uauugacucaaaccaua

SEQ ID NO: 2096912 - RNA, 22 nt, Homo sapiens
aggaaagauuugugaacuggaa

SEQ ID NO: 2096913 - RNA, 20 nt, Homo sapiens
ucagaagaaaggcauugcac

SEQ ID NO: 2096914 - RNA, 12 nt, Homo sapiens
gaaacaggaaac

SEQ ID NO: 2096915 - RNA, 16 nt, Homo sapiens
gccaaauuucuuuugc

SEQ ID NO: 2096916 - RNA, 22 nt, Homo sapiens
agucaagcuguugaagucucag

SEQ ID NO: 2096917 - RNA, 19 nt, Homo sapiens
aacauggccuuugcuugaa

SEQ ID NO: 2096918 - RNA, 22 nt, Homo sapiens
acuucuggccuuuccuagcuag

SEQ ID NO: 2096919 - RNA, 19 nt, Homo sapiens
gaaguuaaaaugauuuaca

SEQ ID NO: 2096920 - RNA, 20 nt, Homo sapiens
aaugcuauacagcugggaac

SEQ ID NO: 2096921 - RNA, 22 nt, Homo sapiens
agcuauuuucaacauaacugaa

SEQ ID NO: 2096922 - RNA, 18 nt, Homo sapiens
uuucugugccaaagcagc

SEQ ID NO: 2096923 - RNA, 22 nt, Homo sapiens
aaacaucaguuacucugaaggg

SEQ ID NO: 2096924 - RNA, 11 nt, Homo sapiens
gaaguuucauc

SEQ ID NO: 2096925 - RNA, 23 nt, Homo sapiens
uccucccucccagcugcacuuua

SEQ ID NO: 2096926 - RNA, 16 nt, Homo sapiens
uuuguuacuuccuuau

SEQ ID NO: 2096927 - RNA, 19 nt, Homo sapiens
cagaaaaaaauaacuauuu

SEQ ID NO: 2096928 - RNA, 13 nt, Homo sapiens
cucacugcaguag

SEQ ID NO: 2096929 - RNA, 16 nt, Homo sapiens
cuccagagaaacccag

SEQ ID NO: 2096930 - RNA, 17 nt, Homo sapiens
uugcuaacaaugcucug

SEQ ID NO: 2096931 - RNA, 16 nt, Homo sapiens
cagccuuacccagucc

SEQ ID NO: 2096932 - RNA, 14 nt, Homo sapiens
ggcuuccugaugau

SEQ ID NO: 2096933 - RNA, 21 nt, Homo sapiens
ugccuuccugccuagucucac

SEQ ID NO: 2096934 - RNA, 21 nt, Homo sapiens
acucuuuccuaaagccaaagu

SEQ ID NO: 2096935 - RNA, 13 nt, Homo sapiens
caucuuccuggac

SEQ ID NO: 2096936 - RNA, 23 nt, Homo sapiens
ucucagaacagucugaaauaccu

SEQ ID NO: 2096937 - RNA, 17 nt, Homo sapiens
cuuuagccaagcuccuc

SEQ ID NO: 2096938 - RNA, 14 nt, Homo sapiens
ucaaaaucaauuaa

SEQ ID NO: 2096939 - RNA, 20 nt, Homo sapiens
ccuccucaggcacacagcua

SEQ ID NO: 2096940 - RNA, 22 nt, Homo sapiens
gcaggcugcaacccuggugugc

SEQ ID NO: 2096941 - RNA, 21 nt, Homo sapiens
acaauuuagcuuaaucagaaa

SEQ ID NO: 2096942 - RNA, 14 nt, Homo sapiens
gaugugaucacuuu

SEQ ID NO: 2096943 - RNA, 19 nt, Homo sapiens
uugccauggucaccaaaca

SEQ ID NO: 2096944 - RNA, 21 nt, Homo sapiens
aagccugcccuugucugagau

SEQ ID NO: 2096945 - RNA, 16 nt, Homo sapiens
ucauaccuacauucaa

SEQ ID NO: 2096946 - RNA, 17 nt, Homo sapiens
augccagcuuaucucag

SEQ ID NO: 2096947 - RNA, 15 nt, Homo sapiens
aaugacggcaaacuc

SEQ ID NO: 2096948 - RNA, 13 nt, Homo sapiens
uuguuauuuugga

SEQ ID NO: 2096949 - RNA, 16 nt, Homo sapiens
caguguccucaggggc

SEQ ID NO: 2096950 - RNA, 15 nt, Homo sapiens
cuuuaaagagaguuu

SEQ ID NO: 2096951 - RNA, 13 nt, Homo sapiens
cucaauaauuucc

SEQ ID NO: 2096952 - RNA, 15 nt, Homo sapiens
gauuaaaaauaccuu

SEQ ID NO: 2096953 - RNA, 15 nt, Homo sapiens
aguaaagaacauccc

SEQ ID NO: 2096954 - RNA, 17 nt, Homo sapiens
uagaacacugcauuaga

SEQ ID NO: 2096955 - RNA, 15 nt, Homo sapiens
ugccacacaaccaga

SEQ ID NO: 2096956 - RNA, 21 nt, Homo sapiens
uccuggggaggauacugaggc

SEQ ID NO: 2096957 - RNA, 23 nt, Homo sapiens
cgcacauagcucaaucacacugg

SEQ ID NO: 2096958 - RNA, 17 nt, Homo sapiens
caguuucuugaagucca

SEQ ID NO: 2096959 - RNA, 13 nt, Homo sapiens
auucaagcuucau

SEQ ID NO: 2096960 - RNA, 21 nt, Homo sapiens
aaacauaccaacauguuuaaa

SEQ ID NO: 2096961 - RNA, 16 nt, Homo sapiens
gacuuuaugcaauaaa

SEQ ID NO: 2096962 - RNA, 21 nt, Homo sapiens
gauuagaaagaauuagccaac

SEQ ID NO: 2096963 - RNA, 20 nt, Homo sapiens
agcagggaagccccagugag

SEQ ID NO: 2096964 - RNA, 18 nt, Homo sapiens
uggcggggagaagcuuuu

SEQ ID NO: 2096965 - RNA, 20 nt, Homo sapiens
uuuaaaaaaaaaaacaaagc

SEQ ID NO: 2096966 - RNA, 23 nt, Homo sapiens
acuaccuugguucccccacugau

SEQ ID NO: 2096967 - RNA, 16 nt, Homo sapiens
ugugaaguacaauaau

SEQ ID NO: 2096968 - RNA, 20 nt, Homo sapiens
caaguuggguucacuugcca

SEQ ID NO: 2096969 - RNA, 21 nt, Homo sapiens
cuagcaucucaugagugccaa

SEQ ID NO: 2096970 - RNA, 23 nt, Homo sapiens
uggggugucaauaaagcugugcu

SEQ ID NO: 2096971 - RNA, 14 nt, Homo sapiens
ucugccaucuuuag

SEQ ID NO: 2096972 - RNA, 21 nt, Homo sapiens
auuauucccauucuacauacu

SEQ ID NO: 2096973 - RNA, 13 nt, Homo sapiens
uuauuacugagag

SEQ ID NO: 2096974 - RNA, 17 nt, Homo sapiens
aauauccuaaacaucau

SEQ ID NO: 2096975 - RNA, 12 nt, Homo sapiens
gagagacacugg

SEQ ID NO: 2096976 - RNA, 18 nt, Homo sapiens
cuaaaaaugucacgaaua

SEQ ID NO: 2096977 - RNA, 20 nt, Homo sapiens
ucccucccagagaacagggg

SEQ ID NO: 2096978 - RNA, 18 nt, Homo sapiens
uuauucccaguguuccau

SEQ ID NO: 2096979 - RNA, 12 nt, Homo sapiens
cucaacuuuaag

SEQ ID NO: 2096980 - RNA, 17 nt, Homo sapiens
uguuccuggcugaugau

SEQ ID NO: 2096981 - RNA, 22 nt, Homo sapiens
guagcaguaucucauugcuguu

SEQ ID NO: 2096982 - RNA, 21 nt, Homo sapiens
acuaaguguguauccagaaga

SEQ ID NO: 2096983 - RNA, 22 nt, Homo sapiens
uacuuucuguguugaagcacug

SEQ ID NO: 2096984 - RNA, 19 nt, Homo sapiens
auaucauuuauccuuacau

SEQ ID NO: 2096985 - RNA, 18 nt, Homo sapiens
aaaggaaauaauugccaa

SEQ ID NO: 2096986 - RNA, 23 nt, Homo sapiens
uaucuagccuggaaccaagguua

SEQ ID NO: 2096987 - RNA, 15 nt, Homo sapiens
aauaaaaacccugua

SEQ ID NO: 2096988 - RNA, 15 nt, Homo sapiens
aauuauaacccagaa

SEQ ID NO: 2096989 - RNA, 15 nt, Homo sapiens
agaacagaucaggaa

SEQ ID NO: 2096990 - RNA, 15 nt, Homo sapiens
acuagagaugugcaa

SEQ ID NO: 2096991 - RNA, 19 nt, Homo sapiens
cugugaccgggguccugag

SEQ ID NO: 2096992 - RNA, 17 nt, Homo sapiens
caauggagucugcagug

SEQ ID NO: 2096993 - RNA, 22 nt, Homo sapiens
aaaggggauggagugagcccau

SEQ ID NO: 2096994 - RNA, 19 nt, Homo sapiens
ucuuccucccugggggccc

SEQ ID NO: 2096995 - RNA, 16 nt, Homo sapiens
aaguuuucaugugcuc

SEQ ID NO: 2096996 - RNA, 15 nt, Homo sapiens
gggcugcccuggugc

SEQ ID NO: 2096997 - RNA, 23 nt, Homo sapiens
gauucuagguugaaaauguuaua

SEQ ID NO: 2096998 - RNA, 18 nt, Homo sapiens
gccggcucuuuccuugcu

SEQ ID NO: 2096999 - RNA, 18 nt, Homo sapiens
caggggccugcccagugc

SEQ ID NO: 2097000 - RNA, 14 nt, Homo sapiens
ugagccccuacccc

SEQ ID NO: 2097001 - RNA, 14 nt, Homo sapiens
cuaagcaugugucc

SEQ ID NO: 2097002 - RNA, 19 nt, Homo sapiens
gcuaaggaguaguggcccu

SEQ ID NO: 2097003 - RNA, 21 nt, Homo sapiens
aaaacauuguuuuguguaaca

SEQ ID NO: 2097004 - RNA, 17 nt, Homo sapiens
gcgugggcgcuugcacc

SEQ ID NO: 2097005 - RNA, 15 nt, Homo sapiens
aucaguucauggcau

SEQ ID NO: 2097006 - RNA, 17 nt, Homo sapiens
aaaaugaaucuucacaa

SEQ ID NO: 2097007 - RNA, 17 nt, Homo sapiens
agcauuuaggaaugaag

SEQ ID NO: 2097008 - RNA, 18 nt, Homo sapiens
caagccugucuucagaga

SEQ ID NO: 2097009 - RNA, 22 nt, Homo sapiens
agccauaugcccucaucauccc

SEQ ID NO: 2097010 - RNA, 21 nt, Homo sapiens
cccaauuacagggugacucac

SEQ ID NO: 2097011 - RNA, 17 nt, Homo sapiens
auucuccuuugcacugu

SEQ ID NO: 2097012 - RNA, 17 nt, Homo sapiens
gaacaagcaaacccaga

SEQ ID NO: 2097013 - RNA, 14 nt, Homo sapiens
uuuacagcacugua

SEQ ID NO: 2097014 - RNA, 13 nt, Homo sapiens
gcaaguuacugca

SEQ ID NO: 2097015 - RNA, 21 nt, Homo sapiens
guugugcauuuguucagcucc

SEQ ID NO: 2097016 - RNA, 17 nt, Homo sapiens
auucuaggaugaacaau

SEQ ID NO: 2097017 - RNA, 13 nt, Homo sapiens
cuagucacuuguu

SEQ ID NO: 2097018 - RNA, 15 nt, Homo sapiens
uccagacuaugcagc

SEQ ID NO: 2097019 - RNA, 22 nt, Homo sapiens
acuacaguaacugugacugaug

SEQ ID NO: 2097020 - RNA, 21 nt, Homo sapiens
cugcagugauguauacaucuu

SEQ ID NO: 2097021 - RNA, 14 nt, Homo sapiens
ggcgugacuucaga

SEQ ID NO: 2097022 - RNA, 13 nt, Homo sapiens
uacgggaggguaa

SEQ ID NO: 2097023 - RNA, 19 nt, Homo sapiens
ccugaagcaacacugccag

SEQ ID NO: 2097024 - RNA, 14 nt, Homo sapiens
agguauagaugccg

SEQ ID NO: 2097025 - RNA, 13 nt, Homo sapiens
uuuauguuguaug

SEQ ID NO: 2097026 - RNA, 12 nt, Homo sapiens
cagaguguccuu

SEQ ID NO: 2097027 - RNA, 19 nt, Homo sapiens
cuuuuaguaaaaacauuua

SEQ ID NO: 2097028 - RNA, 21 nt, Homo sapiens
auuucaugcacugauuaaaau

SEQ ID NO: 2097029 - RNA, 19 nt, Homo sapiens
auguuaauauugugcaaac

SEQ ID NO: 2097030 - RNA, 13 nt, Homo sapiens
cuugcacacauca

SEQ ID NO: 2097031 - RNA, 13 nt, Homo sapiens
aaggaacaaugcc

SEQ ID NO: 2097032 - RNA, 23 nt, Homo sapiens
cuccacauuaggucaccugugca

SEQ ID NO: 2097033 - RNA, 23 nt, Homo sapiens
gauugcagcuuuauguucauuug

SEQ ID NO: 2097034 - RNA, 15 nt, Homo sapiens
uuuccugaucuagca

SEQ ID NO: 2097035 - RNA, 17 nt, Homo sapiens
auugugagacacuaaaa

SEQ ID NO: 2097036 - RNA, 22 nt, Homo sapiens
cagaggccuauaacuuuuggua

SEQ ID NO: 2097037 - RNA, 16 nt, Homo sapiens
caacuuuuuaauucca

SEQ ID NO: 2097038 - RNA, 21 nt, Homo sapiens
cagucuguguuuacagacaga

SEQ ID NO: 2097039 - RNA, 13 nt, Homo sapiens
uucccucuguaua

SEQ ID NO: 2097040 - RNA, 12 nt, Homo sapiens
uuuacaguauuu

SEQ ID NO: 2097041 - RNA, 12 nt, Homo sapiens
acauugagauca

SEQ ID NO: 2097042 - RNA, 22 nt, Homo sapiens
gcacaaaguuggugccaagcuu

SEQ ID NO: 2097043 - RNA, 20 nt, Homo sapiens
aggaacacaugcacacacac

SEQ ID NO: 2097044 - RNA, 20 nt, Homo sapiens
auucuuagaauaucuaagaa

SEQ ID NO: 2097045 - RNA, 19 nt, Homo sapiens
cuggaugucugggugaccu

SEQ ID NO: 2097046 - RNA, 21 nt, Homo sapiens
caaccgcaucugcucaucuga

SEQ ID NO: 2097047 - RNA, 15 nt, Homo sapiens
uuaaaagaguagaaa

SEQ ID NO: 2097048 - RNA, 17 nt, Homo sapiens
auguacaaagauacuug

SEQ ID NO: 2097049 - RNA, 15 nt, Homo sapiens
aaguaaaccaaaaag

SEQ ID NO: 2097050 - RNA, 13 nt, Homo sapiens
uacuaaagcuaua

SEQ ID NO: 2097051 - RNA, 13 nt, Homo sapiens
cucuuaaguaauu

SEQ ID NO: 2097052 - RNA, 20 nt, Homo sapiens
aaaauauucaugcuugccau

SEQ ID NO: 2097053 - RNA, 16 nt, Homo sapiens
cagcacauugauaaga

SEQ ID NO: 2097054 - RNA, 16 nt, Homo sapiens
gaaaucccaucugcau

SEQ ID NO: 2097055 - RNA, 18 nt, Homo sapiens
gcaaccgugguuacugua

SEQ ID NO: 2097056 - RNA, 15 nt, Homo sapiens
guaugggacaggugc

SEQ ID NO: 2097057 - RNA, 15 nt, Homo sapiens
uuucuagagacaaca

SEQ ID NO: 2097058 - RNA, 16 nt, Homo sapiens
cugcuaccucacuggg

SEQ ID NO: 2097059 - RNA, 17 nt, Homo sapiens
ccucauuggcucuugaa

SEQ ID NO: 2097060 - RNA, 24 nt, Homo sapiens
aacccuuuaaauggggacgcagau

SEQ ID NO: 2097061 - RNA, 16 nt, Homo sapiens
guuaaugcugaaacau

SEQ ID NO: 2097062 - RNA, 21 nt, Homo sapiens
gccauugcagcuugaaaaaga

SEQ ID NO: 2097063 - RNA, 17 nt, Homo sapiens
agacuugcuuuggucac

SEQ ID NO: 2097064 - RNA, 13 nt, Homo sapiens
guccaacuacuaa

SEQ ID NO: 2097065 - RNA, 15 nt, Homo sapiens
ugagcagcugggauu

SEQ ID NO: 2097066 - RNA, 18 nt, Homo sapiens
ggccaggcucccugacca

SEQ ID NO: 2097067 - RNA, 15 nt, Homo sapiens
cuccauuaaccaaga

SEQ ID NO: 2097068 - RNA, 17 nt, Homo sapiens
gaccaaagacugcagaa

SEQ ID NO: 2097069 - RNA, 23 nt, Homo sapiens
ugaauaugauuaguaaagaaaug

SEQ ID NO: 2097070 - RNA, 20 nt, Homo sapiens
cucuguaaaaacacugaaaa

SEQ ID NO: 2097071 - RNA, 13 nt, Homo sapiens
gaagacaauguga

SEQ ID NO: 2097072 - RNA, 23 nt, Homo sapiens
auccaagcgaggucaacagagaa

SEQ ID NO: 2097073 - RNA, 13 nt, Homo sapiens
ucuguuauacaca

SEQ ID NO: 2097074 - RNA, 21 nt, Homo sapiens
ucaccauuaggucacuuaaga

SEQ ID NO: 2097075 - RNA, 18 nt, Homo sapiens
aaacuuggauacuuggau

SEQ ID NO: 2097076 - RNA, 12 nt, Homo sapiens
ugccccaugaaa

SEQ ID NO: 2097077 - RNA, 14 nt, Homo sapiens
caacugaauagcaa

SEQ ID NO: 2097078 - RNA, 23 nt, Homo sapiens
gucuccaccccuacacaaggaca

SEQ ID NO: 2097079 - RNA, 20 nt, Homo sapiens
augucuauuauauuuacuua

SEQ ID NO: 2097080 - RNA, 19 nt, Homo sapiens
guugcugugugguuuggug

SEQ ID NO: 2097081 - RNA, 16 nt, Homo sapiens
ugcagggguccacugu

SEQ ID NO: 2097082 - RNA, 24 nt, Homo sapiens
acaaauuuggccuuaagaacugug

SEQ ID NO: 2097083 - RNA, 14 nt, Homo sapiens
aagcauacuugaca

SEQ ID NO: 2097084 - RNA, 14 nt, Homo sapiens
cuauuuccaaagcu

SEQ ID NO: 2097085 - RNA, 15 nt, Homo sapiens
aaggcagaguacaaa

SEQ ID NO: 2097086 - RNA, 16 nt, Homo sapiens
ucaaauuggagcuuca

SEQ ID NO: 2097087 - RNA, 22 nt, Homo sapiens
aaaccauuuuguuauugacuaa

SEQ ID NO: 2097088 - RNA, 12 nt, Homo sapiens
ucucuguuacac

SEQ ID NO: 2097089 - RNA, 11 nt, Homo sapiens
gcaauguggaa

SEQ ID NO: 2097090 - RNA, 16 nt, Homo sapiens
gcacuguaauauguac

SEQ ID NO: 2097091 - RNA, 17 nt, Homo sapiens
cuccagcgguccaaagu

SEQ ID NO: 2097092 - RNA, 13 nt, Homo sapiens
gcuaaaagggaaa

SEQ ID NO: 2097093 - RNA, 17 nt, Homo sapiens
cuggagacguggaaccu

SEQ ID NO: 2097094 - RNA, 17 nt, Homo sapiens
uggcaaaugggcagcuc

SEQ ID NO: 2097095 - RNA, 13 nt, Homo sapiens
ucuugaagugaug

SEQ ID NO: 2097096 - RNA, 20 nt, Homo sapiens
aauacaccgauaaccacagg

SEQ ID NO: 2097097 - RNA, 14 nt, Homo sapiens
gucucacauauuca

SEQ ID NO: 2097098 - RNA, 19 nt, Homo sapiens
cauggaugugucucaggca

SEQ ID NO: 2097099 - RNA, 19 nt, Homo sapiens
cugggacuaaguguaccag

SEQ ID NO: 2097100 - RNA, 21 nt, Homo sapiens
gcagagcugagggcccugugg

SEQ ID NO: 2097101 - RNA, 16 nt, Homo sapiens
acuacgcugauuugau

SEQ ID NO: 2097102 - RNA, 14 nt, Homo sapiens
cuuuacguacugua

SEQ ID NO: 2097103 - RNA, 18 nt, Homo sapiens
aguuggucccccuuccau

SEQ ID NO: 2097104 - RNA, 23 nt, Homo sapiens
cagaaggaaagaagggggcccug

SEQ ID NO: 2097105 - RNA, 20 nt, Homo sapiens
auccauuucuaauguaugca

SEQ ID NO: 2097106 - RNA, 14 nt, Homo sapiens
ccagaucagguaua

SEQ ID NO: 2097107 - RNA, 15 nt, Homo sapiens
acccuugucaucucu

SEQ ID NO: 2097108 - RNA, 15 nt, Homo sapiens
aggagcaaaauugcc

SEQ ID NO: 2097109 - RNA, 14 nt, Homo sapiens
acccauaaccauac

SEQ ID NO: 2097110 - RNA, 18 nt, Homo sapiens
uuuuuaaaaaacugcuga

SEQ ID NO: 2097111 - RNA, 16 nt, Homo sapiens
cuagguuucaccuccc

SEQ ID NO: 2097112 - RNA, 23 nt, Homo sapiens
acggcuuauuagugaaacugggg

SEQ ID NO: 2097113 - RNA, 20 nt, Homo sapiens
cucuacccauccccugaugc

SEQ ID NO: 2097114 - RNA, 14 nt, Homo sapiens
ccagcgcaccuguu

SEQ ID NO: 2097115 - RNA, 20 nt, Homo sapiens
cucaugaugccuuuuuauau

SEQ ID NO: 2097116 - RNA, 18 nt, Homo sapiens
gugcuuccaacaaggaca

SEQ ID NO: 2097117 - RNA, 21 nt, Homo sapiens
cuugggaaaaaaacuuggcac

SEQ ID NO: 2097118 - RNA, 19 nt, Homo sapiens
aaauggacaaacagugcac

SEQ ID NO: 2097119 - RNA, 16 nt, Homo sapiens
aagagacuccgucuca

SEQ ID NO: 2097120 - RNA, 15 nt, Homo sapiens
ugcaaugccaggugg

SEQ ID NO: 2097121 - RNA, 14 nt, Homo sapiens
aagcagagcucaca

SEQ ID NO: 2097122 - RNA, 17 nt, Homo sapiens
acuuuugccauugacuu

SEQ ID NO: 2097123 - RNA, 15 nt, Homo sapiens
cauguagcaaucaga

SEQ ID NO: 2097124 - RNA, 18 nt, Homo sapiens
auuagaaguuaccaaauu

SEQ ID NO: 2097125 - RNA, 17 nt, Homo sapiens
auuuaggguacuauuca

SEQ ID NO: 2097126 - RNA, 14 nt, Homo sapiens
gagcuuucugcuau

SEQ ID NO: 2097127 - RNA, 19 nt, Homo sapiens
cacagugaucgaugauuca

SEQ ID NO: 2097128 - RNA, 16 nt, Homo sapiens
cagaaauaguugucug

SEQ ID NO: 2097129 - RNA, 13 nt, Homo sapiens
cugaacacuguga

SEQ ID NO: 2097130 - RNA, 16 nt, Homo sapiens
guagauguaugcacac

SEQ ID NO: 2097131 - RNA, 12 nt, Homo sapiens
ggcuaagugauc

SEQ ID NO: 2097132 - RNA, 15 nt, Homo sapiens
agcccuaaugucuga

SEQ ID NO: 2097133 - RNA, 20 nt, Homo sapiens
agaaucccuuugcaccugag

SEQ ID NO: 2097134 - RNA, 16 nt, Homo sapiens
uuuugucuuugcugua

SEQ ID NO: 2097135 - RNA, 21 nt, Homo sapiens
gauuauguccuacaaugucaa

SEQ ID NO: 2097136 - RNA, 19 nt, Homo sapiens
uacaugcugugcucuuuga

SEQ ID NO: 2097137 - RNA, 16 nt, Homo sapiens
auaauucuguacauag

SEQ ID NO: 2097138 - RNA, 16 nt, Homo sapiens
cccuggggcauccacc

SEQ ID NO: 2097139 - RNA, 17 nt, Homo sapiens
cacagagauucugaacu

SEQ ID NO: 2097140 - RNA, 21 nt, Homo sapiens
auuuuggaaagauuauccugu

SEQ ID NO: 2097141 - RNA, 20 nt, Homo sapiens
gaaucagguuuccaaucaac

SEQ ID NO: 2097142 - RNA, 15 nt, Homo sapiens
uaacucggauuccag

SEQ ID NO: 2097143 - RNA, 15 nt, Homo sapiens
ucacagagugcauug

SEQ ID NO: 2097144 - RNA, 16 nt, Homo sapiens
agugucugaugaaugu

SEQ ID NO: 2097145 - RNA, 17 nt, Homo sapiens
uggaggaauucagcuca

SEQ ID NO: 2097146 - RNA, 22 nt, Homo sapiens
caguaggagacacgacagcaca

SEQ ID NO: 2097147 - RNA, 22 nt, Homo sapiens
ugugaccaucccaacaccucac

SEQ ID NO: 2097148 - RNA, 14 nt, Homo sapiens
ucaaggguuuucca

SEQ ID NO: 2097149 - RNA, 10 nt, Homo sapiens
cgaaacugcc

SEQ ID NO: 2097150 - RNA, 19 nt, Homo sapiens
uuagaaacucaaaaacuga

SEQ ID NO: 2097151 - RNA, 14 nt, Homo sapiens
acaaacaagcacau

SEQ ID NO: 2097152 - RNA, 23 nt, Homo sapiens
aggaaaaaauaauauccauacag

SEQ ID NO: 2097153 - RNA, 23 nt, Homo sapiens
aggccaguuugaagacuacauga

SEQ ID NO: 2097154 - RNA, 13 nt, Homo sapiens
cccccacuuggga

SEQ ID NO: 2097155 - RNA, 21 nt, Homo sapiens
cagugaaccaaagagacugga

SEQ ID NO: 2097156 - RNA, 14 nt, Homo sapiens
ccuugcucugccau

SEQ ID NO: 2097157 - RNA, 22 nt, Homo sapiens
ugcugcaggagccgcugcugag

SEQ ID NO: 2097158 - RNA, 13 nt, Homo sapiens
gaagccuagggga

SEQ ID NO: 2097159 - RNA, 15 nt, Homo sapiens
cauugaaagugcuuc

SEQ ID NO: 2097160 - RNA, 22 nt, Homo sapiens
auuuucucuauacauagagcuc

SEQ ID NO: 2097161 - RNA, 13 nt, Homo sapiens
ucauaucaagaaa

SEQ ID NO: 2097162 - RNA, 21 nt, Homo sapiens
aagacaauucauucauuugca

SEQ ID NO: 2097163 - RNA, 21 nt, Homo sapiens
ugagagagggggcacuguggu

SEQ ID NO: 2097164 - RNA, 21 nt, Homo sapiens
ugaguuucaacacuagcauuu

SEQ ID NO: 2097165 - RNA, 22 nt, Homo sapiens
ucaacccauauuucauccagga

SEQ ID NO: 2097166 - RNA, 22 nt, Homo sapiens
gcucacuguucuauucaucuca

SEQ ID NO: 2097167 - RNA, 12 nt, Homo sapiens
cacacugugaca

SEQ ID NO: 2097168 - RNA, 12 nt, Homo sapiens
ccugcugugcug

SEQ ID NO: 2097169 - RNA, 12 nt, Homo sapiens
gucacugucuca

SEQ ID NO: 2097170 - RNA, 17 nt, Homo sapiens
uccagcaccauccgcca

SEQ ID NO: 2097171 - RNA, 22 nt, Homo sapiens
caaaaaaagcaucucacugcaa

SEQ ID NO: 2097172 - RNA, 20 nt, Homo sapiens
auagcuaguauaacuuuaca

SEQ ID NO: 2097173 - RNA, 15 nt, Homo sapiens
aacauguacacuggu

SEQ ID NO: 2097174 - RNA, 15 nt, Homo sapiens
auuuuuuaaagcuac

SEQ ID NO: 2097175 - RNA, 19 nt, Homo sapiens
cugggaggucuccacugag

SEQ ID NO: 2097176 - RNA, 18 nt, Homo sapiens
gcauccuccagggggccc

SEQ ID NO: 2097177 - RNA, 18 nt, Homo sapiens
aaucccagacuacuucag

SEQ ID NO: 2097178 - RNA, 18 nt, Homo sapiens
uuccccagugacuccagg

SEQ ID NO: 2097179 - RNA, 22 nt, Homo sapiens
guuauggaggucugacuaggca

SEQ ID NO: 2097180 - RNA, 18 nt, Homo sapiens
caaggauccagacucuca

SEQ ID NO: 2097181 - RNA, 16 nt, Homo sapiens
gaugucaagugucagu

SEQ ID NO: 2097182 - RNA, 14 nt, Homo sapiens
ggccacacagcagc

SEQ ID NO: 2097183 - RNA, 14 nt, Homo sapiens
gggaggacaggcag

SEQ ID NO: 2097184 - RNA, 13 nt, Homo sapiens
ucagcccugcucc

SEQ ID NO: 2097185 - RNA, 17 nt, Homo sapiens
cucauuuguccaugugc

SEQ ID NO: 2097186 - RNA, 12 nt, Homo sapiens
uuuuuaguaugu

SEQ ID NO: 2097187 - RNA, 14 nt, Homo sapiens
aagaauaccaauau

SEQ ID NO: 2097188 - RNA, 22 nt, Homo sapiens
auucacugugcacuuugcucaa

SEQ ID NO: 2097189 - RNA, 16 nt, Homo sapiens
auuuuguggucauuaa

SEQ ID NO: 2097190 - RNA, 22 nt, Homo sapiens
augugaguugcacagcuaugaa

SEQ ID NO: 2097191 - RNA, 13 nt, Homo sapiens
gaugugggguccc

SEQ ID NO: 2097192 - RNA, 18 nt, Homo sapiens
ggacacaaaaaaauggaa

SEQ ID NO: 2097193 - RNA, 16 nt, Homo sapiens
guuauucaaguauuca

SEQ ID NO: 2097194 - RNA, 16 nt, Homo sapiens
aucaucauggcaucau

SEQ ID NO: 2097195 - RNA, 16 nt, Homo sapiens
gggaccugaugaccug

SEQ ID NO: 2097196 - RNA, 18 nt, Homo sapiens
gucuagucacgcaugcag

SEQ ID NO: 2097197 - RNA, 14 nt, Homo sapiens
ugugugugaacugg

SEQ ID NO: 2097198 - RNA, 22 nt, Homo sapiens
auagaugccgcggaaggucccu

SEQ ID NO: 2097199 - RNA, 21 nt, Homo sapiens
uugccuggauugggagccauu

SEQ ID NO: 2097200 - RNA, 14 nt, Homo sapiens
guuucagaugugca

SEQ ID NO: 2097201 - RNA, 20 nt, Homo sapiens
aacaaaaagaaaucuugucu

SEQ ID NO: 2097202 - RNA, 22 nt, Homo sapiens
gcuguugcgcucccaccucagc

SEQ ID NO: 2097203 - RNA, 22 nt, Homo sapiens
gaggcagccccauucugccugc

SEQ ID NO: 2097204 - RNA, 14 nt, Homo sapiens
agaaccgagcaaag

SEQ ID NO: 2097205 - RNA, 15 nt, Homo sapiens
uagugguaugucucu

SEQ ID NO: 2097206 - RNA, 14 nt, Homo sapiens
cuacuuuacuguug

SEQ ID NO: 2097207 - RNA, 21 nt, Homo sapiens
agcuuugaaauaaaauaacaa

SEQ ID NO: 2097208 - RNA, 17 nt, Homo sapiens
gggugcugccagcugcu

SEQ ID NO: 2097209 - RNA, 17 nt, Homo sapiens
cuuucccuuuuccauca

SEQ ID NO: 2097210 - RNA, 20 nt, Homo sapiens
ucccaaguaacugggauuac

SEQ ID NO: 2097211 - RNA, 21 nt, Homo sapiens
cucaugaauaauccaccccuu

SEQ ID NO: 2097212 - RNA, 12 nt, Homo sapiens
acacacauggaa

SEQ ID NO: 2097213 - RNA, 15 nt, Homo sapiens
gaucacuuuguuaaa

SEQ ID NO: 2097214 - RNA, 22 nt, Homo sapiens
guucagugggaaugcagugggu

SEQ ID NO: 2097215 - RNA, 16 nt, Homo sapiens
cucaugaggccaugca

SEQ ID NO: 2097216 - RNA, 18 nt, Homo sapiens
agaaagaaguuaacuaca

SEQ ID NO: 2097217 - RNA, 20 nt, Homo sapiens
cugagcacuguuuauacacu

SEQ ID NO: 2097218 - RNA, 16 nt, Homo sapiens
gcauaaauaugcagug

SEQ ID NO: 2097219 - RNA, 16 nt, Homo sapiens
ugcccgggcucccaca

SEQ ID NO: 2097220 - RNA, 15 nt, Homo sapiens
ccucagcucccacaa

SEQ ID NO: 2097221 - RNA, 13 nt, Homo sapiens
cguguagcuauau

SEQ ID NO: 2097222 - RNA, 20 nt, Homo sapiens
caagagugagacuccgucuc

SEQ ID NO: 2097223 - RNA, 18 nt, Homo sapiens
gauaccacuuaacagguu

SEQ ID NO: 2097224 - RNA, 15 nt, Homo sapiens
ugccuauaucugaga

SEQ ID NO: 2097225 - RNA, 22 nt, Homo sapiens
cgaaaagaagguauuuuuccaa

SEQ ID NO: 2097226 - RNA, 15 nt, Homo sapiens
caaaccguacuguau

SEQ ID NO: 2097227 - RNA, 17 nt, Homo sapiens
agauuguugaaagccau

SEQ ID NO: 2097228 - RNA, 20 nt, Homo sapiens
cuuaaaggccgucauuucau

SEQ ID NO: 2097229 - RNA, 20 nt, Homo sapiens
cuauagcuaaguacacaaua

SEQ ID NO: 2097230 - RNA, 21 nt, Homo sapiens
uaugccaugugcggaauucaa

SEQ ID NO: 2097231 - RNA, 22 nt, Homo sapiens
aaaaggaaagaaaauaaaucua

SEQ ID NO: 2097232 - RNA, 15 nt, Homo sapiens
agggauaagccagcu

SEQ ID NO: 2097233 - RNA, 21 nt, Homo sapiens
gcuggaagaacugcaugggga

SEQ ID NO: 2097234 - RNA, 16 nt, Homo sapiens
uucucgugacaccacc

SEQ ID NO: 2097235 - RNA, 17 nt, Homo sapiens
uucuaaaugaagugcaa

SEQ ID NO: 2097236 - RNA, 22 nt, Homo sapiens
cuaauuagaaaucaacuugugg

SEQ ID NO: 2097237 - RNA, 12 nt, Homo sapiens
aggcacugucag

SEQ ID NO: 2097238 - RNA, 15 nt, Homo sapiens
cuuauuacguaugua

SEQ ID NO: 2097239 - RNA, 14 nt, Homo sapiens
ccagcacuggugaa

SEQ ID NO: 2097240 - RNA, 15 nt, Homo sapiens
uccuuugcagggcag

SEQ ID NO: 2097241 - RNA, 21 nt, Homo sapiens
ucaacucacccccuacacaca

SEQ ID NO: 2097242 - RNA, 19 nt, Homo sapiens
aaauaucaguauucugaca

SEQ ID NO: 2097243 - RNA, 13 nt, Homo sapiens
cccagcccggcuc

SEQ ID NO: 2097244 - RNA, 21 nt, Homo sapiens
gagaaacuuugaucucugcuu

SEQ ID NO: 2097245 - RNA, 19 nt, Homo sapiens
agcuaaauggcaacaaaca

SEQ ID NO: 2097246 - RNA, 13 nt, Homo sapiens
aucaugaagccca

SEQ ID NO: 2097247 - RNA, 23 nt, Homo sapiens
ggugcuugcuccccaagacacau

SEQ ID NO: 2097248 - RNA, 16 nt, Homo sapiens
caaaucuuaacuugaa

SEQ ID NO: 2097249 - RNA, 14 nt, Homo sapiens
ucccuccuaccugu

SEQ ID NO: 2097250 - RNA, 19 nt, Homo sapiens
auuuguuaaaaagacuguu

SEQ ID NO: 2097251 - RNA, 18 nt, Homo sapiens
augucacagggccaacuu

SEQ ID NO: 2097252 - RNA, 18 nt, Homo sapiens
uuguugccuucaucuuca

SEQ ID NO: 2097253 - RNA, 21 nt, Homo sapiens
cuaacauacuauauaagccag

SEQ ID NO: 2097254 - RNA, 17 nt, Homo sapiens
ccagacauggaccucca

SEQ ID NO: 2097255 - RNA, 22 nt, Homo sapiens
uaaaauacuauuuuuacugcca

SEQ ID NO: 2097256 - RNA, 16 nt, Homo sapiens
aacucugaaccaccuu

SEQ ID NO: 2097257 - RNA, 18 nt, Homo sapiens
aggaaaauuggacauuaa

SEQ ID NO: 2097258 - RNA, 17 nt, Homo sapiens
aucucccacaaguauau

SEQ ID NO: 2097259 - RNA, 19 nt, Homo sapiens
gcaguauuuaaaucuugca

SEQ ID NO: 2097260 - RNA, 22 nt, Homo sapiens
aucugccaagggccgacuaaga

SEQ ID NO: 2097261 - RNA, 11 nt, Homo sapiens
acgccacugca

SEQ ID NO: 2097262 - RNA, 11 nt, Homo sapiens
aagccacugaa

SEQ ID NO: 2097263 - RNA, 20 nt, Homo sapiens
agaaugcaagaguggacuga

SEQ ID NO: 2097264 - RNA, 21 nt, Homo sapiens
uuauuuccccaggugugugcu

SEQ ID NO: 2097265 - RNA, 16 nt, Homo sapiens
ccuggucgucuauccc

SEQ ID NO: 2097266 - RNA, 15 nt, Homo sapiens
uuccuggguauuuau

SEQ ID NO: 2097267 - RNA, 22 nt, Homo sapiens
acccaggcugguucuugggcua

SEQ ID NO: 2097268 - RNA, 13 nt, Homo sapiens
gccgaugcccaau

SEQ ID NO: 2097269 - RNA, 21 nt, Homo sapiens
gccggggcucugggugcugcc

SEQ ID NO: 2097270 - RNA, 16 nt, Homo sapiens
auccagucuucacugg

SEQ ID NO: 2097271 - RNA, 19 nt, Homo sapiens
uccaaaguacacuguuuca

SEQ ID NO: 2097272 - RNA, 19 nt, Homo sapiens
gaaaaaacuagagccugug

SEQ ID NO: 2097273 - RNA, 14 nt, Homo sapiens
agcuggacugacca

SEQ ID NO: 2097274 - RNA, 15 nt, Homo sapiens
ccuaaccccuuccag

SEQ ID NO: 2097275 - RNA, 20 nt, Homo sapiens
acccugucucuacuaaaaau

SEQ ID NO: 2097276 - RNA, 23 nt, Homo sapiens
gcacaauaacuaguaauaccaaa

SEQ ID NO: 2097277 - RNA, 19 nt, Homo sapiens
uuugacuuugcccaggcau

SEQ ID NO: 2097278 - RNA, 18 nt, Homo sapiens
agucucaaaaauacaaaa

SEQ ID NO: 2097279 - RNA, 22 nt, Homo sapiens
gguguuuuguaaaggauaucaa

SEQ ID NO: 2097280 - RNA, 20 nt, Homo sapiens
guccaacugucaaccuagaa

SEQ ID NO: 2097281 - RNA, 16 nt, Homo sapiens
uaacacucaccaucag

SEQ ID NO: 2097282 - RNA, 14 nt, Homo sapiens
aaagaaacuaucaa

SEQ ID NO: 2097283 - RNA, 16 nt, Homo sapiens
gaccgucucaaaaaga

SEQ ID NO: 2097284 - RNA, 18 nt, Homo sapiens
uacuuagcaugcacaaag

SEQ ID NO: 2097285 - RNA, 17 nt, Homo sapiens
cucugcuuuuuccagau

SEQ ID NO: 2097286 - RNA, 19 nt, Homo sapiens
uccuuuaccccucauccaa

SEQ ID NO: 2097287 - RNA, 13 nt, Homo sapiens
gaccagugcaguu

SEQ ID NO: 2097288 - RNA, 13 nt, Homo sapiens
agccugguuuuuc

SEQ ID NO: 2097289 - RNA, 17 nt, Homo sapiens
aauaccguguggcccaa

SEQ ID NO: 2097290 - RNA, 19 nt, Homo sapiens
ucagccauugcccugugag

SEQ ID NO: 2097291 - RNA, 15 nt, Homo sapiens
accaggccagcucag

SEQ ID NO: 2097292 - RNA, 18 nt, Homo sapiens
aucuacauuaaaaugaca

SEQ ID NO: 2097293 - RNA, 15 nt, Homo sapiens
cuuaacuauuucaca

SEQ ID NO: 2097294 - RNA, 15 nt, Homo sapiens
cuaaaauauuacaaa

SEQ ID NO: 2097295 - RNA, 14 nt, Homo sapiens
uccaguaagaucac

SEQ ID NO: 2097296 - RNA, 17 nt, Homo sapiens
uuucucagggucacugu

SEQ ID NO: 2097297 - RNA, 11 nt, Homo sapiens
ucuccacuggg

SEQ ID NO: 2097298 - RNA, 11 nt, Homo sapiens
gaaacuuugag

SEQ ID NO: 2097299 - RNA, 15 nt, Homo sapiens
ugcugcugcugcuca

SEQ ID NO: 2097300 - RNA, 20 nt, Homo sapiens
uaaacuuggaaucaagguaa

SEQ ID NO: 2097301 - RNA, 19 nt, Homo sapiens
ugccuuuccagcaccuucc

SEQ ID NO: 2097302 - RNA, 15 nt, Homo sapiens
gcugauucagcagug

SEQ ID NO: 2097303 - RNA, 17 nt, Homo sapiens
auaguuauuuacuugaa

SEQ ID NO: 2097304 - RNA, 16 nt, Homo sapiens
cuguacacauauuuga

SEQ ID NO: 2097305 - RNA, 20 nt, Homo sapiens
uucccugacugcagggguua

SEQ ID NO: 2097306 - RNA, 22 nt, Homo sapiens
gggacugucggaggaaagggau

SEQ ID NO: 2097307 - RNA, 16 nt, Homo sapiens
agagcaugcuauccca

SEQ ID NO: 2097308 - RNA, 21 nt, Homo sapiens
acuaguauggccagcagacag

SEQ ID NO: 2097309 - RNA, 22 nt, Homo sapiens
aguugacuucugacaaaggugg

SEQ ID NO: 2097310 - RNA, 17 nt, Homo sapiens
aagaaguguugauugcc

SEQ ID NO: 2097311 - RNA, 20 nt, Homo sapiens
uggcucugggguccucacau

SEQ ID NO: 2097312 - RNA, 13 nt, Homo sapiens
gaacggaaugugu

SEQ ID NO: 2097313 - RNA, 18 nt, Homo sapiens
aguugauuucuucuucau

SEQ ID NO: 2097314 - RNA, 14 nt, Homo sapiens
aggauggcaaagag

SEQ ID NO: 2097315 - RNA, 14 nt, Homo sapiens
guacaccccaccuc

SEQ ID NO: 2097316 - RNA, 11 nt, Homo sapiens
guaauggagca

SEQ ID NO: 2097317 - RNA, 19 nt, Homo sapiens
caguugcccagagcacuuu

SEQ ID NO: 2097318 - RNA, 21 nt, Homo sapiens
uggaaucugagggaagauuua

SEQ ID NO: 2097319 - RNA, 16 nt, Homo sapiens
uuuaagcagcucuaaa

SEQ ID NO: 2097320 - RNA, 15 nt, Homo sapiens
uuccugaguagcagu

SEQ ID NO: 2097321 - RNA, 20 nt, Homo sapiens
acucauuuggauugccuuac

SEQ ID NO: 2097322 - RNA, 13 nt, Homo sapiens
gagcccagucacc

SEQ ID NO: 2097323 - RNA, 21 nt, Homo sapiens
cuuuucuaaaaagucaauuca

SEQ ID NO: 2097324 - RNA, 14 nt, Homo sapiens
auuaucucaaguaa

SEQ ID NO: 2097325 - RNA, 17 nt, Homo sapiens
gaaaagggauacuuuga

SEQ ID NO: 2097326 - RNA, 13 nt, Homo sapiens
uggcccagccuug

SEQ ID NO: 2097327 - RNA, 14 nt, Homo sapiens
uucuagucucugau

SEQ ID NO: 2097328 - RNA, 23 nt, Homo sapiens
ccgaugcugaggccacccacuga

SEQ ID NO: 2097329 - RNA, 13 nt, Homo sapiens
gugucagcacuca

SEQ ID NO: 2097330 - RNA, 13 nt, Homo sapiens
cuacccauauccc

SEQ ID NO: 2097331 - RNA, 20 nt, Homo sapiens
ccagcccagaaagucucuca

SEQ ID NO: 2097332 - RNA, 14 nt, Homo sapiens
cuuaaugucuguca

SEQ ID NO: 2097333 - RNA, 13 nt, Homo sapiens
gaaaaacaggaaa

SEQ ID NO: 2097334 - RNA, 13 nt, Homo sapiens
cuuccuggccccu

SEQ ID NO: 2097335 - RNA, 16 nt, Homo sapiens
ccuguuuuauauauua

SEQ ID NO: 2097336 - RNA, 14 nt, Homo sapiens
auucaaauaaucca

SEQ ID NO: 2097337 - RNA, 23 nt, Homo sapiens
ccaaggagggcagaucacuucag

SEQ ID NO: 2097338 - RNA, 23 nt, Homo sapiens
auggaguuuuacucuuguugccc

SEQ ID NO: 2097339 - RNA, 14 nt, Homo sapiens
uaccuggauccagc

SEQ ID NO: 2097340 - RNA, 16 nt, Homo sapiens
cccugauugcgcaaaa

SEQ ID NO: 2097341 - RNA, 14 nt, Homo sapiens
cugaccaacaugga

SEQ ID NO: 2097342 - RNA, 14 nt, Homo sapiens
aggagucgggagca

SEQ ID NO: 2097343 - RNA, 15 nt, Homo sapiens
gcagccaagagccau

SEQ ID NO: 2097344 - RNA, 16 nt, Homo sapiens
ugggccugguagcaca

SEQ ID NO: 2097345 - RNA, 16 nt, Homo sapiens
cucgccaacaugguga

SEQ ID NO: 2097346 - RNA, 22 nt, Homo sapiens
caguuucagagauggacagaga

SEQ ID NO: 2097347 - RNA, 21 nt, Homo sapiens
caugcuuaaggggguguaaug

SEQ ID NO: 2097348 - RNA, 19 nt, Homo sapiens
uaaaacucuuuuaacaguc

SEQ ID NO: 2097349 - RNA, 15 nt, Homo sapiens
uuaugagaaacugca

SEQ ID NO: 2097350 - RNA, 14 nt, Homo sapiens
auuuugaguucugu

SEQ ID NO: 2097351 - RNA, 20 nt, Homo sapiens
cuaagugggagaaggacuau

SEQ ID NO: 2097352 - RNA, 16 nt, Homo sapiens
uuuaauaauguaccua

SEQ ID NO: 2097353 - RNA, 22 nt, Homo sapiens
aggcugaggcaggagaauggca

SEQ ID NO: 2097354 - RNA, 21 nt, Homo sapiens
uucaguucugcuugcucccaa

SEQ ID NO: 2097355 - RNA, 11 nt, Homo sapiens
cagacacugug

SEQ ID NO: 2097356 - RNA, 12 nt, Homo sapiens
cuccacugcugc

SEQ ID NO: 2097357 - RNA, 17 nt, Homo sapiens
aacacaugaacauugaa

SEQ ID NO: 2097358 - RNA, 17 nt, Homo sapiens
uugaaaccgccucugga

SEQ ID NO: 2097359 - RNA, 22 nt, Homo sapiens
agucauggaggccaagaacuug

SEQ ID NO: 2097360 - RNA, 17 nt, Homo sapiens
uaguuaaaacacauauc

SEQ ID NO: 2097361 - RNA, 14 nt, Homo sapiens
agaacgcaugcagg

SEQ ID NO: 2097362 - RNA, 17 nt, Homo sapiens
cauuuauaaacuagaau

SEQ ID NO: 2097363 - RNA, 13 nt, Homo sapiens
auguccauggugg

SEQ ID NO: 2097364 - RNA, 17 nt, Homo sapiens
cucggcucagugcaacc

SEQ ID NO: 2097365 - RNA, 12 nt, Homo sapiens
gcaucauucucu

SEQ ID NO: 2097366 - RNA, 16 nt, Homo sapiens
uaccucuuucaggguu

SEQ ID NO: 2097367 - RNA, 16 nt, Homo sapiens
uggcaagugauauugu

SEQ ID NO: 2097368 - RNA, 19 nt, Homo sapiens
acagcuggccaccauggca

SEQ ID NO: 2097369 - RNA, 13 nt, Homo sapiens
uuauugacacuga

SEQ ID NO: 2097370 - RNA, 16 nt, Homo sapiens
ucccagauaauggaga

SEQ ID NO: 2097371 - RNA, 15 nt, Homo sapiens
ucaugaagugcacag

SEQ ID NO: 2097372 - RNA, 21 nt, Homo sapiens
cacugccugcccagugccauc

SEQ ID NO: 2097373 - RNA, 20 nt, Homo sapiens
aaaaaaugcugaacauugca

SEQ ID NO: 2097374 - RNA, 20 nt, Homo sapiens
uccuuccugccaccugcugc

SEQ ID NO: 2097375 - RNA, 14 nt, Homo sapiens
cccuggaaaggggg

SEQ ID NO: 2097376 - RNA, 18 nt, Homo sapiens
cagcuuugucuccaaaga

SEQ ID NO: 2097377 - RNA, 16 nt, Homo sapiens
aggaagcccucgucuc

SEQ ID NO: 2097378 - RNA, 19 nt, Homo sapiens
aaaagcaggaacccaucua

SEQ ID NO: 2097379 - RNA, 21 nt, Homo sapiens
agaaaucauuuggguuaauau

SEQ ID NO: 2097380 - RNA, 22 nt, Homo sapiens
agguuuuuggucugacccacug

SEQ ID NO: 2097381 - RNA, 22 nt, Homo sapiens
uagagcaggcguucagcucacu

SEQ ID NO: 2097382 - RNA, 17 nt, Homo sapiens
acaagaggccacuccca

SEQ ID NO: 2097383 - RNA, 14 nt, Homo sapiens
aguugaacaucuca

SEQ ID NO: 2097384 - RNA, 15 nt, Homo sapiens
guacaggacauauau

SEQ ID NO: 2097385 - RNA, 21 nt, Homo sapiens
ucuugaucggaaagcucuucc

SEQ ID NO: 2097386 - RNA, 13 nt, Homo sapiens
ucaguuuaggccu

SEQ ID NO: 2097387 - RNA, 20 nt, Homo sapiens
agaugcuaccuugugaccca

SEQ ID NO: 2097388 - RNA, 23 nt, Homo sapiens
aaggauauguggagaaucaucaa

SEQ ID NO: 2097389 - RNA, 23 nt, Homo sapiens
gaaaacaauuguaauaaugcuaa

SEQ ID NO: 2097390 - RNA, 23 nt, Homo sapiens
gccgaggggagagagggacucaa

SEQ ID NO: 2097391 - RNA, 20 nt, Homo sapiens
aggcaggugcuuuuggcaga

SEQ ID NO: 2097392 - RNA, 12 nt, Homo sapiens
cacagugcagug

SEQ ID NO: 2097393 - RNA, 20 nt, Homo sapiens
auuucuaauguuuacuauau

SEQ ID NO: 2097394 - RNA, 16 nt, Homo sapiens
gagaguaucugagaac

SEQ ID NO: 2097395 - RNA, 18 nt, Homo sapiens
gucccagcuacucaggag

SEQ ID NO: 2097396 - RNA, 14 nt, Homo sapiens
aagauggggucugu

SEQ ID NO: 2097397 - RNA, 21 nt, Homo sapiens
agacgggcccuggugguggcu

SEQ ID NO: 2097398 - RNA, 19 nt, Homo sapiens
gucacguuaccauuuacau

SEQ ID NO: 2097399 - RNA, 20 nt, Homo sapiens
gcuuccuaguaagucaggac

SEQ ID NO: 2097400 - RNA, 19 nt, Homo sapiens
aaggggcuuuuguccuccu

SEQ ID NO: 2097401 - RNA, 23 nt, Homo sapiens
ccgucuuggcuuauccacuuuga

SEQ ID NO: 2097402 - RNA, 18 nt, Homo sapiens
gaggcagagguugcagug

SEQ ID NO: 2097403 - RNA, 12 nt, Homo sapiens
uccccauuucag

SEQ ID NO: 2097404 - RNA, 15 nt, Homo sapiens
caggugaacucgaag

SEQ ID NO: 2097405 - RNA, 19 nt, Homo sapiens
aaagcacaagcauuccuua

SEQ ID NO: 2097406 - RNA, 16 nt, Homo sapiens
ggaccagagcugccac

SEQ ID NO: 2097407 - RNA, 18 nt, Homo sapiens
ugcugaccagacagccuc

SEQ ID NO: 2097408 - RNA, 23 nt, Homo sapiens
gagaaauacagaagaaaauaaua

SEQ ID NO: 2097409 - RNA, 19 nt, Homo sapiens
cagauugugccacugcucu

SEQ ID NO: 2097410 - RNA, 17 nt, Homo sapiens
uuuacaaguguauauca

SEQ ID NO: 2097411 - RNA, 12 nt, Homo sapiens
gccaagugcaga

SEQ ID NO: 2097412 - RNA, 10 nt, Homo sapiens
agaaauaucu

SEQ ID NO: 2097413 - RNA, 17 nt, Homo sapiens
auguacucuugaacuuc

SEQ ID NO: 2097414 - RNA, 13 nt, Homo sapiens
cugaagaccucca

SEQ ID NO: 2097415 - RNA, 11 nt, Homo sapiens
gcaaagccugu

SEQ ID NO: 2097416 - RNA, 20 nt, Homo sapiens
accccuucucuguagcugcu

SEQ ID NO: 2097417 - RNA, 17 nt, Homo sapiens
aaguggaaaaaggagag

SEQ ID NO: 2097418 - RNA, 15 nt, Homo sapiens
gccauucacugcccc

SEQ ID NO: 2097419 - RNA, 13 nt, Homo sapiens
uaagaaacauaac

SEQ ID NO: 2097420 - RNA, 17 nt, Homo sapiens
aguuuuuuuuuuuccag

SEQ ID NO: 2097421 - RNA, 16 nt, Homo sapiens
auggcaaaaacaaagg

SEQ ID NO: 2097422 - RNA, 19 nt, Homo sapiens
uaacuguuucauagcaaac

SEQ ID NO: 2097423 - RNA, 17 nt, Homo sapiens
cccauaucugugcaaug

SEQ ID NO: 2097424 - RNA, 13 nt, Homo sapiens
uuauugcuauuaa

SEQ ID NO: 2097425 - RNA, 19 nt, Homo sapiens
gaagaagagcaaagggugg

SEQ ID NO: 2097426 - RNA, 20 nt, Homo sapiens
gaaacaccgagugaggccau

SEQ ID NO: 2097427 - RNA, 16 nt, Homo sapiens
cuuuaaccuaugauaa

SEQ ID NO: 2097428 - RNA, 17 nt, Homo sapiens
aagcuagaaggccacau

SEQ ID NO: 2097429 - RNA, 18 nt, Homo sapiens
augcugacagcucuucac

SEQ ID NO: 2097430 - RNA, 14 nt, Homo sapiens
cagcaguuguucca

SEQ ID NO: 2097431 - RNA, 16 nt, Homo sapiens
aggccugagcugcuuc

SEQ ID NO: 2097432 - RNA, 20 nt, Homo sapiens
cacggucuguucuugaagca

SEQ ID NO: 2097433 - RNA, 22 nt, Homo sapiens
cugaaacucacaguaauguguc

SEQ ID NO: 2097434 - RNA, 16 nt, Homo sapiens
cggccgccgccaggac

SEQ ID NO: 2097435 - RNA, 13 nt, Homo sapiens
cagccaggagugc

SEQ ID NO: 2097436 - RNA, 21 nt, Homo sapiens
guuaguugugaaagaaagcug

SEQ ID NO: 2097437 - RNA, 21 nt, Homo sapiens
acugucgugcaaacccaguga

SEQ ID NO: 2097438 - RNA, 16 nt, Homo sapiens
ggagagaaguugcccu

SEQ ID NO: 2097439 - RNA, 20 nt, Homo sapiens
ucauaugcaugcccuuccuu

SEQ ID NO: 2097440 - RNA, 18 nt, Homo sapiens
aucccuggcugaccugcu

SEQ ID NO: 2097441 - RNA, 17 nt, Homo sapiens
ucaagcaauccaaguga

SEQ ID NO: 2097442 - RNA, 16 nt, Homo sapiens
ccugucaucucacauu

SEQ ID NO: 2097443 - RNA, 17 nt, Homo sapiens
aaugagugaaucaccug

SEQ ID NO: 2097444 - RNA, 16 nt, Homo sapiens
uuucacaauaccucau

SEQ ID NO: 2097445 - RNA, 16 nt, Homo sapiens
cuuaaucucacauuca

SEQ ID NO: 2097446 - RNA, 16 nt, Homo sapiens
acaugcacagucauac

SEQ ID NO: 2097447 - RNA, 14 nt, Homo sapiens
uugccuaaauccaa

SEQ ID NO: 2097448 - RNA, 16 nt, Homo sapiens
aacugaucauguuuau

SEQ ID NO: 2097449 - RNA, 21 nt, Homo sapiens
cagccacaguggccaaagagg

SEQ ID NO: 2097450 - RNA, 23 nt, Homo sapiens
augguaccaggcccgcacugggg

SEQ ID NO: 2097451 - RNA, 21 nt, Homo sapiens
acacccgaaguccugucacug

SEQ ID NO: 2097452 - RNA, 18 nt, Homo sapiens
acuucauacuggcaggag

SEQ ID NO: 2097453 - RNA, 16 nt, Homo sapiens
auauuuauugacucuu

SEQ ID NO: 2097454 - RNA, 16 nt, Homo sapiens
cugugucuucuccacc

SEQ ID NO: 2097455 - RNA, 23 nt, Homo sapiens
aguuuagaaccuacaaaagcuug

SEQ ID NO: 2097456 - RNA, 16 nt, Homo sapiens
acaaaccucacugaga

SEQ ID NO: 2097457 - RNA, 17 nt, Homo sapiens
caguuugaaucuauuua

SEQ ID NO: 2097458 - RNA, 18 nt, Homo sapiens
ugaggcagauagcacugg

SEQ ID NO: 2097459 - RNA, 23 nt, Homo sapiens
caaaugaauggaggaacuuucca

SEQ ID NO: 2097460 - RNA, 22 nt, Homo sapiens
cacugauauuuuuuauacagug

SEQ ID NO: 2097461 - RNA, 14 nt, Homo sapiens
auaaagaauacuau

SEQ ID NO: 2097462 - RNA, 15 nt, Homo sapiens
ggacaggaaggaaug

SEQ ID NO: 2097463 - RNA, 16 nt, Homo sapiens
agagaaaaaccaauga

SEQ ID NO: 2097464 - RNA, 13 nt, Homo sapiens
ggcuacauauaca

SEQ ID NO: 2097465 - RNA, 14 nt, Homo sapiens
caggugccuuucaa

SEQ ID NO: 2097466 - RNA, 19 nt, Homo sapiens
aaugccaaaauucauucag

SEQ ID NO: 2097467 - RNA, 20 nt, Homo sapiens
acaaauuguuacuccauaua

SEQ ID NO: 2097468 - RNA, 12 nt, Homo sapiens
cucacacucagg

SEQ ID NO: 2097469 - RNA, 10 nt, Homo sapiens
aaaugcuuuu

SEQ ID NO: 2097470 - RNA, 14 nt, Homo sapiens
ucauugaggaagga

SEQ ID NO: 2097471 - RNA, 20 nt, Homo sapiens
gcacaaacauguguguacau

SEQ ID NO: 2097472 - RNA, 20 nt, Homo sapiens
gcugauggccuuguuucaaa

SEQ ID NO: 2097473 - RNA, 15 nt, Homo sapiens
aacugcugauuugau

SEQ ID NO: 2097474 - RNA, 20 nt, Homo sapiens
aagagcaguaucagcaucau

SEQ ID NO: 2097475 - RNA, 17 nt, Homo sapiens
ucaccccucacugugac

SEQ ID NO: 2097476 - RNA, 23 nt, Homo sapiens
ugcaguuuugccuaauggcaaaa

SEQ ID NO: 2097477 - RNA, 21 nt, Homo sapiens
uauucagauaaggcagaacua

SEQ ID NO: 2097478 - RNA, 22 nt, Homo sapiens
cuuaguauaauauuaaggcuua

SEQ ID NO: 2097479 - RNA, 18 nt, Homo sapiens
aaaaacacacuccuuugc

SEQ ID NO: 2097480 - RNA, 19 nt, Homo sapiens
aacaaaauccaacccuguc

SEQ ID NO: 2097481 - RNA, 21 nt, Homo sapiens
uuguucauugaacuuuugcua

SEQ ID NO: 2097482 - RNA, 13 nt, Homo sapiens
cacaaacuugaca

SEQ ID NO: 2097483 - RNA, 21 nt, Homo sapiens
aggagagcaucugcucugaga

SEQ ID NO: 2097484 - RNA, 14 nt, Homo sapiens
uggaccuauugcca

SEQ ID NO: 2097485 - RNA, 21 nt, Homo sapiens
aacucauggaccacaguaaca

SEQ ID NO: 2097486 - RNA, 14 nt, Homo sapiens
cugccugcagagau

SEQ ID NO: 2097487 - RNA, 14 nt, Homo sapiens
caggaggcugccac

SEQ ID NO: 2097488 - RNA, 13 nt, Homo sapiens
gagucacuugugu

SEQ ID NO: 2097489 - RNA, 13 nt, Homo sapiens
cagacucaaggag

SEQ ID NO: 2097490 - RNA, 23 nt, Homo sapiens
auuccuuuaacaacauguuucca

SEQ ID NO: 2097491 - RNA, 18 nt, Homo sapiens
auuuuguucuaguuuuca

SEQ ID NO: 2097492 - RNA, 16 nt, Homo sapiens
cauuuucaucuacuca

SEQ ID NO: 2097493 - RNA, 18 nt, Homo sapiens
guuaucaggcgucccaua

SEQ ID NO: 2097494 - RNA, 17 nt, Homo sapiens
ugggggccacauuucac

SEQ ID NO: 2097495 - RNA, 22 nt, Homo sapiens
gcaugaguaugugcaccaacag

SEQ ID NO: 2097496 - RNA, 18 nt, Homo sapiens
acaggacccugggaccac

SEQ ID NO: 2097497 - RNA, 13 nt, Homo sapiens
aucugaagggaau

SEQ ID NO: 2097498 - RNA, 16 nt, Homo sapiens
cagagguugcagugag

SEQ ID NO: 2097499 - RNA, 22 nt, Homo sapiens
uuuucacuucaaaacaguauug

SEQ ID NO: 2097500 - RNA, 17 nt, Homo sapiens
gacaccuucugugcuca

SEQ ID NO: 2097501 - RNA, 12 nt, Homo sapiens
ucaagugccaua

SEQ ID NO: 2097502 - RNA, 18 nt, Homo sapiens
uaacaggucuccucuuaa

SEQ ID NO: 2097503 - RNA, 16 nt, Homo sapiens
gaaggcuuguugugcu

SEQ ID NO: 2097504 - RNA, 16 nt, Homo sapiens
uauuaguugccaauau

SEQ ID NO: 2097505 - RNA, 23 nt, Homo sapiens
uggagaccgugaccagugcugcu

SEQ ID NO: 2097506 - RNA, 12 nt, Homo sapiens
augcuccaagau

SEQ ID NO: 2097507 - RNA, 20 nt, Homo sapiens
gcugagacuuacgcccuguu

SEQ ID NO: 2097508 - RNA, 18 nt, Homo sapiens
acaugacccguacacacc

SEQ ID NO: 2097509 - RNA, 21 nt, Homo sapiens
cuucuaguggucucaccugga

SEQ ID NO: 2097510 - RNA, 16 nt, Homo sapiens
gccuaggugcgcagug

SEQ ID NO: 2097511 - RNA, 16 nt, Homo sapiens
acuggaacagcccauu

SEQ ID NO: 2097512 - RNA, 14 nt, Homo sapiens
ugcagaagcacaug

SEQ ID NO: 2097513 - RNA, 21 nt, Homo sapiens
acaguggccaagaucacagug

SEQ ID NO: 2097514 - RNA, 22 nt, Homo sapiens
guuggaacuuacauacaugggg

SEQ ID NO: 2097515 - RNA, 14 nt, Homo sapiens
cugacugugugugg

SEQ ID NO: 2097516 - RNA, 17 nt, Homo sapiens
gacacacauauacauua

SEQ ID NO: 2097517 - RNA, 17 nt, Homo sapiens
uacaaggcacuugucac

SEQ ID NO: 2097518 - RNA, 15 nt, Homo sapiens
cauuacugcaugcac

SEQ ID NO: 2097519 - RNA, 12 nt, Homo sapiens
agugaauacuuu

SEQ ID NO: 2097520 - RNA, 13 nt, Homo sapiens
aaugcacagugaa

SEQ ID NO: 2097521 - RNA, 21 nt, Homo sapiens
agucuggaagaagaggaggaa

SEQ ID NO: 2097522 - RNA, 20 nt, Homo sapiens
cguaugccaccaacuuacaa

SEQ ID NO: 2097523 - RNA, 23 nt, Homo sapiens
cauaugauaaauuugacuguuau

SEQ ID NO: 2097524 - RNA, 21 nt, Homo sapiens
acauauacaaguagcuucccu

SEQ ID NO: 2097525 - RNA, 23 nt, Homo sapiens
acauauuggaauguacaugucaa

SEQ ID NO: 2097526 - RNA, 18 nt, Homo sapiens
auuaguucuguauacagu

SEQ ID NO: 2097527 - RNA, 22 nt, Homo sapiens
auuguggaaagaugaaugcaau

SEQ ID NO: 2097528 - RNA, 22 nt, Homo sapiens
cauucaguggcccacauuuucc

SEQ ID NO: 2097529 - RNA, 22 nt, Homo sapiens
cagaaaucugcugcauuucaca

SEQ ID NO: 2097530 - RNA, 18 nt, Homo sapiens
aaagacacccugucugca

SEQ ID NO: 2097531 - RNA, 13 nt, Homo sapiens
cugucaugguccu

SEQ ID NO: 2097532 - RNA, 15 nt, Homo sapiens
uaacaaaacaagaaa

SEQ ID NO: 2097533 - RNA, 19 nt, Homo sapiens
uuagaguuaccacacccca

SEQ ID NO: 2097534 - RNA, 15 nt, Homo sapiens
accuuccacacaggg

SEQ ID NO: 2097535 - RNA, 20 nt, Homo sapiens
agacaucuuugcuuaugaaa

SEQ ID NO: 2097536 - RNA, 13 nt, Homo sapiens
cagucaauucuga

SEQ ID NO: 2097537 - RNA, 20 nt, Homo sapiens
uucuuuuaauccaauccacu

SEQ ID NO: 2097538 - RNA, 22 nt, Homo sapiens
cauagcugucuagaguagcuua

SEQ ID NO: 2097539 - RNA, 21 nt, Homo sapiens
cagcaccagccccccucucaa

SEQ ID NO: 2097540 - RNA, 14 nt, Homo sapiens
ucucuagacaucua

SEQ ID NO: 2097541 - RNA, 21 nt, Homo sapiens
agcucugcuccccuaaagccu

SEQ ID NO: 2097542 - RNA, 13 nt, Homo sapiens
uuagauugcugaa

SEQ ID NO: 2097543 - RNA, 18 nt, Homo sapiens
gaacugaaggcauaugca

SEQ ID NO: 2097544 - RNA, 21 nt, Homo sapiens
aauccauuuaaucaauauuua

SEQ ID NO: 2097545 - RNA, 20 nt, Homo sapiens
uaacacaugaauuucugcca

SEQ ID NO: 2097546 - RNA, 19 nt, Homo sapiens
aagaaaaucacauuuccag

SEQ ID NO: 2097547 - RNA, 17 nt, Homo sapiens
accuuuuugacuuuucc

SEQ ID NO: 2097548 - RNA, 17 nt, Homo sapiens
cccuggcugacuggcca

SEQ ID NO: 2097549 - RNA, 17 nt, Homo sapiens
cugaaggagauuuuccu

SEQ ID NO: 2097550 - RNA, 13 nt, Homo sapiens
ugcguguaucuaa

SEQ ID NO: 2097551 - RNA, 18 nt, Homo sapiens
cuggaaauguagcacuua

SEQ ID NO: 2097552 - RNA, 20 nt, Homo sapiens
gagagcacuagaagugguuu

SEQ ID NO: 2097553 - RNA, 20 nt, Homo sapiens
uagcgcugccgcaccccaga

SEQ ID NO: 2097554 - RNA, 15 nt, Homo sapiens
uggaauccaaccucc

SEQ ID NO: 2097555 - RNA, 14 nt, Homo sapiens
aguggcuggucuca

SEQ ID NO: 2097556 - RNA, 22 nt, Homo sapiens
guucauuggcaagaugaaauaa

SEQ ID NO: 2097557 - RNA, 14 nt, Homo sapiens
accucaugccaugg

SEQ ID NO: 2097558 - RNA, 18 nt, Homo sapiens
cugggaacaugacccagc

SEQ ID NO: 2097559 - RNA, 13 nt, Homo sapiens
ucuauuugugcuu

SEQ ID NO: 2097560 - RNA, 18 nt, Homo sapiens
ucucaauauuaagucauu

SEQ ID NO: 2097561 - RNA, 19 nt, Homo sapiens
aacauuugggagacugagc

SEQ ID NO: 2097562 - RNA, 20 nt, Homo sapiens
guacacacacagaugcacac

SEQ ID NO: 2097563 - RNA, 18 nt, Homo sapiens
agacaacauuaugaucua

SEQ ID NO: 2097564 - RNA, 13 nt, Homo sapiens
aagcucaugucau

SEQ ID NO: 2097565 - RNA, 15 nt, Homo sapiens
aaugcuaucucaaag

SEQ ID NO: 2097566 - RNA, 15 nt, Homo sapiens
aacccaucagacagg

SEQ ID NO: 2097567 - RNA, 18 nt, Homo sapiens
ucucucugcaagacagaa

SEQ ID NO: 2097568 - RNA, 14 nt, Homo sapiens
ugcccaaaucuucu

SEQ ID NO: 2097569 - RNA, 19 nt, Homo sapiens
ucgggggcggcucugggaa

SEQ ID NO: 2097570 - RNA, 17 nt, Homo sapiens
ugcauuuuuuauuuagu

SEQ ID NO: 2097571 - RNA, 22 nt, Homo sapiens
agcccugggugcaggacacugg

SEQ ID NO: 2097572 - RNA, 20 nt, Homo sapiens
aaugauuguuugucaauaua

SEQ ID NO: 2097573 - RNA, 15 nt, Homo sapiens
agauuagcucuggac

SEQ ID NO: 2097574 - RNA, 12 nt, Homo sapiens
ccaucucaguca

SEQ ID NO: 2097575 - RNA, 17 nt, Homo sapiens
ugcuugagagacacugg

SEQ ID NO: 2097576 - RNA, 13 nt, Homo sapiens
aaauaugaguuuu

SEQ ID NO: 2097577 - RNA, 13 nt, Homo sapiens
accaugaugcauu

SEQ ID NO: 2097578 - RNA, 20 nt, Homo sapiens
gaggaacugcuugugcacug

SEQ ID NO: 2097579 - RNA, 22 nt, Homo sapiens
aaacaaaagugcauaguuuaga

SEQ ID NO: 2097580 - RNA, 13 nt, Homo sapiens
aauaaaccaaaua

SEQ ID NO: 2097581 - RNA, 15 nt, Homo sapiens
uaaaagacacagaac

SEQ ID NO: 2097582 - RNA, 17 nt, Homo sapiens
caaggaucacuugagcc

SEQ ID NO: 2097583 - RNA, 17 nt, Homo sapiens
ccccuugucugcacugu

SEQ ID NO: 2097584 - RNA, 13 nt, Homo sapiens
cuagugggaguua

SEQ ID NO: 2097585 - RNA, 21 nt, Homo sapiens
uguguaaauaauuugcacuga

SEQ ID NO: 2097586 - RNA, 16 nt, Homo sapiens
acuagcuuacugauga

SEQ ID NO: 2097587 - RNA, 15 nt, Homo sapiens
guauuuucagcucaa

SEQ ID NO: 2097588 - RNA, 12 nt, Homo sapiens
agugacccucag

SEQ ID NO: 2097589 - RNA, 14 nt, Homo sapiens
uucagucaucucca

SEQ ID NO: 2097590 - RNA, 20 nt, Homo sapiens
uauuucggagcgcaaugcca

SEQ ID NO: 2097591 - RNA, 18 nt, Homo sapiens
cugcuccauuuuucauca

SEQ ID NO: 2097592 - RNA, 16 nt, Homo sapiens
gaaaauacagcuggau

SEQ ID NO: 2097593 - RNA, 22 nt, Homo sapiens
uauaaauucuguuagcugcuca

SEQ ID NO: 2097594 - RNA, 21 nt, Homo sapiens
aggccaauuuuuccagcauuu

SEQ ID NO: 2097595 - RNA, 15 nt, Homo sapiens
uaacauguauacaaa

SEQ ID NO: 2097596 - RNA, 15 nt, Homo sapiens
uaccaaauaccaugu

SEQ ID NO: 2097597 - RNA, 15 nt, Homo sapiens
cuggcagaggggaca

SEQ ID NO: 2097598 - RNA, 20 nt, Homo sapiens
gagauagcaccauugcacuc

SEQ ID NO: 2097599 - RNA, 21 nt, Homo sapiens
acuccaauuacuccaccauca

SEQ ID NO: 2097600 - RNA, 14 nt, Homo sapiens
gagaugacagggaa

SEQ ID NO: 2097601 - RNA, 22 nt, Homo sapiens
gaccacacgcugucucuugaga

SEQ ID NO: 2097602 - RNA, 18 nt, Homo sapiens
gucugguguuugucaugg

SEQ ID NO: 2097603 - RNA, 14 nt, Homo sapiens
guguggcuuggaac

SEQ ID NO: 2097604 - RNA, 13 nt, Homo sapiens
uuuaaaacauuuc

SEQ ID NO: 2097605 - RNA, 15 nt, Homo sapiens
uuaggaauacuguuu

SEQ ID NO: 2097606 - RNA, 16 nt, Homo sapiens
uguaguguggcugugg

SEQ ID NO: 2097607 - RNA, 17 nt, Homo sapiens
uucucugcuccaccaca

SEQ ID NO: 2097608 - RNA, 16 nt, Homo sapiens
gccgggaaccaagcag

SEQ ID NO: 2097609 - RNA, 21 nt, Homo sapiens
uguacaauaaaaacauugccu

SEQ ID NO: 2097610 - RNA, 16 nt, Homo sapiens
uaagaauaauugaaca

SEQ ID NO: 2097611 - RNA, 21 nt, Homo sapiens
ucucagcuuucccugccacau

SEQ ID NO: 2097612 - RNA, 13 nt, Homo sapiens
ccuuaaguauuau

SEQ ID NO: 2097613 - RNA, 16 nt, Homo sapiens
ccuuuguaagugcagg

SEQ ID NO: 2097614 - RNA, 21 nt, Homo sapiens
uauggcagggaagcuuucacc

SEQ ID NO: 2097615 - RNA, 14 nt, Homo sapiens
uccuugaugauuga

SEQ ID NO: 2097616 - RNA, 21 nt, Homo sapiens
auacaaaguguaccaacauaa

SEQ ID NO: 2097617 - RNA, 18 nt, Homo sapiens
uaguuuuaaaacucuuua

SEQ ID NO: 2097618 - RNA, 15 nt, Homo sapiens
uauuaauaaagcauu

SEQ ID NO: 2097619 - RNA, 14 nt, Homo sapiens
gaugguucauauca

SEQ ID NO: 2097620 - RNA, 17 nt, Homo sapiens
cggaacuuacuguguaa

SEQ ID NO: 2097621 - RNA, 12 nt, Homo sapiens
guguucaaacac

SEQ ID NO: 2097622 - RNA, 12 nt, Homo sapiens
cucaaacauuua

SEQ ID NO: 2097623 - RNA, 21 nt, Homo sapiens
aagggaucagaagauaucuuu

SEQ ID NO: 2097624 - RNA, 13 nt, Homo sapiens
aacuccuauuuca

SEQ ID NO: 2097625 - RNA, 13 nt, Homo sapiens
caccagggagcag

SEQ ID NO: 2097626 - RNA, 22 nt, Homo sapiens
ggucaaaguguuuucucugaac

SEQ ID NO: 2097627 - RNA, 20 nt, Homo sapiens
cagcucagaaaaucaaagag

SEQ ID NO: 2097628 - RNA, 17 nt, Homo sapiens
cagaucgcaccacugca

SEQ ID NO: 2097629 - RNA, 21 nt, Homo sapiens
ucucaugguauuaucuaguag

SEQ ID NO: 2097630 - RNA, 15 nt, Homo sapiens
cuacacggcugugac

SEQ ID NO: 2097631 - RNA, 14 nt, Homo sapiens
agguaagagcaaaa

SEQ ID NO: 2097632 - RNA, 15 nt, Homo sapiens
uucuauauugugcca

SEQ ID NO: 2097633 - RNA, 15 nt, Homo sapiens
ccagggcugcaaugc

SEQ ID NO: 2097634 - RNA, 21 nt, Homo sapiens
ccaggccaccuccccagcauu

SEQ ID NO: 2097635 - RNA, 17 nt, Homo sapiens
caauaucugacaguuac

SEQ ID NO: 2097636 - RNA, 17 nt, Homo sapiens
ugcaauauuuacauuuu

SEQ ID NO: 2097637 - RNA, 20 nt, Homo sapiens
acucaguaaaucagugcagu

SEQ ID NO: 2097638 - RNA, 20 nt, Homo sapiens
cauaaccucucugugccauc

SEQ ID NO: 2097639 - RNA, 16 nt, Homo sapiens
cgacauuccugaaaua

SEQ ID NO: 2097640 - RNA, 22 nt, Homo sapiens
auaccaauauucuuuuguucua

SEQ ID NO: 2097641 - RNA, 22 nt, Homo sapiens
agcuuuccuucugcccuuccuc

SEQ ID NO: 2097642 - RNA, 22 nt, Homo sapiens
aagaauuuuuuuuaacauucca

SEQ ID NO: 2097643 - RNA, 14 nt, Homo sapiens
uguccugacaccuc

SEQ ID NO: 2097644 - RNA, 16 nt, Homo sapiens
uacagaccaccuuuca

SEQ ID NO: 2097645 - RNA, 16 nt, Homo sapiens
cacgucaaugucauuc

SEQ ID NO: 2097646 - RNA, 16 nt, Homo sapiens
ugguuguuucuuccaa

SEQ ID NO: 2097647 - RNA, 17 nt, Homo sapiens
ucccacacgcacugcac

SEQ ID NO: 2097648 - RNA, 17 nt, Homo sapiens
uuaaaaaugagauuucu

SEQ ID NO: 2097649 - RNA, 14 nt, Homo sapiens
gaauacaauaacua

SEQ ID NO: 2097650 - RNA, 19 nt, Homo sapiens
ucuugagcccaggaguuca

SEQ ID NO: 2097651 - RNA, 14 nt, Homo sapiens
caauaauccuuccu

SEQ ID NO: 2097652 - RNA, 13 nt, Homo sapiens
acacauauugcac

SEQ ID NO: 2097653 - RNA, 18 nt, Homo sapiens
ucagacacaugcuauguu

SEQ ID NO: 2097654 - RNA, 21 nt, Homo sapiens
ugauauauaaaugugauugca

SEQ ID NO: 2097655 - RNA, 19 nt, Homo sapiens
guuugggcuugauuccugu

SEQ ID NO: 2097656 - RNA, 12 nt, Homo sapiens
cacgaguguucc

SEQ ID NO: 2097657 - RNA, 14 nt, Homo sapiens
cuguaucaugacaa

SEQ ID NO: 2097658 - RNA, 19 nt, Homo sapiens
uguaaagauguuuauuuca

SEQ ID NO: 2097659 - RNA, 16 nt, Homo sapiens
uccucccucacaugau

SEQ ID NO: 2097660 - RNA, 22 nt, Homo sapiens
gagcuaagcagaauaauggaau

SEQ ID NO: 2097661 - RNA, 18 nt, Homo sapiens
agcaaacaaaaccaccug

SEQ ID NO: 2097662 - RNA, 15 nt, Homo sapiens
gucacacuuugccaa

SEQ ID NO: 2097663 - RNA, 20 nt, Homo sapiens
ccaguuguagcagguuucac

SEQ ID NO: 2097664 - RNA, 17 nt, Homo sapiens
uaacuuuuuuuuacuua

SEQ ID NO: 2097665 - RNA, 20 nt, Homo sapiens
ucauaaugaauaaagugcaa

SEQ ID NO: 2097666 - RNA, 16 nt, Homo sapiens
ucagcccucagaagaa

SEQ ID NO: 2097667 - RNA, 19 nt, Homo sapiens
cugcuuaaaaauguagcag

SEQ ID NO: 2097668 - RNA, 14 nt, Homo sapiens
caauuccugugauu

SEQ ID NO: 2097669 - RNA, 14 nt, Homo sapiens
gguguaccgggaua

SEQ ID NO: 2097670 - RNA, 15 nt, Homo sapiens
ugacugcguaggcaa

SEQ ID NO: 2097671 - RNA, 15 nt, Homo sapiens
cgugaggucccagga

SEQ ID NO: 2097672 - RNA, 14 nt, Homo sapiens
ggcucucacuccag

SEQ ID NO: 2097673 - RNA, 22 nt, Homo sapiens
acuguuaagaagcagccaucac

SEQ ID NO: 2097674 - RNA, 11 nt, Homo sapiens
caaguuugcac

SEQ ID NO: 2097675 - RNA, 11 nt, Homo sapiens
accugucaaug

SEQ ID NO: 2097676 - RNA, 15 nt, Homo sapiens
aauccccagcccuuu

SEQ ID NO: 2097677 - RNA, 17 nt, Homo sapiens
aaaaccacuagaacucu

SEQ ID NO: 2097678 - RNA, 15 nt, Homo sapiens
uagugaaacugcauu

SEQ ID NO: 2097679 - RNA, 19 nt, Homo sapiens
aaggcagauggggcacuga

SEQ ID NO: 2097680 - RNA, 13 nt, Homo sapiens
acccccaacuccu

SEQ ID NO: 2097681 - RNA, 23 nt, Homo sapiens
gguggcagaaucuguuaccagag

SEQ ID NO: 2097682 - RNA, 14 nt, Homo sapiens
auccuggaaggaaa

SEQ ID NO: 2097683 - RNA, 15 nt, Homo sapiens
cugggcauacuuucu

SEQ ID NO: 2097684 - RNA, 21 nt, Homo sapiens
gaauaaugucuagauuuugaa

SEQ ID NO: 2097685 - RNA, 18 nt, Homo sapiens
aaguaacuucacauuaaa

SEQ ID NO: 2097686 - RNA, 13 nt, Homo sapiens
ccugagguaccuu

SEQ ID NO: 2097687 - RNA, 17 nt, Homo sapiens
aacagcuuugucuccaa

SEQ ID NO: 2097688 - RNA, 23 nt, Homo sapiens
cuaacaauaugauugcacuaaau

SEQ ID NO: 2097689 - RNA, 17 nt, Homo sapiens
acuagagcuccauuucu

SEQ ID NO: 2097690 - RNA, 19 nt, Homo sapiens
uuguugcaagaugugaauu

SEQ ID NO: 2097691 - RNA, 22 nt, Homo sapiens
aagaccaauuuuuuguguguga

SEQ ID NO: 2097692 - RNA, 13 nt, Homo sapiens
gucuuaagaugca

SEQ ID NO: 2097693 - RNA, 14 nt, Homo sapiens
gccgggaacagaga

SEQ ID NO: 2097694 - RNA, 12 nt, Homo sapiens
agaaggaaugca

SEQ ID NO: 2097695 - RNA, 16 nt, Homo sapiens
aaaucaauguguacaa

SEQ ID NO: 2097696 - RNA, 18 nt, Homo sapiens
aggacugacugaggcagu

SEQ ID NO: 2097697 - RNA, 12 nt, Homo sapiens
ucucugaucccu

SEQ ID NO: 2097698 - RNA, 17 nt, Homo sapiens
caccugcccugugcaug

SEQ ID NO: 2097699 - RNA, 11 nt, Homo sapiens
gacugcugcuc

SEQ ID NO: 2097700 - RNA, 17 nt, Homo sapiens
caauauacgaaaagcca

SEQ ID NO: 2097701 - RNA, 13 nt, Homo sapiens
gcccucagacugu

SEQ ID NO: 2097702 - RNA, 15 nt, Homo sapiens
accuaguaugcucag

SEQ ID NO: 2097703 - RNA, 21 nt, Homo sapiens
accaccccucccucugcucuc

SEQ ID NO: 2097704 - RNA, 12 nt, Homo sapiens
ggggugugcaug

SEQ ID NO: 2097705 - RNA, 18 nt, Homo sapiens
ugccacccucaucuuuga

SEQ ID NO: 2097706 - RNA, 20 nt, Homo sapiens
gguagggugggagugguuua

SEQ ID NO: 2097707 - RNA, 16 nt, Homo sapiens
uuucuugccacacagu

SEQ ID NO: 2097708 - RNA, 21 nt, Homo sapiens
caaacaguguggcuuaaacau

SEQ ID NO: 2097709 - RNA, 13 nt, Homo sapiens
acagcacccugug

SEQ ID NO: 2097710 - RNA, 17 nt, Homo sapiens
agggugggaagggauaa

SEQ ID NO: 2097711 - RNA, 16 nt, Homo sapiens
augcuauugucaguca

SEQ ID NO: 2097712 - RNA, 21 nt, Homo sapiens
ccaggccacccaaaggagcuc

SEQ ID NO: 2097713 - RNA, 13 nt, Homo sapiens
aaacauuaacucu

SEQ ID NO: 2097714 - RNA, 19 nt, Homo sapiens
aggacguggaugaagcaga

SEQ ID NO: 2097715 - RNA, 20 nt, Homo sapiens
auauuaagucguucaauuca

SEQ ID NO: 2097716 - RNA, 18 nt, Homo sapiens
uuuuaaucaugagccugu

SEQ ID NO: 2097717 - RNA, 15 nt, Homo sapiens
acagaaugagaccaa

SEQ ID NO: 2097718 - RNA, 20 nt, Homo sapiens
gcuccccucugcacggacca

SEQ ID NO: 2097719 - RNA, 19 nt, Homo sapiens
uggcugaagugcauggguc

SEQ ID NO: 2097720 - RNA, 21 nt, Homo sapiens
aggaggccuccaucucaugua

SEQ ID NO: 2097721 - RNA, 13 nt, Homo sapiens
auuaugcuaacaa

SEQ ID NO: 2097722 - RNA, 18 nt, Homo sapiens
cauuggugagaguccaac

SEQ ID NO: 2097723 - RNA, 18 nt, Homo sapiens
acagccucagaauaaaag

SEQ ID NO: 2097724 - RNA, 11 nt, Homo sapiens
cauacagggca

SEQ ID NO: 2097725 - RNA, 15 nt, Homo sapiens
uuugugcugagauca

SEQ ID NO: 2097726 - RNA, 15 nt, Homo sapiens
uauaagauuccaaaa

SEQ ID NO: 2097727 - RNA, 20 nt, Homo sapiens
augaaugccuaaauauaauu

SEQ ID NO: 2097728 - RNA, 12 nt, Homo sapiens
aagugucuucca

SEQ ID NO: 2097729 - RNA, 18 nt, Homo sapiens
cuuugaucuacuugccuc

SEQ ID NO: 2097730 - RNA, 20 nt, Homo sapiens
aauuuuaaugaagugcaaua

SEQ ID NO: 2097731 - RNA, 12 nt, Homo sapiens
aaggugccucau

SEQ ID NO: 2097732 - RNA, 12 nt, Homo sapiens
cauaaccaagaa

SEQ ID NO: 2097733 - RNA, 23 nt, Homo sapiens
uuuagucuaccaaaaacaauacu

SEQ ID NO: 2097734 - RNA, 15 nt, Homo sapiens
aaaggaaaccaaagg

SEQ ID NO: 2097735 - RNA, 15 nt, Homo sapiens
acaggagacaaaaga

SEQ ID NO: 2097736 - RNA, 13 nt, Homo sapiens
gaaaguucugcug

SEQ ID NO: 2097737 - RNA, 17 nt, Homo sapiens
uuuaaaaauacauagca

SEQ ID NO: 2097738 - RNA, 15 nt, Homo sapiens
uuugcucuacuuuau

SEQ ID NO: 2097739 - RNA, 15 nt, Homo sapiens
uaaagugcuaagguu

SEQ ID NO: 2097740 - RNA, 15 nt, Homo sapiens
aaaacuucaaagcug

SEQ ID NO: 2097741 - RNA, 15 nt, Homo sapiens
uuuaaagcuuugaau

SEQ ID NO: 2097742 - RNA, 12 nt, Homo sapiens
gugucucaggag

SEQ ID NO: 2097743 - RNA, 20 nt, Homo sapiens
acguucgauuucuaccucag

SEQ ID NO: 2097744 - RNA, 16 nt, Homo sapiens
gaacaaaaauguuucc

SEQ ID NO: 2097745 - RNA, 21 nt, Homo sapiens
accucccugacccgucuaaua

SEQ ID NO: 2097746 - RNA, 15 nt, Homo sapiens
auuuaaaugccauag

SEQ ID NO: 2097747 - RNA, 13 nt, Homo sapiens
cuugggcucccug

SEQ ID NO: 2097748 - RNA, 21 nt, Homo sapiens
ucugaaguguccuaaauauua

SEQ ID NO: 2097749 - RNA, 17 nt, Homo sapiens
gugaauguuuaccauga

SEQ ID NO: 2097750 - RNA, 20 nt, Homo sapiens
ggcccucacucuugaagucc

SEQ ID NO: 2097751 - RNA, 15 nt, Homo sapiens
uggugauaaguucca

SEQ ID NO: 2097752 - RNA, 17 nt, Homo sapiens
agcgaguugcgcuggga

SEQ ID NO: 2097753 - RNA, 16 nt, Homo sapiens
aucucagcaaucacaa

SEQ ID NO: 2097754 - RNA, 13 nt, Homo sapiens
uuuugcaagugcu

SEQ ID NO: 2097755 - RNA, 20 nt, Homo sapiens
ucaaggacugguaaaauaca

SEQ ID NO: 2097756 - RNA, 20 nt, Homo sapiens
ccucauugcagcuagaggca

SEQ ID NO: 2097757 - RNA, 14 nt, Homo sapiens
uggagacacaacua

SEQ ID NO: 2097758 - RNA, 18 nt, Homo sapiens
acacagugaccaagggaa

SEQ ID NO: 2097759 - RNA, 19 nt, Homo sapiens
ucugcugccucuguggaag

SEQ ID NO: 2097760 - RNA, 21 nt, Homo sapiens
ggacgggacagugaguggcug

SEQ ID NO: 2097761 - RNA, 11 nt, Homo sapiens
cagcuccuugg

SEQ ID NO: 2097762 - RNA, 21 nt, Homo sapiens
ucuaggccuucaggacucuag

SEQ ID NO: 2097763 - RNA, 20 nt, Homo sapiens
cugcuuucuuguugcugcau

SEQ ID NO: 2097764 - RNA, 21 nt, Homo sapiens
gccaguggggccuguggaaug

SEQ ID NO: 2097765 - RNA, 22 nt, Homo sapiens
uucucugccuuuuuacuauaca

SEQ ID NO: 2097766 - RNA, 19 nt, Homo sapiens
uccccuagcuuacugauaa

SEQ ID NO: 2097767 - RNA, 17 nt, Homo sapiens
gcuccugcucauugugg

SEQ ID NO: 2097768 - RNA, 16 nt, Homo sapiens
cugcucacacugcuga

SEQ ID NO: 2097769 - RNA, 13 nt, Homo sapiens
auacuugcuccau

SEQ ID NO: 2097770 - RNA, 21 nt, Homo sapiens
aaucagauugauaacuaugaa

SEQ ID NO: 2097771 - RNA, 14 nt, Homo sapiens
caggauugggccaa

SEQ ID NO: 2097772 - RNA, 20 nt, Homo sapiens
acuuuaaggugaaugaaaga

SEQ ID NO: 2097773 - RNA, 19 nt, Homo sapiens
aaucuuauuaaaguuucaa

SEQ ID NO: 2097774 - RNA, 18 nt, Homo sapiens
uuguaauauuaacuaaau

SEQ ID NO: 2097775 - RNA, 19 nt, Homo sapiens
acuuagggcagaagugaau

SEQ ID NO: 2097776 - RNA, 11 nt, Homo sapiens
caggugcaaau

SEQ ID NO: 2097777 - RNA, 19 nt, Homo sapiens
auucccaagccaaaaaccu

SEQ ID NO: 2097778 - RNA, 20 nt, Homo sapiens
agcugcugcuggagauucaa

SEQ ID NO: 2097779 - RNA, 23 nt, Homo sapiens
cauaaaaauacaacagugcauuu

SEQ ID NO: 2097780 - RNA, 15 nt, Homo sapiens
ucaugaccuagauga

SEQ ID NO: 2097781 - RNA, 11 nt, Homo sapiens
agcucagggac

SEQ ID NO: 2097782 - RNA, 16 nt, Homo sapiens
cucaguguagguccca

SEQ ID NO: 2097783 - RNA, 13 nt, Homo sapiens
ugcccaccaaagg

SEQ ID NO: 2097784 - RNA, 18 nt, Homo sapiens
aaucaacuuuucugagcu

SEQ ID NO: 2097785 - RNA, 12 nt, Homo sapiens
uaaacuguguau

SEQ ID NO: 2097786 - RNA, 19 nt, Homo sapiens
aagggucucucuccagguc

SEQ ID NO: 2097787 - RNA, 21 nt, Homo sapiens
ucccauuuuucucuugccauu

SEQ ID NO: 2097788 - RNA, 16 nt, Homo sapiens
auuacuaucauaauuc

SEQ ID NO: 2097789 - RNA, 21 nt, Homo sapiens
auuuccaaaccuccacugcug

SEQ ID NO: 2097790 - RNA, 17 nt, Homo sapiens
ccugcuucccuguugaa

SEQ ID NO: 2097791 - RNA, 23 nt, Homo sapiens
cuaauauguaaaauuacacuuug

SEQ ID NO: 2097792 - RNA, 12 nt, Homo sapiens
aaaacauuugcu

SEQ ID NO: 2097793 - RNA, 12 nt, Homo sapiens
aacucauuugaa

SEQ ID NO: 2097794 - RNA, 18 nt, Homo sapiens
agcugggauuacaggcuc

SEQ ID NO: 2097795 - RNA, 17 nt, Homo sapiens
gcagagucuaccuugaa

SEQ ID NO: 2097796 - RNA, 15 nt, Homo sapiens
aguagcauccuguga

SEQ ID NO: 2097797 - RNA, 18 nt, Homo sapiens
uuggaaguacaugaauac

SEQ ID NO: 2097798 - RNA, 15 nt, Homo sapiens
gauagauaacucuuu

SEQ ID NO: 2097799 - RNA, 20 nt, Homo sapiens
ccucugccucuuggguucaa

SEQ ID NO: 2097800 - RNA, 16 nt, Homo sapiens
ucacugugucccaaaa

SEQ ID NO: 2097801 - RNA, 20 nt, Homo sapiens
aagugcugggauuacagaca

SEQ ID NO: 2097802 - RNA, 23 nt, Homo sapiens
acugucauugccccuccgaugcu

SEQ ID NO: 2097803 - RNA, 15 nt, Homo sapiens
uaggccugucccuug

SEQ ID NO: 2097804 - RNA, 18 nt, Homo sapiens
guuacacccuuucuugac

SEQ ID NO: 2097805 - RNA, 16 nt, Homo sapiens
gagggaaucaugggca

SEQ ID NO: 2097806 - RNA, 21 nt, Homo sapiens
cuagcacuuugggagacugaa

SEQ ID NO: 2097807 - RNA, 23 nt, Homo sapiens
agaauucauucacucaacaaaca

SEQ ID NO: 2097808 - RNA, 14 nt, Homo sapiens
agcauacagguuaa

SEQ ID NO: 2097809 - RNA, 22 nt, Homo sapiens
uugcauugauucaguauuacaa

SEQ ID NO: 2097810 - RNA, 17 nt, Homo sapiens
aaccccacaaucuagga

SEQ ID NO: 2097811 - RNA, 15 nt, Homo sapiens
uuaaaaaacuuucua

SEQ ID NO: 2097812 - RNA, 15 nt, Homo sapiens
uauucagacaaaaug

SEQ ID NO: 2097813 - RNA, 13 nt, Homo sapiens
augcacacagugc

SEQ ID NO: 2097814 - RNA, 22 nt, Homo sapiens
ugauaguauuuucuacuagcca

SEQ ID NO: 2097815 - RNA, 12 nt, Homo sapiens
agcuacucagga

SEQ ID NO: 2097816 - RNA, 14 nt, Homo sapiens
ccgcggugcucugg

SEQ ID NO: 2097817 - RNA, 13 nt, Homo sapiens
ggcaucacagcua

SEQ ID NO: 2097818 - RNA, 23 nt, Homo sapiens
ccagcaguggacucaaaacccau

SEQ ID NO: 2097819 - RNA, 19 nt, Homo sapiens
agcaaauaaauacguguca

SEQ ID NO: 2097820 - RNA, 17 nt, Homo sapiens
cagagggccauugaacu

SEQ ID NO: 2097821 - RNA, 12 nt, Homo sapiens
gguaugauuaac

SEQ ID NO: 2097822 - RNA, 21 nt, Homo sapiens
uccgggagggugcggcugugc

SEQ ID NO: 2097823 - RNA, 17 nt, Homo sapiens
accaguggaagauuucu

SEQ ID NO: 2097824 - RNA, 18 nt, Homo sapiens
ggacuuccuguccagcuc

SEQ ID NO: 2097825 - RNA, 13 nt, Homo sapiens
uucaugcugcuua

SEQ ID NO: 2097826 - RNA, 20 nt, Homo sapiens
gauccacuggcuggacaaac

SEQ ID NO: 2097827 - RNA, 22 nt, Homo sapiens
ugcacccuggauuugcauacau

SEQ ID NO: 2097828 - RNA, 15 nt, Homo sapiens
cucaugccuugagau

SEQ ID NO: 2097829 - RNA, 15 nt, Homo sapiens
agaugguuucuagag

SEQ ID NO: 2097830 - RNA, 18 nt, Homo sapiens
gaaccaacgggucugugg

SEQ ID NO: 2097831 - RNA, 12 nt, Homo sapiens
uugaacguucuc

SEQ ID NO: 2097832 - RNA, 21 nt, Homo sapiens
gcacuucauguaaagugucag

SEQ ID NO: 2097833 - RNA, 19 nt, Homo sapiens
cuaaauggcaacaaacaca

SEQ ID NO: 2097834 - RNA, 22 nt, Homo sapiens
cuucacucuauccaaaguguca

SEQ ID NO: 2097835 - RNA, 20 nt, Homo sapiens
acaugauguuuuaagcugcu

SEQ ID NO: 2097836 - RNA, 15 nt, Homo sapiens
ucgcccgaaacacca

SEQ ID NO: 2097837 - RNA, 14 nt, Homo sapiens
acagugucuggccu

SEQ ID NO: 2097838 - RNA, 17 nt, Homo sapiens
ucgugcaaacccaguga

SEQ ID NO: 2097839 - RNA, 20 nt, Homo sapiens
ucauaugucagggcacaugu

SEQ ID NO: 2097840 - RNA, 21 nt, Homo sapiens
uucaauaguggcauaccaaau

SEQ ID NO: 2097841 - RNA, 15 nt, Homo sapiens
ugagaaggugcuuug

SEQ ID NO: 2097842 - RNA, 21 nt, Homo sapiens
acagauccgacuuuggccucu

SEQ ID NO: 2097843 - RNA, 16 nt, Homo sapiens
aucuuucuaaaacugc

SEQ ID NO: 2097844 - RNA, 19 nt, Homo sapiens
cauaauucuuuugaaaaua

SEQ ID NO: 2097845 - RNA, 13 nt, Homo sapiens
gcaugccauugaa

SEQ ID NO: 2097846 - RNA, 18 nt, Homo sapiens
acucugacuguaaaauac

SEQ ID NO: 2097847 - RNA, 15 nt, Homo sapiens
caagacucauugcug

SEQ ID NO: 2097848 - RNA, 14 nt, Homo sapiens
cuuuugcagccaau

SEQ ID NO: 2097849 - RNA, 11 nt, Homo sapiens
acacuaaugca

SEQ ID NO: 2097850 - RNA, 11 nt, Homo sapiens
gcuugccaucc

SEQ ID NO: 2097851 - RNA, 16 nt, Homo sapiens
ucacugagagcugccu

SEQ ID NO: 2097852 - RNA, 18 nt, Homo sapiens
acuuguucuguacuugua

SEQ ID NO: 2097853 - RNA, 17 nt, Homo sapiens
uaucucuugcugggaac

SEQ ID NO: 2097854 - RNA, 14 nt, Homo sapiens
ccccauccuguguu

SEQ ID NO: 2097855 - RNA, 22 nt, Homo sapiens
uguaaauugcaaauaaaccacu

SEQ ID NO: 2097856 - RNA, 17 nt, Homo sapiens
uuucagucaaaacuuua

SEQ ID NO: 2097857 - RNA, 22 nt, Homo sapiens
ugccaaaugaauaagacaacaa

SEQ ID NO: 2097858 - RNA, 11 nt, Homo sapiens
caaggcauuua

SEQ ID NO: 2097859 - RNA, 20 nt, Homo sapiens
uuguaacauuucacaguauu

SEQ ID NO: 2097860 - RNA, 23 nt, Homo sapiens
caguaacacaggccacccugugc

SEQ ID NO: 2097861 - RNA, 13 nt, Homo sapiens
cuggaaagugaug

SEQ ID NO: 2097862 - RNA, 17 nt, Homo sapiens
gccuaaaucccaagaaa

SEQ ID NO: 2097863 - RNA, 21 nt, Homo sapiens
agacagcagggcucucuguau

SEQ ID NO: 2097864 - RNA, 15 nt, Homo sapiens
caauguuuaugcaag

SEQ ID NO: 2097865 - RNA, 16 nt, Homo sapiens
ggcuugacaugugcaa

SEQ ID NO: 2097866 - RNA, 20 nt, Homo sapiens
cagcagguagugggugaaug

SEQ ID NO: 2097867 - RNA, 16 nt, Homo sapiens
auuaauaaaugucauu

SEQ ID NO: 2097868 - RNA, 13 nt, Homo sapiens
ccaaugaagaaga

SEQ ID NO: 2097869 - RNA, 12 nt, Homo sapiens
aguuacaccucc

SEQ ID NO: 2097870 - RNA, 20 nt, Homo sapiens
uccugugaaugccacugccu

SEQ ID NO: 2097871 - RNA, 16 nt, Homo sapiens
agccugggaggcacag

SEQ ID NO: 2097872 - RNA, 19 nt, Homo sapiens
ucuuuggccccuggacuau

SEQ ID NO: 2097873 - RNA, 16 nt, Homo sapiens
augcauauuuauaaga

SEQ ID NO: 2097874 - RNA, 17 nt, Homo sapiens
cagagcccaagugccau

SEQ ID NO: 2097875 - RNA, 17 nt, Homo sapiens
cucuauaaaguauggua

SEQ ID NO: 2097876 - RNA, 19 nt, Homo sapiens
uggcccaacacaauucuuc

SEQ ID NO: 2097877 - RNA, 18 nt, Homo sapiens
auaugugauuuucucuaa

SEQ ID NO: 2097878 - RNA, 18 nt, Homo sapiens
auaacuauuuacauauaa

SEQ ID NO: 2097879 - RNA, 21 nt, Homo sapiens
auuugagagaaucuacuaagu

SEQ ID NO: 2097880 - RNA, 13 nt, Homo sapiens
aaccaaugcuuuc

SEQ ID NO: 2097881 - RNA, 15 nt, Homo sapiens
gugagugugugcaag

SEQ ID NO: 2097882 - RNA, 17 nt, Homo sapiens
gugacccgugaaugugc

SEQ ID NO: 2097883 - RNA, 13 nt, Homo sapiens
uguaauaaacucu

SEQ ID NO: 2097884 - RNA, 21 nt, Homo sapiens
gaugggcaaacccuggugcuu

SEQ ID NO: 2097885 - RNA, 12 nt, Homo sapiens
ugcuuuccaaca

SEQ ID NO: 2097886 - RNA, 13 nt, Homo sapiens
cuuugacauuucc

SEQ ID NO: 2097887 - RNA, 13 nt, Homo sapiens
cucccacauucug

SEQ ID NO: 2097888 - RNA, 21 nt, Homo sapiens
cccagcagagguuugcugaca

SEQ ID NO: 2097889 - RNA, 16 nt, Homo sapiens
gugaagugaaucugau

SEQ ID NO: 2097890 - RNA, 18 nt, Homo sapiens
agauguggguauagcuca

SEQ ID NO: 2097891 - RNA, 20 nt, Homo sapiens
aaggauaucgggucacuguc

SEQ ID NO: 2097892 - RNA, 18 nt, Homo sapiens
cuauagggugugaugaag

SEQ ID NO: 2097893 - RNA, 17 nt, Homo sapiens
ccacucagguucuucag

SEQ ID NO: 2097894 - RNA, 17 nt, Homo sapiens
ugagagcucuucagaga

SEQ ID NO: 2097895 - RNA, 22 nt, Homo sapiens
aacuugguucugcuucaauaaa

SEQ ID NO: 2097896 - RNA, 22 nt, Homo sapiens
uuuccaauccuuuauagcuuug

SEQ ID NO: 2097897 - RNA, 18 nt, Homo sapiens
uccucauaggucagggag

SEQ ID NO: 2097898 - RNA, 14 nt, Homo sapiens
aggcugagcugcau

SEQ ID NO: 2097899 - RNA, 13 nt, Homo sapiens
ggagaacgcagua

SEQ ID NO: 2097900 - RNA, 21 nt, Homo sapiens
auaguucuagacauggagguu

SEQ ID NO: 2097901 - RNA, 13 nt, Homo sapiens
cugucuuguccuu

SEQ ID NO: 2097902 - RNA, 22 nt, Homo sapiens
acucaucccucuuuuucuuucu

SEQ ID NO: 2097903 - RNA, 22 nt, Homo sapiens
acuuaggaagaaaucacuuaaa

SEQ ID NO: 2097904 - RNA, 16 nt, Homo sapiens
guguuucaaacuguaa

SEQ ID NO: 2097905 - RNA, 20 nt, Homo sapiens
auuaacugcacaaacaauau

SEQ ID NO: 2097906 - RNA, 19 nt, Homo sapiens
cuccugaggaucagaaagu

SEQ ID NO: 2097907 - RNA, 17 nt, Homo sapiens
uuaaagagccaguuuau

SEQ ID NO: 2097908 - RNA, 12 nt, Homo sapiens
uaaaaaugcacc

SEQ ID NO: 2097909 - RNA, 21 nt, Homo sapiens
ucuucugcaagccucaugcca

SEQ ID NO: 2097910 - RNA, 17 nt, Homo sapiens
uagaagguggggaccug

SEQ ID NO: 2097911 - RNA, 14 nt, Homo sapiens
gcuuugcuccuuca

SEQ ID NO: 2097912 - RNA, 12 nt, Homo sapiens
ccccggcugcuu

SEQ ID NO: 2097913 - RNA, 14 nt, Homo sapiens
ucaugaugaugaua

SEQ ID NO: 2097914 - RNA, 18 nt, Homo sapiens
ucaacaauauauguccua

SEQ ID NO: 2097915 - RNA, 21 nt, Homo sapiens
acuuucugccuucuacauucc

SEQ ID NO: 2097916 - RNA, 20 nt, Homo sapiens
uggccuucuaggaauggagg

SEQ ID NO: 2097917 - RNA, 20 nt, Homo sapiens
cuaacuggcaggggagacag

SEQ ID NO: 2097918 - RNA, 20 nt, Homo sapiens
uuuccccuggccucaguucc

SEQ ID NO: 2097919 - RNA, 20 nt, Homo sapiens
aaggaguaaucuguguacaa

SEQ ID NO: 2097920 - RNA, 17 nt, Homo sapiens
cagguacaacaccuuuu

SEQ ID NO: 2097921 - RNA, 15 nt, Homo sapiens
cacaacuaggaccuc

SEQ ID NO: 2097922 - RNA, 20 nt, Homo sapiens
uccaguguugccuccuccca

SEQ ID NO: 2097923 - RNA, 21 nt, Homo sapiens
uugccaauuuuccuacucuca

SEQ ID NO: 2097924 - RNA, 19 nt, Homo sapiens
guggccccggcugcaugag

SEQ ID NO: 2097925 - RNA, 18 nt, Homo sapiens
ucccaggucacaugcacg

SEQ ID NO: 2097926 - RNA, 15 nt, Homo sapiens
aaguccccucuacuu

SEQ ID NO: 2097927 - RNA, 16 nt, Homo sapiens
uguaggugucugccuu

SEQ ID NO: 2097928 - RNA, 15 nt, Homo sapiens
uuacacacgugugau

SEQ ID NO: 2097929 - RNA, 15 nt, Homo sapiens
acacacagccuagca

SEQ ID NO: 2097930 - RNA, 20 nt, Homo sapiens
gacacaggccgggacaaaac

SEQ ID NO: 2097931 - RNA, 21 nt, Homo sapiens
aacuaggcucagagaugugca

SEQ ID NO: 2097932 - RNA, 13 nt, Homo sapiens
cuugcagggucuu

SEQ ID NO: 2097933 - RNA, 18 nt, Homo sapiens
ugcgcagugguugcuguc

SEQ ID NO: 2097934 - RNA, 23 nt, Homo sapiens
augcuuuagcauacuagaaucag

SEQ ID NO: 2097935 - RNA, 17 nt, Homo sapiens
uauggcacuaaaugcac

SEQ ID NO: 2097936 - RNA, 13 nt, Homo sapiens
guuucugugaaau

SEQ ID NO: 2097937 - RNA, 17 nt, Homo sapiens
ucgcccgcccacacggc

SEQ ID NO: 2097938 - RNA, 13 nt, Homo sapiens
accucuccaaaga

SEQ ID NO: 2097939 - RNA, 14 nt, Homo sapiens
ugagauacauuuga

SEQ ID NO: 2097940 - RNA, 14 nt, Homo sapiens
caaaacucuuucau

SEQ ID NO: 2097941 - RNA, 17 nt, Homo sapiens
guugggcagagcuggac

SEQ ID NO: 2097942 - RNA, 15 nt, Homo sapiens
guauuuacagacaca

SEQ ID NO: 2097943 - RNA, 12 nt, Homo sapiens
aagaggacacaa

SEQ ID NO: 2097944 - RNA, 16 nt, Homo sapiens
uucggacaacucaguc

SEQ ID NO: 2097945 - RNA, 21 nt, Homo sapiens
cagcguggucugucauccugc

SEQ ID NO: 2097946 - RNA, 14 nt, Homo sapiens
uauuaugagcuaca

SEQ ID NO: 2097947 - RNA, 21 nt, Homo sapiens
uccacuaggguccaccaggag

SEQ ID NO: 2097948 - RNA, 13 nt, Homo sapiens
acuguugugcucc

SEQ ID NO: 2097949 - RNA, 23 nt, Homo sapiens
uggcuucagguuagugacauuua

SEQ ID NO: 2097950 - RNA, 18 nt, Homo sapiens
aaguuucucagcucccau

SEQ ID NO: 2097951 - RNA, 11 nt, Homo sapiens
ccccagcacuu

SEQ ID NO: 2097952 - RNA, 19 nt, Homo sapiens
gaaacuggaugaggucaua

SEQ ID NO: 2097953 - RNA, 21 nt, Homo sapiens
accugggaggacucucuuagu

SEQ ID NO: 2097954 - RNA, 13 nt, Homo sapiens
cagaaacuacuga

SEQ ID NO: 2097955 - RNA, 17 nt, Homo sapiens
caggccauacuuuacaa

SEQ ID NO: 2097956 - RNA, 19 nt, Homo sapiens
ccgcaggaucaggugacuu

SEQ ID NO: 2097957 - RNA, 22 nt, Homo sapiens
uuaacacuaaccaaacaaugca

SEQ ID NO: 2097958 - RNA, 13 nt, Homo sapiens
uauucaaaauuca

SEQ ID NO: 2097959 - RNA, 18 nt, Homo sapiens
ccaaaaccacagcccugu

SEQ ID NO: 2097960 - RNA, 19 nt, Homo sapiens
acaugccuugaaaccagaa

SEQ ID NO: 2097961 - RNA, 21 nt, Homo sapiens
aggauggucuccagacaccuu

SEQ ID NO: 2097962 - RNA, 12 nt, Homo sapiens
uuuaagccuuug

SEQ ID NO: 2097963 - RNA, 18 nt, Homo sapiens
aggcucuggcccuugccu

SEQ ID NO: 2097964 - RNA, 23 nt, Homo sapiens
cuacccuuaguauuuauuacuaa

SEQ ID NO: 2097965 - RNA, 13 nt, Homo sapiens
cuuaguggcuuuu

SEQ ID NO: 2097966 - RNA, 15 nt, Homo sapiens
acuugaacacugugu

SEQ ID NO: 2097967 - RNA, 16 nt, Homo sapiens
aaaggacaaaaauaua

SEQ ID NO: 2097968 - RNA, 15 nt, Homo sapiens
ucauuaauauaugga

SEQ ID NO: 2097969 - RNA, 12 nt, Homo sapiens
cuuauuugcaau

SEQ ID NO: 2097970 - RNA, 20 nt, Homo sapiens
uacuaacuaaauaccauuca

SEQ ID NO: 2097971 - RNA, 22 nt, Homo sapiens
acaaaucguccaaagaucucaa

SEQ ID NO: 2097972 - RNA, 13 nt, Homo sapiens
cuauaugauuuca

SEQ ID NO: 2097973 - RNA, 14 nt, Homo sapiens
uugaaccaaucagu

SEQ ID NO: 2097974 - RNA, 18 nt, Homo sapiens
aaaucacaagaacaaaua

SEQ ID NO: 2097975 - RNA, 13 nt, Homo sapiens
uagacagccaggu

SEQ ID NO: 2097976 - RNA, 21 nt, Homo sapiens
auaagcaucuguguaaccucc

SEQ ID NO: 2097977 - RNA, 15 nt, Homo sapiens
cauguaaugacacuu

SEQ ID NO: 2097978 - RNA, 18 nt, Homo sapiens
uggcaggagcuacugaga

SEQ ID NO: 2097979 - RNA, 18 nt, Homo sapiens
agagacccucaccuuccu

SEQ ID NO: 2097980 - RNA, 12 nt, Homo sapiens
caaacugaucua

SEQ ID NO: 2097981 - RNA, 22 nt, Homo sapiens
guucaagugauucuccugccuc

SEQ ID NO: 2097982 - RNA, 16 nt, Homo sapiens
aaugaauuuaucuuua

SEQ ID NO: 2097983 - RNA, 23 nt, Homo sapiens
uuuuucaguagcaggaccugcca

SEQ ID NO: 2097984 - RNA, 22 nt, Homo sapiens
gggcaccucucuugaaccccaa

SEQ ID NO: 2097985 - RNA, 23 nt, Homo sapiens
ugcccaaagagcacaaacauuuu

SEQ ID NO: 2097986 - RNA, 15 nt, Homo sapiens
ccacuucugugccac

SEQ ID NO: 2097987 - RNA, 15 nt, Homo sapiens
guggcgugagcugcc

SEQ ID NO: 2097988 - RNA, 15 nt, Homo sapiens
ccaauuaugugacaa

SEQ ID NO: 2097989 - RNA, 22 nt, Homo sapiens
aauacugaaggacacagcagug

SEQ ID NO: 2097990 - RNA, 15 nt, Homo sapiens
aaugucaaaccacug

SEQ ID NO: 2097991 - RNA, 15 nt, Homo sapiens
uauaguaagugcuua

SEQ ID NO: 2097992 - RNA, 13 nt, Homo sapiens
uccacaccagucc

SEQ ID NO: 2097993 - RNA, 21 nt, Homo sapiens
caaucuacuuuguugcuaugg

SEQ ID NO: 2097994 - RNA, 11 nt, Homo sapiens
ucagacacucu

SEQ ID NO: 2097995 - RNA, 11 nt, Homo sapiens
caagacaccau

SEQ ID NO: 2097996 - RNA, 22 nt, Homo sapiens
caugaugcgggccagugcucca

SEQ ID NO: 2097997 - RNA, 13 nt, Homo sapiens
aaguagcuguaug

SEQ ID NO: 2097998 - RNA, 16 nt, Homo sapiens
ggauguguuuugcacg

SEQ ID NO: 2097999 - RNA, 15 nt, Homo sapiens
aguggcagugucauu

SEQ ID NO: 2098000 - RNA, 17 nt, Homo sapiens
ugaauccucaugaggcu

SEQ ID NO: 2098001 - RNA, 22 nt, Homo sapiens
aacacuccauuauuccucucac

SEQ ID NO: 2098002 - RNA, 23 nt, Homo sapiens
augugugccuccuagagugcagg

SEQ ID NO: 2098003 - RNA, 18 nt, Homo sapiens
gagcuuccuucugugaaa

SEQ ID NO: 2098004 - RNA, 16 nt, Homo sapiens
aaauuaaagcagcaaa

SEQ ID NO: 2098005 - RNA, 16 nt, Homo sapiens
gagcugacacaggaug

SEQ ID NO: 2098006 - RNA, 18 nt, Homo sapiens
gacauccagcgugacgga

SEQ ID NO: 2098007 - RNA, 12 nt, Homo sapiens
gggcuagggagg

SEQ ID NO: 2098008 - RNA, 12 nt, Homo sapiens
uugcuuuccacu

SEQ ID NO: 2098009 - RNA, 22 nt, Homo sapiens
ugcaugaccacauagaacaugu

SEQ ID NO: 2098010 - RNA, 14 nt, Homo sapiens
cccccagagcucuu

SEQ ID NO: 2098011 - RNA, 13 nt, Homo sapiens
aucacucuuugca

SEQ ID NO: 2098012 - RNA, 22 nt, Homo sapiens
cuauuaaaauucugauguuucu

SEQ ID NO: 2098013 - RNA, 21 nt, Homo sapiens
cuuaauaaacucacaacucuc

SEQ ID NO: 2098014 - RNA, 17 nt, Homo sapiens
aauucagauuguuuaaa

SEQ ID NO: 2098015 - RNA, 18 nt, Homo sapiens
uaaagcucaucagcuauc

SEQ ID NO: 2098016 - RNA, 22 nt, Homo sapiens
uaaagugcuaagguucuaaggc

SEQ ID NO: 2098017 - RNA, 11 nt, Homo sapiens
ggcagaagcag

SEQ ID NO: 2098018 - RNA, 20 nt, Homo sapiens
auuuaaauuuuuuuccuuac

SEQ ID NO: 2098019 - RNA, 22 nt, Homo sapiens
aggguccccuccccagcucccu

SEQ ID NO: 2098020 - RNA, 17 nt, Homo sapiens
caguuucuggaaaaagu

SEQ ID NO: 2098021 - RNA, 22 nt, Homo sapiens
cugcauuuauagcauacgguau

SEQ ID NO: 2098022 - RNA, 17 nt, Homo sapiens
ucaacuauuuuauguca

SEQ ID NO: 2098023 - RNA, 18 nt, Homo sapiens
ucagaauucggugugcug

SEQ ID NO: 2098024 - RNA, 17 nt, Homo sapiens
ccuugauggauuuucaa

SEQ ID NO: 2098025 - RNA, 17 nt, Homo sapiens
ccauggucaaugcaguu

SEQ ID NO: 2098026 - RNA, 21 nt, Homo sapiens
aaccugaugccccuuccccaa

SEQ ID NO: 2098027 - RNA, 12 nt, Homo sapiens
uucaaucucuug

SEQ ID NO: 2098028 - RNA, 22 nt, Homo sapiens
uucaaaauuccauuuacuugau

SEQ ID NO: 2098029 - RNA, 14 nt, Homo sapiens
uccucgacugcuuu

SEQ ID NO: 2098030 - RNA, 22 nt, Homo sapiens
uuaauucacagaauagcacaaa

SEQ ID NO: 2098031 - RNA, 19 nt, Homo sapiens
cuacaaaaccucaaaccag

SEQ ID NO: 2098032 - RNA, 22 nt, Homo sapiens
ugauucaggggucugaugacac

SEQ ID NO: 2098033 - RNA, 18 nt, Homo sapiens
acaggaguuugugugcaa

SEQ ID NO: 2098034 - RNA, 15 nt, Homo sapiens
aacaaguauuggaaa

SEQ ID NO: 2098035 - RNA, 24 nt, Homo sapiens
gaaaugggaguagggggguggaca

SEQ ID NO: 2098036 - RNA, 13 nt, Homo sapiens
cauuucaacucca

SEQ ID NO: 2098037 - RNA, 19 nt, Homo sapiens
cugucuccucuucaaauaa

SEQ ID NO: 2098038 - RNA, 14 nt, Homo sapiens
uacagcugcacuga

SEQ ID NO: 2098039 - RNA, 15 nt, Homo sapiens
uauagaaacaccagu

SEQ ID NO: 2098040 - RNA, 14 nt, Homo sapiens
cuauuauuugcuau

SEQ ID NO: 2098041 - RNA, 23 nt, Homo sapiens
aacaguugccacaucacacagac

SEQ ID NO: 2098042 - RNA, 17 nt, Homo sapiens
uuggagggugucccaaa

SEQ ID NO: 2098043 - RNA, 21 nt, Homo sapiens
cugaacaaaauguaaagccag

SEQ ID NO: 2098044 - RNA, 12 nt, Homo sapiens
ucucacuauguu

SEQ ID NO: 2098045 - RNA, 23 nt, Homo sapiens
uugcuaccucagugcuccuggaa

SEQ ID NO: 2098046 - RNA, 13 nt, Homo sapiens
ucuccaaaggcac

SEQ ID NO: 2098047 - RNA, 23 nt, Homo sapiens
caucuucaauuuauuacugaaaa

SEQ ID NO: 2098048 - RNA, 17 nt, Homo sapiens
aauuuuuugugauuuca

SEQ ID NO: 2098049 - RNA, 14 nt, Homo sapiens
aggaacugcaauaa

SEQ ID NO: 2098050 - RNA, 16 nt, Homo sapiens
cacucaaaccuggagc

SEQ ID NO: 2098051 - RNA, 12 nt, Homo sapiens
aggucucugugg

SEQ ID NO: 2098052 - RNA, 20 nt, Homo sapiens
ggagucagagguuucaguga

SEQ ID NO: 2098053 - RNA, 14 nt, Homo sapiens
aauuaaaaccugau

SEQ ID NO: 2098054 - RNA, 16 nt, Homo sapiens
cauagguuuaauaauu

SEQ ID NO: 2098055 - RNA, 15 nt, Homo sapiens
caguuaaugugccaa

SEQ ID NO: 2098056 - RNA, 15 nt, Homo sapiens
agacccgcccuuaga

SEQ ID NO: 2098057 - RNA, 20 nt, Homo sapiens
aggcaugugccaucauaccc

SEQ ID NO: 2098058 - RNA, 23 nt, Homo sapiens
gcuacauugacgagcaugagcug

SEQ ID NO: 2098059 - RNA, 15 nt, Homo sapiens
aaaguaaucuaccuc

SEQ ID NO: 2098060 - RNA, 17 nt, Homo sapiens
ucuaccaagcugugacc

SEQ ID NO: 2098061 - RNA, 23 nt, Homo sapiens
aaaguuuauggaacugaguguua

SEQ ID NO: 2098062 - RNA, 18 nt, Homo sapiens
uagagcagaauucauuau

SEQ ID NO: 2098063 - RNA, 21 nt, Homo sapiens
ucuuccucccucauuccaccu

SEQ ID NO: 2098064 - RNA, 21 nt, Homo sapiens
gaauuguuuggcaaugcacug

SEQ ID NO: 2098065 - RNA, 15 nt, Homo sapiens
uuagugaauuaugga

SEQ ID NO: 2098066 - RNA, 16 nt, Homo sapiens
ucauaucuagucacuu

SEQ ID NO: 2098067 - RNA, 14 nt, Homo sapiens
uccugacacuauuc

SEQ ID NO: 2098068 - RNA, 23 nt, Homo sapiens
gauauauguuaagcagauauuca

SEQ ID NO: 2098069 - RNA, 15 nt, Homo sapiens
gagugcagugagcua

SEQ ID NO: 2098070 - RNA, 23 nt, Homo sapiens
acacagcacuaacacaugcacac

SEQ ID NO: 2098071 - RNA, 24 nt, Homo sapiens
gucucaugcaagacuucacugcag

SEQ ID NO: 2098072 - RNA, 21 nt, Homo sapiens
uggagcccuguuggcagcucu

SEQ ID NO: 2098073 - RNA, 15 nt, Homo sapiens
augucugcagguuuc

SEQ ID NO: 2098074 - RNA, 22 nt, Homo sapiens
aaagucuuugaagugacuucac

SEQ ID NO: 2098075 - RNA, 14 nt, Homo sapiens
ugacuuccucccac

SEQ ID NO: 2098076 - RNA, 14 nt, Homo sapiens
aacagacauuguuu

SEQ ID NO: 2098077 - RNA, 17 nt, Homo sapiens
ccuuuaggauguuuucc

SEQ ID NO: 2098078 - RNA, 18 nt, Homo sapiens
cuauugaaauuacugaaa

SEQ ID NO: 2098079 - RNA, 17 nt, Homo sapiens
aaucuuugguggccaaa

SEQ ID NO: 2098080 - RNA, 14 nt, Homo sapiens
agaaggacaccucc

SEQ ID NO: 2098081 - RNA, 13 nt, Homo sapiens
ccaggagugagcc

SEQ ID NO: 2098082 - RNA, 12 nt, Homo sapiens
auuuucuucaca

SEQ ID NO: 2098083 - RNA, 14 nt, Homo sapiens
uccaugaugcacag

SEQ ID NO: 2098084 - RNA, 14 nt, Homo sapiens
accaaggcagccuc

SEQ ID NO: 2098085 - RNA, 15 nt, Homo sapiens
guauuaguugccaau

SEQ ID NO: 2098086 - RNA, 19 nt, Homo sapiens
ucaacuagcagauacaggg

SEQ ID NO: 2098087 - RNA, 16 nt, Homo sapiens
cccuagcccuuacguc

SEQ ID NO: 2098088 - RNA, 14 nt, Homo sapiens
aaauagcauucucu

SEQ ID NO: 2098089 - RNA, 21 nt, Homo sapiens
auugagaucacuacucagugc

SEQ ID NO: 2098090 - RNA, 18 nt, Homo sapiens
ugugcuccgugccuccac

SEQ ID NO: 2098091 - RNA, 18 nt, Homo sapiens
acuuaaguacccuuucaa

SEQ ID NO: 2098092 - RNA, 21 nt, Homo sapiens
aauaaauugcuuacugauauu

SEQ ID NO: 2098093 - RNA, 21 nt, Homo sapiens
uaagaucugaguugagaccuu

SEQ ID NO: 2098094 - RNA, 16 nt, Homo sapiens
ucaucugaaaaucugg

SEQ ID NO: 2098095 - RNA, 19 nt, Homo sapiens
cuccugcccagcacaggaa

SEQ ID NO: 2098096 - RNA, 17 nt, Homo sapiens
uaauauuggauaucaac

SEQ ID NO: 2098097 - RNA, 21 nt, Homo sapiens
uaaguguggaauuaccugaua

SEQ ID NO: 2098098 - RNA, 16 nt, Homo sapiens
gaguccuuucuuccau

SEQ ID NO: 2098099 - RNA, 19 nt, Homo sapiens
uagguuuccacugccaaaa

SEQ ID NO: 2098100 - RNA, 13 nt, Homo sapiens
uccauauguuaua

SEQ ID NO: 2098101 - RNA, 19 nt, Homo sapiens
uucccuggguuuucugccc

SEQ ID NO: 2098102 - RNA, 14 nt, Homo sapiens
ucuauuuucucagu

SEQ ID NO: 2098103 - RNA, 14 nt, Homo sapiens
agcaacugugcuac

SEQ ID NO: 2098104 - RNA, 20 nt, Homo sapiens
gcagggcugggccagugcau

SEQ ID NO: 2098105 - RNA, 16 nt, Homo sapiens
ugccuuaaacucuguu

SEQ ID NO: 2098106 - RNA, 11 nt, Homo sapiens
uaagauucuaa

SEQ ID NO: 2098107 - RNA, 20 nt, Homo sapiens
uagauccugguuaccacucu

SEQ ID NO: 2098108 - RNA, 18 nt, Homo sapiens
acucugugcccaugggca

SEQ ID NO: 2098109 - RNA, 14 nt, Homo sapiens
augaacacaauaca

SEQ ID NO: 2098110 - RNA, 15 nt, Homo sapiens
ugagaugggcuuccc

SEQ ID NO: 2098111 - RNA, 12 nt, Homo sapiens
aagaugcuccug

SEQ ID NO: 2098112 - RNA, 13 nt, Homo sapiens
cucacuguagcag

SEQ ID NO: 2098113 - RNA, 13 nt, Homo sapiens
ccuucaaaccuca

SEQ ID NO: 2098114 - RNA, 21 nt, Homo sapiens
uaggaugcuugggaagacucc

SEQ ID NO: 2098115 - RNA, 16 nt, Homo sapiens
uccaaagaaagauuaa

SEQ ID NO: 2098116 - RNA, 14 nt, Homo sapiens
agaggccuuggcca

SEQ ID NO: 2098117 - RNA, 22 nt, Homo sapiens
uaugagccgugaacugugcaua

SEQ ID NO: 2098118 - RNA, 15 nt, Homo sapiens
guccaagacaggggc

SEQ ID NO: 2098119 - RNA, 15 nt, Homo sapiens
cccagcccagagaca

SEQ ID NO: 2098120 - RNA, 21 nt, Homo sapiens
uguaagugagagagacaagaa

SEQ ID NO: 2098121 - RNA, 13 nt, Homo sapiens
acaacaaagagaa

SEQ ID NO: 2098122 - RNA, 13 nt, Homo sapiens
aagacaaagcaaa

SEQ ID NO: 2098123 - RNA, 14 nt, Homo sapiens
gaaaccaguucaug

SEQ ID NO: 2098124 - RNA, 18 nt, Homo sapiens
ucagcaaaaugguccugu

SEQ ID NO: 2098125 - RNA, 14 nt, Homo sapiens
gcauguaaggccuu

SEQ ID NO: 2098126 - RNA, 22 nt, Homo sapiens
caagccuguucagguuuggcca

SEQ ID NO: 2098127 - RNA, 21 nt, Homo sapiens
ucauuuugugaauacuaugua

SEQ ID NO: 2098128 - RNA, 13 nt, Homo sapiens
uggaguuugacac

SEQ ID NO: 2098129 - RNA, 21 nt, Homo sapiens
agaaugaauacugggaaucaa

SEQ ID NO: 2098130 - RNA, 21 nt, Homo sapiens
cuaccaauaggcagacugugu

SEQ ID NO: 2098131 - RNA, 16 nt, Homo sapiens
ugagcaguuagcagac

SEQ ID NO: 2098132 - RNA, 17 nt, Homo sapiens
uaaauuauuggcaugaa

SEQ ID NO: 2098133 - RNA, 22 nt, Homo sapiens
ggaaugagucaaucagccuuua

SEQ ID NO: 2098134 - RNA, 11 nt, Homo sapiens
aaaugguuauu

SEQ ID NO: 2098135 - RNA, 18 nt, Homo sapiens
aagauaucuugaaaugaa

SEQ ID NO: 2098136 - RNA, 21 nt, Homo sapiens
uaugaccaaaacuauuccauu

SEQ ID NO: 2098137 - RNA, 23 nt, Homo sapiens
ccucuggguuguuaauacuguau

SEQ ID NO: 2098138 - RNA, 22 nt, Homo sapiens
caggaauagaauggagggagcu

SEQ ID NO: 2098139 - RNA, 13 nt, Homo sapiens
ccagucucuggca

SEQ ID NO: 2098140 - RNA, 16 nt, Homo sapiens
ugaaugauccugucuc

SEQ ID NO: 2098141 - RNA, 22 nt, Homo sapiens
cuccaaaaagaaauauuaauau

SEQ ID NO: 2098142 - RNA, 19 nt, Homo sapiens
uccugccuugcugugaaau

SEQ ID NO: 2098143 - RNA, 12 nt, Homo sapiens
gcugugggacca

SEQ ID NO: 2098144 - RNA, 14 nt, Homo sapiens
cguuugaaucacag

SEQ ID NO: 2098145 - RNA, 13 nt, Homo sapiens
aacaccuccucaa

SEQ ID NO: 2098146 - RNA, 13 nt, Homo sapiens
cuguccucaagua

SEQ ID NO: 2098147 - RNA, 18 nt, Homo sapiens
gauccaucucagucacuu

SEQ ID NO: 2098148 - RNA, 15 nt, Homo sapiens
ucuccuucacaucag

SEQ ID NO: 2098149 - RNA, 15 nt, Homo sapiens
ugcaacuuccuuuga

SEQ ID NO: 2098150 - RNA, 11 nt, Homo sapiens
cuucucaagac

SEQ ID NO: 2098151 - RNA, 18 nt, Homo sapiens
aaguaaaauuauucccug

SEQ ID NO: 2098152 - RNA, 21 nt, Homo sapiens
gaacuccuggccucaagccau

SEQ ID NO: 2098153 - RNA, 20 nt, Homo sapiens
acucacuccacaacccaaga

SEQ ID NO: 2098154 - RNA, 22 nt, Homo sapiens
ggauugggccaacaaggacuca

SEQ ID NO: 2098155 - RNA, 14 nt, Homo sapiens
ccacauucagggaa

SEQ ID NO: 2098156 - RNA, 17 nt, Homo sapiens
ccugaucucugaccucu

SEQ ID NO: 2098157 - RNA, 15 nt, Homo sapiens
aaggauccuucccug

SEQ ID NO: 2098158 - RNA, 19 nt, Homo sapiens
cacuugauguuuccuggaa

SEQ ID NO: 2098159 - RNA, 14 nt, Homo sapiens
guggcaucaucuca

SEQ ID NO: 2098160 - RNA, 19 nt, Homo sapiens
uagacacuacaacauaugg

SEQ ID NO: 2098161 - RNA, 15 nt, Homo sapiens
ucaccacccugcuca

SEQ ID NO: 2098162 - RNA, 15 nt, Homo sapiens
gcuagucugucaggg

SEQ ID NO: 2098163 - RNA, 17 nt, Homo sapiens
aguuuauaaaagacugu

SEQ ID NO: 2098164 - RNA, 20 nt, Homo sapiens
uucugagugaguuuuacucu

SEQ ID NO: 2098165 - RNA, 13 nt, Homo sapiens
uucauacagcauu

SEQ ID NO: 2098166 - RNA, 13 nt, Homo sapiens
gcuuugugucugg

SEQ ID NO: 2098167 - RNA, 15 nt, Homo sapiens
aaacagacuauuuaa

SEQ ID NO: 2098168 - RNA, 20 nt, Homo sapiens
uaaaacagaagccugaugcu

SEQ ID NO: 2098169 - RNA, 17 nt, Homo sapiens
uaccuaaacuguaucau

SEQ ID NO: 2098170 - RNA, 17 nt, Homo sapiens
cacaccugaacuugccu

SEQ ID NO: 2098171 - RNA, 18 nt, Homo sapiens
acagagaaaacuugccuu

SEQ ID NO: 2098172 - RNA, 22 nt, Homo sapiens
ucuaagguaaaaccaucuagga

SEQ ID NO: 2098173 - RNA, 22 nt, Homo sapiens
uuuacuugcccugaacauacac

SEQ ID NO: 2098174 - RNA, 22 nt, Homo sapiens
aaucaauaagaagguagaauga

SEQ ID NO: 2098175 - RNA, 19 nt, Homo sapiens
ucaugcagcaggugcaagg

SEQ ID NO: 2098176 - RNA, 21 nt, Homo sapiens
gaauuuuauauucuaagccag

SEQ ID NO: 2098177 - RNA, 22 nt, Homo sapiens
ccaagcaccuccaaccaaauaa

SEQ ID NO: 2098178 - RNA, 22 nt, Homo sapiens
accugccccagcacucacaccc

SEQ ID NO: 2098179 - RNA, 22 nt, Homo sapiens
acccugcugaccucccagugac

SEQ ID NO: 2098180 - RNA, 16 nt, Homo sapiens
gccaucagugaucuca

SEQ ID NO: 2098181 - RNA, 21 nt, Homo sapiens
ccucuagguccccauacuccu

SEQ ID NO: 2098182 - RNA, 14 nt, Homo sapiens
cggacagagcacgu

SEQ ID NO: 2098183 - RNA, 14 nt, Homo sapiens
aguucaacuuugag

SEQ ID NO: 2098184 - RNA, 17 nt, Homo sapiens
aaaccgauaaugcauga

SEQ ID NO: 2098185 - RNA, 15 nt, Homo sapiens
ccaagacagugaagu

SEQ ID NO: 2098186 - RNA, 15 nt, Homo sapiens
aggcgccugccacaa

SEQ ID NO: 2098187 - RNA, 14 nt, Homo sapiens
agagugagguggaa

SEQ ID NO: 2098188 - RNA, 12 nt, Homo sapiens
ugcaccuugcca

SEQ ID NO: 2098189 - RNA, 21 nt, Homo sapiens
aaucuauaugauuucagaaau

SEQ ID NO: 2098190 - RNA, 20 nt, Homo sapiens
accucaagguguucucugua

SEQ ID NO: 2098191 - RNA, 22 nt, Homo sapiens
uaaacucaagauuugaccaaau

SEQ ID NO: 2098192 - RNA, 18 nt, Homo sapiens
aacagcagaacuucugaa

SEQ ID NO: 2098193 - RNA, 21 nt, Homo sapiens
cuguauaauacuuuguauaca

SEQ ID NO: 2098194 - RNA, 19 nt, Homo sapiens
ugggagauguuagacucau

SEQ ID NO: 2098195 - RNA, 21 nt, Homo sapiens
acaccgauguacacacacaga

SEQ ID NO: 2098196 - RNA, 15 nt, Homo sapiens
gcaggugacagugag

SEQ ID NO: 2098197 - RNA, 19 nt, Homo sapiens
uuaauacaaugaugcuauu

SEQ ID NO: 2098198 - RNA, 16 nt, Homo sapiens
ccguguggcccaagac

SEQ ID NO: 2098199 - RNA, 14 nt, Homo sapiens
cguacaguucuucg

SEQ ID NO: 2098200 - RNA, 17 nt, Homo sapiens
cguugaacgucacaucu

SEQ ID NO: 2098201 - RNA, 15 nt, Homo sapiens
guucaaaccugugaa

SEQ ID NO: 2098202 - RNA, 22 nt, Homo sapiens
aucauuugugaagaauuauuca

SEQ ID NO: 2098203 - RNA, 13 nt, Homo sapiens
cugaguggucuga

SEQ ID NO: 2098204 - RNA, 16 nt, Homo sapiens
cuuuugcuugaauuua

SEQ ID NO: 2098205 - RNA, 15 nt, Homo sapiens
uucucgugacccagu

SEQ ID NO: 2098206 - RNA, 18 nt, Homo sapiens
uccaacccugccgucacc

SEQ ID NO: 2098207 - RNA, 20 nt, Homo sapiens
cucccucgaacccacacugc

SEQ ID NO: 2098208 - RNA, 19 nt, Homo sapiens
aucaauuccaucagcacaa

SEQ ID NO: 2098209 - RNA, 17 nt, Homo sapiens
uacagaacacuuugcua

SEQ ID NO: 2098210 - RNA, 21 nt, Homo sapiens
aauuguccacauacguggaaa

SEQ ID NO: 2098211 - RNA, 10 nt, Homo sapiens
cuuguuucag

SEQ ID NO: 2098212 - RNA, 21 nt, Homo sapiens
ucgaggagcuagaacauucca

SEQ ID NO: 2098213 - RNA, 21 nt, Homo sapiens
aggccgagagcagacaccagc

SEQ ID NO: 2098214 - RNA, 17 nt, Homo sapiens
cccagcccaacaucucc

SEQ ID NO: 2098215 - RNA, 17 nt, Homo sapiens
aaaugcccccauucucc

SEQ ID NO: 2098216 - RNA, 14 nt, Homo sapiens
agucuacuucuuaa

SEQ ID NO: 2098217 - RNA, 16 nt, Homo sapiens
uaggaaauugcucaua

SEQ ID NO: 2098218 - RNA, 17 nt, Homo sapiens
uucugauacguguauga

SEQ ID NO: 2098219 - RNA, 13 nt, Homo sapiens
aauuaacuaugug

SEQ ID NO: 2098220 - RNA, 16 nt, Homo sapiens
gauacugcauguuugc

SEQ ID NO: 2098221 - RNA, 23 nt, Homo sapiens
caaaaagauuuuagcuacaucua

SEQ ID NO: 2098222 - RNA, 15 nt, Homo sapiens
ccugcuccacagugu

SEQ ID NO: 2098223 - RNA, 19 nt, Homo sapiens
auucucuuaaaaugacaaa

SEQ ID NO: 2098224 - RNA, 16 nt, Homo sapiens
cagucauguaugcaag

SEQ ID NO: 2098225 - RNA, 20 nt, Homo sapiens
ugccccagggaguccagggu

SEQ ID NO: 2098226 - RNA, 13 nt, Homo sapiens
gcagaagccagaa

SEQ ID NO: 2098227 - RNA, 21 nt, Homo sapiens
agcccuucuauacccacccag

SEQ ID NO: 2098228 - RNA, 20 nt, Homo sapiens
ccuggagcuauucacagugc

SEQ ID NO: 2098229 - RNA, 15 nt, Homo sapiens
cuggauaaaccaccc

SEQ ID NO: 2098230 - RNA, 14 nt, Homo sapiens
ccucgagcacugaa

SEQ ID NO: 2098231 - RNA, 17 nt, Homo sapiens
auuugccugcagaguuu

SEQ ID NO: 2098232 - RNA, 23 nt, Homo sapiens
accuaaaaaucaaucacuugaaa

SEQ ID NO: 2098233 - RNA, 15 nt, Homo sapiens
agaccuggcacugga

SEQ ID NO: 2098234 - RNA, 13 nt, Homo sapiens
uuggaaugcacag

SEQ ID NO: 2098235 - RNA, 21 nt, Homo sapiens
uagaaacacacuuuugcacau

SEQ ID NO: 2098236 - RNA, 14 nt, Homo sapiens
aagaaaacauuuaa

SEQ ID NO: 2098237 - RNA, 15 nt, Homo sapiens
uaaaauuaguuuuaa

SEQ ID NO: 2098238 - RNA, 15 nt, Homo sapiens
cggaaguggccugag

SEQ ID NO: 2098239 - RNA, 22 nt, Homo sapiens
agugauuaacuuaagauuugcu

SEQ ID NO: 2098240 - RNA, 22 nt, Homo sapiens
auuucccugaaggaaccaaagc

SEQ ID NO: 2098241 - RNA, 17 nt, Homo sapiens
uaauucuaagacuuuug

SEQ ID NO: 2098242 - RNA, 16 nt, Homo sapiens
ucccaggcaugcagcu

SEQ ID NO: 2098243 - RNA, 13 nt, Homo sapiens
aauacacuuuauu

SEQ ID NO: 2098244 - RNA, 23 nt, Homo sapiens
gcuggaaaaguauguuagugcaa

SEQ ID NO: 2098245 - RNA, 12 nt, Homo sapiens
uccccuccccca

SEQ ID NO: 2098246 - RNA, 12 nt, Homo sapiens
ccaacuccucac

SEQ ID NO: 2098247 - RNA, 23 nt, Homo sapiens
acaggaggaaccccuucucuggu

SEQ ID NO: 2098248 - RNA, 20 nt, Homo sapiens
cagacuguggaaccaaagcu

SEQ ID NO: 2098249 - RNA, 19 nt, Homo sapiens
agaugcccaggauuugacu

SEQ ID NO: 2098250 - RNA, 21 nt, Homo sapiens
cuguaacgauugacaccaaaa

SEQ ID NO: 2098251 - RNA, 17 nt, Homo sapiens
auaugcaagugcaaaag

SEQ ID NO: 2098252 - RNA, 11 nt, Homo sapiens
uuggugcacag

SEQ ID NO: 2098253 - RNA, 18 nt, Homo sapiens
agccaggaugggucucca

SEQ ID NO: 2098254 - RNA, 23 nt, Homo sapiens
accuuucuccuuuguacuuugug

SEQ ID NO: 2098255 - RNA, 21 nt, Homo sapiens
uuaaagcaaacuaugauuuau

SEQ ID NO: 2098256 - RNA, 16 nt, Homo sapiens
ugaaaaucaaaguaaa

SEQ ID NO: 2098257 - RNA, 15 nt, Homo sapiens
ucuaagacaaaugca

SEQ ID NO: 2098258 - RNA, 15 nt, Homo sapiens
ccaagcuggcacaaa

SEQ ID NO: 2098259 - RNA, 19 nt, Homo sapiens
aucuagccuaaaguauaca

SEQ ID NO: 2098260 - RNA, 16 nt, Homo sapiens
auuucuagacaguauu

SEQ ID NO: 2098261 - RNA, 14 nt, Homo sapiens
gugugaacugggca

SEQ ID NO: 2098262 - RNA, 15 nt, Homo sapiens
cagcucccaucucau

SEQ ID NO: 2098263 - RNA, 16 nt, Homo sapiens
ugaggggaagccauuu

SEQ ID NO: 2098264 - RNA, 17 nt, Homo sapiens
gaaacauuaugccuuaa

SEQ ID NO: 2098265 - RNA, 21 nt, Homo sapiens
uugaaaccagaagaaguguga

SEQ ID NO: 2098266 - RNA, 17 nt, Homo sapiens
ugaaggagacagcagca

SEQ ID NO: 2098267 - RNA, 20 nt, Homo sapiens
accaggauagagacuggaac

SEQ ID NO: 2098268 - RNA, 10 nt, Homo sapiens
ugaagccuau

SEQ ID NO: 2098269 - RNA, 19 nt, Homo sapiens
gggcacuggcggucaagug

SEQ ID NO: 2098270 - RNA, 18 nt, Homo sapiens
gaaugaggcugcuuucca

SEQ ID NO: 2098271 - RNA, 15 nt, Homo sapiens
gacaaguagccaccu

SEQ ID NO: 2098272 - RNA, 16 nt, Homo sapiens
cuaucuccuucccacc

SEQ ID NO: 2098273 - RNA, 17 nt, Homo sapiens
agaguggcucacuggcu

SEQ ID NO: 2098274 - RNA, 12 nt, Homo sapiens
gaccaccagggc

SEQ ID NO: 2098275 - RNA, 16 nt, Homo sapiens
uaccaaaaucauuucu

SEQ ID NO: 2098276 - RNA, 21 nt, Homo sapiens
caccagaggcugcagaaggcc

SEQ ID NO: 2098277 - RNA, 20 nt, Homo sapiens
agaucaaacaugcauggaug

SEQ ID NO: 2098278 - RNA, 12 nt, Homo sapiens
uguuggcugugg

SEQ ID NO: 2098279 - RNA, 18 nt, Homo sapiens
cacuguauauuuugcaau

SEQ ID NO: 2098280 - RNA, 21 nt, Homo sapiens
uagcauaauaugaagccuuug

SEQ ID NO: 2098281 - RNA, 20 nt, Homo sapiens
uuguccagguugaucuugaa

SEQ ID NO: 2098282 - RNA, 15 nt, Homo sapiens
ggcaucucugagcaa

SEQ ID NO: 2098283 - RNA, 14 nt, Homo sapiens
ucgcugccagauga

SEQ ID NO: 2098284 - RNA, 21 nt, Homo sapiens
aggaggaccugggaauuucag

SEQ ID NO: 2098285 - RNA, 19 nt, Homo sapiens
ccucaaaugcggggugggg

SEQ ID NO: 2098286 - RNA, 17 nt, Homo sapiens
cucaagaggaaaaucca

SEQ ID NO: 2098287 - RNA, 19 nt, Homo sapiens
gacauuuugugacugaaga

SEQ ID NO: 2098288 - RNA, 19 nt, Homo sapiens
ccuuccaccucacaacucc

SEQ ID NO: 2098289 - RNA, 16 nt, Homo sapiens
cuuucagccaagccaa

SEQ ID NO: 2098290 - RNA, 14 nt, Homo sapiens
ucacucuucacuug

SEQ ID NO: 2098291 - RNA, 13 nt, Homo sapiens
aucugcacugggu

SEQ ID NO: 2098292 - RNA, 18 nt, Homo sapiens
aaguaccuugaacucuua

SEQ ID NO: 2098293 - RNA, 13 nt, Homo sapiens
ucucucuguuaca

SEQ ID NO: 2098294 - RNA, 21 nt, Homo sapiens
cgccuugccuccucacccacc

SEQ ID NO: 2098295 - RNA, 20 nt, Homo sapiens
acccacaguggaaagacagc

SEQ ID NO: 2098296 - RNA, 14 nt, Homo sapiens
augacagaacacag

SEQ ID NO: 2098297 - RNA, 15 nt, Homo sapiens
ucugagcacccccuc

SEQ ID NO: 2098298 - RNA, 19 nt, Homo sapiens
cacauacacacauauguca

SEQ ID NO: 2098299 - RNA, 16 nt, Homo sapiens
caguccauagcagaga

SEQ ID NO: 2098300 - RNA, 14 nt, Homo sapiens
ccagcagcagagaa

SEQ ID NO: 2098301 - RNA, 14 nt, Homo sapiens
aucauuucugccau

SEQ ID NO: 2098302 - RNA, 19 nt, Homo sapiens
uacugaguauuaaguagua

SEQ ID NO: 2098303 - RNA, 16 nt, Homo sapiens
uuaucaacaugcacac

SEQ ID NO: 2098304 - RNA, 22 nt, Homo sapiens
agaaaauuggaacucuacucaa

SEQ ID NO: 2098305 - RNA, 22 nt, Homo sapiens
gugguauccugugacauguaac

SEQ ID NO: 2098306 - RNA, 20 nt, Homo sapiens
aggugggaggaucucuugag

SEQ ID NO: 2098307 - RNA, 14 nt, Homo sapiens
gccaugggguccau

SEQ ID NO: 2098308 - RNA, 16 nt, Homo sapiens
acaccuuuguuuugca

SEQ ID NO: 2098309 - RNA, 19 nt, Homo sapiens
gaauaacauuuaaauucca

SEQ ID NO: 2098310 - RNA, 17 nt, Homo sapiens
cuuccuucagcaucuca

SEQ ID NO: 2098311 - RNA, 18 nt, Homo sapiens
ugugaucggccuggggaa

SEQ ID NO: 2098312 - RNA, 23 nt, Homo sapiens
uuucccggggaggaaacacuuuu

SEQ ID NO: 2098313 - RNA, 15 nt, Homo sapiens
acaaaggaggacaag

SEQ ID NO: 2098314 - RNA, 23 nt, Homo sapiens
cacugcgcccagcuauacuguau

SEQ ID NO: 2098315 - RNA, 21 nt, Homo sapiens
uuccacuugggacuagaucac

SEQ ID NO: 2098316 - RNA, 18 nt, Homo sapiens
uugaggggcccuggccag

SEQ ID NO: 2098317 - RNA, 23 nt, Homo sapiens
guggugccccagcacgguggugc

SEQ ID NO: 2098318 - RNA, 16 nt, Homo sapiens
gaagcuccacugucac

SEQ ID NO: 2098319 - RNA, 15 nt, Homo sapiens
aagacuuaacugguu

SEQ ID NO: 2098320 - RNA, 14 nt, Homo sapiens
acuauuuauauaca

SEQ ID NO: 2098321 - RNA, 16 nt, Homo sapiens
auauucaggacuugaa

SEQ ID NO: 2098322 - RNA, 15 nt, Homo sapiens
ucacaacacaaucaa

SEQ ID NO: 2098323 - RNA, 18 nt, Homo sapiens
uguggcccuccaguguau

SEQ ID NO: 2098324 - RNA, 17 nt, Homo sapiens
accaugaaaauagccaa

SEQ ID NO: 2098325 - RNA, 19 nt, Homo sapiens
ugggagggguugaugccag

SEQ ID NO: 2098326 - RNA, 13 nt, Homo sapiens
aucgcacacuggg

SEQ ID NO: 2098327 - RNA, 13 nt, Homo sapiens
ccugccucaggcu

SEQ ID NO: 2098328 - RNA, 23 nt, Homo sapiens
gucucaccccucauccuuuuacu

SEQ ID NO: 2098329 - RNA, 24 nt, Homo sapiens
acuguggaaaugccaaaccaagca

SEQ ID NO: 2098330 - RNA, 20 nt, Homo sapiens
ccaauggcaacaucuugcaa

SEQ ID NO: 2098331 - RNA, 24 nt, Homo sapiens
caaaguauaaccauaugauacuau

SEQ ID NO: 2098332 - RNA, 22 nt, Homo sapiens
cacauuggucauugugaauauu

SEQ ID NO: 2098333 - RNA, 17 nt, Homo sapiens
augugcacugcauuaga

SEQ ID NO: 2098334 - RNA, 15 nt, Homo sapiens
cuuuguauuccuuaa

SEQ ID NO: 2098335 - RNA, 14 nt, Homo sapiens
gucacaauccuaac

SEQ ID NO: 2098336 - RNA, 19 nt, Homo sapiens
uuaaacugugaauguucca

SEQ ID NO: 2098337 - RNA, 21 nt, Homo sapiens
uauccauuagagcaacuuucu

SEQ ID NO: 2098338 - RNA, 15 nt, Homo sapiens
cacugagcaaagcau

SEQ ID NO: 2098339 - RNA, 16 nt, Homo sapiens
agacagccauacuucc

SEQ ID NO: 2098340 - RNA, 19 nt, Homo sapiens
aagaucccagugugaagua

SEQ ID NO: 2098341 - RNA, 16 nt, Homo sapiens
cacuggcgcagacuuc

SEQ ID NO: 2098342 - RNA, 13 nt, Homo sapiens
aagauacaacagc

SEQ ID NO: 2098343 - RNA, 17 nt, Homo sapiens
aguuagaaacaccagcc

SEQ ID NO: 2098344 - RNA, 13 nt, Homo sapiens
acaguagagccag

SEQ ID NO: 2098345 - RNA, 20 nt, Homo sapiens
agucagcuguaccaagcccc

SEQ ID NO: 2098346 - RNA, 16 nt, Homo sapiens
uuacuuuguguucacc

SEQ ID NO: 2098347 - RNA, 14 nt, Homo sapiens
caguuuaccauccu

SEQ ID NO: 2098348 - RNA, 14 nt, Homo sapiens
uuuuuccuagucuu

SEQ ID NO: 2098349 - RNA, 22 nt, Homo sapiens
auacauuuguauuuugugauga

SEQ ID NO: 2098350 - RNA, 13 nt, Homo sapiens
uggcacuauuuga

SEQ ID NO: 2098351 - RNA, 22 nt, Homo sapiens
caauuuccauauagucuauuca

SEQ ID NO: 2098352 - RNA, 17 nt, Homo sapiens
cugaucugcggaucuca

SEQ ID NO: 2098353 - RNA, 14 nt, Homo sapiens
cuugcuaucuauaa

SEQ ID NO: 2098354 - RNA, 21 nt, Homo sapiens
caagcaggcgccaagugcuau

SEQ ID NO: 2098355 - RNA, 14 nt, Homo sapiens
uaccaaguauuuau

SEQ ID NO: 2098356 - RNA, 19 nt, Homo sapiens
cuccuuggcuuuaugcaaa

SEQ ID NO: 2098357 - RNA, 19 nt, Homo sapiens
auuucuauuuuuguagaag

SEQ ID NO: 2098358 - RNA, 14 nt, Homo sapiens
ucacauguucuaau

SEQ ID NO: 2098359 - RNA, 18 nt, Homo sapiens
agaucucuccugcaaaag

SEQ ID NO: 2098360 - RNA, 12 nt, Homo sapiens
agcugggaccac

SEQ ID NO: 2098361 - RNA, 14 nt, Homo sapiens
acuggggugggggu

SEQ ID NO: 2098362 - RNA, 16 nt, Homo sapiens
ugcaucuuugccucaa

SEQ ID NO: 2098363 - RNA, 17 nt, Homo sapiens
agugcauuuggccaaau

SEQ ID NO: 2098364 - RNA, 14 nt, Homo sapiens
ucucaucugugauu

SEQ ID NO: 2098365 - RNA, 17 nt, Homo sapiens
ggagguacgaaaagagg

SEQ ID NO: 2098366 - RNA, 16 nt, Homo sapiens
ccugugcccaccaguu

SEQ ID NO: 2098367 - RNA, 18 nt, Homo sapiens
agcgagacuccaucucaa

SEQ ID NO: 2098368 - RNA, 11 nt, Homo sapiens
cuuccauuugc

SEQ ID NO: 2098369 - RNA, 19 nt, Homo sapiens
gauauaugacuuuuucuca

SEQ ID NO: 2098370 - RNA, 22 nt, Homo sapiens
ugcccacgucccgggcacuguc

SEQ ID NO: 2098371 - RNA, 18 nt, Homo sapiens
uucuggaaacuaccaggu

SEQ ID NO: 2098372 - RNA, 19 nt, Homo sapiens
uacauaccacuuugaauag

SEQ ID NO: 2098373 - RNA, 16 nt, Homo sapiens
ugcacacucacuugua

SEQ ID NO: 2098374 - RNA, 14 nt, Homo sapiens
ugucacuugcauuc

SEQ ID NO: 2098375 - RNA, 10 nt, Homo sapiens
caccauuccc

SEQ ID NO: 2098376 - RNA, 16 nt, Homo sapiens
gucggagccacugguc

SEQ ID NO: 2098377 - RNA, 17 nt, Homo sapiens
aacucuacucaacccau

SEQ ID NO: 2098378 - RNA, 23 nt, Homo sapiens
ccaaucucugccauaucagugaa

SEQ ID NO: 2098379 - RNA, 14 nt, Homo sapiens
agauguacugcaaa

SEQ ID NO: 2098380 - RNA, 19 nt, Homo sapiens
uugauaucagccccugcaa

SEQ ID NO: 2098381 - RNA, 15 nt, Homo sapiens
uguagagaugggaug

SEQ ID NO: 2098382 - RNA, 23 nt, Homo sapiens
ugcugguccccuccucagugaca

SEQ ID NO: 2098383 - RNA, 20 nt, Homo sapiens
ccagcacuuugggaguccaa

SEQ ID NO: 2098384 - RNA, 20 nt, Homo sapiens
aggugcccucggagugccac

SEQ ID NO: 2098385 - RNA, 18 nt, Homo sapiens
guccccuuuccucuaacu

SEQ ID NO: 2098386 - RNA, 21 nt, Homo sapiens
cagcugucaagggcagaauga

SEQ ID NO: 2098387 - RNA, 22 nt, Homo sapiens
ccaaauguucauccucauugcc

SEQ ID NO: 2098388 - RNA, 18 nt, Homo sapiens
uggaauucuucacuugcu

SEQ ID NO: 2098389 - RNA, 16 nt, Homo sapiens
uaugcugcucaucccc

SEQ ID NO: 2098390 - RNA, 17 nt, Homo sapiens
ucuaccuauaugcaguc

SEQ ID NO: 2098391 - RNA, 14 nt, Homo sapiens
accugugagaccaa

SEQ ID NO: 2098392 - RNA, 16 nt, Homo sapiens
auacucugaauuugga

SEQ ID NO: 2098393 - RNA, 22 nt, Homo sapiens
augaacuaacugacagcuucau

SEQ ID NO: 2098394 - RNA, 21 nt, Homo sapiens
ccccucccuggaugacauuaa

SEQ ID NO: 2098395 - RNA, 12 nt, Homo sapiens
cuguaaaaccag

SEQ ID NO: 2098396 - RNA, 11 nt, Homo sapiens
uuucacaagcu

SEQ ID NO: 2098397 - RNA, 21 nt, Homo sapiens
aaaacaagagacugcuugaca

SEQ ID NO: 2098398 - RNA, 18 nt, Homo sapiens
ccugacaaguuauuacug

SEQ ID NO: 2098399 - RNA, 23 nt, Homo sapiens
gaccacaaggcugaaaagugcuu

SEQ ID NO: 2098400 - RNA, 22 nt, Homo sapiens
caucugugcacugcccauggac

SEQ ID NO: 2098401 - RNA, 17 nt, Homo sapiens
caguggggccccaaagc

SEQ ID NO: 2098402 - RNA, 21 nt, Homo sapiens
acuagagaaaauaaauuccaa

SEQ ID NO: 2098403 - RNA, 18 nt, Homo sapiens
agauucucuuggcucaua

SEQ ID NO: 2098404 - RNA, 20 nt, Homo sapiens
gauaaaggaagucaccaaaa

SEQ ID NO: 2098405 - RNA, 16 nt, Homo sapiens
agaacuggaccaucuc

SEQ ID NO: 2098406 - RNA, 15 nt, Homo sapiens
cgggcacucccggga

SEQ ID NO: 2098407 - RNA, 21 nt, Homo sapiens
caugaauaacauuuaaauucc

SEQ ID NO: 2098408 - RNA, 15 nt, Homo sapiens
aaagauuugauguau

SEQ ID NO: 2098409 - RNA, 22 nt, Homo sapiens
caaccacagugccaccaagcuc

SEQ ID NO: 2098410 - RNA, 18 nt, Homo sapiens
guuuccuuucgucugcca

SEQ ID NO: 2098411 - RNA, 15 nt, Homo sapiens
cgagccaccaugcuu

SEQ ID NO: 2098412 - RNA, 16 nt, Homo sapiens
uauagcaucuuucaua

SEQ ID NO: 2098413 - RNA, 17 nt, Homo sapiens
ucauuucacccaaguau

SEQ ID NO: 2098414 - RNA, 23 nt, Homo sapiens
aguauaucacagagccacucuuc

SEQ ID NO: 2098415 - RNA, 17 nt, Homo sapiens
aaugggcacagcacagc

SEQ ID NO: 2098416 - RNA, 21 nt, Homo sapiens
caacauccacuguuagcacau

SEQ ID NO: 2098417 - RNA, 15 nt, Homo sapiens
uccugguccuggaca

SEQ ID NO: 2098418 - RNA, 18 nt, Homo sapiens
gauacacgucacaaagac

SEQ ID NO: 2098419 - RNA, 20 nt, Homo sapiens
aagaugguguggguguccug

SEQ ID NO: 2098420 - RNA, 19 nt, Homo sapiens
agagacuuugacucuccag

SEQ ID NO: 2098421 - RNA, 23 nt, Homo sapiens
ucuuugccagacaacuuguccug

SEQ ID NO: 2098422 - RNA, 13 nt, Homo sapiens
ucccuuagacuuu

SEQ ID NO: 2098423 - RNA, 16 nt, Homo sapiens
acuacaguacagugag

SEQ ID NO: 2098424 - RNA, 19 nt, Homo sapiens
augugccgucuuugguucc

SEQ ID NO: 2098425 - RNA, 17 nt, Homo sapiens
aauacaaugauccugua

SEQ ID NO: 2098426 - RNA, 12 nt, Homo sapiens
ugagauccagag

SEQ ID NO: 2098427 - RNA, 17 nt, Homo sapiens
ccugcagacagaccuca

SEQ ID NO: 2098428 - RNA, 13 nt, Homo sapiens
accuguuccuguu

SEQ ID NO: 2098429 - RNA, 17 nt, Homo sapiens
acucugaauccucauga

SEQ ID NO: 2098430 - RNA, 19 nt, Homo sapiens
aaguccagugugacuuuau

SEQ ID NO: 2098431 - RNA, 21 nt, Homo sapiens
gaaccacucccaccacaggca

SEQ ID NO: 2098432 - RNA, 17 nt, Homo sapiens
agaagccccuaggcaaa

SEQ ID NO: 2098433 - RNA, 17 nt, Homo sapiens
acaaugccaucacugga

SEQ ID NO: 2098434 - RNA, 20 nt, Homo sapiens
aauucuuauuuuuccuaaca

SEQ ID NO: 2098435 - RNA, 15 nt, Homo sapiens
cggccacgucccugc

SEQ ID NO: 2098436 - RNA, 21 nt, Homo sapiens
uuguuuaauaauguaccuauu

SEQ ID NO: 2098437 - RNA, 16 nt, Homo sapiens
cacugcuugaaccaaa

SEQ ID NO: 2098438 - RNA, 16 nt, Homo sapiens
ucugagcuagugauuu

SEQ ID NO: 2098439 - RNA, 20 nt, Homo sapiens
ucccuuuccuuuccuuucau

SEQ ID NO: 2098440 - RNA, 19 nt, Homo sapiens
ugcaugguuucagcacuag

SEQ ID NO: 2098441 - RNA, 20 nt, Homo sapiens
aaguguuucugaagucucaa

SEQ ID NO: 2098442 - RNA, 20 nt, Homo sapiens
uuguuuugagcagacaggcu

SEQ ID NO: 2098443 - RNA, 21 nt, Homo sapiens
aaucuugcccuuaauaucccu

SEQ ID NO: 2098444 - RNA, 21 nt, Homo sapiens
agagcucaucaucagucuuaa

SEQ ID NO: 2098445 - RNA, 21 nt, Homo sapiens
uacaucuuaaaucuuuucaau

SEQ ID NO: 2098446 - RNA, 17 nt, Homo sapiens
gaccaucuuugccaaca

SEQ ID NO: 2098447 - RNA, 20 nt, Homo sapiens
ccuuacucugagcucauuaa

SEQ ID NO: 2098448 - RNA, 16 nt, Homo sapiens
ccaaguuuccaaacaa

SEQ ID NO: 2098449 - RNA, 15 nt, Homo sapiens
ucuugguaucuuucu

SEQ ID NO: 2098450 - RNA, 16 nt, Homo sapiens
aauaauguaagggucu

SEQ ID NO: 2098451 - RNA, 14 nt, Homo sapiens
uaacagaaauguac

SEQ ID NO: 2098452 - RNA, 17 nt, Homo sapiens
ugggaucgcauugcaua

SEQ ID NO: 2098453 - RNA, 23 nt, Homo sapiens
uuuauacucaggcagaucucagc

SEQ ID NO: 2098454 - RNA, 22 nt, Homo sapiens
aaaacaacagcucgauccaaau

SEQ ID NO: 2098455 - RNA, 11 nt, Homo sapiens
ucacaguauuu

SEQ ID NO: 2098456 - RNA, 16 nt, Homo sapiens
cuuguguguaugcaca

SEQ ID NO: 2098457 - RNA, 22 nt, Homo sapiens
agcaugcucaguuggugcugcu

SEQ ID NO: 2098458 - RNA, 14 nt, Homo sapiens
aucagcccaucuca

SEQ ID NO: 2098459 - RNA, 23 nt, Homo sapiens
agucacugcacagugcaucucag

SEQ ID NO: 2098460 - RNA, 14 nt, Homo sapiens
uuaggaaucaauga

SEQ ID NO: 2098461 - RNA, 16 nt, Homo sapiens
acuauacccgggacca

SEQ ID NO: 2098462 - RNA, 16 nt, Homo sapiens
cuguacaaugacacuu

SEQ ID NO: 2098463 - RNA, 20 nt, Homo sapiens
gcgugggucucuggggaccc

SEQ ID NO: 2098464 - RNA, 20 nt, Homo sapiens
acaugacacaguuggauuua

SEQ ID NO: 2098465 - RNA, 21 nt, Homo sapiens
acucaucuuggcccuccucag

SEQ ID NO: 2098466 - RNA, 13 nt, Homo sapiens
uaagaaguagcaa

SEQ ID NO: 2098467 - RNA, 16 nt, Homo sapiens
uuaccaguauuuaacu

SEQ ID NO: 2098468 - RNA, 23 nt, Homo sapiens
accauuccaggaaaacugggaca

SEQ ID NO: 2098469 - RNA, 21 nt, Homo sapiens
cuccaucauggcagugaugaa

SEQ ID NO: 2098470 - RNA, 16 nt, Homo sapiens
cacaacuccaguguuc

SEQ ID NO: 2098471 - RNA, 15 nt, Homo sapiens
cucggauacuugcca

SEQ ID NO: 2098472 - RNA, 20 nt, Homo sapiens
cccaccacgugcucaaucau

SEQ ID NO: 2098473 - RNA, 13 nt, Homo sapiens
aucacauagugaa

SEQ ID NO: 2098474 - RNA, 19 nt, Homo sapiens
aggccacccgggcugccug

SEQ ID NO: 2098475 - RNA, 19 nt, Homo sapiens
uugugaauaguaagcauaa

SEQ ID NO: 2098476 - RNA, 19 nt, Homo sapiens
ugguuccaugccugagggu

SEQ ID NO: 2098477 - RNA, 13 nt, Homo sapiens
cuucuuacuugcc

SEQ ID NO: 2098478 - RNA, 13 nt, Homo sapiens
cuuuaaguauuga

SEQ ID NO: 2098479 - RNA, 18 nt, Homo sapiens
uuuccuaaaugcagugaa

SEQ ID NO: 2098480 - RNA, 20 nt, Homo sapiens
aucaugaguaccucaaagga

SEQ ID NO: 2098481 - RNA, 16 nt, Homo sapiens
uuaugugacuugcaau

SEQ ID NO: 2098482 - RNA, 14 nt, Homo sapiens
guagaaugucuugg

SEQ ID NO: 2098483 - RNA, 17 nt, Homo sapiens
ucagaauuuagacugaa

SEQ ID NO: 2098484 - RNA, 13 nt, Homo sapiens
uaaguucuucaaa

SEQ ID NO: 2098485 - RNA, 22 nt, Homo sapiens
ugccagccuccuugcugacccc

SEQ ID NO: 2098486 - RNA, 18 nt, Homo sapiens
ugucagggguuucuucaa

SEQ ID NO: 2098487 - RNA, 20 nt, Homo sapiens
gcuauaguuauacaucaauu

SEQ ID NO: 2098488 - RNA, 19 nt, Homo sapiens
ucugagacuaaaugagagg

SEQ ID NO: 2098489 - RNA, 18 nt, Homo sapiens
uaaaauagccacuuaccu

SEQ ID NO: 2098490 - RNA, 13 nt, Homo sapiens
guaaucuguguac

SEQ ID NO: 2098491 - RNA, 18 nt, Homo sapiens
gucugugaauauccagaa

SEQ ID NO: 2098492 - RNA, 22 nt, Homo sapiens
uuuaucuguugucuagagcuca

SEQ ID NO: 2098493 - RNA, 11 nt, Homo sapiens
acucaguucca

SEQ ID NO: 2098494 - RNA, 15 nt, Homo sapiens
gacaagcaugguccc

SEQ ID NO: 2098495 - RNA, 19 nt, Homo sapiens
ugacaacgccaacugccca

SEQ ID NO: 2098496 - RNA, 20 nt, Homo sapiens
gcaguggggagcgggggcua

SEQ ID NO: 2098497 - RNA, 23 nt, Homo sapiens
cuuuucaccaaaauuucuacacc

SEQ ID NO: 2098498 - RNA, 12 nt, Homo sapiens
uggggggaccca

SEQ ID NO: 2098499 - RNA, 22 nt, Homo sapiens
aucuuugucuuuauuagauuuu

SEQ ID NO: 2098500 - RNA, 19 nt, Homo sapiens
aacccagagguggauguua

SEQ ID NO: 2098501 - RNA, 17 nt, Homo sapiens
gcaucagcugcucagau

SEQ ID NO: 2098502 - RNA, 17 nt, Homo sapiens
uguguauagcuuaccug

SEQ ID NO: 2098503 - RNA, 19 nt, Homo sapiens
cuuugcgcagcccuaccuu

SEQ ID NO: 2098504 - RNA, 16 nt, Homo sapiens
uaaaguuuuguacaaa

SEQ ID NO: 2098505 - RNA, 17 nt, Homo sapiens
gcagacaacaccuuccu

SEQ ID NO: 2098506 - RNA, 18 nt, Homo sapiens
aauuauuaccaucucucc

SEQ ID NO: 2098507 - RNA, 22 nt, Homo sapiens
aaaggaacuaacuuacugucca

SEQ ID NO: 2098508 - RNA, 20 nt, Homo sapiens
auaguugagccagcagacau

SEQ ID NO: 2098509 - RNA, 15 nt, Homo sapiens
ggguuaagagcucac

SEQ ID NO: 2098510 - RNA, 15 nt, Homo sapiens
ucacccccacacugg

SEQ ID NO: 2098511 - RNA, 17 nt, Homo sapiens
ccugagcagaauacugg

SEQ ID NO: 2098512 - RNA, 16 nt, Homo sapiens
uuagucucaagggcua

SEQ ID NO: 2098513 - RNA, 14 nt, Homo sapiens
agccugggggacag

SEQ ID NO: 2098514 - RNA, 17 nt, Homo sapiens
auauuuuagccacucaa

SEQ ID NO: 2098515 - RNA, 22 nt, Homo sapiens
uuacaggcacgugccaccacgc

SEQ ID NO: 2098516 - RNA, 15 nt, Homo sapiens
uauaaauguugcuau

SEQ ID NO: 2098517 - RNA, 21 nt, Homo sapiens
gggccuuuucugugccagaca

SEQ ID NO: 2098518 - RNA, 12 nt, Homo sapiens
gugaaaauaugu

SEQ ID NO: 2098519 - RNA, 13 nt, Homo sapiens
auuuuuugcccag

SEQ ID NO: 2098520 - RNA, 23 nt, Homo sapiens
cccggugggacccccguggggca

SEQ ID NO: 2098521 - RNA, 20 nt, Homo sapiens
cuugaacacucaugcugaaa

SEQ ID NO: 2098522 - RNA, 20 nt, Homo sapiens
uaagcaagccaggagaagac

SEQ ID NO: 2098523 - RNA, 16 nt, Homo sapiens
ugcaaccaacuaucca

SEQ ID NO: 2098524 - RNA, 17 nt, Homo sapiens
ggucuagggaaugagac

SEQ ID NO: 2098525 - RNA, 12 nt, Homo sapiens
acaucuuguuaa

SEQ ID NO: 2098526 - RNA, 14 nt, Homo sapiens
gaaggcuacuugag

SEQ ID NO: 2098527 - RNA, 14 nt, Homo sapiens
cucucuugcuagac

SEQ ID NO: 2098528 - RNA, 15 nt, Homo sapiens
cuuugucugugggaa

SEQ ID NO: 2098529 - RNA, 23 nt, Homo sapiens
agagaagagccccacucucagag

SEQ ID NO: 2098530 - RNA, 17 nt, Homo sapiens
auagagccaaguccaaa

SEQ ID NO: 2098531 - RNA, 16 nt, Homo sapiens
guucuuagagcacuuu

SEQ ID NO: 2098532 - RNA, 16 nt, Homo sapiens
gugccuguagugccag

SEQ ID NO: 2098533 - RNA, 12 nt, Homo sapiens
gcacggcagcuu

SEQ ID NO: 2098534 - RNA, 11 nt, Homo sapiens
ucauuguacug

SEQ ID NO: 2098535 - RNA, 12 nt, Homo sapiens
ccuuggggccug

SEQ ID NO: 2098536 - RNA, 20 nt, Homo sapiens
uugcugucuucagucucaca

SEQ ID NO: 2098537 - RNA, 14 nt, Homo sapiens
gccccgugaacuca

SEQ ID NO: 2098538 - RNA, 12 nt, Homo sapiens
auuaccuucuau

SEQ ID NO: 2098539 - RNA, 12 nt, Homo sapiens
cauuccaaauau

SEQ ID NO: 2098540 - RNA, 12 nt, Homo sapiens
uuugguuuucca

SEQ ID NO: 2098541 - RNA, 15 nt, Homo sapiens
ggaagcuaauuugca

SEQ ID NO: 2098542 - RNA, 18 nt, Homo sapiens
caaccuuuucucuggaca

SEQ ID NO: 2098543 - RNA, 17 nt, Homo sapiens
gcaggagaauggcguga

SEQ ID NO: 2098544 - RNA, 17 nt, Homo sapiens
uauuaauaaagcauucu

SEQ ID NO: 2098545 - RNA, 22 nt, Homo sapiens
ccauggcaccuuuugcacauaa

SEQ ID NO: 2098546 - RNA, 15 nt, Homo sapiens
guuaacaauuuugca

SEQ ID NO: 2098547 - RNA, 15 nt, Homo sapiens
auguggccaagaaga

SEQ ID NO: 2098548 - RNA, 19 nt, Homo sapiens
uucuaucugggcuguugcu

SEQ ID NO: 2098549 - RNA, 14 nt, Homo sapiens
ugcugucaaaacaa

SEQ ID NO: 2098550 - RNA, 23 nt, Homo sapiens
ugggcaacaugaugaaaucccau

SEQ ID NO: 2098551 - RNA, 14 nt, Homo sapiens
ucaauaaaauacuu

SEQ ID NO: 2098552 - RNA, 23 nt, Homo sapiens
aucagaguggccaaucccugugu

SEQ ID NO: 2098553 - RNA, 21 nt, Homo sapiens
ugggcugucucucccuuccag

SEQ ID NO: 2098554 - RNA, 22 nt, Homo sapiens
auuauccuagauuauaucaaag

SEQ ID NO: 2098555 - RNA, 15 nt, Homo sapiens
gccucuggcucucau

SEQ ID NO: 2098556 - RNA, 16 nt, Homo sapiens
gacuaaaccauugugc

SEQ ID NO: 2098557 - RNA, 11 nt, Homo sapiens
agucaccucac

SEQ ID NO: 2098558 - RNA, 21 nt, Homo sapiens
gauguggauggaggugaugaa

SEQ ID NO: 2098559 - RNA, 15 nt, Homo sapiens
uuucccaaagcacuu

SEQ ID NO: 2098560 - RNA, 16 nt, Homo sapiens
ucucccuccaguccuc

SEQ ID NO: 2098561 - RNA, 16 nt, Homo sapiens
gccuggcacgagggga

SEQ ID NO: 2098562 - RNA, 14 nt, Homo sapiens
gucaggacugugac

SEQ ID NO: 2098563 - RNA, 17 nt, Homo sapiens
agccugagguacagaga

SEQ ID NO: 2098564 - RNA, 16 nt, Homo sapiens
auucuguaaaauuuaa

SEQ ID NO: 2098565 - RNA, 16 nt, Homo sapiens
auuuuuuaaaacugaa

SEQ ID NO: 2098566 - RNA, 21 nt, Homo sapiens
ucuauugagugaacagaauug

SEQ ID NO: 2098567 - RNA, 17 nt, Homo sapiens
aagcccugcccacagaa

SEQ ID NO: 2098568 - RNA, 15 nt, Homo sapiens
uacucucaugcugca

SEQ ID NO: 2098569 - RNA, 23 nt, Homo sapiens
aauccaugugcugcuguggcauc

SEQ ID NO: 2098570 - RNA, 22 nt, Homo sapiens
aucaagagugagugaacaacua

SEQ ID NO: 2098571 - RNA, 21 nt, Homo sapiens
cuuccguggucagagugccac

SEQ ID NO: 2098572 - RNA, 20 nt, Homo sapiens
cuggaguuggaaaagaaaca

SEQ ID NO: 2098573 - RNA, 16 nt, Homo sapiens
uuccuauguaacugca

SEQ ID NO: 2098574 - RNA, 23 nt, Homo sapiens
aaugaucaccauguuagccuuag

SEQ ID NO: 2098575 - RNA, 16 nt, Homo sapiens
caagguccaugucacc

SEQ ID NO: 2098576 - RNA, 17 nt, Homo sapiens
gguucuuauucacugag

SEQ ID NO: 2098577 - RNA, 22 nt, Homo sapiens
gcaauaacguuuaagccaaaac

SEQ ID NO: 2098578 - RNA, 18 nt, Homo sapiens
accuugugauucugcuua

SEQ ID NO: 2098579 - RNA, 20 nt, Homo sapiens
caucgcaauaguuuuuuacu

SEQ ID NO: 2098580 - RNA, 13 nt, Homo sapiens
cagccaugggaac

SEQ ID NO: 2098581 - RNA, 15 nt, Homo sapiens
aaucacuccauugga

SEQ ID NO: 2098582 - RNA, 18 nt, Homo sapiens
ugguccuaagcaccugcc

SEQ ID NO: 2098583 - RNA, 14 nt, Homo sapiens
ucccuuuucccuua

SEQ ID NO: 2098584 - RNA, 14 nt, Homo sapiens
ucuuauuuccucaa

SEQ ID NO: 2098585 - RNA, 18 nt, Homo sapiens
guuacugaucuuacucac

SEQ ID NO: 2098586 - RNA, 18 nt, Homo sapiens
gaggagcgaucucagcag

SEQ ID NO: 2098587 - RNA, 23 nt, Homo sapiens
ccaucuugugguaacuugcugcu

SEQ ID NO: 2098588 - RNA, 18 nt, Homo sapiens
aucaugggccagagccuc

SEQ ID NO: 2098589 - RNA, 18 nt, Homo sapiens
gauauucacucugugguc

SEQ ID NO: 2098590 - RNA, 22 nt, Homo sapiens
uuuccaugcacccucauacaca

SEQ ID NO: 2098591 - RNA, 23 nt, Homo sapiens
caccagugccucagugcugcaau

SEQ ID NO: 2098592 - RNA, 11 nt, Homo sapiens
aaagcugccau

SEQ ID NO: 2098593 - RNA, 19 nt, Homo sapiens
ucuagacugcaagaacugu

SEQ ID NO: 2098594 - RNA, 16 nt, Homo sapiens
gcagaaccuccuggaa

SEQ ID NO: 2098595 - RNA, 20 nt, Homo sapiens
gcccaggcuggaguacaaug

SEQ ID NO: 2098596 - RNA, 19 nt, Homo sapiens
gacuccugcucucuaucca

SEQ ID NO: 2098597 - RNA, 17 nt, Homo sapiens
cacauaacuacaccuga

SEQ ID NO: 2098598 - RNA, 16 nt, Homo sapiens
agaaacguaacugugu

SEQ ID NO: 2098599 - RNA, 22 nt, Homo sapiens
ccagcccuccccaucucggggc

SEQ ID NO: 2098600 - RNA, 20 nt, Homo sapiens
cccaguaagggcguggcucu

SEQ ID NO: 2098601 - RNA, 20 nt, Homo sapiens
uuucccagagaccuucugau

SEQ ID NO: 2098602 - RNA, 16 nt, Homo sapiens
uucugggaacuuccuc

SEQ ID NO: 2098603 - RNA, 17 nt, Homo sapiens
cccaaacagcaugugcu

SEQ ID NO: 2098604 - RNA, 14 nt, Homo sapiens
uuuccguaaauguc

SEQ ID NO: 2098605 - RNA, 19 nt, Homo sapiens
aaaaauuaacagcagucua

SEQ ID NO: 2098606 - RNA, 21 nt, Homo sapiens
caggcugugacucuucucuca

SEQ ID NO: 2098607 - RNA, 18 nt, Homo sapiens
cuaaacuuucacacccca

SEQ ID NO: 2098608 - RNA, 16 nt, Homo sapiens
agauucgccaaucuca

SEQ ID NO: 2098609 - RNA, 19 nt, Homo sapiens
guggugccugcacacagag

SEQ ID NO: 2098610 - RNA, 17 nt, Homo sapiens
cccaagaggccagggug

SEQ ID NO: 2098611 - RNA, 24 nt, Homo sapiens
gacccuuguggguccaugcuaaca

SEQ ID NO: 2098612 - RNA, 20 nt, Homo sapiens
acaguggcucacgccuguaa

SEQ ID NO: 2098613 - RNA, 21 nt, Homo sapiens
ggaacaaaaaaaccacaaagg

SEQ ID NO: 2098614 - RNA, 20 nt, Homo sapiens
cagccagaggaggccgguga

SEQ ID NO: 2098615 - RNA, 23 nt, Homo sapiens
uauguauaaauuaauacagagua

SEQ ID NO: 2098616 - RNA, 14 nt, Homo sapiens
cuacagcagcacug

SEQ ID NO: 2098617 - RNA, 22 nt, Homo sapiens
gcaacuccccauuggugcuacc

SEQ ID NO: 2098618 - RNA, 12 nt, Homo sapiens
uaaaaaggccaa

SEQ ID NO: 2098619 - RNA, 13 nt, Homo sapiens
cauauuaaaacaa

SEQ ID NO: 2098620 - RNA, 15 nt, Homo sapiens
uggcuccuucacuga

SEQ ID NO: 2098621 - RNA, 21 nt, Homo sapiens
aucaugcauagagugugaugu

SEQ ID NO: 2098622 - RNA, 23 nt, Homo sapiens
cauaagcagaagaucaaaaugcu

SEQ ID NO: 2098623 - RNA, 16 nt, Homo sapiens
cagaucgcaccacugc

SEQ ID NO: 2098624 - RNA, 21 nt, Homo sapiens
cuggugguuugauuguuuaca

SEQ ID NO: 2098625 - RNA, 20 nt, Homo sapiens
agaucuugaauagucucauc

SEQ ID NO: 2098626 - RNA, 19 nt, Homo sapiens
gugcgcgccaccgugccug

SEQ ID NO: 2098627 - RNA, 21 nt, Homo sapiens
ccuccuagccccuucuuccaa

SEQ ID NO: 2098628 - RNA, 19 nt, Homo sapiens
accaaacucauucaccaaa

SEQ ID NO: 2098629 - RNA, 16 nt, Homo sapiens
ccuuaaauuaguacag

SEQ ID NO: 2098630 - RNA, 15 nt, Homo sapiens
ccaggccaucaccac

SEQ ID NO: 2098631 - RNA, 22 nt, Homo sapiens
ugcauuguaggaucuuuagcag

SEQ ID NO: 2098632 - RNA, 15 nt, Homo sapiens
cgaggccugacacag

SEQ ID NO: 2098633 - RNA, 22 nt, Homo sapiens
cugaaaugacauuucacuaaaa

SEQ ID NO: 2098634 - RNA, 20 nt, Homo sapiens
aacagagaaucucuagugaa

SEQ ID NO: 2098635 - RNA, 11 nt, Homo sapiens
aauuaugccuu

SEQ ID NO: 2098636 - RNA, 15 nt, Homo sapiens
agacaucaacagaua

SEQ ID NO: 2098637 - RNA, 15 nt, Homo sapiens
ucucaaaaugugaac

SEQ ID NO: 2098638 - RNA, 18 nt, Homo sapiens
uagcaggaagcugugaga

SEQ ID NO: 2098639 - RNA, 14 nt, Homo sapiens
uucccucuacugug

SEQ ID NO: 2098640 - RNA, 20 nt, Homo sapiens
ggcgcuaggggacuugggga

SEQ ID NO: 2098641 - RNA, 21 nt, Homo sapiens
uaugaaguaaagaacugcaca

SEQ ID NO: 2098642 - RNA, 19 nt, Homo sapiens
aggggccucagguuugccu

SEQ ID NO: 2098643 - RNA, 16 nt, Homo sapiens
cucuuuccugcccuuu

SEQ ID NO: 2098644 - RNA, 17 nt, Homo sapiens
uuccaggcgaugugcaa

SEQ ID NO: 2098645 - RNA, 15 nt, Homo sapiens
gagucaccaaaacca

SEQ ID NO: 2098646 - RNA, 18 nt, Homo sapiens
aucugaagaaacuuccca

SEQ ID NO: 2098647 - RNA, 13 nt, Homo sapiens
aagcaaucugauu

SEQ ID NO: 2098648 - RNA, 17 nt, Homo sapiens
uagcccugcuccaacuc

SEQ ID NO: 2098649 - RNA, 17 nt, Homo sapiens
augugaauaauggcacu

SEQ ID NO: 2098650 - RNA, 21 nt, Homo sapiens
uaagcugcccaauuucacaga

SEQ ID NO: 2098651 - RNA, 16 nt, Homo sapiens
ugaagaaugagcaaga

SEQ ID NO: 2098652 - RNA, 15 nt, Homo sapiens
ucaucuccaaaaaca

SEQ ID NO: 2098653 - RNA, 14 nt, Homo sapiens
agggccuggucacc

SEQ ID NO: 2098654 - RNA, 22 nt, Homo sapiens
ggcuaggguaggggcaaggaaa

SEQ ID NO: 2098655 - RNA, 15 nt, Homo sapiens
gcccucacuccacuc

SEQ ID NO: 2098656 - RNA, 21 nt, Homo sapiens
agggaggugaauacucuugaa

SEQ ID NO: 2098657 - RNA, 21 nt, Homo sapiens
uguuaacacucaugaagcaua

SEQ ID NO: 2098658 - RNA, 15 nt, Homo sapiens
ugaggucuuugcauu

SEQ ID NO: 2098659 - RNA, 12 nt, Homo sapiens
acaaccuugucc

SEQ ID NO: 2098660 - RNA, 16 nt, Homo sapiens
aaacagaacaggguca

SEQ ID NO: 2098661 - RNA, 17 nt, Homo sapiens
uauuuucuacagugguu

SEQ ID NO: 2098662 - RNA, 21 nt, Homo sapiens
aggacugugccagcacaaagu

SEQ ID NO: 2098663 - RNA, 19 nt, Homo sapiens
uaugugccuuucacuuuag

SEQ ID NO: 2098664 - RNA, 16 nt, Homo sapiens
cucugcugguuccuga

SEQ ID NO: 2098665 - RNA, 17 nt, Homo sapiens
cucagcuggaagucuac

SEQ ID NO: 2098666 - RNA, 17 nt, Homo sapiens
gacagggaauaguggga

SEQ ID NO: 2098667 - RNA, 14 nt, Homo sapiens
gaugaaacuucuca

SEQ ID NO: 2098668 - RNA, 13 nt, Homo sapiens
cccagagcacugg

SEQ ID NO: 2098669 - RNA, 17 nt, Homo sapiens
ccauauucauguaaaca

SEQ ID NO: 2098670 - RNA, 18 nt, Homo sapiens
gcccuuggcaccaccagg

SEQ ID NO: 2098671 - RNA, 12 nt, Homo sapiens
agcauaauguga

SEQ ID NO: 2098672 - RNA, 16 nt, Homo sapiens
aguuugcuugauauau

SEQ ID NO: 2098673 - RNA, 23 nt, Homo sapiens
auuuugacacuauaucuguauau

SEQ ID NO: 2098674 - RNA, 23 nt, Homo sapiens
cucaguccugggucaacaucuua

SEQ ID NO: 2098675 - RNA, 15 nt, Homo sapiens
uugucaauaguauua

SEQ ID NO: 2098676 - RNA, 17 nt, Homo sapiens
aguucugaggucccugu

SEQ ID NO: 2098677 - RNA, 18 nt, Homo sapiens
cucagcugaaaacccgaa

SEQ ID NO: 2098678 - RNA, 20 nt, Homo sapiens
uuucaagagugagcuaucaa

SEQ ID NO: 2098679 - RNA, 17 nt, Homo sapiens
uaacaaugcaugcuuug

SEQ ID NO: 2098680 - RNA, 19 nt, Homo sapiens
cucaaaagauuguuuuaua

SEQ ID NO: 2098681 - RNA, 20 nt, Homo sapiens
ugcuaaugacagccuugcaa

SEQ ID NO: 2098682 - RNA, 15 nt, Homo sapiens
ggccuccaugcacuu

SEQ ID NO: 2098683 - RNA, 20 nt, Homo sapiens
ugaaugagcaguuagaaaua

SEQ ID NO: 2098684 - RNA, 20 nt, Homo sapiens
auuugaugggccacaacugu

SEQ ID NO: 2098685 - RNA, 20 nt, Homo sapiens
caguuggaggaagcauccaa

SEQ ID NO: 2098686 - RNA, 19 nt, Homo sapiens
agccacuuugcuaccauga

SEQ ID NO: 2098687 - RNA, 23 nt, Homo sapiens
ucuauuaaauaguuauauaauuc

SEQ ID NO: 2098688 - RNA, 18 nt, Homo sapiens
ugguggccacggccacag

SEQ ID NO: 2098689 - RNA, 13 nt, Homo sapiens
uucgauguacuuu

SEQ ID NO: 2098690 - RNA, 17 nt, Homo sapiens
acaacucaagggcacau

SEQ ID NO: 2098691 - RNA, 22 nt, Homo sapiens
ccgugucuucuaaauuugaaau

SEQ ID NO: 2098692 - RNA, 21 nt, Homo sapiens
uuacacugggagaggugccag

SEQ ID NO: 2098693 - RNA, 19 nt, Homo sapiens
aagcuccugcuacuucccc

SEQ ID NO: 2098694 - RNA, 20 nt, Homo sapiens
cccuuaaguucagcaacugu

SEQ ID NO: 2098695 - RNA, 23 nt, Homo sapiens
guucccccaaccaucuucacugg

SEQ ID NO: 2098696 - RNA, 19 nt, Homo sapiens
uaucuagagaauaaucaua

SEQ ID NO: 2098697 - RNA, 23 nt, Homo sapiens
agacaccggaguaugugcagugu

SEQ ID NO: 2098698 - RNA, 14 nt, Homo sapiens
cuguaaaagacuga

SEQ ID NO: 2098699 - RNA, 14 nt, Homo sapiens
gucaggaacagaag

SEQ ID NO: 2098700 - RNA, 17 nt, Homo sapiens
caaguaacugggauuac

SEQ ID NO: 2098701 - RNA, 17 nt, Homo sapiens
cuuuguaauauucuccc

SEQ ID NO: 2098702 - RNA, 19 nt, Homo sapiens
uuccacucaauaugugauu

SEQ ID NO: 2098703 - RNA, 15 nt, Homo sapiens
cuccagcacuaccaa

SEQ ID NO: 2098704 - RNA, 15 nt, Homo sapiens
ugggcugcauuccca

SEQ ID NO: 2098705 - RNA, 19 nt, Homo sapiens
uccccaacuccuuccucuu

SEQ ID NO: 2098706 - RNA, 19 nt, Homo sapiens
cauggcaauuuuuacacaa

SEQ ID NO: 2098707 - RNA, 24 nt, Homo sapiens
auuaauuaaacaagugcacuugaa

SEQ ID NO: 2098708 - RNA, 17 nt, Homo sapiens
aaacccugcugaacaca

SEQ ID NO: 2098709 - RNA, 14 nt, Homo sapiens
aagcaccacucugg

SEQ ID NO: 2098710 - RNA, 21 nt, Homo sapiens
acaguaugauggaacagugaa

SEQ ID NO: 2098711 - RNA, 12 nt, Homo sapiens
ugccuugcugac

SEQ ID NO: 2098712 - RNA, 21 nt, Homo sapiens
uaggagacagucucaagcacu

SEQ ID NO: 2098713 - RNA, 23 nt, Homo sapiens
gacagagccgcaaaucaacccca

SEQ ID NO: 2098714 - RNA, 21 nt, Homo sapiens
auggagugggugucucugcau

SEQ ID NO: 2098715 - RNA, 22 nt, Homo sapiens
agaucagcauccaaaagcagga

SEQ ID NO: 2098716 - RNA, 15 nt, Homo sapiens
gugcacagacugucu

SEQ ID NO: 2098717 - RNA, 17 nt, Homo sapiens
uaugccaauaaaguuug

SEQ ID NO: 2098718 - RNA, 18 nt, Homo sapiens
acauuaaauucacaugca

SEQ ID NO: 2098719 - RNA, 18 nt, Homo sapiens
guuugaugaggcccucca

SEQ ID NO: 2098720 - RNA, 22 nt, Homo sapiens
caguuggauuuauucugccaaa

SEQ ID NO: 2098721 - RNA, 15 nt, Homo sapiens
acguggggcagcaca

SEQ ID NO: 2098722 - RNA, 14 nt, Homo sapiens
acccacucacacuu

SEQ ID NO: 2098723 - RNA, 20 nt, Homo sapiens
gcugacuaaauuuggggaca

SEQ ID NO: 2098724 - RNA, 13 nt, Homo sapiens
accuagagcagag

SEQ ID NO: 2098725 - RNA, 20 nt, Homo sapiens
uggcucuugaggcauuucca

SEQ ID NO: 2098726 - RNA, 20 nt, Homo sapiens
agacaauuuauccaaagcau

SEQ ID NO: 2098727 - RNA, 17 nt, Homo sapiens
aaaccuccagccucccu

SEQ ID NO: 2098728 - RNA, 16 nt, Homo sapiens
cagauagaaugucaau

SEQ ID NO: 2098729 - RNA, 18 nt, Homo sapiens
aaaucuuuacuccuguaa

SEQ ID NO: 2098730 - RNA, 20 nt, Homo sapiens
caugguggcaugugccugua

SEQ ID NO: 2098731 - RNA, 17 nt, Homo sapiens
uugaaaaauauucaugu

SEQ ID NO: 2098732 - RNA, 14 nt, Homo sapiens
ccugggacacacac

SEQ ID NO: 2098733 - RNA, 19 nt, Homo sapiens
uacugacugcuuauaaaca

SEQ ID NO: 2098734 - RNA, 21 nt, Homo sapiens
ucucuugggccaagccagcug

SEQ ID NO: 2098735 - RNA, 16 nt, Homo sapiens
caucacagcagugcau

SEQ ID NO: 2098736 - RNA, 14 nt, Homo sapiens
uuacuugcauuuau

SEQ ID NO: 2098737 - RNA, 20 nt, Homo sapiens
cuagaucucagccauucuaa

SEQ ID NO: 2098738 - RNA, 20 nt, Homo sapiens
cuuuacucugcucuaugcca

SEQ ID NO: 2098739 - RNA, 23 nt, Homo sapiens
uucccuucuuucaggaauacuug

SEQ ID NO: 2098740 - RNA, 19 nt, Homo sapiens
uaucauacccuuuauucuc

SEQ ID NO: 2098741 - RNA, 21 nt, Homo sapiens
ggugaccaccgauuccagcug

SEQ ID NO: 2098742 - RNA, 23 nt, Homo sapiens
agcuggauuuccuaggcugacua

SEQ ID NO: 2098743 - RNA, 14 nt, Homo sapiens
cugaaugucccaga

SEQ ID NO: 2098744 - RNA, 21 nt, Homo sapiens
cacauuggccgggcuggucuu

SEQ ID NO: 2098745 - RNA, 14 nt, Homo sapiens
aacaccccacugag

SEQ ID NO: 2098746 - RNA, 15 nt, Homo sapiens
aaccuuccucuugag

SEQ ID NO: 2098747 - RNA, 16 nt, Homo sapiens
aagauauuauguauaa

SEQ ID NO: 2098748 - RNA, 14 nt, Homo sapiens
gagaugagacugau

SEQ ID NO: 2098749 - RNA, 20 nt, Homo sapiens
agccguugugcgaagacaga

SEQ ID NO: 2098750 - RNA, 21 nt, Homo sapiens
gguuggcaccugcacacucca

SEQ ID NO: 2098751 - RNA, 18 nt, Homo sapiens
gagguuuguuugugugaa

SEQ ID NO: 2098752 - RNA, 20 nt, Homo sapiens
caauugguaauuaaggcauc

SEQ ID NO: 2098753 - RNA, 16 nt, Homo sapiens
aagauuuuuaauuaca

SEQ ID NO: 2098754 - RNA, 19 nt, Homo sapiens
cagucuucucucacuuuga

SEQ ID NO: 2098755 - RNA, 14 nt, Homo sapiens
aaccucacaaagua

SEQ ID NO: 2098756 - RNA, 17 nt, Homo sapiens
aagaacauucuaccaaa

SEQ ID NO: 2098757 - RNA, 22 nt, Homo sapiens
cacaaugagaaaaauaaaugga

SEQ ID NO: 2098758 - RNA, 19 nt, Homo sapiens
ugcuugagcaucaggauac

SEQ ID NO: 2098759 - RNA, 21 nt, Homo sapiens
guucaguggcagggcucagga

SEQ ID NO: 2098760 - RNA, 19 nt, Homo sapiens
accuuccagcuccuguaac

SEQ ID NO: 2098761 - RNA, 14 nt, Homo sapiens
aaaacuccaucuca

SEQ ID NO: 2098762 - RNA, 14 nt, Homo sapiens
gaaacuccgucuca

SEQ ID NO: 2098763 - RNA, 22 nt, Homo sapiens
ugagagcaauauuuaaauucuc

SEQ ID NO: 2098764 - RNA, 22 nt, Homo sapiens
ucuguuuauaugacauuguuaa

SEQ ID NO: 2098765 - RNA, 22 nt, Homo sapiens
ugaaauuuaauuacaaacaaua

SEQ ID NO: 2098766 - RNA, 18 nt, Homo sapiens
acaucuccagugugccag

SEQ ID NO: 2098767 - RNA, 24 nt, Homo sapiens
cuucugaaacuggaguaucauucu

SEQ ID NO: 2098768 - RNA, 11 nt, Homo sapiens
gccaggagcuc

SEQ ID NO: 2098769 - RNA, 23 nt, Homo sapiens
uucauaagucuuugguacaaguu

SEQ ID NO: 2098770 - RNA, 17 nt, Homo sapiens
cuucacugucuuacuca

SEQ ID NO: 2098771 - RNA, 16 nt, Homo sapiens
cacagguuuucagcaa

SEQ ID NO: 2098772 - RNA, 21 nt, Homo sapiens
ugcuuaaacccuuuagugcuu

SEQ ID NO: 2098773 - RNA, 22 nt, Homo sapiens
aaugaacacucuuuugcuuuau

SEQ ID NO: 2098774 - RNA, 18 nt, Homo sapiens
cacugcugagacccacag

SEQ ID NO: 2098775 - RNA, 14 nt, Homo sapiens
gucuuauccuccac

SEQ ID NO: 2098776 - RNA, 21 nt, Homo sapiens
aucuguuugaucccuguuacc

SEQ ID NO: 2098777 - RNA, 23 nt, Homo sapiens
cuauagaaacaccaguaccugaa

SEQ ID NO: 2098778 - RNA, 19 nt, Homo sapiens
ggagcuccuggaagcacag

SEQ ID NO: 2098779 - RNA, 18 nt, Homo sapiens
ucagcuaacauuccaugu

SEQ ID NO: 2098780 - RNA, 18 nt, Homo sapiens
caaguuggguucacuugc

SEQ ID NO: 2098781 - RNA, 21 nt, Homo sapiens
uuuauaauacuacuacuguua

SEQ ID NO: 2098782 - RNA, 21 nt, Homo sapiens
accucuuuuuucuaucugcca

SEQ ID NO: 2098783 - RNA, 16 nt, Homo sapiens
cuauauuaucauaaga

SEQ ID NO: 2098784 - RNA, 17 nt, Homo sapiens
ucaguuuuaccagauga

SEQ ID NO: 2098785 - RNA, 17 nt, Homo sapiens
uuuuaacucugucuuca

SEQ ID NO: 2098786 - RNA, 18 nt, Homo sapiens
cacuguaaauauccacag

SEQ ID NO: 2098787 - RNA, 13 nt, Homo sapiens
uaguaaucuguaa

SEQ ID NO: 2098788 - RNA, 15 nt, Homo sapiens
acgcaugugcagcua

SEQ ID NO: 2098789 - RNA, 23 nt, Homo sapiens
ucccaagguucugggugcaggag

SEQ ID NO: 2098790 - RNA, 15 nt, Homo sapiens
aaaguaaacgauaaa

SEQ ID NO: 2098791 - RNA, 15 nt, Homo sapiens
cauccagagaugacu

SEQ ID NO: 2098792 - RNA, 18 nt, Homo sapiens
uaaaaucucgguguucua

SEQ ID NO: 2098793 - RNA, 19 nt, Homo sapiens
aggcauggcuggugccuga

SEQ ID NO: 2098794 - RNA, 19 nt, Homo sapiens
caugcagaacaaaugaaga

SEQ ID NO: 2098795 - RNA, 22 nt, Homo sapiens
gacucuggucauagaaacaaua

SEQ ID NO: 2098796 - RNA, 12 nt, Homo sapiens
agccucuuccau

SEQ ID NO: 2098797 - RNA, 22 nt, Homo sapiens
cacacaagcuuuuuuacacaaa

SEQ ID NO: 2098798 - RNA, 22 nt, Homo sapiens
ugaaauaaaagcacacugcuua

SEQ ID NO: 2098799 - RNA, 12 nt, Homo sapiens
ccaaaacacagg

SEQ ID NO: 2098800 - RNA, 17 nt, Homo sapiens
ggguggagcaugggccu

SEQ ID NO: 2098801 - RNA, 15 nt, Homo sapiens
aagcaugaaaaagca

SEQ ID NO: 2098802 - RNA, 18 nt, Homo sapiens
uucauccaggacugagau

SEQ ID NO: 2098803 - RNA, 17 nt, Homo sapiens
ccccuggcugugcucua

SEQ ID NO: 2098804 - RNA, 15 nt, Homo sapiens
acucugguggccacu

SEQ ID NO: 2098805 - RNA, 16 nt, Homo sapiens
ggugguuuuugcucuc

SEQ ID NO: 2098806 - RNA, 17 nt, Homo sapiens
ggggucccaucagugaa

SEQ ID NO: 2098807 - RNA, 16 nt, Homo sapiens
caaagaaucuaggaaa

SEQ ID NO: 2098808 - RNA, 15 nt, Homo sapiens
aagauacaaguuuca

SEQ ID NO: 2098809 - RNA, 16 nt, Homo sapiens
ccacaucacuacagua

SEQ ID NO: 2098810 - RNA, 22 nt, Homo sapiens
aagcuaucucugaguugcccug

SEQ ID NO: 2098811 - RNA, 16 nt, Homo sapiens
uaagcuaucagcaaua

SEQ ID NO: 2098812 - RNA, 13 nt, Homo sapiens
ggguaaauucucu

SEQ ID NO: 2098813 - RNA, 13 nt, Homo sapiens
aaaaguuacuuau

SEQ ID NO: 2098814 - RNA, 17 nt, Homo sapiens
cuucagaggguuuggac

SEQ ID NO: 2098815 - RNA, 22 nt, Homo sapiens
ugggcagacugaaccaguccag

SEQ ID NO: 2098816 - RNA, 15 nt, Homo sapiens
agacaugagugcgug

SEQ ID NO: 2098817 - RNA, 20 nt, Homo sapiens
aaccagcucuuuggugccag

SEQ ID NO: 2098818 - RNA, 20 nt, Homo sapiens
ucagggagccuggaagccaa

SEQ ID NO: 2098819 - RNA, 12 nt, Homo sapiens
aaucugcaguga

SEQ ID NO: 2098820 - RNA, 19 nt, Homo sapiens
guucuccucaaacauuuau

SEQ ID NO: 2098821 - RNA, 13 nt, Homo sapiens
aacaucacugggg

SEQ ID NO: 2098822 - RNA, 14 nt, Homo sapiens
cuccagauucugau

SEQ ID NO: 2098823 - RNA, 16 nt, Homo sapiens
gccugaccuuccuucc

SEQ ID NO: 2098824 - RNA, 19 nt, Homo sapiens
ccuuuuaagcaugugaugu

SEQ ID NO: 2098825 - RNA, 14 nt, Homo sapiens
guuugaguuacuau

SEQ ID NO: 2098826 - RNA, 15 nt, Homo sapiens
uaauaguucagugua

SEQ ID NO: 2098827 - RNA, 20 nt, Homo sapiens
aguggagcccagggugcugg

SEQ ID NO: 2098828 - RNA, 18 nt, Homo sapiens
aagagggccugugggagc

SEQ ID NO: 2098829 - RNA, 14 nt, Homo sapiens
guuuaagacauuuu

SEQ ID NO: 2098830 - RNA, 22 nt, Homo sapiens
auuucugggccgggcauggugg

SEQ ID NO: 2098831 - RNA, 14 nt, Homo sapiens
ugcuaaccuggaaa

SEQ ID NO: 2098832 - RNA, 16 nt, Homo sapiens
aaaauguagacugaaa

SEQ ID NO: 2098833 - RNA, 16 nt, Homo sapiens
uuucuccguugaguca

SEQ ID NO: 2098834 - RNA, 18 nt, Homo sapiens
aggcauguaauugcuugu

SEQ ID NO: 2098835 - RNA, 14 nt, Homo sapiens
ucacauuaacucag

SEQ ID NO: 2098836 - RNA, 21 nt, Homo sapiens
uggaagacaaauacacauaca

SEQ ID NO: 2098837 - RNA, 13 nt, Homo sapiens
acuucacuuauua

SEQ ID NO: 2098838 - RNA, 16 nt, Homo sapiens
ccaugaugcagagcuu

SEQ ID NO: 2098839 - RNA, 17 nt, Homo sapiens
uucuuucccaacaccuc

SEQ ID NO: 2098840 - RNA, 17 nt, Homo sapiens
ucugaaaggauguggaa

SEQ ID NO: 2098841 - RNA, 13 nt, Homo sapiens
gacuauuuagaca

SEQ ID NO: 2098842 - RNA, 22 nt, Homo sapiens
guagccaccgguaauaagccaa

SEQ ID NO: 2098843 - RNA, 19 nt, Homo sapiens
acacaguuauacaugucua

SEQ ID NO: 2098844 - RNA, 19 nt, Homo sapiens
uaaucugauguauaaugua

SEQ ID NO: 2098845 - RNA, 20 nt, Homo sapiens
ugagagcccgcgugcuggag

SEQ ID NO: 2098846 - RNA, 21 nt, Homo sapiens
accucaguucccucuugcuca

SEQ ID NO: 2098847 - RNA, 15 nt, Homo sapiens
caggagggugcagua

SEQ ID NO: 2098848 - RNA, 19 nt, Homo sapiens
aguucuuacccaguuaaca

SEQ ID NO: 2098849 - RNA, 19 nt, Homo sapiens
uugcuucuuuuucuuaccc

SEQ ID NO: 2098850 - RNA, 21 nt, Homo sapiens
caugaggaccaggguggagcu

SEQ ID NO: 2098851 - RNA, 19 nt, Homo sapiens
acacacgcaaauacaugcc

SEQ ID NO: 2098852 - RNA, 20 nt, Homo sapiens
acuucucccaaaguguccua

SEQ ID NO: 2098853 - RNA, 16 nt, Homo sapiens
ucauuggcuccuggau

SEQ ID NO: 2098854 - RNA, 17 nt, Homo sapiens
auggacucuguggugcc

SEQ ID NO: 2098855 - RNA, 13 nt, Homo sapiens
aauucaacccagc

SEQ ID NO: 2098856 - RNA, 17 nt, Homo sapiens
gagccggacacuucuca

SEQ ID NO: 2098857 - RNA, 13 nt, Homo sapiens
gagaccagggugg

SEQ ID NO: 2098858 - RNA, 21 nt, Homo sapiens
uaaacaaaacccacauuuccu

SEQ ID NO: 2098859 - RNA, 17 nt, Homo sapiens
caaaggugguaaauuca

SEQ ID NO: 2098860 - RNA, 20 nt, Homo sapiens
cuuucaucucucuaccucca

SEQ ID NO: 2098861 - RNA, 16 nt, Homo sapiens
guccugcccacuaaaa

SEQ ID NO: 2098862 - RNA, 15 nt, Homo sapiens
cuuuagaaacugagu

SEQ ID NO: 2098863 - RNA, 19 nt, Homo sapiens
aaacucaacaagugcuccu

SEQ ID NO: 2098864 - RNA, 16 nt, Homo sapiens
cugagaucgugccauu

SEQ ID NO: 2098865 - RNA, 15 nt, Homo sapiens
cugcacuccaugagu

SEQ ID NO: 2098866 - RNA, 15 nt, Homo sapiens
cugcuggggaccuug

SEQ ID NO: 2098867 - RNA, 20 nt, Homo sapiens
agccccuggggcggugcugg

SEQ ID NO: 2098868 - RNA, 21 nt, Homo sapiens
caggugauucgcccaccucag

SEQ ID NO: 2098869 - RNA, 13 nt, Homo sapiens
ucagggucccauu

SEQ ID NO: 2098870 - RNA, 20 nt, Homo sapiens
acuugcuuagguugucuuga

SEQ ID NO: 2098871 - RNA, 19 nt, Homo sapiens
gccuguaaucccagcacuu

SEQ ID NO: 2098872 - RNA, 18 nt, Homo sapiens
cugagugaaaaaagucac

SEQ ID NO: 2098873 - RNA, 16 nt, Homo sapiens
cagaauucuucauccu

SEQ ID NO: 2098874 - RNA, 23 nt, Homo sapiens
ggcuugacggcuucucucuuuuu

SEQ ID NO: 2098875 - RNA, 17 nt, Homo sapiens
cuugcuggcagggccug

SEQ ID NO: 2098876 - RNA, 15 nt, Homo sapiens
cucuuacaaaacucu

SEQ ID NO: 2098877 - RNA, 22 nt, Homo sapiens
agacuggaauauaauuucaaac

SEQ ID NO: 2098878 - RNA, 21 nt, Homo sapiens
aacuucuccauccuuucugcc

SEQ ID NO: 2098879 - RNA, 17 nt, Homo sapiens
uuuagauuuuaaucaaa

SEQ ID NO: 2098880 - RNA, 23 nt, Homo sapiens
guaaaaagcccagcacuugaauu

SEQ ID NO: 2098881 - RNA, 18 nt, Homo sapiens
ggcaugcccccaguuacu

SEQ ID NO: 2098882 - RNA, 11 nt, Homo sapiens
uaugagcugcu

SEQ ID NO: 2098883 - RNA, 13 nt, Homo sapiens
uaacgaugcacuu

SEQ ID NO: 2098884 - RNA, 20 nt, Homo sapiens
uaucaucucaccacaccaca

SEQ ID NO: 2098885 - RNA, 13 nt, Homo sapiens
ugucaucacucaa

SEQ ID NO: 2098886 - RNA, 22 nt, Homo sapiens
uggcuguaaacuauaaacuacu

SEQ ID NO: 2098887 - RNA, 19 nt, Homo sapiens
aagcugaggccuaugcaga

SEQ ID NO: 2098888 - RNA, 17 nt, Homo sapiens
cugauuuuuagcuuuac

SEQ ID NO: 2098889 - RNA, 22 nt, Homo sapiens
uaguagaaaggucauccaaaga

SEQ ID NO: 2098890 - RNA, 21 nt, Homo sapiens
ggcagagcuuuugcauuuccu

SEQ ID NO: 2098891 - RNA, 11 nt, Homo sapiens
ccuaucaccuc

SEQ ID NO: 2098892 - RNA, 11 nt, Homo sapiens
caucuuuacaa

SEQ ID NO: 2098893 - RNA, 22 nt, Homo sapiens
ugccagauuaccgacacuguca

SEQ ID NO: 2098894 - RNA, 16 nt, Homo sapiens
cuccugcccuguagaa

SEQ ID NO: 2098895 - RNA, 19 nt, Homo sapiens
gcagagcuuucaaggauag

SEQ ID NO: 2098896 - RNA, 19 nt, Homo sapiens
gaggcucugucacugagca

SEQ ID NO: 2098897 - RNA, 22 nt, Homo sapiens
cccagagucacaaguagccucu

SEQ ID NO: 2098898 - RNA, 19 nt, Homo sapiens
auugcucucccagcccuug

SEQ ID NO: 2098899 - RNA, 18 nt, Homo sapiens
uugcuaagugaaagaagc

SEQ ID NO: 2098900 - RNA, 16 nt, Homo sapiens
agcuucccuguauuac

SEQ ID NO: 2098901 - RNA, 19 nt, Homo sapiens
uggccccucacauccucuc

SEQ ID NO: 2098902 - RNA, 13 nt, Homo sapiens
aauaauuucugua

SEQ ID NO: 2098903 - RNA, 12 nt, Homo sapiens
auuccacacagg

SEQ ID NO: 2098904 - RNA, 16 nt, Homo sapiens
ugacaucuuuggucau

SEQ ID NO: 2098905 - RNA, 16 nt, Homo sapiens
ccugucacugagcaca

SEQ ID NO: 2098906 - RNA, 15 nt, Homo sapiens
uagcuauauccaugu

SEQ ID NO: 2098907 - RNA, 14 nt, Homo sapiens
uccacuaugagcug

SEQ ID NO: 2098908 - RNA, 18 nt, Homo sapiens
uggggagcaggaggccaa

SEQ ID NO: 2098909 - RNA, 15 nt, Homo sapiens
acgucgggcauucau

SEQ ID NO: 2098910 - RNA, 19 nt, Homo sapiens
uaauuaaagaaugcaauac

SEQ ID NO: 2098911 - RNA, 15 nt, Homo sapiens
auuuuggaaacucaa

SEQ ID NO: 2098912 - RNA, 20 nt, Homo sapiens
uaucacgggucacuugaaau

SEQ ID NO: 2098913 - RNA, 14 nt, Homo sapiens
ccuaaaaaugaaua

SEQ ID NO: 2098914 - RNA, 19 nt, Homo sapiens
ccaggacugugccagcaca

SEQ ID NO: 2098915 - RNA, 17 nt, Homo sapiens
uauuuauggauaucaca

SEQ ID NO: 2098916 - RNA, 16 nt, Homo sapiens
aucaauuacagauuaa

SEQ ID NO: 2098917 - RNA, 20 nt, Homo sapiens
ugucaccucagcugauauua

SEQ ID NO: 2098918 - RNA, 16 nt, Homo sapiens
gucaaauuuacuuuaa

SEQ ID NO: 2098919 - RNA, 17 nt, Homo sapiens
caugaauguaucaggaa

SEQ ID NO: 2098920 - RNA, 12 nt, Homo sapiens
cuccacuauggc

SEQ ID NO: 2098921 - RNA, 18 nt, Homo sapiens
gggccagaugacacccua

SEQ ID NO: 2098922 - RNA, 14 nt, Homo sapiens
caggugaacagccu

SEQ ID NO: 2098923 - RNA, 18 nt, Homo sapiens
auugaggaaaaauauucc

SEQ ID NO: 2098924 - RNA, 18 nt, Homo sapiens
augcaagaguggacugaa

SEQ ID NO: 2098925 - RNA, 13 nt, Homo sapiens
gggaaggagccca

SEQ ID NO: 2098926 - RNA, 14 nt, Homo sapiens
gcuguaagcaccug

SEQ ID NO: 2098927 - RNA, 23 nt, Homo sapiens
gggaaaucacauaacugguacaa

SEQ ID NO: 2098928 - RNA, 17 nt, Homo sapiens
auaauugaagagacaau

SEQ ID NO: 2098929 - RNA, 17 nt, Homo sapiens
acccguggcugauggug

SEQ ID NO: 2098930 - RNA, 18 nt, Homo sapiens
acuuuugcuuucuaccug

SEQ ID NO: 2098931 - RNA, 23 nt, Homo sapiens
acagauuggccagaaaccuuccu

SEQ ID NO: 2098932 - RNA, 20 nt, Homo sapiens
aaauccauuccagguagcuc

SEQ ID NO: 2098933 - RNA, 20 nt, Homo sapiens
auucuggucucucuauuacc

SEQ ID NO: 2098934 - RNA, 22 nt, Homo sapiens
ccucucucacauggaacgcuuu

SEQ ID NO: 2098935 - RNA, 13 nt, Homo sapiens
uucaacccagugg

SEQ ID NO: 2098936 - RNA, 11 nt, Homo sapiens
uacaaacuauu

SEQ ID NO: 2098937 - RNA, 19 nt, Homo sapiens
caaccgaguggcugucauc

SEQ ID NO: 2098938 - RNA, 17 nt, Homo sapiens
ucagggauccaauauga

SEQ ID NO: 2098939 - RNA, 21 nt, Homo sapiens
ggauggcgaggccucucucag

SEQ ID NO: 2098940 - RNA, 16 nt, Homo sapiens
aaagcaauucuuucaa

SEQ ID NO: 2098941 - RNA, 12 nt, Homo sapiens
ugccacuuugca

SEQ ID NO: 2098942 - RNA, 12 nt, Homo sapiens
uccaacuuuccc

SEQ ID NO: 2098943 - RNA, 20 nt, Homo sapiens
cagaaacacggaguuuccau

SEQ ID NO: 2098944 - RNA, 19 nt, Homo sapiens
uaugcacacacauggauga

SEQ ID NO: 2098945 - RNA, 19 nt, Homo sapiens
acccauauuucauccagga

SEQ ID NO: 2098946 - RNA, 20 nt, Homo sapiens
cagcuguaaucccagcacuu

SEQ ID NO: 2098947 - RNA, 15 nt, Homo sapiens
ucuucucuccacuuc

SEQ ID NO: 2098948 - RNA, 11 nt, Homo sapiens
uuuugcugcua

SEQ ID NO: 2098949 - RNA, 15 nt, Homo sapiens
cugacuaacuauaag

SEQ ID NO: 2098950 - RNA, 22 nt, Homo sapiens
acaaauuagucuguagaaucua

SEQ ID NO: 2098951 - RNA, 14 nt, Homo sapiens
gccccugucauccu

SEQ ID NO: 2098952 - RNA, 14 nt, Homo sapiens
aaccacuucagcug

SEQ ID NO: 2098953 - RNA, 16 nt, Homo sapiens
acgcaugugcagcuau

SEQ ID NO: 2098954 - RNA, 16 nt, Homo sapiens
uagguacgucaaagca

SEQ ID NO: 2098955 - RNA, 21 nt, Homo sapiens
uucuuaaacaaauguaugauu

SEQ ID NO: 2098956 - RNA, 18 nt, Homo sapiens
ccuuauuuaacaagcaag

SEQ ID NO: 2098957 - RNA, 16 nt, Homo sapiens
guuuauugaaugugau

SEQ ID NO: 2098958 - RNA, 19 nt, Homo sapiens
ucaacauggcuacuugcuu

SEQ ID NO: 2098959 - RNA, 21 nt, Homo sapiens
aucuguaucuuugacaauucu

SEQ ID NO: 2098960 - RNA, 14 nt, Homo sapiens
guguaaucucucau

SEQ ID NO: 2098961 - RNA, 21 nt, Homo sapiens
aaauaccaaaugcauuguugu

SEQ ID NO: 2098962 - RNA, 16 nt, Homo sapiens
cagugugcugaucauu

SEQ ID NO: 2098963 - RNA, 13 nt, Homo sapiens
ccagccacuguca

SEQ ID NO: 2098964 - RNA, 15 nt, Homo sapiens
gaggugacuugccug

SEQ ID NO: 2098965 - RNA, 13 nt, Homo sapiens
acuccuaaaucaa

SEQ ID NO: 2098966 - RNA, 17 nt, Homo sapiens
gcauggucccugccuua

SEQ ID NO: 2098967 - RNA, 16 nt, Homo sapiens
uuuauguuuuaauauc

SEQ ID NO: 2098968 - RNA, 16 nt, Homo sapiens
uuuaaaggaguaggac

SEQ ID NO: 2098969 - RNA, 18 nt, Homo sapiens
cuauucucaaaguuuccu

SEQ ID NO: 2098970 - RNA, 23 nt, Homo sapiens
agccuaaaguacagccuggacca

SEQ ID NO: 2098971 - RNA, 19 nt, Homo sapiens
ucaggaccaggcaauguga

SEQ ID NO: 2098972 - RNA, 14 nt, Homo sapiens
gaaagguaaucuga

SEQ ID NO: 2098973 - RNA, 16 nt, Homo sapiens
caggauuucuaaucaa

SEQ ID NO: 2098974 - RNA, 14 nt, Homo sapiens
ucaggaaaacugac

SEQ ID NO: 2098975 - RNA, 20 nt, Homo sapiens
uacauaacaggcauugcacu

SEQ ID NO: 2098976 - RNA, 14 nt, Homo sapiens
auuuuuauccauuu

SEQ ID NO: 2098977 - RNA, 23 nt, Homo sapiens
acacccgccgccuccugcaccga

SEQ ID NO: 2098978 - RNA, 19 nt, Homo sapiens
cuuuucuugggaugcuuau

SEQ ID NO: 2098979 - RNA, 17 nt, Homo sapiens
acacagccccauguaca

SEQ ID NO: 2098980 - RNA, 16 nt, Homo sapiens
gcaaggggaaaaucuc

SEQ ID NO: 2098981 - RNA, 13 nt, Homo sapiens
aacugaacuguga

SEQ ID NO: 2098982 - RNA, 17 nt, Homo sapiens
uauugcugcaaacacuu

SEQ ID NO: 2098983 - RNA, 18 nt, Homo sapiens
gugcucugggcucacugc

SEQ ID NO: 2098984 - RNA, 16 nt, Homo sapiens
gcagaguauuaaugaa

SEQ ID NO: 2098985 - RNA, 19 nt, Homo sapiens
ccacacuugcagagcugcu

SEQ ID NO: 2098986 - RNA, 15 nt, Homo sapiens
ucacauuuguaaaug

SEQ ID NO: 2098987 - RNA, 12 nt, Homo sapiens
ucaugugcauua

SEQ ID NO: 2098988 - RNA, 13 nt, Homo sapiens
uccuuuugcucug

SEQ ID NO: 2098989 - RNA, 12 nt, Homo sapiens
ggucgccaguga

SEQ ID NO: 2098990 - RNA, 13 nt, Homo sapiens
ucucugagcucug

SEQ ID NO: 2098991 - RNA, 16 nt, Homo sapiens
acuggacaagauuucc

SEQ ID NO: 2098992 - RNA, 18 nt, Homo sapiens
gguuucuaucugcaauua

SEQ ID NO: 2098993 - RNA, 21 nt, Homo sapiens
uuccagcagcugcaccccagc

SEQ ID NO: 2098994 - RNA, 14 nt, Homo sapiens
ucccagcuacucag

SEQ ID NO: 2098995 - RNA, 20 nt, Homo sapiens
auguuaauuauuuugacaaa

SEQ ID NO: 2098996 - RNA, 21 nt, Homo sapiens
acagucugcaucaucaucaca

SEQ ID NO: 2098997 - RNA, 22 nt, Homo sapiens
ccagaaucuugacuuucugauu

SEQ ID NO: 2098998 - RNA, 22 nt, Homo sapiens
ucaucaguauugaagcauuuua

SEQ ID NO: 2098999 - RNA, 17 nt, Homo sapiens
gauucuaaugucuucau

SEQ ID NO: 2099000 - RNA, 18 nt, Homo sapiens
auuggaaauuuguuauaa

SEQ ID NO: 2099001 - RNA, 16 nt, Homo sapiens
acaguuaucauuauca

SEQ ID NO: 2099002 - RNA, 18 nt, Homo sapiens
cuuuacaaacugaagaua

SEQ ID NO: 2099003 - RNA, 20 nt, Homo sapiens
agacaaggucaccugggcug

SEQ ID NO: 2099004 - RNA, 17 nt, Homo sapiens
ucagaguuuguguguau

SEQ ID NO: 2099005 - RNA, 19 nt, Homo sapiens
agccugggauuucuaugca

SEQ ID NO: 2099006 - RNA, 15 nt, Homo sapiens
uugaauaaagagaug

SEQ ID NO: 2099007 - RNA, 17 nt, Homo sapiens
accuggggacucgggug

SEQ ID NO: 2099008 - RNA, 12 nt, Homo sapiens
acugaucauuaa

SEQ ID NO: 2099009 - RNA, 14 nt, Homo sapiens
ucauggcaguaauu

SEQ ID NO: 2099010 - RNA, 14 nt, Homo sapiens
uuauuucuacuaua

SEQ ID NO: 2099011 - RNA, 13 nt, Homo sapiens
gucucauguggaa

SEQ ID NO: 2099012 - RNA, 15 nt, Homo sapiens
uuuauuauuaaucuc

SEQ ID NO: 2099013 - RNA, 19 nt, Homo sapiens
gcgucuucaucucccugcc

SEQ ID NO: 2099014 - RNA, 16 nt, Homo sapiens
aaacugcucauuucau

SEQ ID NO: 2099015 - RNA, 18 nt, Homo sapiens
ugacauuuauauauugaa

SEQ ID NO: 2099016 - RNA, 14 nt, Homo sapiens
ucaucaggugcaua

SEQ ID NO: 2099017 - RNA, 21 nt, Homo sapiens
caugucaccucagcugauauu

SEQ ID NO: 2099018 - RNA, 21 nt, Homo sapiens
aaacucaucuggaguucucaa

SEQ ID NO: 2099019 - RNA, 22 nt, Homo sapiens
uggcacauggguggacacggau

SEQ ID NO: 2099020 - RNA, 17 nt, Homo sapiens
augugauauguaccuaa

SEQ ID NO: 2099021 - RNA, 22 nt, Homo sapiens
ucuuaauaacuuaccagaaugu

SEQ ID NO: 2099022 - RNA, 17 nt, Homo sapiens
aggaggcuggcagguau

SEQ ID NO: 2099023 - RNA, 12 nt, Homo sapiens
gaaccaggggag

SEQ ID NO: 2099024 - RNA, 22 nt, Homo sapiens
ucaaacaaagaugccacauuca

SEQ ID NO: 2099025 - RNA, 15 nt, Homo sapiens
uuuuuccuaacagga

SEQ ID NO: 2099026 - RNA, 15 nt, Homo sapiens
uccuaccacuuugaa

SEQ ID NO: 2099027 - RNA, 21 nt, Homo sapiens
cccucaccuuggcaccagaca

SEQ ID NO: 2099028 - RNA, 21 nt, Homo sapiens
ccagagucuggagcugagcua

SEQ ID NO: 2099029 - RNA, 22 nt, Homo sapiens
ugguaugcacaauuccaugaca

SEQ ID NO: 2099030 - RNA, 22 nt, Homo sapiens
aauuucaagucuuccugauaca

SEQ ID NO: 2099031 - RNA, 17 nt, Homo sapiens
agaaggggccaucacag

SEQ ID NO: 2099032 - RNA, 18 nt, Homo sapiens
uugcacugaggauauuca

SEQ ID NO: 2099033 - RNA, 14 nt, Homo sapiens
agaaucugcagcua

SEQ ID NO: 2099034 - RNA, 14 nt, Homo sapiens
caaacaagcacaua

SEQ ID NO: 2099035 - RNA, 23 nt, Homo sapiens
ugccugccccaaacaaauaugca

SEQ ID NO: 2099036 - RNA, 21 nt, Homo sapiens
cacagcccugcagugcccuag

SEQ ID NO: 2099037 - RNA, 21 nt, Homo sapiens
cuagccaccucccaccccacu

SEQ ID NO: 2099038 - RNA, 19 nt, Homo sapiens
gagaguugcuuccaguccu

SEQ ID NO: 2099039 - RNA, 19 nt, Homo sapiens
gaggaugguuugagcucag

SEQ ID NO: 2099040 - RNA, 14 nt, Homo sapiens
uccaaaaagcacau

SEQ ID NO: 2099041 - RNA, 19 nt, Homo sapiens
ugauguuccaccugccaca

SEQ ID NO: 2099042 - RNA, 15 nt, Homo sapiens
aaagacacaugcacg

SEQ ID NO: 2099043 - RNA, 16 nt, Homo sapiens
ugacugagauggagug

SEQ ID NO: 2099044 - RNA, 18 nt, Homo sapiens
aggaaaggcaggagccag

SEQ ID NO: 2099045 - RNA, 18 nt, Homo sapiens
uggccugugauguuuuau

SEQ ID NO: 2099046 - RNA, 19 nt, Homo sapiens
caaaauuguguccacauaa

SEQ ID NO: 2099047 - RNA, 17 nt, Homo sapiens
ugugaaacaguugcugu

SEQ ID NO: 2099048 - RNA, 15 nt, Homo sapiens
guccuacuccuugca

SEQ ID NO: 2099049 - RNA, 21 nt, Homo sapiens
caaaugauuuucaaauuugau

SEQ ID NO: 2099050 - RNA, 22 nt, Homo sapiens
gugacauaauuuacaugcaaua

SEQ ID NO: 2099051 - RNA, 21 nt, Homo sapiens
cccagauggccgggacaugca

SEQ ID NO: 2099052 - RNA, 19 nt, Homo sapiens
gcggccaugauggugcuga

SEQ ID NO: 2099053 - RNA, 15 nt, Homo sapiens
cugaguccuuuccag

SEQ ID NO: 2099054 - RNA, 14 nt, Homo sapiens
agucagaacaaauu

SEQ ID NO: 2099055 - RNA, 13 nt, Homo sapiens
gagugugugcaag

SEQ ID NO: 2099056 - RNA, 19 nt, Homo sapiens
ugaccugcccuacauaucu

SEQ ID NO: 2099057 - RNA, 18 nt, Homo sapiens
cugggugucaagugccug

SEQ ID NO: 2099058 - RNA, 21 nt, Homo sapiens
aucauuguauuaacgcaaaua

SEQ ID NO: 2099059 - RNA, 16 nt, Homo sapiens
gauucuccugccucag

SEQ ID NO: 2099060 - RNA, 18 nt, Homo sapiens
aucuuggcucacugcaac

SEQ ID NO: 2099061 - RNA, 22 nt, Homo sapiens
cacuucauccugaaguuugcau

SEQ ID NO: 2099062 - RNA, 15 nt, Homo sapiens
uccuggggacuuccu

SEQ ID NO: 2099063 - RNA, 13 nt, Homo sapiens
ugaucgacguggu

SEQ ID NO: 2099064 - RNA, 22 nt, Homo sapiens
gagcuucucacagcaaaccucu

SEQ ID NO: 2099065 - RNA, 23 nt, Homo sapiens
uaaugccucugucuagcaugcca

SEQ ID NO: 2099066 - RNA, 13 nt, Homo sapiens
acguauacaauaa

SEQ ID NO: 2099067 - RNA, 20 nt, Homo sapiens
uaaccuaccccaacucugcc

SEQ ID NO: 2099068 - RNA, 21 nt, Homo sapiens
ggguacaagagaugggaugcu

SEQ ID NO: 2099069 - RNA, 13 nt, Homo sapiens
gaaccguuuugaa

SEQ ID NO: 2099070 - RNA, 18 nt, Homo sapiens
uuaccacugugguuuuga

SEQ ID NO: 2099071 - RNA, 19 nt, Homo sapiens
uuauuuguauuuucaagac

SEQ ID NO: 2099072 - RNA, 17 nt, Homo sapiens
aguguucccgugccugg

SEQ ID NO: 2099073 - RNA, 18 nt, Homo sapiens
auuuauuguguguucuca

SEQ ID NO: 2099074 - RNA, 20 nt, Homo sapiens
ugcaguggcgcgaucucagc

SEQ ID NO: 2099075 - RNA, 14 nt, Homo sapiens
cuaaaacuggcaaa

SEQ ID NO: 2099076 - RNA, 17 nt, Homo sapiens
ccugucagcaugaauuu

SEQ ID NO: 2099077 - RNA, 22 nt, Homo sapiens
uuuaaucauuauuugagacugu

SEQ ID NO: 2099078 - RNA, 16 nt, Homo sapiens
uugcaagcuccaucuc

SEQ ID NO: 2099079 - RNA, 19 nt, Homo sapiens
ccaaggaggaaaaacagac

SEQ ID NO: 2099080 - RNA, 19 nt, Homo sapiens
ugcagugucugugauucug

SEQ ID NO: 2099081 - RNA, 14 nt, Homo sapiens
ugagaguugucucu

SEQ ID NO: 2099082 - RNA, 15 nt, Homo sapiens
accagcagcuggaau

SEQ ID NO: 2099083 - RNA, 15 nt, Homo sapiens
acuaggacucugagg

SEQ ID NO: 2099084 - RNA, 14 nt, Homo sapiens
cuccuccccuuuca

SEQ ID NO: 2099085 - RNA, 15 nt, Homo sapiens
agcggagcuugccug

SEQ ID NO: 2099086 - RNA, 18 nt, Homo sapiens
aacucuuugccuaacuaa

SEQ ID NO: 2099087 - RNA, 16 nt, Homo sapiens
uaaagucauucuagac

SEQ ID NO: 2099088 - RNA, 19 nt, Homo sapiens
agcugagggacguggugcc

SEQ ID NO: 2099089 - RNA, 22 nt, Homo sapiens
guaauuucuuugccuguucagu

SEQ ID NO: 2099090 - RNA, 15 nt, Homo sapiens
ugcuuauaacaagca

SEQ ID NO: 2099091 - RNA, 19 nt, Homo sapiens
cuuuccacuccaaccagaa

SEQ ID NO: 2099092 - RNA, 19 nt, Homo sapiens
agcccuaaguggcugccuu

SEQ ID NO: 2099093 - RNA, 16 nt, Homo sapiens
ugcaaucaggcucaaa

SEQ ID NO: 2099094 - RNA, 13 nt, Homo sapiens
aagaaaaguuuau

SEQ ID NO: 2099095 - RNA, 13 nt, Homo sapiens
aauaaaaguugau

SEQ ID NO: 2099096 - RNA, 23 nt, Homo sapiens
uccagcaucgucucauguaaaau

SEQ ID NO: 2099097 - RNA, 15 nt, Homo sapiens
uagagaaaugaauua

SEQ ID NO: 2099098 - RNA, 20 nt, Homo sapiens
aagaagucggaaugucauag

SEQ ID NO: 2099099 - RNA, 22 nt, Homo sapiens
uauuaugcggaaagguauuugg

SEQ ID NO: 2099100 - RNA, 15 nt, Homo sapiens
auggggggugggggg

SEQ ID NO: 2099101 - RNA, 14 nt, Homo sapiens
cucuguauacugag

SEQ ID NO: 2099102 - RNA, 20 nt, Homo sapiens
ccuuuugucuacggaagccu

SEQ ID NO: 2099103 - RNA, 20 nt, Homo sapiens
cugagaaugaacaaagacca

SEQ ID NO: 2099104 - RNA, 19 nt, Homo sapiens
ccuaacagggcacauauuc

SEQ ID NO: 2099105 - RNA, 21 nt, Homo sapiens
cauucacacugggccaagagc

SEQ ID NO: 2099106 - RNA, 20 nt, Homo sapiens
gacuccauuucuuucuucca

SEQ ID NO: 2099107 - RNA, 16 nt, Homo sapiens
gaccccaggucagggg

SEQ ID NO: 2099108 - RNA, 13 nt, Homo sapiens
gcucuucaaagac

SEQ ID NO: 2099109 - RNA, 13 nt, Homo sapiens
acauuguacuuaa

SEQ ID NO: 2099110 - RNA, 13 nt, Homo sapiens
gagccaccccagg

SEQ ID NO: 2099111 - RNA, 14 nt, Homo sapiens
cugauguaaaacgg

SEQ ID NO: 2099112 - RNA, 14 nt, Homo sapiens
acaccccugcacac

SEQ ID NO: 2099113 - RNA, 14 nt, Homo sapiens
ucaaaaugacaguu

SEQ ID NO: 2099114 - RNA, 23 nt, Homo sapiens
aaaaguccuugcaagaauggaga

SEQ ID NO: 2099115 - RNA, 20 nt, Homo sapiens
cagugggacccacagucaca

SEQ ID NO: 2099116 - RNA, 17 nt, Homo sapiens
aaacuuguuacuaaaga

SEQ ID NO: 2099117 - RNA, 13 nt, Homo sapiens
uucuaccaaaugu

SEQ ID NO: 2099118 - RNA, 15 nt, Homo sapiens
cugcagaucaagaaa

SEQ ID NO: 2099119 - RNA, 16 nt, Homo sapiens
aaugcaccaaucagca

SEQ ID NO: 2099120 - RNA, 18 nt, Homo sapiens
acuuuugaagcaauauca

SEQ ID NO: 2099121 - RNA, 21 nt, Homo sapiens
uuucuaccuuucugagucucu

SEQ ID NO: 2099122 - RNA, 21 nt, Homo sapiens
gguuuuuaauuuuguguugcu

SEQ ID NO: 2099123 - RNA, 18 nt, Homo sapiens
uuccuauuacuugcucca

SEQ ID NO: 2099124 - RNA, 18 nt, Homo sapiens
ugcugauaucaacagcuu

SEQ ID NO: 2099125 - RNA, 19 nt, Homo sapiens
cagccuucuugauguauuu

SEQ ID NO: 2099126 - RNA, 15 nt, Homo sapiens
cuggguaugcucugu

SEQ ID NO: 2099127 - RNA, 14 nt, Homo sapiens
caggccaggugccc

SEQ ID NO: 2099128 - RNA, 21 nt, Homo sapiens
gaaaccugcaggcguucucuc

SEQ ID NO: 2099129 - RNA, 22 nt, Homo sapiens
cuuauuacugcuugcaguaauu

SEQ ID NO: 2099130 - RNA, 16 nt, Homo sapiens
aaaucaugaaaagagg

SEQ ID NO: 2099131 - RNA, 21 nt, Homo sapiens
caagcaucagggggaagaagc

SEQ ID NO: 2099132 - RNA, 21 nt, Homo sapiens
cuaaccucugagucaccaucu

SEQ ID NO: 2099133 - RNA, 21 nt, Homo sapiens
gggauugaauuaaaacagcug

SEQ ID NO: 2099134 - RNA, 16 nt, Homo sapiens
ccuccugcagccugac

SEQ ID NO: 2099135 - RNA, 14 nt, Homo sapiens
cugguuacucuggu

SEQ ID NO: 2099136 - RNA, 18 nt, Homo sapiens
uuuugacaucagcauuag

SEQ ID NO: 2099137 - RNA, 15 nt, Homo sapiens
gggagaguucuugcu

SEQ ID NO: 2099138 - RNA, 18 nt, Homo sapiens
gaaugacagcaaacagau

SEQ ID NO: 2099139 - RNA, 19 nt, Homo sapiens
acuacaagugauccucagg

SEQ ID NO: 2099140 - RNA, 23 nt, Homo sapiens
gacagauggacgcaggcccuguc

SEQ ID NO: 2099141 - RNA, 17 nt, Homo sapiens
aaaucaaauuccagaau

SEQ ID NO: 2099142 - RNA, 19 nt, Homo sapiens
acgacaaagcaucauugua

SEQ ID NO: 2099143 - RNA, 19 nt, Homo sapiens
uguaauuguuguuuguaug

SEQ ID NO: 2099144 - RNA, 19 nt, Homo sapiens
ugaaccugaugagcaagaa

SEQ ID NO: 2099145 - RNA, 11 nt, Homo sapiens
gacaaacugug

SEQ ID NO: 2099146 - RNA, 19 nt, Homo sapiens
cagaauauaggauaagaaa

SEQ ID NO: 2099147 - RNA, 18 nt, Homo sapiens
ucauuucguauuucucau

SEQ ID NO: 2099148 - RNA, 16 nt, Homo sapiens
uugaagucuguacaga

SEQ ID NO: 2099149 - RNA, 14 nt, Homo sapiens
acuaauggaaauau

SEQ ID NO: 2099150 - RNA, 16 nt, Homo sapiens
cugaauaaaguaaugc

SEQ ID NO: 2099151 - RNA, 16 nt, Homo sapiens
uaugcuguaucugugc

SEQ ID NO: 2099152 - RNA, 15 nt, Homo sapiens
uaacuuuaccaugcu

SEQ ID NO: 2099153 - RNA, 15 nt, Homo sapiens
uaugacaacucuuau

SEQ ID NO: 2099154 - RNA, 22 nt, Homo sapiens
ucagaacccuuggcuugcccac

SEQ ID NO: 2099155 - RNA, 23 nt, Homo sapiens
ccauuuccaaaccuccacugcug

SEQ ID NO: 2099156 - RNA, 18 nt, Homo sapiens
uggucugggcaccaccuc

SEQ ID NO: 2099157 - RNA, 20 nt, Homo sapiens
caauuccauuuccaguucau

SEQ ID NO: 2099158 - RNA, 22 nt, Homo sapiens
gauuccugguugauacaguuca

SEQ ID NO: 2099159 - RNA, 17 nt, Homo sapiens
gaaaccuuauuguaccu

SEQ ID NO: 2099160 - RNA, 21 nt, Homo sapiens
gaacugcuuuaucccacggaa

SEQ ID NO: 2099161 - RNA, 23 nt, Homo sapiens
cguguucugucugugucuucagg

SEQ ID NO: 2099162 - RNA, 17 nt, Homo sapiens
auaugugcagucuugcu

SEQ ID NO: 2099163 - RNA, 22 nt, Homo sapiens
cuuccugccaggagcucuccac

SEQ ID NO: 2099164 - RNA, 15 nt, Homo sapiens
gcccuuccuugggga

SEQ ID NO: 2099165 - RNA, 16 nt, Homo sapiens
ucauguucacugcaau

SEQ ID NO: 2099166 - RNA, 13 nt, Homo sapiens
acacuuucacugg

SEQ ID NO: 2099167 - RNA, 18 nt, Homo sapiens
agguucuuagugucacuu

SEQ ID NO: 2099168 - RNA, 23 nt, Homo sapiens
gccccagcucgcgggacccgacc

SEQ ID NO: 2099169 - RNA, 23 nt, Homo sapiens
ccacgcuagggcggggcacagau

SEQ ID NO: 2099170 - RNA, 22 nt, Homo sapiens
caguggugugaaacacacaaug

SEQ ID NO: 2099171 - RNA, 13 nt, Homo sapiens
cugccccaugcug

SEQ ID NO: 2099172 - RNA, 15 nt, Homo sapiens
gccuccccaccacug

SEQ ID NO: 2099173 - RNA, 12 nt, Homo sapiens
ccacuucugcca

SEQ ID NO: 2099174 - RNA, 22 nt, Homo sapiens
agaacuggaggcaguccaucua

SEQ ID NO: 2099175 - RNA, 15 nt, Homo sapiens
auuuuagaaaacacc

SEQ ID NO: 2099176 - RNA, 20 nt, Homo sapiens
ccucauuuaaaacaagacuu

SEQ ID NO: 2099177 - RNA, 16 nt, Homo sapiens
ucacuuaaaaguauca

SEQ ID NO: 2099178 - RNA, 15 nt, Homo sapiens
gaauuaucuauuuca

SEQ ID NO: 2099179 - RNA, 15 nt, Homo sapiens
ugccauuacuacugu

SEQ ID NO: 2099180 - RNA, 21 nt, Homo sapiens
guuuacuucucaccauuugag

SEQ ID NO: 2099181 - RNA, 19 nt, Homo sapiens
caugcugaaaacuacacaa

SEQ ID NO: 2099182 - RNA, 13 nt, Homo sapiens
uuuuguaaacagc

SEQ ID NO: 2099183 - RNA, 22 nt, Homo sapiens
guuucauucauccugaccaaga

SEQ ID NO: 2099184 - RNA, 22 nt, Homo sapiens
gaagccaagucagcuuugccuu

SEQ ID NO: 2099185 - RNA, 19 nt, Homo sapiens
cugguauuuuaucuuugau

SEQ ID NO: 2099186 - RNA, 18 nt, Homo sapiens
ccaaacccacucaugacu

SEQ ID NO: 2099187 - RNA, 13 nt, Homo sapiens
guaaaaacauuua

SEQ ID NO: 2099188 - RNA, 22 nt, Homo sapiens
aauuuucagcugcaaggauuca

SEQ ID NO: 2099189 - RNA, 13 nt, Homo sapiens
ccucggacugugu

SEQ ID NO: 2099190 - RNA, 18 nt, Homo sapiens
gaggauugcuaucuggag

SEQ ID NO: 2099191 - RNA, 21 nt, Homo sapiens
cauguucugugugcccugaaa

SEQ ID NO: 2099192 - RNA, 15 nt, Homo sapiens
uggcgcacccggcag

SEQ ID NO: 2099193 - RNA, 14 nt, Homo sapiens
aggucauuaaacca

SEQ ID NO: 2099194 - RNA, 18 nt, Homo sapiens
guaaauccaccaccaaaa

SEQ ID NO: 2099195 - RNA, 19 nt, Homo sapiens
accugccaggcaggggugg

SEQ ID NO: 2099196 - RNA, 17 nt, Homo sapiens
ugauacgugugugaagu

SEQ ID NO: 2099197 - RNA, 17 nt, Homo sapiens
agaaugggggcagcacc

SEQ ID NO: 2099198 - RNA, 22 nt, Homo sapiens
uccagccaaccucauugcagcu

SEQ ID NO: 2099199 - RNA, 23 nt, Homo sapiens
cuuauggauucauauaggccaga

SEQ ID NO: 2099200 - RNA, 20 nt, Homo sapiens
cacaauaugggcacuuuaaa

SEQ ID NO: 2099201 - RNA, 21 nt, Homo sapiens
ucacccuguccagaccuuuga

SEQ ID NO: 2099202 - RNA, 16 nt, Homo sapiens
caaauuacauuacuga

SEQ ID NO: 2099203 - RNA, 18 nt, Homo sapiens
gcacaaaguaagccucac

SEQ ID NO: 2099204 - RNA, 12 nt, Homo sapiens
cuucccagcaca

SEQ ID NO: 2099205 - RNA, 16 nt, Homo sapiens
aaguugacaaaugcca

SEQ ID NO: 2099206 - RNA, 20 nt, Homo sapiens
gcucaguaacacagugcagu

SEQ ID NO: 2099207 - RNA, 15 nt, Homo sapiens
cccaccuuccauagc

SEQ ID NO: 2099208 - RNA, 18 nt, Homo sapiens
ucuuuguguuuuguccaa

SEQ ID NO: 2099209 - RNA, 18 nt, Homo sapiens
gcugcaucuccccucaga

SEQ ID NO: 2099210 - RNA, 21 nt, Homo sapiens
uguauaaccccaccuugccaa

SEQ ID NO: 2099211 - RNA, 17 nt, Homo sapiens
uccccacugcugagcug

SEQ ID NO: 2099212 - RNA, 17 nt, Homo sapiens
ucccacccacaugugac

SEQ ID NO: 2099213 - RNA, 14 nt, Homo sapiens
ugccauuacaccag

SEQ ID NO: 2099214 - RNA, 14 nt, Homo sapiens
ugauuuuacaauug

SEQ ID NO: 2099215 - RNA, 21 nt, Homo sapiens
cuauuauaaaaccauguugau

SEQ ID NO: 2099216 - RNA, 14 nt, Homo sapiens
augacucucuccaa

SEQ ID NO: 2099217 - RNA, 18 nt, Homo sapiens
auagcuuccagauuacaa

SEQ ID NO: 2099218 - RNA, 23 nt, Homo sapiens
uuccaggggcacacaaugcuauu

SEQ ID NO: 2099219 - RNA, 18 nt, Homo sapiens
auuugcacuuauauagca

SEQ ID NO: 2099220 - RNA, 16 nt, Homo sapiens
agcccuguugugccac

SEQ ID NO: 2099221 - RNA, 21 nt, Homo sapiens
cauucaauauugacauuugua

SEQ ID NO: 2099222 - RNA, 18 nt, Homo sapiens
gccucccugaagccuuug

SEQ ID NO: 2099223 - RNA, 22 nt, Homo sapiens
gugaagacgaggccaaggcuga

SEQ ID NO: 2099224 - RNA, 21 nt, Homo sapiens
gccaggccucuuggcagucac

SEQ ID NO: 2099225 - RNA, 17 nt, Homo sapiens
ggauuuauaaagcaaau

SEQ ID NO: 2099226 - RNA, 17 nt, Homo sapiens
agagucuuaaagcauuu

SEQ ID NO: 2099227 - RNA, 19 nt, Homo sapiens
uuaaaaaagauaaacacaa

SEQ ID NO: 2099228 - RNA, 19 nt, Homo sapiens
cuuuguaccuguaggucua

SEQ ID NO: 2099229 - RNA, 20 nt, Homo sapiens
ucaccuaaacuuguacuuua

SEQ ID NO: 2099230 - RNA, 19 nt, Homo sapiens
aguuuaugcagugcugcuu

SEQ ID NO: 2099231 - RNA, 23 nt, Homo sapiens
ccacagaggcuguggucagagag

SEQ ID NO: 2099232 - RNA, 22 nt, Homo sapiens
guaauguuccugaaaauugcaa

SEQ ID NO: 2099233 - RNA, 22 nt, Homo sapiens
aaaccaucaaguugugccaaau

SEQ ID NO: 2099234 - RNA, 17 nt, Homo sapiens
ggaaaggugguguuucu

SEQ ID NO: 2099235 - RNA, 14 nt, Homo sapiens
ccaucaugcaaaau

SEQ ID NO: 2099236 - RNA, 16 nt, Homo sapiens
aaauagaggcuuugag

SEQ ID NO: 2099237 - RNA, 19 nt, Homo sapiens
ucaaacucccgaccucagg

SEQ ID NO: 2099238 - RNA, 18 nt, Homo sapiens
ucuccuauaaucugucaa

SEQ ID NO: 2099239 - RNA, 17 nt, Homo sapiens
gcuguccccacugcccc

SEQ ID NO: 2099240 - RNA, 17 nt, Homo sapiens
aagccucuauugccaug

SEQ ID NO: 2099241 - RNA, 18 nt, Homo sapiens
gaaguguuuguaauccca

SEQ ID NO: 2099242 - RNA, 13 nt, Homo sapiens
cuauguaugcauc

SEQ ID NO: 2099243 - RNA, 22 nt, Homo sapiens
gugccacuuuaauccuuccacu

SEQ ID NO: 2099244 - RNA, 21 nt, Homo sapiens
cuucaggaaccucgaguacug

SEQ ID NO: 2099245 - RNA, 20 nt, Homo sapiens
gcccaucugaacacaaccag

SEQ ID NO: 2099246 - RNA, 18 nt, Homo sapiens
ccaaauaaauguguaaau

SEQ ID NO: 2099247 - RNA, 23 nt, Homo sapiens
uggcauuugggugaacuguggac

SEQ ID NO: 2099248 - RNA, 22 nt, Homo sapiens
gccuaccgcuggcccugccguu

SEQ ID NO: 2099249 - RNA, 17 nt, Homo sapiens
gagcauaguccaaaaag

SEQ ID NO: 2099250 - RNA, 17 nt, Homo sapiens
uuugcccccuugcccau

SEQ ID NO: 2099251 - RNA, 14 nt, Homo sapiens
cuugcauugacauu

SEQ ID NO: 2099252 - RNA, 14 nt, Homo sapiens
aaccacuaaugcuu

SEQ ID NO: 2099253 - RNA, 16 nt, Homo sapiens
aauguaauauuuacaa

SEQ ID NO: 2099254 - RNA, 18 nt, Homo sapiens
agccagggcagaggaaug

SEQ ID NO: 2099255 - RNA, 12 nt, Homo sapiens
caagccagugug

SEQ ID NO: 2099256 - RNA, 22 nt, Homo sapiens
caacuaaaguagaauuaucucu

SEQ ID NO: 2099257 - RNA, 15 nt, Homo sapiens
cuauacucuaaaaug

SEQ ID NO: 2099258 - RNA, 20 nt, Homo sapiens
uucuuccccuuacucucaca

SEQ ID NO: 2099259 - RNA, 18 nt, Homo sapiens
caaaggugcacuccagac

SEQ ID NO: 2099260 - RNA, 15 nt, Homo sapiens
ggaggcugaggcaag

SEQ ID NO: 2099261 - RNA, 15 nt, Homo sapiens
aagcuucucucugag

SEQ ID NO: 2099262 - RNA, 17 nt, Homo sapiens
gagcucacccaugugca

SEQ ID NO: 2099263 - RNA, 23 nt, Homo sapiens
gaccaucgcaaccaggauugaca

SEQ ID NO: 2099264 - RNA, 14 nt, Homo sapiens
acagucucaagcac

SEQ ID NO: 2099265 - RNA, 19 nt, Homo sapiens
cugaccucaggugauccgc

SEQ ID NO: 2099266 - RNA, 19 nt, Homo sapiens
cugaccucaagugauccac

SEQ ID NO: 2099267 - RNA, 16 nt, Homo sapiens
cucacaaaaaggcaaa

SEQ ID NO: 2099268 - RNA, 14 nt, Homo sapiens
gacugaagcaaaga

SEQ ID NO: 2099269 - RNA, 21 nt, Homo sapiens
ugcuaugcuaaaccuccugcc

SEQ ID NO: 2099270 - RNA, 13 nt, Homo sapiens
uuugcagcaauua

SEQ ID NO: 2099271 - RNA, 19 nt, Homo sapiens
agagcgagacuccaucuca

SEQ ID NO: 2099272 - RNA, 19 nt, Homo sapiens
agagcaagacuccgucuca

SEQ ID NO: 2099273 - RNA, 22 nt, Homo sapiens
cacugggaugagccgcugugag

SEQ ID NO: 2099274 - RNA, 22 nt, Homo sapiens
ucagaaacucugccaacacuga

SEQ ID NO: 2099275 - RNA, 23 nt, Homo sapiens
cuacaaacucccacuugucaugu

SEQ ID NO: 2099276 - RNA, 19 nt, Homo sapiens
ugaaacagccagaucucau

SEQ ID NO: 2099277 - RNA, 16 nt, Homo sapiens
uuuuugguguauuuga

SEQ ID NO: 2099278 - RNA, 22 nt, Homo sapiens
aucauuuuacucuuaugaucaa

SEQ ID NO: 2099279 - RNA, 23 nt, Homo sapiens
cacgguggcucacgccuguaauc

SEQ ID NO: 2099280 - RNA, 17 nt, Homo sapiens
uugauauaaucuuucaa

SEQ ID NO: 2099281 - RNA, 12 nt, Homo sapiens
acugaccuaccu

SEQ ID NO: 2099282 - RNA, 15 nt, Homo sapiens
uguagagaaaagcac

SEQ ID NO: 2099283 - RNA, 12 nt, Homo sapiens
uuuccuugcuca

SEQ ID NO: 2099284 - RNA, 12 nt, Homo sapiens
uacacuugcauc

SEQ ID NO: 2099285 - RNA, 19 nt, Homo sapiens
uuaugaagaaggugaauag

SEQ ID NO: 2099286 - RNA, 19 nt, Homo sapiens
agagaaugcacagauauac

SEQ ID NO: 2099287 - RNA, 17 nt, Homo sapiens
auaaaaguccugucacc

SEQ ID NO: 2099288 - RNA, 15 nt, Homo sapiens
ucuugauaucuuucc

SEQ ID NO: 2099289 - RNA, 20 nt, Homo sapiens
uguguucucaacacacagua

SEQ ID NO: 2099290 - RNA, 14 nt, Homo sapiens
caaagcgacagauu

SEQ ID NO: 2099291 - RNA, 19 nt, Homo sapiens
agaugacagggaaaacugc

SEQ ID NO: 2099292 - RNA, 16 nt, Homo sapiens
uucuugaacugcugag

SEQ ID NO: 2099293 - RNA, 20 nt, Homo sapiens
caaugauccuguauucagac

SEQ ID NO: 2099294 - RNA, 15 nt, Homo sapiens
gccaaucccuucucc

SEQ ID NO: 2099295 - RNA, 18 nt, Homo sapiens
cugagaaacuuccuuuga

SEQ ID NO: 2099296 - RNA, 16 nt, Homo sapiens
caaauuauaugcuaau

SEQ ID NO: 2099297 - RNA, 20 nt, Homo sapiens
uuaaaacaaaggaacuaacu

SEQ ID NO: 2099298 - RNA, 14 nt, Homo sapiens
guucaaagagguga

SEQ ID NO: 2099299 - RNA, 22 nt, Homo sapiens
gacagaccacagagcugucacu

SEQ ID NO: 2099300 - RNA, 15 nt, Homo sapiens
cugacuaagccuuug

SEQ ID NO: 2099301 - RNA, 16 nt, Homo sapiens
uaggcauacuuuucaa

SEQ ID NO: 2099302 - RNA, 21 nt, Homo sapiens
gagggauucuggucuucacug

SEQ ID NO: 2099303 - RNA, 18 nt, Homo sapiens
uguuguagguuucaggga

SEQ ID NO: 2099304 - RNA, 16 nt, Homo sapiens
aaauagcaucuaguac

SEQ ID NO: 2099305 - RNA, 17 nt, Homo sapiens
acaguuggaacaguaau

SEQ ID NO: 2099306 - RNA, 21 nt, Homo sapiens
cccuccccugggcccaucuca

SEQ ID NO: 2099307 - RNA, 24 nt, Homo sapiens
gaagauuuuaugcugcuguuuaca

SEQ ID NO: 2099308 - RNA, 17 nt, Homo sapiens
uuccugucaauacaggu

SEQ ID NO: 2099309 - RNA, 17 nt, Homo sapiens
augauggccaggcugau

SEQ ID NO: 2099310 - RNA, 23 nt, Homo sapiens
aaaauucucauuuuucauuucuu

SEQ ID NO: 2099311 - RNA, 14 nt, Homo sapiens
uguugaaucuugca

SEQ ID NO: 2099312 - RNA, 19 nt, Homo sapiens
uaugaaggcuguacacugc

SEQ ID NO: 2099313 - RNA, 13 nt, Homo sapiens
gauucugccucaa

SEQ ID NO: 2099314 - RNA, 20 nt, Homo sapiens
caaugaagugacacuuugac

SEQ ID NO: 2099315 - RNA, 19 nt, Homo sapiens
gacagcuugaucaaaggca

SEQ ID NO: 2099316 - RNA, 14 nt, Homo sapiens
uaauauauuuccau

SEQ ID NO: 2099317 - RNA, 14 nt, Homo sapiens
caauagaucuccag

SEQ ID NO: 2099318 - RNA, 19 nt, Homo sapiens
acguaagcuccuugucugu

SEQ ID NO: 2099319 - RNA, 14 nt, Homo sapiens
acaggucaacuuca

SEQ ID NO: 2099320 - RNA, 14 nt, Homo sapiens
gguuggcagcauuc

SEQ ID NO: 2099321 - RNA, 16 nt, Homo sapiens
uauuuguauacacaua

SEQ ID NO: 2099322 - RNA, 15 nt, Homo sapiens
augcacugauguugu

SEQ ID NO: 2099323 - RNA, 16 nt, Homo sapiens
cugguagaaaggcagu

SEQ ID NO: 2099324 - RNA, 19 nt, Homo sapiens
uuccccccaucuccauugc

SEQ ID NO: 2099325 - RNA, 18 nt, Homo sapiens
ugagaaaagccucuccag

SEQ ID NO: 2099326 - RNA, 14 nt, Homo sapiens
gaugcuguuugaca

SEQ ID NO: 2099327 - RNA, 16 nt, Homo sapiens
guuucacgaguguucc

SEQ ID NO: 2099328 - RNA, 15 nt, Homo sapiens
cucuucccaugacug

SEQ ID NO: 2099329 - RNA, 16 nt, Homo sapiens
cauuuagaacuuuaag

SEQ ID NO: 2099330 - RNA, 22 nt, Homo sapiens
gcugcccuggcccugaggugug

SEQ ID NO: 2099331 - RNA, 16 nt, Homo sapiens
ccguugcacaaaaagg

SEQ ID NO: 2099332 - RNA, 18 nt, Homo sapiens
aggaggaaauuagcauuc

SEQ ID NO: 2099333 - RNA, 20 nt, Homo sapiens
ggauaauagcguucagcagc

SEQ ID NO: 2099334 - RNA, 17 nt, Homo sapiens
aauuuuauaacagaauu

SEQ ID NO: 2099335 - RNA, 22 nt, Homo sapiens
uaagcuauuuugguuuagugca

SEQ ID NO: 2099336 - RNA, 13 nt, Homo sapiens
ucuucauucagug

SEQ ID NO: 2099337 - RNA, 16 nt, Homo sapiens
gcauugcacagaguga

SEQ ID NO: 2099338 - RNA, 16 nt, Homo sapiens
gagaugucaucagagc

SEQ ID NO: 2099339 - RNA, 20 nt, Homo sapiens
aaauauuuauugucuguaaa

SEQ ID NO: 2099340 - RNA, 20 nt, Homo sapiens
ccacuguacauuuuuauaca

SEQ ID NO: 2099341 - RNA, 14 nt, Homo sapiens
uucaaguuucccca

SEQ ID NO: 2099342 - RNA, 14 nt, Homo sapiens
aucaugcaugcacu

SEQ ID NO: 2099343 - RNA, 21 nt, Homo sapiens
gcucugguggccacugagcug

SEQ ID NO: 2099344 - RNA, 15 nt, Homo sapiens
ggcuggucucaccca

SEQ ID NO: 2099345 - RNA, 16 nt, Homo sapiens
guucacucagcacuuu

SEQ ID NO: 2099346 - RNA, 19 nt, Homo sapiens
ggcggugugugugccaugu

SEQ ID NO: 2099347 - RNA, 19 nt, Homo sapiens
cuguggcugguuggugcuu

SEQ ID NO: 2099348 - RNA, 16 nt, Homo sapiens
caggcagcagacugac

SEQ ID NO: 2099349 - RNA, 13 nt, Homo sapiens
aguucuaggcacu

SEQ ID NO: 2099350 - RNA, 17 nt, Homo sapiens
acaccaugauuaaccac

SEQ ID NO: 2099351 - RNA, 18 nt, Homo sapiens
ggaggcuggggccccauc

SEQ ID NO: 2099352 - RNA, 22 nt, Homo sapiens
cuuuauguggguuaucauggaa

SEQ ID NO: 2099353 - RNA, 14 nt, Homo sapiens
caggacagaaccac

SEQ ID NO: 2099354 - RNA, 20 nt, Homo sapiens
agggaaauguacacuuuuua

SEQ ID NO: 2099355 - RNA, 18 nt, Homo sapiens
ccucagugcuccuggaaa

SEQ ID NO: 2099356 - RNA, 12 nt, Homo sapiens
gaaaacauguua

SEQ ID NO: 2099357 - RNA, 23 nt, Homo sapiens
ggauguggccccacccuuuccuc

SEQ ID NO: 2099358 - RNA, 15 nt, Homo sapiens
caaauacacauuugc

SEQ ID NO: 2099359 - RNA, 22 nt, Homo sapiens
uuugucaaggcugacuacucac

SEQ ID NO: 2099360 - RNA, 14 nt, Homo sapiens
ugcuuccugucuua

SEQ ID NO: 2099361 - RNA, 19 nt, Homo sapiens
gccacucaggcccaaagcc

SEQ ID NO: 2099362 - RNA, 24 nt, Homo sapiens
cuccuugcaaacuaugaguucaca

SEQ ID NO: 2099363 - RNA, 18 nt, Homo sapiens
aaaaaagagaacaccucc

SEQ ID NO: 2099364 - RNA, 14 nt, Homo sapiens
uaugcaaucacuga

SEQ ID NO: 2099365 - RNA, 22 nt, Homo sapiens
ucugguuuuaggaaacuuguag

SEQ ID NO: 2099366 - RNA, 14 nt, Homo sapiens
aacucaccauuuca

SEQ ID NO: 2099367 - RNA, 22 nt, Homo sapiens
uggagacuuuuaucuacuucuc

SEQ ID NO: 2099368 - RNA, 20 nt, Homo sapiens
aguggugcaaucacagcuca

SEQ ID NO: 2099369 - RNA, 20 nt, Homo sapiens
aguggcacaaucauggcuca

SEQ ID NO: 2099370 - RNA, 21 nt, Homo sapiens
uggcaacugaaaacaguccca

SEQ ID NO: 2099371 - RNA, 22 nt, Homo sapiens
aaagucacaggucacacgaggg

SEQ ID NO: 2099372 - RNA, 16 nt, Homo sapiens
gcuccaguguccugag

SEQ ID NO: 2099373 - RNA, 20 nt, Homo sapiens
uuucuguggagagugagaau

SEQ ID NO: 2099374 - RNA, 14 nt, Homo sapiens
uaucauuucacugu

SEQ ID NO: 2099375 - RNA, 14 nt, Homo sapiens
acagcaauuccugg

SEQ ID NO: 2099376 - RNA, 16 nt, Homo sapiens
ggucagggaaauauga

SEQ ID NO: 2099377 - RNA, 15 nt, Homo sapiens
guacaggucaucugc

SEQ ID NO: 2099378 - RNA, 19 nt, Homo sapiens
uguuuccuagcacacacuu

SEQ ID NO: 2099379 - RNA, 12 nt, Homo sapiens
caaaccagccug

SEQ ID NO: 2099380 - RNA, 12 nt, Homo sapiens
uuggucucagcu

SEQ ID NO: 2099381 - RNA, 12 nt, Homo sapiens
aucuucucuggg

SEQ ID NO: 2099382 - RNA, 18 nt, Homo sapiens
gcucaagaacacaugugc

SEQ ID NO: 2099383 - RNA, 18 nt, Homo sapiens
aaauccagugagcacuag

SEQ ID NO: 2099384 - RNA, 15 nt, Homo sapiens
aggaagucagacuuu

SEQ ID NO: 2099385 - RNA, 19 nt, Homo sapiens
uagcaaggcauaauguaau

SEQ ID NO: 2099386 - RNA, 22 nt, Homo sapiens
uucacuuuucugaguucuugaa

SEQ ID NO: 2099387 - RNA, 22 nt, Homo sapiens
cacucaugucccauuuuagcca

SEQ ID NO: 2099388 - RNA, 17 nt, Homo sapiens
ucagggccagggcucca

SEQ ID NO: 2099389 - RNA, 14 nt, Homo sapiens
aagaaauaccuuga

SEQ ID NO: 2099390 - RNA, 14 nt, Homo sapiens
acuagauacaguaa

SEQ ID NO: 2099391 - RNA, 13 nt, Homo sapiens
aguugcugucaca

SEQ ID NO: 2099392 - RNA, 13 nt, Homo sapiens
aggacugauacug

SEQ ID NO: 2099393 - RNA, 14 nt, Homo sapiens
uccacuucucuaga

SEQ ID NO: 2099394 - RNA, 20 nt, Homo sapiens
aguguggguuuauauaagga

SEQ ID NO: 2099395 - RNA, 20 nt, Homo sapiens
acugaaaucagugguguuac

SEQ ID NO: 2099396 - RNA, 14 nt, Homo sapiens
ugcuccauuccuga

SEQ ID NO: 2099397 - RNA, 22 nt, Homo sapiens
uuugucauguuaugcagugaac

SEQ ID NO: 2099398 - RNA, 22 nt, Homo sapiens
aaaguaauuaaaaagacacuuu

SEQ ID NO: 2099399 - RNA, 19 nt, Homo sapiens
aggcuacuaccuagggcac

SEQ ID NO: 2099400 - RNA, 13 nt, Homo sapiens
gacaaggcuccag

SEQ ID NO: 2099401 - RNA, 13 nt, Homo sapiens
augugcauauucc

SEQ ID NO: 2099402 - RNA, 14 nt, Homo sapiens
aggaccugccugua

SEQ ID NO: 2099403 - RNA, 23 nt, Homo sapiens
ccuccuugaagcugcccuugaag

SEQ ID NO: 2099404 - RNA, 12 nt, Homo sapiens
aagguugcacag

SEQ ID NO: 2099405 - RNA, 11 nt, Homo sapiens
acaguuuucag

SEQ ID NO: 2099406 - RNA, 16 nt, Homo sapiens
gagccgagauugcacc

SEQ ID NO: 2099407 - RNA, 17 nt, Homo sapiens
guaucacaaaaccaccu

SEQ ID NO: 2099408 - RNA, 17 nt, Homo sapiens
gucccagcuacucagaa

SEQ ID NO: 2099409 - RNA, 22 nt, Homo sapiens
ucaaacaaaaagucauaaaagu

SEQ ID NO: 2099410 - RNA, 16 nt, Homo sapiens
agacuuggggccagcg

SEQ ID NO: 2099411 - RNA, 18 nt, Homo sapiens
ggagucccuauaguuuca

SEQ ID NO: 2099412 - RNA, 20 nt, Homo sapiens
gcacaguauuuacugugcua

SEQ ID NO: 2099413 - RNA, 20 nt, Homo sapiens
uaaucuagagcuaugcacac

SEQ ID NO: 2099414 - RNA, 15 nt, Homo sapiens
cuuagcgggacaaag

SEQ ID NO: 2099415 - RNA, 15 nt, Homo sapiens
auuguaaaaugcacc

SEQ ID NO: 2099416 - RNA, 16 nt, Homo sapiens
aaauaauuuuaucucu

SEQ ID NO: 2099417 - RNA, 21 nt, Homo sapiens
aaaaggacuguauaguuuaaa

SEQ ID NO: 2099418 - RNA, 16 nt, Homo sapiens
guauuccuccugagau

SEQ ID NO: 2099419 - RNA, 17 nt, Homo sapiens
ucaaaugugcauuuugu

SEQ ID NO: 2099420 - RNA, 22 nt, Homo sapiens
caaauagguagagucauucaua

SEQ ID NO: 2099421 - RNA, 24 nt, Homo sapiens
cauuugccaaacuaaauacuguaa

SEQ ID NO: 2099422 - RNA, 18 nt, Homo sapiens
auugauauaaauuacuga

SEQ ID NO: 2099423 - RNA, 14 nt, Homo sapiens
ccuguauacuuuag

SEQ ID NO: 2099424 - RNA, 18 nt, Homo sapiens
uggcacuguuagugacag

SEQ ID NO: 2099425 - RNA, 12 nt, Homo sapiens
gccuuuugcaaa

SEQ ID NO: 2099426 - RNA, 22 nt, Homo sapiens
guaugugaaacacacauggaca

SEQ ID NO: 2099427 - RNA, 17 nt, Homo sapiens
aucagcauucaaaauag

SEQ ID NO: 2099428 - RNA, 18 nt, Homo sapiens
uaacagauaacagugugc

SEQ ID NO: 2099429 - RNA, 14 nt, Homo sapiens
accuuuauagcucu

SEQ ID NO: 2099430 - RNA, 12 nt, Homo sapiens
aaacucagggac

SEQ ID NO: 2099431 - RNA, 10 nt, Homo sapiens
aagcugagga

SEQ ID NO: 2099432 - RNA, 10 nt, Homo sapiens
aacacugcug

SEQ ID NO: 2099433 - RNA, 19 nt, Homo sapiens
ucuugguucgauaccugga

SEQ ID NO: 2099434 - RNA, 15 nt, Homo sapiens
ccucccucaccaaca

SEQ ID NO: 2099435 - RNA, 20 nt, Homo sapiens
gguggacuaggcccuacaca

SEQ ID NO: 2099436 - RNA, 12 nt, Homo sapiens
cuggcacccauc

SEQ ID NO: 2099437 - RNA, 15 nt, Homo sapiens
aucccaagucauuuc

SEQ ID NO: 2099438 - RNA, 20 nt, Homo sapiens
aacuagguuaccgcuuauca

SEQ ID NO: 2099439 - RNA, 19 nt, Homo sapiens
agaaucuucuguuccacau

SEQ ID NO: 2099440 - RNA, 21 nt, Homo sapiens
ccucagggcuggcagaugcag

SEQ ID NO: 2099441 - RNA, 18 nt, Homo sapiens
ucuaguaagaugcacuga

SEQ ID NO: 2099442 - RNA, 20 nt, Homo sapiens
cuuaauacuuuaugaugcua

SEQ ID NO: 2099443 - RNA, 16 nt, Homo sapiens
ugcucacauacauguc

SEQ ID NO: 2099444 - RNA, 15 nt, Homo sapiens
cagcaugauguguug

SEQ ID NO: 2099445 - RNA, 19 nt, Homo sapiens
cuucaaacuaggggacaaa

SEQ ID NO: 2099446 - RNA, 18 nt, Homo sapiens
uuaaauaaaguuacuuga

SEQ ID NO: 2099447 - RNA, 14 nt, Homo sapiens
uuugugcggcagau

SEQ ID NO: 2099448 - RNA, 16 nt, Homo sapiens
uucagcggcagugugu

SEQ ID NO: 2099449 - RNA, 14 nt, Homo sapiens
aaguacacugagag

SEQ ID NO: 2099450 - RNA, 15 nt, Homo sapiens
aaggugaccuugcaa

SEQ ID NO: 2099451 - RNA, 22 nt, Homo sapiens
cugcccaggcagucuuugcuca

SEQ ID NO: 2099452 - RNA, 21 nt, Homo sapiens
acggaagccaacuuggcuuuc

SEQ ID NO: 2099453 - RNA, 22 nt, Homo sapiens
cuguucaaguuuucagcuuuaa

SEQ ID NO: 2099454 - RNA, 16 nt, Homo sapiens
cuugaauaaccaucug

SEQ ID NO: 2099455 - RNA, 19 nt, Homo sapiens
gccgcacccugcaccugcu

SEQ ID NO: 2099456 - RNA, 18 nt, Homo sapiens
ccaucugcuuacaauucc

SEQ ID NO: 2099457 - RNA, 14 nt, Homo sapiens
gaccucaugccaug

SEQ ID NO: 2099458 - RNA, 14 nt, Homo sapiens
caccccaucccacg

SEQ ID NO: 2099459 - RNA, 17 nt, Homo sapiens
uaaaauaccuagaccua

SEQ ID NO: 2099460 - RNA, 19 nt, Homo sapiens
uguacauuccugauacugg

SEQ ID NO: 2099461 - RNA, 20 nt, Homo sapiens
aaaucaugccuaguuauuca

SEQ ID NO: 2099462 - RNA, 17 nt, Homo sapiens
uugugcugccuguggug

SEQ ID NO: 2099463 - RNA, 16 nt, Homo sapiens
uaacuuuuaaugguga

SEQ ID NO: 2099464 - RNA, 19 nt, Homo sapiens
aggaggaaauaaauugcag

SEQ ID NO: 2099465 - RNA, 23 nt, Homo sapiens
aaacuuuucuuaaaaaguuauaa

SEQ ID NO: 2099466 - RNA, 15 nt, Homo sapiens
aauagauugcucaaa

SEQ ID NO: 2099467 - RNA, 19 nt, Homo sapiens
aaucacuugaauccauuga

SEQ ID NO: 2099468 - RNA, 15 nt, Homo sapiens
agaugcaucuguggc

SEQ ID NO: 2099469 - RNA, 18 nt, Homo sapiens
gcucucuauagcaccagg

SEQ ID NO: 2099470 - RNA, 18 nt, Homo sapiens
uccuagccacccaccaca

SEQ ID NO: 2099471 - RNA, 21 nt, Homo sapiens
ucacagcuuguauuuugugaa

SEQ ID NO: 2099472 - RNA, 19 nt, Homo sapiens
ugcaccgucucacugugug

SEQ ID NO: 2099473 - RNA, 21 nt, Homo sapiens
accgcccugcgggccacaggg

SEQ ID NO: 2099474 - RNA, 12 nt, Homo sapiens
gcaaaugcauuc

SEQ ID NO: 2099475 - RNA, 16 nt, Homo sapiens
aaagauuugcuuuaau

SEQ ID NO: 2099476 - RNA, 15 nt, Homo sapiens
aagcagaaauguacu

SEQ ID NO: 2099477 - RNA, 18 nt, Homo sapiens
gggccucaaucuaaggcc

SEQ ID NO: 2099478 - RNA, 14 nt, Homo sapiens
ggacaggauccagg

SEQ ID NO: 2099479 - RNA, 15 nt, Homo sapiens
auaagcccacauaua

SEQ ID NO: 2099480 - RNA, 12 nt, Homo sapiens
uucuaagaguuu

SEQ ID NO: 2099481 - RNA, 18 nt, Homo sapiens
caaugagcaaaucuccau

SEQ ID NO: 2099482 - RNA, 12 nt, Homo sapiens
gguggugaugcu

SEQ ID NO: 2099483 - RNA, 14 nt, Homo sapiens
cacuagacugugcc

SEQ ID NO: 2099484 - RNA, 23 nt, Homo sapiens
cucuccugggacaaccagacucu

SEQ ID NO: 2099485 - RNA, 14 nt, Homo sapiens
ccucucccagucca

SEQ ID NO: 2099486 - RNA, 22 nt, Homo sapiens
gccacuuagacacuuuaccucu

SEQ ID NO: 2099487 - RNA, 21 nt, Homo sapiens
acauauauaagguaugugcua

SEQ ID NO: 2099488 - RNA, 12 nt, Homo sapiens
gaaacccgggga

SEQ ID NO: 2099489 - RNA, 14 nt, Homo sapiens
uguuguguagucaa

SEQ ID NO: 2099490 - RNA, 20 nt, Homo sapiens
aagcugggagaaccaaaaag

SEQ ID NO: 2099491 - RNA, 21 nt, Homo sapiens
uuauaugcagaacacauuuca

SEQ ID NO: 2099492 - RNA, 16 nt, Homo sapiens
caguggugacauaguc

SEQ ID NO: 2099493 - RNA, 20 nt, Homo sapiens
ucuagaauuauaagucacaa

SEQ ID NO: 2099494 - RNA, 14 nt, Homo sapiens
cugcugcugaccca

SEQ ID NO: 2099495 - RNA, 15 nt, Homo sapiens
caccucuuaugcaca

SEQ ID NO: 2099496 - RNA, 15 nt, Homo sapiens
gacagagagccaagc

SEQ ID NO: 2099497 - RNA, 19 nt, Homo sapiens
ugcaaauguccccuugaug

SEQ ID NO: 2099498 - RNA, 21 nt, Homo sapiens
gaaaaagaaugaugcuaugaa

SEQ ID NO: 2099499 - RNA, 17 nt, Homo sapiens
ccccagucaagcuccua

SEQ ID NO: 2099500 - RNA, 21 nt, Homo sapiens
guucucagagcuccacagaag

SEQ ID NO: 2099501 - RNA, 15 nt, Homo sapiens
uguuguguccaaucc

SEQ ID NO: 2099502 - RNA, 16 nt, Homo sapiens
aauacugcagcacucu

SEQ ID NO: 2099503 - RNA, 18 nt, Homo sapiens
ccaagaaggugagugcuu

SEQ ID NO: 2099504 - RNA, 20 nt, Homo sapiens
ccaaugaagcaaacacacag

SEQ ID NO: 2099505 - RNA, 17 nt, Homo sapiens
cucaggcaccugcacuu

SEQ ID NO: 2099506 - RNA, 22 nt, Homo sapiens
accaaccuagccaacaugguga

SEQ ID NO: 2099507 - RNA, 12 nt, Homo sapiens
uuacacuguaua

SEQ ID NO: 2099508 - RNA, 18 nt, Homo sapiens
uuugcuguauacuuuuaa

SEQ ID NO: 2099509 - RNA, 17 nt, Homo sapiens
cuaucucacuuccagau

SEQ ID NO: 2099510 - RNA, 23 nt, Homo sapiens
acucuuucugaggagcuguuacu

SEQ ID NO: 2099511 - RNA, 15 nt, Homo sapiens
ugaugcuguacaggu

SEQ ID NO: 2099512 - RNA, 20 nt, Homo sapiens
gccuuuauauccaaaauaaa

SEQ ID NO: 2099513 - RNA, 14 nt, Homo sapiens
gcucuucuuuccca

SEQ ID NO: 2099514 - RNA, 13 nt, Homo sapiens
auaaucgcucuuu

SEQ ID NO: 2099515 - RNA, 22 nt, Homo sapiens
agcacucucgcacacacaguga

SEQ ID NO: 2099516 - RNA, 14 nt, Homo sapiens
aaagaaagcuuuag

SEQ ID NO: 2099517 - RNA, 17 nt, Homo sapiens
ggcacuuugcaucacag

SEQ ID NO: 2099518 - RNA, 13 nt, Homo sapiens
aggaaacauagua

SEQ ID NO: 2099519 - RNA, 13 nt, Homo sapiens
aauauacauguuu

SEQ ID NO: 2099520 - RNA, 16 nt, Homo sapiens
auagaaaagucuccac

SEQ ID NO: 2099521 - RNA, 19 nt, Homo sapiens
ggacucuuccaccucccaa

SEQ ID NO: 2099522 - RNA, 18 nt, Homo sapiens
gcugucagaaguuucuaa

SEQ ID NO: 2099523 - RNA, 19 nt, Homo sapiens
cagccucccgaguagcugg

SEQ ID NO: 2099524 - RNA, 15 nt, Homo sapiens
acuucugggcagcca

SEQ ID NO: 2099525 - RNA, 17 nt, Homo sapiens
agagcagucacaacaga

SEQ ID NO: 2099526 - RNA, 15 nt, Homo sapiens
aaccacaagcacaca

SEQ ID NO: 2099527 - RNA, 16 nt, Homo sapiens
uacaugcacagucaua

SEQ ID NO: 2099528 - RNA, 14 nt, Homo sapiens
auugccauguggac

SEQ ID NO: 2099529 - RNA, 14 nt, Homo sapiens
aagaaaaugauaca

SEQ ID NO: 2099530 - RNA, 17 nt, Homo sapiens
uugauccugggggacca

SEQ ID NO: 2099531 - RNA, 13 nt, Homo sapiens
agauucuguggaa

SEQ ID NO: 2099532 - RNA, 15 nt, Homo sapiens
acugcuuuuggucug

SEQ ID NO: 2099533 - RNA, 20 nt, Homo sapiens
ucucagaacuccugugugug

SEQ ID NO: 2099534 - RNA, 20 nt, Homo sapiens
caccuguagucccagcuacu

SEQ ID NO: 2099535 - RNA, 10 nt, Homo sapiens
aaaagugaug

SEQ ID NO: 2099536 - RNA, 16 nt, Homo sapiens
guaguuagccaucuaa

SEQ ID NO: 2099537 - RNA, 22 nt, Homo sapiens
ucuuacuuugaguuagugccau

SEQ ID NO: 2099538 - RNA, 23 nt, Homo sapiens
cuaguagcuuuccucccaaaggc

SEQ ID NO: 2099539 - RNA, 12 nt, Homo sapiens
uuagaguuuaau

SEQ ID NO: 2099540 - RNA, 23 nt, Homo sapiens
acuuuccuaauuaaacuaugaug

SEQ ID NO: 2099541 - RNA, 20 nt, Homo sapiens
ccuggagcauggacagugug

SEQ ID NO: 2099542 - RNA, 12 nt, Homo sapiens
aguuucuugcaa

SEQ ID NO: 2099543 - RNA, 15 nt, Homo sapiens
cuuuuaugugucuca

SEQ ID NO: 2099544 - RNA, 17 nt, Homo sapiens
cuguggucacccaugca

SEQ ID NO: 2099545 - RNA, 14 nt, Homo sapiens
acucagggaucuca

SEQ ID NO: 2099546 - RNA, 20 nt, Homo sapiens
gcugccucuugaaugcaggg

SEQ ID NO: 2099547 - RNA, 16 nt, Homo sapiens
acuguggcucuugccu

SEQ ID NO: 2099548 - RNA, 14 nt, Homo sapiens
uccaucagcacaaa

SEQ ID NO: 2099549 - RNA, 17 nt, Homo sapiens
ucucuucaauaaaccac

SEQ ID NO: 2099550 - RNA, 23 nt, Homo sapiens
aaacugucgugcaaacccaguga

SEQ ID NO: 2099551 - RNA, 22 nt, Homo sapiens
auaaaggucuuugcacauguga

SEQ ID NO: 2099552 - RNA, 17 nt, Homo sapiens
ccucaagaggaaugaaa

SEQ ID NO: 2099553 - RNA, 16 nt, Homo sapiens
acuuuguccgguggaa

SEQ ID NO: 2099554 - RNA, 18 nt, Homo sapiens
cauuuggguacgucuggg

SEQ ID NO: 2099555 - RNA, 14 nt, Homo sapiens
augaaaucuuccca

SEQ ID NO: 2099556 - RNA, 18 nt, Homo sapiens
cugacccaagagaacuca

SEQ ID NO: 2099557 - RNA, 17 nt, Homo sapiens
ccugugucugguccaca

SEQ ID NO: 2099558 - RNA, 11 nt, Homo sapiens
guuucugcauc

SEQ ID NO: 2099559 - RNA, 18 nt, Homo sapiens
uuauucaagaaaaguaag

SEQ ID NO: 2099560 - RNA, 20 nt, Homo sapiens
cucccaaagugcuaagauua

SEQ ID NO: 2099561 - RNA, 16 nt, Homo sapiens
uaaaauaaaccaaaua

SEQ ID NO: 2099562 - RNA, 20 nt, Homo sapiens
aaugucaaugaacaagcauu

SEQ ID NO: 2099563 - RNA, 17 nt, Homo sapiens
gacuugcucaccuggaa

SEQ ID NO: 2099564 - RNA, 16 nt, Homo sapiens
aaagguauguaaacuu

SEQ ID NO: 2099565 - RNA, 23 nt, Homo sapiens
acaugcuugaauaacugagcuua

SEQ ID NO: 2099566 - RNA, 21 nt, Homo sapiens
ccuguaaacuuuaucacuuaa

SEQ ID NO: 2099567 - RNA, 14 nt, Homo sapiens
ucuguggaugccag

SEQ ID NO: 2099568 - RNA, 18 nt, Homo sapiens
uagcauugaaguguuugc

SEQ ID NO: 2099569 - RNA, 17 nt, Homo sapiens
ccuagggauauaauucu

SEQ ID NO: 2099570 - RNA, 15 nt, Homo sapiens
caggacuccacugga

SEQ ID NO: 2099571 - RNA, 17 nt, Homo sapiens
aaagugacucucacuaa

SEQ ID NO: 2099572 - RNA, 20 nt, Homo sapiens
agccuuaguuuuuucaucug

SEQ ID NO: 2099573 - RNA, 21 nt, Homo sapiens
uguaaguaaacggucucucac

SEQ ID NO: 2099574 - RNA, 12 nt, Homo sapiens
uaaauagccuuc

SEQ ID NO: 2099575 - RNA, 20 nt, Homo sapiens
agagcccggcgccccugcca

SEQ ID NO: 2099576 - RNA, 16 nt, Homo sapiens
aaauccagaacucaaa

SEQ ID NO: 2099577 - RNA, 17 nt, Homo sapiens
agauaucaguuaucaau

SEQ ID NO: 2099578 - RNA, 15 nt, Homo sapiens
augauaaaagcacuu

SEQ ID NO: 2099579 - RNA, 20 nt, Homo sapiens
uuuacauaucaccucauggc

SEQ ID NO: 2099580 - RNA, 23 nt, Homo sapiens
uuagaaaucaagcauaaaucacu

SEQ ID NO: 2099581 - RNA, 17 nt, Homo sapiens
uuaauauaguaacacac

SEQ ID NO: 2099582 - RNA, 15 nt, Homo sapiens
agaaucguguugaca

SEQ ID NO: 2099583 - RNA, 16 nt, Homo sapiens
aaauguaagauuucau

SEQ ID NO: 2099584 - RNA, 18 nt, Homo sapiens
auauuugaagcaucacau

SEQ ID NO: 2099585 - RNA, 23 nt, Homo sapiens
ucggguguuucccuuuagcuaag

SEQ ID NO: 2099586 - RNA, 22 nt, Homo sapiens
auggacuaaccccaacgcacag

SEQ ID NO: 2099587 - RNA, 20 nt, Homo sapiens
uccuguuaacacuguaauau

SEQ ID NO: 2099588 - RNA, 12 nt, Homo sapiens
auauacauaacu

SEQ ID NO: 2099589 - RNA, 12 nt, Homo sapiens
cuccacaucaac

SEQ ID NO: 2099590 - RNA, 16 nt, Homo sapiens
ccauuggaucuuuuac

SEQ ID NO: 2099591 - RNA, 14 nt, Homo sapiens
aauauuauuagucu

SEQ ID NO: 2099592 - RNA, 13 nt, Homo sapiens
ugcccuccacugc

SEQ ID NO: 2099593 - RNA, 13 nt, Homo sapiens
cuauuuuccucuu

SEQ ID NO: 2099594 - RNA, 17 nt, Homo sapiens
cacagauguucccccau

SEQ ID NO: 2099595 - RNA, 20 nt, Homo sapiens
auagacaaaagaauaagaca

SEQ ID NO: 2099596 - RNA, 18 nt, Homo sapiens
gaugggaguaagagcaaa

SEQ ID NO: 2099597 - RNA, 10 nt, Homo sapiens
ucucagccau

SEQ ID NO: 2099598 - RNA, 20 nt, Homo sapiens
aggugugaaccuaccugccu

SEQ ID NO: 2099599 - RNA, 23 nt, Homo sapiens
ggcccaaccgcgggggcugugag

SEQ ID NO: 2099600 - RNA, 14 nt, Homo sapiens
uggaaccuugcugu

SEQ ID NO: 2099601 - RNA, 22 nt, Homo sapiens
auuaguguaugcuuugaaugua

SEQ ID NO: 2099602 - RNA, 13 nt, Homo sapiens
ucugagcauuuaa

SEQ ID NO: 2099603 - RNA, 19 nt, Homo sapiens
aggagggaugcguguucca

SEQ ID NO: 2099604 - RNA, 19 nt, Homo sapiens
aucuugcaacuuguuaaau

SEQ ID NO: 2099605 - RNA, 13 nt, Homo sapiens
ggagagauguuug

SEQ ID NO: 2099606 - RNA, 13 nt, Homo sapiens
accacaccaagga

SEQ ID NO: 2099607 - RNA, 17 nt, Homo sapiens
gaagggcgagugaaucu

SEQ ID NO: 2099608 - RNA, 16 nt, Homo sapiens
agcacagccaagcccu

SEQ ID NO: 2099609 - RNA, 16 nt, Homo sapiens
uaauaacuagaucucc

SEQ ID NO: 2099610 - RNA, 16 nt, Homo sapiens
uguaaauuaauacuuc

SEQ ID NO: 2099611 - RNA, 20 nt, Homo sapiens
ucugauacccagagcauuac

SEQ ID NO: 2099612 - RNA, 20 nt, Homo sapiens
ugcauuacugcaugcacuuc

SEQ ID NO: 2099613 - RNA, 23 nt, Homo sapiens
agauuuuucauuuuuccaugaca

SEQ ID NO: 2099614 - RNA, 21 nt, Homo sapiens
ugaagcugggagaaccaaaaa

SEQ ID NO: 2099615 - RNA, 14 nt, Homo sapiens
ucuggagcugaagc

SEQ ID NO: 2099616 - RNA, 22 nt, Homo sapiens
agcauguguauuuccagugcaa

SEQ ID NO: 2099617 - RNA, 14 nt, Homo sapiens
gacuacagccagaa

SEQ ID NO: 2099618 - RNA, 22 nt, Homo sapiens
uccacauucauguacaaugaug

SEQ ID NO: 2099619 - RNA, 14 nt, Homo sapiens
cauagagugaccuu

SEQ ID NO: 2099620 - RNA, 19 nt, Homo sapiens
ucaaggccucccacaguga

SEQ ID NO: 2099621 - RNA, 20 nt, Homo sapiens
caaaagcccauucauuccau

SEQ ID NO: 2099622 - RNA, 22 nt, Homo sapiens
caggcacaucaacugaucucau

SEQ ID NO: 2099623 - RNA, 16 nt, Homo sapiens
uaaauaauggugcauu

SEQ ID NO: 2099624 - RNA, 22 nt, Homo sapiens
ccagauccaggaacacaugcac

SEQ ID NO: 2099625 - RNA, 20 nt, Homo sapiens
uucaaauccuuauuguucag

SEQ ID NO: 2099626 - RNA, 14 nt, Homo sapiens
uccugggaggacag

SEQ ID NO: 2099627 - RNA, 20 nt, Homo sapiens
agucaauuaaaggcuuucag

SEQ ID NO: 2099628 - RNA, 22 nt, Homo sapiens
ggaauaaaauccuaagacacaa

SEQ ID NO: 2099629 - RNA, 19 nt, Homo sapiens
caaauacugauggugcauu

SEQ ID NO: 2099630 - RNA, 13 nt, Homo sapiens
ccuuacauuccua

SEQ ID NO: 2099631 - RNA, 20 nt, Homo sapiens
ugcauucucccuccuucccu

SEQ ID NO: 2099632 - RNA, 21 nt, Homo sapiens
cuggauuggggauggggacaa

SEQ ID NO: 2099633 - RNA, 20 nt, Homo sapiens
ugugaguuuugccuuucuaa

SEQ ID NO: 2099634 - RNA, 21 nt, Homo sapiens
uagaaaaaaaaauucacauga

SEQ ID NO: 2099635 - RNA, 21 nt, Homo sapiens
aaacagugaguuaaagcagug

SEQ ID NO: 2099636 - RNA, 20 nt, Homo sapiens
ugggguucaucuagggacac

SEQ ID NO: 2099637 - RNA, 18 nt, Homo sapiens
auaaagaaacuuuugaaa

SEQ ID NO: 2099638 - RNA, 20 nt, Homo sapiens
uuuggauaauaggaauucaa

SEQ ID NO: 2099639 - RNA, 10 nt, Homo sapiens
ggacaugccc

SEQ ID NO: 2099640 - RNA, 15 nt, Homo sapiens
aacacaauguuauuc

SEQ ID NO: 2099641 - RNA, 20 nt, Homo sapiens
cccaugcucaaccacugugg

SEQ ID NO: 2099642 - RNA, 20 nt, Homo sapiens
acucuaacaguaguugcaau

SEQ ID NO: 2099643 - RNA, 14 nt, Homo sapiens
aacgugcaaagcca

SEQ ID NO: 2099644 - RNA, 15 nt, Homo sapiens
uauuucucuuugcac

SEQ ID NO: 2099645 - RNA, 12 nt, Homo sapiens
acccacuacccu

SEQ ID NO: 2099646 - RNA, 17 nt, Homo sapiens
cugagucugccucuguu

SEQ ID NO: 2099647 - RNA, 14 nt, Homo sapiens
aagcucaguucaau

SEQ ID NO: 2099648 - RNA, 17 nt, Homo sapiens
ccuucccacacugucca

SEQ ID NO: 2099649 - RNA, 22 nt, Homo sapiens
guacugauuauucuucuuacau

SEQ ID NO: 2099650 - RNA, 17 nt, Homo sapiens
uacuuuagacuaauugu

SEQ ID NO: 2099651 - RNA, 17 nt, Homo sapiens
ucuuaaaaaacauauau

SEQ ID NO: 2099652 - RNA, 22 nt, Homo sapiens
acagaugugucugggagagccu

SEQ ID NO: 2099653 - RNA, 17 nt, Homo sapiens
guauuauuuuacaauca

SEQ ID NO: 2099654 - RNA, 15 nt, Homo sapiens
acaugccacuaugag

SEQ ID NO: 2099655 - RNA, 22 nt, Homo sapiens
cugccucugaguuuugaugcug

SEQ ID NO: 2099656 - RNA, 19 nt, Homo sapiens
ccuggcuggcugagggcag

SEQ ID NO: 2099657 - RNA, 22 nt, Homo sapiens
acccucagucgcauagacuuau

SEQ ID NO: 2099658 - RNA, 13 nt, Homo sapiens
uggggugagggag

SEQ ID NO: 2099659 - RNA, 17 nt, Homo sapiens
gcaaggagccagggaau

SEQ ID NO: 2099660 - RNA, 22 nt, Homo sapiens
ugcauaaucauaugguugacag

SEQ ID NO: 2099661 - RNA, 14 nt, Homo sapiens
cuggauauaaugua

SEQ ID NO: 2099662 - RNA, 15 nt, Homo sapiens
aauauuuucucucau

SEQ ID NO: 2099663 - RNA, 20 nt, Homo sapiens
uaagaagccaagggggaccu

SEQ ID NO: 2099664 - RNA, 15 nt, Homo sapiens
caccaaccugcauuu

SEQ ID NO: 2099665 - RNA, 22 nt, Homo sapiens
aggacuaaguucucauuguuca

SEQ ID NO: 2099666 - RNA, 14 nt, Homo sapiens
gcaaaugucuucca

SEQ ID NO: 2099667 - RNA, 20 nt, Homo sapiens
gggugguaaagugaacaaaa

SEQ ID NO: 2099668 - RNA, 13 nt, Homo sapiens
uuuccuuuugcca

SEQ ID NO: 2099669 - RNA, 11 nt, Homo sapiens
gcauuugccac

SEQ ID NO: 2099670 - RNA, 15 nt, Homo sapiens
cauuaucuugcucau

SEQ ID NO: 2099671 - RNA, 20 nt, Homo sapiens
uuuaaucagcaauauugccu

SEQ ID NO: 2099672 - RNA, 13 nt, Homo sapiens
agacacaggugua

SEQ ID NO: 2099673 - RNA, 13 nt, Homo sapiens
acaguacugauac

SEQ ID NO: 2099674 - RNA, 21 nt, Homo sapiens
aaagggaucaucaugcagcuc

SEQ ID NO: 2099675 - RNA, 13 nt, Homo sapiens
acuuaacacuucu

SEQ ID NO: 2099676 - RNA, 17 nt, Homo sapiens
cuuuucucuuuaaucuc

SEQ ID NO: 2099677 - RNA, 17 nt, Homo sapiens
ggucccuuggucaggag

SEQ ID NO: 2099678 - RNA, 13 nt, Homo sapiens
ugccugucucuag

SEQ ID NO: 2099679 - RNA, 24 nt, Homo sapiens
cagaguggggaugacaugcacuca

SEQ ID NO: 2099680 - RNA, 14 nt, Homo sapiens
caggggugacacag

SEQ ID NO: 2099681 - RNA, 14 nt, Homo sapiens
cauggcaugucuuu

SEQ ID NO: 2099682 - RNA, 13 nt, Homo sapiens
uuuacuuccucag

SEQ ID NO: 2099683 - RNA, 16 nt, Homo sapiens
ccaauuaacugaagca

SEQ ID NO: 2099684 - RNA, 17 nt, Homo sapiens
gaaaauuguacaaccug

SEQ ID NO: 2099685 - RNA, 21 nt, Homo sapiens
agaaaauuagugaccauuauu

SEQ ID NO: 2099686 - RNA, 19 nt, Homo sapiens
uaaauguucauugcacauc

SEQ ID NO: 2099687 - RNA, 23 nt, Homo sapiens
ccaguacucugggaagccaaggc

SEQ ID NO: 2099688 - RNA, 17 nt, Homo sapiens
uucaccuccuucugcag

SEQ ID NO: 2099689 - RNA, 23 nt, Homo sapiens
uugcuaacugugcuccucacuuc

SEQ ID NO: 2099690 - RNA, 17 nt, Homo sapiens
ucucuucugcugucucu

SEQ ID NO: 2099691 - RNA, 20 nt, Homo sapiens
gacucuggaggccugugccu

SEQ ID NO: 2099692 - RNA, 14 nt, Homo sapiens
acuucaaguucucu

SEQ ID NO: 2099693 - RNA, 14 nt, Homo sapiens
ucuucuagaucuca

SEQ ID NO: 2099694 - RNA, 13 nt, Homo sapiens
ggacaaguaucau

SEQ ID NO: 2099695 - RNA, 20 nt, Homo sapiens
gacuucugucuucacaacag

SEQ ID NO: 2099696 - RNA, 22 nt, Homo sapiens
caggaacauuggagccugcaau

SEQ ID NO: 2099697 - RNA, 12 nt, Homo sapiens
uuauaacuuuaa

SEQ ID NO: 2099698 - RNA, 19 nt, Homo sapiens
agcagucuaucauugcagg

SEQ ID NO: 2099699 - RNA, 20 nt, Homo sapiens
uacaguggaauugugaauaa

SEQ ID NO: 2099700 - RNA, 17 nt, Homo sapiens
ucuacacuguauuacau

SEQ ID NO: 2099701 - RNA, 22 nt, Homo sapiens
caaaguuaaaagccuaccuaag

SEQ ID NO: 2099702 - RNA, 19 nt, Homo sapiens
uaaaaucuuuccaucucau

SEQ ID NO: 2099703 - RNA, 19 nt, Homo sapiens
caauaacuuuucaccaaug

SEQ ID NO: 2099704 - RNA, 14 nt, Homo sapiens
ugucuuuuuacugg

SEQ ID NO: 2099705 - RNA, 17 nt, Homo sapiens
caauggcgugaucucag

SEQ ID NO: 2099706 - RNA, 19 nt, Homo sapiens
uauuacuuugucuuuucaa

SEQ ID NO: 2099707 - RNA, 12 nt, Homo sapiens
cacacucugugu

SEQ ID NO: 2099708 - RNA, 21 nt, Homo sapiens
cugaaaucuccuuuagccauc

SEQ ID NO: 2099709 - RNA, 11 nt, Homo sapiens
agcacacucuu

SEQ ID NO: 2099710 - RNA, 21 nt, Homo sapiens
ucccccaaacuucuuguucaa

SEQ ID NO: 2099711 - RNA, 18 nt, Homo sapiens
uguccauaucuaaccagu

SEQ ID NO: 2099712 - RNA, 18 nt, Homo sapiens
acuauuuaaagccuccuc

SEQ ID NO: 2099713 - RNA, 18 nt, Homo sapiens
caucuguaacagcauuaa

SEQ ID NO: 2099714 - RNA, 15 nt, Homo sapiens
auauagagacaggac

SEQ ID NO: 2099715 - RNA, 11 nt, Homo sapiens
ggcuucuuauu

SEQ ID NO: 2099716 - RNA, 17 nt, Homo sapiens
gcuacagagaaaccagc

SEQ ID NO: 2099717 - RNA, 15 nt, Homo sapiens
guaaauuaguauuua

SEQ ID NO: 2099718 - RNA, 21 nt, Homo sapiens
gaaaccaaggccccgagcuca

SEQ ID NO: 2099719 - RNA, 22 nt, Homo sapiens
cuuuaaaaagcuccaaaugcag

SEQ ID NO: 2099720 - RNA, 19 nt, Homo sapiens
ucagggaccccugcccuug

SEQ ID NO: 2099721 - RNA, 23 nt, Homo sapiens
caaguaaaugcacaacuuuagaa

SEQ ID NO: 2099722 - RNA, 14 nt, Homo sapiens
cacugacucaggcu

SEQ ID NO: 2099723 - RNA, 12 nt, Homo sapiens
ugaggggaccca

SEQ ID NO: 2099724 - RNA, 14 nt, Homo sapiens
cagaaauugcauaa

SEQ ID NO: 2099725 - RNA, 21 nt, Homo sapiens
agguaacuucucccuucuccu

SEQ ID NO: 2099726 - RNA, 21 nt, Homo sapiens
gcagugagccgagaucaugcc

SEQ ID NO: 2099727 - RNA, 21 nt, Homo sapiens
ugaccacugaagcaccacagg

SEQ ID NO: 2099728 - RNA, 21 nt, Homo sapiens
acagccuucuucauguacaau

SEQ ID NO: 2099729 - RNA, 12 nt, Homo sapiens
gaugccaaagcu

SEQ ID NO: 2099730 - RNA, 11 nt, Homo sapiens
uucaccuguaa

SEQ ID NO: 2099731 - RNA, 12 nt, Homo sapiens
guguaugcauac

SEQ ID NO: 2099732 - RNA, 22 nt, Homo sapiens
cucugggccaagucaaagacau

SEQ ID NO: 2099733 - RNA, 15 nt, Homo sapiens
agagcugaguggcag

SEQ ID NO: 2099734 - RNA, 21 nt, Homo sapiens
cagugggcauggagccagugc

SEQ ID NO: 2099735 - RNA, 15 nt, Homo sapiens
uaugacugauuacuc

SEQ ID NO: 2099736 - RNA, 17 nt, Homo sapiens
ccuaucucuccaaccag

SEQ ID NO: 2099737 - RNA, 14 nt, Homo sapiens
ucucaauguuccau

SEQ ID NO: 2099738 - RNA, 17 nt, Homo sapiens
uaaaaccuugaaggucu

SEQ ID NO: 2099739 - RNA, 15 nt, Homo sapiens
aaaaucacacugucu

SEQ ID NO: 2099740 - RNA, 16 nt, Homo sapiens
cccuuaaauaucuuuc

SEQ ID NO: 2099741 - RNA, 14 nt, Homo sapiens
ugggcccacaaagg

SEQ ID NO: 2099742 - RNA, 20 nt, Homo sapiens
uagccagguaugguggcaua

SEQ ID NO: 2099743 - RNA, 16 nt, Homo sapiens
uugaaacuguauuuac

SEQ ID NO: 2099744 - RNA, 20 nt, Homo sapiens
uuucucauguuuuccauugu

SEQ ID NO: 2099745 - RNA, 13 nt, Homo sapiens
gauagacaucaga

SEQ ID NO: 2099746 - RNA, 17 nt, Homo sapiens
accaugagggaagaaua

SEQ ID NO: 2099747 - RNA, 19 nt, Homo sapiens
uaccaacuuccucugccau

SEQ ID NO: 2099748 - RNA, 19 nt, Homo sapiens
uauccuuacuagauucaua

SEQ ID NO: 2099749 - RNA, 17 nt, Homo sapiens
aucauaauucagcacuu

SEQ ID NO: 2099750 - RNA, 15 nt, Homo sapiens
cccccugccagugcc

SEQ ID NO: 2099751 - RNA, 20 nt, Homo sapiens
aaguuaaccccauguccuca

SEQ ID NO: 2099752 - RNA, 15 nt, Homo sapiens
agccguuuuccucau

SEQ ID NO: 2099753 - RNA, 15 nt, Homo sapiens
ugcccucuaccugac

SEQ ID NO: 2099754 - RNA, 13 nt, Homo sapiens
gcaccauucugac

SEQ ID NO: 2099755 - RNA, 16 nt, Homo sapiens
ggaugucauucuuugc

SEQ ID NO: 2099756 - RNA, 16 nt, Homo sapiens
aaagugucuacaugug

SEQ ID NO: 2099757 - RNA, 21 nt, Homo sapiens
agcaaauguuaaaaguuuuau

SEQ ID NO: 2099758 - RNA, 21 nt, Homo sapiens
cagaaaaugagcugagcuuag

SEQ ID NO: 2099759 - RNA, 23 nt, Homo sapiens
uauuaaucaagagaaacuucaaa

SEQ ID NO: 2099760 - RNA, 18 nt, Homo sapiens
auaaauaaaacagcagca

SEQ ID NO: 2099761 - RNA, 19 nt, Homo sapiens
augcugcacagauggauuu

SEQ ID NO: 2099762 - RNA, 23 nt, Homo sapiens
aacauugccauguaacuauguau

SEQ ID NO: 2099763 - RNA, 15 nt, Homo sapiens
uaaaaauaagcuuua

SEQ ID NO: 2099764 - RNA, 15 nt, Homo sapiens
cagagcacuguguaa

SEQ ID NO: 2099765 - RNA, 16 nt, Homo sapiens
guguuagacuauagcc

SEQ ID NO: 2099766 - RNA, 18 nt, Homo sapiens
cagaacccagacccugag

SEQ ID NO: 2099767 - RNA, 14 nt, Homo sapiens
gacuauaacuguca

SEQ ID NO: 2099768 - RNA, 17 nt, Homo sapiens
aaaucucauuugguaca

SEQ ID NO: 2099769 - RNA, 19 nt, Homo sapiens
agcuaucagcaauacucau

SEQ ID NO: 2099770 - RNA, 21 nt, Homo sapiens
ucugcccaaguugcucuguau

SEQ ID NO: 2099771 - RNA, 17 nt, Homo sapiens
uggcaaacagaauguuc

SEQ ID NO: 2099772 - RNA, 23 nt, Homo sapiens
ccuuacucugagcucauuaauaa

SEQ ID NO: 2099773 - RNA, 12 nt, Homo sapiens
uuuuugaucaau

SEQ ID NO: 2099774 - RNA, 11 nt, Homo sapiens
gccugccauuu

SEQ ID NO: 2099775 - RNA, 19 nt, Homo sapiens
cagagcccgguacagggcc

SEQ ID NO: 2099776 - RNA, 20 nt, Homo sapiens
caaacauggagaaaucuacu

SEQ ID NO: 2099777 - RNA, 17 nt, Homo sapiens
aacucuacaucuagcaa

SEQ ID NO: 2099778 - RNA, 18 nt, Homo sapiens
agaccaggggaccagagg

SEQ ID NO: 2099779 - RNA, 21 nt, Homo sapiens
uagcaaauggcagaaccaaag

SEQ ID NO: 2099780 - RNA, 12 nt, Homo sapiens
cauacugcagug

SEQ ID NO: 2099781 - RNA, 22 nt, Homo sapiens
ggagucaccuucccuugccacu

SEQ ID NO: 2099782 - RNA, 13 nt, Homo sapiens
ccugccccagaga

SEQ ID NO: 2099783 - RNA, 15 nt, Homo sapiens
aaacccucugugaaa

SEQ ID NO: 2099784 - RNA, 22 nt, Homo sapiens
aaguccccgaguuuccccagac

SEQ ID NO: 2099785 - RNA, 23 nt, Homo sapiens
augccauguggucauacucucag

SEQ ID NO: 2099786 - RNA, 17 nt, Homo sapiens
caucccagcugcuccca

SEQ ID NO: 2099787 - RNA, 15 nt, Homo sapiens
caggugccuguaauc

SEQ ID NO: 2099788 - RNA, 15 nt, Homo sapiens
ccacuacuguagaaa

SEQ ID NO: 2099789 - RNA, 15 nt, Homo sapiens
uuggcccucucccau

SEQ ID NO: 2099790 - RNA, 14 nt, Homo sapiens
uugguauacuguua

SEQ ID NO: 2099791 - RNA, 13 nt, Homo sapiens
accggccacugca

SEQ ID NO: 2099792 - RNA, 22 nt, Homo sapiens
aacuaaugucagcacauguugc

SEQ ID NO: 2099793 - RNA, 15 nt, Homo sapiens
auuuuuaaauauuca

SEQ ID NO: 2099794 - RNA, 20 nt, Homo sapiens
ggagcacgaggccuucagaa

SEQ ID NO: 2099795 - RNA, 13 nt, Homo sapiens
ugguaagcuucca

SEQ ID NO: 2099796 - RNA, 21 nt, Homo sapiens
cucaacauacuguugaugucu

SEQ ID NO: 2099797 - RNA, 20 nt, Homo sapiens
gagaucgugccacugcacuc

SEQ ID NO: 2099798 - RNA, 22 nt, Homo sapiens
cuugacugcuuuuaaaugacca

SEQ ID NO: 2099799 - RNA, 17 nt, Homo sapiens
aaaauuugcugauucuu

SEQ ID NO: 2099800 - RNA, 19 nt, Homo sapiens
cuuuaaaucaccauagggc

SEQ ID NO: 2099801 - RNA, 22 nt, Homo sapiens
agaaaugucauaaauuacuguu

SEQ ID NO: 2099802 - RNA, 15 nt, Homo sapiens
ugccccaaggacaag

SEQ ID NO: 2099803 - RNA, 14 nt, Homo sapiens
uuaaauaugcaucu

SEQ ID NO: 2099804 - RNA, 17 nt, Homo sapiens
uccacuaacacuuuagu

SEQ ID NO: 2099805 - RNA, 21 nt, Homo sapiens
aggacucuauuuuaaggacug

SEQ ID NO: 2099806 - RNA, 18 nt, Homo sapiens
ugcuacacaaaagccaaa

SEQ ID NO: 2099807 - RNA, 18 nt, Homo sapiens
guccuuccuugaacuguc

SEQ ID NO: 2099808 - RNA, 21 nt, Homo sapiens
guuuccucagugauggaauau

SEQ ID NO: 2099809 - RNA, 15 nt, Homo sapiens
ucuguauaaauguga

SEQ ID NO: 2099810 - RNA, 14 nt, Homo sapiens
auaacuugcaucua

SEQ ID NO: 2099811 - RNA, 20 nt, Homo sapiens
uggcaccuuaguugcaugac

SEQ ID NO: 2099812 - RNA, 16 nt, Homo sapiens
gucccucuuugaggga

SEQ ID NO: 2099813 - RNA, 23 nt, Homo sapiens
ugcagcagcgguggccucuuuuc

SEQ ID NO: 2099814 - RNA, 18 nt, Homo sapiens
cauuuggacuugcugaau

SEQ ID NO: 2099815 - RNA, 20 nt, Homo sapiens
cacuccugacccagcccuga

SEQ ID NO: 2099816 - RNA, 17 nt, Homo sapiens
agucaguuuuaggguug

SEQ ID NO: 2099817 - RNA, 20 nt, Homo sapiens
caaccuaagggcccaaaggc

SEQ ID NO: 2099818 - RNA, 17 nt, Homo sapiens
uuccaaaugauccuagu

SEQ ID NO: 2099819 - RNA, 14 nt, Homo sapiens
guucaauacaguga

SEQ ID NO: 2099820 - RNA, 22 nt, Homo sapiens
guuuacaauaggaguggugauu

SEQ ID NO: 2099821 - RNA, 13 nt, Homo sapiens
ggccaaugggcua

SEQ ID NO: 2099822 - RNA, 13 nt, Homo sapiens
ucuuaaugucuca

SEQ ID NO: 2099823 - RNA, 13 nt, Homo sapiens
cuagacagguguu

SEQ ID NO: 2099824 - RNA, 18 nt, Homo sapiens
ccgcgagccaggcugacc

SEQ ID NO: 2099825 - RNA, 17 nt, Homo sapiens
uaaacaguggaauauaa

SEQ ID NO: 2099826 - RNA, 18 nt, Homo sapiens
ccaagaaagaaaccagac

SEQ ID NO: 2099827 - RNA, 15 nt, Homo sapiens
auuccagcauuugcc

SEQ ID NO: 2099828 - RNA, 20 nt, Homo sapiens
aauauccacuggacacugug

SEQ ID NO: 2099829 - RNA, 18 nt, Homo sapiens
gcuuggcugugcccucag

SEQ ID NO: 2099830 - RNA, 17 nt, Homo sapiens
uuaacucaggacuccag

SEQ ID NO: 2099831 - RNA, 15 nt, Homo sapiens
acuuuuccaacauac

SEQ ID NO: 2099832 - RNA, 20 nt, Homo sapiens
aacgcuucugcuuaaucuga

SEQ ID NO: 2099833 - RNA, 17 nt, Homo sapiens
acugcaaacccuuucau

SEQ ID NO: 2099834 - RNA, 17 nt, Homo sapiens
cuggauauggugcaaaa

SEQ ID NO: 2099835 - RNA, 22 nt, Homo sapiens
uucagaaugaaguucuggagaa

SEQ ID NO: 2099836 - RNA, 18 nt, Homo sapiens
uuaauuccaugucagaua

SEQ ID NO: 2099837 - RNA, 15 nt, Homo sapiens
aggcuuagugcuugg

SEQ ID NO: 2099838 - RNA, 12 nt, Homo sapiens
cucugcuugcca

SEQ ID NO: 2099839 - RNA, 23 nt, Homo sapiens
aggcagcugguauauucagucuc

SEQ ID NO: 2099840 - RNA, 16 nt, Homo sapiens
cccaacuuggcagcuu

SEQ ID NO: 2099841 - RNA, 17 nt, Homo sapiens
cugguucccugcugcgc

SEQ ID NO: 2099842 - RNA, 16 nt, Homo sapiens
cgugaaaaugcuguau

SEQ ID NO: 2099843 - RNA, 21 nt, Homo sapiens
uauagugucuugggaauuuuc

SEQ ID NO: 2099844 - RNA, 22 nt, Homo sapiens
ugaaugagaaugugccauguau

SEQ ID NO: 2099845 - RNA, 24 nt, Homo sapiens
acccugcaaaauuugaugccagga

SEQ ID NO: 2099846 - RNA, 11 nt, Homo sapiens
uccuucuugcu

SEQ ID NO: 2099847 - RNA, 14 nt, Homo sapiens
acccugagcacucu

SEQ ID NO: 2099848 - RNA, 15 nt, Homo sapiens
caguacuuuaugaaa

SEQ ID NO: 2099849 - RNA, 22 nt, Homo sapiens
aauuuuuauuuuugcugagacu

SEQ ID NO: 2099850 - RNA, 19 nt, Homo sapiens
ugaccagaaaucaaaaagg

SEQ ID NO: 2099851 - RNA, 13 nt, Homo sapiens
gcucacucaggac

SEQ ID NO: 2099852 - RNA, 18 nt, Homo sapiens
ucugcaucuuacagucag

SEQ ID NO: 2099853 - RNA, 21 nt, Homo sapiens
cuccagcuuuuccucagggug

SEQ ID NO: 2099854 - RNA, 11 nt, Homo sapiens
ucugaguauaa

SEQ ID NO: 2099855 - RNA, 23 nt, Homo sapiens
auuucccauuaaagagccaguuu

SEQ ID NO: 2099856 - RNA, 16 nt, Homo sapiens
cagauuuacacuggga

SEQ ID NO: 2099857 - RNA, 16 nt, Homo sapiens
cucagugacuguugua

SEQ ID NO: 2099858 - RNA, 19 nt, Homo sapiens
ugcaugaugucuaccucag

SEQ ID NO: 2099859 - RNA, 23 nt, Homo sapiens
augaaccugcaucauuccccgac

SEQ ID NO: 2099860 - RNA, 15 nt, Homo sapiens
auuucccucuacuga

SEQ ID NO: 2099861 - RNA, 19 nt, Homo sapiens
ugcagaggaaagacaggac

SEQ ID NO: 2099862 - RNA, 20 nt, Homo sapiens
cuuguucaauaauuacugua

SEQ ID NO: 2099863 - RNA, 15 nt, Homo sapiens
ucaccuuccuaauca

SEQ ID NO: 2099864 - RNA, 21 nt, Homo sapiens
uccuuccuuguuacccaugaa

SEQ ID NO: 2099865 - RNA, 13 nt, Homo sapiens
ugcaagggugcug

SEQ ID NO: 2099866 - RNA, 13 nt, Homo sapiens
cucuggggcucaa

SEQ ID NO: 2099867 - RNA, 20 nt, Homo sapiens
cugcccuuauccgcugucca

SEQ ID NO: 2099868 - RNA, 22 nt, Homo sapiens
uaaacacauagauucaccugua

SEQ ID NO: 2099869 - RNA, 15 nt, Homo sapiens
cggaauucagccaug

SEQ ID NO: 2099870 - RNA, 16 nt, Homo sapiens
uuaaagcccuguguua

SEQ ID NO: 2099871 - RNA, 14 nt, Homo sapiens
cagagauggcuccu

SEQ ID NO: 2099872 - RNA, 15 nt, Homo sapiens
aggggcaacugauga

SEQ ID NO: 2099873 - RNA, 15 nt, Homo sapiens
caaaauccaaaaaga

SEQ ID NO: 2099874 - RNA, 21 nt, Homo sapiens
aaacugauuucuucagaauua

SEQ ID NO: 2099875 - RNA, 10 nt, Homo sapiens
uuccagacag

SEQ ID NO: 2099876 - RNA, 22 nt, Homo sapiens
aucacuggggggcucucaggga

SEQ ID NO: 2099877 - RNA, 14 nt, Homo sapiens
uguguucucaguga

SEQ ID NO: 2099878 - RNA, 15 nt, Homo sapiens
gguugaaauauuaac

SEQ ID NO: 2099879 - RNA, 19 nt, Homo sapiens
cauauucaggaagcucagg

SEQ ID NO: 2099880 - RNA, 12 nt, Homo sapiens
gggagaaggcau

SEQ ID NO: 2099881 - RNA, 20 nt, Homo sapiens
agugcaaccucgcugagggc

SEQ ID NO: 2099882 - RNA, 20 nt, Homo sapiens
agguuauuaugauuagcuuu

SEQ ID NO: 2099883 - RNA, 18 nt, Homo sapiens
cuggaaccaccuggacga

SEQ ID NO: 2099884 - RNA, 23 nt, Homo sapiens
uauaaagauacagaacucuuuca

SEQ ID NO: 2099885 - RNA, 21 nt, Homo sapiens
ccacuuucugccagcaucugc

SEQ ID NO: 2099886 - RNA, 18 nt, Homo sapiens
cguuucucucaauuugaa

SEQ ID NO: 2099887 - RNA, 23 nt, Homo sapiens
agcuaaggagucccugguucauu

SEQ ID NO: 2099888 - RNA, 15 nt, Homo sapiens
ggucuuucagcucau

SEQ ID NO: 2099889 - RNA, 13 nt, Homo sapiens
aggagaacugugc

SEQ ID NO: 2099890 - RNA, 17 nt, Homo sapiens
ccaaaguacugggauua

SEQ ID NO: 2099891 - RNA, 14 nt, Homo sapiens
cauauaagcuauau

SEQ ID NO: 2099892 - RNA, 17 nt, Homo sapiens
cccugguccugcacugu

SEQ ID NO: 2099893 - RNA, 15 nt, Homo sapiens
cuuucagagccagcc

SEQ ID NO: 2099894 - RNA, 21 nt, Homo sapiens
uuaacuugcaguauaucacag

SEQ ID NO: 2099895 - RNA, 19 nt, Homo sapiens
cuugaucuuugagcccauu

SEQ ID NO: 2099896 - RNA, 17 nt, Homo sapiens
aagauaucuaugacugu

SEQ ID NO: 2099897 - RNA, 14 nt, Homo sapiens
cuuccuguccuccc

SEQ ID NO: 2099898 - RNA, 18 nt, Homo sapiens
ugaaauuugauacuaaaa

SEQ ID NO: 2099899 - RNA, 17 nt, Homo sapiens
ucuacuuaucauguaaa

SEQ ID NO: 2099900 - RNA, 23 nt, Homo sapiens
gugaacucaaacgaugugcaaua

SEQ ID NO: 2099901 - RNA, 19 nt, Homo sapiens
gagugcucucucagcacug

SEQ ID NO: 2099902 - RNA, 11 nt, Homo sapiens
ggguggcugcc

SEQ ID NO: 2099903 - RNA, 20 nt, Homo sapiens
aacgccugagcccagggagg

SEQ ID NO: 2099904 - RNA, 12 nt, Homo sapiens
uuaugugacaac

SEQ ID NO: 2099905 - RNA, 16 nt, Homo sapiens
gcacccagccaaacac

SEQ ID NO: 2099906 - RNA, 19 nt, Homo sapiens
cacggcauuaugaucccuu

SEQ ID NO: 2099907 - RNA, 19 nt, Homo sapiens
ucuucaccaggugcaugca

SEQ ID NO: 2099908 - RNA, 18 nt, Homo sapiens
uuugaagggggcagucga

SEQ ID NO: 2099909 - RNA, 12 nt, Homo sapiens
cucaaaugaauu

SEQ ID NO: 2099910 - RNA, 15 nt, Homo sapiens
acugaagaaaauccu

SEQ ID NO: 2099911 - RNA, 13 nt, Homo sapiens
uuggaccaaaugg

SEQ ID NO: 2099912 - RNA, 17 nt, Homo sapiens
ucaagucccccaagacc

SEQ ID NO: 2099913 - RNA, 17 nt, Homo sapiens
ccuagcugcacagggca

SEQ ID NO: 2099914 - RNA, 23 nt, Homo sapiens
uuuuaaaaugagagucacuugau

SEQ ID NO: 2099915 - RNA, 13 nt, Homo sapiens
cacgaaagcacac

SEQ ID NO: 2099916 - RNA, 13 nt, Homo sapiens
caagcaagcaaaa

SEQ ID NO: 2099917 - RNA, 21 nt, Homo sapiens
ucagcauuuagucuugccagg

SEQ ID NO: 2099918 - RNA, 18 nt, Homo sapiens
uuaaguuuuaaaauaaca

SEQ ID NO: 2099919 - RNA, 23 nt, Homo sapiens
aggaagccccaagccauggugac

SEQ ID NO: 2099920 - RNA, 19 nt, Homo sapiens
ucugaaaucaacucucuuc

SEQ ID NO: 2099921 - RNA, 21 nt, Homo sapiens
uagaggggccccugauccuca

SEQ ID NO: 2099922 - RNA, 15 nt, Homo sapiens
auaaauguaucugaa

SEQ ID NO: 2099923 - RNA, 15 nt, Homo sapiens
agaaaaauagcugug

SEQ ID NO: 2099924 - RNA, 16 nt, Homo sapiens
guuuuuuauuaugcau

SEQ ID NO: 2099925 - RNA, 22 nt, Homo sapiens
uccauccggcuccugucauccc

SEQ ID NO: 2099926 - RNA, 16 nt, Homo sapiens
cugauuaguugacagu

SEQ ID NO: 2099927 - RNA, 18 nt, Homo sapiens
agcuacucgggaggcuga

SEQ ID NO: 2099928 - RNA, 16 nt, Homo sapiens
cugcaccugcagggag

SEQ ID NO: 2099929 - RNA, 15 nt, Homo sapiens
ccugcugagcucuga

SEQ ID NO: 2099930 - RNA, 14 nt, Homo sapiens
uuuauaguguugcu

SEQ ID NO: 2099931 - RNA, 14 nt, Homo sapiens
cagugcugcuguaa

SEQ ID NO: 2099932 - RNA, 14 nt, Homo sapiens
cuuggcugcaugaa

SEQ ID NO: 2099933 - RNA, 16 nt, Homo sapiens
gaagcccaugucuucu

SEQ ID NO: 2099934 - RNA, 14 nt, Homo sapiens
gauagggaacacuc

SEQ ID NO: 2099935 - RNA, 14 nt, Homo sapiens
uuuaauuuuaaucc

SEQ ID NO: 2099936 - RNA, 14 nt, Homo sapiens
aaaacuucacucca

SEQ ID NO: 2099937 - RNA, 14 nt, Homo sapiens
uaaaaaucucucau

SEQ ID NO: 2099938 - RNA, 17 nt, Homo sapiens
cucauaaaccaaugugg

SEQ ID NO: 2099939 - RNA, 16 nt, Homo sapiens
uaaagacuugaugaau

SEQ ID NO: 2099940 - RNA, 18 nt, Homo sapiens
agugaaaccccaucucua

SEQ ID NO: 2099941 - RNA, 16 nt, Homo sapiens
cauuuucaaugcacau

SEQ ID NO: 2099942 - RNA, 18 nt, Homo sapiens
cccucuugccccaacccc

SEQ ID NO: 2099943 - RNA, 15 nt, Homo sapiens
uucuuugggcugugg

SEQ ID NO: 2099944 - RNA, 22 nt, Homo sapiens
aauuccuacugacaacauuaua

SEQ ID NO: 2099945 - RNA, 16 nt, Homo sapiens
uaaauagacacuugag

SEQ ID NO: 2099946 - RNA, 17 nt, Homo sapiens
ucaaaagauuaaugugu

SEQ ID NO: 2099947 - RNA, 18 nt, Homo sapiens
uuugaacagcuugcugcu

SEQ ID NO: 2099948 - RNA, 18 nt, Homo sapiens
aagggccagauuucauuc

SEQ ID NO: 2099949 - RNA, 18 nt, Homo sapiens
ucucaaaaugugaacuga

SEQ ID NO: 2099950 - RNA, 20 nt, Homo sapiens
gcugaauugcccguuuccau

SEQ ID NO: 2099951 - RNA, 15 nt, Homo sapiens
uacuuuuacucugcc

SEQ ID NO: 2099952 - RNA, 21 nt, Homo sapiens
ccuuucucuccagccugacuu

SEQ ID NO: 2099953 - RNA, 22 nt, Homo sapiens
ccgcaggugggugcugcccugu

SEQ ID NO: 2099954 - RNA, 21 nt, Homo sapiens
gaggaggauugcuucuuguga

SEQ ID NO: 2099955 - RNA, 17 nt, Homo sapiens
accacccucgcugccac

SEQ ID NO: 2099956 - RNA, 20 nt, Homo sapiens
gcucaggacacaagaacuaa

SEQ ID NO: 2099957 - RNA, 18 nt, Homo sapiens
accuggccucugcacucc

SEQ ID NO: 2099958 - RNA, 16 nt, Homo sapiens
gaagucacugcacagu

SEQ ID NO: 2099959 - RNA, 20 nt, Homo sapiens
uaugcucauugaacuuuaag

SEQ ID NO: 2099960 - RNA, 17 nt, Homo sapiens
guggaaggcagugaaca

SEQ ID NO: 2099961 - RNA, 20 nt, Homo sapiens
agacaggcaccccucccagc

SEQ ID NO: 2099962 - RNA, 12 nt, Homo sapiens
ucuguaccucaa

SEQ ID NO: 2099963 - RNA, 20 nt, Homo sapiens
uucaacaugucacacuggcu

SEQ ID NO: 2099964 - RNA, 22 nt, Homo sapiens
cuucaaaacaauauaaauggau

SEQ ID NO: 2099965 - RNA, 16 nt, Homo sapiens
gaaaaacagcauguac

SEQ ID NO: 2099966 - RNA, 19 nt, Homo sapiens
aauuuuccacuucuggcau

SEQ ID NO: 2099967 - RNA, 16 nt, Homo sapiens
ucacagcuccuuguga

SEQ ID NO: 2099968 - RNA, 15 nt, Homo sapiens
aauacccccagagac

SEQ ID NO: 2099969 - RNA, 18 nt, Homo sapiens
cuucuguauucauaagau

SEQ ID NO: 2099970 - RNA, 19 nt, Homo sapiens
uaacucccccucauucaca

SEQ ID NO: 2099971 - RNA, 13 nt, Homo sapiens
cagggcugugauc

SEQ ID NO: 2099972 - RNA, 13 nt, Homo sapiens
cagugcugugagc

SEQ ID NO: 2099973 - RNA, 14 nt, Homo sapiens
caguuuuuugccac

SEQ ID NO: 2099974 - RNA, 15 nt, Homo sapiens
caaaacuccgucuca

SEQ ID NO: 2099975 - RNA, 17 nt, Homo sapiens
ccuguggcugcccucca

SEQ ID NO: 2099976 - RNA, 20 nt, Homo sapiens
ugaggaaaacuguagucucu

SEQ ID NO: 2099977 - RNA, 20 nt, Homo sapiens
cugauggaaguaaagccuca

SEQ ID NO: 2099978 - RNA, 17 nt, Homo sapiens
acagugggggugccugg

SEQ ID NO: 2099979 - RNA, 16 nt, Homo sapiens
ccgcauggaacagugc

SEQ ID NO: 2099980 - RNA, 16 nt, Homo sapiens
cugggaagauaccagc

SEQ ID NO: 2099981 - RNA, 15 nt, Homo sapiens
agugcuaugacagag

SEQ ID NO: 2099982 - RNA, 15 nt, Homo sapiens
ucauguguugcuccc

SEQ ID NO: 2099983 - RNA, 18 nt, Homo sapiens
agagggcccccuacuugu

SEQ ID NO: 2099984 - RNA, 14 nt, Homo sapiens
auaaaauguauaaa

SEQ ID NO: 2099985 - RNA, 14 nt, Homo sapiens
uaauauugauuuau

SEQ ID NO: 2099986 - RNA, 21 nt, Homo sapiens
auuuccgugaacucuggugcu

SEQ ID NO: 2099987 - RNA, 14 nt, Homo sapiens
acuguuuaaucaua

SEQ ID NO: 2099988 - RNA, 16 nt, Homo sapiens
aaugcagaaguuacua

SEQ ID NO: 2099989 - RNA, 15 nt, Homo sapiens
accuaacucaugcca

SEQ ID NO: 2099990 - RNA, 17 nt, Homo sapiens
gccuuuugcuacgugcc

SEQ ID NO: 2099991 - RNA, 18 nt, Homo sapiens
ccuggcucugggggaccc

SEQ ID NO: 2099992 - RNA, 19 nt, Homo sapiens
augcugugagcauuaaaua

SEQ ID NO: 2099993 - RNA, 17 nt, Homo sapiens
gcagguuggaccccaga

SEQ ID NO: 2099994 - RNA, 22 nt, Homo sapiens
uacaguaggagcccagcucuga

SEQ ID NO: 2099995 - RNA, 13 nt, Homo sapiens
uucuuuuuugcca

SEQ ID NO: 2099996 - RNA, 18 nt, Homo sapiens
aaccuccuggguucaagc

SEQ ID NO: 2099997 - RNA, 23 nt, Homo sapiens
uccuuaaagcauuugcaacagcu

SEQ ID NO: 2099998 - RNA, 19 nt, Homo sapiens
cugaauucuucuagcuccu

SEQ ID NO: 2099999 - RNA, 15 nt, Homo sapiens
ucuggcccacacaga

SEQ ID NO: 2100000 - RNA, 13 nt, Homo sapiens
aggaaacaaacuc

SEQ ID NO: 2100001 - RNA, 12 nt, Homo sapiens
gcucacacagcu

SEQ ID NO: 2100002 - RNA, 17 nt, Homo sapiens
uuggacugucuauauca

SEQ ID NO: 2100003 - RNA, 14 nt, Homo sapiens
cagucuuucuauca

SEQ ID NO: 2100004 - RNA, 14 nt, Homo sapiens
ggagccccaagacu

SEQ ID NO: 2100005 - RNA, 18 nt, Homo sapiens
uggucuugagaugucuuc

SEQ ID NO: 2100006 - RNA, 14 nt, Homo sapiens
uuccaguacuaugg

SEQ ID NO: 2100007 - RNA, 16 nt, Homo sapiens
uauccaguugcaggua

SEQ ID NO: 2100008 - RNA, 15 nt, Homo sapiens
acagcagcaucuuca

SEQ ID NO: 2100009 - RNA, 13 nt, Homo sapiens
cuauuccuaggcc

SEQ ID NO: 2100010 - RNA, 18 nt, Homo sapiens
ucaguauguuuuacacug

SEQ ID NO: 2100011 - RNA, 14 nt, Homo sapiens
uggaggagacauga

SEQ ID NO: 2100012 - RNA, 21 nt, Homo sapiens
cucaucuccccaucauuggua

SEQ ID NO: 2100013 - RNA, 22 nt, Homo sapiens
aucuggcuuauuuuaaugugau

SEQ ID NO: 2100014 - RNA, 14 nt, Homo sapiens
aggaccuccgggga

SEQ ID NO: 2100015 - RNA, 20 nt, Homo sapiens
aucaauaaagaccacuuuac

SEQ ID NO: 2100016 - RNA, 22 nt, Homo sapiens
guggccaggccuuacaucuggc

SEQ ID NO: 2100017 - RNA, 23 nt, Homo sapiens
acaguuucuggcuggcuucauua

SEQ ID NO: 2100018 - RNA, 14 nt, Homo sapiens
uacguacuaaggau

SEQ ID NO: 2100019 - RNA, 14 nt, Homo sapiens
ucccagauguaaag

SEQ ID NO: 2100020 - RNA, 22 nt, Homo sapiens
accucagggcuguguguacuaa

SEQ ID NO: 2100021 - RNA, 15 nt, Homo sapiens
caaguauuggcaaag

SEQ ID NO: 2100022 - RNA, 17 nt, Homo sapiens
gucgaauguuagauucc

SEQ ID NO: 2100023 - RNA, 14 nt, Homo sapiens
gaaacugaaacuca

SEQ ID NO: 2100024 - RNA, 14 nt, Homo sapiens
acagugggaaauau

SEQ ID NO: 2100025 - RNA, 16 nt, Homo sapiens
cagccuggggugaccu

SEQ ID NO: 2100026 - RNA, 16 nt, Homo sapiens
caaugagaucauugug

SEQ ID NO: 2100027 - RNA, 15 nt, Homo sapiens
uaccaugccucucca

SEQ ID NO: 2100028 - RNA, 20 nt, Homo sapiens
gaacagguguuuuuccacaa

SEQ ID NO: 2100029 - RNA, 18 nt, Homo sapiens
gcugggguagaacuggcu

SEQ ID NO: 2100030 - RNA, 17 nt, Homo sapiens
uuuuuccuuuuaccuuu

SEQ ID NO: 2100031 - RNA, 16 nt, Homo sapiens
uaaauaauuugcacug

SEQ ID NO: 2100032 - RNA, 22 nt, Homo sapiens
aauaauuaccaauaucuugcca

SEQ ID NO: 2100033 - RNA, 18 nt, Homo sapiens
ugcccaccugucaaacaa

SEQ ID NO: 2100034 - RNA, 13 nt, Homo sapiens
cugggaaccagca

SEQ ID NO: 2100035 - RNA, 17 nt, Homo sapiens
ccaucccucggacccac

SEQ ID NO: 2100036 - RNA, 18 nt, Homo sapiens
caagaauuguccaugugc

SEQ ID NO: 2100037 - RNA, 20 nt, Homo sapiens
cauggcacucccuccagcac

SEQ ID NO: 2100038 - RNA, 14 nt, Homo sapiens
cuugacuuugccac

SEQ ID NO: 2100039 - RNA, 15 nt, Homo sapiens
uaagcaacuguaaaa

SEQ ID NO: 2100040 - RNA, 22 nt, Homo sapiens
ugggcauugcagccuugcgcug

SEQ ID NO: 2100041 - RNA, 23 nt, Homo sapiens
auaacucuacccuggcacuauaa

SEQ ID NO: 2100042 - RNA, 21 nt, Homo sapiens
uaagcccaauaucagcucuuu

SEQ ID NO: 2100043 - RNA, 21 nt, Homo sapiens
uuucaccgggcaauccaagua

SEQ ID NO: 2100044 - RNA, 14 nt, Homo sapiens
ugggcacuaagggu

SEQ ID NO: 2100045 - RNA, 21 nt, Homo sapiens
gccaggggcuucccacuuugg

SEQ ID NO: 2100046 - RNA, 23 nt, Homo sapiens
acgccgugcggcgggccagcugg

SEQ ID NO: 2100047 - RNA, 17 nt, Homo sapiens
ugcaggagagacaguga

SEQ ID NO: 2100048 - RNA, 21 nt, Homo sapiens
cauauggucauccaaauggac

SEQ ID NO: 2100049 - RNA, 16 nt, Homo sapiens
cuucaugucuaggaua

SEQ ID NO: 2100050 - RNA, 15 nt, Homo sapiens
ucauaguuacugugu

SEQ ID NO: 2100051 - RNA, 15 nt, Homo sapiens
agagucauuguuaca

SEQ ID NO: 2100052 - RNA, 17 nt, Homo sapiens
auugauaaguucauaca

SEQ ID NO: 2100053 - RNA, 12 nt, Homo sapiens
guaaacuuccaa

SEQ ID NO: 2100054 - RNA, 14 nt, Homo sapiens
uuaaaguguaagaa

SEQ ID NO: 2100055 - RNA, 18 nt, Homo sapiens
guuuuccuuuuguuuucc

SEQ ID NO: 2100056 - RNA, 23 nt, Homo sapiens
uacaggggggucggaagccuguc

SEQ ID NO: 2100057 - RNA, 20 nt, Homo sapiens
ucuugaaguuacacauaacu

SEQ ID NO: 2100058 - RNA, 18 nt, Homo sapiens
cauuauuucaucaugacu

SEQ ID NO: 2100059 - RNA, 16 nt, Homo sapiens
caagaggagacuuuaa

SEQ ID NO: 2100060 - RNA, 17 nt, Homo sapiens
auuuuaacugauuuaac

SEQ ID NO: 2100061 - RNA, 15 nt, Homo sapiens
gagugcgccucacca

SEQ ID NO: 2100062 - RNA, 22 nt, Homo sapiens
ggcauuuucuugguagcacaaa

SEQ ID NO: 2100063 - RNA, 19 nt, Homo sapiens
agacuaguugaacaucuca

SEQ ID NO: 2100064 - RNA, 16 nt, Homo sapiens
gacauauuacuggaag

SEQ ID NO: 2100065 - RNA, 21 nt, Homo sapiens
ccagaguuggacccgacccca

SEQ ID NO: 2100066 - RNA, 21 nt, Homo sapiens
agugaguucccuuagugaauu

SEQ ID NO: 2100067 - RNA, 23 nt, Homo sapiens
cucccuucuacugcuucuaccaa

SEQ ID NO: 2100068 - RNA, 11 nt, Homo sapiens
uaaugcuucuu

SEQ ID NO: 2100069 - RNA, 18 nt, Homo sapiens
uaaggggccugcccucau

SEQ ID NO: 2100070 - RNA, 22 nt, Homo sapiens
ugagcgucaaagaaaaugccua

SEQ ID NO: 2100071 - RNA, 17 nt, Homo sapiens
uguaaauugcaaauaaa

SEQ ID NO: 2100072 - RNA, 17 nt, Homo sapiens
caagucacagaaaaugc

SEQ ID NO: 2100073 - RNA, 17 nt, Homo sapiens
ccaagaaaaaaaauaga

SEQ ID NO: 2100074 - RNA, 16 nt, Homo sapiens
ucuaaacuuuaauuca

SEQ ID NO: 2100075 - RNA, 16 nt, Homo sapiens
ugacacacagcacucu

SEQ ID NO: 2100076 - RNA, 17 nt, Homo sapiens
uuagcaauugacuguca

SEQ ID NO: 2100077 - RNA, 20 nt, Homo sapiens
accgcaggugcucaugcugc

SEQ ID NO: 2100078 - RNA, 15 nt, Homo sapiens
ugcuggaacacugcu

SEQ ID NO: 2100079 - RNA, 13 nt, Homo sapiens
agucauccucaga

SEQ ID NO: 2100080 - RNA, 22 nt, Homo sapiens
aaauguagcccugcauccucca

SEQ ID NO: 2100081 - RNA, 20 nt, Homo sapiens
auguaccguugauguugaua

SEQ ID NO: 2100082 - RNA, 23 nt, Homo sapiens
uuucuaacuuuaugaacucccuc

SEQ ID NO: 2100083 - RNA, 17 nt, Homo sapiens
cauauucuguucacuug

SEQ ID NO: 2100084 - RNA, 20 nt, Homo sapiens
cuuggccugaccuggcacag

SEQ ID NO: 2100085 - RNA, 19 nt, Homo sapiens
ggcucgucagccaccuggg

SEQ ID NO: 2100086 - RNA, 20 nt, Homo sapiens
gaugggagaaucacuugaac

SEQ ID NO: 2100087 - RNA, 18 nt, Homo sapiens
acuuuguggucgacauca

SEQ ID NO: 2100088 - RNA, 13 nt, Homo sapiens
ugaucacuguaaa

SEQ ID NO: 2100089 - RNA, 15 nt, Homo sapiens
uaauuaauugucauu

SEQ ID NO: 2100090 - RNA, 11 nt, Homo sapiens
gcucauuucau

SEQ ID NO: 2100091 - RNA, 19 nt, Homo sapiens
ucuuuaguguucaaauacu

SEQ ID NO: 2100092 - RNA, 20 nt, Homo sapiens
gaccuucauuucuagguucu

SEQ ID NO: 2100093 - RNA, 16 nt, Homo sapiens
cugaauucucugcuca

SEQ ID NO: 2100094 - RNA, 16 nt, Homo sapiens
agucugaugcucaaca

SEQ ID NO: 2100095 - RNA, 16 nt, Homo sapiens
uuggagcagaaagcca

SEQ ID NO: 2100096 - RNA, 23 nt, Homo sapiens
guaaauuuuaauguuaacuuuca

SEQ ID NO: 2100097 - RNA, 21 nt, Homo sapiens
agcacugacugggaccaggca

SEQ ID NO: 2100098 - RNA, 14 nt, Homo sapiens
auaaaaacaaauac

SEQ ID NO: 2100099 - RNA, 14 nt, Homo sapiens
uucuaaacuacaac

SEQ ID NO: 2100100 - RNA, 17 nt, Homo sapiens
uguauaguauuugaaaa

SEQ ID NO: 2100101 - RNA, 19 nt, Homo sapiens
aaacaggucgagcugugcu

SEQ ID NO: 2100102 - RNA, 18 nt, Homo sapiens
auuaaauggcaucagcac

SEQ ID NO: 2100103 - RNA, 16 nt, Homo sapiens
gcucagcccugcacca

SEQ ID NO: 2100104 - RNA, 13 nt, Homo sapiens
auaaguugcagaa

SEQ ID NO: 2100105 - RNA, 18 nt, Homo sapiens
ucuccauaggacaggaag

SEQ ID NO: 2100106 - RNA, 15 nt, Homo sapiens
accuacauuaucuca

SEQ ID NO: 2100107 - RNA, 19 nt, Homo sapiens
cacuacugggugucauuuc

SEQ ID NO: 2100108 - RNA, 15 nt, Homo sapiens
cgagaggcucugagg

SEQ ID NO: 2100109 - RNA, 17 nt, Homo sapiens
gcccaguuucugccucu

SEQ ID NO: 2100110 - RNA, 15 nt, Homo sapiens
uguggauaugagcuu

SEQ ID NO: 2100111 - RNA, 18 nt, Homo sapiens
uuucugagacagcuuguc

SEQ ID NO: 2100112 - RNA, 22 nt, Homo sapiens
aaaguaugcaugcagucuugua

SEQ ID NO: 2100113 - RNA, 15 nt, Homo sapiens
cauuuauuugaaaaa

SEQ ID NO: 2100114 - RNA, 22 nt, Homo sapiens
cucuaauguacaauaaagcaau

SEQ ID NO: 2100115 - RNA, 15 nt, Homo sapiens
auucuaaucuaacaa

SEQ ID NO: 2100116 - RNA, 14 nt, Homo sapiens
ggagaacuauccaa

SEQ ID NO: 2100117 - RNA, 19 nt, Homo sapiens
aaacucuggggcucaagca

SEQ ID NO: 2100118 - RNA, 21 nt, Homo sapiens
gaaguaccuuuguuacagcua

SEQ ID NO: 2100119 - RNA, 21 nt, Homo sapiens
cucucuggucuuuuggauuau

SEQ ID NO: 2100120 - RNA, 20 nt, Homo sapiens
caccccuacucuauucugua

SEQ ID NO: 2100121 - RNA, 18 nt, Homo sapiens
guguucauccagcuacuu

SEQ ID NO: 2100122 - RNA, 15 nt, Homo sapiens
acaaccuuccagcuc

SEQ ID NO: 2100123 - RNA, 22 nt, Homo sapiens
ugggaaggguccaucucagaga

SEQ ID NO: 2100124 - RNA, 16 nt, Homo sapiens
cucucugcucagugau

SEQ ID NO: 2100125 - RNA, 13 nt, Homo sapiens
agggcugacauuu

SEQ ID NO: 2100126 - RNA, 17 nt, Homo sapiens
aagcaugugagacuggu

SEQ ID NO: 2100127 - RNA, 23 nt, Homo sapiens
aauccugcccccagccaugguga

SEQ ID NO: 2100128 - RNA, 18 nt, Homo sapiens
guacugguugacuuucua

SEQ ID NO: 2100129 - RNA, 19 nt, Homo sapiens
ucagcugcuuuguuaccuu

SEQ ID NO: 2100130 - RNA, 13 nt, Homo sapiens
ggcaggagaagaa

SEQ ID NO: 2100131 - RNA, 11 nt, Homo sapiens
cugccagagaa

SEQ ID NO: 2100132 - RNA, 16 nt, Homo sapiens
uguccguccucuuccc

SEQ ID NO: 2100133 - RNA, 16 nt, Homo sapiens
uggagucucacugucu

SEQ ID NO: 2100134 - RNA, 16 nt, Homo sapiens
ccuaugcacauaugga

SEQ ID NO: 2100135 - RNA, 21 nt, Homo sapiens
agaaaaaaaacuuuggcuuuc

SEQ ID NO: 2100136 - RNA, 15 nt, Homo sapiens
ugucucaccuaccca

SEQ ID NO: 2100137 - RNA, 16 nt, Homo sapiens
gaggaugugucucccu

SEQ ID NO: 2100138 - RNA, 18 nt, Homo sapiens
uuuuuauucugaauaaua

SEQ ID NO: 2100139 - RNA, 19 nt, Homo sapiens
cagcuaaggacauuuccca

SEQ ID NO: 2100140 - RNA, 16 nt, Homo sapiens
uuuccuugucucucau

SEQ ID NO: 2100141 - RNA, 14 nt, Homo sapiens
ucauacuuccaucu

SEQ ID NO: 2100142 - RNA, 21 nt, Homo sapiens
uggauacacucucuagcuuua

SEQ ID NO: 2100143 - RNA, 14 nt, Homo sapiens
aguaauacaaacua

SEQ ID NO: 2100144 - RNA, 20 nt, Homo sapiens
gcaacuggcucaaagacaau

SEQ ID NO: 2100145 - RNA, 15 nt, Homo sapiens
aaaguuuugguuauu

SEQ ID NO: 2100146 - RNA, 16 nt, Homo sapiens
ccuggagccagggcag

SEQ ID NO: 2100147 - RNA, 14 nt, Homo sapiens
aggacuccucagaa

SEQ ID NO: 2100148 - RNA, 23 nt, Homo sapiens
uguuuaugccacagaauuugcua

SEQ ID NO: 2100149 - RNA, 13 nt, Homo sapiens
uuugguuuuacau

SEQ ID NO: 2100150 - RNA, 20 nt, Homo sapiens
guuguagcagugauucagua

SEQ ID NO: 2100151 - RNA, 17 nt, Homo sapiens
ugagcagaauacugguc

SEQ ID NO: 2100152 - RNA, 13 nt, Homo sapiens
guucuaugcagaa

SEQ ID NO: 2100153 - RNA, 11 nt, Homo sapiens
uacuucauuaa

SEQ ID NO: 2100154 - RNA, 15 nt, Homo sapiens
cccagggaacagcca

SEQ ID NO: 2100155 - RNA, 22 nt, Homo sapiens
aaaaauauaaccauuacauguu

SEQ ID NO: 2100156 - RNA, 23 nt, Homo sapiens
accccuuacuuagcaugcacaaa

SEQ ID NO: 2100157 - RNA, 17 nt, Homo sapiens
auuuguuaugauaaaag

SEQ ID NO: 2100158 - RNA, 22 nt, Homo sapiens
aucuuaaaaguguuguuaucau

SEQ ID NO: 2100159 - RNA, 23 nt, Homo sapiens
aguuuauuuuuuaaaauucuaag

SEQ ID NO: 2100160 - RNA, 18 nt, Homo sapiens
cucuuaaucacuacugua

SEQ ID NO: 2100161 - RNA, 21 nt, Homo sapiens
ccaguggaagaagaaaacacu

SEQ ID NO: 2100162 - RNA, 16 nt, Homo sapiens
uauuaaaccuuuccau

SEQ ID NO: 2100163 - RNA, 21 nt, Homo sapiens
aaucacaacacagagcugcua

SEQ ID NO: 2100164 - RNA, 12 nt, Homo sapiens
cauucauuugca

SEQ ID NO: 2100165 - RNA, 12 nt, Homo sapiens
uguucauucaca

SEQ ID NO: 2100166 - RNA, 16 nt, Homo sapiens
agagcaguguggaaaa

SEQ ID NO: 2100167 - RNA, 23 nt, Homo sapiens
gcuaaggcugccucagaccugac

SEQ ID NO: 2100168 - RNA, 17 nt, Homo sapiens
aacuccaucucuacuga

SEQ ID NO: 2100169 - RNA, 17 nt, Homo sapiens
ucagucuagcuuuuaag

SEQ ID NO: 2100170 - RNA, 20 nt, Homo sapiens
auggucacccccacucugca

SEQ ID NO: 2100171 - RNA, 17 nt, Homo sapiens
agggaacgguccaugaa

SEQ ID NO: 2100172 - RNA, 19 nt, Homo sapiens
aaacuccacaucugccuua

SEQ ID NO: 2100173 - RNA, 14 nt, Homo sapiens
ucuucugucucaua

SEQ ID NO: 2100174 - RNA, 15 nt, Homo sapiens
cuuuugacauccagc

SEQ ID NO: 2100175 - RNA, 13 nt, Homo sapiens
ggaaaaacuggcu

SEQ ID NO: 2100176 - RNA, 17 nt, Homo sapiens
auguguauggaagacaa

SEQ ID NO: 2100177 - RNA, 13 nt, Homo sapiens
uggugcaaucaca

SEQ ID NO: 2100178 - RNA, 15 nt, Homo sapiens
aauugucaaauguca

SEQ ID NO: 2100179 - RNA, 20 nt, Homo sapiens
agucauauugaggcauucaa

SEQ ID NO: 2100180 - RNA, 16 nt, Homo sapiens
aaaugggccauuccag

SEQ ID NO: 2100181 - RNA, 18 nt, Homo sapiens
auucaguucccaccaucu

SEQ ID NO: 2100182 - RNA, 20 nt, Homo sapiens
ucccgaguaacugagauuac

SEQ ID NO: 2100183 - RNA, 13 nt, Homo sapiens
uccacuucuuuca

SEQ ID NO: 2100184 - RNA, 19 nt, Homo sapiens
uagaaaucacaagaacaaa

SEQ ID NO: 2100185 - RNA, 18 nt, Homo sapiens
ucuacuuccccauuucag

SEQ ID NO: 2100186 - RNA, 16 nt, Homo sapiens
gucuuaucuaccaguu

SEQ ID NO: 2100187 - RNA, 18 nt, Homo sapiens
caaagucugcaacuuuaa

SEQ ID NO: 2100188 - RNA, 18 nt, Homo sapiens
agugaauaaccacuuaaa

SEQ ID NO: 2100189 - RNA, 22 nt, Homo sapiens
ucaaagacaauggaaacuguac

SEQ ID NO: 2100190 - RNA, 21 nt, Homo sapiens
aaugguaaaauugcauggguu

SEQ ID NO: 2100191 - RNA, 18 nt, Homo sapiens
ccucuaagaucuugccuc

SEQ ID NO: 2100192 - RNA, 19 nt, Homo sapiens
agcccugguaaaagggaua

SEQ ID NO: 2100193 - RNA, 20 nt, Homo sapiens
aauaguuuaucauuuacugu

SEQ ID NO: 2100194 - RNA, 15 nt, Homo sapiens
aguacuuuauuguac

SEQ ID NO: 2100195 - RNA, 17 nt, Homo sapiens
gacacccuucucccacu

SEQ ID NO: 2100196 - RNA, 15 nt, Homo sapiens
aaacuaguggcaaua

SEQ ID NO: 2100197 - RNA, 20 nt, Homo sapiens
ucaaaaugagucaggcaauu

SEQ ID NO: 2100198 - RNA, 17 nt, Homo sapiens
cauaagcgaucacuucc

SEQ ID NO: 2100199 - RNA, 12 nt, Homo sapiens
cuugugucacau

SEQ ID NO: 2100200 - RNA, 16 nt, Homo sapiens
ccagguaggaugaaca

SEQ ID NO: 2100201 - RNA, 18 nt, Homo sapiens
gccucauccuccacugaa

SEQ ID NO: 2100202 - RNA, 18 nt, Homo sapiens
uucuuagcccucuagaaa

SEQ ID NO: 2100203 - RNA, 23 nt, Homo sapiens
uagcagaguccuuauucuucuca

SEQ ID NO: 2100204 - RNA, 18 nt, Homo sapiens
aaaguccagguuagcaca

SEQ ID NO: 2100205 - RNA, 21 nt, Homo sapiens
ccaagcuuucagacaagaaug

SEQ ID NO: 2100206 - RNA, 23 nt, Homo sapiens
aaaguauuuaaauguuugccaaa

SEQ ID NO: 2100207 - RNA, 22 nt, Homo sapiens
aguauugaauacuuacauucuc

SEQ ID NO: 2100208 - RNA, 14 nt, Homo sapiens
cagucaccuaucca

SEQ ID NO: 2100209 - RNA, 19 nt, Homo sapiens
aguauuuuuauccaugaca

SEQ ID NO: 2100210 - RNA, 22 nt, Homo sapiens
aguagacaugugugugugugaa

SEQ ID NO: 2100211 - RNA, 12 nt, Homo sapiens
cccaaauguccc

SEQ ID NO: 2100212 - RNA, 14 nt, Homo sapiens
acugaugugugcaa

SEQ ID NO: 2100213 - RNA, 15 nt, Homo sapiens
agcucaggauggcuc

SEQ ID NO: 2100214 - RNA, 21 nt, Homo sapiens
gucuaggcuggaagagccaaa

SEQ ID NO: 2100215 - RNA, 19 nt, Homo sapiens
aguaagagguuaugccaaa

SEQ ID NO: 2100216 - RNA, 16 nt, Homo sapiens
aggagucucacugggc

SEQ ID NO: 2100217 - RNA, 23 nt, Homo sapiens
acuccugaagggaaggcaaaggc

SEQ ID NO: 2100218 - RNA, 18 nt, Homo sapiens
ucaauauccuuugccuca

SEQ ID NO: 2100219 - RNA, 17 nt, Homo sapiens
ucccacccuuucugcca

SEQ ID NO: 2100220 - RNA, 17 nt, Homo sapiens
ggcaagagaauugaaau

SEQ ID NO: 2100221 - RNA, 15 nt, Homo sapiens
uuaauuuauguaucu

SEQ ID NO: 2100222 - RNA, 17 nt, Homo sapiens
uugaauauauaugauga

SEQ ID NO: 2100223 - RNA, 14 nt, Homo sapiens
cuguacuaggauua

SEQ ID NO: 2100224 - RNA, 19 nt, Homo sapiens
cauuagaacacugcauuag

SEQ ID NO: 2100225 - RNA, 22 nt, Homo sapiens
gggcugacuccugcucucugga

SEQ ID NO: 2100226 - RNA, 21 nt, Homo sapiens
acauugugacuguguuugcau

SEQ ID NO: 2100227 - RNA, 14 nt, Homo sapiens
gaaaagaccccaga

SEQ ID NO: 2100228 - RNA, 21 nt, Homo sapiens
cuguuccuuaugauauucuca

SEQ ID NO: 2100229 - RNA, 18 nt, Homo sapiens
agcaaguaagcuagccag

SEQ ID NO: 2100230 - RNA, 21 nt, Homo sapiens
cauuugcucuucauccaggga

SEQ ID NO: 2100231 - RNA, 16 nt, Homo sapiens
cuuacaguuaggauuu

SEQ ID NO: 2100232 - RNA, 13 nt, Homo sapiens
caagaaucuccca

SEQ ID NO: 2100233 - RNA, 17 nt, Homo sapiens
ggguuggacaaccucau

SEQ ID NO: 2100234 - RNA, 16 nt, Homo sapiens
uccccuauuaggcagg

SEQ ID NO: 2100235 - RNA, 18 nt, Homo sapiens
gccucugugccauggaug

SEQ ID NO: 2100236 - RNA, 20 nt, Homo sapiens
acacgcacacaucuuaccuc

SEQ ID NO: 2100237 - RNA, 19 nt, Homo sapiens
ccacuaagagaauacagga

SEQ ID NO: 2100238 - RNA, 14 nt, Homo sapiens
uggaaggugcuacu

SEQ ID NO: 2100239 - RNA, 14 nt, Homo sapiens
aacguacccaaggu

SEQ ID NO: 2100240 - RNA, 18 nt, Homo sapiens
cauucuucugagcacugu

SEQ ID NO: 2100241 - RNA, 16 nt, Homo sapiens
uaccugagacuuaaga

SEQ ID NO: 2100242 - RNA, 16 nt, Homo sapiens
auugauggagccugaa

SEQ ID NO: 2100243 - RNA, 14 nt, Homo sapiens
auuccgucuuaaaa

SEQ ID NO: 2100244 - RNA, 23 nt, Homo sapiens
ccugugaugcuuugaaguacaau

SEQ ID NO: 2100245 - RNA, 17 nt, Homo sapiens
aaggguuuuaagccagg

SEQ ID NO: 2100246 - RNA, 18 nt, Homo sapiens
caaaaugaugucauguca

SEQ ID NO: 2100247 - RNA, 15 nt, Homo sapiens
gccccuuuucuuugg

SEQ ID NO: 2100248 - RNA, 20 nt, Homo sapiens
acccugagcagaauacuggu

SEQ ID NO: 2100249 - RNA, 17 nt, Homo sapiens
guaauuuugaacuguuu

SEQ ID NO: 2100250 - RNA, 14 nt, Homo sapiens
cuccuguaccucag

SEQ ID NO: 2100251 - RNA, 14 nt, Homo sapiens
auuuuagauauuau

SEQ ID NO: 2100252 - RNA, 20 nt, Homo sapiens
gugugugcaaguaugugagu

SEQ ID NO: 2100253 - RNA, 20 nt, Homo sapiens
acaugauccugcaauuccac

SEQ ID NO: 2100254 - RNA, 19 nt, Homo sapiens
uaaaauauuguugaacacu

SEQ ID NO: 2100255 - RNA, 18 nt, Homo sapiens
aacacccauuuuugcucu

SEQ ID NO: 2100256 - RNA, 22 nt, Homo sapiens
cugcuugguguaaaccauucuu

SEQ ID NO: 2100257 - RNA, 20 nt, Homo sapiens
agaaagcaguucugaugcuu

SEQ ID NO: 2100258 - RNA, 20 nt, Homo sapiens
ucacaacacaaucaaaagau

SEQ ID NO: 2100259 - RNA, 20 nt, Homo sapiens
ccugacuuaugaaacuugaa

SEQ ID NO: 2100260 - RNA, 19 nt, Homo sapiens
acaugcuucagugcugcuc

SEQ ID NO: 2100261 - RNA, 19 nt, Homo sapiens
cuacagggagaaaauccag

SEQ ID NO: 2100262 - RNA, 20 nt, Homo sapiens
uuuauuccccagugacucca

SEQ ID NO: 2100263 - RNA, 22 nt, Homo sapiens
cucuucugaauaaagcaauuag

SEQ ID NO: 2100264 - RNA, 20 nt, Homo sapiens
aucagugacugaauucugcc

SEQ ID NO: 2100265 - RNA, 20 nt, Homo sapiens
uuuuauauauauaaagucag

SEQ ID NO: 2100266 - RNA, 16 nt, Homo sapiens
caguaaccucggagac

SEQ ID NO: 2100267 - RNA, 17 nt, Homo sapiens
cacccaucucucaggaa

SEQ ID NO: 2100268 - RNA, 19 nt, Homo sapiens
ugaagcuuuuaugugaaac

SEQ ID NO: 2100269 - RNA, 19 nt, Homo sapiens
uuccuuggcaguggacuca

SEQ ID NO: 2100270 - RNA, 17 nt, Homo sapiens
ccuucuucuuuuugcug

SEQ ID NO: 2100271 - RNA, 15 nt, Homo sapiens
aguuccgucuucccu

SEQ ID NO: 2100272 - RNA, 17 nt, Homo sapiens
auuuacuuuaagcauug

SEQ ID NO: 2100273 - RNA, 17 nt, Homo sapiens
ugugaaagugccaaaau

SEQ ID NO: 2100274 - RNA, 17 nt, Homo sapiens
agaggaagaaaaccagc

SEQ ID NO: 2100275 - RNA, 17 nt, Homo sapiens
caacauuaaacacaaag

SEQ ID NO: 2100276 - RNA, 18 nt, Homo sapiens
ccaguguuccugaagcug

SEQ ID NO: 2100277 - RNA, 18 nt, Homo sapiens
ucaccuggcuucccagga

SEQ ID NO: 2100278 - RNA, 19 nt, Homo sapiens
aagagggaaugagcuucca

SEQ ID NO: 2100279 - RNA, 21 nt, Homo sapiens
ucccgagucaugcacucaggc

SEQ ID NO: 2100280 - RNA, 18 nt, Homo sapiens
ccaaaaauggcagugacu

SEQ ID NO: 2100281 - RNA, 19 nt, Homo sapiens
uauauauuuuuucaauuua

SEQ ID NO: 2100282 - RNA, 14 nt, Homo sapiens
ugcccucagauucc

SEQ ID NO: 2100283 - RNA, 17 nt, Homo sapiens
uagcuuaccugggcaca

SEQ ID NO: 2100284 - RNA, 15 nt, Homo sapiens
cagacuccaaaaggc

SEQ ID NO: 2100285 - RNA, 19 nt, Homo sapiens
uccaauuggguugugaaau

SEQ ID NO: 2100286 - RNA, 19 nt, Homo sapiens
caguaacccccacuggacu

SEQ ID NO: 2100287 - RNA, 13 nt, Homo sapiens
ugcuuaagccauc

SEQ ID NO: 2100288 - RNA, 20 nt, Homo sapiens
uauaacaauucaguaacaaa

SEQ ID NO: 2100289 - RNA, 15 nt, Homo sapiens
accagggcucagcuc

SEQ ID NO: 2100290 - RNA, 18 nt, Homo sapiens
gccuguccaacaugguga

SEQ ID NO: 2100291 - RNA, 18 nt, Homo sapiens
uucuaaguauuuuauucc

SEQ ID NO: 2100292 - RNA, 22 nt, Homo sapiens
agauguuuuacgucugggagaa

SEQ ID NO: 2100293 - RNA, 22 nt, Homo sapiens
gucuuuuucgccaaacugucuc

SEQ ID NO: 2100294 - RNA, 14 nt, Homo sapiens
cccugcuccugcag

SEQ ID NO: 2100295 - RNA, 16 nt, Homo sapiens
auggugugaguccaaa

SEQ ID NO: 2100296 - RNA, 15 nt, Homo sapiens
ggcucuuucagagag

SEQ ID NO: 2100297 - RNA, 11 nt, Homo sapiens
cuguucucugc

SEQ ID NO: 2100298 - RNA, 19 nt, Homo sapiens
aacagucuggcgucuccag

SEQ ID NO: 2100299 - RNA, 22 nt, Homo sapiens
cucucuaagugggcauugccau

SEQ ID NO: 2100300 - RNA, 12 nt, Homo sapiens
ucucuccacuga

SEQ ID NO: 2100301 - RNA, 22 nt, Homo sapiens
aauaugcaucuggcccaggaau

SEQ ID NO: 2100302 - RNA, 21 nt, Homo sapiens
acagacacuuuaaaagcuucu

SEQ ID NO: 2100303 - RNA, 18 nt, Homo sapiens
ugauucuaauggggacac

SEQ ID NO: 2100304 - RNA, 14 nt, Homo sapiens
ucacacacaugcac

SEQ ID NO: 2100305 - RNA, 23 nt, Homo sapiens
cccacccuacgcucaucucugga

SEQ ID NO: 2100306 - RNA, 21 nt, Homo sapiens
uguccaccagacccaccugga

SEQ ID NO: 2100307 - RNA, 18 nt, Homo sapiens
cuaugcuacccuuaauaa

SEQ ID NO: 2100308 - RNA, 14 nt, Homo sapiens
aagaugauuucuca

SEQ ID NO: 2100309 - RNA, 20 nt, Homo sapiens
aggaauaacaucaccacugu

SEQ ID NO: 2100310 - RNA, 21 nt, Homo sapiens
cuguauuuuuauuuuugcaca

SEQ ID NO: 2100311 - RNA, 13 nt, Homo sapiens
agguucucagcaa

SEQ ID NO: 2100312 - RNA, 22 nt, Homo sapiens
uggguaugcucguuucucucaa

SEQ ID NO: 2100313 - RNA, 13 nt, Homo sapiens
uaacaagucauuu

SEQ ID NO: 2100314 - RNA, 12 nt, Homo sapiens
ccucagauuccg

SEQ ID NO: 2100315 - RNA, 16 nt, Homo sapiens
uuaaaagcacacuccc

SEQ ID NO: 2100316 - RNA, 19 nt, Homo sapiens
cagaccaaggaacaagacc

SEQ ID NO: 2100317 - RNA, 16 nt, Homo sapiens
caccaccuucccagcu

SEQ ID NO: 2100318 - RNA, 21 nt, Homo sapiens
aaaggaucucugagaccacag

SEQ ID NO: 2100319 - RNA, 17 nt, Homo sapiens
auuuuaauuuguauuga

SEQ ID NO: 2100320 - RNA, 18 nt, Homo sapiens
ugugcaauugauauugcc

SEQ ID NO: 2100321 - RNA, 18 nt, Homo sapiens
aggagaugaccagugccu

SEQ ID NO: 2100322 - RNA, 21 nt, Homo sapiens
cuguuccagucacauugccau

SEQ ID NO: 2100323 - RNA, 22 nt, Homo sapiens
gaaaguagaaauuuaccaaggu

SEQ ID NO: 2100324 - RNA, 12 nt, Homo sapiens
uuggucaggggg

SEQ ID NO: 2100325 - RNA, 13 nt, Homo sapiens
gacaggauguguu

SEQ ID NO: 2100326 - RNA, 17 nt, Homo sapiens
cagugccugacuuggga

SEQ ID NO: 2100327 - RNA, 22 nt, Homo sapiens
ucuccgcaacagccaaguggaa

SEQ ID NO: 2100328 - RNA, 17 nt, Homo sapiens
uucaugaaauuauccau

SEQ ID NO: 2100329 - RNA, 23 nt, Homo sapiens
aagcccuuccuaccucuggugau

SEQ ID NO: 2100330 - RNA, 13 nt, Homo sapiens
cuccgacucugca

SEQ ID NO: 2100331 - RNA, 13 nt, Homo sapiens
aucagacuaugaa

SEQ ID NO: 2100332 - RNA, 21 nt, Homo sapiens
cucugggagcucaagugaucc

SEQ ID NO: 2100333 - RNA, 17 nt, Homo sapiens
ugaucaagaaugcaaua

SEQ ID NO: 2100334 - RNA, 15 nt, Homo sapiens
ugggucauucucacc

SEQ ID NO: 2100335 - RNA, 18 nt, Homo sapiens
gguaaccucuacuaugaa

SEQ ID NO: 2100336 - RNA, 23 nt, Homo sapiens
uggagcaauaaaagacaaaugca

SEQ ID NO: 2100337 - RNA, 16 nt, Homo sapiens
guaucaucagugccuc

SEQ ID NO: 2100338 - RNA, 17 nt, Homo sapiens
auguaaaaaguguuuau

SEQ ID NO: 2100339 - RNA, 20 nt, Homo sapiens
gagagaggugccacacugaa

SEQ ID NO: 2100340 - RNA, 13 nt, Homo sapiens
cuaugaacaacuc

SEQ ID NO: 2100341 - RNA, 23 nt, Homo sapiens
uacagugaagaguaaguuuuccc

SEQ ID NO: 2100342 - RNA, 22 nt, Homo sapiens
acaagacauuucgaagucauca

SEQ ID NO: 2100343 - RNA, 15 nt, Homo sapiens
ucaggugccacugac

SEQ ID NO: 2100344 - RNA, 22 nt, Homo sapiens
gcuacugacuauggcuaccaaa

SEQ ID NO: 2100345 - RNA, 18 nt, Homo sapiens
auuaacacucauuuccaa

SEQ ID NO: 2100346 - RNA, 14 nt, Homo sapiens
aaccuaaugcucuc

SEQ ID NO: 2100347 - RNA, 17 nt, Homo sapiens
uaaaaucaagucuauaa

SEQ ID NO: 2100348 - RNA, 14 nt, Homo sapiens
cuucaccuuaggaa

SEQ ID NO: 2100349 - RNA, 14 nt, Homo sapiens
aacuguuguuuacu

SEQ ID NO: 2100350 - RNA, 20 nt, Homo sapiens
ucuccuguguaucuuugaag

SEQ ID NO: 2100351 - RNA, 15 nt, Homo sapiens
uaagucuuacauaaa

SEQ ID NO: 2100352 - RNA, 15 nt, Homo sapiens
ugaacaaacuaaagg

SEQ ID NO: 2100353 - RNA, 22 nt, Homo sapiens
aaucauaggcaccuuuuacugu

SEQ ID NO: 2100354 - RNA, 17 nt, Homo sapiens
uaaugucucuacaauuu

SEQ ID NO: 2100355 - RNA, 15 nt, Homo sapiens
ugcugcuuugcacac

SEQ ID NO: 2100356 - RNA, 16 nt, Homo sapiens
gcucacuauggucaaa

SEQ ID NO: 2100357 - RNA, 20 nt, Homo sapiens
uuaaagguguaaaauaacau

SEQ ID NO: 2100358 - RNA, 14 nt, Homo sapiens
gaaugaggcuugcu

SEQ ID NO: 2100359 - RNA, 20 nt, Homo sapiens
uauaaaaaagaaagaauuaa

SEQ ID NO: 2100360 - RNA, 15 nt, Homo sapiens
aaaagugaucucugg

SEQ ID NO: 2100361 - RNA, 13 nt, Homo sapiens
augccauuacaga

SEQ ID NO: 2100362 - RNA, 18 nt, Homo sapiens
cuuuucauguacagcauu

SEQ ID NO: 2100363 - RNA, 20 nt, Homo sapiens
uaauuaugaguuugcuuaug

SEQ ID NO: 2100364 - RNA, 13 nt, Homo sapiens
aaaggcaggcacu

SEQ ID NO: 2100365 - RNA, 13 nt, Homo sapiens
caucucccaugug

SEQ ID NO: 2100366 - RNA, 22 nt, Homo sapiens
cagcagccuccaacacaaggcu

SEQ ID NO: 2100367 - RNA, 22 nt, Homo sapiens
auauuuucuguguaagcuuuua

SEQ ID NO: 2100368 - RNA, 17 nt, Homo sapiens
cauuucuugauguugcu

SEQ ID NO: 2100369 - RNA, 22 nt, Homo sapiens
uuguaagugagagagacaagaa

SEQ ID NO: 2100370 - RNA, 14 nt, Homo sapiens
caaaauguuaauaa

SEQ ID NO: 2100371 - RNA, 13 nt, Homo sapiens
gacuuaaguagaa

SEQ ID NO: 2100372 - RNA, 19 nt, Homo sapiens
cccggcgggacugucaaug

SEQ ID NO: 2100373 - RNA, 22 nt, Homo sapiens
aaaugaugauggggugggagac

SEQ ID NO: 2100374 - RNA, 15 nt, Homo sapiens
ccaaggacuccaaag

SEQ ID NO: 2100375 - RNA, 18 nt, Homo sapiens
ccagcaguucucugccaa

SEQ ID NO: 2100376 - RNA, 19 nt, Homo sapiens
gaucacuucaggucaggag

SEQ ID NO: 2100377 - RNA, 17 nt, Homo sapiens
ugucccaaccccagugg

SEQ ID NO: 2100378 - RNA, 18 nt, Homo sapiens
aaucauaacucacuuuaa

SEQ ID NO: 2100379 - RNA, 17 nt, Homo sapiens
aagcaaguucgucuguu

SEQ ID NO: 2100380 - RNA, 23 nt, Homo sapiens
uugggagacauggaccagcaucu

SEQ ID NO: 2100381 - RNA, 20 nt, Homo sapiens
acaauuccauuuccaguuca

SEQ ID NO: 2100382 - RNA, 16 nt, Homo sapiens
aacccccaucucccua

SEQ ID NO: 2100383 - RNA, 13 nt, Homo sapiens
agcaaauguuaca

SEQ ID NO: 2100384 - RNA, 16 nt, Homo sapiens
cccaggaggugcagug

SEQ ID NO: 2100385 - RNA, 19 nt, Homo sapiens
ugcuaacuggacauucugg

SEQ ID NO: 2100386 - RNA, 21 nt, Homo sapiens
uuagccgggcaugauggugca

SEQ ID NO: 2100387 - RNA, 15 nt, Homo sapiens
aguuagcucauuuga

SEQ ID NO: 2100388 - RNA, 23 nt, Homo sapiens
gggcacccaaguugggauuucau

SEQ ID NO: 2100389 - RNA, 23 nt, Homo sapiens
gcccguguaaauauguacauuuc

SEQ ID NO: 2100390 - RNA, 18 nt, Homo sapiens
agcauuuucugcaucucc

SEQ ID NO: 2100391 - RNA, 20 nt, Homo sapiens
uuaccagaugcuacuggacu

SEQ ID NO: 2100392 - RNA, 14 nt, Homo sapiens
uuuaauuuugagau

SEQ ID NO: 2100393 - RNA, 15 nt, Homo sapiens
uccccccucacucca

SEQ ID NO: 2100394 - RNA, 20 nt, Homo sapiens
ugauaaauuugacuguuauu

SEQ ID NO: 2100395 - RNA, 19 nt, Homo sapiens
ugcuguaugugagcuguaa

SEQ ID NO: 2100396 - RNA, 16 nt, Homo sapiens
uugugucagauuacca

SEQ ID NO: 2100397 - RNA, 20 nt, Homo sapiens
cucagcucggggagccuuag

SEQ ID NO: 2100398 - RNA, 12 nt, Homo sapiens
aacacucuugaa

SEQ ID NO: 2100399 - RNA, 17 nt, Homo sapiens
aaagguuaacaguaaaa

SEQ ID NO: 2100400 - RNA, 20 nt, Homo sapiens
auugauuauuuugugcaaca

SEQ ID NO: 2100401 - RNA, 15 nt, Homo sapiens
gcucagucucaggag

SEQ ID NO: 2100402 - RNA, 20 nt, Homo sapiens
cuugauuuucuuucuccucu

SEQ ID NO: 2100403 - RNA, 20 nt, Homo sapiens
ugcuccaguauaaauuacau

SEQ ID NO: 2100404 - RNA, 17 nt, Homo sapiens
uggaguucuugugccau

SEQ ID NO: 2100405 - RNA, 22 nt, Homo sapiens
gaagaaaauuggacuggugaaa

SEQ ID NO: 2100406 - RNA, 15 nt, Homo sapiens
cguuaagugccccac

SEQ ID NO: 2100407 - RNA, 16 nt, Homo sapiens
aguucauaauguggug

SEQ ID NO: 2100408 - RNA, 12 nt, Homo sapiens
uacaaacauaag

SEQ ID NO: 2100409 - RNA, 17 nt, Homo sapiens
gagauaggguggcacau

SEQ ID NO: 2100410 - RNA, 23 nt, Homo sapiens
cuggguggauuauaaacaacaga

SEQ ID NO: 2100411 - RNA, 15 nt, Homo sapiens
uguuaauuguucaaa

SEQ ID NO: 2100412 - RNA, 14 nt, Homo sapiens
gaacuauaacuguu

SEQ ID NO: 2100413 - RNA, 19 nt, Homo sapiens
cucaucccacgcacuccau

SEQ ID NO: 2100414 - RNA, 18 nt, Homo sapiens
ugugcucaauguguaaau

SEQ ID NO: 2100415 - RNA, 23 nt, Homo sapiens
uggcggcccccccagcugucauc

SEQ ID NO: 2100416 - RNA, 21 nt, Homo sapiens
acauuuauagauaauugauau

SEQ ID NO: 2100417 - RNA, 18 nt, Homo sapiens
cagugcccaugcaauggc

SEQ ID NO: 2100418 - RNA, 14 nt, Homo sapiens
cucacaccaacagu

SEQ ID NO: 2100419 - RNA, 14 nt, Homo sapiens
cuaucuccaaauga

SEQ ID NO: 2100420 - RNA, 21 nt, Homo sapiens
guggagaaauacaucauuugc

SEQ ID NO: 2100421 - RNA, 18 nt, Homo sapiens
cacggcuuguaaauguga

SEQ ID NO: 2100422 - RNA, 17 nt, Homo sapiens
uggaaaguguguauuua

SEQ ID NO: 2100423 - RNA, 21 nt, Homo sapiens
uuaugagaacugguucuugcc

SEQ ID NO: 2100424 - RNA, 20 nt, Homo sapiens
uggucacccuucaacgcucc

SEQ ID NO: 2100425 - RNA, 13 nt, Homo sapiens
ucauggacaugaa

SEQ ID NO: 2100426 - RNA, 16 nt, Homo sapiens
ucauucacuaagccau

SEQ ID NO: 2100427 - RNA, 10 nt, Homo sapiens
caaaccacaa

SEQ ID NO: 2100428 - RNA, 19 nt, Homo sapiens
acuguguaccucauggaug

SEQ ID NO: 2100429 - RNA, 13 nt, Homo sapiens
ucguuaccagaga

SEQ ID NO: 2100430 - RNA, 15 nt, Homo sapiens
gagucucugccaguu

SEQ ID NO: 2100431 - RNA, 19 nt, Homo sapiens
agcugagccuucugaugag

SEQ ID NO: 2100432 - RNA, 14 nt, Homo sapiens
aggcccaacauuaa

SEQ ID NO: 2100433 - RNA, 10 nt, Homo sapiens
guugcaauga

SEQ ID NO: 2100434 - RNA, 14 nt, Homo sapiens
auuuuaucuguuaa

SEQ ID NO: 2100435 - RNA, 22 nt, Homo sapiens
gauguuucgaguaaacuugaaa

SEQ ID NO: 2100436 - RNA, 21 nt, Homo sapiens
ccuccccaagucagcaguccu

SEQ ID NO: 2100437 - RNA, 14 nt, Homo sapiens
caucuaauaaauca

SEQ ID NO: 2100438 - RNA, 13 nt, Homo sapiens
gccagaccaugga

SEQ ID NO: 2100439 - RNA, 12 nt, Homo sapiens
aauaaaagugga

SEQ ID NO: 2100440 - RNA, 17 nt, Homo sapiens
caugugcacaugcacgu

SEQ ID NO: 2100441 - RNA, 17 nt, Homo sapiens
uuaccacguuacugcau

SEQ ID NO: 2100442 - RNA, 12 nt, Homo sapiens
agguaacuguac

SEQ ID NO: 2100443 - RNA, 18 nt, Homo sapiens
acugguuugccaggccaa

SEQ ID NO: 2100444 - RNA, 22 nt, Homo sapiens
auccaucacuagccaugauaac

SEQ ID NO: 2100445 - RNA, 17 nt, Homo sapiens
uugaaugcagaagcaaa

SEQ ID NO: 2100446 - RNA, 16 nt, Homo sapiens
aagcaucacuugggau

SEQ ID NO: 2100447 - RNA, 14 nt, Homo sapiens
ucuccacuauggca

SEQ ID NO: 2100448 - RNA, 22 nt, Homo sapiens
cagcguuucuaugacacaugca

SEQ ID NO: 2100449 - RNA, 16 nt, Homo sapiens
cacugucugcccugaa

SEQ ID NO: 2100450 - RNA, 11 nt, Homo sapiens
acccuuggcac

SEQ ID NO: 2100451 - RNA, 19 nt, Homo sapiens
ugaggaaacugagucacuc

SEQ ID NO: 2100452 - RNA, 15 nt, Homo sapiens
cuaaaacugcugaac

SEQ ID NO: 2100453 - RNA, 20 nt, Homo sapiens
auauccccucaaaauccaag

SEQ ID NO: 2100454 - RNA, 14 nt, Homo sapiens
auuauuuucuguca

SEQ ID NO: 2100455 - RNA, 20 nt, Homo sapiens
acucgcaauccgagccagcu

SEQ ID NO: 2100456 - RNA, 16 nt, Homo sapiens
ucgggcgccccugugg

SEQ ID NO: 2100457 - RNA, 14 nt, Homo sapiens
cagcagggcuguga

SEQ ID NO: 2100458 - RNA, 16 nt, Homo sapiens
cagaggaauccuggca

SEQ ID NO: 2100459 - RNA, 13 nt, Homo sapiens
auuuaccaaaaaa

SEQ ID NO: 2100460 - RNA, 13 nt, Homo sapiens
auuuuccaaaaau

SEQ ID NO: 2100461 - RNA, 23 nt, Homo sapiens
auuccauggugauuccugggaag

SEQ ID NO: 2100462 - RNA, 15 nt, Homo sapiens
ucugcugcuuuccaa

SEQ ID NO: 2100463 - RNA, 15 nt, Homo sapiens
guuccugcgcugcaa

SEQ ID NO: 2100464 - RNA, 21 nt, Homo sapiens
guuaaaauugauuucuucuca

SEQ ID NO: 2100465 - RNA, 15 nt, Homo sapiens
ccuuuauugcuccug

SEQ ID NO: 2100466 - RNA, 18 nt, Homo sapiens
ugaauccaagacagccac

SEQ ID NO: 2100467 - RNA, 14 nt, Homo sapiens
uagaauacuguauu

SEQ ID NO: 2100468 - RNA, 17 nt, Homo sapiens
ugccuuagccucuugga

SEQ ID NO: 2100469 - RNA, 16 nt, Homo sapiens
ccuuaaacagugucca

SEQ ID NO: 2100470 - RNA, 14 nt, Homo sapiens
uacauuucucauac

SEQ ID NO: 2100471 - RNA, 13 nt, Homo sapiens
uuccccagugugg

SEQ ID NO: 2100472 - RNA, 14 nt, Homo sapiens
auguuuucuaguca

SEQ ID NO: 2100473 - RNA, 14 nt, Homo sapiens
uaacuuucauacca

SEQ ID NO: 2100474 - RNA, 22 nt, Homo sapiens
ccaaggauccucuccacuccau

SEQ ID NO: 2100475 - RNA, 13 nt, Homo sapiens
auugaauuaucuu

SEQ ID NO: 2100476 - RNA, 22 nt, Homo sapiens
uggagaaagaugcaguccucag

SEQ ID NO: 2100477 - RNA, 17 nt, Homo sapiens
cucccaacuccauucuc

SEQ ID NO: 2100478 - RNA, 20 nt, Homo sapiens
auauuuaaaagauccauuua

SEQ ID NO: 2100479 - RNA, 22 nt, Homo sapiens
gauuccucggggauagaccaaa

SEQ ID NO: 2100480 - RNA, 17 nt, Homo sapiens
gauucucuccugauuau

SEQ ID NO: 2100481 - RNA, 19 nt, Homo sapiens
ucgauccuggggcccucag

SEQ ID NO: 2100482 - RNA, 15 nt, Homo sapiens
cacuucaaacaugcc

SEQ ID NO: 2100483 - RNA, 14 nt, Homo sapiens
uccacacuaccaca

SEQ ID NO: 2100484 - RNA, 14 nt, Homo sapiens
ucacagcuacacag

SEQ ID NO: 2100485 - RNA, 14 nt, Homo sapiens
auucaucuuuucau

SEQ ID NO: 2100486 - RNA, 14 nt, Homo sapiens
agccaccuugccac

SEQ ID NO: 2100487 - RNA, 17 nt, Homo sapiens
ccaaaugcuuuccauga

SEQ ID NO: 2100488 - RNA, 22 nt, Homo sapiens
gaugggccaccgccgacuuugu

SEQ ID NO: 2100489 - RNA, 13 nt, Homo sapiens
gcugcugccaagu

SEQ ID NO: 2100490 - RNA, 22 nt, Homo sapiens
ucagaauauuuuguaagcuaua

SEQ ID NO: 2100491 - RNA, 12 nt, Homo sapiens
gcccccagcugu

SEQ ID NO: 2100492 - RNA, 18 nt, Homo sapiens
uuugauugcugagagcca

SEQ ID NO: 2100493 - RNA, 17 nt, Homo sapiens
aucccaucccaucccau

SEQ ID NO: 2100494 - RNA, 17 nt, Homo sapiens
cucacucguucuguuac

SEQ ID NO: 2100495 - RNA, 19 nt, Homo sapiens
ugcuuguagaguuguacug

SEQ ID NO: 2100496 - RNA, 16 nt, Homo sapiens
ccacugaauuaugcca

SEQ ID NO: 2100497 - RNA, 15 nt, Homo sapiens
uaauagaaacauuga

SEQ ID NO: 2100498 - RNA, 12 nt, Homo sapiens
gugcuacagggu

SEQ ID NO: 2100499 - RNA, 15 nt, Homo sapiens
cacguguccguccac

SEQ ID NO: 2100500 - RNA, 12 nt, Homo sapiens
uccaaagccaga

SEQ ID NO: 2100501 - RNA, 14 nt, Homo sapiens
gagcaguucagagu

SEQ ID NO: 2100502 - RNA, 20 nt, Homo sapiens
gugguuuccacaugcucuga

SEQ ID NO: 2100503 - RNA, 20 nt, Homo sapiens
gaaucucuuggaugcagcuu

SEQ ID NO: 2100504 - RNA, 11 nt, Homo sapiens
ccuuccagggg

SEQ ID NO: 2100505 - RNA, 14 nt, Homo sapiens
ucgggccacagggc

SEQ ID NO: 2100506 - RNA, 14 nt, Homo sapiens
ucugggcacauggg

SEQ ID NO: 2100507 - RNA, 21 nt, Homo sapiens
gagccaagagugcacuacugu

SEQ ID NO: 2100508 - RNA, 19 nt, Homo sapiens
gcagacgggaaugccuagg

SEQ ID NO: 2100509 - RNA, 21 nt, Homo sapiens
ccugaaaaaaugauacgcugg

SEQ ID NO: 2100510 - RNA, 22 nt, Homo sapiens
gggcccaaguaagggcacagau

SEQ ID NO: 2100511 - RNA, 18 nt, Homo sapiens
ugccuuccagcacccugc

SEQ ID NO: 2100512 - RNA, 23 nt, Homo sapiens
ccuccccggagccggcacugcau

SEQ ID NO: 2100513 - RNA, 18 nt, Homo sapiens
aaauaccauuuaucuacu

SEQ ID NO: 2100514 - RNA, 18 nt, Homo sapiens
uuucuuucuaacuccagu

SEQ ID NO: 2100515 - RNA, 21 nt, Homo sapiens
gcuccuuccuagccuugcacu

SEQ ID NO: 2100516 - RNA, 19 nt, Homo sapiens
ugaaaugguccaguacaaa

SEQ ID NO: 2100517 - RNA, 17 nt, Homo sapiens
aacagaaagaaccuugc

SEQ ID NO: 2100518 - RNA, 14 nt, Homo sapiens
uguaacagugcaag

SEQ ID NO: 2100519 - RNA, 21 nt, Homo sapiens
cagcucggacuauacugcuga

SEQ ID NO: 2100520 - RNA, 14 nt, Homo sapiens
cgucacuccagugc

SEQ ID NO: 2100521 - RNA, 21 nt, Homo sapiens
ggccuggguuuguuccugggg

SEQ ID NO: 2100522 - RNA, 12 nt, Homo sapiens
gaaggcuuucag

SEQ ID NO: 2100523 - RNA, 23 nt, Homo sapiens
ccgugauaauuggcuacuuuucc

SEQ ID NO: 2100524 - RNA, 12 nt, Homo sapiens
cugacucuccag

SEQ ID NO: 2100525 - RNA, 12 nt, Homo sapiens
cuggcucuccaa

SEQ ID NO: 2100526 - RNA, 11 nt, Homo sapiens
aacaguagcau

SEQ ID NO: 2100527 - RNA, 18 nt, Homo sapiens
auaaaauucauuccauuu

SEQ ID NO: 2100528 - RNA, 16 nt, Homo sapiens
caugugagcaugucac

SEQ ID NO: 2100529 - RNA, 18 nt, Homo sapiens
accauucugcauuuagcu

SEQ ID NO: 2100530 - RNA, 14 nt, Homo sapiens
auauaauaugcaca

SEQ ID NO: 2100531 - RNA, 15 nt, Homo sapiens
cugauaaacauuaaa

SEQ ID NO: 2100532 - RNA, 21 nt, Homo sapiens
aaaaccgcaaggguagacugg

SEQ ID NO: 2100533 - RNA, 18 nt, Homo sapiens
caggagccucacuggggc

SEQ ID NO: 2100534 - RNA, 17 nt, Homo sapiens
uagaauuugcacacuua

SEQ ID NO: 2100535 - RNA, 16 nt, Homo sapiens
uaaaauaagagauccu

SEQ ID NO: 2100536 - RNA, 22 nt, Homo sapiens
agaauacuauuuccaaacucau

SEQ ID NO: 2100537 - RNA, 17 nt, Homo sapiens
ugacuucuuuuuggcau

SEQ ID NO: 2100538 - RNA, 18 nt, Homo sapiens
cauugccaauuagacaaa

SEQ ID NO: 2100539 - RNA, 15 nt, Homo sapiens
uaaaauuaccaaaug

SEQ ID NO: 2100540 - RNA, 20 nt, Homo sapiens
aagcacuuuauauuuuccuc

SEQ ID NO: 2100541 - RNA, 19 nt, Homo sapiens
ugaaaaagaacuguauuua

SEQ ID NO: 2100542 - RNA, 18 nt, Homo sapiens
acacuaacauauaauguu

SEQ ID NO: 2100543 - RNA, 18 nt, Homo sapiens
uggggaagaagacacaga

SEQ ID NO: 2100544 - RNA, 12 nt, Homo sapiens
uagaggagcaac

SEQ ID NO: 2100545 - RNA, 21 nt, Homo sapiens
auugaauagggcuaggaauau

SEQ ID NO: 2100546 - RNA, 14 nt, Homo sapiens
uugaaaucacugau

SEQ ID NO: 2100547 - RNA, 14 nt, Homo sapiens
ugccacugccucuu

SEQ ID NO: 2100548 - RNA, 19 nt, Homo sapiens
ugauggauaucccuaccuu

SEQ ID NO: 2100549 - RNA, 13 nt, Homo sapiens
cauuguauguauc

SEQ ID NO: 2100550 - RNA, 14 nt, Homo sapiens
gcaccaccaugcca

SEQ ID NO: 2100551 - RNA, 23 nt, Homo sapiens
uagugccugaauuuguucucuuu

SEQ ID NO: 2100552 - RNA, 21 nt, Homo sapiens
agcuuucuccccgcuaaggaa

SEQ ID NO: 2100553 - RNA, 15 nt, Homo sapiens
cccugaggacagggg

SEQ ID NO: 2100554 - RNA, 23 nt, Homo sapiens
accguuuuucaagaaaacuggaa

SEQ ID NO: 2100555 - RNA, 23 nt, Homo sapiens
aaauuuuuuacuuuuaacuauuu

SEQ ID NO: 2100556 - RNA, 12 nt, Homo sapiens
ccuaccauuuca

SEQ ID NO: 2100557 - RNA, 22 nt, Homo sapiens
gccuggcccuccccacaaugcc

SEQ ID NO: 2100558 - RNA, 16 nt, Homo sapiens
cccugaagaaauccug

SEQ ID NO: 2100559 - RNA, 22 nt, Homo sapiens
uuaccaaguuggucuuacuuug

SEQ ID NO: 2100560 - RNA, 16 nt, Homo sapiens
uacuucuugugcuuua

SEQ ID NO: 2100561 - RNA, 13 nt, Homo sapiens
aucucaguaugaa

SEQ ID NO: 2100562 - RNA, 19 nt, Homo sapiens
uagacuuaucugcauauug

SEQ ID NO: 2100563 - RNA, 13 nt, Homo sapiens
uuccugccacugc

SEQ ID NO: 2100564 - RNA, 12 nt, Homo sapiens
auugcacaggga

SEQ ID NO: 2100565 - RNA, 16 nt, Homo sapiens
ugaccacuuguagucc

SEQ ID NO: 2100566 - RNA, 22 nt, Homo sapiens
agcuaacaauaaagugugagga

SEQ ID NO: 2100567 - RNA, 16 nt, Homo sapiens
accagggcucuucuca

SEQ ID NO: 2100568 - RNA, 22 nt, Homo sapiens
uguuaaugaagauggacauuuu

SEQ ID NO: 2100569 - RNA, 18 nt, Homo sapiens
accucgagaauuguuacc

SEQ ID NO: 2100570 - RNA, 18 nt, Homo sapiens
gcauggagacagcaguuu

SEQ ID NO: 2100571 - RNA, 17 nt, Homo sapiens
uauaaacugcugucaau

SEQ ID NO: 2100572 - RNA, 12 nt, Homo sapiens
uaacuacuucca

SEQ ID NO: 2100573 - RNA, 17 nt, Homo sapiens
acuguaucaagucaugg

SEQ ID NO: 2100574 - RNA, 12 nt, Homo sapiens
aucuguguaaag

SEQ ID NO: 2100575 - RNA, 23 nt, Homo sapiens
acacuggaauauaaaacagucau

SEQ ID NO: 2100576 - RNA, 19 nt, Homo sapiens
uguuuggaaaccacaguca

SEQ ID NO: 2100577 - RNA, 16 nt, Homo sapiens
accugaggccaaauau

SEQ ID NO: 2100578 - RNA, 20 nt, Homo sapiens
cagaauccugaugguaucaa

SEQ ID NO: 2100579 - RNA, 17 nt, Homo sapiens
cuccaaggcaaaugucc

SEQ ID NO: 2100580 - RNA, 15 nt, Homo sapiens
gcagaaaaacucugg

SEQ ID NO: 2100581 - RNA, 17 nt, Homo sapiens
ucacacuguaaacauuc

SEQ ID NO: 2100582 - RNA, 16 nt, Homo sapiens
acauuuaaaauuaaau

SEQ ID NO: 2100583 - RNA, 23 nt, Homo sapiens
gcugaggacaaugucuggcugaa

SEQ ID NO: 2100584 - RNA, 14 nt, Homo sapiens
auuuacucagucuu

SEQ ID NO: 2100585 - RNA, 19 nt, Homo sapiens
cuaauucauguuuucacuu

SEQ ID NO: 2100586 - RNA, 23 nt, Homo sapiens
ugcaaacaggguaacuaacuaaa

SEQ ID NO: 2100587 - RNA, 18 nt, Homo sapiens
gaucauuaucagccugug

SEQ ID NO: 2100588 - RNA, 23 nt, Homo sapiens
gucacugaggccugagacccagg

SEQ ID NO: 2100589 - RNA, 23 nt, Homo sapiens
ucuugaccuaguauaucagugac

SEQ ID NO: 2100590 - RNA, 15 nt, Homo sapiens
gggaaaacaccccuc

SEQ ID NO: 2100591 - RNA, 20 nt, Homo sapiens
auucuguucuaaaacuccaa

SEQ ID NO: 2100592 - RNA, 13 nt, Homo sapiens
uagcuauaugcau

SEQ ID NO: 2100593 - RNA, 21 nt, Homo sapiens
gacuuauuaugcauaaagcca

SEQ ID NO: 2100594 - RNA, 18 nt, Homo sapiens
ucuauauuuuuguccaaa

SEQ ID NO: 2100595 - RNA, 14 nt, Homo sapiens
auuaaaacuaugaa

SEQ ID NO: 2100596 - RNA, 22 nt, Homo sapiens
cuccucuccagcccugcagcua

SEQ ID NO: 2100597 - RNA, 20 nt, Homo sapiens
uggagggcuggucauucaca

SEQ ID NO: 2100598 - RNA, 23 nt, Homo sapiens
guucuuucaaugcugacuggacu

SEQ ID NO: 2100599 - RNA, 14 nt, Homo sapiens
gcauccugcagugg

SEQ ID NO: 2100600 - RNA, 12 nt, Homo sapiens
ggaaguguuuau

SEQ ID NO: 2100601 - RNA, 20 nt, Homo sapiens
aagggagggguuaaugcaga

SEQ ID NO: 2100602 - RNA, 19 nt, Homo sapiens
acauggaagauauuccuuu

SEQ ID NO: 2100603 - RNA, 14 nt, Homo sapiens
uguggugguuguga

SEQ ID NO: 2100604 - RNA, 10 nt, Homo sapiens
ucccaaagaa

SEQ ID NO: 2100605 - RNA, 11 nt, Homo sapiens
cuauauauuca

SEQ ID NO: 2100606 - RNA, 19 nt, Homo sapiens
agcacugccccacaugcau

SEQ ID NO: 2100607 - RNA, 22 nt, Homo sapiens
aaauguuugaguuuucaaagau

SEQ ID NO: 2100608 - RNA, 12 nt, Homo sapiens
gccuuaacaaac

SEQ ID NO: 2100609 - RNA, 16 nt, Homo sapiens
uaaguagggauguuua

SEQ ID NO: 2100610 - RNA, 18 nt, Homo sapiens
agauuuaaagaaaaccac

SEQ ID NO: 2100611 - RNA, 14 nt, Homo sapiens
cucuaaaaauccau

SEQ ID NO: 2100612 - RNA, 18 nt, Homo sapiens
gaagggucggagucugua

SEQ ID NO: 2100613 - RNA, 14 nt, Homo sapiens
acguaagacugugu

SEQ ID NO: 2100614 - RNA, 19 nt, Homo sapiens
agccucuaacuccugggcu

SEQ ID NO: 2100615 - RNA, 13 nt, Homo sapiens
guaaccaaggaga

SEQ ID NO: 2100616 - RNA, 18 nt, Homo sapiens
uauuaaaaaaaaagaagg

SEQ ID NO: 2100617 - RNA, 20 nt, Homo sapiens
aucagaagcucccagcugac

SEQ ID NO: 2100618 - RNA, 17 nt, Homo sapiens
aaggcagaaacuucuuu

SEQ ID NO: 2100619 - RNA, 18 nt, Homo sapiens
cuagagcugagagucuga

SEQ ID NO: 2100620 - RNA, 14 nt, Homo sapiens
guuccaguacuaug

SEQ ID NO: 2100621 - RNA, 15 nt, Homo sapiens
guaaaacccaaaaca

SEQ ID NO: 2100622 - RNA, 18 nt, Homo sapiens
aaagaguauauguucccu

SEQ ID NO: 2100623 - RNA, 19 nt, Homo sapiens
gagauauggcauugcacug

SEQ ID NO: 2100624 - RNA, 19 nt, Homo sapiens
aauauagccuuuaaaucau

SEQ ID NO: 2100625 - RNA, 19 nt, Homo sapiens
auauuuuuuuaacugugau

SEQ ID NO: 2100626 - RNA, 16 nt, Homo sapiens
uuagauccaauuccca

SEQ ID NO: 2100627 - RNA, 22 nt, Homo sapiens
ggauguugaagugagcugagau

SEQ ID NO: 2100628 - RNA, 19 nt, Homo sapiens
ccucuggacagccagugac

SEQ ID NO: 2100629 - RNA, 21 nt, Homo sapiens
uaaacucuguuguaaguaaua

SEQ ID NO: 2100630 - RNA, 15 nt, Homo sapiens
ugcaaucucuugucu

SEQ ID NO: 2100631 - RNA, 18 nt, Homo sapiens
uuuaucuauggcacccau

SEQ ID NO: 2100632 - RNA, 14 nt, Homo sapiens
cagugccacgcaca

SEQ ID NO: 2100633 - RNA, 16 nt, Homo sapiens
gacaccuuuagguucu

SEQ ID NO: 2100634 - RNA, 19 nt, Homo sapiens
auaaaaacucauccauggc

SEQ ID NO: 2100635 - RNA, 17 nt, Homo sapiens
uuuucccuuugccuuca

SEQ ID NO: 2100636 - RNA, 15 nt, Homo sapiens
cuguugaaaagccau

SEQ ID NO: 2100637 - RNA, 21 nt, Homo sapiens
ggcuucucucaggcccagugg

SEQ ID NO: 2100638 - RNA, 14 nt, Homo sapiens
uuagcucuguggaa

SEQ ID NO: 2100639 - RNA, 16 nt, Homo sapiens
acccugcuccuagcac

SEQ ID NO: 2100640 - RNA, 23 nt, Homo sapiens
aggccacacuggcaucucccuga

SEQ ID NO: 2100641 - RNA, 11 nt, Homo sapiens
aagugugagua

SEQ ID NO: 2100642 - RNA, 14 nt, Homo sapiens
ugcuuucagcacuc

SEQ ID NO: 2100643 - RNA, 19 nt, Homo sapiens
guugccuuuauauccaaaa

SEQ ID NO: 2100644 - RNA, 13 nt, Homo sapiens
cuuuguacugcuu

SEQ ID NO: 2100645 - RNA, 19 nt, Homo sapiens
ugaucagugcaauugaccu

SEQ ID NO: 2100646 - RNA, 12 nt, Homo sapiens
gugaggcucucu

SEQ ID NO: 2100647 - RNA, 13 nt, Homo sapiens
agaugauggugac

SEQ ID NO: 2100648 - RNA, 15 nt, Homo sapiens
gguccacagcuggaa

SEQ ID NO: 2100649 - RNA, 23 nt, Homo sapiens
uuuggggaaaaaagcacauacau

SEQ ID NO: 2100650 - RNA, 14 nt, Homo sapiens
uggaugagcuccca

SEQ ID NO: 2100651 - RNA, 12 nt, Homo sapiens
gagugugacagg

SEQ ID NO: 2100652 - RNA, 15 nt, Homo sapiens
acacucuagugccau

SEQ ID NO: 2100653 - RNA, 13 nt, Homo sapiens
ugcgugcaugugc

SEQ ID NO: 2100654 - RNA, 18 nt, Homo sapiens
aggcuccccaucuucucc

SEQ ID NO: 2100655 - RNA, 21 nt, Homo sapiens
aggagccucauccagccucag

SEQ ID NO: 2100656 - RNA, 20 nt, Homo sapiens
uauucuaagcccuuugccau

SEQ ID NO: 2100657 - RNA, 17 nt, Homo sapiens
agccgacucagcaacuu

SEQ ID NO: 2100658 - RNA, 20 nt, Homo sapiens
ucaauuucuaguaccuguga

SEQ ID NO: 2100659 - RNA, 21 nt, Homo sapiens
guucaccuccaagcauuucau

SEQ ID NO: 2100660 - RNA, 18 nt, Homo sapiens
aagggguagaaguggcau

SEQ ID NO: 2100661 - RNA, 19 nt, Homo sapiens
augauaauaaucaugauca

SEQ ID NO: 2100662 - RNA, 15 nt, Homo sapiens
aauuacagccuuauu

SEQ ID NO: 2100663 - RNA, 23 nt, Homo sapiens
agaaucagcauuuagucuugcca

SEQ ID NO: 2100664 - RNA, 15 nt, Homo sapiens
agaacuuuauuucca

SEQ ID NO: 2100665 - RNA, 14 nt, Homo sapiens
uccagucuguucuc

SEQ ID NO: 2100666 - RNA, 14 nt, Homo sapiens
agaaaagcugccau

SEQ ID NO: 2100667 - RNA, 17 nt, Homo sapiens
ucaucauacaugacuca

SEQ ID NO: 2100668 - RNA, 21 nt, Homo sapiens
gcauuaguguccccccuugaa

SEQ ID NO: 2100669 - RNA, 17 nt, Homo sapiens
acagacuccacccuccu

SEQ ID NO: 2100670 - RNA, 20 nt, Homo sapiens
uccuccugcagacaccugga

SEQ ID NO: 2100671 - RNA, 18 nt, Homo sapiens
auugauuuuuaaacagca

SEQ ID NO: 2100672 - RNA, 20 nt, Homo sapiens
aagagcauggaugcauuuca

SEQ ID NO: 2100673 - RNA, 17 nt, Homo sapiens
gagccauuuugugaaug

SEQ ID NO: 2100674 - RNA, 16 nt, Homo sapiens
aggacgcagacugacu

SEQ ID NO: 2100675 - RNA, 23 nt, Homo sapiens
guagagaaagaaaugucugccau

SEQ ID NO: 2100676 - RNA, 21 nt, Homo sapiens
acacacgccacccagccucuu

SEQ ID NO: 2100677 - RNA, 16 nt, Homo sapiens
uaaaaugauuugcacu

SEQ ID NO: 2100678 - RNA, 20 nt, Homo sapiens
cuagccacaucacuacagua

SEQ ID NO: 2100679 - RNA, 22 nt, Homo sapiens
gaggacauaaguaucaugucuc

SEQ ID NO: 2100680 - RNA, 14 nt, Homo sapiens
aacuccugccauuc

SEQ ID NO: 2100681 - RNA, 16 nt, Homo sapiens
caagcgauucuccugc

SEQ ID NO: 2100682 - RNA, 14 nt, Homo sapiens
ucccgagcuacucu

SEQ ID NO: 2100683 - RNA, 22 nt, Homo sapiens
acacacuugggagcaguccuau

SEQ ID NO: 2100684 - RNA, 21 nt, Homo sapiens
auauuucaauaacuuagaaug

SEQ ID NO: 2100685 - RNA, 19 nt, Homo sapiens
ggagcccccaccacaaacu

SEQ ID NO: 2100686 - RNA, 17 nt, Homo sapiens
aggucugggaugcugcg

SEQ ID NO: 2100687 - RNA, 20 nt, Homo sapiens
ugccugggguggacauucag

SEQ ID NO: 2100688 - RNA, 16 nt, Homo sapiens
agagaaaugugucauc

SEQ ID NO: 2100689 - RNA, 15 nt, Homo sapiens
uggagaaggcauguu

SEQ ID NO: 2100690 - RNA, 21 nt, Homo sapiens
cagcagaauacugcuugcuua

SEQ ID NO: 2100691 - RNA, 18 nt, Homo sapiens
caaagggccaucguucau

SEQ ID NO: 2100692 - RNA, 16 nt, Homo sapiens
guuuuguguuuuguca

SEQ ID NO: 2100693 - RNA, 15 nt, Homo sapiens
guacuuacacugaaa

SEQ ID NO: 2100694 - RNA, 20 nt, Homo sapiens
ccuugacaaacuucuuucac

SEQ ID NO: 2100695 - RNA, 21 nt, Homo sapiens
guuauuuuugucccugcuccu

SEQ ID NO: 2100696 - RNA, 15 nt, Homo sapiens
guuuucugacacagu

SEQ ID NO: 2100697 - RNA, 13 nt, Homo sapiens
caccuuagugcaa

SEQ ID NO: 2100698 - RNA, 14 nt, Homo sapiens
ucagauacuuguga

SEQ ID NO: 2100699 - RNA, 20 nt, Homo sapiens
caaaauaaaaagugacacag

SEQ ID NO: 2100700 - RNA, 20 nt, Homo sapiens
gccagaccauggacacuaca

SEQ ID NO: 2100701 - RNA, 20 nt, Homo sapiens
acuugauccauuucuaauua

SEQ ID NO: 2100702 - RNA, 21 nt, Homo sapiens
auuccugccccagauggcuuu

SEQ ID NO: 2100703 - RNA, 15 nt, Homo sapiens
acugcacucuucagg

SEQ ID NO: 2100704 - RNA, 14 nt, Homo sapiens
cuucuccuaauucu

SEQ ID NO: 2100705 - RNA, 19 nt, Homo sapiens
ccgggcagaggggcagaug

SEQ ID NO: 2100706 - RNA, 15 nt, Homo sapiens
agcuccuucccagga

SEQ ID NO: 2100707 - RNA, 23 nt, Homo sapiens
uagucccagaaauaaacugagaa

SEQ ID NO: 2100708 - RNA, 20 nt, Homo sapiens
aaugugaccuuuaauucagg

SEQ ID NO: 2100709 - RNA, 13 nt, Homo sapiens
agagacagaggau

SEQ ID NO: 2100710 - RNA, 20 nt, Homo sapiens
uacauaguggucauuuggug

SEQ ID NO: 2100711 - RNA, 16 nt, Homo sapiens
agcaaugacugugcuc

SEQ ID NO: 2100712 - RNA, 17 nt, Homo sapiens
cuaauguaugcauucau

SEQ ID NO: 2100713 - RNA, 16 nt, Homo sapiens
ugacaauaaaaacaau

SEQ ID NO: 2100714 - RNA, 19 nt, Homo sapiens
ugagcuggcugacuaagcc

SEQ ID NO: 2100715 - RNA, 14 nt, Homo sapiens
cagcauugugacac

SEQ ID NO: 2100716 - RNA, 19 nt, Homo sapiens
aauauucuauuuugcagau

SEQ ID NO: 2100717 - RNA, 18 nt, Homo sapiens
uucagauggcaauuucac

SEQ ID NO: 2100718 - RNA, 17 nt, Homo sapiens
aaaugauguugaauauu

SEQ ID NO: 2100719 - RNA, 15 nt, Homo sapiens
ccuguguuccuguga

SEQ ID NO: 2100720 - RNA, 16 nt, Homo sapiens
cgcugcagugugagua

SEQ ID NO: 2100721 - RNA, 12 nt, Homo sapiens
gcaacaguuuuu

SEQ ID NO: 2100722 - RNA, 18 nt, Homo sapiens
caucaaggcacugccuga

SEQ ID NO: 2100723 - RNA, 19 nt, Homo sapiens
cagucucauugucaccucu

SEQ ID NO: 2100724 - RNA, 17 nt, Homo sapiens
acaucauuuuaacagcu

SEQ ID NO: 2100725 - RNA, 21 nt, Homo sapiens
cacugccaaacaucagucaau

SEQ ID NO: 2100726 - RNA, 21 nt, Homo sapiens
aacugcuaccaugaagugaaa

SEQ ID NO: 2100727 - RNA, 14 nt, Homo sapiens
uuaugcuuccacag

SEQ ID NO: 2100728 - RNA, 13 nt, Homo sapiens
ugccuucuccuau

SEQ ID NO: 2100729 - RNA, 16 nt, Homo sapiens
ucuuacaucuguaaag

SEQ ID NO: 2100730 - RNA, 13 nt, Homo sapiens
caaguauuucaca

SEQ ID NO: 2100731 - RNA, 20 nt, Homo sapiens
ugcccaggcuggagugcaac

SEQ ID NO: 2100732 - RNA, 14 nt, Homo sapiens
gacauuuauucaaa

SEQ ID NO: 2100733 - RNA, 23 nt, Homo sapiens
uugaaaugagaaacuuugaucuc

SEQ ID NO: 2100734 - RNA, 17 nt, Homo sapiens
cagccccgccugucaca

SEQ ID NO: 2100735 - RNA, 12 nt, Homo sapiens
acccaugccaga

SEQ ID NO: 2100736 - RNA, 19 nt, Homo sapiens
gaaagaacuuaagucucga

SEQ ID NO: 2100737 - RNA, 19 nt, Homo sapiens
ggcaggugagaacccagag

SEQ ID NO: 2100738 - RNA, 12 nt, Homo sapiens
gauauuacuuua

SEQ ID NO: 2100739 - RNA, 21 nt, Homo sapiens
ggaagugguccagaaacaaaa

SEQ ID NO: 2100740 - RNA, 15 nt, Homo sapiens
uagaaaggucaucca

SEQ ID NO: 2100741 - RNA, 21 nt, Homo sapiens
caauuuauccaaagcauugca

SEQ ID NO: 2100742 - RNA, 21 nt, Homo sapiens
aaauauaauuauccaaauuga

SEQ ID NO: 2100743 - RNA, 15 nt, Homo sapiens
ggcugcaucuuccag

SEQ ID NO: 2100744 - RNA, 19 nt, Homo sapiens
gaggcagguggaucaccug

SEQ ID NO: 2100745 - RNA, 21 nt, Homo sapiens
cauuuuuaacagcaugcugcu

SEQ ID NO: 2100746 - RNA, 17 nt, Homo sapiens
agaguguagacuguggc

SEQ ID NO: 2100747 - RNA, 21 nt, Homo sapiens
agagccauuagagcacagcuu

SEQ ID NO: 2100748 - RNA, 16 nt, Homo sapiens
uggggaggccagggua

SEQ ID NO: 2100749 - RNA, 18 nt, Homo sapiens
agcgacagugugggaccu

SEQ ID NO: 2100750 - RNA, 18 nt, Homo sapiens
cugggacaucuucuguua

SEQ ID NO: 2100751 - RNA, 22 nt, Homo sapiens
gcugaugccuguguacugccuu

SEQ ID NO: 2100752 - RNA, 21 nt, Homo sapiens
accuaccacaugccaagcacu

SEQ ID NO: 2100753 - RNA, 22 nt, Homo sapiens
gaaaucuuguuggcaaaucaga

SEQ ID NO: 2100754 - RNA, 19 nt, Homo sapiens
cacauccauauacauauau

SEQ ID NO: 2100755 - RNA, 21 nt, Homo sapiens
ucucccuugggcucugaugaa

SEQ ID NO: 2100756 - RNA, 15 nt, Homo sapiens
ccagcaccaccuaca

SEQ ID NO: 2100757 - RNA, 14 nt, Homo sapiens
cucccaaaacauuu

SEQ ID NO: 2100758 - RNA, 22 nt, Homo sapiens
ggcacuggcauugucccugugc

SEQ ID NO: 2100759 - RNA, 20 nt, Homo sapiens
aguuucagagaccauugcaa

SEQ ID NO: 2100760 - RNA, 19 nt, Homo sapiens
cuuagaauuauuugcacua

SEQ ID NO: 2100761 - RNA, 13 nt, Homo sapiens
ccaagcagacugu

SEQ ID NO: 2100762 - RNA, 15 nt, Homo sapiens
cacugaggacugugg

SEQ ID NO: 2100763 - RNA, 16 nt, Homo sapiens
uacucccuccacccuc

SEQ ID NO: 2100764 - RNA, 19 nt, Homo sapiens
gccaggccucagggaccaa

SEQ ID NO: 2100765 - RNA, 17 nt, Homo sapiens
cuggagacccaccccac

SEQ ID NO: 2100766 - RNA, 16 nt, Homo sapiens
gaggccucucauucca

SEQ ID NO: 2100767 - RNA, 16 nt, Homo sapiens
ucccuuugccagccuu

SEQ ID NO: 2100768 - RNA, 21 nt, Homo sapiens
uuccaccaagcguuucccagu

SEQ ID NO: 2100769 - RNA, 15 nt, Homo sapiens
cuaaaucucuaauau

SEQ ID NO: 2100770 - RNA, 15 nt, Homo sapiens
gugggggugauacua

SEQ ID NO: 2100771 - RNA, 16 nt, Homo sapiens
agagaauauaacauga

SEQ ID NO: 2100772 - RNA, 18 nt, Homo sapiens
aacauuacauuugaacua

SEQ ID NO: 2100773 - RNA, 21 nt, Homo sapiens
auagagugguacagcacuguu

SEQ ID NO: 2100774 - RNA, 13 nt, Homo sapiens
ugccuuccucuga

SEQ ID NO: 2100775 - RNA, 21 nt, Homo sapiens
acacccaagcacaaacugucg

SEQ ID NO: 2100776 - RNA, 14 nt, Homo sapiens
ugaggauaacuuuu

SEQ ID NO: 2100777 - RNA, 17 nt, Homo sapiens
guuuaaucccagcacuu

SEQ ID NO: 2100778 - RNA, 14 nt, Homo sapiens
ugucauccugugaa

SEQ ID NO: 2100779 - RNA, 23 nt, Homo sapiens
gcuaucacguugaaccacgugaa

SEQ ID NO: 2100780 - RNA, 23 nt, Homo sapiens
cauaucuaacuuuguaaccagaa

SEQ ID NO: 2100781 - RNA, 16 nt, Homo sapiens
cuuucugugcagagau

SEQ ID NO: 2100782 - RNA, 18 nt, Homo sapiens
aacagaaauagacuuaau

SEQ ID NO: 2100783 - RNA, 16 nt, Homo sapiens
gaaggcauuccagggu

SEQ ID NO: 2100784 - RNA, 16 nt, Homo sapiens
gcaucuggaacaacag

SEQ ID NO: 2100785 - RNA, 17 nt, Homo sapiens
gauucagaauguguuau

SEQ ID NO: 2100786 - RNA, 13 nt, Homo sapiens
agcugcauggcac

SEQ ID NO: 2100787 - RNA, 17 nt, Homo sapiens
auauuaauaaucuuggc

SEQ ID NO: 2100788 - RNA, 17 nt, Homo sapiens
aggacaaacagugaauu

SEQ ID NO: 2100789 - RNA, 15 nt, Homo sapiens
uagaggaacuucuga

SEQ ID NO: 2100790 - RNA, 15 nt, Homo sapiens
ccugguucugaugau

SEQ ID NO: 2100791 - RNA, 14 nt, Homo sapiens
gggaggcgucuuca

SEQ ID NO: 2100792 - RNA, 15 nt, Homo sapiens
aaugauuuugacaua

SEQ ID NO: 2100793 - RNA, 18 nt, Homo sapiens
ucaaguuguuugucaaug

SEQ ID NO: 2100794 - RNA, 23 nt, Homo sapiens
cauacuaguagucauacucccug

SEQ ID NO: 2100795 - RNA, 24 nt, Homo sapiens
uguauagacaucugcccugacuga

SEQ ID NO: 2100796 - RNA, 22 nt, Homo sapiens
gaagacagcucuuauauugcca

SEQ ID NO: 2100797 - RNA, 14 nt, Homo sapiens
acaauucugucccu

SEQ ID NO: 2100798 - RNA, 13 nt, Homo sapiens
cugcacugaggau

SEQ ID NO: 2100799 - RNA, 13 nt, Homo sapiens
aggcacugcugau

SEQ ID NO: 2100800 - RNA, 11 nt, Homo sapiens
cuuacaucugg

SEQ ID NO: 2100801 - RNA, 20 nt, Homo sapiens
agacacgggcaagcaugccu

SEQ ID NO: 2100802 - RNA, 12 nt, Homo sapiens
uauugugagauu

SEQ ID NO: 2100803 - RNA, 15 nt, Homo sapiens
uugaucuguucuggg

SEQ ID NO: 2100804 - RNA, 15 nt, Homo sapiens
uuaugcuuguuucau

SEQ ID NO: 2100805 - RNA, 22 nt, Homo sapiens
gcaacugaguacaauuguuaug

SEQ ID NO: 2100806 - RNA, 19 nt, Homo sapiens
caagagguuucagcauucc

SEQ ID NO: 2100807 - RNA, 23 nt, Homo sapiens
aagcccccaaguugauauuucua

SEQ ID NO: 2100808 - RNA, 18 nt, Homo sapiens
gccgaguggucacuguca

SEQ ID NO: 2100809 - RNA, 17 nt, Homo sapiens
uucucagcucuucugac

SEQ ID NO: 2100810 - RNA, 15 nt, Homo sapiens
guggauccacugugc

SEQ ID NO: 2100811 - RNA, 21 nt, Homo sapiens
aacuuuuggggcuguauuuag

SEQ ID NO: 2100812 - RNA, 20 nt, Homo sapiens
ucuaaagguggugaggcaau

SEQ ID NO: 2100813 - RNA, 12 nt, Homo sapiens
aagaauugcucc

SEQ ID NO: 2100814 - RNA, 13 nt, Homo sapiens
auugcacuggaau

SEQ ID NO: 2100815 - RNA, 23 nt, Homo sapiens
ccuugccugcuuucuccaagaca

SEQ ID NO: 2100816 - RNA, 19 nt, Homo sapiens
aguggaaaccuugcugcua

SEQ ID NO: 2100817 - RNA, 13 nt, Homo sapiens
guugugcgcacau

SEQ ID NO: 2100818 - RNA, 23 nt, Homo sapiens
caaugguuugugucaaaacuggu

SEQ ID NO: 2100819 - RNA, 20 nt, Homo sapiens
gaagcagggugaucgcacaa

SEQ ID NO: 2100820 - RNA, 13 nt, Homo sapiens
gcugcucugcuau

SEQ ID NO: 2100821 - RNA, 13 nt, Homo sapiens
cagacucucaggu

SEQ ID NO: 2100822 - RNA, 23 nt, Homo sapiens
acaauguuggccugucagagcuu

SEQ ID NO: 2100823 - RNA, 16 nt, Homo sapiens
ugagaaaacaggcuca

SEQ ID NO: 2100824 - RNA, 17 nt, Homo sapiens
acuagaagaaagggcaa

SEQ ID NO: 2100825 - RNA, 20 nt, Homo sapiens
uggucccucugcagucucua

SEQ ID NO: 2100826 - RNA, 18 nt, Homo sapiens
gcaacuucuucuccaucc

SEQ ID NO: 2100827 - RNA, 23 nt, Homo sapiens
cuuggccucccaaagugcugaga

SEQ ID NO: 2100828 - RNA, 14 nt, Homo sapiens
caguucucccaucc

SEQ ID NO: 2100829 - RNA, 22 nt, Homo sapiens
guauacuuuaguagacauuuau

SEQ ID NO: 2100830 - RNA, 22 nt, Homo sapiens
cuggaguuuuguuggugugaaa

SEQ ID NO: 2100831 - RNA, 13 nt, Homo sapiens
uacaaguuucaga

SEQ ID NO: 2100832 - RNA, 21 nt, Homo sapiens
uuaauacauucuaugacauuu

SEQ ID NO: 2100833 - RNA, 15 nt, Homo sapiens
aacaacagccaaaac

SEQ ID NO: 2100834 - RNA, 13 nt, Homo sapiens
gagccuucagagu

SEQ ID NO: 2100835 - RNA, 15 nt, Homo sapiens
cagcaugugcucagc

SEQ ID NO: 2100836 - RNA, 13 nt, Homo sapiens
gucauucauauca

SEQ ID NO: 2100837 - RNA, 13 nt, Homo sapiens
ccgugacugcaau

SEQ ID NO: 2100838 - RNA, 22 nt, Homo sapiens
acaucuuugaccacgucaucgg

SEQ ID NO: 2100839 - RNA, 16 nt, Homo sapiens
aaauaaucaacugcau

SEQ ID NO: 2100840 - RNA, 22 nt, Homo sapiens
cucucaagacggagaugcaugg

SEQ ID NO: 2100841 - RNA, 11 nt, Homo sapiens
uccccuaccca

SEQ ID NO: 2100842 - RNA, 22 nt, Homo sapiens
acuuuauuucugaucuauacaa

SEQ ID NO: 2100843 - RNA, 12 nt, Homo sapiens
ggacuuccuccc

SEQ ID NO: 2100844 - RNA, 22 nt, Homo sapiens
gacuaugucacccaaugcauau

SEQ ID NO: 2100845 - RNA, 14 nt, Homo sapiens
ucacuggcuguuaa

SEQ ID NO: 2100846 - RNA, 17 nt, Homo sapiens
gaaaucaaaaagggaau

SEQ ID NO: 2100847 - RNA, 18 nt, Homo sapiens
uccccagggcugucaucu

SEQ ID NO: 2100848 - RNA, 19 nt, Homo sapiens
aagaaggaagaucuugaga

SEQ ID NO: 2100849 - RNA, 20 nt, Homo sapiens
ugugagggcagugcaaggag

SEQ ID NO: 2100850 - RNA, 19 nt, Homo sapiens
aaacauaaggcacauugug

SEQ ID NO: 2100851 - RNA, 14 nt, Homo sapiens
gucuccaugcacau

SEQ ID NO: 2100852 - RNA, 20 nt, Homo sapiens
uuuugaaagucccuaauaaa

SEQ ID NO: 2100853 - RNA, 21 nt, Homo sapiens
guccccagaccaacccuggga

SEQ ID NO: 2100854 - RNA, 18 nt, Homo sapiens
acacguauguacuaguga

SEQ ID NO: 2100855 - RNA, 22 nt, Homo sapiens
gaggcaguuccauuucauuugu

SEQ ID NO: 2100856 - RNA, 16 nt, Homo sapiens
uauugccucuuucaca

SEQ ID NO: 2100857 - RNA, 18 nt, Homo sapiens
gugcugagauuacaggca

SEQ ID NO: 2100858 - RNA, 22 nt, Homo sapiens
uggagccagcagggcugugaug

SEQ ID NO: 2100859 - RNA, 16 nt, Homo sapiens
uuuaaauaaagacaaa

SEQ ID NO: 2100860 - RNA, 15 nt, Homo sapiens
aguuuaaaggacuga

SEQ ID NO: 2100861 - RNA, 19 nt, Homo sapiens
acuuccugggaccuuuugu

SEQ ID NO: 2100862 - RNA, 23 nt, Homo sapiens
ccugaaggcacagcuaaccacuu

SEQ ID NO: 2100863 - RNA, 21 nt, Homo sapiens
acccuuucagaaucuuuucaa

SEQ ID NO: 2100864 - RNA, 19 nt, Homo sapiens
uauaucaguccucuuucaa

SEQ ID NO: 2100865 - RNA, 17 nt, Homo sapiens
gaaccauguguggcaaa

SEQ ID NO: 2100866 - RNA, 23 nt, Homo sapiens
aaacauucacacagggcucuuug

SEQ ID NO: 2100867 - RNA, 11 nt, Homo sapiens
gacugauuacc

SEQ ID NO: 2100868 - RNA, 13 nt, Homo sapiens
auuuaaugucauu

SEQ ID NO: 2100869 - RNA, 14 nt, Homo sapiens
cauuaaagagccag

SEQ ID NO: 2100870 - RNA, 18 nt, Homo sapiens
gaaaauguuaugugcucu

SEQ ID NO: 2100871 - RNA, 19 nt, Homo sapiens
auuuaacaccccacaggca

SEQ ID NO: 2100872 - RNA, 20 nt, Homo sapiens
ugacuaaacaacuaccuccu

SEQ ID NO: 2100873 - RNA, 15 nt, Homo sapiens
caauauugacuuugu

SEQ ID NO: 2100874 - RNA, 19 nt, Homo sapiens
auaaaaauacaugcaaaua

SEQ ID NO: 2100875 - RNA, 18 nt, Homo sapiens
aaggcucaaggcugugca

SEQ ID NO: 2100876 - RNA, 15 nt, Homo sapiens
aaauaugugacugac

SEQ ID NO: 2100877 - RNA, 14 nt, Homo sapiens
cccuuggcucucaa

SEQ ID NO: 2100878 - RNA, 20 nt, Homo sapiens
aggaguacaccccaacagca

SEQ ID NO: 2100879 - RNA, 21 nt, Homo sapiens
aaacaaguacugguugacuuu

SEQ ID NO: 2100880 - RNA, 21 nt, Homo sapiens
ucaagugauucuccugccuca

SEQ ID NO: 2100881 - RNA, 14 nt, Homo sapiens
uguugaaguuuaca

SEQ ID NO: 2100882 - RNA, 17 nt, Homo sapiens
ucaaccaccuaggcaau

SEQ ID NO: 2100883 - RNA, 21 nt, Homo sapiens
cuugaacugaggcccugugau

SEQ ID NO: 2100884 - RNA, 12 nt, Homo sapiens
aaaggagcauua

SEQ ID NO: 2100885 - RNA, 17 nt, Homo sapiens
gcaucuacucuaggcau

SEQ ID NO: 2100886 - RNA, 19 nt, Homo sapiens
gagaugcugggauagccau

SEQ ID NO: 2100887 - RNA, 14 nt, Homo sapiens
uugggagaacacau

SEQ ID NO: 2100888 - RNA, 15 nt, Homo sapiens
gcuuaucauuugaaa

SEQ ID NO: 2100889 - RNA, 23 nt, Homo sapiens
aauguaucuuauuuauauaugaa

SEQ ID NO: 2100890 - RNA, 15 nt, Homo sapiens
cuggaagccaaacaa

SEQ ID NO: 2100891 - RNA, 21 nt, Homo sapiens
cugaaaaucuggugcucaaua

SEQ ID NO: 2100892 - RNA, 13 nt, Homo sapiens
uccagugcuucaa

SEQ ID NO: 2100893 - RNA, 20 nt, Homo sapiens
aaggcagaccugaaucacaa

SEQ ID NO: 2100894 - RNA, 16 nt, Homo sapiens
acagcuaccaugacaa

SEQ ID NO: 2100895 - RNA, 21 nt, Homo sapiens
ucaacggcuccaucaccagcc

SEQ ID NO: 2100896 - RNA, 16 nt, Homo sapiens
gcucaacuagcagaua

SEQ ID NO: 2100897 - RNA, 22 nt, Homo sapiens
gaaggcucuguuccacauauau

SEQ ID NO: 2100898 - RNA, 23 nt, Homo sapiens
aacaagcccguuagccccaggga

SEQ ID NO: 2100899 - RNA, 12 nt, Homo sapiens
uaucuuccacag

SEQ ID NO: 2100900 - RNA, 19 nt, Homo sapiens
gugcacagggggaggccau

SEQ ID NO: 2100901 - RNA, 15 nt, Homo sapiens
ccacuguguauuuaa

SEQ ID NO: 2100902 - RNA, 18 nt, Homo sapiens
uuuuaguagacaguagga

SEQ ID NO: 2100903 - RNA, 17 nt, Homo sapiens
ugucaaguguuuuacua

SEQ ID NO: 2100904 - RNA, 18 nt, Homo sapiens
cagugcauguugccauga

SEQ ID NO: 2100905 - RNA, 13 nt, Homo sapiens
aauuuuuuauuca

SEQ ID NO: 2100906 - RNA, 17 nt, Homo sapiens
acccccgccacggccac

SEQ ID NO: 2100907 - RNA, 19 nt, Homo sapiens
ucuugaaccugugcucauu

SEQ ID NO: 2100908 - RNA, 22 nt, Homo sapiens
uacauguaugaaauugguuuuc

SEQ ID NO: 2100909 - RNA, 12 nt, Homo sapiens
aggggccuggaa

SEQ ID NO: 2100910 - RNA, 18 nt, Homo sapiens
aacuagcuuggaaacugg

SEQ ID NO: 2100911 - RNA, 15 nt, Homo sapiens
ccugaggaccucuca

SEQ ID NO: 2100912 - RNA, 15 nt, Homo sapiens
uggaaacagcaugaa

SEQ ID NO: 2100913 - RNA, 22 nt, Homo sapiens
ccguuguuaacacgugacacug

SEQ ID NO: 2100914 - RNA, 19 nt, Homo sapiens
ucacugcucuggacugugu

SEQ ID NO: 2100915 - RNA, 20 nt, Homo sapiens
cacucuucuccccgugcuuu

SEQ ID NO: 2100916 - RNA, 18 nt, Homo sapiens
auggcaugagaaauacaa

SEQ ID NO: 2100917 - RNA, 16 nt, Homo sapiens
aaacucuuuggugcac

SEQ ID NO: 2100918 - RNA, 18 nt, Homo sapiens
gacccuggcuucucccca

SEQ ID NO: 2100919 - RNA, 22 nt, Homo sapiens
uagucaacaugccauaucucau

SEQ ID NO: 2100920 - RNA, 22 nt, Homo sapiens
aaauaguuuacuucacuuucau

SEQ ID NO: 2100921 - RNA, 23 nt, Homo sapiens
aagccgccaggaccgccaaagaa

SEQ ID NO: 2100922 - RNA, 15 nt, Homo sapiens
ggacccagccugaga

SEQ ID NO: 2100923 - RNA, 21 nt, Homo sapiens
gcauggugcagggagacaucu

SEQ ID NO: 2100924 - RNA, 21 nt, Homo sapiens
uagacuucugaguaauuaaua

SEQ ID NO: 2100925 - RNA, 22 nt, Homo sapiens
ugacugagaauauaauacugua

SEQ ID NO: 2100926 - RNA, 20 nt, Homo sapiens
guuauagacagucguuccca

SEQ ID NO: 2100927 - RNA, 17 nt, Homo sapiens
ucuccuguuccauuuca

SEQ ID NO: 2100928 - RNA, 19 nt, Homo sapiens
ggccucugcccuucagaag

SEQ ID NO: 2100929 - RNA, 22 nt, Homo sapiens
aaagccacaaugagaaugaugc

SEQ ID NO: 2100930 - RNA, 22 nt, Homo sapiens
cagaaccagcagaacagccauu

SEQ ID NO: 2100931 - RNA, 18 nt, Homo sapiens
caugcccccaguuacugu

SEQ ID NO: 2100932 - RNA, 17 nt, Homo sapiens
uccaauuacuacuuugu

SEQ ID NO: 2100933 - RNA, 14 nt, Homo sapiens
gaaacgucaugugu

SEQ ID NO: 2100934 - RNA, 21 nt, Homo sapiens
aaauucacagcgcuaugcaau

SEQ ID NO: 2100935 - RNA, 22 nt, Homo sapiens
ugguggccgugccugagcugca

SEQ ID NO: 2100936 - RNA, 22 nt, Homo sapiens
gucauuucucaaaaaccacagu

SEQ ID NO: 2100937 - RNA, 14 nt, Homo sapiens
ugcaugggcugugg

SEQ ID NO: 2100938 - RNA, 21 nt, Homo sapiens
acugccuuucaaagugcacac

SEQ ID NO: 2100939 - RNA, 15 nt, Homo sapiens
agggccugcaugggg

SEQ ID NO: 2100940 - RNA, 19 nt, Homo sapiens
uaucccacggaaaaugcca

SEQ ID NO: 2100941 - RNA, 13 nt, Homo sapiens
caucugggaaaga

SEQ ID NO: 2100942 - RNA, 13 nt, Homo sapiens
aacuauauucuca

SEQ ID NO: 2100943 - RNA, 12 nt, Homo sapiens
ucccaagccaga

SEQ ID NO: 2100944 - RNA, 19 nt, Homo sapiens
aagcagaaggugugcuauu

SEQ ID NO: 2100945 - RNA, 17 nt, Homo sapiens
aucccacucuucuugca

SEQ ID NO: 2100946 - RNA, 15 nt, Homo sapiens
cauuguacuuauaca

SEQ ID NO: 2100947 - RNA, 15 nt, Homo sapiens
agaccucaucugugg

SEQ ID NO: 2100948 - RNA, 17 nt, Homo sapiens
uauaauaaacuuuucaa

SEQ ID NO: 2100949 - RNA, 17 nt, Homo sapiens
aaaaguuuaauauuaaa

SEQ ID NO: 2100950 - RNA, 15 nt, Homo sapiens
aguauuacacaucag

SEQ ID NO: 2100951 - RNA, 18 nt, Homo sapiens
cuucaaaguuuucugcug

SEQ ID NO: 2100952 - RNA, 22 nt, Homo sapiens
ccucccagcagcgguaccccag

SEQ ID NO: 2100953 - RNA, 12 nt, Homo sapiens
gacacaggcaug

SEQ ID NO: 2100954 - RNA, 19 nt, Homo sapiens
acucagauggcugaggcag

SEQ ID NO: 2100955 - RNA, 19 nt, Homo sapiens
ucucccaacaagugcucuu

SEQ ID NO: 2100956 - RNA, 14 nt, Homo sapiens
uccauccaaucuau

SEQ ID NO: 2100957 - RNA, 22 nt, Homo sapiens
uucccucaugcuguuccaccuc

SEQ ID NO: 2100958 - RNA, 21 nt, Homo sapiens
gagagccauaaaugaccuaac

SEQ ID NO: 2100959 - RNA, 18 nt, Homo sapiens
uuaaaguaccuguaguga

SEQ ID NO: 2100960 - RNA, 22 nt, Homo sapiens
gggccgaauccccucccuguca

SEQ ID NO: 2100961 - RNA, 17 nt, Homo sapiens
ggccaccagccacuuua

SEQ ID NO: 2100962 - RNA, 16 nt, Homo sapiens
aacaugauacugcugc

SEQ ID NO: 2100963 - RNA, 20 nt, Homo sapiens
gacaagcaagggcugugcug

SEQ ID NO: 2100964 - RNA, 15 nt, Homo sapiens
uacaugugcacauug

SEQ ID NO: 2100965 - RNA, 15 nt, Homo sapiens
ucaucaggugcauag

SEQ ID NO: 2100966 - RNA, 20 nt, Homo sapiens
uuaagugcauaaagaauagu

SEQ ID NO: 2100967 - RNA, 13 nt, Homo sapiens
aggcuacagagaa

SEQ ID NO: 2100968 - RNA, 18 nt, Homo sapiens
gaacagguaguauuacac

SEQ ID NO: 2100969 - RNA, 18 nt, Homo sapiens
cuauagcugcuauagcaa

SEQ ID NO: 2100970 - RNA, 21 nt, Homo sapiens
gcccccagaggcucagcacuu

SEQ ID NO: 2100971 - RNA, 14 nt, Homo sapiens
auauacaugcucaa

SEQ ID NO: 2100972 - RNA, 14 nt, Homo sapiens
acauucauguucua

SEQ ID NO: 2100973 - RNA, 13 nt, Homo sapiens
aguaacauuaacu

SEQ ID NO: 2100974 - RNA, 17 nt, Homo sapiens
gggagagggcgagcaug

SEQ ID NO: 2100975 - RNA, 17 nt, Homo sapiens
ucaagucggaucuaguc

SEQ ID NO: 2100976 - RNA, 18 nt, Homo sapiens
ccugcuguguggacuuca

SEQ ID NO: 2100977 - RNA, 15 nt, Homo sapiens
gaguucaagccugug

SEQ ID NO: 2100978 - RNA, 17 nt, Homo sapiens
cacugaauuaugccagg

SEQ ID NO: 2100979 - RNA, 17 nt, Homo sapiens
cccggaaugcuuccagu

SEQ ID NO: 2100980 - RNA, 12 nt, Homo sapiens
ccuggucacugg

SEQ ID NO: 2100981 - RNA, 16 nt, Homo sapiens
ggcauggagccagugc

SEQ ID NO: 2100982 - RNA, 16 nt, Homo sapiens
uuuugaugugguguca

SEQ ID NO: 2100983 - RNA, 19 nt, Homo sapiens
uaaagacccaacauuacua

SEQ ID NO: 2100984 - RNA, 23 nt, Homo sapiens
aagguucuugcuuucucucucau

SEQ ID NO: 2100985 - RNA, 22 nt, Homo sapiens
gccacugagaagugcacuuuaa

SEQ ID NO: 2100986 - RNA, 21 nt, Homo sapiens
caccaccucugugggcacugg

SEQ ID NO: 2100987 - RNA, 21 nt, Homo sapiens
accagaacagcauggcccgaa

SEQ ID NO: 2100988 - RNA, 20 nt, Homo sapiens
uagcaaauguuuacuguauc

SEQ ID NO: 2100989 - RNA, 13 nt, Homo sapiens
augcuaugcugaa

SEQ ID NO: 2100990 - RNA, 21 nt, Homo sapiens
ugaguucaagcaauccaccuu

SEQ ID NO: 2100991 - RNA, 23 nt, Homo sapiens
uaaaucauguugaucauguacuu

SEQ ID NO: 2100992 - RNA, 21 nt, Homo sapiens
gggaccuugucucccagcuca

SEQ ID NO: 2100993 - RNA, 12 nt, Homo sapiens
acacuccagugc

SEQ ID NO: 2100994 - RNA, 12 nt, Homo sapiens
caauaaauucau

SEQ ID NO: 2100995 - RNA, 22 nt, Homo sapiens
aaauaaaguauauauagaaucu

SEQ ID NO: 2100996 - RNA, 18 nt, Homo sapiens
gaccaaagauacauguaa

SEQ ID NO: 2100997 - RNA, 21 nt, Homo sapiens
gcacagucuauuuuuuguaua

SEQ ID NO: 2100998 - RNA, 14 nt, Homo sapiens
ugugguuacuuccu

SEQ ID NO: 2100999 - RNA, 21 nt, Homo sapiens
agauacuggcgccagggccaa

SEQ ID NO: 2101000 - RNA, 18 nt, Homo sapiens
gacgacauacaugcuacu

SEQ ID NO: 2101001 - RNA, 14 nt, Homo sapiens
caaacuucccugac

SEQ ID NO: 2101002 - RNA, 18 nt, Homo sapiens
ucaagcuaugugagcuca

SEQ ID NO: 2101003 - RNA, 19 nt, Homo sapiens
augucaucccauugucuuc

SEQ ID NO: 2101004 - RNA, 21 nt, Homo sapiens
guagcuuuucccaaacugauc

SEQ ID NO: 2101005 - RNA, 18 nt, Homo sapiens
ccugcucuccucuugcca

SEQ ID NO: 2101006 - RNA, 14 nt, Homo sapiens
ggaugauaguugaa

SEQ ID NO: 2101007 - RNA, 22 nt, Homo sapiens
uuguccguguucauacauuuga

SEQ ID NO: 2101008 - RNA, 20 nt, Homo sapiens
ugaguuaugauguaaucucu

SEQ ID NO: 2101009 - RNA, 18 nt, Homo sapiens
cuuuuaaaacacuuccau

SEQ ID NO: 2101010 - RNA, 19 nt, Homo sapiens
ccaaguuuauauacaauua

SEQ ID NO: 2101011 - RNA, 13 nt, Homo sapiens
ugguuaugaaaga

SEQ ID NO: 2101012 - RNA, 20 nt, Homo sapiens
aacauauacuuccaugcacu

SEQ ID NO: 2101013 - RNA, 13 nt, Homo sapiens
ugaguaaucugau

SEQ ID NO: 2101014 - RNA, 23 nt, Homo sapiens
gacaaccaccaggugucaaauga

SEQ ID NO: 2101015 - RNA, 19 nt, Homo sapiens
gauugugggauacuauuua

SEQ ID NO: 2101016 - RNA, 21 nt, Homo sapiens
cuccuuagacugaucaagcca

SEQ ID NO: 2101017 - RNA, 22 nt, Homo sapiens
uuaugaugaaaaccuacauauu

SEQ ID NO: 2101018 - RNA, 13 nt, Homo sapiens
agcacaagccaca

SEQ ID NO: 2101019 - RNA, 15 nt, Homo sapiens
uggguccaucagaga

SEQ ID NO: 2101020 - RNA, 15 nt, Homo sapiens
aggacccucccaggu

SEQ ID NO: 2101021 - RNA, 18 nt, Homo sapiens
acacacuucggcucucug

SEQ ID NO: 2101022 - RNA, 17 nt, Homo sapiens
aggaaaaauaugugaag

SEQ ID NO: 2101023 - RNA, 16 nt, Homo sapiens
ucucuuggccuguccu

SEQ ID NO: 2101024 - RNA, 20 nt, Homo sapiens
acacagcgagacuccgucuc

SEQ ID NO: 2101025 - RNA, 12 nt, Homo sapiens
ucuccugagcua

SEQ ID NO: 2101026 - RNA, 18 nt, Homo sapiens
ucucaugcauauuuuauu

SEQ ID NO: 2101027 - RNA, 17 nt, Homo sapiens
cacuacacccagcaaua

SEQ ID NO: 2101028 - RNA, 12 nt, Homo sapiens
auaauuccauga

SEQ ID NO: 2101029 - RNA, 10 nt, Homo sapiens
aacaucaaag

SEQ ID NO: 2101030 - RNA, 23 nt, Homo sapiens
uggucucaaacccccagccucaa

SEQ ID NO: 2101031 - RNA, 20 nt, Homo sapiens
ucuugucauuccaggugcca

SEQ ID NO: 2101032 - RNA, 15 nt, Homo sapiens
uccuaugcugcaaua

SEQ ID NO: 2101033 - RNA, 17 nt, Homo sapiens
auaaagcuucucucuga

SEQ ID NO: 2101034 - RNA, 18 nt, Homo sapiens
gacuucuuacccaaagca

SEQ ID NO: 2101035 - RNA, 21 nt, Homo sapiens
uaauaauccgccccccaauga

SEQ ID NO: 2101036 - RNA, 15 nt, Homo sapiens
aagggcugguguuga

SEQ ID NO: 2101037 - RNA, 19 nt, Homo sapiens
caaauaggauguacuguug

SEQ ID NO: 2101038 - RNA, 14 nt, Homo sapiens
aggaagcauucaga

SEQ ID NO: 2101039 - RNA, 23 nt, Homo sapiens
cacaguucuuugggccagacaug

SEQ ID NO: 2101040 - RNA, 17 nt, Homo sapiens
aaccucuucuggcucaa

SEQ ID NO: 2101041 - RNA, 17 nt, Homo sapiens
cuagucugguggauaaa

SEQ ID NO: 2101042 - RNA, 21 nt, Homo sapiens
gcguguccaggagaccuucca

SEQ ID NO: 2101043 - RNA, 20 nt, Homo sapiens
uauuucggaaauacacuaca

SEQ ID NO: 2101044 - RNA, 21 nt, Homo sapiens
aucuucagggcacugcugcug

SEQ ID NO: 2101045 - RNA, 14 nt, Homo sapiens
uuuaauguugccca

SEQ ID NO: 2101046 - RNA, 19 nt, Homo sapiens
auuugaccacggacuccag

SEQ ID NO: 2101047 - RNA, 21 nt, Homo sapiens
cacauuaguacuuauguugca

SEQ ID NO: 2101048 - RNA, 16 nt, Homo sapiens
gugaccacugaagcac

SEQ ID NO: 2101049 - RNA, 17 nt, Homo sapiens
cuagcuucagaaaugca

SEQ ID NO: 2101050 - RNA, 23 nt, Homo sapiens
cccagauccauucccuacaauuc

SEQ ID NO: 2101051 - RNA, 14 nt, Homo sapiens
aauucuuucacuug

SEQ ID NO: 2101052 - RNA, 19 nt, Homo sapiens
aaauugggcuucaaucacu

SEQ ID NO: 2101053 - RNA, 16 nt, Homo sapiens
ucagaauucaucugaa

SEQ ID NO: 2101054 - RNA, 15 nt, Homo sapiens
aaacaucauuggaua

SEQ ID NO: 2101055 - RNA, 17 nt, Homo sapiens
ccuggagauugugcucu

SEQ ID NO: 2101056 - RNA, 16 nt, Homo sapiens
uaauauguacuuuucc

SEQ ID NO: 2101057 - RNA, 16 nt, Homo sapiens
aggccaggggaggggu

SEQ ID NO: 2101058 - RNA, 17 nt, Homo sapiens
cugaagugagaacccag

SEQ ID NO: 2101059 - RNA, 23 nt, Homo sapiens
ccaccagcgaacucucagaaaua

SEQ ID NO: 2101060 - RNA, 12 nt, Homo sapiens
acuuuauugcca

SEQ ID NO: 2101061 - RNA, 19 nt, Homo sapiens
ugcugaccucccagugacc

SEQ ID NO: 2101062 - RNA, 14 nt, Homo sapiens
caaccuuuguguaa

SEQ ID NO: 2101063 - RNA, 18 nt, Homo sapiens
uauauauguguguguaua

SEQ ID NO: 2101064 - RNA, 15 nt, Homo sapiens
ugaguuuuacauuac

SEQ ID NO: 2101065 - RNA, 22 nt, Homo sapiens
gcauguuggacucugagcucau

SEQ ID NO: 2101066 - RNA, 21 nt, Homo sapiens
uccaaugagcuuucugaacag

SEQ ID NO: 2101067 - RNA, 16 nt, Homo sapiens
auuccuagcaaauuuc

SEQ ID NO: 2101068 - RNA, 13 nt, Homo sapiens
aaauaagccacau

SEQ ID NO: 2101069 - RNA, 21 nt, Homo sapiens
cagcaacacagccacuaaaac

SEQ ID NO: 2101070 - RNA, 13 nt, Homo sapiens
acacacucuucaa

SEQ ID NO: 2101071 - RNA, 12 nt, Homo sapiens
uucuuugccucu

SEQ ID NO: 2101072 - RNA, 12 nt, Homo sapiens
cuguuugcuugu

SEQ ID NO: 2101073 - RNA, 12 nt, Homo sapiens
cucauugcuuca

SEQ ID NO: 2101074 - RNA, 18 nt, Homo sapiens
uugucuguacauacuggc

SEQ ID NO: 2101075 - RNA, 20 nt, Homo sapiens
agugugugcaaguaugugag

SEQ ID NO: 2101076 - RNA, 20 nt, Homo sapiens
aaacugauuuuuagcuuuac

SEQ ID NO: 2101077 - RNA, 21 nt, Homo sapiens
auacagauagaguuccauaua

SEQ ID NO: 2101078 - RNA, 22 nt, Homo sapiens
cagggaacccugcuugcacuuu

SEQ ID NO: 2101079 - RNA, 21 nt, Homo sapiens
acuuuucggagacagugacug

SEQ ID NO: 2101080 - RNA, 16 nt, Homo sapiens
cuuguuccaaugccac

SEQ ID NO: 2101081 - RNA, 17 nt, Homo sapiens
uuuaauuagauuucuga

SEQ ID NO: 2101082 - RNA, 20 nt, Homo sapiens
acaggcacauuaacuguugc

SEQ ID NO: 2101083 - RNA, 14 nt, Homo sapiens
cuaauaucacuuaa

SEQ ID NO: 2101084 - RNA, 14 nt, Homo sapiens
cuguaaauaccauu

SEQ ID NO: 2101085 - RNA, 19 nt, Homo sapiens
agaaauccaagcaccacca

SEQ ID NO: 2101086 - RNA, 18 nt, Homo sapiens
cuugcacaaaaagcacaa

SEQ ID NO: 2101087 - RNA, 16 nt, Homo sapiens
auauguccauaucuaa

SEQ ID NO: 2101088 - RNA, 14 nt, Homo sapiens
auggccugugccau

SEQ ID NO: 2101089 - RNA, 13 nt, Homo sapiens
ccaccugucucag

SEQ ID NO: 2101090 - RNA, 15 nt, Homo sapiens
ggaccucuccaugau

SEQ ID NO: 2101091 - RNA, 16 nt, Homo sapiens
uauguuuacacuguca

SEQ ID NO: 2101092 - RNA, 13 nt, Homo sapiens
gcccacaaagggg

SEQ ID NO: 2101093 - RNA, 12 nt, Homo sapiens
uuuuaaugccaa

SEQ ID NO: 2101094 - RNA, 14 nt, Homo sapiens
caguuaggugcuga

SEQ ID NO: 2101095 - RNA, 21 nt, Homo sapiens
acaaagacauugacagcaauu

SEQ ID NO: 2101096 - RNA, 17 nt, Homo sapiens
agaaccaaccaaugaaa

SEQ ID NO: 2101097 - RNA, 18 nt, Homo sapiens
ugagcagugccucuuguc

SEQ ID NO: 2101098 - RNA, 12 nt, Homo sapiens
ugcccagaucaa

SEQ ID NO: 2101099 - RNA, 19 nt, Homo sapiens
acaauggugcucauuucau

SEQ ID NO: 2101100 - RNA, 16 nt, Homo sapiens
accaaagacugcagaa

SEQ ID NO: 2101101 - RNA, 20 nt, Homo sapiens
ucagucugugccuacauguu

SEQ ID NO: 2101102 - RNA, 15 nt, Homo sapiens
cuacaugaugacuca

SEQ ID NO: 2101103 - RNA, 16 nt, Homo sapiens
uuccaagcaaguauua

SEQ ID NO: 2101104 - RNA, 15 nt, Homo sapiens
auaaaagagcugucu

SEQ ID NO: 2101105 - RNA, 22 nt, Homo sapiens
aauucaugcaucucaacaaagg

SEQ ID NO: 2101106 - RNA, 13 nt, Homo sapiens
uggagaagcuccc

SEQ ID NO: 2101107 - RNA, 20 nt, Homo sapiens
cccuguggccuucacuuugu

SEQ ID NO: 2101108 - RNA, 14 nt, Homo sapiens
uauguguaucucac

SEQ ID NO: 2101109 - RNA, 18 nt, Homo sapiens
aaguauaggauaaauuac

SEQ ID NO: 2101110 - RNA, 19 nt, Homo sapiens
cuuuuuguuugcaucauuu

SEQ ID NO: 2101111 - RNA, 18 nt, Homo sapiens
agaccuuucaaagccauu

SEQ ID NO: 2101112 - RNA, 19 nt, Homo sapiens
auuggaccauccuauuuaa

SEQ ID NO: 2101113 - RNA, 14 nt, Homo sapiens
gcaucucugagcaa

SEQ ID NO: 2101114 - RNA, 16 nt, Homo sapiens
gcaugguguguggugc

SEQ ID NO: 2101115 - RNA, 14 nt, Homo sapiens
uaaaucuacuguuu

SEQ ID NO: 2101116 - RNA, 18 nt, Homo sapiens
ugcaccccaauugggaau

SEQ ID NO: 2101117 - RNA, 14 nt, Homo sapiens
uaaugaacauguga

SEQ ID NO: 2101118 - RNA, 22 nt, Homo sapiens
aaaucugaggaaucaacagggc

SEQ ID NO: 2101119 - RNA, 22 nt, Homo sapiens
cuagguagugaccuaaccacuu

SEQ ID NO: 2101120 - RNA, 21 nt, Homo sapiens
auaaauacaagauucucugau

SEQ ID NO: 2101121 - RNA, 21 nt, Homo sapiens
cuccccugggcccaucucaag

SEQ ID NO: 2101122 - RNA, 14 nt, Homo sapiens
uaucucacuugugc

SEQ ID NO: 2101123 - RNA, 21 nt, Homo sapiens
ugcgagacgcacacagcugag

SEQ ID NO: 2101124 - RNA, 13 nt, Homo sapiens
aaugaauuuggag

SEQ ID NO: 2101125 - RNA, 12 nt, Homo sapiens
gugcggggcccc

SEQ ID NO: 2101126 - RNA, 22 nt, Homo sapiens
gguguuuauccuaucucuccaa

SEQ ID NO: 2101127 - RNA, 21 nt, Homo sapiens
aaagaccuggccuuucacuuu

SEQ ID NO: 2101128 - RNA, 20 nt, Homo sapiens
ucaucaauggggccagucag

SEQ ID NO: 2101129 - RNA, 13 nt, Homo sapiens
uagucacacauag

SEQ ID NO: 2101130 - RNA, 15 nt, Homo sapiens
caguucauggcauca

SEQ ID NO: 2101131 - RNA, 12 nt, Homo sapiens
cuucagacaccc

SEQ ID NO: 2101132 - RNA, 12 nt, Homo sapiens
ccucagacaucc

SEQ ID NO: 2101133 - RNA, 12 nt, Homo sapiens
ucagcugaccau

SEQ ID NO: 2101134 - RNA, 16 nt, Homo sapiens
aaggaaacacuucuau

SEQ ID NO: 2101135 - RNA, 16 nt, Homo sapiens
cugccucaacacugaa

SEQ ID NO: 2101136 - RNA, 14 nt, Homo sapiens
ugugggcugugagu

SEQ ID NO: 2101137 - RNA, 18 nt, Homo sapiens
ucacaaggcauucaagug

SEQ ID NO: 2101138 - RNA, 13 nt, Homo sapiens
gggacuuccuugc

SEQ ID NO: 2101139 - RNA, 15 nt, Homo sapiens
uguauguuugcugau

SEQ ID NO: 2101140 - RNA, 14 nt, Homo sapiens
cucgcagccugaag

SEQ ID NO: 2101141 - RNA, 21 nt, Homo sapiens
gugucccuggccccacaagcc

SEQ ID NO: 2101142 - RNA, 16 nt, Homo sapiens
agccccuccagcacca

SEQ ID NO: 2101143 - RNA, 13 nt, Homo sapiens
ggcuuagugccac

SEQ ID NO: 2101144 - RNA, 18 nt, Homo sapiens
ugccacaacgcccggcua

SEQ ID NO: 2101145 - RNA, 11 nt, Homo sapiens
cugacccugua

SEQ ID NO: 2101146 - RNA, 12 nt, Homo sapiens
agcugcucagau

SEQ ID NO: 2101147 - RNA, 19 nt, Homo sapiens
ugggggauucaaaugcaug

SEQ ID NO: 2101148 - RNA, 18 nt, Homo sapiens
uuccauaaacacccauga

SEQ ID NO: 2101149 - RNA, 12 nt, Homo sapiens
uguuugcauuua

SEQ ID NO: 2101150 - RNA, 15 nt, Homo sapiens
aaauuucagcagcug

SEQ ID NO: 2101151 - RNA, 15 nt, Homo sapiens
uggccuuacuguuga

SEQ ID NO: 2101152 - RNA, 15 nt, Homo sapiens
cuucuuggucucagu

SEQ ID NO: 2101153 - RNA, 14 nt, Homo sapiens
caaauugcacugaa

SEQ ID NO: 2101154 - RNA, 14 nt, Homo sapiens
ggccagagcucaac

SEQ ID NO: 2101155 - RNA, 19 nt, Homo sapiens
caguuaacuauugcauuua

SEQ ID NO: 2101156 - RNA, 13 nt, Homo sapiens
gcacucccaaguc

SEQ ID NO: 2101157 - RNA, 19 nt, Homo sapiens
ucugcuccagacagggaau

SEQ ID NO: 2101158 - RNA, 13 nt, Homo sapiens
caaaucaaggcaa

SEQ ID NO: 2101159 - RNA, 19 nt, Homo sapiens
agacccguagaugccaggg

SEQ ID NO: 2101160 - RNA, 13 nt, Homo sapiens
agugccagcuuuc

SEQ ID NO: 2101161 - RNA, 16 nt, Homo sapiens
cagcagcccuaaggau

SEQ ID NO: 2101162 - RNA, 12 nt, Homo sapiens
auuccacuccac

SEQ ID NO: 2101163 - RNA, 23 nt, Homo sapiens
uaaaaagugccuguagaugacau

SEQ ID NO: 2101164 - RNA, 16 nt, Homo sapiens
auuuaaaaugagaucg

SEQ ID NO: 2101165 - RNA, 18 nt, Homo sapiens
cugugagcucaacuaagu

SEQ ID NO: 2101166 - RNA, 13 nt, Homo sapiens
aaggcacugagcg

SEQ ID NO: 2101167 - RNA, 11 nt, Homo sapiens
ucucucaggaa

SEQ ID NO: 2101168 - RNA, 21 nt, Homo sapiens
cugccccccuucccaccccua

SEQ ID NO: 2101169 - RNA, 22 nt, Homo sapiens
gcuauaaauuucuuacugucag

SEQ ID NO: 2101170 - RNA, 18 nt, Homo sapiens
gucucuagugcugugaaa

SEQ ID NO: 2101171 - RNA, 16 nt, Homo sapiens
aauccaagacagccac

SEQ ID NO: 2101172 - RNA, 15 nt, Homo sapiens
aggauuccuuggcau

SEQ ID NO: 2101173 - RNA, 20 nt, Homo sapiens
cagaacuaccauuguaauau

SEQ ID NO: 2101174 - RNA, 13 nt, Homo sapiens
ucccccaacagau

SEQ ID NO: 2101175 - RNA, 17 nt, Homo sapiens
gcagcugggaacugaca

SEQ ID NO: 2101176 - RNA, 17 nt, Homo sapiens
gaaaucaauacugcaca

SEQ ID NO: 2101177 - RNA, 15 nt, Homo sapiens
aacguguuacuggaa

SEQ ID NO: 2101178 - RNA, 12 nt, Homo sapiens
cacccaccaggc

SEQ ID NO: 2101179 - RNA, 12 nt, Homo sapiens
cagacaccagca

SEQ ID NO: 2101180 - RNA, 21 nt, Homo sapiens
agcuucccuuuucucccaaga

SEQ ID NO: 2101181 - RNA, 22 nt, Homo sapiens
gaccuguucuguugacuggggc

SEQ ID NO: 2101182 - RNA, 19 nt, Homo sapiens
acccuaaaguauaacaugu

SEQ ID NO: 2101183 - RNA, 14 nt, Homo sapiens
uucauaugcagaug

SEQ ID NO: 2101184 - RNA, 14 nt, Homo sapiens
cuuaacgugucuga

SEQ ID NO: 2101185 - RNA, 13 nt, Homo sapiens
ugacuaacagccu

SEQ ID NO: 2101186 - RNA, 13 nt, Homo sapiens
uuccaaacauaca

SEQ ID NO: 2101187 - RNA, 17 nt, Homo sapiens
aaccuaauaucacuuaa

SEQ ID NO: 2101188 - RNA, 16 nt, Homo sapiens
uacggaauuccaauau

SEQ ID NO: 2101189 - RNA, 17 nt, Homo sapiens
ccgguacaaguggcuca

SEQ ID NO: 2101190 - RNA, 23 nt, Homo sapiens
cuagagugcagggauuacaggcg

SEQ ID NO: 2101191 - RNA, 14 nt, Homo sapiens
aaggcagaggaauu

SEQ ID NO: 2101192 - RNA, 17 nt, Homo sapiens
aggaucagcacugccag

SEQ ID NO: 2101193 - RNA, 22 nt, Homo sapiens
aucucauguucaaagugugaca

SEQ ID NO: 2101194 - RNA, 14 nt, Homo sapiens
uagugguuacccag

SEQ ID NO: 2101195 - RNA, 16 nt, Homo sapiens
aauuuauaacaauuga

SEQ ID NO: 2101196 - RNA, 12 nt, Homo sapiens
uuucauggaaaa

SEQ ID NO: 2101197 - RNA, 19 nt, Homo sapiens
cacaugaaaccuacacacu

SEQ ID NO: 2101198 - RNA, 14 nt, Homo sapiens
cagaauuacaggaa

SEQ ID NO: 2101199 - RNA, 21 nt, Homo sapiens
guuuuucaccacuucacugaa

SEQ ID NO: 2101200 - RNA, 21 nt, Homo sapiens
uggcaaggcuuaggaaaguga

SEQ ID NO: 2101201 - RNA, 22 nt, Homo sapiens
acucccaugcaaguagcuggcu

SEQ ID NO: 2101202 - RNA, 15 nt, Homo sapiens
cagugccuuccauaa

SEQ ID NO: 2101203 - RNA, 16 nt, Homo sapiens
cuugcugcugcugcac

SEQ ID NO: 2101204 - RNA, 22 nt, Homo sapiens
gaauuagggccccaacuacaca

SEQ ID NO: 2101205 - RNA, 12 nt, Homo sapiens
cugcacaugugc

SEQ ID NO: 2101206 - RNA, 19 nt, Homo sapiens
gaauauaaaugggaaauca

SEQ ID NO: 2101207 - RNA, 22 nt, Homo sapiens
aaaguccacauuagaucagaua

SEQ ID NO: 2101208 - RNA, 10 nt, Homo sapiens
ggaagagcuc

SEQ ID NO: 2101209 - RNA, 15 nt, Homo sapiens
acaaaccuagaauuu

SEQ ID NO: 2101210 - RNA, 17 nt, Homo sapiens
uguuuuucacauauaaa

SEQ ID NO: 2101211 - RNA, 17 nt, Homo sapiens
agccugcccucagcaca

SEQ ID NO: 2101212 - RNA, 19 nt, Homo sapiens
uuuucagcucuuugacaac

SEQ ID NO: 2101213 - RNA, 17 nt, Homo sapiens
cccuccucccuguuaaa

SEQ ID NO: 2101214 - RNA, 18 nt, Homo sapiens
cagcugcuucucccacuu

SEQ ID NO: 2101215 - RNA, 19 nt, Homo sapiens
auguuuaaaggacccuaua

SEQ ID NO: 2101216 - RNA, 19 nt, Homo sapiens
aaaaaugggaacauacaga

SEQ ID NO: 2101217 - RNA, 14 nt, Homo sapiens
caucauuuccugug

SEQ ID NO: 2101218 - RNA, 17 nt, Homo sapiens
uaugugcgugcaugugu

SEQ ID NO: 2101219 - RNA, 17 nt, Homo sapiens
ugcacacacaugcauac

SEQ ID NO: 2101220 - RNA, 16 nt, Homo sapiens
ggcacauggcuggcac

SEQ ID NO: 2101221 - RNA, 21 nt, Homo sapiens
uuuaaacauuuuuaucuauca

SEQ ID NO: 2101222 - RNA, 17 nt, Homo sapiens
uccaaccaagaggauuu

SEQ ID NO: 2101223 - RNA, 19 nt, Homo sapiens
uaaucucuuaauauugaga

SEQ ID NO: 2101224 - RNA, 18 nt, Homo sapiens
ucuuguuauugaaguguu

SEQ ID NO: 2101225 - RNA, 16 nt, Homo sapiens
auuuacacauucucac

SEQ ID NO: 2101226 - RNA, 16 nt, Homo sapiens
augccacagcccuguc

SEQ ID NO: 2101227 - RNA, 13 nt, Homo sapiens
agauuaaguauaa

SEQ ID NO: 2101228 - RNA, 16 nt, Homo sapiens
auauugcuuccugugu

SEQ ID NO: 2101229 - RNA, 16 nt, Homo sapiens
aagagcuuaagaacca

SEQ ID NO: 2101230 - RNA, 22 nt, Homo sapiens
caaccuaauuguagcaucuaau

SEQ ID NO: 2101231 - RNA, 20 nt, Homo sapiens
ucucuagaagcugucugcgu

SEQ ID NO: 2101232 - RNA, 10 nt, Homo sapiens
gccucugggc

SEQ ID NO: 2101233 - RNA, 17 nt, Homo sapiens
auaauuaaaauuuaucu

SEQ ID NO: 2101234 - RNA, 20 nt, Homo sapiens
cagcacuggaaccaccugga

SEQ ID NO: 2101235 - RNA, 14 nt, Homo sapiens
uaccagcucagggg

SEQ ID NO: 2101236 - RNA, 22 nt, Homo sapiens
uaaguaguugguuuccuucaca

SEQ ID NO: 2101237 - RNA, 15 nt, Homo sapiens
caacgagagcacuug

SEQ ID NO: 2101238 - RNA, 15 nt, Homo sapiens
ugugccuuugcauaa

SEQ ID NO: 2101239 - RNA, 16 nt, Homo sapiens
auuuuuuuaagcaaca

SEQ ID NO: 2101240 - RNA, 15 nt, Homo sapiens
aguucugcuugcucc

SEQ ID NO: 2101241 - RNA, 20 nt, Homo sapiens
uucaucucaggccucccuca

SEQ ID NO: 2101242 - RNA, 19 nt, Homo sapiens
aagcuuuaaauggcaauuu

SEQ ID NO: 2101243 - RNA, 21 nt, Homo sapiens
ggagcugaugaaacucacaaa

SEQ ID NO: 2101244 - RNA, 18 nt, Homo sapiens
cuguugcuuuacaguuac

SEQ ID NO: 2101245 - RNA, 15 nt, Homo sapiens
gaaguacacauuucu

SEQ ID NO: 2101246 - RNA, 17 nt, Homo sapiens
cgugaacugcagugaug

SEQ ID NO: 2101247 - RNA, 14 nt, Homo sapiens
gcuguauagcuccu

SEQ ID NO: 2101248 - RNA, 14 nt, Homo sapiens
auaccauguauaau

SEQ ID NO: 2101249 - RNA, 17 nt, Homo sapiens
uuaaauuuggcucuaaa

SEQ ID NO: 2101250 - RNA, 13 nt, Homo sapiens
gggaaaaccagac

SEQ ID NO: 2101251 - RNA, 22 nt, Homo sapiens
gaaaaggcuugagucuggauaa

SEQ ID NO: 2101252 - RNA, 15 nt, Homo sapiens
ugaccuuacaaaagu

SEQ ID NO: 2101253 - RNA, 22 nt, Homo sapiens
aagaaaauuauauucuguuuau

SEQ ID NO: 2101254 - RNA, 16 nt, Homo sapiens
ucaugagccugcugga

SEQ ID NO: 2101255 - RNA, 14 nt, Homo sapiens
uuagaaaaggugau

SEQ ID NO: 2101256 - RNA, 21 nt, Homo sapiens
cugccuuagggccucauuugc

SEQ ID NO: 2101257 - RNA, 13 nt, Homo sapiens
cagagacuauuua

SEQ ID NO: 2101258 - RNA, 13 nt, Homo sapiens
gagcaaaccacau

SEQ ID NO: 2101259 - RNA, 14 nt, Homo sapiens
agucacagauucuu

SEQ ID NO: 2101260 - RNA, 22 nt, Homo sapiens
aaaauaguuuggauuacuuaaa

SEQ ID NO: 2101261 - RNA, 23 nt, Homo sapiens
accuccccagccccuagcccagg

SEQ ID NO: 2101262 - RNA, 13 nt, Homo sapiens
gccagacaugcca

SEQ ID NO: 2101263 - RNA, 13 nt, Homo sapiens
gcuccccagugaa

SEQ ID NO: 2101264 - RNA, 15 nt, Homo sapiens
ccuggacaccucuca

SEQ ID NO: 2101265 - RNA, 15 nt, Homo sapiens
ugucaguaaaacucu

SEQ ID NO: 2101266 - RNA, 16 nt, Homo sapiens
auacuggacucuucaa

SEQ ID NO: 2101267 - RNA, 18 nt, Homo sapiens
gcuggcucugcacuaaga

SEQ ID NO: 2101268 - RNA, 23 nt, Homo sapiens
uaaacugguauuuuaucuuugau

SEQ ID NO: 2101269 - RNA, 15 nt, Homo sapiens
uuucuccuuagucuu

SEQ ID NO: 2101270 - RNA, 15 nt, Homo sapiens
cugucuuucaucucc

SEQ ID NO: 2101271 - RNA, 15 nt, Homo sapiens
cacaaugcugaugaa

SEQ ID NO: 2101272 - RNA, 21 nt, Homo sapiens
ggacauuuugggcuggauaaa

SEQ ID NO: 2101273 - RNA, 22 nt, Homo sapiens
uacuggacgcuguccugagaug

SEQ ID NO: 2101274 - RNA, 19 nt, Homo sapiens
augggacucauuguagaaa

SEQ ID NO: 2101275 - RNA, 14 nt, Homo sapiens
aggccuccaaagca

SEQ ID NO: 2101276 - RNA, 18 nt, Homo sapiens
aggaagcauaaagcaauu

SEQ ID NO: 2101277 - RNA, 14 nt, Homo sapiens
cccuucccuuccac

SEQ ID NO: 2101278 - RNA, 14 nt, Homo sapiens
ccauauugaugaag

SEQ ID NO: 2101279 - RNA, 14 nt, Homo sapiens
gccccacuccuucc

SEQ ID NO: 2101280 - RNA, 13 nt, Homo sapiens
uccacaaggggau

SEQ ID NO: 2101281 - RNA, 18 nt, Homo sapiens
cacccaugaaucaaagac

SEQ ID NO: 2101282 - RNA, 23 nt, Homo sapiens
caccauucuuucuuggugcauuc

SEQ ID NO: 2101283 - RNA, 20 nt, Homo sapiens
gaaacauggaggaacaguau

SEQ ID NO: 2101284 - RNA, 20 nt, Homo sapiens
ucuugcccuaggauacccag

SEQ ID NO: 2101285 - RNA, 17 nt, Homo sapiens
aguaacugcacacuauu

SEQ ID NO: 2101286 - RNA, 15 nt, Homo sapiens
uagguguggcuguga

SEQ ID NO: 2101287 - RNA, 19 nt, Homo sapiens
augcaagguauuucuccag

SEQ ID NO: 2101288 - RNA, 19 nt, Homo sapiens
ccagaucgcaccacugcac

SEQ ID NO: 2101289 - RNA, 15 nt, Homo sapiens
uguggcaucuugcca

SEQ ID NO: 2101290 - RNA, 15 nt, Homo sapiens
cuaugacuugaucac

SEQ ID NO: 2101291 - RNA, 15 nt, Homo sapiens
cucacuguugcagug

SEQ ID NO: 2101292 - RNA, 20 nt, Homo sapiens
ugauucaagccauuccaaag

SEQ ID NO: 2101293 - RNA, 20 nt, Homo sapiens
caagauuguuuucagauaua

SEQ ID NO: 2101294 - RNA, 20 nt, Homo sapiens
ugcucccucagccucagagg

SEQ ID NO: 2101295 - RNA, 23 nt, Homo sapiens
auuaaaacacaaaguccuuaaca

SEQ ID NO: 2101296 - RNA, 10 nt, Homo sapiens
aacagggaag

SEQ ID NO: 2101297 - RNA, 15 nt, Homo sapiens
cuucaacuacuucuc

SEQ ID NO: 2101298 - RNA, 15 nt, Homo sapiens
ucuuagacacugugg

SEQ ID NO: 2101299 - RNA, 17 nt, Homo sapiens
agcugauucccagagca

SEQ ID NO: 2101300 - RNA, 20 nt, Homo sapiens
uaacuguaugggagcuuaac

SEQ ID NO: 2101301 - RNA, 16 nt, Homo sapiens
cugugacccaucugua

SEQ ID NO: 2101302 - RNA, 14 nt, Homo sapiens
uuaaaaugucaaga

SEQ ID NO: 2101303 - RNA, 20 nt, Homo sapiens
uucaauaaaaugcacugacc

SEQ ID NO: 2101304 - RNA, 19 nt, Homo sapiens
caaggaaacgcuaccucuc

SEQ ID NO: 2101305 - RNA, 19 nt, Homo sapiens
ccaggagaugcugggccag

SEQ ID NO: 2101306 - RNA, 21 nt, Homo sapiens
guucuuuaauguuguccagga

SEQ ID NO: 2101307 - RNA, 15 nt, Homo sapiens
uuuaagggaauguga

SEQ ID NO: 2101308 - RNA, 23 nt, Homo sapiens
aucaaaacacacuacuaccucuu

SEQ ID NO: 2101309 - RNA, 20 nt, Homo sapiens
cugugccauuucucagggaa

SEQ ID NO: 2101310 - RNA, 19 nt, Homo sapiens
acuccaaugcguggcucuc

SEQ ID NO: 2101311 - RNA, 15 nt, Homo sapiens
ggacccccacuaaga

SEQ ID NO: 2101312 - RNA, 14 nt, Homo sapiens
ccaaaaguuauuaa

SEQ ID NO: 2101313 - RNA, 14 nt, Homo sapiens
cauuggguucaagg

SEQ ID NO: 2101314 - RNA, 14 nt, Homo sapiens
aauagcucuacugc

SEQ ID NO: 2101315 - RNA, 19 nt, Homo sapiens
caggauucccccaacacac

SEQ ID NO: 2101316 - RNA, 20 nt, Homo sapiens
uucuuuagagggaaggaaua

SEQ ID NO: 2101317 - RNA, 13 nt, Homo sapiens
uucuuacuguauu

SEQ ID NO: 2101318 - RNA, 23 nt, Homo sapiens
ucccaacugcagguccagugcag

SEQ ID NO: 2101319 - RNA, 14 nt, Homo sapiens
cuguacaauugcau

SEQ ID NO: 2101320 - RNA, 21 nt, Homo sapiens
acugaacuuaauaacugugua

SEQ ID NO: 2101321 - RNA, 20 nt, Homo sapiens
cagaacggguucaguuuuag

SEQ ID NO: 2101322 - RNA, 22 nt, Homo sapiens
uaacauuaucuaguucauugaa

SEQ ID NO: 2101323 - RNA, 23 nt, Homo sapiens
agcgugcuggcgacacucagggc

SEQ ID NO: 2101324 - RNA, 15 nt, Homo sapiens
agccgccauugccac

SEQ ID NO: 2101325 - RNA, 15 nt, Homo sapiens
cauuugaggaucuca

SEQ ID NO: 2101326 - RNA, 19 nt, Homo sapiens
cuguuauuauauuugacau

SEQ ID NO: 2101327 - RNA, 15 nt, Homo sapiens
caugcaacuccaugc

SEQ ID NO: 2101328 - RNA, 20 nt, Homo sapiens
ggagagcuggggaagcuucu

SEQ ID NO: 2101329 - RNA, 22 nt, Homo sapiens
ugaguagcuggauuacaggcau

SEQ ID NO: 2101330 - RNA, 20 nt, Homo sapiens
gaaagguuugagaagcacug

SEQ ID NO: 2101331 - RNA, 16 nt, Homo sapiens
uccuguucuauaacag

SEQ ID NO: 2101332 - RNA, 16 nt, Homo sapiens
aggcucucuugugcau

SEQ ID NO: 2101333 - RNA, 13 nt, Homo sapiens
cuguuucuugcac

SEQ ID NO: 2101334 - RNA, 19 nt, Homo sapiens
gccauucugugcaggcugc

SEQ ID NO: 2101335 - RNA, 20 nt, Homo sapiens
gacacucuagugacuuccug

SEQ ID NO: 2101336 - RNA, 22 nt, Homo sapiens
cugagaggcaggcauagaggcu

SEQ ID NO: 2101337 - RNA, 19 nt, Homo sapiens
cuuguguuauuuaaugagu

SEQ ID NO: 2101338 - RNA, 18 nt, Homo sapiens
gccugaugcucccucccc

SEQ ID NO: 2101339 - RNA, 20 nt, Homo sapiens
agauuugagcucagcccugg

SEQ ID NO: 2101340 - RNA, 22 nt, Homo sapiens
auagacauggaugcgaggacca

SEQ ID NO: 2101341 - RNA, 21 nt, Homo sapiens
aaaguggcucuucuaaccuca

SEQ ID NO: 2101342 - RNA, 19 nt, Homo sapiens
uacaugacugcaacuguau

SEQ ID NO: 2101343 - RNA, 19 nt, Homo sapiens
caggagcugggauccuaag

SEQ ID NO: 2101344 - RNA, 23 nt, Homo sapiens
augucauaccuuuggauacgaag

SEQ ID NO: 2101345 - RNA, 21 nt, Homo sapiens
uauuuuaggcacuguucaaua

SEQ ID NO: 2101346 - RNA, 16 nt, Homo sapiens
cugugaggcuugccca

SEQ ID NO: 2101347 - RNA, 22 nt, Homo sapiens
ucaugaugguccuaaauaaagu

SEQ ID NO: 2101348 - RNA, 11 nt, Homo sapiens
caaaugcucaa

SEQ ID NO: 2101349 - RNA, 16 nt, Homo sapiens
caggaaggaaugcaaa

SEQ ID NO: 2101350 - RNA, 16 nt, Homo sapiens
gagacaugugacauuu

SEQ ID NO: 2101351 - RNA, 14 nt, Homo sapiens
cuaucuugaaucuu

SEQ ID NO: 2101352 - RNA, 15 nt, Homo sapiens
cugaaaugaccaaga

SEQ ID NO: 2101353 - RNA, 14 nt, Homo sapiens
ucccacagcacuaa

SEQ ID NO: 2101354 - RNA, 13 nt, Homo sapiens
cacagauuuacuc

SEQ ID NO: 2101355 - RNA, 15 nt, Homo sapiens
agcacagcuuuccug

SEQ ID NO: 2101356 - RNA, 13 nt, Homo sapiens
agaaacaacagaa

SEQ ID NO: 2101357 - RNA, 17 nt, Homo sapiens
gucauccagcucacuca

SEQ ID NO: 2101358 - RNA, 14 nt, Homo sapiens
uaagaggcagugag

SEQ ID NO: 2101359 - RNA, 16 nt, Homo sapiens
ucuuagcagugucucu

SEQ ID NO: 2101360 - RNA, 22 nt, Homo sapiens
gagaaucagggcaggcuugcca

SEQ ID NO: 2101361 - RNA, 12 nt, Homo sapiens
cucccaccucaa

SEQ ID NO: 2101362 - RNA, 23 nt, Homo sapiens
cacugacucuggaaaaggcauau

SEQ ID NO: 2101363 - RNA, 21 nt, Homo sapiens
acaccugagcgcuguggacug

SEQ ID NO: 2101364 - RNA, 20 nt, Homo sapiens
gacuuggcuggggaggacca

SEQ ID NO: 2101365 - RNA, 15 nt, Homo sapiens
caaguauuuugccac

SEQ ID NO: 2101366 - RNA, 18 nt, Homo sapiens
cugacugcuaguugccau

SEQ ID NO: 2101367 - RNA, 15 nt, Homo sapiens
gugggcugauggccu

SEQ ID NO: 2101368 - RNA, 13 nt, Homo sapiens
gaaaagauuuuua

SEQ ID NO: 2101369 - RNA, 22 nt, Homo sapiens
cauuuacagaaacgcauccagc

SEQ ID NO: 2101370 - RNA, 15 nt, Homo sapiens
cucuccgaccagaca

SEQ ID NO: 2101371 - RNA, 17 nt, Homo sapiens
uucuauuucuaucccaa

SEQ ID NO: 2101372 - RNA, 13 nt, Homo sapiens
cagucagugcuaa

SEQ ID NO: 2101373 - RNA, 19 nt, Homo sapiens
auagcacacuuuuccacau

SEQ ID NO: 2101374 - RNA, 21 nt, Homo sapiens
aacugugcagagacuuuaucc

SEQ ID NO: 2101375 - RNA, 21 nt, Homo sapiens
aguaggacugcugacauuuug

SEQ ID NO: 2101376 - RNA, 22 nt, Homo sapiens
ugcuaaccuggauaacuguaaa

SEQ ID NO: 2101377 - RNA, 23 nt, Homo sapiens
ucccuggggucacaugcuuuguu

SEQ ID NO: 2101378 - RNA, 14 nt, Homo sapiens
cagauguaaauuaa

SEQ ID NO: 2101379 - RNA, 19 nt, Homo sapiens
gaguuuaugggaaugccuu

SEQ ID NO: 2101380 - RNA, 23 nt, Homo sapiens
aaggcucgaguuaaaacaaugaa

SEQ ID NO: 2101381 - RNA, 17 nt, Homo sapiens
uguauguuuuauaucaa

SEQ ID NO: 2101382 - RNA, 23 nt, Homo sapiens
ugcuggcacagacuucacacagc

SEQ ID NO: 2101383 - RNA, 14 nt, Homo sapiens
ggguuccauucuca

SEQ ID NO: 2101384 - RNA, 19 nt, Homo sapiens
caaaaguuacccaaagggc

SEQ ID NO: 2101385 - RNA, 14 nt, Homo sapiens
auggaggucauaca

SEQ ID NO: 2101386 - RNA, 11 nt, Homo sapiens
cuaaaccaagu

SEQ ID NO: 2101387 - RNA, 15 nt, Homo sapiens
cuucacccugaggug

SEQ ID NO: 2101388 - RNA, 18 nt, Homo sapiens
aaguuaaaaacauuuuca

SEQ ID NO: 2101389 - RNA, 23 nt, Homo sapiens
aacucuucacucuucaaaugccu

SEQ ID NO: 2101390 - RNA, 18 nt, Homo sapiens
ugucucaaaaaauauaua

SEQ ID NO: 2101391 - RNA, 23 nt, Homo sapiens
uaacaucugaagugucuaaugca

SEQ ID NO: 2101392 - RNA, 20 nt, Homo sapiens
aucgacuuagccugagucau

SEQ ID NO: 2101393 - RNA, 18 nt, Homo sapiens
ugaguucuggucaaagaa

SEQ ID NO: 2101394 - RNA, 17 nt, Homo sapiens
acuguacugagacauua

SEQ ID NO: 2101395 - RNA, 18 nt, Homo sapiens
caaagcauuuugccuacc

SEQ ID NO: 2101396 - RNA, 15 nt, Homo sapiens
accaccucaccaguu

SEQ ID NO: 2101397 - RNA, 19 nt, Homo sapiens
uccugggauuacaggugug

SEQ ID NO: 2101398 - RNA, 19 nt, Homo sapiens
ugguauguaauuuaugcaa

SEQ ID NO: 2101399 - RNA, 21 nt, Homo sapiens
uaacaauugucuuaaaaccag

SEQ ID NO: 2101400 - RNA, 19 nt, Homo sapiens
ucaaacucuugaccucagg

SEQ ID NO: 2101401 - RNA, 19 nt, Homo sapiens
acuccaagauucaaagaga

SEQ ID NO: 2101402 - RNA, 23 nt, Homo sapiens
gaaguacaaaaggaacuaugaaa

SEQ ID NO: 2101403 - RNA, 16 nt, Homo sapiens
cauagacaauuccucc

SEQ ID NO: 2101404 - RNA, 22 nt, Homo sapiens
uuagacaguaugcauacuggug

SEQ ID NO: 2101405 - RNA, 17 nt, Homo sapiens
cuggcuuugcucuauua

SEQ ID NO: 2101406 - RNA, 22 nt, Homo sapiens
uaggaagaauuuuuauauccac

SEQ ID NO: 2101407 - RNA, 14 nt, Homo sapiens
caauuccaguggaa

SEQ ID NO: 2101408 - RNA, 22 nt, Homo sapiens
gaccuuggaaacaguuggcacu

SEQ ID NO: 2101409 - RNA, 17 nt, Homo sapiens
uccuggccucauacaga

SEQ ID NO: 2101410 - RNA, 19 nt, Homo sapiens
aagaauacacugugacuua

SEQ ID NO: 2101411 - RNA, 19 nt, Homo sapiens
uauuuucagaagcugauga

SEQ ID NO: 2101412 - RNA, 15 nt, Homo sapiens
uccgcgcuguguaaa

SEQ ID NO: 2101413 - RNA, 21 nt, Homo sapiens
uacaauuuccauauagucuau

SEQ ID NO: 2101414 - RNA, 20 nt, Homo sapiens
cuaaaaucuuauaguucuag

SEQ ID NO: 2101415 - RNA, 12 nt, Homo sapiens
ucucucaggguu

SEQ ID NO: 2101416 - RNA, 16 nt, Homo sapiens
cccaggauuugacucg

SEQ ID NO: 2101417 - RNA, 17 nt, Homo sapiens
augagcguccaggugau

SEQ ID NO: 2101418 - RNA, 21 nt, Homo sapiens
auaugcaaauuccauagcuca

SEQ ID NO: 2101419 - RNA, 18 nt, Homo sapiens
cuugagaagcugccauau

SEQ ID NO: 2101420 - RNA, 14 nt, Homo sapiens
gucauuugaaugag

SEQ ID NO: 2101421 - RNA, 15 nt, Homo sapiens
ugacuaaucagauga

SEQ ID NO: 2101422 - RNA, 19 nt, Homo sapiens
uuaggaccuaaugggaccc

SEQ ID NO: 2101423 - RNA, 22 nt, Homo sapiens
aacucugucuucaccugauuca

SEQ ID NO: 2101424 - RNA, 13 nt, Homo sapiens
ucucagaccccac

SEQ ID NO: 2101425 - RNA, 17 nt, Homo sapiens
cuuggccuccugcuuca

SEQ ID NO: 2101426 - RNA, 16 nt, Homo sapiens
cuuugacaucauucau

SEQ ID NO: 2101427 - RNA, 22 nt, Homo sapiens
gccuaggaaagccaguuacaua

SEQ ID NO: 2101428 - RNA, 14 nt, Homo sapiens
gcuuucagggccau

SEQ ID NO: 2101429 - RNA, 15 nt, Homo sapiens
aagucucuagccucu

SEQ ID NO: 2101430 - RNA, 14 nt, Homo sapiens
ggugugaguccaaa

SEQ ID NO: 2101431 - RNA, 18 nt, Homo sapiens
auauuccauccauauacu

SEQ ID NO: 2101432 - RNA, 18 nt, Homo sapiens
ccacuuugcuguuccuua

SEQ ID NO: 2101433 - RNA, 19 nt, Homo sapiens
ccuccaaaucugauuucau

SEQ ID NO: 2101434 - RNA, 22 nt, Homo sapiens
auacuacauucgugugugucug

SEQ ID NO: 2101435 - RNA, 13 nt, Homo sapiens
ccaucucuuuacc

SEQ ID NO: 2101436 - RNA, 18 nt, Homo sapiens
cuucuucaugaugguggu

SEQ ID NO: 2101437 - RNA, 19 nt, Homo sapiens
ugcacuuuaugaaaacuga

SEQ ID NO: 2101438 - RNA, 23 nt, Homo sapiens
agcuuccaggcuggcgugcagca

SEQ ID NO: 2101439 - RNA, 23 nt, Homo sapiens
gauuuuccucccugcagagccaa

SEQ ID NO: 2101440 - RNA, 17 nt, Homo sapiens
aauaccgcucaguauuu

SEQ ID NO: 2101441 - RNA, 18 nt, Homo sapiens
uuaaaccguacacugugu

SEQ ID NO: 2101442 - RNA, 20 nt, Homo sapiens
ccaguaguaaugugcuuguu

SEQ ID NO: 2101443 - RNA, 15 nt, Homo sapiens
caccuauguggcaug

SEQ ID NO: 2101444 - RNA, 15 nt, Homo sapiens
ucugaaccauuacug

SEQ ID NO: 2101445 - RNA, 15 nt, Homo sapiens
uaaacuacaacgaac

SEQ ID NO: 2101446 - RNA, 17 nt, Homo sapiens
gaugaauguaugugcac

SEQ ID NO: 2101447 - RNA, 14 nt, Homo sapiens
caccuugcauuuca

SEQ ID NO: 2101448 - RNA, 18 nt, Homo sapiens
uuaaaaagcccaaccucu

SEQ ID NO: 2101449 - RNA, 21 nt, Homo sapiens
ucauaccaauuccaacuuuca

SEQ ID NO: 2101450 - RNA, 15 nt, Homo sapiens
ucugagcuauuucau

SEQ ID NO: 2101451 - RNA, 18 nt, Homo sapiens
gauauuucaugugcuaua

SEQ ID NO: 2101452 - RNA, 14 nt, Homo sapiens
agauuuuuauauca

SEQ ID NO: 2101453 - RNA, 16 nt, Homo sapiens
cagugcuugaaugaag

SEQ ID NO: 2101454 - RNA, 20 nt, Homo sapiens
ucuuuauuauggaaaacauu

SEQ ID NO: 2101455 - RNA, 16 nt, Homo sapiens
caaugacugugcucac

SEQ ID NO: 2101456 - RNA, 23 nt, Homo sapiens
cacuuuaucuauaucucauuuca

SEQ ID NO: 2101457 - RNA, 15 nt, Homo sapiens
gcgcauggugcagug

SEQ ID NO: 2101458 - RNA, 18 nt, Homo sapiens
gccaaggcuaauccaauu

SEQ ID NO: 2101459 - RNA, 19 nt, Homo sapiens
agaugacacaacugcacuc

SEQ ID NO: 2101460 - RNA, 14 nt, Homo sapiens
gaacuaaauaugca

SEQ ID NO: 2101461 - RNA, 12 nt, Homo sapiens
aaauacauauga

SEQ ID NO: 2101462 - RNA, 19 nt, Homo sapiens
caugucuguuuacacuucu

SEQ ID NO: 2101463 - RNA, 21 nt, Homo sapiens
ggguaagaugcuccugguggc

SEQ ID NO: 2101464 - RNA, 22 nt, Homo sapiens
ucauaguggcuuaaaacaacac

SEQ ID NO: 2101465 - RNA, 23 nt, Homo sapiens
cuuaacgugucugagagccauaa

SEQ ID NO: 2101466 - RNA, 23 nt, Homo sapiens
uuugaauguuuucaaaaccaagu

SEQ ID NO: 2101467 - RNA, 16 nt, Homo sapiens
caaaauguucuauuua

SEQ ID NO: 2101468 - RNA, 13 nt, Homo sapiens
uuuaauauaugca

SEQ ID NO: 2101469 - RNA, 21 nt, Homo sapiens
aaauguuauuaaaauauccag

SEQ ID NO: 2101470 - RNA, 13 nt, Homo sapiens
auuaauauuugca

SEQ ID NO: 2101471 - RNA, 14 nt, Homo sapiens
ccccgcaccuguac

SEQ ID NO: 2101472 - RNA, 22 nt, Homo sapiens
agcaacaguuaugggacacuga

SEQ ID NO: 2101473 - RNA, 15 nt, Homo sapiens
aucucuagggaccag

SEQ ID NO: 2101474 - RNA, 22 nt, Homo sapiens
uccuggugccccccaccccugg

SEQ ID NO: 2101475 - RNA, 17 nt, Homo sapiens
ggccccauuuacccaac

SEQ ID NO: 2101476 - RNA, 17 nt, Homo sapiens
uuuuuaaauuuuguaug

SEQ ID NO: 2101477 - RNA, 17 nt, Homo sapiens
ugagccccaggcacuuu

SEQ ID NO: 2101478 - RNA, 18 nt, Homo sapiens
gugacugcgcacugagua

SEQ ID NO: 2101479 - RNA, 14 nt, Homo sapiens
agguggguccagga

SEQ ID NO: 2101480 - RNA, 18 nt, Homo sapiens
aauguaaaauguugaaua

SEQ ID NO: 2101481 - RNA, 15 nt, Homo sapiens
ugccuccuugccagc

SEQ ID NO: 2101482 - RNA, 15 nt, Homo sapiens
aauauauaguccaga

SEQ ID NO: 2101483 - RNA, 16 nt, Homo sapiens
uaccguguggcccaag

SEQ ID NO: 2101484 - RNA, 21 nt, Homo sapiens
cuggagagguuaaggugcaau

SEQ ID NO: 2101485 - RNA, 18 nt, Homo sapiens
gggauaggacugaguggu

SEQ ID NO: 2101486 - RNA, 22 nt, Homo sapiens
uuggcccacgcagcagcagagc

SEQ ID NO: 2101487 - RNA, 15 nt, Homo sapiens
aggcaggcagaucac

SEQ ID NO: 2101488 - RNA, 21 nt, Homo sapiens
uuuaaauggcuuuaugcuagu

SEQ ID NO: 2101489 - RNA, 20 nt, Homo sapiens
agccuucucuguucauuucc

SEQ ID NO: 2101490 - RNA, 23 nt, Homo sapiens
ccaggaggcagagguugcaguga

SEQ ID NO: 2101491 - RNA, 21 nt, Homo sapiens
accaguguuauuaaugacaaa

SEQ ID NO: 2101492 - RNA, 14 nt, Homo sapiens
aaaagaaggucaaa

SEQ ID NO: 2101493 - RNA, 16 nt, Homo sapiens
ccagccugccuggcag

SEQ ID NO: 2101494 - RNA, 16 nt, Homo sapiens
ugaggacaccagugaa

SEQ ID NO: 2101495 - RNA, 15 nt, Homo sapiens
aaggacuuugcagcc

SEQ ID NO: 2101496 - RNA, 11 nt, Homo sapiens
accaugacaaa

SEQ ID NO: 2101497 - RNA, 16 nt, Homo sapiens
ugguauuuucagagaa

SEQ ID NO: 2101498 - RNA, 23 nt, Homo sapiens
uggguggggagucagucauguca

SEQ ID NO: 2101499 - RNA, 15 nt, Homo sapiens
gaagauguuguuaaa

SEQ ID NO: 2101500 - RNA, 20 nt, Homo sapiens
gguccccacuuuauugccaa

SEQ ID NO: 2101501 - RNA, 18 nt, Homo sapiens
gcccgggcacuggugggu

SEQ ID NO: 2101502 - RNA, 15 nt, Homo sapiens
guuuuuucugcacaa

SEQ ID NO: 2101503 - RNA, 22 nt, Homo sapiens
ccaccucccugacccgucuaau

SEQ ID NO: 2101504 - RNA, 13 nt, Homo sapiens
accucacacuccu

SEQ ID NO: 2101505 - RNA, 19 nt, Homo sapiens
cagagaaucucuagugaau

SEQ ID NO: 2101506 - RNA, 15 nt, Homo sapiens
gaaaaaaaaauggaa

SEQ ID NO: 2101507 - RNA, 22 nt, Homo sapiens
guauccuuguugacacggccau

SEQ ID NO: 2101508 - RNA, 16 nt, Homo sapiens
cagagugaagagugaa

SEQ ID NO: 2101509 - RNA, 17 nt, Homo sapiens
ucucucacggcuuguaa

SEQ ID NO: 2101510 - RNA, 21 nt, Homo sapiens
aagaaaacuuguauuaugugu

SEQ ID NO: 2101511 - RNA, 14 nt, Homo sapiens
agggagaugggauu

SEQ ID NO: 2101512 - RNA, 21 nt, Homo sapiens
uugagccuuggcccacacuga

SEQ ID NO: 2101513 - RNA, 15 nt, Homo sapiens
agcucuggggggcag

SEQ ID NO: 2101514 - RNA, 21 nt, Homo sapiens
uuuggauuuacgacugaagaa

SEQ ID NO: 2101515 - RNA, 20 nt, Homo sapiens
guggcccuaggacaggagga

SEQ ID NO: 2101516 - RNA, 16 nt, Homo sapiens
ccaacgaaaagcacau

SEQ ID NO: 2101517 - RNA, 18 nt, Homo sapiens
uugcccacugucugcuac

SEQ ID NO: 2101518 - RNA, 17 nt, Homo sapiens
gauuccagucuacuuga

SEQ ID NO: 2101519 - RNA, 17 nt, Homo sapiens
uaggcuaccucaagacu

SEQ ID NO: 2101520 - RNA, 16 nt, Homo sapiens
cuacuuacaacccagg

SEQ ID NO: 2101521 - RNA, 16 nt, Homo sapiens
ucuuggugucuguccu

SEQ ID NO: 2101522 - RNA, 15 nt, Homo sapiens
acauuauuagcacuu

SEQ ID NO: 2101523 - RNA, 23 nt, Homo sapiens
acuuugaccucugcagcaauaaa

SEQ ID NO: 2101524 - RNA, 13 nt, Homo sapiens
ggauagaugaaua

SEQ ID NO: 2101525 - RNA, 18 nt, Homo sapiens
aaauaaagucccagguua

SEQ ID NO: 2101526 - RNA, 15 nt, Homo sapiens
ugugagauacugugu

SEQ ID NO: 2101527 - RNA, 19 nt, Homo sapiens
aagcgauucuccugccuca

SEQ ID NO: 2101528 - RNA, 16 nt, Homo sapiens
uucacagaauagcaca

SEQ ID NO: 2101529 - RNA, 12 nt, Homo sapiens
gaaaauauuuca

SEQ ID NO: 2101530 - RNA, 12 nt, Homo sapiens
agugcugcaauu

SEQ ID NO: 2101531 - RNA, 20 nt, Homo sapiens
agucucacucugucaccagg

SEQ ID NO: 2101532 - RNA, 20 nt, Homo sapiens
aauuaagaugguaagaccuc

SEQ ID NO: 2101533 - RNA, 18 nt, Homo sapiens
acuuuauaaauccaguga

SEQ ID NO: 2101534 - RNA, 23 nt, Homo sapiens
uaauggaugguugaauuaacuuc

SEQ ID NO: 2101535 - RNA, 23 nt, Homo sapiens
uacccagagaccaagaucaucaa

SEQ ID NO: 2101536 - RNA, 12 nt, Homo sapiens
aacccugcaaua

SEQ ID NO: 2101537 - RNA, 20 nt, Homo sapiens
aaacuaaggcauuugauuaa

SEQ ID NO: 2101538 - RNA, 23 nt, Homo sapiens
uauucuuaagggaacuuccacau

SEQ ID NO: 2101539 - RNA, 22 nt, Homo sapiens
aucugagagccgggaaggggaa

SEQ ID NO: 2101540 - RNA, 15 nt, Homo sapiens
cuuuuagcagauaug

SEQ ID NO: 2101541 - RNA, 16 nt, Homo sapiens
ugaaaaucaagcaguu

SEQ ID NO: 2101542 - RNA, 22 nt, Homo sapiens
ucuccuuuucuccacugucaua

SEQ ID NO: 2101543 - RNA, 20 nt, Homo sapiens
uaucaggugccccucuucca

SEQ ID NO: 2101544 - RNA, 11 nt, Homo sapiens
ccagugcaacc

SEQ ID NO: 2101545 - RNA, 21 nt, Homo sapiens
cuugaaaagacaucaagcaca

SEQ ID NO: 2101546 - RNA, 20 nt, Homo sapiens
uccuguuggauaucauacuu

SEQ ID NO: 2101547 - RNA, 13 nt, Homo sapiens
aaaaacauuugua

SEQ ID NO: 2101548 - RNA, 20 nt, Homo sapiens
cagcacccugaugucccugg

SEQ ID NO: 2101549 - RNA, 15 nt, Homo sapiens
uauuugcuauucaaa

SEQ ID NO: 2101550 - RNA, 15 nt, Homo sapiens
agaaugaagaccuaa

SEQ ID NO: 2101551 - RNA, 13 nt, Homo sapiens
gggcccacaaagg

SEQ ID NO: 2101552 - RNA, 15 nt, Homo sapiens
ucaucaagaauuuaa

SEQ ID NO: 2101553 - RNA, 12 nt, Homo sapiens
aauaauaauuag

SEQ ID NO: 2101554 - RNA, 13 nt, Homo sapiens
gcaccucuuggcu

SEQ ID NO: 2101555 - RNA, 14 nt, Homo sapiens
ggcuccccaaaggg

SEQ ID NO: 2101556 - RNA, 17 nt, Homo sapiens
uuugucuuucaaugcag

SEQ ID NO: 2101557 - RNA, 16 nt, Homo sapiens
uaucagaggguggaga

SEQ ID NO: 2101558 - RNA, 16 nt, Homo sapiens
gcaccuggauguacua

SEQ ID NO: 2101559 - RNA, 17 nt, Homo sapiens
caugaacacacauggau

SEQ ID NO: 2101560 - RNA, 22 nt, Homo sapiens
agaagaucacugaagaaacuuc

SEQ ID NO: 2101561 - RNA, 15 nt, Homo sapiens
agaagcuaauaugau

SEQ ID NO: 2101562 - RNA, 15 nt, Homo sapiens
auuacacaaguuuaa

SEQ ID NO: 2101563 - RNA, 22 nt, Homo sapiens
cacaguccaaccagaaacaccc

SEQ ID NO: 2101564 - RNA, 21 nt, Homo sapiens
uccucaggugauuuguaugcu

SEQ ID NO: 2101565 - RNA, 19 nt, Homo sapiens
guccaugugugugcaagug

SEQ ID NO: 2101566 - RNA, 14 nt, Homo sapiens
cuuauuuuugaauu

SEQ ID NO: 2101567 - RNA, 17 nt, Homo sapiens
cacgcucuggugcaguc

SEQ ID NO: 2101568 - RNA, 16 nt, Homo sapiens
cagucauauguucuca

SEQ ID NO: 2101569 - RNA, 22 nt, Homo sapiens
aauuuuuuuucuguaaauggaa

SEQ ID NO: 2101570 - RNA, 14 nt, Homo sapiens
cacucccaccagca

SEQ ID NO: 2101571 - RNA, 12 nt, Homo sapiens
cugcacuuccag

SEQ ID NO: 2101572 - RNA, 14 nt, Homo sapiens
uuauaacagaauua

SEQ ID NO: 2101573 - RNA, 20 nt, Homo sapiens
gcuuauuuuuuucuacauaa

SEQ ID NO: 2101574 - RNA, 19 nt, Homo sapiens
cuagagauuacaauuaaau

SEQ ID NO: 2101575 - RNA, 21 nt, Homo sapiens
aaagagcaacaauccaucucu

SEQ ID NO: 2101576 - RNA, 18 nt, Homo sapiens
uggguuagagauggaguu

SEQ ID NO: 2101577 - RNA, 21 nt, Homo sapiens
cagugcccagcugggggucaa

SEQ ID NO: 2101578 - RNA, 14 nt, Homo sapiens
gcugggagcugccu

SEQ ID NO: 2101579 - RNA, 18 nt, Homo sapiens
cagagguccccugagguc

SEQ ID NO: 2101580 - RNA, 21 nt, Homo sapiens
caagaaagauccacccucaaa

SEQ ID NO: 2101581 - RNA, 18 nt, Homo sapiens
acggucagggucagggcc

SEQ ID NO: 2101582 - RNA, 22 nt, Homo sapiens
cuuccuggacuggcccuugccc

SEQ ID NO: 2101583 - RNA, 16 nt, Homo sapiens
auccacuaaaaucaaa

SEQ ID NO: 2101584 - RNA, 18 nt, Homo sapiens
uagguuucagcaacaaga

SEQ ID NO: 2101585 - RNA, 22 nt, Homo sapiens
ccacauuagccuuugcacugua

SEQ ID NO: 2101586 - RNA, 16 nt, Homo sapiens
ugaacuguugcccuuc

SEQ ID NO: 2101587 - RNA, 15 nt, Homo sapiens
cauugcuaaccacug

SEQ ID NO: 2101588 - RNA, 13 nt, Homo sapiens
cacuguuagcuuu

SEQ ID NO: 2101589 - RNA, 19 nt, Homo sapiens
ugcucacccauugucucau

SEQ ID NO: 2101590 - RNA, 13 nt, Homo sapiens
gcacgugugcugg

SEQ ID NO: 2101591 - RNA, 13 nt, Homo sapiens
ccuuagagcaucu

SEQ ID NO: 2101592 - RNA, 20 nt, Homo sapiens
agugauucucucuucucucc

SEQ ID NO: 2101593 - RNA, 23 nt, Homo sapiens
cucucagcgccgucgccacucgg

SEQ ID NO: 2101594 - RNA, 21 nt, Homo sapiens
ugucagguggacccuguaaau

SEQ ID NO: 2101595 - RNA, 21 nt, Homo sapiens
gguaauuauguuuugugauuc

SEQ ID NO: 2101596 - RNA, 15 nt, Homo sapiens
gaaucguuugaacuc

SEQ ID NO: 2101597 - RNA, 19 nt, Homo sapiens
uaacaagccuuggaccaaa

SEQ ID NO: 2101598 - RNA, 20 nt, Homo sapiens
aacauuuaggaacccagacc

SEQ ID NO: 2101599 - RNA, 22 nt, Homo sapiens
gucauagaauuaauuuucagcc

SEQ ID NO: 2101600 - RNA, 16 nt, Homo sapiens
uauaaguuugcauuau

SEQ ID NO: 2101601 - RNA, 19 nt, Homo sapiens
cugccugggccguggcaca

SEQ ID NO: 2101602 - RNA, 19 nt, Homo sapiens
uuucagcucauuuaauccc

SEQ ID NO: 2101603 - RNA, 12 nt, Homo sapiens
uccucccauuca

SEQ ID NO: 2101604 - RNA, 20 nt, Homo sapiens
ucuggcuuugucucuagccg

SEQ ID NO: 2101605 - RNA, 16 nt, Homo sapiens
auacauaauaaccaaa

SEQ ID NO: 2101606 - RNA, 16 nt, Homo sapiens
gaacuaggguaaggug

SEQ ID NO: 2101607 - RNA, 20 nt, Homo sapiens
gcuuagaaauucagcauuug

SEQ ID NO: 2101608 - RNA, 22 nt, Homo sapiens
ugauaauagcucacagcacauu

SEQ ID NO: 2101609 - RNA, 14 nt, Homo sapiens
aaaaauaauuauuu

SEQ ID NO: 2101610 - RNA, 15 nt, Homo sapiens
aaugauccucagugc

SEQ ID NO: 2101611 - RNA, 19 nt, Homo sapiens
cguggagagggacuggcag

SEQ ID NO: 2101612 - RNA, 16 nt, Homo sapiens
aucucugaaacauauu

SEQ ID NO: 2101613 - RNA, 15 nt, Homo sapiens
uacguggccauguau

SEQ ID NO: 2101614 - RNA, 21 nt, Homo sapiens
aaacaccaagugaggccauag

SEQ ID NO: 2101615 - RNA, 16 nt, Homo sapiens
uccugguuuuugccua

SEQ ID NO: 2101616 - RNA, 14 nt, Homo sapiens
agcagucacuugau

SEQ ID NO: 2101617 - RNA, 14 nt, Homo sapiens
agcaagucacuuaa

SEQ ID NO: 2101618 - RNA, 17 nt, Homo sapiens
uuuaguguuuuuaccuc

SEQ ID NO: 2101619 - RNA, 23 nt, Homo sapiens
aauucucccacacuagcuugcag

SEQ ID NO: 2101620 - RNA, 14 nt, Homo sapiens
cagaguacgugaaa

SEQ ID NO: 2101621 - RNA, 18 nt, Homo sapiens
acaauacaacacauugaa

SEQ ID NO: 2101622 - RNA, 20 nt, Homo sapiens
uaucauguuaguaauaccuc

SEQ ID NO: 2101623 - RNA, 24 nt, Homo sapiens
ugacaccauucuccugccucaccc

SEQ ID NO: 2101624 - RNA, 13 nt, Homo sapiens
ccuguccucaaaa

SEQ ID NO: 2101625 - RNA, 13 nt, Homo sapiens
gcuugaguuauau

SEQ ID NO: 2101626 - RNA, 23 nt, Homo sapiens
aaauuagcuugagcaaccuggcu

SEQ ID NO: 2101627 - RNA, 20 nt, Homo sapiens
agauacacaagugagggcuu

SEQ ID NO: 2101628 - RNA, 18 nt, Homo sapiens
gcaggguccaaaggccag

SEQ ID NO: 2101629 - RNA, 23 nt, Homo sapiens
uuggguucacagcgugcuaaaau

SEQ ID NO: 2101630 - RNA, 17 nt, Homo sapiens
cuccaaccccugcccuu

SEQ ID NO: 2101631 - RNA, 16 nt, Homo sapiens
aauucugaacuuuuca

SEQ ID NO: 2101632 - RNA, 16 nt, Homo sapiens
ccuuuucucauucugu

SEQ ID NO: 2101633 - RNA, 16 nt, Homo sapiens
agagacuauuuagaca

SEQ ID NO: 2101634 - RNA, 13 nt, Homo sapiens
ccucccccgcaga

SEQ ID NO: 2101635 - RNA, 17 nt, Homo sapiens
agcaacaaaaauuacuc

SEQ ID NO: 2101636 - RNA, 22 nt, Homo sapiens
gggcccugccccaccccaucca

SEQ ID NO: 2101637 - RNA, 19 nt, Homo sapiens
acauucuuuuuucuauuca

SEQ ID NO: 2101638 - RNA, 20 nt, Homo sapiens
cacccuguggcucacagugg

SEQ ID NO: 2101639 - RNA, 22 nt, Homo sapiens
accucaagugccuuauucucac

SEQ ID NO: 2101640 - RNA, 22 nt, Homo sapiens
aagggagguucaccugcagcga

SEQ ID NO: 2101641 - RNA, 21 nt, Homo sapiens
cuucugagccugccuuucucc

SEQ ID NO: 2101642 - RNA, 22 nt, Homo sapiens
cuaaaucuguaagcucuuugaa

SEQ ID NO: 2101643 - RNA, 17 nt, Homo sapiens
ucaaugcaaugcaucug

SEQ ID NO: 2101644 - RNA, 19 nt, Homo sapiens
cggcgggaggucugccagg

SEQ ID NO: 2101645 - RNA, 16 nt, Homo sapiens
ucagcugcucugcaag

SEQ ID NO: 2101646 - RNA, 17 nt, Homo sapiens
gugcaacuacuauucaa

SEQ ID NO: 2101647 - RNA, 14 nt, Homo sapiens
ugcuguacaaaagc

SEQ ID NO: 2101648 - RNA, 23 nt, Homo sapiens
accuuaaucugccauaaagccau

SEQ ID NO: 2101649 - RNA, 23 nt, Homo sapiens
gcuaauucuacucacagugcuuu

SEQ ID NO: 2101650 - RNA, 18 nt, Homo sapiens
ugcauguuacccauucaa

SEQ ID NO: 2101651 - RNA, 16 nt, Homo sapiens
ugcuccaggcaucacu

SEQ ID NO: 2101652 - RNA, 18 nt, Homo sapiens
ugauauugaccaugugau

SEQ ID NO: 2101653 - RNA, 19 nt, Homo sapiens
acaaagcaguuacuaauau

SEQ ID NO: 2101654 - RNA, 17 nt, Homo sapiens
ucuggagugauucuaga

SEQ ID NO: 2101655 - RNA, 19 nt, Homo sapiens
cuuagggagggacugggau

SEQ ID NO: 2101656 - RNA, 20 nt, Homo sapiens
aacagccacgucagcuuuuc

SEQ ID NO: 2101657 - RNA, 15 nt, Homo sapiens
ucaauuuaaauaacc

SEQ ID NO: 2101658 - RNA, 15 nt, Homo sapiens
aagauguacugagag

SEQ ID NO: 2101659 - RNA, 21 nt, Homo sapiens
acuugucccuuuuuuguccca

SEQ ID NO: 2101660 - RNA, 18 nt, Homo sapiens
aucuuaguuuacuggaua

SEQ ID NO: 2101661 - RNA, 13 nt, Homo sapiens
gaauguucugcug

SEQ ID NO: 2101662 - RNA, 12 nt, Homo sapiens
augaacuuucuc

SEQ ID NO: 2101663 - RNA, 19 nt, Homo sapiens
uaaaugcuauuauacuguu

SEQ ID NO: 2101664 - RNA, 15 nt, Homo sapiens
cacauucgacauacc

SEQ ID NO: 2101665 - RNA, 18 nt, Homo sapiens
caaagagccucacaguua

SEQ ID NO: 2101666 - RNA, 22 nt, Homo sapiens
agucuugguuccucuacuacuu

SEQ ID NO: 2101667 - RNA, 22 nt, Homo sapiens
aggagaccuacccuccacaggc

SEQ ID NO: 2101668 - RNA, 18 nt, Homo sapiens
auacugccagaugcugau

SEQ ID NO: 2101669 - RNA, 19 nt, Homo sapiens
aucucuacugaaaguacaa

SEQ ID NO: 2101670 - RNA, 18 nt, Homo sapiens
acauuuguuuguggucua

SEQ ID NO: 2101671 - RNA, 13 nt, Homo sapiens
aaacucuucagug

SEQ ID NO: 2101672 - RNA, 19 nt, Homo sapiens
uaaauccaucacuauaaua

SEQ ID NO: 2101673 - RNA, 11 nt, Homo sapiens
cugagaacaaa

SEQ ID NO: 2101674 - RNA, 22 nt, Homo sapiens
aagcugggcugucucucuccau

SEQ ID NO: 2101675 - RNA, 13 nt, Homo sapiens
auacuagauugau

SEQ ID NO: 2101676 - RNA, 23 nt, Homo sapiens
cuggaauuaaggucaaacuaauu

SEQ ID NO: 2101677 - RNA, 19 nt, Homo sapiens
augucagacagaacuugaa

SEQ ID NO: 2101678 - RNA, 13 nt, Homo sapiens
cgugcccggccaa

SEQ ID NO: 2101679 - RNA, 22 nt, Homo sapiens
ucuccacuucacuccagcauca

SEQ ID NO: 2101680 - RNA, 13 nt, Homo sapiens
gccuccuccucac

SEQ ID NO: 2101681 - RNA, 15 nt, Homo sapiens
ccauggggacugggu

SEQ ID NO: 2101682 - RNA, 18 nt, Homo sapiens
gagaaaggagccaccagc

SEQ ID NO: 2101683 - RNA, 19 nt, Homo sapiens
guuauuggagauuaaucua

SEQ ID NO: 2101684 - RNA, 12 nt, Homo sapiens
uguguaaucuaa

SEQ ID NO: 2101685 - RNA, 17 nt, Homo sapiens
uggggaaaccauggcaa

SEQ ID NO: 2101686 - RNA, 12 nt, Homo sapiens
uuguuuacuuaa

SEQ ID NO: 2101687 - RNA, 22 nt, Homo sapiens
augcaguguuucccucuguguu

SEQ ID NO: 2101688 - RNA, 14 nt, Homo sapiens
caguagaagcucac

SEQ ID NO: 2101689 - RNA, 15 nt, Homo sapiens
uuaacaagacuucaa

SEQ ID NO: 2101690 - RNA, 15 nt, Homo sapiens
aggcaggaacacugg

SEQ ID NO: 2101691 - RNA, 23 nt, Homo sapiens
cuggugaauccucguucuaauaa

SEQ ID NO: 2101692 - RNA, 15 nt, Homo sapiens
aucuaaaaugcaaag

SEQ ID NO: 2101693 - RNA, 19 nt, Homo sapiens
aguaugaauauuacucuca

SEQ ID NO: 2101694 - RNA, 16 nt, Homo sapiens
uacaaacuucaaagag

SEQ ID NO: 2101695 - RNA, 23 nt, Homo sapiens
aggaaggguaagggaaaggaugg

SEQ ID NO: 2101696 - RNA, 19 nt, Homo sapiens
gacagcaaacagaucacua

SEQ ID NO: 2101697 - RNA, 15 nt, Homo sapiens
cuugguauagcauau

SEQ ID NO: 2101698 - RNA, 23 nt, Homo sapiens
cagauaugcacacacauggauga

SEQ ID NO: 2101699 - RNA, 13 nt, Homo sapiens
ugcagggcacugu

SEQ ID NO: 2101700 - RNA, 15 nt, Homo sapiens
uuguggcgugugagu

SEQ ID NO: 2101701 - RNA, 17 nt, Homo sapiens
cuggcuuuugugcccaa

SEQ ID NO: 2101702 - RNA, 15 nt, Homo sapiens
uaauccccauaacuu

SEQ ID NO: 2101703 - RNA, 13 nt, Homo sapiens
ucugcugaucuca

SEQ ID NO: 2101704 - RNA, 13 nt, Homo sapiens
ccugcugaccuca

SEQ ID NO: 2101705 - RNA, 20 nt, Homo sapiens
ucaccacccugcucauccac

SEQ ID NO: 2101706 - RNA, 17 nt, Homo sapiens
uuuugaacguaugugcu

SEQ ID NO: 2101707 - RNA, 19 nt, Homo sapiens
cuuauaaaaauaaagggaa

SEQ ID NO: 2101708 - RNA, 13 nt, Homo sapiens
ucuguacacugcc

SEQ ID NO: 2101709 - RNA, 18 nt, Homo sapiens
ucaaguacuguaacugug

SEQ ID NO: 2101710 - RNA, 16 nt, Homo sapiens
gcauguguaguuaauu

SEQ ID NO: 2101711 - RNA, 12 nt, Homo sapiens
aggugccuguua

SEQ ID NO: 2101712 - RNA, 20 nt, Homo sapiens
ugggugaacuaaccaaauaa

SEQ ID NO: 2101713 - RNA, 20 nt, Homo sapiens
cgguugugagagccugugau

SEQ ID NO: 2101714 - RNA, 18 nt, Homo sapiens
ucuuguuucuaacaagga

SEQ ID NO: 2101715 - RNA, 20 nt, Homo sapiens
aaggacgcccgaagcacagu

SEQ ID NO: 2101716 - RNA, 15 nt, Homo sapiens
agagcaugaccugag

SEQ ID NO: 2101717 - RNA, 15 nt, Homo sapiens
gaaaaguaacuguuu

SEQ ID NO: 2101718 - RNA, 13 nt, Homo sapiens
cucuauucucaaa

SEQ ID NO: 2101719 - RNA, 17 nt, Homo sapiens
ugaaaaaauacuaccua

SEQ ID NO: 2101720 - RNA, 23 nt, Homo sapiens
ugggacccaaggaucggggggcc

SEQ ID NO: 2101721 - RNA, 16 nt, Homo sapiens
uccucuucuguaaaau

SEQ ID NO: 2101722 - RNA, 14 nt, Homo sapiens
auucuaagcccuuu

SEQ ID NO: 2101723 - RNA, 18 nt, Homo sapiens
gccgaaaacaggagcaaa

SEQ ID NO: 2101724 - RNA, 18 nt, Homo sapiens
ucagguaacucauuuaca

SEQ ID NO: 2101725 - RNA, 23 nt, Homo sapiens
uggaaagguucuaaggggaccua

SEQ ID NO: 2101726 - RNA, 20 nt, Homo sapiens
aaauaauugccaaauaccua

SEQ ID NO: 2101727 - RNA, 23 nt, Homo sapiens
accuucuaauccaugugcugcug

SEQ ID NO: 2101728 - RNA, 22 nt, Homo sapiens
ucuuuuacccggcacauucccc

SEQ ID NO: 2101729 - RNA, 14 nt, Homo sapiens
aucuuaacacugaa

SEQ ID NO: 2101730 - RNA, 22 nt, Homo sapiens
uaaugcaccaaucuuguuuaua

SEQ ID NO: 2101731 - RNA, 15 nt, Homo sapiens
aauuucaaaaugcau

SEQ ID NO: 2101732 - RNA, 14 nt, Homo sapiens
uaacuauuucuuca

SEQ ID NO: 2101733 - RNA, 22 nt, Homo sapiens
ccaucuccauugcauucaugua

SEQ ID NO: 2101734 - RNA, 17 nt, Homo sapiens
agagcaaaucuaugaga

SEQ ID NO: 2101735 - RNA, 13 nt, Homo sapiens
gcugacccccaua

SEQ ID NO: 2101736 - RNA, 17 nt, Homo sapiens
cauuggaacuagucauu

SEQ ID NO: 2101737 - RNA, 19 nt, Homo sapiens
acaggacauguacugagac

SEQ ID NO: 2101738 - RNA, 20 nt, Homo sapiens
agggaugaaagagaaggugg

SEQ ID NO: 2101739 - RNA, 21 nt, Homo sapiens
uacugugucagggaacauauu

SEQ ID NO: 2101740 - RNA, 20 nt, Homo sapiens
cuggacacacuaucaccuau

SEQ ID NO: 2101741 - RNA, 14 nt, Homo sapiens
ugcugcaaaccaca

SEQ ID NO: 2101742 - RNA, 16 nt, Homo sapiens
aacauacccaucugca

SEQ ID NO: 2101743 - RNA, 23 nt, Homo sapiens
uuaugauauucucauuauuucau

SEQ ID NO: 2101744 - RNA, 16 nt, Homo sapiens
ccuaaucuaucacuuu

SEQ ID NO: 2101745 - RNA, 16 nt, Homo sapiens
accgaauugcuuuuau

SEQ ID NO: 2101746 - RNA, 19 nt, Homo sapiens
aagucaggccucucuggga

SEQ ID NO: 2101747 - RNA, 13 nt, Homo sapiens
uugacaaacugaa

SEQ ID NO: 2101748 - RNA, 13 nt, Homo sapiens
caaucaaauaaua

SEQ ID NO: 2101749 - RNA, 20 nt, Homo sapiens
cugcacucuuguacaaaaga

SEQ ID NO: 2101750 - RNA, 13 nt, Homo sapiens
uugucaaacugua

SEQ ID NO: 2101751 - RNA, 13 nt, Homo sapiens
ucacaaaaccacc

SEQ ID NO: 2101752 - RNA, 20 nt, Homo sapiens
uagugccacccaccuuugcc

SEQ ID NO: 2101753 - RNA, 13 nt, Homo sapiens
gagucuccuucau

SEQ ID NO: 2101754 - RNA, 12 nt, Homo sapiens
uccuggugaugu

SEQ ID NO: 2101755 - RNA, 16 nt, Homo sapiens
gcccaaauucuuucag

SEQ ID NO: 2101756 - RNA, 17 nt, Homo sapiens
gugcacucucugcuuag

SEQ ID NO: 2101757 - RNA, 14 nt, Homo sapiens
auacaugcauauaa

SEQ ID NO: 2101758 - RNA, 13 nt, Homo sapiens
cacauucuauuaa

SEQ ID NO: 2101759 - RNA, 22 nt, Homo sapiens
caucgcccacgauggaauguaa

SEQ ID NO: 2101760 - RNA, 15 nt, Homo sapiens
gcagggcaaaugaca

SEQ ID NO: 2101761 - RNA, 18 nt, Homo sapiens
uccaacagaaagcauaga

SEQ ID NO: 2101762 - RNA, 11 nt, Homo sapiens
cuguaccucau

SEQ ID NO: 2101763 - RNA, 11 nt, Homo sapiens
cuuuaccucag

SEQ ID NO: 2101764 - RNA, 17 nt, Homo sapiens
uggucuuaauucugacc

SEQ ID NO: 2101765 - RNA, 23 nt, Homo sapiens
ggcaauuuuuacacaaaccugaa

SEQ ID NO: 2101766 - RNA, 15 nt, Homo sapiens
ccuuuaagaaccuua

SEQ ID NO: 2101767 - RNA, 18 nt, Homo sapiens
cuuucagaaucuuuucaa

SEQ ID NO: 2101768 - RNA, 22 nt, Homo sapiens
aggagaauugaauucuggaaac

SEQ ID NO: 2101769 - RNA, 16 nt, Homo sapiens
ucgauuuucaauaaua

SEQ ID NO: 2101770 - RNA, 15 nt, Homo sapiens
uuuauacuguuuacu

SEQ ID NO: 2101771 - RNA, 21 nt, Homo sapiens
uuaaaugcuguaugucauuaa

SEQ ID NO: 2101772 - RNA, 14 nt, Homo sapiens
auguaaaugugcau

SEQ ID NO: 2101773 - RNA, 15 nt, Homo sapiens
uuggcaguucugaua

SEQ ID NO: 2101774 - RNA, 13 nt, Homo sapiens
auuaaaugaauau

SEQ ID NO: 2101775 - RNA, 13 nt, Homo sapiens
cucaaaugcacau

SEQ ID NO: 2101776 - RNA, 17 nt, Homo sapiens
ucuagacugacucacau

SEQ ID NO: 2101777 - RNA, 13 nt, Homo sapiens
aauaaaugauuau

SEQ ID NO: 2101778 - RNA, 19 nt, Homo sapiens
gcuguauccagaagccagu

SEQ ID NO: 2101779 - RNA, 21 nt, Homo sapiens
guugaaaagacaauagcccaa

SEQ ID NO: 2101780 - RNA, 20 nt, Homo sapiens
acagacacuggcauggauau

SEQ ID NO: 2101781 - RNA, 15 nt, Homo sapiens
uagaaaaccagcuca

SEQ ID NO: 2101782 - RNA, 16 nt, Homo sapiens
ugcacuguccugacca

SEQ ID NO: 2101783 - RNA, 22 nt, Homo sapiens
uaggggacuaauucacuggcga

SEQ ID NO: 2101784 - RNA, 18 nt, Homo sapiens
uaaaucuaauaauuauuc

SEQ ID NO: 2101785 - RNA, 19 nt, Homo sapiens
gguugggcuggugcucaca

SEQ ID NO: 2101786 - RNA, 15 nt, Homo sapiens
caugacauugcauuu

SEQ ID NO: 2101787 - RNA, 16 nt, Homo sapiens
gccaagggaaggcuau

SEQ ID NO: 2101788 - RNA, 15 nt, Homo sapiens
gauuugcaacacugc

SEQ ID NO: 2101789 - RNA, 16 nt, Homo sapiens
aaacauacgacuuauu

SEQ ID NO: 2101790 - RNA, 17 nt, Homo sapiens
ccucuguuuacaucucc

SEQ ID NO: 2101791 - RNA, 22 nt, Homo sapiens
gaagucaucuccuucaaauacu

SEQ ID NO: 2101792 - RNA, 12 nt, Homo sapiens
guacaugcucug

SEQ ID NO: 2101793 - RNA, 21 nt, Homo sapiens
ugaaacucauagacacugauc

SEQ ID NO: 2101794 - RNA, 10 nt, Homo sapiens
cauccagugg

SEQ ID NO: 2101795 - RNA, 16 nt, Homo sapiens
uucccaauugccacau

SEQ ID NO: 2101796 - RNA, 15 nt, Homo sapiens
gauuucacagugugu

SEQ ID NO: 2101797 - RNA, 15 nt, Homo sapiens
uccccagacuccacc

SEQ ID NO: 2101798 - RNA, 15 nt, Homo sapiens
auaggacaaggggug

SEQ ID NO: 2101799 - RNA, 20 nt, Homo sapiens
accagcuggccugggguccc

SEQ ID NO: 2101800 - RNA, 22 nt, Homo sapiens
cucauuuauuuauuggcaauac

SEQ ID NO: 2101801 - RNA, 16 nt, Homo sapiens
aacuuaacucuuaccu

SEQ ID NO: 2101802 - RNA, 16 nt, Homo sapiens
ucuuuugcacaaggaa

SEQ ID NO: 2101803 - RNA, 16 nt, Homo sapiens
gugguuuuugcaaaug

SEQ ID NO: 2101804 - RNA, 23 nt, Homo sapiens
agccuugguuggaccuauugcca

SEQ ID NO: 2101805 - RNA, 19 nt, Homo sapiens
guucucagguguugccaaa

SEQ ID NO: 2101806 - RNA, 19 nt, Homo sapiens
aaagcaguuacuaauaugc

SEQ ID NO: 2101807 - RNA, 20 nt, Homo sapiens
cagaggaaggcuacuugagc

SEQ ID NO: 2101808 - RNA, 18 nt, Homo sapiens
gcuucugcuuaaucugag

SEQ ID NO: 2101809 - RNA, 22 nt, Homo sapiens
uggaauuacaaaacucagagaa

SEQ ID NO: 2101810 - RNA, 11 nt, Homo sapiens
aacacagugac

SEQ ID NO: 2101811 - RNA, 22 nt, Homo sapiens
gcaccagagagagauucuuccc

SEQ ID NO: 2101812 - RNA, 23 nt, Homo sapiens
cauguagauuuuaguucacuaaa

SEQ ID NO: 2101813 - RNA, 20 nt, Homo sapiens
gcaugcccuaagagugucac

SEQ ID NO: 2101814 - RNA, 18 nt, Homo sapiens
agcugacaucuccucuau

SEQ ID NO: 2101815 - RNA, 17 nt, Homo sapiens
aggauggcaaguugcau

SEQ ID NO: 2101816 - RNA, 19 nt, Homo sapiens
uguuuuccuuugucaucau

SEQ ID NO: 2101817 - RNA, 20 nt, Homo sapiens
auaauuaaaugaaauacuug

SEQ ID NO: 2101818 - RNA, 20 nt, Homo sapiens
cuggggagugguuaggcagc

SEQ ID NO: 2101819 - RNA, 17 nt, Homo sapiens
ucccuaguuagcaucca

SEQ ID NO: 2101820 - RNA, 18 nt, Homo sapiens
aaccaaaguuaguucagu

SEQ ID NO: 2101821 - RNA, 13 nt, Homo sapiens
aaccccaggaggc

SEQ ID NO: 2101822 - RNA, 14 nt, Homo sapiens
cuuucugaauuauu

SEQ ID NO: 2101823 - RNA, 21 nt, Homo sapiens
agcccuuuuuguacugauaua

SEQ ID NO: 2101824 - RNA, 15 nt, Homo sapiens
guugccaauaugcca

SEQ ID NO: 2101825 - RNA, 12 nt, Homo sapiens
gaggacuugaac

SEQ ID NO: 2101826 - RNA, 14 nt, Homo sapiens
gaucuaccugcaac

SEQ ID NO: 2101827 - RNA, 20 nt, Homo sapiens
uuugggauguuaccuucaca

SEQ ID NO: 2101828 - RNA, 16 nt, Homo sapiens
ugcuaauguugaucag

SEQ ID NO: 2101829 - RNA, 11 nt, Homo sapiens
uggcugugagc

SEQ ID NO: 2101830 - RNA, 14 nt, Homo sapiens
auguuacccagccu

SEQ ID NO: 2101831 - RNA, 20 nt, Homo sapiens
cuccagcuagcaaaauuacu

SEQ ID NO: 2101832 - RNA, 18 nt, Homo sapiens
aaggccaggcaugguggu

SEQ ID NO: 2101833 - RNA, 14 nt, Homo sapiens
gcacugcacauaau

SEQ ID NO: 2101834 - RNA, 12 nt, Homo sapiens
gacccuccccaa

SEQ ID NO: 2101835 - RNA, 13 nt, Homo sapiens
uuuugccuaauac

SEQ ID NO: 2101836 - RNA, 18 nt, Homo sapiens
aagaccagggaugcugcc

SEQ ID NO: 2101837 - RNA, 20 nt, Homo sapiens
uaaauggacaaaugcuuaug

SEQ ID NO: 2101838 - RNA, 17 nt, Homo sapiens
auuagaaggcaaguuuc

SEQ ID NO: 2101839 - RNA, 15 nt, Homo sapiens
gaaggggacugccac

SEQ ID NO: 2101840 - RNA, 14 nt, Homo sapiens
cacuuggaacacaa

SEQ ID NO: 2101841 - RNA, 19 nt, Homo sapiens
cgaggacugauacugcagu

SEQ ID NO: 2101842 - RNA, 21 nt, Homo sapiens
uaucucaacaacaugucaaag

SEQ ID NO: 2101843 - RNA, 16 nt, Homo sapiens
uauuuucaguauacug

SEQ ID NO: 2101844 - RNA, 22 nt, Homo sapiens
augaccagaaaacaaaucuuca

SEQ ID NO: 2101845 - RNA, 22 nt, Homo sapiens
gaaagcaugucucugcuuccau

SEQ ID NO: 2101846 - RNA, 16 nt, Homo sapiens
ucuauggauucacuuc

SEQ ID NO: 2101847 - RNA, 22 nt, Homo sapiens
uucaaaacauucuccuuugcag

SEQ ID NO: 2101848 - RNA, 17 nt, Homo sapiens
ucugaagugcugcucca

SEQ ID NO: 2101849 - RNA, 14 nt, Homo sapiens
uuuaugugagauac

SEQ ID NO: 2101850 - RNA, 15 nt, Homo sapiens
agauucgagucacgu

SEQ ID NO: 2101851 - RNA, 18 nt, Homo sapiens
cuacuuuaaccuaugaua

SEQ ID NO: 2101852 - RNA, 18 nt, Homo sapiens
ggagacguggaaccucug

SEQ ID NO: 2101853 - RNA, 14 nt, Homo sapiens
auuuacucacuuca

SEQ ID NO: 2101854 - RNA, 23 nt, Homo sapiens
ucagcucuguuuacgaagcaaua

SEQ ID NO: 2101855 - RNA, 12 nt, Homo sapiens
cauauacauaua

SEQ ID NO: 2101856 - RNA, 12 nt, Homo sapiens
cuaauacauuaa

SEQ ID NO: 2101857 - RNA, 19 nt, Homo sapiens
aauugauggacuacucuau

SEQ ID NO: 2101858 - RNA, 16 nt, Homo sapiens
ucauuaacccaucucu

SEQ ID NO: 2101859 - RNA, 14 nt, Homo sapiens
gccuauaaucccag

SEQ ID NO: 2101860 - RNA, 13 nt, Homo sapiens
cagcaauuccuga

SEQ ID NO: 2101861 - RNA, 22 nt, Homo sapiens
uuaaaaauaugcuaauucucag

SEQ ID NO: 2101862 - RNA, 14 nt, Homo sapiens
acccauugucucau

SEQ ID NO: 2101863 - RNA, 14 nt, Homo sapiens
agcgcaugugugca

SEQ ID NO: 2101864 - RNA, 15 nt, Homo sapiens
cccaacucugcccuu

SEQ ID NO: 2101865 - RNA, 22 nt, Homo sapiens
ucaccaggaagaaggcccggga

SEQ ID NO: 2101866 - RNA, 14 nt, Homo sapiens
acagcugcagagac

SEQ ID NO: 2101867 - RNA, 19 nt, Homo sapiens
gagcucacucccacuggaa

SEQ ID NO: 2101868 - RNA, 16 nt, Homo sapiens
aggagcuuccagugca

SEQ ID NO: 2101869 - RNA, 12 nt, Homo sapiens
uacuaguacagg

SEQ ID NO: 2101870 - RNA, 13 nt, Homo sapiens
cuacuguggcaaa

SEQ ID NO: 2101871 - RNA, 24 nt, Homo sapiens
ucugaaaauauuuuuuucuagcua

SEQ ID NO: 2101872 - RNA, 22 nt, Homo sapiens
aaccucaguuuccucaucugca

SEQ ID NO: 2101873 - RNA, 22 nt, Homo sapiens
agcccaugacguguuucuugaa

SEQ ID NO: 2101874 - RNA, 14 nt, Homo sapiens
uuuaacaguguucu

SEQ ID NO: 2101875 - RNA, 15 nt, Homo sapiens
acccuaagaugaagc

SEQ ID NO: 2101876 - RNA, 16 nt, Homo sapiens
ucucugggcccagaga

SEQ ID NO: 2101877 - RNA, 15 nt, Homo sapiens
uuaaaguauguccuu

SEQ ID NO: 2101878 - RNA, 18 nt, Homo sapiens
gaaagggauggucaggcc

SEQ ID NO: 2101879 - RNA, 19 nt, Homo sapiens
accauuuaaucuugaagga

SEQ ID NO: 2101880 - RNA, 22 nt, Homo sapiens
accuuugcccacacacacuccu

SEQ ID NO: 2101881 - RNA, 11 nt, Homo sapiens
gggucucucau

SEQ ID NO: 2101882 - RNA, 22 nt, Homo sapiens
agauuaugaugaaaaccuacau

SEQ ID NO: 2101883 - RNA, 17 nt, Homo sapiens
cuuaauaccaaacaugc

SEQ ID NO: 2101884 - RNA, 22 nt, Homo sapiens
uccccagagcuuuacagugcca

SEQ ID NO: 2101885 - RNA, 21 nt, Homo sapiens
guuagaggccagccuggcgaa

SEQ ID NO: 2101886 - RNA, 23 nt, Homo sapiens
uaccagaacgguucuuugaccag

SEQ ID NO: 2101887 - RNA, 17 nt, Homo sapiens
uucugccuuuauugacu

SEQ ID NO: 2101888 - RNA, 19 nt, Homo sapiens
uuccacaauucuucuguca

SEQ ID NO: 2101889 - RNA, 16 nt, Homo sapiens
aauaguuuucagucuu

SEQ ID NO: 2101890 - RNA, 14 nt, Homo sapiens
gcgcucugccauuc

SEQ ID NO: 2101891 - RNA, 14 nt, Homo sapiens
cugucuuucacuga

SEQ ID NO: 2101892 - RNA, 17 nt, Homo sapiens
ugagcagugaccuuccu

SEQ ID NO: 2101893 - RNA, 16 nt, Homo sapiens
auuauguaaaucccau

SEQ ID NO: 2101894 - RNA, 13 nt, Homo sapiens
gcugugaggacag

SEQ ID NO: 2101895 - RNA, 15 nt, Homo sapiens
uguauauccuauaua

SEQ ID NO: 2101896 - RNA, 21 nt, Homo sapiens
ucaccugcgugguccauucca

SEQ ID NO: 2101897 - RNA, 18 nt, Homo sapiens
gaaaugugucaccccaga

SEQ ID NO: 2101898 - RNA, 12 nt, Homo sapiens
acaugugcucuc

SEQ ID NO: 2101899 - RNA, 22 nt, Homo sapiens
cuguucccaauauguagccuuu

SEQ ID NO: 2101900 - RNA, 22 nt, Homo sapiens
aaucauugugugucuucaggag

SEQ ID NO: 2101901 - RNA, 13 nt, Homo sapiens
gaauuucuagaca

SEQ ID NO: 2101902 - RNA, 15 nt, Homo sapiens
gcugcuccacugggu

SEQ ID NO: 2101903 - RNA, 14 nt, Homo sapiens
acagcugcauuaaa

SEQ ID NO: 2101904 - RNA, 16 nt, Homo sapiens
uacagugguauugcua

SEQ ID NO: 2101905 - RNA, 16 nt, Homo sapiens
uaaauuuaaugcugcc

SEQ ID NO: 2101906 - RNA, 23 nt, Homo sapiens
agcuccccccaagaugagcugca

SEQ ID NO: 2101907 - RNA, 13 nt, Homo sapiens
uguuacugccaaa

SEQ ID NO: 2101908 - RNA, 21 nt, Homo sapiens
agaauaggaagauaugccacu

SEQ ID NO: 2101909 - RNA, 16 nt, Homo sapiens
accuuuuacauuguga

SEQ ID NO: 2101910 - RNA, 22 nt, Homo sapiens
ugaggauauaguagccaugaca

SEQ ID NO: 2101911 - RNA, 23 nt, Homo sapiens
aaacauguauuuauguaaugaag

SEQ ID NO: 2101912 - RNA, 15 nt, Homo sapiens
caccagcaccaacac

SEQ ID NO: 2101913 - RNA, 11 nt, Homo sapiens
aaagguccuuu

SEQ ID NO: 2101914 - RNA, 14 nt, Homo sapiens
auaagucauuuuaa

SEQ ID NO: 2101915 - RNA, 21 nt, Homo sapiens
aacugaaacuuuucuaaagug

SEQ ID NO: 2101916 - RNA, 23 nt, Homo sapiens
uaugccugaaugacuccacuguu

SEQ ID NO: 2101917 - RNA, 17 nt, Homo sapiens
agccaauaaaugaacug

SEQ ID NO: 2101918 - RNA, 11 nt, Homo sapiens
gagcgacccca

SEQ ID NO: 2101919 - RNA, 22 nt, Homo sapiens
gucauggucacaguaaagagua

SEQ ID NO: 2101920 - RNA, 14 nt, Homo sapiens
augaugugggcuca

SEQ ID NO: 2101921 - RNA, 13 nt, Homo sapiens
uucuaagauucug

SEQ ID NO: 2101922 - RNA, 13 nt, Homo sapiens
aggaaagaaggag

SEQ ID NO: 2101923 - RNA, 22 nt, Homo sapiens
augguuauuuaugcacuguggg

SEQ ID NO: 2101924 - RNA, 17 nt, Homo sapiens
ccguacaucugcaauau

SEQ ID NO: 2101925 - RNA, 19 nt, Homo sapiens
gucuuauuugaaggccagc

SEQ ID NO: 2101926 - RNA, 22 nt, Homo sapiens
cauuucuauuucuccuccaugg

SEQ ID NO: 2101927 - RNA, 23 nt, Homo sapiens
ggagcaguaaacuuucucugcaa

SEQ ID NO: 2101928 - RNA, 19 nt, Homo sapiens
auauuauuuuaguguguaa

SEQ ID NO: 2101929 - RNA, 23 nt, Homo sapiens
gggggagugggcgcaguggcuca

SEQ ID NO: 2101930 - RNA, 15 nt, Homo sapiens
gaccuacucuugccu

SEQ ID NO: 2101931 - RNA, 15 nt, Homo sapiens
ucacugcccaccugc

SEQ ID NO: 2101932 - RNA, 15 nt, Homo sapiens
ccaucaccuacucac

SEQ ID NO: 2101933 - RNA, 12 nt, Homo sapiens
uaaauguuauau

SEQ ID NO: 2101934 - RNA, 13 nt, Homo sapiens
acggaagggaugc

SEQ ID NO: 2101935 - RNA, 18 nt, Homo sapiens
uuaacaucuacaaucagu

SEQ ID NO: 2101936 - RNA, 14 nt, Homo sapiens
uaaaguacuggagu

SEQ ID NO: 2101937 - RNA, 14 nt, Homo sapiens
ugaugaacuaguga

SEQ ID NO: 2101938 - RNA, 20 nt, Homo sapiens
cacugcugaaccuuuccucu

SEQ ID NO: 2101939 - RNA, 22 nt, Homo sapiens
cugaacauggcagucuagggug

SEQ ID NO: 2101940 - RNA, 18 nt, Homo sapiens
acagagcgggccucuucc

SEQ ID NO: 2101941 - RNA, 12 nt, Homo sapiens
aacaauaaggag

SEQ ID NO: 2101942 - RNA, 14 nt, Homo sapiens
uccagccacaggca

SEQ ID NO: 2101943 - RNA, 16 nt, Homo sapiens
aaagaaaucagccaug

SEQ ID NO: 2101944 - RNA, 19 nt, Homo sapiens
uccuggcuaacacagugaa

SEQ ID NO: 2101945 - RNA, 15 nt, Homo sapiens
uuugaugcccagaca

SEQ ID NO: 2101946 - RNA, 17 nt, Homo sapiens
cccacuggggugugugg

SEQ ID NO: 2101947 - RNA, 18 nt, Homo sapiens
agaguguuuuuucuguca

SEQ ID NO: 2101948 - RNA, 18 nt, Homo sapiens
cauuuggcagagcuucuu

SEQ ID NO: 2101949 - RNA, 21 nt, Homo sapiens
cauuuacuugaucauucucag

SEQ ID NO: 2101950 - RNA, 12 nt, Homo sapiens
uagaugauuuca

SEQ ID NO: 2101951 - RNA, 18 nt, Homo sapiens
uuuccacccucucuccac

SEQ ID NO: 2101952 - RNA, 20 nt, Homo sapiens
ugauacaaacacuacagaca

SEQ ID NO: 2101953 - RNA, 14 nt, Homo sapiens
gaaggauugcaaug

SEQ ID NO: 2101954 - RNA, 16 nt, Homo sapiens
ggacuugauguuccuu

SEQ ID NO: 2101955 - RNA, 20 nt, Homo sapiens
aagugcugccuuaguugcua

SEQ ID NO: 2101956 - RNA, 20 nt, Homo sapiens
gcccgucauguuccucaaaa

SEQ ID NO: 2101957 - RNA, 22 nt, Homo sapiens
uguuccaauuugacaaaaccca

SEQ ID NO: 2101958 - RNA, 17 nt, Homo sapiens
ccuccccaccaccaauu

SEQ ID NO: 2101959 - RNA, 18 nt, Homo sapiens
aguaagagcuggugucug

SEQ ID NO: 2101960 - RNA, 18 nt, Homo sapiens
auguuaccuucacauguc

SEQ ID NO: 2101961 - RNA, 20 nt, Homo sapiens
acuguuuauuaaaguacaac

SEQ ID NO: 2101962 - RNA, 16 nt, Homo sapiens
ucucuaacucagaaac

SEQ ID NO: 2101963 - RNA, 13 nt, Homo sapiens
agcugggagacaa

SEQ ID NO: 2101964 - RNA, 17 nt, Homo sapiens
uuugggacaaaacagaa

SEQ ID NO: 2101965 - RNA, 17 nt, Homo sapiens
uguguuuuaaacuggua

SEQ ID NO: 2101966 - RNA, 22 nt, Homo sapiens
gaaaaucuaccaagaacagagu

SEQ ID NO: 2101967 - RNA, 18 nt, Homo sapiens
caccaacuggagcacuga

SEQ ID NO: 2101968 - RNA, 22 nt, Homo sapiens
auauacuauaugaaaagagcaa

SEQ ID NO: 2101969 - RNA, 17 nt, Homo sapiens
ugaccugccucccuuca

SEQ ID NO: 2101970 - RNA, 23 nt, Homo sapiens
agcauauggcacuaaaugcacaa

SEQ ID NO: 2101971 - RNA, 22 nt, Homo sapiens
cauaauucugaaacaacuugcc

SEQ ID NO: 2101972 - RNA, 20 nt, Homo sapiens
cccccagggcacuucacaga

SEQ ID NO: 2101973 - RNA, 23 nt, Homo sapiens
auauaaaccccucagacaguuug

SEQ ID NO: 2101974 - RNA, 19 nt, Homo sapiens
ccagaguugcugugccgug

SEQ ID NO: 2101975 - RNA, 20 nt, Homo sapiens
cgggaaccucaucugccugg

SEQ ID NO: 2101976 - RNA, 20 nt, Homo sapiens
aacuuuuaagccauuuauca

SEQ ID NO: 2101977 - RNA, 22 nt, Homo sapiens
ccaauggcaacaucuugcaaaa

SEQ ID NO: 2101978 - RNA, 18 nt, Homo sapiens
aggccaggcgugguggcu

SEQ ID NO: 2101979 - RNA, 19 nt, Homo sapiens
agaguggggaugacaugca

SEQ ID NO: 2101980 - RNA, 18 nt, Homo sapiens
gcacaacgcaccagacac

SEQ ID NO: 2101981 - RNA, 20 nt, Homo sapiens
ugugcugguacgacuaugug

SEQ ID NO: 2101982 - RNA, 13 nt, Homo sapiens
cuucucugccuca

SEQ ID NO: 2101983 - RNA, 20 nt, Homo sapiens
aagaaauagagccaacugau

SEQ ID NO: 2101984 - RNA, 20 nt, Homo sapiens
cuguguuuuuccuccauaaa

SEQ ID NO: 2101985 - RNA, 14 nt, Homo sapiens
gaaagggacaauga

SEQ ID NO: 2101986 - RNA, 17 nt, Homo sapiens
agaaugacagcaaacag

SEQ ID NO: 2101987 - RNA, 19 nt, Homo sapiens
gugacucagcaucacccac

SEQ ID NO: 2101988 - RNA, 17 nt, Homo sapiens
uggcaaacguuucucaa

SEQ ID NO: 2101989 - RNA, 16 nt, Homo sapiens
gcaagguuuggugcaa

SEQ ID NO: 2101990 - RNA, 14 nt, Homo sapiens
aaggcagggcuccu

SEQ ID NO: 2101991 - RNA, 19 nt, Homo sapiens
augauuucauauugaucuu

SEQ ID NO: 2101992 - RNA, 16 nt, Homo sapiens
gauuacucuccauauc

SEQ ID NO: 2101993 - RNA, 23 nt, Homo sapiens
cuugcaaaguaucccuacuguaa

SEQ ID NO: 2101994 - RNA, 22 nt, Homo sapiens
ugacuaaacaacuaccuccuca

SEQ ID NO: 2101995 - RNA, 13 nt, Homo sapiens
uaaaaguuacuua

SEQ ID NO: 2101996 - RNA, 17 nt, Homo sapiens
acaccgcgcaucucuuc

SEQ ID NO: 2101997 - RNA, 23 nt, Homo sapiens
uuagacucugguauggccaaaga

SEQ ID NO: 2101998 - RNA, 19 nt, Homo sapiens
ugcagcacugcugccucag

SEQ ID NO: 2101999 - RNA, 16 nt, Homo sapiens
gcacccaaguugggau

SEQ ID NO: 2102000 - RNA, 22 nt, Homo sapiens
cuauuguuucuccucugaagca

SEQ ID NO: 2102001 - RNA, 10 nt, Homo sapiens
cuccuugccu

SEQ ID NO: 2102002 - RNA, 14 nt, Homo sapiens
ugcacagggagacg

SEQ ID NO: 2102003 - RNA, 23 nt, Homo sapiens
guagcugccaggcuuucuguaaa

SEQ ID NO: 2102004 - RNA, 15 nt, Homo sapiens
ggaccgccauggugc

SEQ ID NO: 2102005 - RNA, 20 nt, Homo sapiens
uauccucugacacccuuuaa

SEQ ID NO: 2102006 - RNA, 22 nt, Homo sapiens
uaggauucaggcagcagugucu

SEQ ID NO: 2102007 - RNA, 17 nt, Homo sapiens
auuuucuuucccagaag

SEQ ID NO: 2102008 - RNA, 16 nt, Homo sapiens
gcguacaaagugaucu

SEQ ID NO: 2102009 - RNA, 14 nt, Homo sapiens
uuuuaaauaggcua

SEQ ID NO: 2102010 - RNA, 20 nt, Homo sapiens
auuuucccccuuuucugcau

SEQ ID NO: 2102011 - RNA, 22 nt, Homo sapiens
gcagacuuucuacaugcaaauc

SEQ ID NO: 2102012 - RNA, 16 nt, Homo sapiens
gacccuccccuaguca

SEQ ID NO: 2102013 - RNA, 19 nt, Homo sapiens
uccacacacgcuauggaau

SEQ ID NO: 2102014 - RNA, 14 nt, Homo sapiens
uguuuucucuugag

SEQ ID NO: 2102015 - RNA, 15 nt, Homo sapiens
aagaccccaucucaa

SEQ ID NO: 2102016 - RNA, 18 nt, Homo sapiens
caguuuagaaccuacaaa

SEQ ID NO: 2102017 - RNA, 14 nt, Homo sapiens
aaagugacauuugu

SEQ ID NO: 2102018 - RNA, 21 nt, Homo sapiens
agaacguacuuucuguuauca

SEQ ID NO: 2102019 - RNA, 18 nt, Homo sapiens
uucugcaucaucuguaga

SEQ ID NO: 2102020 - RNA, 19 nt, Homo sapiens
ggcagcuauagucuggcac

SEQ ID NO: 2102021 - RNA, 17 nt, Homo sapiens
uacaaguaaagcuagac

SEQ ID NO: 2102022 - RNA, 20 nt, Homo sapiens
ggugcucuuccucaucucau

SEQ ID NO: 2102023 - RNA, 16 nt, Homo sapiens
guucuuacaaaccaua

SEQ ID NO: 2102024 - RNA, 20 nt, Homo sapiens
acaugcauugccaugaauuu

SEQ ID NO: 2102025 - RNA, 21 nt, Homo sapiens
ccuuucugaggacaccaguga

SEQ ID NO: 2102026 - RNA, 18 nt, Homo sapiens
gacaaggaaaaaauaaca

SEQ ID NO: 2102027 - RNA, 23 nt, Homo sapiens
acugucaucuuuuuccacuuuga

SEQ ID NO: 2102028 - RNA, 13 nt, Homo sapiens
agcuggagccugg

SEQ ID NO: 2102029 - RNA, 13 nt, Homo sapiens
agcuugagccugu

SEQ ID NO: 2102030 - RNA, 13 nt, Homo sapiens
agguccuggugcc

SEQ ID NO: 2102031 - RNA, 14 nt, Homo sapiens
aagcucugcagucc

SEQ ID NO: 2102032 - RNA, 19 nt, Homo sapiens
uucucagggcuccugccuu

SEQ ID NO: 2102033 - RNA, 22 nt, Homo sapiens
uuaccuuguuauuuaacccauu

SEQ ID NO: 2102034 - RNA, 11 nt, Homo sapiens
cuccacuaaua

SEQ ID NO: 2102035 - RNA, 22 nt, Homo sapiens
acuccccauuggugcuaccugg

SEQ ID NO: 2102036 - RNA, 23 nt, Homo sapiens
caucuuuccuucucuaagcacaa

SEQ ID NO: 2102037 - RNA, 14 nt, Homo sapiens
aacccagucuuucu

SEQ ID NO: 2102038 - RNA, 20 nt, Homo sapiens
cauugccaauuagacaaaca

SEQ ID NO: 2102039 - RNA, 16 nt, Homo sapiens
agguguacacaugcca

SEQ ID NO: 2102040 - RNA, 21 nt, Homo sapiens
agccuucuccugucuccauga

SEQ ID NO: 2102041 - RNA, 16 nt, Homo sapiens
cauaugccccauuccc

SEQ ID NO: 2102042 - RNA, 20 nt, Homo sapiens
acuuccccuauggaauuuau

SEQ ID NO: 2102043 - RNA, 21 nt, Homo sapiens
aauuagcuuguuacaauucua

SEQ ID NO: 2102044 - RNA, 19 nt, Homo sapiens
uacuugaaaaauguuauaa

SEQ ID NO: 2102045 - RNA, 13 nt, Homo sapiens
uagugcacaaaau

SEQ ID NO: 2102046 - RNA, 19 nt, Homo sapiens
acaccaaugaaaacaugua

SEQ ID NO: 2102047 - RNA, 20 nt, Homo sapiens
ucacugaaaacaucuggaag

SEQ ID NO: 2102048 - RNA, 14 nt, Homo sapiens
agaugauuugguca

SEQ ID NO: 2102049 - RNA, 20 nt, Homo sapiens
augcuggcuuguacauagua

SEQ ID NO: 2102050 - RNA, 22 nt, Homo sapiens
gccaggagaugcugggccaguu

SEQ ID NO: 2102051 - RNA, 20 nt, Homo sapiens
cugcauuaacugcacaaaca

SEQ ID NO: 2102052 - RNA, 21 nt, Homo sapiens
ucuugccccaaaucacaaaca

SEQ ID NO: 2102053 - RNA, 19 nt, Homo sapiens
auuuaaagaaagaaugcau

SEQ ID NO: 2102054 - RNA, 12 nt, Homo sapiens
caaauuuguaca

SEQ ID NO: 2102055 - RNA, 16 nt, Homo sapiens
cugcuuugcaaauuca

SEQ ID NO: 2102056 - RNA, 12 nt, Homo sapiens
aacuguggaauc

SEQ ID NO: 2102057 - RNA, 20 nt, Homo sapiens
caaacuaggggacaaagcaa

SEQ ID NO: 2102058 - RNA, 17 nt, Homo sapiens
uguuuguuuuugcuugu

SEQ ID NO: 2102059 - RNA, 14 nt, Homo sapiens
uguaguaacugccu

SEQ ID NO: 2102060 - RNA, 16 nt, Homo sapiens
aauuaucugcauuuau

SEQ ID NO: 2102061 - RNA, 22 nt, Homo sapiens
uagggcaguaacauuggguccu

SEQ ID NO: 2102062 - RNA, 14 nt, Homo sapiens
cuuuaaaucuguga

SEQ ID NO: 2102063 - RNA, 23 nt, Homo sapiens
uuuuagguagaaaaacauauucu

SEQ ID NO: 2102064 - RNA, 22 nt, Homo sapiens
acagaaagcuagauaugccuua

SEQ ID NO: 2102065 - RNA, 22 nt, Homo sapiens
guguggggugaggggagggagu

SEQ ID NO: 2102066 - RNA, 14 nt, Homo sapiens
aggcuuccacacuu

SEQ ID NO: 2102067 - RNA, 17 nt, Homo sapiens
ggaccuccaagccacug

SEQ ID NO: 2102068 - RNA, 22 nt, Homo sapiens
cuuccauaauuaugacaguuau

SEQ ID NO: 2102069 - RNA, 16 nt, Homo sapiens
gaggccucugugcugu

SEQ ID NO: 2102070 - RNA, 14 nt, Homo sapiens
uugucaaaaaguuc

SEQ ID NO: 2102071 - RNA, 23 nt, Homo sapiens
acacugagagggcaaucuuugcc

SEQ ID NO: 2102072 - RNA, 16 nt, Homo sapiens
uguacagguacaggcu

SEQ ID NO: 2102073 - RNA, 13 nt, Homo sapiens
uggcaguguuugu

SEQ ID NO: 2102074 - RNA, 16 nt, Homo sapiens
cacccaucagcacucu

SEQ ID NO: 2102075 - RNA, 16 nt, Homo sapiens
gucucuuccacaggaa

SEQ ID NO: 2102076 - RNA, 22 nt, Homo sapiens
aucgauggaugggaugcacucu

SEQ ID NO: 2102077 - RNA, 16 nt, Homo sapiens
acuuugacaaacugaa

SEQ ID NO: 2102078 - RNA, 20 nt, Homo sapiens
cuuuuuaagaugucuauuau

SEQ ID NO: 2102079 - RNA, 12 nt, Homo sapiens
uccagacuguaa

SEQ ID NO: 2102080 - RNA, 15 nt, Homo sapiens
aguaagugccuucca

SEQ ID NO: 2102081 - RNA, 20 nt, Homo sapiens
cugguccaguuccuucacuu

SEQ ID NO: 2102082 - RNA, 20 nt, Homo sapiens
cuacagagagugaauacacu

SEQ ID NO: 2102083 - RNA, 20 nt, Homo sapiens
aguccaaggaaaccacagcu

SEQ ID NO: 2102084 - RNA, 17 nt, Homo sapiens
uuaagugacacagacau

SEQ ID NO: 2102085 - RNA, 20 nt, Homo sapiens
ccuaagguccuaaggcaucu

SEQ ID NO: 2102086 - RNA, 20 nt, Homo sapiens
aucugugugugugugcgugu

SEQ ID NO: 2102087 - RNA, 15 nt, Homo sapiens
cuacaugccaugacc

SEQ ID NO: 2102088 - RNA, 23 nt, Homo sapiens
ugcuuuugcccauuuugaaucac

SEQ ID NO: 2102089 - RNA, 18 nt, Homo sapiens
uguuaauaaacaaaguaa

SEQ ID NO: 2102090 - RNA, 16 nt, Homo sapiens
cacucuuuugcuuuau

SEQ ID NO: 2102091 - RNA, 18 nt, Homo sapiens
ggugaugcaagucacuaa

SEQ ID NO: 2102092 - RNA, 22 nt, Homo sapiens
agcaauugugaaauacaguaua

SEQ ID NO: 2102093 - RNA, 16 nt, Homo sapiens
gaacuuucucuagcaa

SEQ ID NO: 2102094 - RNA, 22 nt, Homo sapiens
agguucuuuuuuuuuucaggaa

SEQ ID NO: 2102095 - RNA, 14 nt, Homo sapiens
uggaugcacuuuca

SEQ ID NO: 2102096 - RNA, 15 nt, Homo sapiens
gaucaagucacucau

SEQ ID NO: 2102097 - RNA, 18 nt, Homo sapiens
aggucuguggugcagugu

SEQ ID NO: 2102098 - RNA, 20 nt, Homo sapiens
auagauuuucuucugagacu

SEQ ID NO: 2102099 - RNA, 23 nt, Homo sapiens
accacagcagagaccaccacauu

SEQ ID NO: 2102100 - RNA, 21 nt, Homo sapiens
ggaagaaacacguggucauga

SEQ ID NO: 2102101 - RNA, 19 nt, Homo sapiens
uccaugagggcaggcacau

SEQ ID NO: 2102102 - RNA, 14 nt, Homo sapiens
ugcagggaccaaga

SEQ ID NO: 2102103 - RNA, 13 nt, Homo sapiens
gcacuuuugaaaa

SEQ ID NO: 2102104 - RNA, 16 nt, Homo sapiens
gaggaguuagccaaac

SEQ ID NO: 2102105 - RNA, 21 nt, Homo sapiens
cccacgauugguaugaugcug

SEQ ID NO: 2102106 - RNA, 22 nt, Homo sapiens
aacucaauuucuugguauuauu

SEQ ID NO: 2102107 - RNA, 13 nt, Homo sapiens
cuagaaccuggag

SEQ ID NO: 2102108 - RNA, 17 nt, Homo sapiens
uaagucuuaaucauuug

SEQ ID NO: 2102109 - RNA, 23 nt, Homo sapiens
uacagugugugugggugaaaugg

SEQ ID NO: 2102110 - RNA, 18 nt, Homo sapiens
aaaaugccucaauucaca

SEQ ID NO: 2102111 - RNA, 20 nt, Homo sapiens
ggagcagcuggcacugacag

SEQ ID NO: 2102112 - RNA, 20 nt, Homo sapiens
ucuggccugggcgacagagc

SEQ ID NO: 2102113 - RNA, 17 nt, Homo sapiens
ucaaaucuauucagaca

SEQ ID NO: 2102114 - RNA, 23 nt, Homo sapiens
ucauuaccacgccuugaccuucc

SEQ ID NO: 2102115 - RNA, 21 nt, Homo sapiens
auuuuaccuuugacaaaggua

SEQ ID NO: 2102116 - RNA, 15 nt, Homo sapiens
cugccaaaacaucaa

SEQ ID NO: 2102117 - RNA, 13 nt, Homo sapiens
ucuuaaugcuuuc

SEQ ID NO: 2102118 - RNA, 16 nt, Homo sapiens
aauuugauuuacauau

SEQ ID NO: 2102119 - RNA, 18 nt, Homo sapiens
cacuccccagugcuccug

SEQ ID NO: 2102120 - RNA, 22 nt, Homo sapiens
gaggcucugugcccccaucacc

SEQ ID NO: 2102121 - RNA, 20 nt, Homo sapiens
caccauuguuccuuaccuuu

SEQ ID NO: 2102122 - RNA, 16 nt, Homo sapiens
agccugucucuuccau

SEQ ID NO: 2102123 - RNA, 21 nt, Homo sapiens
ggcccccaccgccgggguccu

SEQ ID NO: 2102124 - RNA, 15 nt, Homo sapiens
auucucuagucaguu

SEQ ID NO: 2102125 - RNA, 23 nt, Homo sapiens
aauauuuagucugcauugcuggc

SEQ ID NO: 2102126 - RNA, 21 nt, Homo sapiens
aucugcuuaucagugugcaau

SEQ ID NO: 2102127 - RNA, 22 nt, Homo sapiens
aucaggucauuauuuuuuacaa

SEQ ID NO: 2102128 - RNA, 17 nt, Homo sapiens
gagauggguuugacaag

SEQ ID NO: 2102129 - RNA, 23 nt, Homo sapiens
uggcauucgcagugcccagugau

SEQ ID NO: 2102130 - RNA, 17 nt, Homo sapiens
accccacagacacuuac

SEQ ID NO: 2102131 - RNA, 12 nt, Homo sapiens
guccaggccagu

SEQ ID NO: 2102132 - RNA, 21 nt, Homo sapiens
auuguuccucuuuguuuauga

SEQ ID NO: 2102133 - RNA, 18 nt, Homo sapiens
aaucuccagauuucugua

SEQ ID NO: 2102134 - RNA, 14 nt, Homo sapiens
ugcccacucuccac

SEQ ID NO: 2102135 - RNA, 13 nt, Homo sapiens
cucugccaccaga

SEQ ID NO: 2102136 - RNA, 17 nt, Homo sapiens
aaauuagaaucugagua

SEQ ID NO: 2102137 - RNA, 17 nt, Homo sapiens
acuccauuuaaaaaaca

SEQ ID NO: 2102138 - RNA, 15 nt, Homo sapiens
agaacugagggcucu

SEQ ID NO: 2102139 - RNA, 20 nt, Homo sapiens
guaaccucuacuaugaagug

SEQ ID NO: 2102140 - RNA, 15 nt, Homo sapiens
uaaauagaacuaucu

SEQ ID NO: 2102141 - RNA, 13 nt, Homo sapiens
accagagcauuuc

SEQ ID NO: 2102142 - RNA, 17 nt, Homo sapiens
cagcuguugcaggcagu

SEQ ID NO: 2102143 - RNA, 13 nt, Homo sapiens
gcuaaucuugucc

SEQ ID NO: 2102144 - RNA, 21 nt, Homo sapiens
gagagugcagaucugugcuca

SEQ ID NO: 2102145 - RNA, 14 nt, Homo sapiens
ucccgccaugcuca

SEQ ID NO: 2102146 - RNA, 18 nt, Homo sapiens
guuaagaacugugaaauu

SEQ ID NO: 2102147 - RNA, 13 nt, Homo sapiens
gacccccaggaag

SEQ ID NO: 2102148 - RNA, 17 nt, Homo sapiens
cacauccacacagccaa

SEQ ID NO: 2102149 - RNA, 15 nt, Homo sapiens
agcacuugagaacca

SEQ ID NO: 2102150 - RNA, 13 nt, Homo sapiens
aaugcuacugaaa

SEQ ID NO: 2102151 - RNA, 13 nt, Homo sapiens
uaugcuaauugaa

SEQ ID NO: 2102152 - RNA, 20 nt, Homo sapiens
agcugggcuuuccucuguga

SEQ ID NO: 2102153 - RNA, 14 nt, Homo sapiens
ggaaaacucaugaa

SEQ ID NO: 2102154 - RNA, 19 nt, Homo sapiens
caagugagggcuuuuuaac

SEQ ID NO: 2102155 - RNA, 22 nt, Homo sapiens
uaaucaguuuuauccacagaaa

SEQ ID NO: 2102156 - RNA, 14 nt, Homo sapiens
ugucauuugcuaau

SEQ ID NO: 2102157 - RNA, 17 nt, Homo sapiens
guguuggggaaaccuuc

SEQ ID NO: 2102158 - RNA, 17 nt, Homo sapiens
gcccccuggucaccgag

SEQ ID NO: 2102159 - RNA, 14 nt, Homo sapiens
cugccugcugggga

SEQ ID NO: 2102160 - RNA, 14 nt, Homo sapiens
uaggaugacugcug

SEQ ID NO: 2102161 - RNA, 18 nt, Homo sapiens
ucugacauccccacucac

SEQ ID NO: 2102162 - RNA, 19 nt, Homo sapiens
uucugaugagaaaggccug

SEQ ID NO: 2102163 - RNA, 20 nt, Homo sapiens
aagaucgugccauugcacuc

SEQ ID NO: 2102164 - RNA, 21 nt, Homo sapiens
uccugugacgcacagcacucc

SEQ ID NO: 2102165 - RNA, 14 nt, Homo sapiens
gcuguucucauucc

SEQ ID NO: 2102166 - RNA, 17 nt, Homo sapiens
aguuuuauuuacuucug

SEQ ID NO: 2102167 - RNA, 17 nt, Homo sapiens
acccauucuacacagag

SEQ ID NO: 2102168 - RNA, 16 nt, Homo sapiens
ucaacuccgugcuuaa

SEQ ID NO: 2102169 - RNA, 23 nt, Homo sapiens
uauacaccuuagucuuuccuuag

SEQ ID NO: 2102170 - RNA, 19 nt, Homo sapiens
ugaugacagacacuucuaa

SEQ ID NO: 2102171 - RNA, 17 nt, Homo sapiens
agucuggaaagugaugu

SEQ ID NO: 2102172 - RNA, 17 nt, Homo sapiens
caggugaacugggagca

SEQ ID NO: 2102173 - RNA, 17 nt, Homo sapiens
aaucuuaccagaugcua

SEQ ID NO: 2102174 - RNA, 21 nt, Homo sapiens
cagcuggacaauaugaaucuu

SEQ ID NO: 2102175 - RNA, 16 nt, Homo sapiens
gcaaccucugucuccc

SEQ ID NO: 2102176 - RNA, 14 nt, Homo sapiens
gacuauuccuggga

SEQ ID NO: 2102177 - RNA, 18 nt, Homo sapiens
cagccugucccauggaca

SEQ ID NO: 2102178 - RNA, 16 nt, Homo sapiens
agcuuaaaacacuucu

SEQ ID NO: 2102179 - RNA, 20 nt, Homo sapiens
uauauuuaaaaaauuaugga

SEQ ID NO: 2102180 - RNA, 13 nt, Homo sapiens
uuuuucacauauc

SEQ ID NO: 2102181 - RNA, 13 nt, Homo sapiens
uagauaaucuugu

SEQ ID NO: 2102182 - RNA, 22 nt, Homo sapiens
ccugcaaaaacagagguggaua

SEQ ID NO: 2102183 - RNA, 15 nt, Homo sapiens
uacuuaugccauaga

SEQ ID NO: 2102184 - RNA, 22 nt, Homo sapiens
aauccagauuuucacuguucca

SEQ ID NO: 2102185 - RNA, 14 nt, Homo sapiens
auuaugggaucuca

SEQ ID NO: 2102186 - RNA, 21 nt, Homo sapiens
caauugcggggcccaccuuag

SEQ ID NO: 2102187 - RNA, 19 nt, Homo sapiens
ugcaguauggccaugggcu

SEQ ID NO: 2102188 - RNA, 18 nt, Homo sapiens
ucugaugauauguggucc

SEQ ID NO: 2102189 - RNA, 21 nt, Homo sapiens
gcuaaacauugugaugauuau

SEQ ID NO: 2102190 - RNA, 21 nt, Homo sapiens
acuaguauuucauguugcaca

SEQ ID NO: 2102191 - RNA, 14 nt, Homo sapiens
ugguagcucugagc

SEQ ID NO: 2102192 - RNA, 21 nt, Homo sapiens
cagcgccaggcugaccacagc

SEQ ID NO: 2102193 - RNA, 19 nt, Homo sapiens
agaucacuguuuagauuug

SEQ ID NO: 2102194 - RNA, 20 nt, Homo sapiens
accucucuuguagcucucug

SEQ ID NO: 2102195 - RNA, 23 nt, Homo sapiens
augauggucugcauuagucucau

SEQ ID NO: 2102196 - RNA, 21 nt, Homo sapiens
uaagcacaaagcccauagcac

SEQ ID NO: 2102197 - RNA, 16 nt, Homo sapiens
guuggaggauggcacu

SEQ ID NO: 2102198 - RNA, 20 nt, Homo sapiens
cuaauaucacuuaaaucgag

SEQ ID NO: 2102199 - RNA, 16 nt, Homo sapiens
aauuuuauguucacuu

SEQ ID NO: 2102200 - RNA, 23 nt, Homo sapiens
acaccauuuuggcaagcucuauc

SEQ ID NO: 2102201 - RNA, 14 nt, Homo sapiens
aaggugcuugccug

SEQ ID NO: 2102202 - RNA, 15 nt, Homo sapiens
acuuagccauugaaa

SEQ ID NO: 2102203 - RNA, 22 nt, Homo sapiens
uugaauugggggagucaugguc

SEQ ID NO: 2102204 - RNA, 21 nt, Homo sapiens
aauacaaucagcccagugcaa

SEQ ID NO: 2102205 - RNA, 19 nt, Homo sapiens
acacugaagaacauguccu

SEQ ID NO: 2102206 - RNA, 13 nt, Homo sapiens
gagcucagugugu

SEQ ID NO: 2102207 - RNA, 13 nt, Homo sapiens
gaugacaguggca

SEQ ID NO: 2102208 - RNA, 20 nt, Homo sapiens
cccaccuaacucaugccauu

SEQ ID NO: 2102209 - RNA, 10 nt, Homo sapiens
gaaucauuug

SEQ ID NO: 2102210 - RNA, 12 nt, Homo sapiens
auccuguucucu

SEQ ID NO: 2102211 - RNA, 15 nt, Homo sapiens
gggcugcagguugca

SEQ ID NO: 2102212 - RNA, 19 nt, Homo sapiens
aacagaucaggaauucuaa

SEQ ID NO: 2102213 - RNA, 17 nt, Homo sapiens
aagugaccucacuggcc

SEQ ID NO: 2102214 - RNA, 14 nt, Homo sapiens
auucagugagauau

SEQ ID NO: 2102215 - RNA, 16 nt, Homo sapiens
uaugauaaacaguuga

SEQ ID NO: 2102216 - RNA, 18 nt, Homo sapiens
auaguuuuguuuguuaga

SEQ ID NO: 2102217 - RNA, 19 nt, Homo sapiens
uagcuauggaaucaauuca

SEQ ID NO: 2102218 - RNA, 16 nt, Homo sapiens
uaccugaucaaugaca

SEQ ID NO: 2102219 - RNA, 15 nt, Homo sapiens
cugaugggcaaaaaa

SEQ ID NO: 2102220 - RNA, 14 nt, Homo sapiens
cagcauugccagua

SEQ ID NO: 2102221 - RNA, 19 nt, Homo sapiens
uggccacuuuccagggugg

SEQ ID NO: 2102222 - RNA, 15 nt, Homo sapiens
ugcaacagaagcaaa

SEQ ID NO: 2102223 - RNA, 20 nt, Homo sapiens
gucauucagauaugauucaa

SEQ ID NO: 2102224 - RNA, 13 nt, Homo sapiens
cacaccauucucc

SEQ ID NO: 2102225 - RNA, 16 nt, Homo sapiens
aagguagacauggauu

SEQ ID NO: 2102226 - RNA, 15 nt, Homo sapiens
agcauguguauuucc

SEQ ID NO: 2102227 - RNA, 23 nt, Homo sapiens
gcaaaccugcaguuuuuaauuug

SEQ ID NO: 2102228 - RNA, 17 nt, Homo sapiens
gugccaguuggggcccc

SEQ ID NO: 2102229 - RNA, 12 nt, Homo sapiens
acgugucagggc

SEQ ID NO: 2102230 - RNA, 17 nt, Homo sapiens
gauuccuuuauggcaaa

SEQ ID NO: 2102231 - RNA, 13 nt, Homo sapiens
aacaggcagcuca

SEQ ID NO: 2102232 - RNA, 15 nt, Homo sapiens
gcaggaacacuggag

SEQ ID NO: 2102233 - RNA, 22 nt, Homo sapiens
aauucagagaauagcaguuuca

SEQ ID NO: 2102234 - RNA, 14 nt, Homo sapiens
cugacucccaugca

SEQ ID NO: 2102235 - RNA, 19 nt, Homo sapiens
aagagacuaggcgcugggg

SEQ ID NO: 2102236 - RNA, 16 nt, Homo sapiens
agccauaaaugaccua

SEQ ID NO: 2102237 - RNA, 13 nt, Homo sapiens
acagaauaguuua

SEQ ID NO: 2102238 - RNA, 17 nt, Homo sapiens
uuauuguuguacauacg

SEQ ID NO: 2102239 - RNA, 15 nt, Homo sapiens
cugucaccagagcuu

SEQ ID NO: 2102240 - RNA, 21 nt, Homo sapiens
gcuagguggguugaaagccaa

SEQ ID NO: 2102241 - RNA, 13 nt, Homo sapiens
gcaauucauucuc

SEQ ID NO: 2102242 - RNA, 19 nt, Homo sapiens
ugggcucccuuuaagccaa

SEQ ID NO: 2102243 - RNA, 15 nt, Homo sapiens
gucuugucuauugua

SEQ ID NO: 2102244 - RNA, 20 nt, Homo sapiens
uuagagcaagaacauucaaa

SEQ ID NO: 2102245 - RNA, 14 nt, Homo sapiens
agaguuuacugaag

SEQ ID NO: 2102246 - RNA, 16 nt, Homo sapiens
ugagucagaggacacc

SEQ ID NO: 2102247 - RNA, 20 nt, Homo sapiens
ccucugccuccuggguucaa

SEQ ID NO: 2102248 - RNA, 17 nt, Homo sapiens
ccaagggccagacagac

SEQ ID NO: 2102249 - RNA, 16 nt, Homo sapiens
cuaguuuucagcugcu

SEQ ID NO: 2102250 - RNA, 21 nt, Homo sapiens
auguguccgugaaaguuguga

SEQ ID NO: 2102251 - RNA, 18 nt, Homo sapiens
aaguauugcaccuuugaa

SEQ ID NO: 2102252 - RNA, 12 nt, Homo sapiens
ugacuaaccauu

SEQ ID NO: 2102253 - RNA, 18 nt, Homo sapiens
auugcugcuaaagguuac

SEQ ID NO: 2102254 - RNA, 12 nt, Homo sapiens
cuucaucuguga

SEQ ID NO: 2102255 - RNA, 14 nt, Homo sapiens
uuaaacguguaaau

SEQ ID NO: 2102256 - RNA, 19 nt, Homo sapiens
aucugcuguuaacugcaac

SEQ ID NO: 2102257 - RNA, 20 nt, Homo sapiens
gcacauguuguucucauuga

SEQ ID NO: 2102258 - RNA, 13 nt, Homo sapiens
aacacaugccuua

SEQ ID NO: 2102259 - RNA, 18 nt, Homo sapiens
gauguuccagugaggaac

SEQ ID NO: 2102260 - RNA, 17 nt, Homo sapiens
uauugguguacuguaau

SEQ ID NO: 2102261 - RNA, 21 nt, Homo sapiens
ccuuuucuuuuucccuugaac

SEQ ID NO: 2102262 - RNA, 18 nt, Homo sapiens
caccacccacccuaccug

SEQ ID NO: 2102263 - RNA, 18 nt, Homo sapiens
auguaagaucguucucug

SEQ ID NO: 2102264 - RNA, 13 nt, Homo sapiens
aauagaaacauau

SEQ ID NO: 2102265 - RNA, 18 nt, Homo sapiens
gauucgaaacuccauuga

SEQ ID NO: 2102266 - RNA, 20 nt, Homo sapiens
aaaugggaguacugaugaaa

SEQ ID NO: 2102267 - RNA, 21 nt, Homo sapiens
acuccagucuggcaacagagc

SEQ ID NO: 2102268 - RNA, 16 nt, Homo sapiens
aauguacaauaaagca

SEQ ID NO: 2102269 - RNA, 23 nt, Homo sapiens
aaugaugcucaaaaucuuuccaa

SEQ ID NO: 2102270 - RNA, 18 nt, Homo sapiens
acagcuuuugcaacuuaa

SEQ ID NO: 2102271 - RNA, 16 nt, Homo sapiens
aauccaaugcacugau

SEQ ID NO: 2102272 - RNA, 13 nt, Homo sapiens
ugccugggcucag

SEQ ID NO: 2102273 - RNA, 22 nt, Homo sapiens
gaucucccuuaauaaacucaca

SEQ ID NO: 2102274 - RNA, 12 nt, Homo sapiens
aguuacaacaga

SEQ ID NO: 2102275 - RNA, 20 nt, Homo sapiens
ucaccuuuuuuuaaguagua

SEQ ID NO: 2102276 - RNA, 13 nt, Homo sapiens
gcuaguacuguau

SEQ ID NO: 2102277 - RNA, 13 nt, Homo sapiens
gccggggacugcc

SEQ ID NO: 2102278 - RNA, 22 nt, Homo sapiens
aaauauuauugguguuuaccca

SEQ ID NO: 2102279 - RNA, 23 nt, Homo sapiens
acaaacuguuguggguuccugcc

SEQ ID NO: 2102280 - RNA, 14 nt, Homo sapiens
cauucuacuagcag

SEQ ID NO: 2102281 - RNA, 15 nt, Homo sapiens
acacuccacuugaag

SEQ ID NO: 2102282 - RNA, 21 nt, Homo sapiens
cuuaaucaacagaaguaucaa

SEQ ID NO: 2102283 - RNA, 15 nt, Homo sapiens
uaaaguauacucuua

SEQ ID NO: 2102284 - RNA, 12 nt, Homo sapiens
cugaguccuguu

SEQ ID NO: 2102285 - RNA, 15 nt, Homo sapiens
cucagaucauuauca

SEQ ID NO: 2102286 - RNA, 15 nt, Homo sapiens
cuuauaucaucagca

SEQ ID NO: 2102287 - RNA, 19 nt, Homo sapiens
ggaaagccucacugauaua

SEQ ID NO: 2102288 - RNA, 15 nt, Homo sapiens
auaaauaagaucaga

SEQ ID NO: 2102289 - RNA, 21 nt, Homo sapiens
acgcagucugcuucagugcag

SEQ ID NO: 2102290 - RNA, 22 nt, Homo sapiens
gaucagcauuuuagaaacuaca

SEQ ID NO: 2102291 - RNA, 20 nt, Homo sapiens
auagucuguauccaaauaau

SEQ ID NO: 2102292 - RNA, 18 nt, Homo sapiens
uauggcuuuugugcauua

SEQ ID NO: 2102293 - RNA, 21 nt, Homo sapiens
caugaagggagggucccugug

SEQ ID NO: 2102294 - RNA, 21 nt, Homo sapiens
ccugucccacucaggucugua

SEQ ID NO: 2102295 - RNA, 22 nt, Homo sapiens
aauaaaccuccgccaaugcacg

SEQ ID NO: 2102296 - RNA, 20 nt, Homo sapiens
ccuagagucuuaaagcauuu

SEQ ID NO: 2102297 - RNA, 22 nt, Homo sapiens
uuuguugaccauuuuguuaaaa

SEQ ID NO: 2102298 - RNA, 18 nt, Homo sapiens
caacacaaagacauggaa

SEQ ID NO: 2102299 - RNA, 22 nt, Homo sapiens
ugagccuaaaaauaaagcacaa

SEQ ID NO: 2102300 - RNA, 18 nt, Homo sapiens
uugugaggaagugagcca

SEQ ID NO: 2102301 - RNA, 19 nt, Homo sapiens
aucuugcuaccaguauuua

SEQ ID NO: 2102302 - RNA, 22 nt, Homo sapiens
ugacagauacauagauggacca

SEQ ID NO: 2102303 - RNA, 15 nt, Homo sapiens
uccucucugcccuaa

SEQ ID NO: 2102304 - RNA, 15 nt, Homo sapiens
auacaauuugcccaa

SEQ ID NO: 2102305 - RNA, 18 nt, Homo sapiens
ucugaaucccgacucuga

SEQ ID NO: 2102306 - RNA, 20 nt, Homo sapiens
ugcacauccauucccaagaa

SEQ ID NO: 2102307 - RNA, 22 nt, Homo sapiens
cuuuugugcuccccuuugccua

SEQ ID NO: 2102308 - RNA, 22 nt, Homo sapiens
aauguuuuacugugaaacuggc

SEQ ID NO: 2102309 - RNA, 18 nt, Homo sapiens
aaaacuggaaacaucuga

SEQ ID NO: 2102310 - RNA, 19 nt, Homo sapiens
cccuagggcucuccaagca

SEQ ID NO: 2102311 - RNA, 12 nt, Homo sapiens
ccugaaaggaag

SEQ ID NO: 2102312 - RNA, 23 nt, Homo sapiens
ucacagcucccuagguaggcacc

SEQ ID NO: 2102313 - RNA, 18 nt, Homo sapiens
ccugucuggccccugaga

SEQ ID NO: 2102314 - RNA, 13 nt, Homo sapiens
uagguuucaccuc

SEQ ID NO: 2102315 - RNA, 13 nt, Homo sapiens
cacagugaucaag

SEQ ID NO: 2102316 - RNA, 17 nt, Homo sapiens
aucagaacuucaggugu

SEQ ID NO: 2102317 - RNA, 15 nt, Homo sapiens
aaguguacacuauug

SEQ ID NO: 2102318 - RNA, 14 nt, Homo sapiens
auauguaacagcca

SEQ ID NO: 2102319 - RNA, 15 nt, Homo sapiens
aauacaggggugaaa

SEQ ID NO: 2102320 - RNA, 19 nt, Homo sapiens
gagaugcugcaguuccaaa

SEQ ID NO: 2102321 - RNA, 21 nt, Homo sapiens
cuuggagagcaaaggcccaug

SEQ ID NO: 2102322 - RNA, 23 nt, Homo sapiens
guauuuuccauacacauccccag

SEQ ID NO: 2102323 - RNA, 21 nt, Homo sapiens
ugccaauuacgguguacaguu

SEQ ID NO: 2102324 - RNA, 15 nt, Homo sapiens
aggagucagccaugu

SEQ ID NO: 2102325 - RNA, 21 nt, Homo sapiens
aaggagaaaugacuuuuauaa

SEQ ID NO: 2102326 - RNA, 14 nt, Homo sapiens
auuuguuucaaugg

SEQ ID NO: 2102327 - RNA, 16 nt, Homo sapiens
auuagccauuugacua

SEQ ID NO: 2102328 - RNA, 15 nt, Homo sapiens
ucaguuccuuugauc

SEQ ID NO: 2102329 - RNA, 14 nt, Homo sapiens
agccuggaacauca

SEQ ID NO: 2102330 - RNA, 22 nt, Homo sapiens
augaacauaaucuaccaacgaa

SEQ ID NO: 2102331 - RNA, 22 nt, Homo sapiens
aagaggcccacuagagggccca

SEQ ID NO: 2102332 - RNA, 15 nt, Homo sapiens
cugccuccugccucc

SEQ ID NO: 2102333 - RNA, 22 nt, Homo sapiens
gguucuaggagaacugucauga

SEQ ID NO: 2102334 - RNA, 15 nt, Homo sapiens
agauaugcacacacc

SEQ ID NO: 2102335 - RNA, 21 nt, Homo sapiens
cagaggugugaauaaaagcau

SEQ ID NO: 2102336 - RNA, 14 nt, Homo sapiens
cauccugaccagcu

SEQ ID NO: 2102337 - RNA, 23 nt, Homo sapiens
aguuuccuauguuucacugugca

SEQ ID NO: 2102338 - RNA, 12 nt, Homo sapiens
uguacacugugu

SEQ ID NO: 2102339 - RNA, 20 nt, Homo sapiens
accuguucagugucccgggc

SEQ ID NO: 2102340 - RNA, 17 nt, Homo sapiens
uggagauucuaauccca

SEQ ID NO: 2102341 - RNA, 15 nt, Homo sapiens
uguaaauuuacugag

SEQ ID NO: 2102342 - RNA, 15 nt, Homo sapiens
agggccugcucugcu

SEQ ID NO: 2102343 - RNA, 17 nt, Homo sapiens
ucaacagaucaacaaua

SEQ ID NO: 2102344 - RNA, 17 nt, Homo sapiens
caaugugaaaauguauc

SEQ ID NO: 2102345 - RNA, 19 nt, Homo sapiens
caaaauuuuauaagcaaau

SEQ ID NO: 2102346 - RNA, 17 nt, Homo sapiens
auucugggaauccacag

SEQ ID NO: 2102347 - RNA, 17 nt, Homo sapiens
caugagacucagugcag

SEQ ID NO: 2102348 - RNA, 20 nt, Homo sapiens
acacuuuggucauuucucaa

SEQ ID NO: 2102349 - RNA, 12 nt, Homo sapiens
acucaugaucuu

SEQ ID NO: 2102350 - RNA, 16 nt, Homo sapiens
cugccagcaccaagcg

SEQ ID NO: 2102351 - RNA, 14 nt, Homo sapiens
cuaguggucucacc

SEQ ID NO: 2102352 - RNA, 17 nt, Homo sapiens
caaaugucauugucuac

SEQ ID NO: 2102353 - RNA, 19 nt, Homo sapiens
uaugaucuuucuuuuccca

SEQ ID NO: 2102354 - RNA, 22 nt, Homo sapiens
auguacccagccuaccagagau

SEQ ID NO: 2102355 - RNA, 19 nt, Homo sapiens
acugacgcaggcaccuucu

SEQ ID NO: 2102356 - RNA, 19 nt, Homo sapiens
cguuuuguaaauguugugc

SEQ ID NO: 2102357 - RNA, 19 nt, Homo sapiens
aucauccagaaguuccuca

SEQ ID NO: 2102358 - RNA, 14 nt, Homo sapiens
caaaaggaaaaagc

SEQ ID NO: 2102359 - RNA, 20 nt, Homo sapiens
aauguugguuuuaauacuug

SEQ ID NO: 2102360 - RNA, 17 nt, Homo sapiens
ccacgcucaucuugcaa

SEQ ID NO: 2102361 - RNA, 21 nt, Homo sapiens
gcgugugcgugcaugugcacu

SEQ ID NO: 2102362 - RNA, 18 nt, Homo sapiens
cuaaugaaagugaugaca

SEQ ID NO: 2102363 - RNA, 17 nt, Homo sapiens
cguacuuucacaucucu

SEQ ID NO: 2102364 - RNA, 19 nt, Homo sapiens
uugaaucagaaugccuuca

SEQ ID NO: 2102365 - RNA, 23 nt, Homo sapiens
ccuguguuucauguucuguguca

SEQ ID NO: 2102366 - RNA, 23 nt, Homo sapiens
cauuaauauaauuggcacagaaa

SEQ ID NO: 2102367 - RNA, 21 nt, Homo sapiens
guuacuuuucauauuugcacu

SEQ ID NO: 2102368 - RNA, 21 nt, Homo sapiens
cccuuuccucuuaauucccaa

SEQ ID NO: 2102369 - RNA, 23 nt, Homo sapiens
cugugguuuguuaucaguacaau

SEQ ID NO: 2102370 - RNA, 12 nt, Homo sapiens
uuagaaugccuc

SEQ ID NO: 2102371 - RNA, 18 nt, Homo sapiens
cuucaaccccacuuccua

SEQ ID NO: 2102372 - RNA, 13 nt, Homo sapiens
guaaauacuguga

SEQ ID NO: 2102373 - RNA, 22 nt, Homo sapiens
cuauguguuuuagacuuagacu

SEQ ID NO: 2102374 - RNA, 21 nt, Homo sapiens
ucuccaaccagauugucagcu

SEQ ID NO: 2102375 - RNA, 19 nt, Homo sapiens
uuguaucaccucuucacaa

SEQ ID NO: 2102376 - RNA, 21 nt, Homo sapiens
caaacaugcggugccaugaag

SEQ ID NO: 2102377 - RNA, 14 nt, Homo sapiens
aauuaaaaccaucu

SEQ ID NO: 2102378 - RNA, 15 nt, Homo sapiens
acuuuggccaaaacc

SEQ ID NO: 2102379 - RNA, 15 nt, Homo sapiens
acgcccuucaaugcu

SEQ ID NO: 2102380 - RNA, 16 nt, Homo sapiens
ucucagguguugccaa

SEQ ID NO: 2102381 - RNA, 13 nt, Homo sapiens
cauuaaccaucuu

SEQ ID NO: 2102382 - RNA, 12 nt, Homo sapiens
cugcugcuggug

SEQ ID NO: 2102383 - RNA, 13 nt, Homo sapiens
ugcaaaguacugu

SEQ ID NO: 2102384 - RNA, 15 nt, Homo sapiens
ucucuuucuuuccaa

SEQ ID NO: 2102385 - RNA, 23 nt, Homo sapiens
uuccagcuuagaaugcaucucau

SEQ ID NO: 2102386 - RNA, 15 nt, Homo sapiens
gccucagucccccaa

SEQ ID NO: 2102387 - RNA, 19 nt, Homo sapiens
ucagaaucuccaucccuga

SEQ ID NO: 2102388 - RNA, 12 nt, Homo sapiens
aguggaaaaaga

SEQ ID NO: 2102389 - RNA, 23 nt, Homo sapiens
caacccgagucauucguucugug

SEQ ID NO: 2102390 - RNA, 16 nt, Homo sapiens
auucuuguaucaaauu

SEQ ID NO: 2102391 - RNA, 17 nt, Homo sapiens
agguagggguugggaau

SEQ ID NO: 2102392 - RNA, 13 nt, Homo sapiens
guugggaccucag

SEQ ID NO: 2102393 - RNA, 15 nt, Homo sapiens
auucuacuacuugga

SEQ ID NO: 2102394 - RNA, 17 nt, Homo sapiens
ggcuugaagcugcucac

SEQ ID NO: 2102395 - RNA, 13 nt, Homo sapiens
uaacucauagauu

SEQ ID NO: 2102396 - RNA, 19 nt, Homo sapiens
acugcaucccagcccacau

SEQ ID NO: 2102397 - RNA, 19 nt, Homo sapiens
guuauguacaaacuaguuu

SEQ ID NO: 2102398 - RNA, 14 nt, Homo sapiens
ccacugccugggau

SEQ ID NO: 2102399 - RNA, 22 nt, Homo sapiens
aggugggucaacuccaaggcaa

SEQ ID NO: 2102400 - RNA, 13 nt, Homo sapiens
cacucagcucuug

SEQ ID NO: 2102401 - RNA, 15 nt, Homo sapiens
ccacauacacugcau

SEQ ID NO: 2102402 - RNA, 22 nt, Homo sapiens
ggagccccaggggacaagggau

SEQ ID NO: 2102403 - RNA, 16 nt, Homo sapiens
aggagcagugugaccu

SEQ ID NO: 2102404 - RNA, 13 nt, Homo sapiens
ugcagcugugagu

SEQ ID NO: 2102405 - RNA, 19 nt, Homo sapiens
aucuucauacaaugacaag

SEQ ID NO: 2102406 - RNA, 15 nt, Homo sapiens
cucuucaacaugaca

SEQ ID NO: 2102407 - RNA, 14 nt, Homo sapiens
acuaaauuugauac

SEQ ID NO: 2102408 - RNA, 14 nt, Homo sapiens
gcaggcugggccau

SEQ ID NO: 2102409 - RNA, 16 nt, Homo sapiens
acccauccccugaugc

SEQ ID NO: 2102410 - RNA, 18 nt, Homo sapiens
acucuguuuccuggucag

SEQ ID NO: 2102411 - RNA, 13 nt, Homo sapiens
uugaaaacacuaa

SEQ ID NO: 2102412 - RNA, 15 nt, Homo sapiens
acuggaugaggucau

SEQ ID NO: 2102413 - RNA, 21 nt, Homo sapiens
gggugcccuggcuccuugcag

SEQ ID NO: 2102414 - RNA, 19 nt, Homo sapiens
aacuuaccucugcuucuga

SEQ ID NO: 2102415 - RNA, 15 nt, Homo sapiens
uauuuaaaaucuccu

SEQ ID NO: 2102416 - RNA, 15 nt, Homo sapiens
aacuucuauuuucaa

SEQ ID NO: 2102417 - RNA, 18 nt, Homo sapiens
auggaaaacuuaguuugu

SEQ ID NO: 2102418 - RNA, 19 nt, Homo sapiens
aacuagguaugaaguauaa

SEQ ID NO: 2102419 - RNA, 18 nt, Homo sapiens
acugcugugggcugcuca

SEQ ID NO: 2102420 - RNA, 16 nt, Homo sapiens
cacauacaauuugcac

SEQ ID NO: 2102421 - RNA, 14 nt, Homo sapiens
aaaccaaauuacaa

SEQ ID NO: 2102422 - RNA, 16 nt, Homo sapiens
ggcaaucccaccaaau

SEQ ID NO: 2102423 - RNA, 12 nt, Homo sapiens
gagagauguuuu

SEQ ID NO: 2102424 - RNA, 15 nt, Homo sapiens
uguggacaccacuga

SEQ ID NO: 2102425 - RNA, 16 nt, Homo sapiens
cccacuuuagauguau

SEQ ID NO: 2102426 - RNA, 17 nt, Homo sapiens
aacuugucacuugccag

SEQ ID NO: 2102427 - RNA, 22 nt, Homo sapiens
uagaugauuucaguucuaggaa

SEQ ID NO: 2102428 - RNA, 19 nt, Homo sapiens
guaagcugcucuauuguag

SEQ ID NO: 2102429 - RNA, 13 nt, Homo sapiens
guuucaacaaaga

SEQ ID NO: 2102430 - RNA, 13 nt, Homo sapiens
augcaaccaacua

SEQ ID NO: 2102431 - RNA, 17 nt, Homo sapiens
ugcaccauugcacucua

SEQ ID NO: 2102432 - RNA, 15 nt, Homo sapiens
ggaccccuccaggaa

SEQ ID NO: 2102433 - RNA, 12 nt, Homo sapiens
caaacaucuaau

SEQ ID NO: 2102434 - RNA, 22 nt, Homo sapiens
gguuucucucuacagugccaac

SEQ ID NO: 2102435 - RNA, 13 nt, Homo sapiens
aaaaaaugugcau

SEQ ID NO: 2102436 - RNA, 19 nt, Homo sapiens
aaauaaaaauauuguguug

SEQ ID NO: 2102437 - RNA, 23 nt, Homo sapiens
ccuggaccgcuucccagaggcca

SEQ ID NO: 2102438 - RNA, 14 nt, Homo sapiens
cucuucccaugacu

SEQ ID NO: 2102439 - RNA, 16 nt, Homo sapiens
ugccaugaacuggagg

SEQ ID NO: 2102440 - RNA, 14 nt, Homo sapiens
ucucacuagugcca

SEQ ID NO: 2102441 - RNA, 13 nt, Homo sapiens
cugaacccaggca

SEQ ID NO: 2102442 - RNA, 16 nt, Homo sapiens
aguuaaaguauauuau

SEQ ID NO: 2102443 - RNA, 13 nt, Homo sapiens
aucacuacuguau

SEQ ID NO: 2102444 - RNA, 16 nt, Homo sapiens
gcaaauguaacugugc

SEQ ID NO: 2102445 - RNA, 16 nt, Homo sapiens
aaaagucugccuaucc

SEQ ID NO: 2102446 - RNA, 14 nt, Homo sapiens
uuaaauauauccca

SEQ ID NO: 2102447 - RNA, 21 nt, Homo sapiens
gaagaccaagacacagaucac

SEQ ID NO: 2102448 - RNA, 17 nt, Homo sapiens
gacauuuuauaaucuau

SEQ ID NO: 2102449 - RNA, 17 nt, Homo sapiens
aucauagcugacucaga

SEQ ID NO: 2102450 - RNA, 15 nt, Homo sapiens
ggaucccucucugga

SEQ ID NO: 2102451 - RNA, 19 nt, Homo sapiens
uagacuauauacaugugug

SEQ ID NO: 2102452 - RNA, 23 nt, Homo sapiens
gaaguucauuuuuaucccuuccu

SEQ ID NO: 2102453 - RNA, 13 nt, Homo sapiens
guguuugucaugg

SEQ ID NO: 2102454 - RNA, 13 nt, Homo sapiens
cagguguaccucc

SEQ ID NO: 2102455 - RNA, 21 nt, Homo sapiens
cuuucacccgcuccuacagcu

SEQ ID NO: 2102456 - RNA, 13 nt, Homo sapiens
aucugaugauaug

SEQ ID NO: 2102457 - RNA, 13 nt, Homo sapiens
uuaauauguucau

SEQ ID NO: 2102458 - RNA, 18 nt, Homo sapiens
auuccagcaguuguucca

SEQ ID NO: 2102459 - RNA, 16 nt, Homo sapiens
uguauguuaauaucug

SEQ ID NO: 2102460 - RNA, 19 nt, Homo sapiens
gcuuuauccagcagucaau

SEQ ID NO: 2102461 - RNA, 16 nt, Homo sapiens
gaaaaacaaaugccau

SEQ ID NO: 2102462 - RNA, 19 nt, Homo sapiens
aggccagagggcaguggcc

SEQ ID NO: 2102463 - RNA, 21 nt, Homo sapiens
aagagaaacaggguguuguca

SEQ ID NO: 2102464 - RNA, 21 nt, Homo sapiens
gccugaguuuagggucaagga

SEQ ID NO: 2102465 - RNA, 16 nt, Homo sapiens
gugacacaaucucggc

SEQ ID NO: 2102466 - RNA, 15 nt, Homo sapiens
auauaaacugugaga

SEQ ID NO: 2102467 - RNA, 17 nt, Homo sapiens
uaggggcaaggaaacuc

SEQ ID NO: 2102468 - RNA, 17 nt, Homo sapiens
guccaaagaacaagaaa

SEQ ID NO: 2102469 - RNA, 14 nt, Homo sapiens
uauggcccaggcag

SEQ ID NO: 2102470 - RNA, 14 nt, Homo sapiens
guuucuugccucau

SEQ ID NO: 2102471 - RNA, 18 nt, Homo sapiens
ccuaaacuauaugccaua

SEQ ID NO: 2102472 - RNA, 19 nt, Homo sapiens
cacugauccuggagaaaag

SEQ ID NO: 2102473 - RNA, 15 nt, Homo sapiens
uuucaauaucauuac

SEQ ID NO: 2102474 - RNA, 19 nt, Homo sapiens
auuacaagagaaacaaaua

SEQ ID NO: 2102475 - RNA, 12 nt, Homo sapiens
aaacugugcacc

SEQ ID NO: 2102476 - RNA, 20 nt, Homo sapiens
guuucgaaguugaugcaauc

SEQ ID NO: 2102477 - RNA, 15 nt, Homo sapiens
agcccuccauuccaa

SEQ ID NO: 2102478 - RNA, 20 nt, Homo sapiens
uguuauauacauacuaugaa

SEQ ID NO: 2102479 - RNA, 14 nt, Homo sapiens
gcuccgacugcccu

SEQ ID NO: 2102480 - RNA, 22 nt, Homo sapiens
cuaaccuuggugccugauccau

SEQ ID NO: 2102481 - RNA, 20 nt, Homo sapiens
gcaauucugccccacaccca

SEQ ID NO: 2102482 - RNA, 22 nt, Homo sapiens
agauacugaugcauugaccuca

SEQ ID NO: 2102483 - RNA, 21 nt, Homo sapiens
cccaggagacggggugaagcu

SEQ ID NO: 2102484 - RNA, 22 nt, Homo sapiens
ggcucuguaccacgcuggccau

SEQ ID NO: 2102485 - RNA, 17 nt, Homo sapiens
agaauuaucaucccaac

SEQ ID NO: 2102486 - RNA, 21 nt, Homo sapiens
aaauggucucuaacauuuccu

SEQ ID NO: 2102487 - RNA, 17 nt, Homo sapiens
gcccaugugcaccugcc

SEQ ID NO: 2102488 - RNA, 14 nt, Homo sapiens
uuguuuuuguacag

SEQ ID NO: 2102489 - RNA, 19 nt, Homo sapiens
auuaagacgguuaaauacu

SEQ ID NO: 2102490 - RNA, 23 nt, Homo sapiens
gcauuucccccaccccauuucuc

SEQ ID NO: 2102491 - RNA, 17 nt, Homo sapiens
uugcaugugcugcaggu

SEQ ID NO: 2102492 - RNA, 19 nt, Homo sapiens
agacauuccugcgcauggu

SEQ ID NO: 2102493 - RNA, 18 nt, Homo sapiens
uuuccccaggagcagaag

SEQ ID NO: 2102494 - RNA, 20 nt, Homo sapiens
uugccagguugcagcugcuc

SEQ ID NO: 2102495 - RNA, 17 nt, Homo sapiens
caggcuggagugcaaug

SEQ ID NO: 2102496 - RNA, 17 nt, Homo sapiens
agaauggggaucacaga

SEQ ID NO: 2102497 - RNA, 19 nt, Homo sapiens
uaucacccaggaaucucaa

SEQ ID NO: 2102498 - RNA, 22 nt, Homo sapiens
cuuaauaaacuguggugcuuuu

SEQ ID NO: 2102499 - RNA, 20 nt, Homo sapiens
agaacccagaugaucucuua

SEQ ID NO: 2102500 - RNA, 21 nt, Homo sapiens
uugaauguaaaaauuggucac

SEQ ID NO: 2102501 - RNA, 23 nt, Homo sapiens
ggcuaauuuaacaagaacuuuaa

SEQ ID NO: 2102502 - RNA, 21 nt, Homo sapiens
augagaaggcagccaccagcg

SEQ ID NO: 2102503 - RNA, 14 nt, Homo sapiens
ccuggacacuguac

SEQ ID NO: 2102504 - RNA, 17 nt, Homo sapiens
auuacagcuuucacagu

SEQ ID NO: 2102505 - RNA, 19 nt, Homo sapiens
auagcaccuuucaaccagg

SEQ ID NO: 2102506 - RNA, 16 nt, Homo sapiens
auucaaugaucuuaga

SEQ ID NO: 2102507 - RNA, 17 nt, Homo sapiens
cugguguuuguaguuga

SEQ ID NO: 2102508 - RNA, 17 nt, Homo sapiens
ccugagcagugccagcu

SEQ ID NO: 2102509 - RNA, 13 nt, Homo sapiens
uuuuccacuuaga

SEQ ID NO: 2102510 - RNA, 16 nt, Homo sapiens
uucauauaaaaaagac

SEQ ID NO: 2102511 - RNA, 15 nt, Homo sapiens
ggaacacaucuggcu

SEQ ID NO: 2102512 - RNA, 19 nt, Homo sapiens
uggagaggcccggccucuc

SEQ ID NO: 2102513 - RNA, 15 nt, Homo sapiens
auuccuguaauacua

SEQ ID NO: 2102514 - RNA, 13 nt, Homo sapiens
aacuuacauuuaa

SEQ ID NO: 2102515 - RNA, 18 nt, Homo sapiens
uaauuuguacaggggcca

SEQ ID NO: 2102516 - RNA, 13 nt, Homo sapiens
caucugauuuacu

SEQ ID NO: 2102517 - RNA, 19 nt, Homo sapiens
uugugucuuuuaaacugga

SEQ ID NO: 2102518 - RNA, 20 nt, Homo sapiens
acugaggauguaaagaucaa

SEQ ID NO: 2102519 - RNA, 12 nt, Homo sapiens
caaauacauuaa

SEQ ID NO: 2102520 - RNA, 17 nt, Homo sapiens
agagagacgcugugauu

SEQ ID NO: 2102521 - RNA, 17 nt, Homo sapiens
agagcagugagcagggu

SEQ ID NO: 2102522 - RNA, 17 nt, Homo sapiens
ucgcaacugagaucucc

SEQ ID NO: 2102523 - RNA, 18 nt, Homo sapiens
uggagccauugaacagcu

SEQ ID NO: 2102524 - RNA, 23 nt, Homo sapiens
cuuauguuacagguuacgugaga

SEQ ID NO: 2102525 - RNA, 16 nt, Homo sapiens
augcugaacauugcau

SEQ ID NO: 2102526 - RNA, 19 nt, Homo sapiens
uuagauuugugugcaucag

SEQ ID NO: 2102527 - RNA, 18 nt, Homo sapiens
cugugcgagaacacaagc

SEQ ID NO: 2102528 - RNA, 21 nt, Homo sapiens
cuaagaaaagccuaaucacag

SEQ ID NO: 2102529 - RNA, 13 nt, Homo sapiens
auacuaaccauuu

SEQ ID NO: 2102530 - RNA, 13 nt, Homo sapiens
aauuuaaccuacu

SEQ ID NO: 2102531 - RNA, 21 nt, Homo sapiens
guacuucauucaaaaagccaa

SEQ ID NO: 2102532 - RNA, 23 nt, Homo sapiens
aguauuuauugcaggaugguguc

SEQ ID NO: 2102533 - RNA, 18 nt, Homo sapiens
cuuucacuaucuguaaug

SEQ ID NO: 2102534 - RNA, 21 nt, Homo sapiens
ccuuucuugaauuagcauuuu

SEQ ID NO: 2102535 - RNA, 15 nt, Homo sapiens
gauauuguaagcauu

SEQ ID NO: 2102536 - RNA, 22 nt, Homo sapiens
ggugcuaugucccaagagccau

SEQ ID NO: 2102537 - RNA, 22 nt, Homo sapiens
auuggaggugaacaagcaaacc

SEQ ID NO: 2102538 - RNA, 22 nt, Homo sapiens
aacauggacuacacacaauaca

SEQ ID NO: 2102539 - RNA, 19 nt, Homo sapiens
agaccccuuguugcacugc

SEQ ID NO: 2102540 - RNA, 12 nt, Homo sapiens
agcuucaugccu

SEQ ID NO: 2102541 - RNA, 12 nt, Homo sapiens
agccucaugccc

SEQ ID NO: 2102542 - RNA, 16 nt, Homo sapiens
uaaggaaacgaugaaa

SEQ ID NO: 2102543 - RNA, 15 nt, Homo sapiens
cauuucuagcaguga

SEQ ID NO: 2102544 - RNA, 14 nt, Homo sapiens
acgauucacuccuu

SEQ ID NO: 2102545 - RNA, 10 nt, Homo sapiens
agacucugac

SEQ ID NO: 2102546 - RNA, 18 nt, Homo sapiens
ugugucugucaccacauc

SEQ ID NO: 2102547 - RNA, 18 nt, Homo sapiens
gaugauucccacccaaac

SEQ ID NO: 2102548 - RNA, 21 nt, Homo sapiens
aguggcaagcucuucauugca

SEQ ID NO: 2102549 - RNA, 19 nt, Homo sapiens
ccuuagaccaccaagccuu

SEQ ID NO: 2102550 - RNA, 17 nt, Homo sapiens
ucaugauagacuuguua

SEQ ID NO: 2102551 - RNA, 16 nt, Homo sapiens
ugcuucaguacuugug

SEQ ID NO: 2102552 - RNA, 20 nt, Homo sapiens
gucuucaacauccugccagc

SEQ ID NO: 2102553 - RNA, 17 nt, Homo sapiens
ggccucgggcccggccu

SEQ ID NO: 2102554 - RNA, 19 nt, Homo sapiens
gugccagugcuaaacuacu

SEQ ID NO: 2102555 - RNA, 16 nt, Homo sapiens
uuugacuccaggaaca

SEQ ID NO: 2102556 - RNA, 23 nt, Homo sapiens
ucaagucuuccugauacaugacu

SEQ ID NO: 2102557 - RNA, 14 nt, Homo sapiens
auguauucaaguaa

SEQ ID NO: 2102558 - RNA, 21 nt, Homo sapiens
uugaaugugguuacuuccuac

SEQ ID NO: 2102559 - RNA, 17 nt, Homo sapiens
ggagcugauaacauuuu

SEQ ID NO: 2102560 - RNA, 14 nt, Homo sapiens
gcauuaaacugaau

SEQ ID NO: 2102561 - RNA, 13 nt, Homo sapiens
cacagguuuucag

SEQ ID NO: 2102562 - RNA, 17 nt, Homo sapiens
gacuacuaaggccuuuu

SEQ ID NO: 2102563 - RNA, 11 nt, Homo sapiens
cucaaacugcc

SEQ ID NO: 2102564 - RNA, 23 nt, Homo sapiens
aucacccuugaaaacucucaguc

SEQ ID NO: 2102565 - RNA, 22 nt, Homo sapiens
ccuccugugcuauuuguacaaa

SEQ ID NO: 2102566 - RNA, 14 nt, Homo sapiens
cuugcuuccugucu

SEQ ID NO: 2102567 - RNA, 19 nt, Homo sapiens
gugguaucuucacguagaa

SEQ ID NO: 2102568 - RNA, 22 nt, Homo sapiens
gauuccaacauuucucacugaa

SEQ ID NO: 2102569 - RNA, 11 nt, Homo sapiens
uacacaggccu

SEQ ID NO: 2102570 - RNA, 23 nt, Homo sapiens
ucuaugaccucgcccuccacaaa

SEQ ID NO: 2102571 - RNA, 22 nt, Homo sapiens
ucaaugugacaccuaacucuuu

SEQ ID NO: 2102572 - RNA, 23 nt, Homo sapiens
cccuguuuaaagauuucaagaag

SEQ ID NO: 2102573 - RNA, 15 nt, Homo sapiens
cuugccuaggccaaa

SEQ ID NO: 2102574 - RNA, 15 nt, Homo sapiens
gcugcauaguauucc

SEQ ID NO: 2102575 - RNA, 22 nt, Homo sapiens
aacaagcauuucccccagggaa

SEQ ID NO: 2102576 - RNA, 13 nt, Homo sapiens
uugcuucuugcca

SEQ ID NO: 2102577 - RNA, 22 nt, Homo sapiens
gauuaaaaaaaaauguaugcaa

SEQ ID NO: 2102578 - RNA, 20 nt, Homo sapiens
aaucuuggcucgcaaccucc

SEQ ID NO: 2102579 - RNA, 17 nt, Homo sapiens
gagccaggacaugaaga

SEQ ID NO: 2102580 - RNA, 20 nt, Homo sapiens
auugacaacugcacaugaaa

SEQ ID NO: 2102581 - RNA, 15 nt, Homo sapiens
ugaagucuacuuuag

SEQ ID NO: 2102582 - RNA, 12 nt, Homo sapiens
auguuacagauu

SEQ ID NO: 2102583 - RNA, 15 nt, Homo sapiens
agaccuaaugcuccu

SEQ ID NO: 2102584 - RNA, 15 nt, Homo sapiens
aucuauuauuacaca

SEQ ID NO: 2102585 - RNA, 20 nt, Homo sapiens
agucuugaugacauuucacu

SEQ ID NO: 2102586 - RNA, 22 nt, Homo sapiens
uaugcaucuuugagaauauuau

SEQ ID NO: 2102587 - RNA, 19 nt, Homo sapiens
caguaaauaacaggcauuu

SEQ ID NO: 2102588 - RNA, 15 nt, Homo sapiens
acaugccagcuuccu

SEQ ID NO: 2102589 - RNA, 16 nt, Homo sapiens
uaaacaacuaccuccu

SEQ ID NO: 2102590 - RNA, 17 nt, Homo sapiens
uuuacauuauuaagaaa

SEQ ID NO: 2102591 - RNA, 17 nt, Homo sapiens
cagggcaugccccggcc

SEQ ID NO: 2102592 - RNA, 14 nt, Homo sapiens
cuguucagccuuug

SEQ ID NO: 2102593 - RNA, 19 nt, Homo sapiens
cucuuguaauaaaaugucu

SEQ ID NO: 2102594 - RNA, 15 nt, Homo sapiens
cagugguccuuuuca

SEQ ID NO: 2102595 - RNA, 21 nt, Homo sapiens
ugggcguuugaacucagggag

SEQ ID NO: 2102596 - RNA, 20 nt, Homo sapiens
uccagaaggauccaagacaa

SEQ ID NO: 2102597 - RNA, 16 nt, Homo sapiens
guagcacaaauuuucu

SEQ ID NO: 2102598 - RNA, 18 nt, Homo sapiens
aauaucacuguaaugagu

SEQ ID NO: 2102599 - RNA, 21 nt, Homo sapiens
guaucuuuacgaggagucuca

SEQ ID NO: 2102600 - RNA, 13 nt, Homo sapiens
cccucggcauuca

SEQ ID NO: 2102601 - RNA, 16 nt, Homo sapiens
ccagugggcuguguug

SEQ ID NO: 2102602 - RNA, 14 nt, Homo sapiens
guugcccagugugu

SEQ ID NO: 2102603 - RNA, 19 nt, Homo sapiens
cacauggccuaugcacaua

SEQ ID NO: 2102604 - RNA, 16 nt, Homo sapiens
gaagcagcucaaggga

SEQ ID NO: 2102605 - RNA, 12 nt, Homo sapiens
uucuguccugua

SEQ ID NO: 2102606 - RNA, 23 nt, Homo sapiens
agaagcuaaauccuuuacuguua

SEQ ID NO: 2102607 - RNA, 21 nt, Homo sapiens
aaaaauuuuaagccaguuuua

SEQ ID NO: 2102608 - RNA, 16 nt, Homo sapiens
uuuacgguccaugccu

SEQ ID NO: 2102609 - RNA, 19 nt, Homo sapiens
aguaaauuuugugaugaau

SEQ ID NO: 2102610 - RNA, 21 nt, Homo sapiens
cagaugcagaaaauugccuaa

SEQ ID NO: 2102611 - RNA, 20 nt, Homo sapiens
accuaccaccccuuccuguc

SEQ ID NO: 2102612 - RNA, 17 nt, Homo sapiens
ucacccccagcuggaaa

SEQ ID NO: 2102613 - RNA, 21 nt, Homo sapiens
gcuggcaccgcgugccaugca

SEQ ID NO: 2102614 - RNA, 23 nt, Homo sapiens
ugugggaggagugacaugaagca

SEQ ID NO: 2102615 - RNA, 19 nt, Homo sapiens
ugugaacauggacucuucc

SEQ ID NO: 2102616 - RNA, 11 nt, Homo sapiens
augacacgaau

SEQ ID NO: 2102617 - RNA, 14 nt, Homo sapiens
aaugaaugagccaa

SEQ ID NO: 2102618 - RNA, 22 nt, Homo sapiens
uccucuagcaggccuaagacau

SEQ ID NO: 2102619 - RNA, 13 nt, Homo sapiens
aaccaagugcuua

SEQ ID NO: 2102620 - RNA, 23 nt, Homo sapiens
aauggcuuuacaaagcuggcaau

SEQ ID NO: 2102621 - RNA, 13 nt, Homo sapiens
uggccggugcugg

SEQ ID NO: 2102622 - RNA, 17 nt, Homo sapiens
gcugaugagaaucaugc

SEQ ID NO: 2102623 - RNA, 22 nt, Homo sapiens
caggggugcuccugugcucacc

SEQ ID NO: 2102624 - RNA, 19 nt, Homo sapiens
agcgucccagucucuggca

SEQ ID NO: 2102625 - RNA, 20 nt, Homo sapiens
accguaugagggaacugugu

SEQ ID NO: 2102626 - RNA, 21 nt, Homo sapiens
ugcagaugccacccuagccaa

SEQ ID NO: 2102627 - RNA, 15 nt, Homo sapiens
gaaaucaaagcgcca

SEQ ID NO: 2102628 - RNA, 20 nt, Homo sapiens
cuuucaaguuugucacuaaa

SEQ ID NO: 2102629 - RNA, 20 nt, Homo sapiens
cugcuuuuucucagcccuga

SEQ ID NO: 2102630 - RNA, 22 nt, Homo sapiens
ucacaacuuugcuuuuagguug

SEQ ID NO: 2102631 - RNA, 20 nt, Homo sapiens
uggcugcuggcccacagcuc

SEQ ID NO: 2102632 - RNA, 16 nt, Homo sapiens
uaaacagaagguaaua

SEQ ID NO: 2102633 - RNA, 18 nt, Homo sapiens
gugucauuggaagccauc

SEQ ID NO: 2102634 - RNA, 23 nt, Homo sapiens
uucuucuaaugagucgacuuuga

SEQ ID NO: 2102635 - RNA, 12 nt, Homo sapiens
gaagaccaaaaa

SEQ ID NO: 2102636 - RNA, 13 nt, Homo sapiens
caccuugcugugu

SEQ ID NO: 2102637 - RNA, 18 nt, Homo sapiens
ccacuucuucagcuuggg

SEQ ID NO: 2102638 - RNA, 24 nt, Homo sapiens
ucagagcacuuuaaaaacaggcca

SEQ ID NO: 2102639 - RNA, 16 nt, Homo sapiens
uuggaugcacuuuaua

SEQ ID NO: 2102640 - RNA, 14 nt, Homo sapiens
agauauuacuuuau

SEQ ID NO: 2102641 - RNA, 19 nt, Homo sapiens
ugccagggccugucucuga

SEQ ID NO: 2102642 - RNA, 17 nt, Homo sapiens
aauccuucucacuaaaa

SEQ ID NO: 2102643 - RNA, 20 nt, Homo sapiens
ccugucgucccagcuacuca

SEQ ID NO: 2102644 - RNA, 13 nt, Homo sapiens
gacgcagcacaag

SEQ ID NO: 2102645 - RNA, 20 nt, Homo sapiens
aagccacucugucccuuccu

SEQ ID NO: 2102646 - RNA, 17 nt, Homo sapiens
aaauucaauucauagaa

SEQ ID NO: 2102647 - RNA, 13 nt, Homo sapiens
ggauggagcacuu

SEQ ID NO: 2102648 - RNA, 12 nt, Homo sapiens
gaugugccuaaa

SEQ ID NO: 2102649 - RNA, 22 nt, Homo sapiens
uaauacuuaaauaaacaugacc

SEQ ID NO: 2102650 - RNA, 23 nt, Homo sapiens
guaggcuaaaaggcuuccaggcu

SEQ ID NO: 2102651 - RNA, 13 nt, Homo sapiens
aauccaucugucu

SEQ ID NO: 2102652 - RNA, 19 nt, Homo sapiens
uggucccagcggaugcugc

SEQ ID NO: 2102653 - RNA, 16 nt, Homo sapiens
ccaggaccaccacuua

SEQ ID NO: 2102654 - RNA, 16 nt, Homo sapiens
ucaggaagaagagaug

SEQ ID NO: 2102655 - RNA, 11 nt, Homo sapiens
acaacaaggac

SEQ ID NO: 2102656 - RNA, 22 nt, Homo sapiens
auucacuauggggggaggugua

SEQ ID NO: 2102657 - RNA, 23 nt, Homo sapiens
ggacacacacucaccaguggccu

SEQ ID NO: 2102658 - RNA, 14 nt, Homo sapiens
guauuauuugcaca

SEQ ID NO: 2102659 - RNA, 18 nt, Homo sapiens
agugauagcuacuguaga

SEQ ID NO: 2102660 - RNA, 21 nt, Homo sapiens
ucccagagggugggcuucagg

SEQ ID NO: 2102661 - RNA, 16 nt, Homo sapiens
uacaacacugagccau

SEQ ID NO: 2102662 - RNA, 22 nt, Homo sapiens
aggcaggugccccucucuccau

SEQ ID NO: 2102663 - RNA, 14 nt, Homo sapiens
aauuuccugugagg

SEQ ID NO: 2102664 - RNA, 20 nt, Homo sapiens
cugcagccucagagacauca

SEQ ID NO: 2102665 - RNA, 17 nt, Homo sapiens
ugcauguuaagugccau

SEQ ID NO: 2102666 - RNA, 22 nt, Homo sapiens
auucaacaagagcacuacauuc

SEQ ID NO: 2102667 - RNA, 14 nt, Homo sapiens
acguuauacugaaa

SEQ ID NO: 2102668 - RNA, 21 nt, Homo sapiens
cucaguugaaaaugcaacucu

SEQ ID NO: 2102669 - RNA, 21 nt, Homo sapiens
guucaaagagcaauauuccag

SEQ ID NO: 2102670 - RNA, 21 nt, Homo sapiens
ugcucaguaacacagugcagu

SEQ ID NO: 2102671 - RNA, 15 nt, Homo sapiens
uaaaugcauguccuc

SEQ ID NO: 2102672 - RNA, 13 nt, Homo sapiens
aaugaguguuaua

SEQ ID NO: 2102673 - RNA, 19 nt, Homo sapiens
ucgaaaacuuuaacaaaca

SEQ ID NO: 2102674 - RNA, 21 nt, Homo sapiens
ucagagaaaguuccauuuccg

SEQ ID NO: 2102675 - RNA, 23 nt, Homo sapiens
uguaugaguaucuguauguauau

SEQ ID NO: 2102676 - RNA, 17 nt, Homo sapiens
guccccggcgggacugu

SEQ ID NO: 2102677 - RNA, 20 nt, Homo sapiens
accacucgaggccugcaaac

SEQ ID NO: 2102678 - RNA, 17 nt, Homo sapiens
gaaaauaaaaacuuuag

SEQ ID NO: 2102679 - RNA, 17 nt, Homo sapiens
aaaaucauuaacacuuu

SEQ ID NO: 2102680 - RNA, 15 nt, Homo sapiens
ucuucccacauacau

SEQ ID NO: 2102681 - RNA, 19 nt, Homo sapiens
agaauaauuucuccucauu

SEQ ID NO: 2102682 - RNA, 17 nt, Homo sapiens
ccuccagagacaggaaa

SEQ ID NO: 2102683 - RNA, 20 nt, Homo sapiens
acauuaggauggugaaccag

SEQ ID NO: 2102684 - RNA, 23 nt, Homo sapiens
cauggccaaauguucaauaugag

SEQ ID NO: 2102685 - RNA, 19 nt, Homo sapiens
acaccuagcgucaguauuu

SEQ ID NO: 2102686 - RNA, 13 nt, Homo sapiens
cgugcacucccua

SEQ ID NO: 2102687 - RNA, 13 nt, Homo sapiens
cuucgacuacugc

SEQ ID NO: 2102688 - RNA, 15 nt, Homo sapiens
gccuguggcauucau

SEQ ID NO: 2102689 - RNA, 19 nt, Homo sapiens
ugcucugcccacugugaaa

SEQ ID NO: 2102690 - RNA, 19 nt, Homo sapiens
uuggggaauuaaaagucau

SEQ ID NO: 2102691 - RNA, 18 nt, Homo sapiens
uugagcccacaaagccuu

SEQ ID NO: 2102692 - RNA, 16 nt, Homo sapiens
aaccguaacccacccc

SEQ ID NO: 2102693 - RNA, 18 nt, Homo sapiens
ccaaagcuugccacuuuc

SEQ ID NO: 2102694 - RNA, 19 nt, Homo sapiens
auaaaccuccgccaaugca

SEQ ID NO: 2102695 - RNA, 20 nt, Homo sapiens
gcccucagcccaccugggga

SEQ ID NO: 2102696 - RNA, 18 nt, Homo sapiens
aguucuaguuugcauucc

SEQ ID NO: 2102697 - RNA, 13 nt, Homo sapiens
cacggucuucaca

SEQ ID NO: 2102698 - RNA, 16 nt, Homo sapiens
uccaaugucaauguga

SEQ ID NO: 2102699 - RNA, 22 nt, Homo sapiens
gccagucccgggggccugcccu

SEQ ID NO: 2102700 - RNA, 21 nt, Homo sapiens
aguugugucagcuacugcgga

SEQ ID NO: 2102701 - RNA, 17 nt, Homo sapiens
gcaaguuaacuuggaaa

SEQ ID NO: 2102702 - RNA, 15 nt, Homo sapiens
aacaucagaaacuga

SEQ ID NO: 2102703 - RNA, 15 nt, Homo sapiens
auucuggcucaggga

SEQ ID NO: 2102704 - RNA, 21 nt, Homo sapiens
ucccagggaggcugugcacag

SEQ ID NO: 2102705 - RNA, 22 nt, Homo sapiens
gacgggguuucaccauguuggc

SEQ ID NO: 2102706 - RNA, 23 nt, Homo sapiens
auugaccuguccucuuugugaua

SEQ ID NO: 2102707 - RNA, 16 nt, Homo sapiens
ucagcacaaagacaca

SEQ ID NO: 2102708 - RNA, 13 nt, Homo sapiens
auuuucccuaccc

SEQ ID NO: 2102709 - RNA, 14 nt, Homo sapiens
ugguccgaucuuug

SEQ ID NO: 2102710 - RNA, 19 nt, Homo sapiens
gauacaggugacagugaag

SEQ ID NO: 2102711 - RNA, 13 nt, Homo sapiens
ucagaacagucug

SEQ ID NO: 2102712 - RNA, 16 nt, Homo sapiens
auccugacuucagugu

SEQ ID NO: 2102713 - RNA, 18 nt, Homo sapiens
cuguauguuaggugacau

SEQ ID NO: 2102714 - RNA, 14 nt, Homo sapiens
uaacuaauucuguc

SEQ ID NO: 2102715 - RNA, 15 nt, Homo sapiens
caucacuaguggcaa

SEQ ID NO: 2102716 - RNA, 22 nt, Homo sapiens
uagauaauaugaaaaucuccau

SEQ ID NO: 2102717 - RNA, 16 nt, Homo sapiens
uacaaagaacaugaac

SEQ ID NO: 2102718 - RNA, 14 nt, Homo sapiens
ugugagcuaggaga

SEQ ID NO: 2102719 - RNA, 11 nt, Homo sapiens
guccucucagu

SEQ ID NO: 2102720 - RNA, 15 nt, Homo sapiens
aaaaaguugcacauu

SEQ ID NO: 2102721 - RNA, 21 nt, Homo sapiens
cuuuccugguuuucaucagga

SEQ ID NO: 2102722 - RNA, 12 nt, Homo sapiens
uacuacauacaa

SEQ ID NO: 2102723 - RNA, 16 nt, Homo sapiens
agggaccaugugucac

SEQ ID NO: 2102724 - RNA, 21 nt, Homo sapiens
auuuagguaaauaaagcucaa

SEQ ID NO: 2102725 - RNA, 20 nt, Homo sapiens
aaacagggaauacauuguau

SEQ ID NO: 2102726 - RNA, 16 nt, Homo sapiens
ccaguaacgugcugcu

SEQ ID NO: 2102727 - RNA, 18 nt, Homo sapiens
cuacaaacguuugacaaa

SEQ ID NO: 2102728 - RNA, 18 nt, Homo sapiens
cucugugucucuccauca

SEQ ID NO: 2102729 - RNA, 12 nt, Homo sapiens
cccuauuacuug

SEQ ID NO: 2102730 - RNA, 20 nt, Homo sapiens
uaacucccuccaccagccug

SEQ ID NO: 2102731 - RNA, 20 nt, Homo sapiens
ucccuccuggugucacccca

SEQ ID NO: 2102732 - RNA, 22 nt, Homo sapiens
uaagcauggucccuugucacca

SEQ ID NO: 2102733 - RNA, 20 nt, Homo sapiens
gcagcccucagggcugcuuu

SEQ ID NO: 2102734 - RNA, 18 nt, Homo sapiens
cccucaaagcuuccauuc

SEQ ID NO: 2102735 - RNA, 16 nt, Homo sapiens
acuauaaaaacugccc

SEQ ID NO: 2102736 - RNA, 13 nt, Homo sapiens
uauuaaucacugu

SEQ ID NO: 2102737 - RNA, 18 nt, Homo sapiens
cuaccccauucucuagac

SEQ ID NO: 2102738 - RNA, 22 nt, Homo sapiens
uguguaaacuuggggauggcug

SEQ ID NO: 2102739 - RNA, 14 nt, Homo sapiens
ccuuguugaugugg

SEQ ID NO: 2102740 - RNA, 16 nt, Homo sapiens
ucaggcuugcauuaaa

SEQ ID NO: 2102741 - RNA, 19 nt, Homo sapiens
guauacuguaaucgugcua

SEQ ID NO: 2102742 - RNA, 18 nt, Homo sapiens
aggaugcggcuuucucug

SEQ ID NO: 2102743 - RNA, 22 nt, Homo sapiens
uaaaggcuuuuggcagcaaagu

SEQ ID NO: 2102744 - RNA, 15 nt, Homo sapiens
cuugagcuacuucaa

SEQ ID NO: 2102745 - RNA, 15 nt, Homo sapiens
aaacuuuaucucaca

SEQ ID NO: 2102746 - RNA, 21 nt, Homo sapiens
ugcccuagcgcucucuuccag

SEQ ID NO: 2102747 - RNA, 14 nt, Homo sapiens
ucauaaguagcauu

SEQ ID NO: 2102748 - RNA, 19 nt, Homo sapiens
uguaaaauacuauuggaca

SEQ ID NO: 2102749 - RNA, 14 nt, Homo sapiens
cauccagaggccau

SEQ ID NO: 2102750 - RNA, 16 nt, Homo sapiens
auaaauaugugaaaau

SEQ ID NO: 2102751 - RNA, 14 nt, Homo sapiens
gcccauaucuguga

SEQ ID NO: 2102752 - RNA, 22 nt, Homo sapiens
ccuccaggaugaguuacuugaa

SEQ ID NO: 2102753 - RNA, 20 nt, Homo sapiens
cucuuaauucccaaucccau

SEQ ID NO: 2102754 - RNA, 21 nt, Homo sapiens
gcuggagcaaaagucauuaca

SEQ ID NO: 2102755 - RNA, 18 nt, Homo sapiens
gccuggaugccagcugug

SEQ ID NO: 2102756 - RNA, 20 nt, Homo sapiens
acaauguuuuaaacauucuu

SEQ ID NO: 2102757 - RNA, 20 nt, Homo sapiens
cucaugucuguaaucccagc

SEQ ID NO: 2102758 - RNA, 14 nt, Homo sapiens
gaagaauugccaau

SEQ ID NO: 2102759 - RNA, 22 nt, Homo sapiens
auauuuauuugacucagcacug

SEQ ID NO: 2102760 - RNA, 16 nt, Homo sapiens
ugagaaagaaugagca

SEQ ID NO: 2102761 - RNA, 16 nt, Homo sapiens
cuuccgacaccacugg

SEQ ID NO: 2102762 - RNA, 20 nt, Homo sapiens
acuucuuuacuaacacuggc

SEQ ID NO: 2102763 - RNA, 13 nt, Homo sapiens
uaccucaccuggg

SEQ ID NO: 2102764 - RNA, 20 nt, Homo sapiens
acacagaugucuuaaaagac

SEQ ID NO: 2102765 - RNA, 19 nt, Homo sapiens
uuguuccaaaagaguccau

SEQ ID NO: 2102766 - RNA, 13 nt, Homo sapiens
aagaggagaacaa

SEQ ID NO: 2102767 - RNA, 19 nt, Homo sapiens
cuuucuaaaacacauuuaa

SEQ ID NO: 2102768 - RNA, 19 nt, Homo sapiens
aacuuuuuuaaauaaacuu

SEQ ID NO: 2102769 - RNA, 13 nt, Homo sapiens
ucuccuacucacu

SEQ ID NO: 2102770 - RNA, 14 nt, Homo sapiens
agcggguaaaaaga

SEQ ID NO: 2102771 - RNA, 22 nt, Homo sapiens
cccacgagggucaggacuguga

SEQ ID NO: 2102772 - RNA, 20 nt, Homo sapiens
uaaagcaucauuaaugcaca

SEQ ID NO: 2102773 - RNA, 23 nt, Homo sapiens
ggcccgugacauccccacccuug

SEQ ID NO: 2102774 - RNA, 14 nt, Homo sapiens
aucuggacacuggg

SEQ ID NO: 2102775 - RNA, 21 nt, Homo sapiens
ucagcaucccuagaaagccau

SEQ ID NO: 2102776 - RNA, 16 nt, Homo sapiens
cacuauuauggaugaa

SEQ ID NO: 2102777 - RNA, 17 nt, Homo sapiens
gcccugcugaagcugcu

SEQ ID NO: 2102778 - RNA, 18 nt, Homo sapiens
ucuuguugcuuuguugca

SEQ ID NO: 2102779 - RNA, 18 nt, Homo sapiens
auacuguaacacuguaua

SEQ ID NO: 2102780 - RNA, 16 nt, Homo sapiens
cauaaucucauucaaa

SEQ ID NO: 2102781 - RNA, 21 nt, Homo sapiens
cuuugguacaaguuuacauga

SEQ ID NO: 2102782 - RNA, 14 nt, Homo sapiens
ucaucugacuauga

SEQ ID NO: 2102783 - RNA, 13 nt, Homo sapiens
gucuguacuucau

SEQ ID NO: 2102784 - RNA, 18 nt, Homo sapiens
uuaguugaggccuucuag

SEQ ID NO: 2102785 - RNA, 21 nt, Homo sapiens
cccccagugggcauagucagu

SEQ ID NO: 2102786 - RNA, 13 nt, Homo sapiens
acccuguccuccc

SEQ ID NO: 2102787 - RNA, 16 nt, Homo sapiens
auacaccccugaguga

SEQ ID NO: 2102788 - RNA, 17 nt, Homo sapiens
aaguaauuuugccaucc

SEQ ID NO: 2102789 - RNA, 16 nt, Homo sapiens
gaaucucguucccaaa

SEQ ID NO: 2102790 - RNA, 20 nt, Homo sapiens
ugaaaggaacacuggcuuga

SEQ ID NO: 2102791 - RNA, 20 nt, Homo sapiens
gacauaaaggaaaagacaca

SEQ ID NO: 2102792 - RNA, 20 nt, Homo sapiens
caaccccuucgcuccugugu

SEQ ID NO: 2102793 - RNA, 14 nt, Homo sapiens
agauagacggguug

SEQ ID NO: 2102794 - RNA, 19 nt, Homo sapiens
acaguaugucuacuccuca

SEQ ID NO: 2102795 - RNA, 13 nt, Homo sapiens
auucuuguaaaua

SEQ ID NO: 2102796 - RNA, 17 nt, Homo sapiens
gugcuacaacaugugag

SEQ ID NO: 2102797 - RNA, 22 nt, Homo sapiens
aauauuccuuuauuuugcugcu

SEQ ID NO: 2102798 - RNA, 18 nt, Homo sapiens
aagccuagcccuucucuc

SEQ ID NO: 2102799 - RNA, 21 nt, Homo sapiens
ccucuguggcucacauuucau

SEQ ID NO: 2102800 - RNA, 14 nt, Homo sapiens
cucgaccaccucaa

SEQ ID NO: 2102801 - RNA, 12 nt, Homo sapiens
gcugcuccuagg

SEQ ID NO: 2102802 - RNA, 12 nt, Homo sapiens
ucuggagcccac

SEQ ID NO: 2102803 - RNA, 22 nt, Homo sapiens
augccuaauaaacaauucaagu

SEQ ID NO: 2102804 - RNA, 13 nt, Homo sapiens
aacucucauuucu

SEQ ID NO: 2102805 - RNA, 13 nt, Homo sapiens
ccucccaaagugu

SEQ ID NO: 2102806 - RNA, 15 nt, Homo sapiens
augacaucuccucca

SEQ ID NO: 2102807 - RNA, 14 nt, Homo sapiens
aguaggacugcuga

SEQ ID NO: 2102808 - RNA, 19 nt, Homo sapiens
cuauucauggcuaccucag

SEQ ID NO: 2102809 - RNA, 18 nt, Homo sapiens
ugccagucauccagcuga

SEQ ID NO: 2102810 - RNA, 18 nt, Homo sapiens
gaaauguuuuaaugccag

SEQ ID NO: 2102811 - RNA, 20 nt, Homo sapiens
uucgucuaaugggggcaguc

SEQ ID NO: 2102812 - RNA, 21 nt, Homo sapiens
cuugucucaaaaaccauuaca

SEQ ID NO: 2102813 - RNA, 22 nt, Homo sapiens
cuuaaaauaagcagguggaucu

SEQ ID NO: 2102814 - RNA, 22 nt, Homo sapiens
acaagcucugcgccaaucacag

SEQ ID NO: 2102815 - RNA, 13 nt, Homo sapiens
uuuauauguugcu

SEQ ID NO: 2102816 - RNA, 14 nt, Homo sapiens
cuucucuccagcug

SEQ ID NO: 2102817 - RNA, 13 nt, Homo sapiens
uaggucggcacuu

SEQ ID NO: 2102818 - RNA, 14 nt, Homo sapiens
caaugucuaaaaac

SEQ ID NO: 2102819 - RNA, 18 nt, Homo sapiens
gcuuguggucacacugug

SEQ ID NO: 2102820 - RNA, 13 nt, Homo sapiens
aguuuucaccugg

SEQ ID NO: 2102821 - RNA, 15 nt, Homo sapiens
gugugcugcuguucu

SEQ ID NO: 2102822 - RNA, 20 nt, Homo sapiens
auugucuuccuguaagaccu

SEQ ID NO: 2102823 - RNA, 12 nt, Homo sapiens
uggacugaccaa

SEQ ID NO: 2102824 - RNA, 14 nt, Homo sapiens
cuuuaaacuacuga

SEQ ID NO: 2102825 - RNA, 15 nt, Homo sapiens
ucugauagacuuugu

SEQ ID NO: 2102826 - RNA, 15 nt, Homo sapiens
ggacaggcauguucu

SEQ ID NO: 2102827 - RNA, 13 nt, Homo sapiens
auucauaaugcaa

SEQ ID NO: 2102828 - RNA, 18 nt, Homo sapiens
caagcaagggcugugcug

SEQ ID NO: 2102829 - RNA, 19 nt, Homo sapiens
uccucgagggcagggacuu

SEQ ID NO: 2102830 - RNA, 17 nt, Homo sapiens
uagugcauuucaaggaa

SEQ ID NO: 2102831 - RNA, 14 nt, Homo sapiens
uccuggaacuugcu

SEQ ID NO: 2102832 - RNA, 15 nt, Homo sapiens
aggaagccacgugcu

SEQ ID NO: 2102833 - RNA, 13 nt, Homo sapiens
cucugaacuucca

SEQ ID NO: 2102834 - RNA, 23 nt, Homo sapiens
ccucuuugcucccugaguucacu

SEQ ID NO: 2102835 - RNA, 20 nt, Homo sapiens
ucucuaaccauucaaaugac

SEQ ID NO: 2102836 - RNA, 16 nt, Homo sapiens
agaguuguacacugug

SEQ ID NO: 2102837 - RNA, 20 nt, Homo sapiens
uuucagcagcaaaaccaaac

SEQ ID NO: 2102838 - RNA, 12 nt, Homo sapiens
uggcagaugucu

SEQ ID NO: 2102839 - RNA, 23 nt, Homo sapiens
cauaguacagguaaggugaggga

SEQ ID NO: 2102840 - RNA, 17 nt, Homo sapiens
aguaacaguauuuccau

SEQ ID NO: 2102841 - RNA, 16 nt, Homo sapiens
caaagggggaggcuaa

SEQ ID NO: 2102842 - RNA, 11 nt, Homo sapiens
cuuguccuucc

SEQ ID NO: 2102843 - RNA, 16 nt, Homo sapiens
uuuaacaacauggcuu

SEQ ID NO: 2102844 - RNA, 22 nt, Homo sapiens
auuucucacacucuaacuguau

SEQ ID NO: 2102845 - RNA, 20 nt, Homo sapiens
uaaaaugucucaagugcaau

SEQ ID NO: 2102846 - RNA, 19 nt, Homo sapiens
acccagggcccccaaagag

SEQ ID NO: 2102847 - RNA, 14 nt, Homo sapiens
caggcugugggccu

SEQ ID NO: 2102848 - RNA, 17 nt, Homo sapiens
gggaaguggaaggaaga

SEQ ID NO: 2102849 - RNA, 18 nt, Homo sapiens
uauaauucuuucaauaca

SEQ ID NO: 2102850 - RNA, 15 nt, Homo sapiens
ucccuccaccagugu

SEQ ID NO: 2102851 - RNA, 21 nt, Homo sapiens
ccauccuuccaacauauauuu

SEQ ID NO: 2102852 - RNA, 22 nt, Homo sapiens
acaucauuacagauucugcuag

SEQ ID NO: 2102853 - RNA, 18 nt, Homo sapiens
ccacucaugugacucuuu

SEQ ID NO: 2102854 - RNA, 14 nt, Homo sapiens
agguacccaugaau

SEQ ID NO: 2102855 - RNA, 11 nt, Homo sapiens
gaacccaugag

SEQ ID NO: 2102856 - RNA, 19 nt, Homo sapiens
ccuauagcagaagcacauu

SEQ ID NO: 2102857 - RNA, 20 nt, Homo sapiens
ccaagucucccaauauccaa

SEQ ID NO: 2102858 - RNA, 16 nt, Homo sapiens
agaacugagcaucucc

SEQ ID NO: 2102859 - RNA, 14 nt, Homo sapiens
cugauuuacauuca

SEQ ID NO: 2102860 - RNA, 20 nt, Homo sapiens
guaauauucuccccacccac

SEQ ID NO: 2102861 - RNA, 14 nt, Homo sapiens
augaguuccugaga

SEQ ID NO: 2102862 - RNA, 14 nt, Homo sapiens
cuucuuucauucua

SEQ ID NO: 2102863 - RNA, 19 nt, Homo sapiens
aaaauuaaacaaauaugca

SEQ ID NO: 2102864 - RNA, 19 nt, Homo sapiens
gcuguccacaugaccucca

SEQ ID NO: 2102865 - RNA, 20 nt, Homo sapiens
gacagcuuuguccugagucu

SEQ ID NO: 2102866 - RNA, 22 nt, Homo sapiens
acacauauacauguaggagugu

SEQ ID NO: 2102867 - RNA, 17 nt, Homo sapiens
auugugagaaauuccac

SEQ ID NO: 2102868 - RNA, 15 nt, Homo sapiens
ccugacuguguucag

SEQ ID NO: 2102869 - RNA, 21 nt, Homo sapiens
uaaauccauccauccaaaggc

SEQ ID NO: 2102870 - RNA, 21 nt, Homo sapiens
ggaagccagaaucaacagcuc

SEQ ID NO: 2102871 - RNA, 13 nt, Homo sapiens
cuggacacuucac

SEQ ID NO: 2102872 - RNA, 11 nt, Homo sapiens
gaggucccuuc

SEQ ID NO: 2102873 - RNA, 20 nt, Homo sapiens
acuccaggaaccauuuucac

SEQ ID NO: 2102874 - RNA, 19 nt, Homo sapiens
uagaucagaagacuacaaa

SEQ ID NO: 2102875 - RNA, 18 nt, Homo sapiens
gauuggccacacacugag

SEQ ID NO: 2102876 - RNA, 13 nt, Homo sapiens
aucgauuugcacc

SEQ ID NO: 2102877 - RNA, 15 nt, Homo sapiens
auugaggaccucauc

SEQ ID NO: 2102878 - RNA, 14 nt, Homo sapiens
uauauacacauaca

SEQ ID NO: 2102879 - RNA, 18 nt, Homo sapiens
guauuugucaaugcauca

SEQ ID NO: 2102880 - RNA, 21 nt, Homo sapiens
accauuuuauagacuaccaau

SEQ ID NO: 2102881 - RNA, 13 nt, Homo sapiens
ucuaaauguuugu

SEQ ID NO: 2102882 - RNA, 18 nt, Homo sapiens
aggcugaauuacagugaa

SEQ ID NO: 2102883 - RNA, 14 nt, Homo sapiens
aagcuaaaagcaug

SEQ ID NO: 2102884 - RNA, 19 nt, Homo sapiens
gaaacacuaaagcauucaa

SEQ ID NO: 2102885 - RNA, 17 nt, Homo sapiens
gccaaccggucacccag

SEQ ID NO: 2102886 - RNA, 17 nt, Homo sapiens
cggaaggauugcaaugc

SEQ ID NO: 2102887 - RNA, 22 nt, Homo sapiens
ugaauguagugugucagaguaa

SEQ ID NO: 2102888 - RNA, 22 nt, Homo sapiens
cuguaaucaaaaggaggaauuu

SEQ ID NO: 2102889 - RNA, 22 nt, Homo sapiens
gaguugauuuccucccucugcc

SEQ ID NO: 2102890 - RNA, 14 nt, Homo sapiens
aauggcaccuuccc

SEQ ID NO: 2102891 - RNA, 20 nt, Homo sapiens
uuuaucuuucgcacagcagu

SEQ ID NO: 2102892 - RNA, 21 nt, Homo sapiens
gcccaggaguuugaauccauc

SEQ ID NO: 2102893 - RNA, 13 nt, Homo sapiens
caugcuucuugcc

SEQ ID NO: 2102894 - RNA, 11 nt, Homo sapiens
uggggccauaa

SEQ ID NO: 2102895 - RNA, 16 nt, Homo sapiens
cacugugaaaccacua

SEQ ID NO: 2102896 - RNA, 13 nt, Homo sapiens
uaccacagcaucc

SEQ ID NO: 2102897 - RNA, 22 nt, Homo sapiens
ccucucucuaucccugaaaucc

SEQ ID NO: 2102898 - RNA, 14 nt, Homo sapiens
ucacuaggccucug

SEQ ID NO: 2102899 - RNA, 17 nt, Homo sapiens
gaagccagaucuaugcc

SEQ ID NO: 2102900 - RNA, 16 nt, Homo sapiens
ucacugcuguagacau

SEQ ID NO: 2102901 - RNA, 15 nt, Homo sapiens
gugaggugacacucc

SEQ ID NO: 2102902 - RNA, 18 nt, Homo sapiens
uggaagugugggucugug

SEQ ID NO: 2102903 - RNA, 17 nt, Homo sapiens
uacccaucuaguacuug

SEQ ID NO: 2102904 - RNA, 19 nt, Homo sapiens
uagcucaauuaguguggcu

SEQ ID NO: 2102905 - RNA, 17 nt, Homo sapiens
aauuauaaugcaauaaa

SEQ ID NO: 2102906 - RNA, 14 nt, Homo sapiens
cuauaccucauuca

SEQ ID NO: 2102907 - RNA, 15 nt, Homo sapiens
ugagcccugccccac

SEQ ID NO: 2102908 - RNA, 14 nt, Homo sapiens
gaaccaauucacuu

SEQ ID NO: 2102909 - RNA, 16 nt, Homo sapiens
uuuacuuucucucucc

SEQ ID NO: 2102910 - RNA, 16 nt, Homo sapiens
uuuggcuuaaaccaga

SEQ ID NO: 2102911 - RNA, 15 nt, Homo sapiens
aaacaauucugugac

SEQ ID NO: 2102912 - RNA, 21 nt, Homo sapiens
agagugugugauuagaagcua

SEQ ID NO: 2102913 - RNA, 20 nt, Homo sapiens
aaaguguuugaaagcuuuau

SEQ ID NO: 2102914 - RNA, 17 nt, Homo sapiens
uuaaaagaagacuggaa

SEQ ID NO: 2102915 - RNA, 17 nt, Homo sapiens
gaaguugacuuauagua

SEQ ID NO: 2102916 - RNA, 16 nt, Homo sapiens
gaaguuuuaugccaug

SEQ ID NO: 2102917 - RNA, 17 nt, Homo sapiens
uccucagaucauuauca

SEQ ID NO: 2102918 - RNA, 17 nt, Homo sapiens
uguauuuucacuggaga

SEQ ID NO: 2102919 - RNA, 21 nt, Homo sapiens
ugggaaggaggccgcuaugca

SEQ ID NO: 2102920 - RNA, 22 nt, Homo sapiens
uauuuucuuacccaauuuccca

SEQ ID NO: 2102921 - RNA, 16 nt, Homo sapiens
cacgccacaacuccag

SEQ ID NO: 2102922 - RNA, 17 nt, Homo sapiens
cuauuucuccaaagccu

SEQ ID NO: 2102923 - RNA, 22 nt, Homo sapiens
cucccaugagggagaugccaug

SEQ ID NO: 2102924 - RNA, 16 nt, Homo sapiens
agagaggccuuguccc

SEQ ID NO: 2102925 - RNA, 20 nt, Homo sapiens
agcaagagccaaccucacag

SEQ ID NO: 2102926 - RNA, 18 nt, Homo sapiens
agaauucuguacuuccaa

SEQ ID NO: 2102927 - RNA, 12 nt, Homo sapiens
ggaagagguggc

SEQ ID NO: 2102928 - RNA, 14 nt, Homo sapiens
uugcacuucaaaaa

SEQ ID NO: 2102929 - RNA, 20 nt, Homo sapiens
gaacagccguaacaggucaa

SEQ ID NO: 2102930 - RNA, 19 nt, Homo sapiens
cuuguaaaauuucacuuaa

SEQ ID NO: 2102931 - RNA, 19 nt, Homo sapiens
ugauggcccucaucuccag

SEQ ID NO: 2102932 - RNA, 18 nt, Homo sapiens
cucucagggaaagccucu

SEQ ID NO: 2102933 - RNA, 12 nt, Homo sapiens
aggaagcucucu

SEQ ID NO: 2102934 - RNA, 17 nt, Homo sapiens
auugccaaagguccaau

SEQ ID NO: 2102935 - RNA, 13 nt, Homo sapiens
gggaggagggugg

SEQ ID NO: 2102936 - RNA, 12 nt, Homo sapiens
cccaucaucccu

SEQ ID NO: 2102937 - RNA, 12 nt, Homo sapiens
gccuucaugcca

SEQ ID NO: 2102938 - RNA, 12 nt, Homo sapiens
auauucauauaa

SEQ ID NO: 2102939 - RNA, 12 nt, Homo sapiens
gccaucaugccu

SEQ ID NO: 2102940 - RNA, 12 nt, Homo sapiens
uucuucauuuca

SEQ ID NO: 2102941 - RNA, 15 nt, Homo sapiens
gugcuaggauuacag

SEQ ID NO: 2102942 - RNA, 20 nt, Homo sapiens
auguaucaaauguaacuuac

SEQ ID NO: 2102943 - RNA, 19 nt, Homo sapiens
ugcaagugucugugugcaa

SEQ ID NO: 2102944 - RNA, 15 nt, Homo sapiens
guaagggaaacugcc

SEQ ID NO: 2102945 - RNA, 19 nt, Homo sapiens
gacacaugccagggccaug

SEQ ID NO: 2102946 - RNA, 17 nt, Homo sapiens
aauugccuaacaugugg

SEQ ID NO: 2102947 - RNA, 13 nt, Homo sapiens
guauugugcauag

SEQ ID NO: 2102948 - RNA, 21 nt, Homo sapiens
caguuuaccgaaaaucauaua

SEQ ID NO: 2102949 - RNA, 15 nt, Homo sapiens
uucauacagaaggca

SEQ ID NO: 2102950 - RNA, 18 nt, Homo sapiens
aacuuggguucuucucag

SEQ ID NO: 2102951 - RNA, 13 nt, Homo sapiens
ccuggccagacac

SEQ ID NO: 2102952 - RNA, 14 nt, Homo sapiens
ccugaggacaggag

SEQ ID NO: 2102953 - RNA, 15 nt, Homo sapiens
cugaggccacacuca

SEQ ID NO: 2102954 - RNA, 14 nt, Homo sapiens
gacuaaggaacuaa

SEQ ID NO: 2102955 - RNA, 13 nt, Homo sapiens
cagggcacuuccg

SEQ ID NO: 2102956 - RNA, 11 nt, Homo sapiens
gaaaacauaca

SEQ ID NO: 2102957 - RNA, 19 nt, Homo sapiens
ccagguguugccauuucuc

SEQ ID NO: 2102958 - RNA, 14 nt, Homo sapiens
aaguauaccuggcu

SEQ ID NO: 2102959 - RNA, 14 nt, Homo sapiens
uaguuagcuuuauu

SEQ ID NO: 2102960 - RNA, 20 nt, Homo sapiens
ugcacaugucuuguacaugu

SEQ ID NO: 2102961 - RNA, 19 nt, Homo sapiens
gggagguggcacuagggau

SEQ ID NO: 2102962 - RNA, 22 nt, Homo sapiens
ucuuacaagaggauuguaaaau

SEQ ID NO: 2102963 - RNA, 13 nt, Homo sapiens
uaauaugcuuuac

SEQ ID NO: 2102964 - RNA, 15 nt, Homo sapiens
cuuauguauuuauga

SEQ ID NO: 2102965 - RNA, 15 nt, Homo sapiens
cagauuaauagauuu

SEQ ID NO: 2102966 - RNA, 12 nt, Homo sapiens
augcaccaaaua

SEQ ID NO: 2102967 - RNA, 21 nt, Homo sapiens
uaaccucaagugauccuccca

SEQ ID NO: 2102968 - RNA, 23 nt, Homo sapiens
agcaccucuuuuugaacagggaa

SEQ ID NO: 2102969 - RNA, 17 nt, Homo sapiens
gccucuccugggacaac

SEQ ID NO: 2102970 - RNA, 21 nt, Homo sapiens
cacauucccaugaauaucaag

SEQ ID NO: 2102971 - RNA, 11 nt, Homo sapiens
augguggugca

SEQ ID NO: 2102972 - RNA, 19 nt, Homo sapiens
cauagcauagccagcauuc

SEQ ID NO: 2102973 - RNA, 22 nt, Homo sapiens
auuauucugcugaagauucagu

SEQ ID NO: 2102974 - RNA, 16 nt, Homo sapiens
gcucaauagcuugaag

SEQ ID NO: 2102975 - RNA, 21 nt, Homo sapiens
aguuucuaucccuuaccugcu

SEQ ID NO: 2102976 - RNA, 22 nt, Homo sapiens
uccaguacuauggagugcucac

SEQ ID NO: 2102977 - RNA, 14 nt, Homo sapiens
aacuaaaagcauag

SEQ ID NO: 2102978 - RNA, 13 nt, Homo sapiens
ugucacaaccaag

SEQ ID NO: 2102979 - RNA, 18 nt, Homo sapiens
cuccaaaggcucagauua

SEQ ID NO: 2102980 - RNA, 19 nt, Homo sapiens
uucuauaaaugacuauugu

SEQ ID NO: 2102981 - RNA, 15 nt, Homo sapiens
agcaggaggccaaua

SEQ ID NO: 2102982 - RNA, 22 nt, Homo sapiens
aauuuuugaaaaaaguacauau

SEQ ID NO: 2102983 - RNA, 19 nt, Homo sapiens
aagcucgccccaccuccac

SEQ ID NO: 2102984 - RNA, 16 nt, Homo sapiens
gaaaccacugggcaua

SEQ ID NO: 2102985 - RNA, 15 nt, Homo sapiens
aacucuaacugaugu

SEQ ID NO: 2102986 - RNA, 17 nt, Homo sapiens
uuuaaagacaaagacau

SEQ ID NO: 2102987 - RNA, 19 nt, Homo sapiens
ccaagcacuccacaacuca

SEQ ID NO: 2102988 - RNA, 21 nt, Homo sapiens
gaaccucuccaucaucuuccg

SEQ ID NO: 2102989 - RNA, 13 nt, Homo sapiens
ugacuuugcauca

SEQ ID NO: 2102990 - RNA, 13 nt, Homo sapiens
cucauuucaauuu

SEQ ID NO: 2102991 - RNA, 19 nt, Homo sapiens
aucaugguagucacuaaca

SEQ ID NO: 2102992 - RNA, 19 nt, Homo sapiens
aguguuuggaugaaaaaag

SEQ ID NO: 2102993 - RNA, 20 nt, Homo sapiens
uucauucuuuacugcacuca

SEQ ID NO: 2102994 - RNA, 18 nt, Homo sapiens
uaccagcauuuacuaugc

SEQ ID NO: 2102995 - RNA, 18 nt, Homo sapiens
uagcacacuuuuccacau

SEQ ID NO: 2102996 - RNA, 16 nt, Homo sapiens
gcaggggccaggggug

SEQ ID NO: 2102997 - RNA, 22 nt, Homo sapiens
acaaugaccaaggacugcuaca

SEQ ID NO: 2102998 - RNA, 21 nt, Homo sapiens
ugaacaucccuuuuucaauga

SEQ ID NO: 2102999 - RNA, 15 nt, Homo sapiens
cggccccucccacac

SEQ ID NO: 2103000 - RNA, 18 nt, Homo sapiens
acauguucucaugcaugu

SEQ ID NO: 2103001 - RNA, 13 nt, Homo sapiens
gucucccagcuca

SEQ ID NO: 2103002 - RNA, 21 nt, Homo sapiens
ucuagaauuauaagucacaaa

SEQ ID NO: 2103003 - RNA, 15 nt, Homo sapiens
ugcaccuaagugugu

SEQ ID NO: 2103004 - RNA, 18 nt, Homo sapiens
uccaaggaaaccacagcu

SEQ ID NO: 2103005 - RNA, 14 nt, Homo sapiens
ccccaggcccuaca

SEQ ID NO: 2103006 - RNA, 22 nt, Homo sapiens
caagaugcuuuucaaacugaua

SEQ ID NO: 2103007 - RNA, 23 nt, Homo sapiens
uauuguaguaaacuauucuuaau

SEQ ID NO: 2103008 - RNA, 20 nt, Homo sapiens
cacuuuggcuucuccuguga

SEQ ID NO: 2103009 - RNA, 13 nt, Homo sapiens
ggauguugcuaua

SEQ ID NO: 2103010 - RNA, 22 nt, Homo sapiens
ucugaaauuggucacuuuccua

SEQ ID NO: 2103011 - RNA, 15 nt, Homo sapiens
ugauucauauugcau

SEQ ID NO: 2103012 - RNA, 17 nt, Homo sapiens
aacucagaucacuacug

SEQ ID NO: 2103013 - RNA, 16 nt, Homo sapiens
ugggaccacagacuca

SEQ ID NO: 2103014 - RNA, 12 nt, Homo sapiens
ucacucucagga

SEQ ID NO: 2103015 - RNA, 12 nt, Homo sapiens
acacucucugga

SEQ ID NO: 2103016 - RNA, 17 nt, Homo sapiens
aucuuacagccagagga

SEQ ID NO: 2103017 - RNA, 18 nt, Homo sapiens
gacucagaugaggacaga

SEQ ID NO: 2103018 - RNA, 18 nt, Homo sapiens
uuaauuggcccuguacag

SEQ ID NO: 2103019 - RNA, 17 nt, Homo sapiens
aguuauaauaacugaac

SEQ ID NO: 2103020 - RNA, 17 nt, Homo sapiens
agauagcccaucuuccu

SEQ ID NO: 2103021 - RNA, 23 nt, Homo sapiens
gccuccugggaacacaucuggcu

SEQ ID NO: 2103022 - RNA, 23 nt, Homo sapiens
gcacacacacacacacacacuca

SEQ ID NO: 2103023 - RNA, 20 nt, Homo sapiens
gagugcaauggcgugaucuc

SEQ ID NO: 2103024 - RNA, 16 nt, Homo sapiens
uaagugucugugaugc

SEQ ID NO: 2103025 - RNA, 15 nt, Homo sapiens
cauggacuguugcca

SEQ ID NO: 2103026 - RNA, 16 nt, Homo sapiens
gccccgucucuguucc

SEQ ID NO: 2103027 - RNA, 11 nt, Homo sapiens
acuuacuguac

SEQ ID NO: 2103028 - RNA, 14 nt, Homo sapiens
cauaagauugugaa

SEQ ID NO: 2103029 - RNA, 17 nt, Homo sapiens
ucuacugaucaacagac

SEQ ID NO: 2103030 - RNA, 14 nt, Homo sapiens
gggagccaagggau

SEQ ID NO: 2103031 - RNA, 18 nt, Homo sapiens
aacauuaauuauauguau

SEQ ID NO: 2103032 - RNA, 22 nt, Homo sapiens
agcccugucucagcaauccacc

SEQ ID NO: 2103033 - RNA, 16 nt, Homo sapiens
cucaggugcgugccac

SEQ ID NO: 2103034 - RNA, 21 nt, Homo sapiens
aguuuucuuuccuccuuuccu

SEQ ID NO: 2103035 - RNA, 19 nt, Homo sapiens
guacaaauaauauugccuu

SEQ ID NO: 2103036 - RNA, 15 nt, Homo sapiens
ugcucagaaugucug

SEQ ID NO: 2103037 - RNA, 22 nt, Homo sapiens
ggcaggccuauuucaucacaag

SEQ ID NO: 2103038 - RNA, 13 nt, Homo sapiens
augacucaguaag

SEQ ID NO: 2103039 - RNA, 13 nt, Homo sapiens
guuggggggcaag

SEQ ID NO: 2103040 - RNA, 15 nt, Homo sapiens
ccaguuuuugcagag

SEQ ID NO: 2103041 - RNA, 20 nt, Homo sapiens
aaggagugcgugccugcuac

SEQ ID NO: 2103042 - RNA, 22 nt, Homo sapiens
cacuucgcgugcccucgcugcu

SEQ ID NO: 2103043 - RNA, 13 nt, Homo sapiens
ucacuagcagcug

SEQ ID NO: 2103044 - RNA, 19 nt, Homo sapiens
aaucucucuacucagauga

SEQ ID NO: 2103045 - RNA, 15 nt, Homo sapiens
aagagacuucugcuu

SEQ ID NO: 2103046 - RNA, 16 nt, Homo sapiens
aggcaguuuagugcau

SEQ ID NO: 2103047 - RNA, 16 nt, Homo sapiens
ugaggaaaauucuuaa

SEQ ID NO: 2103048 - RNA, 20 nt, Homo sapiens
agccucccugucggccuggu

SEQ ID NO: 2103049 - RNA, 19 nt, Homo sapiens
gcugucacucugugccuuu

SEQ ID NO: 2103050 - RNA, 23 nt, Homo sapiens
acagaagaaguuaucaacaugca

SEQ ID NO: 2103051 - RNA, 20 nt, Homo sapiens
cagugaagcagcacugugag

SEQ ID NO: 2103052 - RNA, 22 nt, Homo sapiens
cucuaucggggucacuugcaau

SEQ ID NO: 2103053 - RNA, 14 nt, Homo sapiens
cccccaugcugccu

SEQ ID NO: 2103054 - RNA, 12 nt, Homo sapiens
cuuucuucuccc

SEQ ID NO: 2103055 - RNA, 13 nt, Homo sapiens
acaggugugagcc

SEQ ID NO: 2103056 - RNA, 14 nt, Homo sapiens
gaaggaguucacug

SEQ ID NO: 2103057 - RNA, 13 nt, Homo sapiens
cgcgccuguaauc

SEQ ID NO: 2103058 - RNA, 15 nt, Homo sapiens
uaauucaaacuaaua

SEQ ID NO: 2103059 - RNA, 23 nt, Homo sapiens
aggauccagggcagcaggccaga

SEQ ID NO: 2103060 - RNA, 23 nt, Homo sapiens
auccauaaugauggauuuaacag

SEQ ID NO: 2103061 - RNA, 13 nt, Homo sapiens
ucugggcauuaca

SEQ ID NO: 2103062 - RNA, 19 nt, Homo sapiens
uaaaagaaagaugcugaug

SEQ ID NO: 2103063 - RNA, 13 nt, Homo sapiens
cacugugcuucuu

SEQ ID NO: 2103064 - RNA, 16 nt, Homo sapiens
ggcugcuuuguucaau

SEQ ID NO: 2103065 - RNA, 12 nt, Homo sapiens
uguaaucucagc

SEQ ID NO: 2103066 - RNA, 23 nt, Homo sapiens
ucacaaacagccuacagccagaa

SEQ ID NO: 2103067 - RNA, 13 nt, Homo sapiens
ccuugucugcacu

SEQ ID NO: 2103068 - RNA, 22 nt, Homo sapiens
accauccuuguagacucagaaa

SEQ ID NO: 2103069 - RNA, 12 nt, Homo sapiens
gaugguacguga

SEQ ID NO: 2103070 - RNA, 13 nt, Homo sapiens
caccuagacugua

SEQ ID NO: 2103071 - RNA, 12 nt, Homo sapiens
aaccuuugccaa

SEQ ID NO: 2103072 - RNA, 20 nt, Homo sapiens
ccaacaccucacccucuguc

SEQ ID NO: 2103073 - RNA, 21 nt, Homo sapiens
acccuacaagaugccaaggag

SEQ ID NO: 2103074 - RNA, 15 nt, Homo sapiens
cucaaauaauaauaa

SEQ ID NO: 2103075 - RNA, 18 nt, Homo sapiens
ggcucuuggcccucccac

SEQ ID NO: 2103076 - RNA, 13 nt, Homo sapiens
ccuugcagauauc

SEQ ID NO: 2103077 - RNA, 20 nt, Homo sapiens
caaauggcuaccguuuuaca

SEQ ID NO: 2103078 - RNA, 22 nt, Homo sapiens
caagauuggucucccauaugca

SEQ ID NO: 2103079 - RNA, 16 nt, Homo sapiens
guauaaacaaaaguuu

SEQ ID NO: 2103080 - RNA, 23 nt, Homo sapiens
gcauuuaaccgucaauaggcaaa

SEQ ID NO: 2103081 - RNA, 14 nt, Homo sapiens
uuuuguuaagcuca

SEQ ID NO: 2103082 - RNA, 23 nt, Homo sapiens
gaaccagauguuagaucagggga

SEQ ID NO: 2103083 - RNA, 15 nt, Homo sapiens
gugccugggguguua

SEQ ID NO: 2103084 - RNA, 18 nt, Homo sapiens
gacaugcccaaggccacg

SEQ ID NO: 2103085 - RNA, 18 nt, Homo sapiens
uugauaucucaaucugca

SEQ ID NO: 2103086 - RNA, 14 nt, Homo sapiens
aaucaaucuuauua

SEQ ID NO: 2103087 - RNA, 16 nt, Homo sapiens
cauaaagaaacacuuu

SEQ ID NO: 2103088 - RNA, 19 nt, Homo sapiens
gcucccacggagcaucuca

SEQ ID NO: 2103089 - RNA, 11 nt, Homo sapiens
cagagcacaaa

SEQ ID NO: 2103090 - RNA, 22 nt, Homo sapiens
uagaugcuuuagguugcuucag

SEQ ID NO: 2103091 - RNA, 14 nt, Homo sapiens
aggggagaagccaa

SEQ ID NO: 2103092 - RNA, 21 nt, Homo sapiens
agaccuuugauuuuugcccag

SEQ ID NO: 2103093 - RNA, 11 nt, Homo sapiens
cacgacacugc

SEQ ID NO: 2103094 - RNA, 11 nt, Homo sapiens
caggacacugg

SEQ ID NO: 2103095 - RNA, 16 nt, Homo sapiens
ucucaaagauucacac

SEQ ID NO: 2103096 - RNA, 23 nt, Homo sapiens
cucagaauauugcuuuggucaua

SEQ ID NO: 2103097 - RNA, 16 nt, Homo sapiens
aauacaguacaguacu

SEQ ID NO: 2103098 - RNA, 16 nt, Homo sapiens
uuacaggggcuugaac

SEQ ID NO: 2103099 - RNA, 11 nt, Homo sapiens
aguucaccagc

SEQ ID NO: 2103100 - RNA, 21 nt, Homo sapiens
uaaaguuugcucuaccaaaua

SEQ ID NO: 2103101 - RNA, 20 nt, Homo sapiens
ggaugggcccuaugucucag

SEQ ID NO: 2103102 - RNA, 19 nt, Homo sapiens
cuccuccgugcuuccucag

SEQ ID NO: 2103103 - RNA, 11 nt, Homo sapiens
ucuggacccug

SEQ ID NO: 2103104 - RNA, 18 nt, Homo sapiens
gccuguuuuucaaucuca

SEQ ID NO: 2103105 - RNA, 16 nt, Homo sapiens
gagcauaguccaaaaa

SEQ ID NO: 2103106 - RNA, 15 nt, Homo sapiens
ucaccaucaacauuc

SEQ ID NO: 2103107 - RNA, 16 nt, Homo sapiens
acugcagcagaaaaca

SEQ ID NO: 2103108 - RNA, 15 nt, Homo sapiens
cuccccagagcauuu

SEQ ID NO: 2103109 - RNA, 13 nt, Homo sapiens
aguguacauguac

SEQ ID NO: 2103110 - RNA, 17 nt, Homo sapiens
gcucaucuguacauacu

SEQ ID NO: 2103111 - RNA, 18 nt, Homo sapiens
aauuauuacacuguaaga

SEQ ID NO: 2103112 - RNA, 15 nt, Homo sapiens
aaaauagacuuaaau

SEQ ID NO: 2103113 - RNA, 20 nt, Homo sapiens
cuguguauauaguuuuuacc

SEQ ID NO: 2103114 - RNA, 13 nt, Homo sapiens
gcacaggccaugg

SEQ ID NO: 2103115 - RNA, 15 nt, Homo sapiens
uguugcaggcugugg

SEQ ID NO: 2103116 - RNA, 21 nt, Homo sapiens
caaguagcugggaccacaagu

SEQ ID NO: 2103117 - RNA, 21 nt, Homo sapiens
ugcaugcuuuucucuugcuaa

SEQ ID NO: 2103118 - RNA, 16 nt, Homo sapiens
ccuuccgcuuggagcu

SEQ ID NO: 2103119 - RNA, 19 nt, Homo sapiens
caugugcagucacuggugu

SEQ ID NO: 2103120 - RNA, 21 nt, Homo sapiens
aacagcucuucucccagaugu

SEQ ID NO: 2103121 - RNA, 11 nt, Homo sapiens
ucaauggguaa

SEQ ID NO: 2103122 - RNA, 14 nt, Homo sapiens
ugugcuuccuccug

SEQ ID NO: 2103123 - RNA, 20 nt, Homo sapiens
accauauaacugugaugaaa

SEQ ID NO: 2103124 - RNA, 15 nt, Homo sapiens
augucuugacuguua

SEQ ID NO: 2103125 - RNA, 19 nt, Homo sapiens
uccagcaaacaaaauggac

SEQ ID NO: 2103126 - RNA, 16 nt, Homo sapiens
gaugcggccauucaag

SEQ ID NO: 2103127 - RNA, 20 nt, Homo sapiens
auaugaugaucuggauccac

SEQ ID NO: 2103128 - RNA, 17 nt, Homo sapiens
uugaaaaacugaguauu

SEQ ID NO: 2103129 - RNA, 19 nt, Homo sapiens
auuuuuguuaguuuacaau

SEQ ID NO: 2103130 - RNA, 15 nt, Homo sapiens
gggagcuaugaucca

SEQ ID NO: 2103131 - RNA, 16 nt, Homo sapiens
cuugauaaagggccaa

SEQ ID NO: 2103132 - RNA, 14 nt, Homo sapiens
cugagaagaucuga

SEQ ID NO: 2103133 - RNA, 19 nt, Homo sapiens
acuucaguauguugucaaa

SEQ ID NO: 2103134 - RNA, 20 nt, Homo sapiens
caaccuugagaauagcuuua

SEQ ID NO: 2103135 - RNA, 13 nt, Homo sapiens
ucaaaguguaaca

SEQ ID NO: 2103136 - RNA, 22 nt, Homo sapiens
uaauccagcaauacaguuuacu

SEQ ID NO: 2103137 - RNA, 22 nt, Homo sapiens
cucaggacacuaauacaccagg

SEQ ID NO: 2103138 - RNA, 19 nt, Homo sapiens
agaaucccuggcaaaggga

SEQ ID NO: 2103139 - RNA, 20 nt, Homo sapiens
uuacagcuggguggcacugc

SEQ ID NO: 2103140 - RNA, 21 nt, Homo sapiens
cucccugcgaggaggggagaa

SEQ ID NO: 2103141 - RNA, 17 nt, Homo sapiens
ugccaggaggaacaaag

SEQ ID NO: 2103142 - RNA, 18 nt, Homo sapiens
acuguaagcuccaugagg

SEQ ID NO: 2103143 - RNA, 23 nt, Homo sapiens
accuuugacacugacagaugugu

SEQ ID NO: 2103144 - RNA, 13 nt, Homo sapiens
uugaaaacacuac

SEQ ID NO: 2103145 - RNA, 20 nt, Homo sapiens
acuauugacaucagcaucac

SEQ ID NO: 2103146 - RNA, 14 nt, Homo sapiens
agucugucuacugu

SEQ ID NO: 2103147 - RNA, 18 nt, Homo sapiens
uugccaacccugugucac

SEQ ID NO: 2103148 - RNA, 20 nt, Homo sapiens
ucuguuuauggccacauuua

SEQ ID NO: 2103149 - RNA, 23 nt, Homo sapiens
ugggcaaaggacaugaacagaca

SEQ ID NO: 2103150 - RNA, 16 nt, Homo sapiens
agugacuccaggguga

SEQ ID NO: 2103151 - RNA, 16 nt, Homo sapiens
agguucccacuuaaaa

SEQ ID NO: 2103152 - RNA, 20 nt, Homo sapiens
aaagacuucucuacccaucu

SEQ ID NO: 2103153 - RNA, 19 nt, Homo sapiens
cuuucuucauuaagauuuu

SEQ ID NO: 2103154 - RNA, 13 nt, Homo sapiens
ccauaucagugaa

SEQ ID NO: 2103155 - RNA, 21 nt, Homo sapiens
acuuucuguuggauuccaugc

SEQ ID NO: 2103156 - RNA, 22 nt, Homo sapiens
auaacgauaaaagacagugaaa

SEQ ID NO: 2103157 - RNA, 23 nt, Homo sapiens
ggaauauguuagagaauuuccuu

SEQ ID NO: 2103158 - RNA, 14 nt, Homo sapiens
agggcaugauuaac

SEQ ID NO: 2103159 - RNA, 13 nt, Homo sapiens
uuauaauuuuacu

SEQ ID NO: 2103160 - RNA, 13 nt, Homo sapiens
uggacuucucuga

SEQ ID NO: 2103161 - RNA, 14 nt, Homo sapiens
aggcccaacuguga

SEQ ID NO: 2103162 - RNA, 21 nt, Homo sapiens
ggcuaugaagggacagcugcu

SEQ ID NO: 2103163 - RNA, 20 nt, Homo sapiens
ccucucagagugacagucau

SEQ ID NO: 2103164 - RNA, 22 nt, Homo sapiens
ggucagcgauuccugccaagua

SEQ ID NO: 2103165 - RNA, 22 nt, Homo sapiens
agaacuaaaaauuaaaaccucu

SEQ ID NO: 2103166 - RNA, 18 nt, Homo sapiens
ucacuaaccaagccagaa

SEQ ID NO: 2103167 - RNA, 12 nt, Homo sapiens
acacuuugccau

SEQ ID NO: 2103168 - RNA, 14 nt, Homo sapiens
cucuacacccugaa

SEQ ID NO: 2103169 - RNA, 20 nt, Homo sapiens
aggccaugaaaaaaaugauc

SEQ ID NO: 2103170 - RNA, 17 nt, Homo sapiens
aacauuugccuugcaga

SEQ ID NO: 2103171 - RNA, 19 nt, Homo sapiens
cauuaucuugcagcuguaa

SEQ ID NO: 2103172 - RNA, 14 nt, Homo sapiens
auuuucauuucacu

SEQ ID NO: 2103173 - RNA, 16 nt, Homo sapiens
cuuuagguuugaaagg

SEQ ID NO: 2103174 - RNA, 16 nt, Homo sapiens
gaucucuaauuagucu

SEQ ID NO: 2103175 - RNA, 22 nt, Homo sapiens
guggaaugccgcugucucugag

SEQ ID NO: 2103176 - RNA, 22 nt, Homo sapiens
gagcacccuugcccggcuguga

SEQ ID NO: 2103177 - RNA, 16 nt, Homo sapiens
uugaaauaagaauuca

SEQ ID NO: 2103178 - RNA, 17 nt, Homo sapiens
caagccccucagcccuu

SEQ ID NO: 2103179 - RNA, 22 nt, Homo sapiens
cuuuaauuuuacauuuccuaaa

SEQ ID NO: 2103180 - RNA, 14 nt, Homo sapiens
cccucccugcccaa

SEQ ID NO: 2103181 - RNA, 19 nt, Homo sapiens
uacuuauucuuccgucaca

SEQ ID NO: 2103182 - RNA, 13 nt, Homo sapiens
ugcccuuccccuu

SEQ ID NO: 2103183 - RNA, 22 nt, Homo sapiens
gcagcugauuuugucacugucu

SEQ ID NO: 2103184 - RNA, 20 nt, Homo sapiens
uacuugcuuauuacauuuaa

SEQ ID NO: 2103185 - RNA, 14 nt, Homo sapiens
gcagcccagggccu

SEQ ID NO: 2103186 - RNA, 22 nt, Homo sapiens
uuuucccuuuccuuuccuuuca

SEQ ID NO: 2103187 - RNA, 21 nt, Homo sapiens
gcuggugaauaacuaugccag

SEQ ID NO: 2103188 - RNA, 13 nt, Homo sapiens
aguuaaguauuua

SEQ ID NO: 2103189 - RNA, 17 nt, Homo sapiens
auaaaccaaaaacauuu

SEQ ID NO: 2103190 - RNA, 16 nt, Homo sapiens
cagagucucauucugu

SEQ ID NO: 2103191 - RNA, 17 nt, Homo sapiens
gcuuccauuaugcugca

SEQ ID NO: 2103192 - RNA, 20 nt, Homo sapiens
ggcuaaacaagggcagugag

SEQ ID NO: 2103193 - RNA, 13 nt, Homo sapiens
uagaaacuuguau

SEQ ID NO: 2103194 - RNA, 18 nt, Homo sapiens
gaagaugugaucaauaga

SEQ ID NO: 2103195 - RNA, 22 nt, Homo sapiens
auccaaauaaaaauaacaucau

SEQ ID NO: 2103196 - RNA, 20 nt, Homo sapiens
guauaggccaggcacagugg

SEQ ID NO: 2103197 - RNA, 21 nt, Homo sapiens
cuuaagcuuccgccgucucaa

SEQ ID NO: 2103198 - RNA, 15 nt, Homo sapiens
ccugccaggcugcua

SEQ ID NO: 2103199 - RNA, 15 nt, Homo sapiens
guccacugcuccauu

SEQ ID NO: 2103200 - RNA, 18 nt, Homo sapiens
ucacauuuuaauugccac

SEQ ID NO: 2103201 - RNA, 22 nt, Homo sapiens
cucaaaucacugcauucauucu

SEQ ID NO: 2103202 - RNA, 14 nt, Homo sapiens
ggauaaagccacuu

SEQ ID NO: 2103203 - RNA, 14 nt, Homo sapiens
aaaguggugcuaua

SEQ ID NO: 2103204 - RNA, 21 nt, Homo sapiens
cagugagccaucaucauggca

SEQ ID NO: 2103205 - RNA, 17 nt, Homo sapiens
auauuaagaaacaccug

SEQ ID NO: 2103206 - RNA, 23 nt, Homo sapiens
agccaacucuaacaggcacuuug

SEQ ID NO: 2103207 - RNA, 23 nt, Homo sapiens
uugaaacuggaauaaguguuuau

SEQ ID NO: 2103208 - RNA, 18 nt, Homo sapiens
aaggcugacauucacuga

SEQ ID NO: 2103209 - RNA, 21 nt, Homo sapiens
ccuaggacuuaaaauuagucu

SEQ ID NO: 2103210 - RNA, 13 nt, Homo sapiens
uccugaggagcag

SEQ ID NO: 2103211 - RNA, 20 nt, Homo sapiens
uuagaccaagcuuguccaac

SEQ ID NO: 2103212 - RNA, 15 nt, Homo sapiens
ucuauguucaaagac

SEQ ID NO: 2103213 - RNA, 15 nt, Homo sapiens
uguacaggcagauga

SEQ ID NO: 2103214 - RNA, 17 nt, Homo sapiens
cagagggcaguggcccu

SEQ ID NO: 2103215 - RNA, 19 nt, Homo sapiens
accaugagugugccacuuu

SEQ ID NO: 2103216 - RNA, 19 nt, Homo sapiens
ugugccaaaaugucaauuu

SEQ ID NO: 2103217 - RNA, 19 nt, Homo sapiens
cauauuaauauauuuccau

SEQ ID NO: 2103218 - RNA, 23 nt, Homo sapiens
aaauuacagucaucugucuuuca

SEQ ID NO: 2103219 - RNA, 16 nt, Homo sapiens
accucgggaauggcaa

SEQ ID NO: 2103220 - RNA, 16 nt, Homo sapiens
uacuuccccauuucag

SEQ ID NO: 2103221 - RNA, 16 nt, Homo sapiens
augccaucuguguccu

SEQ ID NO: 2103222 - RNA, 18 nt, Homo sapiens
caaugccucccagcuaga

SEQ ID NO: 2103223 - RNA, 15 nt, Homo sapiens
guaaaaaugcugcuc

SEQ ID NO: 2103224 - RNA, 21 nt, Homo sapiens
ucaggugauccgccuaccuca

SEQ ID NO: 2103225 - RNA, 15 nt, Homo sapiens
ucagaggagccagaa

SEQ ID NO: 2103226 - RNA, 18 nt, Homo sapiens
agccggcuaauuuagaua

SEQ ID NO: 2103227 - RNA, 19 nt, Homo sapiens
uuucuucuacaaccagagc

SEQ ID NO: 2103228 - RNA, 13 nt, Homo sapiens
uagcauugcacuu

SEQ ID NO: 2103229 - RNA, 19 nt, Homo sapiens
agggugacgccugagacag

SEQ ID NO: 2103230 - RNA, 16 nt, Homo sapiens
cccuccaaguggucca

SEQ ID NO: 2103231 - RNA, 23 nt, Homo sapiens
cucuguccuucgcccugugcacc

SEQ ID NO: 2103232 - RNA, 22 nt, Homo sapiens
cacccaaaagaauuaucauccc

SEQ ID NO: 2103233 - RNA, 19 nt, Homo sapiens
gaagugcaugggucagggu

SEQ ID NO: 2103234 - RNA, 13 nt, Homo sapiens
ugaaccacaccau

SEQ ID NO: 2103235 - RNA, 16 nt, Homo sapiens
ugggaguauguuguca

SEQ ID NO: 2103236 - RNA, 12 nt, Homo sapiens
caggacauagca

SEQ ID NO: 2103237 - RNA, 14 nt, Homo sapiens
guucuaaugcugca

SEQ ID NO: 2103238 - RNA, 14 nt, Homo sapiens
accccauagugccu

SEQ ID NO: 2103239 - RNA, 14 nt, Homo sapiens
augaauuagccaaa

SEQ ID NO: 2103240 - RNA, 21 nt, Homo sapiens
uuaaaaagaugguugccaagc

SEQ ID NO: 2103241 - RNA, 17 nt, Homo sapiens
uuuuaaaaaauucuugu

SEQ ID NO: 2103242 - RNA, 23 nt, Homo sapiens
aucugcagaauaaugacugacuu

SEQ ID NO: 2103243 - RNA, 19 nt, Homo sapiens
uucaaaugucaguucauaa

SEQ ID NO: 2103244 - RNA, 18 nt, Homo sapiens
acaucaauccuuuaccac

SEQ ID NO: 2103245 - RNA, 22 nt, Homo sapiens
aaauuagagcaagaacauucaa

SEQ ID NO: 2103246 - RNA, 15 nt, Homo sapiens
ugcauauucuuaugu

SEQ ID NO: 2103247 - RNA, 17 nt, Homo sapiens
uaacacugagauccaga

SEQ ID NO: 2103248 - RNA, 13 nt, Homo sapiens
uucucuauggccu

SEQ ID NO: 2103249 - RNA, 14 nt, Homo sapiens
aaccuccauucuau

SEQ ID NO: 2103250 - RNA, 21 nt, Homo sapiens
cuucucaagaccgaguguaca

SEQ ID NO: 2103251 - RNA, 23 nt, Homo sapiens
auuccacuuguucauucugugac

SEQ ID NO: 2103252 - RNA, 23 nt, Homo sapiens
gacuuaugaaacuugaaaccgcc

SEQ ID NO: 2103253 - RNA, 18 nt, Homo sapiens
auguguguugauacuguu

SEQ ID NO: 2103254 - RNA, 21 nt, Homo sapiens
aauugcucccuaccagcugaa

SEQ ID NO: 2103255 - RNA, 20 nt, Homo sapiens
cugcuacucaaguagcauuu

SEQ ID NO: 2103256 - RNA, 14 nt, Homo sapiens
agaagagagaacuu

SEQ ID NO: 2103257 - RNA, 15 nt, Homo sapiens
uagccuccaccaucc

SEQ ID NO: 2103258 - RNA, 13 nt, Homo sapiens
gcugagguuuuga

SEQ ID NO: 2103259 - RNA, 22 nt, Homo sapiens
accuuuuggucuucagccuccc

SEQ ID NO: 2103260 - RNA, 20 nt, Homo sapiens
auacaaauugauagucaaua

SEQ ID NO: 2103261 - RNA, 22 nt, Homo sapiens
cauucuccuccuauugccucca

SEQ ID NO: 2103262 - RNA, 20 nt, Homo sapiens
aagauuccaaaaagcacaua

SEQ ID NO: 2103263 - RNA, 13 nt, Homo sapiens
ugagaaagcucaa

SEQ ID NO: 2103264 - RNA, 15 nt, Homo sapiens
aaaaauuuuuccuga

SEQ ID NO: 2103265 - RNA, 15 nt, Homo sapiens
ccuagagcgcggcug

SEQ ID NO: 2103266 - RNA, 17 nt, Homo sapiens
acucaagauucccagga

SEQ ID NO: 2103267 - RNA, 19 nt, Homo sapiens
ugagaaauaaagaucugaa

SEQ ID NO: 2103268 - RNA, 20 nt, Homo sapiens
uccuugaggaccuccaccug

SEQ ID NO: 2103269 - RNA, 15 nt, Homo sapiens
aaagggacuaccucu

SEQ ID NO: 2103270 - RNA, 16 nt, Homo sapiens
caaugaggcugcuuau

SEQ ID NO: 2103271 - RNA, 21 nt, Homo sapiens
ccagaagagucaaaguaguua

SEQ ID NO: 2103272 - RNA, 16 nt, Homo sapiens
gcccaguucaucccaa

SEQ ID NO: 2103273 - RNA, 17 nt, Homo sapiens
ggaaggacaugggugcc

SEQ ID NO: 2103274 - RNA, 21 nt, Homo sapiens
acucugaacuggagcugcuaa

SEQ ID NO: 2103275 - RNA, 15 nt, Homo sapiens
uaccuaguagucauu

SEQ ID NO: 2103276 - RNA, 18 nt, Homo sapiens
accccccuauugcugcug

SEQ ID NO: 2103277 - RNA, 19 nt, Homo sapiens
caaguagcugggauuacag

SEQ ID NO: 2103278 - RNA, 14 nt, Homo sapiens
uagauugaugugca

SEQ ID NO: 2103279 - RNA, 21 nt, Homo sapiens
aaaccucaagggcuuucccac

SEQ ID NO: 2103280 - RNA, 18 nt, Homo sapiens
uguucgcacaaucuacac

SEQ ID NO: 2103281 - RNA, 17 nt, Homo sapiens
gagcaagaugauguaau

SEQ ID NO: 2103282 - RNA, 14 nt, Homo sapiens
cauaaugcuuuguu

SEQ ID NO: 2103283 - RNA, 21 nt, Homo sapiens
aacuuaccacccccauacuau

SEQ ID NO: 2103284 - RNA, 21 nt, Homo sapiens
ccucucucucccaacugcugc

SEQ ID NO: 2103285 - RNA, 16 nt, Homo sapiens
uacauugaaaacaaca

SEQ ID NO: 2103286 - RNA, 18 nt, Homo sapiens
aauaaauuaugcuucaua

SEQ ID NO: 2103287 - RNA, 22 nt, Homo sapiens
gaucaucaccacugacagauga

SEQ ID NO: 2103288 - RNA, 13 nt, Homo sapiens
agcauagauaucu

SEQ ID NO: 2103289 - RNA, 17 nt, Homo sapiens
aucucacucuguugccc

SEQ ID NO: 2103290 - RNA, 13 nt, Homo sapiens
uggauacagcugc

SEQ ID NO: 2103291 - RNA, 12 nt, Homo sapiens
ugggccuuggca

SEQ ID NO: 2103292 - RNA, 20 nt, Homo sapiens
aucaacaaguggggaauucu

SEQ ID NO: 2103293 - RNA, 16 nt, Homo sapiens
ccagagccaagaaaca

SEQ ID NO: 2103294 - RNA, 18 nt, Homo sapiens
aucacuuuaaagcccuuu

SEQ ID NO: 2103295 - RNA, 17 nt, Homo sapiens
cgcuggcuaaagugggu

SEQ ID NO: 2103296 - RNA, 13 nt, Homo sapiens
auagaggaaaaug

SEQ ID NO: 2103297 - RNA, 13 nt, Homo sapiens
acccuuauuacac

SEQ ID NO: 2103298 - RNA, 14 nt, Homo sapiens
ccagccaggaacug

SEQ ID NO: 2103299 - RNA, 22 nt, Homo sapiens
accacauuuauggaccaugaaa

SEQ ID NO: 2103300 - RNA, 17 nt, Homo sapiens
ccggcuuugcagggaga

SEQ ID NO: 2103301 - RNA, 23 nt, Homo sapiens
aacugucgugcaaacccagugag

SEQ ID NO: 2103302 - RNA, 22 nt, Homo sapiens
uauuuaucuccugucuacaguu

SEQ ID NO: 2103303 - RNA, 18 nt, Homo sapiens
ugcucugagaauuguuga

SEQ ID NO: 2103304 - RNA, 18 nt, Homo sapiens
auauccaggcaccaggac

SEQ ID NO: 2103305 - RNA, 14 nt, Homo sapiens
gacauugccuccac

SEQ ID NO: 2103306 - RNA, 16 nt, Homo sapiens
uggcaagucacaugcg

SEQ ID NO: 2103307 - RNA, 19 nt, Homo sapiens
aaauguuaaagaacugcuu

SEQ ID NO: 2103308 - RNA, 14 nt, Homo sapiens
cuaaccccuuccag

SEQ ID NO: 2103309 - RNA, 18 nt, Homo sapiens
aaagaugagaucggagac

SEQ ID NO: 2103310 - RNA, 19 nt, Homo sapiens
uuccaguucaucuauggca

SEQ ID NO: 2103311 - RNA, 17 nt, Homo sapiens
cugcagagggacagaug

SEQ ID NO: 2103312 - RNA, 17 nt, Homo sapiens
agucuggccugccaggc

SEQ ID NO: 2103313 - RNA, 19 nt, Homo sapiens
ucaauuaggcucugaaauc

SEQ ID NO: 2103314 - RNA, 14 nt, Homo sapiens
ugguagagcaauaa

SEQ ID NO: 2103315 - RNA, 19 nt, Homo sapiens
ugugucagcgccuggccua

SEQ ID NO: 2103316 - RNA, 21 nt, Homo sapiens
cagagaggcaugugaugugca

SEQ ID NO: 2103317 - RNA, 23 nt, Homo sapiens
caaauugggaaauccauuccauu

SEQ ID NO: 2103318 - RNA, 15 nt, Homo sapiens
ggccagcgggcacag

SEQ ID NO: 2103319 - RNA, 21 nt, Homo sapiens
agccaggagggaccugcaucu

SEQ ID NO: 2103320 - RNA, 16 nt, Homo sapiens
augcaccccugagcca

SEQ ID NO: 2103321 - RNA, 14 nt, Homo sapiens
uaguacauaaucuu

SEQ ID NO: 2103322 - RNA, 17 nt, Homo sapiens
uacacagaauuguucca

SEQ ID NO: 2103323 - RNA, 19 nt, Homo sapiens
uaguuugcaguuacacuaa

SEQ ID NO: 2103324 - RNA, 14 nt, Homo sapiens
uuaaaaacaaacaa

SEQ ID NO: 2103325 - RNA, 15 nt, Homo sapiens
caaguucaaaacuua

SEQ ID NO: 2103326 - RNA, 12 nt, Homo sapiens
cggaaugcauug

SEQ ID NO: 2103327 - RNA, 18 nt, Homo sapiens
augggcuuucucaguguc

SEQ ID NO: 2103328 - RNA, 11 nt, Homo sapiens
ucaaugcauuu

SEQ ID NO: 2103329 - RNA, 16 nt, Homo sapiens
ccagucucaucuccug

SEQ ID NO: 2103330 - RNA, 13 nt, Homo sapiens
auuucucugagau

SEQ ID NO: 2103331 - RNA, 22 nt, Homo sapiens
agaguuguucucaggggugcug

SEQ ID NO: 2103332 - RNA, 18 nt, Homo sapiens
aacagggcaccccagcug

SEQ ID NO: 2103333 - RNA, 15 nt, Homo sapiens
acaacaaacacugug

SEQ ID NO: 2103334 - RNA, 22 nt, Homo sapiens
acuguacccucgcaugacuguu

SEQ ID NO: 2103335 - RNA, 12 nt, Homo sapiens
ugagacuuucaa

SEQ ID NO: 2103336 - RNA, 21 nt, Homo sapiens
cuauaguuucaccacuccucu

SEQ ID NO: 2103337 - RNA, 20 nt, Homo sapiens
aauuuugauauauucaaaga

SEQ ID NO: 2103338 - RNA, 21 nt, Homo sapiens
agggcagagucuaccuugaaa

SEQ ID NO: 2103339 - RNA, 14 nt, Homo sapiens
aaaaauuaccugua

SEQ ID NO: 2103340 - RNA, 14 nt, Homo sapiens
auuagaaaguuaac

SEQ ID NO: 2103341 - RNA, 17 nt, Homo sapiens
acucugugaucuugcuc

SEQ ID NO: 2103342 - RNA, 19 nt, Homo sapiens
cugugagaggugacacugu

SEQ ID NO: 2103343 - RNA, 16 nt, Homo sapiens
agaaaggaacuuuuaa

SEQ ID NO: 2103344 - RNA, 13 nt, Homo sapiens
gccuccuugccag

SEQ ID NO: 2103345 - RNA, 13 nt, Homo sapiens
ccagacaaaugga

SEQ ID NO: 2103346 - RNA, 14 nt, Homo sapiens
ugaacauagggaca

SEQ ID NO: 2103347 - RNA, 22 nt, Homo sapiens
agaaucccagcccccugaccac

SEQ ID NO: 2103348 - RNA, 11 nt, Homo sapiens
ccacacugaga

SEQ ID NO: 2103349 - RNA, 16 nt, Homo sapiens
cacacuccauggaguc

SEQ ID NO: 2103350 - RNA, 13 nt, Homo sapiens
uuaucuagcuguc

SEQ ID NO: 2103351 - RNA, 17 nt, Homo sapiens
aaggacacaguggagau

SEQ ID NO: 2103352 - RNA, 21 nt, Homo sapiens
agaagauuuugccacauuuga

SEQ ID NO: 2103353 - RNA, 12 nt, Homo sapiens
cuguguccuccc

SEQ ID NO: 2103354 - RNA, 20 nt, Homo sapiens
ccucacaacuccuuccaucc

SEQ ID NO: 2103355 - RNA, 12 nt, Homo sapiens
cccaguguaaag

SEQ ID NO: 2103356 - RNA, 19 nt, Homo sapiens
gaguugaacuuuacugggg

SEQ ID NO: 2103357 - RNA, 15 nt, Homo sapiens
cugggacuacaggca

SEQ ID NO: 2103358 - RNA, 17 nt, Homo sapiens
uguccuccucugugaaa

SEQ ID NO: 2103359 - RNA, 17 nt, Homo sapiens
uccugcauguucuguga

SEQ ID NO: 2103360 - RNA, 17 nt, Homo sapiens
caacaaacaaaacgcaa

SEQ ID NO: 2103361 - RNA, 21 nt, Homo sapiens
acacugauccagcccugaguu

SEQ ID NO: 2103362 - RNA, 20 nt, Homo sapiens
ucccauaucuccuuuaauga

SEQ ID NO: 2103363 - RNA, 14 nt, Homo sapiens
uaguuaaaguaaug

SEQ ID NO: 2103364 - RNA, 16 nt, Homo sapiens
gagcauuuguuuaaua

SEQ ID NO: 2103365 - RNA, 16 nt, Homo sapiens
auuucuaaaagccaau

SEQ ID NO: 2103366 - RNA, 17 nt, Homo sapiens
gacugguuagugaugca

SEQ ID NO: 2103367 - RNA, 16 nt, Homo sapiens
augagggcaugugaua

SEQ ID NO: 2103368 - RNA, 15 nt, Homo sapiens
ccuuguguuacuuaa

SEQ ID NO: 2103369 - RNA, 15 nt, Homo sapiens
ucuaguaucacauag

SEQ ID NO: 2103370 - RNA, 17 nt, Homo sapiens
ucaauaaauuucugcuu

SEQ ID NO: 2103371 - RNA, 23 nt, Homo sapiens
acugauucaagaacaagcaauga

SEQ ID NO: 2103372 - RNA, 23 nt, Homo sapiens
aaacccuuuagugcuuugugaua

SEQ ID NO: 2103373 - RNA, 16 nt, Homo sapiens
uauaucucuccagcug

SEQ ID NO: 2103374 - RNA, 16 nt, Homo sapiens
ucuugaaguacuuaac

SEQ ID NO: 2103375 - RNA, 18 nt, Homo sapiens
accaaugcuauugugauu

SEQ ID NO: 2103376 - RNA, 12 nt, Homo sapiens
caacuuucugua

SEQ ID NO: 2103377 - RNA, 10 nt, Homo sapiens
aacagcacug

SEQ ID NO: 2103378 - RNA, 17 nt, Homo sapiens
uuguaauguaucaaaua

SEQ ID NO: 2103379 - RNA, 14 nt, Homo sapiens
cagaacuaucucag

SEQ ID NO: 2103380 - RNA, 14 nt, Homo sapiens
gaaggucacgcuga

SEQ ID NO: 2103381 - RNA, 14 nt, Homo sapiens
gagcauacccagug

SEQ ID NO: 2103382 - RNA, 21 nt, Homo sapiens
agacuucuuccucuagacuug

SEQ ID NO: 2103383 - RNA, 14 nt, Homo sapiens
cauacucauuuaaa

SEQ ID NO: 2103384 - RNA, 19 nt, Homo sapiens
aggauuugggcucuuggaa

SEQ ID NO: 2103385 - RNA, 15 nt, Homo sapiens
auaacaucaacaaca

SEQ ID NO: 2103386 - RNA, 19 nt, Homo sapiens
acgugaucuccugauuaga

SEQ ID NO: 2103387 - RNA, 19 nt, Homo sapiens
auaaauguugcaaugcaug

SEQ ID NO: 2103388 - RNA, 13 nt, Homo sapiens
aaggcagugcaug

SEQ ID NO: 2103389 - RNA, 13 nt, Homo sapiens
uuuaaaaacucac

SEQ ID NO: 2103390 - RNA, 13 nt, Homo sapiens
cuaaccacuaaug

SEQ ID NO: 2103391 - RNA, 15 nt, Homo sapiens
ccugcuguccuggug

SEQ ID NO: 2103392 - RNA, 15 nt, Homo sapiens
cagacauucagagau

SEQ ID NO: 2103393 - RNA, 19 nt, Homo sapiens
ugcccucggagugccacac

SEQ ID NO: 2103394 - RNA, 17 nt, Homo sapiens
guuucugguggucuguu

SEQ ID NO: 2103395 - RNA, 17 nt, Homo sapiens
gacccacagagugccau

SEQ ID NO: 2103396 - RNA, 17 nt, Homo sapiens
acgaaaauaguauuuca

SEQ ID NO: 2103397 - RNA, 23 nt, Homo sapiens
ucaauaaaaaaaauaauaaucau

SEQ ID NO: 2103398 - RNA, 17 nt, Homo sapiens
aaauauauagaaugauc

SEQ ID NO: 2103399 - RNA, 17 nt, Homo sapiens
aacauggccacauccaa

SEQ ID NO: 2103400 - RNA, 18 nt, Homo sapiens
cugucgccugcggacucc

SEQ ID NO: 2103401 - RNA, 14 nt, Homo sapiens
agcucccacucccu

SEQ ID NO: 2103402 - RNA, 19 nt, Homo sapiens
ccuccugaguaauaagcau

SEQ ID NO: 2103403 - RNA, 19 nt, Homo sapiens
ccaaaaaaauaaagcauua

SEQ ID NO: 2103404 - RNA, 15 nt, Homo sapiens
cggcuacucuggaau

SEQ ID NO: 2103405 - RNA, 18 nt, Homo sapiens
uggucccccuuccaugga

SEQ ID NO: 2103406 - RNA, 21 nt, Homo sapiens
ugaccccuuccugucuggccc

SEQ ID NO: 2103407 - RNA, 21 nt, Homo sapiens
guauguauacacacauauaca

SEQ ID NO: 2103408 - RNA, 22 nt, Homo sapiens
uaugcacugaagagcucuuggc

SEQ ID NO: 2103409 - RNA, 20 nt, Homo sapiens
gcucuaacaaugacauuuau

SEQ ID NO: 2103410 - RNA, 16 nt, Homo sapiens
gauucucacauaugcc

SEQ ID NO: 2103411 - RNA, 14 nt, Homo sapiens
uguaacuauaccuc

SEQ ID NO: 2103412 - RNA, 18 nt, Homo sapiens
agugaguucguuuuggag

SEQ ID NO: 2103413 - RNA, 15 nt, Homo sapiens
cagaaauuguaucuu

SEQ ID NO: 2103414 - RNA, 19 nt, Homo sapiens
ucugcagcucuacagguga

SEQ ID NO: 2103415 - RNA, 14 nt, Homo sapiens
gaaauauuccuuaa

SEQ ID NO: 2103416 - RNA, 17 nt, Homo sapiens
gcugcgcaccaaugccc

SEQ ID NO: 2103417 - RNA, 18 nt, Homo sapiens
ggugugugugccauguca

SEQ ID NO: 2103418 - RNA, 20 nt, Homo sapiens
ugcucuaagucaaauuccaa

SEQ ID NO: 2103419 - RNA, 20 nt, Homo sapiens
caagcuuagugagcagugag

SEQ ID NO: 2103420 - RNA, 15 nt, Homo sapiens
ugcuauuucuauauu

SEQ ID NO: 2103421 - RNA, 17 nt, Homo sapiens
ucaaaauaaaaaugagg

SEQ ID NO: 2103422 - RNA, 17 nt, Homo sapiens
auguaauacauauagca

SEQ ID NO: 2103423 - RNA, 13 nt, Homo sapiens
aaggagauucuuu

SEQ ID NO: 2103424 - RNA, 19 nt, Homo sapiens
gcuuguuagcaaaauggau

SEQ ID NO: 2103425 - RNA, 16 nt, Homo sapiens
cccacaacgacuuuau

SEQ ID NO: 2103426 - RNA, 12 nt, Homo sapiens
aaagguaccuuu

SEQ ID NO: 2103427 - RNA, 15 nt, Homo sapiens
uggagagaagggcau

SEQ ID NO: 2103428 - RNA, 19 nt, Homo sapiens
gagacuugaaaccagaaga

SEQ ID NO: 2103429 - RNA, 19 nt, Homo sapiens
aauaaagcguccucucagu

SEQ ID NO: 2103430 - RNA, 16 nt, Homo sapiens
caguauugaguguucu

SEQ ID NO: 2103431 - RNA, 15 nt, Homo sapiens
cuggguucaaaaaga

SEQ ID NO: 2103432 - RNA, 18 nt, Homo sapiens
uuggggaaggccaggacc

SEQ ID NO: 2103433 - RNA, 13 nt, Homo sapiens
gguagcaacugaa

SEQ ID NO: 2103434 - RNA, 15 nt, Homo sapiens
uggcugaacuacaag

SEQ ID NO: 2103435 - RNA, 13 nt, Homo sapiens
uugcuaccaaaaa

SEQ ID NO: 2103436 - RNA, 20 nt, Homo sapiens
gucaaugggaccuguggcug

SEQ ID NO: 2103437 - RNA, 17 nt, Homo sapiens
cuucagucucuauacca

SEQ ID NO: 2103438 - RNA, 20 nt, Homo sapiens
uuggcaaaagccuuguguau

SEQ ID NO: 2103439 - RNA, 17 nt, Homo sapiens
ccauaagcuacugccau

SEQ ID NO: 2103440 - RNA, 22 nt, Homo sapiens
guggcauaaauugcaucacugu

SEQ ID NO: 2103441 - RNA, 16 nt, Homo sapiens
aguauuuauauuggau

SEQ ID NO: 2103442 - RNA, 17 nt, Homo sapiens
ucaguccuguacucugg

SEQ ID NO: 2103443 - RNA, 16 nt, Homo sapiens
acugcauguaagccaa

SEQ ID NO: 2103444 - RNA, 16 nt, Homo sapiens
augcaaacugcuuuau

SEQ ID NO: 2103445 - RNA, 22 nt, Homo sapiens
cuuuggcccuauuuaaggcaga

SEQ ID NO: 2103446 - RNA, 19 nt, Homo sapiens
uagacuuggagaauacugc

SEQ ID NO: 2103447 - RNA, 15 nt, Homo sapiens
ccuucccccagcuuu

SEQ ID NO: 2103448 - RNA, 22 nt, Homo sapiens
gccagguuuugucccugcucgu

SEQ ID NO: 2103449 - RNA, 16 nt, Homo sapiens
uuauuugugggguaca

SEQ ID NO: 2103450 - RNA, 17 nt, Homo sapiens
gaggagagcagcuguca

SEQ ID NO: 2103451 - RNA, 19 nt, Homo sapiens
ccucuuccaggaagcacag

SEQ ID NO: 2103452 - RNA, 16 nt, Homo sapiens
gccccuuuaacucuua

SEQ ID NO: 2103453 - RNA, 16 nt, Homo sapiens
aaauagcagcacagcu

SEQ ID NO: 2103454 - RNA, 17 nt, Homo sapiens
uucccaacaacauccau

SEQ ID NO: 2103455 - RNA, 18 nt, Homo sapiens
cugcucuccgaccagaca

SEQ ID NO: 2103456 - RNA, 19 nt, Homo sapiens
ucagacuccugugcaacuu

SEQ ID NO: 2103457 - RNA, 19 nt, Homo sapiens
ugaagcaacugugaauuca

SEQ ID NO: 2103458 - RNA, 19 nt, Homo sapiens
cugcuuccccuuccuaagu

SEQ ID NO: 2103459 - RNA, 12 nt, Homo sapiens
acaauuccacac

SEQ ID NO: 2103460 - RNA, 13 nt, Homo sapiens
cacacagauaugc

SEQ ID NO: 2103461 - RNA, 22 nt, Homo sapiens
acugcuccauuuauaaccccag

SEQ ID NO: 2103462 - RNA, 21 nt, Homo sapiens
cugcagagcaauaacacuaua

SEQ ID NO: 2103463 - RNA, 14 nt, Homo sapiens
ccuacugugucuca

SEQ ID NO: 2103464 - RNA, 23 nt, Homo sapiens
uguccagaaauugugugugcaag

SEQ ID NO: 2103465 - RNA, 17 nt, Homo sapiens
cucacuguugaauuuuc

SEQ ID NO: 2103466 - RNA, 23 nt, Homo sapiens
augaagcguugccauugaacuca

SEQ ID NO: 2103467 - RNA, 23 nt, Homo sapiens
ucccaaccucaaugcccugccau

SEQ ID NO: 2103468 - RNA, 18 nt, Homo sapiens
cagaagggcuacuuucca

SEQ ID NO: 2103469 - RNA, 21 nt, Homo sapiens
agaggagauuggccagugaga

SEQ ID NO: 2103470 - RNA, 13 nt, Homo sapiens
uuuaguacuuguu

SEQ ID NO: 2103471 - RNA, 22 nt, Homo sapiens
ucacccaaagccugucccagga

SEQ ID NO: 2103472 - RNA, 22 nt, Homo sapiens
gaaggguucaccaggucaggga

SEQ ID NO: 2103473 - RNA, 11 nt, Homo sapiens
cugaagccacu

SEQ ID NO: 2103474 - RNA, 14 nt, Homo sapiens
cuguauacauuaca

SEQ ID NO: 2103475 - RNA, 14 nt, Homo sapiens
cagaauacaauuca

SEQ ID NO: 2103476 - RNA, 22 nt, Homo sapiens
gaaaauauauuuaauaccuuug

SEQ ID NO: 2103477 - RNA, 22 nt, Homo sapiens
uggcaaaaaggagccuuuugcu

SEQ ID NO: 2103478 - RNA, 13 nt, Homo sapiens
auaccaugcaaua

SEQ ID NO: 2103479 - RNA, 18 nt, Homo sapiens
agggaacuagagguguua

SEQ ID NO: 2103480 - RNA, 23 nt, Homo sapiens
cacugcccucuuguggugcauug

SEQ ID NO: 2103481 - RNA, 19 nt, Homo sapiens
guacuauugugaccacagg

SEQ ID NO: 2103482 - RNA, 19 nt, Homo sapiens
auuuccguaccccugagga

SEQ ID NO: 2103483 - RNA, 17 nt, Homo sapiens
auauaguuaugcauaca

SEQ ID NO: 2103484 - RNA, 17 nt, Homo sapiens
uuaaauuuuaacuaaau

SEQ ID NO: 2103485 - RNA, 17 nt, Homo sapiens
uucuacguggauguucu

SEQ ID NO: 2103486 - RNA, 21 nt, Homo sapiens
guaaaacauuccaaauaauuc

SEQ ID NO: 2103487 - RNA, 13 nt, Homo sapiens
cggccacaccccu

SEQ ID NO: 2103488 - RNA, 14 nt, Homo sapiens
agugggaccuggug

SEQ ID NO: 2103489 - RNA, 19 nt, Homo sapiens
ccacaagccaggaccugcu

SEQ ID NO: 2103490 - RNA, 13 nt, Homo sapiens
auugcugacuuua

SEQ ID NO: 2103491 - RNA, 23 nt, Homo sapiens
ugauaugucagggcgugggacau

SEQ ID NO: 2103492 - RNA, 22 nt, Homo sapiens
cagacuauggauguguucucua

SEQ ID NO: 2103493 - RNA, 22 nt, Homo sapiens
uuggaaaauaauaaaagaauca

SEQ ID NO: 2103494 - RNA, 13 nt, Homo sapiens
cauacacacuguu

SEQ ID NO: 2103495 - RNA, 19 nt, Homo sapiens
cagagguccugccauggaa

SEQ ID NO: 2103496 - RNA, 22 nt, Homo sapiens
acaggcaaauguacuucucacc

SEQ ID NO: 2103497 - RNA, 18 nt, Homo sapiens
guauugagggccagugau

SEQ ID NO: 2103498 - RNA, 22 nt, Homo sapiens
ccucagggaucuugcauuccca

SEQ ID NO: 2103499 - RNA, 21 nt, Homo sapiens
gacaagccauuauaccaccag

SEQ ID NO: 2103500 - RNA, 15 nt, Homo sapiens
auaaaauuaugccau

SEQ ID NO: 2103501 - RNA, 18 nt, Homo sapiens
agugcugcccaugagcaa

SEQ ID NO: 2103502 - RNA, 16 nt, Homo sapiens
uguaguuccuaaugga

SEQ ID NO: 2103503 - RNA, 19 nt, Homo sapiens
ccaagagauuauguaacuc

SEQ ID NO: 2103504 - RNA, 17 nt, Homo sapiens
ccauaccacacacauua

SEQ ID NO: 2103505 - RNA, 18 nt, Homo sapiens
aauauaacgagggauaaa

SEQ ID NO: 2103506 - RNA, 23 nt, Homo sapiens
ccacaaaugguggguacaaaaag

SEQ ID NO: 2103507 - RNA, 14 nt, Homo sapiens
auccaauguaugaa

SEQ ID NO: 2103508 - RNA, 14 nt, Homo sapiens
uuaaaauauauagu

SEQ ID NO: 2103509 - RNA, 16 nt, Homo sapiens
agguucacagcagcuu

SEQ ID NO: 2103510 - RNA, 16 nt, Homo sapiens
gcuccugagugucaug

SEQ ID NO: 2103511 - RNA, 18 nt, Homo sapiens
ucccaggaccccauccuc

SEQ ID NO: 2103512 - RNA, 22 nt, Homo sapiens
ugagaguauuagucacaauuaa

SEQ ID NO: 2103513 - RNA, 18 nt, Homo sapiens
acaugcuucaauaguuca

SEQ ID NO: 2103514 - RNA, 19 nt, Homo sapiens
uuaauuuuugauacuaagc

SEQ ID NO: 2103515 - RNA, 17 nt, Homo sapiens
cgacuuuggaauuugca

SEQ ID NO: 2103516 - RNA, 15 nt, Homo sapiens
uggucccucuguguc

SEQ ID NO: 2103517 - RNA, 18 nt, Homo sapiens
caugcauucuagugcaga

SEQ ID NO: 2103518 - RNA, 15 nt, Homo sapiens
ccuugggaugaucuu

SEQ ID NO: 2103519 - RNA, 17 nt, Homo sapiens
ugcuaguacuaguacua

SEQ ID NO: 2103520 - RNA, 20 nt, Homo sapiens
caucuuagauagaugguacu

SEQ ID NO: 2103521 - RNA, 17 nt, Homo sapiens
augugcacuaccauagc

SEQ ID NO: 2103522 - RNA, 15 nt, Homo sapiens
guuacugaaggugau

SEQ ID NO: 2103523 - RNA, 15 nt, Homo sapiens
ccaaaguuaguucag

SEQ ID NO: 2103524 - RNA, 14 nt, Homo sapiens
gucugcaugugcac

SEQ ID NO: 2103525 - RNA, 22 nt, Homo sapiens
ugcuucuccagccucagccucc

SEQ ID NO: 2103526 - RNA, 16 nt, Homo sapiens
cauuagugggaaaaag

SEQ ID NO: 2103527 - RNA, 17 nt, Homo sapiens
auuaauucagcucuuca

SEQ ID NO: 2103528 - RNA, 22 nt, Homo sapiens
ggguagaaaccugccgggcugu

SEQ ID NO: 2103529 - RNA, 15 nt, Homo sapiens
augacaggauaugag

SEQ ID NO: 2103530 - RNA, 20 nt, Homo sapiens
auacuucuuaaaaugugcua

SEQ ID NO: 2103531 - RNA, 14 nt, Homo sapiens
uucacugagauuau

SEQ ID NO: 2103532 - RNA, 17 nt, Homo sapiens
cucaagcaggggauccu

SEQ ID NO: 2103533 - RNA, 19 nt, Homo sapiens
uacugauggaagcacacaa

SEQ ID NO: 2103534 - RNA, 14 nt, Homo sapiens
accccaccgacuca

SEQ ID NO: 2103535 - RNA, 20 nt, Homo sapiens
ucagucacacacacauacaa

SEQ ID NO: 2103536 - RNA, 16 nt, Homo sapiens
uugacuaacaagaaug

SEQ ID NO: 2103537 - RNA, 16 nt, Homo sapiens
cuggcuucugcauuac

SEQ ID NO: 2103538 - RNA, 17 nt, Homo sapiens
aucaccauuucuuggca

SEQ ID NO: 2103539 - RNA, 12 nt, Homo sapiens
aagccugugaaa

SEQ ID NO: 2103540 - RNA, 16 nt, Homo sapiens
ccaacagcacccucuc

SEQ ID NO: 2103541 - RNA, 21 nt, Homo sapiens
uccuaugcgcucaugagcguc

SEQ ID NO: 2103542 - RNA, 21 nt, Homo sapiens
acccccaaaagaacacuauaa

SEQ ID NO: 2103543 - RNA, 22 nt, Homo sapiens
ggccucccacggugcugagacu

SEQ ID NO: 2103544 - RNA, 18 nt, Homo sapiens
cguagcuuucccaaauaa

SEQ ID NO: 2103545 - RNA, 21 nt, Homo sapiens
ggagaaacaaaauccucagga

SEQ ID NO: 2103546 - RNA, 19 nt, Homo sapiens
cuuucacuggaaugaagac

SEQ ID NO: 2103547 - RNA, 21 nt, Homo sapiens
auaagagggcacacacugugu

SEQ ID NO: 2103548 - RNA, 22 nt, Homo sapiens
ccaggagguggagguugcagug

SEQ ID NO: 2103549 - RNA, 15 nt, Homo sapiens
cucaucacauaaaag

SEQ ID NO: 2103550 - RNA, 15 nt, Homo sapiens
cauguaguagccuuu

SEQ ID NO: 2103551 - RNA, 17 nt, Homo sapiens
ugcaaaacacuaaagau

SEQ ID NO: 2103552 - RNA, 13 nt, Homo sapiens
ugaaacauuugca

SEQ ID NO: 2103553 - RNA, 22 nt, Homo sapiens
aauauaauuguaccaaccucau

SEQ ID NO: 2103554 - RNA, 22 nt, Homo sapiens
auuuuugcccagaaaguccagc

SEQ ID NO: 2103555 - RNA, 22 nt, Homo sapiens
aaaguagaucauguucacugca

SEQ ID NO: 2103556 - RNA, 15 nt, Homo sapiens
ccuggcccaucagug

SEQ ID NO: 2103557 - RNA, 20 nt, Homo sapiens
ccaaagggagucugccaggg

SEQ ID NO: 2103558 - RNA, 15 nt, Homo sapiens
aaagcugcccacugu

SEQ ID NO: 2103559 - RNA, 16 nt, Homo sapiens
ggauucauuggcccau

SEQ ID NO: 2103560 - RNA, 15 nt, Homo sapiens
uacucuaagucucca

SEQ ID NO: 2103561 - RNA, 18 nt, Homo sapiens
caaauuuagcaaccuaga

SEQ ID NO: 2103562 - RNA, 19 nt, Homo sapiens
cagaauuugauucguauga

SEQ ID NO: 2103563 - RNA, 19 nt, Homo sapiens
ugugcauaaaaguuaacau

SEQ ID NO: 2103564 - RNA, 22 nt, Homo sapiens
aacugaaggcuaaaaagcaaca

SEQ ID NO: 2103565 - RNA, 19 nt, Homo sapiens
gccugcuagucacuggaaa

SEQ ID NO: 2103566 - RNA, 14 nt, Homo sapiens
gaaagauucaguga

SEQ ID NO: 2103567 - RNA, 15 nt, Homo sapiens
cuggaucuaugugua

SEQ ID NO: 2103568 - RNA, 16 nt, Homo sapiens
auuaaagaagaccuga

SEQ ID NO: 2103569 - RNA, 16 nt, Homo sapiens
gacaucuagucucagu

SEQ ID NO: 2103570 - RNA, 20 nt, Homo sapiens
ccauucuguuccaccacugu

SEQ ID NO: 2103571 - RNA, 19 nt, Homo sapiens
gcccuggcaccuguggcca

SEQ ID NO: 2103572 - RNA, 18 nt, Homo sapiens
aaugaaaaaagucuccau

SEQ ID NO: 2103573 - RNA, 17 nt, Homo sapiens
acucaagaccaaaugga

SEQ ID NO: 2103574 - RNA, 23 nt, Homo sapiens
uggaugucuccaucucugucuca

SEQ ID NO: 2103575 - RNA, 15 nt, Homo sapiens
uguaccucaaucuau

SEQ ID NO: 2103576 - RNA, 16 nt, Homo sapiens
uuuacaucuaucccag

SEQ ID NO: 2103577 - RNA, 17 nt, Homo sapiens
ccaacauggcacaugua

SEQ ID NO: 2103578 - RNA, 13 nt, Homo sapiens
acaagcuguggua

SEQ ID NO: 2103579 - RNA, 17 nt, Homo sapiens
aagugggcgugagugga

SEQ ID NO: 2103580 - RNA, 20 nt, Homo sapiens
augucccccaccucuuuucc

SEQ ID NO: 2103581 - RNA, 23 nt, Homo sapiens
cacacagggacgugacagagcua

SEQ ID NO: 2103582 - RNA, 22 nt, Homo sapiens
cuaaguuaaauauuucugcaca

SEQ ID NO: 2103583 - RNA, 21 nt, Homo sapiens
uuuuugaaaaaaguacauauu

SEQ ID NO: 2103584 - RNA, 22 nt, Homo sapiens
cagaaugcugcaggacuugaga

SEQ ID NO: 2103585 - RNA, 19 nt, Homo sapiens
uaauguuuacaacaauaaa

SEQ ID NO: 2103586 - RNA, 19 nt, Homo sapiens
aaaguaauuguuccagaga

SEQ ID NO: 2103587 - RNA, 21 nt, Homo sapiens
caaguauguugagaguugcug

SEQ ID NO: 2103588 - RNA, 18 nt, Homo sapiens
caugugaaacucaucuca

SEQ ID NO: 2103589 - RNA, 22 nt, Homo sapiens
ugcauaauguuucuggauuuca

SEQ ID NO: 2103590 - RNA, 19 nt, Homo sapiens
agucagaccucagcaauau

SEQ ID NO: 2103591 - RNA, 16 nt, Homo sapiens
uuuacaggcacccacc

SEQ ID NO: 2103592 - RNA, 21 nt, Homo sapiens
auguguucauuaaagcaugaa

SEQ ID NO: 2103593 - RNA, 16 nt, Homo sapiens
uuagcuuuucugcaau

SEQ ID NO: 2103594 - RNA, 13 nt, Homo sapiens
uucauacacuccc

SEQ ID NO: 2103595 - RNA, 13 nt, Homo sapiens
uauauacacaucc

SEQ ID NO: 2103596 - RNA, 23 nt, Homo sapiens
uugcuguuccuuaauuugauuaa

SEQ ID NO: 2103597 - RNA, 13 nt, Homo sapiens
ggaaugcaauaaa

SEQ ID NO: 2103598 - RNA, 18 nt, Homo sapiens
agaccagccagggcaaca

SEQ ID NO: 2103599 - RNA, 21 nt, Homo sapiens
cuggagcccuaaccccuucca

SEQ ID NO: 2103600 - RNA, 16 nt, Homo sapiens
guccucuuaagacacu

SEQ ID NO: 2103601 - RNA, 18 nt, Homo sapiens
aggucagcucccaucuca

SEQ ID NO: 2103602 - RNA, 20 nt, Homo sapiens
caggcuguuuauauguucac

SEQ ID NO: 2103603 - RNA, 23 nt, Homo sapiens
aaugcccucauacccaugcacag

SEQ ID NO: 2103604 - RNA, 16 nt, Homo sapiens
gaaguuccaguguucu

SEQ ID NO: 2103605 - RNA, 19 nt, Homo sapiens
caguuaaaccagcuacuca

SEQ ID NO: 2103606 - RNA, 12 nt, Homo sapiens
aaaaugccaaaa

SEQ ID NO: 2103607 - RNA, 12 nt, Homo sapiens
aaagugccaaag

SEQ ID NO: 2103608 - RNA, 18 nt, Homo sapiens
guguggguggaagggcug

SEQ ID NO: 2103609 - RNA, 23 nt, Homo sapiens
gcuaugguuuucuccaagagcua

SEQ ID NO: 2103610 - RNA, 14 nt, Homo sapiens
aaucuaaccacuua

SEQ ID NO: 2103611 - RNA, 14 nt, Homo sapiens
augucuccacuuca

SEQ ID NO: 2103612 - RNA, 13 nt, Homo sapiens
ccaccuagacugu

SEQ ID NO: 2103613 - RNA, 18 nt, Homo sapiens
acugaauguaaacaaagg

SEQ ID NO: 2103614 - RNA, 16 nt, Homo sapiens
uuguggaaacugucau

SEQ ID NO: 2103615 - RNA, 18 nt, Homo sapiens
caauccgaaguaugaggg

SEQ ID NO: 2103616 - RNA, 15 nt, Homo sapiens
aggcccccagugggg

SEQ ID NO: 2103617 - RNA, 21 nt, Homo sapiens
ugggaaaggaaaaccagggau

SEQ ID NO: 2103618 - RNA, 14 nt, Homo sapiens
guucccccugugca

SEQ ID NO: 2103619 - RNA, 18 nt, Homo sapiens
gcuagaucuaguucucaa

SEQ ID NO: 2103620 - RNA, 21 nt, Homo sapiens
caaugcuuugggaggccaagg

SEQ ID NO: 2103621 - RNA, 14 nt, Homo sapiens
uggauggacuugua

SEQ ID NO: 2103622 - RNA, 16 nt, Homo sapiens
cuacauugugcaauug

SEQ ID NO: 2103623 - RNA, 21 nt, Homo sapiens
cauuuccucgcagccucucag

SEQ ID NO: 2103624 - RNA, 13 nt, Homo sapiens
cggaacucaaaua

SEQ ID NO: 2103625 - RNA, 14 nt, Homo sapiens
gauuaaaaccagag

SEQ ID NO: 2103626 - RNA, 22 nt, Homo sapiens
ugaaaucuauuggguuaauuuc

SEQ ID NO: 2103627 - RNA, 23 nt, Homo sapiens
ucccauuauuauuucuguucuua

SEQ ID NO: 2103628 - RNA, 15 nt, Homo sapiens
guuacucaguguuaa

SEQ ID NO: 2103629 - RNA, 18 nt, Homo sapiens
acagagugauuguaguuu

SEQ ID NO: 2103630 - RNA, 17 nt, Homo sapiens
cccacacccacuguccu

SEQ ID NO: 2103631 - RNA, 23 nt, Homo sapiens
uaagaugcuuugacacugaauaa

SEQ ID NO: 2103632 - RNA, 23 nt, Homo sapiens
uucuccccgcuaaggaagauauc

SEQ ID NO: 2103633 - RNA, 21 nt, Homo sapiens
cacccuuuccucuuaauuccc

SEQ ID NO: 2103634 - RNA, 12 nt, Homo sapiens
ccuuauggagcu

SEQ ID NO: 2103635 - RNA, 16 nt, Homo sapiens
uucuacaaauguuacu

SEQ ID NO: 2103636 - RNA, 21 nt, Homo sapiens
uuggacuccaggccugaccag

SEQ ID NO: 2103637 - RNA, 21 nt, Homo sapiens
aaugggucucucuugccccac

SEQ ID NO: 2103638 - RNA, 16 nt, Homo sapiens
ggcacaccagugcaag

SEQ ID NO: 2103639 - RNA, 13 nt, Homo sapiens
ccccuccacucuc

SEQ ID NO: 2103640 - RNA, 16 nt, Homo sapiens
aacugcuuugugcaua

SEQ ID NO: 2103641 - RNA, 22 nt, Homo sapiens
accaguuuccuuucgucugcca

SEQ ID NO: 2103642 - RNA, 15 nt, Homo sapiens
agcccggaaacucca

SEQ ID NO: 2103643 - RNA, 17 nt, Homo sapiens
agccuugacacacugug

SEQ ID NO: 2103644 - RNA, 24 nt, Homo sapiens
ccaaauaaggauuuguucacaugc

SEQ ID NO: 2103645 - RNA, 19 nt, Homo sapiens
aaaguacaucucuacuaaa

SEQ ID NO: 2103646 - RNA, 16 nt, Homo sapiens
uaugaauaguuuccaa

SEQ ID NO: 2103647 - RNA, 14 nt, Homo sapiens
ccagggacacucca

SEQ ID NO: 2103648 - RNA, 14 nt, Homo sapiens
ucagaaaacagaaa

SEQ ID NO: 2103649 - RNA, 19 nt, Homo sapiens
aacacacagucacauucga

SEQ ID NO: 2103650 - RNA, 17 nt, Homo sapiens
cccccaucauaagggca

SEQ ID NO: 2103651 - RNA, 20 nt, Homo sapiens
agugcuuguuuacuaagcau

SEQ ID NO: 2103652 - RNA, 15 nt, Homo sapiens
acauccugcagcuua

SEQ ID NO: 2103653 - RNA, 14 nt, Homo sapiens
agcuuucugugcau

SEQ ID NO: 2103654 - RNA, 15 nt, Homo sapiens
ccugcccccaaggag

SEQ ID NO: 2103655 - RNA, 21 nt, Homo sapiens
ccuaguagaauauggacuugg

SEQ ID NO: 2103656 - RNA, 19 nt, Homo sapiens
auucucaagccgcauccca

SEQ ID NO: 2103657 - RNA, 14 nt, Homo sapiens
auuuguaaguuuau

SEQ ID NO: 2103658 - RNA, 14 nt, Homo sapiens
acacguaagcacau

SEQ ID NO: 2103659 - RNA, 17 nt, Homo sapiens
uucacaacacaaucaaa

SEQ ID NO: 2103660 - RNA, 13 nt, Homo sapiens
caugcaaugccuc

SEQ ID NO: 2103661 - RNA, 12 nt, Homo sapiens
gcuugacacaaa

SEQ ID NO: 2103662 - RNA, 13 nt, Homo sapiens
aaauccuauguga

SEQ ID NO: 2103663 - RNA, 21 nt, Homo sapiens
cuucugaaaacauucacuugu

SEQ ID NO: 2103664 - RNA, 19 nt, Homo sapiens
cagccucagugccacuuga

SEQ ID NO: 2103665 - RNA, 23 nt, Homo sapiens
aauugguagaaaaauaucuuuaa

SEQ ID NO: 2103666 - RNA, 18 nt, Homo sapiens
gaagcaucauuuccccaa

SEQ ID NO: 2103667 - RNA, 21 nt, Homo sapiens
guuugaagucuuguguauuug

SEQ ID NO: 2103668 - RNA, 19 nt, Homo sapiens
cuuucagcauuaggcuuuu

SEQ ID NO: 2103669 - RNA, 19 nt, Homo sapiens
auguccgugagaacaucau

SEQ ID NO: 2103670 - RNA, 12 nt, Homo sapiens
cuguaguugcag

SEQ ID NO: 2103671 - RNA, 22 nt, Homo sapiens
ucauuagggcuuuugauuuaua

SEQ ID NO: 2103672 - RNA, 21 nt, Homo sapiens
ucugguaauaaaugugacuca

SEQ ID NO: 2103673 - RNA, 12 nt, Homo sapiens
uggacugaccac

SEQ ID NO: 2103674 - RNA, 18 nt, Homo sapiens
cuugaucuguauauacaa

SEQ ID NO: 2103675 - RNA, 24 nt, Homo sapiens
gaccaccuccucugccagcaggaa

SEQ ID NO: 2103676 - RNA, 16 nt, Homo sapiens
cucccuucccaguggg

SEQ ID NO: 2103677 - RNA, 13 nt, Homo sapiens
cuuguucuuuaaa

SEQ ID NO: 2103678 - RNA, 22 nt, Homo sapiens
ugcuucuccuucaaaacacuca

SEQ ID NO: 2103679 - RNA, 11 nt, Homo sapiens
auuacagucau

SEQ ID NO: 2103680 - RNA, 18 nt, Homo sapiens
ccucuaaccgacauuccu

SEQ ID NO: 2103681 - RNA, 21 nt, Homo sapiens
aguacucauaaaggacacugg

SEQ ID NO: 2103682 - RNA, 19 nt, Homo sapiens
ucucgcauuuucucuagcu

SEQ ID NO: 2103683 - RNA, 18 nt, Homo sapiens
aauauuuuucaugcuauc

SEQ ID NO: 2103684 - RNA, 15 nt, Homo sapiens
uucaauaaaccacaa

SEQ ID NO: 2103685 - RNA, 17 nt, Homo sapiens
uccauucuucagugucu

SEQ ID NO: 2103686 - RNA, 14 nt, Homo sapiens
uuuucuaugcuuau

SEQ ID NO: 2103687 - RNA, 21 nt, Homo sapiens
aaguuuuguggaggagcucag

SEQ ID NO: 2103688 - RNA, 19 nt, Homo sapiens
aaggcuucucauccacugu

SEQ ID NO: 2103689 - RNA, 23 nt, Homo sapiens
cacaaaaaaugaggaauagcaaa

SEQ ID NO: 2103690 - RNA, 19 nt, Homo sapiens
cgcccucucaugcagaagc

SEQ ID NO: 2103691 - RNA, 18 nt, Homo sapiens
caaugggcuuugcugcuu

SEQ ID NO: 2103692 - RNA, 14 nt, Homo sapiens
uaucaccucucuuc

SEQ ID NO: 2103693 - RNA, 14 nt, Homo sapiens
acuaggaaauucca

SEQ ID NO: 2103694 - RNA, 22 nt, Homo sapiens
auuaugggaaugacucugacuu

SEQ ID NO: 2103695 - RNA, 21 nt, Homo sapiens
agaguggcagccaagagccau

SEQ ID NO: 2103696 - RNA, 19 nt, Homo sapiens
agcccauggccucuggcca

SEQ ID NO: 2103697 - RNA, 21 nt, Homo sapiens
gaagaugcagucucugcugau

SEQ ID NO: 2103698 - RNA, 17 nt, Homo sapiens
gcugaacaauaggcugu

SEQ ID NO: 2103699 - RNA, 16 nt, Homo sapiens
cuucaaugcuagaaaa

SEQ ID NO: 2103700 - RNA, 21 nt, Homo sapiens
cagcccugggcaaggaagcuu

SEQ ID NO: 2103701 - RNA, 15 nt, Homo sapiens
cugaaucaagcacac

SEQ ID NO: 2103702 - RNA, 20 nt, Homo sapiens
cuuugugaacaagucccugu

SEQ ID NO: 2103703 - RNA, 15 nt, Homo sapiens
gacugacaaccucau

SEQ ID NO: 2103704 - RNA, 23 nt, Homo sapiens
ggcuccaacacugcaacaugggg

SEQ ID NO: 2103705 - RNA, 14 nt, Homo sapiens
uaagguuccaucca

SEQ ID NO: 2103706 - RNA, 14 nt, Homo sapiens
cuuaaacuuuguca

SEQ ID NO: 2103707 - RNA, 20 nt, Homo sapiens
uaaaaauuccaaauggacua

SEQ ID NO: 2103708 - RNA, 18 nt, Homo sapiens
gagccaccucacccagcc

SEQ ID NO: 2103709 - RNA, 18 nt, Homo sapiens
gcaaacugggaaccccuu

SEQ ID NO: 2103710 - RNA, 18 nt, Homo sapiens
ugcccaagagugggguuu

SEQ ID NO: 2103711 - RNA, 23 nt, Homo sapiens
aagaucacgccauugcacuccag

SEQ ID NO: 2103712 - RNA, 17 nt, Homo sapiens
cugguguggaagagcuc

SEQ ID NO: 2103713 - RNA, 16 nt, Homo sapiens
aacuucccagugaauu

SEQ ID NO: 2103714 - RNA, 22 nt, Homo sapiens
ucagcuuuuaauaaaauugaca

SEQ ID NO: 2103715 - RNA, 14 nt, Homo sapiens
uacaacccuacccu

SEQ ID NO: 2103716 - RNA, 15 nt, Homo sapiens
gacauuaauuaucua

SEQ ID NO: 2103717 - RNA, 16 nt, Homo sapiens
caaauuuuucaaauca

SEQ ID NO: 2103718 - RNA, 21 nt, Homo sapiens
caaccauggauggcaaaugug

SEQ ID NO: 2103719 - RNA, 18 nt, Homo sapiens
agccugcaaacucacugc

SEQ ID NO: 2103720 - RNA, 17 nt, Homo sapiens
uuaaucauagcaggaua

SEQ ID NO: 2103721 - RNA, 15 nt, Homo sapiens
uuauauucacuacuu

SEQ ID NO: 2103722 - RNA, 18 nt, Homo sapiens
ucaauuaaaggcuuucag

SEQ ID NO: 2103723 - RNA, 16 nt, Homo sapiens
uugcuaagugugcuua

SEQ ID NO: 2103724 - RNA, 21 nt, Homo sapiens
aacuuuucaccaaugagccuu

SEQ ID NO: 2103725 - RNA, 18 nt, Homo sapiens
cugcagacugcuaguguu

SEQ ID NO: 2103726 - RNA, 22 nt, Homo sapiens
cuuaaugcagacaaacaaacau

SEQ ID NO: 2103727 - RNA, 13 nt, Homo sapiens
caagauguuauau

SEQ ID NO: 2103728 - RNA, 11 nt, Homo sapiens
ggacugugucc

SEQ ID NO: 2103729 - RNA, 17 nt, Homo sapiens
agacacauacagagugg

SEQ ID NO: 2103730 - RNA, 17 nt, Homo sapiens
ccaguuagcaacaaauc

SEQ ID NO: 2103731 - RNA, 12 nt, Homo sapiens
auaggaguucac

SEQ ID NO: 2103732 - RNA, 13 nt, Homo sapiens
ccaggagcucuuc

SEQ ID NO: 2103733 - RNA, 19 nt, Homo sapiens
acccaguuuagaggggaaa

SEQ ID NO: 2103734 - RNA, 19 nt, Homo sapiens
aagucacucacacuggcca

SEQ ID NO: 2103735 - RNA, 20 nt, Homo sapiens
cgacaaaggccacaggcagu

SEQ ID NO: 2103736 - RNA, 18 nt, Homo sapiens
uuuccacuacugcuacca

SEQ ID NO: 2103737 - RNA, 18 nt, Homo sapiens
cagaauuuaagcaagaaa

SEQ ID NO: 2103738 - RNA, 12 nt, Homo sapiens
auagagcagugc

SEQ ID NO: 2103739 - RNA, 14 nt, Homo sapiens
uaaaucaugaugcu

SEQ ID NO: 2103740 - RNA, 13 nt, Homo sapiens
cauuaucuaugau

SEQ ID NO: 2103741 - RNA, 14 nt, Homo sapiens
ucaagcacauguaa

SEQ ID NO: 2103742 - RNA, 14 nt, Homo sapiens
gcagcccaugccca

SEQ ID NO: 2103743 - RNA, 14 nt, Homo sapiens
uccuacuacuuugu

SEQ ID NO: 2103744 - RNA, 18 nt, Homo sapiens
caccucucuguaguuuau

SEQ ID NO: 2103745 - RNA, 15 nt, Homo sapiens
acaauucaaucaaag

SEQ ID NO: 2103746 - RNA, 14 nt, Homo sapiens
ccagcacaaacaca

SEQ ID NO: 2103747 - RNA, 13 nt, Homo sapiens
cugugauggggcc

SEQ ID NO: 2103748 - RNA, 12 nt, Homo sapiens
uauuuauagucg

SEQ ID NO: 2103749 - RNA, 14 nt, Homo sapiens
gauguuuccagacu

SEQ ID NO: 2103750 - RNA, 20 nt, Homo sapiens
uucaaagacagagaagacca

SEQ ID NO: 2103751 - RNA, 12 nt, Homo sapiens
aaauauugcuau

SEQ ID NO: 2103752 - RNA, 12 nt, Homo sapiens
uaaaaccucagc

SEQ ID NO: 2103753 - RNA, 16 nt, Homo sapiens
agagauuugaauagaa

SEQ ID NO: 2103754 - RNA, 16 nt, Homo sapiens
cuuuccagggauccag

SEQ ID NO: 2103755 - RNA, 23 nt, Homo sapiens
ucugagcagugaaugauucagug

SEQ ID NO: 2103756 - RNA, 15 nt, Homo sapiens
ugucauccucacagu

SEQ ID NO: 2103757 - RNA, 14 nt, Homo sapiens
acuaaaaaugcaaa

SEQ ID NO: 2103758 - RNA, 12 nt, Homo sapiens
uuuucugcacaa

SEQ ID NO: 2103759 - RNA, 14 nt, Homo sapiens
auucacaacuagga

SEQ ID NO: 2103760 - RNA, 12 nt, Homo sapiens
ucaaagcacugu

SEQ ID NO: 2103761 - RNA, 22 nt, Homo sapiens
ccuggguguggcugggcugcuc

SEQ ID NO: 2103762 - RNA, 15 nt, Homo sapiens
cuguuagcaagugug

SEQ ID NO: 2103763 - RNA, 12 nt, Homo sapiens
ugaaaccaaaga

SEQ ID NO: 2103764 - RNA, 16 nt, Homo sapiens
cuugaaaagaaaacca

SEQ ID NO: 2103765 - RNA, 17 nt, Homo sapiens
aaugcauuauggguggu

SEQ ID NO: 2103766 - RNA, 18 nt, Homo sapiens
auggcucagaugccacuu

SEQ ID NO: 2103767 - RNA, 22 nt, Homo sapiens
cagaugauucuaugucucauga

SEQ ID NO: 2103768 - RNA, 13 nt, Homo sapiens
agauaaacugcuc

SEQ ID NO: 2103769 - RNA, 23 nt, Homo sapiens
uauuuuguaugcaagcaguuuca

SEQ ID NO: 2103770 - RNA, 20 nt, Homo sapiens
cugggauccaguguauaaau

SEQ ID NO: 2103771 - RNA, 21 nt, Homo sapiens
gaaugugagcacaaugcauaa

SEQ ID NO: 2103772 - RNA, 21 nt, Homo sapiens
uccauuuggcagaacugcugg

SEQ ID NO: 2103773 - RNA, 14 nt, Homo sapiens
acuuccucugccac

SEQ ID NO: 2103774 - RNA, 14 nt, Homo sapiens
gauaggagcuucca

SEQ ID NO: 2103775 - RNA, 23 nt, Homo sapiens
gccacugagaagugcacuuuaag

SEQ ID NO: 2103776 - RNA, 15 nt, Homo sapiens
cuacuuaaugcacag

SEQ ID NO: 2103777 - RNA, 13 nt, Homo sapiens
cgaaaaaagagac

SEQ ID NO: 2103778 - RNA, 11 nt, Homo sapiens
uuuuugcucuc

SEQ ID NO: 2103779 - RNA, 13 nt, Homo sapiens
ucugcucaggaau

SEQ ID NO: 2103780 - RNA, 19 nt, Homo sapiens
accucccccaggugcagug

SEQ ID NO: 2103781 - RNA, 13 nt, Homo sapiens
auacugacuccua

SEQ ID NO: 2103782 - RNA, 22 nt, Homo sapiens
ugcuucugccguugcugccagc

SEQ ID NO: 2103783 - RNA, 23 nt, Homo sapiens
ucaaauagagcuguucaacauca

SEQ ID NO: 2103784 - RNA, 20 nt, Homo sapiens
aagguacaggugacuacccu

SEQ ID NO: 2103785 - RNA, 23 nt, Homo sapiens
acauggcucucauguacuuuuaa

SEQ ID NO: 2103786 - RNA, 14 nt, Homo sapiens
guugggaacagaaa

SEQ ID NO: 2103787 - RNA, 14 nt, Homo sapiens
caaaaacaagacaa

SEQ ID NO: 2103788 - RNA, 15 nt, Homo sapiens
cacauagagauaugc

SEQ ID NO: 2103789 - RNA, 12 nt, Homo sapiens
auaaagaacaau

SEQ ID NO: 2103790 - RNA, 16 nt, Homo sapiens
cagcagcaaaugccac

SEQ ID NO: 2103791 - RNA, 14 nt, Homo sapiens
aucaagagggauaa

SEQ ID NO: 2103792 - RNA, 12 nt, Homo sapiens
cgucccuaagca

SEQ ID NO: 2103793 - RNA, 22 nt, Homo sapiens
gccuucccugacacccugggcu

SEQ ID NO: 2103794 - RNA, 18 nt, Homo sapiens
ucaguuaauucuuagaua

SEQ ID NO: 2103795 - RNA, 22 nt, Homo sapiens
cuuuguagaacugcccauuucc

SEQ ID NO: 2103796 - RNA, 23 nt, Homo sapiens
caaggauucagcauuauuccucc

SEQ ID NO: 2103797 - RNA, 17 nt, Homo sapiens
ugccucagacuccgccc

SEQ ID NO: 2103798 - RNA, 20 nt, Homo sapiens
agcagaacagaucuuuuacu

SEQ ID NO: 2103799 - RNA, 13 nt, Homo sapiens
aaguaaagcccag

SEQ ID NO: 2103800 - RNA, 17 nt, Homo sapiens
aaucugaaucagccagu

SEQ ID NO: 2103801 - RNA, 17 nt, Homo sapiens
uauauguauacauauag

SEQ ID NO: 2103802 - RNA, 16 nt, Homo sapiens
gucugggauauggcug

SEQ ID NO: 2103803 - RNA, 22 nt, Homo sapiens
cuucauagacuugaauaacucu

SEQ ID NO: 2103804 - RNA, 18 nt, Homo sapiens
ugcauaaaccaaugagcu

SEQ ID NO: 2103805 - RNA, 21 nt, Homo sapiens
caauuuuccuuggaacacaua

SEQ ID NO: 2103806 - RNA, 21 nt, Homo sapiens
uagccccagcgccaaaggaga

SEQ ID NO: 2103807 - RNA, 13 nt, Homo sapiens
gauaguucccaaa

SEQ ID NO: 2103808 - RNA, 14 nt, Homo sapiens
ugggcugcuggcca

SEQ ID NO: 2103809 - RNA, 23 nt, Homo sapiens
agaggacaccauuuuuccagagc

SEQ ID NO: 2103810 - RNA, 18 nt, Homo sapiens
gagagggaggucacugga

SEQ ID NO: 2103811 - RNA, 13 nt, Homo sapiens
cucuuccacagga

SEQ ID NO: 2103812 - RNA, 15 nt, Homo sapiens
aggcgucucuucaaa

SEQ ID NO: 2103813 - RNA, 19 nt, Homo sapiens
aagcagagcaaaaugcucu

SEQ ID NO: 2103814 - RNA, 12 nt, Homo sapiens
ccaacacccaaa

SEQ ID NO: 2103815 - RNA, 13 nt, Homo sapiens
aaauccuaggugc

SEQ ID NO: 2103816 - RNA, 17 nt, Homo sapiens
ggcaccguggugugagc

SEQ ID NO: 2103817 - RNA, 16 nt, Homo sapiens
cagaggcagggcagca

SEQ ID NO: 2103818 - RNA, 18 nt, Homo sapiens
aggguggcccuugcaguu

SEQ ID NO: 2103819 - RNA, 17 nt, Homo sapiens
agcaaaacaaagcugau

SEQ ID NO: 2103820 - RNA, 14 nt, Homo sapiens
aggaaccauuuuca

SEQ ID NO: 2103821 - RNA, 14 nt, Homo sapiens
ucucaaaugcacau

SEQ ID NO: 2103822 - RNA, 22 nt, Homo sapiens
ccagaucucaugagaagucacu

SEQ ID NO: 2103823 - RNA, 14 nt, Homo sapiens
guccugagcaccug

SEQ ID NO: 2103824 - RNA, 14 nt, Homo sapiens
aaugguauggccaa

SEQ ID NO: 2103825 - RNA, 13 nt, Homo sapiens
agaguccucugga

SEQ ID NO: 2103826 - RNA, 16 nt, Homo sapiens
acgugguagucacuug

SEQ ID NO: 2103827 - RNA, 16 nt, Homo sapiens
agaagaaugacuaugc

SEQ ID NO: 2103828 - RNA, 14 nt, Homo sapiens
aucaguugccaaag

SEQ ID NO: 2103829 - RNA, 15 nt, Homo sapiens
uucacaccuaugaca

SEQ ID NO: 2103830 - RNA, 16 nt, Homo sapiens
uauuuuguucugcaaa

SEQ ID NO: 2103831 - RNA, 16 nt, Homo sapiens
cugccucucccaggca

SEQ ID NO: 2103832 - RNA, 15 nt, Homo sapiens
caaaucguccaaaga

SEQ ID NO: 2103833 - RNA, 16 nt, Homo sapiens
accuuguguacuuucu

SEQ ID NO: 2103834 - RNA, 15 nt, Homo sapiens
auguuaaagcauuuc

SEQ ID NO: 2103835 - RNA, 12 nt, Homo sapiens
aaaugcuuccaa

SEQ ID NO: 2103836 - RNA, 23 nt, Homo sapiens
auuuuacuuccaugauacuuuaa

SEQ ID NO: 2103837 - RNA, 15 nt, Homo sapiens
uuuacauguggccca

SEQ ID NO: 2103838 - RNA, 21 nt, Homo sapiens
ucuggauuuuauucaucauau

SEQ ID NO: 2103839 - RNA, 14 nt, Homo sapiens
gucuuaaagcauuu

SEQ ID NO: 2103840 - RNA, 17 nt, Homo sapiens
caucaaaaacacucuca

SEQ ID NO: 2103841 - RNA, 16 nt, Homo sapiens
caaaggacagauccag

SEQ ID NO: 2103842 - RNA, 18 nt, Homo sapiens
uccacuauuuucaaagaa

SEQ ID NO: 2103843 - RNA, 13 nt, Homo sapiens
aacagcauaugca

SEQ ID NO: 2103844 - RNA, 21 nt, Homo sapiens
agccagucucagagaccagca

SEQ ID NO: 2103845 - RNA, 14 nt, Homo sapiens
caucugauugugau

SEQ ID NO: 2103846 - RNA, 14 nt, Homo sapiens
caauuguucaggga

SEQ ID NO: 2103847 - RNA, 15 nt, Homo sapiens
gcuuuucacuacuuu

SEQ ID NO: 2103848 - RNA, 12 nt, Homo sapiens
auuauacuguau

SEQ ID NO: 2103849 - RNA, 17 nt, Homo sapiens
ccagaaaacacauuucu

SEQ ID NO: 2103850 - RNA, 11 nt, Homo sapiens
ccuucaugucu

SEQ ID NO: 2103851 - RNA, 15 nt, Homo sapiens
auggaggcccuccug

SEQ ID NO: 2103852 - RNA, 18 nt, Homo sapiens
aucaaaagggccaaagaa

SEQ ID NO: 2103853 - RNA, 21 nt, Homo sapiens
aucuuucaaagugucuugaau

SEQ ID NO: 2103854 - RNA, 12 nt, Homo sapiens
auaacugcauaa

SEQ ID NO: 2103855 - RNA, 18 nt, Homo sapiens
ccucaagguguucucugu

SEQ ID NO: 2103856 - RNA, 17 nt, Homo sapiens
aacaaagaacugaagcu

SEQ ID NO: 2103857 - RNA, 13 nt, Homo sapiens
ccagaaaguuauu

SEQ ID NO: 2103858 - RNA, 17 nt, Homo sapiens
caaaguccacacaaaga

SEQ ID NO: 2103859 - RNA, 17 nt, Homo sapiens
ugaguuagaggagaaaa

SEQ ID NO: 2103860 - RNA, 15 nt, Homo sapiens
cugcuccagugcagg

SEQ ID NO: 2103861 - RNA, 19 nt, Homo sapiens
uaauguagcugcuagcuau

SEQ ID NO: 2103862 - RNA, 13 nt, Homo sapiens
ugaaguagaaucc

SEQ ID NO: 2103863 - RNA, 20 nt, Homo sapiens
uucauguggcucagugccuu

SEQ ID NO: 2103864 - RNA, 13 nt, Homo sapiens
cauuauucauuua

SEQ ID NO: 2103865 - RNA, 16 nt, Homo sapiens
ccuccaccuccugggu

SEQ ID NO: 2103866 - RNA, 23 nt, Homo sapiens
cugugugcuccggagaugaauau

SEQ ID NO: 2103867 - RNA, 18 nt, Homo sapiens
accuccugagccccucaa

SEQ ID NO: 2103868 - RNA, 15 nt, Homo sapiens
aagcacagcuugggu

SEQ ID NO: 2103869 - RNA, 18 nt, Homo sapiens
uaaucuccucugcucauu

SEQ ID NO: 2103870 - RNA, 22 nt, Homo sapiens
acaaaagcagguuuuuauaugu

SEQ ID NO: 2103871 - RNA, 19 nt, Homo sapiens
accuacacaagcaucaccu

SEQ ID NO: 2103872 - RNA, 16 nt, Homo sapiens
gaauuggagugauaau

SEQ ID NO: 2103873 - RNA, 16 nt, Homo sapiens
auauucuuauuucacu

SEQ ID NO: 2103874 - RNA, 19 nt, Homo sapiens
ggagcagcagccagcacca

SEQ ID NO: 2103875 - RNA, 14 nt, Homo sapiens
acugaaguuucaca

SEQ ID NO: 2103876 - RNA, 14 nt, Homo sapiens
cacugccucuucca

SEQ ID NO: 2103877 - RNA, 21 nt, Homo sapiens
accaaguugauacuugaauaa

SEQ ID NO: 2103878 - RNA, 20 nt, Homo sapiens
uaugccaccaacacugcuca

SEQ ID NO: 2103879 - RNA, 14 nt, Homo sapiens
ugaacucaaugcau

SEQ ID NO: 2103880 - RNA, 16 nt, Homo sapiens
aaauguaaauacucau

SEQ ID NO: 2103881 - RNA, 22 nt, Homo sapiens
aaagugauuccuucuugcucag

SEQ ID NO: 2103882 - RNA, 21 nt, Homo sapiens
ucagaacuauaacauucaauu

SEQ ID NO: 2103883 - RNA, 13 nt, Homo sapiens
aagacagugcagu

SEQ ID NO: 2103884 - RNA, 23 nt, Homo sapiens
ucgccguguuacuguugcacuga

SEQ ID NO: 2103885 - RNA, 17 nt, Homo sapiens
gcauuccaacuaucuca

SEQ ID NO: 2103886 - RNA, 17 nt, Homo sapiens
gguuucucagaauccaa

SEQ ID NO: 2103887 - RNA, 19 nt, Homo sapiens
ugguggagaaagcacugac

SEQ ID NO: 2103888 - RNA, 19 nt, Homo sapiens
gacacauuuuuaaaaugca

SEQ ID NO: 2103889 - RNA, 13 nt, Homo sapiens
aauaacagugugu

SEQ ID NO: 2103890 - RNA, 18 nt, Homo sapiens
guacaauaaagcaaugug

SEQ ID NO: 2103891 - RNA, 17 nt, Homo sapiens
cuucaggaaaauaaaua

SEQ ID NO: 2103892 - RNA, 15 nt, Homo sapiens
aaucaagucugugaa

SEQ ID NO: 2103893 - RNA, 20 nt, Homo sapiens
ccuagaauggaagccuccac

SEQ ID NO: 2103894 - RNA, 16 nt, Homo sapiens
cugcuccacgcgcuuc

SEQ ID NO: 2103895 - RNA, 17 nt, Homo sapiens
ccaucagaaaaccaaag

SEQ ID NO: 2103896 - RNA, 18 nt, Homo sapiens
augugguucagugccuuc

SEQ ID NO: 2103897 - RNA, 16 nt, Homo sapiens
aguuucuaucucuaag

SEQ ID NO: 2103898 - RNA, 17 nt, Homo sapiens
uaaaaacacuaccucuu

SEQ ID NO: 2103899 - RNA, 18 nt, Homo sapiens
gggcugaagggaagccca

SEQ ID NO: 2103900 - RNA, 16 nt, Homo sapiens
gcaugaugauagcaua

SEQ ID NO: 2103901 - RNA, 15 nt, Homo sapiens
ugugacagucuugca

SEQ ID NO: 2103902 - RNA, 15 nt, Homo sapiens
ucagguggugauaug

SEQ ID NO: 2103903 - RNA, 23 nt, Homo sapiens
ggcccgaggacgcucccugcucc

SEQ ID NO: 2103904 - RNA, 14 nt, Homo sapiens
aucuaauuuauaca

SEQ ID NO: 2103905 - RNA, 14 nt, Homo sapiens
gggucuucagcuuu

SEQ ID NO: 2103906 - RNA, 14 nt, Homo sapiens
acgugguaauaauu

SEQ ID NO: 2103907 - RNA, 20 nt, Homo sapiens
uaccuccauccauccuucca

SEQ ID NO: 2103908 - RNA, 18 nt, Homo sapiens
caggaucccuacugccaa

SEQ ID NO: 2103909 - RNA, 13 nt, Homo sapiens
uagccuugcugua

SEQ ID NO: 2103910 - RNA, 20 nt, Homo sapiens
guuacuugaaauaccaguga

SEQ ID NO: 2103911 - RNA, 14 nt, Homo sapiens
cacuccagugccag

SEQ ID NO: 2103912 - RNA, 19 nt, Homo sapiens
cuucucuccuccacucuga

SEQ ID NO: 2103913 - RNA, 14 nt, Homo sapiens
ucuuggacuauccg

SEQ ID NO: 2103914 - RNA, 13 nt, Homo sapiens
aguuucucuccac

SEQ ID NO: 2103915 - RNA, 22 nt, Homo sapiens
auugcaucuggguagcuguaag

SEQ ID NO: 2103916 - RNA, 15 nt, Homo sapiens
cuuuaccacuaugca

SEQ ID NO: 2103917 - RNA, 20 nt, Homo sapiens
agggaagaaaaagcaagugu

SEQ ID NO: 2103918 - RNA, 20 nt, Homo sapiens
aauaaaaugucuucucccac

SEQ ID NO: 2103919 - RNA, 17 nt, Homo sapiens
auucauaggcagcaucu

SEQ ID NO: 2103920 - RNA, 16 nt, Homo sapiens
cacaaugcuauugaaa

SEQ ID NO: 2103921 - RNA, 19 nt, Homo sapiens
cagugaagagccacugcca

SEQ ID NO: 2103922 - RNA, 14 nt, Homo sapiens
ucgcagguucaagc

SEQ ID NO: 2103923 - RNA, 19 nt, Homo sapiens
uaauaaauugucaucagug

SEQ ID NO: 2103924 - RNA, 17 nt, Homo sapiens
cuucagcccccaccagg

SEQ ID NO: 2103925 - RNA, 18 nt, Homo sapiens
gaaucauuuuuguaggaa

SEQ ID NO: 2103926 - RNA, 19 nt, Homo sapiens
ugcuauaauauauaaugaa

SEQ ID NO: 2103927 - RNA, 14 nt, Homo sapiens
acagguuaaugugg

SEQ ID NO: 2103928 - RNA, 13 nt, Homo sapiens
uguuuugugauuc

SEQ ID NO: 2103929 - RNA, 13 nt, Homo sapiens
uaggcuguggggu

SEQ ID NO: 2103930 - RNA, 19 nt, Homo sapiens
uggcgcaagagaacauuuc

SEQ ID NO: 2103931 - RNA, 22 nt, Homo sapiens
cugucccuccaggcccaucuca

SEQ ID NO: 2103932 - RNA, 17 nt, Homo sapiens
aaaggcuaugauugucu

SEQ ID NO: 2103933 - RNA, 18 nt, Homo sapiens
gagacagcgcuaaggaug

SEQ ID NO: 2103934 - RNA, 13 nt, Homo sapiens
aaagauugagaag

SEQ ID NO: 2103935 - RNA, 14 nt, Homo sapiens
acuauuaaagcaca

SEQ ID NO: 2103936 - RNA, 17 nt, Homo sapiens
auuuuaaugaagugcaa

SEQ ID NO: 2103937 - RNA, 14 nt, Homo sapiens
agccagccaucuuu

SEQ ID NO: 2103938 - RNA, 21 nt, Homo sapiens
gacuagccagaauucuacccu

SEQ ID NO: 2103939 - RNA, 20 nt, Homo sapiens
ugccuucaucuucacugcaa

SEQ ID NO: 2103940 - RNA, 15 nt, Homo sapiens
ccaaaauucaucugu

SEQ ID NO: 2103941 - RNA, 19 nt, Homo sapiens
ccuuaaaaauuaaaaagua

SEQ ID NO: 2103942 - RNA, 12 nt, Homo sapiens
ugaccucuaccu

SEQ ID NO: 2103943 - RNA, 23 nt, Homo sapiens
cuuaaggggacccacaaguauug

SEQ ID NO: 2103944 - RNA, 17 nt, Homo sapiens
ucacuuaaagucaggag

SEQ ID NO: 2103945 - RNA, 22 nt, Homo sapiens
ggguaauccaggcacagcugag

SEQ ID NO: 2103946 - RNA, 19 nt, Homo sapiens
ugccagaugauuguucaaa

SEQ ID NO: 2103947 - RNA, 23 nt, Homo sapiens
acuggaccaaaaaaauaaagcau

SEQ ID NO: 2103948 - RNA, 17 nt, Homo sapiens
aucaucuuugccaagua

SEQ ID NO: 2103949 - RNA, 17 nt, Homo sapiens
gguucucuuagagccau

SEQ ID NO: 2103950 - RNA, 23 nt, Homo sapiens
gcauuuuuuuuuuaugauuuguc

SEQ ID NO: 2103951 - RNA, 11 nt, Homo sapiens
cuguccugcuc

SEQ ID NO: 2103952 - RNA, 16 nt, Homo sapiens
agcaggagccagccaa

SEQ ID NO: 2103953 - RNA, 17 nt, Homo sapiens
gcugaggugcccaggag

SEQ ID NO: 2103954 - RNA, 13 nt, Homo sapiens
gggggacagacag

SEQ ID NO: 2103955 - RNA, 19 nt, Homo sapiens
gaacguaauaaaccagguu

SEQ ID NO: 2103956 - RNA, 20 nt, Homo sapiens
cuguguguccuugugugcau

SEQ ID NO: 2103957 - RNA, 16 nt, Homo sapiens
aaguaaaacacucuaa

SEQ ID NO: 2103958 - RNA, 13 nt, Homo sapiens
acagacucucaca

SEQ ID NO: 2103959 - RNA, 16 nt, Homo sapiens
ugaaauucauccucca

SEQ ID NO: 2103960 - RNA, 12 nt, Homo sapiens
agaucugcuguc

SEQ ID NO: 2103961 - RNA, 18 nt, Homo sapiens
gcucuggugacaccagcc

SEQ ID NO: 2103962 - RNA, 15 nt, Homo sapiens
cugcuuggucuuuca

SEQ ID NO: 2103963 - RNA, 13 nt, Homo sapiens
gccgucugugcuu

SEQ ID NO: 2103964 - RNA, 10 nt, Homo sapiens
ucggggagcu

SEQ ID NO: 2103965 - RNA, 11 nt, Homo sapiens
cacccaaaugu

SEQ ID NO: 2103966 - RNA, 22 nt, Homo sapiens
acuccugguuccuaggugagca

SEQ ID NO: 2103967 - RNA, 17 nt, Homo sapiens
uagugaccccugccuac

SEQ ID NO: 2103968 - RNA, 21 nt, Homo sapiens
aagaacugaauccauauuuca

SEQ ID NO: 2103969 - RNA, 19 nt, Homo sapiens
acagcuccuccccugcuac

SEQ ID NO: 2103970 - RNA, 19 nt, Homo sapiens
agaaguuuggcaguauuua

SEQ ID NO: 2103971 - RNA, 21 nt, Homo sapiens
aaagcacuuacaccaguuuga

SEQ ID NO: 2103972 - RNA, 19 nt, Homo sapiens
agaaaaggcaucacuuucc

SEQ ID NO: 2103973 - RNA, 22 nt, Homo sapiens
cuuucccacucaccuuucucca

SEQ ID NO: 2103974 - RNA, 16 nt, Homo sapiens
ugagaaggaacuucca

SEQ ID NO: 2103975 - RNA, 17 nt, Homo sapiens
ccacccuccugucuucc

SEQ ID NO: 2103976 - RNA, 18 nt, Homo sapiens
cuuuuggagcugagauca

SEQ ID NO: 2103977 - RNA, 19 nt, Homo sapiens
gcuggaguguaguggcaca

SEQ ID NO: 2103978 - RNA, 18 nt, Homo sapiens
ggcuccugagugucauga

SEQ ID NO: 2103979 - RNA, 21 nt, Homo sapiens
gagcuuugagacaggugccug

SEQ ID NO: 2103980 - RNA, 20 nt, Homo sapiens
aaaacaaaugggaaaauguc

SEQ ID NO: 2103981 - RNA, 20 nt, Homo sapiens
cuuaaguuucucagcuccca

SEQ ID NO: 2103982 - RNA, 16 nt, Homo sapiens
ucaucacuaguggcaa

SEQ ID NO: 2103983 - RNA, 15 nt, Homo sapiens
ugcuucuugugaagg

SEQ ID NO: 2103984 - RNA, 14 nt, Homo sapiens
uuugcaauuggaau

SEQ ID NO: 2103985 - RNA, 17 nt, Homo sapiens
gugugaacaaauggaaa

SEQ ID NO: 2103986 - RNA, 14 nt, Homo sapiens
ucaagauguuauau

SEQ ID NO: 2103987 - RNA, 21 nt, Homo sapiens
ccacgcugauaauaugcaaau

SEQ ID NO: 2103988 - RNA, 17 nt, Homo sapiens
agcucuuccgaaaacca

SEQ ID NO: 2103989 - RNA, 22 nt, Homo sapiens
ucccuugcuuuucccucuuuuc

SEQ ID NO: 2103990 - RNA, 19 nt, Homo sapiens
caggccccgaggacccaga

SEQ ID NO: 2103991 - RNA, 13 nt, Homo sapiens
aacauuucugcca

SEQ ID NO: 2103992 - RNA, 21 nt, Homo sapiens
augcugaacugaaggcucaga

SEQ ID NO: 2103993 - RNA, 16 nt, Homo sapiens
gacuagccaucucaag

SEQ ID NO: 2103994 - RNA, 19 nt, Homo sapiens
ugaguagagagcaagggaa

SEQ ID NO: 2103995 - RNA, 13 nt, Homo sapiens
ucagacaggcaaa

SEQ ID NO: 2103996 - RNA, 20 nt, Homo sapiens
ccugcauagucuguuccuuu

SEQ ID NO: 2103997 - RNA, 19 nt, Homo sapiens
cucuuggccuuugcauuua

SEQ ID NO: 2103998 - RNA, 16 nt, Homo sapiens
ucucaaccaccuuuca

SEQ ID NO: 2103999 - RNA, 15 nt, Homo sapiens
gaaggucucaugccu

SEQ ID NO: 2104000 - RNA, 14 nt, Homo sapiens
aucucauggcuuug

SEQ ID NO: 2104001 - RNA, 22 nt, Homo sapiens
uuacagacugaaaggugugaac

SEQ ID NO: 2104002 - RNA, 23 nt, Homo sapiens
ucucuuagaagccaugggaccuc

SEQ ID NO: 2104003 - RNA, 21 nt, Homo sapiens
uaauuagcauggccacaucug

SEQ ID NO: 2104004 - RNA, 17 nt, Homo sapiens
cauugaaaacaacaaaa

SEQ ID NO: 2104005 - RNA, 16 nt, Homo sapiens
agagauggucaauuaa

SEQ ID NO: 2104006 - RNA, 20 nt, Homo sapiens
cuugccucugcucugugcac

SEQ ID NO: 2104007 - RNA, 20 nt, Homo sapiens
aucaaugcccaacagggcaa

SEQ ID NO: 2104008 - RNA, 12 nt, Homo sapiens
auguauuugcaa

SEQ ID NO: 2104009 - RNA, 15 nt, Homo sapiens
cucucucucaccuac

SEQ ID NO: 2104010 - RNA, 13 nt, Homo sapiens
cagccacugaggg

SEQ ID NO: 2104011 - RNA, 17 nt, Homo sapiens
ucagaaagucaccagga

SEQ ID NO: 2104012 - RNA, 21 nt, Homo sapiens
gcggcgccuccuucuaccacu

SEQ ID NO: 2104013 - RNA, 14 nt, Homo sapiens
ugcacuggggccac

SEQ ID NO: 2104014 - RNA, 22 nt, Homo sapiens
ccccacugacacccaguguccu

SEQ ID NO: 2104015 - RNA, 19 nt, Homo sapiens
cccagugcgugaagaccaa

SEQ ID NO: 2104016 - RNA, 21 nt, Homo sapiens
ucauuaagcgggaucccagca

SEQ ID NO: 2104017 - RNA, 14 nt, Homo sapiens
ccucugaacccccu

SEQ ID NO: 2104018 - RNA, 22 nt, Homo sapiens
ggaaauagcuucaggauacugu

SEQ ID NO: 2104019 - RNA, 21 nt, Homo sapiens
cucauccaaaaagucugagcg

SEQ ID NO: 2104020 - RNA, 17 nt, Homo sapiens
ccuucuuuaaggcauag

SEQ ID NO: 2104021 - RNA, 19 nt, Homo sapiens
cacuuaugauuucaugugc

SEQ ID NO: 2104022 - RNA, 16 nt, Homo sapiens
auggcuaguaucaaaa

SEQ ID NO: 2104023 - RNA, 22 nt, Homo sapiens
ugacccggccucucugccccac

SEQ ID NO: 2104024 - RNA, 23 nt, Homo sapiens
gaguggggaaaacagaccgugaa

SEQ ID NO: 2104025 - RNA, 18 nt, Homo sapiens
uacuuugauaucugauca

SEQ ID NO: 2104026 - RNA, 16 nt, Homo sapiens
acaggagaaucucuug

SEQ ID NO: 2104027 - RNA, 19 nt, Homo sapiens
aaucaaucauuucuauuaa

SEQ ID NO: 2104028 - RNA, 23 nt, Homo sapiens
ccccaccucggcacacacugugc

SEQ ID NO: 2104029 - RNA, 16 nt, Homo sapiens
gccuucugaccugggc

SEQ ID NO: 2104030 - RNA, 18 nt, Homo sapiens
uuccuauguauucugggu

SEQ ID NO: 2104031 - RNA, 18 nt, Homo sapiens
gggugggccagauccaaa

SEQ ID NO: 2104032 - RNA, 19 nt, Homo sapiens
cauuauuucagugugcaua

SEQ ID NO: 2104033 - RNA, 19 nt, Homo sapiens
ucacaugaggaauguacuu

SEQ ID NO: 2104034 - RNA, 17 nt, Homo sapiens
ccagccucagugcagcc

SEQ ID NO: 2104035 - RNA, 20 nt, Homo sapiens
ucuggcccuguugugggggu

SEQ ID NO: 2104036 - RNA, 17 nt, Homo sapiens
aaaugaucgcuaucuag

SEQ ID NO: 2104037 - RNA, 13 nt, Homo sapiens
uucagggagacaa

SEQ ID NO: 2104038 - RNA, 20 nt, Homo sapiens
uauuauucaaaccaauuucu

SEQ ID NO: 2104039 - RNA, 14 nt, Homo sapiens
gagcacccugccca

SEQ ID NO: 2104040 - RNA, 14 nt, Homo sapiens
auguugcuucuuga

SEQ ID NO: 2104041 - RNA, 19 nt, Homo sapiens
uaagccacgaggugcagua

SEQ ID NO: 2104042 - RNA, 18 nt, Homo sapiens
caucagccauuugccauc

SEQ ID NO: 2104043 - RNA, 14 nt, Homo sapiens
acaaaacccuuucu

SEQ ID NO: 2104044 - RNA, 19 nt, Homo sapiens
agacuguugaguuaugaua

SEQ ID NO: 2104045 - RNA, 17 nt, Homo sapiens
gccuggaguacuuuuag

SEQ ID NO: 2104046 - RNA, 16 nt, Homo sapiens
cuccuccguggcacau

SEQ ID NO: 2104047 - RNA, 22 nt, Homo sapiens
auuuuaaguaaaagucuaccug

SEQ ID NO: 2104048 - RNA, 18 nt, Homo sapiens
cauucugcauugcuagau

SEQ ID NO: 2104049 - RNA, 17 nt, Homo sapiens
ggcuacccuaaagggag

SEQ ID NO: 2104050 - RNA, 18 nt, Homo sapiens
accaaacggaacucuuca

SEQ ID NO: 2104051 - RNA, 14 nt, Homo sapiens
aauguuuacagugg

SEQ ID NO: 2104052 - RNA, 15 nt, Homo sapiens
augugcaguuuaauc

SEQ ID NO: 2104053 - RNA, 17 nt, Homo sapiens
uucguuuuuuuggucac

SEQ ID NO: 2104054 - RNA, 15 nt, Homo sapiens
uuacagaaaugccaa

SEQ ID NO: 2104055 - RNA, 16 nt, Homo sapiens
auaaaguugcugugaa

SEQ ID NO: 2104056 - RNA, 14 nt, Homo sapiens
caagaugugacaug

SEQ ID NO: 2104057 - RNA, 17 nt, Homo sapiens
gucacuguacaguuuug

SEQ ID NO: 2104058 - RNA, 20 nt, Homo sapiens
caugguggcgcaugccugua

SEQ ID NO: 2104059 - RNA, 16 nt, Homo sapiens
cuaguuuuauacaaag

SEQ ID NO: 2104060 - RNA, 17 nt, Homo sapiens
acaccagggaugguacu

SEQ ID NO: 2104061 - RNA, 23 nt, Homo sapiens
aaacuggaaugcuguuacuuuga

SEQ ID NO: 2104062 - RNA, 23 nt, Homo sapiens
uaguuaacauaguaaguucagca

SEQ ID NO: 2104063 - RNA, 20 nt, Homo sapiens
aaacugaagcugcacagugu

SEQ ID NO: 2104064 - RNA, 20 nt, Homo sapiens
ugguuuguuuucuacauuga

SEQ ID NO: 2104065 - RNA, 15 nt, Homo sapiens
acgccuccuggccag

SEQ ID NO: 2104066 - RNA, 18 nt, Homo sapiens
gcuaguuuucacauucuu

SEQ ID NO: 2104067 - RNA, 19 nt, Homo sapiens
ugcccagagugacagcugu

SEQ ID NO: 2104068 - RNA, 18 nt, Homo sapiens
ucuuuacugcacucagau

SEQ ID NO: 2104069 - RNA, 17 nt, Homo sapiens
auuaaauucacaugcag

SEQ ID NO: 2104070 - RNA, 22 nt, Homo sapiens
auuguauucucauaauacugaa

SEQ ID NO: 2104071 - RNA, 14 nt, Homo sapiens
agcggugggcugcc

SEQ ID NO: 2104072 - RNA, 13 nt, Homo sapiens
auaacagguuuaa

SEQ ID NO: 2104073 - RNA, 23 nt, Homo sapiens
uaaaaugugauuuuucuucaggu

SEQ ID NO: 2104074 - RNA, 24 nt, Homo sapiens
cugaucugcggaucucagcuuuga

SEQ ID NO: 2104075 - RNA, 17 nt, Homo sapiens
gauucauggcuuuaaca

SEQ ID NO: 2104076 - RNA, 18 nt, Homo sapiens
caaguggugccuaaaguu

SEQ ID NO: 2104077 - RNA, 16 nt, Homo sapiens
cagggccaccauuguc

SEQ ID NO: 2104078 - RNA, 14 nt, Homo sapiens
cucucccaacucaa

SEQ ID NO: 2104079 - RNA, 22 nt, Homo sapiens
acaaacacacgaggagcaugca

SEQ ID NO: 2104080 - RNA, 22 nt, Homo sapiens
cccugagcuuuggugcaucuca

SEQ ID NO: 2104081 - RNA, 16 nt, Homo sapiens
auuccucauucugcau

SEQ ID NO: 2104082 - RNA, 23 nt, Homo sapiens
cagaauauguuucaaacuuugga

SEQ ID NO: 2104083 - RNA, 14 nt, Homo sapiens
auucuauaagagac

SEQ ID NO: 2104084 - RNA, 16 nt, Homo sapiens
gcugagggagaccccc

SEQ ID NO: 2104085 - RNA, 19 nt, Homo sapiens
cagaguggcuuccaucuca

SEQ ID NO: 2104086 - RNA, 17 nt, Homo sapiens
uuuucauuuaacuuuau

SEQ ID NO: 2104087 - RNA, 13 nt, Homo sapiens
agucucaccuuca

SEQ ID NO: 2104088 - RNA, 20 nt, Homo sapiens
agugcaugcauugagcugcc

SEQ ID NO: 2104089 - RNA, 17 nt, Homo sapiens
uaaaccuaauaaucuga

SEQ ID NO: 2104090 - RNA, 12 nt, Homo sapiens
ggacaucucuag

SEQ ID NO: 2104091 - RNA, 15 nt, Homo sapiens
cccuaaagaucuucu

SEQ ID NO: 2104092 - RNA, 17 nt, Homo sapiens
aucucuguugcaccuga

SEQ ID NO: 2104093 - RNA, 20 nt, Homo sapiens
gucauuucauugcacuggaa

SEQ ID NO: 2104094 - RNA, 13 nt, Homo sapiens
gcgggagaccccu

SEQ ID NO: 2104095 - RNA, 18 nt, Homo sapiens
uuuaaaaaacaugaaugu

SEQ ID NO: 2104096 - RNA, 22 nt, Homo sapiens
aucucuuuugcgaaccuuucag

SEQ ID NO: 2104097 - RNA, 22 nt, Homo sapiens
aguccagacacuuaacucaauu

SEQ ID NO: 2104098 - RNA, 21 nt, Homo sapiens
ccagagacuuggggaccagag

SEQ ID NO: 2104099 - RNA, 15 nt, Homo sapiens
accggggaagggcau

SEQ ID NO: 2104100 - RNA, 21 nt, Homo sapiens
gccuguuuuguuggcucuuuc

SEQ ID NO: 2104101 - RNA, 17 nt, Homo sapiens
cugggacacaaccacua

SEQ ID NO: 2104102 - RNA, 11 nt, Homo sapiens
aaauauucucu

SEQ ID NO: 2104103 - RNA, 15 nt, Homo sapiens
ggcuucuccagggaa

SEQ ID NO: 2104104 - RNA, 20 nt, Homo sapiens
uugcgucaggagcagcauca

SEQ ID NO: 2104105 - RNA, 13 nt, Homo sapiens
gccauugaccacc

SEQ ID NO: 2104106 - RNA, 19 nt, Homo sapiens
aaacaugcuaaauaguucu

SEQ ID NO: 2104107 - RNA, 14 nt, Homo sapiens
gaauuaaccuggug

SEQ ID NO: 2104108 - RNA, 19 nt, Homo sapiens
auuuugggcuggauaaaua

SEQ ID NO: 2104109 - RNA, 16 nt, Homo sapiens
gagcagccaccccaug

SEQ ID NO: 2104110 - RNA, 21 nt, Homo sapiens
accauuaacuccuccugagcu

SEQ ID NO: 2104111 - RNA, 19 nt, Homo sapiens
aucagccucgcucuugucu

SEQ ID NO: 2104112 - RNA, 15 nt, Homo sapiens
caagcucccaaggga

SEQ ID NO: 2104113 - RNA, 14 nt, Homo sapiens
cugauagcuuacac

SEQ ID NO: 2104114 - RNA, 14 nt, Homo sapiens
uugauagcacacau

SEQ ID NO: 2104115 - RNA, 13 nt, Homo sapiens
aggcgaugugcaa

SEQ ID NO: 2104116 - RNA, 10 nt, Homo sapiens
uaaugccuuc

SEQ ID NO: 2104117 - RNA, 18 nt, Homo sapiens
agaugaaaccgucccuga

SEQ ID NO: 2104118 - RNA, 13 nt, Homo sapiens
cuuggaugugguu

SEQ ID NO: 2104119 - RNA, 23 nt, Homo sapiens
ucuugaucagugugcuaaccuca

SEQ ID NO: 2104120 - RNA, 22 nt, Homo sapiens
auuccugcuggccccuucuggg

SEQ ID NO: 2104121 - RNA, 19 nt, Homo sapiens
uacacacacagaugcacac

SEQ ID NO: 2104122 - RNA, 19 nt, Homo sapiens
ucuuuggaaaguacacucu

SEQ ID NO: 2104123 - RNA, 11 nt, Homo sapiens
agcuucuugcu

SEQ ID NO: 2104124 - RNA, 16 nt, Homo sapiens
agccaaagagcucuuu

SEQ ID NO: 2104125 - RNA, 15 nt, Homo sapiens
ugauuaagcuuuugu

SEQ ID NO: 2104126 - RNA, 17 nt, Homo sapiens
agacaauuucacaugga

SEQ ID NO: 2104127 - RNA, 19 nt, Homo sapiens
aacacccgacuccucaaaa

SEQ ID NO: 2104128 - RNA, 20 nt, Homo sapiens
cagccugcucuagugggaca

SEQ ID NO: 2104129 - RNA, 15 nt, Homo sapiens
uacagacguaugcuu

SEQ ID NO: 2104130 - RNA, 22 nt, Homo sapiens
agcagcccugcucuggggugcu

SEQ ID NO: 2104131 - RNA, 13 nt, Homo sapiens
cuucaucagugug

SEQ ID NO: 2104132 - RNA, 18 nt, Homo sapiens
aguccuggaugauacuaa

SEQ ID NO: 2104133 - RNA, 16 nt, Homo sapiens
gaagacccaguguaaa

SEQ ID NO: 2104134 - RNA, 20 nt, Homo sapiens
uuucucuaacuccugccauu

SEQ ID NO: 2104135 - RNA, 18 nt, Homo sapiens
guugccagcucccaugua

SEQ ID NO: 2104136 - RNA, 18 nt, Homo sapiens
uaccccaggaugcaugca

SEQ ID NO: 2104137 - RNA, 20 nt, Homo sapiens
ucaacguuuuuggacacugu

SEQ ID NO: 2104138 - RNA, 16 nt, Homo sapiens
cugggcucacugcagg

SEQ ID NO: 2104139 - RNA, 15 nt, Homo sapiens
ucgguggcauuugcu

SEQ ID NO: 2104140 - RNA, 17 nt, Homo sapiens
ucagugauuuggaugaa

SEQ ID NO: 2104141 - RNA, 19 nt, Homo sapiens
acccaguguuggucugugu

SEQ ID NO: 2104142 - RNA, 20 nt, Homo sapiens
augcauauagugacaguaua

SEQ ID NO: 2104143 - RNA, 13 nt, Homo sapiens
aggcaaaggcaga

SEQ ID NO: 2104144 - RNA, 14 nt, Homo sapiens
uggacuacacaaua

SEQ ID NO: 2104145 - RNA, 20 nt, Homo sapiens
cuugucagacauaaagccau

SEQ ID NO: 2104146 - RNA, 18 nt, Homo sapiens
uaaaacaauacaucaaca

SEQ ID NO: 2104147 - RNA, 22 nt, Homo sapiens
ccucuuugagggaggggagcua

SEQ ID NO: 2104148 - RNA, 20 nt, Homo sapiens
ugaaaggggggaaccaguga

SEQ ID NO: 2104149 - RNA, 21 nt, Homo sapiens
aaacccauaaguuuaacugua

SEQ ID NO: 2104150 - RNA, 16 nt, Homo sapiens
auuugaucacuacaag

SEQ ID NO: 2104151 - RNA, 11 nt, Homo sapiens
gggcuguguuu

SEQ ID NO: 2104152 - RNA, 20 nt, Homo sapiens
cccucugcauugaccuggag

SEQ ID NO: 2104153 - RNA, 21 nt, Homo sapiens
uucauaagguaauucauggca

SEQ ID NO: 2104154 - RNA, 15 nt, Homo sapiens
gcauuuuucugggag

SEQ ID NO: 2104155 - RNA, 22 nt, Homo sapiens
uuuucaauuuugcaugcucgau

SEQ ID NO: 2104156 - RNA, 14 nt, Homo sapiens
agacugcuacaggu

SEQ ID NO: 2104157 - RNA, 17 nt, Homo sapiens
uuccugguuugacucag

SEQ ID NO: 2104158 - RNA, 17 nt, Homo sapiens
gcaacccuaacaguaag

SEQ ID NO: 2104159 - RNA, 22 nt, Homo sapiens
gagaaguauccaauuaugugac

SEQ ID NO: 2104160 - RNA, 21 nt, Homo sapiens
agggucccccuucguggagcu

SEQ ID NO: 2104161 - RNA, 17 nt, Homo sapiens
ugccugcugggcucuua

SEQ ID NO: 2104162 - RNA, 19 nt, Homo sapiens
uuaggaaauacgugauuaa

SEQ ID NO: 2104163 - RNA, 23 nt, Homo sapiens
uuauauaaagguggugggcaaaa

SEQ ID NO: 2104164 - RNA, 19 nt, Homo sapiens
agcguuccaaguuccccau

SEQ ID NO: 2104165 - RNA, 17 nt, Homo sapiens
auaaguguuugucauau

SEQ ID NO: 2104166 - RNA, 20 nt, Homo sapiens
cucaguguccucaucuguaa

SEQ ID NO: 2104167 - RNA, 15 nt, Homo sapiens
agacaaaacuagaga

SEQ ID NO: 2104168 - RNA, 16 nt, Homo sapiens
ccaagugugaccccac

SEQ ID NO: 2104169 - RNA, 15 nt, Homo sapiens
ucugccuucugcuga

SEQ ID NO: 2104170 - RNA, 23 nt, Homo sapiens
cuuagaauuuuggguauuguaau

SEQ ID NO: 2104171 - RNA, 13 nt, Homo sapiens
agauacuuuucau

SEQ ID NO: 2104172 - RNA, 22 nt, Homo sapiens
ugcugugaugugcaaaggcauc

SEQ ID NO: 2104173 - RNA, 14 nt, Homo sapiens
gcauauuguauuac

SEQ ID NO: 2104174 - RNA, 20 nt, Homo sapiens
auuguauacuaccauaguga

SEQ ID NO: 2104175 - RNA, 23 nt, Homo sapiens
ugauuacauggauacuucuaaaa

SEQ ID NO: 2104176 - RNA, 12 nt, Homo sapiens
uacuauugcuag

SEQ ID NO: 2104177 - RNA, 13 nt, Homo sapiens
accuucaggaaau

SEQ ID NO: 2104178 - RNA, 21 nt, Homo sapiens
auaaagcuuauucuuugucca

SEQ ID NO: 2104179 - RNA, 14 nt, Homo sapiens
cuugauuuuagccu

SEQ ID NO: 2104180 - RNA, 20 nt, Homo sapiens
agaggugaaugcacagugaa

SEQ ID NO: 2104181 - RNA, 18 nt, Homo sapiens
acaugcccuguguggcug

SEQ ID NO: 2104182 - RNA, 13 nt, Homo sapiens
ccggggaagggaa

SEQ ID NO: 2104183 - RNA, 14 nt, Homo sapiens
acaauuuucauccc

SEQ ID NO: 2104184 - RNA, 15 nt, Homo sapiens
gaguuugcuuucaaa

SEQ ID NO: 2104185 - RNA, 18 nt, Homo sapiens
uggaagauugagagccca

SEQ ID NO: 2104186 - RNA, 22 nt, Homo sapiens
cagccucuuccuccccauguca

SEQ ID NO: 2104187 - RNA, 18 nt, Homo sapiens
cggagccccugaaagccu

SEQ ID NO: 2104188 - RNA, 22 nt, Homo sapiens
guaccccuaaaaagauugccaa

SEQ ID NO: 2104189 - RNA, 15 nt, Homo sapiens
uaauuucauguguau

SEQ ID NO: 2104190 - RNA, 15 nt, Homo sapiens
uugacaggaaccuua

SEQ ID NO: 2104191 - RNA, 12 nt, Homo sapiens
gccuuaaauaua

SEQ ID NO: 2104192 - RNA, 21 nt, Homo sapiens
uuccuacauuuugaaggugau

SEQ ID NO: 2104193 - RNA, 19 nt, Homo sapiens
uuauuaaagguaugcauuu

SEQ ID NO: 2104194 - RNA, 15 nt, Homo sapiens
cccuccccagagcac

SEQ ID NO: 2104195 - RNA, 15 nt, Homo sapiens
accccgugacaaagg

SEQ ID NO: 2104196 - RNA, 16 nt, Homo sapiens
ccugagcgagugucca

SEQ ID NO: 2104197 - RNA, 16 nt, Homo sapiens
cuacagguaugugcca

SEQ ID NO: 2104198 - RNA, 12 nt, Homo sapiens
ggcaaaauaugg

SEQ ID NO: 2104199 - RNA, 22 nt, Homo sapiens
uuauuuacaaauguuuugcuca

SEQ ID NO: 2104200 - RNA, 16 nt, Homo sapiens
gauuggaauaacccaa

SEQ ID NO: 2104201 - RNA, 17 nt, Homo sapiens
ugccuagugcuacagau

SEQ ID NO: 2104202 - RNA, 19 nt, Homo sapiens
ucucuccacugugcuuuca

SEQ ID NO: 2104203 - RNA, 15 nt, Homo sapiens
ccucacugauauauu

SEQ ID NO: 2104204 - RNA, 21 nt, Homo sapiens
uagccugcagccucaucauuu

SEQ ID NO: 2104205 - RNA, 19 nt, Homo sapiens
ucuauaauuuugccuuuaa

SEQ ID NO: 2104206 - RNA, 13 nt, Homo sapiens
gcacaguaggaau

SEQ ID NO: 2104207 - RNA, 10 nt, Homo sapiens
accaccaguu

SEQ ID NO: 2104208 - RNA, 17 nt, Homo sapiens
gucccuugcugugagca

SEQ ID NO: 2104209 - RNA, 13 nt, Homo sapiens
gagagggggccac

SEQ ID NO: 2104210 - RNA, 17 nt, Homo sapiens
uguauuucaaauaucua

SEQ ID NO: 2104211 - RNA, 18 nt, Homo sapiens
gcaccaggggugcacaau

SEQ ID NO: 2104212 - RNA, 19 nt, Homo sapiens
augaauugcauuuuacuuu

SEQ ID NO: 2104213 - RNA, 17 nt, Homo sapiens
aggggugauuucagaga

SEQ ID NO: 2104214 - RNA, 14 nt, Homo sapiens
caguaagugugaau

SEQ ID NO: 2104215 - RNA, 22 nt, Homo sapiens
gagggcgccaucuauggugugg

SEQ ID NO: 2104216 - RNA, 19 nt, Homo sapiens
ugaaauucugaauuugcaa

SEQ ID NO: 2104217 - RNA, 16 nt, Homo sapiens
ucaugauggagacuuc

SEQ ID NO: 2104218 - RNA, 12 nt, Homo sapiens
ugucaucucucu

SEQ ID NO: 2104219 - RNA, 17 nt, Homo sapiens
aggcuauagcugggaac

SEQ ID NO: 2104220 - RNA, 18 nt, Homo sapiens
ucgaauuaguuugcacuu

SEQ ID NO: 2104221 - RNA, 21 nt, Homo sapiens
ccugcaguuauuaacacuaac

SEQ ID NO: 2104222 - RNA, 22 nt, Homo sapiens
aauauuguuuuugcaccagacg

SEQ ID NO: 2104223 - RNA, 23 nt, Homo sapiens
gcaucucagcggggcgcacaugu

SEQ ID NO: 2104224 - RNA, 14 nt, Homo sapiens
cuaacccucuguca

SEQ ID NO: 2104225 - RNA, 16 nt, Homo sapiens
ggcaugggucgggaga

SEQ ID NO: 2104226 - RNA, 19 nt, Homo sapiens
gccucccaggagaaucacu

SEQ ID NO: 2104227 - RNA, 20 nt, Homo sapiens
ccauuuuuccucuguucaca

SEQ ID NO: 2104228 - RNA, 19 nt, Homo sapiens
aucucaauaaagugcuuua

SEQ ID NO: 2104229 - RNA, 14 nt, Homo sapiens
cauaaaacuucuga

SEQ ID NO: 2104230 - RNA, 13 nt, Homo sapiens
aauuacaguuaaa

SEQ ID NO: 2104231 - RNA, 16 nt, Homo sapiens
ugugaacugggcauuu

SEQ ID NO: 2104232 - RNA, 15 nt, Homo sapiens
aacgugcucacugug

SEQ ID NO: 2104233 - RNA, 20 nt, Homo sapiens
ugaugcauagaucccauagu

SEQ ID NO: 2104234 - RNA, 23 nt, Homo sapiens
aaacugggggauauuaugaaggg

SEQ ID NO: 2104235 - RNA, 17 nt, Homo sapiens
cuauacugcugaguucu

SEQ ID NO: 2104236 - RNA, 21 nt, Homo sapiens
uuuccaacuuuaucauggaau

SEQ ID NO: 2104237 - RNA, 16 nt, Homo sapiens
ccaggguuaaccacug

SEQ ID NO: 2104238 - RNA, 15 nt, Homo sapiens
ggucgggggggaccc

SEQ ID NO: 2104239 - RNA, 18 nt, Homo sapiens
ucccacuacuguagaaag

SEQ ID NO: 2104240 - RNA, 14 nt, Homo sapiens
uugugaucaugaga

SEQ ID NO: 2104241 - RNA, 19 nt, Homo sapiens
gagcugagugcugaaauaa

SEQ ID NO: 2104242 - RNA, 19 nt, Homo sapiens
uaaauugcuccuugacauu

SEQ ID NO: 2104243 - RNA, 19 nt, Homo sapiens
ucaccauguauuuuguaaa

SEQ ID NO: 2104244 - RNA, 20 nt, Homo sapiens
gccuggagacaaggugcuaa

SEQ ID NO: 2104245 - RNA, 14 nt, Homo sapiens
ccuccaacgggugg

SEQ ID NO: 2104246 - RNA, 21 nt, Homo sapiens
uggcagucuagggugaacaau

SEQ ID NO: 2104247 - RNA, 23 nt, Homo sapiens
aacuuucuguuggauuccaugcu

SEQ ID NO: 2104248 - RNA, 15 nt, Homo sapiens
ucuugggaaaauauc

SEQ ID NO: 2104249 - RNA, 17 nt, Homo sapiens
ccuugcggaagccauag

SEQ ID NO: 2104250 - RNA, 21 nt, Homo sapiens
ucaaccugguggcaccagaug

SEQ ID NO: 2104251 - RNA, 19 nt, Homo sapiens
ggcgguacacuacgcacug

SEQ ID NO: 2104252 - RNA, 21 nt, Homo sapiens
ugauuuaucugagucaacucc

SEQ ID NO: 2104253 - RNA, 23 nt, Homo sapiens
acauaauaauagcagugguaaaa

SEQ ID NO: 2104254 - RNA, 12 nt, Homo sapiens
cccuccuguaaa

SEQ ID NO: 2104255 - RNA, 16 nt, Homo sapiens
cagggcccaccccagc

SEQ ID NO: 2104256 - RNA, 19 nt, Homo sapiens
agaugggaaaucugccuau

SEQ ID NO: 2104257 - RNA, 21 nt, Homo sapiens
ucccaggggagccagcugcuu

SEQ ID NO: 2104258 - RNA, 16 nt, Homo sapiens
gguaugaguugcccau

SEQ ID NO: 2104259 - RNA, 13 nt, Homo sapiens
ugggaucauuuga

SEQ ID NO: 2104260 - RNA, 17 nt, Homo sapiens
uggcuugccacagcucu

SEQ ID NO: 2104261 - RNA, 21 nt, Homo sapiens
cuggaaauaacugagcacuuu

SEQ ID NO: 2104262 - RNA, 21 nt, Homo sapiens
uuauaauugguaauuggacca

SEQ ID NO: 2104263 - RNA, 16 nt, Homo sapiens
aaauguuuaccagugu

SEQ ID NO: 2104264 - RNA, 14 nt, Homo sapiens
guuaaugguuugaa

SEQ ID NO: 2104265 - RNA, 16 nt, Homo sapiens
gauaggacuuccuuaa

SEQ ID NO: 2104266 - RNA, 20 nt, Homo sapiens
caaggggugggccugugaau

SEQ ID NO: 2104267 - RNA, 18 nt, Homo sapiens
aguauuauuuuacaauca

SEQ ID NO: 2104268 - RNA, 15 nt, Homo sapiens
acgccuaugauccca

SEQ ID NO: 2104269 - RNA, 14 nt, Homo sapiens
ggaaaacucaggau

SEQ ID NO: 2104270 - RNA, 13 nt, Homo sapiens
guuugacucagua

SEQ ID NO: 2104271 - RNA, 18 nt, Homo sapiens
ggugccugccucugccau

SEQ ID NO: 2104272 - RNA, 22 nt, Homo sapiens
ucauguugaagucaaauuugga

SEQ ID NO: 2104273 - RNA, 12 nt, Homo sapiens
aucuuacauaua

SEQ ID NO: 2104274 - RNA, 20 nt, Homo sapiens
cuuccuaaugcccuaugugu

SEQ ID NO: 2104275 - RNA, 23 nt, Homo sapiens
acuccccauuaacagauggaaaa

SEQ ID NO: 2104276 - RNA, 13 nt, Homo sapiens
uugcucugaaugu

SEQ ID NO: 2104277 - RNA, 23 nt, Homo sapiens
uggaggcugcaccuacugaggau

SEQ ID NO: 2104278 - RNA, 21 nt, Homo sapiens
ugcuuaccuuguuuugccagu

SEQ ID NO: 2104279 - RNA, 17 nt, Homo sapiens
gugccuucccagacacu

SEQ ID NO: 2104280 - RNA, 20 nt, Homo sapiens
uucaugugguucagugccuu

SEQ ID NO: 2104281 - RNA, 14 nt, Homo sapiens
uucagccaagacca

SEQ ID NO: 2104282 - RNA, 15 nt, Homo sapiens
acuugccaugcagga

SEQ ID NO: 2104283 - RNA, 18 nt, Homo sapiens
ccaaagugcugggauuac

SEQ ID NO: 2104284 - RNA, 14 nt, Homo sapiens
acccaggccacuga

SEQ ID NO: 2104285 - RNA, 12 nt, Homo sapiens
ugugcuaccucu

SEQ ID NO: 2104286 - RNA, 21 nt, Homo sapiens
uaguaaauuuaaguccaccuc

SEQ ID NO: 2104287 - RNA, 19 nt, Homo sapiens
guaugaggaaaaagcgaga

SEQ ID NO: 2104288 - RNA, 23 nt, Homo sapiens
agagaauauuuuuggcauuccuc

SEQ ID NO: 2104289 - RNA, 21 nt, Homo sapiens
cuacaaaaaacugcaguuuga

SEQ ID NO: 2104290 - RNA, 14 nt, Homo sapiens
uccuuuucugucuc

SEQ ID NO: 2104291 - RNA, 13 nt, Homo sapiens
uuaguguguaaaa

SEQ ID NO: 2104292 - RNA, 18 nt, Homo sapiens
uuaacccccaaauucaaa

SEQ ID NO: 2104293 - RNA, 17 nt, Homo sapiens
uguucauccuaacauga

SEQ ID NO: 2104294 - RNA, 17 nt, Homo sapiens
gucccguggcauuucaa

SEQ ID NO: 2104295 - RNA, 14 nt, Homo sapiens
cacggacccugugu

SEQ ID NO: 2104296 - RNA, 22 nt, Homo sapiens
cacuguccaugaagcacugagc

SEQ ID NO: 2104297 - RNA, 13 nt, Homo sapiens
uugggcacagucc

SEQ ID NO: 2104298 - RNA, 21 nt, Homo sapiens
uccaauaauuuuccugugaca

SEQ ID NO: 2104299 - RNA, 21 nt, Homo sapiens
aauaaucaucccuccuugccu

SEQ ID NO: 2104300 - RNA, 22 nt, Homo sapiens
uaaaaggauuuggacugcauuu

SEQ ID NO: 2104301 - RNA, 19 nt, Homo sapiens
gcccuguccuaagcacuuu

SEQ ID NO: 2104302 - RNA, 19 nt, Homo sapiens
agaaauaaaagaagcugcu

SEQ ID NO: 2104303 - RNA, 18 nt, Homo sapiens
ggaacauagacucacucu

SEQ ID NO: 2104304 - RNA, 17 nt, Homo sapiens
guaauuccucugauucu

SEQ ID NO: 2104305 - RNA, 18 nt, Homo sapiens
gauaucuuggcuuugcca

SEQ ID NO: 2104306 - RNA, 16 nt, Homo sapiens
ccauggccaccccaga

SEQ ID NO: 2104307 - RNA, 18 nt, Homo sapiens
ccagaauuugcugcauuu

SEQ ID NO: 2104308 - RNA, 20 nt, Homo sapiens
aucuucucccuuguccugcu

SEQ ID NO: 2104309 - RNA, 23 nt, Homo sapiens
caacaaaauggucauccaaacuc

SEQ ID NO: 2104310 - RNA, 21 nt, Homo sapiens
accauccaccuucccuucuac

SEQ ID NO: 2104311 - RNA, 22 nt, Homo sapiens
ggccgccaucugcgcagggugg

SEQ ID NO: 2104312 - RNA, 17 nt, Homo sapiens
aaggcaggugccuccag

SEQ ID NO: 2104313 - RNA, 17 nt, Homo sapiens
aaccugaaccugggaac

SEQ ID NO: 2104314 - RNA, 13 nt, Homo sapiens
ccauucauuccau

SEQ ID NO: 2104315 - RNA, 13 nt, Homo sapiens
aaugaagacuguu

SEQ ID NO: 2104316 - RNA, 16 nt, Homo sapiens
gcccuguugccuugag

SEQ ID NO: 2104317 - RNA, 16 nt, Homo sapiens
cagucucagaaagccu

SEQ ID NO: 2104318 - RNA, 15 nt, Homo sapiens
cccuugugccucuca

SEQ ID NO: 2104319 - RNA, 16 nt, Homo sapiens
cagucuagugcaaaag

SEQ ID NO: 2104320 - RNA, 14 nt, Homo sapiens
ccagagccugggaa

SEQ ID NO: 2104321 - RNA, 18 nt, Homo sapiens
cugaugaaggcaugccua

SEQ ID NO: 2104322 - RNA, 14 nt, Homo sapiens
aaagaauacuuuca

SEQ ID NO: 2104323 - RNA, 17 nt, Homo sapiens
aagaucaaaacagucau

SEQ ID NO: 2104324 - RNA, 15 nt, Homo sapiens
uuagguugaaacaua

SEQ ID NO: 2104325 - RNA, 15 nt, Homo sapiens
acuaaaauucaaaaa

SEQ ID NO: 2104326 - RNA, 12 nt, Homo sapiens
agggaacauauu

SEQ ID NO: 2104327 - RNA, 23 nt, Homo sapiens
caucauccuugcuuuaccacaau

SEQ ID NO: 2104328 - RNA, 17 nt, Homo sapiens
cuuguuugguugcaaaa

SEQ ID NO: 2104329 - RNA, 15 nt, Homo sapiens
agcacacuuuuccac

SEQ ID NO: 2104330 - RNA, 22 nt, Homo sapiens
acuaaucaagaaaaacaucuuu

SEQ ID NO: 2104331 - RNA, 22 nt, Homo sapiens
ugcccaggguuggcaugacugu

SEQ ID NO: 2104332 - RNA, 22 nt, Homo sapiens
uaaaauggcagagaagaugaaa

SEQ ID NO: 2104333 - RNA, 13 nt, Homo sapiens
ugauauugcagcu

SEQ ID NO: 2104334 - RNA, 15 nt, Homo sapiens
uaggcaaaguacaaa

SEQ ID NO: 2104335 - RNA, 16 nt, Homo sapiens
accugaacucugcaac

SEQ ID NO: 2104336 - RNA, 20 nt, Homo sapiens
cauuucaccugugacaaagg

SEQ ID NO: 2104337 - RNA, 15 nt, Homo sapiens
agcuuugcacuucaa

SEQ ID NO: 2104338 - RNA, 15 nt, Homo sapiens
ucauggaaagacugg

SEQ ID NO: 2104339 - RNA, 14 nt, Homo sapiens
auaguauugugcau

SEQ ID NO: 2104340 - RNA, 17 nt, Homo sapiens
aagcaaacaucaaauaa

SEQ ID NO: 2104341 - RNA, 16 nt, Homo sapiens
uaaucuuagagacaaa

SEQ ID NO: 2104342 - RNA, 22 nt, Homo sapiens
gcugguuugcaagaaugaaaug

SEQ ID NO: 2104343 - RNA, 20 nt, Homo sapiens
aggaaacuccacaucugccu

SEQ ID NO: 2104344 - RNA, 12 nt, Homo sapiens
cauuagaccaag

SEQ ID NO: 2104345 - RNA, 13 nt, Homo sapiens
ccaggcugccuga

SEQ ID NO: 2104346 - RNA, 16 nt, Homo sapiens
agaguguggauuguau

SEQ ID NO: 2104347 - RNA, 23 nt, Homo sapiens
ccuuccugagaaacguccaucuc

SEQ ID NO: 2104348 - RNA, 21 nt, Homo sapiens
caagcugcuuuggacaacuga

SEQ ID NO: 2104349 - RNA, 21 nt, Homo sapiens
auaugcauugucugcaauggu

SEQ ID NO: 2104350 - RNA, 22 nt, Homo sapiens
cauaguggguggauuuguugcc

SEQ ID NO: 2104351 - RNA, 19 nt, Homo sapiens
agagccugugcuaaagaag

SEQ ID NO: 2104352 - RNA, 13 nt, Homo sapiens
agcagaaccaaag

SEQ ID NO: 2104353 - RNA, 19 nt, Homo sapiens
cauuucuagaacaauuaca

SEQ ID NO: 2104354 - RNA, 14 nt, Homo sapiens
aggggucugggagu

SEQ ID NO: 2104355 - RNA, 16 nt, Homo sapiens
caaggcuuuugcaaag

SEQ ID NO: 2104356 - RNA, 19 nt, Homo sapiens
uucagcaggcuagacagaa

SEQ ID NO: 2104357 - RNA, 14 nt, Homo sapiens
aaaacuucuuuaaa

SEQ ID NO: 2104358 - RNA, 14 nt, Homo sapiens
aauaauucuuaaca

SEQ ID NO: 2104359 - RNA, 14 nt, Homo sapiens
uauucaucauauau

SEQ ID NO: 2104360 - RNA, 21 nt, Homo sapiens
uccacaucaaaaaugcaucaa

SEQ ID NO: 2104361 - RNA, 17 nt, Homo sapiens
auuauucaaaugcuucu

SEQ ID NO: 2104362 - RNA, 22 nt, Homo sapiens
augguguggacugaaugggauc

SEQ ID NO: 2104363 - RNA, 23 nt, Homo sapiens
gcucugaggauguauaccccugg

SEQ ID NO: 2104364 - RNA, 23 nt, Homo sapiens
aacaccagacagacaacacuggg

SEQ ID NO: 2104365 - RNA, 17 nt, Homo sapiens
caauaaaaaccaaacuc

SEQ ID NO: 2104366 - RNA, 21 nt, Homo sapiens
uugaggucucuaacauaccuu

SEQ ID NO: 2104367 - RNA, 17 nt, Homo sapiens
uaaccuuuaagucuuac

SEQ ID NO: 2104368 - RNA, 16 nt, Homo sapiens
uuuauucccccaaagc

SEQ ID NO: 2104369 - RNA, 22 nt, Homo sapiens
uaguggucuaaucaacagauaa

SEQ ID NO: 2104370 - RNA, 22 nt, Homo sapiens
augugucccuggcgcugugcua

SEQ ID NO: 2104371 - RNA, 14 nt, Homo sapiens
gguugcauucuacu

SEQ ID NO: 2104372 - RNA, 14 nt, Homo sapiens
aggggcuacuguga

SEQ ID NO: 2104373 - RNA, 23 nt, Homo sapiens
aucagaggugaaugcacagugaa

SEQ ID NO: 2104374 - RNA, 14 nt, Homo sapiens
uguacaaguauucu

SEQ ID NO: 2104375 - RNA, 14 nt, Homo sapiens
aacauaagagcuuu

SEQ ID NO: 2104376 - RNA, 15 nt, Homo sapiens
uaugacuaugcacua

SEQ ID NO: 2104377 - RNA, 13 nt, Homo sapiens
gccuagcccuccc

SEQ ID NO: 2104378 - RNA, 15 nt, Homo sapiens
uacgaaucgaauaca

SEQ ID NO: 2104379 - RNA, 18 nt, Homo sapiens
gcgccuugcugauggcuu

SEQ ID NO: 2104380 - RNA, 16 nt, Homo sapiens
cacuuuugaggacaag

SEQ ID NO: 2104381 - RNA, 19 nt, Homo sapiens
gagaucaacacacacuccc

SEQ ID NO: 2104382 - RNA, 16 nt, Homo sapiens
ucuguacauagccuau

SEQ ID NO: 2104383 - RNA, 16 nt, Homo sapiens
gccaugcuucuugccc

SEQ ID NO: 2104384 - RNA, 21 nt, Homo sapiens
ucuggcucagggucaaagaca

SEQ ID NO: 2104385 - RNA, 23 nt, Homo sapiens
augaacuugcaaacaggcugaua

SEQ ID NO: 2104386 - RNA, 16 nt, Homo sapiens
uuucaggccacauggc

SEQ ID NO: 2104387 - RNA, 20 nt, Homo sapiens
ugaaaucucuagccucuuug

SEQ ID NO: 2104388 - RNA, 19 nt, Homo sapiens
gaaguguaguggcauccau

SEQ ID NO: 2104389 - RNA, 16 nt, Homo sapiens
cugugggcaagccuaa

SEQ ID NO: 2104390 - RNA, 21 nt, Homo sapiens
uuucuagaagcacauguguau

SEQ ID NO: 2104391 - RNA, 23 nt, Homo sapiens
uuucuaaagggaucugcuuaaag

SEQ ID NO: 2104392 - RNA, 17 nt, Homo sapiens
ugucuagggcagaguau

SEQ ID NO: 2104393 - RNA, 15 nt, Homo sapiens
ugccuuagucucagu

SEQ ID NO: 2104394 - RNA, 12 nt, Homo sapiens
auauugcucuca

SEQ ID NO: 2104395 - RNA, 13 nt, Homo sapiens
ugaaacacagcug

SEQ ID NO: 2104396 - RNA, 14 nt, Homo sapiens
uccaucuccagugg

SEQ ID NO: 2104397 - RNA, 14 nt, Homo sapiens
uaaggaggcacugc

SEQ ID NO: 2104398 - RNA, 14 nt, Homo sapiens
cuacaguacuaugu

SEQ ID NO: 2104399 - RNA, 23 nt, Homo sapiens
auuuuccaaaucuuaauucaacu

SEQ ID NO: 2104400 - RNA, 22 nt, Homo sapiens
ccuucaugccugggccugcagg

SEQ ID NO: 2104401 - RNA, 13 nt, Homo sapiens
caacaacucugau

SEQ ID NO: 2104402 - RNA, 13 nt, Homo sapiens
gaaaggugcucaa

SEQ ID NO: 2104403 - RNA, 12 nt, Homo sapiens
agcaaugguggu

SEQ ID NO: 2104404 - RNA, 23 nt, Homo sapiens
caugaguauuugcuaauguugau

SEQ ID NO: 2104405 - RNA, 15 nt, Homo sapiens
cagucaugugugcau

SEQ ID NO: 2104406 - RNA, 20 nt, Homo sapiens
uagagugccuccaggguggu

SEQ ID NO: 2104407 - RNA, 15 nt, Homo sapiens
agagggaggucacug

SEQ ID NO: 2104408 - RNA, 23 nt, Homo sapiens
uggaaucagauauuguaagcauu

SEQ ID NO: 2104409 - RNA, 15 nt, Homo sapiens
aacgcacaacaggaa

SEQ ID NO: 2104410 - RNA, 12 nt, Homo sapiens
aaaaaguaccag

SEQ ID NO: 2104411 - RNA, 17 nt, Homo sapiens
aaauaaaaaaagacaaa

SEQ ID NO: 2104412 - RNA, 17 nt, Homo sapiens
uaaaauaaaaguuuaca

SEQ ID NO: 2104413 - RNA, 17 nt, Homo sapiens
uagaaaccaaauuacaa

SEQ ID NO: 2104414 - RNA, 16 nt, Homo sapiens
cucuucccaugacugc

SEQ ID NO: 2104415 - RNA, 18 nt, Homo sapiens
aauacugccggucaccca

SEQ ID NO: 2104416 - RNA, 18 nt, Homo sapiens
agcagcccuggcucucac

SEQ ID NO: 2104417 - RNA, 22 nt, Homo sapiens
aauggugcuuuaugugagauac

SEQ ID NO: 2104418 - RNA, 18 nt, Homo sapiens
acaaagcccuuccauguc

SEQ ID NO: 2104419 - RNA, 20 nt, Homo sapiens
augggcaaauuaaggcauaa

SEQ ID NO: 2104420 - RNA, 18 nt, Homo sapiens
cuuauggggugagaauau

SEQ ID NO: 2104421 - RNA, 18 nt, Homo sapiens
gaacaucucgaauacaau

SEQ ID NO: 2104422 - RNA, 20 nt, Homo sapiens
ucucugcugccucuguggaa

SEQ ID NO: 2104423 - RNA, 18 nt, Homo sapiens
caaauauaagacauuugu

SEQ ID NO: 2104424 - RNA, 19 nt, Homo sapiens
acuccugaaggucuggguc

SEQ ID NO: 2104425 - RNA, 20 nt, Homo sapiens
auuaccuagaagugcaagaa

SEQ ID NO: 2104426 - RNA, 21 nt, Homo sapiens
uccuucaauaaccaugaugac

SEQ ID NO: 2104427 - RNA, 16 nt, Homo sapiens
acuaaaguagagcccu

SEQ ID NO: 2104428 - RNA, 14 nt, Homo sapiens
aaagguuggccuua

SEQ ID NO: 2104429 - RNA, 22 nt, Homo sapiens
gauuaccugaaggacagcugaa

SEQ ID NO: 2104430 - RNA, 13 nt, Homo sapiens
cccaccccaucca

SEQ ID NO: 2104431 - RNA, 12 nt, Homo sapiens
agcccaaccucu

SEQ ID NO: 2104432 - RNA, 18 nt, Homo sapiens
uacuguaauagugugauu

SEQ ID NO: 2104433 - RNA, 15 nt, Homo sapiens
cuuagggacagucaa

SEQ ID NO: 2104434 - RNA, 17 nt, Homo sapiens
agagugucucugauaaa

SEQ ID NO: 2104435 - RNA, 19 nt, Homo sapiens
uccucgcacugcccaggga

SEQ ID NO: 2104436 - RNA, 15 nt, Homo sapiens
acccauaaucugcuu

SEQ ID NO: 2104437 - RNA, 14 nt, Homo sapiens
ccguguucaaagag

SEQ ID NO: 2104438 - RNA, 22 nt, Homo sapiens
cuggaauaaacagugagcauau

SEQ ID NO: 2104439 - RNA, 18 nt, Homo sapiens
aaaaucgagccucuccca

SEQ ID NO: 2104440 - RNA, 17 nt, Homo sapiens
uccagaucacugccaca

SEQ ID NO: 2104441 - RNA, 21 nt, Homo sapiens
ccacagagagggagagcagag

SEQ ID NO: 2104442 - RNA, 23 nt, Homo sapiens
cagaccgcuccccaauacucucc

SEQ ID NO: 2104443 - RNA, 12 nt, Homo sapiens
auacaaucagcc

SEQ ID NO: 2104444 - RNA, 16 nt, Homo sapiens
gcaggaagugguggca

SEQ ID NO: 2104445 - RNA, 14 nt, Homo sapiens
cugauuaugaaaug

SEQ ID NO: 2104446 - RNA, 18 nt, Homo sapiens
caaguagcauuuacugug

SEQ ID NO: 2104447 - RNA, 15 nt, Homo sapiens
aggcaaaguacaaaa

SEQ ID NO: 2104448 - RNA, 17 nt, Homo sapiens
cuguguaauauaaaaga

SEQ ID NO: 2104449 - RNA, 22 nt, Homo sapiens
cgaaauuaaaucugaauaaaua

SEQ ID NO: 2104450 - RNA, 14 nt, Homo sapiens
cugcuucucggggu

SEQ ID NO: 2104451 - RNA, 18 nt, Homo sapiens
gaccaucacaucccuuca

SEQ ID NO: 2104452 - RNA, 13 nt, Homo sapiens
gcccagacuuuag

SEQ ID NO: 2104453 - RNA, 23 nt, Homo sapiens
uucucuucuggacauguccagga

SEQ ID NO: 2104454 - RNA, 13 nt, Homo sapiens
aaaaauucaugca

SEQ ID NO: 2104455 - RNA, 18 nt, Homo sapiens
gaaaaacugcucauauga

SEQ ID NO: 2104456 - RNA, 14 nt, Homo sapiens
ugcccuuccuccag

SEQ ID NO: 2104457 - RNA, 23 nt, Homo sapiens
gcacuugcugaggccaagccacu

SEQ ID NO: 2104458 - RNA, 20 nt, Homo sapiens
ccccaacuacccccagcugu

SEQ ID NO: 2104459 - RNA, 19 nt, Homo sapiens
cuuuucuuacaguaacuga

SEQ ID NO: 2104460 - RNA, 17 nt, Homo sapiens
aaguauuugaucaguaa

SEQ ID NO: 2104461 - RNA, 12 nt, Homo sapiens
uaaaugugauau

SEQ ID NO: 2104462 - RNA, 22 nt, Homo sapiens
aauugcuucuucuucaagauuu

SEQ ID NO: 2104463 - RNA, 17 nt, Homo sapiens
gccacaggggauucuua

SEQ ID NO: 2104464 - RNA, 22 nt, Homo sapiens
ugcuccuaccccuguccugggg

SEQ ID NO: 2104465 - RNA, 22 nt, Homo sapiens
uaaaugcuucauuuguauguca

SEQ ID NO: 2104466 - RNA, 18 nt, Homo sapiens
auuuuacaggugcgaaug

SEQ ID NO: 2104467 - RNA, 17 nt, Homo sapiens
uccccgagaacuuucug

SEQ ID NO: 2104468 - RNA, 16 nt, Homo sapiens
cccuccccucguguca

SEQ ID NO: 2104469 - RNA, 13 nt, Homo sapiens
uuagaaacaguga

SEQ ID NO: 2104470 - RNA, 13 nt, Homo sapiens
ccacacacagcua

SEQ ID NO: 2104471 - RNA, 19 nt, Homo sapiens
caaucuuauugucaacacu

SEQ ID NO: 2104472 - RNA, 22 nt, Homo sapiens
ccacuccccccauaucuuuaaa

SEQ ID NO: 2104473 - RNA, 20 nt, Homo sapiens
ugccaaaucuggcuccuuua

SEQ ID NO: 2104474 - RNA, 14 nt, Homo sapiens
ucuccugggacaac

SEQ ID NO: 2104475 - RNA, 18 nt, Homo sapiens
cuucguacauagucuguu

SEQ ID NO: 2104476 - RNA, 13 nt, Homo sapiens
gaggacuuuggua

SEQ ID NO: 2104477 - RNA, 17 nt, Homo sapiens
aguugcauaagcauugc

SEQ ID NO: 2104478 - RNA, 17 nt, Homo sapiens
aaccccuccucccucag

SEQ ID NO: 2104479 - RNA, 23 nt, Homo sapiens
aaaacauuuuacuuuaaaaggag

SEQ ID NO: 2104480 - RNA, 23 nt, Homo sapiens
aauuauguagcucuuugucaggg

SEQ ID NO: 2104481 - RNA, 13 nt, Homo sapiens
ugcccaacuccca

SEQ ID NO: 2104482 - RNA, 14 nt, Homo sapiens
acucuggggcuugu

SEQ ID NO: 2104483 - RNA, 17 nt, Homo sapiens
ucccccugcuugucuuc

SEQ ID NO: 2104484 - RNA, 15 nt, Homo sapiens
auguucuccacugac

SEQ ID NO: 2104485 - RNA, 18 nt, Homo sapiens
aauauucagccagcuuaa

SEQ ID NO: 2104486 - RNA, 13 nt, Homo sapiens
ccaugaagugugu

SEQ ID NO: 2104487 - RNA, 21 nt, Homo sapiens
gaaacagcuccccaccaacca

SEQ ID NO: 2104488 - RNA, 18 nt, Homo sapiens
ugcaauaccaauguucua

SEQ ID NO: 2104489 - RNA, 21 nt, Homo sapiens
uaccaguauaauugaguuuuc

SEQ ID NO: 2104490 - RNA, 21 nt, Homo sapiens
acaagccagucugccucuucc

SEQ ID NO: 2104491 - RNA, 17 nt, Homo sapiens
uaagcuauuuugguuua

SEQ ID NO: 2104492 - RNA, 22 nt, Homo sapiens
cauguauguggauacagucauu

SEQ ID NO: 2104493 - RNA, 14 nt, Homo sapiens
uauuuaaaaguaua

SEQ ID NO: 2104494 - RNA, 14 nt, Homo sapiens
aguugauucagcuc

SEQ ID NO: 2104495 - RNA, 22 nt, Homo sapiens
ucuuuagaaggacucaguauua

SEQ ID NO: 2104496 - RNA, 14 nt, Homo sapiens
cagagcugugccug

SEQ ID NO: 2104497 - RNA, 13 nt, Homo sapiens
cccugcaaccaac

SEQ ID NO: 2104498 - RNA, 13 nt, Homo sapiens
caugccacaaaua

SEQ ID NO: 2104499 - RNA, 13 nt, Homo sapiens
ucaagcaauccuc

SEQ ID NO: 2104500 - RNA, 13 nt, Homo sapiens
cagaugcaguuug

SEQ ID NO: 2104501 - RNA, 17 nt, Homo sapiens
aggguguguacugcaca

SEQ ID NO: 2104502 - RNA, 19 nt, Homo sapiens
uaugaaauuauaaucugug

SEQ ID NO: 2104503 - RNA, 15 nt, Homo sapiens
agaagccucagcucc

SEQ ID NO: 2104504 - RNA, 18 nt, Homo sapiens
uggagggaggcucuucag

SEQ ID NO: 2104505 - RNA, 14 nt, Homo sapiens
ucucaggggugcug

SEQ ID NO: 2104506 - RNA, 16 nt, Homo sapiens
caggagggcccuaccu

SEQ ID NO: 2104507 - RNA, 19 nt, Homo sapiens
agugagaucuuacagguau

SEQ ID NO: 2104508 - RNA, 19 nt, Homo sapiens
uaaacguguaaauugcaca

SEQ ID NO: 2104509 - RNA, 15 nt, Homo sapiens
aauucgagaagcaau

SEQ ID NO: 2104510 - RNA, 20 nt, Homo sapiens
ucauaguggauuaaugcauu

SEQ ID NO: 2104511 - RNA, 20 nt, Homo sapiens
gagucucgcuauugucacca

SEQ ID NO: 2104512 - RNA, 17 nt, Homo sapiens
gagguggugccuucuca

SEQ ID NO: 2104513 - RNA, 17 nt, Homo sapiens
ucuaaaugugacaugca

SEQ ID NO: 2104514 - RNA, 14 nt, Homo sapiens
agguccauuuugcc

SEQ ID NO: 2104515 - RNA, 19 nt, Homo sapiens
cuugagacaaaucuaugcc

SEQ ID NO: 2104516 - RNA, 15 nt, Homo sapiens
accgagccucuguca

SEQ ID NO: 2104517 - RNA, 16 nt, Homo sapiens
uuaaacucaucaaugu

SEQ ID NO: 2104518 - RNA, 20 nt, Homo sapiens
uggauacuucuaaaagcuaa

SEQ ID NO: 2104519 - RNA, 19 nt, Homo sapiens
ugaggagagaaggacaugu

SEQ ID NO: 2104520 - RNA, 18 nt, Homo sapiens
gcugcagaugacuggaaa

SEQ ID NO: 2104521 - RNA, 19 nt, Homo sapiens
cacacacaaaaugcucaag

SEQ ID NO: 2104522 - RNA, 16 nt, Homo sapiens
acaccacaaaucugaa

SEQ ID NO: 2104523 - RNA, 19 nt, Homo sapiens
gccucugcuggcucaggag

SEQ ID NO: 2104524 - RNA, 12 nt, Homo sapiens
accuucuuggcu

SEQ ID NO: 2104525 - RNA, 14 nt, Homo sapiens
uacugguugcaugg

SEQ ID NO: 2104526 - RNA, 23 nt, Homo sapiens
caggaacccaucacugugucuca

SEQ ID NO: 2104527 - RNA, 20 nt, Homo sapiens
auuguuguaauugcauuaua

SEQ ID NO: 2104528 - RNA, 21 nt, Homo sapiens
ccguguggcccaagaccccca

SEQ ID NO: 2104529 - RNA, 19 nt, Homo sapiens
auauuuagcuguaaacuga

SEQ ID NO: 2104530 - RNA, 21 nt, Homo sapiens
ucuaaucaagaaaagaauuac

SEQ ID NO: 2104531 - RNA, 14 nt, Homo sapiens
uucuagugccucug

SEQ ID NO: 2104532 - RNA, 14 nt, Homo sapiens
cuuuuuugucccau

SEQ ID NO: 2104533 - RNA, 14 nt, Homo sapiens
uugucugugugcua

SEQ ID NO: 2104534 - RNA, 20 nt, Homo sapiens
gcagcuuuugcagacgggca

SEQ ID NO: 2104535 - RNA, 20 nt, Homo sapiens
uacaaugugaacuuuauuaa

SEQ ID NO: 2104536 - RNA, 23 nt, Homo sapiens
gagugucuauggagcagccggaa

SEQ ID NO: 2104537 - RNA, 19 nt, Homo sapiens
cccaagccuacuuuugcca

SEQ ID NO: 2104538 - RNA, 23 nt, Homo sapiens
ucgcuauugauuuuuacuucaau

SEQ ID NO: 2104539 - RNA, 13 nt, Homo sapiens
aaaaaaggacugu

SEQ ID NO: 2104540 - RNA, 16 nt, Homo sapiens
agucccagcuacuuga

SEQ ID NO: 2104541 - RNA, 20 nt, Homo sapiens
aaucucugaaggaucaucua

SEQ ID NO: 2104542 - RNA, 12 nt, Homo sapiens
uagccaaagagg

SEQ ID NO: 2104543 - RNA, 16 nt, Homo sapiens
gccgacagcucuccaa

SEQ ID NO: 2104544 - RNA, 15 nt, Homo sapiens
gaucagguguggcca

SEQ ID NO: 2104545 - RNA, 17 nt, Homo sapiens
gcacccucccacccggc

SEQ ID NO: 2104546 - RNA, 14 nt, Homo sapiens
agggccgugucugg

SEQ ID NO: 2104547 - RNA, 13 nt, Homo sapiens
cuccucuguaaug

SEQ ID NO: 2104548 - RNA, 22 nt, Homo sapiens
uacuaguguguguguguauaua

SEQ ID NO: 2104549 - RNA, 17 nt, Homo sapiens
ucccugaggcaggugag

SEQ ID NO: 2104550 - RNA, 22 nt, Homo sapiens
gcacaucccugcccuccuacag

SEQ ID NO: 2104551 - RNA, 14 nt, Homo sapiens
aaggaaacuuugaa

SEQ ID NO: 2104552 - RNA, 16 nt, Homo sapiens
cagaauacuugcacuc

SEQ ID NO: 2104553 - RNA, 17 nt, Homo sapiens
uaucgggaacaguguuu

SEQ ID NO: 2104554 - RNA, 19 nt, Homo sapiens
aaauagggaugaucacucu

SEQ ID NO: 2104555 - RNA, 21 nt, Homo sapiens
cauuguccuccuuuucacuuu

SEQ ID NO: 2104556 - RNA, 15 nt, Homo sapiens
uuccuaggccacguc

SEQ ID NO: 2104557 - RNA, 15 nt, Homo sapiens
guaguauuuuugcca

SEQ ID NO: 2104558 - RNA, 20 nt, Homo sapiens
cuucuuuuggcuuccaugau

SEQ ID NO: 2104559 - RNA, 20 nt, Homo sapiens
ucagcuaacaaacuagaaaa

SEQ ID NO: 2104560 - RNA, 19 nt, Homo sapiens
gcgagcgcccagcuccuga

SEQ ID NO: 2104561 - RNA, 23 nt, Homo sapiens
agaaacauuguaaauauuuacuc

SEQ ID NO: 2104562 - RNA, 16 nt, Homo sapiens
accuagggaaugaacu

SEQ ID NO: 2104563 - RNA, 18 nt, Homo sapiens
gcugcugcugcacccaac

SEQ ID NO: 2104564 - RNA, 13 nt, Homo sapiens
ucaaaagaaauaa

SEQ ID NO: 2104565 - RNA, 20 nt, Homo sapiens
agucacacuguuacuccaca

SEQ ID NO: 2104566 - RNA, 13 nt, Homo sapiens
auuggagaugcaa

SEQ ID NO: 2104567 - RNA, 17 nt, Homo sapiens
gacacuaaaaacuguua

SEQ ID NO: 2104568 - RNA, 12 nt, Homo sapiens
cguuuaaucaca

SEQ ID NO: 2104569 - RNA, 20 nt, Homo sapiens
cugaaggcagucauaucaaa

SEQ ID NO: 2104570 - RNA, 18 nt, Homo sapiens
cccucucucccugccuca

SEQ ID NO: 2104571 - RNA, 19 nt, Homo sapiens
ugucaggauaguugcucca

SEQ ID NO: 2104572 - RNA, 22 nt, Homo sapiens
aagcuuucauguaaacugugca

SEQ ID NO: 2104573 - RNA, 22 nt, Homo sapiens
uccacagcuuacagcaauuuga

SEQ ID NO: 2104574 - RNA, 16 nt, Homo sapiens
aucacuuaguucucag

SEQ ID NO: 2104575 - RNA, 22 nt, Homo sapiens
auucucaguguagggcagagag

SEQ ID NO: 2104576 - RNA, 14 nt, Homo sapiens
uugagaaacaugaa

SEQ ID NO: 2104577 - RNA, 14 nt, Homo sapiens
uuuugcaugcaugc

SEQ ID NO: 2104578 - RNA, 12 nt, Homo sapiens
uacucugaaaug

SEQ ID NO: 2104579 - RNA, 14 nt, Homo sapiens
cucauuuguuguuu

SEQ ID NO: 2104580 - RNA, 15 nt, Homo sapiens
uggaggcucuguauu

SEQ ID NO: 2104581 - RNA, 16 nt, Homo sapiens
uauuauugagcucuau

SEQ ID NO: 2104582 - RNA, 18 nt, Homo sapiens
gacaucgguucauauuaa

SEQ ID NO: 2104583 - RNA, 21 nt, Homo sapiens
aguaaaacaaacaauaccuga

SEQ ID NO: 2104584 - RNA, 22 nt, Homo sapiens
acuuuguuuagcccaaaaccaa

SEQ ID NO: 2104585 - RNA, 19 nt, Homo sapiens
uggcucgugggcucuggcu

SEQ ID NO: 2104586 - RNA, 18 nt, Homo sapiens
ugcccaaacaccagucac

SEQ ID NO: 2104587 - RNA, 20 nt, Homo sapiens
augaugcaagccagcuuccu

SEQ ID NO: 2104588 - RNA, 22 nt, Homo sapiens
uacacaacuuagaaaccaaauu

SEQ ID NO: 2104589 - RNA, 20 nt, Homo sapiens
cuuugaaauaugcauguacu

SEQ ID NO: 2104590 - RNA, 23 nt, Homo sapiens
uuaccuuuacauauuaucauguc

SEQ ID NO: 2104591 - RNA, 13 nt, Homo sapiens
cucuuccuguguu

SEQ ID NO: 2104592 - RNA, 15 nt, Homo sapiens
cuuaugucaaaugga

SEQ ID NO: 2104593 - RNA, 14 nt, Homo sapiens
ugugcucaccagua

SEQ ID NO: 2104594 - RNA, 14 nt, Homo sapiens
ccagcucaugugua

SEQ ID NO: 2104595 - RNA, 15 nt, Homo sapiens
uaggcagugcaguac

SEQ ID NO: 2104596 - RNA, 21 nt, Homo sapiens
auaugugagcacuaucuuuca

SEQ ID NO: 2104597 - RNA, 12 nt, Homo sapiens
ugcuaacaaugc

SEQ ID NO: 2104598 - RNA, 13 nt, Homo sapiens
cuggggccaccau

SEQ ID NO: 2104599 - RNA, 22 nt, Homo sapiens
cuucuccaaggagcaugucacu

SEQ ID NO: 2104600 - RNA, 17 nt, Homo sapiens
ucauaucaacuuaguca

SEQ ID NO: 2104601 - RNA, 17 nt, Homo sapiens
uccaggcagacacagcu

SEQ ID NO: 2104602 - RNA, 18 nt, Homo sapiens
agguuucuaagcauaaaa

SEQ ID NO: 2104603 - RNA, 16 nt, Homo sapiens
aaucauccucaugccu

SEQ ID NO: 2104604 - RNA, 21 nt, Homo sapiens
augaacuguauuauugcaauu

SEQ ID NO: 2104605 - RNA, 21 nt, Homo sapiens
uggcgcaaucucggcucacug

SEQ ID NO: 2104606 - RNA, 12 nt, Homo sapiens
uugcaagccaua

SEQ ID NO: 2104607 - RNA, 23 nt, Homo sapiens
caaaauagggacuaucuaucuua

SEQ ID NO: 2104608 - RNA, 16 nt, Homo sapiens
guuaccacacaucuau

SEQ ID NO: 2104609 - RNA, 18 nt, Homo sapiens
aagaaauccaguuuccca

SEQ ID NO: 2104610 - RNA, 18 nt, Homo sapiens
auaaauuuuuauuacuua

SEQ ID NO: 2104611 - RNA, 16 nt, Homo sapiens
uaacacacuggccauu

SEQ ID NO: 2104612 - RNA, 20 nt, Homo sapiens
uguacacccacccacauauc

SEQ ID NO: 2104613 - RNA, 15 nt, Homo sapiens
caucuccagcuauuu

SEQ ID NO: 2104614 - RNA, 12 nt, Homo sapiens
acugugcaucuc

SEQ ID NO: 2104615 - RNA, 20 nt, Homo sapiens
aaaguagcaaaacaaauuca

SEQ ID NO: 2104616 - RNA, 23 nt, Homo sapiens
uaaauagcuauauccauguacug

SEQ ID NO: 2104617 - RNA, 17 nt, Homo sapiens
ccagacucacuugccau

SEQ ID NO: 2104618 - RNA, 15 nt, Homo sapiens
caguaacuugguuau

SEQ ID NO: 2104619 - RNA, 15 nt, Homo sapiens
caaguacuugagaau

SEQ ID NO: 2104620 - RNA, 21 nt, Homo sapiens
uacuagggagaagguuucauu

SEQ ID NO: 2104621 - RNA, 18 nt, Homo sapiens
uagcuacuguaugcaaag

SEQ ID NO: 2104622 - RNA, 19 nt, Homo sapiens
ucuggcauuuguuuccuca

SEQ ID NO: 2104623 - RNA, 12 nt, Homo sapiens
agugugauucac

SEQ ID NO: 2104624 - RNA, 17 nt, Homo sapiens
acagaugcacacacaga

SEQ ID NO: 2104625 - RNA, 20 nt, Homo sapiens
ugccauguacccauugcaga

SEQ ID NO: 2104626 - RNA, 16 nt, Homo sapiens
ccaugagaugaugcca

SEQ ID NO: 2104627 - RNA, 22 nt, Homo sapiens
aauguaaagacaaaaaacuaua

SEQ ID NO: 2104628 - RNA, 14 nt, Homo sapiens
uaauaauaaucuag

SEQ ID NO: 2104629 - RNA, 19 nt, Homo sapiens
uaauuccacaggucaucag

SEQ ID NO: 2104630 - RNA, 22 nt, Homo sapiens
caacauuuaagggaaugugagc

SEQ ID NO: 2104631 - RNA, 17 nt, Homo sapiens
aaacuuguacuauguua

SEQ ID NO: 2104632 - RNA, 15 nt, Homo sapiens
gcauucaauuuacag

SEQ ID NO: 2104633 - RNA, 17 nt, Homo sapiens
aacaucacacaguauac

SEQ ID NO: 2104634 - RNA, 13 nt, Homo sapiens
aaaucguuucuca

SEQ ID NO: 2104635 - RNA, 22 nt, Homo sapiens
auugacgacuucacacuaugga

SEQ ID NO: 2104636 - RNA, 18 nt, Homo sapiens
uaaaauagcauacugugu

SEQ ID NO: 2104637 - RNA, 15 nt, Homo sapiens
acccuccccugagga

SEQ ID NO: 2104638 - RNA, 13 nt, Homo sapiens
agcucucagggcu

SEQ ID NO: 2104639 - RNA, 20 nt, Homo sapiens
gacgcaccgccugaaggcac

SEQ ID NO: 2104640 - RNA, 20 nt, Homo sapiens
agucucugaguccuuugcua

SEQ ID NO: 2104641 - RNA, 18 nt, Homo sapiens
agugacauuucuaucaca

SEQ ID NO: 2104642 - RNA, 17 nt, Homo sapiens
ucauuuuauaugucaaa

SEQ ID NO: 2104643 - RNA, 13 nt, Homo sapiens
cuuucacuaucug

SEQ ID NO: 2104644 - RNA, 14 nt, Homo sapiens
gauguacacacaca

SEQ ID NO: 2104645 - RNA, 19 nt, Homo sapiens
uauacuuuuaaagccuauu

SEQ ID NO: 2104646 - RNA, 19 nt, Homo sapiens
uacuuugaacaaccaaaug

SEQ ID NO: 2104647 - RNA, 23 nt, Homo sapiens
aucagcacugccggcccagugac

SEQ ID NO: 2104648 - RNA, 15 nt, Homo sapiens
ccacaaagagauuau

SEQ ID NO: 2104649 - RNA, 18 nt, Homo sapiens
cugugcuccacacucaga

SEQ ID NO: 2104650 - RNA, 19 nt, Homo sapiens
ucauccucaagcucagggc

SEQ ID NO: 2104651 - RNA, 16 nt, Homo sapiens
cugaaucaucauaucu

SEQ ID NO: 2104652 - RNA, 10 nt, Homo sapiens
aggccugaag

SEQ ID NO: 2104653 - RNA, 16 nt, Homo sapiens
gagccagccguaaugg

SEQ ID NO: 2104654 - RNA, 14 nt, Homo sapiens
ugagggagacugca

SEQ ID NO: 2104655 - RNA, 14 nt, Homo sapiens
aggccagugugucu

SEQ ID NO: 2104656 - RNA, 13 nt, Homo sapiens
uggaauugcucaa

SEQ ID NO: 2104657 - RNA, 12 nt, Homo sapiens
acacucuucccu

SEQ ID NO: 2104658 - RNA, 21 nt, Homo sapiens
auccuccagagaaacccaggg

SEQ ID NO: 2104659 - RNA, 14 nt, Homo sapiens
agaaguaauuugaa

SEQ ID NO: 2104660 - RNA, 13 nt, Homo sapiens
ccugugccagcuc

SEQ ID NO: 2104661 - RNA, 22 nt, Homo sapiens
agagguguuuuuauaauaucca

SEQ ID NO: 2104662 - RNA, 21 nt, Homo sapiens
ugauuggacauuuucuucaga

SEQ ID NO: 2104663 - RNA, 14 nt, Homo sapiens
cuuugcugcauggc

SEQ ID NO: 2104664 - RNA, 23 nt, Homo sapiens
uuguuuggaccgauaagugugcu

SEQ ID NO: 2104665 - RNA, 14 nt, Homo sapiens
gagguuguggagaa

SEQ ID NO: 2104666 - RNA, 18 nt, Homo sapiens
cgcccaaaagauugaacu

SEQ ID NO: 2104667 - RNA, 16 nt, Homo sapiens
uuuggaguaaucagaa

SEQ ID NO: 2104668 - RNA, 15 nt, Homo sapiens
guaaacuaaggauaa

SEQ ID NO: 2104669 - RNA, 13 nt, Homo sapiens
auugcucaucuca

SEQ ID NO: 2104670 - RNA, 13 nt, Homo sapiens
acugcucauuuca

SEQ ID NO: 2104671 - RNA, 22 nt, Homo sapiens
ggugacagaaggaccagcccuu

SEQ ID NO: 2104672 - RNA, 15 nt, Homo sapiens
acggauggugcaugg

SEQ ID NO: 2104673 - RNA, 16 nt, Homo sapiens
ugaaccuuccaucucg

SEQ ID NO: 2104674 - RNA, 15 nt, Homo sapiens
uagagucauuuacuc

SEQ ID NO: 2104675 - RNA, 15 nt, Homo sapiens
cccauguaaccacug

SEQ ID NO: 2104676 - RNA, 15 nt, Homo sapiens
cuaauguaauaacug

SEQ ID NO: 2104677 - RNA, 22 nt, Homo sapiens
aaaauaacggugcuugugucac

SEQ ID NO: 2104678 - RNA, 18 nt, Homo sapiens
uacauccugcagcuuauu

SEQ ID NO: 2104679 - RNA, 14 nt, Homo sapiens
cuuucaacaauggg

SEQ ID NO: 2104680 - RNA, 21 nt, Homo sapiens
ucagagugggcugggccccug

SEQ ID NO: 2104681 - RNA, 19 nt, Homo sapiens
gaacguuuagcugacaaaa

SEQ ID NO: 2104682 - RNA, 14 nt, Homo sapiens
acauugucccugcc

SEQ ID NO: 2104683 - RNA, 17 nt, Homo sapiens
uucucucugaccuuuca

SEQ ID NO: 2104684 - RNA, 16 nt, Homo sapiens
ccaaggggucugcucc

SEQ ID NO: 2104685 - RNA, 16 nt, Homo sapiens
uuucccccgagcucuu

SEQ ID NO: 2104686 - RNA, 18 nt, Homo sapiens
caaaggacuccacccauc

SEQ ID NO: 2104687 - RNA, 20 nt, Homo sapiens
aaaugccaagggggugacug

SEQ ID NO: 2104688 - RNA, 16 nt, Homo sapiens
cugggaccacacagac

SEQ ID NO: 2104689 - RNA, 22 nt, Homo sapiens
ugucuucccaaacccagucucc

SEQ ID NO: 2104690 - RNA, 19 nt, Homo sapiens
uguugacaaaauuuucuca

SEQ ID NO: 2104691 - RNA, 15 nt, Homo sapiens
agaccuagugcuguu

SEQ ID NO: 2104692 - RNA, 19 nt, Homo sapiens
ccucacgcucuggacauga

SEQ ID NO: 2104693 - RNA, 14 nt, Homo sapiens
cacucaagcacuga

SEQ ID NO: 2104694 - RNA, 14 nt, Homo sapiens
ccaggaagccagca

SEQ ID NO: 2104695 - RNA, 21 nt, Homo sapiens
gcauucauauuucauauucau

SEQ ID NO: 2104696 - RNA, 19 nt, Homo sapiens
uuacacaaaacaaaugcca

SEQ ID NO: 2104697 - RNA, 16 nt, Homo sapiens
agcaccaccauuuaau

SEQ ID NO: 2104698 - RNA, 12 nt, Homo sapiens
acaccugacuaa

SEQ ID NO: 2104699 - RNA, 21 nt, Homo sapiens
caaaacauugugccaugucaa

SEQ ID NO: 2104700 - RNA, 17 nt, Homo sapiens
auaugaaacuuaggaag

SEQ ID NO: 2104701 - RNA, 18 nt, Homo sapiens
accuguacacacacagac

SEQ ID NO: 2104702 - RNA, 20 nt, Homo sapiens
accucucaacauuaccaaaa

SEQ ID NO: 2104703 - RNA, 18 nt, Homo sapiens
ugaugggaugauugaaga

SEQ ID NO: 2104704 - RNA, 16 nt, Homo sapiens
cauuaauauuugcuga

SEQ ID NO: 2104705 - RNA, 15 nt, Homo sapiens
gggacccagugcaga

SEQ ID NO: 2104706 - RNA, 22 nt, Homo sapiens
cccaaggcgauauaagcaaaau

SEQ ID NO: 2104707 - RNA, 18 nt, Homo sapiens
ccuaggagcaacaggcca

SEQ ID NO: 2104708 - RNA, 14 nt, Homo sapiens
ccugaaaaacugau

SEQ ID NO: 2104709 - RNA, 14 nt, Homo sapiens
accucuaacccuca

SEQ ID NO: 2104710 - RNA, 14 nt, Homo sapiens
cucacaaaaucacu

SEQ ID NO: 2104711 - RNA, 23 nt, Homo sapiens
auauuucucccaacuuauccaag

SEQ ID NO: 2104712 - RNA, 12 nt, Homo sapiens
aguuaugacagc

SEQ ID NO: 2104713 - RNA, 22 nt, Homo sapiens
aaaaccugaagacugaggacaa

SEQ ID NO: 2104714 - RNA, 20 nt, Homo sapiens
uucucauuucgggugaaucu

SEQ ID NO: 2104715 - RNA, 13 nt, Homo sapiens
ucccugcugccag

SEQ ID NO: 2104716 - RNA, 19 nt, Homo sapiens
cacuuuguucacuaccugu

SEQ ID NO: 2104717 - RNA, 23 nt, Homo sapiens
gauuuaaaaacaaaaaaacacaa

SEQ ID NO: 2104718 - RNA, 16 nt, Homo sapiens
ggcagcacagcccagg

SEQ ID NO: 2104719 - RNA, 13 nt, Homo sapiens
gcaauccuuccaa

SEQ ID NO: 2104720 - RNA, 19 nt, Homo sapiens
ucugucaggggcucccaca

SEQ ID NO: 2104721 - RNA, 22 nt, Homo sapiens
agcuguugacucuaguacugug

SEQ ID NO: 2104722 - RNA, 17 nt, Homo sapiens
ugaaauguaugugcucu

SEQ ID NO: 2104723 - RNA, 20 nt, Homo sapiens
cuuaaguaagcaacagcaua

SEQ ID NO: 2104724 - RNA, 12 nt, Homo sapiens
cauauacuuugu

SEQ ID NO: 2104725 - RNA, 15 nt, Homo sapiens
uguugugcucaggac

SEQ ID NO: 2104726 - RNA, 23 nt, Homo sapiens
cugaggcagaacucacugggggu

SEQ ID NO: 2104727 - RNA, 23 nt, Homo sapiens
cuuuucguuuagaaucagaauaa

SEQ ID NO: 2104728 - RNA, 14 nt, Homo sapiens
caacaaggugcaca

SEQ ID NO: 2104729 - RNA, 18 nt, Homo sapiens
cgggagacucaaagggag

SEQ ID NO: 2104730 - RNA, 17 nt, Homo sapiens
uauacuugaacaaaagg

SEQ ID NO: 2104731 - RNA, 19 nt, Homo sapiens
acuuuuucucggagcauau

SEQ ID NO: 2104732 - RNA, 17 nt, Homo sapiens
cccuggcaugauggaca

SEQ ID NO: 2104733 - RNA, 12 nt, Homo sapiens
ccagucccucag

SEQ ID NO: 2104734 - RNA, 12 nt, Homo sapiens
ccacucccucac

SEQ ID NO: 2104735 - RNA, 15 nt, Homo sapiens
caccaaaaagggauc

SEQ ID NO: 2104736 - RNA, 14 nt, Homo sapiens
ugccuacuccaaaa

SEQ ID NO: 2104737 - RNA, 23 nt, Homo sapiens
ugaaaacagugucuugagcucua

SEQ ID NO: 2104738 - RNA, 21 nt, Homo sapiens
auguugaauucuuuugccaag

SEQ ID NO: 2104739 - RNA, 22 nt, Homo sapiens
accaucaaacaaaucauuuuga

SEQ ID NO: 2104740 - RNA, 21 nt, Homo sapiens
uggauuaaauggcaccuguau

SEQ ID NO: 2104741 - RNA, 21 nt, Homo sapiens
gaagguuggaacugcugccau

SEQ ID NO: 2104742 - RNA, 14 nt, Homo sapiens
acauagacugaaga

SEQ ID NO: 2104743 - RNA, 19 nt, Homo sapiens
ugccucugcaaacuaagga

SEQ ID NO: 2104744 - RNA, 13 nt, Homo sapiens
ugugugcugcuaa

SEQ ID NO: 2104745 - RNA, 16 nt, Homo sapiens
uguuacaccagccuuu

SEQ ID NO: 2104746 - RNA, 22 nt, Homo sapiens
ugaaccacccuggaaauucugc

SEQ ID NO: 2104747 - RNA, 19 nt, Homo sapiens
gugaaaggucacacuacca

SEQ ID NO: 2104748 - RNA, 12 nt, Homo sapiens
ccugugaagcug

SEQ ID NO: 2104749 - RNA, 20 nt, Homo sapiens
guugcccucuaccugacucc

SEQ ID NO: 2104750 - RNA, 17 nt, Homo sapiens
cgccacugguacccgcc

SEQ ID NO: 2104751 - RNA, 19 nt, Homo sapiens
uguaaagcccuugcacagc

SEQ ID NO: 2104752 - RNA, 20 nt, Homo sapiens
ccauuaaccagggcaccaag

SEQ ID NO: 2104753 - RNA, 18 nt, Homo sapiens
acugguucugaggccaga

SEQ ID NO: 2104754 - RNA, 20 nt, Homo sapiens
uugggacauggcacaggccc

SEQ ID NO: 2104755 - RNA, 14 nt, Homo sapiens
agugguggcaaaag

SEQ ID NO: 2104756 - RNA, 21 nt, Homo sapiens
auuuacccaacucuguacaaa

SEQ ID NO: 2104757 - RNA, 14 nt, Homo sapiens
gucucaucucccau

SEQ ID NO: 2104758 - RNA, 15 nt, Homo sapiens
caguccaugcuccag

SEQ ID NO: 2104759 - RNA, 23 nt, Homo sapiens
auuuucccagucugugaagucaa

SEQ ID NO: 2104760 - RNA, 16 nt, Homo sapiens
cugcuucuuggagcuu

SEQ ID NO: 2104761 - RNA, 12 nt, Homo sapiens
uuaauugcucaa

SEQ ID NO: 2104762 - RNA, 23 nt, Homo sapiens
uuaaaaagcugacuacuugauau

SEQ ID NO: 2104763 - RNA, 22 nt, Homo sapiens
acgugauucaauucaacacucc

SEQ ID NO: 2104764 - RNA, 21 nt, Homo sapiens
gaugcacugaaguagccaaca

SEQ ID NO: 2104765 - RNA, 13 nt, Homo sapiens
cugcccaaugaga

SEQ ID NO: 2104766 - RNA, 15 nt, Homo sapiens
ugggacuauucauug

SEQ ID NO: 2104767 - RNA, 12 nt, Homo sapiens
cuaaaucccucc

SEQ ID NO: 2104768 - RNA, 15 nt, Homo sapiens
cacaucaugagccuu

SEQ ID NO: 2104769 - RNA, 22 nt, Homo sapiens
aaaagggaagucuagaguuccu

SEQ ID NO: 2104770 - RNA, 22 nt, Homo sapiens
guuuuugaagaagggaaauuca

SEQ ID NO: 2104771 - RNA, 23 nt, Homo sapiens
gacucguucucgugacccagugg

SEQ ID NO: 2104772 - RNA, 17 nt, Homo sapiens
gcacuugccuguagucu

SEQ ID NO: 2104773 - RNA, 16 nt, Homo sapiens
cagcucuucacagucc

SEQ ID NO: 2104774 - RNA, 13 nt, Homo sapiens
auuuaauuccuuc

SEQ ID NO: 2104775 - RNA, 23 nt, Homo sapiens
aucacaaggcauucaaguguaca

SEQ ID NO: 2104776 - RNA, 18 nt, Homo sapiens
augugcaggauacuacau

SEQ ID NO: 2104777 - RNA, 15 nt, Homo sapiens
aguaaaacuguggua

SEQ ID NO: 2104778 - RNA, 18 nt, Homo sapiens
ucuguggagaauguacac

SEQ ID NO: 2104779 - RNA, 22 nt, Homo sapiens
uggaguuaaacuuuagugcuac

SEQ ID NO: 2104780 - RNA, 22 nt, Homo sapiens
cuuucagaacugcuaccaugaa

SEQ ID NO: 2104781 - RNA, 15 nt, Homo sapiens
ccauuucccauuaaa

SEQ ID NO: 2104782 - RNA, 20 nt, Homo sapiens
gcguuugugcauaucugccu

SEQ ID NO: 2104783 - RNA, 13 nt, Homo sapiens
gcuucgcuggaaa

SEQ ID NO: 2104784 - RNA, 23 nt, Homo sapiens
ucacaagaacagaaccugcaaau

SEQ ID NO: 2104785 - RNA, 19 nt, Homo sapiens
aaacuacauuguaaccugu

SEQ ID NO: 2104786 - RNA, 23 nt, Homo sapiens
uuccacguguuuuauuccuguau

SEQ ID NO: 2104787 - RNA, 23 nt, Homo sapiens
ccaagcagaauucugcaugguga

SEQ ID NO: 2104788 - RNA, 18 nt, Homo sapiens
uagagcauaccacuugaa

SEQ ID NO: 2104789 - RNA, 17 nt, Homo sapiens
ccuugugugugcccugg

SEQ ID NO: 2104790 - RNA, 23 nt, Homo sapiens
aaugugauuacugcucuauucca

SEQ ID NO: 2104791 - RNA, 16 nt, Homo sapiens
uggcaggacagcuccu

SEQ ID NO: 2104792 - RNA, 20 nt, Homo sapiens
gaucagccugggcaauguga

SEQ ID NO: 2104793 - RNA, 14 nt, Homo sapiens
uuguacacugugua

SEQ ID NO: 2104794 - RNA, 12 nt, Homo sapiens
uuugucuuuaug

SEQ ID NO: 2104795 - RNA, 14 nt, Homo sapiens
gaaccuuaaugugg

SEQ ID NO: 2104796 - RNA, 14 nt, Homo sapiens
aacugaacauccaa

SEQ ID NO: 2104797 - RNA, 16 nt, Homo sapiens
ccauauuccgcacugg

SEQ ID NO: 2104798 - RNA, 14 nt, Homo sapiens
aguaagaguuuaca

SEQ ID NO: 2104799 - RNA, 23 nt, Homo sapiens
gaacauuugugauauauguauua

SEQ ID NO: 2104800 - RNA, 23 nt, Homo sapiens
aaaauguuuucuucaucugugac

SEQ ID NO: 2104801 - RNA, 14 nt, Homo sapiens
ggagagauguuugg

SEQ ID NO: 2104802 - RNA, 17 nt, Homo sapiens
auauuucuugcuuucaa

SEQ ID NO: 2104803 - RNA, 18 nt, Homo sapiens
cuggucaaaaccuacaca

SEQ ID NO: 2104804 - RNA, 13 nt, Homo sapiens
augugccuuuagu

SEQ ID NO: 2104805 - RNA, 14 nt, Homo sapiens
cuaauaugaaagaa

SEQ ID NO: 2104806 - RNA, 13 nt, Homo sapiens
guugcuauccugc

SEQ ID NO: 2104807 - RNA, 22 nt, Homo sapiens
cuucugugcauuguaaacauaa

SEQ ID NO: 2104808 - RNA, 15 nt, Homo sapiens
aacaucaugcauuca

SEQ ID NO: 2104809 - RNA, 20 nt, Homo sapiens
acagucaggaagccuccugc

SEQ ID NO: 2104810 - RNA, 18 nt, Homo sapiens
aagccuggccuacauggu

SEQ ID NO: 2104811 - RNA, 13 nt, Homo sapiens
aacuaaauguugc

SEQ ID NO: 2104812 - RNA, 17 nt, Homo sapiens
uuucaauaaugugaaug

SEQ ID NO: 2104813 - RNA, 14 nt, Homo sapiens
gacagauaccucca

SEQ ID NO: 2104814 - RNA, 15 nt, Homo sapiens
aaggcaucuaagaca

SEQ ID NO: 2104815 - RNA, 17 nt, Homo sapiens
caagagggggaccugcc

SEQ ID NO: 2104816 - RNA, 14 nt, Homo sapiens
ucuuagaugcaguu

SEQ ID NO: 2104817 - RNA, 18 nt, Homo sapiens
acugaggagcggacucac

SEQ ID NO: 2104818 - RNA, 19 nt, Homo sapiens
agcccuaauagcagaaaua

SEQ ID NO: 2104819 - RNA, 15 nt, Homo sapiens
ucauugcacuuugau

SEQ ID NO: 2104820 - RNA, 20 nt, Homo sapiens
aggagccaaacauccuacaa

SEQ ID NO: 2104821 - RNA, 21 nt, Homo sapiens
cgcuucgacuuuucuuaacaa

SEQ ID NO: 2104822 - RNA, 19 nt, Homo sapiens
acaggaaucgguggucucc

SEQ ID NO: 2104823 - RNA, 12 nt, Homo sapiens
caaguguuccca

SEQ ID NO: 2104824 - RNA, 14 nt, Homo sapiens
cuucuaguauauua

SEQ ID NO: 2104825 - RNA, 14 nt, Homo sapiens
cuuuaaguauacaa

SEQ ID NO: 2104826 - RNA, 23 nt, Homo sapiens
cuuaggagacgcugcacuugaca

SEQ ID NO: 2104827 - RNA, 18 nt, Homo sapiens
aauugcccguuuccauac

SEQ ID NO: 2104828 - RNA, 17 nt, Homo sapiens
acuguggggaaacaauu

SEQ ID NO: 2104829 - RNA, 20 nt, Homo sapiens
acugaugagauacauuugau

SEQ ID NO: 2104830 - RNA, 20 nt, Homo sapiens
cuguguauugacaagcauca

SEQ ID NO: 2104831 - RNA, 20 nt, Homo sapiens
aucaaaaucuuucagcacuc

SEQ ID NO: 2104832 - RNA, 23 nt, Homo sapiens
ggccaccugccugcgucuuccgc

SEQ ID NO: 2104833 - RNA, 15 nt, Homo sapiens
cuuugcuucccauug

SEQ ID NO: 2104834 - RNA, 15 nt, Homo sapiens
uuaaaugacuuagaa

SEQ ID NO: 2104835 - RNA, 19 nt, Homo sapiens
auaaaaugcuuuauuaauu

SEQ ID NO: 2104836 - RNA, 15 nt, Homo sapiens
gccucugccaggugu

SEQ ID NO: 2104837 - RNA, 14 nt, Homo sapiens
acaaacacauuaua

SEQ ID NO: 2104838 - RNA, 21 nt, Homo sapiens
ucaaaagaaggguaagugcuu

SEQ ID NO: 2104839 - RNA, 18 nt, Homo sapiens
ucuuauacacaacacaca

SEQ ID NO: 2104840 - RNA, 23 nt, Homo sapiens
acucauugcaaccuccaccuucu

SEQ ID NO: 2104841 - RNA, 20 nt, Homo sapiens
guggggacagauucgcagca

SEQ ID NO: 2104842 - RNA, 13 nt, Homo sapiens
ucucaggccaaac

SEQ ID NO: 2104843 - RNA, 20 nt, Homo sapiens
ucauguucacugugagugaa

SEQ ID NO: 2104844 - RNA, 20 nt, Homo sapiens
ucccugugcugauccugcug

SEQ ID NO: 2104845 - RNA, 17 nt, Homo sapiens
gcuguauacuguacuga

SEQ ID NO: 2104846 - RNA, 16 nt, Homo sapiens
cagcuacaaauuugag

SEQ ID NO: 2104847 - RNA, 18 nt, Homo sapiens
cucacugggaagcuccca

SEQ ID NO: 2104848 - RNA, 20 nt, Homo sapiens
uaaagaccugacaccuuuca

SEQ ID NO: 2104849 - RNA, 17 nt, Homo sapiens
agggugguuuaccugca

SEQ ID NO: 2104850 - RNA, 21 nt, Homo sapiens
caauuuuugaguagcauauua

SEQ ID NO: 2104851 - RNA, 15 nt, Homo sapiens
aggucacucugggcc

SEQ ID NO: 2104852 - RNA, 16 nt, Homo sapiens
gccauugcacuccagc

SEQ ID NO: 2104853 - RNA, 16 nt, Homo sapiens
uucugacgcugacaau

SEQ ID NO: 2104854 - RNA, 21 nt, Homo sapiens
gaguuuaaauuugagaaucaa

SEQ ID NO: 2104855 - RNA, 23 nt, Homo sapiens
uccuggugugaagguccugcuau

SEQ ID NO: 2104856 - RNA, 15 nt, Homo sapiens
uccuacagcauaaag

SEQ ID NO: 2104857 - RNA, 18 nt, Homo sapiens
ucugcugcauagcucuau

SEQ ID NO: 2104858 - RNA, 19 nt, Homo sapiens
ccaauaucagcucuuucuc

SEQ ID NO: 2104859 - RNA, 20 nt, Homo sapiens
cuuugagcugagugcugaaa

SEQ ID NO: 2104860 - RNA, 21 nt, Homo sapiens
acuaguucagacacuuuggaa

SEQ ID NO: 2104861 - RNA, 16 nt, Homo sapiens
gugccacuggaccuca

SEQ ID NO: 2104862 - RNA, 17 nt, Homo sapiens
ugcccuuccuccugccu

SEQ ID NO: 2104863 - RNA, 14 nt, Homo sapiens
cucuggcuccagaa

SEQ ID NO: 2104864 - RNA, 14 nt, Homo sapiens
cauccagugacaaa

SEQ ID NO: 2104865 - RNA, 21 nt, Homo sapiens
gcuguuuaugaacggaaauca

SEQ ID NO: 2104866 - RNA, 23 nt, Homo sapiens
gaaaagaacacuagagucuguca

SEQ ID NO: 2104867 - RNA, 22 nt, Homo sapiens
ucuagagauuuucuuggcagua

SEQ ID NO: 2104868 - RNA, 15 nt, Homo sapiens
aggggacaagggauu

SEQ ID NO: 2104869 - RNA, 16 nt, Homo sapiens
cugacuuggcacuuaa

SEQ ID NO: 2104870 - RNA, 21 nt, Homo sapiens
agccguccuucuaaugaagac

SEQ ID NO: 2104871 - RNA, 13 nt, Homo sapiens
cuggaugaaguua

SEQ ID NO: 2104872 - RNA, 14 nt, Homo sapiens
auccucaguucuca

SEQ ID NO: 2104873 - RNA, 15 nt, Homo sapiens
cuugacuuugccaca

SEQ ID NO: 2104874 - RNA, 21 nt, Homo sapiens
uuucagaauauuuucaaaaua

SEQ ID NO: 2104875 - RNA, 21 nt, Homo sapiens
ucaguaacauuucuguucuca

SEQ ID NO: 2104876 - RNA, 17 nt, Homo sapiens
ccuggaacugucucuca

SEQ ID NO: 2104877 - RNA, 15 nt, Homo sapiens
cauuucgccccucau

SEQ ID NO: 2104878 - RNA, 23 nt, Homo sapiens
ugugucagcgccuggccuaccca

SEQ ID NO: 2104879 - RNA, 17 nt, Homo sapiens
uagauaauaguacaugu

SEQ ID NO: 2104880 - RNA, 15 nt, Homo sapiens
auacaucauuccaca

SEQ ID NO: 2104881 - RNA, 19 nt, Homo sapiens
agcgcugagugggagaagg

SEQ ID NO: 2104882 - RNA, 17 nt, Homo sapiens
acccuuucucugagaga

SEQ ID NO: 2104883 - RNA, 20 nt, Homo sapiens
uauaaauuuuauaacagaau

SEQ ID NO: 2104884 - RNA, 15 nt, Homo sapiens
acucaagaaggaauu

SEQ ID NO: 2104885 - RNA, 18 nt, Homo sapiens
cccagugaaugauuuaga

SEQ ID NO: 2104886 - RNA, 14 nt, Homo sapiens
cagaggcugauguc

SEQ ID NO: 2104887 - RNA, 23 nt, Homo sapiens
uuugaguccacgcccaccagccu

SEQ ID NO: 2104888 - RNA, 21 nt, Homo sapiens
aaaugcgcgugugcacgugug

SEQ ID NO: 2104889 - RNA, 16 nt, Homo sapiens
caaguacuacaaggaa

SEQ ID NO: 2104890 - RNA, 18 nt, Homo sapiens
accaugaaaaugaaugcu

SEQ ID NO: 2104891 - RNA, 16 nt, Homo sapiens
aacagcgcccaaagga

SEQ ID NO: 2104892 - RNA, 22 nt, Homo sapiens
uucaaagagacauauacuaaga

SEQ ID NO: 2104893 - RNA, 14 nt, Homo sapiens
caaauacuuagcaa

SEQ ID NO: 2104894 - RNA, 20 nt, Homo sapiens
aagauucuucccauucucca

SEQ ID NO: 2104895 - RNA, 16 nt, Homo sapiens
uaaggcagugcaguac

SEQ ID NO: 2104896 - RNA, 15 nt, Homo sapiens
gaagcuuucaguauu

SEQ ID NO: 2104897 - RNA, 14 nt, Homo sapiens
accugucauuguau

SEQ ID NO: 2104898 - RNA, 22 nt, Homo sapiens
ccaccugacacuaaccagaguc

SEQ ID NO: 2104899 - RNA, 18 nt, Homo sapiens
caaucugucacauaaaag

SEQ ID NO: 2104900 - RNA, 16 nt, Homo sapiens
guaucucuacuuuccu

SEQ ID NO: 2104901 - RNA, 15 nt, Homo sapiens
ucaugcugugcauuu

SEQ ID NO: 2104902 - RNA, 19 nt, Homo sapiens
agauaaauuuugacuugaa

SEQ ID NO: 2104903 - RNA, 21 nt, Homo sapiens
uacuugauauaauuacuuaau

SEQ ID NO: 2104904 - RNA, 13 nt, Homo sapiens
aagugccaaagaa

SEQ ID NO: 2104905 - RNA, 14 nt, Homo sapiens
aaccacccagagug

SEQ ID NO: 2104906 - RNA, 17 nt, Homo sapiens
auucucauuuguucuca

SEQ ID NO: 2104907 - RNA, 19 nt, Homo sapiens
ccaagcugaagugaaggag

SEQ ID NO: 2104908 - RNA, 17 nt, Homo sapiens
aguuuaaacugaaugaa

SEQ ID NO: 2104909 - RNA, 19 nt, Homo sapiens
ccaacuucauuugaugcua

SEQ ID NO: 2104910 - RNA, 14 nt, Homo sapiens
ccccccagcuguca

SEQ ID NO: 2104911 - RNA, 17 nt, Homo sapiens
uucagauguggagccag

SEQ ID NO: 2104912 - RNA, 13 nt, Homo sapiens
agccagcuccugc

SEQ ID NO: 2104913 - RNA, 22 nt, Homo sapiens
auguacuauucaaucuuuacac

SEQ ID NO: 2104914 - RNA, 13 nt, Homo sapiens
acacccuccuuca

SEQ ID NO: 2104915 - RNA, 19 nt, Homo sapiens
gccuccccacaggagcccu

SEQ ID NO: 2104916 - RNA, 22 nt, Homo sapiens
uggcaaaugaauuuaucauuuu

SEQ ID NO: 2104917 - RNA, 17 nt, Homo sapiens
uggagccugcucuuuga

SEQ ID NO: 2104918 - RNA, 18 nt, Homo sapiens
aaacuugguucccagaaa

SEQ ID NO: 2104919 - RNA, 19 nt, Homo sapiens
guuuugccaacauugccua

SEQ ID NO: 2104920 - RNA, 13 nt, Homo sapiens
guuauaacugugg

SEQ ID NO: 2104921 - RNA, 20 nt, Homo sapiens
agagagaaccaccacugccu

SEQ ID NO: 2104922 - RNA, 18 nt, Homo sapiens
cauuucuguauacuguaa

SEQ ID NO: 2104923 - RNA, 17 nt, Homo sapiens
gaaggaugcucuuuccc

SEQ ID NO: 2104924 - RNA, 22 nt, Homo sapiens
uacaaaugacauggacacauca

SEQ ID NO: 2104925 - RNA, 17 nt, Homo sapiens
uaaugagagugcacugc

SEQ ID NO: 2104926 - RNA, 18 nt, Homo sapiens
uuuccaggagacauauau

SEQ ID NO: 2104927 - RNA, 13 nt, Homo sapiens
gaauuuucuugaa

SEQ ID NO: 2104928 - RNA, 21 nt, Homo sapiens
cuaaggagcugauacuuugac

SEQ ID NO: 2104929 - RNA, 12 nt, Homo sapiens
uccacuuaccug

SEQ ID NO: 2104930 - RNA, 15 nt, Homo sapiens
aguuccaaaugcaau

SEQ ID NO: 2104931 - RNA, 21 nt, Homo sapiens
uuuauagaccagaaccagagc

SEQ ID NO: 2104932 - RNA, 17 nt, Homo sapiens
cuuuuacagcucuuggc

SEQ ID NO: 2104933 - RNA, 16 nt, Homo sapiens
ugcaacugacacuccc

SEQ ID NO: 2104934 - RNA, 12 nt, Homo sapiens
aagggauugcuu

SEQ ID NO: 2104935 - RNA, 13 nt, Homo sapiens
cucaacucugucc

SEQ ID NO: 2104936 - RNA, 15 nt, Homo sapiens
uuacaagacugcuga

SEQ ID NO: 2104937 - RNA, 23 nt, Homo sapiens
gcauccuccagccccuguagaac

SEQ ID NO: 2104938 - RNA, 22 nt, Homo sapiens
uuauauugauaacagcacugac

SEQ ID NO: 2104939 - RNA, 15 nt, Homo sapiens
cgggaugggggaaaa

SEQ ID NO: 2104940 - RNA, 17 nt, Homo sapiens
gucacugcccaccaaag

SEQ ID NO: 2104941 - RNA, 20 nt, Homo sapiens
uuugaagcagucuugcucug

SEQ ID NO: 2104942 - RNA, 21 nt, Homo sapiens
ugccccaucacugcgccacug

SEQ ID NO: 2104943 - RNA, 20 nt, Homo sapiens
cugauuuccccuuuugcauu

SEQ ID NO: 2104944 - RNA, 20 nt, Homo sapiens
ugcauagagcccuggccagc

SEQ ID NO: 2104945 - RNA, 16 nt, Homo sapiens
caacgauaaaauuaca

SEQ ID NO: 2104946 - RNA, 14 nt, Homo sapiens
cucggacaccaucu

SEQ ID NO: 2104947 - RNA, 14 nt, Homo sapiens
cggaggcugcucag

SEQ ID NO: 2104948 - RNA, 12 nt, Homo sapiens
aaaaacaauuaa

SEQ ID NO: 2104949 - RNA, 17 nt, Homo sapiens
aucauuuuaagugcaug

SEQ ID NO: 2104950 - RNA, 13 nt, Homo sapiens
uguaaaugccaca

SEQ ID NO: 2104951 - RNA, 16 nt, Homo sapiens
ucucugccgcaauaca

SEQ ID NO: 2104952 - RNA, 12 nt, Homo sapiens
caguuugcaauu

SEQ ID NO: 2104953 - RNA, 20 nt, Homo sapiens
aacuacacaaauuauaagca

SEQ ID NO: 2104954 - RNA, 21 nt, Homo sapiens
gguuuauuccagagaagccag

SEQ ID NO: 2104955 - RNA, 22 nt, Homo sapiens
agaauagaaacguaaacuauga

SEQ ID NO: 2104956 - RNA, 19 nt, Homo sapiens
uaauuuucgaaaacuuccc

SEQ ID NO: 2104957 - RNA, 15 nt, Homo sapiens
gagaacauggccaau

SEQ ID NO: 2104958 - RNA, 17 nt, Homo sapiens
aggcagcugacacaucu

SEQ ID NO: 2104959 - RNA, 14 nt, Homo sapiens
cuuccucaccacuu

SEQ ID NO: 2104960 - RNA, 14 nt, Homo sapiens
cuuuuaacccagug

SEQ ID NO: 2104961 - RNA, 14 nt, Homo sapiens
ccuauuaucagaag

SEQ ID NO: 2104962 - RNA, 24 nt, Homo sapiens
acacuuaucagcagcaacaacugu

SEQ ID NO: 2104963 - RNA, 16 nt, Homo sapiens
ucugaccccuccucac

SEQ ID NO: 2104964 - RNA, 16 nt, Homo sapiens
ggcaaucucagaugca

SEQ ID NO: 2104965 - RNA, 17 nt, Homo sapiens
ucaacagugaagacaga

SEQ ID NO: 2104966 - RNA, 15 nt, Homo sapiens
auaguaaacuaaagu

SEQ ID NO: 2104967 - RNA, 19 nt, Homo sapiens
aacacuacuccuuuuccuc

SEQ ID NO: 2104968 - RNA, 19 nt, Homo sapiens
agcauucuugucacaauaa

SEQ ID NO: 2104969 - RNA, 17 nt, Homo sapiens
uagaauaaaggccugcg

SEQ ID NO: 2104970 - RNA, 14 nt, Homo sapiens
ccucauaccaugga

SEQ ID NO: 2104971 - RNA, 13 nt, Homo sapiens
agucaugcauuuu

SEQ ID NO: 2104972 - RNA, 16 nt, Homo sapiens
aucccuacccuugucc

SEQ ID NO: 2104973 - RNA, 22 nt, Homo sapiens
ggccagcgucuugcucuguuca

SEQ ID NO: 2104974 - RNA, 13 nt, Homo sapiens
uuccuucucccau

SEQ ID NO: 2104975 - RNA, 15 nt, Homo sapiens
cuaccagcuccucca

SEQ ID NO: 2104976 - RNA, 17 nt, Homo sapiens
cuaaugugaucauauga

SEQ ID NO: 2104977 - RNA, 18 nt, Homo sapiens
cauguuuuugcaaauacu

SEQ ID NO: 2104978 - RNA, 22 nt, Homo sapiens
aagagcaaucagaauugugcuu

SEQ ID NO: 2104979 - RNA, 22 nt, Homo sapiens
uaauauuucugaaaaccuacca

SEQ ID NO: 2104980 - RNA, 17 nt, Homo sapiens
ugggaccacuggguaca

SEQ ID NO: 2104981 - RNA, 14 nt, Homo sapiens
accacccugccaag

SEQ ID NO: 2104982 - RNA, 14 nt, Homo sapiens
agacagcuggaccc

SEQ ID NO: 2104983 - RNA, 19 nt, Homo sapiens
gccagggcgcacuuuccac

SEQ ID NO: 2104984 - RNA, 20 nt, Homo sapiens
uuuacaauuugacauacaaa

SEQ ID NO: 2104985 - RNA, 15 nt, Homo sapiens
caugccuggagaaac

SEQ ID NO: 2104986 - RNA, 19 nt, Homo sapiens
cguauguaacaugauguua

SEQ ID NO: 2104987 - RNA, 15 nt, Homo sapiens
ucuaagcacauucca

SEQ ID NO: 2104988 - RNA, 17 nt, Homo sapiens
auuuuucaugcuaucaa

SEQ ID NO: 2104989 - RNA, 17 nt, Homo sapiens
uaacagguuuucuucua

SEQ ID NO: 2104990 - RNA, 18 nt, Homo sapiens
guuaaaacauaaacacau

SEQ ID NO: 2104991 - RNA, 15 nt, Homo sapiens
ucucuguucuuucau

SEQ ID NO: 2104992 - RNA, 15 nt, Homo sapiens
ccuguggcuaaugga

SEQ ID NO: 2104993 - RNA, 21 nt, Homo sapiens
ccuuaagggacaacauccuua

SEQ ID NO: 2104994 - RNA, 14 nt, Homo sapiens
acuaaaaacacugg

SEQ ID NO: 2104995 - RNA, 20 nt, Homo sapiens
aaccccaaaugcucucucuu

SEQ ID NO: 2104996 - RNA, 23 nt, Homo sapiens
aaaguuuuaugagaaaugccagu

SEQ ID NO: 2104997 - RNA, 21 nt, Homo sapiens
cuccccagaugugacuacuga

SEQ ID NO: 2104998 - RNA, 22 nt, Homo sapiens
gcacugucaugcccagcuugga

SEQ ID NO: 2104999 - RNA, 17 nt, Homo sapiens
ccccaugcugggcucac

SEQ ID NO: 2105000 - RNA, 9 nt, Homo sapiens
aaccaauga

SEQ ID NO: 2105001 - RNA, 13 nt, Homo sapiens
ugaaucucucaaa

SEQ ID NO: 2105002 - RNA, 13 nt, Homo sapiens
ugcuucucuccua

SEQ ID NO: 2105003 - RNA, 15 nt, Homo sapiens
cucccacagugacuc

SEQ ID NO: 2105004 - RNA, 22 nt, Homo sapiens
guacacacccuccagcacagac

SEQ ID NO: 2105005 - RNA, 21 nt, Homo sapiens
guaaacuuccaagucauucuc

SEQ ID NO: 2105006 - RNA, 14 nt, Homo sapiens
cuugucacuugcca

SEQ ID NO: 2105007 - RNA, 14 nt, Homo sapiens
ccugaaggaaccaa

SEQ ID NO: 2105008 - RNA, 23 nt, Homo sapiens
ucaugguuuccuccagaggagac

SEQ ID NO: 2105009 - RNA, 12 nt, Homo sapiens
cuacuugaguua

SEQ ID NO: 2105010 - RNA, 22 nt, Homo sapiens
ggcuuccuccagcggcugggug

SEQ ID NO: 2105011 - RNA, 13 nt, Homo sapiens
cuauguauauaaa

SEQ ID NO: 2105012 - RNA, 20 nt, Homo sapiens
gcauccacccagugcugcca

SEQ ID NO: 2105013 - RNA, 19 nt, Homo sapiens
ucaauacuuacauaucuga

SEQ ID NO: 2105014 - RNA, 19 nt, Homo sapiens
ucugcguaggaaaaugaau

SEQ ID NO: 2105015 - RNA, 16 nt, Homo sapiens
uacgcacguggagcug

SEQ ID NO: 2105016 - RNA, 22 nt, Homo sapiens
guccuugaugccagagggccag

SEQ ID NO: 2105017 - RNA, 13 nt, Homo sapiens
gccuccucaguga

SEQ ID NO: 2105018 - RNA, 12 nt, Homo sapiens
ggaggaggccaa

SEQ ID NO: 2105019 - RNA, 18 nt, Homo sapiens
cauuugugugugugcaag

SEQ ID NO: 2105020 - RNA, 18 nt, Homo sapiens
acucuuaggcacaucaau

SEQ ID NO: 2105021 - RNA, 15 nt, Homo sapiens
cucaauauuccugaa

SEQ ID NO: 2105022 - RNA, 14 nt, Homo sapiens
agacaaccaaaaca

SEQ ID NO: 2105023 - RNA, 18 nt, Homo sapiens
guuucauguucuguguca

SEQ ID NO: 2105024 - RNA, 22 nt, Homo sapiens
aguuguuuuaauaacuuaucua

SEQ ID NO: 2105025 - RNA, 13 nt, Homo sapiens
cguuuauuucaca

SEQ ID NO: 2105026 - RNA, 14 nt, Homo sapiens
aaaaugcaguaaca

SEQ ID NO: 2105027 - RNA, 21 nt, Homo sapiens
uugcuauggggacauuccaau

SEQ ID NO: 2105028 - RNA, 14 nt, Homo sapiens
gccacgacauggcu

SEQ ID NO: 2105029 - RNA, 15 nt, Homo sapiens
guucguggcugcaaa

SEQ ID NO: 2105030 - RNA, 23 nt, Homo sapiens
ggccccguggugacauuucccaa

SEQ ID NO: 2105031 - RNA, 12 nt, Homo sapiens
guccaaauccaa

SEQ ID NO: 2105032 - RNA, 13 nt, Homo sapiens
acauucagugaaa

SEQ ID NO: 2105033 - RNA, 19 nt, Homo sapiens
ccuguccuggcaucaguag

SEQ ID NO: 2105034 - RNA, 13 nt, Homo sapiens
uccuaaucaucca

SEQ ID NO: 2105035 - RNA, 21 nt, Homo sapiens
ucaaauuucagaccaguucuu

SEQ ID NO: 2105036 - RNA, 15 nt, Homo sapiens
ggccagguugugucc

SEQ ID NO: 2105037 - RNA, 20 nt, Homo sapiens
gcccauaauucauagugaua

SEQ ID NO: 2105038 - RNA, 20 nt, Homo sapiens
ucaccuaagucucugugaau

SEQ ID NO: 2105039 - RNA, 18 nt, Homo sapiens
ggugcugcggaagaacug

SEQ ID NO: 2105040 - RNA, 23 nt, Homo sapiens
ccucgcaugucucccuccagucc

SEQ ID NO: 2105041 - RNA, 15 nt, Homo sapiens
cuacagcacugugau

SEQ ID NO: 2105042 - RNA, 15 nt, Homo sapiens
aaauucacuaaugau

SEQ ID NO: 2105043 - RNA, 17 nt, Homo sapiens
guaacugugacugauga

SEQ ID NO: 2105044 - RNA, 13 nt, Homo sapiens
cuuuuuucuuaac

SEQ ID NO: 2105045 - RNA, 12 nt, Homo sapiens
aggaagcacaga

SEQ ID NO: 2105046 - RNA, 20 nt, Homo sapiens
ccccucuuagcuuacaggaa

SEQ ID NO: 2105047 - RNA, 16 nt, Homo sapiens
gacagggaaaggucag

SEQ ID NO: 2105048 - RNA, 18 nt, Homo sapiens
cgaauguuagauuccucu

SEQ ID NO: 2105049 - RNA, 15 nt, Homo sapiens
uaccaaguguguugg

SEQ ID NO: 2105050 - RNA, 19 nt, Homo sapiens
cuccaguggcagacaaaca

SEQ ID NO: 2105051 - RNA, 20 nt, Homo sapiens
uaggaacagcaguguucuca

SEQ ID NO: 2105052 - RNA, 19 nt, Homo sapiens
acaaugaguggacaaguca

SEQ ID NO: 2105053 - RNA, 22 nt, Homo sapiens
agaacugaacuguaacuuaaau

SEQ ID NO: 2105054 - RNA, 18 nt, Homo sapiens
ucuagauccuaugugaaa

SEQ ID NO: 2105055 - RNA, 15 nt, Homo sapiens
uucacugccaugccu

SEQ ID NO: 2105056 - RNA, 23 nt, Homo sapiens
ccccaacagcacccucuccagau

SEQ ID NO: 2105057 - RNA, 20 nt, Homo sapiens
uuauccacaggaaaguguua

SEQ ID NO: 2105058 - RNA, 15 nt, Homo sapiens
aagaaaaaggaacua

SEQ ID NO: 2105059 - RNA, 14 nt, Homo sapiens
gaauuuacuacuuu

SEQ ID NO: 2105060 - RNA, 18 nt, Homo sapiens
caucaggaaacaggaaga

SEQ ID NO: 2105061 - RNA, 11 nt, Homo sapiens
uuacaagcccc

SEQ ID NO: 2105062 - RNA, 20 nt, Homo sapiens
uagguguccagcauugcugg

SEQ ID NO: 2105063 - RNA, 21 nt, Homo sapiens
aggcauggcuggggugggggu

SEQ ID NO: 2105064 - RNA, 16 nt, Homo sapiens
ccuggggauggccagg

SEQ ID NO: 2105065 - RNA, 20 nt, Homo sapiens
ugagauuuccugacagggaa

SEQ ID NO: 2105066 - RNA, 20 nt, Homo sapiens
ggcaaaaaaaaaaauuacau

SEQ ID NO: 2105067 - RNA, 20 nt, Homo sapiens
agaccuuucuuugggacugu

SEQ ID NO: 2105068 - RNA, 20 nt, Homo sapiens
cauaaagagaaaaugaugag

SEQ ID NO: 2105069 - RNA, 13 nt, Homo sapiens
auacacuuaauga

SEQ ID NO: 2105070 - RNA, 15 nt, Homo sapiens
caguuugcaccuguc

SEQ ID NO: 2105071 - RNA, 15 nt, Homo sapiens
gaugugcuuauauca

SEQ ID NO: 2105072 - RNA, 17 nt, Homo sapiens
agcccuuauguuuaauc

SEQ ID NO: 2105073 - RNA, 13 nt, Homo sapiens
gcuccaguaucuc

SEQ ID NO: 2105074 - RNA, 13 nt, Homo sapiens
auccuagugcuuu

SEQ ID NO: 2105075 - RNA, 20 nt, Homo sapiens
aagucuagaaaccaguaugg

SEQ ID NO: 2105076 - RNA, 17 nt, Homo sapiens
cucagcuucacccugag

SEQ ID NO: 2105077 - RNA, 17 nt, Homo sapiens
aaacccccacuccagcu

SEQ ID NO: 2105078 - RNA, 23 nt, Homo sapiens
ugcagcccuggcccaucaugggg

SEQ ID NO: 2105079 - RNA, 14 nt, Homo sapiens
uuucaugcagaguu

SEQ ID NO: 2105080 - RNA, 14 nt, Homo sapiens
ugacaugcauuguu

SEQ ID NO: 2105081 - RNA, 23 nt, Homo sapiens
cccuaagcauggucccuugucac

SEQ ID NO: 2105082 - RNA, 14 nt, Homo sapiens
ggugcccaccugug

SEQ ID NO: 2105083 - RNA, 14 nt, Homo sapiens
ccugcccaggugug

SEQ ID NO: 2105084 - RNA, 21 nt, Homo sapiens
ggaggauacugaggcacacag

SEQ ID NO: 2105085 - RNA, 16 nt, Homo sapiens
auuccaugggauguua

SEQ ID NO: 2105086 - RNA, 12 nt, Homo sapiens
cagugcacugaa

SEQ ID NO: 2105087 - RNA, 21 nt, Homo sapiens
ugagcacagggggccuccagg

SEQ ID NO: 2105088 - RNA, 14 nt, Homo sapiens
ccacugaagaguau

SEQ ID NO: 2105089 - RNA, 17 nt, Homo sapiens
cccaaaagcccauucau

SEQ ID NO: 2105090 - RNA, 13 nt, Homo sapiens
uugcaggaaaugu

SEQ ID NO: 2105091 - RNA, 14 nt, Homo sapiens
cuuuguuuacauga

SEQ ID NO: 2105092 - RNA, 22 nt, Homo sapiens
cugcagcccacagaggacagug

SEQ ID NO: 2105093 - RNA, 18 nt, Homo sapiens
aagugcugagauuacaca

SEQ ID NO: 2105094 - RNA, 13 nt, Homo sapiens
gugcuguuucaaa

SEQ ID NO: 2105095 - RNA, 14 nt, Homo sapiens
agcuagaacauucc

SEQ ID NO: 2105096 - RNA, 12 nt, Homo sapiens
gcagaaagggaa

SEQ ID NO: 2105097 - RNA, 16 nt, Homo sapiens
ucccaacaacauccau

SEQ ID NO: 2105098 - RNA, 20 nt, Homo sapiens
gugaggucaucccggggcca

SEQ ID NO: 2105099 - RNA, 18 nt, Homo sapiens
caagguaaauauucauuu

SEQ ID NO: 2105100 - RNA, 22 nt, Homo sapiens
gucaucaugaacuggcuuguac

SEQ ID NO: 2105101 - RNA, 17 nt, Homo sapiens
agcugaagaguugcccc

SEQ ID NO: 2105102 - RNA, 17 nt, Homo sapiens
ccaagauggguggcacc

SEQ ID NO: 2105103 - RNA, 22 nt, Homo sapiens
gccagucacuccguuuugcaaa

SEQ ID NO: 2105104 - RNA, 15 nt, Homo sapiens
aaaaugacacaacuu

SEQ ID NO: 2105105 - RNA, 15 nt, Homo sapiens
cugcauuuacagugu

SEQ ID NO: 2105106 - RNA, 17 nt, Homo sapiens
gagaugaauaugagcuc

SEQ ID NO: 2105107 - RNA, 18 nt, Homo sapiens
uccuuuaguaccugaaaa

SEQ ID NO: 2105108 - RNA, 15 nt, Homo sapiens
caaacugaggaauuu

SEQ ID NO: 2105109 - RNA, 13 nt, Homo sapiens
acuuucaaacaua

SEQ ID NO: 2105110 - RNA, 23 nt, Homo sapiens
acugcaaccuccgcaucccgggu

SEQ ID NO: 2105111 - RNA, 22 nt, Homo sapiens
cugaagcugacagcacuacaaa

SEQ ID NO: 2105112 - RNA, 17 nt, Homo sapiens
uccuggacaaccuggac

SEQ ID NO: 2105113 - RNA, 14 nt, Homo sapiens
uuuggaacaauuau

SEQ ID NO: 2105114 - RNA, 14 nt, Homo sapiens
aauuguacuuugaa

SEQ ID NO: 2105115 - RNA, 13 nt, Homo sapiens
ccaugcucucuca

SEQ ID NO: 2105116 - RNA, 24 nt, Homo sapiens
gaacacagcaguucugcagaggac

SEQ ID NO: 2105117 - RNA, 14 nt, Homo sapiens
caaguaacauuuug

SEQ ID NO: 2105118 - RNA, 21 nt, Homo sapiens
uauauaauaaauacucaguga

SEQ ID NO: 2105119 - RNA, 15 nt, Homo sapiens
accuaauccaggcag

SEQ ID NO: 2105120 - RNA, 18 nt, Homo sapiens
caagggucucacugcuca

SEQ ID NO: 2105121 - RNA, 18 nt, Homo sapiens
auuccauaaaucuauugu

SEQ ID NO: 2105122 - RNA, 17 nt, Homo sapiens
caacugcagaccaacua

SEQ ID NO: 2105123 - RNA, 20 nt, Homo sapiens
uugguuuuuuuuugagacag

SEQ ID NO: 2105124 - RNA, 22 nt, Homo sapiens
uacagaaguccccucuacuuua

SEQ ID NO: 2105125 - RNA, 18 nt, Homo sapiens
acacaggcaaaauccuug

SEQ ID NO: 2105126 - RNA, 17 nt, Homo sapiens
ugagguagaggaaaauc

SEQ ID NO: 2105127 - RNA, 21 nt, Homo sapiens
cuuuggguggcucacuacuga

SEQ ID NO: 2105128 - RNA, 23 nt, Homo sapiens
auuuaaauuacaauuuuaucugu

SEQ ID NO: 2105129 - RNA, 19 nt, Homo sapiens
ggugauuuccucuaaagaa

SEQ ID NO: 2105130 - RNA, 22 nt, Homo sapiens
gggccuggcaggccagugucug

SEQ ID NO: 2105131 - RNA, 16 nt, Homo sapiens
cacagggucugcacuc

SEQ ID NO: 2105132 - RNA, 18 nt, Homo sapiens
ccuugcccaucagccauu

SEQ ID NO: 2105133 - RNA, 14 nt, Homo sapiens
cagaaagauuuucc

SEQ ID NO: 2105134 - RNA, 14 nt, Homo sapiens
gguccugcacuguc

SEQ ID NO: 2105135 - RNA, 20 nt, Homo sapiens
gugcaguggugcaaucacag

SEQ ID NO: 2105136 - RNA, 23 nt, Homo sapiens
ucugucucuaaccauucaaauga

SEQ ID NO: 2105137 - RNA, 11 nt, Homo sapiens
ucccaaagugu

SEQ ID NO: 2105138 - RNA, 16 nt, Homo sapiens
aaauauucuccauggg

SEQ ID NO: 2105139 - RNA, 21 nt, Homo sapiens
aauuaaaggaaaaaaauggaa

SEQ ID NO: 2105140 - RNA, 23 nt, Homo sapiens
gguuagaaucccauggauguuuc

SEQ ID NO: 2105141 - RNA, 20 nt, Homo sapiens
ugcuggaguccuguucucag

SEQ ID NO: 2105142 - RNA, 18 nt, Homo sapiens
gaauuggccgcugucacu

SEQ ID NO: 2105143 - RNA, 20 nt, Homo sapiens
gaauggcauuugcaauaaaa

SEQ ID NO: 2105144 - RNA, 18 nt, Homo sapiens
guuacugaaaucuuguaa

SEQ ID NO: 2105145 - RNA, 20 nt, Homo sapiens
gugguucuuaaauguuuaua

SEQ ID NO: 2105146 - RNA, 13 nt, Homo sapiens
gucugucuugaga

SEQ ID NO: 2105147 - RNA, 14 nt, Homo sapiens
aaauugcagaagaa

SEQ ID NO: 2105148 - RNA, 20 nt, Homo sapiens
aauagagcgugugcuguuga

SEQ ID NO: 2105149 - RNA, 18 nt, Homo sapiens
ugccucccuucaugcaug

SEQ ID NO: 2105150 - RNA, 20 nt, Homo sapiens
cauaauucuaagucuuccac

SEQ ID NO: 2105151 - RNA, 19 nt, Homo sapiens
gaaggaaaagauacccaaa

SEQ ID NO: 2105152 - RNA, 15 nt, Homo sapiens
uccugagcacccaga

SEQ ID NO: 2105153 - RNA, 20 nt, Homo sapiens
aaagugcuagccacuggaaa

SEQ ID NO: 2105154 - RNA, 22 nt, Homo sapiens
gcaaaauguuucaaguacugua

SEQ ID NO: 2105155 - RNA, 22 nt, Homo sapiens
uaauaaucauucuuuccccuca

SEQ ID NO: 2105156 - RNA, 20 nt, Homo sapiens
aggcaggauauuccaagggc

SEQ ID NO: 2105157 - RNA, 19 nt, Homo sapiens
uguaauucagguaccacgu

SEQ ID NO: 2105158 - RNA, 15 nt, Homo sapiens
gaaugauucauguua

SEQ ID NO: 2105159 - RNA, 16 nt, Homo sapiens
accuguccguguuaca

SEQ ID NO: 2105160 - RNA, 14 nt, Homo sapiens
guucuguguuugau

SEQ ID NO: 2105161 - RNA, 14 nt, Homo sapiens
cagggccucuguca

SEQ ID NO: 2105162 - RNA, 23 nt, Homo sapiens
cuuaacgugaucaucaccacuga

SEQ ID NO: 2105163 - RNA, 18 nt, Homo sapiens
ccuccaccagauguccac

SEQ ID NO: 2105164 - RNA, 22 nt, Homo sapiens
uccagccaauaaaucaacucca

SEQ ID NO: 2105165 - RNA, 21 nt, Homo sapiens
guuggacaaaccgagugcaau

SEQ ID NO: 2105166 - RNA, 14 nt, Homo sapiens
cuacacagacauua

SEQ ID NO: 2105167 - RNA, 15 nt, Homo sapiens
ugggaagcaaaaccc

SEQ ID NO: 2105168 - RNA, 22 nt, Homo sapiens
augcucagcccugacuggugcu

SEQ ID NO: 2105169 - RNA, 19 nt, Homo sapiens
cuaauggggacacagauca

SEQ ID NO: 2105170 - RNA, 19 nt, Homo sapiens
auuuuauucccaagcucua

SEQ ID NO: 2105171 - RNA, 13 nt, Homo sapiens
cuuuauagcacau

SEQ ID NO: 2105172 - RNA, 23 nt, Homo sapiens
cuuccgguuggaggcucucaugu

SEQ ID NO: 2105173 - RNA, 16 nt, Homo sapiens
gcucacacccuaccuu

SEQ ID NO: 2105174 - RNA, 17 nt, Homo sapiens
ggcuucagccccugggg

SEQ ID NO: 2105175 - RNA, 22 nt, Homo sapiens
auguccagaagaauauucagga

SEQ ID NO: 2105176 - RNA, 22 nt, Homo sapiens
gauuuauuuaagggggaaaaag

SEQ ID NO: 2105177 - RNA, 23 nt, Homo sapiens
uuaucugucccagguuaucuggg

SEQ ID NO: 2105178 - RNA, 16 nt, Homo sapiens
accaggagcugcucac

SEQ ID NO: 2105179 - RNA, 21 nt, Homo sapiens
caaucugagccagugcuuuaa

SEQ ID NO: 2105180 - RNA, 15 nt, Homo sapiens
gagugagagcacaaa

SEQ ID NO: 2105181 - RNA, 17 nt, Homo sapiens
gugucugagagcaaagu

SEQ ID NO: 2105182 - RNA, 22 nt, Homo sapiens
agagcaucugucccacugggac

SEQ ID NO: 2105183 - RNA, 19 nt, Homo sapiens
gauacaucaucgggaaaaa

SEQ ID NO: 2105184 - RNA, 19 nt, Homo sapiens
aagaaggccagcccacugg

SEQ ID NO: 2105185 - RNA, 13 nt, Homo sapiens
aaggcaccugcuc

SEQ ID NO: 2105186 - RNA, 14 nt, Homo sapiens
agugaucuucccac

SEQ ID NO: 2105187 - RNA, 19 nt, Homo sapiens
guucucaauucugucucau

SEQ ID NO: 2105188 - RNA, 14 nt, Homo sapiens
gcuacaaaugcauu

SEQ ID NO: 2105189 - RNA, 20 nt, Homo sapiens
cccuggagaguucaauggcu

SEQ ID NO: 2105190 - RNA, 19 nt, Homo sapiens
acugcaauacaaguuucau

SEQ ID NO: 2105191 - RNA, 19 nt, Homo sapiens
gagugcaauggugugaucu

SEQ ID NO: 2105192 - RNA, 17 nt, Homo sapiens
agagggggucucagaaa

SEQ ID NO: 2105193 - RNA, 18 nt, Homo sapiens
ugacguggcacuuaccca

SEQ ID NO: 2105194 - RNA, 22 nt, Homo sapiens
gaggucagugcuucgugccucg

SEQ ID NO: 2105195 - RNA, 13 nt, Homo sapiens
aagaggugggagc

SEQ ID NO: 2105196 - RNA, 19 nt, Homo sapiens
ucacuaccaagcagcucac

SEQ ID NO: 2105197 - RNA, 13 nt, Homo sapiens
cuggcacuggcaa

SEQ ID NO: 2105198 - RNA, 19 nt, Homo sapiens
aauuauguuuugugauuca

SEQ ID NO: 2105199 - RNA, 21 nt, Homo sapiens
cuaaugugcuucuaguaggca

SEQ ID NO: 2105200 - RNA, 17 nt, Homo sapiens
uguuugucagauaugau

SEQ ID NO: 2105201 - RNA, 17 nt, Homo sapiens
uaauucgagcaaacaac

SEQ ID NO: 2105202 - RNA, 15 nt, Homo sapiens
cuggcugccccguga

SEQ ID NO: 2105203 - RNA, 20 nt, Homo sapiens
caguggcacaaucauggcuc

SEQ ID NO: 2105204 - RNA, 16 nt, Homo sapiens
cagggaucauagcuga

SEQ ID NO: 2105205 - RNA, 18 nt, Homo sapiens
cacaaaggcaugcuggag

SEQ ID NO: 2105206 - RNA, 18 nt, Homo sapiens
agugacaugcauucacau

SEQ ID NO: 2105207 - RNA, 17 nt, Homo sapiens
auuccagugcuagaaaa

SEQ ID NO: 2105208 - RNA, 23 nt, Homo sapiens
guaucaaguggcaugugcuguga

SEQ ID NO: 2105209 - RNA, 22 nt, Homo sapiens
uuccucuugugauuucuuuaaa

SEQ ID NO: 2105210 - RNA, 20 nt, Homo sapiens
acacugaaucucaccugcug

SEQ ID NO: 2105211 - RNA, 16 nt, Homo sapiens
gaugacaacuggaaua

SEQ ID NO: 2105212 - RNA, 13 nt, Homo sapiens
cacauaugacaau

SEQ ID NO: 2105213 - RNA, 19 nt, Homo sapiens
ccugaaaaggguguugcua

SEQ ID NO: 2105214 - RNA, 12 nt, Homo sapiens
uucucucagaaa

SEQ ID NO: 2105215 - RNA, 15 nt, Homo sapiens
gcagggucuuuucau

SEQ ID NO: 2105216 - RNA, 19 nt, Homo sapiens
uccaaaggcauaagacccu

SEQ ID NO: 2105217 - RNA, 13 nt, Homo sapiens
uugcccaccccuc

SEQ ID NO: 2105218 - RNA, 17 nt, Homo sapiens
uauauuuuugguggugg

SEQ ID NO: 2105219 - RNA, 22 nt, Homo sapiens
ggcuagauccgagguggcagcu

SEQ ID NO: 2105220 - RNA, 19 nt, Homo sapiens
caggugaauuguuugaacc

SEQ ID NO: 2105221 - RNA, 12 nt, Homo sapiens
ucaaggcccacu

SEQ ID NO: 2105222 - RNA, 14 nt, Homo sapiens
gcgagcaggugccc

SEQ ID NO: 2105223 - RNA, 17 nt, Homo sapiens
caaagguugcagugagu

SEQ ID NO: 2105224 - RNA, 21 nt, Homo sapiens
agccuaagaauaugaucaggu

SEQ ID NO: 2105225 - RNA, 18 nt, Homo sapiens
cuuaugccccugcacuga

SEQ ID NO: 2105226 - RNA, 22 nt, Homo sapiens
accgaauuuaguucaugcauug

SEQ ID NO: 2105227 - RNA, 22 nt, Homo sapiens
uuauaguaacucccaucaccuc

SEQ ID NO: 2105228 - RNA, 13 nt, Homo sapiens
cugaacaugccua

SEQ ID NO: 2105229 - RNA, 20 nt, Homo sapiens
cuacacacguaccuucaugu

SEQ ID NO: 2105230 - RNA, 19 nt, Homo sapiens
ucuugcuuucuaugcuguu

SEQ ID NO: 2105231 - RNA, 19 nt, Homo sapiens
auuggugcaaauuggcuaa

SEQ ID NO: 2105232 - RNA, 19 nt, Homo sapiens
ccuaguacaauauagugau

SEQ ID NO: 2105233 - RNA, 17 nt, Homo sapiens
ucugcucucauccauuc

SEQ ID NO: 2105234 - RNA, 18 nt, Homo sapiens
auggaggcgcugcugcca

SEQ ID NO: 2105235 - RNA, 20 nt, Homo sapiens
cuuacacagguuucagaaaa

SEQ ID NO: 2105236 - RNA, 16 nt, Homo sapiens
gaccccacacuccaug

SEQ ID NO: 2105237 - RNA, 17 nt, Homo sapiens
gguggagcuugcaguga

SEQ ID NO: 2105238 - RNA, 16 nt, Homo sapiens
gggcaacccuggugac

SEQ ID NO: 2105239 - RNA, 17 nt, Homo sapiens
gcaguugggaggaggaa

SEQ ID NO: 2105240 - RNA, 20 nt, Homo sapiens
auucaaaaaaaaaagcaaca

SEQ ID NO: 2105241 - RNA, 15 nt, Homo sapiens
agcuugccucagggc

SEQ ID NO: 2105242 - RNA, 16 nt, Homo sapiens
ugugaccuugggacca

SEQ ID NO: 2105243 - RNA, 18 nt, Homo sapiens
acuguacucugugggcaa

SEQ ID NO: 2105244 - RNA, 22 nt, Homo sapiens
auuccucuugccucucucagga

SEQ ID NO: 2105245 - RNA, 18 nt, Homo sapiens
ugaagggcaggugguggg

SEQ ID NO: 2105246 - RNA, 16 nt, Homo sapiens
gacuccaccucaaaaa

SEQ ID NO: 2105247 - RNA, 18 nt, Homo sapiens
cacaucuaacaaagucaa

SEQ ID NO: 2105248 - RNA, 22 nt, Homo sapiens
auaaaacgcaaagggcugaaag

SEQ ID NO: 2105249 - RNA, 21 nt, Homo sapiens
accaucuucguacaugaauaa

SEQ ID NO: 2105250 - RNA, 16 nt, Homo sapiens
uuaggaaaaauuccac

SEQ ID NO: 2105251 - RNA, 23 nt, Homo sapiens
uucauucucacucugcuuugcau

SEQ ID NO: 2105252 - RNA, 21 nt, Homo sapiens
uuggaaacauuuaacucagac

SEQ ID NO: 2105253 - RNA, 16 nt, Homo sapiens
acugcagauagccaga

SEQ ID NO: 2105254 - RNA, 23 nt, Homo sapiens
aauguuacuaaauuuucuaauua

SEQ ID NO: 2105255 - RNA, 15 nt, Homo sapiens
acauacauacauaua

SEQ ID NO: 2105256 - RNA, 15 nt, Homo sapiens
auauauauauauaca

SEQ ID NO: 2105257 - RNA, 18 nt, Homo sapiens
cucugaagguccaaagag

SEQ ID NO: 2105258 - RNA, 18 nt, Homo sapiens
aauacagacaaagcauaa

SEQ ID NO: 2105259 - RNA, 14 nt, Homo sapiens
ccccucccuggaug

SEQ ID NO: 2105260 - RNA, 19 nt, Homo sapiens
acaagggucacaauacugu

SEQ ID NO: 2105261 - RNA, 18 nt, Homo sapiens
cuucucagaagcacagaa

SEQ ID NO: 2105262 - RNA, 18 nt, Homo sapiens
auuuagugaaguugugca

SEQ ID NO: 2105263 - RNA, 18 nt, Homo sapiens
ccugaguagcugggacua

SEQ ID NO: 2105264 - RNA, 14 nt, Homo sapiens
gugguacagcacug

SEQ ID NO: 2105265 - RNA, 18 nt, Homo sapiens
aauguuuuaaacauucuu

SEQ ID NO: 2105266 - RNA, 15 nt, Homo sapiens
cuucacuggcuucca

SEQ ID NO: 2105267 - RNA, 17 nt, Homo sapiens
agagauuagaauaucug

SEQ ID NO: 2105268 - RNA, 13 nt, Homo sapiens
gcucuuaggugcu

SEQ ID NO: 2105269 - RNA, 15 nt, Homo sapiens
ccuucccucuaagcc

SEQ ID NO: 2105270 - RNA, 21 nt, Homo sapiens
cuucaaugcaaaguacaugua

SEQ ID NO: 2105271 - RNA, 19 nt, Homo sapiens
cuagaaucagagcuggauu

SEQ ID NO: 2105272 - RNA, 16 nt, Homo sapiens
uuccuguuugauguga

SEQ ID NO: 2105273 - RNA, 12 nt, Homo sapiens
guaaguuuugaa

SEQ ID NO: 2105274 - RNA, 17 nt, Homo sapiens
ggaaacuaacaauauga

SEQ ID NO: 2105275 - RNA, 21 nt, Homo sapiens
ccaugguagacugugacacag

SEQ ID NO: 2105276 - RNA, 23 nt, Homo sapiens
gcaaaugugcuggucacccuuca

SEQ ID NO: 2105277 - RNA, 16 nt, Homo sapiens
uucuugaaaacuggga

SEQ ID NO: 2105278 - RNA, 16 nt, Homo sapiens
uaagaaacccucuguc

SEQ ID NO: 2105279 - RNA, 18 nt, Homo sapiens
caauuuuuuaucaugcau

SEQ ID NO: 2105280 - RNA, 20 nt, Homo sapiens
aauuaaaaaaaaaacuucau

SEQ ID NO: 2105281 - RNA, 21 nt, Homo sapiens
ugaaugccucgcucccuucaa

SEQ ID NO: 2105282 - RNA, 15 nt, Homo sapiens
uauggugcuguauau

SEQ ID NO: 2105283 - RNA, 17 nt, Homo sapiens
cacaugcaccuacccau

SEQ ID NO: 2105284 - RNA, 17 nt, Homo sapiens
ucuucccauacuugcau

SEQ ID NO: 2105285 - RNA, 18 nt, Homo sapiens
agcugacauagggguaag

SEQ ID NO: 2105286 - RNA, 14 nt, Homo sapiens
acaaguaguucugu

SEQ ID NO: 2105287 - RNA, 17 nt, Homo sapiens
aauauggaacuguaaua

SEQ ID NO: 2105288 - RNA, 22 nt, Homo sapiens
caagauaccuucaugguguuca

SEQ ID NO: 2105289 - RNA, 17 nt, Homo sapiens
aaauauugcuuaugucu

SEQ ID NO: 2105290 - RNA, 22 nt, Homo sapiens
ggcguggggccaauacccagac

SEQ ID NO: 2105291 - RNA, 11 nt, Homo sapiens
uagauguugcu

SEQ ID NO: 2105292 - RNA, 12 nt, Homo sapiens
acauguauacau

SEQ ID NO: 2105293 - RNA, 12 nt, Homo sapiens
auauguauauau

SEQ ID NO: 2105294 - RNA, 21 nt, Homo sapiens
uccaccagacgccuuccucuc

SEQ ID NO: 2105295 - RNA, 15 nt, Homo sapiens
uacccacuucuccca

SEQ ID NO: 2105296 - RNA, 13 nt, Homo sapiens
accuauuuuccuc

SEQ ID NO: 2105297 - RNA, 18 nt, Homo sapiens
gaauugagaauuuugauu

SEQ ID NO: 2105298 - RNA, 15 nt, Homo sapiens
acaugcccauucaca

SEQ ID NO: 2105299 - RNA, 22 nt, Homo sapiens
acauccccagagcccagcucuu

SEQ ID NO: 2105300 - RNA, 22 nt, Homo sapiens
ucuccagcuucccgaguaccag

SEQ ID NO: 2105301 - RNA, 23 nt, Homo sapiens
gauuucaugccuggugcuuccaa

SEQ ID NO: 2105302 - RNA, 13 nt, Homo sapiens
cuccauacuuugg

SEQ ID NO: 2105303 - RNA, 15 nt, Homo sapiens
cugaaucaugucugu

SEQ ID NO: 2105304 - RNA, 12 nt, Homo sapiens
gacaaucaugua

SEQ ID NO: 2105305 - RNA, 15 nt, Homo sapiens
aaaacuuugacaaau

SEQ ID NO: 2105306 - RNA, 15 nt, Homo sapiens
gccauaccaggguga

SEQ ID NO: 2105307 - RNA, 13 nt, Homo sapiens
gugggccugugaa

SEQ ID NO: 2105308 - RNA, 15 nt, Homo sapiens
aacaacauuccucaa

SEQ ID NO: 2105309 - RNA, 17 nt, Homo sapiens
uggcucaggggagcaag

SEQ ID NO: 2105310 - RNA, 16 nt, Homo sapiens
cacaucuaaccucauc

SEQ ID NO: 2105311 - RNA, 17 nt, Homo sapiens
aaaccaggaacucugga

SEQ ID NO: 2105312 - RNA, 11 nt, Homo sapiens
aaccacuucag

SEQ ID NO: 2105313 - RNA, 21 nt, Homo sapiens
ugaauauaaaugggaaaucag

SEQ ID NO: 2105314 - RNA, 24 nt, Homo sapiens
agcucuggaugaagcucuggccaa

SEQ ID NO: 2105315 - RNA, 21 nt, Homo sapiens
ccucaguguaccacuacuuag

SEQ ID NO: 2105316 - RNA, 13 nt, Homo sapiens
acuugcacugugc

SEQ ID NO: 2105317 - RNA, 15 nt, Homo sapiens
uuuaugaaccuagag

SEQ ID NO: 2105318 - RNA, 16 nt, Homo sapiens
gcuuuccacaucccca

SEQ ID NO: 2105319 - RNA, 15 nt, Homo sapiens
aaauugucuuaaugg

SEQ ID NO: 2105320 - RNA, 17 nt, Homo sapiens
acugaagacaggcacaa

SEQ ID NO: 2105321 - RNA, 22 nt, Homo sapiens
aaagaaguuggggacacaugua

SEQ ID NO: 2105322 - RNA, 15 nt, Homo sapiens
cuuggcugugcccuc

SEQ ID NO: 2105323 - RNA, 15 nt, Homo sapiens
auuauauaaggcauu

SEQ ID NO: 2105324 - RNA, 21 nt, Homo sapiens
aguuggggguguggcucugcc

SEQ ID NO: 2105325 - RNA, 21 nt, Homo sapiens
uaucugagagaccugugugaa

SEQ ID NO: 2105326 - RNA, 21 nt, Homo sapiens
ccccugggcaggugugugugg

SEQ ID NO: 2105327 - RNA, 19 nt, Homo sapiens
gcugaucuucuagaugcca

SEQ ID NO: 2105328 - RNA, 19 nt, Homo sapiens
uaaacagaaauccuuucau

SEQ ID NO: 2105329 - RNA, 16 nt, Homo sapiens
ucucccuggcccucag

SEQ ID NO: 2105330 - RNA, 24 nt, Homo sapiens
acaaaggagagcuagcagcaggga

SEQ ID NO: 2105331 - RNA, 20 nt, Homo sapiens
uucauauuucaaaccacaau

SEQ ID NO: 2105332 - RNA, 15 nt, Homo sapiens
uauauguauacauau

SEQ ID NO: 2105333 - RNA, 23 nt, Homo sapiens
ggcaggugggcuggccuggcaca

SEQ ID NO: 2105334 - RNA, 12 nt, Homo sapiens
uaagacugugua

SEQ ID NO: 2105335 - RNA, 14 nt, Homo sapiens
uuacauuuauacau

SEQ ID NO: 2105336 - RNA, 20 nt, Homo sapiens
cguuucccguuagucucuga

SEQ ID NO: 2105337 - RNA, 23 nt, Homo sapiens
ugaaaguucagauuguguuacuc

SEQ ID NO: 2105338 - RNA, 14 nt, Homo sapiens
uuugcacaggagaa

SEQ ID NO: 2105339 - RNA, 16 nt, Homo sapiens
uccaugauacuuuaau

SEQ ID NO: 2105340 - RNA, 16 nt, Homo sapiens
uccuauuuucgaugaa

SEQ ID NO: 2105341 - RNA, 22 nt, Homo sapiens
acuccaggggcccccguguuca

SEQ ID NO: 2105342 - RNA, 13 nt, Homo sapiens
uagcauauauaau

SEQ ID NO: 2105343 - RNA, 13 nt, Homo sapiens
auugccauuguca

SEQ ID NO: 2105344 - RNA, 22 nt, Homo sapiens
gguaaaaguucuuuuugcucua

SEQ ID NO: 2105345 - RNA, 17 nt, Homo sapiens
auuagcuuacugauuaa

SEQ ID NO: 2105346 - RNA, 17 nt, Homo sapiens
caucauaagaauagcug

SEQ ID NO: 2105347 - RNA, 20 nt, Homo sapiens
ccuuucagaugucuucugcc

SEQ ID NO: 2105348 - RNA, 22 nt, Homo sapiens
aauuuaccaucaaacaaaucau

SEQ ID NO: 2105349 - RNA, 20 nt, Homo sapiens
uguggguuuuuucacauaaa

SEQ ID NO: 2105350 - RNA, 21 nt, Homo sapiens
acuuacaaacugcgguauaca

SEQ ID NO: 2105351 - RNA, 18 nt, Homo sapiens
cccaacaggaggacaauu

SEQ ID NO: 2105352 - RNA, 19 nt, Homo sapiens
gccauuuuuugucugugau

SEQ ID NO: 2105353 - RNA, 21 nt, Homo sapiens
ccccugccccguccccugggc

SEQ ID NO: 2105354 - RNA, 18 nt, Homo sapiens
ugugggcugugggcugca

SEQ ID NO: 2105355 - RNA, 15 nt, Homo sapiens
gacaugcuaaauaac

SEQ ID NO: 2105356 - RNA, 13 nt, Homo sapiens
aaaaccaccaaaa

SEQ ID NO: 2105357 - RNA, 13 nt, Homo sapiens
ccagccacacaga

SEQ ID NO: 2105358 - RNA, 22 nt, Homo sapiens
gcuuggaaaggaccaguaugcu

SEQ ID NO: 2105359 - RNA, 19 nt, Homo sapiens
cuugucccucuuugaggga

SEQ ID NO: 2105360 - RNA, 16 nt, Homo sapiens
ucaugaaagcagugaa

SEQ ID NO: 2105361 - RNA, 20 nt, Homo sapiens
cucacagccagcgaacugac

SEQ ID NO: 2105362 - RNA, 20 nt, Homo sapiens
acugcacuuuccaaugccac

SEQ ID NO: 2105363 - RNA, 22 nt, Homo sapiens
aggaagguggugcuuacauccu

SEQ ID NO: 2105364 - RNA, 14 nt, Homo sapiens
cuggggccccaucu

SEQ ID NO: 2105365 - RNA, 16 nt, Homo sapiens
ugcgucucauacucac

SEQ ID NO: 2105366 - RNA, 12 nt, Homo sapiens
acaaaguuugcu

SEQ ID NO: 2105367 - RNA, 15 nt, Homo sapiens
cuccauacguucaga

SEQ ID NO: 2105368 - RNA, 14 nt, Homo sapiens
aacguuuuuccagu

SEQ ID NO: 2105369 - RNA, 16 nt, Homo sapiens
uagaaagcaagaugua

SEQ ID NO: 2105370 - RNA, 19 nt, Homo sapiens
cuuucccuggugauggucu

SEQ ID NO: 2105371 - RNA, 18 nt, Homo sapiens
uaggaauguccaccauga

SEQ ID NO: 2105372 - RNA, 20 nt, Homo sapiens
uacucauuaaaaauaauaga

SEQ ID NO: 2105373 - RNA, 18 nt, Homo sapiens
cccaggcuggagugaucu

SEQ ID NO: 2105374 - RNA, 16 nt, Homo sapiens
uuuuauaucaugcaaa

SEQ ID NO: 2105375 - RNA, 15 nt, Homo sapiens
aggagauuccuuucc

SEQ ID NO: 2105376 - RNA, 18 nt, Homo sapiens
uauugcuggcaucugugc

SEQ ID NO: 2105377 - RNA, 17 nt, Homo sapiens
cauaaauaaaaauucaa

SEQ ID NO: 2105378 - RNA, 18 nt, Homo sapiens
caugugccuugaacauau

SEQ ID NO: 2105379 - RNA, 19 nt, Homo sapiens
aucaagacuaucuacaaaa

SEQ ID NO: 2105380 - RNA, 19 nt, Homo sapiens
agcuaaaauguuacucccu

SEQ ID NO: 2105381 - RNA, 14 nt, Homo sapiens
uugauuggugauua

SEQ ID NO: 2105382 - RNA, 19 nt, Homo sapiens
uagcccagacucugagcug

SEQ ID NO: 2105383 - RNA, 22 nt, Homo sapiens
cuucaaguauaacaacuuugaa

SEQ ID NO: 2105384 - RNA, 17 nt, Homo sapiens
ggaugucaauagcauug

SEQ ID NO: 2105385 - RNA, 15 nt, Homo sapiens
uuccuucagagugaa

SEQ ID NO: 2105386 - RNA, 17 nt, Homo sapiens
agaugaacugacugaag

SEQ ID NO: 2105387 - RNA, 22 nt, Homo sapiens
acaaauuucauugcacuuuccu

SEQ ID NO: 2105388 - RNA, 10 nt, Homo sapiens
cuucagucuu

SEQ ID NO: 2105389 - RNA, 21 nt, Homo sapiens
ccugaaggugcugacaaagau

SEQ ID NO: 2105390 - RNA, 15 nt, Homo sapiens
uccuguggucucuga

SEQ ID NO: 2105391 - RNA, 22 nt, Homo sapiens
cuaaucaauguacaagacuuua

SEQ ID NO: 2105392 - RNA, 17 nt, Homo sapiens
uaacucagacacaaaua

SEQ ID NO: 2105393 - RNA, 23 nt, Homo sapiens
aauaucuaccugcccucucucag

SEQ ID NO: 2105394 - RNA, 18 nt, Homo sapiens
auccuguuuuuaaaccau

SEQ ID NO: 2105395 - RNA, 16 nt, Homo sapiens
gaagagaaaugcugcu

SEQ ID NO: 2105396 - RNA, 16 nt, Homo sapiens
uugcuguuuuucuggu

SEQ ID NO: 2105397 - RNA, 18 nt, Homo sapiens
gacccuaaaucugaggaa

SEQ ID NO: 2105398 - RNA, 15 nt, Homo sapiens
augcaaauuucauga

SEQ ID NO: 2105399 - RNA, 15 nt, Homo sapiens
acuccuguugccaug

SEQ ID NO: 2105400 - RNA, 19 nt, Homo sapiens
agauaccuuaaaauuugaa

SEQ ID NO: 2105401 - RNA, 17 nt, Homo sapiens
cucuggcuucugugaug

SEQ ID NO: 2105402 - RNA, 15 nt, Homo sapiens
auuucacauuccuga

SEQ ID NO: 2105403 - RNA, 21 nt, Homo sapiens
auuuuacuuuguugaguauua

SEQ ID NO: 2105404 - RNA, 19 nt, Homo sapiens
uccagaaaaacauuuggca

SEQ ID NO: 2105405 - RNA, 21 nt, Homo sapiens
uaaaaguguauuuuuguuuaa

SEQ ID NO: 2105406 - RNA, 21 nt, Homo sapiens
cuggggcuuuagcuagaagaa

SEQ ID NO: 2105407 - RNA, 18 nt, Homo sapiens
ccuuauguccaccacuuc

SEQ ID NO: 2105408 - RNA, 13 nt, Homo sapiens
uccaaaaagggga

SEQ ID NO: 2105409 - RNA, 19 nt, Homo sapiens
auacguacuuuagcuggaa

SEQ ID NO: 2105410 - RNA, 16 nt, Homo sapiens
auuccccacccugaaa

SEQ ID NO: 2105411 - RNA, 16 nt, Homo sapiens
augggacucaaugcac

SEQ ID NO: 2105412 - RNA, 15 nt, Homo sapiens
gggcagguccuaguc

SEQ ID NO: 2105413 - RNA, 16 nt, Homo sapiens
uucaugcucccagcca

SEQ ID NO: 2105414 - RNA, 12 nt, Homo sapiens
guccaaaggaca

SEQ ID NO: 2105415 - RNA, 12 nt, Homo sapiens
uuaaaaaguaac

SEQ ID NO: 2105416 - RNA, 18 nt, Homo sapiens
acguucuggaacauucug

SEQ ID NO: 2105417 - RNA, 18 nt, Homo sapiens
caaaacagauuguuugca

SEQ ID NO: 2105418 - RNA, 17 nt, Homo sapiens
ggaagugugugaucugu

SEQ ID NO: 2105419 - RNA, 13 nt, Homo sapiens
ugggguuccugcu

SEQ ID NO: 2105420 - RNA, 20 nt, Homo sapiens
cucuuuacuugaaauuuggc

SEQ ID NO: 2105421 - RNA, 14 nt, Homo sapiens
uugcauagugccug

SEQ ID NO: 2105422 - RNA, 20 nt, Homo sapiens
aguagaauugauuucccuuc

SEQ ID NO: 2105423 - RNA, 16 nt, Homo sapiens
accucgugaucugccc

SEQ ID NO: 2105424 - RNA, 14 nt, Homo sapiens
acucucugaagaug

SEQ ID NO: 2105425 - RNA, 18 nt, Homo sapiens
accgguuugcuacauucu

SEQ ID NO: 2105426 - RNA, 19 nt, Homo sapiens
uccgagggcccaacacugg

SEQ ID NO: 2105427 - RNA, 17 nt, Homo sapiens
acugcugccucagcuca

SEQ ID NO: 2105428 - RNA, 17 nt, Homo sapiens
gcaaguacgcaagaaau

SEQ ID NO: 2105429 - RNA, 14 nt, Homo sapiens
aacuagccaaucag

SEQ ID NO: 2105430 - RNA, 17 nt, Homo sapiens
ugggaaagagaaagaga

SEQ ID NO: 2105431 - RNA, 17 nt, Homo sapiens
auuucacgucauaggaa

SEQ ID NO: 2105432 - RNA, 11 nt, Homo sapiens
aaguguacaau

SEQ ID NO: 2105433 - RNA, 18 nt, Homo sapiens
uagaauggggcaauaaca

SEQ ID NO: 2105434 - RNA, 21 nt, Homo sapiens
gggaaaggcaucuaagacauu

SEQ ID NO: 2105435 - RNA, 23 nt, Homo sapiens
ugagugguguguguuaucagaua

SEQ ID NO: 2105436 - RNA, 22 nt, Homo sapiens
auguaugaauacagcagcaaga

SEQ ID NO: 2105437 - RNA, 15 nt, Homo sapiens
aacccaucucugaac

SEQ ID NO: 2105438 - RNA, 17 nt, Homo sapiens
caccuggcuucauacag

SEQ ID NO: 2105439 - RNA, 19 nt, Homo sapiens
ucuuacaaugcauucugag

SEQ ID NO: 2105440 - RNA, 15 nt, Homo sapiens
uuauaugcuugugua

SEQ ID NO: 2105441 - RNA, 18 nt, Homo sapiens
ugcaauaaaauaguauug

SEQ ID NO: 2105442 - RNA, 20 nt, Homo sapiens
uuuuacccuauacauccaca

SEQ ID NO: 2105443 - RNA, 17 nt, Homo sapiens
gauugugugacuauuca

SEQ ID NO: 2105444 - RNA, 19 nt, Homo sapiens
cuuaucuuucuaaaacugc

SEQ ID NO: 2105445 - RNA, 14 nt, Homo sapiens
acauaaucauggau

SEQ ID NO: 2105446 - RNA, 23 nt, Homo sapiens
agucucuauaccaauaaagugac

SEQ ID NO: 2105447 - RNA, 20 nt, Homo sapiens
aucuguuuguuacugcauca

SEQ ID NO: 2105448 - RNA, 13 nt, Homo sapiens
caggucccagugc

SEQ ID NO: 2105449 - RNA, 15 nt, Homo sapiens
cuaucuuaggaguaa

SEQ ID NO: 2105450 - RNA, 16 nt, Homo sapiens
cauacagcacaauguu

SEQ ID NO: 2105451 - RNA, 23 nt, Homo sapiens
acucacugaggguaucugacaau

SEQ ID NO: 2105452 - RNA, 14 nt, Homo sapiens
cccuucggcagcua

SEQ ID NO: 2105453 - RNA, 13 nt, Homo sapiens
gacguugcagggu

SEQ ID NO: 2105454 - RNA, 15 nt, Homo sapiens
uaaagucacagaauu

SEQ ID NO: 2105455 - RNA, 24 nt, Homo sapiens
cuucagccuaguggcuuguccuca

SEQ ID NO: 2105456 - RNA, 20 nt, Homo sapiens
cacaguuguaccauucaccg

SEQ ID NO: 2105457 - RNA, 21 nt, Homo sapiens
cagcaaccuguaagacugaua

SEQ ID NO: 2105458 - RNA, 12 nt, Homo sapiens
ugacuguaucug

SEQ ID NO: 2105459 - RNA, 18 nt, Homo sapiens
gcccacugaacaugcuca

SEQ ID NO: 2105460 - RNA, 15 nt, Homo sapiens
gcuuccaucaguggu

SEQ ID NO: 2105461 - RNA, 20 nt, Homo sapiens
aauaaauguaucugaauauc

SEQ ID NO: 2105462 - RNA, 19 nt, Homo sapiens
auuauaauaugugccuuaa

SEQ ID NO: 2105463 - RNA, 14 nt, Homo sapiens
aagauucaguuuuc

SEQ ID NO: 2105464 - RNA, 21 nt, Homo sapiens
gaaagacauagccaacugcug

SEQ ID NO: 2105465 - RNA, 21 nt, Homo sapiens
ucuuuuaaaauaagcauuuag

SEQ ID NO: 2105466 - RNA, 22 nt, Homo sapiens
gaggcccagcgcggacaucccc

SEQ ID NO: 2105467 - RNA, 19 nt, Homo sapiens
caggaccucccuuccgacc

SEQ ID NO: 2105468 - RNA, 17 nt, Homo sapiens
ugcguagaaaguuuuag

SEQ ID NO: 2105469 - RNA, 19 nt, Homo sapiens
cccaggcuggaaugcagug

SEQ ID NO: 2105470 - RNA, 15 nt, Homo sapiens
uccugggagcacugc

SEQ ID NO: 2105471 - RNA, 18 nt, Homo sapiens
ugcuuuggggcuuaucag

SEQ ID NO: 2105472 - RNA, 17 nt, Homo sapiens
cggcguggagacuggca

SEQ ID NO: 2105473 - RNA, 19 nt, Homo sapiens
aggcuaguugggaugggca

SEQ ID NO: 2105474 - RNA, 17 nt, Homo sapiens
acagggucauguuugca

SEQ ID NO: 2105475 - RNA, 12 nt, Homo sapiens
gaacuuccuccc

SEQ ID NO: 2105476 - RNA, 17 nt, Homo sapiens
ucuugaaagacagucca

SEQ ID NO: 2105477 - RNA, 13 nt, Homo sapiens
gacauuagauuga

SEQ ID NO: 2105478 - RNA, 15 nt, Homo sapiens
uguuaauauggugua

SEQ ID NO: 2105479 - RNA, 16 nt, Homo sapiens
ugaaauaugcauacua

SEQ ID NO: 2105480 - RNA, 12 nt, Homo sapiens
ccuccucagggg

SEQ ID NO: 2105481 - RNA, 17 nt, Homo sapiens
gccaguacuacugcucu

SEQ ID NO: 2105482 - RNA, 20 nt, Homo sapiens
gaccagguugucacugagaa

SEQ ID NO: 2105483 - RNA, 20 nt, Homo sapiens
uaacuuacaagaauggaauu

SEQ ID NO: 2105484 - RNA, 19 nt, Homo sapiens
agcuauagucuaugcaguc

SEQ ID NO: 2105485 - RNA, 20 nt, Homo sapiens
aaucagaauuggaaucacau

SEQ ID NO: 2105486 - RNA, 16 nt, Homo sapiens
auguguaagacacugu

SEQ ID NO: 2105487 - RNA, 19 nt, Homo sapiens
aguuaaaucccccaccucc

SEQ ID NO: 2105488 - RNA, 19 nt, Homo sapiens
gcuggaugugcuuucaucc

SEQ ID NO: 2105489 - RNA, 14 nt, Homo sapiens
uuuagcacaaaaaa

SEQ ID NO: 2105490 - RNA, 18 nt, Homo sapiens
gacauagccgauucucug

SEQ ID NO: 2105491 - RNA, 14 nt, Homo sapiens
uuacugcacucaga

SEQ ID NO: 2105492 - RNA, 22 nt, Homo sapiens
aggguuuuaguuuuuaauuuau

SEQ ID NO: 2105493 - RNA, 20 nt, Homo sapiens
gcugucaguaugacauuuca

SEQ ID NO: 2105494 - RNA, 17 nt, Homo sapiens
cucugucgccaggcuag

SEQ ID NO: 2105495 - RNA, 14 nt, Homo sapiens
gagaaguuaagcaa

SEQ ID NO: 2105496 - RNA, 14 nt, Homo sapiens
acccaguugccaaa

SEQ ID NO: 2105497 - RNA, 21 nt, Homo sapiens
cuucuccaacaccaccucucc

SEQ ID NO: 2105498 - RNA, 20 nt, Homo sapiens
aauugcuucuguguagucaa

SEQ ID NO: 2105499 - RNA, 15 nt, Homo sapiens
auuucugaacaguac

SEQ ID NO: 2105500 - RNA, 15 nt, Homo sapiens
auagcagagaagccu

SEQ ID NO: 2105501 - RNA, 13 nt, Homo sapiens
aagcacuagccuu

SEQ ID NO: 2105502 - RNA, 15 nt, Homo sapiens
uccucuaacucauuc

SEQ ID NO: 2105503 - RNA, 15 nt, Homo sapiens
uccacccacucuuca

SEQ ID NO: 2105504 - RNA, 13 nt, Homo sapiens
ccuuugcuuuaca

SEQ ID NO: 2105505 - RNA, 13 nt, Homo sapiens
cacuccacacucu

SEQ ID NO: 2105506 - RNA, 16 nt, Homo sapiens
ucuccaccuuccaaag

SEQ ID NO: 2105507 - RNA, 21 nt, Homo sapiens
ugcacuccagccugggggaca

SEQ ID NO: 2105508 - RNA, 14 nt, Homo sapiens
uaagacucauuccc

SEQ ID NO: 2105509 - RNA, 21 nt, Homo sapiens
caaaauccaugugaccauucu

SEQ ID NO: 2105510 - RNA, 17 nt, Homo sapiens
cuaugccuguugaucua

SEQ ID NO: 2105511 - RNA, 20 nt, Homo sapiens
acuuggcaguagaaauccag

SEQ ID NO: 2105512 - RNA, 19 nt, Homo sapiens
caaucucguuuagugccaa

SEQ ID NO: 2105513 - RNA, 20 nt, Homo sapiens
caucuccaaaaacaguaaaa

SEQ ID NO: 2105514 - RNA, 16 nt, Homo sapiens
ccauagagacuuugug

SEQ ID NO: 2105515 - RNA, 12 nt, Homo sapiens
gguguccauuuu

SEQ ID NO: 2105516 - RNA, 19 nt, Homo sapiens
cuucuuccccccgcuguca

SEQ ID NO: 2105517 - RNA, 13 nt, Homo sapiens
aguggacccugga

SEQ ID NO: 2105518 - RNA, 14 nt, Homo sapiens
gcugagcgccagga

SEQ ID NO: 2105519 - RNA, 18 nt, Homo sapiens
cuauauaaauaaagcaaa

SEQ ID NO: 2105520 - RNA, 12 nt, Homo sapiens
ucccaaacccuu

SEQ ID NO: 2105521 - RNA, 20 nt, Homo sapiens
cagccagaacuuucuuucac

SEQ ID NO: 2105522 - RNA, 22 nt, Homo sapiens
cacuaguuuaugcuaccuaguc

SEQ ID NO: 2105523 - RNA, 12 nt, Homo sapiens
guguugacugcu

SEQ ID NO: 2105524 - RNA, 22 nt, Homo sapiens
ucuccuuauccccccaaaugga

SEQ ID NO: 2105525 - RNA, 20 nt, Homo sapiens
agauccauuuaaaacaagcu

SEQ ID NO: 2105526 - RNA, 18 nt, Homo sapiens
augcauguuuccugcucu

SEQ ID NO: 2105527 - RNA, 11 nt, Homo sapiens
caccauucacc

SEQ ID NO: 2105528 - RNA, 19 nt, Homo sapiens
cuuuaggagacuaauggaa

SEQ ID NO: 2105529 - RNA, 15 nt, Homo sapiens
ugaagucuucuuauc

SEQ ID NO: 2105530 - RNA, 13 nt, Homo sapiens
aagcaaacccaga

SEQ ID NO: 2105531 - RNA, 19 nt, Homo sapiens
uuagauuuuucucaucucc

SEQ ID NO: 2105532 - RNA, 12 nt, Homo sapiens
aguacauugugc

SEQ ID NO: 2105533 - RNA, 12 nt, Homo sapiens
gaagccaaagca

SEQ ID NO: 2105534 - RNA, 19 nt, Homo sapiens
auugaaaagcaaaucugua

SEQ ID NO: 2105535 - RNA, 18 nt, Homo sapiens
uaaaaucugauuuacacu

SEQ ID NO: 2105536 - RNA, 17 nt, Homo sapiens
uguagaagccacuauua

SEQ ID NO: 2105537 - RNA, 13 nt, Homo sapiens
ucaaaauauguca

SEQ ID NO: 2105538 - RNA, 16 nt, Homo sapiens
acaaucuuugcuguau

SEQ ID NO: 2105539 - RNA, 17 nt, Homo sapiens
aagcaacuuauguauuu

SEQ ID NO: 2105540 - RNA, 12 nt, Homo sapiens
gcacugggauga

SEQ ID NO: 2105541 - RNA, 19 nt, Homo sapiens
gcagccacgaggugcaaca

SEQ ID NO: 2105542 - RNA, 19 nt, Homo sapiens
cucaccuuaaaggucaagg

SEQ ID NO: 2105543 - RNA, 19 nt, Homo sapiens
caauauugguguacuguaa

SEQ ID NO: 2105544 - RNA, 22 nt, Homo sapiens
aaggagagacucccaugaagcc

SEQ ID NO: 2105545 - RNA, 15 nt, Homo sapiens
caugggaaaacagac

SEQ ID NO: 2105546 - RNA, 17 nt, Homo sapiens
aagaauuuugagugaau

SEQ ID NO: 2105547 - RNA, 15 nt, Homo sapiens
ccuaguaauugccua

SEQ ID NO: 2105548 - RNA, 16 nt, Homo sapiens
ugaugcuuuaacugau

SEQ ID NO: 2105549 - RNA, 14 nt, Homo sapiens
cccuaaagucucag

SEQ ID NO: 2105550 - RNA, 22 nt, Homo sapiens
cugagccaaacacacuguaaau

SEQ ID NO: 2105551 - RNA, 19 nt, Homo sapiens
aucugcaucuuaacaugcu

SEQ ID NO: 2105552 - RNA, 22 nt, Homo sapiens
cuuuccuucucgucuuccucuc

SEQ ID NO: 2105553 - RNA, 22 nt, Homo sapiens
uaacauuauuucuuuucuaaaa

SEQ ID NO: 2105554 - RNA, 14 nt, Homo sapiens
ucaugugaacccgg

SEQ ID NO: 2105555 - RNA, 14 nt, Homo sapiens
aauccuccuaccuc

SEQ ID NO: 2105556 - RNA, 15 nt, Homo sapiens
acagcaguagacauu

SEQ ID NO: 2105557 - RNA, 20 nt, Homo sapiens
gaugaaggaaggacuaugac

SEQ ID NO: 2105558 - RNA, 15 nt, Homo sapiens
aggugucugcaccca

SEQ ID NO: 2105559 - RNA, 20 nt, Homo sapiens
cguggccgagggcuucccua

SEQ ID NO: 2105560 - RNA, 15 nt, Homo sapiens
acuaagauacuccau

SEQ ID NO: 2105561 - RNA, 20 nt, Homo sapiens
agagucucacucuguugccc

SEQ ID NO: 2105562 - RNA, 21 nt, Homo sapiens
ucacccagcuaaucuguaggg

SEQ ID NO: 2105563 - RNA, 12 nt, Homo sapiens
gcagagaagcau

SEQ ID NO: 2105564 - RNA, 14 nt, Homo sapiens
agagaaucugauca

SEQ ID NO: 2105565 - RNA, 14 nt, Homo sapiens
uauucaucaaugaa

SEQ ID NO: 2105566 - RNA, 20 nt, Homo sapiens
agccacaggccugagauuuc

SEQ ID NO: 2105567 - RNA, 15 nt, Homo sapiens
aacacuggugccaac

SEQ ID NO: 2105568 - RNA, 22 nt, Homo sapiens
acccaccauggaccagcccauu

SEQ ID NO: 2105569 - RNA, 15 nt, Homo sapiens
acaccauucauucca

SEQ ID NO: 2105570 - RNA, 17 nt, Homo sapiens
cagagacuuagaagcau

SEQ ID NO: 2105571 - RNA, 21 nt, Homo sapiens
auaauuaccaauaucuugcca

SEQ ID NO: 2105572 - RNA, 20 nt, Homo sapiens
cgaggucuugugauauugcc

SEQ ID NO: 2105573 - RNA, 16 nt, Homo sapiens
acauuaaacacuguaa

SEQ ID NO: 2105574 - RNA, 15 nt, Homo sapiens
guuuauauguucaca

SEQ ID NO: 2105575 - RNA, 20 nt, Homo sapiens
uggcuuuucauagugcucag

SEQ ID NO: 2105576 - RNA, 13 nt, Homo sapiens
ucucaucaguucu

SEQ ID NO: 2105577 - RNA, 20 nt, Homo sapiens
uaacaaaacuauacuuguac

SEQ ID NO: 2105578 - RNA, 23 nt, Homo sapiens
ggcuccuugggaugaagagggua

SEQ ID NO: 2105579 - RNA, 20 nt, Homo sapiens
ugcagagggacagaugacca

SEQ ID NO: 2105580 - RNA, 20 nt, Homo sapiens
uuaucaugcguuuuauaucu

SEQ ID NO: 2105581 - RNA, 16 nt, Homo sapiens
aaccaggcuacaguug

SEQ ID NO: 2105582 - RNA, 16 nt, Homo sapiens
auacccucugagacag

SEQ ID NO: 2105583 - RNA, 23 nt, Homo sapiens
cccagacuuuuuuaaauguuugc

SEQ ID NO: 2105584 - RNA, 22 nt, Homo sapiens
acaacccaggcaguaccauuca

SEQ ID NO: 2105585 - RNA, 23 nt, Homo sapiens
caggcucugcccugcccuagcuc

SEQ ID NO: 2105586 - RNA, 18 nt, Homo sapiens
ggggcaggggaggccauc

SEQ ID NO: 2105587 - RNA, 15 nt, Homo sapiens
agauaacauuuccaa

SEQ ID NO: 2105588 - RNA, 18 nt, Homo sapiens
cuugugacuagugcugaa

SEQ ID NO: 2105589 - RNA, 19 nt, Homo sapiens
caccuuggccuucugggaa

SEQ ID NO: 2105590 - RNA, 19 nt, Homo sapiens
agugccucuguuaccacca

SEQ ID NO: 2105591 - RNA, 21 nt, Homo sapiens
augcugcugcucaaaaugcca

SEQ ID NO: 2105592 - RNA, 17 nt, Homo sapiens
acauggcggggcuuucc

SEQ ID NO: 2105593 - RNA, 11 nt, Homo sapiens
uuuuucaccuu

SEQ ID NO: 2105594 - RNA, 11 nt, Homo sapiens
caucuuccuag

SEQ ID NO: 2105595 - RNA, 18 nt, Homo sapiens
cagcgucacucuaccuaa

SEQ ID NO: 2105596 - RNA, 15 nt, Homo sapiens
ucuaggaacauacuu

SEQ ID NO: 2105597 - RNA, 15 nt, Homo sapiens
acugagcaguauuag

SEQ ID NO: 2105598 - RNA, 16 nt, Homo sapiens
aacugaaaauggaccu

SEQ ID NO: 2105599 - RNA, 15 nt, Homo sapiens
caaaccuaccaaaau

SEQ ID NO: 2105600 - RNA, 15 nt, Homo sapiens
aaaacaaaacaaaca

SEQ ID NO: 2105601 - RNA, 18 nt, Homo sapiens
cugcucaagauauggaag

SEQ ID NO: 2105602 - RNA, 20 nt, Homo sapiens
uuuaaaaaccuguucaaguc

SEQ ID NO: 2105603 - RNA, 15 nt, Homo sapiens
guauggcccaggcag

SEQ ID NO: 2105604 - RNA, 16 nt, Homo sapiens
agccgcugccaggggc

SEQ ID NO: 2105605 - RNA, 19 nt, Homo sapiens
auuauggguauguguugcc

SEQ ID NO: 2105606 - RNA, 22 nt, Homo sapiens
auauaaggaaagugauccaaaa

SEQ ID NO: 2105607 - RNA, 16 nt, Homo sapiens
uggacuuaacuaguua

SEQ ID NO: 2105608 - RNA, 13 nt, Homo sapiens
aucagacuaguga

SEQ ID NO: 2105609 - RNA, 23 nt, Homo sapiens
gagaacuuucugauucacagucu

SEQ ID NO: 2105610 - RNA, 17 nt, Homo sapiens
ggccugccaaugccaca

SEQ ID NO: 2105611 - RNA, 16 nt, Homo sapiens
uaaagaguauuuacaa

SEQ ID NO: 2105612 - RNA, 16 nt, Homo sapiens
accuaccaucagggac

SEQ ID NO: 2105613 - RNA, 14 nt, Homo sapiens
aauacaaacauucu

SEQ ID NO: 2105614 - RNA, 23 nt, Homo sapiens
caccuuaaaacauuagugcuaug

SEQ ID NO: 2105615 - RNA, 17 nt, Homo sapiens
gcacacacacaaacaca

SEQ ID NO: 2105616 - RNA, 17 nt, Homo sapiens
auaauguaauacuguag

SEQ ID NO: 2105617 - RNA, 17 nt, Homo sapiens
ucaaagcccaacugugg

SEQ ID NO: 2105618 - RNA, 14 nt, Homo sapiens
aauguaugugcaca

SEQ ID NO: 2105619 - RNA, 17 nt, Homo sapiens
aauguacagacauauuu

SEQ ID NO: 2105620 - RNA, 18 nt, Homo sapiens
ugggcgggaaaaacacca

SEQ ID NO: 2105621 - RNA, 17 nt, Homo sapiens
aauacauaaaacaaaag

SEQ ID NO: 2105622 - RNA, 22 nt, Homo sapiens
cucuucaauaaaccacaagcau

SEQ ID NO: 2105623 - RNA, 14 nt, Homo sapiens
accuguagauucag

SEQ ID NO: 2105624 - RNA, 14 nt, Homo sapiens
uucaucacuaccuu

SEQ ID NO: 2105625 - RNA, 17 nt, Homo sapiens
cagccacgucagcuuuu

SEQ ID NO: 2105626 - RNA, 20 nt, Homo sapiens
cuuuaaugacauugauuucu

SEQ ID NO: 2105627 - RNA, 21 nt, Homo sapiens
ugaggacagaugccuccuucc

SEQ ID NO: 2105628 - RNA, 17 nt, Homo sapiens
guuccaaagccagugaa

SEQ ID NO: 2105629 - RNA, 24 nt, Homo sapiens
ccucugcacgugcacacaccugca

SEQ ID NO: 2105630 - RNA, 14 nt, Homo sapiens
gcaaacagucauuu

SEQ ID NO: 2105631 - RNA, 17 nt, Homo sapiens
auaaaucuauucugcua

SEQ ID NO: 2105632 - RNA, 16 nt, Homo sapiens
ccaagacucuuuauga

SEQ ID NO: 2105633 - RNA, 21 nt, Homo sapiens
uucagaaucacuucugagaac

SEQ ID NO: 2105634 - RNA, 17 nt, Homo sapiens
ccugcccccuuggguga

SEQ ID NO: 2105635 - RNA, 17 nt, Homo sapiens
accucgugaucugccca

SEQ ID NO: 2105636 - RNA, 19 nt, Homo sapiens
guacaccccaacagcaccc

SEQ ID NO: 2105637 - RNA, 14 nt, Homo sapiens
uuucauacaacaga

SEQ ID NO: 2105638 - RNA, 18 nt, Homo sapiens
aaauauacaaacaugugg

SEQ ID NO: 2105639 - RNA, 11 nt, Homo sapiens
gaugacaauaa

SEQ ID NO: 2105640 - RNA, 11 nt, Homo sapiens
cagaguuuuca

SEQ ID NO: 2105641 - RNA, 14 nt, Homo sapiens
uaaucaugcucaug

SEQ ID NO: 2105642 - RNA, 21 nt, Homo sapiens
gagcacaggucccaccuccag

SEQ ID NO: 2105643 - RNA, 16 nt, Homo sapiens
cuucuuugugccugag

SEQ ID NO: 2105644 - RNA, 20 nt, Homo sapiens
cugaccccagugaaugaagc

SEQ ID NO: 2105645 - RNA, 16 nt, Homo sapiens
cucguugcagucugua

SEQ ID NO: 2105646 - RNA, 23 nt, Homo sapiens
aaagaaauugugaaaaaugagcu

SEQ ID NO: 2105647 - RNA, 14 nt, Homo sapiens
cuauuaccaugaga

SEQ ID NO: 2105648 - RNA, 22 nt, Homo sapiens
guccuuuccccggaguaccuau

SEQ ID NO: 2105649 - RNA, 21 nt, Homo sapiens
caauggggccagucaggccca

SEQ ID NO: 2105650 - RNA, 18 nt, Homo sapiens
uuuuggcaagaccccacc

SEQ ID NO: 2105651 - RNA, 17 nt, Homo sapiens
ugaaaacaaacuucucg

SEQ ID NO: 2105652 - RNA, 21 nt, Homo sapiens
cuucagucucuauaccaauaa

SEQ ID NO: 2105653 - RNA, 13 nt, Homo sapiens
aguuuaaccuaaa

SEQ ID NO: 2105654 - RNA, 12 nt, Homo sapiens
aguaaauccaug

SEQ ID NO: 2105655 - RNA, 19 nt, Homo sapiens
agcuaacacuaaaagucac

SEQ ID NO: 2105656 - RNA, 22 nt, Homo sapiens
ucaaagaaauuuccacucaggu

SEQ ID NO: 2105657 - RNA, 16 nt, Homo sapiens
cacaggcagguacugu

SEQ ID NO: 2105658 - RNA, 17 nt, Homo sapiens
ggcuucuguccaaggca

SEQ ID NO: 2105659 - RNA, 14 nt, Homo sapiens
ccaggaagagcuga

SEQ ID NO: 2105660 - RNA, 10 nt, Homo sapiens
gaggguacac

SEQ ID NO: 2105661 - RNA, 19 nt, Homo sapiens
uccucuccccagcaaguga

SEQ ID NO: 2105662 - RNA, 19 nt, Homo sapiens
cccuuaaugaaauacauca

SEQ ID NO: 2105663 - RNA, 15 nt, Homo sapiens
ggcuccagguccgga

SEQ ID NO: 2105664 - RNA, 17 nt, Homo sapiens
agauauuugguaccaug

SEQ ID NO: 2105665 - RNA, 13 nt, Homo sapiens
ugacuucaucugg

SEQ ID NO: 2105666 - RNA, 18 nt, Homo sapiens
gaaacuaagccaggccug

SEQ ID NO: 2105667 - RNA, 14 nt, Homo sapiens
gcaacauaauucuu

SEQ ID NO: 2105668 - RNA, 15 nt, Homo sapiens
aagaguaguuauaua

SEQ ID NO: 2105669 - RNA, 18 nt, Homo sapiens
auucuuaccucauuugca

SEQ ID NO: 2105670 - RNA, 11 nt, Homo sapiens
ggccacugucc

SEQ ID NO: 2105671 - RNA, 23 nt, Homo sapiens
ggaauugacugccuaugccaagu

SEQ ID NO: 2105672 - RNA, 15 nt, Homo sapiens
cuaauaaguauauaa

SEQ ID NO: 2105673 - RNA, 20 nt, Homo sapiens
aucguggugugucaaugcca

SEQ ID NO: 2105674 - RNA, 17 nt, Homo sapiens
ggcaccauggcuacuac

SEQ ID NO: 2105675 - RNA, 14 nt, Homo sapiens
ugccagcagcugcc

SEQ ID NO: 2105676 - RNA, 22 nt, Homo sapiens
aggaauccucugggagcuucuu

SEQ ID NO: 2105677 - RNA, 16 nt, Homo sapiens
uaaauagagcaaccua

SEQ ID NO: 2105678 - RNA, 15 nt, Homo sapiens
gcugucuuucacuga

SEQ ID NO: 2105679 - RNA, 16 nt, Homo sapiens
accuaccguagcuuuu

SEQ ID NO: 2105680 - RNA, 22 nt, Homo sapiens
ccugcuuuccuaucuagcauuu

SEQ ID NO: 2105681 - RNA, 16 nt, Homo sapiens
uaaauugaacugccaa

SEQ ID NO: 2105682 - RNA, 12 nt, Homo sapiens
aaccaguccagg

SEQ ID NO: 2105683 - RNA, 16 nt, Homo sapiens
aaccagaaaggugauu

SEQ ID NO: 2105684 - RNA, 14 nt, Homo sapiens
guacaggcaguuag

SEQ ID NO: 2105685 - RNA, 14 nt, Homo sapiens
guacaagcaguuaa

SEQ ID NO: 2105686 - RNA, 21 nt, Homo sapiens
caauuaaaauauucuuuaaua

SEQ ID NO: 2105687 - RNA, 22 nt, Homo sapiens
aaaaugcuuauuggacacguaa

SEQ ID NO: 2105688 - RNA, 21 nt, Homo sapiens
ucuuaaacauaauaaaucaca

SEQ ID NO: 2105689 - RNA, 15 nt, Homo sapiens
ugcuugcuuuugccu

SEQ ID NO: 2105690 - RNA, 21 nt, Homo sapiens
ggcacagagucgaugcucaau

SEQ ID NO: 2105691 - RNA, 13 nt, Homo sapiens
agugccuugcuca

SEQ ID NO: 2105692 - RNA, 12 nt, Homo sapiens
cccucucaauaa

SEQ ID NO: 2105693 - RNA, 21 nt, Homo sapiens
agagaauauuggagauguccu

SEQ ID NO: 2105694 - RNA, 20 nt, Homo sapiens
cucacagagacccaccuuca

SEQ ID NO: 2105695 - RNA, 15 nt, Homo sapiens
agguguuggugacaa

SEQ ID NO: 2105696 - RNA, 22 nt, Homo sapiens
uugauugggaaaacauuugcug

SEQ ID NO: 2105697 - RNA, 16 nt, Homo sapiens
cucccagcuccuuuca

SEQ ID NO: 2105698 - RNA, 18 nt, Homo sapiens
aaugaugaagaccaaaga

SEQ ID NO: 2105699 - RNA, 20 nt, Homo sapiens
uuuccacuauuuucaaagaa

SEQ ID NO: 2105700 - RNA, 13 nt, Homo sapiens
uaacggugcucag

SEQ ID NO: 2105701 - RNA, 16 nt, Homo sapiens
agaguaacacauaaca

SEQ ID NO: 2105702 - RNA, 21 nt, Homo sapiens
cacugcccauggcaugucuuu

SEQ ID NO: 2105703 - RNA, 18 nt, Homo sapiens
auauccuagacuagacau

SEQ ID NO: 2105704 - RNA, 20 nt, Homo sapiens
aucugagggagacugcaaau

SEQ ID NO: 2105705 - RNA, 20 nt, Homo sapiens
auuauugaggggacuaggcu

SEQ ID NO: 2105706 - RNA, 16 nt, Homo sapiens
uaauugcuuugccaaa

SEQ ID NO: 2105707 - RNA, 19 nt, Homo sapiens
ugcccuuaaaauaaugauu

SEQ ID NO: 2105708 - RNA, 19 nt, Homo sapiens
aacuauuaauuccauguga

SEQ ID NO: 2105709 - RNA, 15 nt, Homo sapiens
gauuaauuuaauuca

SEQ ID NO: 2105710 - RNA, 13 nt, Homo sapiens
aucuuccauuccu

SEQ ID NO: 2105711 - RNA, 13 nt, Homo sapiens
acuuuccaucucu

SEQ ID NO: 2105712 - RNA, 15 nt, Homo sapiens
agcaacuauucacaa

SEQ ID NO: 2105713 - RNA, 18 nt, Homo sapiens
uugucaguuccaaacaga

SEQ ID NO: 2105714 - RNA, 12 nt, Homo sapiens
uuuccuguguau

SEQ ID NO: 2105715 - RNA, 17 nt, Homo sapiens
cucacucccaccugcau

SEQ ID NO: 2105716 - RNA, 22 nt, Homo sapiens
aacugcuccaaaccaacaugga

SEQ ID NO: 2105717 - RNA, 22 nt, Homo sapiens
cugccaagcccucaauaagcca

SEQ ID NO: 2105718 - RNA, 20 nt, Homo sapiens
guggagcauuggcugagaga

SEQ ID NO: 2105719 - RNA, 22 nt, Homo sapiens
aguucugaggucccugugugua

SEQ ID NO: 2105720 - RNA, 19 nt, Homo sapiens
ggagucccagaauugcuga

SEQ ID NO: 2105721 - RNA, 12 nt, Homo sapiens
cacucaucacaa

SEQ ID NO: 2105722 - RNA, 12 nt, Homo sapiens
cccucaucaaaa

SEQ ID NO: 2105723 - RNA, 17 nt, Homo sapiens
cuaauugucugguugag

SEQ ID NO: 2105724 - RNA, 16 nt, Homo sapiens
ucaccuacauuaucuc

SEQ ID NO: 2105725 - RNA, 15 nt, Homo sapiens
caguaugagucaaug

SEQ ID NO: 2105726 - RNA, 21 nt, Homo sapiens
cacauuccaagccucaugucc

SEQ ID NO: 2105727 - RNA, 19 nt, Homo sapiens
aagcgaccgaggcccuccc

SEQ ID NO: 2105728 - RNA, 17 nt, Homo sapiens
uccucugcuugcaucac

SEQ ID NO: 2105729 - RNA, 15 nt, Homo sapiens
aaugugacgaacugc

SEQ ID NO: 2105730 - RNA, 21 nt, Homo sapiens
ugcaugacaaacacacaucca

SEQ ID NO: 2105731 - RNA, 16 nt, Homo sapiens
gugcagcuuuccaguu

SEQ ID NO: 2105732 - RNA, 16 nt, Homo sapiens
guagcacauuaccaau

SEQ ID NO: 2105733 - RNA, 18 nt, Homo sapiens
ggucucucucccuaccuc

SEQ ID NO: 2105734 - RNA, 20 nt, Homo sapiens
auuuguuuucuucuguaugu

SEQ ID NO: 2105735 - RNA, 21 nt, Homo sapiens
gcaguucccuccgcagaacac

SEQ ID NO: 2105736 - RNA, 13 nt, Homo sapiens
ugugugucucuga

SEQ ID NO: 2105737 - RNA, 13 nt, Homo sapiens
uacagaugccaua

SEQ ID NO: 2105738 - RNA, 14 nt, Homo sapiens
guggccuuccccuu

SEQ ID NO: 2105739 - RNA, 16 nt, Homo sapiens
auaccucauucacagc

SEQ ID NO: 2105740 - RNA, 18 nt, Homo sapiens
uaaguuugaucugucagc

SEQ ID NO: 2105741 - RNA, 19 nt, Homo sapiens
augcagcaccucucaggau

SEQ ID NO: 2105742 - RNA, 20 nt, Homo sapiens
uaacaguugugaugacuaug

SEQ ID NO: 2105743 - RNA, 19 nt, Homo sapiens
gucugggccccaucauuaa

SEQ ID NO: 2105744 - RNA, 23 nt, Homo sapiens
guuuguucccugugucauuucaa

SEQ ID NO: 2105745 - RNA, 15 nt, Homo sapiens
gaaaguaaacuguaa

SEQ ID NO: 2105746 - RNA, 16 nt, Homo sapiens
ucagucucacagagaa

SEQ ID NO: 2105747 - RNA, 22 nt, Homo sapiens
cacauaaaugcagcccauuucu

SEQ ID NO: 2105748 - RNA, 16 nt, Homo sapiens
acgccuguaauccuag

SEQ ID NO: 2105749 - RNA, 15 nt, Homo sapiens
uaauacuuacuguua

SEQ ID NO: 2105750 - RNA, 17 nt, Homo sapiens
ccacucaaaauauguca

SEQ ID NO: 2105751 - RNA, 20 nt, Homo sapiens
aguuauuuacuuuuaccacu

SEQ ID NO: 2105752 - RNA, 13 nt, Homo sapiens
aaagauguauaua

SEQ ID NO: 2105753 - RNA, 17 nt, Homo sapiens
gccuaaaugcacaguca

SEQ ID NO: 2105754 - RNA, 19 nt, Homo sapiens
cuguaucuuguuuuuccac

SEQ ID NO: 2105755 - RNA, 15 nt, Homo sapiens
cuguucuguguugca

SEQ ID NO: 2105756 - RNA, 19 nt, Homo sapiens
agccuguccuuccaugccc

SEQ ID NO: 2105757 - RNA, 12 nt, Homo sapiens
acucacuguggg

SEQ ID NO: 2105758 - RNA, 16 nt, Homo sapiens
cugcgaaauccagaac

SEQ ID NO: 2105759 - RNA, 22 nt, Homo sapiens
aagagguucugauuuucuugua

SEQ ID NO: 2105760 - RNA, 13 nt, Homo sapiens
aguauuacaugau

SEQ ID NO: 2105761 - RNA, 16 nt, Homo sapiens
uguuuucucuaagaua

SEQ ID NO: 2105762 - RNA, 12 nt, Homo sapiens
cuggcuugacag

SEQ ID NO: 2105763 - RNA, 23 nt, Homo sapiens
acaccuuugaauuacagcaguug

SEQ ID NO: 2105764 - RNA, 14 nt, Homo sapiens
uuccuuucugccac

SEQ ID NO: 2105765 - RNA, 15 nt, Homo sapiens
agaugucucugcaaa

SEQ ID NO: 2105766 - RNA, 17 nt, Homo sapiens
uaucuuuuugcuuacag

SEQ ID NO: 2105767 - RNA, 23 nt, Homo sapiens
cuuaaauaacaaaacugugccaa

SEQ ID NO: 2105768 - RNA, 12 nt, Homo sapiens
ccccacagugac

SEQ ID NO: 2105769 - RNA, 16 nt, Homo sapiens
cuuggcaccagacacc

SEQ ID NO: 2105770 - RNA, 18 nt, Homo sapiens
aguuguuccuccacucua

SEQ ID NO: 2105771 - RNA, 15 nt, Homo sapiens
caguaucacaggcca

SEQ ID NO: 2105772 - RNA, 17 nt, Homo sapiens
auaucaugguagucacu

SEQ ID NO: 2105773 - RNA, 17 nt, Homo sapiens
auggcggccugcagugg

SEQ ID NO: 2105774 - RNA, 16 nt, Homo sapiens
gaacugugcauagugc

SEQ ID NO: 2105775 - RNA, 16 nt, Homo sapiens
aguggcaccugggaag

SEQ ID NO: 2105776 - RNA, 14 nt, Homo sapiens
uaccagaagccaga

SEQ ID NO: 2105777 - RNA, 16 nt, Homo sapiens
acaauccacaaaugau

SEQ ID NO: 2105778 - RNA, 19 nt, Homo sapiens
aauguccccacgguacuua

SEQ ID NO: 2105779 - RNA, 13 nt, Homo sapiens
ccuugcccagaga

SEQ ID NO: 2105780 - RNA, 14 nt, Homo sapiens
gauaaaaaaacagc

SEQ ID NO: 2105781 - RNA, 19 nt, Homo sapiens
cuucacugcucugccccca

SEQ ID NO: 2105782 - RNA, 18 nt, Homo sapiens
uccuugcacaaauggagg

SEQ ID NO: 2105783 - RNA, 18 nt, Homo sapiens
ggaaguguuccugucuca

SEQ ID NO: 2105784 - RNA, 19 nt, Homo sapiens
ucccaccugacauguccuu

SEQ ID NO: 2105785 - RNA, 15 nt, Homo sapiens
gcacacacacauaca

SEQ ID NO: 2105786 - RNA, 15 nt, Homo sapiens
auguaugcgugcaug

SEQ ID NO: 2105787 - RNA, 18 nt, Homo sapiens
ucaaagauguacugagag

SEQ ID NO: 2105788 - RNA, 15 nt, Homo sapiens
ucuuuugaaaugcca

SEQ ID NO: 2105789 - RNA, 13 nt, Homo sapiens
aaguaauuccucu

SEQ ID NO: 2105790 - RNA, 15 nt, Homo sapiens
aaaucauuaagacaa

SEQ ID NO: 2105791 - RNA, 16 nt, Homo sapiens
uaguuugcaacuucaa

SEQ ID NO: 2105792 - RNA, 18 nt, Homo sapiens
aagaaguaugucaguuau

SEQ ID NO: 2105793 - RNA, 17 nt, Homo sapiens
acugccuucaguaucaa

SEQ ID NO: 2105794 - RNA, 12 nt, Homo sapiens
aaaaucaaagag

SEQ ID NO: 2105795 - RNA, 14 nt, Homo sapiens
agaacuugaaugug

SEQ ID NO: 2105796 - RNA, 17 nt, Homo sapiens
gccacggccuugugucu

SEQ ID NO: 2105797 - RNA, 21 nt, Homo sapiens
uucugggcugauuugggucuc

SEQ ID NO: 2105798 - RNA, 19 nt, Homo sapiens
agaaggcacauagaaauaa

SEQ ID NO: 2105799 - RNA, 18 nt, Homo sapiens
uaaauagcuaaauggcaa

SEQ ID NO: 2105800 - RNA, 15 nt, Homo sapiens
cugggaaguggcuua

SEQ ID NO: 2105801 - RNA, 21 nt, Homo sapiens
cuuguuuuuccacuacugcua

SEQ ID NO: 2105802 - RNA, 12 nt, Homo sapiens
cucuugcugucu

SEQ ID NO: 2105803 - RNA, 12 nt, Homo sapiens
ccuucagccuua

SEQ ID NO: 2105804 - RNA, 22 nt, Homo sapiens
guaagcucuacugaggugcuau

SEQ ID NO: 2105805 - RNA, 21 nt, Homo sapiens
ucacuggggaggacgugauga

SEQ ID NO: 2105806 - RNA, 14 nt, Homo sapiens
agucugaaacuggc

SEQ ID NO: 2105807 - RNA, 13 nt, Homo sapiens
aauauguuuugcc

SEQ ID NO: 2105808 - RNA, 14 nt, Homo sapiens
uccucuacugguaa

SEQ ID NO: 2105809 - RNA, 20 nt, Homo sapiens
cgcuacccgggaagggggcu

SEQ ID NO: 2105810 - RNA, 18 nt, Homo sapiens
ccuguaaucccagcacuu

SEQ ID NO: 2105811 - RNA, 12 nt, Homo sapiens
ugcucacagucc

SEQ ID NO: 2105812 - RNA, 12 nt, Homo sapiens
uaaaaaaacuga

SEQ ID NO: 2105813 - RNA, 13 nt, Homo sapiens
aaggccugugauc

SEQ ID NO: 2105814 - RNA, 16 nt, Homo sapiens
uggccuccagccuuug

SEQ ID NO: 2105815 - RNA, 17 nt, Homo sapiens
cuucaaccccacuuccu

SEQ ID NO: 2105816 - RNA, 16 nt, Homo sapiens
cuguggauuauuucau

SEQ ID NO: 2105817 - RNA, 12 nt, Homo sapiens
cuucucauuucu

SEQ ID NO: 2105818 - RNA, 16 nt, Homo sapiens
aauggcugugccccac

SEQ ID NO: 2105819 - RNA, 22 nt, Homo sapiens
uggcuuuccaggagacauauau

SEQ ID NO: 2105820 - RNA, 22 nt, Homo sapiens
ugcccugaugcgucuacccaga

SEQ ID NO: 2105821 - RNA, 23 nt, Homo sapiens
agcauugaucugagugcuuucau

SEQ ID NO: 2105822 - RNA, 20 nt, Homo sapiens
acagagaaauccuaaaagag

SEQ ID NO: 2105823 - RNA, 22 nt, Homo sapiens
acuugggucacaugacucucau

SEQ ID NO: 2105824 - RNA, 19 nt, Homo sapiens
ugaauagggcuaggaauau

SEQ ID NO: 2105825 - RNA, 13 nt, Homo sapiens
auuaaaugaacau

SEQ ID NO: 2105826 - RNA, 15 nt, Homo sapiens
gguuguuucuuccaa

SEQ ID NO: 2105827 - RNA, 20 nt, Homo sapiens
ugccacaaauaacaucucac

SEQ ID NO: 2105828 - RNA, 19 nt, Homo sapiens
cauaaaacuucugauuucu

SEQ ID NO: 2105829 - RNA, 15 nt, Homo sapiens
ucuccuuuuacuuca

SEQ ID NO: 2105830 - RNA, 19 nt, Homo sapiens
caguauaaaauguaaaaac

SEQ ID NO: 2105831 - RNA, 12 nt, Homo sapiens
cccuuggcacug

SEQ ID NO: 2105832 - RNA, 15 nt, Homo sapiens
ucugcuguggucuau

SEQ ID NO: 2105833 - RNA, 16 nt, Homo sapiens
cucauuucaagcagau

SEQ ID NO: 2105834 - RNA, 20 nt, Homo sapiens
gaaaacucaugaauaaucca

SEQ ID NO: 2105835 - RNA, 17 nt, Homo sapiens
cucugcuccuacaucca

SEQ ID NO: 2105836 - RNA, 20 nt, Homo sapiens
cuuucuuugagaaagacaau

SEQ ID NO: 2105837 - RNA, 19 nt, Homo sapiens
ucauaugauguacauguac

SEQ ID NO: 2105838 - RNA, 14 nt, Homo sapiens
cuccaugcugccag

SEQ ID NO: 2105839 - RNA, 18 nt, Homo sapiens
cuuuagcaagugugcacu

SEQ ID NO: 2105840 - RNA, 19 nt, Homo sapiens
uaguucaauccugauucau

SEQ ID NO: 2105841 - RNA, 13 nt, Homo sapiens
uuaucuugcucau

SEQ ID NO: 2105842 - RNA, 13 nt, Homo sapiens
uucucuugcuaau

SEQ ID NO: 2105843 - RNA, 15 nt, Homo sapiens
uaugccugucuuuac

SEQ ID NO: 2105844 - RNA, 15 nt, Homo sapiens
auucucacccuguga

SEQ ID NO: 2105845 - RNA, 12 nt, Homo sapiens
gggcgcgguggc

SEQ ID NO: 2105846 - RNA, 23 nt, Homo sapiens
caacugcugcugugcacauuuau

SEQ ID NO: 2105847 - RNA, 18 nt, Homo sapiens
cauaauaauaauuugcac

SEQ ID NO: 2105848 - RNA, 22 nt, Homo sapiens
uaucagugaauauaaauguacu

SEQ ID NO: 2105849 - RNA, 12 nt, Homo sapiens
uguaaguagcca

SEQ ID NO: 2105850 - RNA, 21 nt, Homo sapiens
auggcagaagggaauugcuca

SEQ ID NO: 2105851 - RNA, 20 nt, Homo sapiens
cagauuaguucuuuuugcca

SEQ ID NO: 2105852 - RNA, 23 nt, Homo sapiens
aguucauucaugccaaguaucuu

SEQ ID NO: 2105853 - RNA, 15 nt, Homo sapiens
gaucaagaacauguc

SEQ ID NO: 2105854 - RNA, 15 nt, Homo sapiens
aacagagcugggcua

SEQ ID NO: 2105855 - RNA, 13 nt, Homo sapiens
uggauucucuggg

SEQ ID NO: 2105856 - RNA, 22 nt, Homo sapiens
augaauaaaguugcugugaaua

SEQ ID NO: 2105857 - RNA, 15 nt, Homo sapiens
ugucuuuaauauaau

SEQ ID NO: 2105858 - RNA, 18 nt, Homo sapiens
caauauagugaugccauc

SEQ ID NO: 2105859 - RNA, 23 nt, Homo sapiens
acagaacagggucauguuugcag

SEQ ID NO: 2105860 - RNA, 22 nt, Homo sapiens
gccuguagaugacauggugaaa

SEQ ID NO: 2105861 - RNA, 17 nt, Homo sapiens
uauuacuuuucaucuaa

SEQ ID NO: 2105862 - RNA, 20 nt, Homo sapiens
ugcaggacccugaucuuuug

SEQ ID NO: 2105863 - RNA, 17 nt, Homo sapiens
auuuuaugagacagggu

SEQ ID NO: 2105864 - RNA, 15 nt, Homo sapiens
guagaugugauuaac

SEQ ID NO: 2105865 - RNA, 15 nt, Homo sapiens
cuuaaaucaguuuau

SEQ ID NO: 2105866 - RNA, 19 nt, Homo sapiens
uuccaucuguuugauacag

SEQ ID NO: 2105867 - RNA, 13 nt, Homo sapiens
gggaaacagggag

SEQ ID NO: 2105868 - RNA, 17 nt, Homo sapiens
auuuccaaauucacaag

SEQ ID NO: 2105869 - RNA, 14 nt, Homo sapiens
gacaccaaaaugaa

SEQ ID NO: 2105870 - RNA, 15 nt, Homo sapiens
gcaucagcacuuuaa

SEQ ID NO: 2105871 - RNA, 19 nt, Homo sapiens
auucuacuugcuuauuaca

SEQ ID NO: 2105872 - RNA, 13 nt, Homo sapiens
uugcucacuguca

SEQ ID NO: 2105873 - RNA, 16 nt, Homo sapiens
guacagauuguucuca

SEQ ID NO: 2105874 - RNA, 16 nt, Homo sapiens
aaauacccaacgcaca

SEQ ID NO: 2105875 - RNA, 15 nt, Homo sapiens
aguaucaguauuuac

SEQ ID NO: 2105876 - RNA, 14 nt, Homo sapiens
aacaguugccacau

SEQ ID NO: 2105877 - RNA, 19 nt, Homo sapiens
acgugcauuuaaacucugc

SEQ ID NO: 2105878 - RNA, 16 nt, Homo sapiens
cuugucucuguagaag

SEQ ID NO: 2105879 - RNA, 13 nt, Homo sapiens
guuacuaguacag

SEQ ID NO: 2105880 - RNA, 22 nt, Homo sapiens
cacacaugaaucugcacaucug

SEQ ID NO: 2105881 - RNA, 20 nt, Homo sapiens
aucaaaaaacaagucuuuag

SEQ ID NO: 2105882 - RNA, 13 nt, Homo sapiens
agaaguuugcauc

SEQ ID NO: 2105883 - RNA, 14 nt, Homo sapiens
gaacacuccuucac

SEQ ID NO: 2105884 - RNA, 22 nt, Homo sapiens
aucauucuggcuuaaacaacac

SEQ ID NO: 2105885 - RNA, 13 nt, Homo sapiens
aggauuucccuga

SEQ ID NO: 2105886 - RNA, 13 nt, Homo sapiens
uaauucuuucaau

SEQ ID NO: 2105887 - RNA, 20 nt, Homo sapiens
caauucuguuuuagguuaaa

SEQ ID NO: 2105888 - RNA, 23 nt, Homo sapiens
cuuggcacacagcaggcuuucaa

SEQ ID NO: 2105889 - RNA, 18 nt, Homo sapiens
uaccgugagcgacaaaga

SEQ ID NO: 2105890 - RNA, 20 nt, Homo sapiens
caccuauggcccagccacug

SEQ ID NO: 2105891 - RNA, 15 nt, Homo sapiens
auaauuuaacuucag

SEQ ID NO: 2105892 - RNA, 21 nt, Homo sapiens
gcgagacuccaccucuaccaa

SEQ ID NO: 2105893 - RNA, 18 nt, Homo sapiens
uaaaauuagaaagcaacu

SEQ ID NO: 2105894 - RNA, 12 nt, Homo sapiens
gacaagcacuuu

SEQ ID NO: 2105895 - RNA, 22 nt, Homo sapiens
cggcccuucugacuguuuauuu

SEQ ID NO: 2105896 - RNA, 16 nt, Homo sapiens
auuacauaguccagug

SEQ ID NO: 2105897 - RNA, 16 nt, Homo sapiens
ugagcagcaacugugu

SEQ ID NO: 2105898 - RNA, 12 nt, Homo sapiens
gcuuuccagggu

SEQ ID NO: 2105899 - RNA, 18 nt, Homo sapiens
guccagaaguggcccuug

SEQ ID NO: 2105900 - RNA, 23 nt, Homo sapiens
uggcugcugacaggauguggcac

SEQ ID NO: 2105901 - RNA, 17 nt, Homo sapiens
gacaaacagaccauaaa

SEQ ID NO: 2105902 - RNA, 18 nt, Homo sapiens
cucuauaagauuccaaaa

SEQ ID NO: 2105903 - RNA, 15 nt, Homo sapiens
cuggccaugcaagug

SEQ ID NO: 2105904 - RNA, 13 nt, Homo sapiens
gcaggugcaaaug

SEQ ID NO: 2105905 - RNA, 19 nt, Homo sapiens
aucgucaggaaaccaaaua

SEQ ID NO: 2105906 - RNA, 13 nt, Homo sapiens
uuggacuacauau

SEQ ID NO: 2105907 - RNA, 13 nt, Homo sapiens
gaaacuguguauu

SEQ ID NO: 2105908 - RNA, 14 nt, Homo sapiens
ccuuguggaaccaa

SEQ ID NO: 2105909 - RNA, 20 nt, Homo sapiens
acaagagcuguuaugcuguu

SEQ ID NO: 2105910 - RNA, 14 nt, Homo sapiens
cacagccucagaau

SEQ ID NO: 2105911 - RNA, 14 nt, Homo sapiens
uauacaauauacuu

SEQ ID NO: 2105912 - RNA, 13 nt, Homo sapiens
ccaccuuucagga

SEQ ID NO: 2105913 - RNA, 17 nt, Homo sapiens
gacuacaggcacccacc

SEQ ID NO: 2105914 - RNA, 18 nt, Homo sapiens
agaucaugaaaguccagc

SEQ ID NO: 2105915 - RNA, 23 nt, Homo sapiens
acucaaacgccgcugacugccac

SEQ ID NO: 2105916 - RNA, 17 nt, Homo sapiens
cugagccacaggcauuu

SEQ ID NO: 2105917 - RNA, 19 nt, Homo sapiens
gacuuauucauuccucaca

SEQ ID NO: 2105918 - RNA, 13 nt, Homo sapiens
agcacagccauag

SEQ ID NO: 2105919 - RNA, 15 nt, Homo sapiens
gaaugcauugcauca

SEQ ID NO: 2105920 - RNA, 14 nt, Homo sapiens
uggggagguggagu

SEQ ID NO: 2105921 - RNA, 13 nt, Homo sapiens
cuggaagcuguca

SEQ ID NO: 2105922 - RNA, 15 nt, Homo sapiens
agcaucugcuccauc

SEQ ID NO: 2105923 - RNA, 13 nt, Homo sapiens
augcauaggauuc

SEQ ID NO: 2105924 - RNA, 13 nt, Homo sapiens
gagucuagauuca

SEQ ID NO: 2105925 - RNA, 18 nt, Homo sapiens
aucuguacccuuuuccau

SEQ ID NO: 2105926 - RNA, 16 nt, Homo sapiens
gagccaggaccacaga

SEQ ID NO: 2105927 - RNA, 15 nt, Homo sapiens
ccuuagcuggcauua

SEQ ID NO: 2105928 - RNA, 15 nt, Homo sapiens
agaggcugggagcau

SEQ ID NO: 2105929 - RNA, 23 nt, Homo sapiens
cuauuaggugcaauuucaagguu

SEQ ID NO: 2105930 - RNA, 16 nt, Homo sapiens
cugccagcaucugcag

SEQ ID NO: 2105931 - RNA, 14 nt, Homo sapiens
aggugccacuccag

SEQ ID NO: 2105932 - RNA, 15 nt, Homo sapiens
uugaaacaaagaagg

SEQ ID NO: 2105933 - RNA, 22 nt, Homo sapiens
augacggggccuccuucuucaa

SEQ ID NO: 2105934 - RNA, 20 nt, Homo sapiens
cuuuuccuggcagcugcugu

SEQ ID NO: 2105935 - RNA, 20 nt, Homo sapiens
gagccugggauuucuaugca

SEQ ID NO: 2105936 - RNA, 17 nt, Homo sapiens
cauguuucagugaagau

SEQ ID NO: 2105937 - RNA, 23 nt, Homo sapiens
gccucuagaacacccacuggcca

SEQ ID NO: 2105938 - RNA, 15 nt, Homo sapiens
gauuuuacaaguaua

SEQ ID NO: 2105939 - RNA, 14 nt, Homo sapiens
ccacugcacuccag

SEQ ID NO: 2105940 - RNA, 17 nt, Homo sapiens
cucccuaggcugcccac

SEQ ID NO: 2105941 - RNA, 14 nt, Homo sapiens
aaccgcuugccaua

SEQ ID NO: 2105942 - RNA, 13 nt, Homo sapiens
gacacugugcaaa

SEQ ID NO: 2105943 - RNA, 13 nt, Homo sapiens
acaaauguaacac

SEQ ID NO: 2105944 - RNA, 15 nt, Homo sapiens
auuucguguacugca

SEQ ID NO: 2105945 - RNA, 17 nt, Homo sapiens
uagauuucuucucuuua

SEQ ID NO: 2105946 - RNA, 22 nt, Homo sapiens
uauuaaguucucaaugugaaaa

SEQ ID NO: 2105947 - RNA, 16 nt, Homo sapiens
gcaguggcucaugccu

SEQ ID NO: 2105948 - RNA, 12 nt, Homo sapiens
ccaguguucucc

SEQ ID NO: 2105949 - RNA, 20 nt, Homo sapiens
caucuuccaccucaccucuu

SEQ ID NO: 2105950 - RNA, 12 nt, Homo sapiens
aacuuccuucuc

SEQ ID NO: 2105951 - RNA, 22 nt, Homo sapiens
agcaaucuguguacugaacaua

SEQ ID NO: 2105952 - RNA, 13 nt, Homo sapiens
cuacccauuuaca

SEQ ID NO: 2105953 - RNA, 12 nt, Homo sapiens
acagucucacca

SEQ ID NO: 2105954 - RNA, 12 nt, Homo sapiens
gacaguggcacc

SEQ ID NO: 2105955 - RNA, 13 nt, Homo sapiens
cagcugcuucugu

SEQ ID NO: 2105956 - RNA, 15 nt, Homo sapiens
cuaaaaaugcaacuu

SEQ ID NO: 2105957 - RNA, 15 nt, Homo sapiens
ugugagcauggggcc

SEQ ID NO: 2105958 - RNA, 21 nt, Homo sapiens
aucacacacauugcugugaac

SEQ ID NO: 2105959 - RNA, 17 nt, Homo sapiens
gucaguguuuggugcac

SEQ ID NO: 2105960 - RNA, 22 nt, Homo sapiens
aucuuucuuuucccaacauaug

SEQ ID NO: 2105961 - RNA, 22 nt, Homo sapiens
gaaugaacuaugucgaugcaca

SEQ ID NO: 2105962 - RNA, 20 nt, Homo sapiens
uaauugcacguguguauugc

SEQ ID NO: 2105963 - RNA, 19 nt, Homo sapiens
gacuuuauggagaguucag

SEQ ID NO: 2105964 - RNA, 20 nt, Homo sapiens
cuaaagagugaaugccauuu

SEQ ID NO: 2105965 - RNA, 13 nt, Homo sapiens
auuaucucacuua

SEQ ID NO: 2105966 - RNA, 17 nt, Homo sapiens
gccuggucaauaaacca

SEQ ID NO: 2105967 - RNA, 15 nt, Homo sapiens
accgaaaucccucag

SEQ ID NO: 2105968 - RNA, 13 nt, Homo sapiens
agacuaguuuaca

SEQ ID NO: 2105969 - RNA, 13 nt, Homo sapiens
agucugggccagg

SEQ ID NO: 2105970 - RNA, 13 nt, Homo sapiens
cuaaugggcuaaa

SEQ ID NO: 2105971 - RNA, 13 nt, Homo sapiens
gagauggggagaa

SEQ ID NO: 2105972 - RNA, 13 nt, Homo sapiens
cagcugggcagca

SEQ ID NO: 2105973 - RNA, 21 nt, Homo sapiens
aguguaugcacgugugcacac

SEQ ID NO: 2105974 - RNA, 19 nt, Homo sapiens
gaggcucaucuaacucugu

SEQ ID NO: 2105975 - RNA, 14 nt, Homo sapiens
cuagagugcauaua

SEQ ID NO: 2105976 - RNA, 12 nt, Homo sapiens
augcauucugag

SEQ ID NO: 2105977 - RNA, 15 nt, Homo sapiens
ugcaugacagucaca

SEQ ID NO: 2105978 - RNA, 16 nt, Homo sapiens
uaucccuuaccugcuu

SEQ ID NO: 2105979 - RNA, 23 nt, Homo sapiens
auguuuacuaaguggacuggugu

SEQ ID NO: 2105980 - RNA, 20 nt, Homo sapiens
acuccuaggcaggacaugcu

SEQ ID NO: 2105981 - RNA, 20 nt, Homo sapiens
gaacacacauggaugcacac

SEQ ID NO: 2105982 - RNA, 15 nt, Homo sapiens
uggcugggccuucac

SEQ ID NO: 2105983 - RNA, 16 nt, Homo sapiens
auuauaaaauggacac

SEQ ID NO: 2105984 - RNA, 14 nt, Homo sapiens
ggugaaaucccugc

SEQ ID NO: 2105985 - RNA, 15 nt, Homo sapiens
acaggccaggacaaa

SEQ ID NO: 2105986 - RNA, 16 nt, Homo sapiens
uggaagaggccuuccc

SEQ ID NO: 2105987 - RNA, 19 nt, Homo sapiens
ggaaaucuuguuuugccaa

SEQ ID NO: 2105988 - RNA, 15 nt, Homo sapiens
cauucugcaccucuu

SEQ ID NO: 2105989 - RNA, 23 nt, Homo sapiens
uuugcuacuaaguucacauuaga

SEQ ID NO: 2105990 - RNA, 16 nt, Homo sapiens
agaacgaaccuuggcc

SEQ ID NO: 2105991 - RNA, 16 nt, Homo sapiens
agagcaggggcuccag

SEQ ID NO: 2105992 - RNA, 12 nt, Homo sapiens
gacacugcagug

SEQ ID NO: 2105993 - RNA, 23 nt, Homo sapiens
ucagagacauacaccuaugucau

SEQ ID NO: 2105994 - RNA, 21 nt, Homo sapiens
ugggcaccuggggagugggac

SEQ ID NO: 2105995 - RNA, 19 nt, Homo sapiens
cucugcccuucagccuuca

SEQ ID NO: 2105996 - RNA, 13 nt, Homo sapiens
auuauuuugcacu

SEQ ID NO: 2105997 - RNA, 17 nt, Homo sapiens
ucauuuuggcaucugca

SEQ ID NO: 2105998 - RNA, 16 nt, Homo sapiens
aucuaagggucucuca

SEQ ID NO: 2105999 - RNA, 23 nt, Homo sapiens
agccagucugcagaagcauuuga

SEQ ID NO: 2106000 - RNA, 16 nt, Homo sapiens
agaaugagcaagaggc

SEQ ID NO: 2106001 - RNA, 16 nt, Homo sapiens
guacgaggcuucucua

SEQ ID NO: 2106002 - RNA, 21 nt, Homo sapiens
cucggggcgaccccucagugc

SEQ ID NO: 2106003 - RNA, 21 nt, Homo sapiens
uucucugccaucaacuacuau

SEQ ID NO: 2106004 - RNA, 18 nt, Homo sapiens
uucaaguguuaccuaaca

SEQ ID NO: 2106005 - RNA, 17 nt, Homo sapiens
uugccaaagguccaaua

SEQ ID NO: 2106006 - RNA, 15 nt, Homo sapiens
gaaaaccaacaccau

SEQ ID NO: 2106007 - RNA, 12 nt, Homo sapiens
uaagucuuucau

SEQ ID NO: 2106008 - RNA, 22 nt, Homo sapiens
uugccaaacagccacacugugg

SEQ ID NO: 2106009 - RNA, 18 nt, Homo sapiens
acuucagccuuuaaugcc

SEQ ID NO: 2106010 - RNA, 17 nt, Homo sapiens
uagauugggcacugugg

SEQ ID NO: 2106011 - RNA, 17 nt, Homo sapiens
aaagagaagcugugucu

SEQ ID NO: 2106012 - RNA, 13 nt, Homo sapiens
auguaaagguuuu

SEQ ID NO: 2106013 - RNA, 16 nt, Homo sapiens
cuguuaugcaagcaca

SEQ ID NO: 2106014 - RNA, 12 nt, Homo sapiens
uuacagcccagg

SEQ ID NO: 2106015 - RNA, 18 nt, Homo sapiens
uuaagguucaagacagau

SEQ ID NO: 2106016 - RNA, 17 nt, Homo sapiens
gauuuuguugaccucaa

SEQ ID NO: 2106017 - RNA, 13 nt, Homo sapiens
uuaaagagacaaa

SEQ ID NO: 2106018 - RNA, 13 nt, Homo sapiens
uccucacagugaa

SEQ ID NO: 2106019 - RNA, 18 nt, Homo sapiens
cuggauuaggucucuguu

SEQ ID NO: 2106020 - RNA, 22 nt, Homo sapiens
ugcccaugguguguguguccag

SEQ ID NO: 2106021 - RNA, 23 nt, Homo sapiens
gccagaccagcaggcuggccuau

SEQ ID NO: 2106022 - RNA, 17 nt, Homo sapiens
cuuaccaggcaccaaaa

SEQ ID NO: 2106023 - RNA, 22 nt, Homo sapiens
uggaaugaaaaauaaacauucu

SEQ ID NO: 2106024 - RNA, 17 nt, Homo sapiens
gcagacaguagacagaa

SEQ ID NO: 2106025 - RNA, 17 nt, Homo sapiens
ugggccucggaccccac

SEQ ID NO: 2106026 - RNA, 19 nt, Homo sapiens
aaagcuauuccaagacuca

SEQ ID NO: 2106027 - RNA, 19 nt, Homo sapiens
auaugagcaugcucccuca

SEQ ID NO: 2106028 - RNA, 18 nt, Homo sapiens
caugugccuuucuuugcc

SEQ ID NO: 2106029 - RNA, 13 nt, Homo sapiens
uauuucaaaauca

SEQ ID NO: 2106030 - RNA, 12 nt, Homo sapiens
ucuaaaugaagc

SEQ ID NO: 2106031 - RNA, 16 nt, Homo sapiens
agauggcucuuucuau

SEQ ID NO: 2106032 - RNA, 19 nt, Homo sapiens
agugcagugauguuugcca

SEQ ID NO: 2106033 - RNA, 13 nt, Homo sapiens
ucagcugcugcua

SEQ ID NO: 2106034 - RNA, 18 nt, Homo sapiens
gugauuucuuaugccugu

SEQ ID NO: 2106035 - RNA, 17 nt, Homo sapiens
ggccaaggacagggugg

SEQ ID NO: 2106036 - RNA, 22 nt, Homo sapiens
gcccucuccccaccccuuccaa

SEQ ID NO: 2106037 - RNA, 12 nt, Homo sapiens
aacaaagacauu

SEQ ID NO: 2106038 - RNA, 20 nt, Homo sapiens
ugagucuuugguucuaagga

SEQ ID NO: 2106039 - RNA, 21 nt, Homo sapiens
ucaaauuuuucaucucuucaa

SEQ ID NO: 2106040 - RNA, 16 nt, Homo sapiens
uggcuggugcccauga

SEQ ID NO: 2106041 - RNA, 18 nt, Homo sapiens
uccuggaucucccugaga

SEQ ID NO: 2106042 - RNA, 14 nt, Homo sapiens
ugacuuugccaaaa

SEQ ID NO: 2106043 - RNA, 23 nt, Homo sapiens
uagccauauuuguaaaaugacaa

SEQ ID NO: 2106044 - RNA, 16 nt, Homo sapiens
aacuugcaauuugcaa

SEQ ID NO: 2106045 - RNA, 14 nt, Homo sapiens
uauuugcauaacaa

SEQ ID NO: 2106046 - RNA, 17 nt, Homo sapiens
guuucaacugugcucuu

SEQ ID NO: 2106047 - RNA, 19 nt, Homo sapiens
cgcccaggcuggagugcag

SEQ ID NO: 2106048 - RNA, 18 nt, Homo sapiens
uugccucuaugugcaacu

SEQ ID NO: 2106049 - RNA, 20 nt, Homo sapiens
ggauagucagcuguaccaag

SEQ ID NO: 2106050 - RNA, 12 nt, Homo sapiens
uuuccagggaua

SEQ ID NO: 2106051 - RNA, 15 nt, Homo sapiens
acccaccagacuuuu

SEQ ID NO: 2106052 - RNA, 14 nt, Homo sapiens
ccucugcagucucu

SEQ ID NO: 2106053 - RNA, 14 nt, Homo sapiens
uccuccgguugcau

SEQ ID NO: 2106054 - RNA, 13 nt, Homo sapiens
guucugcacccag

SEQ ID NO: 2106055 - RNA, 19 nt, Homo sapiens
acugcguggugcucuuugc

SEQ ID NO: 2106056 - RNA, 11 nt, Homo sapiens
auaaacacaga

SEQ ID NO: 2106057 - RNA, 19 nt, Homo sapiens
acuguauauauaauacuga

SEQ ID NO: 2106058 - RNA, 15 nt, Homo sapiens
agucagucaugucac

SEQ ID NO: 2106059 - RNA, 16 nt, Homo sapiens
ccaacccaaaccugga

SEQ ID NO: 2106060 - RNA, 22 nt, Homo sapiens
gugugaccacugcagaagacag

SEQ ID NO: 2106061 - RNA, 17 nt, Homo sapiens
auggcugcgcaccaucu

SEQ ID NO: 2106062 - RNA, 13 nt, Homo sapiens
guaggaaaggaau

SEQ ID NO: 2106063 - RNA, 19 nt, Homo sapiens
agaggcccaagugcaaaag

SEQ ID NO: 2106064 - RNA, 21 nt, Homo sapiens
cacagcugcagcugggcccca

SEQ ID NO: 2106065 - RNA, 23 nt, Homo sapiens
uccuaggggaacagaccagugac

SEQ ID NO: 2106066 - RNA, 18 nt, Homo sapiens
agcuuggacuugcauucc

SEQ ID NO: 2106067 - RNA, 16 nt, Homo sapiens
gcaguuugacuucuuu

SEQ ID NO: 2106068 - RNA, 20 nt, Homo sapiens
cauauuuauuuuuaccugcu

SEQ ID NO: 2106069 - RNA, 13 nt, Homo sapiens
agcaggacacuga

SEQ ID NO: 2106070 - RNA, 23 nt, Homo sapiens
gaaaauguuuugaaaagaacaaa

SEQ ID NO: 2106071 - RNA, 15 nt, Homo sapiens
ugguuucaacaaaga

SEQ ID NO: 2106072 - RNA, 16 nt, Homo sapiens
cuagaucucccuuaau

SEQ ID NO: 2106073 - RNA, 17 nt, Homo sapiens
ucugugaagaaugaagu

SEQ ID NO: 2106074 - RNA, 14 nt, Homo sapiens
cucaagcacugaca

SEQ ID NO: 2106075 - RNA, 21 nt, Homo sapiens
cucaggugaucuaccugccuc

SEQ ID NO: 2106076 - RNA, 18 nt, Homo sapiens
gggacucguggcugucaa

SEQ ID NO: 2106077 - RNA, 20 nt, Homo sapiens
gacauccagcaguccaaggu

SEQ ID NO: 2106078 - RNA, 22 nt, Homo sapiens
gcgugaguggacgugucaggug

SEQ ID NO: 2106079 - RNA, 16 nt, Homo sapiens
uaucccuugacaaaaa

SEQ ID NO: 2106080 - RNA, 22 nt, Homo sapiens
guacagaauuuuuaaugacuuu

SEQ ID NO: 2106081 - RNA, 15 nt, Homo sapiens
ucagcaggcaaagac

SEQ ID NO: 2106082 - RNA, 22 nt, Homo sapiens
aaagaugcauguuacugccaaa

SEQ ID NO: 2106083 - RNA, 15 nt, Homo sapiens
caacugcugccccaa

SEQ ID NO: 2106084 - RNA, 23 nt, Homo sapiens
aaacuccugauuuuguaguuaau

SEQ ID NO: 2106085 - RNA, 18 nt, Homo sapiens
uuauuaauauuauuauga

SEQ ID NO: 2106086 - RNA, 19 nt, Homo sapiens
ucugguacugcaggaccuc

SEQ ID NO: 2106087 - RNA, 20 nt, Homo sapiens
aucuggcccuuacacacuca

SEQ ID NO: 2106088 - RNA, 16 nt, Homo sapiens
cauguugccuugcaua

SEQ ID NO: 2106089 - RNA, 17 nt, Homo sapiens
aagcaggcgacaaaauc

SEQ ID NO: 2106090 - RNA, 20 nt, Homo sapiens
caaagcacuggccuugccuc

SEQ ID NO: 2106091 - RNA, 22 nt, Homo sapiens
aucccagauaugguugcacaaa

SEQ ID NO: 2106092 - RNA, 21 nt, Homo sapiens
uguuuaugaagaaagauacua

SEQ ID NO: 2106093 - RNA, 14 nt, Homo sapiens
aauuguuuaugugu

SEQ ID NO: 2106094 - RNA, 18 nt, Homo sapiens
caacaauuuauccauuca

SEQ ID NO: 2106095 - RNA, 15 nt, Homo sapiens
aauuagggagcucuu

SEQ ID NO: 2106096 - RNA, 20 nt, Homo sapiens
aaaugaugucaugucagcuc

SEQ ID NO: 2106097 - RNA, 18 nt, Homo sapiens
accaaaggauagugcgau

SEQ ID NO: 2106098 - RNA, 19 nt, Homo sapiens
ggaucaugguuuuugcucu

SEQ ID NO: 2106099 - RNA, 21 nt, Homo sapiens
acugugcuaauaacagugcau

SEQ ID NO: 2106100 - RNA, 14 nt, Homo sapiens
agccuggacagcuu

SEQ ID NO: 2106101 - RNA, 10 nt, Homo sapiens
ccacugccag

SEQ ID NO: 2106102 - RNA, 20 nt, Homo sapiens
gguuaaacccacagccaaac

SEQ ID NO: 2106103 - RNA, 16 nt, Homo sapiens
ugggguucggccugug

SEQ ID NO: 2106104 - RNA, 23 nt, Homo sapiens
uccuggaggugggagacaaggaa

SEQ ID NO: 2106105 - RNA, 20 nt, Homo sapiens
gaguucuaaauacaggaaau

SEQ ID NO: 2106106 - RNA, 17 nt, Homo sapiens
ucuucagggcacugcug

SEQ ID NO: 2106107 - RNA, 15 nt, Homo sapiens
cccgaggucgcugca

SEQ ID NO: 2106108 - RNA, 18 nt, Homo sapiens
uuaaugucugccagguga

SEQ ID NO: 2106109 - RNA, 20 nt, Homo sapiens
cgcugggagaaaagccagau

SEQ ID NO: 2106110 - RNA, 23 nt, Homo sapiens
cuuguacacauauacauaugauc

SEQ ID NO: 2106111 - RNA, 14 nt, Homo sapiens
uguuccuuugcucu

SEQ ID NO: 2106112 - RNA, 13 nt, Homo sapiens
gccaagugaaaaa

SEQ ID NO: 2106113 - RNA, 18 nt, Homo sapiens
uccuauguuuguguauag

SEQ ID NO: 2106114 - RNA, 18 nt, Homo sapiens
ccuaucaaaaagauauca

SEQ ID NO: 2106115 - RNA, 16 nt, Homo sapiens
gccccuacugcuguga

SEQ ID NO: 2106116 - RNA, 16 nt, Homo sapiens
agacccauaaccauua

SEQ ID NO: 2106117 - RNA, 17 nt, Homo sapiens
uugauauuuuccaaaug

SEQ ID NO: 2106118 - RNA, 17 nt, Homo sapiens
gucuaaucaacagauaa

SEQ ID NO: 2106119 - RNA, 16 nt, Homo sapiens
uaaaugcauguccuca

SEQ ID NO: 2106120 - RNA, 16 nt, Homo sapiens
aaguaggacuaucaca

SEQ ID NO: 2106121 - RNA, 13 nt, Homo sapiens
acagauuuguuca

SEQ ID NO: 2106122 - RNA, 22 nt, Homo sapiens
auuaugacacuagauacaguaa

SEQ ID NO: 2106123 - RNA, 13 nt, Homo sapiens
guaacaugauguu

SEQ ID NO: 2106124 - RNA, 17 nt, Homo sapiens
cauuuaauaucuuugau

SEQ ID NO: 2106125 - RNA, 13 nt, Homo sapiens
gugacgcuacuaa

SEQ ID NO: 2106126 - RNA, 19 nt, Homo sapiens
cacccacucuccugugaga

SEQ ID NO: 2106127 - RNA, 16 nt, Homo sapiens
uugcacagcaucucag

SEQ ID NO: 2106128 - RNA, 19 nt, Homo sapiens
gaaaaacaccgcuucugcc

SEQ ID NO: 2106129 - RNA, 17 nt, Homo sapiens
uuaaagccuuuaguauc

SEQ ID NO: 2106130 - RNA, 23 nt, Homo sapiens
ucagauaagguaaaaugccauga

SEQ ID NO: 2106131 - RNA, 14 nt, Homo sapiens
cacuggggcccaag

SEQ ID NO: 2106132 - RNA, 20 nt, Homo sapiens
cagggcugggcgggagagac

SEQ ID NO: 2106133 - RNA, 16 nt, Homo sapiens
cucuucuggcuguguu

SEQ ID NO: 2106134 - RNA, 14 nt, Homo sapiens
aucaguuacucuga

SEQ ID NO: 2106135 - RNA, 16 nt, Homo sapiens
aucugccuuagacaaa

SEQ ID NO: 2106136 - RNA, 15 nt, Homo sapiens
cuuuaagccaaagaa

SEQ ID NO: 2106137 - RNA, 13 nt, Homo sapiens
gucugaacaaagu

SEQ ID NO: 2106138 - RNA, 15 nt, Homo sapiens
ggaacugguccaggc

SEQ ID NO: 2106139 - RNA, 20 nt, Homo sapiens
aaaugcaggagagcuucccc

SEQ ID NO: 2106140 - RNA, 15 nt, Homo sapiens
ugaaaucucuagccu

SEQ ID NO: 2106141 - RNA, 22 nt, Homo sapiens
uuuaaucucuuaauauugagaa

SEQ ID NO: 2106142 - RNA, 11 nt, Homo sapiens
accaacugugu

SEQ ID NO: 2106143 - RNA, 11 nt, Homo sapiens
cuugcucugca

SEQ ID NO: 2106144 - RNA, 18 nt, Homo sapiens
ccagcauucagcacacac

SEQ ID NO: 2106145 - RNA, 17 nt, Homo sapiens
cugcgccugggaucucg

SEQ ID NO: 2106146 - RNA, 17 nt, Homo sapiens
cuccaccagugugcuug

SEQ ID NO: 2106147 - RNA, 23 nt, Homo sapiens
uaaauuugucuuucaagugaaac

SEQ ID NO: 2106148 - RNA, 12 nt, Homo sapiens
aaaaucacucaa

SEQ ID NO: 2106149 - RNA, 20 nt, Homo sapiens
ggcugcaugauguuugccca

SEQ ID NO: 2106150 - RNA, 12 nt, Homo sapiens
ugcuacuugacc

SEQ ID NO: 2106151 - RNA, 21 nt, Homo sapiens
gccaguggugcuaaaugcuac

SEQ ID NO: 2106152 - RNA, 15 nt, Homo sapiens
cuguguggacuguga

SEQ ID NO: 2106153 - RNA, 16 nt, Homo sapiens
cugcccaccuccugga

SEQ ID NO: 2106154 - RNA, 20 nt, Homo sapiens
uggacucgccuguaaucuca

SEQ ID NO: 2106155 - RNA, 18 nt, Homo sapiens
uccuaugcuuuagcuuau

SEQ ID NO: 2106156 - RNA, 24 nt, Homo sapiens
auaccuagugauacggauuuagcu

SEQ ID NO: 2106157 - RNA, 13 nt, Homo sapiens
acaucccagacac

SEQ ID NO: 2106158 - RNA, 20 nt, Homo sapiens
aaagaaguuaacuacagugu

SEQ ID NO: 2106159 - RNA, 11 nt, Homo sapiens
aguucaaugau

SEQ ID NO: 2106160 - RNA, 13 nt, Homo sapiens
uuugacauuucau

SEQ ID NO: 2106161 - RNA, 11 nt, Homo sapiens
gcaucauucac

SEQ ID NO: 2106162 - RNA, 22 nt, Homo sapiens
cuuaggcuaagagaugugacua

SEQ ID NO: 2106163 - RNA, 12 nt, Homo sapiens
aaugaaagugau

SEQ ID NO: 2106164 - RNA, 15 nt, Homo sapiens
acacccuuagccucc

SEQ ID NO: 2106165 - RNA, 23 nt, Homo sapiens
ccagcauggaugugucucaggca

SEQ ID NO: 2106166 - RNA, 17 nt, Homo sapiens
aggcaguuggccagaga

SEQ ID NO: 2106167 - RNA, 14 nt, Homo sapiens
gaaggccuucagga

SEQ ID NO: 2106168 - RNA, 22 nt, Homo sapiens
auuuaugugaguguguguuugu

SEQ ID NO: 2106169 - RNA, 21 nt, Homo sapiens
uccugaucaggaaaccagaaa

SEQ ID NO: 2106170 - RNA, 22 nt, Homo sapiens
ccuucuggugccagauccucuu

SEQ ID NO: 2106171 - RNA, 15 nt, Homo sapiens
uggauugugguucca

SEQ ID NO: 2106172 - RNA, 12 nt, Homo sapiens
uccuauguguaa

SEQ ID NO: 2106173 - RNA, 14 nt, Homo sapiens
gugaauagaacucu

SEQ ID NO: 2106174 - RNA, 14 nt, Homo sapiens
agcccagcguccac

SEQ ID NO: 2106175 - RNA, 16 nt, Homo sapiens
uugcuguuaaucugau

SEQ ID NO: 2106176 - RNA, 21 nt, Homo sapiens
gcuuacaguaggagugagaaa

SEQ ID NO: 2106177 - RNA, 21 nt, Homo sapiens
cauaauuuuuauuuuuggcaa

SEQ ID NO: 2106178 - RNA, 22 nt, Homo sapiens
cuuuggcauuuguguagcugag

SEQ ID NO: 2106179 - RNA, 19 nt, Homo sapiens
augguggcacgugccugua

SEQ ID NO: 2106180 - RNA, 12 nt, Homo sapiens
uuuccugccucc

SEQ ID NO: 2106181 - RNA, 18 nt, Homo sapiens
acuccaguuuucaaauca

SEQ ID NO: 2106182 - RNA, 14 nt, Homo sapiens
acugggaaucaaga

SEQ ID NO: 2106183 - RNA, 22 nt, Homo sapiens
aaagcaaacacuuacagaauua

SEQ ID NO: 2106184 - RNA, 14 nt, Homo sapiens
uguugaaaagccau

SEQ ID NO: 2106185 - RNA, 13 nt, Homo sapiens
uaacaauugugua

SEQ ID NO: 2106186 - RNA, 21 nt, Homo sapiens
gccauauaaguuugaaggaaa

SEQ ID NO: 2106187 - RNA, 21 nt, Homo sapiens
aacaauguaaaccaccaucuu

SEQ ID NO: 2106188 - RNA, 14 nt, Homo sapiens
cgugcucauugcua

SEQ ID NO: 2106189 - RNA, 18 nt, Homo sapiens
cuugcacuauucuuaaua

SEQ ID NO: 2106190 - RNA, 16 nt, Homo sapiens
aaugucuuucuauuca

SEQ ID NO: 2106191 - RNA, 16 nt, Homo sapiens
uaaaucacacauucag

SEQ ID NO: 2106192 - RNA, 17 nt, Homo sapiens
aucacuauaaccaucag

SEQ ID NO: 2106193 - RNA, 15 nt, Homo sapiens
uaccugaaaauucaa

SEQ ID NO: 2106194 - RNA, 15 nt, Homo sapiens
aucagcauuuuacua

SEQ ID NO: 2106195 - RNA, 14 nt, Homo sapiens
uaacuagaguauaa

SEQ ID NO: 2106196 - RNA, 16 nt, Homo sapiens
ucacuccucugucaua

SEQ ID NO: 2106197 - RNA, 20 nt, Homo sapiens
uggcaggaagggacugccaa

SEQ ID NO: 2106198 - RNA, 22 nt, Homo sapiens
augccagggcccaggaggaccg

SEQ ID NO: 2106199 - RNA, 15 nt, Homo sapiens
agaggcagcuagcca

SEQ ID NO: 2106200 - RNA, 16 nt, Homo sapiens
ccggggguggugacau

SEQ ID NO: 2106201 - RNA, 12 nt, Homo sapiens
aauguuccuccc

SEQ ID NO: 2106202 - RNA, 21 nt, Homo sapiens
acagaagaguuucuuaacuua

SEQ ID NO: 2106203 - RNA, 14 nt, Homo sapiens
caugcgcugcucaa

SEQ ID NO: 2106204 - RNA, 14 nt, Homo sapiens
caugagcugcucca

SEQ ID NO: 2106205 - RNA, 16 nt, Homo sapiens
ucuaguuaacauuuca

SEQ ID NO: 2106206 - RNA, 12 nt, Homo sapiens
aauaacacuguc

SEQ ID NO: 2106207 - RNA, 18 nt, Homo sapiens
ugucauucgcucccacau

SEQ ID NO: 2106208 - RNA, 17 nt, Homo sapiens
cagcagaacuucugaaa

SEQ ID NO: 2106209 - RNA, 17 nt, Homo sapiens
aauauuuauugaauuau

SEQ ID NO: 2106210 - RNA, 16 nt, Homo sapiens
ccuuccacacagggug

SEQ ID NO: 2106211 - RNA, 19 nt, Homo sapiens
caucauaacugcauacuca

SEQ ID NO: 2106212 - RNA, 22 nt, Homo sapiens
aagggacauguuuucuagccuu

SEQ ID NO: 2106213 - RNA, 17 nt, Homo sapiens
auuaauaaacaaucucc

SEQ ID NO: 2106214 - RNA, 23 nt, Homo sapiens
aguacuccuuaaaauaaaacacu

SEQ ID NO: 2106215 - RNA, 18 nt, Homo sapiens
auucuaauuagauuaacc

SEQ ID NO: 2106216 - RNA, 23 nt, Homo sapiens
uaucagcagacacuccaguuugc

SEQ ID NO: 2106217 - RNA, 15 nt, Homo sapiens
aauuugagauucuac

SEQ ID NO: 2106218 - RNA, 23 nt, Homo sapiens
aaagguccaauaaaaugccucaa

SEQ ID NO: 2106219 - RNA, 14 nt, Homo sapiens
ucagagaccuucca

SEQ ID NO: 2106220 - RNA, 16 nt, Homo sapiens
cagccaagaaagcuau

SEQ ID NO: 2106221 - RNA, 18 nt, Homo sapiens
acacagauuugagcucag

SEQ ID NO: 2106222 - RNA, 15 nt, Homo sapiens
gaggcauucuucuaa

SEQ ID NO: 2106223 - RNA, 15 nt, Homo sapiens
cuccgcaggacuucc

SEQ ID NO: 2106224 - RNA, 14 nt, Homo sapiens
acuggaccagacaa

SEQ ID NO: 2106225 - RNA, 20 nt, Homo sapiens
cugauggacaggugucugag

SEQ ID NO: 2106226 - RNA, 22 nt, Homo sapiens
caaauugagacagugcacauga

SEQ ID NO: 2106227 - RNA, 15 nt, Homo sapiens
cacaauauccagcga

SEQ ID NO: 2106228 - RNA, 17 nt, Homo sapiens
gccucacaccccagugg

SEQ ID NO: 2106229 - RNA, 19 nt, Homo sapiens
aucucuaaaauucuagucu

SEQ ID NO: 2106230 - RNA, 22 nt, Homo sapiens
aauguuauuuuuuaauuauuau

SEQ ID NO: 2106231 - RNA, 22 nt, Homo sapiens
uguggcuucuuaaucuuuucac

SEQ ID NO: 2106232 - RNA, 13 nt, Homo sapiens
aaguauaaaguaa

SEQ ID NO: 2106233 - RNA, 19 nt, Homo sapiens
gaacuggaggaguuccuug

SEQ ID NO: 2106234 - RNA, 21 nt, Homo sapiens
auuucugucucucucuguccu

SEQ ID NO: 2106235 - RNA, 21 nt, Homo sapiens
ccccaacuauuaaagugccau

SEQ ID NO: 2106236 - RNA, 23 nt, Homo sapiens
uguggguagacacacaugaaguc

SEQ ID NO: 2106237 - RNA, 17 nt, Homo sapiens
uaaggacauuaaaagcu

SEQ ID NO: 2106238 - RNA, 20 nt, Homo sapiens
uugauucaaauaacccugaa

SEQ ID NO: 2106239 - RNA, 16 nt, Homo sapiens
aauggggaggacaaaa

SEQ ID NO: 2106240 - RNA, 24 nt, Homo sapiens
aguuuacagacgcugcugucacaa

SEQ ID NO: 2106241 - RNA, 22 nt, Homo sapiens
ccuguacucuggagagacugug

SEQ ID NO: 2106242 - RNA, 21 nt, Homo sapiens
agaggacagaucaauggcgca

SEQ ID NO: 2106243 - RNA, 16 nt, Homo sapiens
gagcugccugcugcca

SEQ ID NO: 2106244 - RNA, 22 nt, Homo sapiens
uagcauuucuagaacaauuaca

SEQ ID NO: 2106245 - RNA, 22 nt, Homo sapiens
ccaaugaagaagacaaagucua

SEQ ID NO: 2106246 - RNA, 23 nt, Homo sapiens
aauaaguuuuccuuuuguuuucc

SEQ ID NO: 2106247 - RNA, 15 nt, Homo sapiens
uugacuuucauugga

SEQ ID NO: 2106248 - RNA, 19 nt, Homo sapiens
cccugcuguaucuuccaga

SEQ ID NO: 2106249 - RNA, 22 nt, Homo sapiens
uaacuuugcccuucacuguugc

SEQ ID NO: 2106250 - RNA, 23 nt, Homo sapiens
cagucacaguuuuugguuccucu

SEQ ID NO: 2106251 - RNA, 15 nt, Homo sapiens
ucacgcagugcuuuc

SEQ ID NO: 2106252 - RNA, 17 nt, Homo sapiens
uaauuaaaaacuaguag

SEQ ID NO: 2106253 - RNA, 13 nt, Homo sapiens
caggagucaccau

SEQ ID NO: 2106254 - RNA, 15 nt, Homo sapiens
agccggacagcugcc

SEQ ID NO: 2106255 - RNA, 13 nt, Homo sapiens
cugcccugcuauu

SEQ ID NO: 2106256 - RNA, 20 nt, Homo sapiens
uugcuguccucucauuugca

SEQ ID NO: 2106257 - RNA, 15 nt, Homo sapiens
uucacucauacaucu

SEQ ID NO: 2106258 - RNA, 13 nt, Homo sapiens
guguggcaguguu

SEQ ID NO: 2106259 - RNA, 17 nt, Homo sapiens
ugggugaugcuuuugcu

SEQ ID NO: 2106260 - RNA, 21 nt, Homo sapiens
ugaaaacgcaaacaugaauau

SEQ ID NO: 2106261 - RNA, 17 nt, Homo sapiens
agaagguuuacucugug

SEQ ID NO: 2106262 - RNA, 13 nt, Homo sapiens
guagccucucuuu

SEQ ID NO: 2106263 - RNA, 22 nt, Homo sapiens
gggugugggaagaccaaaggaa

SEQ ID NO: 2106264 - RNA, 23 nt, Homo sapiens
agacaccuucugaguauucucau

SEQ ID NO: 2106265 - RNA, 21 nt, Homo sapiens
auaaaaauauuguguugugaa

SEQ ID NO: 2106266 - RNA, 12 nt, Homo sapiens
cuuuuguugccc

SEQ ID NO: 2106267 - RNA, 13 nt, Homo sapiens
caucgguagcuug

SEQ ID NO: 2106268 - RNA, 23 nt, Homo sapiens
uuuaauggcaauaggacauugug

SEQ ID NO: 2106269 - RNA, 16 nt, Homo sapiens
cgcaagaccagucacu

SEQ ID NO: 2106270 - RNA, 24 nt, Homo sapiens
ccaccuagagguagguaggaucau

SEQ ID NO: 2106271 - RNA, 18 nt, Homo sapiens
gacuccugaggacagcug

SEQ ID NO: 2106272 - RNA, 19 nt, Homo sapiens
aagugaaaaaagcaaauag

SEQ ID NO: 2106273 - RNA, 16 nt, Homo sapiens
ucuuauagcacuuuga

SEQ ID NO: 2106274 - RNA, 18 nt, Homo sapiens
aaccauguugguugcacu

SEQ ID NO: 2106275 - RNA, 20 nt, Homo sapiens
ugccuggagcuccugggaag

SEQ ID NO: 2106276 - RNA, 23 nt, Homo sapiens
cuccccaguucauugcacuuuga

SEQ ID NO: 2106277 - RNA, 17 nt, Homo sapiens
uaacugagaauuuucua

SEQ ID NO: 2106278 - RNA, 13 nt, Homo sapiens
uaauaaagcuuuu

SEQ ID NO: 2106279 - RNA, 20 nt, Homo sapiens
uauuccaggaugcugcugca

SEQ ID NO: 2106280 - RNA, 21 nt, Homo sapiens
guuccccuaguucuacaugaa

SEQ ID NO: 2106281 - RNA, 23 nt, Homo sapiens
aacagaaacgagauuugccaaaa

SEQ ID NO: 2106282 - RNA, 18 nt, Homo sapiens
uuuaauuggcccuguaca

SEQ ID NO: 2106283 - RNA, 10 nt, Homo sapiens
gaaaacaauu

SEQ ID NO: 2106284 - RNA, 14 nt, Homo sapiens
ggagggcuguggug

SEQ ID NO: 2106285 - RNA, 21 nt, Homo sapiens
ugaaagacugugcuguccuuu

SEQ ID NO: 2106286 - RNA, 16 nt, Homo sapiens
uaucccaaacuaagcu

SEQ ID NO: 2106287 - RNA, 14 nt, Homo sapiens
accuggaacuggag

SEQ ID NO: 2106288 - RNA, 12 nt, Homo sapiens
guuacgugaaga

SEQ ID NO: 2106289 - RNA, 19 nt, Homo sapiens
aaugcugcccgcucugcag

SEQ ID NO: 2106290 - RNA, 23 nt, Homo sapiens
accuuauccauaggcgcaggugc

SEQ ID NO: 2106291 - RNA, 13 nt, Homo sapiens
cuuuuaaugcucc

SEQ ID NO: 2106292 - RNA, 23 nt, Homo sapiens
uccuuuguuuuuuuuuccugucc

SEQ ID NO: 2106293 - RNA, 22 nt, Homo sapiens
aucaguaauguauucuaucucu

SEQ ID NO: 2106294 - RNA, 20 nt, Homo sapiens
ccugaauggucucagcuuga

SEQ ID NO: 2106295 - RNA, 23 nt, Homo sapiens
caauuccaccaagacagugcuga

SEQ ID NO: 2106296 - RNA, 13 nt, Homo sapiens
acagaugugaaaa

SEQ ID NO: 2106297 - RNA, 17 nt, Homo sapiens
cagugccaugggggcaa

SEQ ID NO: 2106298 - RNA, 15 nt, Homo sapiens
acuauuuauuuacau

SEQ ID NO: 2106299 - RNA, 20 nt, Homo sapiens
aaagaauugugccucuccca

SEQ ID NO: 2106300 - RNA, 23 nt, Homo sapiens
uccucgggaaacacacaagcaac

SEQ ID NO: 2106301 - RNA, 15 nt, Homo sapiens
gauuauuuaucacau

SEQ ID NO: 2106302 - RNA, 23 nt, Homo sapiens
gaacuggugcuuuaguaaugugg

SEQ ID NO: 2106303 - RNA, 13 nt, Homo sapiens
uggaacaauguuu

SEQ ID NO: 2106304 - RNA, 21 nt, Homo sapiens
caccuguagucccagcacuuu

SEQ ID NO: 2106305 - RNA, 13 nt, Homo sapiens
gcaggccagagaa

SEQ ID NO: 2106306 - RNA, 14 nt, Homo sapiens
gggcugggucacag

SEQ ID NO: 2106307 - RNA, 21 nt, Homo sapiens
gcagauaagaaggugcgaggg

SEQ ID NO: 2106308 - RNA, 19 nt, Homo sapiens
auuauuuaugugaaaguca

SEQ ID NO: 2106309 - RNA, 16 nt, Homo sapiens
gaccuuccaaaccuca

SEQ ID NO: 2106310 - RNA, 12 nt, Homo sapiens
ucucaguucucu

SEQ ID NO: 2106311 - RNA, 14 nt, Homo sapiens
cuucuccaccaaag

SEQ ID NO: 2106312 - RNA, 14 nt, Homo sapiens
agacggcagccgcc

SEQ ID NO: 2106313 - RNA, 19 nt, Homo sapiens
agcuuuuuuuggaaguaac

SEQ ID NO: 2106314 - RNA, 16 nt, Homo sapiens
cauaagauuauauaca

SEQ ID NO: 2106315 - RNA, 19 nt, Homo sapiens
uuucucuguuguaagaaua

SEQ ID NO: 2106316 - RNA, 18 nt, Homo sapiens
uaugaucaauaaaggaca

SEQ ID NO: 2106317 - RNA, 19 nt, Homo sapiens
acaccaauugaagugaaau

SEQ ID NO: 2106318 - RNA, 23 nt, Homo sapiens
uuauuguuuauuuaucagugaca

SEQ ID NO: 2106319 - RNA, 20 nt, Homo sapiens
ccuacccauacuuuguacaa

SEQ ID NO: 2106320 - RNA, 10 nt, Homo sapiens
aaaugucucc

SEQ ID NO: 2106321 - RNA, 23 nt, Homo sapiens
cucagccacacccaggcacuuaa

SEQ ID NO: 2106322 - RNA, 18 nt, Homo sapiens
cccaggaccccauggcag

SEQ ID NO: 2106323 - RNA, 18 nt, Homo sapiens
accuuaaaugcugagauc

SEQ ID NO: 2106324 - RNA, 18 nt, Homo sapiens
agccugggcagcauagca

SEQ ID NO: 2106325 - RNA, 18 nt, Homo sapiens
ccaccaagggaucugcca

SEQ ID NO: 2106326 - RNA, 14 nt, Homo sapiens
cauauaacaauuca

SEQ ID NO: 2106327 - RNA, 20 nt, Homo sapiens
guaacacuguauaacauuua

SEQ ID NO: 2106328 - RNA, 13 nt, Homo sapiens
aaaaacucuucag

SEQ ID NO: 2106329 - RNA, 21 nt, Homo sapiens
gcuugaagguuuguccacauu

SEQ ID NO: 2106330 - RNA, 21 nt, Homo sapiens
uuaagcuaugaaaaauacaau

SEQ ID NO: 2106331 - RNA, 17 nt, Homo sapiens
guucuaaggcugugcca

SEQ ID NO: 2106332 - RNA, 16 nt, Homo sapiens
uuucaggugucaugga

SEQ ID NO: 2106333 - RNA, 21 nt, Homo sapiens
ccccacuccucuccaccagac

SEQ ID NO: 2106334 - RNA, 19 nt, Homo sapiens
agaaugaugcacauuucau

SEQ ID NO: 2106335 - RNA, 15 nt, Homo sapiens
aagcgagucauuucg

SEQ ID NO: 2106336 - RNA, 21 nt, Homo sapiens
ucaguggcucacaccuguaau

SEQ ID NO: 2106337 - RNA, 18 nt, Homo sapiens
uaaaaaucauaguacucu

SEQ ID NO: 2106338 - RNA, 15 nt, Homo sapiens
ccccagaucugcucc

SEQ ID NO: 2106339 - RNA, 17 nt, Homo sapiens
cucaguuggugcugcuu

SEQ ID NO: 2106340 - RNA, 18 nt, Homo sapiens
ccucuagaacagccagac

SEQ ID NO: 2106341 - RNA, 21 nt, Homo sapiens
aagaauguguuaugaaucggu

SEQ ID NO: 2106342 - RNA, 17 nt, Homo sapiens
ggcaagucuuccaugac

SEQ ID NO: 2106343 - RNA, 15 nt, Homo sapiens
aggcucaaguuuuua

SEQ ID NO: 2106344 - RNA, 23 nt, Homo sapiens
uaaaccuggaaucuacaagccaa

SEQ ID NO: 2106345 - RNA, 11 nt, Homo sapiens
acaaaacagaa

SEQ ID NO: 2106346 - RNA, 22 nt, Homo sapiens
aguugcuuauaauaaaauaauu

SEQ ID NO: 2106347 - RNA, 17 nt, Homo sapiens
guugccucuugcaaugc

SEQ ID NO: 2106348 - RNA, 19 nt, Homo sapiens
ccauauucagcauuugauu

SEQ ID NO: 2106349 - RNA, 15 nt, Homo sapiens
agguuaauuccauuc

SEQ ID NO: 2106350 - RNA, 23 nt, Homo sapiens
ccuuuaggaucucaggcuucugc

SEQ ID NO: 2106351 - RNA, 15 nt, Homo sapiens
ccaaauaagauauuu

SEQ ID NO: 2106352 - RNA, 21 nt, Homo sapiens
uaaaaugcaaaauccugguga

SEQ ID NO: 2106353 - RNA, 15 nt, Homo sapiens
gugcugaagcaaagu

SEQ ID NO: 2106354 - RNA, 15 nt, Homo sapiens
augaauaaacacuuu

SEQ ID NO: 2106355 - RNA, 13 nt, Homo sapiens
accuuuaccccau

SEQ ID NO: 2106356 - RNA, 19 nt, Homo sapiens
cucuacaucuagcaauuuc

SEQ ID NO: 2106357 - RNA, 23 nt, Homo sapiens
uuaaggaaucaaaucuuacaaaa

SEQ ID NO: 2106358 - RNA, 21 nt, Homo sapiens
ccuguacucuggagagacugu

SEQ ID NO: 2106359 - RNA, 20 nt, Homo sapiens
ugaauguguucugucacuca

SEQ ID NO: 2106360 - RNA, 14 nt, Homo sapiens
ucuacaaaauaucc

SEQ ID NO: 2106361 - RNA, 16 nt, Homo sapiens
cacagcccagaaccac

SEQ ID NO: 2106362 - RNA, 17 nt, Homo sapiens
uaacacuaaauugcagu

SEQ ID NO: 2106363 - RNA, 20 nt, Homo sapiens
uguuuuuugccuaaauccaa

SEQ ID NO: 2106364 - RNA, 13 nt, Homo sapiens
uggaagaaguaua

SEQ ID NO: 2106365 - RNA, 22 nt, Homo sapiens
ugagaaaauccccaacuaugca

SEQ ID NO: 2106366 - RNA, 15 nt, Homo sapiens
gcaccacgugccaag

SEQ ID NO: 2106367 - RNA, 16 nt, Homo sapiens
aagacuuuauguaguu

SEQ ID NO: 2106368 - RNA, 17 nt, Homo sapiens
aaauccccaugccugug

SEQ ID NO: 2106369 - RNA, 14 nt, Homo sapiens
cccuacaaugcuca

SEQ ID NO: 2106370 - RNA, 15 nt, Homo sapiens
ugcuccaagacuuua

SEQ ID NO: 2106371 - RNA, 20 nt, Homo sapiens
guaaauguguuagcacugau

SEQ ID NO: 2106372 - RNA, 23 nt, Homo sapiens
aauaggcauuaaaugcaaaaaua

SEQ ID NO: 2106373 - RNA, 22 nt, Homo sapiens
uuuggugaccaauacuacugua

SEQ ID NO: 2106374 - RNA, 17 nt, Homo sapiens
guacccugcaggccagg

SEQ ID NO: 2106375 - RNA, 17 nt, Homo sapiens
caagaauauugcaaaau

SEQ ID NO: 2106376 - RNA, 23 nt, Homo sapiens
ccaauccuaugcaugguuucagc

SEQ ID NO: 2106377 - RNA, 16 nt, Homo sapiens
aauuacugccuugaaa

SEQ ID NO: 2106378 - RNA, 18 nt, Homo sapiens
agaagagggucugcauuu

SEQ ID NO: 2106379 - RNA, 23 nt, Homo sapiens
cuagaggcccuuugcugucccau

SEQ ID NO: 2106380 - RNA, 15 nt, Homo sapiens
gaacaacagcaucuu

SEQ ID NO: 2106381 - RNA, 23 nt, Homo sapiens
agaaaauuguugcaaacuaugca

SEQ ID NO: 2106382 - RNA, 22 nt, Homo sapiens
uguguguauauaguaugaaugc

SEQ ID NO: 2106383 - RNA, 13 nt, Homo sapiens
cucagcacauccg

SEQ ID NO: 2106384 - RNA, 13 nt, Homo sapiens
ccacacacacaaa

SEQ ID NO: 2106385 - RNA, 13 nt, Homo sapiens
cuuaacacauuca

SEQ ID NO: 2106386 - RNA, 19 nt, Homo sapiens
agaauguuguguucugugu

SEQ ID NO: 2106387 - RNA, 12 nt, Homo sapiens
cauaaagaucaa

SEQ ID NO: 2106388 - RNA, 13 nt, Homo sapiens
gaaauaugugauu

SEQ ID NO: 2106389 - RNA, 16 nt, Homo sapiens
ucugucauaugcagaa

SEQ ID NO: 2106390 - RNA, 21 nt, Homo sapiens
agaaguacaaagguugcagug

SEQ ID NO: 2106391 - RNA, 19 nt, Homo sapiens
cagccuacauugaugccaa

SEQ ID NO: 2106392 - RNA, 14 nt, Homo sapiens
cuuuaucaccagag

SEQ ID NO: 2106393 - RNA, 20 nt, Homo sapiens
uaguuaaauguuaccucuga

SEQ ID NO: 2106394 - RNA, 16 nt, Homo sapiens
cgcccccccuaucucu

SEQ ID NO: 2106395 - RNA, 17 nt, Homo sapiens
guuuacagugucugugu

SEQ ID NO: 2106396 - RNA, 15 nt, Homo sapiens
aggcugggaggaaca

SEQ ID NO: 2106397 - RNA, 18 nt, Homo sapiens
gcuugugggacuagccug

SEQ ID NO: 2106398 - RNA, 16 nt, Homo sapiens
caccccuauggugcuc

SEQ ID NO: 2106399 - RNA, 17 nt, Homo sapiens
uauucugugaaacuaau

SEQ ID NO: 2106400 - RNA, 14 nt, Homo sapiens
cuucaccacuguag

SEQ ID NO: 2106401 - RNA, 17 nt, Homo sapiens
uacauaauaaccaaaca

SEQ ID NO: 2106402 - RNA, 21 nt, Homo sapiens
gcuagcugcaagugacaucuc

SEQ ID NO: 2106403 - RNA, 17 nt, Homo sapiens
ucaccugggcugugaug

SEQ ID NO: 2106404 - RNA, 12 nt, Homo sapiens
aacuucuuguug

SEQ ID NO: 2106405 - RNA, 17 nt, Homo sapiens
aucuccccuggggagcc

SEQ ID NO: 2106406 - RNA, 20 nt, Homo sapiens
uguggucacuuguaccauau

SEQ ID NO: 2106407 - RNA, 17 nt, Homo sapiens
cuccagaccauucagga

SEQ ID NO: 2106408 - RNA, 14 nt, Homo sapiens
ccgaaagaggcacc

SEQ ID NO: 2106409 - RNA, 23 nt, Homo sapiens
gucaaaacagauuguuugcaaag

SEQ ID NO: 2106410 - RNA, 20 nt, Homo sapiens
cucuucagccccuagugcua

SEQ ID NO: 2106411 - RNA, 19 nt, Homo sapiens
gcugaucacagacaccagc

SEQ ID NO: 2106412 - RNA, 16 nt, Homo sapiens
agauuagaaacuacca

SEQ ID NO: 2106413 - RNA, 17 nt, Homo sapiens
ccaguggguuaucuuuu

SEQ ID NO: 2106414 - RNA, 17 nt, Homo sapiens
caaagcaggaagaagcu

SEQ ID NO: 2106415 - RNA, 18 nt, Homo sapiens
uugauauaaaacucuggg

SEQ ID NO: 2106416 - RNA, 13 nt, Homo sapiens
auguuuuguauac

SEQ ID NO: 2106417 - RNA, 22 nt, Homo sapiens
agggcagccaggggcugcucau

SEQ ID NO: 2106418 - RNA, 21 nt, Homo sapiens
cgacauaacauuguacuguaa

SEQ ID NO: 2106419 - RNA, 15 nt, Homo sapiens
acuccaagagggaau

SEQ ID NO: 2106420 - RNA, 17 nt, Homo sapiens
aauccuaagcaaaaaga

SEQ ID NO: 2106421 - RNA, 19 nt, Homo sapiens
cagauggggucugugacug

SEQ ID NO: 2106422 - RNA, 16 nt, Homo sapiens
cuuuacaggaucaugu

SEQ ID NO: 2106423 - RNA, 23 nt, Homo sapiens
gaagaggguagagugggcugcug

SEQ ID NO: 2106424 - RNA, 18 nt, Homo sapiens
cacuucccguuuccucuu

SEQ ID NO: 2106425 - RNA, 20 nt, Homo sapiens
aacacugcaguguuauuuuc

SEQ ID NO: 2106426 - RNA, 18 nt, Homo sapiens
cuggaccaugcugagaca

SEQ ID NO: 2106427 - RNA, 17 nt, Homo sapiens
ugagggcagcacuggga

SEQ ID NO: 2106428 - RNA, 20 nt, Homo sapiens
acggugguucaugccuguaa

SEQ ID NO: 2106429 - RNA, 17 nt, Homo sapiens
gaaaacaagaagucaua

SEQ ID NO: 2106430 - RNA, 19 nt, Homo sapiens
cuuauuguuucucugaaag

SEQ ID NO: 2106431 - RNA, 21 nt, Homo sapiens
accuuaagauuuugcaccugu

SEQ ID NO: 2106432 - RNA, 22 nt, Homo sapiens
acaaacuucccugacucuucaa

SEQ ID NO: 2106433 - RNA, 22 nt, Homo sapiens
cuucuguugcugguguacucua

SEQ ID NO: 2106434 - RNA, 20 nt, Homo sapiens
ccaugagaugauacauccaa

SEQ ID NO: 2106435 - RNA, 14 nt, Homo sapiens
augucaucaugcuu

SEQ ID NO: 2106436 - RNA, 23 nt, Homo sapiens
gaggaaagguuugagaagcacug

SEQ ID NO: 2106437 - RNA, 23 nt, Homo sapiens
gcugcuggccaugaaucucugcc

SEQ ID NO: 2106438 - RNA, 17 nt, Homo sapiens
ugccagucccagaucac

SEQ ID NO: 2106439 - RNA, 19 nt, Homo sapiens
augggccccucagccaggg

SEQ ID NO: 2106440 - RNA, 14 nt, Homo sapiens
cuucagcagucaau

SEQ ID NO: 2106441 - RNA, 23 nt, Homo sapiens
uaaugaaacuuggauuugcucag

SEQ ID NO: 2106442 - RNA, 20 nt, Homo sapiens
uuaacugugaaauaccacaa

SEQ ID NO: 2106443 - RNA, 14 nt, Homo sapiens
ggacuuccugucau

SEQ ID NO: 2106444 - RNA, 19 nt, Homo sapiens
ccauacuuugucugaaaaa

SEQ ID NO: 2106445 - RNA, 23 nt, Homo sapiens
uaaaagaugccguuuaaaagcau

SEQ ID NO: 2106446 - RNA, 17 nt, Homo sapiens
acuuucugaaacucccu

SEQ ID NO: 2106447 - RNA, 10 nt, Homo sapiens
acauguuaau

SEQ ID NO: 2106448 - RNA, 15 nt, Homo sapiens
uguccuggcuuuuau

SEQ ID NO: 2106449 - RNA, 19 nt, Homo sapiens
uccucuacccuacaagauc

SEQ ID NO: 2106450 - RNA, 13 nt, Homo sapiens
agaggaucaucug

SEQ ID NO: 2106451 - RNA, 11 nt, Homo sapiens
uacgugcaaua

SEQ ID NO: 2106452 - RNA, 22 nt, Homo sapiens
aguguuuuugaaacccacaguu

SEQ ID NO: 2106453 - RNA, 22 nt, Homo sapiens
caaaaaucuguguaacuguaaa

SEQ ID NO: 2106454 - RNA, 19 nt, Homo sapiens
ggggacaaccuuggcuugg

SEQ ID NO: 2106455 - RNA, 22 nt, Homo sapiens
caaagauacacaaucugaaaca

SEQ ID NO: 2106456 - RNA, 22 nt, Homo sapiens
cuaguuaauccaaacaugcauc

SEQ ID NO: 2106457 - RNA, 23 nt, Homo sapiens
guaugagauaggcacaugcaucu

SEQ ID NO: 2106458 - RNA, 18 nt, Homo sapiens
aggagaauuuaaacaaug

SEQ ID NO: 2106459 - RNA, 21 nt, Homo sapiens
gacaaagggccagcagucuac

SEQ ID NO: 2106460 - RNA, 17 nt, Homo sapiens
aaaagcaaauagaucau

SEQ ID NO: 2106461 - RNA, 22 nt, Homo sapiens
caaagaucuguccucagccuug

SEQ ID NO: 2106462 - RNA, 13 nt, Homo sapiens
gccuaaugcugcg

SEQ ID NO: 2106463 - RNA, 20 nt, Homo sapiens
uaaccccaacgcacaggaaa

SEQ ID NO: 2106464 - RNA, 16 nt, Homo sapiens
uuaaccucaucuacaa

SEQ ID NO: 2106465 - RNA, 20 nt, Homo sapiens
aguacaccccaccucuuccu

SEQ ID NO: 2106466 - RNA, 20 nt, Homo sapiens
auugaaaaauaaaaaccaua

SEQ ID NO: 2106467 - RNA, 16 nt, Homo sapiens
uaguuguagacaaagu

SEQ ID NO: 2106468 - RNA, 19 nt, Homo sapiens
agaugauggcucauuuaca

SEQ ID NO: 2106469 - RNA, 15 nt, Homo sapiens
uuuuuggucaugaaa

SEQ ID NO: 2106470 - RNA, 15 nt, Homo sapiens
accaccaccaucacc

SEQ ID NO: 2106471 - RNA, 18 nt, Homo sapiens
ggccguguccaccuuuca

SEQ ID NO: 2106472 - RNA, 18 nt, Homo sapiens
uucuuaaucuccacuguu

SEQ ID NO: 2106473 - RNA, 23 nt, Homo sapiens
agugucccucccuggcuugccuu

SEQ ID NO: 2106474 - RNA, 16 nt, Homo sapiens
acuuaauaaagcuuuu

SEQ ID NO: 2106475 - RNA, 19 nt, Homo sapiens
caugauguaaaaaauacaa

SEQ ID NO: 2106476 - RNA, 16 nt, Homo sapiens
agccugugaaguccua

SEQ ID NO: 2106477 - RNA, 20 nt, Homo sapiens
uggcugauuuauuucuacua

SEQ ID NO: 2106478 - RNA, 13 nt, Homo sapiens
cuguaaucgugcu

SEQ ID NO: 2106479 - RNA, 14 nt, Homo sapiens
caguaguugcaaug

SEQ ID NO: 2106480 - RNA, 19 nt, Homo sapiens
guugccaccccaacccaau

SEQ ID NO: 2106481 - RNA, 13 nt, Homo sapiens
uccccaagccugg

SEQ ID NO: 2106482 - RNA, 21 nt, Homo sapiens
acagugcucuuuucuccucac

SEQ ID NO: 2106483 - RNA, 13 nt, Homo sapiens
auuuacaagggaa

SEQ ID NO: 2106484 - RNA, 18 nt, Homo sapiens
uauccaauugcucuuuca

SEQ ID NO: 2106485 - RNA, 14 nt, Homo sapiens
uuuuaacuccucaa

SEQ ID NO: 2106486 - RNA, 15 nt, Homo sapiens
uggcagggagcagua

SEQ ID NO: 2106487 - RNA, 23 nt, Homo sapiens
auccuuaacagaugaacuaucca

SEQ ID NO: 2106488 - RNA, 12 nt, Homo sapiens
ggaauaaucucc

SEQ ID NO: 2106489 - RNA, 15 nt, Homo sapiens
ucuuuucaaccuacu

SEQ ID NO: 2106490 - RNA, 17 nt, Homo sapiens
uaccagggauguagauu

SEQ ID NO: 2106491 - RNA, 20 nt, Homo sapiens
aauucuuuuaucaaucccag

SEQ ID NO: 2106492 - RNA, 21 nt, Homo sapiens
ucucauuuuuaucccauugag

SEQ ID NO: 2106493 - RNA, 16 nt, Homo sapiens
uuggaaauacuguaug

SEQ ID NO: 2106494 - RNA, 18 nt, Homo sapiens
gcccaaccuaaugcucuc

SEQ ID NO: 2106495 - RNA, 20 nt, Homo sapiens
gaauuucaucucaucaggca

SEQ ID NO: 2106496 - RNA, 21 nt, Homo sapiens
caccagcccugaccccagugu

SEQ ID NO: 2106497 - RNA, 18 nt, Homo sapiens
ugggcugaccgugucucu

SEQ ID NO: 2106498 - RNA, 20 nt, Homo sapiens
ccugauugaucacacagugu

SEQ ID NO: 2106499 - RNA, 14 nt, Homo sapiens
ugaaaauauagcua

SEQ ID NO: 2106500 - RNA, 19 nt, Homo sapiens
cuuggugauuaagguccug

SEQ ID NO: 2106501 - RNA, 14 nt, Homo sapiens
augcucaccaagga

SEQ ID NO: 2106502 - RNA, 16 nt, Homo sapiens
agcacaaggccuugcc

SEQ ID NO: 2106503 - RNA, 19 nt, Homo sapiens
caccgcugucucuuuguca

SEQ ID NO: 2106504 - RNA, 22 nt, Homo sapiens
agagucuuugauucaccaaaca

SEQ ID NO: 2106505 - RNA, 16 nt, Homo sapiens
aaauaaauaagaucag

SEQ ID NO: 2106506 - RNA, 21 nt, Homo sapiens
agaagcucuuuuggguaucaa

SEQ ID NO: 2106507 - RNA, 15 nt, Homo sapiens
uugaacuccuagacu

SEQ ID NO: 2106508 - RNA, 14 nt, Homo sapiens
aggaaaaagugcuu

SEQ ID NO: 2106509 - RNA, 14 nt, Homo sapiens
cugggcuggcacag

SEQ ID NO: 2106510 - RNA, 23 nt, Homo sapiens
cugccacucaggcccaaagccuc

SEQ ID NO: 2106511 - RNA, 14 nt, Homo sapiens
aggcuaagcacuuu

SEQ ID NO: 2106512 - RNA, 13 nt, Homo sapiens
gaauaaugugaua

SEQ ID NO: 2106513 - RNA, 16 nt, Homo sapiens
auaagcccacauauaa

SEQ ID NO: 2106514 - RNA, 18 nt, Homo sapiens
uggaaaacagaacacuua

SEQ ID NO: 2106515 - RNA, 17 nt, Homo sapiens
gacccugccacagccag

SEQ ID NO: 2106516 - RNA, 13 nt, Homo sapiens
agaaaacauuucu

SEQ ID NO: 2106517 - RNA, 14 nt, Homo sapiens
cuaaccccauuccu

SEQ ID NO: 2106518 - RNA, 18 nt, Homo sapiens
uccaugcugccagccuuc

SEQ ID NO: 2106519 - RNA, 15 nt, Homo sapiens
cuaucaaaugugaug

SEQ ID NO: 2106520 - RNA, 22 nt, Homo sapiens
caacauuuacaacucauuccag

SEQ ID NO: 2106521 - RNA, 23 nt, Homo sapiens
gaauuuucucccuuuauguaucu

SEQ ID NO: 2106522 - RNA, 17 nt, Homo sapiens
uguaucuaaaccauaug

SEQ ID NO: 2106523 - RNA, 22 nt, Homo sapiens
caggucuugacucauggcagcu

SEQ ID NO: 2106524 - RNA, 18 nt, Homo sapiens
ucaaggaaugaagaacaa

SEQ ID NO: 2106525 - RNA, 21 nt, Homo sapiens
gcacuauaauguaagcucuac

SEQ ID NO: 2106526 - RNA, 19 nt, Homo sapiens
cccaacaccugccucugac

SEQ ID NO: 2106527 - RNA, 19 nt, Homo sapiens
aggcugccccucucaccaa

SEQ ID NO: 2106528 - RNA, 17 nt, Homo sapiens
ugugaacguguauguac

SEQ ID NO: 2106529 - RNA, 12 nt, Homo sapiens
cagcauuugcca

SEQ ID NO: 2106530 - RNA, 19 nt, Homo sapiens
ccagagcccuucacugcca

SEQ ID NO: 2106531 - RNA, 20 nt, Homo sapiens
uugggggauggcuaaaacca

SEQ ID NO: 2106532 - RNA, 20 nt, Homo sapiens
ugaaaaugcuuucuuggcca

SEQ ID NO: 2106533 - RNA, 17 nt, Homo sapiens
ucacuauggugccaaug

SEQ ID NO: 2106534 - RNA, 18 nt, Homo sapiens
accugcucacaguccuca

SEQ ID NO: 2106535 - RNA, 17 nt, Homo sapiens
auaaaaaccauggaacu

SEQ ID NO: 2106536 - RNA, 17 nt, Homo sapiens
auaaaauauucacucuc

SEQ ID NO: 2106537 - RNA, 16 nt, Homo sapiens
ggcuuuucccuugcuu

SEQ ID NO: 2106538 - RNA, 14 nt, Homo sapiens
cuuaccgagcaugg

SEQ ID NO: 2106539 - RNA, 15 nt, Homo sapiens
cauuuuguuauagaa

SEQ ID NO: 2106540 - RNA, 14 nt, Homo sapiens
agagaaacacugcu

SEQ ID NO: 2106541 - RNA, 20 nt, Homo sapiens
gaacggggguacacgguggg

SEQ ID NO: 2106542 - RNA, 22 nt, Homo sapiens
uggagcccuaaccccuuccaga

SEQ ID NO: 2106543 - RNA, 22 nt, Homo sapiens
uaucaaaauagucuaaggccau

SEQ ID NO: 2106544 - RNA, 19 nt, Homo sapiens
cuccauguauauauucuuc

SEQ ID NO: 2106545 - RNA, 16 nt, Homo sapiens
aucuggguaagaagaa

SEQ ID NO: 2106546 - RNA, 17 nt, Homo sapiens
uaucccgagucugggac

SEQ ID NO: 2106547 - RNA, 20 nt, Homo sapiens
aaggcauuccacaggaucau

SEQ ID NO: 2106548 - RNA, 15 nt, Homo sapiens
agccucuauccuaca

SEQ ID NO: 2106549 - RNA, 16 nt, Homo sapiens
ugaagaauauuguuaa

SEQ ID NO: 2106550 - RNA, 16 nt, Homo sapiens
cagcuguacauacuca

SEQ ID NO: 2106551 - RNA, 23 nt, Homo sapiens
ugucuucuaaauuugaaauauaa

SEQ ID NO: 2106552 - RNA, 21 nt, Homo sapiens
ggacaaaguguagcagccucc

SEQ ID NO: 2106553 - RNA, 21 nt, Homo sapiens
ucaaaauuugauggugaauau

SEQ ID NO: 2106554 - RNA, 13 nt, Homo sapiens
aacuuuaucucac

SEQ ID NO: 2106555 - RNA, 15 nt, Homo sapiens
uuguauguugaggau

SEQ ID NO: 2106556 - RNA, 20 nt, Homo sapiens
cuuaguugcaugaccacaua

SEQ ID NO: 2106557 - RNA, 22 nt, Homo sapiens
aguauucuaaagcuuucugaca

SEQ ID NO: 2106558 - RNA, 13 nt, Homo sapiens
aauuaugaccaug

SEQ ID NO: 2106559 - RNA, 15 nt, Homo sapiens
agcugaggccuugcc

SEQ ID NO: 2106560 - RNA, 18 nt, Homo sapiens
cuuuaugccggaugugcu

SEQ ID NO: 2106561 - RNA, 14 nt, Homo sapiens
cauugccuuuccag

SEQ ID NO: 2106562 - RNA, 15 nt, Homo sapiens
uauuguuacacauua

SEQ ID NO: 2106563 - RNA, 23 nt, Homo sapiens
ucccaguaguguuuggaauuuuc

SEQ ID NO: 2106564 - RNA, 12 nt, Homo sapiens
uuuagucuugau

SEQ ID NO: 2106565 - RNA, 14 nt, Homo sapiens
cuucaccaguguuu

SEQ ID NO: 2106566 - RNA, 17 nt, Homo sapiens
aggaaaaucugcacugu

SEQ ID NO: 2106567 - RNA, 18 nt, Homo sapiens
ugugaccccuuucacuua

SEQ ID NO: 2106568 - RNA, 11 nt, Homo sapiens
uguaauuuuga

SEQ ID NO: 2106569 - RNA, 21 nt, Homo sapiens
auguuuauccauguacuuucc

SEQ ID NO: 2106570 - RNA, 12 nt, Homo sapiens
uugcagguaccg

SEQ ID NO: 2106571 - RNA, 13 nt, Homo sapiens
aaauuggcuccuu

SEQ ID NO: 2106572 - RNA, 22 nt, Homo sapiens
cuggugccagggugggugucca

SEQ ID NO: 2106573 - RNA, 16 nt, Homo sapiens
cccaaaaaacuacuuc

SEQ ID NO: 2106574 - RNA, 18 nt, Homo sapiens
ggaauucuuuacaauaaa

SEQ ID NO: 2106575 - RNA, 13 nt, Homo sapiens
ugauuaacuugcu

SEQ ID NO: 2106576 - RNA, 15 nt, Homo sapiens
cagagaccagcacuc

SEQ ID NO: 2106577 - RNA, 20 nt, Homo sapiens
acuauugaaaucaagcuuau

SEQ ID NO: 2106578 - RNA, 21 nt, Homo sapiens
uccaguauugaaaacuucaaa

SEQ ID NO: 2106579 - RNA, 20 nt, Homo sapiens
caacccuuucauuagaacuu

SEQ ID NO: 2106580 - RNA, 14 nt, Homo sapiens
uuggauagacuucu

SEQ ID NO: 2106581 - RNA, 14 nt, Homo sapiens
guuucaaucacugu

SEQ ID NO: 2106582 - RNA, 20 nt, Homo sapiens
agccucacuggggcagacaa

SEQ ID NO: 2106583 - RNA, 22 nt, Homo sapiens
aggaagggcgugucccauggga

SEQ ID NO: 2106584 - RNA, 22 nt, Homo sapiens
ccauucacaauaaaagcuuaaa

SEQ ID NO: 2106585 - RNA, 16 nt, Homo sapiens
uguaaaacccaaaaca

SEQ ID NO: 2106586 - RNA, 22 nt, Homo sapiens
agccuuacaguuauccugcaag

SEQ ID NO: 2106587 - RNA, 24 nt, Homo sapiens
ugaaaaaccugaugcagugcucca

SEQ ID NO: 2106588 - RNA, 22 nt, Homo sapiens
aauaauugcauauaaaaugcuu

SEQ ID NO: 2106589 - RNA, 14 nt, Homo sapiens
aacauugagacugc

SEQ ID NO: 2106590 - RNA, 16 nt, Homo sapiens
gaugauucaaauauca

SEQ ID NO: 2106591 - RNA, 19 nt, Homo sapiens
accgugcagugugcauuuu

SEQ ID NO: 2106592 - RNA, 18 nt, Homo sapiens
uaaugcucaacaauuuau

SEQ ID NO: 2106593 - RNA, 19 nt, Homo sapiens
agugacaugauacaaacac

SEQ ID NO: 2106594 - RNA, 13 nt, Homo sapiens
uggacuuacaaaa

SEQ ID NO: 2106595 - RNA, 18 nt, Homo sapiens
accagacaagauggcuag

SEQ ID NO: 2106596 - RNA, 21 nt, Homo sapiens
uucauugaccaagaugaucac

SEQ ID NO: 2106597 - RNA, 18 nt, Homo sapiens
cuguaacuugauccauuu

SEQ ID NO: 2106598 - RNA, 14 nt, Homo sapiens
uucccuucugccac

SEQ ID NO: 2106599 - RNA, 21 nt, Homo sapiens
cccaauaaaguccucuucccu

SEQ ID NO: 2106600 - RNA, 19 nt, Homo sapiens
gaaaggguuuuuaaucucc

SEQ ID NO: 2106601 - RNA, 13 nt, Homo sapiens
uggggucaugccc

SEQ ID NO: 2106602 - RNA, 19 nt, Homo sapiens
augaggaggcagagagggu

SEQ ID NO: 2106603 - RNA, 20 nt, Homo sapiens
cacacagaugcacacacaga

SEQ ID NO: 2106604 - RNA, 18 nt, Homo sapiens
cuugaccuggagccaucu

SEQ ID NO: 2106605 - RNA, 23 nt, Homo sapiens
auuuucuuucuuuuucuggaaau

SEQ ID NO: 2106606 - RNA, 16 nt, Homo sapiens
cucugggucugaguca

SEQ ID NO: 2106607 - RNA, 23 nt, Homo sapiens
ccaccaagaagcacugggugacc

SEQ ID NO: 2106608 - RNA, 23 nt, Homo sapiens
cugccugaaggcucacaccucau

SEQ ID NO: 2106609 - RNA, 19 nt, Homo sapiens
auaugcaaaccaggauuuc

SEQ ID NO: 2106610 - RNA, 22 nt, Homo sapiens
aucagaccauaauguuacauua

SEQ ID NO: 2106611 - RNA, 14 nt, Homo sapiens
uugcacugaugucc

SEQ ID NO: 2106612 - RNA, 16 nt, Homo sapiens
accuagauuccauaca

SEQ ID NO: 2106613 - RNA, 14 nt, Homo sapiens
uacauuccauuuca

SEQ ID NO: 2106614 - RNA, 13 nt, Homo sapiens
agcugacaaagca

SEQ ID NO: 2106615 - RNA, 21 nt, Homo sapiens
uaguaacuacuuuuuauacuc

SEQ ID NO: 2106616 - RNA, 15 nt, Homo sapiens
aaaauggaacauuaa

SEQ ID NO: 2106617 - RNA, 22 nt, Homo sapiens
acaguggggaagagugacucuc

SEQ ID NO: 2106618 - RNA, 19 nt, Homo sapiens
gcccaggggucgaaugggg

SEQ ID NO: 2106619 - RNA, 20 nt, Homo sapiens
auucucuuaaucacuacugu

SEQ ID NO: 2106620 - RNA, 22 nt, Homo sapiens
ccccagccugcucccuagccag

SEQ ID NO: 2106621 - RNA, 16 nt, Homo sapiens
uucauguguugcuccc

SEQ ID NO: 2106622 - RNA, 22 nt, Homo sapiens
ucugcuaacucuguuauucuuc

SEQ ID NO: 2106623 - RNA, 16 nt, Homo sapiens
ggcuuuguugugagaa

SEQ ID NO: 2106624 - RNA, 16 nt, Homo sapiens
ccauucagagcuaugg

SEQ ID NO: 2106625 - RNA, 12 nt, Homo sapiens
cauccaacuccg

SEQ ID NO: 2106626 - RNA, 18 nt, Homo sapiens
gggaaaagaagcacccag

SEQ ID NO: 2106627 - RNA, 13 nt, Homo sapiens
uuuucaucaugau

SEQ ID NO: 2106628 - RNA, 18 nt, Homo sapiens
ggggaagaaacacuuucu

SEQ ID NO: 2106629 - RNA, 18 nt, Homo sapiens
acuaaccaaacaaugcag

SEQ ID NO: 2106630 - RNA, 14 nt, Homo sapiens
aaaauguucucuua

SEQ ID NO: 2106631 - RNA, 12 nt, Homo sapiens
cauaauuuacau

SEQ ID NO: 2106632 - RNA, 21 nt, Homo sapiens
auaacgcugacugcaaaaacu

SEQ ID NO: 2106633 - RNA, 15 nt, Homo sapiens
ucuaugcuauauuca

SEQ ID NO: 2106634 - RNA, 17 nt, Homo sapiens
auccaccugcacaaaca

SEQ ID NO: 2106635 - RNA, 22 nt, Homo sapiens
ugcauaggugaucucauuuaau

SEQ ID NO: 2106636 - RNA, 15 nt, Homo sapiens
ucucaucacagaagu

SEQ ID NO: 2106637 - RNA, 19 nt, Homo sapiens
cagaugaucagggauccaa

SEQ ID NO: 2106638 - RNA, 20 nt, Homo sapiens
ucaaauuaagauucucugcc

SEQ ID NO: 2106639 - RNA, 18 nt, Homo sapiens
caaguauccaaccaacuu

SEQ ID NO: 2106640 - RNA, 16 nt, Homo sapiens
accuccucagggaugg

SEQ ID NO: 2106641 - RNA, 21 nt, Homo sapiens
aaguauacauuuuugcauugc

SEQ ID NO: 2106642 - RNA, 15 nt, Homo sapiens
aucccucucuucccc

SEQ ID NO: 2106643 - RNA, 21 nt, Homo sapiens
cagggugaagccuucaaagcu

SEQ ID NO: 2106644 - RNA, 14 nt, Homo sapiens
auugaaaguccuag

SEQ ID NO: 2106645 - RNA, 14 nt, Homo sapiens
uaacuggaagugaa

SEQ ID NO: 2106646 - RNA, 18 nt, Homo sapiens
gcaauaaacuccuacuaa

SEQ ID NO: 2106647 - RNA, 16 nt, Homo sapiens
caggguagugugguau

SEQ ID NO: 2106648 - RNA, 15 nt, Homo sapiens
caucuaacgugcauu

SEQ ID NO: 2106649 - RNA, 17 nt, Homo sapiens
augagcugucugggaag

SEQ ID NO: 2106650 - RNA, 20 nt, Homo sapiens
ucuuugucccaccaacuuaa

SEQ ID NO: 2106651 - RNA, 16 nt, Homo sapiens
cagugccaacuccuca

SEQ ID NO: 2106652 - RNA, 15 nt, Homo sapiens
aggagaaacacuuga

SEQ ID NO: 2106653 - RNA, 13 nt, Homo sapiens
uuuaaaugauaca

SEQ ID NO: 2106654 - RNA, 14 nt, Homo sapiens
auuuaaagcauuuu

SEQ ID NO: 2106655 - RNA, 16 nt, Homo sapiens
cuggaggucacauuca

SEQ ID NO: 2106656 - RNA, 21 nt, Homo sapiens
aaauccugaugagguuucuac

SEQ ID NO: 2106657 - RNA, 23 nt, Homo sapiens
gcuaugcaggguagcacugggaa

SEQ ID NO: 2106658 - RNA, 16 nt, Homo sapiens
aucaucagugccucuu

SEQ ID NO: 2106659 - RNA, 20 nt, Homo sapiens
gucuucaugugucuugcaau

SEQ ID NO: 2106660 - RNA, 22 nt, Homo sapiens
uauuuuaaucuaauucuaagga

SEQ ID NO: 2106661 - RNA, 14 nt, Homo sapiens
ggcuuugggguccu

SEQ ID NO: 2106662 - RNA, 16 nt, Homo sapiens
acccugaagauuucag

SEQ ID NO: 2106663 - RNA, 20 nt, Homo sapiens
ugggaaggcaccugcuccca

SEQ ID NO: 2106664 - RNA, 16 nt, Homo sapiens
gccucaccacggacca

SEQ ID NO: 2106665 - RNA, 13 nt, Homo sapiens
aagacuauuuacc

SEQ ID NO: 2106666 - RNA, 13 nt, Homo sapiens
aaaauuauuugcu

SEQ ID NO: 2106667 - RNA, 21 nt, Homo sapiens
acucaaaagaaaauauaguca

SEQ ID NO: 2106668 - RNA, 19 nt, Homo sapiens
aaacuguuaaacuaaugag

SEQ ID NO: 2106669 - RNA, 19 nt, Homo sapiens
cugcaaaugugcaguucag

SEQ ID NO: 2106670 - RNA, 12 nt, Homo sapiens
cuccauuuucaa

SEQ ID NO: 2106671 - RNA, 23 nt, Homo sapiens
uaucagcuuuuuaaaguggguua

SEQ ID NO: 2106672 - RNA, 15 nt, Homo sapiens
caucagcccaucuca

SEQ ID NO: 2106673 - RNA, 15 nt, Homo sapiens
acacacacacacugc

SEQ ID NO: 2106674 - RNA, 16 nt, Homo sapiens
ggcuugaaggccagca

SEQ ID NO: 2106675 - RNA, 14 nt, Homo sapiens
gaaaauguccuccc

SEQ ID NO: 2106676 - RNA, 16 nt, Homo sapiens
ucccuaagaauuccca

SEQ ID NO: 2106677 - RNA, 22 nt, Homo sapiens
uaaaauaaaaaggaaaacagac

SEQ ID NO: 2106678 - RNA, 21 nt, Homo sapiens
ccuauucccucucucucccag

SEQ ID NO: 2106679 - RNA, 19 nt, Homo sapiens
ugccuugaguccccagggg

SEQ ID NO: 2106680 - RNA, 21 nt, Homo sapiens
ugacaaagaugaccugcugcu

SEQ ID NO: 2106681 - RNA, 21 nt, Homo sapiens
agaggcauagaauacacauuu

SEQ ID NO: 2106682 - RNA, 20 nt, Homo sapiens
cucagccuccugaguagcug

SEQ ID NO: 2106683 - RNA, 20 nt, Homo sapiens
cuugugguugaaaaccacag

SEQ ID NO: 2106684 - RNA, 18 nt, Homo sapiens
cucgaaugugugggccca

SEQ ID NO: 2106685 - RNA, 11 nt, Homo sapiens
agagcucuuaa

SEQ ID NO: 2106686 - RNA, 19 nt, Homo sapiens
aucucccuuaauaaacuca

SEQ ID NO: 2106687 - RNA, 21 nt, Homo sapiens
cucuagaacacccacuggcca

SEQ ID NO: 2106688 - RNA, 15 nt, Homo sapiens
gaaauaaaccccagu

SEQ ID NO: 2106689 - RNA, 20 nt, Homo sapiens
gucuagaggugagaccaaag

SEQ ID NO: 2106690 - RNA, 19 nt, Homo sapiens
aggaaguggcugucccugu

SEQ ID NO: 2106691 - RNA, 16 nt, Homo sapiens
cugcaccccugggcca

SEQ ID NO: 2106692 - RNA, 19 nt, Homo sapiens
aaacaguuguaccacugcu

SEQ ID NO: 2106693 - RNA, 20 nt, Homo sapiens
aagcuuguuaucagcuuuca

SEQ ID NO: 2106694 - RNA, 16 nt, Homo sapiens
gaggccacacccagag

SEQ ID NO: 2106695 - RNA, 21 nt, Homo sapiens
gaguagagaggcccgcccgcc

SEQ ID NO: 2106696 - RNA, 16 nt, Homo sapiens
uucacauugaaaccca

SEQ ID NO: 2106697 - RNA, 12 nt, Homo sapiens
ugcuauaaucau

SEQ ID NO: 2106698 - RNA, 14 nt, Homo sapiens
aacugaaggccacu

SEQ ID NO: 2106699 - RNA, 21 nt, Homo sapiens
ugugcaacgugggcaagucau

SEQ ID NO: 2106700 - RNA, 21 nt, Homo sapiens
uauauuucagguuauauccaa

SEQ ID NO: 2106701 - RNA, 20 nt, Homo sapiens
ucacugcugauuauucacua

SEQ ID NO: 2106702 - RNA, 13 nt, Homo sapiens
aaagcaguagcau

SEQ ID NO: 2106703 - RNA, 23 nt, Homo sapiens
agcauuuugaaacaaaguacucu

SEQ ID NO: 2106704 - RNA, 21 nt, Homo sapiens
ccuggccuggucccugguccu

SEQ ID NO: 2106705 - RNA, 23 nt, Homo sapiens
ccaugcuuccuauacaguucuau

SEQ ID NO: 2106706 - RNA, 16 nt, Homo sapiens
cacugucuugccagau

SEQ ID NO: 2106707 - RNA, 21 nt, Homo sapiens
guauucuagugaaugaaucuc

SEQ ID NO: 2106708 - RNA, 17 nt, Homo sapiens
cuggacagucacugcca

SEQ ID NO: 2106709 - RNA, 18 nt, Homo sapiens
guuccucuuggugucaua

SEQ ID NO: 2106710 - RNA, 18 nt, Homo sapiens
gauucauauugcaucaua

SEQ ID NO: 2106711 - RNA, 19 nt, Homo sapiens
cccgggacccacggagccc

SEQ ID NO: 2106712 - RNA, 14 nt, Homo sapiens
cuuggcuuuaugca

SEQ ID NO: 2106713 - RNA, 14 nt, Homo sapiens
agacaagauuuaug

SEQ ID NO: 2106714 - RNA, 15 nt, Homo sapiens
cuuccacuguagcua

SEQ ID NO: 2106715 - RNA, 22 nt, Homo sapiens
gcgcuggacaccuacagcagca

SEQ ID NO: 2106716 - RNA, 14 nt, Homo sapiens
aagaaugaauccau

SEQ ID NO: 2106717 - RNA, 22 nt, Homo sapiens
ucucaccuaaacccucugugaa

SEQ ID NO: 2106718 - RNA, 13 nt, Homo sapiens
agcauugcacuug

SEQ ID NO: 2106719 - RNA, 23 nt, Homo sapiens
uauaguuuguuuuuaaacuaaua

SEQ ID NO: 2106720 - RNA, 14 nt, Homo sapiens
auuauuuacaucac

SEQ ID NO: 2106721 - RNA, 14 nt, Homo sapiens
cucugccuauuuau

SEQ ID NO: 2106722 - RNA, 15 nt, Homo sapiens
ugaucaggaccucca

SEQ ID NO: 2106723 - RNA, 17 nt, Homo sapiens
ggcagagguugugguga

SEQ ID NO: 2106724 - RNA, 21 nt, Homo sapiens
aguagcagcagaggccagugg

SEQ ID NO: 2106725 - RNA, 16 nt, Homo sapiens
uucucaugcacugcaa

SEQ ID NO: 2106726 - RNA, 13 nt, Homo sapiens
acccugugaaaug

SEQ ID NO: 2106727 - RNA, 13 nt, Homo sapiens
acagaaaugccac

SEQ ID NO: 2106728 - RNA, 15 nt, Homo sapiens
agucacucacauuga

SEQ ID NO: 2106729 - RNA, 15 nt, Homo sapiens
acacagacaguuucu

SEQ ID NO: 2106730 - RNA, 16 nt, Homo sapiens
gugauauggagcccug

SEQ ID NO: 2106731 - RNA, 16 nt, Homo sapiens
uaccugggcauacuaa

SEQ ID NO: 2106732 - RNA, 18 nt, Homo sapiens
uggccauuccaacagcuc

SEQ ID NO: 2106733 - RNA, 13 nt, Homo sapiens
aaagcauccuccu

SEQ ID NO: 2106734 - RNA, 13 nt, Homo sapiens
cuugauauaauua

SEQ ID NO: 2106735 - RNA, 22 nt, Homo sapiens
accaaaucauccugaaucugau

SEQ ID NO: 2106736 - RNA, 16 nt, Homo sapiens
ccaauucagugucugu

SEQ ID NO: 2106737 - RNA, 21 nt, Homo sapiens
gguacuuuuaugauguauauu

SEQ ID NO: 2106738 - RNA, 13 nt, Homo sapiens
gucuucuucaggg

SEQ ID NO: 2106739 - RNA, 19 nt, Homo sapiens
cugugguacugauggacuu

SEQ ID NO: 2106740 - RNA, 22 nt, Homo sapiens
ugcccagaucagccagaagcca

SEQ ID NO: 2106741 - RNA, 16 nt, Homo sapiens
cuggggaggugaacug

SEQ ID NO: 2106742 - RNA, 17 nt, Homo sapiens
uccacucagcacucugg

SEQ ID NO: 2106743 - RNA, 16 nt, Homo sapiens
agccugaccaacaugg

SEQ ID NO: 2106744 - RNA, 11 nt, Homo sapiens
ggaaaugugag

SEQ ID NO: 2106745 - RNA, 21 nt, Homo sapiens
uagcauuuagaucuacacucu

SEQ ID NO: 2106746 - RNA, 15 nt, Homo sapiens
auauuugguaccaug

SEQ ID NO: 2106747 - RNA, 15 nt, Homo sapiens
ggccucuuucugugc

SEQ ID NO: 2106748 - RNA, 22 nt, Homo sapiens
gugcaaggcaggggcacggugg

SEQ ID NO: 2106749 - RNA, 16 nt, Homo sapiens
auuuuguauuuuccaa

SEQ ID NO: 2106750 - RNA, 23 nt, Homo sapiens
ugaaaguuuucuaaacucaauaa

SEQ ID NO: 2106751 - RNA, 14 nt, Homo sapiens
cuccagacauacaa

SEQ ID NO: 2106752 - RNA, 16 nt, Homo sapiens
ggucuacucuagaaga

SEQ ID NO: 2106753 - RNA, 12 nt, Homo sapiens
gguucugaugau

SEQ ID NO: 2106754 - RNA, 18 nt, Homo sapiens
cauucaacugaacaacua

SEQ ID NO: 2106755 - RNA, 12 nt, Homo sapiens
auggcagacucu

SEQ ID NO: 2106756 - RNA, 16 nt, Homo sapiens
aaccagaaauccaguu

SEQ ID NO: 2106757 - RNA, 16 nt, Homo sapiens
aacauuuuaucauuaa

SEQ ID NO: 2106758 - RNA, 21 nt, Homo sapiens
ccagcagcacagucacccaug

SEQ ID NO: 2106759 - RNA, 18 nt, Homo sapiens
ugucauauaucaaaucau

SEQ ID NO: 2106760 - RNA, 13 nt, Homo sapiens
cccaguccaugcu

SEQ ID NO: 2106761 - RNA, 20 nt, Homo sapiens
cccaggcuggagcgcagugg

SEQ ID NO: 2106762 - RNA, 14 nt, Homo sapiens
uagaucucccuuaa

SEQ ID NO: 2106763 - RNA, 21 nt, Homo sapiens
gagacaggagaaacacuugaa

SEQ ID NO: 2106764 - RNA, 15 nt, Homo sapiens
cgccugccugccacc

SEQ ID NO: 2106765 - RNA, 16 nt, Homo sapiens
ggacgcagacugacuc

SEQ ID NO: 2106766 - RNA, 12 nt, Homo sapiens
uuuaguggagcc

SEQ ID NO: 2106767 - RNA, 14 nt, Homo sapiens
aaacccagcaugua

SEQ ID NO: 2106768 - RNA, 13 nt, Homo sapiens
ggagaauggugcu

SEQ ID NO: 2106769 - RNA, 14 nt, Homo sapiens
uaaacucugaccaa

SEQ ID NO: 2106770 - RNA, 19 nt, Homo sapiens
agauacugucucuuucaug

SEQ ID NO: 2106771 - RNA, 11 nt, Homo sapiens
uuuucauucau

SEQ ID NO: 2106772 - RNA, 18 nt, Homo sapiens
uuagugcacaagcacuau

SEQ ID NO: 2106773 - RNA, 16 nt, Homo sapiens
aagccacugggcacug

SEQ ID NO: 2106774 - RNA, 14 nt, Homo sapiens
gcaacaguagcaua

SEQ ID NO: 2106775 - RNA, 16 nt, Homo sapiens
ucgcacucaaugccaa

SEQ ID NO: 2106776 - RNA, 23 nt, Homo sapiens
auuuuauggugaugucacucacc

SEQ ID NO: 2106777 - RNA, 22 nt, Homo sapiens
acacaccagggaauacuauaca

SEQ ID NO: 2106778 - RNA, 15 nt, Homo sapiens
gucuccauaggacag

SEQ ID NO: 2106779 - RNA, 15 nt, Homo sapiens
ggaagaucaggucau

SEQ ID NO: 2106780 - RNA, 21 nt, Homo sapiens
aggaauuaaggguuaccccac

SEQ ID NO: 2106781 - RNA, 22 nt, Homo sapiens
aaacuucuuuaguacuuacauc

SEQ ID NO: 2106782 - RNA, 21 nt, Homo sapiens
cuugcugauggugacauugca

SEQ ID NO: 2106783 - RNA, 11 nt, Homo sapiens
gaaccuaauaa

SEQ ID NO: 2106784 - RNA, 15 nt, Homo sapiens
ugaaauaacacagca

SEQ ID NO: 2106785 - RNA, 22 nt, Homo sapiens
ucaccaggaggcggcagugcaa

SEQ ID NO: 2106786 - RNA, 21 nt, Homo sapiens
aauauugacuuuuuauggcac

SEQ ID NO: 2106787 - RNA, 17 nt, Homo sapiens
cugcucacuuaaacaau

SEQ ID NO: 2106788 - RNA, 13 nt, Homo sapiens
cuccuucagcucu

SEQ ID NO: 2106789 - RNA, 17 nt, Homo sapiens
ugccucuccagcacuuc

SEQ ID NO: 2106790 - RNA, 16 nt, Homo sapiens
aguaaaacuguauaaa

SEQ ID NO: 2106791 - RNA, 13 nt, Homo sapiens
aguuuuugcagag

SEQ ID NO: 2106792 - RNA, 15 nt, Homo sapiens
cccuaugucucagga

SEQ ID NO: 2106793 - RNA, 19 nt, Homo sapiens
uccgugagagucaucucaa

SEQ ID NO: 2106794 - RNA, 14 nt, Homo sapiens
uauucauaugcaua

SEQ ID NO: 2106795 - RNA, 14 nt, Homo sapiens
aauauauaagcuca

SEQ ID NO: 2106796 - RNA, 14 nt, Homo sapiens
uauacuaaccauuu

SEQ ID NO: 2106797 - RNA, 23 nt, Homo sapiens
uaaguaaaagcuacuauguacug

SEQ ID NO: 2106798 - RNA, 19 nt, Homo sapiens
cacuuaguaguuuuuacaa

SEQ ID NO: 2106799 - RNA, 17 nt, Homo sapiens
acuggaacacuaaugag

SEQ ID NO: 2106800 - RNA, 21 nt, Homo sapiens
cuuccuucucaucuugccuca

SEQ ID NO: 2106801 - RNA, 20 nt, Homo sapiens
ugugaugucaugaaacugua

SEQ ID NO: 2106802 - RNA, 15 nt, Homo sapiens
cuucuuugcugcugc

SEQ ID NO: 2106803 - RNA, 16 nt, Homo sapiens
ucacauguuuaacuuu

SEQ ID NO: 2106804 - RNA, 16 nt, Homo sapiens
gcaacauuguacaagu

SEQ ID NO: 2106805 - RNA, 23 nt, Homo sapiens
aguauggccagcagacaggcugg

SEQ ID NO: 2106806 - RNA, 15 nt, Homo sapiens
aguuccuagcacugc

SEQ ID NO: 2106807 - RNA, 18 nt, Homo sapiens
ugagguuugcuuguuacc

SEQ ID NO: 2106808 - RNA, 19 nt, Homo sapiens
gcuucuaucaggucccauc

SEQ ID NO: 2106809 - RNA, 13 nt, Homo sapiens
accuaaacugagc

SEQ ID NO: 2106810 - RNA, 16 nt, Homo sapiens
ucccgcccccuuggcu

SEQ ID NO: 2106811 - RNA, 17 nt, Homo sapiens
ugaccuuggguccugaa

SEQ ID NO: 2106812 - RNA, 15 nt, Homo sapiens
ugcccaggacugcau

SEQ ID NO: 2106813 - RNA, 13 nt, Homo sapiens
gagacaccaggca

SEQ ID NO: 2106814 - RNA, 20 nt, Homo sapiens
guugcucaccgacucaccug

SEQ ID NO: 2106815 - RNA, 22 nt, Homo sapiens
ugggagccgggacccucaggug

SEQ ID NO: 2106816 - RNA, 13 nt, Homo sapiens
cuagcuugaacuu

SEQ ID NO: 2106817 - RNA, 14 nt, Homo sapiens
aguguggccugagu

SEQ ID NO: 2106818 - RNA, 18 nt, Homo sapiens
aacugaguauguguaaca

SEQ ID NO: 2106819 - RNA, 18 nt, Homo sapiens
ucaaguaauaggcauuuu

SEQ ID NO: 2106820 - RNA, 21 nt, Homo sapiens
ucaacuagcagaaaauauaaa

SEQ ID NO: 2106821 - RNA, 20 nt, Homo sapiens
aaaggaacagccccagugca

SEQ ID NO: 2106822 - RNA, 15 nt, Homo sapiens
uugcaugaauaggcu

SEQ ID NO: 2106823 - RNA, 17 nt, Homo sapiens
agguguaauaagacuau

SEQ ID NO: 2106824 - RNA, 14 nt, Homo sapiens
auagcccaucuucc

SEQ ID NO: 2106825 - RNA, 12 nt, Homo sapiens
auuugcauuucu

SEQ ID NO: 2106826 - RNA, 21 nt, Homo sapiens
caccuucccuaguucuuugca

SEQ ID NO: 2106827 - RNA, 16 nt, Homo sapiens
agaaggaggggagcag

SEQ ID NO: 2106828 - RNA, 23 nt, Homo sapiens
agcauuauaaaccccuccaauuc

SEQ ID NO: 2106829 - RNA, 18 nt, Homo sapiens
ucccauuaaaaacaaaac

SEQ ID NO: 2106830 - RNA, 13 nt, Homo sapiens
aagugggugaaug

SEQ ID NO: 2106831 - RNA, 24 nt, Homo sapiens
gacaucuccucuaucacauuacau

SEQ ID NO: 2106832 - RNA, 22 nt, Homo sapiens
uagaaaaaaaauaaaacuucaa

SEQ ID NO: 2106833 - RNA, 21 nt, Homo sapiens
uaaagggcuucauuuuagucc

SEQ ID NO: 2106834 - RNA, 19 nt, Homo sapiens
agucucagcccugaccuuc

SEQ ID NO: 2106835 - RNA, 19 nt, Homo sapiens
uccagggcccccaucucau

SEQ ID NO: 2106836 - RNA, 18 nt, Homo sapiens
cucuaucccugaaaucca

SEQ ID NO: 2106837 - RNA, 18 nt, Homo sapiens
caguauguugccaagagc

SEQ ID NO: 2106838 - RNA, 16 nt, Homo sapiens
uccucagccuccucau

SEQ ID NO: 2106839 - RNA, 13 nt, Homo sapiens
aagacuugugcau

SEQ ID NO: 2106840 - RNA, 21 nt, Homo sapiens
acagccuuucguucugcugac

SEQ ID NO: 2106841 - RNA, 19 nt, Homo sapiens
ccacauucacuacugcaaa

SEQ ID NO: 2106842 - RNA, 14 nt, Homo sapiens
caccaucccaaagc

SEQ ID NO: 2106843 - RNA, 19 nt, Homo sapiens
aguguucacaaacugugaa

SEQ ID NO: 2106844 - RNA, 19 nt, Homo sapiens
ucacauugguguuguacuc

SEQ ID NO: 2106845 - RNA, 21 nt, Homo sapiens
ugggucucagcugcugacacg

SEQ ID NO: 2106846 - RNA, 23 nt, Homo sapiens
agacacucccacuuggcaucauu

SEQ ID NO: 2106847 - RNA, 14 nt, Homo sapiens
cugaggcaccagaa

SEQ ID NO: 2106848 - RNA, 18 nt, Homo sapiens
cauaaacugucacucuag

SEQ ID NO: 2106849 - RNA, 21 nt, Homo sapiens
caaagaccugccugugugcuc

SEQ ID NO: 2106850 - RNA, 14 nt, Homo sapiens
agaauauuguuaaa

SEQ ID NO: 2106851 - RNA, 21 nt, Homo sapiens
aucucuuccuccgaggccagu

SEQ ID NO: 2106852 - RNA, 17 nt, Homo sapiens
gagugacccagcuacug

SEQ ID NO: 2106853 - RNA, 16 nt, Homo sapiens
cugagaaauggccaaa

SEQ ID NO: 2106854 - RNA, 14 nt, Homo sapiens
ucucccuuuuaccc

SEQ ID NO: 2106855 - RNA, 14 nt, Homo sapiens
uuucuauuucacua

SEQ ID NO: 2106856 - RNA, 14 nt, Homo sapiens
auauaauuacuuaa

SEQ ID NO: 2106857 - RNA, 16 nt, Homo sapiens
cuacagaaagcacaaa

SEQ ID NO: 2106858 - RNA, 16 nt, Homo sapiens
uuuaaaacaggcaaag

SEQ ID NO: 2106859 - RNA, 14 nt, Homo sapiens
guuuugugccuuug

SEQ ID NO: 2106860 - RNA, 16 nt, Homo sapiens
uauuuguauuugccau

SEQ ID NO: 2106861 - RNA, 14 nt, Homo sapiens
auccagggcugcca

SEQ ID NO: 2106862 - RNA, 23 nt, Homo sapiens
agguagaagggaccucaagcacc

SEQ ID NO: 2106863 - RNA, 13 nt, Homo sapiens
uuugaaaugcacc

SEQ ID NO: 2106864 - RNA, 21 nt, Homo sapiens
cauccuguuuguaucauagca

SEQ ID NO: 2106865 - RNA, 16 nt, Homo sapiens
uuaaggguacaguuug

SEQ ID NO: 2106866 - RNA, 22 nt, Homo sapiens
acuucaaaagccauaacuugaa

SEQ ID NO: 2106867 - RNA, 14 nt, Homo sapiens
cuuuggaaggugac

SEQ ID NO: 2106868 - RNA, 14 nt, Homo sapiens
uaagacagugcagu

SEQ ID NO: 2106869 - RNA, 13 nt, Homo sapiens
aaggaaaaugggg

SEQ ID NO: 2106870 - RNA, 21 nt, Homo sapiens
cacuaccguaaauguccauuu

SEQ ID NO: 2106871 - RNA, 20 nt, Homo sapiens
acuuuaaauccuaccaaagu

SEQ ID NO: 2106872 - RNA, 17 nt, Homo sapiens
aggcaaaggcagaggaa

SEQ ID NO: 2106873 - RNA, 19 nt, Homo sapiens
aaauacuucuuuuucauua

SEQ ID NO: 2106874 - RNA, 22 nt, Homo sapiens
gcaaaucuccuuuguccauuua

SEQ ID NO: 2106875 - RNA, 19 nt, Homo sapiens
caucagaccugucuuccaa

SEQ ID NO: 2106876 - RNA, 18 nt, Homo sapiens
auacuguugcacgugugu

SEQ ID NO: 2106877 - RNA, 15 nt, Homo sapiens
uguauuuagugaaaa

SEQ ID NO: 2106878 - RNA, 17 nt, Homo sapiens
agaugauauuacaggac

SEQ ID NO: 2106879 - RNA, 15 nt, Homo sapiens
agacagcacagggca

SEQ ID NO: 2106880 - RNA, 14 nt, Homo sapiens
aguuucucaaagau

SEQ ID NO: 2106881 - RNA, 18 nt, Homo sapiens
uugaacaaaaaugacaga

SEQ ID NO: 2106882 - RNA, 13 nt, Homo sapiens
caaaccauugaaa

SEQ ID NO: 2106883 - RNA, 12 nt, Homo sapiens
ggaggagaagua

SEQ ID NO: 2106884 - RNA, 18 nt, Homo sapiens
gcuucgcaaaauguuuca

SEQ ID NO: 2106885 - RNA, 11 nt, Homo sapiens
auauaagcaaa

SEQ ID NO: 2106886 - RNA, 19 nt, Homo sapiens
ugcauauccuuuuagucug

SEQ ID NO: 2106887 - RNA, 16 nt, Homo sapiens
gagaggcugcuuuuga

SEQ ID NO: 2106888 - RNA, 21 nt, Homo sapiens
guguuacgcacacguacuuaa

SEQ ID NO: 2106889 - RNA, 14 nt, Homo sapiens
ugcugcccaugcac

SEQ ID NO: 2106890 - RNA, 23 nt, Homo sapiens
ccugcuccugcccacgugcagca

SEQ ID NO: 2106891 - RNA, 18 nt, Homo sapiens
cuccuagacucugugauc

SEQ ID NO: 2106892 - RNA, 12 nt, Homo sapiens
auuuacauucuu

SEQ ID NO: 2106893 - RNA, 23 nt, Homo sapiens
agaauucacuaggaggucaucaa

SEQ ID NO: 2106894 - RNA, 11 nt, Homo sapiens
auuuauucucu

SEQ ID NO: 2106895 - RNA, 21 nt, Homo sapiens
aacucauaaaggagcauauaa

SEQ ID NO: 2106896 - RNA, 12 nt, Homo sapiens
cagacaacacug

SEQ ID NO: 2106897 - RNA, 23 nt, Homo sapiens
gacacaggccagcuccacagugu

SEQ ID NO: 2106898 - RNA, 21 nt, Homo sapiens
ucgauccccugucacgugugg

SEQ ID NO: 2106899 - RNA, 15 nt, Homo sapiens
ggguuccugccaggc

SEQ ID NO: 2106900 - RNA, 13 nt, Homo sapiens
acagaacuaugga

SEQ ID NO: 2106901 - RNA, 13 nt, Homo sapiens
gcaggacuguggg

SEQ ID NO: 2106902 - RNA, 18 nt, Homo sapiens
ucguguaauuggcccaag

SEQ ID NO: 2106903 - RNA, 12 nt, Homo sapiens
ucaacucugaaa

SEQ ID NO: 2106904 - RNA, 16 nt, Homo sapiens
accucaggcagcucaa

SEQ ID NO: 2106905 - RNA, 22 nt, Homo sapiens
cuggcaagaaagcuugagucuc

SEQ ID NO: 2106906 - RNA, 14 nt, Homo sapiens
aggagaaugugcag

SEQ ID NO: 2106907 - RNA, 22 nt, Homo sapiens
auuauaccgcuaucauuccaaa

SEQ ID NO: 2106908 - RNA, 12 nt, Homo sapiens
gcaucagcuuuc

SEQ ID NO: 2106909 - RNA, 14 nt, Homo sapiens
gaugcaugcagggc

SEQ ID NO: 2106910 - RNA, 21 nt, Homo sapiens
accuguagauucagguaauac

SEQ ID NO: 2106911 - RNA, 22 nt, Homo sapiens
uuugucuuggcuuuucuuuggg

SEQ ID NO: 2106912 - RNA, 15 nt, Homo sapiens
gaauacaaagaccca

SEQ ID NO: 2106913 - RNA, 17 nt, Homo sapiens
cuucuuuagaugccaaa

SEQ ID NO: 2106914 - RNA, 23 nt, Homo sapiens
cagagcagaggaaggcuacuuga

SEQ ID NO: 2106915 - RNA, 20 nt, Homo sapiens
gcugauuuucaucaaaacca

SEQ ID NO: 2106916 - RNA, 19 nt, Homo sapiens
uuaaaucuuuggauuugau

SEQ ID NO: 2106917 - RNA, 20 nt, Homo sapiens
ucaguaaaauuauacugugu

SEQ ID NO: 2106918 - RNA, 17 nt, Homo sapiens
cucuuguugagugccag

SEQ ID NO: 2106919 - RNA, 18 nt, Homo sapiens
uccagaaaaacucaugga

SEQ ID NO: 2106920 - RNA, 22 nt, Homo sapiens
ggcucgccaugccggggguuca

SEQ ID NO: 2106921 - RNA, 17 nt, Homo sapiens
uaggaagacgcagagca

SEQ ID NO: 2106922 - RNA, 18 nt, Homo sapiens
aaaagcugccucugguca

SEQ ID NO: 2106923 - RNA, 22 nt, Homo sapiens
gagauuggccagugagaagcug

SEQ ID NO: 2106924 - RNA, 11 nt, Homo sapiens
uugcagcugcu

SEQ ID NO: 2106925 - RNA, 23 nt, Homo sapiens
acauaaaugucuguauuucauuc

SEQ ID NO: 2106926 - RNA, 22 nt, Homo sapiens
ugggcagcugauuuugucacug

SEQ ID NO: 2106927 - RNA, 19 nt, Homo sapiens
uguguaauguaaacugugc

SEQ ID NO: 2106928 - RNA, 20 nt, Homo sapiens
uaaaaauuuauacaccagca

SEQ ID NO: 2106929 - RNA, 17 nt, Homo sapiens
aguguagaccugagcug

SEQ ID NO: 2106930 - RNA, 16 nt, Homo sapiens
aggccacccacugugg

SEQ ID NO: 2106931 - RNA, 23 nt, Homo sapiens
uuucuccaaagaagauaugcaaa

SEQ ID NO: 2106932 - RNA, 21 nt, Homo sapiens
agacccaguggacucuuccac

SEQ ID NO: 2106933 - RNA, 22 nt, Homo sapiens
cuaauccuugcuauuaagaauu

SEQ ID NO: 2106934 - RNA, 16 nt, Homo sapiens
acauauauaacaccuu

SEQ ID NO: 2106935 - RNA, 14 nt, Homo sapiens
acaggcagcuucca

SEQ ID NO: 2106936 - RNA, 20 nt, Homo sapiens
gaggucaaggcugcagugag

SEQ ID NO: 2106937 - RNA, 16 nt, Homo sapiens
cauaucaucacauuga

SEQ ID NO: 2106938 - RNA, 15 nt, Homo sapiens
gaacuaagcaucuuu

SEQ ID NO: 2106939 - RNA, 15 nt, Homo sapiens
cauggugaaauuaua

SEQ ID NO: 2106940 - RNA, 13 nt, Homo sapiens
gauucuauguuaa

SEQ ID NO: 2106941 - RNA, 20 nt, Homo sapiens
uguacuucugugugcaauug

SEQ ID NO: 2106942 - RNA, 23 nt, Homo sapiens
augauguagagugugguuaugaa

SEQ ID NO: 2106943 - RNA, 22 nt, Homo sapiens
aagaugggagguggaagcagag

SEQ ID NO: 2106944 - RNA, 23 nt, Homo sapiens
ggaguuccucuaacauuugcaaa

SEQ ID NO: 2106945 - RNA, 20 nt, Homo sapiens
aauccagguacgcacagaca

SEQ ID NO: 2106946 - RNA, 13 nt, Homo sapiens
gaugugaagccaa

SEQ ID NO: 2106947 - RNA, 13 nt, Homo sapiens
auguaaacugcca

SEQ ID NO: 2106948 - RNA, 20 nt, Homo sapiens
aaaaacucuuauuacuguug

SEQ ID NO: 2106949 - RNA, 23 nt, Homo sapiens
aguguggcccagggaagccaaaa

SEQ ID NO: 2106950 - RNA, 15 nt, Homo sapiens
aauaucuauauucua

SEQ ID NO: 2106951 - RNA, 19 nt, Homo sapiens
ccucugguuccacucagcu

SEQ ID NO: 2106952 - RNA, 22 nt, Homo sapiens
acaaaaggaaaggucucagcuu

SEQ ID NO: 2106953 - RNA, 16 nt, Homo sapiens
gcccagcuacauuccu

SEQ ID NO: 2106954 - RNA, 16 nt, Homo sapiens
gaacacaaaacuugaa

SEQ ID NO: 2106955 - RNA, 23 nt, Homo sapiens
cauaaucucuuuccaucuuacuu

SEQ ID NO: 2106956 - RNA, 13 nt, Homo sapiens
cacuauggacuua

SEQ ID NO: 2106957 - RNA, 12 nt, Homo sapiens
cuccaugcacau

SEQ ID NO: 2106958 - RNA, 12 nt, Homo sapiens
ucccagauccuc

SEQ ID NO: 2106959 - RNA, 22 nt, Homo sapiens
cugagcaucacuagugacaagu

SEQ ID NO: 2106960 - RNA, 23 nt, Homo sapiens
cuuauuuaaaauuccauuaucuu

SEQ ID NO: 2106961 - RNA, 17 nt, Homo sapiens
aauggcuuguucaguca

SEQ ID NO: 2106962 - RNA, 13 nt, Homo sapiens
uuaagacuuuaaa

SEQ ID NO: 2106963 - RNA, 13 nt, Homo sapiens
cccaaacucccag

SEQ ID NO: 2106964 - RNA, 22 nt, Homo sapiens
gacaugcacccgcauguacaaa

SEQ ID NO: 2106965 - RNA, 16 nt, Homo sapiens
acaccauucauuccau

SEQ ID NO: 2106966 - RNA, 13 nt, Homo sapiens
aaaacccuuucug

SEQ ID NO: 2106967 - RNA, 19 nt, Homo sapiens
caaggacguggaugacccu

SEQ ID NO: 2106968 - RNA, 12 nt, Homo sapiens
aagauacagugu

SEQ ID NO: 2106969 - RNA, 15 nt, Homo sapiens
cauuuuauaaauuca

SEQ ID NO: 2106970 - RNA, 19 nt, Homo sapiens
aguauuuaggauaaccuug

SEQ ID NO: 2106971 - RNA, 14 nt, Homo sapiens
gaauacauugcaau

SEQ ID NO: 2106972 - RNA, 14 nt, Homo sapiens
ugccaacuccucac

SEQ ID NO: 2106973 - RNA, 16 nt, Homo sapiens
cacagcagacaccauu

SEQ ID NO: 2106974 - RNA, 18 nt, Homo sapiens
cuaauaauaguacuauua

SEQ ID NO: 2106975 - RNA, 20 nt, Homo sapiens
accugccugcaucugugaaa

SEQ ID NO: 2106976 - RNA, 20 nt, Homo sapiens
ucuccaugcccaaccuaaga

SEQ ID NO: 2106977 - RNA, 16 nt, Homo sapiens
uaaacauuucauuucc

SEQ ID NO: 2106978 - RNA, 16 nt, Homo sapiens
guagucccagccacuc

SEQ ID NO: 2106979 - RNA, 19 nt, Homo sapiens
cuguuuauuacuuccauga

SEQ ID NO: 2106980 - RNA, 20 nt, Homo sapiens
uggugccaccagccuuccug

SEQ ID NO: 2106981 - RNA, 16 nt, Homo sapiens
caagacaagcuccucc

SEQ ID NO: 2106982 - RNA, 18 nt, Homo sapiens
gcacccuggauuugcaua

SEQ ID NO: 2106983 - RNA, 21 nt, Homo sapiens
cugcauuguucuuugccagag

SEQ ID NO: 2106984 - RNA, 13 nt, Homo sapiens
caggugaagcacc

SEQ ID NO: 2106985 - RNA, 20 nt, Homo sapiens
agaugucccacagggaccac

SEQ ID NO: 2106986 - RNA, 18 nt, Homo sapiens
auuuuagauaauucuuaa

SEQ ID NO: 2106987 - RNA, 22 nt, Homo sapiens
gucuuucagaacacgacagaaa

SEQ ID NO: 2106988 - RNA, 23 nt, Homo sapiens
gcaccugccugccgcugcaggaa

SEQ ID NO: 2106989 - RNA, 23 nt, Homo sapiens
cauuuugcuuuggacacaguguu

SEQ ID NO: 2106990 - RNA, 19 nt, Homo sapiens
cagcucgggcccucuguga

SEQ ID NO: 2106991 - RNA, 18 nt, Homo sapiens
ccaaauuuuaucuggaag

SEQ ID NO: 2106992 - RNA, 18 nt, Homo sapiens
gaguccauuguggagcca

SEQ ID NO: 2106993 - RNA, 17 nt, Homo sapiens
agucggagccacugguc

SEQ ID NO: 2106994 - RNA, 23 nt, Homo sapiens
aaccaaccaccuuuccagccaua

SEQ ID NO: 2106995 - RNA, 16 nt, Homo sapiens
gaauuucuucagucca

SEQ ID NO: 2106996 - RNA, 13 nt, Homo sapiens
agaaccauuucac

SEQ ID NO: 2106997 - RNA, 22 nt, Homo sapiens
agcccucauuuuuauaaccugg

SEQ ID NO: 2106998 - RNA, 13 nt, Homo sapiens
ucuuuacagaaug

SEQ ID NO: 2106999 - RNA, 22 nt, Homo sapiens
cacucgccgguuaagacagggu

SEQ ID NO: 2107000 - RNA, 18 nt, Homo sapiens
aaaaaccucuuagcuuuu

SEQ ID NO: 2107001 - RNA, 15 nt, Homo sapiens
gaagcucccaggaac

SEQ ID NO: 2107002 - RNA, 14 nt, Homo sapiens
aauucccuggaaaa

SEQ ID NO: 2107003 - RNA, 14 nt, Homo sapiens
cuuuggacuaaaga

SEQ ID NO: 2107004 - RNA, 23 nt, Homo sapiens
cauggucugaguggggcuuccug

SEQ ID NO: 2107005 - RNA, 20 nt, Homo sapiens
caccagucaccucgucuccc

SEQ ID NO: 2107006 - RNA, 23 nt, Homo sapiens
uuccauauuuauacagcagagaa

SEQ ID NO: 2107007 - RNA, 12 nt, Homo sapiens
ccagugccuuau

SEQ ID NO: 2107008 - RNA, 16 nt, Homo sapiens
gagaacaucuuugaca

SEQ ID NO: 2107009 - RNA, 16 nt, Homo sapiens
gauugaaucugaacca

SEQ ID NO: 2107010 - RNA, 17 nt, Homo sapiens
auaagcacuagaucucc

SEQ ID NO: 2107011 - RNA, 19 nt, Homo sapiens
acuguuucaaagccaagac

SEQ ID NO: 2107012 - RNA, 23 nt, Homo sapiens
aggaugaaucauauucauaugca

SEQ ID NO: 2107013 - RNA, 15 nt, Homo sapiens
ugaaggcuuacuuca

SEQ ID NO: 2107014 - RNA, 17 nt, Homo sapiens
guaacuugguuauacau

SEQ ID NO: 2107015 - RNA, 18 nt, Homo sapiens
ggcaccuuaacuggagac

SEQ ID NO: 2107016 - RNA, 18 nt, Homo sapiens
agcuccuggccaggauaa

SEQ ID NO: 2107017 - RNA, 19 nt, Homo sapiens
uaaugaagacccaguguaa

SEQ ID NO: 2107018 - RNA, 15 nt, Homo sapiens
aagguuguucuuggc

SEQ ID NO: 2107019 - RNA, 17 nt, Homo sapiens
acccccaggacaggcug

SEQ ID NO: 2107020 - RNA, 23 nt, Homo sapiens
ugcggcaggagcaggaacagaga

SEQ ID NO: 2107021 - RNA, 20 nt, Homo sapiens
agccagccccuagaugaaga

SEQ ID NO: 2107022 - RNA, 19 nt, Homo sapiens
uugagggacugagccagac

SEQ ID NO: 2107023 - RNA, 19 nt, Homo sapiens
uccccugcccugucuuucc

SEQ ID NO: 2107024 - RNA, 14 nt, Homo sapiens
ugccuauaauccca

SEQ ID NO: 2107025 - RNA, 15 nt, Homo sapiens
agcuggaaaaccucc

SEQ ID NO: 2107026 - RNA, 20 nt, Homo sapiens
ccugaucacucccagcacuc

SEQ ID NO: 2107027 - RNA, 14 nt, Homo sapiens
ugcccaaccuaccu

SEQ ID NO: 2107028 - RNA, 20 nt, Homo sapiens
ugacagcaugguaaugaagg

SEQ ID NO: 2107029 - RNA, 20 nt, Homo sapiens
ccauugucauccuguaccac

SEQ ID NO: 2107030 - RNA, 12 nt, Homo sapiens
cucuaucugcaa

SEQ ID NO: 2107031 - RNA, 19 nt, Homo sapiens
guggaaaguguucauugca

SEQ ID NO: 2107032 - RNA, 20 nt, Homo sapiens
caagauuuuuuuacuuauua

SEQ ID NO: 2107033 - RNA, 15 nt, Homo sapiens
agaaaaguauucuca

SEQ ID NO: 2107034 - RNA, 12 nt, Homo sapiens
uggaggguccca

SEQ ID NO: 2107035 - RNA, 19 nt, Homo sapiens
gagaagaaggaagaucuug

SEQ ID NO: 2107036 - RNA, 23 nt, Homo sapiens
aaaugcacccaucagcacucugu

SEQ ID NO: 2107037 - RNA, 21 nt, Homo sapiens
ggagaguacagugagccaaga

SEQ ID NO: 2107038 - RNA, 19 nt, Homo sapiens
aguuaccacauuacucugc

SEQ ID NO: 2107039 - RNA, 18 nt, Homo sapiens
uccagagaccccaggaac

SEQ ID NO: 2107040 - RNA, 15 nt, Homo sapiens
acaggcgucugccac

SEQ ID NO: 2107041 - RNA, 21 nt, Homo sapiens
cucuugagccugggaggucaa

SEQ ID NO: 2107042 - RNA, 22 nt, Homo sapiens
gcccuuuuuuguggugucuagc

SEQ ID NO: 2107043 - RNA, 13 nt, Homo sapiens
aggguuacuaugc

SEQ ID NO: 2107044 - RNA, 20 nt, Homo sapiens
uggggauuuaaaaacauucg

SEQ ID NO: 2107045 - RNA, 19 nt, Homo sapiens
ggacaaauuagcaugcaag

SEQ ID NO: 2107046 - RNA, 14 nt, Homo sapiens
accugagcugccau

SEQ ID NO: 2107047 - RNA, 23 nt, Homo sapiens
uaaagaaguggauuguauuguga

SEQ ID NO: 2107048 - RNA, 13 nt, Homo sapiens
cagccuccagugc

SEQ ID NO: 2107049 - RNA, 12 nt, Homo sapiens
ucugugugcugc

SEQ ID NO: 2107050 - RNA, 12 nt, Homo sapiens
ucucugugcugg

SEQ ID NO: 2107051 - RNA, 22 nt, Homo sapiens
ccauacagcuguccacacugaa

SEQ ID NO: 2107052 - RNA, 16 nt, Homo sapiens
uaagaauuagacaucu

SEQ ID NO: 2107053 - RNA, 22 nt, Homo sapiens
caaauacauggauaacacauuu

SEQ ID NO: 2107054 - RNA, 16 nt, Homo sapiens
uaauaaaugaguucaa

SEQ ID NO: 2107055 - RNA, 22 nt, Homo sapiens
cagagaagcuccugcuacuucc

SEQ ID NO: 2107056 - RNA, 13 nt, Homo sapiens
caguuugugcaag

SEQ ID NO: 2107057 - RNA, 17 nt, Homo sapiens
ccuccccaccacugagc

SEQ ID NO: 2107058 - RNA, 22 nt, Homo sapiens
uuucugagaaagacuauucaaa

SEQ ID NO: 2107059 - RNA, 20 nt, Homo sapiens
aagcucagggcccaucccuu

SEQ ID NO: 2107060 - RNA, 20 nt, Homo sapiens
cauccaaggccuucucaggc

SEQ ID NO: 2107061 - RNA, 13 nt, Homo sapiens
gugacuagugcug

SEQ ID NO: 2107062 - RNA, 18 nt, Homo sapiens
uucaugcaauccuuccaa

SEQ ID NO: 2107063 - RNA, 16 nt, Homo sapiens
gcaacaggaacuguga

SEQ ID NO: 2107064 - RNA, 19 nt, Homo sapiens
auggugcaaucacagcuca

SEQ ID NO: 2107065 - RNA, 17 nt, Homo sapiens
uuuagguucccaaaccu

SEQ ID NO: 2107066 - RNA, 21 nt, Homo sapiens
gccaagauuuuccucuuguga

SEQ ID NO: 2107067 - RNA, 20 nt, Homo sapiens
cuaacauguaauugcagaua

SEQ ID NO: 2107068 - RNA, 20 nt, Homo sapiens
uccauuuuaacaacugcucu

SEQ ID NO: 2107069 - RNA, 22 nt, Homo sapiens
ucaguaauaaaacaucuuucca

SEQ ID NO: 2107070 - RNA, 21 nt, Homo sapiens
uccaggccccaaaaccacagc

SEQ ID NO: 2107071 - RNA, 22 nt, Homo sapiens
uuucuaagaauaauggacucuu

SEQ ID NO: 2107072 - RNA, 21 nt, Homo sapiens
cucugccuuuaugaugcuaag

SEQ ID NO: 2107073 - RNA, 14 nt, Homo sapiens
ugguggccugggau

SEQ ID NO: 2107074 - RNA, 15 nt, Homo sapiens
cugugucuguauaca

SEQ ID NO: 2107075 - RNA, 14 nt, Homo sapiens
cacaacacccagcc

SEQ ID NO: 2107076 - RNA, 22 nt, Homo sapiens
guuggauuuguuuaaaaaccaa

SEQ ID NO: 2107077 - RNA, 14 nt, Homo sapiens
caucuaaugaaugu

SEQ ID NO: 2107078 - RNA, 18 nt, Homo sapiens
cuauuuucugaccaaaau

SEQ ID NO: 2107079 - RNA, 17 nt, Homo sapiens
caaaaacaaaaaaccac

SEQ ID NO: 2107080 - RNA, 16 nt, Homo sapiens
aaacugaauccauuca

SEQ ID NO: 2107081 - RNA, 21 nt, Homo sapiens
acacagggcauccaacugaga

SEQ ID NO: 2107082 - RNA, 15 nt, Homo sapiens
ccagcucugguccau

SEQ ID NO: 2107083 - RNA, 23 nt, Homo sapiens
uagguugaaggcaaaaccaacuc

SEQ ID NO: 2107084 - RNA, 17 nt, Homo sapiens
gacguggguugcacugg

SEQ ID NO: 2107085 - RNA, 23 nt, Homo sapiens
cagaaaaaaaaaaaaaagccuuu

SEQ ID NO: 2107086 - RNA, 20 nt, Homo sapiens
agagcacacuuaugggccaa

SEQ ID NO: 2107087 - RNA, 17 nt, Homo sapiens
acaccuaaguguuagaa

SEQ ID NO: 2107088 - RNA, 15 nt, Homo sapiens
uagaggaauguguuc

SEQ ID NO: 2107089 - RNA, 21 nt, Homo sapiens
uaaacuuuagaauuaauuuau

SEQ ID NO: 2107090 - RNA, 17 nt, Homo sapiens
cuuguucuguacuugua

SEQ ID NO: 2107091 - RNA, 11 nt, Homo sapiens
gcggagcugca

SEQ ID NO: 2107092 - RNA, 16 nt, Homo sapiens
uaaaacgauuacugac

SEQ ID NO: 2107093 - RNA, 18 nt, Homo sapiens
aaaggaagccuugcucau

SEQ ID NO: 2107094 - RNA, 12 nt, Homo sapiens
cuccacauccac

SEQ ID NO: 2107095 - RNA, 19 nt, Homo sapiens
agaaaagauuuaaguaauu

SEQ ID NO: 2107096 - RNA, 23 nt, Homo sapiens
gaaaacccaccccguagauuccc

SEQ ID NO: 2107097 - RNA, 19 nt, Homo sapiens
cuggggaggcccuagggga

SEQ ID NO: 2107098 - RNA, 22 nt, Homo sapiens
agcaugcacacugagaaugcua

SEQ ID NO: 2107099 - RNA, 15 nt, Homo sapiens
ccaagcccugcauug

SEQ ID NO: 2107100 - RNA, 20 nt, Homo sapiens
auugccucugccuugccccu

SEQ ID NO: 2107101 - RNA, 21 nt, Homo sapiens
aucaauggagcaugugugcaa

SEQ ID NO: 2107102 - RNA, 23 nt, Homo sapiens
aagaaacuuauuucucauaucaa

SEQ ID NO: 2107103 - RNA, 13 nt, Homo sapiens
auacuguacauaa

SEQ ID NO: 2107104 - RNA, 23 nt, Homo sapiens
agaagacugugcggcacaggaaa

SEQ ID NO: 2107105 - RNA, 23 nt, Homo sapiens
auaaauaacccugggcuguccag

SEQ ID NO: 2107106 - RNA, 15 nt, Homo sapiens
ugggagacuggaaaa

SEQ ID NO: 2107107 - RNA, 22 nt, Homo sapiens
agugguucaagcacacuggaau

SEQ ID NO: 2107108 - RNA, 18 nt, Homo sapiens
aacuuaaaaagucugcau

SEQ ID NO: 2107109 - RNA, 15 nt, Homo sapiens
gugccagcaaugaca

SEQ ID NO: 2107110 - RNA, 17 nt, Homo sapiens
ccagcccucaguuuuca

SEQ ID NO: 2107111 - RNA, 16 nt, Homo sapiens
acauaaguaacuuuua

SEQ ID NO: 2107112 - RNA, 22 nt, Homo sapiens
guuucaucauguuggccagggu

SEQ ID NO: 2107113 - RNA, 12 nt, Homo sapiens
auucaacuggaa

SEQ ID NO: 2107114 - RNA, 20 nt, Homo sapiens
ugauuucacucagggugaua

SEQ ID NO: 2107115 - RNA, 14 nt, Homo sapiens
ccagcauguacaaa

SEQ ID NO: 2107116 - RNA, 21 nt, Homo sapiens
caagauccugucuugcugagg

SEQ ID NO: 2107117 - RNA, 23 nt, Homo sapiens
uuaucaggaaauguuuucuuaag

SEQ ID NO: 2107118 - RNA, 16 nt, Homo sapiens
caauaaacuccuacua

SEQ ID NO: 2107119 - RNA, 21 nt, Homo sapiens
caaaacuauccugauuccaaa

SEQ ID NO: 2107120 - RNA, 20 nt, Homo sapiens
ccugagacacaugggugcua

SEQ ID NO: 2107121 - RNA, 13 nt, Homo sapiens
aaaacacuuccau

SEQ ID NO: 2107122 - RNA, 22 nt, Homo sapiens
augggaccugcucuuaaccuca

SEQ ID NO: 2107123 - RNA, 19 nt, Homo sapiens
ggccggugccagcugcccu

SEQ ID NO: 2107124 - RNA, 13 nt, Homo sapiens
auuucaaaacaca

SEQ ID NO: 2107125 - RNA, 18 nt, Homo sapiens
aucaggacagguggugca

SEQ ID NO: 2107126 - RNA, 15 nt, Homo sapiens
gagcaucugcaacaa

SEQ ID NO: 2107127 - RNA, 20 nt, Homo sapiens
uugaaauauaauucuguuuc

SEQ ID NO: 2107128 - RNA, 18 nt, Homo sapiens
uacaauagacauugcaaa

SEQ ID NO: 2107129 - RNA, 19 nt, Homo sapiens
aauggccuuuaucaucuag

SEQ ID NO: 2107130 - RNA, 17 nt, Homo sapiens
aguccgguucuucuugu

SEQ ID NO: 2107131 - RNA, 14 nt, Homo sapiens
cccucacucugcca

SEQ ID NO: 2107132 - RNA, 19 nt, Homo sapiens
uccauuagagaguggcaau

SEQ ID NO: 2107133 - RNA, 17 nt, Homo sapiens
aggcucugcauacacau

SEQ ID NO: 2107134 - RNA, 23 nt, Homo sapiens
uaauuuuuuugugggaaauccac

SEQ ID NO: 2107135 - RNA, 17 nt, Homo sapiens
auuugcuguuuuaaaca

SEQ ID NO: 2107136 - RNA, 22 nt, Homo sapiens
cuggggucuggcuuuggugaac

SEQ ID NO: 2107137 - RNA, 16 nt, Homo sapiens
cauccaucaucaugug

SEQ ID NO: 2107138 - RNA, 20 nt, Homo sapiens
auguuguuaugggcaggaug

SEQ ID NO: 2107139 - RNA, 13 nt, Homo sapiens
gggcgaaggccau

SEQ ID NO: 2107140 - RNA, 16 nt, Homo sapiens
acccagaguggcccaa

SEQ ID NO: 2107141 - RNA, 13 nt, Homo sapiens
gcaugaaccacug

SEQ ID NO: 2107142 - RNA, 21 nt, Homo sapiens
aagucucucuauuacacugga

SEQ ID NO: 2107143 - RNA, 13 nt, Homo sapiens
ucaaaacaaucaa

SEQ ID NO: 2107144 - RNA, 17 nt, Homo sapiens
agagaggacacaucucc

SEQ ID NO: 2107145 - RNA, 16 nt, Homo sapiens
aagacccccagcacuu

SEQ ID NO: 2107146 - RNA, 19 nt, Homo sapiens
cuuauguacuugauacuga

SEQ ID NO: 2107147 - RNA, 17 nt, Homo sapiens
augaucaaaaacugccu

SEQ ID NO: 2107148 - RNA, 17 nt, Homo sapiens
ucucugucucagacuuu

SEQ ID NO: 2107149 - RNA, 13 nt, Homo sapiens
uaaaacaagagac

SEQ ID NO: 2107150 - RNA, 17 nt, Homo sapiens
cuuugauauccaugcca

SEQ ID NO: 2107151 - RNA, 14 nt, Homo sapiens
caaggcuucaguga

SEQ ID NO: 2107152 - RNA, 15 nt, Homo sapiens
gagcccccacccggg

SEQ ID NO: 2107153 - RNA, 15 nt, Homo sapiens
uccaguuugcaauua

SEQ ID NO: 2107154 - RNA, 18 nt, Homo sapiens
ucuucacuuaauccauuu

SEQ ID NO: 2107155 - RNA, 18 nt, Homo sapiens
cuauucaaucuuuacaca

SEQ ID NO: 2107156 - RNA, 15 nt, Homo sapiens
ccucagcaacagcca

SEQ ID NO: 2107157 - RNA, 17 nt, Homo sapiens
gucgaugagacuguuua

SEQ ID NO: 2107158 - RNA, 23 nt, Homo sapiens
aauugcacacacucagugcagca

SEQ ID NO: 2107159 - RNA, 16 nt, Homo sapiens
acaaguaaaacugugg

SEQ ID NO: 2107160 - RNA, 17 nt, Homo sapiens
ucaguuccuuugaucuc

SEQ ID NO: 2107161 - RNA, 15 nt, Homo sapiens
ucuagagacaacaaa

SEQ ID NO: 2107162 - RNA, 12 nt, Homo sapiens
gagggccaguga

SEQ ID NO: 2107163 - RNA, 13 nt, Homo sapiens
uucuaauugcuua

SEQ ID NO: 2107164 - RNA, 12 nt, Homo sapiens
uaagcagucuca

SEQ ID NO: 2107165 - RNA, 17 nt, Homo sapiens
agcacauugcccugagg

SEQ ID NO: 2107166 - RNA, 18 nt, Homo sapiens
auccaaauggacuggcca

SEQ ID NO: 2107167 - RNA, 11 nt, Homo sapiens
gcaacugggac

SEQ ID NO: 2107168 - RNA, 15 nt, Homo sapiens
augaccaugcugaua

SEQ ID NO: 2107169 - RNA, 15 nt, Homo sapiens
gaaagaggugaaaga

SEQ ID NO: 2107170 - RNA, 20 nt, Homo sapiens
uuuaaaguauguuauugcau

SEQ ID NO: 2107171 - RNA, 18 nt, Homo sapiens
cucucaagggcaggauua

SEQ ID NO: 2107172 - RNA, 23 nt, Homo sapiens
uugccaacaccacagaaaugggg

SEQ ID NO: 2107173 - RNA, 21 nt, Homo sapiens
uugcaaauaaaggcucuggaa

SEQ ID NO: 2107174 - RNA, 17 nt, Homo sapiens
auauuguaaauacugga

SEQ ID NO: 2107175 - RNA, 21 nt, Homo sapiens
caaaggagacccgccccaggg

SEQ ID NO: 2107176 - RNA, 19 nt, Homo sapiens
ccaaacccagccucuagaa

SEQ ID NO: 2107177 - RNA, 18 nt, Homo sapiens
ccugcagauguucuggua

SEQ ID NO: 2107178 - RNA, 10 nt, Homo sapiens
ucugcuccac

SEQ ID NO: 2107179 - RNA, 15 nt, Homo sapiens
guuucugugcuccaa

SEQ ID NO: 2107180 - RNA, 22 nt, Homo sapiens
uuuugggagaaaacuucucaca

SEQ ID NO: 2107181 - RNA, 21 nt, Homo sapiens
caccuugcuccuccuucugcu

SEQ ID NO: 2107182 - RNA, 14 nt, Homo sapiens
uaaaacugugacau

SEQ ID NO: 2107183 - RNA, 15 nt, Homo sapiens
ggucugaauucugga

SEQ ID NO: 2107184 - RNA, 13 nt, Homo sapiens
gaauggcaauaaa

SEQ ID NO: 2107185 - RNA, 14 nt, Homo sapiens
cugcucccuagcca

SEQ ID NO: 2107186 - RNA, 13 nt, Homo sapiens
ccuagaugcuccu

SEQ ID NO: 2107187 - RNA, 16 nt, Homo sapiens
acccugugcagaaccu

SEQ ID NO: 2107188 - RNA, 16 nt, Homo sapiens
cuuuuauuccuuugaa

SEQ ID NO: 2107189 - RNA, 23 nt, Homo sapiens
ccugcacaugaguggaaauacac

SEQ ID NO: 2107190 - RNA, 16 nt, Homo sapiens
aucccucaguuucuua

SEQ ID NO: 2107191 - RNA, 17 nt, Homo sapiens
ccacugguuucucagaa

SEQ ID NO: 2107192 - RNA, 21 nt, Homo sapiens
acaucuccaugcugucacuug

SEQ ID NO: 2107193 - RNA, 15 nt, Homo sapiens
auacagccugaauaa

SEQ ID NO: 2107194 - RNA, 22 nt, Homo sapiens
aaccucuuugucuacaccauua

SEQ ID NO: 2107195 - RNA, 20 nt, Homo sapiens
caugcugcuuuaauugugaa

SEQ ID NO: 2107196 - RNA, 21 nt, Homo sapiens
uguacaguagauuuuccaaau

SEQ ID NO: 2107197 - RNA, 16 nt, Homo sapiens
ucuccuggacugccuu

SEQ ID NO: 2107198 - RNA, 18 nt, Homo sapiens
uggaauguaaagugcaau

SEQ ID NO: 2107199 - RNA, 13 nt, Homo sapiens
cuugauauuuucc

SEQ ID NO: 2107200 - RNA, 18 nt, Homo sapiens
agcaaugcccugccuugc

SEQ ID NO: 2107201 - RNA, 20 nt, Homo sapiens
uagccacuugcucagccaua

SEQ ID NO: 2107202 - RNA, 12 nt, Homo sapiens
uucuaacuuaag

SEQ ID NO: 2107203 - RNA, 15 nt, Homo sapiens
gcccuaaacacacgc

SEQ ID NO: 2107204 - RNA, 17 nt, Homo sapiens
uuguccugcagugcuca

SEQ ID NO: 2107205 - RNA, 14 nt, Homo sapiens
ucauauuaguauua

SEQ ID NO: 2107206 - RNA, 23 nt, Homo sapiens
cagaaggaucgugucugcugacu

SEQ ID NO: 2107207 - RNA, 20 nt, Homo sapiens
uacugagagaaggugaaaua

SEQ ID NO: 2107208 - RNA, 17 nt, Homo sapiens
gcaagugucugugugca

SEQ ID NO: 2107209 - RNA, 21 nt, Homo sapiens
uaaacuuuugguuuucagaua

SEQ ID NO: 2107210 - RNA, 21 nt, Homo sapiens
ggacccuucuggguccaggga

SEQ ID NO: 2107211 - RNA, 14 nt, Homo sapiens
auaccucccuuaga

SEQ ID NO: 2107212 - RNA, 19 nt, Homo sapiens
agaucuaacaagauagcca

SEQ ID NO: 2107213 - RNA, 18 nt, Homo sapiens
gguggagacaaaugaggu

SEQ ID NO: 2107214 - RNA, 11 nt, Homo sapiens
ggcaauuccuc

SEQ ID NO: 2107215 - RNA, 18 nt, Homo sapiens
gaaggaugccuuaucucu

SEQ ID NO: 2107216 - RNA, 16 nt, Homo sapiens
gcauauaauaagcacu

SEQ ID NO: 2107217 - RNA, 19 nt, Homo sapiens
auuuacuuuuuauuugcaa

SEQ ID NO: 2107218 - RNA, 22 nt, Homo sapiens
cugaugaugucucuuguagaag

SEQ ID NO: 2107219 - RNA, 19 nt, Homo sapiens
agguugcuguugugcagug

SEQ ID NO: 2107220 - RNA, 15 nt, Homo sapiens
gcuucugaagagccu

SEQ ID NO: 2107221 - RNA, 13 nt, Homo sapiens
cgcuccucgggaa

SEQ ID NO: 2107222 - RNA, 14 nt, Homo sapiens
cuuauuccaugacu

SEQ ID NO: 2107223 - RNA, 16 nt, Homo sapiens
aauacucaaaagagag

SEQ ID NO: 2107224 - RNA, 17 nt, Homo sapiens
aggaagaacuugaagug

SEQ ID NO: 2107225 - RNA, 21 nt, Homo sapiens
cuucaauguaguuuuccaucc

SEQ ID NO: 2107226 - RNA, 19 nt, Homo sapiens
aaagccacuguaugauucu

SEQ ID NO: 2107227 - RNA, 19 nt, Homo sapiens
aaugucaauacuuacuucu

SEQ ID NO: 2107228 - RNA, 20 nt, Homo sapiens
cauucagugauuacugucaa

SEQ ID NO: 2107229 - RNA, 21 nt, Homo sapiens
ugaaaauaacugaaccaaauu

SEQ ID NO: 2107230 - RNA, 16 nt, Homo sapiens
uccucggguaccaaua

SEQ ID NO: 2107231 - RNA, 15 nt, Homo sapiens
uguauauauauucuc

SEQ ID NO: 2107232 - RNA, 17 nt, Homo sapiens
gucaccaaaagacacug

SEQ ID NO: 2107233 - RNA, 14 nt, Homo sapiens
cuagucucugaggg

SEQ ID NO: 2107234 - RNA, 20 nt, Homo sapiens
uucaaggaaaaaugcugcuu

SEQ ID NO: 2107235 - RNA, 22 nt, Homo sapiens
gcucccgagcuacucucuugcc

SEQ ID NO: 2107236 - RNA, 14 nt, Homo sapiens
acagcugacagaua

SEQ ID NO: 2107237 - RNA, 18 nt, Homo sapiens
gaccacaggugccuacca

SEQ ID NO: 2107238 - RNA, 17 nt, Homo sapiens
uuaaacaaauguaugau

SEQ ID NO: 2107239 - RNA, 14 nt, Homo sapiens
uaaaacagcugcga

SEQ ID NO: 2107240 - RNA, 16 nt, Homo sapiens
ggagaggagcgggacc

SEQ ID NO: 2107241 - RNA, 20 nt, Homo sapiens
cucuaaagaaaaaugccugu

SEQ ID NO: 2107242 - RNA, 18 nt, Homo sapiens
ggagaguuaaaaugaccu

SEQ ID NO: 2107243 - RNA, 19 nt, Homo sapiens
gaaugccgcugucucugag

SEQ ID NO: 2107244 - RNA, 11 nt, Homo sapiens
uuuaagccagg

SEQ ID NO: 2107245 - RNA, 23 nt, Homo sapiens
ugauagagguucuuuauugcuca

SEQ ID NO: 2107246 - RNA, 21 nt, Homo sapiens
cucacauuuggggcuagacag

SEQ ID NO: 2107247 - RNA, 13 nt, Homo sapiens
agccaggaccugc

SEQ ID NO: 2107248 - RNA, 15 nt, Homo sapiens
aaguguaaauccuuu

SEQ ID NO: 2107249 - RNA, 16 nt, Homo sapiens
gcaugaucacagcuca

SEQ ID NO: 2107250 - RNA, 19 nt, Homo sapiens
guuccaaggcuacuacaga

SEQ ID NO: 2107251 - RNA, 13 nt, Homo sapiens
uacuucuucucau

SEQ ID NO: 2107252 - RNA, 13 nt, Homo sapiens
uucuucuucacau

SEQ ID NO: 2107253 - RNA, 17 nt, Homo sapiens
ccacgaacuugcugggu

SEQ ID NO: 2107254 - RNA, 18 nt, Homo sapiens
uaacagcugucuauguau

SEQ ID NO: 2107255 - RNA, 17 nt, Homo sapiens
guuuuggaagcucugaa

SEQ ID NO: 2107256 - RNA, 16 nt, Homo sapiens
uuauagcgccuguaua

SEQ ID NO: 2107257 - RNA, 13 nt, Homo sapiens
ugaggucugggau

SEQ ID NO: 2107258 - RNA, 15 nt, Homo sapiens
ccugggacaaccaga

SEQ ID NO: 2107259 - RNA, 21 nt, Homo sapiens
uagacaguacucuuaacuccu

SEQ ID NO: 2107260 - RNA, 21 nt, Homo sapiens
cuugucauuggaaacacugcc

SEQ ID NO: 2107261 - RNA, 14 nt, Homo sapiens
ggugagaugcagcu

SEQ ID NO: 2107262 - RNA, 14 nt, Homo sapiens
uaaaccugggcaag

SEQ ID NO: 2107263 - RNA, 13 nt, Homo sapiens
uaaucucucagcu

SEQ ID NO: 2107264 - RNA, 20 nt, Homo sapiens
auaaugaguuuuacauuaca

SEQ ID NO: 2107265 - RNA, 18 nt, Homo sapiens
aacuugaaaccugggcau

SEQ ID NO: 2107266 - RNA, 19 nt, Homo sapiens
uauuuuauaaguaucuuca

SEQ ID NO: 2107267 - RNA, 14 nt, Homo sapiens
cuccucucuggacu

SEQ ID NO: 2107268 - RNA, 20 nt, Homo sapiens
aaucugaacugaccuugaau

SEQ ID NO: 2107269 - RNA, 12 nt, Homo sapiens
auuuuaucucag

SEQ ID NO: 2107270 - RNA, 21 nt, Homo sapiens
cauuuuauuuuuucuugcaaa

SEQ ID NO: 2107271 - RNA, 20 nt, Homo sapiens
gugaaauaaaaguagaauaa

SEQ ID NO: 2107272 - RNA, 19 nt, Homo sapiens
gagacgcugcacuugacac

SEQ ID NO: 2107273 - RNA, 18 nt, Homo sapiens
caccuauaaaacagguca

SEQ ID NO: 2107274 - RNA, 23 nt, Homo sapiens
ucucuucauuauucucugcuaua

SEQ ID NO: 2107275 - RNA, 13 nt, Homo sapiens
ccugagaccaguu

SEQ ID NO: 2107276 - RNA, 15 nt, Homo sapiens
uccccaugucaccac

SEQ ID NO: 2107277 - RNA, 21 nt, Homo sapiens
cuggcccacagcaggugcuga

SEQ ID NO: 2107278 - RNA, 15 nt, Homo sapiens
acccgacauguguac

SEQ ID NO: 2107279 - RNA, 19 nt, Homo sapiens
uagacggacuucauugaaa

SEQ ID NO: 2107280 - RNA, 14 nt, Homo sapiens
aaauauaauuuaca

SEQ ID NO: 2107281 - RNA, 14 nt, Homo sapiens
uaaacaaaauuuau

SEQ ID NO: 2107282 - RNA, 14 nt, Homo sapiens
cuugaggaucauau

SEQ ID NO: 2107283 - RNA, 12 nt, Homo sapiens
cagcauagagcu

SEQ ID NO: 2107284 - RNA, 22 nt, Homo sapiens
uaugaaaaccguaaagugccuu

SEQ ID NO: 2107285 - RNA, 17 nt, Homo sapiens
agcuacuuggcaggcua

SEQ ID NO: 2107286 - RNA, 22 nt, Homo sapiens
gaagcugcugugacuguguccc

SEQ ID NO: 2107287 - RNA, 14 nt, Homo sapiens
augaguuagcuuuc

SEQ ID NO: 2107288 - RNA, 12 nt, Homo sapiens
aaacuaaggauu

SEQ ID NO: 2107289 - RNA, 17 nt, Homo sapiens
agccuugcugaccuccc

SEQ ID NO: 2107290 - RNA, 19 nt, Homo sapiens
acugaauguuuauuccuug

SEQ ID NO: 2107291 - RNA, 15 nt, Homo sapiens
augucuguguauaca

SEQ ID NO: 2107292 - RNA, 20 nt, Homo sapiens
gaaaaugcaccucauuccag

SEQ ID NO: 2107293 - RNA, 17 nt, Homo sapiens
aggugaaugcacaguga

SEQ ID NO: 2107294 - RNA, 20 nt, Homo sapiens
ucaauuuggcaaaacaaaau

SEQ ID NO: 2107295 - RNA, 20 nt, Homo sapiens
ucaggguaagcugcucugag

SEQ ID NO: 2107296 - RNA, 16 nt, Homo sapiens
caauuccuguccuuca

SEQ ID NO: 2107297 - RNA, 17 nt, Homo sapiens
caccgugcagagcugca

SEQ ID NO: 2107298 - RNA, 23 nt, Homo sapiens
gaaacugcuucuagaaacucugg

SEQ ID NO: 2107299 - RNA, 23 nt, Homo sapiens
uccaccuucauuuaacucuuuga

SEQ ID NO: 2107300 - RNA, 12 nt, Homo sapiens
uugaagccaaac

SEQ ID NO: 2107301 - RNA, 22 nt, Homo sapiens
accauuauggcuuugugcuugu

SEQ ID NO: 2107302 - RNA, 16 nt, Homo sapiens
agaagaccccugccca

SEQ ID NO: 2107303 - RNA, 17 nt, Homo sapiens
aucauuucaagacuaga

SEQ ID NO: 2107304 - RNA, 17 nt, Homo sapiens
gcagugagcacugaaac

SEQ ID NO: 2107305 - RNA, 14 nt, Homo sapiens
caccuucuucagcc

SEQ ID NO: 2107306 - RNA, 12 nt, Homo sapiens
ucuccuccgugg

SEQ ID NO: 2107307 - RNA, 16 nt, Homo sapiens
auuuucaaagacuuaa

SEQ ID NO: 2107308 - RNA, 16 nt, Homo sapiens
cuugugggagacagca

SEQ ID NO: 2107309 - RNA, 21 nt, Homo sapiens
aauuuucuucauacuuaaaaa

SEQ ID NO: 2107310 - RNA, 15 nt, Homo sapiens
uggaaagugauguca

SEQ ID NO: 2107311 - RNA, 15 nt, Homo sapiens
caauagcaugcaaaa

SEQ ID NO: 2107312 - RNA, 17 nt, Homo sapiens
caauuccuuacauuuac

SEQ ID NO: 2107313 - RNA, 20 nt, Homo sapiens
gcagagccacccuguguuga

SEQ ID NO: 2107314 - RNA, 17 nt, Homo sapiens
auccccaccuacuccug

SEQ ID NO: 2107315 - RNA, 22 nt, Homo sapiens
uguguaucaaaacuaccuguga

SEQ ID NO: 2107316 - RNA, 23 nt, Homo sapiens
aacuucccacacgauuagcuuua

SEQ ID NO: 2107317 - RNA, 21 nt, Homo sapiens
auaaaggagaaaagugggcug

SEQ ID NO: 2107318 - RNA, 22 nt, Homo sapiens
ggccaccugccugcgucuuccg

SEQ ID NO: 2107319 - RNA, 19 nt, Homo sapiens
aaacccuuuuuauggcuca

SEQ ID NO: 2107320 - RNA, 20 nt, Homo sapiens
acccuaggcaucacaugcuc

SEQ ID NO: 2107321 - RNA, 21 nt, Homo sapiens
caucuggaaaccucuacauau

SEQ ID NO: 2107322 - RNA, 21 nt, Homo sapiens
acugcuuuuccucaagcaaua

SEQ ID NO: 2107323 - RNA, 15 nt, Homo sapiens
uugacugucagcaag

SEQ ID NO: 2107324 - RNA, 23 nt, Homo sapiens
aauaugucugggaaaaagugcac

SEQ ID NO: 2107325 - RNA, 18 nt, Homo sapiens
caaggucauagacaauuc

SEQ ID NO: 2107326 - RNA, 18 nt, Homo sapiens
aggaggaauaaggggaag

SEQ ID NO: 2107327 - RNA, 18 nt, Homo sapiens
cuagaugauugaauaaca

SEQ ID NO: 2107328 - RNA, 15 nt, Homo sapiens
uaaagcuacaacaaa

SEQ ID NO: 2107329 - RNA, 13 nt, Homo sapiens
acucuaucagaac

SEQ ID NO: 2107330 - RNA, 17 nt, Homo sapiens
accccaggaacaauaaa

SEQ ID NO: 2107331 - RNA, 18 nt, Homo sapiens
cuggaugggggucccugu

SEQ ID NO: 2107332 - RNA, 14 nt, Homo sapiens
uaauaauuacuuaa

SEQ ID NO: 2107333 - RNA, 19 nt, Homo sapiens
uauuuguuuuaugcuacug

SEQ ID NO: 2107334 - RNA, 15 nt, Homo sapiens
cuggauacuggacac

SEQ ID NO: 2107335 - RNA, 15 nt, Homo sapiens
cuaaaaccugagcua

SEQ ID NO: 2107336 - RNA, 12 nt, Homo sapiens
agcggcccugag

SEQ ID NO: 2107337 - RNA, 23 nt, Homo sapiens
cacucuauaagauuccaaaaagc

SEQ ID NO: 2107338 - RNA, 20 nt, Homo sapiens
gugcucacccguaggcaaau

SEQ ID NO: 2107339 - RNA, 16 nt, Homo sapiens
caucacuuaaaacacg

SEQ ID NO: 2107340 - RNA, 13 nt, Homo sapiens
uccccucggagaa

SEQ ID NO: 2107341 - RNA, 15 nt, Homo sapiens
ucccaauaaaguccu

SEQ ID NO: 2107342 - RNA, 14 nt, Homo sapiens
gugcuguuuugcca

SEQ ID NO: 2107343 - RNA, 21 nt, Homo sapiens
gcaugucacuucccugcuuaa

SEQ ID NO: 2107344 - RNA, 21 nt, Homo sapiens
ggucauuucuuagauggagaa

SEQ ID NO: 2107345 - RNA, 13 nt, Homo sapiens
ccaccaaauucug

SEQ ID NO: 2107346 - RNA, 16 nt, Homo sapiens
cuugaguuuuccugcu

SEQ ID NO: 2107347 - RNA, 20 nt, Homo sapiens
aguuuaaaaaucaguuuguu

SEQ ID NO: 2107348 - RNA, 12 nt, Homo sapiens
aagcacccuguu

SEQ ID NO: 2107349 - RNA, 20 nt, Homo sapiens
uagaaaaguuauguagaaaa

SEQ ID NO: 2107350 - RNA, 19 nt, Homo sapiens
ccagaggcagcuucuuugc

SEQ ID NO: 2107351 - RNA, 12 nt, Homo sapiens
agagauucugug

SEQ ID NO: 2107352 - RNA, 13 nt, Homo sapiens
gauucaagccauu

SEQ ID NO: 2107353 - RNA, 18 nt, Homo sapiens
uaccuguacuaaaccacc

SEQ ID NO: 2107354 - RNA, 20 nt, Homo sapiens
accuccgccucccagguuca

SEQ ID NO: 2107355 - RNA, 19 nt, Homo sapiens
aacugaacccccucaaaag

SEQ ID NO: 2107356 - RNA, 13 nt, Homo sapiens
cacauucacugac

SEQ ID NO: 2107357 - RNA, 13 nt, Homo sapiens
aguuuacuggaua

SEQ ID NO: 2107358 - RNA, 16 nt, Homo sapiens
auggucauugcaggaa

SEQ ID NO: 2107359 - RNA, 14 nt, Homo sapiens
auucaaggcauuau

SEQ ID NO: 2107360 - RNA, 15 nt, Homo sapiens
gcaggaugaugcugu

SEQ ID NO: 2107361 - RNA, 17 nt, Homo sapiens
ugaaaaaaacauaucca

SEQ ID NO: 2107362 - RNA, 22 nt, Homo sapiens
auuuccaguguucuaugaacaa

SEQ ID NO: 2107363 - RNA, 22 nt, Homo sapiens
gccaguaaacagaggaguacag

SEQ ID NO: 2107364 - RNA, 21 nt, Homo sapiens
uaacugagaugaauguaauuu

SEQ ID NO: 2107365 - RNA, 12 nt, Homo sapiens
uacuauggagug

SEQ ID NO: 2107366 - RNA, 11 nt, Homo sapiens
cagcagugggg

SEQ ID NO: 2107367 - RNA, 15 nt, Homo sapiens
auuuccuucugcuau

SEQ ID NO: 2107368 - RNA, 21 nt, Homo sapiens
uggccaguugcccagagcacu

SEQ ID NO: 2107369 - RNA, 17 nt, Homo sapiens
gagggaagcaccaugaa

SEQ ID NO: 2107370 - RNA, 13 nt, Homo sapiens
ucauguucuugca

SEQ ID NO: 2107371 - RNA, 20 nt, Homo sapiens
aagaggagauuggccaguga

SEQ ID NO: 2107372 - RNA, 12 nt, Homo sapiens
cugcuccagaga

SEQ ID NO: 2107373 - RNA, 15 nt, Homo sapiens
gacaguaaaucucac

SEQ ID NO: 2107374 - RNA, 16 nt, Homo sapiens
cagaccucggcugugu

SEQ ID NO: 2107375 - RNA, 16 nt, Homo sapiens
accccgcggcccagac

SEQ ID NO: 2107376 - RNA, 13 nt, Homo sapiens
ucacucaagcacu

SEQ ID NO: 2107377 - RNA, 20 nt, Homo sapiens
agggugguggugguggugaa

SEQ ID NO: 2107378 - RNA, 12 nt, Homo sapiens
ucuucucauucc

SEQ ID NO: 2107379 - RNA, 14 nt, Homo sapiens
gaggguugugccca

SEQ ID NO: 2107380 - RNA, 14 nt, Homo sapiens
cuuuaaaaugccaa

SEQ ID NO: 2107381 - RNA, 23 nt, Homo sapiens
gagccacugugcccagcaguuuc

SEQ ID NO: 2107382 - RNA, 22 nt, Homo sapiens
gucuccaaauuacagcccagga

SEQ ID NO: 2107383 - RNA, 21 nt, Homo sapiens
aggggcagcgcaugugugcau

SEQ ID NO: 2107384 - RNA, 23 nt, Homo sapiens
aaauguacuuuuucuuccagaaa

SEQ ID NO: 2107385 - RNA, 15 nt, Homo sapiens
cuugauucacaauga

SEQ ID NO: 2107386 - RNA, 18 nt, Homo sapiens
ucaagcuuccugugaugg

SEQ ID NO: 2107387 - RNA, 20 nt, Homo sapiens
gcuuucauaaacuucaggga

SEQ ID NO: 2107388 - RNA, 15 nt, Homo sapiens
uucagugagaaucug

SEQ ID NO: 2107389 - RNA, 22 nt, Homo sapiens
cuagacaccuucugugcucaug

SEQ ID NO: 2107390 - RNA, 17 nt, Homo sapiens
ggcugccaggauggcgu

SEQ ID NO: 2107391 - RNA, 19 nt, Homo sapiens
ugcccaguguuugugcaag

SEQ ID NO: 2107392 - RNA, 21 nt, Homo sapiens
uuucagaagaaaggcauugca

SEQ ID NO: 2107393 - RNA, 16 nt, Homo sapiens
ugaugaaggauucaua

SEQ ID NO: 2107394 - RNA, 14 nt, Homo sapiens
caaauugcuuuaca

SEQ ID NO: 2107395 - RNA, 15 nt, Homo sapiens
uaaaaguauuauuca

SEQ ID NO: 2107396 - RNA, 21 nt, Homo sapiens
gcuguccucucauuugcaguc

SEQ ID NO: 2107397 - RNA, 20 nt, Homo sapiens
guacgaucuuucuggcaaau

SEQ ID NO: 2107398 - RNA, 17 nt, Homo sapiens
ugggauaaggaaacacu

SEQ ID NO: 2107399 - RNA, 13 nt, Homo sapiens
gucucauccuccu

SEQ ID NO: 2107400 - RNA, 17 nt, Homo sapiens
ugcagguuguugucauc

SEQ ID NO: 2107401 - RNA, 17 nt, Homo sapiens
ucuugcugcaccugugc

SEQ ID NO: 2107402 - RNA, 16 nt, Homo sapiens
aauuugaauacugcau

SEQ ID NO: 2107403 - RNA, 18 nt, Homo sapiens
uaauuugugaauuugcaa

SEQ ID NO: 2107404 - RNA, 22 nt, Homo sapiens
cuucauguaacuucccugaaaa

SEQ ID NO: 2107405 - RNA, 18 nt, Homo sapiens
gcccacuucuucucagaa

SEQ ID NO: 2107406 - RNA, 18 nt, Homo sapiens
aggacuggcuuuguccca

SEQ ID NO: 2107407 - RNA, 22 nt, Homo sapiens
auuucugcacaugguucaccau

SEQ ID NO: 2107408 - RNA, 15 nt, Homo sapiens
cuuauuuauauauca

SEQ ID NO: 2107409 - RNA, 23 nt, Homo sapiens
cccuucuauacuuucucacaugu

SEQ ID NO: 2107410 - RNA, 16 nt, Homo sapiens
uggaagaggaacagca

SEQ ID NO: 2107411 - RNA, 17 nt, Homo sapiens
ucaacaaagaucauuua

SEQ ID NO: 2107412 - RNA, 23 nt, Homo sapiens
aaacauuaacucuaacugugaca

SEQ ID NO: 2107413 - RNA, 17 nt, Homo sapiens
cagccuggccaacaugg

SEQ ID NO: 2107414 - RNA, 21 nt, Homo sapiens
uccuauccccggacgcaugca

SEQ ID NO: 2107415 - RNA, 21 nt, Homo sapiens
uacuaccccaggaugcaugca

SEQ ID NO: 2107416 - RNA, 14 nt, Homo sapiens
uauuuagucugcau

SEQ ID NO: 2107417 - RNA, 19 nt, Homo sapiens
guugucacaucucagggaa

SEQ ID NO: 2107418 - RNA, 14 nt, Homo sapiens
gcgcgacugagaac

SEQ ID NO: 2107419 - RNA, 13 nt, Homo sapiens
agcaaguuucacc

SEQ ID NO: 2107420 - RNA, 15 nt, Homo sapiens
ccucaaacaggaugg

SEQ ID NO: 2107421 - RNA, 18 nt, Homo sapiens
cuguaccacaaugcgcau

SEQ ID NO: 2107422 - RNA, 13 nt, Homo sapiens
ucacugcauuugc

SEQ ID NO: 2107423 - RNA, 18 nt, Homo sapiens
aauaucuaaacaucuuug

SEQ ID NO: 2107424 - RNA, 23 nt, Homo sapiens
ugguacccaggcuuuagcauuau

SEQ ID NO: 2107425 - RNA, 22 nt, Homo sapiens
ggcagcggguggcauccaggcu

SEQ ID NO: 2107426 - RNA, 21 nt, Homo sapiens
augccugagagacauggcuuu

SEQ ID NO: 2107427 - RNA, 22 nt, Homo sapiens
ugucuuuucuuggcaaaagccu

SEQ ID NO: 2107428 - RNA, 16 nt, Homo sapiens
acaguuccauucaacu

SEQ ID NO: 2107429 - RNA, 20 nt, Homo sapiens
gugcugcucucccaucuccc

SEQ ID NO: 2107430 - RNA, 12 nt, Homo sapiens
uucacuggagac

SEQ ID NO: 2107431 - RNA, 18 nt, Homo sapiens
cgacuccacgcuguccuu

SEQ ID NO: 2107432 - RNA, 17 nt, Homo sapiens
gccugccaugggccagc

SEQ ID NO: 2107433 - RNA, 16 nt, Homo sapiens
uaaaauccuacaguga

SEQ ID NO: 2107434 - RNA, 21 nt, Homo sapiens
gcagugggguugggaccucag

SEQ ID NO: 2107435 - RNA, 20 nt, Homo sapiens
aauaagucaucugaugagaa

SEQ ID NO: 2107436 - RNA, 16 nt, Homo sapiens
uccaugagacacaucu

SEQ ID NO: 2107437 - RNA, 13 nt, Homo sapiens
caccggugccaaa

SEQ ID NO: 2107438 - RNA, 14 nt, Homo sapiens
ccuggagagcuccu

SEQ ID NO: 2107439 - RNA, 16 nt, Homo sapiens
gcaccacugcuuccca

SEQ ID NO: 2107440 - RNA, 14 nt, Homo sapiens
gaugucacugccug

SEQ ID NO: 2107441 - RNA, 15 nt, Homo sapiens
auaucuucaguuuaa

SEQ ID NO: 2107442 - RNA, 10 nt, Homo sapiens
cacagcacug

SEQ ID NO: 2107443 - RNA, 16 nt, Homo sapiens
gaacacucagcugcuu

SEQ ID NO: 2107444 - RNA, 18 nt, Homo sapiens
ugcacuuaucuuuuggag

SEQ ID NO: 2107445 - RNA, 18 nt, Homo sapiens
uuggcuuguuuggagcau

SEQ ID NO: 2107446 - RNA, 14 nt, Homo sapiens
ucauuuuugugcac

SEQ ID NO: 2107447 - RNA, 16 nt, Homo sapiens
ucaaaaaacaagucuu

SEQ ID NO: 2107448 - RNA, 14 nt, Homo sapiens
uagagcacacugua

SEQ ID NO: 2107449 - RNA, 20 nt, Homo sapiens
cguggucuccuugcacuuuc

SEQ ID NO: 2107450 - RNA, 13 nt, Homo sapiens
ugaugauccauua

SEQ ID NO: 2107451 - RNA, 18 nt, Homo sapiens
ggagaaggacaugagauc

SEQ ID NO: 2107452 - RNA, 14 nt, Homo sapiens
gauauuagguccca

SEQ ID NO: 2107453 - RNA, 14 nt, Homo sapiens
uagucacauaucaa

SEQ ID NO: 2107454 - RNA, 12 nt, Homo sapiens
aggauaaauauc

SEQ ID NO: 2107455 - RNA, 13 nt, Homo sapiens
cuuaggagcaaaa

SEQ ID NO: 2107456 - RNA, 13 nt, Homo sapiens
ucugccugagauu

SEQ ID NO: 2107457 - RNA, 14 nt, Homo sapiens
cugacuucaggggc

SEQ ID NO: 2107458 - RNA, 16 nt, Homo sapiens
gauauuuuaaauaucc

SEQ ID NO: 2107459 - RNA, 13 nt, Homo sapiens
augugcacuucaa

SEQ ID NO: 2107460 - RNA, 21 nt, Homo sapiens
ucagaguuucgucagugaaca

SEQ ID NO: 2107461 - RNA, 18 nt, Homo sapiens
auucauuuauucauucau

SEQ ID NO: 2107462 - RNA, 15 nt, Homo sapiens
ucaaaccuguagaug

SEQ ID NO: 2107463 - RNA, 21 nt, Homo sapiens
uugcuucuagagcuuagcaua

SEQ ID NO: 2107464 - RNA, 15 nt, Homo sapiens
agugacauguuuaca

SEQ ID NO: 2107465 - RNA, 18 nt, Homo sapiens
cugugcuucucuuugucc

SEQ ID NO: 2107466 - RNA, 17 nt, Homo sapiens
uuuccaauuuuguugca

SEQ ID NO: 2107467 - RNA, 22 nt, Homo sapiens
uaacuuuugaugacuucaguga

SEQ ID NO: 2107468 - RNA, 21 nt, Homo sapiens
augacuuuugaauuacagaga

SEQ ID NO: 2107469 - RNA, 21 nt, Homo sapiens
agcacccuucucggagaccca

SEQ ID NO: 2107470 - RNA, 18 nt, Homo sapiens
uguaaugucagacuuugc

SEQ ID NO: 2107471 - RNA, 22 nt, Homo sapiens
guccuagacuucccagggcaag

SEQ ID NO: 2107472 - RNA, 14 nt, Homo sapiens
ucacuuccauagug

SEQ ID NO: 2107473 - RNA, 18 nt, Homo sapiens
uaugugagaaaucagaau

SEQ ID NO: 2107474 - RNA, 20 nt, Homo sapiens
aagguuucauguucacugug

SEQ ID NO: 2107475 - RNA, 20 nt, Homo sapiens
caaugucagaaacucgauga

SEQ ID NO: 2107476 - RNA, 16 nt, Homo sapiens
gccugaacauccuucc

SEQ ID NO: 2107477 - RNA, 19 nt, Homo sapiens
ggcuuccucuagaagccaa

SEQ ID NO: 2107478 - RNA, 18 nt, Homo sapiens
cucaaaugcuacucagua

SEQ ID NO: 2107479 - RNA, 23 nt, Homo sapiens
gggcucccggagagggagucagu

SEQ ID NO: 2107480 - RNA, 16 nt, Homo sapiens
ugucccaggacucacc

SEQ ID NO: 2107481 - RNA, 14 nt, Homo sapiens
cacacgcgugcaca

SEQ ID NO: 2107482 - RNA, 14 nt, Homo sapiens
uacuucacuucaaa

SEQ ID NO: 2107483 - RNA, 20 nt, Homo sapiens
cagaaagugcauuaaacuga

SEQ ID NO: 2107484 - RNA, 15 nt, Homo sapiens
cugagugcugggcac

SEQ ID NO: 2107485 - RNA, 20 nt, Homo sapiens
uguuugcuggguauuagcca

SEQ ID NO: 2107486 - RNA, 13 nt, Homo sapiens
aggcaaugggagc

SEQ ID NO: 2107487 - RNA, 17 nt, Homo sapiens
uuauuugcacacugcac

SEQ ID NO: 2107488 - RNA, 17 nt, Homo sapiens
cuguggcuagugacaaa

SEQ ID NO: 2107489 - RNA, 12 nt, Homo sapiens
aaauaacuagua

SEQ ID NO: 2107490 - RNA, 20 nt, Homo sapiens
uggacccuggaccauuccag

SEQ ID NO: 2107491 - RNA, 20 nt, Homo sapiens
cgagcuaauuaacuaacuca

SEQ ID NO: 2107492 - RNA, 18 nt, Homo sapiens
aauucggauguaugaucu

SEQ ID NO: 2107493 - RNA, 15 nt, Homo sapiens
ccgccucagccuccc

SEQ ID NO: 2107494 - RNA, 22 nt, Homo sapiens
aaguuuagaugcuuugugacuu

SEQ ID NO: 2107495 - RNA, 16 nt, Homo sapiens
gaaaacacugugcaca

SEQ ID NO: 2107496 - RNA, 21 nt, Homo sapiens
uaaaucugcagcacauugaua

SEQ ID NO: 2107497 - RNA, 20 nt, Homo sapiens
ucuaaagccuuaagucuuaa

SEQ ID NO: 2107498 - RNA, 16 nt, Homo sapiens
uuaaaaagcacagggg

SEQ ID NO: 2107499 - RNA, 20 nt, Homo sapiens
cagcccccaccccagcacag

SEQ ID NO: 2107500 - RNA, 19 nt, Homo sapiens
uagauuuuuuuauuugaug

SEQ ID NO: 2107501 - RNA, 21 nt, Homo sapiens
ucccaaucaaagaauuacagu

SEQ ID NO: 2107502 - RNA, 19 nt, Homo sapiens
uaguugcguggacucugca

SEQ ID NO: 2107503 - RNA, 19 nt, Homo sapiens
uucaucugaaacccacaga

SEQ ID NO: 2107504 - RNA, 15 nt, Homo sapiens
ugcacgccaccacac

SEQ ID NO: 2107505 - RNA, 17 nt, Homo sapiens
uggccuccucuucuaug

SEQ ID NO: 2107506 - RNA, 20 nt, Homo sapiens
acguguguguguuucaucug

SEQ ID NO: 2107507 - RNA, 21 nt, Homo sapiens
cuguuccacacccaaugcugc

SEQ ID NO: 2107508 - RNA, 13 nt, Homo sapiens
guucucaugacuc

SEQ ID NO: 2107509 - RNA, 21 nt, Homo sapiens
cacuccacuuuguauagacau

SEQ ID NO: 2107510 - RNA, 11 nt, Homo sapiens
ucagacuauga

SEQ ID NO: 2107511 - RNA, 12 nt, Homo sapiens
uauuaugaagga

SEQ ID NO: 2107512 - RNA, 22 nt, Homo sapiens
gggagaccaagaacagguugaa

SEQ ID NO: 2107513 - RNA, 14 nt, Homo sapiens
cuguauuucauucu

SEQ ID NO: 2107514 - RNA, 21 nt, Homo sapiens
guagaguuuuuaaaaagugaa

SEQ ID NO: 2107515 - RNA, 18 nt, Homo sapiens
aguuuaugcagugcugcu

SEQ ID NO: 2107516 - RNA, 21 nt, Homo sapiens
gacagugcccagagugacagc

SEQ ID NO: 2107517 - RNA, 21 nt, Homo sapiens
uucaccauccagagaccaaau

SEQ ID NO: 2107518 - RNA, 17 nt, Homo sapiens
acuguuauuaacagaua

SEQ ID NO: 2107519 - RNA, 16 nt, Homo sapiens
ugcuucuucaauggca

SEQ ID NO: 2107520 - RNA, 20 nt, Homo sapiens
uggucagaaccuuuggacaa

SEQ ID NO: 2107521 - RNA, 17 nt, Homo sapiens
gcgguaccuguguuucc

SEQ ID NO: 2107522 - RNA, 22 nt, Homo sapiens
uccccgccuccucccacuggga

SEQ ID NO: 2107523 - RNA, 16 nt, Homo sapiens
aggguaugaaagugcc

SEQ ID NO: 2107524 - RNA, 15 nt, Homo sapiens
acagggcaccugcca

SEQ ID NO: 2107525 - RNA, 17 nt, Homo sapiens
accuccuggugguacca

SEQ ID NO: 2107526 - RNA, 22 nt, Homo sapiens
cuggccuauuuuggacguguga

SEQ ID NO: 2107527 - RNA, 21 nt, Homo sapiens
auauuaaauuuauaucuuaua

SEQ ID NO: 2107528 - RNA, 21 nt, Homo sapiens
aaacagggcaccccagcugac

SEQ ID NO: 2107529 - RNA, 19 nt, Homo sapiens
uauuaagguaacuacugcu

SEQ ID NO: 2107530 - RNA, 22 nt, Homo sapiens
aacuugccuuucaguauugaca

SEQ ID NO: 2107531 - RNA, 17 nt, Homo sapiens
aaugucagugugacuga

SEQ ID NO: 2107532 - RNA, 18 nt, Homo sapiens
caggaauccccaacaugc

SEQ ID NO: 2107533 - RNA, 21 nt, Homo sapiens
auacaacuguaaagcaaauau

SEQ ID NO: 2107534 - RNA, 21 nt, Homo sapiens
uaccaucuucuguaccaaaaa

SEQ ID NO: 2107535 - RNA, 17 nt, Homo sapiens
agcccugacuauuuaca

SEQ ID NO: 2107536 - RNA, 15 nt, Homo sapiens
gaauuauucagugaa

SEQ ID NO: 2107537 - RNA, 12 nt, Homo sapiens
agugcagacuca

SEQ ID NO: 2107538 - RNA, 12 nt, Homo sapiens
uacacagacuau

SEQ ID NO: 2107539 - RNA, 16 nt, Homo sapiens
uucuaguuugcauucc

SEQ ID NO: 2107540 - RNA, 15 nt, Homo sapiens
cccucaguuucccua

SEQ ID NO: 2107541 - RNA, 15 nt, Homo sapiens
ccuucuguuuuccaa

SEQ ID NO: 2107542 - RNA, 12 nt, Homo sapiens
aguaugugcuac

SEQ ID NO: 2107543 - RNA, 21 nt, Homo sapiens
ucaguaauacaauacaguacu

SEQ ID NO: 2107544 - RNA, 22 nt, Homo sapiens
cugaaaggauguggaagagcau

SEQ ID NO: 2107545 - RNA, 21 nt, Homo sapiens
agacuguaggaagaguagcau

SEQ ID NO: 2107546 - RNA, 14 nt, Homo sapiens
uccucacuaccugc

SEQ ID NO: 2107547 - RNA, 12 nt, Homo sapiens
caacaguuucca

SEQ ID NO: 2107548 - RNA, 18 nt, Homo sapiens
cacagccccuugcuucua

SEQ ID NO: 2107549 - RNA, 18 nt, Homo sapiens
gccaggauggacuccauc

SEQ ID NO: 2107550 - RNA, 23 nt, Homo sapiens
uacuuauuuucuggaucuaucug

SEQ ID NO: 2107551 - RNA, 21 nt, Homo sapiens
cggggaccccagaaaggucag

SEQ ID NO: 2107552 - RNA, 11 nt, Homo sapiens
aucagagccuu

SEQ ID NO: 2107553 - RNA, 16 nt, Homo sapiens
uugacauacucaggau

SEQ ID NO: 2107554 - RNA, 15 nt, Homo sapiens
agaagacugucagga

SEQ ID NO: 2107555 - RNA, 21 nt, Homo sapiens
uuaacaucucuuucucauuag

SEQ ID NO: 2107556 - RNA, 17 nt, Homo sapiens
cugcacuuauacccaug

SEQ ID NO: 2107557 - RNA, 13 nt, Homo sapiens
uaccuucucccca

SEQ ID NO: 2107558 - RNA, 13 nt, Homo sapiens
gaggaacagggaa

SEQ ID NO: 2107559 - RNA, 14 nt, Homo sapiens
uuguugagugcacu

SEQ ID NO: 2107560 - RNA, 21 nt, Homo sapiens
ggauuagccgucccagugaaa

SEQ ID NO: 2107561 - RNA, 20 nt, Homo sapiens
augaaaaccguaaagugccu

SEQ ID NO: 2107562 - RNA, 15 nt, Homo sapiens
acaggagaugcugug

SEQ ID NO: 2107563 - RNA, 10 nt, Homo sapiens
ccauuugcca

SEQ ID NO: 2107564 - RNA, 18 nt, Homo sapiens
ucacaugcauacauacac

SEQ ID NO: 2107565 - RNA, 15 nt, Homo sapiens
cugaaaguucuugcu

SEQ ID NO: 2107566 - RNA, 19 nt, Homo sapiens
agaauugaaugucaauaug

SEQ ID NO: 2107567 - RNA, 15 nt, Homo sapiens
ccaacgaagugccag

SEQ ID NO: 2107568 - RNA, 21 nt, Homo sapiens
uggggcuggaugucuccaucu

SEQ ID NO: 2107569 - RNA, 20 nt, Homo sapiens
gguuuuuaugauagugcaag

SEQ ID NO: 2107570 - RNA, 23 nt, Homo sapiens
uucccagcuagaauucacuccac

SEQ ID NO: 2107571 - RNA, 17 nt, Homo sapiens
uuaacaauaacuacugu

SEQ ID NO: 2107572 - RNA, 15 nt, Homo sapiens
ccggcugacaccugg

SEQ ID NO: 2107573 - RNA, 20 nt, Homo sapiens
cagucuauauguuuguauaa

SEQ ID NO: 2107574 - RNA, 18 nt, Homo sapiens
gagucuugcucuguuacc

SEQ ID NO: 2107575 - RNA, 19 nt, Homo sapiens
ggcgagccaggaccacaga

SEQ ID NO: 2107576 - RNA, 18 nt, Homo sapiens
cuacaguaaccaaaacag

SEQ ID NO: 2107577 - RNA, 14 nt, Homo sapiens
aguuuuucugucaa

SEQ ID NO: 2107578 - RNA, 22 nt, Homo sapiens
aggaggggccgcugccacccac

SEQ ID NO: 2107579 - RNA, 13 nt, Homo sapiens
acguuaugaugac

SEQ ID NO: 2107580 - RNA, 13 nt, Homo sapiens
uguacacugugua

SEQ ID NO: 2107581 - RNA, 19 nt, Homo sapiens
ggcaggggugcuguggaca

SEQ ID NO: 2107582 - RNA, 13 nt, Homo sapiens
cagcgcauguguc

SEQ ID NO: 2107583 - RNA, 21 nt, Homo sapiens
uguccuguacauugugggaug

SEQ ID NO: 2107584 - RNA, 14 nt, Homo sapiens
ugugacugucacuu

SEQ ID NO: 2107585 - RNA, 15 nt, Homo sapiens
gcccaagcaugcccc

SEQ ID NO: 2107586 - RNA, 20 nt, Homo sapiens
ccagccccuccccagacucu

SEQ ID NO: 2107587 - RNA, 19 nt, Homo sapiens
gagcuaggaagagucuacc

SEQ ID NO: 2107588 - RNA, 19 nt, Homo sapiens
cacuggcgcagacuucaca

SEQ ID NO: 2107589 - RNA, 16 nt, Homo sapiens
uccuugaccugcauug

SEQ ID NO: 2107590 - RNA, 13 nt, Homo sapiens
aaacccucaaggg

SEQ ID NO: 2107591 - RNA, 21 nt, Homo sapiens
ucuucagccucauucacuguc

SEQ ID NO: 2107592 - RNA, 16 nt, Homo sapiens
ggccacacuggucaca

SEQ ID NO: 2107593 - RNA, 18 nt, Homo sapiens
caagaagguggaaggcag

SEQ ID NO: 2107594 - RNA, 16 nt, Homo sapiens
gccuaaaucuccagug

SEQ ID NO: 2107595 - RNA, 20 nt, Homo sapiens
cuaugucacccaaugcauau

SEQ ID NO: 2107596 - RNA, 19 nt, Homo sapiens
uuugucagaaaagagccac

SEQ ID NO: 2107597 - RNA, 12 nt, Homo sapiens
auucaacuaccu

SEQ ID NO: 2107598 - RNA, 21 nt, Homo sapiens
gugcaacgcuuuuugggagaa

SEQ ID NO: 2107599 - RNA, 15 nt, Homo sapiens
accagaacaguauga

SEQ ID NO: 2107600 - RNA, 15 nt, Homo sapiens
uaaguaaaccaaaaa

SEQ ID NO: 2107601 - RNA, 21 nt, Homo sapiens
caaaagcccaauguaaugcau

SEQ ID NO: 2107602 - RNA, 22 nt, Homo sapiens
gucucuacccaguagaugccac

SEQ ID NO: 2107603 - RNA, 20 nt, Homo sapiens
cuuccagaugaggcccaaaa

SEQ ID NO: 2107604 - RNA, 23 nt, Homo sapiens
uaccgaaguaaacugauguacug

SEQ ID NO: 2107605 - RNA, 22 nt, Homo sapiens
cucaugaacuaccccacaacac

SEQ ID NO: 2107606 - RNA, 20 nt, Homo sapiens
cauguaaauauuuuguuauc

SEQ ID NO: 2107607 - RNA, 23 nt, Homo sapiens
ugagaggcugucuguuguauuca

SEQ ID NO: 2107608 - RNA, 20 nt, Homo sapiens
caaugacaauggugcccgaa

SEQ ID NO: 2107609 - RNA, 21 nt, Homo sapiens
cuccagagggccuucccugac

SEQ ID NO: 2107610 - RNA, 14 nt, Homo sapiens
gcuauuacugucca

SEQ ID NO: 2107611 - RNA, 19 nt, Homo sapiens
uaccccagguucuagucau

SEQ ID NO: 2107612 - RNA, 15 nt, Homo sapiens
auuuucuucaccucu

SEQ ID NO: 2107613 - RNA, 11 nt, Homo sapiens
aguacccaggg

SEQ ID NO: 2107614 - RNA, 11 nt, Homo sapiens
aggacccaggu

SEQ ID NO: 2107615 - RNA, 18 nt, Homo sapiens
auguaaaucugcucagga

SEQ ID NO: 2107616 - RNA, 15 nt, Homo sapiens
uaaauuggcuaauca

SEQ ID NO: 2107617 - RNA, 22 nt, Homo sapiens
ugcccucacugccucuuugcag

SEQ ID NO: 2107618 - RNA, 15 nt, Homo sapiens
gaccgugaccaucuu

SEQ ID NO: 2107619 - RNA, 17 nt, Homo sapiens
cugaguuguuaccccaa

SEQ ID NO: 2107620 - RNA, 16 nt, Homo sapiens
ugggaagccgugcucg

SEQ ID NO: 2107621 - RNA, 16 nt, Homo sapiens
ccaauuugcaccaguu

SEQ ID NO: 2107622 - RNA, 13 nt, Homo sapiens
cacaaauuaucuu

SEQ ID NO: 2107623 - RNA, 15 nt, Homo sapiens
gguauauccuugcga

SEQ ID NO: 2107624 - RNA, 17 nt, Homo sapiens
acacaaguggccuuaag

SEQ ID NO: 2107625 - RNA, 13 nt, Homo sapiens
uaguuugcccaga

SEQ ID NO: 2107626 - RNA, 14 nt, Homo sapiens
ccaggcaggcauuu

SEQ ID NO: 2107627 - RNA, 16 nt, Homo sapiens
cauauauacauacgca

SEQ ID NO: 2107628 - RNA, 16 nt, Homo sapiens
ucaccucugaggacag

SEQ ID NO: 2107629 - RNA, 18 nt, Homo sapiens
uggaaaagaggggcugga

SEQ ID NO: 2107630 - RNA, 15 nt, Homo sapiens
uaaaauaacuaagca

SEQ ID NO: 2107631 - RNA, 22 nt, Homo sapiens
cucuaagugggcauugccaugu

SEQ ID NO: 2107632 - RNA, 23 nt, Homo sapiens
guuuguuuauuauaaacaaaaag

SEQ ID NO: 2107633 - RNA, 18 nt, Homo sapiens
aggagcuuuggaccuaau

SEQ ID NO: 2107634 - RNA, 13 nt, Homo sapiens
ucaauauuuacua

SEQ ID NO: 2107635 - RNA, 20 nt, Homo sapiens
ugacgcgagaggcucugagg

SEQ ID NO: 2107636 - RNA, 19 nt, Homo sapiens
gagacuuuaaaagcauuuu

SEQ ID NO: 2107637 - RNA, 17 nt, Homo sapiens
acggacacucaaaagcu

SEQ ID NO: 2107638 - RNA, 17 nt, Homo sapiens
ugaaucagacccuaccc

SEQ ID NO: 2107639 - RNA, 20 nt, Homo sapiens
caaaguaccacacugaguuc

SEQ ID NO: 2107640 - RNA, 20 nt, Homo sapiens
gaggaaaaauauuccuguga

SEQ ID NO: 2107641 - RNA, 21 nt, Homo sapiens
ggcuucagguuagugacauuu

SEQ ID NO: 2107642 - RNA, 19 nt, Homo sapiens
auuuuuuuaccaauuccaa

SEQ ID NO: 2107643 - RNA, 14 nt, Homo sapiens
uuuucagacuuuaa

SEQ ID NO: 2107644 - RNA, 21 nt, Homo sapiens
ggagcccugaggaccucucag

SEQ ID NO: 2107645 - RNA, 14 nt, Homo sapiens
uccucuugauuccu

SEQ ID NO: 2107646 - RNA, 21 nt, Homo sapiens
cuacauccuaagguucuugcu

SEQ ID NO: 2107647 - RNA, 16 nt, Homo sapiens
uacuuguauguagcag

SEQ ID NO: 2107648 - RNA, 12 nt, Homo sapiens
guugugcucagg

SEQ ID NO: 2107649 - RNA, 15 nt, Homo sapiens
ucuaauuggcaugaa

SEQ ID NO: 2107650 - RNA, 11 nt, Homo sapiens
agcauggagcu

SEQ ID NO: 2107651 - RNA, 17 nt, Homo sapiens
uggcuggcugggucccc

SEQ ID NO: 2107652 - RNA, 21 nt, Homo sapiens
caccaauauuucucagacauc

SEQ ID NO: 2107653 - RNA, 22 nt, Homo sapiens
uaacuacaaggacaaugccuug

SEQ ID NO: 2107654 - RNA, 20 nt, Homo sapiens
aaaauccaugggcaguauga

SEQ ID NO: 2107655 - RNA, 15 nt, Homo sapiens
agaagagaauuccuu

SEQ ID NO: 2107656 - RNA, 12 nt, Homo sapiens
ugaaauaaagca

SEQ ID NO: 2107657 - RNA, 20 nt, Homo sapiens
ucuaguggguugaccuuuaa

SEQ ID NO: 2107658 - RNA, 15 nt, Homo sapiens
gaguauuugaaguca

SEQ ID NO: 2107659 - RNA, 18 nt, Homo sapiens
ucaacuuacuuaaaaauc

SEQ ID NO: 2107660 - RNA, 11 nt, Homo sapiens
cuuucuugucu

SEQ ID NO: 2107661 - RNA, 18 nt, Homo sapiens
ccagguagaaacuuuuau

SEQ ID NO: 2107662 - RNA, 17 nt, Homo sapiens
aauccauccugcucuuc

SEQ ID NO: 2107663 - RNA, 22 nt, Homo sapiens
ccagaaugcugcaggacuugag

SEQ ID NO: 2107664 - RNA, 13 nt, Homo sapiens
aaggguacugaaa

SEQ ID NO: 2107665 - RNA, 17 nt, Homo sapiens
uaugaauuuuacuugca

SEQ ID NO: 2107666 - RNA, 13 nt, Homo sapiens
aaccucaaaguga

SEQ ID NO: 2107667 - RNA, 23 nt, Homo sapiens
cagugacuucacacacaccucau

SEQ ID NO: 2107668 - RNA, 21 nt, Homo sapiens
ccugcuuuggucuugccccau

SEQ ID NO: 2107669 - RNA, 18 nt, Homo sapiens
cuaggccucaauuguucc

SEQ ID NO: 2107670 - RNA, 18 nt, Homo sapiens
uucccuccucccauguca

SEQ ID NO: 2107671 - RNA, 22 nt, Homo sapiens
uauuaucuaccuguucuguagc

SEQ ID NO: 2107672 - RNA, 22 nt, Homo sapiens
accuuuguauucucuccuguac

SEQ ID NO: 2107673 - RNA, 18 nt, Homo sapiens
accugaaauuaacucaga

SEQ ID NO: 2107674 - RNA, 19 nt, Homo sapiens
caugaugugcaaccagcau

SEQ ID NO: 2107675 - RNA, 23 nt, Homo sapiens
uccuguuggacacccagugccag

SEQ ID NO: 2107676 - RNA, 16 nt, Homo sapiens
cauaccauucccaugg

SEQ ID NO: 2107677 - RNA, 17 nt, Homo sapiens
ccuuguccucagggcua

SEQ ID NO: 2107678 - RNA, 17 nt, Homo sapiens
cucuaacuccugccauu

SEQ ID NO: 2107679 - RNA, 16 nt, Homo sapiens
ccuggaugacauuaaa

SEQ ID NO: 2107680 - RNA, 17 nt, Homo sapiens
ggacuuuuauuuuggca

SEQ ID NO: 2107681 - RNA, 15 nt, Homo sapiens
gccugggacccagcu

SEQ ID NO: 2107682 - RNA, 20 nt, Homo sapiens
accuuggccucccaaagugu

SEQ ID NO: 2107683 - RNA, 12 nt, Homo sapiens
guuauaaugugu

SEQ ID NO: 2107684 - RNA, 11 nt, Homo sapiens
guauguuaaag

SEQ ID NO: 2107685 - RNA, 20 nt, Homo sapiens
gccaacaaagaacacuaacu

SEQ ID NO: 2107686 - RNA, 16 nt, Homo sapiens
gaaaauccccauugaa

SEQ ID NO: 2107687 - RNA, 12 nt, Homo sapiens
acuuuaccaugc

SEQ ID NO: 2107688 - RNA, 19 nt, Homo sapiens
cuuuuguucagggcuguga

SEQ ID NO: 2107689 - RNA, 19 nt, Homo sapiens
ucuuuuucuggacucugga

SEQ ID NO: 2107690 - RNA, 23 nt, Homo sapiens
guuaagucccauucaguggcaac

SEQ ID NO: 2107691 - RNA, 19 nt, Homo sapiens
auuaccuaguagucauuuc

SEQ ID NO: 2107692 - RNA, 15 nt, Homo sapiens
gagcugacacaggau

SEQ ID NO: 2107693 - RNA, 20 nt, Homo sapiens
auucccaccauucuaccuga

SEQ ID NO: 2107694 - RNA, 19 nt, Homo sapiens
cugggauuacaggugugca

SEQ ID NO: 2107695 - RNA, 14 nt, Homo sapiens
cuguuggaugacuu

SEQ ID NO: 2107696 - RNA, 16 nt, Homo sapiens
uuagcaaaucaguaua

SEQ ID NO: 2107697 - RNA, 21 nt, Homo sapiens
gaagaugggaaaaccauggua

SEQ ID NO: 2107698 - RNA, 15 nt, Homo sapiens
cacuuacauuuacaa

SEQ ID NO: 2107699 - RNA, 13 nt, Homo sapiens
gcuaccccuuuga

SEQ ID NO: 2107700 - RNA, 13 nt, Homo sapiens
gcccacuggagac

SEQ ID NO: 2107701 - RNA, 17 nt, Homo sapiens
cucagaauaacuaccuc

SEQ ID NO: 2107702 - RNA, 17 nt, Homo sapiens
auauugcugauggugca

SEQ ID NO: 2107703 - RNA, 18 nt, Homo sapiens
agagccccacccucagau

SEQ ID NO: 2107704 - RNA, 21 nt, Homo sapiens
aaaucauauccuaugacccag

SEQ ID NO: 2107705 - RNA, 19 nt, Homo sapiens
ccauguaaucugacgucau

SEQ ID NO: 2107706 - RNA, 12 nt, Homo sapiens
cagaaugagaug

SEQ ID NO: 2107707 - RNA, 16 nt, Homo sapiens
accugcuuccuuccag

SEQ ID NO: 2107708 - RNA, 13 nt, Homo sapiens
aaacccccagugu

SEQ ID NO: 2107709 - RNA, 15 nt, Homo sapiens
cuucucaucugcaaa

SEQ ID NO: 2107710 - RNA, 17 nt, Homo sapiens
gccuggcuucaccgcau

SEQ ID NO: 2107711 - RNA, 12 nt, Homo sapiens
aguaaucuugca

SEQ ID NO: 2107712 - RNA, 20 nt, Homo sapiens
auaaaugcacaaaaucugua

SEQ ID NO: 2107713 - RNA, 14 nt, Homo sapiens
gauguccaaacugu

SEQ ID NO: 2107714 - RNA, 15 nt, Homo sapiens
agccugggguguccu

SEQ ID NO: 2107715 - RNA, 19 nt, Homo sapiens
cucccuucacagggguaca

SEQ ID NO: 2107716 - RNA, 15 nt, Homo sapiens
cacuaaccuaugagg

SEQ ID NO: 2107717 - RNA, 13 nt, Homo sapiens
ucuucagucucac

SEQ ID NO: 2107718 - RNA, 19 nt, Homo sapiens
cuccaggcacccccaggau

SEQ ID NO: 2107719 - RNA, 22 nt, Homo sapiens
gcaaggugggggucaggcuaca

SEQ ID NO: 2107720 - RNA, 20 nt, Homo sapiens
gcccuuggccagaagucaag

SEQ ID NO: 2107721 - RNA, 13 nt, Homo sapiens
uuugagcuucuag

SEQ ID NO: 2107722 - RNA, 12 nt, Homo sapiens
gaaagauuugua

SEQ ID NO: 2107723 - RNA, 19 nt, Homo sapiens
auucacuuuuauuuagcac

SEQ ID NO: 2107724 - RNA, 12 nt, Homo sapiens
aacuugccaugu

SEQ ID NO: 2107725 - RNA, 12 nt, Homo sapiens
cugaaagcacug

SEQ ID NO: 2107726 - RNA, 18 nt, Homo sapiens
gcugguuggugcuuuguu

SEQ ID NO: 2107727 - RNA, 21 nt, Homo sapiens
aauugcuuugccaaaauacca

SEQ ID NO: 2107728 - RNA, 23 nt, Homo sapiens
auaccuuugcuacuacuaugugc

SEQ ID NO: 2107729 - RNA, 16 nt, Homo sapiens
ugaauguacauuuaau

SEQ ID NO: 2107730 - RNA, 18 nt, Homo sapiens
guucccggguagccacug

SEQ ID NO: 2107731 - RNA, 19 nt, Homo sapiens
ucuugccagccacauauga

SEQ ID NO: 2107732 - RNA, 18 nt, Homo sapiens
agaugagucagugccaug

SEQ ID NO: 2107733 - RNA, 16 nt, Homo sapiens
aggguuucugagcugc

SEQ ID NO: 2107734 - RNA, 16 nt, Homo sapiens
gaaauuccuguacugu

SEQ ID NO: 2107735 - RNA, 18 nt, Homo sapiens
ugcaucuucccacagugg

SEQ ID NO: 2107736 - RNA, 15 nt, Homo sapiens
cugucaccagguuug

SEQ ID NO: 2107737 - RNA, 20 nt, Homo sapiens
aacaucaaaaggcugccuaa

SEQ ID NO: 2107738 - RNA, 20 nt, Homo sapiens
gcguccauauuuaacaugua

SEQ ID NO: 2107739 - RNA, 19 nt, Homo sapiens
acauuugcuccauccuccu

SEQ ID NO: 2107740 - RNA, 17 nt, Homo sapiens
guuuauguaacuaucaa

SEQ ID NO: 2107741 - RNA, 19 nt, Homo sapiens
uggaguccucgacuuauca

SEQ ID NO: 2107742 - RNA, 23 nt, Homo sapiens
accaguggcccccacucacaggg

SEQ ID NO: 2107743 - RNA, 21 nt, Homo sapiens
ccaccccagcaggacagugac

SEQ ID NO: 2107744 - RNA, 21 nt, Homo sapiens
cacuauguuuauuuacuaauu

SEQ ID NO: 2107745 - RNA, 15 nt, Homo sapiens
ugaccagcucucuuc

SEQ ID NO: 2107746 - RNA, 19 nt, Homo sapiens
gacaaagccucaauuacua

SEQ ID NO: 2107747 - RNA, 22 nt, Homo sapiens
gcuucuccuguuuuauauauua

SEQ ID NO: 2107748 - RNA, 20 nt, Homo sapiens
gauuccucuuuucucugcca

SEQ ID NO: 2107749 - RNA, 21 nt, Homo sapiens
gauguguauucauacugacau

SEQ ID NO: 2107750 - RNA, 23 nt, Homo sapiens
cccaguagaugccacuagcccuc

SEQ ID NO: 2107751 - RNA, 18 nt, Homo sapiens
uugaaagagaagcacuaa

SEQ ID NO: 2107752 - RNA, 12 nt, Homo sapiens
cuacugccccug

SEQ ID NO: 2107753 - RNA, 14 nt, Homo sapiens
aaacauucagucug

SEQ ID NO: 2107754 - RNA, 16 nt, Homo sapiens
gggcugcagauuuccu

SEQ ID NO: 2107755 - RNA, 23 nt, Homo sapiens
guguaagauuuuguuugcaucug

SEQ ID NO: 2107756 - RNA, 14 nt, Homo sapiens
uauagacucuagga

SEQ ID NO: 2107757 - RNA, 19 nt, Homo sapiens
aacguuugucauuccaguu

SEQ ID NO: 2107758 - RNA, 16 nt, Homo sapiens
auaauacauugcagca

SEQ ID NO: 2107759 - RNA, 13 nt, Homo sapiens
uuuucugugccaa

SEQ ID NO: 2107760 - RNA, 12 nt, Homo sapiens
ugcauuccagaa

SEQ ID NO: 2107761 - RNA, 15 nt, Homo sapiens
ugcucucccagguga

SEQ ID NO: 2107762 - RNA, 23 nt, Homo sapiens
gcaccaucacccuugaaaacucu

SEQ ID NO: 2107763 - RNA, 14 nt, Homo sapiens
uuugucucgcuaua

SEQ ID NO: 2107764 - RNA, 19 nt, Homo sapiens
cagaaacacggaguuucca

SEQ ID NO: 2107765 - RNA, 15 nt, Homo sapiens
ucaauacccuuguga

SEQ ID NO: 2107766 - RNA, 18 nt, Homo sapiens
gcugucagauacccuguu

SEQ ID NO: 2107767 - RNA, 22 nt, Homo sapiens
gucucuuccuuacccuuucugu

SEQ ID NO: 2107768 - RNA, 21 nt, Homo sapiens
uuuaagaaaaaggaugcacag

SEQ ID NO: 2107769 - RNA, 14 nt, Homo sapiens
ccacggccacugca

SEQ ID NO: 2107770 - RNA, 12 nt, Homo sapiens
uaaaggcuccug

SEQ ID NO: 2107771 - RNA, 19 nt, Homo sapiens
gccugugguuaacaucuca

SEQ ID NO: 2107772 - RNA, 21 nt, Homo sapiens
aaggcuuggaugcguguguaa

SEQ ID NO: 2107773 - RNA, 13 nt, Homo sapiens
ugcucacucccua

SEQ ID NO: 2107774 - RNA, 19 nt, Homo sapiens
cacucuccauuuaauaauu

SEQ ID NO: 2107775 - RNA, 15 nt, Homo sapiens
agaucauucaguguu

SEQ ID NO: 2107776 - RNA, 21 nt, Homo sapiens
aggccaacuuuuuuuccuugu

SEQ ID NO: 2107777 - RNA, 21 nt, Homo sapiens
acaguuauugcaagaguuuaa

SEQ ID NO: 2107778 - RNA, 19 nt, Homo sapiens
cccagggcugugaaggcag

SEQ ID NO: 2107779 - RNA, 15 nt, Homo sapiens
cuuugugauucccuc

SEQ ID NO: 2107780 - RNA, 22 nt, Homo sapiens
uggagcacauguuacugcuuca

SEQ ID NO: 2107781 - RNA, 19 nt, Homo sapiens
aauauauuuucaaggaugu

SEQ ID NO: 2107782 - RNA, 12 nt, Homo sapiens
uuucauugcacu

SEQ ID NO: 2107783 - RNA, 16 nt, Homo sapiens
aguccacggaccccca

SEQ ID NO: 2107784 - RNA, 18 nt, Homo sapiens
uccauguaccuuguguac

SEQ ID NO: 2107785 - RNA, 21 nt, Homo sapiens
agcagaaaaaaaagugucuca

SEQ ID NO: 2107786 - RNA, 14 nt, Homo sapiens
aauaaaguauuuaa

SEQ ID NO: 2107787 - RNA, 22 nt, Homo sapiens
ugcuaagcuaaagaaacugcuu

SEQ ID NO: 2107788 - RNA, 18 nt, Homo sapiens
accuuccauucacaccag

SEQ ID NO: 2107789 - RNA, 19 nt, Homo sapiens
ucaacuugucacaaaguga

SEQ ID NO: 2107790 - RNA, 18 nt, Homo sapiens
uucacuccccuaucccau

SEQ ID NO: 2107791 - RNA, 22 nt, Homo sapiens
uauugguuuuaaaaaagcauua

SEQ ID NO: 2107792 - RNA, 18 nt, Homo sapiens
aggggaaugggaagcagc

SEQ ID NO: 2107793 - RNA, 13 nt, Homo sapiens
uacucaaguacca

SEQ ID NO: 2107794 - RNA, 14 nt, Homo sapiens
aaucucacuacaca

SEQ ID NO: 2107795 - RNA, 15 nt, Homo sapiens
aggaaggguguugca

SEQ ID NO: 2107796 - RNA, 13 nt, Homo sapiens
cauauuucuuugg

SEQ ID NO: 2107797 - RNA, 11 nt, Homo sapiens
cauacuuguga

SEQ ID NO: 2107798 - RNA, 21 nt, Homo sapiens
caagauacacgucacaaagac

SEQ ID NO: 2107799 - RNA, 21 nt, Homo sapiens
ggcuggagcugccucucucau

SEQ ID NO: 2107800 - RNA, 13 nt, Homo sapiens
gacguuucugggc

SEQ ID NO: 2107801 - RNA, 20 nt, Homo sapiens
agucagguccaugugcacug

SEQ ID NO: 2107802 - RNA, 23 nt, Homo sapiens
caugaccacucuuggcuauugaa

SEQ ID NO: 2107803 - RNA, 14 nt, Homo sapiens
agagugacagucau

SEQ ID NO: 2107804 - RNA, 16 nt, Homo sapiens
gccgucuccauggcau

SEQ ID NO: 2107805 - RNA, 15 nt, Homo sapiens
cuauauauuggccaa

SEQ ID NO: 2107806 - RNA, 19 nt, Homo sapiens
agugggugggacacagaga

SEQ ID NO: 2107807 - RNA, 16 nt, Homo sapiens
gaaauaugcacugcuc

SEQ ID NO: 2107808 - RNA, 16 nt, Homo sapiens
uuucagcccacgucac

SEQ ID NO: 2107809 - RNA, 16 nt, Homo sapiens
cacccagugacugaca

SEQ ID NO: 2107810 - RNA, 23 nt, Homo sapiens
cagccuugccagagauccaaaag

SEQ ID NO: 2107811 - RNA, 19 nt, Homo sapiens
ggguuagagccaagcugca

SEQ ID NO: 2107812 - RNA, 16 nt, Homo sapiens
ggcuccuggggcaaug

SEQ ID NO: 2107813 - RNA, 17 nt, Homo sapiens
uuggagggaucauuuuc

SEQ ID NO: 2107814 - RNA, 17 nt, Homo sapiens
accagggagcaguugcc

SEQ ID NO: 2107815 - RNA, 13 nt, Homo sapiens
auaaagugcuuua

SEQ ID NO: 2107816 - RNA, 17 nt, Homo sapiens
guuacuguguaaacuca

SEQ ID NO: 2107817 - RNA, 22 nt, Homo sapiens
uccccuggggguuucaccuggg

SEQ ID NO: 2107818 - RNA, 18 nt, Homo sapiens
aucaaacacaaugccuca

SEQ ID NO: 2107819 - RNA, 18 nt, Homo sapiens
ggcuccugccuugaugaa

SEQ ID NO: 2107820 - RNA, 18 nt, Homo sapiens
ucacaugagcuauuucca

SEQ ID NO: 2107821 - RNA, 18 nt, Homo sapiens
gcaugcaggcuguguuuu

SEQ ID NO: 2107822 - RNA, 19 nt, Homo sapiens
aauguuugugucugugguu

SEQ ID NO: 2107823 - RNA, 16 nt, Homo sapiens
ccuccuggcugucuga

SEQ ID NO: 2107824 - RNA, 13 nt, Homo sapiens
cacucuccuguga

SEQ ID NO: 2107825 - RNA, 19 nt, Homo sapiens
ucggaccaagcagagcuca

SEQ ID NO: 2107826 - RNA, 19 nt, Homo sapiens
cacauccaaacauguaucu

SEQ ID NO: 2107827 - RNA, 18 nt, Homo sapiens
gugcccccaggcucucau

SEQ ID NO: 2107828 - RNA, 12 nt, Homo sapiens
aggaacuacuga

SEQ ID NO: 2107829 - RNA, 15 nt, Homo sapiens
uucuucucgacuuca

SEQ ID NO: 2107830 - RNA, 18 nt, Homo sapiens
aggcaauuccuaccucuu

SEQ ID NO: 2107831 - RNA, 14 nt, Homo sapiens
gcuuuucacuguga

SEQ ID NO: 2107832 - RNA, 13 nt, Homo sapiens
caggugguugugg

SEQ ID NO: 2107833 - RNA, 22 nt, Homo sapiens
gugcucuugaaccugugcucau

SEQ ID NO: 2107834 - RNA, 20 nt, Homo sapiens
uuacauaauacuugaaaaau

SEQ ID NO: 2107835 - RNA, 18 nt, Homo sapiens
uauuucuggaauggaaaa

SEQ ID NO: 2107836 - RNA, 11 nt, Homo sapiens
uaaaguggcag

SEQ ID NO: 2107837 - RNA, 20 nt, Homo sapiens
ugaaauucaaguguaccugc

SEQ ID NO: 2107838 - RNA, 15 nt, Homo sapiens
cggggcccuguguag

SEQ ID NO: 2107839 - RNA, 19 nt, Homo sapiens
ucucucccucuuucuagcc

SEQ ID NO: 2107840 - RNA, 16 nt, Homo sapiens
caaucauguguguuaa

SEQ ID NO: 2107841 - RNA, 21 nt, Homo sapiens
ucaugccccaguauuagcaau

SEQ ID NO: 2107842 - RNA, 19 nt, Homo sapiens
agugggcagccccucuacc

SEQ ID NO: 2107843 - RNA, 14 nt, Homo sapiens
gcacagacuucaca

SEQ ID NO: 2107844 - RNA, 20 nt, Homo sapiens
ugaggaaauucggagcuaua

SEQ ID NO: 2107845 - RNA, 17 nt, Homo sapiens
ucguuuagcauggcaug

SEQ ID NO: 2107846 - RNA, 22 nt, Homo sapiens
gcucagaaauuuucugaucuca

SEQ ID NO: 2107847 - RNA, 17 nt, Homo sapiens
agguuguggagaaaaag

SEQ ID NO: 2107848 - RNA, 15 nt, Homo sapiens
agaaaagcugaugag

SEQ ID NO: 2107849 - RNA, 19 nt, Homo sapiens
uuuuaaaguacugguguca

SEQ ID NO: 2107850 - RNA, 22 nt, Homo sapiens
aauaaauggcccggacaugucu

SEQ ID NO: 2107851 - RNA, 15 nt, Homo sapiens
cauuuguucauauua

SEQ ID NO: 2107852 - RNA, 22 nt, Homo sapiens
cuguaguccagucucuccagca

SEQ ID NO: 2107853 - RNA, 23 nt, Homo sapiens
ucuacaccaaugaaaacauguac

SEQ ID NO: 2107854 - RNA, 14 nt, Homo sapiens
aguacguugugcau

SEQ ID NO: 2107855 - RNA, 15 nt, Homo sapiens
aacuuaaagugaauu

SEQ ID NO: 2107856 - RNA, 18 nt, Homo sapiens
accccgggcaagacuuuu

SEQ ID NO: 2107857 - RNA, 13 nt, Homo sapiens
auggaguuccuuc

SEQ ID NO: 2107858 - RNA, 13 nt, Homo sapiens
gcuggaacccagg

SEQ ID NO: 2107859 - RNA, 15 nt, Homo sapiens
ugaaauugggaggaa

SEQ ID NO: 2107860 - RNA, 16 nt, Homo sapiens
uugaaaaaaguacaua

SEQ ID NO: 2107861 - RNA, 17 nt, Homo sapiens
aguucccuuagugaauu

SEQ ID NO: 2107862 - RNA, 14 nt, Homo sapiens
cuaagaaccaaaaa

SEQ ID NO: 2107863 - RNA, 20 nt, Homo sapiens
auuuucauugaaaugcacag

SEQ ID NO: 2107864 - RNA, 21 nt, Homo sapiens
aguaugaguguugugccuacu

SEQ ID NO: 2107865 - RNA, 13 nt, Homo sapiens
uucuugacaauca

SEQ ID NO: 2107866 - RNA, 18 nt, Homo sapiens
cacagcagauaccuggug

SEQ ID NO: 2107867 - RNA, 20 nt, Homo sapiens
aaguaugcuuucuccugaaa

SEQ ID NO: 2107868 - RNA, 11 nt, Homo sapiens
aaccacaaaag

SEQ ID NO: 2107869 - RNA, 20 nt, Homo sapiens
caagcuuuggguuggagcug

SEQ ID NO: 2107870 - RNA, 21 nt, Homo sapiens
guaaaacaugcugaaaacuac

SEQ ID NO: 2107871 - RNA, 11 nt, Homo sapiens
cuaugcaaggg

SEQ ID NO: 2107872 - RNA, 22 nt, Homo sapiens
agcacuguuuucuaguguauca

SEQ ID NO: 2107873 - RNA, 21 nt, Homo sapiens
cccuggcccccaguagugugu

SEQ ID NO: 2107874 - RNA, 23 nt, Homo sapiens
cccgucacgugcgcugggcacuu

SEQ ID NO: 2107875 - RNA, 21 nt, Homo sapiens
cuucagcuucccgaguagcug

SEQ ID NO: 2107876 - RNA, 12 nt, Homo sapiens
cuuguauacuua

SEQ ID NO: 2107877 - RNA, 14 nt, Homo sapiens
caguagaugccacu

SEQ ID NO: 2107878 - RNA, 14 nt, Homo sapiens
cagacaaccaaaac

SEQ ID NO: 2107879 - RNA, 15 nt, Homo sapiens
gugccuugagcugcc

SEQ ID NO: 2107880 - RNA, 18 nt, Homo sapiens
uugucauauaaaccugau

SEQ ID NO: 2107881 - RNA, 20 nt, Homo sapiens
cuuaguaaauuccuaauucu

SEQ ID NO: 2107882 - RNA, 17 nt, Homo sapiens
aaagcuugggacaguua

SEQ ID NO: 2107883 - RNA, 20 nt, Homo sapiens
cugcggcacccuugcgcuuu

SEQ ID NO: 2107884 - RNA, 16 nt, Homo sapiens
ucacaagaagaccaga

SEQ ID NO: 2107885 - RNA, 20 nt, Homo sapiens
aguuugacacuugaaaaaag

SEQ ID NO: 2107886 - RNA, 19 nt, Homo sapiens
ccugggcuugagcugcaga

SEQ ID NO: 2107887 - RNA, 18 nt, Homo sapiens
agacauuaaaucuaugaa

SEQ ID NO: 2107888 - RNA, 22 nt, Homo sapiens
cugagguggcuaagggggacca

SEQ ID NO: 2107889 - RNA, 23 nt, Homo sapiens
acucauggaugagacuacuucag

SEQ ID NO: 2107890 - RNA, 19 nt, Homo sapiens
aaggguccguggaccagga

SEQ ID NO: 2107891 - RNA, 17 nt, Homo sapiens
cugcugauguaggagcu

SEQ ID NO: 2107892 - RNA, 16 nt, Homo sapiens
cagguuuagacaguau

SEQ ID NO: 2107893 - RNA, 15 nt, Homo sapiens
accuacagugcugug

SEQ ID NO: 2107894 - RNA, 15 nt, Homo sapiens
auaaacgaaacauuu

SEQ ID NO: 2107895 - RNA, 20 nt, Homo sapiens
auauuuuauuuaauccccac

SEQ ID NO: 2107896 - RNA, 15 nt, Homo sapiens
ucaagaucaacauuc

SEQ ID NO: 2107897 - RNA, 23 nt, Homo sapiens
agugcaccuacaccaacugcucu

SEQ ID NO: 2107898 - RNA, 15 nt, Homo sapiens
auagaaccacuauga

SEQ ID NO: 2107899 - RNA, 17 nt, Homo sapiens
uacugcuaugugucaca

SEQ ID NO: 2107900 - RNA, 16 nt, Homo sapiens
uucuucuguauguuag

SEQ ID NO: 2107901 - RNA, 22 nt, Homo sapiens
uguuaucaaugacaauggugcc

SEQ ID NO: 2107902 - RNA, 22 nt, Homo sapiens
ugaugaauagcgaaucaucuca

SEQ ID NO: 2107903 - RNA, 15 nt, Homo sapiens
aucugcaaaauggga

SEQ ID NO: 2107904 - RNA, 15 nt, Homo sapiens
ugaguugccaagaca

SEQ ID NO: 2107905 - RNA, 19 nt, Homo sapiens
augggagaauugcacacag

SEQ ID NO: 2107906 - RNA, 17 nt, Homo sapiens
cuggacaaagaauucca

SEQ ID NO: 2107907 - RNA, 19 nt, Homo sapiens
uuacuguuuugggccucca

SEQ ID NO: 2107908 - RNA, 13 nt, Homo sapiens
cuuagaaugccau

SEQ ID NO: 2107909 - RNA, 19 nt, Homo sapiens
aaaaauguauaaugacuuu

SEQ ID NO: 2107910 - RNA, 18 nt, Homo sapiens
cuuaugagcgucacugcc

SEQ ID NO: 2107911 - RNA, 15 nt, Homo sapiens
ugggccugugaauca

SEQ ID NO: 2107912 - RNA, 18 nt, Homo sapiens
aaauuaguuugacacugc

SEQ ID NO: 2107913 - RNA, 18 nt, Homo sapiens
aguuuaaugaacuaccau

SEQ ID NO: 2107914 - RNA, 18 nt, Homo sapiens
acgcauguuauggugcua

SEQ ID NO: 2107915 - RNA, 19 nt, Homo sapiens
ccagccuaaaaaccaccau

SEQ ID NO: 2107916 - RNA, 22 nt, Homo sapiens
uacacugccuucucaacuccaa

SEQ ID NO: 2107917 - RNA, 11 nt, Homo sapiens
acaaaacuaca

SEQ ID NO: 2107918 - RNA, 11 nt, Homo sapiens
gcaaaacugca

SEQ ID NO: 2107919 - RNA, 11 nt, Homo sapiens
gucaaacuguc

SEQ ID NO: 2107920 - RNA, 11 nt, Homo sapiens
gagaaacugag

SEQ ID NO: 2107921 - RNA, 15 nt, Homo sapiens
cagaugcuccaagau

SEQ ID NO: 2107922 - RNA, 14 nt, Homo sapiens
accaagcacagcag

SEQ ID NO: 2107923 - RNA, 16 nt, Homo sapiens
auuguacaaccuguga

SEQ ID NO: 2107924 - RNA, 18 nt, Homo sapiens
uggagauucccaucugau

SEQ ID NO: 2107925 - RNA, 21 nt, Homo sapiens
aguuauaggaacaauucucuu

SEQ ID NO: 2107926 - RNA, 20 nt, Homo sapiens
cgauuccuuuauauuugcuc

SEQ ID NO: 2107927 - RNA, 18 nt, Homo sapiens
cauggauaacuacauuac

SEQ ID NO: 2107928 - RNA, 19 nt, Homo sapiens
gucccagaaccacacuguu

SEQ ID NO: 2107929 - RNA, 21 nt, Homo sapiens
ugaagcagguggagggcauca

SEQ ID NO: 2107930 - RNA, 17 nt, Homo sapiens
uuguaaugagagcacuu

SEQ ID NO: 2107931 - RNA, 17 nt, Homo sapiens
gccaagccagcugccua

SEQ ID NO: 2107932 - RNA, 11 nt, Homo sapiens
auacauaucag

SEQ ID NO: 2107933 - RNA, 22 nt, Homo sapiens
uacaaaugcaauuucauuuaaa

SEQ ID NO: 2107934 - RNA, 13 nt, Homo sapiens
ccucagccagccu

SEQ ID NO: 2107935 - RNA, 17 nt, Homo sapiens
ugcugccaaacacccau

SEQ ID NO: 2107936 - RNA, 12 nt, Homo sapiens
ccaggacuguga

SEQ ID NO: 2107937 - RNA, 15 nt, Homo sapiens
gggauucaggcugcu

SEQ ID NO: 2107938 - RNA, 21 nt, Homo sapiens
auaucugaauggaagaguguu

SEQ ID NO: 2107939 - RNA, 17 nt, Homo sapiens
aagcuggcaggagacac

SEQ ID NO: 2107940 - RNA, 21 nt, Homo sapiens
uauauuauuauuaauuacaau

SEQ ID NO: 2107941 - RNA, 20 nt, Homo sapiens
acccuuuccggcacacugcc

SEQ ID NO: 2107942 - RNA, 14 nt, Homo sapiens
auaucaaucaagcc

SEQ ID NO: 2107943 - RNA, 19 nt, Homo sapiens
aggaaauggagaagcucug

SEQ ID NO: 2107944 - RNA, 13 nt, Homo sapiens
uuguaacuccacc

SEQ ID NO: 2107945 - RNA, 14 nt, Homo sapiens
caccaguaccugaa

SEQ ID NO: 2107946 - RNA, 22 nt, Homo sapiens
ucauugauagaacuacuuugaa

SEQ ID NO: 2107947 - RNA, 14 nt, Homo sapiens
ucuaaaaaauaacu

SEQ ID NO: 2107948 - RNA, 14 nt, Homo sapiens
uauugagcagagcc

SEQ ID NO: 2107949 - RNA, 14 nt, Homo sapiens
ccaacugcucugcc

SEQ ID NO: 2107950 - RNA, 17 nt, Homo sapiens
caguucugcucuaagaa

SEQ ID NO: 2107951 - RNA, 20 nt, Homo sapiens
ccucaggugaaacuccagau

SEQ ID NO: 2107952 - RNA, 14 nt, Homo sapiens
aaagcuuauggcug

SEQ ID NO: 2107953 - RNA, 18 nt, Homo sapiens
cacaucuacuugcuuaaa

SEQ ID NO: 2107954 - RNA, 20 nt, Homo sapiens
aacgugcaacuacuauucaa

SEQ ID NO: 2107955 - RNA, 21 nt, Homo sapiens
agaauuuugggacauuugcau

SEQ ID NO: 2107956 - RNA, 17 nt, Homo sapiens
aaauguacuacuaaaga

SEQ ID NO: 2107957 - RNA, 13 nt, Homo sapiens
cacugacugugaa

SEQ ID NO: 2107958 - RNA, 21 nt, Homo sapiens
uucagaaauguaaauguuauu

SEQ ID NO: 2107959 - RNA, 18 nt, Homo sapiens
accuguauacagugcaga

SEQ ID NO: 2107960 - RNA, 15 nt, Homo sapiens
ugcacuuggugcugc

SEQ ID NO: 2107961 - RNA, 16 nt, Homo sapiens
gcaaggccugugcugc

SEQ ID NO: 2107962 - RNA, 14 nt, Homo sapiens
agaucuuaagauuc

SEQ ID NO: 2107963 - RNA, 16 nt, Homo sapiens
agaauguguguagaua

SEQ ID NO: 2107964 - RNA, 14 nt, Homo sapiens
auguauuaguacaa

SEQ ID NO: 2107965 - RNA, 16 nt, Homo sapiens
ccaggccacugaccuc

SEQ ID NO: 2107966 - RNA, 16 nt, Homo sapiens
auguuagaaugagauc

SEQ ID NO: 2107967 - RNA, 14 nt, Homo sapiens
gucaaaaggugccu

SEQ ID NO: 2107968 - RNA, 19 nt, Homo sapiens
uagcuggcugcagaacucc

SEQ ID NO: 2107969 - RNA, 19 nt, Homo sapiens
cuuugccacacacaguuac

SEQ ID NO: 2107970 - RNA, 14 nt, Homo sapiens
cauggcccugccau

SEQ ID NO: 2107971 - RNA, 18 nt, Homo sapiens
cucacucagcaccacuca

SEQ ID NO: 2107972 - RNA, 16 nt, Homo sapiens
cuccugccuacauucc

SEQ ID NO: 2107973 - RNA, 21 nt, Homo sapiens
gcaaaauggaagcaaagacaa

SEQ ID NO: 2107974 - RNA, 22 nt, Homo sapiens
uagucccaaagaggcuacugua

SEQ ID NO: 2107975 - RNA, 12 nt, Homo sapiens
guaaacaaagac

SEQ ID NO: 2107976 - RNA, 20 nt, Homo sapiens
cacuggauccauccguccag

SEQ ID NO: 2107977 - RNA, 17 nt, Homo sapiens
agcaaacucugcugucu

SEQ ID NO: 2107978 - RNA, 15 nt, Homo sapiens
ugauuaacucagucc

SEQ ID NO: 2107979 - RNA, 23 nt, Homo sapiens
ucaacagccaagugugaccccac

SEQ ID NO: 2107980 - RNA, 17 nt, Homo sapiens
cuucagucuuuuccaug

SEQ ID NO: 2107981 - RNA, 21 nt, Homo sapiens
cuggacaaagaaauuccccaa

SEQ ID NO: 2107982 - RNA, 15 nt, Homo sapiens
cccagaaacuccaac

SEQ ID NO: 2107983 - RNA, 16 nt, Homo sapiens
cucugaaucagaaaag

SEQ ID NO: 2107984 - RNA, 16 nt, Homo sapiens
cuccccucucaccuca

SEQ ID NO: 2107985 - RNA, 18 nt, Homo sapiens
aaggauuguugggcuugg

SEQ ID NO: 2107986 - RNA, 14 nt, Homo sapiens
gcagggcugacucu

SEQ ID NO: 2107987 - RNA, 19 nt, Homo sapiens
accugccaggaagccagca

SEQ ID NO: 2107988 - RNA, 13 nt, Homo sapiens
gaggcaggugaga

SEQ ID NO: 2107989 - RNA, 18 nt, Homo sapiens
cguuuaauccacucccuu

SEQ ID NO: 2107990 - RNA, 22 nt, Homo sapiens
gccaucauccucccgccaggag

SEQ ID NO: 2107991 - RNA, 14 nt, Homo sapiens
uguaguaauugaca

SEQ ID NO: 2107992 - RNA, 16 nt, Homo sapiens
cuccucacagaccucu

SEQ ID NO: 2107993 - RNA, 13 nt, Homo sapiens
uuaccuggcugcu

SEQ ID NO: 2107994 - RNA, 16 nt, Homo sapiens
uugagacagagggcaa

SEQ ID NO: 2107995 - RNA, 21 nt, Homo sapiens
gccuccaggagccuacccccu

SEQ ID NO: 2107996 - RNA, 20 nt, Homo sapiens
gcaucuucugguuuaaacuu

SEQ ID NO: 2107997 - RNA, 20 nt, Homo sapiens
ugaugcaagcaagaaacacu

SEQ ID NO: 2107998 - RNA, 21 nt, Homo sapiens
cucacaagaagaccagacugu

SEQ ID NO: 2107999 - RNA, 18 nt, Homo sapiens
uaaauugaacuucccaca

SEQ ID NO: 2108000 - RNA, 17 nt, Homo sapiens
cagcagaaauuaaauga

SEQ ID NO: 2108001 - RNA, 15 nt, Homo sapiens
augggccaagccagg

SEQ ID NO: 2108002 - RNA, 19 nt, Homo sapiens
ucaauuuguucagucuuuc

SEQ ID NO: 2108003 - RNA, 20 nt, Homo sapiens
ucagcccuggccccuguggg

SEQ ID NO: 2108004 - RNA, 15 nt, Homo sapiens
ugccacuggggaaaa

SEQ ID NO: 2108005 - RNA, 19 nt, Homo sapiens
gucguucccuugugucugu

SEQ ID NO: 2108006 - RNA, 18 nt, Homo sapiens
cuugacaauagaacauug

SEQ ID NO: 2108007 - RNA, 16 nt, Homo sapiens
cuccccugauccagac

SEQ ID NO: 2108008 - RNA, 14 nt, Homo sapiens
cauacuuaacuuua

SEQ ID NO: 2108009 - RNA, 16 nt, Homo sapiens
ugcaaaggagaagcac

SEQ ID NO: 2108010 - RNA, 19 nt, Homo sapiens
acaaagcucaaaguaugca

SEQ ID NO: 2108011 - RNA, 19 nt, Homo sapiens
caucuauucucuccaaaaa

SEQ ID NO: 2108012 - RNA, 16 nt, Homo sapiens
uaaaaauaaagcuacu

SEQ ID NO: 2108013 - RNA, 14 nt, Homo sapiens
agcuguaaccgaua

SEQ ID NO: 2108014 - RNA, 17 nt, Homo sapiens
uuaacggugcuaaaaau

SEQ ID NO: 2108015 - RNA, 17 nt, Homo sapiens
ccugcuggcagggccag

SEQ ID NO: 2108016 - RNA, 15 nt, Homo sapiens
uugaucagacauuca

SEQ ID NO: 2108017 - RNA, 15 nt, Homo sapiens
aacuccuaguacuua

SEQ ID NO: 2108018 - RNA, 20 nt, Homo sapiens
ugauuuugagcaaaccacau

SEQ ID NO: 2108019 - RNA, 13 nt, Homo sapiens
ggaguuacuggau

SEQ ID NO: 2108020 - RNA, 20 nt, Homo sapiens
cagggcuggagucaaaacac

SEQ ID NO: 2108021 - RNA, 20 nt, Homo sapiens
acaggcuggucucaaacucc

SEQ ID NO: 2108022 - RNA, 23 nt, Homo sapiens
guccccaccccagcgcagcagcc

SEQ ID NO: 2108023 - RNA, 16 nt, Homo sapiens
gacucuaggugcccuu

SEQ ID NO: 2108024 - RNA, 21 nt, Homo sapiens
uacucuuagauggauucucca

SEQ ID NO: 2108025 - RNA, 16 nt, Homo sapiens
ugauuuguagcacuga

SEQ ID NO: 2108026 - RNA, 17 nt, Homo sapiens
aacuccacugucuuuaa

SEQ ID NO: 2108027 - RNA, 16 nt, Homo sapiens
aggcuugucacuagca

SEQ ID NO: 2108028 - RNA, 19 nt, Homo sapiens
gcagaccugacucucuuaa

SEQ ID NO: 2108029 - RNA, 21 nt, Homo sapiens
gaagcuaauguaggacuguau

SEQ ID NO: 2108030 - RNA, 23 nt, Homo sapiens
ggugcacagauugcugaaacugu

SEQ ID NO: 2108031 - RNA, 17 nt, Homo sapiens
cauggauauuugucaac

SEQ ID NO: 2108032 - RNA, 17 nt, Homo sapiens
ucaaaauauacauucaa

SEQ ID NO: 2108033 - RNA, 16 nt, Homo sapiens
auaaauccuugaauca

SEQ ID NO: 2108034 - RNA, 23 nt, Homo sapiens
cucagauaagguaaaaugccaug

SEQ ID NO: 2108035 - RNA, 17 nt, Homo sapiens
cugagcuccugucccag

SEQ ID NO: 2108036 - RNA, 21 nt, Homo sapiens
acaucagcuuucuaauguucu

SEQ ID NO: 2108037 - RNA, 11 nt, Homo sapiens
aaugggagaaa

SEQ ID NO: 2108038 - RNA, 21 nt, Homo sapiens
uugugaacuuuuuguagggga

SEQ ID NO: 2108039 - RNA, 17 nt, Homo sapiens
aaugaaugaucuuggcu

SEQ ID NO: 2108040 - RNA, 17 nt, Homo sapiens
gaugaaagauucaguga

SEQ ID NO: 2108041 - RNA, 21 nt, Homo sapiens
aauaucuauguuuuaccaagc

SEQ ID NO: 2108042 - RNA, 17 nt, Homo sapiens
ucauaagcuacugauga

SEQ ID NO: 2108043 - RNA, 17 nt, Homo sapiens
augcugguuaaggugaa

SEQ ID NO: 2108044 - RNA, 12 nt, Homo sapiens
aucuuuggucau

SEQ ID NO: 2108045 - RNA, 13 nt, Homo sapiens
caauccuauguuu

SEQ ID NO: 2108046 - RNA, 17 nt, Homo sapiens
caccccuccuuccuuga

SEQ ID NO: 2108047 - RNA, 19 nt, Homo sapiens
cccagcacacgaguuccag

SEQ ID NO: 2108048 - RNA, 10 nt, Homo sapiens
cugcuuccag

SEQ ID NO: 2108049 - RNA, 15 nt, Homo sapiens
gcuguaaacuuguag

SEQ ID NO: 2108050 - RNA, 13 nt, Homo sapiens
gguacacacuuga

SEQ ID NO: 2108051 - RNA, 18 nt, Homo sapiens
aauuguuaagaguaucau

SEQ ID NO: 2108052 - RNA, 23 nt, Homo sapiens
ucugagugcuuucauauuuucca

SEQ ID NO: 2108053 - RNA, 16 nt, Homo sapiens
gccuuaaugcuucaua

SEQ ID NO: 2108054 - RNA, 16 nt, Homo sapiens
cuauacuugaacaaaa

SEQ ID NO: 2108055 - RNA, 15 nt, Homo sapiens
auuuucauuuaacua

SEQ ID NO: 2108056 - RNA, 21 nt, Homo sapiens
uacaauucuuuguugcuuaau

SEQ ID NO: 2108057 - RNA, 17 nt, Homo sapiens
auuucugauaagacaug

SEQ ID NO: 2108058 - RNA, 22 nt, Homo sapiens
uggacugaugcuuuuagcucaa

SEQ ID NO: 2108059 - RNA, 12 nt, Homo sapiens
uagaagggcaaa

SEQ ID NO: 2108060 - RNA, 21 nt, Homo sapiens
acguggagagaaguugcccuc

SEQ ID NO: 2108061 - RNA, 22 nt, Homo sapiens
cuaauaauuguaucuacauuaa

SEQ ID NO: 2108062 - RNA, 17 nt, Homo sapiens
uaauuguaaacuaguac

SEQ ID NO: 2108063 - RNA, 18 nt, Homo sapiens
uggcccaguuaauuugca

SEQ ID NO: 2108064 - RNA, 22 nt, Homo sapiens
caaaucccaagcaucauaucau

SEQ ID NO: 2108065 - RNA, 22 nt, Homo sapiens
ucccaauaggagacaaaggaga

SEQ ID NO: 2108066 - RNA, 21 nt, Homo sapiens
ccagauggcagguuugcaauc

SEQ ID NO: 2108067 - RNA, 15 nt, Homo sapiens
cuggccucugcugaa

SEQ ID NO: 2108068 - RNA, 16 nt, Homo sapiens
acaacuucaauaucca

SEQ ID NO: 2108069 - RNA, 14 nt, Homo sapiens
gaucaacaauaccu

SEQ ID NO: 2108070 - RNA, 17 nt, Homo sapiens
auugagauuuaauuccc

SEQ ID NO: 2108071 - RNA, 15 nt, Homo sapiens
guuauguucagucac

SEQ ID NO: 2108072 - RNA, 18 nt, Homo sapiens
aaucaguaagagguguua

SEQ ID NO: 2108073 - RNA, 18 nt, Homo sapiens
auggaugcggugacaaau

SEQ ID NO: 2108074 - RNA, 14 nt, Homo sapiens
gacagcagauucca

SEQ ID NO: 2108075 - RNA, 17 nt, Homo sapiens
ggaaccgggaagggugg

SEQ ID NO: 2108076 - RNA, 17 nt, Homo sapiens
uacaugcauaaacuaaa

SEQ ID NO: 2108077 - RNA, 23 nt, Homo sapiens
aacucuuugcccaguucauccca

SEQ ID NO: 2108078 - RNA, 16 nt, Homo sapiens
acggcugcaccugcag

SEQ ID NO: 2108079 - RNA, 13 nt, Homo sapiens
guuuaucugagcu

SEQ ID NO: 2108080 - RNA, 12 nt, Homo sapiens
uuacugugaauu

SEQ ID NO: 2108081 - RNA, 20 nt, Homo sapiens
aauucugagauccagcacaa

SEQ ID NO: 2108082 - RNA, 16 nt, Homo sapiens
cuacaagucagcucca

SEQ ID NO: 2108083 - RNA, 17 nt, Homo sapiens
auagcuucuccaaaggc

SEQ ID NO: 2108084 - RNA, 17 nt, Homo sapiens
auuauuuuacaaucaac

SEQ ID NO: 2108085 - RNA, 17 nt, Homo sapiens
caaccuuuaguacgugu

SEQ ID NO: 2108086 - RNA, 17 nt, Homo sapiens
cauaaaaguuucuuucc

SEQ ID NO: 2108087 - RNA, 15 nt, Homo sapiens
cacuuacagaauuau

SEQ ID NO: 2108088 - RNA, 21 nt, Homo sapiens
cacuucaggguucuaaccuuu

SEQ ID NO: 2108089 - RNA, 19 nt, Homo sapiens
ugggaggcucggggcuccc

SEQ ID NO: 2108090 - RNA, 15 nt, Homo sapiens
gaaggccacauguga

SEQ ID NO: 2108091 - RNA, 14 nt, Homo sapiens
aucuguaacagcau

SEQ ID NO: 2108092 - RNA, 14 nt, Homo sapiens
auccagaacagugg

SEQ ID NO: 2108093 - RNA, 20 nt, Homo sapiens
aacaaucugaguccaggaau

SEQ ID NO: 2108094 - RNA, 14 nt, Homo sapiens
aaucagagcaguga

SEQ ID NO: 2108095 - RNA, 14 nt, Homo sapiens
cagguucacacuca

SEQ ID NO: 2108096 - RNA, 18 nt, Homo sapiens
gaaagcauaacaaaaaga

SEQ ID NO: 2108097 - RNA, 17 nt, Homo sapiens
uccacaaguaaaaggaa

SEQ ID NO: 2108098 - RNA, 13 nt, Homo sapiens
cgaaugugucuuu

SEQ ID NO: 2108099 - RNA, 13 nt, Homo sapiens
uguaugugccauu

SEQ ID NO: 2108100 - RNA, 18 nt, Homo sapiens
aggccuuaacacacuggc

SEQ ID NO: 2108101 - RNA, 18 nt, Homo sapiens
aaacccagacaaccaaaa

SEQ ID NO: 2108102 - RNA, 21 nt, Homo sapiens
acacauggcuuaagugacaaa

SEQ ID NO: 2108103 - RNA, 17 nt, Homo sapiens
caggaagcucugaugca

SEQ ID NO: 2108104 - RNA, 22 nt, Homo sapiens
accgcgcccagccuacauucac

SEQ ID NO: 2108105 - RNA, 16 nt, Homo sapiens
auaacauuauacacaa

SEQ ID NO: 2108106 - RNA, 17 nt, Homo sapiens
aaaugccauuuagcaau

SEQ ID NO: 2108107 - RNA, 17 nt, Homo sapiens
caguauucuugcacuga

SEQ ID NO: 2108108 - RNA, 15 nt, Homo sapiens
cagcuccagugccag

SEQ ID NO: 2108109 - RNA, 19 nt, Homo sapiens
caagcugcuuaaguucuua

SEQ ID NO: 2108110 - RNA, 20 nt, Homo sapiens
uuggauuuguuuaaaaacca

SEQ ID NO: 2108111 - RNA, 23 nt, Homo sapiens
aggagacuuuauggagaguucag

SEQ ID NO: 2108112 - RNA, 14 nt, Homo sapiens
cgccuuacuggcaa

SEQ ID NO: 2108113 - RNA, 15 nt, Homo sapiens
gagaggaugugcaag

SEQ ID NO: 2108114 - RNA, 15 nt, Homo sapiens
aaaccagccuggcca

SEQ ID NO: 2108115 - RNA, 21 nt, Homo sapiens
aaugucuucauaaaguacuug

SEQ ID NO: 2108116 - RNA, 21 nt, Homo sapiens
uuaugaaccgcaauaugggag

SEQ ID NO: 2108117 - RNA, 13 nt, Homo sapiens
aacaccucugcac

SEQ ID NO: 2108118 - RNA, 21 nt, Homo sapiens
gcaucauuuccccucccgcuu

SEQ ID NO: 2108119 - RNA, 16 nt, Homo sapiens
cauuauuugagacugu

SEQ ID NO: 2108120 - RNA, 20 nt, Homo sapiens
cuccaugaauuaguucuccu

SEQ ID NO: 2108121 - RNA, 12 nt, Homo sapiens
auuccucagggc

SEQ ID NO: 2108122 - RNA, 12 nt, Homo sapiens
caccugcacauu

SEQ ID NO: 2108123 - RNA, 15 nt, Homo sapiens
ccccuguuugcauga

SEQ ID NO: 2108124 - RNA, 17 nt, Homo sapiens
uucuuuuaguuacauga

SEQ ID NO: 2108125 - RNA, 21 nt, Homo sapiens
cuguggaggccugaugcugcc

SEQ ID NO: 2108126 - RNA, 15 nt, Homo sapiens
uaaaaugucucaagu

SEQ ID NO: 2108127 - RNA, 19 nt, Homo sapiens
gguagccaucaagcacuuc

SEQ ID NO: 2108128 - RNA, 19 nt, Homo sapiens
ccuccuuauauuuggccca

SEQ ID NO: 2108129 - RNA, 19 nt, Homo sapiens
aaugcuuuguuaaugcuuu

SEQ ID NO: 2108130 - RNA, 15 nt, Homo sapiens
caggccuaaccugcu

SEQ ID NO: 2108131 - RNA, 17 nt, Homo sapiens
guugccuaaguauuaaa

SEQ ID NO: 2108132 - RNA, 21 nt, Homo sapiens
gcuggcaccuuaguugcauga

SEQ ID NO: 2108133 - RNA, 20 nt, Homo sapiens
gggugggcuugggcaauaaa

SEQ ID NO: 2108134 - RNA, 16 nt, Homo sapiens
uauaauuaauugucau

SEQ ID NO: 2108135 - RNA, 21 nt, Homo sapiens
agcacuaaucccccucugccc

SEQ ID NO: 2108136 - RNA, 16 nt, Homo sapiens
ggaggaaguuggcuga

SEQ ID NO: 2108137 - RNA, 21 nt, Homo sapiens
cacauacacaagugcacagac

SEQ ID NO: 2108138 - RNA, 13 nt, Homo sapiens
acagcccaucacc

SEQ ID NO: 2108139 - RNA, 19 nt, Homo sapiens
augaagaagccuuuguuca

SEQ ID NO: 2108140 - RNA, 21 nt, Homo sapiens
cauguauggacgugugugaau

SEQ ID NO: 2108141 - RNA, 15 nt, Homo sapiens
gaaaacuuauuugag

SEQ ID NO: 2108142 - RNA, 16 nt, Homo sapiens
uguaucccuucucaca

SEQ ID NO: 2108143 - RNA, 19 nt, Homo sapiens
guaauaauacagccaaaga

SEQ ID NO: 2108144 - RNA, 18 nt, Homo sapiens
ucuuacagccacaggcac

SEQ ID NO: 2108145 - RNA, 17 nt, Homo sapiens
uagacagguguuacuua

SEQ ID NO: 2108146 - RNA, 17 nt, Homo sapiens
ucccugcagaugccacc

SEQ ID NO: 2108147 - RNA, 14 nt, Homo sapiens
caggcuuaugaaua

SEQ ID NO: 2108148 - RNA, 21 nt, Homo sapiens
cccaugugggcugaaggaugg

SEQ ID NO: 2108149 - RNA, 18 nt, Homo sapiens
gggauaggaagugcccca

SEQ ID NO: 2108150 - RNA, 23 nt, Homo sapiens
acuuccauagcuucauccacuga

SEQ ID NO: 2108151 - RNA, 16 nt, Homo sapiens
uucaauacuucaugau

SEQ ID NO: 2108152 - RNA, 20 nt, Homo sapiens
acaguuuagugcuuuacaug

SEQ ID NO: 2108153 - RNA, 19 nt, Homo sapiens
ugacucaacgagagcacuu

SEQ ID NO: 2108154 - RNA, 23 nt, Homo sapiens
acacagcugcccuagcugacccc

SEQ ID NO: 2108155 - RNA, 20 nt, Homo sapiens
aaguuggaagggaccccaga

SEQ ID NO: 2108156 - RNA, 18 nt, Homo sapiens
cccagcgacgaacuuucc

SEQ ID NO: 2108157 - RNA, 23 nt, Homo sapiens
ggacaugaagggaugcugcaaug

SEQ ID NO: 2108158 - RNA, 21 nt, Homo sapiens
accuaccuuauagagcacaau

SEQ ID NO: 2108159 - RNA, 21 nt, Homo sapiens
uaccuuccuguguaugcugag

SEQ ID NO: 2108160 - RNA, 14 nt, Homo sapiens
cugcccacuggccg

SEQ ID NO: 2108161 - RNA, 18 nt, Homo sapiens
aaggcauguucccagaaa

SEQ ID NO: 2108162 - RNA, 19 nt, Homo sapiens
augucucuggggcagaucc

SEQ ID NO: 2108163 - RNA, 23 nt, Homo sapiens
acaagacuguaaauuccaaagau

SEQ ID NO: 2108164 - RNA, 12 nt, Homo sapiens
uuguguggcucc

SEQ ID NO: 2108165 - RNA, 16 nt, Homo sapiens
gacaacagugcuuugu

SEQ ID NO: 2108166 - RNA, 22 nt, Homo sapiens
ucuggagaccguccuggagcug

SEQ ID NO: 2108167 - RNA, 19 nt, Homo sapiens
acucuaagcugugugcagg

SEQ ID NO: 2108168 - RNA, 17 nt, Homo sapiens
ugccauucucuugcauu

SEQ ID NO: 2108169 - RNA, 17 nt, Homo sapiens
gcuaaagacugaucuca

SEQ ID NO: 2108170 - RNA, 13 nt, Homo sapiens
acagacuacauuu

SEQ ID NO: 2108171 - RNA, 24 nt, Homo sapiens
accuguacauucuuccaucaucac

SEQ ID NO: 2108172 - RNA, 15 nt, Homo sapiens
gcuccauagacauca

SEQ ID NO: 2108173 - RNA, 16 nt, Homo sapiens
aguuggagugcaaugg

SEQ ID NO: 2108174 - RNA, 15 nt, Homo sapiens
auguauucagcuuua

SEQ ID NO: 2108175 - RNA, 20 nt, Homo sapiens
agaaaauaugaccagaucag

SEQ ID NO: 2108176 - RNA, 18 nt, Homo sapiens
uccauaacugaacaucca

SEQ ID NO: 2108177 - RNA, 15 nt, Homo sapiens
accuugaagacuauu

SEQ ID NO: 2108178 - RNA, 19 nt, Homo sapiens
aaagaucuuucauuuugca

SEQ ID NO: 2108179 - RNA, 23 nt, Homo sapiens
gagaaaaaauauuuuccugccag

SEQ ID NO: 2108180 - RNA, 22 nt, Homo sapiens
aaugcauaauaacuacuuccau

SEQ ID NO: 2108181 - RNA, 18 nt, Homo sapiens
ugaaacuugugucauuga

SEQ ID NO: 2108182 - RNA, 22 nt, Homo sapiens
cucuacugaggugcuauguucu

SEQ ID NO: 2108183 - RNA, 22 nt, Homo sapiens
aauucugagcuggcccuuucca

SEQ ID NO: 2108184 - RNA, 15 nt, Homo sapiens
cuguauucugaccca

SEQ ID NO: 2108185 - RNA, 15 nt, Homo sapiens
uggagguugugcaug

SEQ ID NO: 2108186 - RNA, 13 nt, Homo sapiens
uacuuaugcaaga

SEQ ID NO: 2108187 - RNA, 20 nt, Homo sapiens
cauucuagcugagaagcaau

SEQ ID NO: 2108188 - RNA, 22 nt, Homo sapiens
acauuugaagaaacuccaccua

SEQ ID NO: 2108189 - RNA, 21 nt, Homo sapiens
gacacauuaaugauaaacuca

SEQ ID NO: 2108190 - RNA, 15 nt, Homo sapiens
gaguucaauggcugc

SEQ ID NO: 2108191 - RNA, 17 nt, Homo sapiens
agggggaagaagcagag

SEQ ID NO: 2108192 - RNA, 14 nt, Homo sapiens
ugccucucuugcca

SEQ ID NO: 2108193 - RNA, 15 nt, Homo sapiens
auuauuuuggaucua

SEQ ID NO: 2108194 - RNA, 17 nt, Homo sapiens
uguaucagcacuccuca

SEQ ID NO: 2108195 - RNA, 22 nt, Homo sapiens
aucccugacaucuggaaucugg

SEQ ID NO: 2108196 - RNA, 12 nt, Homo sapiens
ugagcagacaga

SEQ ID NO: 2108197 - RNA, 21 nt, Homo sapiens
cuuggggaccagagcugccac

SEQ ID NO: 2108198 - RNA, 15 nt, Homo sapiens
aaccucuccaaagag

SEQ ID NO: 2108199 - RNA, 11 nt, Homo sapiens
ggcaccuggga

SEQ ID NO: 2108200 - RNA, 11 nt, Homo sapiens
cccaccugcca

SEQ ID NO: 2108201 - RNA, 16 nt, Homo sapiens
accagauuugaggcug

SEQ ID NO: 2108202 - RNA, 21 nt, Homo sapiens
aguuuguggaagcacaggcaa

SEQ ID NO: 2108203 - RNA, 21 nt, Homo sapiens
cggaaugucauagucuugaaa

SEQ ID NO: 2108204 - RNA, 18 nt, Homo sapiens
aacauaaaaugaggcagu

SEQ ID NO: 2108205 - RNA, 16 nt, Homo sapiens
agucuaaacuguuaaa

SEQ ID NO: 2108206 - RNA, 16 nt, Homo sapiens
cugcuuaaaguuuuaa

SEQ ID NO: 2108207 - RNA, 19 nt, Homo sapiens
ucugucucauccaaaaagu

SEQ ID NO: 2108208 - RNA, 15 nt, Homo sapiens
gcacaugugugcgug

SEQ ID NO: 2108209 - RNA, 14 nt, Homo sapiens
cacuuccuccagga

SEQ ID NO: 2108210 - RNA, 18 nt, Homo sapiens
cuagagucucacugcugg

SEQ ID NO: 2108211 - RNA, 18 nt, Homo sapiens
ucuuaauugcaucaguau

SEQ ID NO: 2108212 - RNA, 23 nt, Homo sapiens
aaugccccauggggcaucucuug

SEQ ID NO: 2108213 - RNA, 16 nt, Homo sapiens
cuaggugcacauauac

SEQ ID NO: 2108214 - RNA, 19 nt, Homo sapiens
ugcacagauacacauacac

SEQ ID NO: 2108215 - RNA, 22 nt, Homo sapiens
agggcaagggaggggugguauu

SEQ ID NO: 2108216 - RNA, 16 nt, Homo sapiens
uguugaaauugucaaa

SEQ ID NO: 2108217 - RNA, 13 nt, Homo sapiens
caaggcaaacccu

SEQ ID NO: 2108218 - RNA, 17 nt, Homo sapiens
gcauaucuguuauaugu

SEQ ID NO: 2108219 - RNA, 15 nt, Homo sapiens
cgggugugaagcaca

SEQ ID NO: 2108220 - RNA, 22 nt, Homo sapiens
cagacacccagaauguagcauc

SEQ ID NO: 2108221 - RNA, 16 nt, Homo sapiens
gucuuuuuguaucuca

SEQ ID NO: 2108222 - RNA, 18 nt, Homo sapiens
ucaucgggguggugcagg

SEQ ID NO: 2108223 - RNA, 22 nt, Homo sapiens
gucuuuucaaaaggauuuacuu

SEQ ID NO: 2108224 - RNA, 23 nt, Homo sapiens
uagcuuuaaaaccugugugccau

SEQ ID NO: 2108225 - RNA, 15 nt, Homo sapiens
ccuaccacagugucu

SEQ ID NO: 2108226 - RNA, 13 nt, Homo sapiens
uauguaacaaagu

SEQ ID NO: 2108227 - RNA, 19 nt, Homo sapiens
agggacauaaguucauuca

SEQ ID NO: 2108228 - RNA, 15 nt, Homo sapiens
ucugaaccacuuugc

SEQ ID NO: 2108229 - RNA, 17 nt, Homo sapiens
uuugccaaggcaaaaaa

SEQ ID NO: 2108230 - RNA, 16 nt, Homo sapiens
gaaaauguuuaugcca

SEQ ID NO: 2108231 - RNA, 22 nt, Homo sapiens
gcaccgagagagauggaauaaa

SEQ ID NO: 2108232 - RNA, 13 nt, Homo sapiens
ugguccagcucuu

SEQ ID NO: 2108233 - RNA, 15 nt, Homo sapiens
guaauaauaccucaa

SEQ ID NO: 2108234 - RNA, 16 nt, Homo sapiens
ggaacagcauaugcaa

SEQ ID NO: 2108235 - RNA, 19 nt, Homo sapiens
cuucuggagucuccagugg

SEQ ID NO: 2108236 - RNA, 21 nt, Homo sapiens
ccguuucuuaaaaaacauaua

SEQ ID NO: 2108237 - RNA, 14 nt, Homo sapiens
uccuuaggccucug

SEQ ID NO: 2108238 - RNA, 23 nt, Homo sapiens
uaaacacuaaucacaaacugaau

SEQ ID NO: 2108239 - RNA, 17 nt, Homo sapiens
cacaggcccuagcuuua

SEQ ID NO: 2108240 - RNA, 16 nt, Homo sapiens
cugcgggacagaggac

SEQ ID NO: 2108241 - RNA, 21 nt, Homo sapiens
uuguauaagaagauacacugc

SEQ ID NO: 2108242 - RNA, 14 nt, Homo sapiens
cuuuugcucccuac

SEQ ID NO: 2108243 - RNA, 22 nt, Homo sapiens
acuuagaaauugcauuuccuga

SEQ ID NO: 2108244 - RNA, 17 nt, Homo sapiens
caaaauuguaagccaga

SEQ ID NO: 2108245 - RNA, 22 nt, Homo sapiens
gaaaaagaucuuucauuuugca

SEQ ID NO: 2108246 - RNA, 19 nt, Homo sapiens
aaacuguacagaauuucca

SEQ ID NO: 2108247 - RNA, 15 nt, Homo sapiens
gagaaguaauuccuc

SEQ ID NO: 2108248 - RNA, 12 nt, Homo sapiens
cugccaaaaagg

SEQ ID NO: 2108249 - RNA, 14 nt, Homo sapiens
gaagacuucauccc

SEQ ID NO: 2108250 - RNA, 23 nt, Homo sapiens
ccauguuggccaggcugaucuca

SEQ ID NO: 2108251 - RNA, 13 nt, Homo sapiens
acaguauagucac

SEQ ID NO: 2108252 - RNA, 18 nt, Homo sapiens
aacuauugagccuugcau

SEQ ID NO: 2108253 - RNA, 21 nt, Homo sapiens
uaaguccacucuaguugugga

SEQ ID NO: 2108254 - RNA, 16 nt, Homo sapiens
uaaaaauaugcuucua

SEQ ID NO: 2108255 - RNA, 18 nt, Homo sapiens
guaccugcccccaaucca

SEQ ID NO: 2108256 - RNA, 13 nt, Homo sapiens
auuuguuaaugau

SEQ ID NO: 2108257 - RNA, 20 nt, Homo sapiens
uacaugaauacgucuugauc

SEQ ID NO: 2108258 - RNA, 22 nt, Homo sapiens
auaucucuuuuauuucacucaa

SEQ ID NO: 2108259 - RNA, 22 nt, Homo sapiens
ccaugaaacuuuagagauuaac

SEQ ID NO: 2108260 - RNA, 23 nt, Homo sapiens
aagugggggaguggccacagaaa

SEQ ID NO: 2108261 - RNA, 18 nt, Homo sapiens
agcgagaagaugcucugg

SEQ ID NO: 2108262 - RNA, 21 nt, Homo sapiens
accuaaaauuaagaaguacaa

SEQ ID NO: 2108263 - RNA, 18 nt, Homo sapiens
uucaggcagcagugucug

SEQ ID NO: 2108264 - RNA, 15 nt, Homo sapiens
guucugagcaccgug

SEQ ID NO: 2108265 - RNA, 22 nt, Homo sapiens
cagugagcugagaucguaccua

SEQ ID NO: 2108266 - RNA, 21 nt, Homo sapiens
auacagaguuuuagaaaugag

SEQ ID NO: 2108267 - RNA, 13 nt, Homo sapiens
aaccaaagaccau

SEQ ID NO: 2108268 - RNA, 19 nt, Homo sapiens
uaaaaaauuaugacaaugu

SEQ ID NO: 2108269 - RNA, 18 nt, Homo sapiens
uccaaauguccuuucuca

SEQ ID NO: 2108270 - RNA, 16 nt, Homo sapiens
uggccacugaaaagcu

SEQ ID NO: 2108271 - RNA, 19 nt, Homo sapiens
aaagugcuuccaaggcaga

SEQ ID NO: 2108272 - RNA, 12 nt, Homo sapiens
uccugcaaugaa

SEQ ID NO: 2108273 - RNA, 19 nt, Homo sapiens
cucugacgcaccacugcca

SEQ ID NO: 2108274 - RNA, 15 nt, Homo sapiens
aaaaguaauauuuau

SEQ ID NO: 2108275 - RNA, 20 nt, Homo sapiens
ugggaacugugccuuugagu

SEQ ID NO: 2108276 - RNA, 21 nt, Homo sapiens
ugauauuauuucaggguccca

SEQ ID NO: 2108277 - RNA, 21 nt, Homo sapiens
uuggaacuauacccgggacca

SEQ ID NO: 2108278 - RNA, 23 nt, Homo sapiens
agcugagguuuagaugugcaacc

SEQ ID NO: 2108279 - RNA, 14 nt, Homo sapiens
uguaauugcuuguu

SEQ ID NO: 2108280 - RNA, 20 nt, Homo sapiens
uucuuugacauuugguggua

SEQ ID NO: 2108281 - RNA, 21 nt, Homo sapiens
ugcagaugaucagggauccaa

SEQ ID NO: 2108282 - RNA, 20 nt, Homo sapiens
auuuacucugcuccaaagua

SEQ ID NO: 2108283 - RNA, 13 nt, Homo sapiens
uagugucaccugc

SEQ ID NO: 2108284 - RNA, 18 nt, Homo sapiens
uagucuguuagauuuuau

SEQ ID NO: 2108285 - RNA, 15 nt, Homo sapiens
caugucaccuggcug

SEQ ID NO: 2108286 - RNA, 16 nt, Homo sapiens
ucuauuuaagugcaau

SEQ ID NO: 2108287 - RNA, 15 nt, Homo sapiens
gggacgggggcugcu

SEQ ID NO: 2108288 - RNA, 19 nt, Homo sapiens
aggggcucccuacauuccc

SEQ ID NO: 2108289 - RNA, 12 nt, Homo sapiens
aggaauuucuga

SEQ ID NO: 2108290 - RNA, 20 nt, Homo sapiens
ccuacauuaucucacuuagu

SEQ ID NO: 2108291 - RNA, 22 nt, Homo sapiens
cgcacccaguuugauaccugca

SEQ ID NO: 2108292 - RNA, 13 nt, Homo sapiens
aaucuuauuguca

SEQ ID NO: 2108293 - RNA, 12 nt, Homo sapiens
agcuccuuccac

SEQ ID NO: 2108294 - RNA, 22 nt, Homo sapiens
accuugaggagucuugugugca

SEQ ID NO: 2108295 - RNA, 21 nt, Homo sapiens
aguuagccagguaugguggca

SEQ ID NO: 2108296 - RNA, 14 nt, Homo sapiens
aauaaucuuggcaa

SEQ ID NO: 2108297 - RNA, 11 nt, Homo sapiens
guuuggcacug

SEQ ID NO: 2108298 - RNA, 15 nt, Homo sapiens
ggcuaguggggugaa

SEQ ID NO: 2108299 - RNA, 21 nt, Homo sapiens
aaacauuucuaagacuacuaa

SEQ ID NO: 2108300 - RNA, 17 nt, Homo sapiens
ggacaaaugaugccaug

SEQ ID NO: 2108301 - RNA, 17 nt, Homo sapiens
caguguuggcaagcucu

SEQ ID NO: 2108302 - RNA, 17 nt, Homo sapiens
accugcgcacagguggg

SEQ ID NO: 2108303 - RNA, 19 nt, Homo sapiens
auuuuguaacgaagacaca

SEQ ID NO: 2108304 - RNA, 20 nt, Homo sapiens
agaagcugcccucagccaga

SEQ ID NO: 2108305 - RNA, 17 nt, Homo sapiens
acaaguaaaacuguggu

SEQ ID NO: 2108306 - RNA, 15 nt, Homo sapiens
cacuacuuuacuguu

SEQ ID NO: 2108307 - RNA, 11 nt, Homo sapiens
aggugaucuca

SEQ ID NO: 2108308 - RNA, 20 nt, Homo sapiens
acucuuguguuuuuugcuca

SEQ ID NO: 2108309 - RNA, 22 nt, Homo sapiens
agggguucuucuggggugcuaa

SEQ ID NO: 2108310 - RNA, 15 nt, Homo sapiens
cuuuguuuuguugcu

SEQ ID NO: 2108311 - RNA, 23 nt, Homo sapiens
ucccauugucaccuaacucugaa

SEQ ID NO: 2108312 - RNA, 16 nt, Homo sapiens
uccuucucauugcugc

SEQ ID NO: 2108313 - RNA, 13 nt, Homo sapiens
caucugugccaga

SEQ ID NO: 2108314 - RNA, 14 nt, Homo sapiens
uauggccacauuca

SEQ ID NO: 2108315 - RNA, 15 nt, Homo sapiens
cuccugcugauccag

SEQ ID NO: 2108316 - RNA, 19 nt, Homo sapiens
caugcccacaacuugucac

SEQ ID NO: 2108317 - RNA, 15 nt, Homo sapiens
uguuucacauugcac

SEQ ID NO: 2108318 - RNA, 20 nt, Homo sapiens
acugugaacuuggggaacaa

SEQ ID NO: 2108319 - RNA, 19 nt, Homo sapiens
caagcucuaucaccaagga

SEQ ID NO: 2108320 - RNA, 14 nt, Homo sapiens
cacguuucuucccc

SEQ ID NO: 2108321 - RNA, 18 nt, Homo sapiens
uaaaugucuuaaucauga

SEQ ID NO: 2108322 - RNA, 19 nt, Homo sapiens
cuacugucuggaagacaug

SEQ ID NO: 2108323 - RNA, 14 nt, Homo sapiens
acaacaucauucca

SEQ ID NO: 2108324 - RNA, 20 nt, Homo sapiens
caucuagucacaaagacucc

SEQ ID NO: 2108325 - RNA, 15 nt, Homo sapiens
ugccuuaaaauggaa

SEQ ID NO: 2108326 - RNA, 23 nt, Homo sapiens
cucuggugggaaaauguccccca

SEQ ID NO: 2108327 - RNA, 13 nt, Homo sapiens
augagacauuagg

SEQ ID NO: 2108328 - RNA, 20 nt, Homo sapiens
ccuacuuuauguauggagcu

SEQ ID NO: 2108329 - RNA, 12 nt, Homo sapiens
guaaaacaugcu

SEQ ID NO: 2108330 - RNA, 20 nt, Homo sapiens
guguauauauuauauauaca

SEQ ID NO: 2108331 - RNA, 19 nt, Homo sapiens
caaagacauagaugugaaa

SEQ ID NO: 2108332 - RNA, 20 nt, Homo sapiens
gaaacaaaaaaguguucccu

SEQ ID NO: 2108333 - RNA, 23 nt, Homo sapiens
agguacaucguuugcaaauguca

SEQ ID NO: 2108334 - RNA, 15 nt, Homo sapiens
uuggauugggguccc

SEQ ID NO: 2108335 - RNA, 13 nt, Homo sapiens
cgcuugcuuuagc

SEQ ID NO: 2108336 - RNA, 18 nt, Homo sapiens
uaaaacuuguuacaccac

SEQ ID NO: 2108337 - RNA, 18 nt, Homo sapiens
ccaaaucaaaugcucacu

SEQ ID NO: 2108338 - RNA, 18 nt, Homo sapiens
guaguucaauagucuaau

SEQ ID NO: 2108339 - RNA, 18 nt, Homo sapiens
uguagcuccuccccugga

SEQ ID NO: 2108340 - RNA, 17 nt, Homo sapiens
uaccauauguagcauua

SEQ ID NO: 2108341 - RNA, 14 nt, Homo sapiens
cugucaccuagcuc

SEQ ID NO: 2108342 - RNA, 18 nt, Homo sapiens
gacagcaaggaacuguca

SEQ ID NO: 2108343 - RNA, 21 nt, Homo sapiens
gaucagaugcugaauugagaa

SEQ ID NO: 2108344 - RNA, 16 nt, Homo sapiens
cccgacagugccaucc

SEQ ID NO: 2108345 - RNA, 21 nt, Homo sapiens
uaaaguauuauuuauuugaau

SEQ ID NO: 2108346 - RNA, 14 nt, Homo sapiens
ucagggcuuccuua

SEQ ID NO: 2108347 - RNA, 12 nt, Homo sapiens
cugccugaagag

SEQ ID NO: 2108348 - RNA, 16 nt, Homo sapiens
uucuauguagaacugu

SEQ ID NO: 2108349 - RNA, 14 nt, Homo sapiens
cucuuucagugcuu

SEQ ID NO: 2108350 - RNA, 19 nt, Homo sapiens
aauucuaugucuagcacau

SEQ ID NO: 2108351 - RNA, 23 nt, Homo sapiens
agaaaaaaaaugagaaaaaagua

SEQ ID NO: 2108352 - RNA, 16 nt, Homo sapiens
uaccugggaccuccac

SEQ ID NO: 2108353 - RNA, 12 nt, Homo sapiens
ucccccccaugc

SEQ ID NO: 2108354 - RNA, 12 nt, Homo sapiens
uccuccccaugu

SEQ ID NO: 2108355 - RNA, 15 nt, Homo sapiens
ccuggcugagcaguu

SEQ ID NO: 2108356 - RNA, 15 nt, Homo sapiens
cagcggccucagggu

SEQ ID NO: 2108357 - RNA, 21 nt, Homo sapiens
ggccaccuagaaaggggccca

SEQ ID NO: 2108358 - RNA, 14 nt, Homo sapiens
uuuauucauccagc

SEQ ID NO: 2108359 - RNA, 21 nt, Homo sapiens
auuugaaugugguuacuuccu

SEQ ID NO: 2108360 - RNA, 17 nt, Homo sapiens
cuguuugucugaacaaa

SEQ ID NO: 2108361 - RNA, 17 nt, Homo sapiens
aacccuccagaccuccc

SEQ ID NO: 2108362 - RNA, 22 nt, Homo sapiens
uagcuuccaagagacaugcuga

SEQ ID NO: 2108363 - RNA, 21 nt, Homo sapiens
uuucaguauuguaaagagauu

SEQ ID NO: 2108364 - RNA, 20 nt, Homo sapiens
uuaccgccugucucuuuaag

SEQ ID NO: 2108365 - RNA, 23 nt, Homo sapiens
cuaauaauuguaucuacauuaaa

SEQ ID NO: 2108366 - RNA, 21 nt, Homo sapiens
ucaaaaauuagugaaguucuu

SEQ ID NO: 2108367 - RNA, 18 nt, Homo sapiens
uaaacauaugcaaacagc

SEQ ID NO: 2108368 - RNA, 14 nt, Homo sapiens
cuggcuaacugaug

SEQ ID NO: 2108369 - RNA, 15 nt, Homo sapiens
ccaaacauguuccca

SEQ ID NO: 2108370 - RNA, 16 nt, Homo sapiens
auuaaagauaucaaua

SEQ ID NO: 2108371 - RNA, 21 nt, Homo sapiens
guugcauuuaugaugcaguuu

SEQ ID NO: 2108372 - RNA, 13 nt, Homo sapiens
agcccuaccuaaa

SEQ ID NO: 2108373 - RNA, 17 nt, Homo sapiens
acugaaaagccaugugu

SEQ ID NO: 2108374 - RNA, 19 nt, Homo sapiens
agcauaccccgaaguggag

SEQ ID NO: 2108375 - RNA, 23 nt, Homo sapiens
uucuaugagaccucccccaggga

SEQ ID NO: 2108376 - RNA, 20 nt, Homo sapiens
gauuuuuuucauuuugccaa

SEQ ID NO: 2108377 - RNA, 19 nt, Homo sapiens
aauauucacucuccauuag

SEQ ID NO: 2108378 - RNA, 15 nt, Homo sapiens
gcugaacgacagucc

SEQ ID NO: 2108379 - RNA, 21 nt, Homo sapiens
aauaucuuuaauagguuaaua

SEQ ID NO: 2108380 - RNA, 14 nt, Homo sapiens
ggaaaggauucaug

SEQ ID NO: 2108381 - RNA, 14 nt, Homo sapiens
uggccagugcugcu

SEQ ID NO: 2108382 - RNA, 19 nt, Homo sapiens
uucucuggcucuuguccau

SEQ ID NO: 2108383 - RNA, 15 nt, Homo sapiens
augccucuaaucuca

SEQ ID NO: 2108384 - RNA, 22 nt, Homo sapiens
auauauacguauguauauacac

SEQ ID NO: 2108385 - RNA, 16 nt, Homo sapiens
aaauauuuugguucau

SEQ ID NO: 2108386 - RNA, 15 nt, Homo sapiens
uaauaaagcuuuaua

SEQ ID NO: 2108387 - RNA, 12 nt, Homo sapiens
cuucagagccag

SEQ ID NO: 2108388 - RNA, 14 nt, Homo sapiens
ucaaagacauggaa

SEQ ID NO: 2108389 - RNA, 20 nt, Homo sapiens
aauaaacacacuauggcaug

SEQ ID NO: 2108390 - RNA, 22 nt, Homo sapiens
uuaauaacagaaauacaucaua

SEQ ID NO: 2108391 - RNA, 23 nt, Homo sapiens
gauuuuggggagacaaagggaaa

SEQ ID NO: 2108392 - RNA, 17 nt, Homo sapiens
guaaagcuuugugcaga

SEQ ID NO: 2108393 - RNA, 22 nt, Homo sapiens
accaucugcacuggcaucuagu

SEQ ID NO: 2108394 - RNA, 21 nt, Homo sapiens
acauaccagagucuggagcug

SEQ ID NO: 2108395 - RNA, 18 nt, Homo sapiens
acgacuguuguacaagcu

SEQ ID NO: 2108396 - RNA, 13 nt, Homo sapiens
cacuugugccagc

SEQ ID NO: 2108397 - RNA, 14 nt, Homo sapiens
uuguuuuuuacuca

SEQ ID NO: 2108398 - RNA, 14 nt, Homo sapiens
aauaaguucuuaaa

SEQ ID NO: 2108399 - RNA, 18 nt, Homo sapiens
caaaucguuuauuucaca

SEQ ID NO: 2108400 - RNA, 17 nt, Homo sapiens
agcacucucaccccaag

SEQ ID NO: 2108401 - RNA, 13 nt, Homo sapiens
cacuagaugccaa

SEQ ID NO: 2108402 - RNA, 20 nt, Homo sapiens
uccaggauggaugcaucaca

SEQ ID NO: 2108403 - RNA, 20 nt, Homo sapiens
cacgguguucugugauauaa

SEQ ID NO: 2108404 - RNA, 16 nt, Homo sapiens
gacaggacuaacacuc

SEQ ID NO: 2108405 - RNA, 18 nt, Homo sapiens
caguagugcaccaucuca

SEQ ID NO: 2108406 - RNA, 21 nt, Homo sapiens
aauccuaguuuaugcacauga

SEQ ID NO: 2108407 - RNA, 21 nt, Homo sapiens
aacaaugugggcguuuguaaa

SEQ ID NO: 2108408 - RNA, 18 nt, Homo sapiens
cuguuaggcucacaguua

SEQ ID NO: 2108409 - RNA, 23 nt, Homo sapiens
gggugucacgagcccauucucau

SEQ ID NO: 2108410 - RNA, 22 nt, Homo sapiens
cuuaaauuucaaaccauuuacc

SEQ ID NO: 2108411 - RNA, 21 nt, Homo sapiens
aagguauuuuguagaugugau

SEQ ID NO: 2108412 - RNA, 19 nt, Homo sapiens
acucuccaaauagcauuag

SEQ ID NO: 2108413 - RNA, 20 nt, Homo sapiens
caggaaauaccaacugaagu

SEQ ID NO: 2108414 - RNA, 13 nt, Homo sapiens
uaaaugacaagca

SEQ ID NO: 2108415 - RNA, 17 nt, Homo sapiens
agcucuaauguuugcau

SEQ ID NO: 2108416 - RNA, 14 nt, Homo sapiens
aucuuaaguaccaa

SEQ ID NO: 2108417 - RNA, 23 nt, Homo sapiens
gcgcuauugcuucagcugcugaa

SEQ ID NO: 2108418 - RNA, 18 nt, Homo sapiens
caaguauucaguuccaau

SEQ ID NO: 2108419 - RNA, 13 nt, Homo sapiens
aguggcagccaag

SEQ ID NO: 2108420 - RNA, 17 nt, Homo sapiens
ccagaagcuuccauagu

SEQ ID NO: 2108421 - RNA, 12 nt, Homo sapiens
cuucaagaaugg

SEQ ID NO: 2108422 - RNA, 13 nt, Homo sapiens
uuuuuaucuccaa

SEQ ID NO: 2108423 - RNA, 17 nt, Homo sapiens
uccaccucccugcaaua

SEQ ID NO: 2108424 - RNA, 13 nt, Homo sapiens
cagcuguggugag

SEQ ID NO: 2108425 - RNA, 15 nt, Homo sapiens
ugguuuaaaagucac

SEQ ID NO: 2108426 - RNA, 14 nt, Homo sapiens
acagcagggacaag

SEQ ID NO: 2108427 - RNA, 18 nt, Homo sapiens
caagugauccucaggcag

SEQ ID NO: 2108428 - RNA, 18 nt, Homo sapiens
acuacaaacaaaagcagc

SEQ ID NO: 2108429 - RNA, 14 nt, Homo sapiens
caagauauggacac

SEQ ID NO: 2108430 - RNA, 16 nt, Homo sapiens
gccucaggcacucucc

SEQ ID NO: 2108431 - RNA, 21 nt, Homo sapiens
uguuucuuaagggcacacaca

SEQ ID NO: 2108432 - RNA, 14 nt, Homo sapiens
auucucuuacccag

SEQ ID NO: 2108433 - RNA, 18 nt, Homo sapiens
uugccuuggagaucaaaa

SEQ ID NO: 2108434 - RNA, 16 nt, Homo sapiens
acaaacccaaaaaaga

SEQ ID NO: 2108435 - RNA, 14 nt, Homo sapiens
cgccagcuccccca

SEQ ID NO: 2108436 - RNA, 22 nt, Homo sapiens
cuggcaaaaaugcaacaaauga

SEQ ID NO: 2108437 - RNA, 20 nt, Homo sapiens
aauacacaauccuccaagaa

SEQ ID NO: 2108438 - RNA, 18 nt, Homo sapiens
auuuucuccaugucugua

SEQ ID NO: 2108439 - RNA, 17 nt, Homo sapiens
uaccauggcacugacaa

SEQ ID NO: 2108440 - RNA, 12 nt, Homo sapiens
cagugcugugag

SEQ ID NO: 2108441 - RNA, 12 nt, Homo sapiens
cagggcugugau

SEQ ID NO: 2108442 - RNA, 23 nt, Homo sapiens
ugguuguugcaguucagacaaau

SEQ ID NO: 2108443 - RNA, 17 nt, Homo sapiens
guauugucuacucugaa

SEQ ID NO: 2108444 - RNA, 17 nt, Homo sapiens
ccucucugcuccagaga

SEQ ID NO: 2108445 - RNA, 15 nt, Homo sapiens
ccaguugcagguaau

SEQ ID NO: 2108446 - RNA, 17 nt, Homo sapiens
caguucacugcugcaug

SEQ ID NO: 2108447 - RNA, 17 nt, Homo sapiens
cuuagggacagucaaaa

SEQ ID NO: 2108448 - RNA, 12 nt, Homo sapiens
auaucuaaaaac

SEQ ID NO: 2108449 - RNA, 24 nt, Homo sapiens
gucucuaucuugcaucuaccugcu

SEQ ID NO: 2108450 - RNA, 23 nt, Homo sapiens
cuggagcucuugugucauuguua

SEQ ID NO: 2108451 - RNA, 20 nt, Homo sapiens
aauucugucauuucaaagac

SEQ ID NO: 2108452 - RNA, 19 nt, Homo sapiens
cacugagaaagccaaugac

SEQ ID NO: 2108453 - RNA, 16 nt, Homo sapiens
ggcaauugacuuccuc

SEQ ID NO: 2108454 - RNA, 18 nt, Homo sapiens
uugaaaccaagcuuucaa

SEQ ID NO: 2108455 - RNA, 15 nt, Homo sapiens
ucucguuucaaaaac

SEQ ID NO: 2108456 - RNA, 19 nt, Homo sapiens
cuccaggccaugauggccu

SEQ ID NO: 2108457 - RNA, 20 nt, Homo sapiens
cuugccuccaggaccuugcu

SEQ ID NO: 2108458 - RNA, 18 nt, Homo sapiens
acucaguaacagugcagu

SEQ ID NO: 2108459 - RNA, 15 nt, Homo sapiens
aagcaugaaaacuga

SEQ ID NO: 2108460 - RNA, 15 nt, Homo sapiens
accccuacucacaua

SEQ ID NO: 2108461 - RNA, 15 nt, Homo sapiens
uuaccuccauccauc

SEQ ID NO: 2108462 - RNA, 21 nt, Homo sapiens
cuuauuaagagcaaacuuuag

SEQ ID NO: 2108463 - RNA, 12 nt, Homo sapiens
augcuaguucau

SEQ ID NO: 2108464 - RNA, 23 nt, Homo sapiens
acccaggcacugggcaagugaag

SEQ ID NO: 2108465 - RNA, 13 nt, Homo sapiens
aaaagcaccaaag

SEQ ID NO: 2108466 - RNA, 23 nt, Homo sapiens
aaggauauuuaagaaaauacaau

SEQ ID NO: 2108467 - RNA, 16 nt, Homo sapiens
cuauaugcuuacugug

SEQ ID NO: 2108468 - RNA, 14 nt, Homo sapiens
uucguuaaucuugc

SEQ ID NO: 2108469 - RNA, 17 nt, Homo sapiens
acucaaaacucuugaaa

SEQ ID NO: 2108470 - RNA, 15 nt, Homo sapiens
ucauccaacuggaag

SEQ ID NO: 2108471 - RNA, 13 nt, Homo sapiens
ccuucccaugacc

SEQ ID NO: 2108472 - RNA, 14 nt, Homo sapiens
aauuacugauauca

SEQ ID NO: 2108473 - RNA, 16 nt, Homo sapiens
cuugaggccaaaugag

SEQ ID NO: 2108474 - RNA, 23 nt, Homo sapiens
ucucuaaccgaauauucauggau

SEQ ID NO: 2108475 - RNA, 13 nt, Homo sapiens
aaaugcaccacuu

SEQ ID NO: 2108476 - RNA, 19 nt, Homo sapiens
cauaaaacaaaagcauuuu

SEQ ID NO: 2108477 - RNA, 16 nt, Homo sapiens
auuuuauuucugaaga

SEQ ID NO: 2108478 - RNA, 12 nt, Homo sapiens
gggugugucucu

SEQ ID NO: 2108479 - RNA, 16 nt, Homo sapiens
agaagcaaucuuugaa

SEQ ID NO: 2108480 - RNA, 16 nt, Homo sapiens
caaguagggcacaaaa

SEQ ID NO: 2108481 - RNA, 23 nt, Homo sapiens
auuucucaaucagugcagugaua

SEQ ID NO: 2108482 - RNA, 22 nt, Homo sapiens
gaggaaacuaguguuuguuaaa

SEQ ID NO: 2108483 - RNA, 17 nt, Homo sapiens
uguacaacuucugggcc

SEQ ID NO: 2108484 - RNA, 22 nt, Homo sapiens
acugcuacaccucugauuacaa

SEQ ID NO: 2108485 - RNA, 19 nt, Homo sapiens
ggcuggacuuuugcagcuu

SEQ ID NO: 2108486 - RNA, 19 nt, Homo sapiens
aucagaacaucaauuccag

SEQ ID NO: 2108487 - RNA, 22 nt, Homo sapiens
uugaaucuugucccagccucag

SEQ ID NO: 2108488 - RNA, 20 nt, Homo sapiens
agugagguguugcagcccaa

SEQ ID NO: 2108489 - RNA, 18 nt, Homo sapiens
ccagcccaagggcaucau

SEQ ID NO: 2108490 - RNA, 17 nt, Homo sapiens
caucugagagaggcuaa

SEQ ID NO: 2108491 - RNA, 22 nt, Homo sapiens
gggggagcugcagucccaugca

SEQ ID NO: 2108492 - RNA, 21 nt, Homo sapiens
cacagcaucauuuugcauuca

SEQ ID NO: 2108493 - RNA, 14 nt, Homo sapiens
cauuuacagucaua

SEQ ID NO: 2108494 - RNA, 15 nt, Homo sapiens
augugcgucagcaau

SEQ ID NO: 2108495 - RNA, 23 nt, Homo sapiens
aauguccuucuuuaucugugaua

SEQ ID NO: 2108496 - RNA, 19 nt, Homo sapiens
guacaucaaugauaaugcu

SEQ ID NO: 2108497 - RNA, 22 nt, Homo sapiens
gaaaaguauuuccaacuuguca

SEQ ID NO: 2108498 - RNA, 20 nt, Homo sapiens
aggucagcgugcuuagccuc

SEQ ID NO: 2108499 - RNA, 21 nt, Homo sapiens
ucaacugaggauguggcuuau

SEQ ID NO: 2108500 - RNA, 13 nt, Homo sapiens
caaaaaguaauca

SEQ ID NO: 2108501 - RNA, 17 nt, Homo sapiens
cucagccucuucucugc

SEQ ID NO: 2108502 - RNA, 15 nt, Homo sapiens
ccuggaaaucagggu

SEQ ID NO: 2108503 - RNA, 18 nt, Homo sapiens
auucugaggaagucuuau

SEQ ID NO: 2108504 - RNA, 22 nt, Homo sapiens
auaaugcuuucacaacauuugc

SEQ ID NO: 2108505 - RNA, 15 nt, Homo sapiens
auucucagugccaac

SEQ ID NO: 2108506 - RNA, 19 nt, Homo sapiens
agauauuguaagcauucuu

SEQ ID NO: 2108507 - RNA, 18 nt, Homo sapiens
uugaagagcauugcaugg

SEQ ID NO: 2108508 - RNA, 16 nt, Homo sapiens
ccacgucucuaaauaa

SEQ ID NO: 2108509 - RNA, 23 nt, Homo sapiens
caagagccauguaccaguguacu

SEQ ID NO: 2108510 - RNA, 21 nt, Homo sapiens
ucucaaauucucaaccuacca

SEQ ID NO: 2108511 - RNA, 17 nt, Homo sapiens
ccugcugcuucugcaaa

SEQ ID NO: 2108512 - RNA, 17 nt, Homo sapiens
ugcccacgucccgggca

SEQ ID NO: 2108513 - RNA, 18 nt, Homo sapiens
ugccagauccucuucuca

SEQ ID NO: 2108514 - RNA, 20 nt, Homo sapiens
guggaaaugagguuggggga

SEQ ID NO: 2108515 - RNA, 16 nt, Homo sapiens
auugaaaugauuucac

SEQ ID NO: 2108516 - RNA, 19 nt, Homo sapiens
uucuccugacuccagugag

SEQ ID NO: 2108517 - RNA, 16 nt, Homo sapiens
caaaccugaccacaga

SEQ ID NO: 2108518 - RNA, 20 nt, Homo sapiens
uccaggccgagaugugcaac

SEQ ID NO: 2108519 - RNA, 19 nt, Homo sapiens
uauuccugccuuucuucca

SEQ ID NO: 2108520 - RNA, 12 nt, Homo sapiens
auccuuggcagu

SEQ ID NO: 2108521 - RNA, 17 nt, Homo sapiens
gaauccuuccauuccac

SEQ ID NO: 2108522 - RNA, 15 nt, Homo sapiens
ucauuucuacugaag

SEQ ID NO: 2108523 - RNA, 18 nt, Homo sapiens
aaggggcauuacugggaa

SEQ ID NO: 2108524 - RNA, 15 nt, Homo sapiens
augcggauccugcug

SEQ ID NO: 2108525 - RNA, 21 nt, Homo sapiens
ucaaucauaauaccugcugug

SEQ ID NO: 2108526 - RNA, 16 nt, Homo sapiens
ucuacagcagcacugu

SEQ ID NO: 2108527 - RNA, 16 nt, Homo sapiens
ugacauucacugagug

SEQ ID NO: 2108528 - RNA, 12 nt, Homo sapiens
cuccucuugacu

SEQ ID NO: 2108529 - RNA, 14 nt, Homo sapiens
cuaacucacaggca

SEQ ID NO: 2108530 - RNA, 20 nt, Homo sapiens
uugugaucuguaacagggua

SEQ ID NO: 2108531 - RNA, 23 nt, Homo sapiens
uugccacuuagaauagcauuugc

SEQ ID NO: 2108532 - RNA, 12 nt, Homo sapiens
aggggguugugg

SEQ ID NO: 2108533 - RNA, 13 nt, Homo sapiens
gaccaauacuacu

SEQ ID NO: 2108534 - RNA, 15 nt, Homo sapiens
agauggggcauauuc

SEQ ID NO: 2108535 - RNA, 19 nt, Homo sapiens
uuaaccaaggaggggccag

SEQ ID NO: 2108536 - RNA, 17 nt, Homo sapiens
ucccagucucaucuccu

SEQ ID NO: 2108537 - RNA, 19 nt, Homo sapiens
caaugaauuuuauaaucug

SEQ ID NO: 2108538 - RNA, 19 nt, Homo sapiens
ugugaccccuuucacuuac

SEQ ID NO: 2108539 - RNA, 22 nt, Homo sapiens
gugucuuucucucucucucuuc

SEQ ID NO: 2108540 - RNA, 18 nt, Homo sapiens
cacaacuugucacccaaa

SEQ ID NO: 2108541 - RNA, 14 nt, Homo sapiens
ucuuugcccaaaug

SEQ ID NO: 2108542 - RNA, 14 nt, Homo sapiens
aggccagagaggga

SEQ ID NO: 2108543 - RNA, 16 nt, Homo sapiens
uucuuagcgcaguugu

SEQ ID NO: 2108544 - RNA, 16 nt, Homo sapiens
caauaccuacaaguca

SEQ ID NO: 2108545 - RNA, 19 nt, Homo sapiens
uuuaggaagcaagcuuaau

SEQ ID NO: 2108546 - RNA, 19 nt, Homo sapiens
augggagaaucacuugaac

SEQ ID NO: 2108547 - RNA, 21 nt, Homo sapiens
auguauguugcaugaauccau

SEQ ID NO: 2108548 - RNA, 15 nt, Homo sapiens
gaaaaauugccuuca

SEQ ID NO: 2108549 - RNA, 19 nt, Homo sapiens
aagccauuuacuuugcaag

SEQ ID NO: 2108550 - RNA, 22 nt, Homo sapiens
gggucaaguacaccagccaccu

SEQ ID NO: 2108551 - RNA, 19 nt, Homo sapiens
gugaucaacuguucagggu

SEQ ID NO: 2108552 - RNA, 14 nt, Homo sapiens
acuuccccugggca

SEQ ID NO: 2108553 - RNA, 14 nt, Homo sapiens
uguauccagaggaa

SEQ ID NO: 2108554 - RNA, 21 nt, Homo sapiens
uuucaaaaccagguccaauga

SEQ ID NO: 2108555 - RNA, 19 nt, Homo sapiens
aaauauuuacucuuugcaa

SEQ ID NO: 2108556 - RNA, 15 nt, Homo sapiens
gaccuccuccuucau

SEQ ID NO: 2108557 - RNA, 17 nt, Homo sapiens
auccuaaaaaguuccau

SEQ ID NO: 2108558 - RNA, 19 nt, Homo sapiens
ccaucaaacauaauucucu

SEQ ID NO: 2108559 - RNA, 11 nt, Homo sapiens
agcuacuuagc

SEQ ID NO: 2108560 - RNA, 20 nt, Homo sapiens
cgagaggugguuacaccaga

SEQ ID NO: 2108561 - RNA, 19 nt, Homo sapiens
ugacaggucauccuugcca

SEQ ID NO: 2108562 - RNA, 21 nt, Homo sapiens
caaaucugcuuucauccagcc

SEQ ID NO: 2108563 - RNA, 19 nt, Homo sapiens
uuccagggauuugccucac

SEQ ID NO: 2108564 - RNA, 22 nt, Homo sapiens
uaaacuucaccuacauuaucuc

SEQ ID NO: 2108565 - RNA, 17 nt, Homo sapiens
uauuaggauaauacaua

SEQ ID NO: 2108566 - RNA, 20 nt, Homo sapiens
agaagaccuuuacaguuugu

SEQ ID NO: 2108567 - RNA, 17 nt, Homo sapiens
uauuucauuccaguuug

SEQ ID NO: 2108568 - RNA, 14 nt, Homo sapiens
gaggagacagccuc

SEQ ID NO: 2108569 - RNA, 14 nt, Homo sapiens
agccagacgagguc

SEQ ID NO: 2108570 - RNA, 16 nt, Homo sapiens
augccaggcugugcua

SEQ ID NO: 2108571 - RNA, 18 nt, Homo sapiens
ggcagauuaaaagcacaa

SEQ ID NO: 2108572 - RNA, 21 nt, Homo sapiens
uauaccaaccaaaccaauuca

SEQ ID NO: 2108573 - RNA, 14 nt, Homo sapiens
aagccuuccuacac

SEQ ID NO: 2108574 - RNA, 13 nt, Homo sapiens
cagacacccucca

SEQ ID NO: 2108575 - RNA, 20 nt, Homo sapiens
gguaaaaaucuguaaauauc

SEQ ID NO: 2108576 - RNA, 23 nt, Homo sapiens
gcuggagcggagaggaagccagc

SEQ ID NO: 2108577 - RNA, 22 nt, Homo sapiens
caccaaucagcacucuguaaaa

SEQ ID NO: 2108578 - RNA, 16 nt, Homo sapiens
uagggcagacaugccu

SEQ ID NO: 2108579 - RNA, 14 nt, Homo sapiens
aacgcgacuuccac

SEQ ID NO: 2108580 - RNA, 20 nt, Homo sapiens
gggaggcggagguuccagug

SEQ ID NO: 2108581 - RNA, 16 nt, Homo sapiens
aauaagaugaaucacu

SEQ ID NO: 2108582 - RNA, 14 nt, Homo sapiens
gaucccgugugcca

SEQ ID NO: 2108583 - RNA, 17 nt, Homo sapiens
caugcccuguaccugug

SEQ ID NO: 2108584 - RNA, 22 nt, Homo sapiens
guauguauggaugcguggauau

SEQ ID NO: 2108585 - RNA, 16 nt, Homo sapiens
cagcauuuuugcacug

SEQ ID NO: 2108586 - RNA, 12 nt, Homo sapiens
cuggaugacauu

SEQ ID NO: 2108587 - RNA, 13 nt, Homo sapiens
aaagccaaaaaau

SEQ ID NO: 2108588 - RNA, 22 nt, Homo sapiens
agccgcgugugacagucuugca

SEQ ID NO: 2108589 - RNA, 18 nt, Homo sapiens
aggcagcagagggucucc

SEQ ID NO: 2108590 - RNA, 20 nt, Homo sapiens
ucuauaccgcuucgacugga

SEQ ID NO: 2108591 - RNA, 17 nt, Homo sapiens
aaagcggggagagggua

SEQ ID NO: 2108592 - RNA, 20 nt, Homo sapiens
uugcugagccagagucaaaa

SEQ ID NO: 2108593 - RNA, 21 nt, Homo sapiens
aguggggaguagucagaaguu

SEQ ID NO: 2108594 - RNA, 21 nt, Homo sapiens
cugacaguuguuuugcuucuu

SEQ ID NO: 2108595 - RNA, 24 nt, Homo sapiens
cagccugggccccagcucgcggga

SEQ ID NO: 2108596 - RNA, 15 nt, Homo sapiens
gucucaagacugaaa

SEQ ID NO: 2108597 - RNA, 13 nt, Homo sapiens
augagcuccagac

SEQ ID NO: 2108598 - RNA, 18 nt, Homo sapiens
aagauaccggugcuucug

SEQ ID NO: 2108599 - RNA, 18 nt, Homo sapiens
uaagacaacaggcauuuu

SEQ ID NO: 2108600 - RNA, 16 nt, Homo sapiens
aaugggcagagccagg

SEQ ID NO: 2108601 - RNA, 15 nt, Homo sapiens
gagccuucacaugaa

SEQ ID NO: 2108602 - RNA, 21 nt, Homo sapiens
gcagagaacuggaaagacaua

SEQ ID NO: 2108603 - RNA, 12 nt, Homo sapiens
ucaguugcaaau

SEQ ID NO: 2108604 - RNA, 12 nt, Homo sapiens
uauuuugcacug

SEQ ID NO: 2108605 - RNA, 18 nt, Homo sapiens
acaaagaauuucagucuc

SEQ ID NO: 2108606 - RNA, 20 nt, Homo sapiens
cuuggccaccaggacuccuu

SEQ ID NO: 2108607 - RNA, 20 nt, Homo sapiens
acgcuuguagaacucacucu

SEQ ID NO: 2108608 - RNA, 12 nt, Homo sapiens
uaaagugguggu

SEQ ID NO: 2108609 - RNA, 13 nt, Homo sapiens
aucccacauccca

SEQ ID NO: 2108610 - RNA, 16 nt, Homo sapiens
aacauaauucacuuuc

SEQ ID NO: 2108611 - RNA, 20 nt, Homo sapiens
aggaaucuccguagaauuuu

SEQ ID NO: 2108612 - RNA, 16 nt, Homo sapiens
aaaaaguguuuaucuu

SEQ ID NO: 2108613 - RNA, 13 nt, Homo sapiens
ugcacuuacauaa

SEQ ID NO: 2108614 - RNA, 22 nt, Homo sapiens
ggacagagcacguuugcagaag

SEQ ID NO: 2108615 - RNA, 17 nt, Homo sapiens
ccauuggauuuuuucca

SEQ ID NO: 2108616 - RNA, 23 nt, Homo sapiens
aaagucagaauaguccuugggca

SEQ ID NO: 2108617 - RNA, 12 nt, Homo sapiens
aacccagacuca

SEQ ID NO: 2108618 - RNA, 12 nt, Homo sapiens
uuuuuugauuga

SEQ ID NO: 2108619 - RNA, 22 nt, Homo sapiens
ucaauuuuaucccucaccugua

SEQ ID NO: 2108620 - RNA, 18 nt, Homo sapiens
cuccaagaggcuccugaa

SEQ ID NO: 2108621 - RNA, 18 nt, Homo sapiens
gcuccugaauaucaguca

SEQ ID NO: 2108622 - RNA, 13 nt, Homo sapiens
gcuuggagugggu

SEQ ID NO: 2108623 - RNA, 21 nt, Homo sapiens
uaaucugucaaaacacugugg

SEQ ID NO: 2108624 - RNA, 20 nt, Homo sapiens
ucaaguucagcccaccaucu

SEQ ID NO: 2108625 - RNA, 16 nt, Homo sapiens
uguuauuuguacaguu

SEQ ID NO: 2108626 - RNA, 16 nt, Homo sapiens
aaguauuuugaugaag

SEQ ID NO: 2108627 - RNA, 21 nt, Homo sapiens
acacagacccaaaccauacca

SEQ ID NO: 2108628 - RNA, 19 nt, Homo sapiens
caucccuuuuucugcuaau

SEQ ID NO: 2108629 - RNA, 22 nt, Homo sapiens
gcuuucaagugagacccaaagg

SEQ ID NO: 2108630 - RNA, 19 nt, Homo sapiens
cuaugaaguuggcacauuu

SEQ ID NO: 2108631 - RNA, 14 nt, Homo sapiens
ugaacuaugagucu

SEQ ID NO: 2108632 - RNA, 22 nt, Homo sapiens
cacuucugagaacucaucccua

SEQ ID NO: 2108633 - RNA, 17 nt, Homo sapiens
caacuauauuaucaugc

SEQ ID NO: 2108634 - RNA, 22 nt, Homo sapiens
uccagguugccucaacagcagg

SEQ ID NO: 2108635 - RNA, 11 nt, Homo sapiens
aaguucaguga

SEQ ID NO: 2108636 - RNA, 16 nt, Homo sapiens
agagugaaugccauuu

SEQ ID NO: 2108637 - RNA, 20 nt, Homo sapiens
uccagcaaaauggaagcaaa

SEQ ID NO: 2108638 - RNA, 18 nt, Homo sapiens
ucugcucaucauucucug

SEQ ID NO: 2108639 - RNA, 19 nt, Homo sapiens
cacccccaugcagccucuu

SEQ ID NO: 2108640 - RNA, 13 nt, Homo sapiens
ucuugcaccccaa

SEQ ID NO: 2108641 - RNA, 20 nt, Homo sapiens
uaauucaguuauuugcacaa

SEQ ID NO: 2108642 - RNA, 23 nt, Homo sapiens
ucuggaacauggacuuucuugca

SEQ ID NO: 2108643 - RNA, 19 nt, Homo sapiens
uuuauaugauucacaugcu

SEQ ID NO: 2108644 - RNA, 14 nt, Homo sapiens
ccaaggcgugcagg

SEQ ID NO: 2108645 - RNA, 19 nt, Homo sapiens
acagcacauuuguuaauga

SEQ ID NO: 2108646 - RNA, 22 nt, Homo sapiens
gaccugugaccagcacugucuc

SEQ ID NO: 2108647 - RNA, 12 nt, Homo sapiens
gcaagugcuauu

SEQ ID NO: 2108648 - RNA, 15 nt, Homo sapiens
uguuccugacuguuc

SEQ ID NO: 2108649 - RNA, 12 nt, Homo sapiens
agcaugugcaau

SEQ ID NO: 2108650 - RNA, 20 nt, Homo sapiens
ccaaaauaagaugaaucacu

SEQ ID NO: 2108651 - RNA, 21 nt, Homo sapiens
cuucagccucauucacugucc

SEQ ID NO: 2108652 - RNA, 23 nt, Homo sapiens
cacuuggggauuaucugucauuc

SEQ ID NO: 2108653 - RNA, 17 nt, Homo sapiens
ccauaauguuccuuagu

SEQ ID NO: 2108654 - RNA, 19 nt, Homo sapiens
ugacuuuccccaccagaug

SEQ ID NO: 2108655 - RNA, 16 nt, Homo sapiens
agguggggacucugga

SEQ ID NO: 2108656 - RNA, 21 nt, Homo sapiens
uacaggugauucguuggaaaa

SEQ ID NO: 2108657 - RNA, 18 nt, Homo sapiens
agcucuauuaugaaugug

SEQ ID NO: 2108658 - RNA, 14 nt, Homo sapiens
uuccuuuaauccca

SEQ ID NO: 2108659 - RNA, 17 nt, Homo sapiens
uguuuugacacaccccu

SEQ ID NO: 2108660 - RNA, 15 nt, Homo sapiens
cacgcacugcacugc

SEQ ID NO: 2108661 - RNA, 15 nt, Homo sapiens
gcagugcucacccac

SEQ ID NO: 2108662 - RNA, 10 nt, Homo sapiens
uuggggacuc

SEQ ID NO: 2108663 - RNA, 20 nt, Homo sapiens
aggcagcuuuuucucuccca

SEQ ID NO: 2108664 - RNA, 12 nt, Homo sapiens
auuucacugucu

SEQ ID NO: 2108665 - RNA, 22 nt, Homo sapiens
cugggauauuuccauauggcaa

SEQ ID NO: 2108666 - RNA, 16 nt, Homo sapiens
ucaauaaacugugucu

SEQ ID NO: 2108667 - RNA, 11 nt, Homo sapiens
ucuggacaaag

SEQ ID NO: 2108668 - RNA, 23 nt, Homo sapiens
gauucauuauuuuuccacuuugu

SEQ ID NO: 2108669 - RNA, 16 nt, Homo sapiens
uccuuuuugacacuga

SEQ ID NO: 2108670 - RNA, 22 nt, Homo sapiens
cacagagaggcugcucugccau

SEQ ID NO: 2108671 - RNA, 17 nt, Homo sapiens
uaggcuaugccaugugc

SEQ ID NO: 2108672 - RNA, 15 nt, Homo sapiens
ucuaugguguaugac

SEQ ID NO: 2108673 - RNA, 12 nt, Homo sapiens
gaaagacacaaa

SEQ ID NO: 2108674 - RNA, 15 nt, Homo sapiens
auuugggaaccaagc

SEQ ID NO: 2108675 - RNA, 21 nt, Homo sapiens
ugccagcauuuagacccugca

SEQ ID NO: 2108676 - RNA, 15 nt, Homo sapiens
cgucuucuguauacu

SEQ ID NO: 2108677 - RNA, 11 nt, Homo sapiens
ccugucuguac

SEQ ID NO: 2108678 - RNA, 15 nt, Homo sapiens
cuacucuuaagccau

SEQ ID NO: 2108679 - RNA, 15 nt, Homo sapiens
aagaaaaaaagggag

SEQ ID NO: 2108680 - RNA, 18 nt, Homo sapiens
gaaccucuaagugcugcu

SEQ ID NO: 2108681 - RNA, 17 nt, Homo sapiens
auagaauggcacauguc

SEQ ID NO: 2108682 - RNA, 21 nt, Homo sapiens
acuccuuuugguuuaccuggg

SEQ ID NO: 2108683 - RNA, 20 nt, Homo sapiens
cagacucccaccccagggau

SEQ ID NO: 2108684 - RNA, 18 nt, Homo sapiens
ccuuguagguauuacauc

SEQ ID NO: 2108685 - RNA, 14 nt, Homo sapiens
uucccacaccuguc

SEQ ID NO: 2108686 - RNA, 14 nt, Homo sapiens
uaacagauuugcuc

SEQ ID NO: 2108687 - RNA, 20 nt, Homo sapiens
guuuauuuugcuugucauau

SEQ ID NO: 2108688 - RNA, 20 nt, Homo sapiens
cuuaauaaaauaauucucaa

SEQ ID NO: 2108689 - RNA, 17 nt, Homo sapiens
cugauccgagcucaggg

SEQ ID NO: 2108690 - RNA, 14 nt, Homo sapiens
uauuuaagauguga

SEQ ID NO: 2108691 - RNA, 18 nt, Homo sapiens
ugaaguucaugaaucuug

SEQ ID NO: 2108692 - RNA, 13 nt, Homo sapiens
gauucacuauuag

SEQ ID NO: 2108693 - RNA, 16 nt, Homo sapiens
ccucacuccaaaauag

SEQ ID NO: 2108694 - RNA, 22 nt, Homo sapiens
uacauuuuugucuuuaucucaa

SEQ ID NO: 2108695 - RNA, 15 nt, Homo sapiens
auccucccaccucaa

SEQ ID NO: 2108696 - RNA, 12 nt, Homo sapiens
cuauuggucucc

SEQ ID NO: 2108697 - RNA, 15 nt, Homo sapiens
uaagaccacuacagu

SEQ ID NO: 2108698 - RNA, 20 nt, Homo sapiens
agaaacccuaagccaagacc

SEQ ID NO: 2108699 - RNA, 12 nt, Homo sapiens
ucaauagcuguc

SEQ ID NO: 2108700 - RNA, 17 nt, Homo sapiens
cggacugucaguucucu

SEQ ID NO: 2108701 - RNA, 22 nt, Homo sapiens
aguccugugccucaucacugcu

SEQ ID NO: 2108702 - RNA, 18 nt, Homo sapiens
cagacugugcaauacuua

SEQ ID NO: 2108703 - RNA, 16 nt, Homo sapiens
ggccucaccugcugga

SEQ ID NO: 2108704 - RNA, 23 nt, Homo sapiens
agcuccuuuauuauaaucaaagc

SEQ ID NO: 2108705 - RNA, 12 nt, Homo sapiens
aaaaaaccacau

SEQ ID NO: 2108706 - RNA, 12 nt, Homo sapiens
aauaaaccacuu

SEQ ID NO: 2108707 - RNA, 19 nt, Homo sapiens
acucugggcugccauguga

SEQ ID NO: 2108708 - RNA, 18 nt, Homo sapiens
guauuuauugagcaccug

SEQ ID NO: 2108709 - RNA, 23 nt, Homo sapiens
gggagagaaagcuuuauauuugu

SEQ ID NO: 2108710 - RNA, 15 nt, Homo sapiens
cccaguccuccagac

SEQ ID NO: 2108711 - RNA, 15 nt, Homo sapiens
cagacaccuagacuc

SEQ ID NO: 2108712 - RNA, 20 nt, Homo sapiens
caaaguaaaagaaaccacuu

SEQ ID NO: 2108713 - RNA, 18 nt, Homo sapiens
cauagcuccuucccagga

SEQ ID NO: 2108714 - RNA, 19 nt, Homo sapiens
aaugcugugcaaacagugu

SEQ ID NO: 2108715 - RNA, 21 nt, Homo sapiens
agccgcuggugcccaccagcu

SEQ ID NO: 2108716 - RNA, 21 nt, Homo sapiens
cuugaaugccauagucaaaga

SEQ ID NO: 2108717 - RNA, 14 nt, Homo sapiens
uaauccagcaaagu

SEQ ID NO: 2108718 - RNA, 15 nt, Homo sapiens
ugugaguucugggcu

SEQ ID NO: 2108719 - RNA, 14 nt, Homo sapiens
cuguacauuucaca

SEQ ID NO: 2108720 - RNA, 16 nt, Homo sapiens
agugaugugugagcua

SEQ ID NO: 2108721 - RNA, 14 nt, Homo sapiens
ccccaccagugccu

SEQ ID NO: 2108722 - RNA, 19 nt, Homo sapiens
auucugcaggaacaugacc

SEQ ID NO: 2108723 - RNA, 14 nt, Homo sapiens
ggugcuucucacca

SEQ ID NO: 2108724 - RNA, 17 nt, Homo sapiens
guauuuuaauccuguac

SEQ ID NO: 2108725 - RNA, 19 nt, Homo sapiens
accucagagggauaaggca

SEQ ID NO: 2108726 - RNA, 16 nt, Homo sapiens
cuccugcgcugacaag

SEQ ID NO: 2108727 - RNA, 20 nt, Homo sapiens
caucuuugauacuuguucaa

SEQ ID NO: 2108728 - RNA, 19 nt, Homo sapiens
agucugauuaaagguggug

SEQ ID NO: 2108729 - RNA, 21 nt, Homo sapiens
auauuaguaaaagaugccaua

SEQ ID NO: 2108730 - RNA, 16 nt, Homo sapiens
ggcccugccuccccau

SEQ ID NO: 2108731 - RNA, 15 nt, Homo sapiens
uucagcugcaguuga

SEQ ID NO: 2108732 - RNA, 12 nt, Homo sapiens
ccaccuaccugc

SEQ ID NO: 2108733 - RNA, 21 nt, Homo sapiens
uuaagauuguaaaaauaauca

SEQ ID NO: 2108734 - RNA, 23 nt, Homo sapiens
agguuuggcccccucacuaucuc

SEQ ID NO: 2108735 - RNA, 17 nt, Homo sapiens
acucauugaaaugucac

SEQ ID NO: 2108736 - RNA, 14 nt, Homo sapiens
aacaugugcucagg

SEQ ID NO: 2108737 - RNA, 22 nt, Homo sapiens
auucuuugaauuucccagucuc

SEQ ID NO: 2108738 - RNA, 20 nt, Homo sapiens
acucuugccaaccuguaaua

SEQ ID NO: 2108739 - RNA, 23 nt, Homo sapiens
accaaccuuccauucacaccagc

SEQ ID NO: 2108740 - RNA, 18 nt, Homo sapiens
ccugcccgccccaagccc

SEQ ID NO: 2108741 - RNA, 22 nt, Homo sapiens
ucaauggaauacagucauucca

SEQ ID NO: 2108742 - RNA, 17 nt, Homo sapiens
uuugaccggaucuacac

SEQ ID NO: 2108743 - RNA, 21 nt, Homo sapiens
ucugcccgcuccauggaaaag

SEQ ID NO: 2108744 - RNA, 13 nt, Homo sapiens
ccuagcacuuugg

SEQ ID NO: 2108745 - RNA, 17 nt, Homo sapiens
ugcucacacauuacaac

SEQ ID NO: 2108746 - RNA, 15 nt, Homo sapiens
guccuaagaacuuca

SEQ ID NO: 2108747 - RNA, 22 nt, Homo sapiens
agagggcuguuggacagcugcu

SEQ ID NO: 2108748 - RNA, 13 nt, Homo sapiens
aguuuaugcagug

SEQ ID NO: 2108749 - RNA, 19 nt, Homo sapiens
guuaucuaaccuguuccau

SEQ ID NO: 2108750 - RNA, 13 nt, Homo sapiens
agacuaccaggag

SEQ ID NO: 2108751 - RNA, 22 nt, Homo sapiens
aaagguugacaauaaaugugcu

SEQ ID NO: 2108752 - RNA, 16 nt, Homo sapiens
aaucucucugcagcug

SEQ ID NO: 2108753 - RNA, 14 nt, Homo sapiens
gcugugucauucca

SEQ ID NO: 2108754 - RNA, 17 nt, Homo sapiens
cuuuaguugauuuaaac

SEQ ID NO: 2108755 - RNA, 11 nt, Homo sapiens
cuccacagggc

SEQ ID NO: 2108756 - RNA, 11 nt, Homo sapiens
gggcacagcug

SEQ ID NO: 2108757 - RNA, 13 nt, Homo sapiens
agucagcacguag

SEQ ID NO: 2108758 - RNA, 22 nt, Homo sapiens
ugggccucaugguaagagucac

SEQ ID NO: 2108759 - RNA, 22 nt, Homo sapiens
aaguagauuaaaauauuugccu

SEQ ID NO: 2108760 - RNA, 17 nt, Homo sapiens
aguaacucaucugucac

SEQ ID NO: 2108761 - RNA, 23 nt, Homo sapiens
cagagcaggaagcauucagagag

SEQ ID NO: 2108762 - RNA, 20 nt, Homo sapiens
agcacccugcccaccaagaa

SEQ ID NO: 2108763 - RNA, 21 nt, Homo sapiens
aagcuggcacugccacugugg

SEQ ID NO: 2108764 - RNA, 21 nt, Homo sapiens
gcuuaaacuacaaacacaagc

SEQ ID NO: 2108765 - RNA, 17 nt, Homo sapiens
gcuucucuuucucugag

SEQ ID NO: 2108766 - RNA, 16 nt, Homo sapiens
acaccaguugcccaga

SEQ ID NO: 2108767 - RNA, 17 nt, Homo sapiens
cuguagauucacauaca

SEQ ID NO: 2108768 - RNA, 19 nt, Homo sapiens
aucacuaaauaagcuucca

SEQ ID NO: 2108769 - RNA, 19 nt, Homo sapiens
gagcucugguggagacaaa

SEQ ID NO: 2108770 - RNA, 17 nt, Homo sapiens
cacaggcaggggugaga

SEQ ID NO: 2108771 - RNA, 14 nt, Homo sapiens
ugauccugcuccag

SEQ ID NO: 2108772 - RNA, 20 nt, Homo sapiens
ccuuuggauugacucugcau

SEQ ID NO: 2108773 - RNA, 19 nt, Homo sapiens
agaacccaguguuuccaca

SEQ ID NO: 2108774 - RNA, 22 nt, Homo sapiens
ugacauuuaugucucauguaau

SEQ ID NO: 2108775 - RNA, 16 nt, Homo sapiens
uugcagauccuugaua

SEQ ID NO: 2108776 - RNA, 12 nt, Homo sapiens
uaagcugggauc

SEQ ID NO: 2108777 - RNA, 13 nt, Homo sapiens
cgccucugagcca

SEQ ID NO: 2108778 - RNA, 22 nt, Homo sapiens
uagagacggggcuucaccaucu

SEQ ID NO: 2108779 - RNA, 22 nt, Homo sapiens
cuaaacuaguuuuuccuaucau

SEQ ID NO: 2108780 - RNA, 16 nt, Homo sapiens
ugcagugagcccagau

SEQ ID NO: 2108781 - RNA, 16 nt, Homo sapiens
ccacuuguuugcacug

SEQ ID NO: 2108782 - RNA, 21 nt, Homo sapiens
acacccccaccuccugcaaua

SEQ ID NO: 2108783 - RNA, 21 nt, Homo sapiens
agaugagccccacguggagcu

SEQ ID NO: 2108784 - RNA, 21 nt, Homo sapiens
gccaggccuaguaaccaaggc

SEQ ID NO: 2108785 - RNA, 14 nt, Homo sapiens
acuguacugagaca

SEQ ID NO: 2108786 - RNA, 16 nt, Homo sapiens
accuuuuauguagcac

SEQ ID NO: 2108787 - RNA, 15 nt, Homo sapiens
gucagaguucugcuc

SEQ ID NO: 2108788 - RNA, 21 nt, Homo sapiens
ugagauuucccaguuuaggug

SEQ ID NO: 2108789 - RNA, 19 nt, Homo sapiens
gaaaauuuaucauguuuua

SEQ ID NO: 2108790 - RNA, 12 nt, Homo sapiens
augcacaguaau

SEQ ID NO: 2108791 - RNA, 13 nt, Homo sapiens
accuuccuccuca

SEQ ID NO: 2108792 - RNA, 16 nt, Homo sapiens
gaccagccuccuggga

SEQ ID NO: 2108793 - RNA, 23 nt, Homo sapiens
cuggagaauguggagaacuaaag

SEQ ID NO: 2108794 - RNA, 15 nt, Homo sapiens
auuuucacagaggaa

SEQ ID NO: 2108795 - RNA, 15 nt, Homo sapiens
ugauuccacuugugu

SEQ ID NO: 2108796 - RNA, 22 nt, Homo sapiens
gcgcuguggcucacgccuguaa

SEQ ID NO: 2108797 - RNA, 11 nt, Homo sapiens
caggugggugg

SEQ ID NO: 2108798 - RNA, 12 nt, Homo sapiens
aagcuccaucuc

SEQ ID NO: 2108799 - RNA, 16 nt, Homo sapiens
auuugcauaaagugaa

SEQ ID NO: 2108800 - RNA, 19 nt, Homo sapiens
cagggacacuaucacucau

SEQ ID NO: 2108801 - RNA, 18 nt, Homo sapiens
gguggcccccugugccag

SEQ ID NO: 2108802 - RNA, 13 nt, Homo sapiens
uuguuuacucauc

SEQ ID NO: 2108803 - RNA, 21 nt, Homo sapiens
uggcgcuuagagaggacaaua

SEQ ID NO: 2108804 - RNA, 17 nt, Homo sapiens
auaaaccugaccuccuu

SEQ ID NO: 2108805 - RNA, 18 nt, Homo sapiens
gaaaauguaaaauaaagg

SEQ ID NO: 2108806 - RNA, 19 nt, Homo sapiens
auccucaacaacaaaccaa

SEQ ID NO: 2108807 - RNA, 15 nt, Homo sapiens
gcccuccuucugggc

SEQ ID NO: 2108808 - RNA, 14 nt, Homo sapiens
auucauuguucaaa

SEQ ID NO: 2108809 - RNA, 13 nt, Homo sapiens
acugugguagcca

SEQ ID NO: 2108810 - RNA, 13 nt, Homo sapiens
uucagggccaguc

SEQ ID NO: 2108811 - RNA, 20 nt, Homo sapiens
cauucauauuuuccaucuua

SEQ ID NO: 2108812 - RNA, 15 nt, Homo sapiens
aucauucucaguauc

SEQ ID NO: 2108813 - RNA, 13 nt, Homo sapiens
caggaaaauggac

SEQ ID NO: 2108814 - RNA, 13 nt, Homo sapiens
uugccauguugcc

SEQ ID NO: 2108815 - RNA, 13 nt, Homo sapiens
cacacaugcacac

SEQ ID NO: 2108816 - RNA, 13 nt, Homo sapiens
accugaugaccug

SEQ ID NO: 2108817 - RNA, 13 nt, Homo sapiens
ucagaaugucaga

SEQ ID NO: 2108818 - RNA, 13 nt, Homo sapiens
guacacacuugac

SEQ ID NO: 2108819 - RNA, 17 nt, Homo sapiens
agcucacugcagccuca

SEQ ID NO: 2108820 - RNA, 20 nt, Homo sapiens
cacagucaauggauccacaa

SEQ ID NO: 2108821 - RNA, 19 nt, Homo sapiens
cccuggaccucagagguga

SEQ ID NO: 2108822 - RNA, 23 nt, Homo sapiens
ugaggauauggacacuggugcca

SEQ ID NO: 2108823 - RNA, 15 nt, Homo sapiens
aucauuugaggaaua

SEQ ID NO: 2108824 - RNA, 15 nt, Homo sapiens
cgagcagccacuggc

SEQ ID NO: 2108825 - RNA, 21 nt, Homo sapiens
caucaauaaauguugcaaugc

SEQ ID NO: 2108826 - RNA, 19 nt, Homo sapiens
aggacaaaacuucuuguca

SEQ ID NO: 2108827 - RNA, 21 nt, Homo sapiens
gagauuccaguuuacaaucac

SEQ ID NO: 2108828 - RNA, 22 nt, Homo sapiens
caaagguaaaucagacuaugaa

SEQ ID NO: 2108829 - RNA, 18 nt, Homo sapiens
gggacuggcugggcugcu

SEQ ID NO: 2108830 - RNA, 23 nt, Homo sapiens
ccaauguucuauuaaucaccucu

SEQ ID NO: 2108831 - RNA, 21 nt, Homo sapiens
acuuuaucaaagauuggccau

SEQ ID NO: 2108832 - RNA, 17 nt, Homo sapiens
ugaacaggauauucuca

SEQ ID NO: 2108833 - RNA, 17 nt, Homo sapiens
uuaaaacauaagaacgu

SEQ ID NO: 2108834 - RNA, 12 nt, Homo sapiens
uccccuacauca

SEQ ID NO: 2108835 - RNA, 20 nt, Homo sapiens
uuauuaacauauauuguuau

SEQ ID NO: 2108836 - RNA, 17 nt, Homo sapiens
augacaauaagccacga

SEQ ID NO: 2108837 - RNA, 13 nt, Homo sapiens
aaucuccagugga

SEQ ID NO: 2108838 - RNA, 19 nt, Homo sapiens
agcccaugugcaccugccc

SEQ ID NO: 2108839 - RNA, 13 nt, Homo sapiens
ugcucugaccaag

SEQ ID NO: 2108840 - RNA, 16 nt, Homo sapiens
acccuaccacaguccg

SEQ ID NO: 2108841 - RNA, 13 nt, Homo sapiens
aggauguacaguu

SEQ ID NO: 2108842 - RNA, 23 nt, Homo sapiens
ccuggaguacuuugaagauguca

SEQ ID NO: 2108843 - RNA, 19 nt, Homo sapiens
gauccgggagacugacacg

SEQ ID NO: 2108844 - RNA, 13 nt, Homo sapiens
augguuaauacua

SEQ ID NO: 2108845 - RNA, 11 nt, Homo sapiens
cauaccacagc

SEQ ID NO: 2108846 - RNA, 21 nt, Homo sapiens
uuuagaucaaauauauuucaa

SEQ ID NO: 2108847 - RNA, 18 nt, Homo sapiens
gaaacuggaugaggucau

SEQ ID NO: 2108848 - RNA, 15 nt, Homo sapiens
uaacaaacuagucag

SEQ ID NO: 2108849 - RNA, 20 nt, Homo sapiens
cacugcggugucugcagcuc

SEQ ID NO: 2108850 - RNA, 23 nt, Homo sapiens
gagagccuuaauggaugcucauu

SEQ ID NO: 2108851 - RNA, 18 nt, Homo sapiens
auaaauggugagaauuaa

SEQ ID NO: 2108852 - RNA, 20 nt, Homo sapiens
cauguucccagcucagugcc

SEQ ID NO: 2108853 - RNA, 22 nt, Homo sapiens
cucuucuucuuuccuuccauca

SEQ ID NO: 2108854 - RNA, 21 nt, Homo sapiens
aaucaguaugcaaagcaaucu

SEQ ID NO: 2108855 - RNA, 21 nt, Homo sapiens
cuugcuuaguaugguucucag

SEQ ID NO: 2108856 - RNA, 16 nt, Homo sapiens
aggugaacgcacuuau

SEQ ID NO: 2108857 - RNA, 18 nt, Homo sapiens
cuaaaccagaaaggugau

SEQ ID NO: 2108858 - RNA, 21 nt, Homo sapiens
aauuuauuuccaauguuucaa

SEQ ID NO: 2108859 - RNA, 17 nt, Homo sapiens
aaucagcuuaaaaucca

SEQ ID NO: 2108860 - RNA, 16 nt, Homo sapiens
aacacauacaaugaag

SEQ ID NO: 2108861 - RNA, 15 nt, Homo sapiens
uagagaagugccuau

SEQ ID NO: 2108862 - RNA, 18 nt, Homo sapiens
caaaguucacuguuuauu

SEQ ID NO: 2108863 - RNA, 19 nt, Homo sapiens
cuuaccuuaaaaaguaauu

SEQ ID NO: 2108864 - RNA, 16 nt, Homo sapiens
aacaguauuacagugu

SEQ ID NO: 2108865 - RNA, 21 nt, Homo sapiens
aggagggugaauaagauuaau

SEQ ID NO: 2108866 - RNA, 17 nt, Homo sapiens
gacuguaagcuccauga

SEQ ID NO: 2108867 - RNA, 12 nt, Homo sapiens
caccgugaucaa

SEQ ID NO: 2108868 - RNA, 12 nt, Homo sapiens
gguucaagugau

SEQ ID NO: 2108869 - RNA, 13 nt, Homo sapiens
caugcacggugag

SEQ ID NO: 2108870 - RNA, 20 nt, Homo sapiens
cugagacuugaaucaaguca

SEQ ID NO: 2108871 - RNA, 17 nt, Homo sapiens
uaguaaaagaugccaua

SEQ ID NO: 2108872 - RNA, 16 nt, Homo sapiens
cuggggcuuugccauu

SEQ ID NO: 2108873 - RNA, 16 nt, Homo sapiens
ggaaagcauaugcagc

SEQ ID NO: 2108874 - RNA, 17 nt, Homo sapiens
uaacugauaaaccaaaa

SEQ ID NO: 2108875 - RNA, 15 nt, Homo sapiens
cuccacacagugcuc

SEQ ID NO: 2108876 - RNA, 22 nt, Homo sapiens
gcaugcuggcucccagggccau

SEQ ID NO: 2108877 - RNA, 17 nt, Homo sapiens
gcaauuuucgaacauuc

SEQ ID NO: 2108878 - RNA, 14 nt, Homo sapiens
cugcugggugccuc

SEQ ID NO: 2108879 - RNA, 17 nt, Homo sapiens
cuguguauuaacaugca

SEQ ID NO: 2108880 - RNA, 18 nt, Homo sapiens
augaauauauuaaucagc

SEQ ID NO: 2108881 - RNA, 21 nt, Homo sapiens
ccuggagugucggauccugug

SEQ ID NO: 2108882 - RNA, 17 nt, Homo sapiens
uauuugaaaaacauaca

SEQ ID NO: 2108883 - RNA, 17 nt, Homo sapiens
cuucuuuauuauagucc

SEQ ID NO: 2108884 - RNA, 15 nt, Homo sapiens
gaccccgccaugcau

SEQ ID NO: 2108885 - RNA, 23 nt, Homo sapiens
aacaauaaaaugucuucucccac

SEQ ID NO: 2108886 - RNA, 20 nt, Homo sapiens
uagugcauuaguggggagga

SEQ ID NO: 2108887 - RNA, 15 nt, Homo sapiens
uggagaauacugcca

SEQ ID NO: 2108888 - RNA, 22 nt, Homo sapiens
cacauauauguauacgcacgca

SEQ ID NO: 2108889 - RNA, 17 nt, Homo sapiens
guucauccaggcccaac

SEQ ID NO: 2108890 - RNA, 13 nt, Homo sapiens
caggugcacacau

SEQ ID NO: 2108891 - RNA, 13 nt, Homo sapiens
cacgugcacagau

SEQ ID NO: 2108892 - RNA, 21 nt, Homo sapiens
cuggauguggccccacccuuu

SEQ ID NO: 2108893 - RNA, 14 nt, Homo sapiens
uguagccccaguga

SEQ ID NO: 2108894 - RNA, 17 nt, Homo sapiens
ucacacuaucaacacug

SEQ ID NO: 2108895 - RNA, 15 nt, Homo sapiens
gccaggauuggcaca

SEQ ID NO: 2108896 - RNA, 15 nt, Homo sapiens
aauaaacgugcuccc

SEQ ID NO: 2108897 - RNA, 17 nt, Homo sapiens
ucuuggaaaaggaacuc

SEQ ID NO: 2108898 - RNA, 22 nt, Homo sapiens
gggaauccaagccuccacagcg

SEQ ID NO: 2108899 - RNA, 20 nt, Homo sapiens
acccugcgucgaaggaugcu

SEQ ID NO: 2108900 - RNA, 17 nt, Homo sapiens
guggguucaauuugcca

SEQ ID NO: 2108901 - RNA, 18 nt, Homo sapiens
uuccucagcaccccuagc

SEQ ID NO: 2108902 - RNA, 14 nt, Homo sapiens
aacuugacauguag

SEQ ID NO: 2108903 - RNA, 15 nt, Homo sapiens
caccagagaccaaac

SEQ ID NO: 2108904 - RNA, 19 nt, Homo sapiens
ucaacaugccauaucucau

SEQ ID NO: 2108905 - RNA, 19 nt, Homo sapiens
caauaguggauaacaugua

SEQ ID NO: 2108906 - RNA, 21 nt, Homo sapiens
uuuguuauauauaauaaauac

SEQ ID NO: 2108907 - RNA, 21 nt, Homo sapiens
ucacagaaugacugacaaaga

SEQ ID NO: 2108908 - RNA, 15 nt, Homo sapiens
cacaagguccacucc

SEQ ID NO: 2108909 - RNA, 20 nt, Homo sapiens
ucugggaggcuucaguuacc

SEQ ID NO: 2108910 - RNA, 14 nt, Homo sapiens
augucaagagucgc

SEQ ID NO: 2108911 - RNA, 13 nt, Homo sapiens
cuaugugcaaaaa

SEQ ID NO: 2108912 - RNA, 21 nt, Homo sapiens
auaaacauuuuacaugcagcu

SEQ ID NO: 2108913 - RNA, 16 nt, Homo sapiens
gcaguggcuuuugccc

SEQ ID NO: 2108914 - RNA, 17 nt, Homo sapiens
uuuugugaugcauuuua

SEQ ID NO: 2108915 - RNA, 15 nt, Homo sapiens
aggauguauguguau

SEQ ID NO: 2108916 - RNA, 14 nt, Homo sapiens
uaaaaaaacagacu

SEQ ID NO: 2108917 - RNA, 18 nt, Homo sapiens
aagaagugggagcagcuu

SEQ ID NO: 2108918 - RNA, 18 nt, Homo sapiens
uccuacuaucacugaaca

SEQ ID NO: 2108919 - RNA, 21 nt, Homo sapiens
ucuaagauuaauagcauucga

SEQ ID NO: 2108920 - RNA, 18 nt, Homo sapiens
agaagggcugaguggucu

SEQ ID NO: 2108921 - RNA, 13 nt, Homo sapiens
ucuagcacacuuu

SEQ ID NO: 2108922 - RNA, 15 nt, Homo sapiens
ugaacagcauuagaa

SEQ ID NO: 2108923 - RNA, 15 nt, Homo sapiens
aauagauacaagaga

SEQ ID NO: 2108924 - RNA, 19 nt, Homo sapiens
acacagacaguuucugaca

SEQ ID NO: 2108925 - RNA, 15 nt, Homo sapiens
ucuucccuaccucag

SEQ ID NO: 2108926 - RNA, 16 nt, Homo sapiens
cauaggacauacugca

SEQ ID NO: 2108927 - RNA, 22 nt, Homo sapiens
uauuaagcaucagaaacucugc

SEQ ID NO: 2108928 - RNA, 21 nt, Homo sapiens
ucacugggccuccaaccaugu

SEQ ID NO: 2108929 - RNA, 16 nt, Homo sapiens
cucaauugaguuaaau

SEQ ID NO: 2108930 - RNA, 19 nt, Homo sapiens
gaugcaacaaauguggcca

SEQ ID NO: 2108931 - RNA, 22 nt, Homo sapiens
auuugaaacugcuaauuacaca

SEQ ID NO: 2108932 - RNA, 18 nt, Homo sapiens
caguggcccauggcauuu

SEQ ID NO: 2108933 - RNA, 16 nt, Homo sapiens
cgacugaugaaggcau

SEQ ID NO: 2108934 - RNA, 19 nt, Homo sapiens
uucugcauuuaaccgucaa

SEQ ID NO: 2108935 - RNA, 18 nt, Homo sapiens
auggccagugugauccca

SEQ ID NO: 2108936 - RNA, 15 nt, Homo sapiens
ucagauugaaccauu

SEQ ID NO: 2108937 - RNA, 23 nt, Homo sapiens
aucuuaaacauaauaaaucacac

SEQ ID NO: 2108938 - RNA, 21 nt, Homo sapiens
gaccuaguccccuuuccucua

SEQ ID NO: 2108939 - RNA, 17 nt, Homo sapiens
caaacggugcaacagaa

SEQ ID NO: 2108940 - RNA, 14 nt, Homo sapiens
caacagaucaauga

SEQ ID NO: 2108941 - RNA, 16 nt, Homo sapiens
ugauauucuaucugua

SEQ ID NO: 2108942 - RNA, 17 nt, Homo sapiens
gaaauuauacuuacuuc

SEQ ID NO: 2108943 - RNA, 13 nt, Homo sapiens
uggaaacuggcca

SEQ ID NO: 2108944 - RNA, 22 nt, Homo sapiens
cugggaagcuugagccuccccc

SEQ ID NO: 2108945 - RNA, 19 nt, Homo sapiens
caggaugaugacuauggaa

SEQ ID NO: 2108946 - RNA, 12 nt, Homo sapiens
auaugauccauc

SEQ ID NO: 2108947 - RNA, 20 nt, Homo sapiens
ugaaguucacucagagggaa

SEQ ID NO: 2108948 - RNA, 14 nt, Homo sapiens
gggugccccacuaa

SEQ ID NO: 2108949 - RNA, 18 nt, Homo sapiens
uggccaauagucauaugu

SEQ ID NO: 2108950 - RNA, 21 nt, Homo sapiens
acagcaaucuguguacugaac

SEQ ID NO: 2108951 - RNA, 17 nt, Homo sapiens
uugauagaaccauugca

SEQ ID NO: 2108952 - RNA, 16 nt, Homo sapiens
cagaaaaaaggacugu

SEQ ID NO: 2108953 - RNA, 17 nt, Homo sapiens
auuaucgggaacagugu

SEQ ID NO: 2108954 - RNA, 14 nt, Homo sapiens
caggagacauuggu

SEQ ID NO: 2108955 - RNA, 18 nt, Homo sapiens
cugccuugguucuggcca

SEQ ID NO: 2108956 - RNA, 18 nt, Homo sapiens
uggcuccuccaggcacgu

SEQ ID NO: 2108957 - RNA, 13 nt, Homo sapiens
cacuuucuggaac

SEQ ID NO: 2108958 - RNA, 16 nt, Homo sapiens
cucugcaucagcacug

SEQ ID NO: 2108959 - RNA, 16 nt, Homo sapiens
cuccccauuagcuuuc

SEQ ID NO: 2108960 - RNA, 17 nt, Homo sapiens
ucugauguuacugagau

SEQ ID NO: 2108961 - RNA, 22 nt, Homo sapiens
augccuucccugagcuuuggug

SEQ ID NO: 2108962 - RNA, 18 nt, Homo sapiens
acaaauaaggacacaaac

SEQ ID NO: 2108963 - RNA, 22 nt, Homo sapiens
gaguggcccaagacucccagau

SEQ ID NO: 2108964 - RNA, 21 nt, Homo sapiens
cuuuaacuuucagaggcaaua

SEQ ID NO: 2108965 - RNA, 20 nt, Homo sapiens
augauauuuccccuaacuau

SEQ ID NO: 2108966 - RNA, 19 nt, Homo sapiens
uccaggcuccucaugaggc

SEQ ID NO: 2108967 - RNA, 23 nt, Homo sapiens
gacuaaccccaacgcacaggaaa

SEQ ID NO: 2108968 - RNA, 19 nt, Homo sapiens
aguggcuacugacuacccu

SEQ ID NO: 2108969 - RNA, 22 nt, Homo sapiens
agccuguggcuuggaguggcca

SEQ ID NO: 2108970 - RNA, 20 nt, Homo sapiens
aguuccuguagaacugagaa

SEQ ID NO: 2108971 - RNA, 15 nt, Homo sapiens
guaucaguucugcug

SEQ ID NO: 2108972 - RNA, 18 nt, Homo sapiens
gagggggcuugaagccaa

SEQ ID NO: 2108973 - RNA, 20 nt, Homo sapiens
ucauacuugaaaauaugaca

SEQ ID NO: 2108974 - RNA, 23 nt, Homo sapiens
cagacacugaccauccacucuac

SEQ ID NO: 2108975 - RNA, 18 nt, Homo sapiens
cucccacuucacugcgaa

SEQ ID NO: 2108976 - RNA, 20 nt, Homo sapiens
guacuaacuagcauuguaaa

SEQ ID NO: 2108977 - RNA, 18 nt, Homo sapiens
aaauuggaagcugucaua

SEQ ID NO: 2108978 - RNA, 20 nt, Homo sapiens
guauaaagucccugauuuca

SEQ ID NO: 2108979 - RNA, 13 nt, Homo sapiens
uaauaaaggccac

SEQ ID NO: 2108980 - RNA, 16 nt, Homo sapiens
uggugucuccucaugc

SEQ ID NO: 2108981 - RNA, 20 nt, Homo sapiens
accuggccugguugugugca

SEQ ID NO: 2108982 - RNA, 18 nt, Homo sapiens
ugggcaucauagcaagac

SEQ ID NO: 2108983 - RNA, 21 nt, Homo sapiens
aucuuaauuuugguuguauuc

SEQ ID NO: 2108984 - RNA, 14 nt, Homo sapiens
cuacgaaagcacag

SEQ ID NO: 2108985 - RNA, 16 nt, Homo sapiens
aggguucuaaguggga

SEQ ID NO: 2108986 - RNA, 18 nt, Homo sapiens
uuuaugggaacccucuuu

SEQ ID NO: 2108987 - RNA, 20 nt, Homo sapiens
ccuaaacucuuuuucaucca

SEQ ID NO: 2108988 - RNA, 15 nt, Homo sapiens
aaucuauaucuuuac

SEQ ID NO: 2108989 - RNA, 14 nt, Homo sapiens
cccucaugaucauu

SEQ ID NO: 2108990 - RNA, 16 nt, Homo sapiens
ucugcuauaugccuua

SEQ ID NO: 2108991 - RNA, 20 nt, Homo sapiens
gcccaggggagcguguuccu

SEQ ID NO: 2108992 - RNA, 15 nt, Homo sapiens
acacuaacauauaau

SEQ ID NO: 2108993 - RNA, 15 nt, Homo sapiens
auccucacaccuacu

SEQ ID NO: 2108994 - RNA, 17 nt, Homo sapiens
gucuguagaaucuagcc

SEQ ID NO: 2108995 - RNA, 18 nt, Homo sapiens
augauacuucgacacugu

SEQ ID NO: 2108996 - RNA, 18 nt, Homo sapiens
ggcuccucugcuucucac

SEQ ID NO: 2108997 - RNA, 22 nt, Homo sapiens
gcaaacagagugaaaugccauu

SEQ ID NO: 2108998 - RNA, 19 nt, Homo sapiens
cacuacaagugauccucag

SEQ ID NO: 2108999 - RNA, 15 nt, Homo sapiens
guuggauacaggaga

SEQ ID NO: 2109000 - RNA, 13 nt, Homo sapiens
cuuggacuugagg

SEQ ID NO: 2109001 - RNA, 23 nt, Homo sapiens
cucuuccuagcuuaaaaucugau

SEQ ID NO: 2109002 - RNA, 16 nt, Homo sapiens
cacuaaggugugcucu

SEQ ID NO: 2109003 - RNA, 17 nt, Homo sapiens
agggcaggcccccgggg

SEQ ID NO: 2109004 - RNA, 14 nt, Homo sapiens
cuuguugcacuaaa

SEQ ID NO: 2109005 - RNA, 14 nt, Homo sapiens
gcuauuuaucucaa

SEQ ID NO: 2109006 - RNA, 14 nt, Homo sapiens
caaagugcacauga

SEQ ID NO: 2109007 - RNA, 13 nt, Homo sapiens
ugaggaccaccuc

SEQ ID NO: 2109008 - RNA, 19 nt, Homo sapiens
gcuugcagagcaugaccug

SEQ ID NO: 2109009 - RNA, 15 nt, Homo sapiens
cugauguauaaugua

SEQ ID NO: 2109010 - RNA, 21 nt, Homo sapiens
cuugcucuaagucaaauucca

SEQ ID NO: 2109011 - RNA, 14 nt, Homo sapiens
caauuuguuuauau

SEQ ID NO: 2109012 - RNA, 21 nt, Homo sapiens
caaacaugggugguaacaaga

SEQ ID NO: 2109013 - RNA, 14 nt, Homo sapiens
gauucuuuguuaca

SEQ ID NO: 2109014 - RNA, 21 nt, Homo sapiens
ucauaaaaaaaugucaaggaa

SEQ ID NO: 2109015 - RNA, 14 nt, Homo sapiens
ggaggaggugaaag

SEQ ID NO: 2109016 - RNA, 13 nt, Homo sapiens
cguaacccaacuc

SEQ ID NO: 2109017 - RNA, 16 nt, Homo sapiens
uaaguuuuguuucaau

SEQ ID NO: 2109018 - RNA, 17 nt, Homo sapiens
auuguaucaggcaagau

SEQ ID NO: 2109019 - RNA, 17 nt, Homo sapiens
uucaacguaagacugug

SEQ ID NO: 2109020 - RNA, 14 nt, Homo sapiens
cugccucacuccuc

SEQ ID NO: 2109021 - RNA, 22 nt, Homo sapiens
aagccugacccuguaaaaugga

SEQ ID NO: 2109022 - RNA, 14 nt, Homo sapiens
auuuuaaagacaaa

SEQ ID NO: 2109023 - RNA, 23 nt, Homo sapiens
acaugaaugaaugaaccaugaau

SEQ ID NO: 2109024 - RNA, 12 nt, Homo sapiens
ugaccuacaggg

SEQ ID NO: 2109025 - RNA, 15 nt, Homo sapiens
aggguguaucuagcu

SEQ ID NO: 2109026 - RNA, 18 nt, Homo sapiens
ugcaugcacugucucagc

SEQ ID NO: 2109027 - RNA, 16 nt, Homo sapiens
uuaagugacuauagaa

SEQ ID NO: 2109028 - RNA, 22 nt, Homo sapiens
guuacaguuugagacuuccaaa

SEQ ID NO: 2109029 - RNA, 23 nt, Homo sapiens
ucugcgcuuggucuuucugugcu

SEQ ID NO: 2109030 - RNA, 17 nt, Homo sapiens
cccauuaaaaugaauuu

SEQ ID NO: 2109031 - RNA, 20 nt, Homo sapiens
ugagggguaaaagcugaucu

SEQ ID NO: 2109032 - RNA, 16 nt, Homo sapiens
gaacaauucucucuua

SEQ ID NO: 2109033 - RNA, 23 nt, Homo sapiens
uaagaaaaaccaaaauacuccaa

SEQ ID NO: 2109034 - RNA, 12 nt, Homo sapiens
caaagauuugcu

SEQ ID NO: 2109035 - RNA, 18 nt, Homo sapiens
caugucugcuggguguga

SEQ ID NO: 2109036 - RNA, 21 nt, Homo sapiens
acagcccuccuugacccugaa

SEQ ID NO: 2109037 - RNA, 16 nt, Homo sapiens
aguaggacuuuccuaa

SEQ ID NO: 2109038 - RNA, 18 nt, Homo sapiens
agauaucacuuacucagu

SEQ ID NO: 2109039 - RNA, 16 nt, Homo sapiens
gcacuaaaucagagac

SEQ ID NO: 2109040 - RNA, 19 nt, Homo sapiens
gugcagggagacaucugca

SEQ ID NO: 2109041 - RNA, 22 nt, Homo sapiens
auggaaucauauagugucuguc

SEQ ID NO: 2109042 - RNA, 15 nt, Homo sapiens
ugaaauacugagaug

SEQ ID NO: 2109043 - RNA, 15 nt, Homo sapiens
ccaacagcccagcaa

SEQ ID NO: 2109044 - RNA, 18 nt, Homo sapiens
acucccgcugagcccacu

SEQ ID NO: 2109045 - RNA, 16 nt, Homo sapiens
aauacacuuauuucag

SEQ ID NO: 2109046 - RNA, 14 nt, Homo sapiens
ucaucugcacuaug

SEQ ID NO: 2109047 - RNA, 14 nt, Homo sapiens
ccagaagagguaua

SEQ ID NO: 2109048 - RNA, 17 nt, Homo sapiens
uccuagucauucuuccc

SEQ ID NO: 2109049 - RNA, 20 nt, Homo sapiens
aguggcaggugggcugccug

SEQ ID NO: 2109050 - RNA, 23 nt, Homo sapiens
caaggaaacccccaguguaauaa

SEQ ID NO: 2109051 - RNA, 13 nt, Homo sapiens
uuaucugucuuua

SEQ ID NO: 2109052 - RNA, 21 nt, Homo sapiens
agaugucuucguacaguucuu

SEQ ID NO: 2109053 - RNA, 22 nt, Homo sapiens
ugaaaccccgucucuacuaaaa

SEQ ID NO: 2109054 - RNA, 22 nt, Homo sapiens
uaaaaccccaucucuacuaaaa

SEQ ID NO: 2109055 - RNA, 16 nt, Homo sapiens
gagaagcacagcuccu

SEQ ID NO: 2109056 - RNA, 13 nt, Homo sapiens
uaauacagcagaa

SEQ ID NO: 2109057 - RNA, 14 nt, Homo sapiens
acuguucaaaccuc

SEQ ID NO: 2109058 - RNA, 16 nt, Homo sapiens
guacuauuacuaguac

SEQ ID NO: 2109059 - RNA, 15 nt, Homo sapiens
caagcauuuguggac

SEQ ID NO: 2109060 - RNA, 19 nt, Homo sapiens
cuauugcauguaaaaugca

SEQ ID NO: 2109061 - RNA, 16 nt, Homo sapiens
gugagcauggggccag

SEQ ID NO: 2109062 - RNA, 16 nt, Homo sapiens
ggcccugcauuggccu

SEQ ID NO: 2109063 - RNA, 15 nt, Homo sapiens
cccugggguuuccac

SEQ ID NO: 2109064 - RNA, 20 nt, Homo sapiens
agagaacagaaaucggggaa

SEQ ID NO: 2109065 - RNA, 19 nt, Homo sapiens
acaaucucuuuauuacuga

SEQ ID NO: 2109066 - RNA, 22 nt, Homo sapiens
cccuuggcccucucccaugcac

SEQ ID NO: 2109067 - RNA, 23 nt, Homo sapiens
uccgucaccucagagacauacac

SEQ ID NO: 2109068 - RNA, 12 nt, Homo sapiens
uuaaauuccaca

SEQ ID NO: 2109069 - RNA, 21 nt, Homo sapiens
ugaccuugaugucuugagagc

SEQ ID NO: 2109070 - RNA, 16 nt, Homo sapiens
ccuugcacagcacuga

SEQ ID NO: 2109071 - RNA, 14 nt, Homo sapiens
acagucuagugcaa

SEQ ID NO: 2109072 - RNA, 22 nt, Homo sapiens
uuaaaagacaagacuucaguau

SEQ ID NO: 2109073 - RNA, 13 nt, Homo sapiens
auccaaaagacaa

SEQ ID NO: 2109074 - RNA, 19 nt, Homo sapiens
gaucuuuccaaauacccaa

SEQ ID NO: 2109075 - RNA, 23 nt, Homo sapiens
ggacaugcacccgcauguacaaa

SEQ ID NO: 2109076 - RNA, 20 nt, Homo sapiens
gucccauuuuucucuugcca

SEQ ID NO: 2109077 - RNA, 13 nt, Homo sapiens
ccuuacuccucuu

SEQ ID NO: 2109078 - RNA, 13 nt, Homo sapiens
uuccucucucuca

SEQ ID NO: 2109079 - RNA, 17 nt, Homo sapiens
gacauccacaugcucug

SEQ ID NO: 2109080 - RNA, 19 nt, Homo sapiens
aggguccaggaauggugcu

SEQ ID NO: 2109081 - RNA, 15 nt, Homo sapiens
agcggacaguggcag

SEQ ID NO: 2109082 - RNA, 19 nt, Homo sapiens
agaacagguguuggugaca

SEQ ID NO: 2109083 - RNA, 16 nt, Homo sapiens
cagacaugugcaacca

SEQ ID NO: 2109084 - RNA, 16 nt, Homo sapiens
cugguacucugugaaa

SEQ ID NO: 2109085 - RNA, 22 nt, Homo sapiens
caugccacaaccacggucacac

SEQ ID NO: 2109086 - RNA, 17 nt, Homo sapiens
uuauugccucacuucag

SEQ ID NO: 2109087 - RNA, 17 nt, Homo sapiens
auaaauauuacagugaa

SEQ ID NO: 2109088 - RNA, 20 nt, Homo sapiens
uggcaauuuaacauguguau

SEQ ID NO: 2109089 - RNA, 21 nt, Homo sapiens
aauggcuuuaugcuaguuuga

SEQ ID NO: 2109090 - RNA, 13 nt, Homo sapiens
accccuuugcacu

SEQ ID NO: 2109091 - RNA, 22 nt, Homo sapiens
ucuggauaacaagacuuugacu

SEQ ID NO: 2109092 - RNA, 19 nt, Homo sapiens
aucagaugacucucuccaa

SEQ ID NO: 2109093 - RNA, 14 nt, Homo sapiens
gcuagucacuggca

SEQ ID NO: 2109094 - RNA, 15 nt, Homo sapiens
auaaaugaacugcau

SEQ ID NO: 2109095 - RNA, 12 nt, Homo sapiens
gguggccacucc

SEQ ID NO: 2109096 - RNA, 14 nt, Homo sapiens
gaacgaggauuuua

SEQ ID NO: 2109097 - RNA, 20 nt, Homo sapiens
gaacaaaaugaauucuggga

SEQ ID NO: 2109098 - RNA, 15 nt, Homo sapiens
aaaagggcaucucaa

SEQ ID NO: 2109099 - RNA, 14 nt, Homo sapiens
uucagauuccccau

SEQ ID NO: 2109100 - RNA, 18 nt, Homo sapiens
agucacgugaaacagagu

SEQ ID NO: 2109101 - RNA, 17 nt, Homo sapiens
uauaguauaagcagugu

SEQ ID NO: 2109102 - RNA, 21 nt, Homo sapiens
cuaggccucuccaguuugcac

SEQ ID NO: 2109103 - RNA, 22 nt, Homo sapiens
cuucugcaacugaaauuacaua

SEQ ID NO: 2109104 - RNA, 11 nt, Homo sapiens
cccucccacac

SEQ ID NO: 2109105 - RNA, 22 nt, Homo sapiens
caaaucagccaugugcugcgug

SEQ ID NO: 2109106 - RNA, 14 nt, Homo sapiens
uuaaaauguaaaac

SEQ ID NO: 2109107 - RNA, 15 nt, Homo sapiens
ugucccaaguuccac

SEQ ID NO: 2109108 - RNA, 14 nt, Homo sapiens
agccugucccugaa

SEQ ID NO: 2109109 - RNA, 18 nt, Homo sapiens
cauuaaaacucauaauua

SEQ ID NO: 2109110 - RNA, 18 nt, Homo sapiens
uucuuugacuuaaugucu

SEQ ID NO: 2109111 - RNA, 14 nt, Homo sapiens
ccaaauaacuucag

SEQ ID NO: 2109112 - RNA, 23 nt, Homo sapiens
auaggcggggcacgguggcucau

SEQ ID NO: 2109113 - RNA, 16 nt, Homo sapiens
ucuucuaccucuucca

SEQ ID NO: 2109114 - RNA, 12 nt, Homo sapiens
caaaaacagcaa

SEQ ID NO: 2109115 - RNA, 13 nt, Homo sapiens
uuuaugaguacuu

SEQ ID NO: 2109116 - RNA, 17 nt, Homo sapiens
cugcugcugcuacugcu

SEQ ID NO: 2109117 - RNA, 20 nt, Homo sapiens
cuagaaaacauuccaaaacu

SEQ ID NO: 2109118 - RNA, 13 nt, Homo sapiens
agaacagccagac

SEQ ID NO: 2109119 - RNA, 16 nt, Homo sapiens
gaauucaaacuggggc

SEQ ID NO: 2109120 - RNA, 14 nt, Homo sapiens
aacccuuccaccaa

SEQ ID NO: 2109121 - RNA, 15 nt, Homo sapiens
gucaaaauaaucuga

SEQ ID NO: 2109122 - RNA, 16 nt, Homo sapiens
acccugagccugugug

SEQ ID NO: 2109123 - RNA, 19 nt, Homo sapiens
gcaaugguagcaaaacaag

SEQ ID NO: 2109124 - RNA, 16 nt, Homo sapiens
uuauaaauuauuauga

SEQ ID NO: 2109125 - RNA, 22 nt, Homo sapiens
cugaacuggagcugcuaagcua

SEQ ID NO: 2109126 - RNA, 17 nt, Homo sapiens
gguguacaaaauggaau

SEQ ID NO: 2109127 - RNA, 23 nt, Homo sapiens
caauuguugcgggaagucaggga

SEQ ID NO: 2109128 - RNA, 17 nt, Homo sapiens
aagguucccucccacuc

SEQ ID NO: 2109129 - RNA, 22 nt, Homo sapiens
ucaauacgugaucucuguuaca

SEQ ID NO: 2109130 - RNA, 22 nt, Homo sapiens
cugaacaaaauguaaagccagc

SEQ ID NO: 2109131 - RNA, 23 nt, Homo sapiens
aaacuucaccuacauuaucucac

SEQ ID NO: 2109132 - RNA, 21 nt, Homo sapiens
aguuaaucccuuugucuguca

SEQ ID NO: 2109133 - RNA, 16 nt, Homo sapiens
uacuaauauuaagaaa

SEQ ID NO: 2109134 - RNA, 15 nt, Homo sapiens
augaacuauccacag

SEQ ID NO: 2109135 - RNA, 14 nt, Homo sapiens
ugcucaauacacag

SEQ ID NO: 2109136 - RNA, 16 nt, Homo sapiens
cuuaagccauaaaaua

SEQ ID NO: 2109137 - RNA, 12 nt, Homo sapiens
gaucugcagcuc

SEQ ID NO: 2109138 - RNA, 12 nt, Homo sapiens
cuacuccugacu

SEQ ID NO: 2109139 - RNA, 20 nt, Homo sapiens
cacauacugcaugcucagga

SEQ ID NO: 2109140 - RNA, 16 nt, Homo sapiens
caugagguaaaagagc

SEQ ID NO: 2109141 - RNA, 21 nt, Homo sapiens
ggcucccugccugagggucac

SEQ ID NO: 2109142 - RNA, 13 nt, Homo sapiens
ccaacuccagggg

SEQ ID NO: 2109143 - RNA, 20 nt, Homo sapiens
acaccauaguuuacaauauu

SEQ ID NO: 2109144 - RNA, 22 nt, Homo sapiens
uuaaaaacaaaacacuaacaau

SEQ ID NO: 2109145 - RNA, 13 nt, Homo sapiens
cuacaccuguugc

SEQ ID NO: 2109146 - RNA, 11 nt, Homo sapiens
auuuaaucuca

SEQ ID NO: 2109147 - RNA, 13 nt, Homo sapiens
gucagagcuaaac

SEQ ID NO: 2109148 - RNA, 20 nt, Homo sapiens
cuuauacuuuucucaauauu

SEQ ID NO: 2109149 - RNA, 15 nt, Homo sapiens
cagcugaacacccuc

SEQ ID NO: 2109150 - RNA, 21 nt, Homo sapiens
aaucuaaaggaaagaugaugg

SEQ ID NO: 2109151 - RNA, 17 nt, Homo sapiens
agcauuugaguuugcaa

SEQ ID NO: 2109152 - RNA, 22 nt, Homo sapiens
uaaaauuaaaugcauguccuca

SEQ ID NO: 2109153 - RNA, 14 nt, Homo sapiens
ccaaucaugaauua

SEQ ID NO: 2109154 - RNA, 18 nt, Homo sapiens
uaugugcuuucaucacaa

SEQ ID NO: 2109155 - RNA, 15 nt, Homo sapiens
gauagggaacugggg

SEQ ID NO: 2109156 - RNA, 13 nt, Homo sapiens
gucuuuugaauau

SEQ ID NO: 2109157 - RNA, 16 nt, Homo sapiens
ccuggcuuuuacuuua

SEQ ID NO: 2109158 - RNA, 17 nt, Homo sapiens
caccacuccacuccucc

SEQ ID NO: 2109159 - RNA, 20 nt, Homo sapiens
cugcugagcugcgugccaca

SEQ ID NO: 2109160 - RNA, 20 nt, Homo sapiens
cccuccagagauuugcucaa

SEQ ID NO: 2109161 - RNA, 20 nt, Homo sapiens
ugcuacccauuuacaaauaa

SEQ ID NO: 2109162 - RNA, 17 nt, Homo sapiens
aaagcaguaaauuugcu

SEQ ID NO: 2109163 - RNA, 15 nt, Homo sapiens
ccagggagagcccag

SEQ ID NO: 2109164 - RNA, 13 nt, Homo sapiens
cugaacccugugc

SEQ ID NO: 2109165 - RNA, 16 nt, Homo sapiens
cacucucagugcuucu

SEQ ID NO: 2109166 - RNA, 15 nt, Homo sapiens
ccuuuggaaggugac

SEQ ID NO: 2109167 - RNA, 22 nt, Homo sapiens
cccagaaccuuuuuauagguug

SEQ ID NO: 2109168 - RNA, 10 nt, Homo sapiens
caaguucaau

SEQ ID NO: 2109169 - RNA, 17 nt, Homo sapiens
acaguaaguccaguaaa

SEQ ID NO: 2109170 - RNA, 16 nt, Homo sapiens
agcugagugcacuccu

SEQ ID NO: 2109171 - RNA, 13 nt, Homo sapiens
aauacuguacaua

SEQ ID NO: 2109172 - RNA, 21 nt, Homo sapiens
guugcccuuuuccuugacuau

SEQ ID NO: 2109173 - RNA, 16 nt, Homo sapiens
gaagaaaucuuuccag

SEQ ID NO: 2109174 - RNA, 23 nt, Homo sapiens
gacacagaggacagcuuccccau

SEQ ID NO: 2109175 - RNA, 16 nt, Homo sapiens
cucccauuacuuugau

SEQ ID NO: 2109176 - RNA, 22 nt, Homo sapiens
uuaaauucugaacaauucucuc

SEQ ID NO: 2109177 - RNA, 19 nt, Homo sapiens
uuaguaucuagucaguauc

SEQ ID NO: 2109178 - RNA, 16 nt, Homo sapiens
aucccaagugcacuuu

SEQ ID NO: 2109179 - RNA, 12 nt, Homo sapiens
acuggacuaugc

SEQ ID NO: 2109180 - RNA, 23 nt, Homo sapiens
cccagccucuagaacagccagac

SEQ ID NO: 2109181 - RNA, 15 nt, Homo sapiens
uggaggaaaacugag

SEQ ID NO: 2109182 - RNA, 17 nt, Homo sapiens
gaaaugcauauuugcaa

SEQ ID NO: 2109183 - RNA, 14 nt, Homo sapiens
cugccuuaugcaag

SEQ ID NO: 2109184 - RNA, 19 nt, Homo sapiens
agccaugaaacugacucau

SEQ ID NO: 2109185 - RNA, 12 nt, Homo sapiens
cucuucaaggac

SEQ ID NO: 2109186 - RNA, 16 nt, Homo sapiens
aguuuguuuacuuuau

SEQ ID NO: 2109187 - RNA, 22 nt, Homo sapiens
aaccauggauagaaucaauauu

SEQ ID NO: 2109188 - RNA, 23 nt, Homo sapiens
ugugauugaaggugauaagggaa

SEQ ID NO: 2109189 - RNA, 16 nt, Homo sapiens
acccacaagaacuccu

SEQ ID NO: 2109190 - RNA, 12 nt, Homo sapiens
cucauucaaaag

SEQ ID NO: 2109191 - RNA, 22 nt, Homo sapiens
cuagacuucccaacagccuuag

SEQ ID NO: 2109192 - RNA, 15 nt, Homo sapiens
auauuuauugugcau

SEQ ID NO: 2109193 - RNA, 17 nt, Homo sapiens
guauuaucaaagggaua

SEQ ID NO: 2109194 - RNA, 17 nt, Homo sapiens
gcccagaucucugcauc

SEQ ID NO: 2109195 - RNA, 15 nt, Homo sapiens
ggaccuuacaggccc

SEQ ID NO: 2109196 - RNA, 23 nt, Homo sapiens
agcucacaaccaccauucaguca

SEQ ID NO: 2109197 - RNA, 12 nt, Homo sapiens
cagccugaaccc

SEQ ID NO: 2109198 - RNA, 18 nt, Homo sapiens
auaauggauucacugagg

SEQ ID NO: 2109199 - RNA, 23 nt, Homo sapiens
ugccauggaggcacacagcugca

SEQ ID NO: 2109200 - RNA, 17 nt, Homo sapiens
ucccugaguucacucuc

SEQ ID NO: 2109201 - RNA, 22 nt, Homo sapiens
uaaggcccagcaaucugcauuu

SEQ ID NO: 2109202 - RNA, 11 nt, Homo sapiens
gucaguauuuu

SEQ ID NO: 2109203 - RNA, 14 nt, Homo sapiens
caguguacccuccu

SEQ ID NO: 2109204 - RNA, 18 nt, Homo sapiens
gaugacacuuguacaauu

SEQ ID NO: 2109205 - RNA, 19 nt, Homo sapiens
aaaauauaauuuacauuaa

SEQ ID NO: 2109206 - RNA, 15 nt, Homo sapiens
gacccaggcccucca

SEQ ID NO: 2109207 - RNA, 20 nt, Homo sapiens
aguccagagggacagucagu

SEQ ID NO: 2109208 - RNA, 15 nt, Homo sapiens
auuuuccuguuguca

SEQ ID NO: 2109209 - RNA, 16 nt, Homo sapiens
auguuuauucuguucc

SEQ ID NO: 2109210 - RNA, 20 nt, Homo sapiens
cacaccguggccuaccuggg

SEQ ID NO: 2109211 - RNA, 22 nt, Homo sapiens
accugucuuccaaggagaccaa

SEQ ID NO: 2109212 - RNA, 13 nt, Homo sapiens
cucccaccucccu

SEQ ID NO: 2109213 - RNA, 15 nt, Homo sapiens
ucaauuuauugcaca

SEQ ID NO: 2109214 - RNA, 22 nt, Homo sapiens
aacuaagcccccgcuguaauga

SEQ ID NO: 2109215 - RNA, 19 nt, Homo sapiens
gcacaguagagcaaaucua

SEQ ID NO: 2109216 - RNA, 20 nt, Homo sapiens
uugcugauggguaguaccug

SEQ ID NO: 2109217 - RNA, 15 nt, Homo sapiens
ucugacacuaccuua

SEQ ID NO: 2109218 - RNA, 14 nt, Homo sapiens
aaagccaucucagg

SEQ ID NO: 2109219 - RNA, 23 nt, Homo sapiens
aauacugcuugaccguacucuca

SEQ ID NO: 2109220 - RNA, 14 nt, Homo sapiens
ugaauuucaucuca

SEQ ID NO: 2109221 - RNA, 21 nt, Homo sapiens
auaaauacaaagcaaacaaac

SEQ ID NO: 2109222 - RNA, 20 nt, Homo sapiens
aagauaauccuagagucuua

SEQ ID NO: 2109223 - RNA, 20 nt, Homo sapiens
gaucugaugaaaaggucaga

SEQ ID NO: 2109224 - RNA, 18 nt, Homo sapiens
uccuggugccaccucaga

SEQ ID NO: 2109225 - RNA, 16 nt, Homo sapiens
aaauugggacuaguuu

SEQ ID NO: 2109226 - RNA, 23 nt, Homo sapiens
acccugagacauagaccauggau

SEQ ID NO: 2109227 - RNA, 14 nt, Homo sapiens
gaaaaagauggaau

SEQ ID NO: 2109228 - RNA, 15 nt, Homo sapiens
ucagcugcucccaca

SEQ ID NO: 2109229 - RNA, 16 nt, Homo sapiens
ucccugcauaugcuuc

SEQ ID NO: 2109230 - RNA, 13 nt, Homo sapiens
ucaucccauucca

SEQ ID NO: 2109231 - RNA, 20 nt, Homo sapiens
aacuuacaucacgacuuucu

SEQ ID NO: 2109232 - RNA, 18 nt, Homo sapiens
acuaaauugacacuuaaa

SEQ ID NO: 2109233 - RNA, 22 nt, Homo sapiens
acacuguaccgacuuugauaga

SEQ ID NO: 2109234 - RNA, 17 nt, Homo sapiens
agggaaggguuugccaa

SEQ ID NO: 2109235 - RNA, 12 nt, Homo sapiens
auguaucucagg

SEQ ID NO: 2109236 - RNA, 23 nt, Homo sapiens
aauauuguugacaacugugacug

SEQ ID NO: 2109237 - RNA, 15 nt, Homo sapiens
ucccaugacugcacc

SEQ ID NO: 2109238 - RNA, 17 nt, Homo sapiens
cauccccuggacuggga

SEQ ID NO: 2109239 - RNA, 17 nt, Homo sapiens
ccacuuucugccagcau

SEQ ID NO: 2109240 - RNA, 17 nt, Homo sapiens
ggcaauuuugcacugaa

SEQ ID NO: 2109241 - RNA, 20 nt, Homo sapiens
acaaacuauuucuauccuga

SEQ ID NO: 2109242 - RNA, 21 nt, Homo sapiens
uuagaaacacacuuuugcaca

SEQ ID NO: 2109243 - RNA, 21 nt, Homo sapiens
agagguggcugcugugcuagu

SEQ ID NO: 2109244 - RNA, 15 nt, Homo sapiens
cuauucugauuacac

SEQ ID NO: 2109245 - RNA, 17 nt, Homo sapiens
aauugaggaugucccug

SEQ ID NO: 2109246 - RNA, 23 nt, Homo sapiens
uaugucaagggcagcuuugcuca

SEQ ID NO: 2109247 - RNA, 23 nt, Homo sapiens
caggaagucucucccgauaucac

SEQ ID NO: 2109248 - RNA, 16 nt, Homo sapiens
uccaaccgaccagcuu

SEQ ID NO: 2109249 - RNA, 16 nt, Homo sapiens
gauaauguugucaaga

SEQ ID NO: 2109250 - RNA, 21 nt, Homo sapiens
aaagaauggaaguagcuguau

SEQ ID NO: 2109251 - RNA, 22 nt, Homo sapiens
cuugaauuuuuuuaauuuacac

SEQ ID NO: 2109252 - RNA, 22 nt, Homo sapiens
gagcagagggcaggggugcugu

SEQ ID NO: 2109253 - RNA, 15 nt, Homo sapiens
guuucugaagucuca

SEQ ID NO: 2109254 - RNA, 19 nt, Homo sapiens
augucuuuguguuuugucc

SEQ ID NO: 2109255 - RNA, 21 nt, Homo sapiens
uuguaggagaaacucccaugu

SEQ ID NO: 2109256 - RNA, 23 nt, Homo sapiens
cuaaaugaccucagcaaauccuc

SEQ ID NO: 2109257 - RNA, 14 nt, Homo sapiens
agcuaacacacuuu

SEQ ID NO: 2109258 - RNA, 21 nt, Homo sapiens
gaauucucgaacugcauguau

SEQ ID NO: 2109259 - RNA, 17 nt, Homo sapiens
cuguucagcugguugag

SEQ ID NO: 2109260 - RNA, 18 nt, Homo sapiens
ugccucccuuucugggag

SEQ ID NO: 2109261 - RNA, 19 nt, Homo sapiens
agcugaaauuuuuguguaa

SEQ ID NO: 2109262 - RNA, 16 nt, Homo sapiens
acccuauucaugucuc

SEQ ID NO: 2109263 - RNA, 12 nt, Homo sapiens
cuccacauuucc

SEQ ID NO: 2109264 - RNA, 13 nt, Homo sapiens
aaaacaugaaugu

SEQ ID NO: 2109265 - RNA, 22 nt, Homo sapiens
auggucaaguucccaacugagu

SEQ ID NO: 2109266 - RNA, 18 nt, Homo sapiens
auaucuggguuaaguguu

SEQ ID NO: 2109267 - RNA, 15 nt, Homo sapiens
cccacccgucuucaa

SEQ ID NO: 2109268 - RNA, 16 nt, Homo sapiens
aguuguggacuuuucc

SEQ ID NO: 2109269 - RNA, 15 nt, Homo sapiens
cuucuuaugguauaa

SEQ ID NO: 2109270 - RNA, 17 nt, Homo sapiens
ccaucuccuuucaggga

SEQ ID NO: 2109271 - RNA, 18 nt, Homo sapiens
caauucacccacucccuu

SEQ ID NO: 2109272 - RNA, 15 nt, Homo sapiens
gguuucaaagugaua

SEQ ID NO: 2109273 - RNA, 22 nt, Homo sapiens
gggcuagucuucccuuaccuca

SEQ ID NO: 2109274 - RNA, 13 nt, Homo sapiens
guauucuucauca

SEQ ID NO: 2109275 - RNA, 12 nt, Homo sapiens
uaauacugagaa

SEQ ID NO: 2109276 - RNA, 12 nt, Homo sapiens
aaauacugugaa

SEQ ID NO: 2109277 - RNA, 22 nt, Homo sapiens
cgugugcgugcaugugcacuug

SEQ ID NO: 2109278 - RNA, 12 nt, Homo sapiens
ucacuucaugca

SEQ ID NO: 2109279 - RNA, 15 nt, Homo sapiens
uacucauuagugacu

SEQ ID NO: 2109280 - RNA, 18 nt, Homo sapiens
acgauugguaugaugcug

SEQ ID NO: 2109281 - RNA, 14 nt, Homo sapiens
auuacagugcaguu

SEQ ID NO: 2109282 - RNA, 20 nt, Homo sapiens
auguccaaacccacucauga

SEQ ID NO: 2109283 - RNA, 15 nt, Homo sapiens
uuucucgaguccaaa

SEQ ID NO: 2109284 - RNA, 18 nt, Homo sapiens
cacgcuaguaacuccucu

SEQ ID NO: 2109285 - RNA, 18 nt, Homo sapiens
caacaucgaauguguaca

SEQ ID NO: 2109286 - RNA, 20 nt, Homo sapiens
gaauguuuucaaauguucuc

SEQ ID NO: 2109287 - RNA, 12 nt, Homo sapiens
aaaauaaucaug

SEQ ID NO: 2109288 - RNA, 11 nt, Homo sapiens
uuguacuggau

SEQ ID NO: 2109289 - RNA, 17 nt, Homo sapiens
ccccggggugcccacag

SEQ ID NO: 2109290 - RNA, 19 nt, Homo sapiens
uuaucuagccaaagagcuc

SEQ ID NO: 2109291 - RNA, 20 nt, Homo sapiens
gaaaccuguauaacccuguu

SEQ ID NO: 2109292 - RNA, 14 nt, Homo sapiens
ucacuaaggacuua

SEQ ID NO: 2109293 - RNA, 15 nt, Homo sapiens
ugagguggauuuacu

SEQ ID NO: 2109294 - RNA, 16 nt, Homo sapiens
gugcaagugugugcac

SEQ ID NO: 2109295 - RNA, 17 nt, Homo sapiens
uauuuuagagcaucuca

SEQ ID NO: 2109296 - RNA, 18 nt, Homo sapiens
ggucuccgcacuuggaaa

SEQ ID NO: 2109297 - RNA, 20 nt, Homo sapiens
cuaauguacaauaaagcaau

SEQ ID NO: 2109298 - RNA, 13 nt, Homo sapiens
caucacagggugg

SEQ ID NO: 2109299 - RNA, 22 nt, Homo sapiens
cacagcuucugcagcagacugu

SEQ ID NO: 2109300 - RNA, 17 nt, Homo sapiens
gauaugcaagugcaaaa

SEQ ID NO: 2109301 - RNA, 14 nt, Homo sapiens
guauaauugaccua

SEQ ID NO: 2109302 - RNA, 18 nt, Homo sapiens
agaacugacaugcagguc

SEQ ID NO: 2109303 - RNA, 23 nt, Homo sapiens
cagaaggguggggauaucagggc

SEQ ID NO: 2109304 - RNA, 14 nt, Homo sapiens
ccuuucagucccaa

SEQ ID NO: 2109305 - RNA, 13 nt, Homo sapiens
acugugggacuca

SEQ ID NO: 2109306 - RNA, 23 nt, Homo sapiens
auguagaaauauuauaaauccaa

SEQ ID NO: 2109307 - RNA, 20 nt, Homo sapiens
ugcucaugagcuccugauca

SEQ ID NO: 2109308 - RNA, 22 nt, Homo sapiens
aauuccucucaaauucagcucu

SEQ ID NO: 2109309 - RNA, 20 nt, Homo sapiens
agcaggcugacuaugugccg

SEQ ID NO: 2109310 - RNA, 16 nt, Homo sapiens
guaauuucaaaauaca

SEQ ID NO: 2109311 - RNA, 18 nt, Homo sapiens
uccuucugaaguguuuca

SEQ ID NO: 2109312 - RNA, 16 nt, Homo sapiens
ucauggugcuguugcc

SEQ ID NO: 2109313 - RNA, 21 nt, Homo sapiens
agggaaaaggguucaacaaag

SEQ ID NO: 2109314 - RNA, 16 nt, Homo sapiens
acauacuccuuccauc

SEQ ID NO: 2109315 - RNA, 13 nt, Homo sapiens
ucauucaguucua

SEQ ID NO: 2109316 - RNA, 15 nt, Homo sapiens
uaaagaauagcuuua

SEQ ID NO: 2109317 - RNA, 15 nt, Homo sapiens
caggcaacgcacaaa

SEQ ID NO: 2109318 - RNA, 13 nt, Homo sapiens
ccaggacugagau

SEQ ID NO: 2109319 - RNA, 16 nt, Homo sapiens
aaucccagcacuuugg

SEQ ID NO: 2109320 - RNA, 19 nt, Homo sapiens
augguuuuucaccugggaa

SEQ ID NO: 2109321 - RNA, 17 nt, Homo sapiens
uccagaccauucaggac

SEQ ID NO: 2109322 - RNA, 14 nt, Homo sapiens
ugcaauacauuuca

SEQ ID NO: 2109323 - RNA, 19 nt, Homo sapiens
caguaaauguacaacugca

SEQ ID NO: 2109324 - RNA, 18 nt, Homo sapiens
auacuauugaaguaugua

SEQ ID NO: 2109325 - RNA, 16 nt, Homo sapiens
cuccugaccugaggcu

SEQ ID NO: 2109326 - RNA, 15 nt, Homo sapiens
gcuaauauacuugua

SEQ ID NO: 2109327 - RNA, 16 nt, Homo sapiens
agaucucuaacuucac

SEQ ID NO: 2109328 - RNA, 14 nt, Homo sapiens
gcauucacauaucu

SEQ ID NO: 2109329 - RNA, 18 nt, Homo sapiens
uguucgaugcugauacuu

SEQ ID NO: 2109330 - RNA, 16 nt, Homo sapiens
uggcaucccaguggcc

SEQ ID NO: 2109331 - RNA, 12 nt, Homo sapiens
ugaugagcuuag

SEQ ID NO: 2109332 - RNA, 14 nt, Homo sapiens
ggaagccaaagagu

SEQ ID NO: 2109333 - RNA, 14 nt, Homo sapiens
uccaucuccaggag

SEQ ID NO: 2109334 - RNA, 21 nt, Homo sapiens
gcacagcugggguggggaccu

SEQ ID NO: 2109335 - RNA, 21 nt, Homo sapiens
ucugccaguucccucccucaa

SEQ ID NO: 2109336 - RNA, 15 nt, Homo sapiens
augacaugcacugac

SEQ ID NO: 2109337 - RNA, 14 nt, Homo sapiens
agcagcacuuauaa

SEQ ID NO: 2109338 - RNA, 20 nt, Homo sapiens
cuccuaaaauaaacaugaag

SEQ ID NO: 2109339 - RNA, 14 nt, Homo sapiens
uccuguugucuaca

SEQ ID NO: 2109340 - RNA, 13 nt, Homo sapiens
ccaggccugacca

SEQ ID NO: 2109341 - RNA, 17 nt, Homo sapiens
gcacuuccuugccaguc

SEQ ID NO: 2109342 - RNA, 22 nt, Homo sapiens
uugcccugcgucccuucucuuu

SEQ ID NO: 2109343 - RNA, 13 nt, Homo sapiens
gacaacuucugaa

SEQ ID NO: 2109344 - RNA, 19 nt, Homo sapiens
augauucagaggucacuuc

SEQ ID NO: 2109345 - RNA, 12 nt, Homo sapiens
aagaauaccaau

SEQ ID NO: 2109346 - RNA, 19 nt, Homo sapiens
gggacauugcaauuugcag

SEQ ID NO: 2109347 - RNA, 17 nt, Homo sapiens
ugccacuacacuccagc

SEQ ID NO: 2109348 - RNA, 15 nt, Homo sapiens
ccccaucuuuacaaa

SEQ ID NO: 2109349 - RNA, 20 nt, Homo sapiens
aaauagcugugaacagagag

SEQ ID NO: 2109350 - RNA, 21 nt, Homo sapiens
cagagagggcaccaucacaau

SEQ ID NO: 2109351 - RNA, 16 nt, Homo sapiens
guuuuccugaaaucaa

SEQ ID NO: 2109352 - RNA, 14 nt, Homo sapiens
ugaagccuuugcca

SEQ ID NO: 2109353 - RNA, 14 nt, Homo sapiens
acugaacacaugac

SEQ ID NO: 2109354 - RNA, 15 nt, Homo sapiens
aaauauuacuguaau

SEQ ID NO: 2109355 - RNA, 21 nt, Homo sapiens
cugaucugguuugacuccgcu

SEQ ID NO: 2109356 - RNA, 17 nt, Homo sapiens
gcccaugcugagcucau

SEQ ID NO: 2109357 - RNA, 21 nt, Homo sapiens
accacugaguaccaggggcug

SEQ ID NO: 2109358 - RNA, 16 nt, Homo sapiens
aaccucacucuugcca

SEQ ID NO: 2109359 - RNA, 13 nt, Homo sapiens
caugggcucugac

SEQ ID NO: 2109360 - RNA, 13 nt, Homo sapiens
aggcccugcccug

SEQ ID NO: 2109361 - RNA, 15 nt, Homo sapiens
aaauacacauuugcu

SEQ ID NO: 2109362 - RNA, 12 nt, Homo sapiens
uuauaaucuuuc

SEQ ID NO: 2109363 - RNA, 12 nt, Homo sapiens
ucagaagauauc

SEQ ID NO: 2109364 - RNA, 14 nt, Homo sapiens
cucacagaggcagu

SEQ ID NO: 2109365 - RNA, 18 nt, Homo sapiens
cauagaaauacaucaaua

SEQ ID NO: 2109366 - RNA, 17 nt, Homo sapiens
caggcuugucacuagca

SEQ ID NO: 2109367 - RNA, 14 nt, Homo sapiens
gaggcugcacugga

SEQ ID NO: 2109368 - RNA, 15 nt, Homo sapiens
ugaaauccacacauc

SEQ ID NO: 2109369 - RNA, 14 nt, Homo sapiens
cuuauugcuguuuc

SEQ ID NO: 2109370 - RNA, 16 nt, Homo sapiens
agauaccgagaaugau

SEQ ID NO: 2109371 - RNA, 18 nt, Homo sapiens
cauuccccuaauguggaa

SEQ ID NO: 2109372 - RNA, 18 nt, Homo sapiens
uuauaauuccuauauccu

SEQ ID NO: 2109373 - RNA, 14 nt, Homo sapiens
gaaaauaaacaugu

SEQ ID NO: 2109374 - RNA, 22 nt, Homo sapiens
agaagggaucccuaacuguucc

SEQ ID NO: 2109375 - RNA, 16 nt, Homo sapiens
uaaaggcucugugcuu

SEQ ID NO: 2109376 - RNA, 17 nt, Homo sapiens
aaggcagaaaacagcuc

SEQ ID NO: 2109377 - RNA, 19 nt, Homo sapiens
caugauuuuuuacaaauua

SEQ ID NO: 2109378 - RNA, 20 nt, Homo sapiens
cauauuaauauauuuccauu

SEQ ID NO: 2109379 - RNA, 15 nt, Homo sapiens
ucuaacaggcacuuu

SEQ ID NO: 2109380 - RNA, 17 nt, Homo sapiens
ggcccaggaguccaggc

SEQ ID NO: 2109381 - RNA, 12 nt, Homo sapiens
uaggcuggccag

SEQ ID NO: 2109382 - RNA, 12 nt, Homo sapiens
caguaugacaua

SEQ ID NO: 2109383 - RNA, 21 nt, Homo sapiens
gccuggagccacagcagccac

SEQ ID NO: 2109384 - RNA, 15 nt, Homo sapiens
uuaacuaauaaaaua

SEQ ID NO: 2109385 - RNA, 21 nt, Homo sapiens
ccuaccucuccacaaggggau

SEQ ID NO: 2109386 - RNA, 22 nt, Homo sapiens
caaaagucaccacuccauuccc

SEQ ID NO: 2109387 - RNA, 12 nt, Homo sapiens
uguuugcacuuu

SEQ ID NO: 2109388 - RNA, 12 nt, Homo sapiens
cucaugcaugca

SEQ ID NO: 2109389 - RNA, 16 nt, Homo sapiens
gaaacacagaacucag

SEQ ID NO: 2109390 - RNA, 22 nt, Homo sapiens
uccacaagaacaauucaagaaa

SEQ ID NO: 2109391 - RNA, 14 nt, Homo sapiens
uugcagacaguguu

SEQ ID NO: 2109392 - RNA, 16 nt, Homo sapiens
gaguccuaggacuuaa

SEQ ID NO: 2109393 - RNA, 17 nt, Homo sapiens
acauuauuggacuucca

SEQ ID NO: 2109394 - RNA, 16 nt, Homo sapiens
accggcugguggagcu

SEQ ID NO: 2109395 - RNA, 13 nt, Homo sapiens
uaacacaugcaca

SEQ ID NO: 2109396 - RNA, 16 nt, Homo sapiens
cagggugccugcacuu

SEQ ID NO: 2109397 - RNA, 12 nt, Homo sapiens
caaguccaucaa

SEQ ID NO: 2109398 - RNA, 22 nt, Homo sapiens
auuaaacguguaaauugcacag

SEQ ID NO: 2109399 - RNA, 14 nt, Homo sapiens
agacaguaaagacc

SEQ ID NO: 2109400 - RNA, 15 nt, Homo sapiens
aguuugaauauuuaa

SEQ ID NO: 2109401 - RNA, 16 nt, Homo sapiens
cuaugauaugcuaaua

SEQ ID NO: 2109402 - RNA, 21 nt, Homo sapiens
uaaauacuguaacacuguaua

SEQ ID NO: 2109403 - RNA, 19 nt, Homo sapiens
auguaggcaauacauguau

SEQ ID NO: 2109404 - RNA, 16 nt, Homo sapiens
uuaaguaaaccaaaaa

SEQ ID NO: 2109405 - RNA, 17 nt, Homo sapiens
uacauaaugcgugcaua

SEQ ID NO: 2109406 - RNA, 17 nt, Homo sapiens
aguuacugccgguuuga

SEQ ID NO: 2109407 - RNA, 20 nt, Homo sapiens
aggaaacccagcucacagga

SEQ ID NO: 2109408 - RNA, 15 nt, Homo sapiens
augauaaucugggca

SEQ ID NO: 2109409 - RNA, 22 nt, Homo sapiens
ccuaucagccugucucuuccau

SEQ ID NO: 2109410 - RNA, 16 nt, Homo sapiens
uuagguugugaaugca

SEQ ID NO: 2109411 - RNA, 13 nt, Homo sapiens
cuucaguuuuagg

SEQ ID NO: 2109412 - RNA, 20 nt, Homo sapiens
aauaaguuauaaagauuuag

SEQ ID NO: 2109413 - RNA, 19 nt, Homo sapiens
auguucugucaaauguguc

SEQ ID NO: 2109414 - RNA, 19 nt, Homo sapiens
cacguggagauagugccag

SEQ ID NO: 2109415 - RNA, 15 nt, Homo sapiens
uucugacgcugacaa

SEQ ID NO: 2109416 - RNA, 21 nt, Homo sapiens
gccagcagcacagucacccau

SEQ ID NO: 2109417 - RNA, 19 nt, Homo sapiens
cccagcuccugacacugcu

SEQ ID NO: 2109418 - RNA, 20 nt, Homo sapiens
acuaaauauuuaagugcagu

SEQ ID NO: 2109419 - RNA, 21 nt, Homo sapiens
aacuguuuucuucuuggugcu

SEQ ID NO: 2109420 - RNA, 21 nt, Homo sapiens
ugugaccaaugucuugaugca

SEQ ID NO: 2109421 - RNA, 21 nt, Homo sapiens
caugaucaugccacugcacuc

SEQ ID NO: 2109422 - RNA, 13 nt, Homo sapiens
gaauugaagucau

SEQ ID NO: 2109423 - RNA, 16 nt, Homo sapiens
caugugucaugaagaa

SEQ ID NO: 2109424 - RNA, 23 nt, Homo sapiens
uuaagccuuauauaauauuguaa

SEQ ID NO: 2109425 - RNA, 14 nt, Homo sapiens
aagaauucuuccac

SEQ ID NO: 2109426 - RNA, 17 nt, Homo sapiens
aauuuaagacaaguuca

SEQ ID NO: 2109427 - RNA, 21 nt, Homo sapiens
caaguuuuuuaauuaagcaga

SEQ ID NO: 2109428 - RNA, 14 nt, Homo sapiens
cuagaugugucuua

SEQ ID NO: 2109429 - RNA, 21 nt, Homo sapiens
gcacauuuccccagaccugag

SEQ ID NO: 2109430 - RNA, 13 nt, Homo sapiens
acuaugacaucua

SEQ ID NO: 2109431 - RNA, 18 nt, Homo sapiens
caaagguauuaguacaau

SEQ ID NO: 2109432 - RNA, 18 nt, Homo sapiens
auagcuaauaauaccuug

SEQ ID NO: 2109433 - RNA, 15 nt, Homo sapiens
agaucugcacugggu

SEQ ID NO: 2109434 - RNA, 21 nt, Homo sapiens
caaaucagugugaggagguag

SEQ ID NO: 2109435 - RNA, 15 nt, Homo sapiens
gaaggccacauguca

SEQ ID NO: 2109436 - RNA, 17 nt, Homo sapiens
cucggccugggauuuca

SEQ ID NO: 2109437 - RNA, 11 nt, Homo sapiens
uuaaauugcag

SEQ ID NO: 2109438 - RNA, 18 nt, Homo sapiens
auacuagccccccagugg

SEQ ID NO: 2109439 - RNA, 14 nt, Homo sapiens
aaagaguccuauuu

SEQ ID NO: 2109440 - RNA, 17 nt, Homo sapiens
gaagcaaaaucccuuaa

SEQ ID NO: 2109441 - RNA, 16 nt, Homo sapiens
acagcuugucucuugc

SEQ ID NO: 2109442 - RNA, 23 nt, Homo sapiens
ucccccgugacagugacggcugc

SEQ ID NO: 2109443 - RNA, 15 nt, Homo sapiens
agcaccacccuaguc

SEQ ID NO: 2109444 - RNA, 15 nt, Homo sapiens
cuacauguauugcac

SEQ ID NO: 2109445 - RNA, 21 nt, Homo sapiens
cuccucccaggaacugggcca

SEQ ID NO: 2109446 - RNA, 23 nt, Homo sapiens
uucucuaaaauaacuaguacaaa

SEQ ID NO: 2109447 - RNA, 17 nt, Homo sapiens
gagcaccuuuccugaaa

SEQ ID NO: 2109448 - RNA, 12 nt, Homo sapiens
uuugaaagaaua

SEQ ID NO: 2109449 - RNA, 16 nt, Homo sapiens
ugaaguguucugcuga

SEQ ID NO: 2109450 - RNA, 24 nt, Homo sapiens
uuggcugcguacuccacuggucug

SEQ ID NO: 2109451 - RNA, 14 nt, Homo sapiens
agaugaaaagcuac

SEQ ID NO: 2109452 - RNA, 19 nt, Homo sapiens
uagaucuaguucacucucc

SEQ ID NO: 2109453 - RNA, 15 nt, Homo sapiens
aauuuauuacugaaa

SEQ ID NO: 2109454 - RNA, 22 nt, Homo sapiens
gccaagcccuuugcuguucgca

SEQ ID NO: 2109455 - RNA, 17 nt, Homo sapiens
caaugcacauccauucc

SEQ ID NO: 2109456 - RNA, 14 nt, Homo sapiens
caaaccuccacugc

SEQ ID NO: 2109457 - RNA, 12 nt, Homo sapiens
acugucgagucc

SEQ ID NO: 2109458 - RNA, 21 nt, Homo sapiens
gaggccaagguuucccaguga

SEQ ID NO: 2109459 - RNA, 23 nt, Homo sapiens
agccucgcgggugucacauuccu

SEQ ID NO: 2109460 - RNA, 15 nt, Homo sapiens
auuuccaacaccaca

SEQ ID NO: 2109461 - RNA, 20 nt, Homo sapiens
agagccaauuagacuugaaa

SEQ ID NO: 2109462 - RNA, 17 nt, Homo sapiens
auagggcuucugccuaa

SEQ ID NO: 2109463 - RNA, 17 nt, Homo sapiens
ugauagauccagaugag

SEQ ID NO: 2109464 - RNA, 13 nt, Homo sapiens
guuaaucaaagau

SEQ ID NO: 2109465 - RNA, 23 nt, Homo sapiens
uagcaugugaaguuuugcaaaua

SEQ ID NO: 2109466 - RNA, 19 nt, Homo sapiens
cauaauacugaaccacuug

SEQ ID NO: 2109467 - RNA, 13 nt, Homo sapiens
ggucuuucugugc

SEQ ID NO: 2109468 - RNA, 11 nt, Homo sapiens
uuucaucuccu

SEQ ID NO: 2109469 - RNA, 17 nt, Homo sapiens
caauaaaccuccgccaa

SEQ ID NO: 2109470 - RNA, 14 nt, Homo sapiens
uccucccucagacc

SEQ ID NO: 2109471 - RNA, 19 nt, Homo sapiens
gaauugauguuuacauguc

SEQ ID NO: 2109472 - RNA, 14 nt, Homo sapiens
aauggauacauggu

SEQ ID NO: 2109473 - RNA, 19 nt, Homo sapiens
aacaauaaaugaaugaaua

SEQ ID NO: 2109474 - RNA, 22 nt, Homo sapiens
aaaugcuuuguagaacagagca

SEQ ID NO: 2109475 - RNA, 20 nt, Homo sapiens
aauagauauuuuaaggguaa

SEQ ID NO: 2109476 - RNA, 24 nt, Homo sapiens
uucaauaacugacggauguaaggu

SEQ ID NO: 2109477 - RNA, 12 nt, Homo sapiens
ugcacuuucuau

SEQ ID NO: 2109478 - RNA, 18 nt, Homo sapiens
guccuucgcccugugcac

SEQ ID NO: 2109479 - RNA, 18 nt, Homo sapiens
auaguuuuuagucugugu

SEQ ID NO: 2109480 - RNA, 18 nt, Homo sapiens
cuuaguguauaaaaacca

SEQ ID NO: 2109481 - RNA, 18 nt, Homo sapiens
cagauaacaaacacugaa

SEQ ID NO: 2109482 - RNA, 16 nt, Homo sapiens
uaaugacaaaugcccu

SEQ ID NO: 2109483 - RNA, 16 nt, Homo sapiens
auuggcagccaaggaa

SEQ ID NO: 2109484 - RNA, 15 nt, Homo sapiens
ggaagggcaggucug

SEQ ID NO: 2109485 - RNA, 21 nt, Homo sapiens
gaauucaaggaggaaagaaga

SEQ ID NO: 2109486 - RNA, 14 nt, Homo sapiens
auaacuguucucau

SEQ ID NO: 2109487 - RNA, 23 nt, Homo sapiens
cuagauuucuagaaaagcuuccu

SEQ ID NO: 2109488 - RNA, 18 nt, Homo sapiens
guuuagccaaaggauaag

SEQ ID NO: 2109489 - RNA, 13 nt, Homo sapiens
ucuggaaucugga

SEQ ID NO: 2109490 - RNA, 23 nt, Homo sapiens
agguaaauaaagccacuuuccuc

SEQ ID NO: 2109491 - RNA, 12 nt, Homo sapiens
gccaccuagucc

SEQ ID NO: 2109492 - RNA, 22 nt, Homo sapiens
uguucuccugcugcucccucag

SEQ ID NO: 2109493 - RNA, 15 nt, Homo sapiens
gcugcgagacccggc

SEQ ID NO: 2109494 - RNA, 17 nt, Homo sapiens
uugcagugaauucauau

SEQ ID NO: 2109495 - RNA, 16 nt, Homo sapiens
ucagcaacuguuuaac

SEQ ID NO: 2109496 - RNA, 22 nt, Homo sapiens
ccuguugcuguguuuaauuuga

SEQ ID NO: 2109497 - RNA, 18 nt, Homo sapiens
ugagcuggaaggggccac

SEQ ID NO: 2109498 - RNA, 13 nt, Homo sapiens
aagaccuaccucc

SEQ ID NO: 2109499 - RNA, 20 nt, Homo sapiens
ccugccucagccucccaauu

SEQ ID NO: 2109500 - RNA, 17 nt, Homo sapiens
aacuaagaugcugccug

SEQ ID NO: 2109501 - RNA, 14 nt, Homo sapiens
cauaauucuuccaa

SEQ ID NO: 2109502 - RNA, 17 nt, Homo sapiens
aaaguuucuuaaggaaa

SEQ ID NO: 2109503 - RNA, 16 nt, Homo sapiens
guagcaagaugcaaau

SEQ ID NO: 2109504 - RNA, 18 nt, Homo sapiens
gccacacccagcggcccc

SEQ ID NO: 2109505 - RNA, 15 nt, Homo sapiens
agaaagcucaucuca

SEQ ID NO: 2109506 - RNA, 23 nt, Homo sapiens
acuuugccauuaugcaaauggag

SEQ ID NO: 2109507 - RNA, 22 nt, Homo sapiens
caagccacauggugacuuuuga

SEQ ID NO: 2109508 - RNA, 20 nt, Homo sapiens
auuugggagggaaaagggaa

SEQ ID NO: 2109509 - RNA, 14 nt, Homo sapiens
cggaauuccaauau

SEQ ID NO: 2109510 - RNA, 22 nt, Homo sapiens
ugacuauuucaccauguugcca

SEQ ID NO: 2109511 - RNA, 14 nt, Homo sapiens
cuggggcugugcau

SEQ ID NO: 2109512 - RNA, 14 nt, Homo sapiens
gaccaucaugcccu

SEQ ID NO: 2109513 - RNA, 18 nt, Homo sapiens
caucaucucugccuuuga

SEQ ID NO: 2109514 - RNA, 22 nt, Homo sapiens
aaggcaaggucaccugccucuu

SEQ ID NO: 2109515 - RNA, 15 nt, Homo sapiens
caaugugacauuuac

SEQ ID NO: 2109516 - RNA, 17 nt, Homo sapiens
gcacuggugccaaaacc

SEQ ID NO: 2109517 - RNA, 13 nt, Homo sapiens
caccuuuuacucu

SEQ ID NO: 2109518 - RNA, 13 nt, Homo sapiens
cagcucaccucaa

SEQ ID NO: 2109519 - RNA, 19 nt, Homo sapiens
ucccugucuccagcugccu

SEQ ID NO: 2109520 - RNA, 20 nt, Homo sapiens
aguguguuuaaauaaacaca

SEQ ID NO: 2109521 - RNA, 19 nt, Homo sapiens
aaacgagaagguacugaaa

SEQ ID NO: 2109522 - RNA, 18 nt, Homo sapiens
acacugauacacuugaag

SEQ ID NO: 2109523 - RNA, 17 nt, Homo sapiens
caacugucuccuaccuc

SEQ ID NO: 2109524 - RNA, 19 nt, Homo sapiens
acuucaauccauguaggaa

SEQ ID NO: 2109525 - RNA, 20 nt, Homo sapiens
guuuccguggguucugucau

SEQ ID NO: 2109526 - RNA, 18 nt, Homo sapiens
auuuucuggguuugauac

SEQ ID NO: 2109527 - RNA, 15 nt, Homo sapiens
ggauaacuuccuugc

SEQ ID NO: 2109528 - RNA, 20 nt, Homo sapiens
uggaacaugcuuuuacuuua

SEQ ID NO: 2109529 - RNA, 23 nt, Homo sapiens
cucacugagucuuaacuuuucac

SEQ ID NO: 2109530 - RNA, 20 nt, Homo sapiens
ucaaagacauagaugugaaa

SEQ ID NO: 2109531 - RNA, 18 nt, Homo sapiens
gcugauuuagaccaaaag

SEQ ID NO: 2109532 - RNA, 15 nt, Homo sapiens
ugaaguuuaaacucu

SEQ ID NO: 2109533 - RNA, 16 nt, Homo sapiens
cugaaagccuuaggga

SEQ ID NO: 2109534 - RNA, 22 nt, Homo sapiens
acauaugauccaguuaacauca

SEQ ID NO: 2109535 - RNA, 13 nt, Homo sapiens
uuggaaccagacu

SEQ ID NO: 2109536 - RNA, 18 nt, Homo sapiens
ugucucuacccacuaugc

SEQ ID NO: 2109537 - RNA, 23 nt, Homo sapiens
ugaagaacaacaacucucagugg

SEQ ID NO: 2109538 - RNA, 14 nt, Homo sapiens
gagggcuaauaucu

SEQ ID NO: 2109539 - RNA, 20 nt, Homo sapiens
cucuccagguggucagaggg

SEQ ID NO: 2109540 - RNA, 23 nt, Homo sapiens
ucuuuuuaaugcuguuaacuuaa

SEQ ID NO: 2109541 - RNA, 14 nt, Homo sapiens
caaagaccccaugg

SEQ ID NO: 2109542 - RNA, 15 nt, Homo sapiens
gcccaugugugagug

SEQ ID NO: 2109543 - RNA, 19 nt, Homo sapiens
gcaacuccccuacaucaaa

SEQ ID NO: 2109544 - RNA, 18 nt, Homo sapiens
cuuaguuguucaguugcc

SEQ ID NO: 2109545 - RNA, 12 nt, Homo sapiens
agcacucaagac

SEQ ID NO: 2109546 - RNA, 23 nt, Homo sapiens
aaauuuuaauguuaacuuucaaa

SEQ ID NO: 2109547 - RNA, 15 nt, Homo sapiens
aucaaaccacuguua

SEQ ID NO: 2109548 - RNA, 22 nt, Homo sapiens
cuccauagauccccccacugag

SEQ ID NO: 2109549 - RNA, 17 nt, Homo sapiens
cauuccccgacacugcc

SEQ ID NO: 2109550 - RNA, 17 nt, Homo sapiens
aggcagguugagacuac

SEQ ID NO: 2109551 - RNA, 14 nt, Homo sapiens
ccucgcacacaggg

SEQ ID NO: 2109552 - RNA, 20 nt, Homo sapiens
auuauguauaaaauguaaca

SEQ ID NO: 2109553 - RNA, 19 nt, Homo sapiens
ucugagggagacugcaaau

SEQ ID NO: 2109554 - RNA, 23 nt, Homo sapiens
aauuugcaacaguaaucagaguu

SEQ ID NO: 2109555 - RNA, 17 nt, Homo sapiens
acccuuggucucaugcc

SEQ ID NO: 2109556 - RNA, 16 nt, Homo sapiens
agagagaguucucaca

SEQ ID NO: 2109557 - RNA, 22 nt, Homo sapiens
ucaagagagcuuaacagauaaa

SEQ ID NO: 2109558 - RNA, 20 nt, Homo sapiens
ggugaaaagggguguggcaa

SEQ ID NO: 2109559 - RNA, 19 nt, Homo sapiens
caguugaccuuugccaaac

SEQ ID NO: 2109560 - RNA, 15 nt, Homo sapiens
cuccgagacagucca

SEQ ID NO: 2109561 - RNA, 18 nt, Homo sapiens
ccaggacacgacuuguaa

SEQ ID NO: 2109562 - RNA, 20 nt, Homo sapiens
accagguccauuuugccuga

SEQ ID NO: 2109563 - RNA, 20 nt, Homo sapiens
aucacugauagaauccaguu

SEQ ID NO: 2109564 - RNA, 17 nt, Homo sapiens
caucugggucuacucaa

SEQ ID NO: 2109565 - RNA, 19 nt, Homo sapiens
agccucuccagagaaguuu

SEQ ID NO: 2109566 - RNA, 14 nt, Homo sapiens
acuguccugcaaau

SEQ ID NO: 2109567 - RNA, 17 nt, Homo sapiens
aauagguuaauaucaau

SEQ ID NO: 2109568 - RNA, 18 nt, Homo sapiens
caaagaugagauaaaaca

SEQ ID NO: 2109569 - RNA, 21 nt, Homo sapiens
caguggcuuagcugccaucuu

SEQ ID NO: 2109570 - RNA, 21 nt, Homo sapiens
uaaugucuuuuguuauugaga

SEQ ID NO: 2109571 - RNA, 13 nt, Homo sapiens
aaugacugucuaa

SEQ ID NO: 2109572 - RNA, 13 nt, Homo sapiens
aaagacugucaaa

SEQ ID NO: 2109573 - RNA, 22 nt, Homo sapiens
uaaaguaaauuauuaagcagac

SEQ ID NO: 2109574 - RNA, 18 nt, Homo sapiens
aggaucauuugagcccag

SEQ ID NO: 2109575 - RNA, 15 nt, Homo sapiens
gucucaaacuccuga

SEQ ID NO: 2109576 - RNA, 14 nt, Homo sapiens
cuucaguccuuugu

SEQ ID NO: 2109577 - RNA, 17 nt, Homo sapiens
ucaaaacucaguaucau

SEQ ID NO: 2109578 - RNA, 19 nt, Homo sapiens
guaaaacacaccaaucagc

SEQ ID NO: 2109579 - RNA, 22 nt, Homo sapiens
cccagaguagcccaggucacug

SEQ ID NO: 2109580 - RNA, 22 nt, Homo sapiens
aggagacgggggagcagcacga

SEQ ID NO: 2109581 - RNA, 15 nt, Homo sapiens
augcagaguugacau

SEQ ID NO: 2109582 - RNA, 21 nt, Homo sapiens
cuuccccaucgccuucugggg

SEQ ID NO: 2109583 - RNA, 18 nt, Homo sapiens
ccaaggggguggacgcaa

SEQ ID NO: 2109584 - RNA, 22 nt, Homo sapiens
caggcauuuuuguaaugagcca

SEQ ID NO: 2109585 - RNA, 12 nt, Homo sapiens
uauauugucauu

SEQ ID NO: 2109586 - RNA, 17 nt, Homo sapiens
uaauucuaaucuaacaa

SEQ ID NO: 2109587 - RNA, 21 nt, Homo sapiens
aaauccagugagcacuagaau

SEQ ID NO: 2109588 - RNA, 17 nt, Homo sapiens
ggcggcuccagcagggu

SEQ ID NO: 2109589 - RNA, 13 nt, Homo sapiens
uacacauacauau

SEQ ID NO: 2109590 - RNA, 12 nt, Homo sapiens
agaaaagacacu

SEQ ID NO: 2109591 - RNA, 12 nt, Homo sapiens
gaaaucuuccca

SEQ ID NO: 2109592 - RNA, 15 nt, Homo sapiens
ucccuugaccuuucc

SEQ ID NO: 2109593 - RNA, 18 nt, Homo sapiens
guuauaauuacuaaugua

SEQ ID NO: 2109594 - RNA, 16 nt, Homo sapiens
gagaagggacaaaagg

SEQ ID NO: 2109595 - RNA, 19 nt, Homo sapiens
ucucaucuuacauuucuca

SEQ ID NO: 2109596 - RNA, 11 nt, Homo sapiens
ccuacugccuc

SEQ ID NO: 2109597 - RNA, 14 nt, Homo sapiens
aaaugauucagcuc

SEQ ID NO: 2109598 - RNA, 13 nt, Homo sapiens
ccuagaugaccug

SEQ ID NO: 2109599 - RNA, 13 nt, Homo sapiens
acuucaugcccac

SEQ ID NO: 2109600 - RNA, 19 nt, Homo sapiens
aagccaaguaaagugcuua

SEQ ID NO: 2109601 - RNA, 13 nt, Homo sapiens
caaucauagccaa

SEQ ID NO: 2109602 - RNA, 21 nt, Homo sapiens
gaugcaucacacucaaggaca

SEQ ID NO: 2109603 - RNA, 18 nt, Homo sapiens
cugugauaacucugcaaa

SEQ ID NO: 2109604 - RNA, 22 nt, Homo sapiens
uaggguuauuaguccaaaugug

SEQ ID NO: 2109605 - RNA, 20 nt, Homo sapiens
gacuuucucuucuacacguc

SEQ ID NO: 2109606 - RNA, 19 nt, Homo sapiens
guaaaugauucauauaucc

SEQ ID NO: 2109607 - RNA, 19 nt, Homo sapiens
cucugagacucgcgacaau

SEQ ID NO: 2109608 - RNA, 15 nt, Homo sapiens
aagcgauuuccugcg

SEQ ID NO: 2109609 - RNA, 16 nt, Homo sapiens
uaauauuuuauucuca

SEQ ID NO: 2109610 - RNA, 19 nt, Homo sapiens
ugggggagaaaaaaucacu

SEQ ID NO: 2109611 - RNA, 18 nt, Homo sapiens
ugugcacacacaccacac

SEQ ID NO: 2109612 - RNA, 19 nt, Homo sapiens
accccucuuucgucuacug

SEQ ID NO: 2109613 - RNA, 14 nt, Homo sapiens
uucccaccaauuug

SEQ ID NO: 2109614 - RNA, 18 nt, Homo sapiens
aagguuaggguuggagca

SEQ ID NO: 2109615 - RNA, 21 nt, Homo sapiens
uagauaugaagaaucugcucu

SEQ ID NO: 2109616 - RNA, 16 nt, Homo sapiens
agcgagcuaugaucgc

SEQ ID NO: 2109617 - RNA, 22 nt, Homo sapiens
gagcuuugguaaucucugugaa

SEQ ID NO: 2109618 - RNA, 19 nt, Homo sapiens
acauacuugaagggccaga

SEQ ID NO: 2109619 - RNA, 17 nt, Homo sapiens
guagggccccugcacac

SEQ ID NO: 2109620 - RNA, 20 nt, Homo sapiens
ccuggacugggagguagaua

SEQ ID NO: 2109621 - RNA, 19 nt, Homo sapiens
auucuaaguuagacucuuc

SEQ ID NO: 2109622 - RNA, 23 nt, Homo sapiens
aaaacuuucauccugguuuccac

SEQ ID NO: 2109623 - RNA, 16 nt, Homo sapiens
uuucagucucucugaa

SEQ ID NO: 2109624 - RNA, 22 nt, Homo sapiens
uuugcuucaaauucaaggccuu

SEQ ID NO: 2109625 - RNA, 17 nt, Homo sapiens
aaucuuauggggccgga

SEQ ID NO: 2109626 - RNA, 18 nt, Homo sapiens
ccuaaggacacacuaauc

SEQ ID NO: 2109627 - RNA, 23 nt, Homo sapiens
ucagccucccaagcaccugggau

SEQ ID NO: 2109628 - RNA, 20 nt, Homo sapiens
ucccuuuuacauacugcugu

SEQ ID NO: 2109629 - RNA, 18 nt, Homo sapiens
ccaccuccucucuuggac

SEQ ID NO: 2109630 - RNA, 20 nt, Homo sapiens
gucuguauuugguauauacu

SEQ ID NO: 2109631 - RNA, 20 nt, Homo sapiens
caggcugggcuucaguggca

SEQ ID NO: 2109632 - RNA, 13 nt, Homo sapiens
acuccagaucugc

SEQ ID NO: 2109633 - RNA, 20 nt, Homo sapiens
uacaguggcaguauugacaa

SEQ ID NO: 2109634 - RNA, 14 nt, Homo sapiens
ucucugagcaguga

SEQ ID NO: 2109635 - RNA, 23 nt, Homo sapiens
auuuuuuuuuuuaacagucagaa

SEQ ID NO: 2109636 - RNA, 14 nt, Homo sapiens
ucccucuggucuac

SEQ ID NO: 2109637 - RNA, 15 nt, Homo sapiens
guugcaucaacaaag

SEQ ID NO: 2109638 - RNA, 20 nt, Homo sapiens
aaaaugaaaggaaguuucag

SEQ ID NO: 2109639 - RNA, 12 nt, Homo sapiens
gugguuugaaaa

SEQ ID NO: 2109640 - RNA, 16 nt, Homo sapiens
uuuucacacugguaaa

SEQ ID NO: 2109641 - RNA, 16 nt, Homo sapiens
cuaucaguauugugaa

SEQ ID NO: 2109642 - RNA, 20 nt, Homo sapiens
ccugcuaccuaguuuguuag

SEQ ID NO: 2109643 - RNA, 17 nt, Homo sapiens
aguaguggccacugggg

SEQ ID NO: 2109644 - RNA, 22 nt, Homo sapiens
uaagcuccaugauuagcauaaa

SEQ ID NO: 2109645 - RNA, 15 nt, Homo sapiens
agugguacucugugu

SEQ ID NO: 2109646 - RNA, 14 nt, Homo sapiens
ggauuccacuaucu

SEQ ID NO: 2109647 - RNA, 19 nt, Homo sapiens
ugagguuuucugugcuuug

SEQ ID NO: 2109648 - RNA, 15 nt, Homo sapiens
uggagccacagcagc

SEQ ID NO: 2109649 - RNA, 15 nt, Homo sapiens
guggaaaauggugau

SEQ ID NO: 2109650 - RNA, 17 nt, Homo sapiens
cccagcucaaugcaaug

SEQ ID NO: 2109651 - RNA, 14 nt, Homo sapiens
ugcuggcucucaga

SEQ ID NO: 2109652 - RNA, 17 nt, Homo sapiens
aagacacaccucuggau

SEQ ID NO: 2109653 - RNA, 16 nt, Homo sapiens
uuauauuacacuacac

SEQ ID NO: 2109654 - RNA, 14 nt, Homo sapiens
ucuuauauuuacaa

SEQ ID NO: 2109655 - RNA, 20 nt, Homo sapiens
uuuugcuggucacugccaug

SEQ ID NO: 2109656 - RNA, 22 nt, Homo sapiens
agaccauugucuuccaacccca

SEQ ID NO: 2109657 - RNA, 17 nt, Homo sapiens
gacacuucaaggugaca

SEQ ID NO: 2109658 - RNA, 16 nt, Homo sapiens
cuuuccccccauguug

SEQ ID NO: 2109659 - RNA, 23 nt, Homo sapiens
aacagauuuacaucccagacaca

SEQ ID NO: 2109660 - RNA, 11 nt, Homo sapiens
aacagcuccuu

SEQ ID NO: 2109661 - RNA, 17 nt, Homo sapiens
uccaucuuuccugaugg

SEQ ID NO: 2109662 - RNA, 16 nt, Homo sapiens
auuucuaaaguuguag

SEQ ID NO: 2109663 - RNA, 20 nt, Homo sapiens
uaaagaaaaucucugugaaa

SEQ ID NO: 2109664 - RNA, 17 nt, Homo sapiens
cugacuucucacuuccu

SEQ ID NO: 2109665 - RNA, 14 nt, Homo sapiens
gcuauacugcacuu

SEQ ID NO: 2109666 - RNA, 21 nt, Homo sapiens
ugcccaggccggccagccuca

SEQ ID NO: 2109667 - RNA, 20 nt, Homo sapiens
cagaaagagacuccgucuca

SEQ ID NO: 2109668 - RNA, 12 nt, Homo sapiens
uaagccuucgaa

SEQ ID NO: 2109669 - RNA, 13 nt, Homo sapiens
ccaaaaacuaaau

SEQ ID NO: 2109670 - RNA, 16 nt, Homo sapiens
aauguuaacuacauau

SEQ ID NO: 2109671 - RNA, 23 nt, Homo sapiens
acagguaucauuaacugccacuu

SEQ ID NO: 2109672 - RNA, 20 nt, Homo sapiens
cagagaguaucugagaacca

SEQ ID NO: 2109673 - RNA, 17 nt, Homo sapiens
gugcgagggaagcaauu

SEQ ID NO: 2109674 - RNA, 15 nt, Homo sapiens
aaggaaauucuuaua

SEQ ID NO: 2109675 - RNA, 14 nt, Homo sapiens
aguaguaccuuguu

SEQ ID NO: 2109676 - RNA, 22 nt, Homo sapiens
acuuuaauccuuccacuaucau

SEQ ID NO: 2109677 - RNA, 22 nt, Homo sapiens
ccaaucauacaaauacuaucca

SEQ ID NO: 2109678 - RNA, 23 nt, Homo sapiens
aaugccucuccuuaaaugcuucu

SEQ ID NO: 2109679 - RNA, 15 nt, Homo sapiens
aggauuuaccaaaua

SEQ ID NO: 2109680 - RNA, 18 nt, Homo sapiens
agugcaccucucaucagc

SEQ ID NO: 2109681 - RNA, 23 nt, Homo sapiens
auauguuucucccccuuuccaaa

SEQ ID NO: 2109682 - RNA, 20 nt, Homo sapiens
aucaggccuggcacgguggc

SEQ ID NO: 2109683 - RNA, 18 nt, Homo sapiens
acaguucagaccaaugcu

SEQ ID NO: 2109684 - RNA, 16 nt, Homo sapiens
uugauaguuuggcuau

SEQ ID NO: 2109685 - RNA, 14 nt, Homo sapiens
uaaacaaaaagcca

SEQ ID NO: 2109686 - RNA, 14 nt, Homo sapiens
uuuaauagcaaaga

SEQ ID NO: 2109687 - RNA, 18 nt, Homo sapiens
cuagaagaaaguaaaaag

SEQ ID NO: 2109688 - RNA, 16 nt, Homo sapiens
ugcacggugggagacc

SEQ ID NO: 2109689 - RNA, 16 nt, Homo sapiens
gcgugggggcacugac

SEQ ID NO: 2109690 - RNA, 18 nt, Homo sapiens
cuacuguuuaaauuccca

SEQ ID NO: 2109691 - RNA, 17 nt, Homo sapiens
gucccagcuacucagga

SEQ ID NO: 2109692 - RNA, 14 nt, Homo sapiens
aggugaacacuucc

SEQ ID NO: 2109693 - RNA, 22 nt, Homo sapiens
aaacauguuucugccuucuuua

SEQ ID NO: 2109694 - RNA, 14 nt, Homo sapiens
auuuuacacacaca

SEQ ID NO: 2109695 - RNA, 13 nt, Homo sapiens
acucuccuaguga

SEQ ID NO: 2109696 - RNA, 20 nt, Homo sapiens
auuuuuaaaaaucuaccugu

SEQ ID NO: 2109697 - RNA, 17 nt, Homo sapiens
auaccgcucaguauuuu

SEQ ID NO: 2109698 - RNA, 14 nt, Homo sapiens
ucgauucuuugaag

SEQ ID NO: 2109699 - RNA, 16 nt, Homo sapiens
ccaguacauuccaacu

SEQ ID NO: 2109700 - RNA, 21 nt, Homo sapiens
cuucagggcagggcucugaua

SEQ ID NO: 2109701 - RNA, 18 nt, Homo sapiens
auuguauauucuggaaaa

SEQ ID NO: 2109702 - RNA, 14 nt, Homo sapiens
ugcaaucuguguuc

SEQ ID NO: 2109703 - RNA, 20 nt, Homo sapiens
acucgaagcccuuccagugg

SEQ ID NO: 2109704 - RNA, 16 nt, Homo sapiens
uaucacuacagaucuc

SEQ ID NO: 2109705 - RNA, 21 nt, Homo sapiens
gagcuuaagugacuuccucga

SEQ ID NO: 2109706 - RNA, 15 nt, Homo sapiens
aggaacaacagcauc

SEQ ID NO: 2109707 - RNA, 18 nt, Homo sapiens
cagacauuuucacuggaa

SEQ ID NO: 2109708 - RNA, 21 nt, Homo sapiens
gagcagugaaugauucagugu

SEQ ID NO: 2109709 - RNA, 13 nt, Homo sapiens
gauacauguaauu

SEQ ID NO: 2109710 - RNA, 14 nt, Homo sapiens
uuugugucccugaa

SEQ ID NO: 2109711 - RNA, 19 nt, Homo sapiens
ggucaggaguucgagacca

SEQ ID NO: 2109712 - RNA, 20 nt, Homo sapiens
agcaugaccugugaccagca

SEQ ID NO: 2109713 - RNA, 20 nt, Homo sapiens
ucugagugaauuacagacaa

SEQ ID NO: 2109714 - RNA, 22 nt, Homo sapiens
uggccuugggagagaugccuuc

SEQ ID NO: 2109715 - RNA, 15 nt, Homo sapiens
ucaguuauuacaugu

SEQ ID NO: 2109716 - RNA, 15 nt, Homo sapiens
caaauugaggacuua

SEQ ID NO: 2109717 - RNA, 22 nt, Homo sapiens
aauauaguugucuuucuuugcu

SEQ ID NO: 2109718 - RNA, 22 nt, Homo sapiens
ccagagaaacugccacauacac

SEQ ID NO: 2109719 - RNA, 17 nt, Homo sapiens
cuggaggaguuccuuga

SEQ ID NO: 2109720 - RNA, 17 nt, Homo sapiens
auccauccugagccaaa

SEQ ID NO: 2109721 - RNA, 17 nt, Homo sapiens
ucugagaucagugccua

SEQ ID NO: 2109722 - RNA, 14 nt, Homo sapiens
uacuucugagcaaa

SEQ ID NO: 2109723 - RNA, 17 nt, Homo sapiens
cauguacauacccuggc

SEQ ID NO: 2109724 - RNA, 17 nt, Homo sapiens
gaucacaguggccacgg

SEQ ID NO: 2109725 - RNA, 19 nt, Homo sapiens
cacuccagugcucagcugu

SEQ ID NO: 2109726 - RNA, 17 nt, Homo sapiens
ucuuucccaauucacau

SEQ ID NO: 2109727 - RNA, 21 nt, Homo sapiens
auaguccaccucccauuacuu

SEQ ID NO: 2109728 - RNA, 14 nt, Homo sapiens
acugaacgagggau

SEQ ID NO: 2109729 - RNA, 17 nt, Homo sapiens
cgagacuccgucucaaa

SEQ ID NO: 2109730 - RNA, 17 nt, Homo sapiens
ugagacucugucucaaa

SEQ ID NO: 2109731 - RNA, 17 nt, Homo sapiens
acaucuuccuccucuac

SEQ ID NO: 2109732 - RNA, 17 nt, Homo sapiens
ugaaaaaaugugccauu

SEQ ID NO: 2109733 - RNA, 22 nt, Homo sapiens
aaugaauaugccaucuaugcag

SEQ ID NO: 2109734 - RNA, 22 nt, Homo sapiens
ugcugcaccccaaguccagguc

SEQ ID NO: 2109735 - RNA, 13 nt, Homo sapiens
cugguugcuguag

SEQ ID NO: 2109736 - RNA, 22 nt, Homo sapiens
uccucaggacccucccaggaga

SEQ ID NO: 2109737 - RNA, 13 nt, Homo sapiens
ugaccucugugac

SEQ ID NO: 2109738 - RNA, 14 nt, Homo sapiens
gcauggacauuuag

SEQ ID NO: 2109739 - RNA, 22 nt, Homo sapiens
uuccauuuugccaccuuuccug

SEQ ID NO: 2109740 - RNA, 19 nt, Homo sapiens
gucuuuggugaacauugca

SEQ ID NO: 2109741 - RNA, 13 nt, Homo sapiens
caguuccagcuuu

SEQ ID NO: 2109742 - RNA, 15 nt, Homo sapiens
cuugccaacuccauc

SEQ ID NO: 2109743 - RNA, 18 nt, Homo sapiens
uggucgccaauccaugcu

SEQ ID NO: 2109744 - RNA, 16 nt, Homo sapiens
aaucaagccugauuca

SEQ ID NO: 2109745 - RNA, 23 nt, Homo sapiens
ccaguuauacccaguauuuugag

SEQ ID NO: 2109746 - RNA, 22 nt, Homo sapiens
gagaucacgucacugcacucca

SEQ ID NO: 2109747 - RNA, 22 nt, Homo sapiens
cuuuucagcccuuugcucugau

SEQ ID NO: 2109748 - RNA, 21 nt, Homo sapiens
gccuagcuccugccacaugga

SEQ ID NO: 2109749 - RNA, 15 nt, Homo sapiens
aaauagaaacauauc

SEQ ID NO: 2109750 - RNA, 18 nt, Homo sapiens
auucuuuacccccuggga

SEQ ID NO: 2109751 - RNA, 19 nt, Homo sapiens
aaacuuucacaccccagac

SEQ ID NO: 2109752 - RNA, 20 nt, Homo sapiens
uaacaggugcgguuccucau

SEQ ID NO: 2109753 - RNA, 14 nt, Homo sapiens
cauggaaucucuuc

SEQ ID NO: 2109754 - RNA, 22 nt, Homo sapiens
cugauuuucaucaaaaccaaga

SEQ ID NO: 2109755 - RNA, 14 nt, Homo sapiens
uucuccacugcuug

SEQ ID NO: 2109756 - RNA, 21 nt, Homo sapiens
uucauucccaagguuacugga

SEQ ID NO: 2109757 - RNA, 17 nt, Homo sapiens
uccucugccagcaggaa

SEQ ID NO: 2109758 - RNA, 14 nt, Homo sapiens
gcaggaugagggaa

SEQ ID NO: 2109759 - RNA, 21 nt, Homo sapiens
acugcugcuucuuaaccccag

SEQ ID NO: 2109760 - RNA, 13 nt, Homo sapiens
uccaaucucuggu

SEQ ID NO: 2109761 - RNA, 23 nt, Homo sapiens
acguaacccauuaaaaugaauuu

SEQ ID NO: 2109762 - RNA, 18 nt, Homo sapiens
agcaagcagacauuuauc

SEQ ID NO: 2109763 - RNA, 15 nt, Homo sapiens
ccgauuuugcucugu

SEQ ID NO: 2109764 - RNA, 16 nt, Homo sapiens
agccaguaaucuuuau

SEQ ID NO: 2109765 - RNA, 15 nt, Homo sapiens
ugaaacaacccaaag

SEQ ID NO: 2109766 - RNA, 18 nt, Homo sapiens
uccccaccccagcuguua

SEQ ID NO: 2109767 - RNA, 21 nt, Homo sapiens
cacccgguccccucugcccca

SEQ ID NO: 2109768 - RNA, 19 nt, Homo sapiens
gcagggugguguaccugcu

SEQ ID NO: 2109769 - RNA, 11 nt, Homo sapiens
uuagagcucuc

SEQ ID NO: 2109770 - RNA, 13 nt, Homo sapiens
gguguugucaagu

SEQ ID NO: 2109771 - RNA, 20 nt, Homo sapiens
cugaggcgggagaaucaugu

SEQ ID NO: 2109772 - RNA, 20 nt, Homo sapiens
gaggggaggaguuccacaga

SEQ ID NO: 2109773 - RNA, 23 nt, Homo sapiens
ugguuaaaaguagucauggauaa

SEQ ID NO: 2109774 - RNA, 23 nt, Homo sapiens
aacuacugcuaauguugaucagc

SEQ ID NO: 2109775 - RNA, 15 nt, Homo sapiens
uaacuucugcuacua

SEQ ID NO: 2109776 - RNA, 21 nt, Homo sapiens
uugcacaaaguaagccucacc

SEQ ID NO: 2109777 - RNA, 16 nt, Homo sapiens
auuccucaaaauggga

SEQ ID NO: 2109778 - RNA, 19 nt, Homo sapiens
auucuaucacuggcaauau

SEQ ID NO: 2109779 - RNA, 15 nt, Homo sapiens
ccuuucucaccagcc

SEQ ID NO: 2109780 - RNA, 18 nt, Homo sapiens
auuuuagagacagaagaa

SEQ ID NO: 2109781 - RNA, 20 nt, Homo sapiens
gaagcucuucucuccagugu

SEQ ID NO: 2109782 - RNA, 18 nt, Homo sapiens
agagugccccaccugcca

SEQ ID NO: 2109783 - RNA, 18 nt, Homo sapiens
auuugguauccuuaucua

SEQ ID NO: 2109784 - RNA, 20 nt, Homo sapiens
caacacaugucuagcuuuca

SEQ ID NO: 2109785 - RNA, 18 nt, Homo sapiens
ugaacacuggcuaaagau

SEQ ID NO: 2109786 - RNA, 12 nt, Homo sapiens
gcuuauggccag

SEQ ID NO: 2109787 - RNA, 19 nt, Homo sapiens
caugguaggcuacuuuuca

SEQ ID NO: 2109788 - RNA, 15 nt, Homo sapiens
uuacuuccaugauac

SEQ ID NO: 2109789 - RNA, 14 nt, Homo sapiens
ucagccugagucuc

SEQ ID NO: 2109790 - RNA, 13 nt, Homo sapiens
ggagugaagccac

SEQ ID NO: 2109791 - RNA, 13 nt, Homo sapiens
agagacagaauuc

SEQ ID NO: 2109792 - RNA, 22 nt, Homo sapiens
uccaccuaccacucacaugaca

SEQ ID NO: 2109793 - RNA, 23 nt, Homo sapiens
acuuuguauuuguucaguaugca

SEQ ID NO: 2109794 - RNA, 18 nt, Homo sapiens
cuuccauuucuacuguau

SEQ ID NO: 2109795 - RNA, 18 nt, Homo sapiens
aauauuuauauauuugaa

SEQ ID NO: 2109796 - RNA, 18 nt, Homo sapiens
aucaacagaucaacaaua

SEQ ID NO: 2109797 - RNA, 20 nt, Homo sapiens
agccugagguugaccagcuc

SEQ ID NO: 2109798 - RNA, 19 nt, Homo sapiens
aguuccaaaauaaagcaua

SEQ ID NO: 2109799 - RNA, 15 nt, Homo sapiens
gauaacauuuuccca

SEQ ID NO: 2109800 - RNA, 17 nt, Homo sapiens
uucaccauguuggucag

SEQ ID NO: 2109801 - RNA, 14 nt, Homo sapiens
caucaauaucacaa

SEQ ID NO: 2109802 - RNA, 21 nt, Homo sapiens
uuacuuggacgcaacauugca

SEQ ID NO: 2109803 - RNA, 14 nt, Homo sapiens
uuggauuucugacc

SEQ ID NO: 2109804 - RNA, 16 nt, Homo sapiens
uggggaccacacugau

SEQ ID NO: 2109805 - RNA, 15 nt, Homo sapiens
uacugaugacagugu

SEQ ID NO: 2109806 - RNA, 18 nt, Homo sapiens
gcauuccagcgucugcug

SEQ ID NO: 2109807 - RNA, 15 nt, Homo sapiens
caaaggaaacccaau

SEQ ID NO: 2109808 - RNA, 11 nt, Homo sapiens
acagcucugca

SEQ ID NO: 2109809 - RNA, 18 nt, Homo sapiens
gauuuuaaaaagucuuca

SEQ ID NO: 2109810 - RNA, 16 nt, Homo sapiens
cacuguauaccgauca

SEQ ID NO: 2109811 - RNA, 12 nt, Homo sapiens
caccaugcugcu

SEQ ID NO: 2109812 - RNA, 14 nt, Homo sapiens
acccucaucuuucu

SEQ ID NO: 2109813 - RNA, 17 nt, Homo sapiens
agaaaaaaaauguaccc

SEQ ID NO: 2109814 - RNA, 17 nt, Homo sapiens
uuuguuuuccccacauu

SEQ ID NO: 2109815 - RNA, 13 nt, Homo sapiens
ccacauggugacu

SEQ ID NO: 2109816 - RNA, 13 nt, Homo sapiens
uacuaaugugccc

SEQ ID NO: 2109817 - RNA, 18 nt, Homo sapiens
cuugaaaacucucaguca

SEQ ID NO: 2109818 - RNA, 20 nt, Homo sapiens
gcuauuuguguguaugcuga

SEQ ID NO: 2109819 - RNA, 19 nt, Homo sapiens
ugccguccugcaguccuua

SEQ ID NO: 2109820 - RNA, 17 nt, Homo sapiens
acacuugaacucagacc

SEQ ID NO: 2109821 - RNA, 18 nt, Homo sapiens
cuccuacccuggcccuuu

SEQ ID NO: 2109822 - RNA, 20 nt, Homo sapiens
cuugaagugaacaaauuuca

SEQ ID NO: 2109823 - RNA, 14 nt, Homo sapiens
cuuggcuguuccac

SEQ ID NO: 2109824 - RNA, 22 nt, Homo sapiens
ucuuauggaggagaguguuuaa

SEQ ID NO: 2109825 - RNA, 21 nt, Homo sapiens
agaccaucugaggaaugagaa

SEQ ID NO: 2109826 - RNA, 15 nt, Homo sapiens
auuugcaacagcuac

SEQ ID NO: 2109827 - RNA, 13 nt, Homo sapiens
ggccauuugcaau

SEQ ID NO: 2109828 - RNA, 21 nt, Homo sapiens
gcaauuuuuccaaaagccagu

SEQ ID NO: 2109829 - RNA, 17 nt, Homo sapiens
accgccaaagaaugccu

SEQ ID NO: 2109830 - RNA, 18 nt, Homo sapiens
acacugcaguuuccugga

SEQ ID NO: 2109831 - RNA, 17 nt, Homo sapiens
ggcauauccaccaccuc

SEQ ID NO: 2109832 - RNA, 20 nt, Homo sapiens
agagagcuagagggacaaag

SEQ ID NO: 2109833 - RNA, 12 nt, Homo sapiens
gugggaguccac

SEQ ID NO: 2109834 - RNA, 15 nt, Homo sapiens
agccuuuuaacugug

SEQ ID NO: 2109835 - RNA, 18 nt, Homo sapiens
caggucaucuaggagcaa

SEQ ID NO: 2109836 - RNA, 15 nt, Homo sapiens
ccucccuagcucuga

SEQ ID NO: 2109837 - RNA, 18 nt, Homo sapiens
ggaagccucuauugccau

SEQ ID NO: 2109838 - RNA, 16 nt, Homo sapiens
aauaaauaaacuucaa

SEQ ID NO: 2109839 - RNA, 12 nt, Homo sapiens
aauauacauuca

SEQ ID NO: 2109840 - RNA, 20 nt, Homo sapiens
ugcuuaggaaaccucacgac

SEQ ID NO: 2109841 - RNA, 21 nt, Homo sapiens
cuuaaccuuugauucuacuua

SEQ ID NO: 2109842 - RNA, 16 nt, Homo sapiens
agucacaugaccugau

SEQ ID NO: 2109843 - RNA, 20 nt, Homo sapiens
uggcauucucucugcucagu

SEQ ID NO: 2109844 - RNA, 16 nt, Homo sapiens
caacaucgcaauaguu

SEQ ID NO: 2109845 - RNA, 16 nt, Homo sapiens
caauagugcaacaucu

SEQ ID NO: 2109846 - RNA, 16 nt, Homo sapiens
cacaggcagcauuuag

SEQ ID NO: 2109847 - RNA, 16 nt, Homo sapiens
ugcccuggggccacug

SEQ ID NO: 2109848 - RNA, 20 nt, Homo sapiens
cacuuucagaaaaacaaaug

SEQ ID NO: 2109849 - RNA, 20 nt, Homo sapiens
auaaaagcccaggagcccau

SEQ ID NO: 2109850 - RNA, 22 nt, Homo sapiens
aagaggacuuaguuugugaugu

SEQ ID NO: 2109851 - RNA, 13 nt, Homo sapiens
ggacuccugucug

SEQ ID NO: 2109852 - RNA, 17 nt, Homo sapiens
uggcuggcuguguccuc

SEQ ID NO: 2109853 - RNA, 16 nt, Homo sapiens
gcccuugagaagccaa

SEQ ID NO: 2109854 - RNA, 17 nt, Homo sapiens
uaaaaugacaaagccau

SEQ ID NO: 2109855 - RNA, 16 nt, Homo sapiens
ccaucuuaaucuuuau

SEQ ID NO: 2109856 - RNA, 13 nt, Homo sapiens
ugcccagagccac

SEQ ID NO: 2109857 - RNA, 16 nt, Homo sapiens
aucccucucacccaga

SEQ ID NO: 2109858 - RNA, 19 nt, Homo sapiens
aauguuuucaaaagguauu

SEQ ID NO: 2109859 - RNA, 12 nt, Homo sapiens
aucacaguggga

SEQ ID NO: 2109860 - RNA, 17 nt, Homo sapiens
cgucccacaucagggcg

SEQ ID NO: 2109861 - RNA, 12 nt, Homo sapiens
ucugcugcugag

SEQ ID NO: 2109862 - RNA, 16 nt, Homo sapiens
cuuaacgcagcacuua

SEQ ID NO: 2109863 - RNA, 12 nt, Homo sapiens
ucaacugcugua

SEQ ID NO: 2109864 - RNA, 15 nt, Homo sapiens
aauagugccaggaaa

SEQ ID NO: 2109865 - RNA, 15 nt, Homo sapiens
cuuaauuuuaagugu

SEQ ID NO: 2109866 - RNA, 17 nt, Homo sapiens
guucagaggaagcacau

SEQ ID NO: 2109867 - RNA, 16 nt, Homo sapiens
caagcaauucuccugc

SEQ ID NO: 2109868 - RNA, 16 nt, Homo sapiens
aaucccacuaaugcaa

SEQ ID NO: 2109869 - RNA, 17 nt, Homo sapiens
aggcuaauauauuccaa

SEQ ID NO: 2109870 - RNA, 14 nt, Homo sapiens
agugagcuggugac

SEQ ID NO: 2109871 - RNA, 19 nt, Homo sapiens
uccuggcuaacauggugaa

SEQ ID NO: 2109872 - RNA, 20 nt, Homo sapiens
aguuuaagaaguggugacau

SEQ ID NO: 2109873 - RNA, 20 nt, Homo sapiens
acugauuauaguacugacag

SEQ ID NO: 2109874 - RNA, 18 nt, Homo sapiens
ugaaauuugugauggcca

SEQ ID NO: 2109875 - RNA, 13 nt, Homo sapiens
ggcaaggccuuug

SEQ ID NO: 2109876 - RNA, 13 nt, Homo sapiens
cugcugggcucag

SEQ ID NO: 2109877 - RNA, 13 nt, Homo sapiens
cccaagauucaua

SEQ ID NO: 2109878 - RNA, 12 nt, Homo sapiens
caaaucaucucu

SEQ ID NO: 2109879 - RNA, 12 nt, Homo sapiens
aucaucauaaau

SEQ ID NO: 2109880 - RNA, 15 nt, Homo sapiens
gccuuuuccuaugua

SEQ ID NO: 2109881 - RNA, 12 nt, Homo sapiens
ggccagugccag

SEQ ID NO: 2109882 - RNA, 20 nt, Homo sapiens
agaacacccucuaaauggga

SEQ ID NO: 2109883 - RNA, 20 nt, Homo sapiens
agaugagaaaacaggcucac

SEQ ID NO: 2109884 - RNA, 16 nt, Homo sapiens
uucacuaaagugucau

SEQ ID NO: 2109885 - RNA, 19 nt, Homo sapiens
uacucuggaggcugagaua

SEQ ID NO: 2109886 - RNA, 19 nt, Homo sapiens
cuaagccguuggcaccucu

SEQ ID NO: 2109887 - RNA, 17 nt, Homo sapiens
ucgaggacagcaaugca

SEQ ID NO: 2109888 - RNA, 17 nt, Homo sapiens
auaaagauugaguuugc

SEQ ID NO: 2109889 - RNA, 24 nt, Homo sapiens
cuagaucucccuuaauaaacucac

SEQ ID NO: 2109890 - RNA, 22 nt, Homo sapiens
cagcuucccaaguagcugagau

SEQ ID NO: 2109891 - RNA, 12 nt, Homo sapiens
agugcuacagau

SEQ ID NO: 2109892 - RNA, 23 nt, Homo sapiens
caaacacaagugcgccuugcaaa

SEQ ID NO: 2109893 - RNA, 16 nt, Homo sapiens
cugaaauaaaagccuc

SEQ ID NO: 2109894 - RNA, 22 nt, Homo sapiens
uaaacucuguugcaagugcaau

SEQ ID NO: 2109895 - RNA, 22 nt, Homo sapiens
aaugaauuuuuuuuauccuccu

SEQ ID NO: 2109896 - RNA, 18 nt, Homo sapiens
accacuugacagacugua

SEQ ID NO: 2109897 - RNA, 17 nt, Homo sapiens
caucuacccugcugacc

SEQ ID NO: 2109898 - RNA, 16 nt, Homo sapiens
gaugagccacagaaau

SEQ ID NO: 2109899 - RNA, 23 nt, Homo sapiens
aggaaugcaccacggcagcucuc

SEQ ID NO: 2109900 - RNA, 20 nt, Homo sapiens
acuaccagugggcauguauu

SEQ ID NO: 2109901 - RNA, 14 nt, Homo sapiens
uccaaggguacuaa

SEQ ID NO: 2109902 - RNA, 23 nt, Homo sapiens
agacgcugcugucacaaccaaga

SEQ ID NO: 2109903 - RNA, 18 nt, Homo sapiens
uacacgggacugacgcaa

SEQ ID NO: 2109904 - RNA, 22 nt, Homo sapiens
caggagugugaggaggagacag

SEQ ID NO: 2109905 - RNA, 19 nt, Homo sapiens
auugugcacauacuugaga

SEQ ID NO: 2109906 - RNA, 12 nt, Homo sapiens
cccaaacacuuc

SEQ ID NO: 2109907 - RNA, 20 nt, Homo sapiens
cucaaauggggccagaucca

SEQ ID NO: 2109908 - RNA, 19 nt, Homo sapiens
cucagcguuccuggacaaa

SEQ ID NO: 2109909 - RNA, 13 nt, Homo sapiens
caggaaacauuca

SEQ ID NO: 2109910 - RNA, 19 nt, Homo sapiens
uuuuguaaaguugccuuua

SEQ ID NO: 2109911 - RNA, 18 nt, Homo sapiens
caagcccacagaugagaa

SEQ ID NO: 2109912 - RNA, 19 nt, Homo sapiens
gcaaauaaauuaugcaauu

SEQ ID NO: 2109913 - RNA, 17 nt, Homo sapiens
acacgucgauucugucc

SEQ ID NO: 2109914 - RNA, 23 nt, Homo sapiens
acacaaauguccucaacugucau

SEQ ID NO: 2109915 - RNA, 23 nt, Homo sapiens
agaaauuaguuucaaauuuaccu

SEQ ID NO: 2109916 - RNA, 20 nt, Homo sapiens
cacagcugaacuuguugaga

SEQ ID NO: 2109917 - RNA, 21 nt, Homo sapiens
aggugguggcagcaauggugu

SEQ ID NO: 2109918 - RNA, 16 nt, Homo sapiens
acuguuguacaagcuc

SEQ ID NO: 2109919 - RNA, 16 nt, Homo sapiens
gacuuccuacuugguc

SEQ ID NO: 2109920 - RNA, 15 nt, Homo sapiens
auauaucuaccccag

SEQ ID NO: 2109921 - RNA, 22 nt, Homo sapiens
aaugaggauuauugauaguacu

SEQ ID NO: 2109922 - RNA, 22 nt, Homo sapiens
ugcuuuugguggcuaccaugca

SEQ ID NO: 2109923 - RNA, 18 nt, Homo sapiens
cacagguggccaucacag

SEQ ID NO: 2109924 - RNA, 13 nt, Homo sapiens
aaaugauucaucu

SEQ ID NO: 2109925 - RNA, 15 nt, Homo sapiens
cacccucuggcugag

SEQ ID NO: 2109926 - RNA, 15 nt, Homo sapiens
ugaccggaucuacac

SEQ ID NO: 2109927 - RNA, 23 nt, Homo sapiens
cucaucccccaucagaugauggg

SEQ ID NO: 2109928 - RNA, 20 nt, Homo sapiens
ucaaaaucuuucagcacuca

SEQ ID NO: 2109929 - RNA, 16 nt, Homo sapiens
cuggugacaggccaaa

SEQ ID NO: 2109930 - RNA, 13 nt, Homo sapiens
uugaccaugugau

SEQ ID NO: 2109931 - RNA, 22 nt, Homo sapiens
guucugagauuauuuuaaucua

SEQ ID NO: 2109932 - RNA, 20 nt, Homo sapiens
uuucgaucccugggaccaac

SEQ ID NO: 2109933 - RNA, 17 nt, Homo sapiens
guuuggacuguuuucaa

SEQ ID NO: 2109934 - RNA, 19 nt, Homo sapiens
ucaggugaagcuggagcuc

SEQ ID NO: 2109935 - RNA, 22 nt, Homo sapiens
augagaaacuuugaucucugcu

SEQ ID NO: 2109936 - RNA, 17 nt, Homo sapiens
cagaacuggaccaucuc

SEQ ID NO: 2109937 - RNA, 19 nt, Homo sapiens
ugccaccccaugugccuuu

SEQ ID NO: 2109938 - RNA, 12 nt, Homo sapiens
uugggcauuuaa

SEQ ID NO: 2109939 - RNA, 17 nt, Homo sapiens
auuaccacacucagcua

SEQ ID NO: 2109940 - RNA, 14 nt, Homo sapiens
cgcugacugcacca

SEQ ID NO: 2109941 - RNA, 17 nt, Homo sapiens
uuugaacgugccagcag

SEQ ID NO: 2109942 - RNA, 19 nt, Homo sapiens
agauuuuuaagaacuucau

SEQ ID NO: 2109943 - RNA, 19 nt, Homo sapiens
cuuggacccaccugaaaug

SEQ ID NO: 2109944 - RNA, 19 nt, Homo sapiens
cacagcugcagcugaucca

SEQ ID NO: 2109945 - RNA, 22 nt, Homo sapiens
cuugagaggguggaauauccaa

SEQ ID NO: 2109946 - RNA, 14 nt, Homo sapiens
ggcugcagauuucc

SEQ ID NO: 2109947 - RNA, 15 nt, Homo sapiens
gugauuuagguuugu

SEQ ID NO: 2109948 - RNA, 11 nt, Homo sapiens
uuccuggugcu

SEQ ID NO: 2109949 - RNA, 15 nt, Homo sapiens
ugccuuagugugaaa

SEQ ID NO: 2109950 - RNA, 16 nt, Homo sapiens
ccuucuggauccaugg

SEQ ID NO: 2109951 - RNA, 24 nt, Homo sapiens
gcugacgggaggccccagcucuga

SEQ ID NO: 2109952 - RNA, 13 nt, Homo sapiens
uuguaaccugcau

SEQ ID NO: 2109953 - RNA, 17 nt, Homo sapiens
agccugcagggugaccu

SEQ ID NO: 2109954 - RNA, 17 nt, Homo sapiens
uuuaguacauccagaaa

SEQ ID NO: 2109955 - RNA, 18 nt, Homo sapiens
uauaggucauacaaucca

SEQ ID NO: 2109956 - RNA, 16 nt, Homo sapiens
uaugaauuugauuuau

SEQ ID NO: 2109957 - RNA, 18 nt, Homo sapiens
uaaucucacagcauuugc

SEQ ID NO: 2109958 - RNA, 20 nt, Homo sapiens
cacagaugcacaacacuccu

SEQ ID NO: 2109959 - RNA, 17 nt, Homo sapiens
uuaacccauuugucucu

SEQ ID NO: 2109960 - RNA, 13 nt, Homo sapiens
gucauagcauuca

SEQ ID NO: 2109961 - RNA, 15 nt, Homo sapiens
agaaugguagcacua

SEQ ID NO: 2109962 - RNA, 20 nt, Homo sapiens
auuuuguaaaucuguacuuu

SEQ ID NO: 2109963 - RNA, 22 nt, Homo sapiens
guauugcaccuuugaaaugcac

SEQ ID NO: 2109964 - RNA, 15 nt, Homo sapiens
ugaaugauacccuga

SEQ ID NO: 2109965 - RNA, 20 nt, Homo sapiens
uagcagcccacccugcugcu

SEQ ID NO: 2109966 - RNA, 15 nt, Homo sapiens
cuccucuccaugcaa

SEQ ID NO: 2109967 - RNA, 15 nt, Homo sapiens
cuauucuccugccau

SEQ ID NO: 2109968 - RNA, 20 nt, Homo sapiens
acuauaaucaaaugauuuca

SEQ ID NO: 2109969 - RNA, 22 nt, Homo sapiens
cuguguuacuugaaguaacuau

SEQ ID NO: 2109970 - RNA, 15 nt, Homo sapiens
auuuaauccuuguga

SEQ ID NO: 2109971 - RNA, 14 nt, Homo sapiens
ggacaaauugagac

SEQ ID NO: 2109972 - RNA, 18 nt, Homo sapiens
uugcacuaucuuucagcu

SEQ ID NO: 2109973 - RNA, 13 nt, Homo sapiens
uauaccauuuuau

SEQ ID NO: 2109974 - RNA, 23 nt, Homo sapiens
gaaacaacaauuucuacuuugaa

SEQ ID NO: 2109975 - RNA, 14 nt, Homo sapiens
acucccgaccucag

SEQ ID NO: 2109976 - RNA, 16 nt, Homo sapiens
agagaugaaugcccag

SEQ ID NO: 2109977 - RNA, 15 nt, Homo sapiens
ggaauggacauuucu

SEQ ID NO: 2109978 - RNA, 16 nt, Homo sapiens
cuuugucacuugccac

SEQ ID NO: 2109979 - RNA, 21 nt, Homo sapiens
ccaaguugagauuuuaauucu

SEQ ID NO: 2109980 - RNA, 13 nt, Homo sapiens
aaguuacuugaaa

SEQ ID NO: 2109981 - RNA, 19 nt, Homo sapiens
gauuacaggcaugagccac

SEQ ID NO: 2109982 - RNA, 13 nt, Homo sapiens
cuuuugcuugucc

SEQ ID NO: 2109983 - RNA, 20 nt, Homo sapiens
gagcugccucuucucuugac

SEQ ID NO: 2109984 - RNA, 23 nt, Homo sapiens
auucuccauuuguuaucugggaa

SEQ ID NO: 2109985 - RNA, 21 nt, Homo sapiens
cacugugguggugugcugcuu

SEQ ID NO: 2109986 - RNA, 18 nt, Homo sapiens
uaaaaaucacuuucauaa

SEQ ID NO: 2109987 - RNA, 19 nt, Homo sapiens
uaauccugaauguaaacaa

SEQ ID NO: 2109988 - RNA, 15 nt, Homo sapiens
uccuccccugcuacc

SEQ ID NO: 2109989 - RNA, 15 nt, Homo sapiens
acaucaacagauaaa

SEQ ID NO: 2109990 - RNA, 22 nt, Homo sapiens
gaucuguagaagucugucuuuc

SEQ ID NO: 2109991 - RNA, 13 nt, Homo sapiens
accuaggauuuca

SEQ ID NO: 2109992 - RNA, 22 nt, Homo sapiens
uuugagguggagucuugcucug

SEQ ID NO: 2109993 - RNA, 22 nt, Homo sapiens
caguugcucaaaaagaaaucaa

SEQ ID NO: 2109994 - RNA, 11 nt, Homo sapiens
uguauguuaaa

SEQ ID NO: 2109995 - RNA, 13 nt, Homo sapiens
ugaaauacuaaaa

SEQ ID NO: 2109996 - RNA, 15 nt, Homo sapiens
aaauccauaucuuaa

SEQ ID NO: 2109997 - RNA, 13 nt, Homo sapiens
uagugaugcaguu

SEQ ID NO: 2109998 - RNA, 16 nt, Homo sapiens
gcaaguguaugcacgu

SEQ ID NO: 2109999 - RNA, 23 nt, Homo sapiens
aagcagugggguugggaccucag

SEQ ID NO: 2110000 - RNA, 11 nt, Homo sapiens
aagaccagcuu

SEQ ID NO: 2110001 - RNA, 21 nt, Homo sapiens
agugcaggcuuggggagcuuu

SEQ ID NO: 2110002 - RNA, 13 nt, Homo sapiens
cuggcaaauccag

SEQ ID NO: 2110003 - RNA, 20 nt, Homo sapiens
guacuuugaauuuuagcaca

SEQ ID NO: 2110004 - RNA, 16 nt, Homo sapiens
gcccaagaggacugag

SEQ ID NO: 2110005 - RNA, 11 nt, Homo sapiens
cuuggaaccac

SEQ ID NO: 2110006 - RNA, 17 nt, Homo sapiens
aaaaacguaucuccuaa

SEQ ID NO: 2110007 - RNA, 19 nt, Homo sapiens
cacauuuuacgacaaggau

SEQ ID NO: 2110008 - RNA, 23 nt, Homo sapiens
cuggugaugggguuuguuuucau

SEQ ID NO: 2110009 - RNA, 19 nt, Homo sapiens
cacuggcuucaggcaaagc

SEQ ID NO: 2110010 - RNA, 18 nt, Homo sapiens
uaaauacacucucuuauu

SEQ ID NO: 2110011 - RNA, 23 nt, Homo sapiens
cagauguauuaaaaaaagauuug

SEQ ID NO: 2110012 - RNA, 15 nt, Homo sapiens
gaacugcauaucgga

SEQ ID NO: 2110013 - RNA, 12 nt, Homo sapiens
cuccauguguuu

SEQ ID NO: 2110014 - RNA, 12 nt, Homo sapiens
guucaugucucu

SEQ ID NO: 2110015 - RNA, 18 nt, Homo sapiens
aaaaacuucccaacucac

SEQ ID NO: 2110016 - RNA, 14 nt, Homo sapiens
agugagagcuuccu

SEQ ID NO: 2110017 - RNA, 11 nt, Homo sapiens
guccaguuuau

SEQ ID NO: 2110018 - RNA, 21 nt, Homo sapiens
ccucccauaauugcuuugcca

SEQ ID NO: 2110019 - RNA, 14 nt, Homo sapiens
cuaucuagcauuua

SEQ ID NO: 2110020 - RNA, 23 nt, Homo sapiens
auccuacccccugugccuuguca

SEQ ID NO: 2110021 - RNA, 16 nt, Homo sapiens
caucacaggacacggg

SEQ ID NO: 2110022 - RNA, 21 nt, Homo sapiens
aggacacccucccuccagggu

SEQ ID NO: 2110023 - RNA, 20 nt, Homo sapiens
cagaggugacccaaugcucc

SEQ ID NO: 2110024 - RNA, 21 nt, Homo sapiens
cuccaggccagggggccaguc

SEQ ID NO: 2110025 - RNA, 23 nt, Homo sapiens
gaccugacaccgucccucaguga

SEQ ID NO: 2110026 - RNA, 18 nt, Homo sapiens
gaacuagagacucuguga

SEQ ID NO: 2110027 - RNA, 20 nt, Homo sapiens
aaaugaaacaagucuagucu

SEQ ID NO: 2110028 - RNA, 12 nt, Homo sapiens
gaguuuguuacc

SEQ ID NO: 2110029 - RNA, 16 nt, Homo sapiens
gcuuacuuaugccaua

SEQ ID NO: 2110030 - RNA, 23 nt, Homo sapiens
ucucaguccaccugagcugccau

SEQ ID NO: 2110031 - RNA, 23 nt, Homo sapiens
ccagaagcuuccauaguggugca

SEQ ID NO: 2110032 - RNA, 17 nt, Homo sapiens
caagcuguguuacuuga

SEQ ID NO: 2110033 - RNA, 19 nt, Homo sapiens
uaauguauacauuacaucu

SEQ ID NO: 2110034 - RNA, 17 nt, Homo sapiens
uagaaaaaucucauucc

SEQ ID NO: 2110035 - RNA, 17 nt, Homo sapiens
agggaaggaugacaaaa

SEQ ID NO: 2110036 - RNA, 23 nt, Homo sapiens
ccuagaagggcuagaaccuggag

SEQ ID NO: 2110037 - RNA, 17 nt, Homo sapiens
aagauuuuccucuugug

SEQ ID NO: 2110038 - RNA, 15 nt, Homo sapiens
ccaugcagcugcucc

SEQ ID NO: 2110039 - RNA, 20 nt, Homo sapiens
aagcuuuaucugucuugacu

SEQ ID NO: 2110040 - RNA, 13 nt, Homo sapiens
cccacagaccuca

SEQ ID NO: 2110041 - RNA, 13 nt, Homo sapiens
cacccagacauaa

SEQ ID NO: 2110042 - RNA, 19 nt, Homo sapiens
cuuuacuccuguaagcaag

SEQ ID NO: 2110043 - RNA, 22 nt, Homo sapiens
guccgacucuucugagcaccua

SEQ ID NO: 2110044 - RNA, 23 nt, Homo sapiens
uaacuguuaaggagcuucaggga

SEQ ID NO: 2110045 - RNA, 16 nt, Homo sapiens
ucugucaagcuuacua

SEQ ID NO: 2110046 - RNA, 14 nt, Homo sapiens
cccaaguaggcauu

SEQ ID NO: 2110047 - RNA, 15 nt, Homo sapiens
agcucaagaugacag

SEQ ID NO: 2110048 - RNA, 19 nt, Homo sapiens
cagcucugccuugcacugu

SEQ ID NO: 2110049 - RNA, 16 nt, Homo sapiens
ucugcuauauuuucau

SEQ ID NO: 2110050 - RNA, 19 nt, Homo sapiens
gucccagaaaugucaugag

SEQ ID NO: 2110051 - RNA, 22 nt, Homo sapiens
gaaacuuuacaaccugauguca

SEQ ID NO: 2110052 - RNA, 17 nt, Homo sapiens
aaagaauaaaguccaaa

SEQ ID NO: 2110053 - RNA, 14 nt, Homo sapiens
aacaaaggcagcug

SEQ ID NO: 2110054 - RNA, 13 nt, Homo sapiens
acaaaaacuugua

SEQ ID NO: 2110055 - RNA, 17 nt, Homo sapiens
cccaacugaccugccag

SEQ ID NO: 2110056 - RNA, 13 nt, Homo sapiens
cccucccaaugcc

SEQ ID NO: 2110057 - RNA, 17 nt, Homo sapiens
aauaaccauugucauaa

SEQ ID NO: 2110058 - RNA, 17 nt, Homo sapiens
cucucuccccaaaguga

SEQ ID NO: 2110059 - RNA, 19 nt, Homo sapiens
caggugccccucucuccau

SEQ ID NO: 2110060 - RNA, 16 nt, Homo sapiens
ugaaaagaauuugaug

SEQ ID NO: 2110061 - RNA, 15 nt, Homo sapiens
ugaaauuccaguuua

SEQ ID NO: 2110062 - RNA, 23 nt, Homo sapiens
cuucacauaggaagggaucugag

SEQ ID NO: 2110063 - RNA, 12 nt, Homo sapiens
cacuugaacccg

SEQ ID NO: 2110064 - RNA, 16 nt, Homo sapiens
guugcucacucaggac

SEQ ID NO: 2110065 - RNA, 21 nt, Homo sapiens
uguagucccggaggccuuccc

SEQ ID NO: 2110066 - RNA, 18 nt, Homo sapiens
gauuuggaggcuaccuca

SEQ ID NO: 2110067 - RNA, 20 nt, Homo sapiens
cugcuucuacggccaugaga

SEQ ID NO: 2110068 - RNA, 13 nt, Homo sapiens
aucccaucaaaga

SEQ ID NO: 2110069 - RNA, 20 nt, Homo sapiens
ccuccaagucuguaccucaa

SEQ ID NO: 2110070 - RNA, 17 nt, Homo sapiens
aguaaucucacacuuca

SEQ ID NO: 2110071 - RNA, 13 nt, Homo sapiens
ccucgaaacugcc

SEQ ID NO: 2110072 - RNA, 13 nt, Homo sapiens
ccuagaaacugac

SEQ ID NO: 2110073 - RNA, 18 nt, Homo sapiens
acuucaguauguugucaa

SEQ ID NO: 2110074 - RNA, 15 nt, Homo sapiens
aacaguugcauuuag

SEQ ID NO: 2110075 - RNA, 22 nt, Homo sapiens
agagcucuuuaccaaggaugaa

SEQ ID NO: 2110076 - RNA, 19 nt, Homo sapiens
aaaacauuuugaaggaaaa

SEQ ID NO: 2110077 - RNA, 18 nt, Homo sapiens
cccugacgacacugaaga

SEQ ID NO: 2110078 - RNA, 21 nt, Homo sapiens
auuuuacuacaguaaauggca

SEQ ID NO: 2110079 - RNA, 21 nt, Homo sapiens
uuccccaggugugugcuuuag

SEQ ID NO: 2110080 - RNA, 17 nt, Homo sapiens
uaagaaauguaguugau

SEQ ID NO: 2110081 - RNA, 21 nt, Homo sapiens
uaaacggcccaggccaggugc

SEQ ID NO: 2110082 - RNA, 14 nt, Homo sapiens
gacuuagugcaaca

SEQ ID NO: 2110083 - RNA, 20 nt, Homo sapiens
ugcuagacaagcuuguccau

SEQ ID NO: 2110084 - RNA, 11 nt, Homo sapiens
uggaggacaaa

SEQ ID NO: 2110085 - RNA, 15 nt, Homo sapiens
aucauuaucagccug

SEQ ID NO: 2110086 - RNA, 22 nt, Homo sapiens
ggagcuguugggugucuugccu

SEQ ID NO: 2110087 - RNA, 14 nt, Homo sapiens
uaggcucauacuca

SEQ ID NO: 2110088 - RNA, 21 nt, Homo sapiens
uuccuguaaagaaacauuucc

SEQ ID NO: 2110089 - RNA, 16 nt, Homo sapiens
aagcagaugcucugaa

SEQ ID NO: 2110090 - RNA, 17 nt, Homo sapiens
guggaguuuucaugaca

SEQ ID NO: 2110091 - RNA, 18 nt, Homo sapiens
uaaaauacaagacugcca

SEQ ID NO: 2110092 - RNA, 21 nt, Homo sapiens
guuacuuaagaggcagagaag

SEQ ID NO: 2110093 - RNA, 19 nt, Homo sapiens
ccuguuuucuacagguuag

SEQ ID NO: 2110094 - RNA, 22 nt, Homo sapiens
uuuuuacuaaacucagaggcag

SEQ ID NO: 2110095 - RNA, 15 nt, Homo sapiens
accaccacugugucc

SEQ ID NO: 2110096 - RNA, 16 nt, Homo sapiens
ugccaucgaccuggag

SEQ ID NO: 2110097 - RNA, 21 nt, Homo sapiens
agcuugaccgugaggccagag

SEQ ID NO: 2110098 - RNA, 17 nt, Homo sapiens
agcccuugcucuaccug

SEQ ID NO: 2110099 - RNA, 14 nt, Homo sapiens
gccaguuucuuugg

SEQ ID NO: 2110100 - RNA, 16 nt, Homo sapiens
aguaaacuguaauaaa

SEQ ID NO: 2110101 - RNA, 22 nt, Homo sapiens
ugccacuuuucaugucauuuga

SEQ ID NO: 2110102 - RNA, 21 nt, Homo sapiens
augguuuucuccaagagcuac

SEQ ID NO: 2110103 - RNA, 13 nt, Homo sapiens
uuccagacccagc

SEQ ID NO: 2110104 - RNA, 20 nt, Homo sapiens
ucauucugguucccugcugc

SEQ ID NO: 2110105 - RNA, 22 nt, Homo sapiens
acacagauguucacccaaccac

SEQ ID NO: 2110106 - RNA, 22 nt, Homo sapiens
gaaccucacucuugccaaccug

SEQ ID NO: 2110107 - RNA, 21 nt, Homo sapiens
ugucacaaauaaacauaauaa

SEQ ID NO: 2110108 - RNA, 18 nt, Homo sapiens
acacgaacaaaccaagga

SEQ ID NO: 2110109 - RNA, 13 nt, Homo sapiens
gucaagcaccugc

SEQ ID NO: 2110110 - RNA, 17 nt, Homo sapiens
cuauaguuucaccacuc

SEQ ID NO: 2110111 - RNA, 18 nt, Homo sapiens
uggagcaggaugagggaa

SEQ ID NO: 2110112 - RNA, 22 nt, Homo sapiens
auaugagcuuccuucugugaaa

SEQ ID NO: 2110113 - RNA, 17 nt, Homo sapiens
gcaggagacuggcaaga

SEQ ID NO: 2110114 - RNA, 15 nt, Homo sapiens
aagagacucuggccu

SEQ ID NO: 2110115 - RNA, 20 nt, Homo sapiens
guucccagggucugcugagg

SEQ ID NO: 2110116 - RNA, 14 nt, Homo sapiens
ucagggaacucugg

SEQ ID NO: 2110117 - RNA, 17 nt, Homo sapiens
uggcugguuucugagag

SEQ ID NO: 2110118 - RNA, 14 nt, Homo sapiens
agauucacauacag

SEQ ID NO: 2110119 - RNA, 18 nt, Homo sapiens
accaaaugaaaugccaaa

SEQ ID NO: 2110120 - RNA, 17 nt, Homo sapiens
auuucacagcaccaaaa

SEQ ID NO: 2110121 - RNA, 13 nt, Homo sapiens
cucaucauccuug

SEQ ID NO: 2110122 - RNA, 13 nt, Homo sapiens
auuugcauaccau

SEQ ID NO: 2110123 - RNA, 16 nt, Homo sapiens
uaugcaaauacaauca

SEQ ID NO: 2110124 - RNA, 20 nt, Homo sapiens
ccugcuugaacugcugccaa

SEQ ID NO: 2110125 - RNA, 21 nt, Homo sapiens
aguuuuguaaaaacugaagaa

SEQ ID NO: 2110126 - RNA, 17 nt, Homo sapiens
agguuaaaaacagggaa

SEQ ID NO: 2110127 - RNA, 16 nt, Homo sapiens
gaaggcuuucagcuga

SEQ ID NO: 2110128 - RNA, 19 nt, Homo sapiens
ggagacccguagaugccag

SEQ ID NO: 2110129 - RNA, 20 nt, Homo sapiens
uuugcaccaacauagucaua

SEQ ID NO: 2110130 - RNA, 21 nt, Homo sapiens
ccaaauuuggcaaaacagccc

SEQ ID NO: 2110131 - RNA, 15 nt, Homo sapiens
cugaggcacacagag

SEQ ID NO: 2110132 - RNA, 22 nt, Homo sapiens
cacugcagauagccagacacau

SEQ ID NO: 2110133 - RNA, 20 nt, Homo sapiens
agcucugauugcagcacaga

SEQ ID NO: 2110134 - RNA, 20 nt, Homo sapiens
cuauuuugaugcagcauuug

SEQ ID NO: 2110135 - RNA, 16 nt, Homo sapiens
cacccuucucauucca

SEQ ID NO: 2110136 - RNA, 13 nt, Homo sapiens
ccagagugcagug

SEQ ID NO: 2110137 - RNA, 20 nt, Homo sapiens
uucagaugaccucaaugccu

SEQ ID NO: 2110138 - RNA, 14 nt, Homo sapiens
uacuaggacuccuu

SEQ ID NO: 2110139 - RNA, 15 nt, Homo sapiens
ucauuuugucagcag

SEQ ID NO: 2110140 - RNA, 14 nt, Homo sapiens
aggaccuugcuuug

SEQ ID NO: 2110141 - RNA, 11 nt, Homo sapiens
gucagugcagc

SEQ ID NO: 2110142 - RNA, 13 nt, Homo sapiens
uugccuucauccc

SEQ ID NO: 2110143 - RNA, 13 nt, Homo sapiens
aggaauucugcaa

SEQ ID NO: 2110144 - RNA, 19 nt, Homo sapiens
ccuugggagccacugccac

SEQ ID NO: 2110145 - RNA, 18 nt, Homo sapiens
aauaugaggaaaauccau

SEQ ID NO: 2110146 - RNA, 13 nt, Homo sapiens
gccucauacacau

SEQ ID NO: 2110147 - RNA, 16 nt, Homo sapiens
cucggccuccaagggg

SEQ ID NO: 2110148 - RNA, 17 nt, Homo sapiens
acaaucagcggcauuua

SEQ ID NO: 2110149 - RNA, 17 nt, Homo sapiens
aauuaaauggcaucagc

SEQ ID NO: 2110150 - RNA, 15 nt, Homo sapiens
acacacacucuucaa

SEQ ID NO: 2110151 - RNA, 20 nt, Homo sapiens
uagaugucuguguauacaua

SEQ ID NO: 2110152 - RNA, 15 nt, Homo sapiens
caauccaucucucaa

SEQ ID NO: 2110153 - RNA, 14 nt, Homo sapiens
uaguacuggcacaa

SEQ ID NO: 2110154 - RNA, 15 nt, Homo sapiens
auaacccuaacacac

SEQ ID NO: 2110155 - RNA, 13 nt, Homo sapiens
ucaugaagugaau

SEQ ID NO: 2110156 - RNA, 18 nt, Homo sapiens
ccuuggcaugccuuccag

SEQ ID NO: 2110157 - RNA, 22 nt, Homo sapiens
aggucauauauuuuuugcuacu

SEQ ID NO: 2110158 - RNA, 15 nt, Homo sapiens
uccugggugcuguca

SEQ ID NO: 2110159 - RNA, 16 nt, Homo sapiens
aggauaauuagcaucu

SEQ ID NO: 2110160 - RNA, 13 nt, Homo sapiens
uaauauguacaaa

SEQ ID NO: 2110161 - RNA, 19 nt, Homo sapiens
cuuccuguggccugaagaa

SEQ ID NO: 2110162 - RNA, 20 nt, Homo sapiens
augugcauuucugugauguu

SEQ ID NO: 2110163 - RNA, 13 nt, Homo sapiens
guugauggugcua

SEQ ID NO: 2110164 - RNA, 23 nt, Homo sapiens
uaagauagcccuaaauguacucu

SEQ ID NO: 2110165 - RNA, 15 nt, Homo sapiens
uggcgcaucauaugc

SEQ ID NO: 2110166 - RNA, 20 nt, Homo sapiens
uugagcaguggcugguccag

SEQ ID NO: 2110167 - RNA, 15 nt, Homo sapiens
ucucacuauaccagu

SEQ ID NO: 2110168 - RNA, 17 nt, Homo sapiens
uaaauuuuagaucuuuc

SEQ ID NO: 2110169 - RNA, 19 nt, Homo sapiens
uauaaccccaccuugccaa

SEQ ID NO: 2110170 - RNA, 17 nt, Homo sapiens
agcccgacagugccauc

SEQ ID NO: 2110171 - RNA, 17 nt, Homo sapiens
cccaagccuggucuccu

SEQ ID NO: 2110172 - RNA, 20 nt, Homo sapiens
ccaagugaagaaucuaauga

SEQ ID NO: 2110173 - RNA, 18 nt, Homo sapiens
aaauguaccggcuuccau

SEQ ID NO: 2110174 - RNA, 19 nt, Homo sapiens
caggcugagugcacuggca

SEQ ID NO: 2110175 - RNA, 20 nt, Homo sapiens
aaauucugacaccaugugca

SEQ ID NO: 2110176 - RNA, 16 nt, Homo sapiens
uaagguggguccagga

SEQ ID NO: 2110177 - RNA, 16 nt, Homo sapiens
cauuuaaauuccacag

SEQ ID NO: 2110178 - RNA, 17 nt, Homo sapiens
cucucuguggccuccau

SEQ ID NO: 2110179 - RNA, 20 nt, Homo sapiens
ugcaaaguucccuacuuccu

SEQ ID NO: 2110180 - RNA, 13 nt, Homo sapiens
ugauucucucucc

SEQ ID NO: 2110181 - RNA, 12 nt, Homo sapiens
ugaggaggacaa

SEQ ID NO: 2110182 - RNA, 19 nt, Homo sapiens
aaucacuauugcuuccuaa

SEQ ID NO: 2110183 - RNA, 15 nt, Homo sapiens
auaaaugaaugaaua

SEQ ID NO: 2110184 - RNA, 15 nt, Homo sapiens
cauuuuuuaaaugca

SEQ ID NO: 2110185 - RNA, 16 nt, Homo sapiens
uuaaguuuuacuugag

SEQ ID NO: 2110186 - RNA, 23 nt, Homo sapiens
uguggauuuuguccauucaucuc

SEQ ID NO: 2110187 - RNA, 15 nt, Homo sapiens
aaaagaaaacacuua

SEQ ID NO: 2110188 - RNA, 18 nt, Homo sapiens
gcucuaccgggaggacag

SEQ ID NO: 2110189 - RNA, 14 nt, Homo sapiens
auaaaccagacuca

SEQ ID NO: 2110190 - RNA, 13 nt, Homo sapiens
agcuuccucggua

SEQ ID NO: 2110191 - RNA, 16 nt, Homo sapiens
ccagaaucuugacuuu

SEQ ID NO: 2110192 - RNA, 20 nt, Homo sapiens
caucuuuuauagacgcucuu

SEQ ID NO: 2110193 - RNA, 18 nt, Homo sapiens
cugggcucacccucagga

SEQ ID NO: 2110194 - RNA, 18 nt, Homo sapiens
ugaaauaccagugaacca

SEQ ID NO: 2110195 - RNA, 18 nt, Homo sapiens
cugcuuccuuacacauag

SEQ ID NO: 2110196 - RNA, 13 nt, Homo sapiens
aacaaaaucuggg

SEQ ID NO: 2110197 - RNA, 22 nt, Homo sapiens
uguauaauuuaacagugcccuu

SEQ ID NO: 2110198 - RNA, 14 nt, Homo sapiens
aaggguugugagcc

SEQ ID NO: 2110199 - RNA, 18 nt, Homo sapiens
gacaguagccaaguuaua

SEQ ID NO: 2110200 - RNA, 22 nt, Homo sapiens
gcugcugcagucagcacagaga

SEQ ID NO: 2110201 - RNA, 18 nt, Homo sapiens
ugcagugguaugaucacg

SEQ ID NO: 2110202 - RNA, 19 nt, Homo sapiens
cagugagccgagauugugc

SEQ ID NO: 2110203 - RNA, 15 nt, Homo sapiens
ugccccaaugugacc

SEQ ID NO: 2110204 - RNA, 19 nt, Homo sapiens
uggugagccgagauugcac

SEQ ID NO: 2110205 - RNA, 17 nt, Homo sapiens
aaaugagggaagaacau

SEQ ID NO: 2110206 - RNA, 18 nt, Homo sapiens
augugcccacugucucuu

SEQ ID NO: 2110207 - RNA, 20 nt, Homo sapiens
gauugugccacuucacucca

SEQ ID NO: 2110208 - RNA, 22 nt, Homo sapiens
aagcacaaaguucucagagcuc

SEQ ID NO: 2110209 - RNA, 22 nt, Homo sapiens
gaccaauucaacccuuugcccc

SEQ ID NO: 2110210 - RNA, 19 nt, Homo sapiens
aucucaaaacuguacuguc

SEQ ID NO: 2110211 - RNA, 23 nt, Homo sapiens
uggcaugacucuugacucuugcc

SEQ ID NO: 2110212 - RNA, 15 nt, Homo sapiens
uucccaaauacauua

SEQ ID NO: 2110213 - RNA, 17 nt, Homo sapiens
ugauuggaccaggccau

SEQ ID NO: 2110214 - RNA, 17 nt, Homo sapiens
ccaggaauauccagugg

SEQ ID NO: 2110215 - RNA, 21 nt, Homo sapiens
auuaauauugcagucaaucuc

SEQ ID NO: 2110216 - RNA, 16 nt, Homo sapiens
gaguagauaaaaaaca

SEQ ID NO: 2110217 - RNA, 12 nt, Homo sapiens
uccccuccgcca

SEQ ID NO: 2110218 - RNA, 14 nt, Homo sapiens
ugccucccaugccu

SEQ ID NO: 2110219 - RNA, 22 nt, Homo sapiens
ucuucuugaacacucaugcuga

SEQ ID NO: 2110220 - RNA, 19 nt, Homo sapiens
acaggaugaugacuaugga

SEQ ID NO: 2110221 - RNA, 13 nt, Homo sapiens
aucugaccaaaac

SEQ ID NO: 2110222 - RNA, 21 nt, Homo sapiens
auacagccccaaaccagggug

SEQ ID NO: 2110223 - RNA, 15 nt, Homo sapiens
caaucuaaaauggca

SEQ ID NO: 2110224 - RNA, 17 nt, Homo sapiens
uacucuugagagcucag

SEQ ID NO: 2110225 - RNA, 12 nt, Homo sapiens
cauuacaguauu

SEQ ID NO: 2110226 - RNA, 16 nt, Homo sapiens
ccguucagaaaaccac

SEQ ID NO: 2110227 - RNA, 19 nt, Homo sapiens
gcugcuccccuaaagccag

SEQ ID NO: 2110228 - RNA, 17 nt, Homo sapiens
aauuuagauauuuucca

SEQ ID NO: 2110229 - RNA, 17 nt, Homo sapiens
cucccucccucccagau

SEQ ID NO: 2110230 - RNA, 23 nt, Homo sapiens
caaauucaaugaaucaaauccaa

SEQ ID NO: 2110231 - RNA, 13 nt, Homo sapiens
cuuugucaguaua

SEQ ID NO: 2110232 - RNA, 17 nt, Homo sapiens
caaacagaacaggguca

SEQ ID NO: 2110233 - RNA, 16 nt, Homo sapiens
ucaccuucaccuucau

SEQ ID NO: 2110234 - RNA, 12 nt, Homo sapiens
gacacauuugaa

SEQ ID NO: 2110235 - RNA, 23 nt, Homo sapiens
ucugaggcccugagcauucuugg

SEQ ID NO: 2110236 - RNA, 17 nt, Homo sapiens
agucacugacaguuaau

SEQ ID NO: 2110237 - RNA, 21 nt, Homo sapiens
aaggaaaaauauugaacucaa

SEQ ID NO: 2110238 - RNA, 23 nt, Homo sapiens
caugaacuauuuacauuuuccaa

SEQ ID NO: 2110239 - RNA, 23 nt, Homo sapiens
cuugaggggcccacagacagauc

SEQ ID NO: 2110240 - RNA, 14 nt, Homo sapiens
ucauaggucccuga

SEQ ID NO: 2110241 - RNA, 21 nt, Homo sapiens
uccacuuggagcuaaaacugg

SEQ ID NO: 2110242 - RNA, 22 nt, Homo sapiens
aaacaaacauacccaucugcac

SEQ ID NO: 2110243 - RNA, 22 nt, Homo sapiens
gcacguggcuucugaugaaucu

SEQ ID NO: 2110244 - RNA, 15 nt, Homo sapiens
ugcaucugucagcca

SEQ ID NO: 2110245 - RNA, 18 nt, Homo sapiens
cgccaccucacugcagua

SEQ ID NO: 2110246 - RNA, 18 nt, Homo sapiens
uauguagaagccuaggau

SEQ ID NO: 2110247 - RNA, 15 nt, Homo sapiens
acaggucgccaguga

SEQ ID NO: 2110248 - RNA, 17 nt, Homo sapiens
auaugccauaaaccuca

SEQ ID NO: 2110249 - RNA, 20 nt, Homo sapiens
ccucauuccggccacaucau

SEQ ID NO: 2110250 - RNA, 15 nt, Homo sapiens
uggaagugugugauc

SEQ ID NO: 2110251 - RNA, 23 nt, Homo sapiens
cuuggaauuggaauuacuguaaa

SEQ ID NO: 2110252 - RNA, 17 nt, Homo sapiens
ggcaacuugaggucuga

SEQ ID NO: 2110253 - RNA, 17 nt, Homo sapiens
accucggccuccuaaag

SEQ ID NO: 2110254 - RNA, 23 nt, Homo sapiens
ggaagcccaggcucggaggaccc

SEQ ID NO: 2110255 - RNA, 15 nt, Homo sapiens
uaguuauacaccaua

SEQ ID NO: 2110256 - RNA, 18 nt, Homo sapiens
ccuccuauggguugucac

SEQ ID NO: 2110257 - RNA, 23 nt, Homo sapiens
uuugucacuggaaccucccuggg

SEQ ID NO: 2110258 - RNA, 20 nt, Homo sapiens
auuuaagggaaugugagcac

SEQ ID NO: 2110259 - RNA, 12 nt, Homo sapiens
caauugucauug

SEQ ID NO: 2110260 - RNA, 14 nt, Homo sapiens
ccucucgcggcccu

SEQ ID NO: 2110261 - RNA, 18 nt, Homo sapiens
agcagccacaaccaaaaa

SEQ ID NO: 2110262 - RNA, 17 nt, Homo sapiens
ggccugggauggggcuu

SEQ ID NO: 2110263 - RNA, 22 nt, Homo sapiens
uuaauucauguauuaugauuaa

SEQ ID NO: 2110264 - RNA, 21 nt, Homo sapiens
agacaauucauucauuugcau

SEQ ID NO: 2110265 - RNA, 20 nt, Homo sapiens
cagcuuucccuggcucaggg

SEQ ID NO: 2110266 - RNA, 16 nt, Homo sapiens
ugucaaugcaguuguc

SEQ ID NO: 2110267 - RNA, 19 nt, Homo sapiens
cacauagauuaauggcacu

SEQ ID NO: 2110268 - RNA, 11 nt, Homo sapiens
ugguugcaauu

SEQ ID NO: 2110269 - RNA, 20 nt, Homo sapiens
ucaaggaguacaaugcccag

SEQ ID NO: 2110270 - RNA, 14 nt, Homo sapiens
gcuguccuccagag

SEQ ID NO: 2110271 - RNA, 19 nt, Homo sapiens
uucaguaaacaccaugaag

SEQ ID NO: 2110272 - RNA, 18 nt, Homo sapiens
guuaggucucaauaccug

SEQ ID NO: 2110273 - RNA, 22 nt, Homo sapiens
ucuguaggucccacucccacag

SEQ ID NO: 2110274 - RNA, 19 nt, Homo sapiens
aauuacagggugacucaca

SEQ ID NO: 2110275 - RNA, 16 nt, Homo sapiens
ucaugaugcuacccga

SEQ ID NO: 2110276 - RNA, 11 nt, Homo sapiens
augcuuccaac

SEQ ID NO: 2110277 - RNA, 10 nt, Homo sapiens
aacacuggag

SEQ ID NO: 2110278 - RNA, 19 nt, Homo sapiens
accaagggaucugccauug

SEQ ID NO: 2110279 - RNA, 24 nt, Homo sapiens
gccugcgcagcuuggauggagacu

SEQ ID NO: 2110280 - RNA, 19 nt, Homo sapiens
aagggcccaaaggccuugg

SEQ ID NO: 2110281 - RNA, 17 nt, Homo sapiens
augagaccacuguuauc

SEQ ID NO: 2110282 - RNA, 20 nt, Homo sapiens
gccuuuuccauucgcaugaa

SEQ ID NO: 2110283 - RNA, 22 nt, Homo sapiens
accagccuggccaacaugguga

SEQ ID NO: 2110284 - RNA, 18 nt, Homo sapiens
aggagaugcggccaaaga

SEQ ID NO: 2110285 - RNA, 13 nt, Homo sapiens
aaugcaaccaagu

SEQ ID NO: 2110286 - RNA, 13 nt, Homo sapiens
ugaacuuccagga

SEQ ID NO: 2110287 - RNA, 21 nt, Homo sapiens
ugaguugguguugacaugugc

SEQ ID NO: 2110288 - RNA, 12 nt, Homo sapiens
ugacagccauuu

SEQ ID NO: 2110289 - RNA, 12 nt, Homo sapiens
ugcuggugcaca

SEQ ID NO: 2110290 - RNA, 13 nt, Homo sapiens
caagucuaaacca

SEQ ID NO: 2110291 - RNA, 17 nt, Homo sapiens
caguccuguacucuggg

SEQ ID NO: 2110292 - RNA, 21 nt, Homo sapiens
uucacaggcagugcaugugaa

SEQ ID NO: 2110293 - RNA, 14 nt, Homo sapiens
ugccauuuugcauu

SEQ ID NO: 2110294 - RNA, 13 nt, Homo sapiens
acacacaugcaca

SEQ ID NO: 2110295 - RNA, 14 nt, Homo sapiens
agcggcaucaggcu

SEQ ID NO: 2110296 - RNA, 15 nt, Homo sapiens
cauguaccaucaaua

SEQ ID NO: 2110297 - RNA, 18 nt, Homo sapiens
uucuccugucuccaugau

SEQ ID NO: 2110298 - RNA, 16 nt, Homo sapiens
aggaccaacauccagu

SEQ ID NO: 2110299 - RNA, 19 nt, Homo sapiens
cacuuuuuaacauucucaa

SEQ ID NO: 2110300 - RNA, 12 nt, Homo sapiens
uauccugggacc

SEQ ID NO: 2110301 - RNA, 11 nt, Homo sapiens
cauagcacuug

SEQ ID NO: 2110302 - RNA, 23 nt, Homo sapiens
uaggguccaaccagaccuggaag

SEQ ID NO: 2110303 - RNA, 16 nt, Homo sapiens
augcgguucagggcug

SEQ ID NO: 2110304 - RNA, 17 nt, Homo sapiens
cuuaacauuucucucca

SEQ ID NO: 2110305 - RNA, 18 nt, Homo sapiens
aauaagcccagugcugcu

SEQ ID NO: 2110306 - RNA, 12 nt, Homo sapiens
acauagcgagac

SEQ ID NO: 2110307 - RNA, 18 nt, Homo sapiens
uauaaauggaccauccuu

SEQ ID NO: 2110308 - RNA, 14 nt, Homo sapiens
gucuacaugugcca

SEQ ID NO: 2110309 - RNA, 17 nt, Homo sapiens
gaugacuuugagauuau

SEQ ID NO: 2110310 - RNA, 20 nt, Homo sapiens
gcaccuucaauacuucauga

SEQ ID NO: 2110311 - RNA, 15 nt, Homo sapiens
aagaugacuucccaa

SEQ ID NO: 2110312 - RNA, 15 nt, Homo sapiens
uguaucuacaguaau

SEQ ID NO: 2110313 - RNA, 23 nt, Homo sapiens
uauuuaauagcugugaucaguga

SEQ ID NO: 2110314 - RNA, 13 nt, Homo sapiens
ccuccccaaguca

SEQ ID NO: 2110315 - RNA, 20 nt, Homo sapiens
cagacacagacuggcaauaa

SEQ ID NO: 2110316 - RNA, 22 nt, Homo sapiens
ucuccaucccugaaauuucuca

SEQ ID NO: 2110317 - RNA, 23 nt, Homo sapiens
ccuaaagagcauccugauaccau

SEQ ID NO: 2110318 - RNA, 16 nt, Homo sapiens
acugcaaaaaaagccu

SEQ ID NO: 2110319 - RNA, 21 nt, Homo sapiens
gccaggcuguaagcauucuga

SEQ ID NO: 2110320 - RNA, 18 nt, Homo sapiens
ggucacaguaccuugaau

SEQ ID NO: 2110321 - RNA, 22 nt, Homo sapiens
aguguguaaaauuaauguaaua

SEQ ID NO: 2110322 - RNA, 23 nt, Homo sapiens
accccaugcuguugauugcuaaa

SEQ ID NO: 2110323 - RNA, 23 nt, Homo sapiens
uaucuugcagcuguaaacauauu

SEQ ID NO: 2110324 - RNA, 21 nt, Homo sapiens
uguuugggggacguuucucau

SEQ ID NO: 2110325 - RNA, 17 nt, Homo sapiens
uucucccuuuaaggugc

SEQ ID NO: 2110326 - RNA, 13 nt, Homo sapiens
uuccacgcugaug

SEQ ID NO: 2110327 - RNA, 14 nt, Homo sapiens
ccaucaugucugua

SEQ ID NO: 2110328 - RNA, 12 nt, Homo sapiens
cugggcuuucug

SEQ ID NO: 2110329 - RNA, 22 nt, Homo sapiens
acucaggaugcccagggccacu

SEQ ID NO: 2110330 - RNA, 21 nt, Homo sapiens
cagcaagguggccacaguguc

SEQ ID NO: 2110331 - RNA, 16 nt, Homo sapiens
uaaauaccauucacua

SEQ ID NO: 2110332 - RNA, 18 nt, Homo sapiens
ugcuggccagggacccag

SEQ ID NO: 2110333 - RNA, 18 nt, Homo sapiens
aaaaaugcccauuugccu

SEQ ID NO: 2110334 - RNA, 18 nt, Homo sapiens
cacuuuuccccaauucau

SEQ ID NO: 2110335 - RNA, 22 nt, Homo sapiens
ucaggggcggggagggugacag

SEQ ID NO: 2110336 - RNA, 15 nt, Homo sapiens
uauggcaaauagcca

SEQ ID NO: 2110337 - RNA, 22 nt, Homo sapiens
ggacaacugcucccaccuccug

SEQ ID NO: 2110338 - RNA, 20 nt, Homo sapiens
gauacgacaguacacuguca

SEQ ID NO: 2110339 - RNA, 20 nt, Homo sapiens
cagcgugacaauauacuuca

SEQ ID NO: 2110340 - RNA, 14 nt, Homo sapiens
cucccucccagcuc

SEQ ID NO: 2110341 - RNA, 15 nt, Homo sapiens
cugucacacacugga

SEQ ID NO: 2110342 - RNA, 15 nt, Homo sapiens
auguggaaaacucac

SEQ ID NO: 2110343 - RNA, 22 nt, Homo sapiens
aguccacucugagucgauuaac

SEQ ID NO: 2110344 - RNA, 22 nt, Homo sapiens
augcauuugauggccaccagcu

SEQ ID NO: 2110345 - RNA, 13 nt, Homo sapiens
aacuauaagcaag

SEQ ID NO: 2110346 - RNA, 20 nt, Homo sapiens
aggauagauuucauguuaug

SEQ ID NO: 2110347 - RNA, 14 nt, Homo sapiens
ccugcaaagggaau

SEQ ID NO: 2110348 - RNA, 13 nt, Homo sapiens
caucagcacagcu

SEQ ID NO: 2110349 - RNA, 13 nt, Homo sapiens
uugcugcauuuca

SEQ ID NO: 2110350 - RNA, 14 nt, Homo sapiens
ggcugggcacugcu

SEQ ID NO: 2110351 - RNA, 20 nt, Homo sapiens
aguucacuucaucuucucag

SEQ ID NO: 2110352 - RNA, 22 nt, Homo sapiens
cucuccccuguccugauggcac

SEQ ID NO: 2110353 - RNA, 17 nt, Homo sapiens
ccagaaccccugucaca

SEQ ID NO: 2110354 - RNA, 22 nt, Homo sapiens
uuugccagaagacuaccuuaca

SEQ ID NO: 2110355 - RNA, 22 nt, Homo sapiens
cauucaugagauuggucauuaa

SEQ ID NO: 2110356 - RNA, 16 nt, Homo sapiens
ugaaguguaauugaga

SEQ ID NO: 2110357 - RNA, 14 nt, Homo sapiens
agcuguagccaugg

SEQ ID NO: 2110358 - RNA, 23 nt, Homo sapiens
gaugucucacauccucugucuau

SEQ ID NO: 2110359 - RNA, 20 nt, Homo sapiens
aguguuaauuuuaccuuguu

SEQ ID NO: 2110360 - RNA, 19 nt, Homo sapiens
gccugaggucaauggugca

SEQ ID NO: 2110361 - RNA, 15 nt, Homo sapiens
cuuuaaaaagcucca

SEQ ID NO: 2110362 - RNA, 18 nt, Homo sapiens
acucucagucagugucau

SEQ ID NO: 2110363 - RNA, 15 nt, Homo sapiens
aaggacaaaguuuua

SEQ ID NO: 2110364 - RNA, 19 nt, Homo sapiens
uucuguaaaaguuacuaau

SEQ ID NO: 2110365 - RNA, 15 nt, Homo sapiens
uucauagccaaacag

SEQ ID NO: 2110366 - RNA, 14 nt, Homo sapiens
aguggcugguuggg

SEQ ID NO: 2110367 - RNA, 17 nt, Homo sapiens
ggaaacucacacucccc

SEQ ID NO: 2110368 - RNA, 15 nt, Homo sapiens
agaaaguaagucuuu

SEQ ID NO: 2110369 - RNA, 16 nt, Homo sapiens
uggggauaucagggca

SEQ ID NO: 2110370 - RNA, 20 nt, Homo sapiens
ucauauuuuaaacagaggau

SEQ ID NO: 2110371 - RNA, 16 nt, Homo sapiens
uuguaucuugcauuca

SEQ ID NO: 2110372 - RNA, 17 nt, Homo sapiens
cgaugcguucacuccaa

SEQ ID NO: 2110373 - RNA, 14 nt, Homo sapiens
cugccagcaaagag

SEQ ID NO: 2110374 - RNA, 22 nt, Homo sapiens
aguugucuggcuuuuugcacgu

SEQ ID NO: 2110375 - RNA, 21 nt, Homo sapiens
ucucccuuugaagaaacuaua

SEQ ID NO: 2110376 - RNA, 21 nt, Homo sapiens
acccguggagaugggaugcuu

SEQ ID NO: 2110377 - RNA, 14 nt, Homo sapiens
auauuuaacaugua

SEQ ID NO: 2110378 - RNA, 21 nt, Homo sapiens
uggugggggagccucuggaau

SEQ ID NO: 2110379 - RNA, 15 nt, Homo sapiens
agaccugacaagcac

SEQ ID NO: 2110380 - RNA, 23 nt, Homo sapiens
cuaguuucuuuugauaguauuua

SEQ ID NO: 2110381 - RNA, 14 nt, Homo sapiens
cuaucucacuucca

SEQ ID NO: 2110382 - RNA, 16 nt, Homo sapiens
ugugacaccaaagcca

SEQ ID NO: 2110383 - RNA, 18 nt, Homo sapiens
acugaguccacucggagu

SEQ ID NO: 2110384 - RNA, 23 nt, Homo sapiens
uggucaggcucuccaggugguca

SEQ ID NO: 2110385 - RNA, 12 nt, Homo sapiens
agauguuuauau

SEQ ID NO: 2110386 - RNA, 21 nt, Homo sapiens
aagguuaaauaccuguguuca

SEQ ID NO: 2110387 - RNA, 14 nt, Homo sapiens
aaaaauauguacaa

SEQ ID NO: 2110388 - RNA, 21 nt, Homo sapiens
cccacguccugggugcuguca

SEQ ID NO: 2110389 - RNA, 14 nt, Homo sapiens
uguggcaaguuugc

SEQ ID NO: 2110390 - RNA, 17 nt, Homo sapiens
gcuaacuccagucuccu

SEQ ID NO: 2110391 - RNA, 14 nt, Homo sapiens
gcacugccaaaaca

SEQ ID NO: 2110392 - RNA, 14 nt, Homo sapiens
auucuuauguucca

SEQ ID NO: 2110393 - RNA, 14 nt, Homo sapiens
aauguaaugaugcu

SEQ ID NO: 2110394 - RNA, 13 nt, Homo sapiens
aaaccacaauccu

SEQ ID NO: 2110395 - RNA, 13 nt, Homo sapiens
gaaacacagucau

SEQ ID NO: 2110396 - RNA, 17 nt, Homo sapiens
gaacugacaaugaaggg

SEQ ID NO: 2110397 - RNA, 19 nt, Homo sapiens
aauacucagggaaagcauu

SEQ ID NO: 2110398 - RNA, 13 nt, Homo sapiens
uuuugaagaauau

SEQ ID NO: 2110399 - RNA, 18 nt, Homo sapiens
uccuggaaagaaagggcc

SEQ ID NO: 2110400 - RNA, 21 nt, Homo sapiens
gcacaccggcuuaacacuauc

SEQ ID NO: 2110401 - RNA, 21 nt, Homo sapiens
uucaguuggcugacuuccaca

SEQ ID NO: 2110402 - RNA, 14 nt, Homo sapiens
auggagugccugua

SEQ ID NO: 2110403 - RNA, 14 nt, Homo sapiens
augcaaugccucug

SEQ ID NO: 2110404 - RNA, 21 nt, Homo sapiens
aauugucuauuccugaguuau

SEQ ID NO: 2110405 - RNA, 17 nt, Homo sapiens
uuccauaugucuauaac

SEQ ID NO: 2110406 - RNA, 14 nt, Homo sapiens
uaaucucuuuccau

SEQ ID NO: 2110407 - RNA, 20 nt, Homo sapiens
cagugagcugauaucaugcc

SEQ ID NO: 2110408 - RNA, 19 nt, Homo sapiens
aaacuguuccaaucaugaa

SEQ ID NO: 2110409 - RNA, 16 nt, Homo sapiens
uuuucacuguuuccua

SEQ ID NO: 2110410 - RNA, 23 nt, Homo sapiens
aacgccgcugacugccacccaca

SEQ ID NO: 2110411 - RNA, 17 nt, Homo sapiens
ugcaauaguuaccucaa

SEQ ID NO: 2110412 - RNA, 16 nt, Homo sapiens
caaguuggagugcagu

SEQ ID NO: 2110413 - RNA, 14 nt, Homo sapiens
uaacucuagaauuu

SEQ ID NO: 2110414 - RNA, 15 nt, Homo sapiens
uuaaagaaaaccaca

SEQ ID NO: 2110415 - RNA, 16 nt, Homo sapiens
ucaaauuauaaucuca

SEQ ID NO: 2110416 - RNA, 21 nt, Homo sapiens
ccacguguccccagagcuuua

SEQ ID NO: 2110417 - RNA, 20 nt, Homo sapiens
aacauguuacgugugcaaca

SEQ ID NO: 2110418 - RNA, 20 nt, Homo sapiens
ugaggaauucuucuguucuc

SEQ ID NO: 2110419 - RNA, 17 nt, Homo sapiens
aacacucuucuugagca

SEQ ID NO: 2110420 - RNA, 17 nt, Homo sapiens
aggaaaaauugaugaau

SEQ ID NO: 2110421 - RNA, 22 nt, Homo sapiens
cccucacagagacccaccuuca

SEQ ID NO: 2110422 - RNA, 17 nt, Homo sapiens
cucauaacaucuuugaa

SEQ ID NO: 2110423 - RNA, 18 nt, Homo sapiens
cuggcuuaacuuaguaua

SEQ ID NO: 2110424 - RNA, 15 nt, Homo sapiens
ucaaucauuaauuca

SEQ ID NO: 2110425 - RNA, 14 nt, Homo sapiens
uaggaaaaugccau

SEQ ID NO: 2110426 - RNA, 22 nt, Homo sapiens
gagcagcagcaccuuucucuga

SEQ ID NO: 2110427 - RNA, 14 nt, Homo sapiens
aacacuucucauca

SEQ ID NO: 2110428 - RNA, 15 nt, Homo sapiens
aauacugacuuucaa

SEQ ID NO: 2110429 - RNA, 17 nt, Homo sapiens
accaccucugugggcac

SEQ ID NO: 2110430 - RNA, 14 nt, Homo sapiens
ugaaaugaaaggga

SEQ ID NO: 2110431 - RNA, 18 nt, Homo sapiens
auaacuuuuuaaagugac

SEQ ID NO: 2110432 - RNA, 15 nt, Homo sapiens
aaauucgcaaacuuu

SEQ ID NO: 2110433 - RNA, 21 nt, Homo sapiens
gugagguucuuguaccacuuc

SEQ ID NO: 2110434 - RNA, 18 nt, Homo sapiens
uguuucacaauaccucau

SEQ ID NO: 2110435 - RNA, 17 nt, Homo sapiens
ccugaauuuuguugcug

SEQ ID NO: 2110436 - RNA, 12 nt, Homo sapiens
agacuggcuuua

SEQ ID NO: 2110437 - RNA, 13 nt, Homo sapiens
uuaauuucaggaa

SEQ ID NO: 2110438 - RNA, 20 nt, Homo sapiens
cccugugucauuucaaacag

SEQ ID NO: 2110439 - RNA, 12 nt, Homo sapiens
uaaaauagagua

SEQ ID NO: 2110440 - RNA, 18 nt, Homo sapiens
ccaggccucacuggcuca

SEQ ID NO: 2110441 - RNA, 18 nt, Homo sapiens
gaagaggaguugcuugau

SEQ ID NO: 2110442 - RNA, 22 nt, Homo sapiens
agcuggagccaacagauguguc

SEQ ID NO: 2110443 - RNA, 18 nt, Homo sapiens
guauaaggaaauaucaua

SEQ ID NO: 2110444 - RNA, 13 nt, Homo sapiens
aucacuuaucagu

SEQ ID NO: 2110445 - RNA, 16 nt, Homo sapiens
aaacuaaacccucaca

SEQ ID NO: 2110446 - RNA, 21 nt, Homo sapiens
acucuaaccaguguacagguc

SEQ ID NO: 2110447 - RNA, 16 nt, Homo sapiens
ucuaacuguagcuauc

SEQ ID NO: 2110448 - RNA, 23 nt, Homo sapiens
cuagauggagaaaguaacacaaa

SEQ ID NO: 2110449 - RNA, 18 nt, Homo sapiens
ucuggaacauucugucau

SEQ ID NO: 2110450 - RNA, 17 nt, Homo sapiens
ggacagucuggaggucc

SEQ ID NO: 2110451 - RNA, 17 nt, Homo sapiens
guaaauagcucaggugu

SEQ ID NO: 2110452 - RNA, 13 nt, Homo sapiens
caucugagcuccu

SEQ ID NO: 2110453 - RNA, 15 nt, Homo sapiens
agcucucccagugaa

SEQ ID NO: 2110454 - RNA, 19 nt, Homo sapiens
auacagcuguauugucuga

SEQ ID NO: 2110455 - RNA, 21 nt, Homo sapiens
agaugcaggaggcucagguga

SEQ ID NO: 2110456 - RNA, 22 nt, Homo sapiens
ccaaccuggaguauaauauuca

SEQ ID NO: 2110457 - RNA, 20 nt, Homo sapiens
cucccuguuaauaaacagcu

SEQ ID NO: 2110458 - RNA, 23 nt, Homo sapiens
uauucuaguuuugucaaacugua

SEQ ID NO: 2110459 - RNA, 20 nt, Homo sapiens
agguuuuccuuccaagcacc

SEQ ID NO: 2110460 - RNA, 22 nt, Homo sapiens
uacuaccugucaagguuugugu

SEQ ID NO: 2110461 - RNA, 23 nt, Homo sapiens
ccucacccuuuaccuuccucagg

SEQ ID NO: 2110462 - RNA, 16 nt, Homo sapiens
caucauacaugacuca

SEQ ID NO: 2110463 - RNA, 11 nt, Homo sapiens
ccauaccagcu

SEQ ID NO: 2110464 - RNA, 17 nt, Homo sapiens
agacacuuuucaaaaga

SEQ ID NO: 2110465 - RNA, 14 nt, Homo sapiens
uacgugacaacaca

SEQ ID NO: 2110466 - RNA, 21 nt, Homo sapiens
agaaauacaauuuuagauauc

SEQ ID NO: 2110467 - RNA, 18 nt, Homo sapiens
cagcggcucuagccacug

SEQ ID NO: 2110468 - RNA, 12 nt, Homo sapiens
caacugcaacuc

SEQ ID NO: 2110469 - RNA, 22 nt, Homo sapiens
cucuuccgacucuuucugagug

SEQ ID NO: 2110470 - RNA, 12 nt, Homo sapiens
cuuuaaaaccag

SEQ ID NO: 2110471 - RNA, 15 nt, Homo sapiens
augggaaggguccau

SEQ ID NO: 2110472 - RNA, 22 nt, Homo sapiens
aguaaaacucccccccacccaa

SEQ ID NO: 2110473 - RNA, 17 nt, Homo sapiens
augggucgcccaugaga

SEQ ID NO: 2110474 - RNA, 20 nt, Homo sapiens
gaugccaauuuccucuccac

SEQ ID NO: 2110475 - RNA, 19 nt, Homo sapiens
cacuguuaucuucacuuuu

SEQ ID NO: 2110476 - RNA, 17 nt, Homo sapiens
uaaaacuauucaugcua

SEQ ID NO: 2110477 - RNA, 21 nt, Homo sapiens
ccuagcucacacucauccaca

SEQ ID NO: 2110478 - RNA, 16 nt, Homo sapiens
cuccuuaauaugaucu

SEQ ID NO: 2110479 - RNA, 21 nt, Homo sapiens
cuugauaaauauauaugauca

SEQ ID NO: 2110480 - RNA, 16 nt, Homo sapiens
auaauuuucaagcaaa

SEQ ID NO: 2110481 - RNA, 20 nt, Homo sapiens
guuuugauaaaagauuuucc

SEQ ID NO: 2110482 - RNA, 15 nt, Homo sapiens
ucaagucuauugaau

SEQ ID NO: 2110483 - RNA, 23 nt, Homo sapiens
uuuaaagcuacaaucuguucaau

SEQ ID NO: 2110484 - RNA, 18 nt, Homo sapiens
uuuaucacacaaagcaga

SEQ ID NO: 2110485 - RNA, 15 nt, Homo sapiens
cuggcuguccuacca

SEQ ID NO: 2110486 - RNA, 18 nt, Homo sapiens
cucccaaccaaccagcag

SEQ ID NO: 2110487 - RNA, 15 nt, Homo sapiens
uguuaccuccuauaa

SEQ ID NO: 2110488 - RNA, 22 nt, Homo sapiens
aaaggaccugcauuuuccuaca

SEQ ID NO: 2110489 - RNA, 15 nt, Homo sapiens
cagggcgcacuuucc

SEQ ID NO: 2110490 - RNA, 16 nt, Homo sapiens
gcaaagacuuuccucu

SEQ ID NO: 2110491 - RNA, 19 nt, Homo sapiens
ugagcuguaaaaauguuac

SEQ ID NO: 2110492 - RNA, 17 nt, Homo sapiens
uugugagaaacaucuca

SEQ ID NO: 2110493 - RNA, 13 nt, Homo sapiens
auacucagacaaa

SEQ ID NO: 2110494 - RNA, 16 nt, Homo sapiens
agauuagguagacuuu

SEQ ID NO: 2110495 - RNA, 20 nt, Homo sapiens
guuugaggauuaguuuagaa

SEQ ID NO: 2110496 - RNA, 18 nt, Homo sapiens
auauugauaacagcacug

SEQ ID NO: 2110497 - RNA, 17 nt, Homo sapiens
ccaggcagccaccagug

SEQ ID NO: 2110498 - RNA, 15 nt, Homo sapiens
ggacaccccacggga

SEQ ID NO: 2110499 - RNA, 23 nt, Homo sapiens
ggcagccagcuacaggcuugagc

SEQ ID NO: 2110500 - RNA, 21 nt, Homo sapiens
ccaaggacagucagcauuucu

SEQ ID NO: 2110501 - RNA, 14 nt, Homo sapiens
uggacaugagccau

SEQ ID NO: 2110502 - RNA, 14 nt, Homo sapiens
aaauacagcaauua

SEQ ID NO: 2110503 - RNA, 21 nt, Homo sapiens
cccaaaccggcaggugcgauu

SEQ ID NO: 2110504 - RNA, 20 nt, Homo sapiens
ugccgugugagugugacagg

SEQ ID NO: 2110505 - RNA, 15 nt, Homo sapiens
uuaaaaugucauuug

SEQ ID NO: 2110506 - RNA, 21 nt, Homo sapiens
ucagaaaauggggcuugcccu

SEQ ID NO: 2110507 - RNA, 21 nt, Homo sapiens
gcccuugaagauaucuugaaa

SEQ ID NO: 2110508 - RNA, 16 nt, Homo sapiens
gggaguccaggcacag

SEQ ID NO: 2110509 - RNA, 16 nt, Homo sapiens
gcaugacaaguacugu

SEQ ID NO: 2110510 - RNA, 18 nt, Homo sapiens
ggguagcccgccugccag

SEQ ID NO: 2110511 - RNA, 15 nt, Homo sapiens
ucugauuacugucca

SEQ ID NO: 2110512 - RNA, 16 nt, Homo sapiens
uaaauagcaacaugcu

SEQ ID NO: 2110513 - RNA, 24 nt, Homo sapiens
caagccugcagcgagcugagauca

SEQ ID NO: 2110514 - RNA, 21 nt, Homo sapiens
ucucauaaugcuuuguuaaau

SEQ ID NO: 2110515 - RNA, 22 nt, Homo sapiens
uucuguuucuauucucuccuca

SEQ ID NO: 2110516 - RNA, 13 nt, Homo sapiens
agaucacaccacu

SEQ ID NO: 2110517 - RNA, 20 nt, Homo sapiens
cuucacaggcuauucuacuu

SEQ ID NO: 2110518 - RNA, 20 nt, Homo sapiens
ugcuucauuugggaaauuca

SEQ ID NO: 2110519 - RNA, 22 nt, Homo sapiens
uuacugcccuuucaaagcacuu

SEQ ID NO: 2110520 - RNA, 14 nt, Homo sapiens
auucccaaucccau

SEQ ID NO: 2110521 - RNA, 19 nt, Homo sapiens
aaaucugaaaaauggccau

SEQ ID NO: 2110522 - RNA, 20 nt, Homo sapiens
gcccucgacacucaccauga

SEQ ID NO: 2110523 - RNA, 19 nt, Homo sapiens
ccucaggaaugggcuguuu

SEQ ID NO: 2110524 - RNA, 20 nt, Homo sapiens
uaagcccccucaacuaccau

SEQ ID NO: 2110525 - RNA, 22 nt, Homo sapiens
ucaagcacuuacagcucuggcc

SEQ ID NO: 2110526 - RNA, 21 nt, Homo sapiens
gggaccucaccugcuggggac

SEQ ID NO: 2110527 - RNA, 12 nt, Homo sapiens
ccuccuugccac

SEQ ID NO: 2110528 - RNA, 13 nt, Homo sapiens
caggggugcugug

SEQ ID NO: 2110529 - RNA, 23 nt, Homo sapiens
gaauaaagccacuguaugauucu

SEQ ID NO: 2110530 - RNA, 13 nt, Homo sapiens
cuuucaauacucu

SEQ ID NO: 2110531 - RNA, 23 nt, Homo sapiens
aagaauuagaucgguucugugcc

SEQ ID NO: 2110532 - RNA, 14 nt, Homo sapiens
cagaacuugaaugu

SEQ ID NO: 2110533 - RNA, 16 nt, Homo sapiens
gaagucuuuccugaua

SEQ ID NO: 2110534 - RNA, 17 nt, Homo sapiens
uccugaggaugggcaac

SEQ ID NO: 2110535 - RNA, 12 nt, Homo sapiens
gcauuccagcuc

SEQ ID NO: 2110536 - RNA, 22 nt, Homo sapiens
auuuauuccccagugacuccag

SEQ ID NO: 2110537 - RNA, 13 nt, Homo sapiens
ccaucuucacugg

SEQ ID NO: 2110538 - RNA, 15 nt, Homo sapiens
gguggauauggugca

SEQ ID NO: 2110539 - RNA, 23 nt, Homo sapiens
ggccaguauccuggauuccucua

SEQ ID NO: 2110540 - RNA, 12 nt, Homo sapiens
ccccgcucugca

SEQ ID NO: 2110541 - RNA, 13 nt, Homo sapiens
cucuuuugccucc

SEQ ID NO: 2110542 - RNA, 13 nt, Homo sapiens
aggcugcagugag

SEQ ID NO: 2110543 - RNA, 21 nt, Homo sapiens
uuauaugggaggguucugggu

SEQ ID NO: 2110544 - RNA, 15 nt, Homo sapiens
aaauaccagccagua

SEQ ID NO: 2110545 - RNA, 16 nt, Homo sapiens
ccagcugccaaggaaa

SEQ ID NO: 2110546 - RNA, 18 nt, Homo sapiens
ccaagagucugaugauuu

SEQ ID NO: 2110547 - RNA, 14 nt, Homo sapiens
aggaguaccuggac

SEQ ID NO: 2110548 - RNA, 22 nt, Homo sapiens
cuguaucuugggggacagggcu

SEQ ID NO: 2110549 - RNA, 20 nt, Homo sapiens
auccaguuucccaugcacca

SEQ ID NO: 2110550 - RNA, 13 nt, Homo sapiens
cugcuuuucugca

SEQ ID NO: 2110551 - RNA, 20 nt, Homo sapiens
ucuauucccaucgcuggaaa

SEQ ID NO: 2110552 - RNA, 22 nt, Homo sapiens
caggugacuacccuaguucaaa

SEQ ID NO: 2110553 - RNA, 20 nt, Homo sapiens
gguaacaaagggcagcucag

SEQ ID NO: 2110554 - RNA, 21 nt, Homo sapiens
accgggaggacagcugccugu

SEQ ID NO: 2110555 - RNA, 21 nt, Homo sapiens
caguaacugugacugaugacu

SEQ ID NO: 2110556 - RNA, 22 nt, Homo sapiens
gacuguuuguacgaagcaugua

SEQ ID NO: 2110557 - RNA, 16 nt, Homo sapiens
gaacugcagucagcau

SEQ ID NO: 2110558 - RNA, 14 nt, Homo sapiens
gaacuaaagcaaau

SEQ ID NO: 2110559 - RNA, 14 nt, Homo sapiens
gaaauaaagcacau

SEQ ID NO: 2110560 - RNA, 16 nt, Homo sapiens
cuccauucaggauucu

SEQ ID NO: 2110561 - RNA, 15 nt, Homo sapiens
cucccaaaguguccu

SEQ ID NO: 2110562 - RNA, 19 nt, Homo sapiens
acugaagacaggcacaaaa

SEQ ID NO: 2110563 - RNA, 15 nt, Homo sapiens
auguggucaauggaa

SEQ ID NO: 2110564 - RNA, 15 nt, Homo sapiens
gccacacacacagaa

SEQ ID NO: 2110565 - RNA, 18 nt, Homo sapiens
guaaguaaacagauuuga

SEQ ID NO: 2110566 - RNA, 15 nt, Homo sapiens
ugaugggcuccccag

SEQ ID NO: 2110567 - RNA, 16 nt, Homo sapiens
uggugcuuaaguucca

SEQ ID NO: 2110568 - RNA, 15 nt, Homo sapiens
gcacaacaugcacau

SEQ ID NO: 2110569 - RNA, 17 nt, Homo sapiens
acagauagauguugcuc

SEQ ID NO: 2110570 - RNA, 15 nt, Homo sapiens
auuauccuucacaau

SEQ ID NO: 2110571 - RNA, 20 nt, Homo sapiens
uuaaaguuacugaucacagg

SEQ ID NO: 2110572 - RNA, 19 nt, Homo sapiens
aguguaucaaaaugcucuu

SEQ ID NO: 2110573 - RNA, 20 nt, Homo sapiens
acuacaucuccaaugugcuu

SEQ ID NO: 2110574 - RNA, 23 nt, Homo sapiens
ucugaaacugcauaagugaaaau

SEQ ID NO: 2110575 - RNA, 17 nt, Homo sapiens
guguuuuuaacauguca

SEQ ID NO: 2110576 - RNA, 23 nt, Homo sapiens
uucuuacuugacuugaaugugca

SEQ ID NO: 2110577 - RNA, 17 nt, Homo sapiens
aagcagcccuggcucuc

SEQ ID NO: 2110578 - RNA, 22 nt, Homo sapiens
uaaauugucagaugcugugcaa

SEQ ID NO: 2110579 - RNA, 15 nt, Homo sapiens
uaaaagugcacauua

SEQ ID NO: 2110580 - RNA, 19 nt, Homo sapiens
ugucauuguuauauaauca

SEQ ID NO: 2110581 - RNA, 18 nt, Homo sapiens
agggaacacucaucccug

SEQ ID NO: 2110582 - RNA, 21 nt, Homo sapiens
auuuuuuagugcauccaguua

SEQ ID NO: 2110583 - RNA, 16 nt, Homo sapiens
ccaggcagcugcaguu

SEQ ID NO: 2110584 - RNA, 18 nt, Homo sapiens
guagcaggucaaaaaccu

SEQ ID NO: 2110585 - RNA, 17 nt, Homo sapiens
cuuacccucaccuguca

SEQ ID NO: 2110586 - RNA, 17 nt, Homo sapiens
agcuaggugcuauuugu

SEQ ID NO: 2110587 - RNA, 21 nt, Homo sapiens
cagagcuugaacacaggcuua

SEQ ID NO: 2110588 - RNA, 21 nt, Homo sapiens
aacaacuugucuauuaccugu

SEQ ID NO: 2110589 - RNA, 18 nt, Homo sapiens
gggauuucuuugcuguaa

SEQ ID NO: 2110590 - RNA, 14 nt, Homo sapiens
aauggcagcugcca

SEQ ID NO: 2110591 - RNA, 21 nt, Homo sapiens
acccucggggauguguccuga

SEQ ID NO: 2110592 - RNA, 12 nt, Homo sapiens
ucugcuagggaa

SEQ ID NO: 2110593 - RNA, 20 nt, Homo sapiens
aucaacugcugcuucaccag

SEQ ID NO: 2110594 - RNA, 22 nt, Homo sapiens
gacuccucucguacuugaacuc

SEQ ID NO: 2110595 - RNA, 23 nt, Homo sapiens
gagaacuauaccugcuucaguga

SEQ ID NO: 2110596 - RNA, 14 nt, Homo sapiens
ugaggcaauaaaaa

SEQ ID NO: 2110597 - RNA, 18 nt, Homo sapiens
caacauggauguguugcc

SEQ ID NO: 2110598 - RNA, 19 nt, Homo sapiens
agguuuccuuccuucgcag

SEQ ID NO: 2110599 - RNA, 19 nt, Homo sapiens
cacuaaaguuacaaacaga

SEQ ID NO: 2110600 - RNA, 16 nt, Homo sapiens
uggccaggcacugccu

SEQ ID NO: 2110601 - RNA, 14 nt, Homo sapiens
agucaccugcccca

SEQ ID NO: 2110602 - RNA, 16 nt, Homo sapiens
caguucugcuugcucc

SEQ ID NO: 2110603 - RNA, 20 nt, Homo sapiens
cccccaggcuggagugcagu

SEQ ID NO: 2110604 - RNA, 18 nt, Homo sapiens
aauacagauauaagaaau

SEQ ID NO: 2110605 - RNA, 21 nt, Homo sapiens
gaaugcuucugcaucaaagga

SEQ ID NO: 2110606 - RNA, 16 nt, Homo sapiens
cuguucccuugccauc

SEQ ID NO: 2110607 - RNA, 18 nt, Homo sapiens
uuuccucccuucugcuac

SEQ ID NO: 2110608 - RNA, 20 nt, Homo sapiens
cuuuugugugccugguagaa

SEQ ID NO: 2110609 - RNA, 20 nt, Homo sapiens
aaauagaguaaauacaggua

SEQ ID NO: 2110610 - RNA, 17 nt, Homo sapiens
gauguggccuuuagcaa

SEQ ID NO: 2110611 - RNA, 18 nt, Homo sapiens
augcuguuuguagugaaa

SEQ ID NO: 2110612 - RNA, 13 nt, Homo sapiens
gccucuuggcagu

SEQ ID NO: 2110613 - RNA, 19 nt, Homo sapiens
ucccacuccugcugcacag

SEQ ID NO: 2110614 - RNA, 21 nt, Homo sapiens
cucagccguucuugacaucaa

SEQ ID NO: 2110615 - RNA, 16 nt, Homo sapiens
ccucuuucacuucuua

SEQ ID NO: 2110616 - RNA, 15 nt, Homo sapiens
ggcaugaaccacugc

SEQ ID NO: 2110617 - RNA, 14 nt, Homo sapiens
cuaaugcacugaug

SEQ ID NO: 2110618 - RNA, 14 nt, Homo sapiens
cuaaaacacugaaa

SEQ ID NO: 2110619 - RNA, 14 nt, Homo sapiens
auaaaccaaugaac

SEQ ID NO: 2110620 - RNA, 13 nt, Homo sapiens
aggucuccuccac

SEQ ID NO: 2110621 - RNA, 21 nt, Homo sapiens
cuccuauugaaagaccagauc

SEQ ID NO: 2110622 - RNA, 23 nt, Homo sapiens
uugauuuaaucaccacucaaaaa

SEQ ID NO: 2110623 - RNA, 22 nt, Homo sapiens
cagcaccuguggcugacgaauu

SEQ ID NO: 2110624 - RNA, 21 nt, Homo sapiens
caccaccgacugaagugugug

SEQ ID NO: 2110625 - RNA, 15 nt, Homo sapiens
gaacuaguuuaaugu

SEQ ID NO: 2110626 - RNA, 18 nt, Homo sapiens
acuccaaccuaaccugug

SEQ ID NO: 2110627 - RNA, 19 nt, Homo sapiens
ugagauuuuuuauugcuag

SEQ ID NO: 2110628 - RNA, 17 nt, Homo sapiens
uugugccucacuggacu

SEQ ID NO: 2110629 - RNA, 14 nt, Homo sapiens
ucagucagugcacu

SEQ ID NO: 2110630 - RNA, 20 nt, Homo sapiens
acucacaaucaucuucuccc

SEQ ID NO: 2110631 - RNA, 11 nt, Homo sapiens
acuauggaaau

SEQ ID NO: 2110632 - RNA, 17 nt, Homo sapiens
auuucauugcacuggaa

SEQ ID NO: 2110633 - RNA, 19 nt, Homo sapiens
ccuuuuggccuccugcaaa

SEQ ID NO: 2110634 - RNA, 16 nt, Homo sapiens
uucugugaaauauaau

SEQ ID NO: 2110635 - RNA, 20 nt, Homo sapiens
auguaugcuuccagggacaa

SEQ ID NO: 2110636 - RNA, 14 nt, Homo sapiens
gugugaugcaccug

SEQ ID NO: 2110637 - RNA, 17 nt, Homo sapiens
auuuugagaucaucagu

SEQ ID NO: 2110638 - RNA, 17 nt, Homo sapiens
acacuguacugcaauaa

SEQ ID NO: 2110639 - RNA, 17 nt, Homo sapiens
cauaaguagagacugaa

SEQ ID NO: 2110640 - RNA, 16 nt, Homo sapiens
cuacuuccaagacuua

SEQ ID NO: 2110641 - RNA, 22 nt, Homo sapiens
cugaugaaaacauagcaucuca

SEQ ID NO: 2110642 - RNA, 14 nt, Homo sapiens
uggcgcuggcugcg

SEQ ID NO: 2110643 - RNA, 16 nt, Homo sapiens
ucaaguauacacuguu

SEQ ID NO: 2110644 - RNA, 16 nt, Homo sapiens
acaucagcacugccaa

SEQ ID NO: 2110645 - RNA, 17 nt, Homo sapiens
uaaaagaucuugaauag

SEQ ID NO: 2110646 - RNA, 24 nt, Homo sapiens
gcuguccugagcccccugcaccca

SEQ ID NO: 2110647 - RNA, 20 nt, Homo sapiens
ucucaaggggcccagccucc

SEQ ID NO: 2110648 - RNA, 20 nt, Homo sapiens
gauaauaacugucuucugga

SEQ ID NO: 2110649 - RNA, 13 nt, Homo sapiens
cucagucuauucu

SEQ ID NO: 2110650 - RNA, 17 nt, Homo sapiens
agagccuuuugugcaaa

SEQ ID NO: 2110651 - RNA, 15 nt, Homo sapiens
auagaugugagccag

SEQ ID NO: 2110652 - RNA, 22 nt, Homo sapiens
aaauauucugucauugguuaca

SEQ ID NO: 2110653 - RNA, 20 nt, Homo sapiens
guccugugagcaaagugcag

SEQ ID NO: 2110654 - RNA, 22 nt, Homo sapiens
auguuaaaauucucauuacucu

SEQ ID NO: 2110655 - RNA, 21 nt, Homo sapiens
cuccucauagcaauacuugga

SEQ ID NO: 2110656 - RNA, 16 nt, Homo sapiens
caaaagcucauccauu

SEQ ID NO: 2110657 - RNA, 17 nt, Homo sapiens
auuuugauauaccaugu

SEQ ID NO: 2110658 - RNA, 14 nt, Homo sapiens
aaggauacuuuaca

SEQ ID NO: 2110659 - RNA, 16 nt, Homo sapiens
uucuuaaccuuugcua

SEQ ID NO: 2110660 - RNA, 20 nt, Homo sapiens
guaaaaucuagaagcuuaag

SEQ ID NO: 2110661 - RNA, 13 nt, Homo sapiens
cauucucucucau

SEQ ID NO: 2110662 - RNA, 13 nt, Homo sapiens
aauucucuaucau

SEQ ID NO: 2110663 - RNA, 16 nt, Homo sapiens
acugcagcauuuugcu

SEQ ID NO: 2110664 - RNA, 19 nt, Homo sapiens
cuuaacauuucauuguaca

SEQ ID NO: 2110665 - RNA, 19 nt, Homo sapiens
aaaacuauuuaacuugagc

SEQ ID NO: 2110666 - RNA, 14 nt, Homo sapiens
ucaauaaacaguca

SEQ ID NO: 2110667 - RNA, 20 nt, Homo sapiens
ugcaguuuuuaucagccuug

SEQ ID NO: 2110668 - RNA, 20 nt, Homo sapiens
caggucuuuccuaaggcugc

SEQ ID NO: 2110669 - RNA, 22 nt, Homo sapiens
ugauaaucaucagguuuacuca

SEQ ID NO: 2110670 - RNA, 23 nt, Homo sapiens
agaagaccuuuacaguuugugcu

SEQ ID NO: 2110671 - RNA, 21 nt, Homo sapiens
ggagauccuuguguuuaucag

SEQ ID NO: 2110672 - RNA, 13 nt, Homo sapiens
gcugaaagccaag

SEQ ID NO: 2110673 - RNA, 15 nt, Homo sapiens
auauauauaauuuaa

SEQ ID NO: 2110674 - RNA, 14 nt, Homo sapiens
cuuuacaguggcaa

SEQ ID NO: 2110675 - RNA, 20 nt, Homo sapiens
cccacgcugaccaugcguca

SEQ ID NO: 2110676 - RNA, 23 nt, Homo sapiens
cugcaggagagucgggggaccag

SEQ ID NO: 2110677 - RNA, 17 nt, Homo sapiens
agauuuggcuugacaaa

SEQ ID NO: 2110678 - RNA, 20 nt, Homo sapiens
gaagaacaucaagauaccuu

SEQ ID NO: 2110679 - RNA, 17 nt, Homo sapiens
cgccgcccccugcccca

SEQ ID NO: 2110680 - RNA, 21 nt, Homo sapiens
uaacaccaagaguagcaccuu

SEQ ID NO: 2110681 - RNA, 22 nt, Homo sapiens
ugggccagggucucgucaggag

SEQ ID NO: 2110682 - RNA, 22 nt, Homo sapiens
cacaucugcaguggagccugaa

SEQ ID NO: 2110683 - RNA, 23 nt, Homo sapiens
auuacuuuugauccugggggacc

SEQ ID NO: 2110684 - RNA, 20 nt, Homo sapiens
uugcaggaccucaggugaga

SEQ ID NO: 2110685 - RNA, 13 nt, Homo sapiens
aaaauaagaucuc

SEQ ID NO: 2110686 - RNA, 18 nt, Homo sapiens
ccuuuugaccaaauaaag

SEQ ID NO: 2110687 - RNA, 20 nt, Homo sapiens
acaaacccucuguagcuaua

SEQ ID NO: 2110688 - RNA, 21 nt, Homo sapiens
ucaaguuuuucucucaaauga

SEQ ID NO: 2110689 - RNA, 15 nt, Homo sapiens
uacaaccuauguaau

SEQ ID NO: 2110690 - RNA, 20 nt, Homo sapiens
aaaccgaagggacuggaucu

SEQ ID NO: 2110691 - RNA, 23 nt, Homo sapiens
cuuaauaacauacaaugaccaca

SEQ ID NO: 2110692 - RNA, 20 nt, Homo sapiens
gaagauguuaauuacuuuug

SEQ ID NO: 2110693 - RNA, 20 nt, Homo sapiens
accagaauuguuuugcauuu

SEQ ID NO: 2110694 - RNA, 14 nt, Homo sapiens
gauucugugucaga

SEQ ID NO: 2110695 - RNA, 15 nt, Homo sapiens
cacaucuuguaacuu

SEQ ID NO: 2110696 - RNA, 11 nt, Homo sapiens
ucucauucccu

SEQ ID NO: 2110697 - RNA, 12 nt, Homo sapiens
gugacagucucc

SEQ ID NO: 2110698 - RNA, 12 nt, Homo sapiens
gagacagucacc

SEQ ID NO: 2110699 - RNA, 22 nt, Homo sapiens
acuccaaagaaauguaagggaa

SEQ ID NO: 2110700 - RNA, 20 nt, Homo sapiens
acccucccuguucaucccau

SEQ ID NO: 2110701 - RNA, 15 nt, Homo sapiens
agaggguacuugaau

SEQ ID NO: 2110702 - RNA, 23 nt, Homo sapiens
auugaaguuuugacaucaaugau

SEQ ID NO: 2110703 - RNA, 13 nt, Homo sapiens
auauaacugagau

SEQ ID NO: 2110704 - RNA, 13 nt, Homo sapiens
cugucacccacag

SEQ ID NO: 2110705 - RNA, 14 nt, Homo sapiens
uauuauauuugaca

SEQ ID NO: 2110706 - RNA, 19 nt, Homo sapiens
caaggaguaaguacaaaua

SEQ ID NO: 2110707 - RNA, 19 nt, Homo sapiens
aaaguuuaucacacagugu

SEQ ID NO: 2110708 - RNA, 21 nt, Homo sapiens
gaauaauuagcuuguuacaau

SEQ ID NO: 2110709 - RNA, 17 nt, Homo sapiens
uaagcauggauuuuccc

SEQ ID NO: 2110710 - RNA, 21 nt, Homo sapiens
acgacagcucucugugcacug

SEQ ID NO: 2110711 - RNA, 18 nt, Homo sapiens
ucaguuauaauaaccugg

SEQ ID NO: 2110712 - RNA, 12 nt, Homo sapiens
ccacuccagugc

SEQ ID NO: 2110713 - RNA, 23 nt, Homo sapiens
guagauacaaucagcugcuuugu

SEQ ID NO: 2110714 - RNA, 19 nt, Homo sapiens
cccuucuaaccugaacuga

SEQ ID NO: 2110715 - RNA, 14 nt, Homo sapiens
aacuuuauacccag

SEQ ID NO: 2110716 - RNA, 21 nt, Homo sapiens
ucagaaaguaacaaucuaugg

SEQ ID NO: 2110717 - RNA, 12 nt, Homo sapiens
ucuuauggggcc

SEQ ID NO: 2110718 - RNA, 22 nt, Homo sapiens
ucacaaagcuaaauacauggaa

SEQ ID NO: 2110719 - RNA, 15 nt, Homo sapiens
agaagggcuaacuca

SEQ ID NO: 2110720 - RNA, 21 nt, Homo sapiens
aacauuuguaaaaauacuguu

SEQ ID NO: 2110721 - RNA, 16 nt, Homo sapiens
gauuuuucucaucucc

SEQ ID NO: 2110722 - RNA, 16 nt, Homo sapiens
aaguuaaaagcacaaa

SEQ ID NO: 2110723 - RNA, 13 nt, Homo sapiens
aauauaaauauca

SEQ ID NO: 2110724 - RNA, 23 nt, Homo sapiens
gcaggaagggugggaagggauaa

SEQ ID NO: 2110725 - RNA, 15 nt, Homo sapiens
agucaacucuggcca

SEQ ID NO: 2110726 - RNA, 21 nt, Homo sapiens
caucaaugauaaugcuaauuu

SEQ ID NO: 2110727 - RNA, 19 nt, Homo sapiens
cacugagcugggcaccaca

SEQ ID NO: 2110728 - RNA, 13 nt, Homo sapiens
uucccucugggcc

SEQ ID NO: 2110729 - RNA, 14 nt, Homo sapiens
aauacaacucacug

SEQ ID NO: 2110730 - RNA, 22 nt, Homo sapiens
uccaaugcuucuguugaucuca

SEQ ID NO: 2110731 - RNA, 16 nt, Homo sapiens
aaggagucacugagac

SEQ ID NO: 2110732 - RNA, 21 nt, Homo sapiens
aaacuuagcaucuaauuucaa

SEQ ID NO: 2110733 - RNA, 13 nt, Homo sapiens
guuuuguugcacu

SEQ ID NO: 2110734 - RNA, 16 nt, Homo sapiens
gaugugauugccucaa

SEQ ID NO: 2110735 - RNA, 21 nt, Homo sapiens
gcccagccaaucuagaggcaa

SEQ ID NO: 2110736 - RNA, 12 nt, Homo sapiens
ugaggacacgug

SEQ ID NO: 2110737 - RNA, 21 nt, Homo sapiens
cuuggccagcguggcgcagug

SEQ ID NO: 2110738 - RNA, 22 nt, Homo sapiens
gaguguguguuuguguguuuca

SEQ ID NO: 2110739 - RNA, 15 nt, Homo sapiens
cagacugcugcuaga

SEQ ID NO: 2110740 - RNA, 20 nt, Homo sapiens
ucacuauugcaaggacagca

SEQ ID NO: 2110741 - RNA, 14 nt, Homo sapiens
ugccccagggggau

SEQ ID NO: 2110742 - RNA, 20 nt, Homo sapiens
aaggcugcuuagaauccaaa

SEQ ID NO: 2110743 - RNA, 18 nt, Homo sapiens
auucuacguaucugcuac

SEQ ID NO: 2110744 - RNA, 12 nt, Homo sapiens
uguccuacacaa

SEQ ID NO: 2110745 - RNA, 11 nt, Homo sapiens
acccaccauug

SEQ ID NO: 2110746 - RNA, 21 nt, Homo sapiens
ucuaguaguuaaaacagcuau

SEQ ID NO: 2110747 - RNA, 16 nt, Homo sapiens
cagaggugaaagcuau

SEQ ID NO: 2110748 - RNA, 18 nt, Homo sapiens
cuucacugcagccuuuca

SEQ ID NO: 2110749 - RNA, 20 nt, Homo sapiens
cacacuggucacaggcaaag

SEQ ID NO: 2110750 - RNA, 11 nt, Homo sapiens
aaaguuuacuu

SEQ ID NO: 2110751 - RNA, 22 nt, Homo sapiens
gaagccuuagccaggaggccag

SEQ ID NO: 2110752 - RNA, 13 nt, Homo sapiens
caguggaagggaa

SEQ ID NO: 2110753 - RNA, 19 nt, Homo sapiens
accugcggcuccccugugu

SEQ ID NO: 2110754 - RNA, 16 nt, Homo sapiens
acacagggaggcugua

SEQ ID NO: 2110755 - RNA, 18 nt, Homo sapiens
aagcaccagugggacugu

SEQ ID NO: 2110756 - RNA, 16 nt, Homo sapiens
uucgggggcugaccua

SEQ ID NO: 2110757 - RNA, 20 nt, Homo sapiens
agaaacccaaauugggacaa

SEQ ID NO: 2110758 - RNA, 12 nt, Homo sapiens
ccuguuccagaa

SEQ ID NO: 2110759 - RNA, 15 nt, Homo sapiens
aagauaauuuacuua

SEQ ID NO: 2110760 - RNA, 15 nt, Homo sapiens
auaaauauuagcaaa

SEQ ID NO: 2110761 - RNA, 20 nt, Homo sapiens
gaauuucuaaaaaacagagg

SEQ ID NO: 2110762 - RNA, 18 nt, Homo sapiens
uaaucucucuagguccau

SEQ ID NO: 2110763 - RNA, 16 nt, Homo sapiens
acuuuguaucaaucca

SEQ ID NO: 2110764 - RNA, 15 nt, Homo sapiens
uaacgucaucucagg

SEQ ID NO: 2110765 - RNA, 16 nt, Homo sapiens
ucccaauggccuucca

SEQ ID NO: 2110766 - RNA, 16 nt, Homo sapiens
cagugucuuccauaau

SEQ ID NO: 2110767 - RNA, 17 nt, Homo sapiens
ugcugaaugccucgcuc

SEQ ID NO: 2110768 - RNA, 20 nt, Homo sapiens
uagcaaccuucugcauucau

SEQ ID NO: 2110769 - RNA, 14 nt, Homo sapiens
uuucuuaggcacuu

SEQ ID NO: 2110770 - RNA, 19 nt, Homo sapiens
uccagcaucuaguggugga

SEQ ID NO: 2110771 - RNA, 23 nt, Homo sapiens
aacuaauuuccucugacauguaa

SEQ ID NO: 2110772 - RNA, 22 nt, Homo sapiens
uccaggcaggucugaagcucaa

SEQ ID NO: 2110773 - RNA, 20 nt, Homo sapiens
aagcaaguagcuuuccacau

SEQ ID NO: 2110774 - RNA, 17 nt, Homo sapiens
uuuggaugaccagaaca

SEQ ID NO: 2110775 - RNA, 16 nt, Homo sapiens
aggguugauccugcau

SEQ ID NO: 2110776 - RNA, 17 nt, Homo sapiens
uuacauggacagaauuu

SEQ ID NO: 2110777 - RNA, 13 nt, Homo sapiens
auauuugaaugaa

SEQ ID NO: 2110778 - RNA, 23 nt, Homo sapiens
ugggggugaggggccaggccaug

SEQ ID NO: 2110779 - RNA, 13 nt, Homo sapiens
augucccaaauaa

SEQ ID NO: 2110780 - RNA, 20 nt, Homo sapiens
uguacagacagaaaaaacug

SEQ ID NO: 2110781 - RNA, 14 nt, Homo sapiens
aacaucucuuucau

SEQ ID NO: 2110782 - RNA, 14 nt, Homo sapiens
aauaauucuuccuc

SEQ ID NO: 2110783 - RNA, 19 nt, Homo sapiens
caauaaaaugcacugacca

SEQ ID NO: 2110784 - RNA, 16 nt, Homo sapiens
caaaagggccaaagaa

SEQ ID NO: 2110785 - RNA, 14 nt, Homo sapiens
ggacuucagugugu

SEQ ID NO: 2110786 - RNA, 15 nt, Homo sapiens
gucuuccugcauuca

SEQ ID NO: 2110787 - RNA, 21 nt, Homo sapiens
ggugcaugauaagagcaucuc

SEQ ID NO: 2110788 - RNA, 14 nt, Homo sapiens
ucucauucuugccc

SEQ ID NO: 2110789 - RNA, 16 nt, Homo sapiens
ccggggccagcacuuc

SEQ ID NO: 2110790 - RNA, 18 nt, Homo sapiens
caaaguccucugcuccag

SEQ ID NO: 2110791 - RNA, 23 nt, Homo sapiens
agcuuauguagcugaaugugaua

SEQ ID NO: 2110792 - RNA, 20 nt, Homo sapiens
uacacuccagccugggcaac

SEQ ID NO: 2110793 - RNA, 16 nt, Homo sapiens
ugggucccauucuugg

SEQ ID NO: 2110794 - RNA, 20 nt, Homo sapiens
ccuaugugaguuucagaaau

SEQ ID NO: 2110795 - RNA, 16 nt, Homo sapiens
caagugucugugcaug

SEQ ID NO: 2110796 - RNA, 15 nt, Homo sapiens
auggggaggccucac

SEQ ID NO: 2110797 - RNA, 22 nt, Homo sapiens
cucucaguccuucuugggggua

SEQ ID NO: 2110798 - RNA, 18 nt, Homo sapiens
gcccucccccagcuccuu

SEQ ID NO: 2110799 - RNA, 19 nt, Homo sapiens
cccugagaaccccucuggg

SEQ ID NO: 2110800 - RNA, 14 nt, Homo sapiens
gauggggucuguaa

SEQ ID NO: 2110801 - RNA, 21 nt, Homo sapiens
acauugggcugaccgugucuc

SEQ ID NO: 2110802 - RNA, 20 nt, Homo sapiens
gugauuuuccuuuguagcua

SEQ ID NO: 2110803 - RNA, 19 nt, Homo sapiens
cugugcuguauuuugauau

SEQ ID NO: 2110804 - RNA, 17 nt, Homo sapiens
guuauaugaacauacaa

SEQ ID NO: 2110805 - RNA, 13 nt, Homo sapiens
uguuugaauuauc

SEQ ID NO: 2110806 - RNA, 14 nt, Homo sapiens
caauaaaugaauga

SEQ ID NO: 2110807 - RNA, 12 nt, Homo sapiens
agaggggccagg

SEQ ID NO: 2110808 - RNA, 23 nt, Homo sapiens
ccaggacaccacuagguggugcu

SEQ ID NO: 2110809 - RNA, 17 nt, Homo sapiens
agcuacaucaguuugau

SEQ ID NO: 2110810 - RNA, 19 nt, Homo sapiens
aguguuggaaauaggcaau

SEQ ID NO: 2110811 - RNA, 13 nt, Homo sapiens
agguggacagauu

SEQ ID NO: 2110812 - RNA, 15 nt, Homo sapiens
auuuuguauuguggu

SEQ ID NO: 2110813 - RNA, 22 nt, Homo sapiens
agauuguuaggagugguucuca

SEQ ID NO: 2110814 - RNA, 23 nt, Homo sapiens
uccccagugacuccagggugaca

SEQ ID NO: 2110815 - RNA, 23 nt, Homo sapiens
accauuuguguuuugaaagccca

SEQ ID NO: 2110816 - RNA, 22 nt, Homo sapiens
aauuuacacucaaccaugaccu

SEQ ID NO: 2110817 - RNA, 12 nt, Homo sapiens
agcauccucuac

SEQ ID NO: 2110818 - RNA, 21 nt, Homo sapiens
ucucccagccagguucugacu

SEQ ID NO: 2110819 - RNA, 18 nt, Homo sapiens
cuucuccauccacauggg

SEQ ID NO: 2110820 - RNA, 22 nt, Homo sapiens
auugaacuguauucuaguggcu

SEQ ID NO: 2110821 - RNA, 14 nt, Homo sapiens
ccuugcuagcugac

SEQ ID NO: 2110822 - RNA, 19 nt, Homo sapiens
agaggaggaggagggucua

SEQ ID NO: 2110823 - RNA, 18 nt, Homo sapiens
ugaaacagggcaccccag

SEQ ID NO: 2110824 - RNA, 11 nt, Homo sapiens
cuuugcugcuu

SEQ ID NO: 2110825 - RNA, 21 nt, Homo sapiens
caucugcucagcagcuauuug

SEQ ID NO: 2110826 - RNA, 15 nt, Homo sapiens
auuuggaaucuucuc

SEQ ID NO: 2110827 - RNA, 12 nt, Homo sapiens
caccucaauauu

SEQ ID NO: 2110828 - RNA, 18 nt, Homo sapiens
uaauauaaaucaaucuua

SEQ ID NO: 2110829 - RNA, 22 nt, Homo sapiens
ugaaugagcuugucaaugugau

SEQ ID NO: 2110830 - RNA, 17 nt, Homo sapiens
ugaaauucacaguaaua

SEQ ID NO: 2110831 - RNA, 16 nt, Homo sapiens
gagaauucaggcaaac

SEQ ID NO: 2110832 - RNA, 13 nt, Homo sapiens
ccccuaaagugcc

SEQ ID NO: 2110833 - RNA, 20 nt, Homo sapiens
agaucaugagaaauuaccaa

SEQ ID NO: 2110834 - RNA, 23 nt, Homo sapiens
ugcugggcccccagccuggccag

SEQ ID NO: 2110835 - RNA, 12 nt, Homo sapiens
ucagcucccaca

SEQ ID NO: 2110836 - RNA, 22 nt, Homo sapiens
aaauuugcaaaucucaggauaa

SEQ ID NO: 2110837 - RNA, 13 nt, Homo sapiens
ucuuggcugagga

SEQ ID NO: 2110838 - RNA, 16 nt, Homo sapiens
gaauuuucauugccuu

SEQ ID NO: 2110839 - RNA, 18 nt, Homo sapiens
ccuucaaugcaaaauaca

SEQ ID NO: 2110840 - RNA, 19 nt, Homo sapiens
cugaccccaaguuauccac

SEQ ID NO: 2110841 - RNA, 13 nt, Homo sapiens
aguucagcaaaga

SEQ ID NO: 2110842 - RNA, 19 nt, Homo sapiens
gacauacauauuaucucau

SEQ ID NO: 2110843 - RNA, 20 nt, Homo sapiens
gaacaaccugcacaaccugg

SEQ ID NO: 2110844 - RNA, 16 nt, Homo sapiens
gagguuugcacuuccu

SEQ ID NO: 2110845 - RNA, 13 nt, Homo sapiens
gaacugacccuca

SEQ ID NO: 2110846 - RNA, 15 nt, Homo sapiens
gccggcuguggagca

SEQ ID NO: 2110847 - RNA, 23 nt, Homo sapiens
cagagccuugagagacccagcug

SEQ ID NO: 2110848 - RNA, 17 nt, Homo sapiens
agccuugauaauacuug

SEQ ID NO: 2110849 - RNA, 15 nt, Homo sapiens
aaacguguaaauugc

SEQ ID NO: 2110850 - RNA, 23 nt, Homo sapiens
auuuuauaugaaauguuucacua

SEQ ID NO: 2110851 - RNA, 15 nt, Homo sapiens
ccugugucaucccau

SEQ ID NO: 2110852 - RNA, 16 nt, Homo sapiens
acacucuugguagaag

SEQ ID NO: 2110853 - RNA, 21 nt, Homo sapiens
caggugugugccaccacaccc

SEQ ID NO: 2110854 - RNA, 16 nt, Homo sapiens
acagggugucugucag

SEQ ID NO: 2110855 - RNA, 19 nt, Homo sapiens
ccuccaggauagacuuuuc

SEQ ID NO: 2110856 - RNA, 18 nt, Homo sapiens
accuccuaagaaggcacc

SEQ ID NO: 2110857 - RNA, 16 nt, Homo sapiens
uucuuuuauacugaca

SEQ ID NO: 2110858 - RNA, 16 nt, Homo sapiens
ugccgaacauuaggaa

SEQ ID NO: 2110859 - RNA, 19 nt, Homo sapiens
uuggcaauaccuaguucug

SEQ ID NO: 2110860 - RNA, 24 nt, Homo sapiens
cuucucccaggcaaggcuguggac

SEQ ID NO: 2110861 - RNA, 21 nt, Homo sapiens
cacccacacccuacagcagau

SEQ ID NO: 2110862 - RNA, 13 nt, Homo sapiens
cguucugcugcuu

SEQ ID NO: 2110863 - RNA, 19 nt, Homo sapiens
auuucucaucaguaguuca

SEQ ID NO: 2110864 - RNA, 13 nt, Homo sapiens
ccuggaggugcca

SEQ ID NO: 2110865 - RNA, 18 nt, Homo sapiens
gggacacugcgggacaga

SEQ ID NO: 2110866 - RNA, 18 nt, Homo sapiens
ucaaguuaggagcuuuua

SEQ ID NO: 2110867 - RNA, 14 nt, Homo sapiens
ggcccagccauggc

SEQ ID NO: 2110868 - RNA, 16 nt, Homo sapiens
ccuacuucuuuugcuc

SEQ ID NO: 2110869 - RNA, 15 nt, Homo sapiens
acaaagaugugcaaa

SEQ ID NO: 2110870 - RNA, 15 nt, Homo sapiens
cauucucgcuucccu

SEQ ID NO: 2110871 - RNA, 16 nt, Homo sapiens
gugagaccauguuuca

SEQ ID NO: 2110872 - RNA, 17 nt, Homo sapiens
ucguuuuuuucauucca

SEQ ID NO: 2110873 - RNA, 23 nt, Homo sapiens
uggccuuccccuccaaaaccucc

SEQ ID NO: 2110874 - RNA, 17 nt, Homo sapiens
uggcuagagggcccaaa

SEQ ID NO: 2110875 - RNA, 18 nt, Homo sapiens
ggcaagucuuccaugacc

SEQ ID NO: 2110876 - RNA, 17 nt, Homo sapiens
ggagggagagucuccca

SEQ ID NO: 2110877 - RNA, 11 nt, Homo sapiens
aaaaugcaugu

SEQ ID NO: 2110878 - RNA, 20 nt, Homo sapiens
augaaguuccacuugguuca

SEQ ID NO: 2110879 - RNA, 15 nt, Homo sapiens
uguaauggaaaccaa

SEQ ID NO: 2110880 - RNA, 17 nt, Homo sapiens
accucacacuacuguau

SEQ ID NO: 2110881 - RNA, 14 nt, Homo sapiens
aaaagcccagcuuu

SEQ ID NO: 2110882 - RNA, 20 nt, Homo sapiens
cguccagcuggaagggucaa

SEQ ID NO: 2110883 - RNA, 12 nt, Homo sapiens
aaauuuggucaa

SEQ ID NO: 2110884 - RNA, 17 nt, Homo sapiens
ucacaaacugaaugacu

SEQ ID NO: 2110885 - RNA, 14 nt, Homo sapiens
ucauaacauugauu

SEQ ID NO: 2110886 - RNA, 14 nt, Homo sapiens
ggagcuacugacau

SEQ ID NO: 2110887 - RNA, 21 nt, Homo sapiens
auagaauucaauuugaacuca

SEQ ID NO: 2110888 - RNA, 21 nt, Homo sapiens
uccuccuuaacccugccaguu

SEQ ID NO: 2110889 - RNA, 22 nt, Homo sapiens
aauucugcagaguuuccaaaac

SEQ ID NO: 2110890 - RNA, 11 nt, Homo sapiens
aauaaauggac

SEQ ID NO: 2110891 - RNA, 13 nt, Homo sapiens
ccuaggcaucaca

SEQ ID NO: 2110892 - RNA, 21 nt, Homo sapiens
cuccauuuggaaaauguucac

SEQ ID NO: 2110893 - RNA, 17 nt, Homo sapiens
accuuucaggagacuuu

SEQ ID NO: 2110894 - RNA, 19 nt, Homo sapiens
cuggaugauggucuucagc

SEQ ID NO: 2110895 - RNA, 15 nt, Homo sapiens
cugagccgcagagaa

SEQ ID NO: 2110896 - RNA, 14 nt, Homo sapiens
ucuuggcucugaga

SEQ ID NO: 2110897 - RNA, 15 nt, Homo sapiens
gauugagaacugaca

SEQ ID NO: 2110898 - RNA, 14 nt, Homo sapiens
gcaaagggaaccau

SEQ ID NO: 2110899 - RNA, 14 nt, Homo sapiens
caguggugcucaau

SEQ ID NO: 2110900 - RNA, 18 nt, Homo sapiens
ugaaaacugacaucagau

SEQ ID NO: 2110901 - RNA, 17 nt, Homo sapiens
uauuuuuccucuuucac

SEQ ID NO: 2110902 - RNA, 10 nt, Homo sapiens
guuguucaua

SEQ ID NO: 2110903 - RNA, 15 nt, Homo sapiens
ucuagcuuugucaua

SEQ ID NO: 2110904 - RNA, 14 nt, Homo sapiens
gaaauuaguguuuu

SEQ ID NO: 2110905 - RNA, 18 nt, Homo sapiens
gaauggguuuacucucaa

SEQ ID NO: 2110906 - RNA, 13 nt, Homo sapiens
cucaaaagccaaa

SEQ ID NO: 2110907 - RNA, 13 nt, Homo sapiens
gucaaaaggcaaa

SEQ ID NO: 2110908 - RNA, 15 nt, Homo sapiens
gguccacuguguuua

SEQ ID NO: 2110909 - RNA, 15 nt, Homo sapiens
uuucagcggugccaa

SEQ ID NO: 2110910 - RNA, 18 nt, Homo sapiens
acagggacugaaaaccuc

SEQ ID NO: 2110911 - RNA, 16 nt, Homo sapiens
uguacccgagcacaua

SEQ ID NO: 2110912 - RNA, 23 nt, Homo sapiens
gauguacacacacagaugcacac

SEQ ID NO: 2110913 - RNA, 19 nt, Homo sapiens
cugaauuuacuuccuugca

SEQ ID NO: 2110914 - RNA, 19 nt, Homo sapiens
cuacaggacugguacucaa

SEQ ID NO: 2110915 - RNA, 19 nt, Homo sapiens
ucuuugagaccaaguucca

SEQ ID NO: 2110916 - RNA, 17 nt, Homo sapiens
aaauucaaccacuguaa

SEQ ID NO: 2110917 - RNA, 22 nt, Homo sapiens
agacuguacuggccagugucau

SEQ ID NO: 2110918 - RNA, 23 nt, Homo sapiens
ccacagagucuguguguagccag

SEQ ID NO: 2110919 - RNA, 14 nt, Homo sapiens
caggccagcuccac

SEQ ID NO: 2110920 - RNA, 20 nt, Homo sapiens
cucuaaauauuucaugauuc

SEQ ID NO: 2110921 - RNA, 14 nt, Homo sapiens
auauuagaugugau

SEQ ID NO: 2110922 - RNA, 22 nt, Homo sapiens
ucgggaggcagagacaggagaa

SEQ ID NO: 2110923 - RNA, 16 nt, Homo sapiens
agcgauaauuuuuaga

SEQ ID NO: 2110924 - RNA, 20 nt, Homo sapiens
aaacaccgagugaggccaua

SEQ ID NO: 2110925 - RNA, 17 nt, Homo sapiens
cucaggucuguacuuag

SEQ ID NO: 2110926 - RNA, 16 nt, Homo sapiens
aguugagcacaggcaa

SEQ ID NO: 2110927 - RNA, 17 nt, Homo sapiens
uuguacuguaauggagu

SEQ ID NO: 2110928 - RNA, 20 nt, Homo sapiens
aagcauuuccagccuaucua

SEQ ID NO: 2110929 - RNA, 23 nt, Homo sapiens
auccugugcaauagacacauaca

SEQ ID NO: 2110930 - RNA, 17 nt, Homo sapiens
ugccuuuugguuucacc

SEQ ID NO: 2110931 - RNA, 19 nt, Homo sapiens
ucggucgccccguguuugc

SEQ ID NO: 2110932 - RNA, 15 nt, Homo sapiens
ucggugguaccugag

SEQ ID NO: 2110933 - RNA, 19 nt, Homo sapiens
caggcuagagugcaauggu

SEQ ID NO: 2110934 - RNA, 21 nt, Homo sapiens
cccaggacuuauccaugcauc

SEQ ID NO: 2110935 - RNA, 19 nt, Homo sapiens
ugugaacuaaacuuucaca

SEQ ID NO: 2110936 - RNA, 22 nt, Homo sapiens
cugacaagggacuagugaguca

SEQ ID NO: 2110937 - RNA, 17 nt, Homo sapiens
cacuccucccugaugua

SEQ ID NO: 2110938 - RNA, 19 nt, Homo sapiens
aacacuauaaaaacagcuc

SEQ ID NO: 2110939 - RNA, 12 nt, Homo sapiens
ugugagcaagaa

SEQ ID NO: 2110940 - RNA, 14 nt, Homo sapiens
uccucccacaaccc

SEQ ID NO: 2110941 - RNA, 20 nt, Homo sapiens
ugaucucaaagcacaaugug

SEQ ID NO: 2110942 - RNA, 22 nt, Homo sapiens
gggaucagagucuggccugcca

SEQ ID NO: 2110943 - RNA, 20 nt, Homo sapiens
uauuuugagcccccauucca

SEQ ID NO: 2110944 - RNA, 13 nt, Homo sapiens
ugcugcaagucau

SEQ ID NO: 2110945 - RNA, 21 nt, Homo sapiens
uccaaguggcauaauucaggg

SEQ ID NO: 2110946 - RNA, 21 nt, Homo sapiens
acuagucuguguaacuuuaaa

SEQ ID NO: 2110947 - RNA, 17 nt, Homo sapiens
ucuaagucaaauuccaa

SEQ ID NO: 2110948 - RNA, 13 nt, Homo sapiens
cgagagucccugc

SEQ ID NO: 2110949 - RNA, 17 nt, Homo sapiens
acucaccagccucugcu

SEQ ID NO: 2110950 - RNA, 19 nt, Homo sapiens
gacauggagaccgugacca

SEQ ID NO: 2110951 - RNA, 16 nt, Homo sapiens
aagaccucuugggcag

SEQ ID NO: 2110952 - RNA, 16 nt, Homo sapiens
aacucacucugggcug

SEQ ID NO: 2110953 - RNA, 22 nt, Homo sapiens
aacccuuuuacagucacauuca

SEQ ID NO: 2110954 - RNA, 16 nt, Homo sapiens
auuuuuagacagaguc

SEQ ID NO: 2110955 - RNA, 23 nt, Homo sapiens
cuugaggaccugcgaaauccaga

SEQ ID NO: 2110956 - RNA, 19 nt, Homo sapiens
gccucuuccucccucauuc

SEQ ID NO: 2110957 - RNA, 15 nt, Homo sapiens
agaauaauaugaagc

SEQ ID NO: 2110958 - RNA, 16 nt, Homo sapiens
aaugugauacaugccg

SEQ ID NO: 2110959 - RNA, 13 nt, Homo sapiens
aaccugugcugaa

SEQ ID NO: 2110960 - RNA, 14 nt, Homo sapiens
ucaaggaacagcca

SEQ ID NO: 2110961 - RNA, 16 nt, Homo sapiens
augugagaaaugucua

SEQ ID NO: 2110962 - RNA, 22 nt, Homo sapiens
aucgcauauuaguuaaucuccu

SEQ ID NO: 2110963 - RNA, 14 nt, Homo sapiens
acaaaccaagccau

SEQ ID NO: 2110964 - RNA, 14 nt, Homo sapiens
aucuuagugccuga

SEQ ID NO: 2110965 - RNA, 15 nt, Homo sapiens
cuucuccauucccua

SEQ ID NO: 2110966 - RNA, 17 nt, Homo sapiens
uugauuauagcaaugug

SEQ ID NO: 2110967 - RNA, 23 nt, Homo sapiens
ccucuaacauuugcaaaauggaa

SEQ ID NO: 2110968 - RNA, 15 nt, Homo sapiens
cuagaggcccuuugc

SEQ ID NO: 2110969 - RNA, 14 nt, Homo sapiens
uguccuaagagauu

SEQ ID NO: 2110970 - RNA, 17 nt, Homo sapiens
agugagucauaucuuaa

SEQ ID NO: 2110971 - RNA, 23 nt, Homo sapiens
aauaugguugauaguuuaccuga

SEQ ID NO: 2110972 - RNA, 15 nt, Homo sapiens
aaauaauauugauuu

SEQ ID NO: 2110973 - RNA, 23 nt, Homo sapiens
gauggcccauucuacuugcucug

SEQ ID NO: 2110974 - RNA, 21 nt, Homo sapiens
uguaaucucucugcagcugcc

SEQ ID NO: 2110975 - RNA, 15 nt, Homo sapiens
gagccugggcgacca

SEQ ID NO: 2110976 - RNA, 13 nt, Homo sapiens
cgggccagggugg

SEQ ID NO: 2110977 - RNA, 19 nt, Homo sapiens
acacacaccugucugugca

SEQ ID NO: 2110978 - RNA, 23 nt, Homo sapiens
ccugacuaaacuaccaccucagg

SEQ ID NO: 2110979 - RNA, 23 nt, Homo sapiens
ucaauaaaguuccccugugacac

SEQ ID NO: 2110980 - RNA, 19 nt, Homo sapiens
agcgauucucuugccucaa

SEQ ID NO: 2110981 - RNA, 13 nt, Homo sapiens
ugaugauacuucc

SEQ ID NO: 2110982 - RNA, 17 nt, Homo sapiens
cugccauugggacccuc

SEQ ID NO: 2110983 - RNA, 18 nt, Homo sapiens
ucaaggaauaaugggcuu

SEQ ID NO: 2110984 - RNA, 23 nt, Homo sapiens
acuauauaaaguacuacuguaga

SEQ ID NO: 2110985 - RNA, 19 nt, Homo sapiens
aaaaaaaugcacugugaca

SEQ ID NO: 2110986 - RNA, 20 nt, Homo sapiens
auuaucuaaaguaugaagca

SEQ ID NO: 2110987 - RNA, 16 nt, Homo sapiens
ugucagcugcuguuga

SEQ ID NO: 2110988 - RNA, 16 nt, Homo sapiens
aggagcugccauguca

SEQ ID NO: 2110989 - RNA, 17 nt, Homo sapiens
acaagcuuuuaacuuuu

SEQ ID NO: 2110990 - RNA, 14 nt, Homo sapiens
cauguguaaagguu

SEQ ID NO: 2110991 - RNA, 17 nt, Homo sapiens
caugccgggggagccac

SEQ ID NO: 2110992 - RNA, 22 nt, Homo sapiens
accuggagagcuagaaccuaga

SEQ ID NO: 2110993 - RNA, 13 nt, Homo sapiens
cuacauuacacag

SEQ ID NO: 2110994 - RNA, 18 nt, Homo sapiens
agauguggucaauggaag

SEQ ID NO: 2110995 - RNA, 22 nt, Homo sapiens
aagauacagugucugacuauaa

SEQ ID NO: 2110996 - RNA, 21 nt, Homo sapiens
aaaauccucacucauucccau

SEQ ID NO: 2110997 - RNA, 12 nt, Homo sapiens
uuugugagccgu

SEQ ID NO: 2110998 - RNA, 15 nt, Homo sapiens
agcuagaugcuuuag

SEQ ID NO: 2110999 - RNA, 17 nt, Homo sapiens
aaacugcaaaugugcag

SEQ ID NO: 2111000 - RNA, 15 nt, Homo sapiens
caugccuucccugag

SEQ ID NO: 2111001 - RNA, 20 nt, Homo sapiens
guucaacuuggugacacucu

SEQ ID NO: 2111002 - RNA, 18 nt, Homo sapiens
aaugaaauaauacuucag

SEQ ID NO: 2111003 - RNA, 17 nt, Homo sapiens
accaaauaaaguaccau

SEQ ID NO: 2111004 - RNA, 20 nt, Homo sapiens
caacaaacccaacucuaaug

SEQ ID NO: 2111005 - RNA, 15 nt, Homo sapiens
uguauuguggaacac

SEQ ID NO: 2111006 - RNA, 19 nt, Homo sapiens
uucggagugaauguggcag

SEQ ID NO: 2111007 - RNA, 12 nt, Homo sapiens
auucccuccuga

SEQ ID NO: 2111008 - RNA, 18 nt, Homo sapiens
acugcuuaauucaaauaa

SEQ ID NO: 2111009 - RNA, 11 nt, Homo sapiens
aucuugccuca

SEQ ID NO: 2111010 - RNA, 17 nt, Homo sapiens
gagagggcuagcccuga

SEQ ID NO: 2111011 - RNA, 14 nt, Homo sapiens
cucauggaccagug

SEQ ID NO: 2111012 - RNA, 19 nt, Homo sapiens
uaaacagguguuugccuua

SEQ ID NO: 2111013 - RNA, 16 nt, Homo sapiens
gccuccugaguagaug

SEQ ID NO: 2111014 - RNA, 20 nt, Homo sapiens
ggagcauagcagaggggcca

SEQ ID NO: 2111015 - RNA, 17 nt, Homo sapiens
gcuggacagcacucugc

SEQ ID NO: 2111016 - RNA, 19 nt, Homo sapiens
ucagaaaagagccacuuuc

SEQ ID NO: 2111017 - RNA, 23 nt, Homo sapiens
gaccagccuggccaacauaguga

SEQ ID NO: 2111018 - RNA, 17 nt, Homo sapiens
ccagugacacaacucau

SEQ ID NO: 2111019 - RNA, 14 nt, Homo sapiens
uagacgucucaggu

SEQ ID NO: 2111020 - RNA, 23 nt, Homo sapiens
uugaaauauucagaaauucucca

SEQ ID NO: 2111021 - RNA, 20 nt, Homo sapiens
gugagcuguaaaaauguuac

SEQ ID NO: 2111022 - RNA, 12 nt, Homo sapiens
ccacagcauuua

SEQ ID NO: 2111023 - RNA, 18 nt, Homo sapiens
ucaccuaagucucuguga

SEQ ID NO: 2111024 - RNA, 15 nt, Homo sapiens
gauucaguauuacaa

SEQ ID NO: 2111025 - RNA, 14 nt, Homo sapiens
acugcaacauacag

SEQ ID NO: 2111026 - RNA, 22 nt, Homo sapiens
gcuggagguggaaaauggugcc

SEQ ID NO: 2111027 - RNA, 14 nt, Homo sapiens
acaaaacaguuuga

SEQ ID NO: 2111028 - RNA, 11 nt, Homo sapiens
gggccagugaa

SEQ ID NO: 2111029 - RNA, 13 nt, Homo sapiens
aggccaaggcagg

SEQ ID NO: 2111030 - RNA, 22 nt, Homo sapiens
auucaaauccauaagcagguua

SEQ ID NO: 2111031 - RNA, 12 nt, Homo sapiens
gugccuucugcc

SEQ ID NO: 2111032 - RNA, 18 nt, Homo sapiens
guaaaaagcccuauguga

SEQ ID NO: 2111033 - RNA, 21 nt, Homo sapiens
ucagucaucaaagcagaaguc

SEQ ID NO: 2111034 - RNA, 13 nt, Homo sapiens
uuccauuuaguaa

SEQ ID NO: 2111035 - RNA, 21 nt, Homo sapiens
augugcauugaauacucugaa

SEQ ID NO: 2111036 - RNA, 14 nt, Homo sapiens
agcuacucucccca

SEQ ID NO: 2111037 - RNA, 18 nt, Homo sapiens
gcaccaauaaagccuuca

SEQ ID NO: 2111038 - RNA, 17 nt, Homo sapiens
cugcaccguacugugga

SEQ ID NO: 2111039 - RNA, 15 nt, Homo sapiens
gugucucugccaugu

SEQ ID NO: 2111040 - RNA, 17 nt, Homo sapiens
aagucaucauuccucuc

SEQ ID NO: 2111041 - RNA, 22 nt, Homo sapiens
gccucugccccuggccuuugag

SEQ ID NO: 2111042 - RNA, 21 nt, Homo sapiens
ucuucggcuugugaggcuucc

SEQ ID NO: 2111043 - RNA, 21 nt, Homo sapiens
aagaauuucccagugaaauaa

SEQ ID NO: 2111044 - RNA, 20 nt, Homo sapiens
acugaucacccaaugcauca

SEQ ID NO: 2111045 - RNA, 16 nt, Homo sapiens
uugcaaccccaucauc

SEQ ID NO: 2111046 - RNA, 22 nt, Homo sapiens
caauuucauuuuuggcagucua

SEQ ID NO: 2111047 - RNA, 18 nt, Homo sapiens
aauguccauucuuuauca

SEQ ID NO: 2111048 - RNA, 20 nt, Homo sapiens
caguggugaagaaaacuccu

SEQ ID NO: 2111049 - RNA, 14 nt, Homo sapiens
acagccaacagcua

SEQ ID NO: 2111050 - RNA, 13 nt, Homo sapiens
ugcucagcacagg

SEQ ID NO: 2111051 - RNA, 19 nt, Homo sapiens
aaucauauaauaaauguac

SEQ ID NO: 2111052 - RNA, 20 nt, Homo sapiens
gcacacaccaccaugcucaa

SEQ ID NO: 2111053 - RNA, 15 nt, Homo sapiens
gucaguuagcaucau

SEQ ID NO: 2111054 - RNA, 13 nt, Homo sapiens
cagggcagggaaa

SEQ ID NO: 2111055 - RNA, 22 nt, Homo sapiens
cacuugggauugucuuacuguu

SEQ ID NO: 2111056 - RNA, 22 nt, Homo sapiens
uacacuuguauaaauguauaua

SEQ ID NO: 2111057 - RNA, 13 nt, Homo sapiens
accuuucccucac

SEQ ID NO: 2111058 - RNA, 14 nt, Homo sapiens
caaauccucuccag

SEQ ID NO: 2111059 - RNA, 13 nt, Homo sapiens
auagcugcuuccg

SEQ ID NO: 2111060 - RNA, 21 nt, Homo sapiens
aagaggcugccccucucacca

SEQ ID NO: 2111061 - RNA, 13 nt, Homo sapiens
uaggacugcugac

SEQ ID NO: 2111062 - RNA, 19 nt, Homo sapiens
ucaauaaagaaagauggaa

SEQ ID NO: 2111063 - RNA, 14 nt, Homo sapiens
agguaaaaacugga

SEQ ID NO: 2111064 - RNA, 14 nt, Homo sapiens
aacugcauugagaa

SEQ ID NO: 2111065 - RNA, 19 nt, Homo sapiens
caugagcugcucauuacag

SEQ ID NO: 2111066 - RNA, 15 nt, Homo sapiens
aagaaaacccaacuc

SEQ ID NO: 2111067 - RNA, 16 nt, Homo sapiens
ucuaaaacagcuauuu

SEQ ID NO: 2111068 - RNA, 14 nt, Homo sapiens
gcuucaugacauuc

SEQ ID NO: 2111069 - RNA, 20 nt, Homo sapiens
cauggccgggcccucuguag

SEQ ID NO: 2111070 - RNA, 21 nt, Homo sapiens
cacuucugacagccucaguga

SEQ ID NO: 2111071 - RNA, 21 nt, Homo sapiens
cuccuucccaccccuacacac

SEQ ID NO: 2111072 - RNA, 17 nt, Homo sapiens
agcagccaauugggaag

SEQ ID NO: 2111073 - RNA, 14 nt, Homo sapiens
gggcuucaggucuc

SEQ ID NO: 2111074 - RNA, 22 nt, Homo sapiens
cgugccugagucccaauuacau

SEQ ID NO: 2111075 - RNA, 17 nt, Homo sapiens
gaucuugcucuaucuca

SEQ ID NO: 2111076 - RNA, 16 nt, Homo sapiens
augacacucuagucaa

SEQ ID NO: 2111077 - RNA, 17 nt, Homo sapiens
cucagggcagccucccc

SEQ ID NO: 2111078 - RNA, 16 nt, Homo sapiens
ccugauacuggguaca

SEQ ID NO: 2111079 - RNA, 20 nt, Homo sapiens
gagugugcagacagcuauuu

SEQ ID NO: 2111080 - RNA, 15 nt, Homo sapiens
ccuaaacauaugaau

SEQ ID NO: 2111081 - RNA, 22 nt, Homo sapiens
guauccuuguagcaaagcacau

SEQ ID NO: 2111082 - RNA, 21 nt, Homo sapiens
gagaucgugcuacugcacucc

SEQ ID NO: 2111083 - RNA, 13 nt, Homo sapiens
agaauucuacccu

SEQ ID NO: 2111084 - RNA, 16 nt, Homo sapiens
gugcaaccaucaccag

SEQ ID NO: 2111085 - RNA, 15 nt, Homo sapiens
uauuuggugaugaga

SEQ ID NO: 2111086 - RNA, 18 nt, Homo sapiens
ggcugggccccuccagga

SEQ ID NO: 2111087 - RNA, 15 nt, Homo sapiens
aucaucaaucuuuau

SEQ ID NO: 2111088 - RNA, 22 nt, Homo sapiens
auccacauuguuaggugcugac

SEQ ID NO: 2111089 - RNA, 17 nt, Homo sapiens
uucuaaagcucugacau

SEQ ID NO: 2111090 - RNA, 20 nt, Homo sapiens
uaucuuccagaaacuacaug

SEQ ID NO: 2111091 - RNA, 15 nt, Homo sapiens
agucgcugugccaca

SEQ ID NO: 2111092 - RNA, 15 nt, Homo sapiens
cucauugaugucaaa

SEQ ID NO: 2111093 - RNA, 20 nt, Homo sapiens
aggggaucuggaagggccaa

SEQ ID NO: 2111094 - RNA, 13 nt, Homo sapiens
aaaguuccuguca

SEQ ID NO: 2111095 - RNA, 21 nt, Homo sapiens
agaggcuauuccuaggccuca

SEQ ID NO: 2111096 - RNA, 14 nt, Homo sapiens
cccccugcugccau

SEQ ID NO: 2111097 - RNA, 17 nt, Homo sapiens
cuacugcagcaccucca

SEQ ID NO: 2111098 - RNA, 18 nt, Homo sapiens
cagaaugcugcaggacuu

SEQ ID NO: 2111099 - RNA, 19 nt, Homo sapiens
aucaccugcgugucccauc

SEQ ID NO: 2111100 - RNA, 18 nt, Homo sapiens
uccccaggggaaaaugaa

SEQ ID NO: 2111101 - RNA, 13 nt, Homo sapiens
gcuagcaacauac

SEQ ID NO: 2111102 - RNA, 19 nt, Homo sapiens
cugcuuuccccugugggga

SEQ ID NO: 2111103 - RNA, 19 nt, Homo sapiens
uacuauauuuauacuguau

SEQ ID NO: 2111104 - RNA, 20 nt, Homo sapiens
gaaagaagacaaacuuugca

SEQ ID NO: 2111105 - RNA, 18 nt, Homo sapiens
gcagcaagugugcuggcc

SEQ ID NO: 2111106 - RNA, 20 nt, Homo sapiens
ucugcagccuccucugugac

SEQ ID NO: 2111107 - RNA, 19 nt, Homo sapiens
agacacgcacuucuggggc

SEQ ID NO: 2111108 - RNA, 18 nt, Homo sapiens
aguauuucaugcugggaa

SEQ ID NO: 2111109 - RNA, 15 nt, Homo sapiens
uuucuuuaugaucuu

SEQ ID NO: 2111110 - RNA, 23 nt, Homo sapiens
ggcugccuccacucccacuuccc

SEQ ID NO: 2111111 - RNA, 17 nt, Homo sapiens
auguuuguggccucaga

SEQ ID NO: 2111112 - RNA, 24 nt, Homo sapiens
ucauccuuuaagaaaaacaucugg

SEQ ID NO: 2111113 - RNA, 14 nt, Homo sapiens
uucuggggcuucag

SEQ ID NO: 2111114 - RNA, 16 nt, Homo sapiens
auuucuaggacugaau

SEQ ID NO: 2111115 - RNA, 18 nt, Homo sapiens
uuccuuaugggaucauuu

SEQ ID NO: 2111116 - RNA, 22 nt, Homo sapiens
auacacacacacgcgugcacac

SEQ ID NO: 2111117 - RNA, 20 nt, Homo sapiens
ugcuuauguaugccuauuca

SEQ ID NO: 2111118 - RNA, 18 nt, Homo sapiens
gaaaauacacuuauuuca

SEQ ID NO: 2111119 - RNA, 23 nt, Homo sapiens
gaccucagcuuugauauuucacu

SEQ ID NO: 2111120 - RNA, 22 nt, Homo sapiens
uccuucccacccccaguccugu

SEQ ID NO: 2111121 - RNA, 17 nt, Homo sapiens
augaaauauagauguua

SEQ ID NO: 2111122 - RNA, 15 nt, Homo sapiens
agacugcuccugagc

SEQ ID NO: 2111123 - RNA, 13 nt, Homo sapiens
uagugcuacaggg

SEQ ID NO: 2111124 - RNA, 13 nt, Homo sapiens
ggcuccagcgugg

SEQ ID NO: 2111125 - RNA, 17 nt, Homo sapiens
uacaauuuacaaagugu

SEQ ID NO: 2111126 - RNA, 18 nt, Homo sapiens
gcaggauccuugccucca

SEQ ID NO: 2111127 - RNA, 16 nt, Homo sapiens
aguaccccugggaggu

SEQ ID NO: 2111128 - RNA, 18 nt, Homo sapiens
auugguguugacauacau

SEQ ID NO: 2111129 - RNA, 15 nt, Homo sapiens
auuugugagacugua

SEQ ID NO: 2111130 - RNA, 16 nt, Homo sapiens
acugcaggggcugcag

SEQ ID NO: 2111131 - RNA, 17 nt, Homo sapiens
cgucccuccacguucac

SEQ ID NO: 2111132 - RNA, 17 nt, Homo sapiens
gauuccuaaaacucugc

SEQ ID NO: 2111133 - RNA, 16 nt, Homo sapiens
ugaagaagauauguga

SEQ ID NO: 2111134 - RNA, 18 nt, Homo sapiens
gaaaauggagccaugaca

SEQ ID NO: 2111135 - RNA, 13 nt, Homo sapiens
aauugucugccau

SEQ ID NO: 2111136 - RNA, 15 nt, Homo sapiens
ucagagaaggccuua

SEQ ID NO: 2111137 - RNA, 19 nt, Homo sapiens
ucucccaggcuggagugca

SEQ ID NO: 2111138 - RNA, 15 nt, Homo sapiens
caucuuuaacacagc

SEQ ID NO: 2111139 - RNA, 15 nt, Homo sapiens
ugccuugcugugaaa

SEQ ID NO: 2111140 - RNA, 13 nt, Homo sapiens
agaacccacagug

SEQ ID NO: 2111141 - RNA, 13 nt, Homo sapiens
ugaaaucccauca

SEQ ID NO: 2111142 - RNA, 19 nt, Homo sapiens
cauaaaaauuuuuccugag

SEQ ID NO: 2111143 - RNA, 19 nt, Homo sapiens
caaagaaagagauguuaag

SEQ ID NO: 2111144 - RNA, 18 nt, Homo sapiens
auaugagccuuugcacag

SEQ ID NO: 2111145 - RNA, 22 nt, Homo sapiens
aaaaaggucucaccacauacca

SEQ ID NO: 2111146 - RNA, 14 nt, Homo sapiens
gcgucuccugccca

SEQ ID NO: 2111147 - RNA, 14 nt, Homo sapiens
gcuccuggaaccaa

SEQ ID NO: 2111148 - RNA, 15 nt, Homo sapiens
cacuauuuccaaaag

SEQ ID NO: 2111149 - RNA, 15 nt, Homo sapiens
aaagccacaaaguca

SEQ ID NO: 2111150 - RNA, 18 nt, Homo sapiens
cagccucccauccagggc

SEQ ID NO: 2111151 - RNA, 16 nt, Homo sapiens
gcacugcucauaaacu

SEQ ID NO: 2111152 - RNA, 19 nt, Homo sapiens
agccacaccuuuuccagga

SEQ ID NO: 2111153 - RNA, 18 nt, Homo sapiens
aauuuauaaauauauuca

SEQ ID NO: 2111154 - RNA, 23 nt, Homo sapiens
gagucugggcaaugaaaccaaag

SEQ ID NO: 2111155 - RNA, 22 nt, Homo sapiens
ccuaguccccagccugcucccu

SEQ ID NO: 2111156 - RNA, 19 nt, Homo sapiens
ggcaaaguguaguguuaua

SEQ ID NO: 2111157 - RNA, 15 nt, Homo sapiens
ucauccuguaaaggu

SEQ ID NO: 2111158 - RNA, 16 nt, Homo sapiens
aagccucgacugagcu

SEQ ID NO: 2111159 - RNA, 23 nt, Homo sapiens
agauuuaagccuugacacacugu

SEQ ID NO: 2111160 - RNA, 21 nt, Homo sapiens
auuguauuuaccuucuaccuc

SEQ ID NO: 2111161 - RNA, 21 nt, Homo sapiens
ucuacacauauaaacacagua

SEQ ID NO: 2111162 - RNA, 13 nt, Homo sapiens
cccaaaugcaaac

SEQ ID NO: 2111163 - RNA, 21 nt, Homo sapiens
agggggaugccacuccucccu

SEQ ID NO: 2111164 - RNA, 21 nt, Homo sapiens
aggaggacgguuaacuuguau

SEQ ID NO: 2111165 - RNA, 11 nt, Homo sapiens
acccugugaua

SEQ ID NO: 2111166 - RNA, 12 nt, Homo sapiens
aacugugcugaa

SEQ ID NO: 2111167 - RNA, 12 nt, Homo sapiens
ugccucugcucu

SEQ ID NO: 2111168 - RNA, 14 nt, Homo sapiens
ucagagcacagcag

SEQ ID NO: 2111169 - RNA, 15 nt, Homo sapiens
uccuccuuccaugga

SEQ ID NO: 2111170 - RNA, 14 nt, Homo sapiens
aaaccuuagcuccc

SEQ ID NO: 2111171 - RNA, 18 nt, Homo sapiens
uuggcuuaaauaaucucu

SEQ ID NO: 2111172 - RNA, 21 nt, Homo sapiens
acaccuggcacugcugugcug

SEQ ID NO: 2111173 - RNA, 15 nt, Homo sapiens
gucuguugcugccac

SEQ ID NO: 2111174 - RNA, 23 nt, Homo sapiens
gucuccucaauuuuugucucaga

SEQ ID NO: 2111175 - RNA, 20 nt, Homo sapiens
ucaauuuugucuguacucau

SEQ ID NO: 2111176 - RNA, 23 nt, Homo sapiens
ggcggaggcccgcagagcacaga

SEQ ID NO: 2111177 - RNA, 19 nt, Homo sapiens
agcaagguggacaucuuca

SEQ ID NO: 2111178 - RNA, 21 nt, Homo sapiens
cacucuucuguaaauagauga

SEQ ID NO: 2111179 - RNA, 15 nt, Homo sapiens
guuuguauuuggcca

SEQ ID NO: 2111180 - RNA, 15 nt, Homo sapiens
agaccuggaaccaga

SEQ ID NO: 2111181 - RNA, 15 nt, Homo sapiens
aacccuggagacaga

SEQ ID NO: 2111182 - RNA, 14 nt, Homo sapiens
agggucgugcuccg

SEQ ID NO: 2111183 - RNA, 16 nt, Homo sapiens
gcaaauaaaagcauuu

SEQ ID NO: 2111184 - RNA, 15 nt, Homo sapiens
ucuguacuaucuuac

SEQ ID NO: 2111185 - RNA, 11 nt, Homo sapiens
agccgggaccc

SEQ ID NO: 2111186 - RNA, 20 nt, Homo sapiens
guugcguggacucugcacau

SEQ ID NO: 2111187 - RNA, 19 nt, Homo sapiens
uauuuuacuuuucugccaa

SEQ ID NO: 2111188 - RNA, 20 nt, Homo sapiens
gcgcccagggucgucuuugu

SEQ ID NO: 2111189 - RNA, 22 nt, Homo sapiens
cgcuucuccaaugcucuggagu

SEQ ID NO: 2111190 - RNA, 19 nt, Homo sapiens
uauuugcacuauuuccaca

SEQ ID NO: 2111191 - RNA, 12 nt, Homo sapiens
ucagugccaacu

SEQ ID NO: 2111192 - RNA, 15 nt, Homo sapiens
ccuaaaugaccucag

SEQ ID NO: 2111193 - RNA, 16 nt, Homo sapiens
cucagccacugaagua

SEQ ID NO: 2111194 - RNA, 20 nt, Homo sapiens
gccaagaucgccccacugca

SEQ ID NO: 2111195 - RNA, 22 nt, Homo sapiens
gauguaagucucaacucugucc

SEQ ID NO: 2111196 - RNA, 21 nt, Homo sapiens
ggcccaagugaggagugccag

SEQ ID NO: 2111197 - RNA, 19 nt, Homo sapiens
uaaguguuagagggaacag

SEQ ID NO: 2111198 - RNA, 17 nt, Homo sapiens
aguuuuugauagcuuua

SEQ ID NO: 2111199 - RNA, 23 nt, Homo sapiens
ucaugucuauaaucccagcacuu

SEQ ID NO: 2111200 - RNA, 17 nt, Homo sapiens
ccuugacuuugcuccuc

SEQ ID NO: 2111201 - RNA, 18 nt, Homo sapiens
ucuaauucggauuugcca

SEQ ID NO: 2111202 - RNA, 16 nt, Homo sapiens
acuggaauagauuccg

SEQ ID NO: 2111203 - RNA, 23 nt, Homo sapiens
agccgagauugcgccauugcacu

SEQ ID NO: 2111204 - RNA, 10 nt, Homo sapiens
caacugagag

SEQ ID NO: 2111205 - RNA, 16 nt, Homo sapiens
caacuaaguucaggga

SEQ ID NO: 2111206 - RNA, 19 nt, Homo sapiens
acaucacucucaccuucca

SEQ ID NO: 2111207 - RNA, 23 nt, Homo sapiens
cauuuauaaaaggagcaaucaua

SEQ ID NO: 2111208 - RNA, 13 nt, Homo sapiens
auauuucagugac

SEQ ID NO: 2111209 - RNA, 15 nt, Homo sapiens
aaagcaaaugggaga

SEQ ID NO: 2111210 - RNA, 13 nt, Homo sapiens
uaaaaagguuuaa

SEQ ID NO: 2111211 - RNA, 15 nt, Homo sapiens
uuuagagaaagagaa

SEQ ID NO: 2111212 - RNA, 15 nt, Homo sapiens
aagccaaauuuccag

SEQ ID NO: 2111213 - RNA, 15 nt, Homo sapiens
uauugcgaaugugca

SEQ ID NO: 2111214 - RNA, 19 nt, Homo sapiens
agaaauucuguuaauguua

SEQ ID NO: 2111215 - RNA, 22 nt, Homo sapiens
gccagggaacccacagagucac

SEQ ID NO: 2111216 - RNA, 22 nt, Homo sapiens
ugugacaauggcaacaauuuga

SEQ ID NO: 2111217 - RNA, 12 nt, Homo sapiens
gcacaugcacac

SEQ ID NO: 2111218 - RNA, 12 nt, Homo sapiens
gucaaugcauca

SEQ ID NO: 2111219 - RNA, 21 nt, Homo sapiens
aaauucccauuccaccacagu

SEQ ID NO: 2111220 - RNA, 22 nt, Homo sapiens
cagacacacacacacacacaaa

SEQ ID NO: 2111221 - RNA, 15 nt, Homo sapiens
uggaugaaaaaagcc

SEQ ID NO: 2111222 - RNA, 16 nt, Homo sapiens
gcugugaugugcaaag

SEQ ID NO: 2111223 - RNA, 22 nt, Homo sapiens
cccagggcccuaacgggggugc

SEQ ID NO: 2111224 - RNA, 16 nt, Homo sapiens
cuuuugguaugugaca

SEQ ID NO: 2111225 - RNA, 13 nt, Homo sapiens
gcaguuugccacc

SEQ ID NO: 2111226 - RNA, 18 nt, Homo sapiens
aggacuccccaggagcac

SEQ ID NO: 2111227 - RNA, 19 nt, Homo sapiens
ugagcaagaugauguaaug

SEQ ID NO: 2111228 - RNA, 12 nt, Homo sapiens
ccugucagcucc

SEQ ID NO: 2111229 - RNA, 20 nt, Homo sapiens
auggcccugggagagccaga

SEQ ID NO: 2111230 - RNA, 21 nt, Homo sapiens
aaauaaaguacuaaaucucac

SEQ ID NO: 2111231 - RNA, 17 nt, Homo sapiens
cauucauuuauucauuc

SEQ ID NO: 2111232 - RNA, 17 nt, Homo sapiens
uacauacauacauacau

SEQ ID NO: 2111233 - RNA, 17 nt, Homo sapiens
auacuucaauacuucau

SEQ ID NO: 2111234 - RNA, 17 nt, Homo sapiens
ucucucugucucucugu

SEQ ID NO: 2111235 - RNA, 15 nt, Homo sapiens
uaaauuauaguguag

SEQ ID NO: 2111236 - RNA, 14 nt, Homo sapiens
cuaauaguuuuauu

SEQ ID NO: 2111237 - RNA, 20 nt, Homo sapiens
cugaaauugaaaaguuauuu

SEQ ID NO: 2111238 - RNA, 16 nt, Homo sapiens
cacagagggaagccau

SEQ ID NO: 2111239 - RNA, 16 nt, Homo sapiens
auuuuuuggugcuaau

SEQ ID NO: 2111240 - RNA, 22 nt, Homo sapiens
uucaacuuggugacacucuaua

SEQ ID NO: 2111241 - RNA, 16 nt, Homo sapiens
agggaauggagcucag

SEQ ID NO: 2111242 - RNA, 16 nt, Homo sapiens
agaguggguuucacaa

SEQ ID NO: 2111243 - RNA, 20 nt, Homo sapiens
ggacuccauccaccucauca

SEQ ID NO: 2111244 - RNA, 14 nt, Homo sapiens
aggcugugccuugg

SEQ ID NO: 2111245 - RNA, 14 nt, Homo sapiens
caguuuugccuuaa

SEQ ID NO: 2111246 - RNA, 18 nt, Homo sapiens
ugucccagaaugccuccu

SEQ ID NO: 2111247 - RNA, 18 nt, Homo sapiens
ucugcaugcuccucugcc

SEQ ID NO: 2111248 - RNA, 15 nt, Homo sapiens
uaaugcacucugggu

SEQ ID NO: 2111249 - RNA, 18 nt, Homo sapiens
cuccacgaugccuuugag

SEQ ID NO: 2111250 - RNA, 17 nt, Homo sapiens
caaaaugcuucugcaca

SEQ ID NO: 2111251 - RNA, 16 nt, Homo sapiens
cuuuuuuccugucaau

SEQ ID NO: 2111252 - RNA, 19 nt, Homo sapiens
cucuugauuaagaucucag

SEQ ID NO: 2111253 - RNA, 14 nt, Homo sapiens
ugagaaaguucuca

SEQ ID NO: 2111254 - RNA, 22 nt, Homo sapiens
acuagagcugggaaacagggag

SEQ ID NO: 2111255 - RNA, 19 nt, Homo sapiens
ucacuaggaugcagaugga

SEQ ID NO: 2111256 - RNA, 18 nt, Homo sapiens
gcucccauguaccagcag

SEQ ID NO: 2111257 - RNA, 15 nt, Homo sapiens
uggggaagauggagc

SEQ ID NO: 2111258 - RNA, 22 nt, Homo sapiens
gagucagaucuuucuccuugaa

SEQ ID NO: 2111259 - RNA, 17 nt, Homo sapiens
auauuggccaaacuggu

SEQ ID NO: 2111260 - RNA, 19 nt, Homo sapiens
aggcagguagaucacuuga

SEQ ID NO: 2111261 - RNA, 20 nt, Homo sapiens
cucaauaaggcagugcagug

SEQ ID NO: 2111262 - RNA, 16 nt, Homo sapiens
auaggaaaaaaacugg

SEQ ID NO: 2111263 - RNA, 13 nt, Homo sapiens
uccuuacuugcac

SEQ ID NO: 2111264 - RNA, 21 nt, Homo sapiens
auacccacagguucuaugauu

SEQ ID NO: 2111265 - RNA, 21 nt, Homo sapiens
ucuuggagcgagcagaugcaa

SEQ ID NO: 2111266 - RNA, 19 nt, Homo sapiens
aggaaucaccccucugccc

SEQ ID NO: 2111267 - RNA, 17 nt, Homo sapiens
caggcgcaguggcucau

SEQ ID NO: 2111268 - RNA, 22 nt, Homo sapiens
aacuagcaaugccugagccuga

SEQ ID NO: 2111269 - RNA, 16 nt, Homo sapiens
uccauugccuagcucu

SEQ ID NO: 2111270 - RNA, 22 nt, Homo sapiens
agauuaugugacuugcaauaaa

SEQ ID NO: 2111271 - RNA, 20 nt, Homo sapiens
cagagaaucauacuuagcaa

SEQ ID NO: 2111272 - RNA, 16 nt, Homo sapiens
uucagucaucaucuca

SEQ ID NO: 2111273 - RNA, 14 nt, Homo sapiens
ccgcucucucugag

SEQ ID NO: 2111274 - RNA, 15 nt, Homo sapiens
uucaaaaacuaaaau

SEQ ID NO: 2111275 - RNA, 12 nt, Homo sapiens
cuuggguccuga

SEQ ID NO: 2111276 - RNA, 17 nt, Homo sapiens
augcuggcugguggaac

SEQ ID NO: 2111277 - RNA, 11 nt, Homo sapiens
ucuuagcucau

SEQ ID NO: 2111278 - RNA, 15 nt, Homo sapiens
gaaugugauauuuga

SEQ ID NO: 2111279 - RNA, 18 nt, Homo sapiens
ccaauccucccuggagaa

SEQ ID NO: 2111280 - RNA, 16 nt, Homo sapiens
cacccacuaccauaca

SEQ ID NO: 2111281 - RNA, 12 nt, Homo sapiens
accucugaccaa

SEQ ID NO: 2111282 - RNA, 17 nt, Homo sapiens
cccaaagugugacucau

SEQ ID NO: 2111283 - RNA, 18 nt, Homo sapiens
gcuuuacauggguucaau

SEQ ID NO: 2111284 - RNA, 15 nt, Homo sapiens
aauaauaugaugcca

SEQ ID NO: 2111285 - RNA, 22 nt, Homo sapiens
uagauguaucaaaauacuacca

SEQ ID NO: 2111286 - RNA, 17 nt, Homo sapiens
auuuuuuuucuguuaua

SEQ ID NO: 2111287 - RNA, 15 nt, Homo sapiens
ugucuucaauggaau

SEQ ID NO: 2111288 - RNA, 19 nt, Homo sapiens
cuuuguauacaaguacugg

SEQ ID NO: 2111289 - RNA, 21 nt, Homo sapiens
augcuaagaaugcauuauuga

SEQ ID NO: 2111290 - RNA, 18 nt, Homo sapiens
agguggggggauuacccg

SEQ ID NO: 2111291 - RNA, 18 nt, Homo sapiens
acgaagcuuaguauaaac

SEQ ID NO: 2111292 - RNA, 23 nt, Homo sapiens
aaauuuguaccucuaaguacaua

SEQ ID NO: 2111293 - RNA, 12 nt, Homo sapiens
caucuacuacag

SEQ ID NO: 2111294 - RNA, 23 nt, Homo sapiens
aauaaccggauauauacauagca

SEQ ID NO: 2111295 - RNA, 14 nt, Homo sapiens
gaaaauccuaccaa

SEQ ID NO: 2111296 - RNA, 15 nt, Homo sapiens
ugcacauugugcagg

SEQ ID NO: 2111297 - RNA, 17 nt, Homo sapiens
agagcuauuauuuacuc

SEQ ID NO: 2111298 - RNA, 13 nt, Homo sapiens
aaugaucuuggcu

SEQ ID NO: 2111299 - RNA, 13 nt, Homo sapiens
auagcccugugaa

SEQ ID NO: 2111300 - RNA, 23 nt, Homo sapiens
ugccacaccagucacaugaccug

SEQ ID NO: 2111301 - RNA, 12 nt, Homo sapiens
uauuuacacaua

SEQ ID NO: 2111302 - RNA, 18 nt, Homo sapiens
agaccaaagcauugccug

SEQ ID NO: 2111303 - RNA, 22 nt, Homo sapiens
uauuugcacaaguucagugaga

SEQ ID NO: 2111304 - RNA, 19 nt, Homo sapiens
acgugcauccuuguaauac

SEQ ID NO: 2111305 - RNA, 19 nt, Homo sapiens
uucucauauuagauuacua

SEQ ID NO: 2111306 - RNA, 23 nt, Homo sapiens
caauuugggucccagcuaaagag

SEQ ID NO: 2111307 - RNA, 23 nt, Homo sapiens
agagcuaagagcaguacucugaa

SEQ ID NO: 2111308 - RNA, 23 nt, Homo sapiens
aggacuggggcuugccaggcuug

SEQ ID NO: 2111309 - RNA, 15 nt, Homo sapiens
agaagacaaagucua

SEQ ID NO: 2111310 - RNA, 19 nt, Homo sapiens
gacacuaagaaugaggaau

SEQ ID NO: 2111311 - RNA, 17 nt, Homo sapiens
cacaggcugagugcagg

SEQ ID NO: 2111312 - RNA, 20 nt, Homo sapiens
guggcagacaucggccucca

SEQ ID NO: 2111313 - RNA, 12 nt, Homo sapiens
aucccaucccau

SEQ ID NO: 2111314 - RNA, 19 nt, Homo sapiens
ccuaguggggaggggccug

SEQ ID NO: 2111315 - RNA, 23 nt, Homo sapiens
guaucuuuugaacuggcaauugu

SEQ ID NO: 2111316 - RNA, 13 nt, Homo sapiens
aggcaggggacaa

SEQ ID NO: 2111317 - RNA, 11 nt, Homo sapiens
gcccuuccuuc

SEQ ID NO: 2111318 - RNA, 21 nt, Homo sapiens
augaaaugucuggucugucca

SEQ ID NO: 2111319 - RNA, 16 nt, Homo sapiens
gcccacuagacccacu

SEQ ID NO: 2111320 - RNA, 15 nt, Homo sapiens
ucuuaccaugcauuu

SEQ ID NO: 2111321 - RNA, 17 nt, Homo sapiens
ugauaacauuuucccaa

SEQ ID NO: 2111322 - RNA, 23 nt, Homo sapiens
gggcccacaauggagugggagau

SEQ ID NO: 2111323 - RNA, 18 nt, Homo sapiens
cccuggcuugagugaucc

SEQ ID NO: 2111324 - RNA, 19 nt, Homo sapiens
caagggggacugucuuuca

SEQ ID NO: 2111325 - RNA, 21 nt, Homo sapiens
gcaguaucucccauaaacaaa

SEQ ID NO: 2111326 - RNA, 20 nt, Homo sapiens
cuucccuggcaugauggaca

SEQ ID NO: 2111327 - RNA, 17 nt, Homo sapiens
uggagucaccuguaaau

SEQ ID NO: 2111328 - RNA, 17 nt, Homo sapiens
gaacaguuuuggcauaa

SEQ ID NO: 2111329 - RNA, 15 nt, Homo sapiens
cugugugcgugcgca

SEQ ID NO: 2111330 - RNA, 13 nt, Homo sapiens
aguaguagcugaa

SEQ ID NO: 2111331 - RNA, 14 nt, Homo sapiens
acuaucauucucag

SEQ ID NO: 2111332 - RNA, 12 nt, Homo sapiens
acccccaagaaa

SEQ ID NO: 2111333 - RNA, 23 nt, Homo sapiens
agacaaaaauaucaauggugcug

SEQ ID NO: 2111334 - RNA, 12 nt, Homo sapiens
aagcuaauguga

SEQ ID NO: 2111335 - RNA, 18 nt, Homo sapiens
ucuauuuuucaaucauca

SEQ ID NO: 2111336 - RNA, 16 nt, Homo sapiens
ucauaaagucuugccu

SEQ ID NO: 2111337 - RNA, 17 nt, Homo sapiens
cuuuauuggucuugccc

SEQ ID NO: 2111338 - RNA, 22 nt, Homo sapiens
aauuuauauucauaaaguuaca

SEQ ID NO: 2111339 - RNA, 17 nt, Homo sapiens
cuuuaugggaacccucu

SEQ ID NO: 2111340 - RNA, 21 nt, Homo sapiens
gccauugaaaugucaaauuga

SEQ ID NO: 2111341 - RNA, 19 nt, Homo sapiens
ugcuggacaguaucacugu

SEQ ID NO: 2111342 - RNA, 19 nt, Homo sapiens
guuauaaaucaaugucacu

SEQ ID NO: 2111343 - RNA, 18 nt, Homo sapiens
ugugaugauuaauacaau

SEQ ID NO: 2111344 - RNA, 20 nt, Homo sapiens
ugcagcucuugggaccgugu

SEQ ID NO: 2111345 - RNA, 13 nt, Homo sapiens
cauuuuauagaau

SEQ ID NO: 2111346 - RNA, 16 nt, Homo sapiens
aaauggauguaauaua

SEQ ID NO: 2111347 - RNA, 16 nt, Homo sapiens
gcacaucucugcagua

SEQ ID NO: 2111348 - RNA, 20 nt, Homo sapiens
uggcaagucaguggggacag

SEQ ID NO: 2111349 - RNA, 18 nt, Homo sapiens
cacuuauuucagccaaaa

SEQ ID NO: 2111350 - RNA, 21 nt, Homo sapiens
gagaagugccuucuccuuccc

SEQ ID NO: 2111351 - RNA, 15 nt, Homo sapiens
cagggcagccaggga

SEQ ID NO: 2111352 - RNA, 15 nt, Homo sapiens
acauucaauuugcua

SEQ ID NO: 2111353 - RNA, 14 nt, Homo sapiens
uagcucauccuuua

SEQ ID NO: 2111354 - RNA, 16 nt, Homo sapiens
auaaauuacagucauc

SEQ ID NO: 2111355 - RNA, 14 nt, Homo sapiens
cugccaaacacauu

SEQ ID NO: 2111356 - RNA, 18 nt, Homo sapiens
acuguucuugacaaucau

SEQ ID NO: 2111357 - RNA, 22 nt, Homo sapiens
agcucaaagcguggacaggugu

SEQ ID NO: 2111358 - RNA, 15 nt, Homo sapiens
uccuuggcagaggca

SEQ ID NO: 2111359 - RNA, 19 nt, Homo sapiens
ugucuggcacuugggacaa

SEQ ID NO: 2111360 - RNA, 17 nt, Homo sapiens
accaauccauuacagcu

SEQ ID NO: 2111361 - RNA, 17 nt, Homo sapiens
uucccagcccucauccc

SEQ ID NO: 2111362 - RNA, 12 nt, Homo sapiens
agaaaucacuga

SEQ ID NO: 2111363 - RNA, 20 nt, Homo sapiens
uucaugugagaaagcuaaaa

SEQ ID NO: 2111364 - RNA, 19 nt, Homo sapiens
caagaaauccaguuuccca

SEQ ID NO: 2111365 - RNA, 20 nt, Homo sapiens
cuguauuuaacaaaaagugc

SEQ ID NO: 2111366 - RNA, 18 nt, Homo sapiens
cuauccugcgggaucacu

SEQ ID NO: 2111367 - RNA, 16 nt, Homo sapiens
auuagaaaccaugaaa

SEQ ID NO: 2111368 - RNA, 16 nt, Homo sapiens
ccaaauaaauuuauaa

SEQ ID NO: 2111369 - RNA, 14 nt, Homo sapiens
agaccuguuggccu

SEQ ID NO: 2111370 - RNA, 22 nt, Homo sapiens
cuguuccauaggaaggcuguga

SEQ ID NO: 2111371 - RNA, 22 nt, Homo sapiens
ucagaggugaaagcuauaucaa

SEQ ID NO: 2111372 - RNA, 19 nt, Homo sapiens
agaauauagcaucuuucau

SEQ ID NO: 2111373 - RNA, 15 nt, Homo sapiens
uuagaaugcaucuca

SEQ ID NO: 2111374 - RNA, 19 nt, Homo sapiens
acucauucccauguuguca

SEQ ID NO: 2111375 - RNA, 22 nt, Homo sapiens
ccaggagccggacacuucucag

SEQ ID NO: 2111376 - RNA, 23 nt, Homo sapiens
acuaggcucuuaugugugccuuu

SEQ ID NO: 2111377 - RNA, 23 nt, Homo sapiens
ccugaggagggcccugaggaaua

SEQ ID NO: 2111378 - RNA, 12 nt, Homo sapiens
uauauaaaguca

SEQ ID NO: 2111379 - RNA, 19 nt, Homo sapiens
guauuucuuuagaacaaca

SEQ ID NO: 2111380 - RNA, 15 nt, Homo sapiens
aaggaaauagacuuu

SEQ ID NO: 2111381 - RNA, 23 nt, Homo sapiens
acagauucugcuagccuguucuu

SEQ ID NO: 2111382 - RNA, 20 nt, Homo sapiens
ccuccccuugaauaugggug

SEQ ID NO: 2111383 - RNA, 20 nt, Homo sapiens
uaaaaaauuaguugggcaua

SEQ ID NO: 2111384 - RNA, 20 nt, Homo sapiens
auguucuuacuuuguuuacu

SEQ ID NO: 2111385 - RNA, 11 nt, Homo sapiens
ccuccagagac

SEQ ID NO: 2111386 - RNA, 18 nt, Homo sapiens
cccaggcugcagugcaau

SEQ ID NO: 2111387 - RNA, 22 nt, Homo sapiens
cuucaugaagacuuaacuggcc

SEQ ID NO: 2111388 - RNA, 17 nt, Homo sapiens
ucagcaaugccauuuca

SEQ ID NO: 2111389 - RNA, 22 nt, Homo sapiens
aaaaggccauuuacaauugcau

SEQ ID NO: 2111390 - RNA, 23 nt, Homo sapiens
aacucacugauucucuacaugcu

SEQ ID NO: 2111391 - RNA, 19 nt, Homo sapiens
ucugcagcacgcuggacag

SEQ ID NO: 2111392 - RNA, 13 nt, Homo sapiens
gcgagacuccauc

SEQ ID NO: 2111393 - RNA, 22 nt, Homo sapiens
ucucccacauauucacauacgu

SEQ ID NO: 2111394 - RNA, 18 nt, Homo sapiens
gccaaguaacaaugcaug

SEQ ID NO: 2111395 - RNA, 17 nt, Homo sapiens
aguagacacacuaucau

SEQ ID NO: 2111396 - RNA, 21 nt, Homo sapiens
aaaccagaagaagugugagaa

SEQ ID NO: 2111397 - RNA, 13 nt, Homo sapiens
guccuccaagcuc

SEQ ID NO: 2111398 - RNA, 17 nt, Homo sapiens
auaccacuacuaaaaau

SEQ ID NO: 2111399 - RNA, 21 nt, Homo sapiens
uggagauacugauuauugagu

SEQ ID NO: 2111400 - RNA, 19 nt, Homo sapiens
ugcugauuucuacaacuga

SEQ ID NO: 2111401 - RNA, 22 nt, Homo sapiens
auuuuuaacuuaauggcacaaa

SEQ ID NO: 2111402 - RNA, 15 nt, Homo sapiens
caaaugugcauugaa

SEQ ID NO: 2111403 - RNA, 23 nt, Homo sapiens
cacuaacugggaggacauucugc

SEQ ID NO: 2111404 - RNA, 14 nt, Homo sapiens
aucauucagcaaau

SEQ ID NO: 2111405 - RNA, 21 nt, Homo sapiens
auugggacgcacagugcaguu

SEQ ID NO: 2111406 - RNA, 20 nt, Homo sapiens
gacaucagccugcuucuucc

SEQ ID NO: 2111407 - RNA, 14 nt, Homo sapiens
agacagaaugauau

SEQ ID NO: 2111408 - RNA, 21 nt, Homo sapiens
gcacugaggcagcgaccucaa

SEQ ID NO: 2111409 - RNA, 14 nt, Homo sapiens
uggaaagucaugca

SEQ ID NO: 2111410 - RNA, 15 nt, Homo sapiens
agguuuuaaagaccu

SEQ ID NO: 2111411 - RNA, 20 nt, Homo sapiens
uggagagcucaggauggcuc

SEQ ID NO: 2111412 - RNA, 11 nt, Homo sapiens
uugcuguauau

SEQ ID NO: 2111413 - RNA, 17 nt, Homo sapiens
uauaaauguacuuuucc

SEQ ID NO: 2111414 - RNA, 18 nt, Homo sapiens
auuauguuugccacuuug

SEQ ID NO: 2111415 - RNA, 16 nt, Homo sapiens
aauaccguaucuucua

SEQ ID NO: 2111416 - RNA, 20 nt, Homo sapiens
uuauugaccaauuccugaca

SEQ ID NO: 2111417 - RNA, 19 nt, Homo sapiens
uauuucaauucuaaaauac

SEQ ID NO: 2111418 - RNA, 18 nt, Homo sapiens
auguauauauacacggua

SEQ ID NO: 2111419 - RNA, 22 nt, Homo sapiens
gccugacucagcuaaugucaca

SEQ ID NO: 2111420 - RNA, 14 nt, Homo sapiens
guuguguugacaca

SEQ ID NO: 2111421 - RNA, 20 nt, Homo sapiens
acgcccaugugugagugugu

SEQ ID NO: 2111422 - RNA, 19 nt, Homo sapiens
cuuagcagcuaucucucag

SEQ ID NO: 2111423 - RNA, 18 nt, Homo sapiens
aaguuuccuuauuuucau

SEQ ID NO: 2111424 - RNA, 11 nt, Homo sapiens
aagugugcaua

SEQ ID NO: 2111425 - RNA, 14 nt, Homo sapiens
caaaccaaaucaua

SEQ ID NO: 2111426 - RNA, 16 nt, Homo sapiens
acaucuacgaagccac

SEQ ID NO: 2111427 - RNA, 14 nt, Homo sapiens
auugucuaaugaca

SEQ ID NO: 2111428 - RNA, 20 nt, Homo sapiens
cuacugagucccuggcaaga

SEQ ID NO: 2111429 - RNA, 12 nt, Homo sapiens
uuaauuccucag

SEQ ID NO: 2111430 - RNA, 19 nt, Homo sapiens
gaacucuucacucuucaaa

SEQ ID NO: 2111431 - RNA, 14 nt, Homo sapiens
caucuggggcaccu

SEQ ID NO: 2111432 - RNA, 22 nt, Homo sapiens
cuuacaauucccucuacugugu

SEQ ID NO: 2111433 - RNA, 17 nt, Homo sapiens
cacugaugcuguucucu

SEQ ID NO: 2111434 - RNA, 12 nt, Homo sapiens
uggcuagucaua

SEQ ID NO: 2111435 - RNA, 21 nt, Homo sapiens
uccagaacugucuuagucaua

SEQ ID NO: 2111436 - RNA, 22 nt, Homo sapiens
ucugcccacugugaaaccacua

SEQ ID NO: 2111437 - RNA, 12 nt, Homo sapiens
accaaacucugu

SEQ ID NO: 2111438 - RNA, 13 nt, Homo sapiens
auaaagucuugcc

SEQ ID NO: 2111439 - RNA, 15 nt, Homo sapiens
cuggcaagaaagcuu

SEQ ID NO: 2111440 - RNA, 14 nt, Homo sapiens
auacuucauucucu

SEQ ID NO: 2111441 - RNA, 23 nt, Homo sapiens
agguauuacacucuguaauugaa

SEQ ID NO: 2111442 - RNA, 20 nt, Homo sapiens
gggagcggaaagcagcucaa

SEQ ID NO: 2111443 - RNA, 13 nt, Homo sapiens
ugguauacauuga

SEQ ID NO: 2111444 - RNA, 18 nt, Homo sapiens
cugaggcaggagaauggc

SEQ ID NO: 2111445 - RNA, 18 nt, Homo sapiens
caguagcugcccuuccug

SEQ ID NO: 2111446 - RNA, 15 nt, Homo sapiens
gaaacuacauuucua

SEQ ID NO: 2111447 - RNA, 22 nt, Homo sapiens
gaagugagccagcaguggccuu

SEQ ID NO: 2111448 - RNA, 22 nt, Homo sapiens
cuuguucagcaggcuagacaga

SEQ ID NO: 2111449 - RNA, 14 nt, Homo sapiens
ugccucucucagga

SEQ ID NO: 2111450 - RNA, 14 nt, Homo sapiens
ugcaccccaugagu

SEQ ID NO: 2111451 - RNA, 19 nt, Homo sapiens
ucgaguuaaaacaaugaag

SEQ ID NO: 2111452 - RNA, 15 nt, Homo sapiens
ccuaaaagcauuuga

SEQ ID NO: 2111453 - RNA, 14 nt, Homo sapiens
uucucuuccuucac

SEQ ID NO: 2111454 - RNA, 19 nt, Homo sapiens
aaaccugccaaggagcauc

SEQ ID NO: 2111455 - RNA, 19 nt, Homo sapiens
gggcucagggaccauggcu

SEQ ID NO: 2111456 - RNA, 13 nt, Homo sapiens
ggucuucuuacau

SEQ ID NO: 2111457 - RNA, 22 nt, Homo sapiens
cugaaagcuguuggauuucagu

SEQ ID NO: 2111458 - RNA, 20 nt, Homo sapiens
ucuuccacccacgagcacuu

SEQ ID NO: 2111459 - RNA, 18 nt, Homo sapiens
uauguuaaacuagcauau

SEQ ID NO: 2111460 - RNA, 18 nt, Homo sapiens
ccauucccagauguacca

SEQ ID NO: 2111461 - RNA, 18 nt, Homo sapiens
auggcuggccacugcaca

SEQ ID NO: 2111462 - RNA, 17 nt, Homo sapiens
aguucuuggucccucca

SEQ ID NO: 2111463 - RNA, 15 nt, Homo sapiens
aauaaccuucaucaa

SEQ ID NO: 2111464 - RNA, 17 nt, Homo sapiens
acucuggagagacugug

SEQ ID NO: 2111465 - RNA, 18 nt, Homo sapiens
ugaauuauuaaugaaugc

SEQ ID NO: 2111466 - RNA, 13 nt, Homo sapiens
guuauucuugaca

SEQ ID NO: 2111467 - RNA, 22 nt, Homo sapiens
ucacccuguaauaaauaugugu

SEQ ID NO: 2111468 - RNA, 12 nt, Homo sapiens
ugaucccagaaa

SEQ ID NO: 2111469 - RNA, 13 nt, Homo sapiens
uuugagaauguuu

SEQ ID NO: 2111470 - RNA, 15 nt, Homo sapiens
agccagugacacuaa

SEQ ID NO: 2111471 - RNA, 12 nt, Homo sapiens
gggggaugcuga

SEQ ID NO: 2111472 - RNA, 20 nt, Homo sapiens
aaauacauccuuuuucugcu

SEQ ID NO: 2111473 - RNA, 21 nt, Homo sapiens
auguauguguuuagaauugaa

SEQ ID NO: 2111474 - RNA, 19 nt, Homo sapiens
aucucaaccaggauccuga

SEQ ID NO: 2111475 - RNA, 18 nt, Homo sapiens
cagacauggaacagugua

SEQ ID NO: 2111476 - RNA, 16 nt, Homo sapiens
uagagggggucucaga

SEQ ID NO: 2111477 - RNA, 19 nt, Homo sapiens
ggaagccuggaucugugug

SEQ ID NO: 2111478 - RNA, 19 nt, Homo sapiens
gagucucccuuagcgccau

SEQ ID NO: 2111479 - RNA, 17 nt, Homo sapiens
acaguaagaacaucaua

SEQ ID NO: 2111480 - RNA, 18 nt, Homo sapiens
ccucgaggcggaucuuug

SEQ ID NO: 2111481 - RNA, 15 nt, Homo sapiens
cuugcuaaagcacuu

SEQ ID NO: 2111482 - RNA, 13 nt, Homo sapiens
aacaccugccucu

SEQ ID NO: 2111483 - RNA, 16 nt, Homo sapiens
ugacuuugcuccucac

SEQ ID NO: 2111484 - RNA, 16 nt, Homo sapiens
uccacuggcuccacau

SEQ ID NO: 2111485 - RNA, 11 nt, Homo sapiens
ccaugccuguc

SEQ ID NO: 2111486 - RNA, 17 nt, Homo sapiens
guguccaggcuggucug

SEQ ID NO: 2111487 - RNA, 16 nt, Homo sapiens
ucuucuacuaccccca

SEQ ID NO: 2111488 - RNA, 21 nt, Homo sapiens
ucauuuuacucuuaugaucaa

SEQ ID NO: 2111489 - RNA, 23 nt, Homo sapiens
aaauauaaaugaaaaucuauccu

SEQ ID NO: 2111490 - RNA, 20 nt, Homo sapiens
ucccugcuggcuuucuuuuc

SEQ ID NO: 2111491 - RNA, 19 nt, Homo sapiens
uauaauacuaaagugucua

SEQ ID NO: 2111492 - RNA, 10 nt, Homo sapiens
guacauguau

SEQ ID NO: 2111493 - RNA, 10 nt, Homo sapiens
acacaugugc

SEQ ID NO: 2111494 - RNA, 10 nt, Homo sapiens
gcacauguac

SEQ ID NO: 2111495 - RNA, 12 nt, Homo sapiens
aagccuuaggga

SEQ ID NO: 2111496 - RNA, 23 nt, Homo sapiens
ucaauguuuacuuuuuugguacu

SEQ ID NO: 2111497 - RNA, 22 nt, Homo sapiens
cuuggugguuaugucccaugac

SEQ ID NO: 2111498 - RNA, 15 nt, Homo sapiens
aagcugcaucucuac

SEQ ID NO: 2111499 - RNA, 20 nt, Homo sapiens
uauguacaaauaauauugcc

SEQ ID NO: 2111500 - RNA, 21 nt, Homo sapiens
ugguauguguguguaugcuac

SEQ ID NO: 2111501 - RNA, 15 nt, Homo sapiens
aagaagaaaguguuc

SEQ ID NO: 2111502 - RNA, 14 nt, Homo sapiens
uuuguacucugcag

SEQ ID NO: 2111503 - RNA, 15 nt, Homo sapiens
auccacuuuggcagg

SEQ ID NO: 2111504 - RNA, 13 nt, Homo sapiens
gugcaaaccacuu

SEQ ID NO: 2111505 - RNA, 19 nt, Homo sapiens
cuggugucggcaucauacu

SEQ ID NO: 2111506 - RNA, 13 nt, Homo sapiens
cagcaacugaaga

SEQ ID NO: 2111507 - RNA, 15 nt, Homo sapiens
cuugugagaaaagaa

SEQ ID NO: 2111508 - RNA, 15 nt, Homo sapiens
cugagugcugaaaua

SEQ ID NO: 2111509 - RNA, 14 nt, Homo sapiens
cuuagagauugcau

SEQ ID NO: 2111510 - RNA, 13 nt, Homo sapiens
ggaucuugccaca

SEQ ID NO: 2111511 - RNA, 13 nt, Homo sapiens
guucucugcuaaa

SEQ ID NO: 2111512 - RNA, 22 nt, Homo sapiens
ccuuucuuucugaaauagucaa

SEQ ID NO: 2111513 - RNA, 21 nt, Homo sapiens
cuguuguuggucgcagcuaca

SEQ ID NO: 2111514 - RNA, 18 nt, Homo sapiens
gcugucaucugugcacug

SEQ ID NO: 2111515 - RNA, 14 nt, Homo sapiens
aaauagacauauua

SEQ ID NO: 2111516 - RNA, 18 nt, Homo sapiens
ccccaauuucggauuuuu

SEQ ID NO: 2111517 - RNA, 20 nt, Homo sapiens
aaugcaguagccagcacguu

SEQ ID NO: 2111518 - RNA, 14 nt, Homo sapiens
aaaugagcauggca

SEQ ID NO: 2111519 - RNA, 14 nt, Homo sapiens
cuaugagccaggca

SEQ ID NO: 2111520 - RNA, 19 nt, Homo sapiens
cuguccuguuucugucaag

SEQ ID NO: 2111521 - RNA, 23 nt, Homo sapiens
ugaccucagugagauauuuggua

SEQ ID NO: 2111522 - RNA, 19 nt, Homo sapiens
caacagcccugucucaaaa

SEQ ID NO: 2111523 - RNA, 14 nt, Homo sapiens
aaucaacucaaaac

SEQ ID NO: 2111524 - RNA, 21 nt, Homo sapiens
acaccuuuucuauuuaccucc

SEQ ID NO: 2111525 - RNA, 22 nt, Homo sapiens
guguccuggggaauacuggcca

SEQ ID NO: 2111526 - RNA, 15 nt, Homo sapiens
cggauguaugaucuc

SEQ ID NO: 2111527 - RNA, 17 nt, Homo sapiens
ugucacagaugcagauu

SEQ ID NO: 2111528 - RNA, 18 nt, Homo sapiens
gccagaucgggagcaaac

SEQ ID NO: 2111529 - RNA, 16 nt, Homo sapiens
aaacuuaccugagaac

SEQ ID NO: 2111530 - RNA, 18 nt, Homo sapiens
cacguauucuuguaucaa

SEQ ID NO: 2111531 - RNA, 20 nt, Homo sapiens
ucaucaucgucgucugucaa

SEQ ID NO: 2111532 - RNA, 18 nt, Homo sapiens
uuaagagcucuggugaua

SEQ ID NO: 2111533 - RNA, 22 nt, Homo sapiens
ccuaagcgggggugaaagagga

SEQ ID NO: 2111534 - RNA, 16 nt, Homo sapiens
cccagacauccuguga

SEQ ID NO: 2111535 - RNA, 19 nt, Homo sapiens
guuaauuuuauugcaaagu

SEQ ID NO: 2111536 - RNA, 14 nt, Homo sapiens
uaaacuacucuuug

SEQ ID NO: 2111537 - RNA, 22 nt, Homo sapiens
gguggcugccucauuuagagag

SEQ ID NO: 2111538 - RNA, 18 nt, Homo sapiens
ugcaacuauuuccaccuc

SEQ ID NO: 2111539 - RNA, 14 nt, Homo sapiens
cucuagugcuacug

SEQ ID NO: 2111540 - RNA, 21 nt, Homo sapiens
ucuugaggauguaaugcauua

SEQ ID NO: 2111541 - RNA, 14 nt, Homo sapiens
cccaagcuucccuc

SEQ ID NO: 2111542 - RNA, 18 nt, Homo sapiens
guccucaccuucaaaaau

SEQ ID NO: 2111543 - RNA, 13 nt, Homo sapiens
cuggaaacauaca

SEQ ID NO: 2111544 - RNA, 19 nt, Homo sapiens
cuguugaugggaugauuga

SEQ ID NO: 2111545 - RNA, 13 nt, Homo sapiens
caaaacucaguag

SEQ ID NO: 2111546 - RNA, 14 nt, Homo sapiens
aauaaagcuugcaa

SEQ ID NO: 2111547 - RNA, 18 nt, Homo sapiens
uugcuuuugccucugccc

SEQ ID NO: 2111548 - RNA, 13 nt, Homo sapiens
aguacaguauauu

SEQ ID NO: 2111549 - RNA, 21 nt, Homo sapiens
caagauugcgccguuguacuc

SEQ ID NO: 2111550 - RNA, 15 nt, Homo sapiens
aauaaaaguaaagac

SEQ ID NO: 2111551 - RNA, 21 nt, Homo sapiens
uccauuuacuuaagacuuaau

SEQ ID NO: 2111552 - RNA, 19 nt, Homo sapiens
aaagaggagaugacuacau

SEQ ID NO: 2111553 - RNA, 18 nt, Homo sapiens
guuucuuccccaaccccu

SEQ ID NO: 2111554 - RNA, 14 nt, Homo sapiens
cccuggugaaggau

SEQ ID NO: 2111555 - RNA, 16 nt, Homo sapiens
ugguuugaaagaugca

SEQ ID NO: 2111556 - RNA, 15 nt, Homo sapiens
auuugcauacauucu

SEQ ID NO: 2111557 - RNA, 13 nt, Homo sapiens
acauacagagaua

SEQ ID NO: 2111558 - RNA, 18 nt, Homo sapiens
uaacacuucaccuucugu

SEQ ID NO: 2111559 - RNA, 15 nt, Homo sapiens
agaaaggggcuagca

SEQ ID NO: 2111560 - RNA, 18 nt, Homo sapiens
ggucuaccugagaucuau

SEQ ID NO: 2111561 - RNA, 19 nt, Homo sapiens
acugagaagugcacuuuaa

SEQ ID NO: 2111562 - RNA, 15 nt, Homo sapiens
uuucucauucuugcc

SEQ ID NO: 2111563 - RNA, 18 nt, Homo sapiens
augucccgaccguugcca

SEQ ID NO: 2111564 - RNA, 15 nt, Homo sapiens
uauuaagcacuuuaa

SEQ ID NO: 2111565 - RNA, 18 nt, Homo sapiens
agccaggagaagaccccu

SEQ ID NO: 2111566 - RNA, 15 nt, Homo sapiens
auaaaccaguugaau

SEQ ID NO: 2111567 - RNA, 22 nt, Homo sapiens
auuuaugaugcacuuauucaau

SEQ ID NO: 2111568 - RNA, 14 nt, Homo sapiens
ucugaacacaggca

SEQ ID NO: 2111569 - RNA, 14 nt, Homo sapiens
uugauuacuuccac

SEQ ID NO: 2111570 - RNA, 20 nt, Homo sapiens
gcugccugguauauccaaaa

SEQ ID NO: 2111571 - RNA, 13 nt, Homo sapiens
aagguggccucug

SEQ ID NO: 2111572 - RNA, 14 nt, Homo sapiens
gauagacuucgaaa

SEQ ID NO: 2111573 - RNA, 11 nt, Homo sapiens
uuacacaagag

SEQ ID NO: 2111574 - RNA, 17 nt, Homo sapiens
auugagccaguggugcu

SEQ ID NO: 2111575 - RNA, 20 nt, Homo sapiens
ucaggagaguagcaacaaaa

SEQ ID NO: 2111576 - RNA, 24 nt, Homo sapiens
uccaaacagggguucuuagucuca

SEQ ID NO: 2111577 - RNA, 14 nt, Homo sapiens
aaggcuuuccuacc

SEQ ID NO: 2111578 - RNA, 14 nt, Homo sapiens
cagauuuuacuguc

SEQ ID NO: 2111579 - RNA, 18 nt, Homo sapiens
agguuugucaacacaaag

SEQ ID NO: 2111580 - RNA, 23 nt, Homo sapiens
cugaaagcuuuauacaguugaau

SEQ ID NO: 2111581 - RNA, 18 nt, Homo sapiens
aaugcuucuaaauaugaa

SEQ ID NO: 2111582 - RNA, 21 nt, Homo sapiens
aggccuuuggaaagacuugaa

SEQ ID NO: 2111583 - RNA, 12 nt, Homo sapiens
agcuuugcacuu

SEQ ID NO: 2111584 - RNA, 13 nt, Homo sapiens
aggcaaagacagg

SEQ ID NO: 2111585 - RNA, 20 nt, Homo sapiens
uuauuauauugccuaagaau

SEQ ID NO: 2111586 - RNA, 15 nt, Homo sapiens
aauggggugcaugaa

SEQ ID NO: 2111587 - RNA, 21 nt, Homo sapiens
cuagguugacagauacuuugu

SEQ ID NO: 2111588 - RNA, 18 nt, Homo sapiens
uagagcacuuuucacuua

SEQ ID NO: 2111589 - RNA, 13 nt, Homo sapiens
agguccaagcaca

SEQ ID NO: 2111590 - RNA, 18 nt, Homo sapiens
ugggaaagaaccacacag

SEQ ID NO: 2111591 - RNA, 22 nt, Homo sapiens
uccucuauuuguucagaucuca

SEQ ID NO: 2111592 - RNA, 14 nt, Homo sapiens
acauuaugaucuaa

SEQ ID NO: 2111593 - RNA, 13 nt, Homo sapiens
uccgucacauuca

SEQ ID NO: 2111594 - RNA, 13 nt, Homo sapiens
gcaugaagcacau

SEQ ID NO: 2111595 - RNA, 21 nt, Homo sapiens
auucagaaugaucugcaagaa

SEQ ID NO: 2111596 - RNA, 16 nt, Homo sapiens
uauaugcuuguguaac

SEQ ID NO: 2111597 - RNA, 16 nt, Homo sapiens
ggagacaugugacauu

SEQ ID NO: 2111598 - RNA, 14 nt, Homo sapiens
cuauagacuguaag

SEQ ID NO: 2111599 - RNA, 21 nt, Homo sapiens
auauuucucccaacuuaucca

SEQ ID NO: 2111600 - RNA, 23 nt, Homo sapiens
cuaaucagaguggccaaucccug

SEQ ID NO: 2111601 - RNA, 18 nt, Homo sapiens
gaaugccugucaguuuca

SEQ ID NO: 2111602 - RNA, 16 nt, Homo sapiens
accaacaaacccaacu

SEQ ID NO: 2111603 - RNA, 19 nt, Homo sapiens
auauuuuuuaaaaaacacu

SEQ ID NO: 2111604 - RNA, 22 nt, Homo sapiens
ccuguuacugaauuugcuaaua

SEQ ID NO: 2111605 - RNA, 15 nt, Homo sapiens
ugcuccagacucacu

SEQ ID NO: 2111606 - RNA, 16 nt, Homo sapiens
ucugugccgccaccuc

SEQ ID NO: 2111607 - RNA, 19 nt, Homo sapiens
gugacccugagaaggcaaa

SEQ ID NO: 2111608 - RNA, 21 nt, Homo sapiens
uuuaacagauaacagugugcu

SEQ ID NO: 2111609 - RNA, 23 nt, Homo sapiens
aaacaaaugauuuccacaaacag

SEQ ID NO: 2111610 - RNA, 13 nt, Homo sapiens
auaaaagaauugu

SEQ ID NO: 2111611 - RNA, 23 nt, Homo sapiens
ucacggagcucacccaugugcac

SEQ ID NO: 2111612 - RNA, 23 nt, Homo sapiens
agauccuggaaacagcaguguau

SEQ ID NO: 2111613 - RNA, 15 nt, Homo sapiens
ucauccuuaccgcac

SEQ ID NO: 2111614 - RNA, 15 nt, Homo sapiens
aguccuaaggccuua

SEQ ID NO: 2111615 - RNA, 16 nt, Homo sapiens
caggcgugguggcaca

SEQ ID NO: 2111616 - RNA, 14 nt, Homo sapiens
aguucuguauacag

SEQ ID NO: 2111617 - RNA, 16 nt, Homo sapiens
ggagccuggccucuca

SEQ ID NO: 2111618 - RNA, 17 nt, Homo sapiens
uugugcccaagcucacc

SEQ ID NO: 2111619 - RNA, 19 nt, Homo sapiens
uguaccaagccccuuggcc

SEQ ID NO: 2111620 - RNA, 18 nt, Homo sapiens
cuucauucaaaaagccaa

SEQ ID NO: 2111621 - RNA, 17 nt, Homo sapiens
cccuaggauaugcccuc

SEQ ID NO: 2111622 - RNA, 20 nt, Homo sapiens
ucugcuugucauucugcuaa

SEQ ID NO: 2111623 - RNA, 20 nt, Homo sapiens
gaacagacaacagaagucau

SEQ ID NO: 2111624 - RNA, 16 nt, Homo sapiens
aucagaagcaaggaag

SEQ ID NO: 2111625 - RNA, 22 nt, Homo sapiens
auuguucauugcuaguagauag

SEQ ID NO: 2111626 - RNA, 17 nt, Homo sapiens
ucuaaaggggacagauc

SEQ ID NO: 2111627 - RNA, 18 nt, Homo sapiens
uuggauuuauucugccaa

SEQ ID NO: 2111628 - RNA, 20 nt, Homo sapiens
ugugaaaagagcaaucagaa

SEQ ID NO: 2111629 - RNA, 12 nt, Homo sapiens
ggccaaauaugc

SEQ ID NO: 2111630 - RNA, 19 nt, Homo sapiens
caaaccagcuucauguggc

SEQ ID NO: 2111631 - RNA, 19 nt, Homo sapiens
cguguguuuuucuauuaaa

SEQ ID NO: 2111632 - RNA, 19 nt, Homo sapiens
aggcaagacaccuucccag

SEQ ID NO: 2111633 - RNA, 19 nt, Homo sapiens
ccucguucaaaacauucca

SEQ ID NO: 2111634 - RNA, 22 nt, Homo sapiens
ccgcuagcaguacuaaucaugu

SEQ ID NO: 2111635 - RNA, 15 nt, Homo sapiens
gcuccaggacuccac

SEQ ID NO: 2111636 - RNA, 17 nt, Homo sapiens
accuuuuguaagacauu

SEQ ID NO: 2111637 - RNA, 17 nt, Homo sapiens
acuuugcuucucuccac

SEQ ID NO: 2111638 - RNA, 19 nt, Homo sapiens
gccccacaguuguguucau

SEQ ID NO: 2111639 - RNA, 15 nt, Homo sapiens
auggcagcagugaag

SEQ ID NO: 2111640 - RNA, 15 nt, Homo sapiens
uuggagcuacugcaa

SEQ ID NO: 2111641 - RNA, 23 nt, Homo sapiens
ugcugaaaaaucauccaagacag

SEQ ID NO: 2111642 - RNA, 14 nt, Homo sapiens
gacagccuccuagg

SEQ ID NO: 2111643 - RNA, 12 nt, Homo sapiens
cgggaagggugg

SEQ ID NO: 2111644 - RNA, 22 nt, Homo sapiens
augagcuggggaugucucucau

SEQ ID NO: 2111645 - RNA, 17 nt, Homo sapiens
acucagaucacuacugc

SEQ ID NO: 2111646 - RNA, 17 nt, Homo sapiens
ucuuucuuuaccugaga

SEQ ID NO: 2111647 - RNA, 18 nt, Homo sapiens
gcaccccacacuggagcc

SEQ ID NO: 2111648 - RNA, 18 nt, Homo sapiens
cgaccagaggagccuuuu

SEQ ID NO: 2111649 - RNA, 15 nt, Homo sapiens
uacugucucuggcau

SEQ ID NO: 2111650 - RNA, 21 nt, Homo sapiens
cucuuuuuccaucauaauucu

SEQ ID NO: 2111651 - RNA, 13 nt, Homo sapiens
caaauguccaagc

SEQ ID NO: 2111652 - RNA, 12 nt, Homo sapiens
ucaggcaccuga

SEQ ID NO: 2111653 - RNA, 19 nt, Homo sapiens
ccuuuguugucuacauuaa

SEQ ID NO: 2111654 - RNA, 13 nt, Homo sapiens
cggcacagccuuc

SEQ ID NO: 2111655 - RNA, 21 nt, Homo sapiens
cagccucuucccaugcuggug

SEQ ID NO: 2111656 - RNA, 23 nt, Homo sapiens
uaaaaagucugcauuacauuccu

SEQ ID NO: 2111657 - RNA, 19 nt, Homo sapiens
aauuucauaccuaucaucu

SEQ ID NO: 2111658 - RNA, 21 nt, Homo sapiens
cuucugcuguauacuguacug

SEQ ID NO: 2111659 - RNA, 23 nt, Homo sapiens
ugaaaguaugugauaucugaaca

SEQ ID NO: 2111660 - RNA, 16 nt, Homo sapiens
acguggaugaagcaga

SEQ ID NO: 2111661 - RNA, 15 nt, Homo sapiens
uggagaguuugccug

SEQ ID NO: 2111662 - RNA, 14 nt, Homo sapiens
ggaacaaaauugaa

SEQ ID NO: 2111663 - RNA, 20 nt, Homo sapiens
ucuuggcucacuacaaccuc

SEQ ID NO: 2111664 - RNA, 15 nt, Homo sapiens
augcuucugcacaca

SEQ ID NO: 2111665 - RNA, 19 nt, Homo sapiens
cuuggaaaaaaaccacagc

SEQ ID NO: 2111666 - RNA, 16 nt, Homo sapiens
cuacaucaaaugcuca

SEQ ID NO: 2111667 - RNA, 16 nt, Homo sapiens
gggccaggauucaggc

SEQ ID NO: 2111668 - RNA, 23 nt, Homo sapiens
uugcuaucucucaagagugcuga

SEQ ID NO: 2111669 - RNA, 14 nt, Homo sapiens
uucaacgacugccg

SEQ ID NO: 2111670 - RNA, 16 nt, Homo sapiens
caagagggauaaaaca

SEQ ID NO: 2111671 - RNA, 14 nt, Homo sapiens
acaugauacugaug

SEQ ID NO: 2111672 - RNA, 16 nt, Homo sapiens
cauuucagauauucca

SEQ ID NO: 2111673 - RNA, 20 nt, Homo sapiens
accagucuauuuccacugaa

SEQ ID NO: 2111674 - RNA, 16 nt, Homo sapiens
auuuacuuaagacuua

SEQ ID NO: 2111675 - RNA, 18 nt, Homo sapiens
caguuaauacuccagaga

SEQ ID NO: 2111676 - RNA, 17 nt, Homo sapiens
guugcacagcaucucag

SEQ ID NO: 2111677 - RNA, 23 nt, Homo sapiens
aaccccugcccuuccucuucccc

SEQ ID NO: 2111678 - RNA, 21 nt, Homo sapiens
ccuuuaagccugcauucuuaa

SEQ ID NO: 2111679 - RNA, 15 nt, Homo sapiens
uuacaguaaauacac

SEQ ID NO: 2111680 - RNA, 17 nt, Homo sapiens
gucccaagcccagggac

SEQ ID NO: 2111681 - RNA, 15 nt, Homo sapiens
gauaccaugaugcug

SEQ ID NO: 2111682 - RNA, 20 nt, Homo sapiens
gcuguuguugggacauggca

SEQ ID NO: 2111683 - RNA, 15 nt, Homo sapiens
cuggguggugaagga

SEQ ID NO: 2111684 - RNA, 11 nt, Homo sapiens
guccacagggc

SEQ ID NO: 2111685 - RNA, 22 nt, Homo sapiens
ucaggccauggguucaccagcc

SEQ ID NO: 2111686 - RNA, 15 nt, Homo sapiens
aacuccugaccucag

SEQ ID NO: 2111687 - RNA, 13 nt, Homo sapiens
ugggucuguguca

SEQ ID NO: 2111688 - RNA, 23 nt, Homo sapiens
uugauaagcuauugucuguaaua

SEQ ID NO: 2111689 - RNA, 22 nt, Homo sapiens
aggcgauccaccugucucagcc

SEQ ID NO: 2111690 - RNA, 22 nt, Homo sapiens
uguguauacuguaaucgugcua

SEQ ID NO: 2111691 - RNA, 12 nt, Homo sapiens
gucuuggcucac

SEQ ID NO: 2111692 - RNA, 16 nt, Homo sapiens
gagcacuccuggugca

SEQ ID NO: 2111693 - RNA, 21 nt, Homo sapiens
gauaagcuugucuaugguaca

SEQ ID NO: 2111694 - RNA, 19 nt, Homo sapiens
aaaucuccagcuuacuaua

SEQ ID NO: 2111695 - RNA, 17 nt, Homo sapiens
acacucccacuuggcau

SEQ ID NO: 2111696 - RNA, 16 nt, Homo sapiens
ucucucacacaucaca

SEQ ID NO: 2111697 - RNA, 13 nt, Homo sapiens
aucaugugccugg

SEQ ID NO: 2111698 - RNA, 19 nt, Homo sapiens
accauccgcaaccugagga

SEQ ID NO: 2111699 - RNA, 11 nt, Homo sapiens
guauuuugcca

SEQ ID NO: 2111700 - RNA, 22 nt, Homo sapiens
uuaauaccugggugauuacaua

SEQ ID NO: 2111701 - RNA, 15 nt, Homo sapiens
gccuugcacaggaca

SEQ ID NO: 2111702 - RNA, 22 nt, Homo sapiens
uuaccacguuacugcauacuga

SEQ ID NO: 2111703 - RNA, 18 nt, Homo sapiens
cccuucccccugcaaaaa

SEQ ID NO: 2111704 - RNA, 14 nt, Homo sapiens
agauagacaaucac

SEQ ID NO: 2111705 - RNA, 17 nt, Homo sapiens
ugugaccuguaguguac

SEQ ID NO: 2111706 - RNA, 13 nt, Homo sapiens
auacaagaaccaa

SEQ ID NO: 2111707 - RNA, 14 nt, Homo sapiens
aaauccaguauuau

SEQ ID NO: 2111708 - RNA, 17 nt, Homo sapiens
caucucccggugccuug

SEQ ID NO: 2111709 - RNA, 20 nt, Homo sapiens
aaacccaucuuuuguucucc

SEQ ID NO: 2111710 - RNA, 18 nt, Homo sapiens
cagaacacaagacaccaa

SEQ ID NO: 2111711 - RNA, 18 nt, Homo sapiens
auaaaacccaaaccacau

SEQ ID NO: 2111712 - RNA, 15 nt, Homo sapiens
aaggacuucuuccag

SEQ ID NO: 2111713 - RNA, 11 nt, Homo sapiens
gucacagggac

SEQ ID NO: 2111714 - RNA, 19 nt, Homo sapiens
aacauggaaacaacuucua

SEQ ID NO: 2111715 - RNA, 17 nt, Homo sapiens
uugaaggugcugccacc

SEQ ID NO: 2111716 - RNA, 17 nt, Homo sapiens
ggagcuccaguguccug

SEQ ID NO: 2111717 - RNA, 22 nt, Homo sapiens
gacaauccccacauaccaucug

SEQ ID NO: 2111718 - RNA, 21 nt, Homo sapiens
augaagucccucuaugucguc

SEQ ID NO: 2111719 - RNA, 16 nt, Homo sapiens
aaagaaaaguauuucc

SEQ ID NO: 2111720 - RNA, 18 nt, Homo sapiens
auuagcucacugaaucuu

SEQ ID NO: 2111721 - RNA, 16 nt, Homo sapiens
acaaauacuugacuca

SEQ ID NO: 2111722 - RNA, 21 nt, Homo sapiens
auacuauguaagggcuuuaaa

SEQ ID NO: 2111723 - RNA, 23 nt, Homo sapiens
uaauguguaugucugguaaauag

SEQ ID NO: 2111724 - RNA, 20 nt, Homo sapiens
acggugcuaaaaaugaaaau

SEQ ID NO: 2111725 - RNA, 13 nt, Homo sapiens
ccuugccaucaca

SEQ ID NO: 2111726 - RNA, 16 nt, Homo sapiens
cccguguguugcacca

SEQ ID NO: 2111727 - RNA, 13 nt, Homo sapiens
ucuuccaucugau

SEQ ID NO: 2111728 - RNA, 16 nt, Homo sapiens
aggcagauguuugccu

SEQ ID NO: 2111729 - RNA, 15 nt, Homo sapiens
cucccacagucccau

SEQ ID NO: 2111730 - RNA, 21 nt, Homo sapiens
cuaugguguguuguaucuuug

SEQ ID NO: 2111731 - RNA, 20 nt, Homo sapiens
gcccagaucaccaccugaac

SEQ ID NO: 2111732 - RNA, 18 nt, Homo sapiens
acccaggcccaugccaag

SEQ ID NO: 2111733 - RNA, 19 nt, Homo sapiens
ugcuggauggccugaggaa

SEQ ID NO: 2111734 - RNA, 13 nt, Homo sapiens
cauuucaccaugu

SEQ ID NO: 2111735 - RNA, 13 nt, Homo sapiens
aaauucacaaagu

SEQ ID NO: 2111736 - RNA, 13 nt, Homo sapiens
aguuucacagugu

SEQ ID NO: 2111737 - RNA, 19 nt, Homo sapiens
gauuuguuaaagggccaaa

SEQ ID NO: 2111738 - RNA, 15 nt, Homo sapiens
ugagacagggucuca

SEQ ID NO: 2111739 - RNA, 21 nt, Homo sapiens
cccagguauugucuuuugaca

SEQ ID NO: 2111740 - RNA, 15 nt, Homo sapiens
acauaucuagauuuu

SEQ ID NO: 2111741 - RNA, 12 nt, Homo sapiens
agcaacuuugau

SEQ ID NO: 2111742 - RNA, 19 nt, Homo sapiens
cagcaggcuuuuguguucu

SEQ ID NO: 2111743 - RNA, 23 nt, Homo sapiens
ucagcacugauggaaaauaccag

SEQ ID NO: 2111744 - RNA, 23 nt, Homo sapiens
ccaugguagccuuagggugcuga

SEQ ID NO: 2111745 - RNA, 21 nt, Homo sapiens
gcagaacuaagcucaguaugu

SEQ ID NO: 2111746 - RNA, 21 nt, Homo sapiens
ccuggcacacccagucguccu

SEQ ID NO: 2111747 - RNA, 23 nt, Homo sapiens
cucuguagagagcagcauuccca

SEQ ID NO: 2111748 - RNA, 13 nt, Homo sapiens
gaaauaguuugag

SEQ ID NO: 2111749 - RNA, 23 nt, Homo sapiens
ugucuguaucaguggauuuccca

SEQ ID NO: 2111750 - RNA, 17 nt, Homo sapiens
aacaugacaguauucca

SEQ ID NO: 2111751 - RNA, 20 nt, Homo sapiens
ccuuaguuauaauucugugu

SEQ ID NO: 2111752 - RNA, 14 nt, Homo sapiens
ugggucccuggaau

SEQ ID NO: 2111753 - RNA, 21 nt, Homo sapiens
uuaugcaucauuucaggaguu

SEQ ID NO: 2111754 - RNA, 14 nt, Homo sapiens
uaauuuugauuucu

SEQ ID NO: 2111755 - RNA, 16 nt, Homo sapiens
aggagcuaaacaugcu

SEQ ID NO: 2111756 - RNA, 16 nt, Homo sapiens
guccucccaggccagg

SEQ ID NO: 2111757 - RNA, 17 nt, Homo sapiens
ccuguaacauaucugua

SEQ ID NO: 2111758 - RNA, 19 nt, Homo sapiens
uuauuacauggggucuaga

SEQ ID NO: 2111759 - RNA, 17 nt, Homo sapiens
uauaaaccguggucuca

SEQ ID NO: 2111760 - RNA, 14 nt, Homo sapiens
ugccucuguccuua

SEQ ID NO: 2111761 - RNA, 21 nt, Homo sapiens
ucagaccuuuuaacuccucaa

SEQ ID NO: 2111762 - RNA, 17 nt, Homo sapiens
acucaaaacacccaaaa

SEQ ID NO: 2111763 - RNA, 14 nt, Homo sapiens
uauuaugcuggaau

SEQ ID NO: 2111764 - RNA, 15 nt, Homo sapiens
aggaauacugaacau

SEQ ID NO: 2111765 - RNA, 14 nt, Homo sapiens
agccugcuuucaca

SEQ ID NO: 2111766 - RNA, 22 nt, Homo sapiens
agcuaccugcucagcccugcac

SEQ ID NO: 2111767 - RNA, 18 nt, Homo sapiens
auucauuuuaacaucuga

SEQ ID NO: 2111768 - RNA, 23 nt, Homo sapiens
aacucuguccuuacauacucaau

SEQ ID NO: 2111769 - RNA, 14 nt, Homo sapiens
auaaaggucccaug

SEQ ID NO: 2111770 - RNA, 23 nt, Homo sapiens
cugucacuacaauuuaaacacca

SEQ ID NO: 2111771 - RNA, 22 nt, Homo sapiens
ucauccuuuucuccuaucuuca

SEQ ID NO: 2111772 - RNA, 11 nt, Homo sapiens
uauauacuguu

SEQ ID NO: 2111773 - RNA, 20 nt, Homo sapiens
guuaccucaaggccuacuga

SEQ ID NO: 2111774 - RNA, 16 nt, Homo sapiens
gaaaguggcucuucua

SEQ ID NO: 2111775 - RNA, 15 nt, Homo sapiens
ccuuuauauuugcuc

SEQ ID NO: 2111776 - RNA, 19 nt, Homo sapiens
gacaaaggugguaaauuca

SEQ ID NO: 2111777 - RNA, 20 nt, Homo sapiens
cuccuuggcugucugugggc

SEQ ID NO: 2111778 - RNA, 17 nt, Homo sapiens
agaacauggacuuguau

SEQ ID NO: 2111779 - RNA, 21 nt, Homo sapiens
gccugaaugucuuacugugau

SEQ ID NO: 2111780 - RNA, 13 nt, Homo sapiens
agaauaaagccuc

SEQ ID NO: 2111781 - RNA, 17 nt, Homo sapiens
aguuccuguaacaggug

SEQ ID NO: 2111782 - RNA, 16 nt, Homo sapiens
cuugucacgaauucca

SEQ ID NO: 2111783 - RNA, 23 nt, Homo sapiens
cauugagcugauauaaauucugu

SEQ ID NO: 2111784 - RNA, 14 nt, Homo sapiens
accaucugucuugc

SEQ ID NO: 2111785 - RNA, 16 nt, Homo sapiens
ugccccggaccuaccu

SEQ ID NO: 2111786 - RNA, 23 nt, Homo sapiens
ugacuguucuugcgggggauaaa

SEQ ID NO: 2111787 - RNA, 19 nt, Homo sapiens
gggauucuaggaaacccaa

SEQ ID NO: 2111788 - RNA, 19 nt, Homo sapiens
acaugaccaaaaaccaaaa

SEQ ID NO: 2111789 - RNA, 17 nt, Homo sapiens
accaggaggcggcagug

SEQ ID NO: 2111790 - RNA, 11 nt, Homo sapiens
uuaggugcuga

SEQ ID NO: 2111791 - RNA, 18 nt, Homo sapiens
cucguugcccagcacugu

SEQ ID NO: 2111792 - RNA, 17 nt, Homo sapiens
cagggugguguaccugc

SEQ ID NO: 2111793 - RNA, 18 nt, Homo sapiens
gucaaccuugugugagug

SEQ ID NO: 2111794 - RNA, 15 nt, Homo sapiens
uccaccaugagcuca

SEQ ID NO: 2111795 - RNA, 14 nt, Homo sapiens
caccacaugugcac

SEQ ID NO: 2111796 - RNA, 13 nt, Homo sapiens
uuguaaaaagccc

SEQ ID NO: 2111797 - RNA, 21 nt, Homo sapiens
ugucugucuacauuucugcag

SEQ ID NO: 2111798 - RNA, 12 nt, Homo sapiens
uugagauauuaa

SEQ ID NO: 2111799 - RNA, 19 nt, Homo sapiens
augcugaaaaaucauccaa

SEQ ID NO: 2111800 - RNA, 15 nt, Homo sapiens
ggaagacaaugugaa

SEQ ID NO: 2111801 - RNA, 12 nt, Homo sapiens
cucuugcaauuc

SEQ ID NO: 2111802 - RNA, 18 nt, Homo sapiens
cucgaggcccuagcauuu

SEQ ID NO: 2111803 - RNA, 14 nt, Homo sapiens
ucuguuguccauca

SEQ ID NO: 2111804 - RNA, 20 nt, Homo sapiens
aucuccacccugagccugac

SEQ ID NO: 2111805 - RNA, 15 nt, Homo sapiens
aguuccagugcugca

SEQ ID NO: 2111806 - RNA, 16 nt, Homo sapiens
aaaucaugcaaugcag

SEQ ID NO: 2111807 - RNA, 20 nt, Homo sapiens
aucacuuaaacuugcaucac

SEQ ID NO: 2111808 - RNA, 13 nt, Homo sapiens
augagagggccca

SEQ ID NO: 2111809 - RNA, 13 nt, Homo sapiens
gcuccagcacauc

SEQ ID NO: 2111810 - RNA, 19 nt, Homo sapiens
uucaaaaccaaguaucaca

SEQ ID NO: 2111811 - RNA, 20 nt, Homo sapiens
gcuugaugagaagaacacau

SEQ ID NO: 2111812 - RNA, 16 nt, Homo sapiens
ggccuagggcccagga

SEQ ID NO: 2111813 - RNA, 17 nt, Homo sapiens
agguaugaucucuucug

SEQ ID NO: 2111814 - RNA, 13 nt, Homo sapiens
cuuaaagucagaa

SEQ ID NO: 2111815 - RNA, 20 nt, Homo sapiens
ucuaauaaacacagauuauu

SEQ ID NO: 2111816 - RNA, 23 nt, Homo sapiens
uacccuugugagagcccauuccc

SEQ ID NO: 2111817 - RNA, 17 nt, Homo sapiens
ccccugccuggguuuuc

SEQ ID NO: 2111818 - RNA, 17 nt, Homo sapiens
ggaaaagagaaacacua

SEQ ID NO: 2111819 - RNA, 11 nt, Homo sapiens
cccaguauuuu

SEQ ID NO: 2111820 - RNA, 23 nt, Homo sapiens
ggugcuacacccuuuuccagcug

SEQ ID NO: 2111821 - RNA, 15 nt, Homo sapiens
gugaagugguuuaaa

SEQ ID NO: 2111822 - RNA, 16 nt, Homo sapiens
acuagaagggccaguc

SEQ ID NO: 2111823 - RNA, 18 nt, Homo sapiens
gaaacuguaccauacaca

SEQ ID NO: 2111824 - RNA, 22 nt, Homo sapiens
ccacccuguuuaaagauuucaa

SEQ ID NO: 2111825 - RNA, 21 nt, Homo sapiens
gacaaaguuuugcucuuguca

SEQ ID NO: 2111826 - RNA, 19 nt, Homo sapiens
uaaccaacuuuucuauuaa

SEQ ID NO: 2111827 - RNA, 12 nt, Homo sapiens
gaaccacuuugc

SEQ ID NO: 2111828 - RNA, 18 nt, Homo sapiens
gaaggaaauaaucaucua

SEQ ID NO: 2111829 - RNA, 18 nt, Homo sapiens
aauggcuuugucuugaaa

SEQ ID NO: 2111830 - RNA, 23 nt, Homo sapiens
uauacauguauaucucgagugag

SEQ ID NO: 2111831 - RNA, 20 nt, Homo sapiens
gccacuguuuugaaucucau

SEQ ID NO: 2111832 - RNA, 13 nt, Homo sapiens
cucaccacaugcg

SEQ ID NO: 2111833 - RNA, 19 nt, Homo sapiens
uuacaggaagccucucaua

SEQ ID NO: 2111834 - RNA, 15 nt, Homo sapiens
ugccucugugcacag

SEQ ID NO: 2111835 - RNA, 23 nt, Homo sapiens
gagggcaagcccugcccacagaa

SEQ ID NO: 2111836 - RNA, 15 nt, Homo sapiens
agggcacucacaugc

SEQ ID NO: 2111837 - RNA, 15 nt, Homo sapiens
cagugcgcuguagua

SEQ ID NO: 2111838 - RNA, 20 nt, Homo sapiens
agaacuagccaaaccaggac

SEQ ID NO: 2111839 - RNA, 15 nt, Homo sapiens
aaauuugucuuucaa

SEQ ID NO: 2111840 - RNA, 13 nt, Homo sapiens
aauuacagacucu

SEQ ID NO: 2111841 - RNA, 19 nt, Homo sapiens
gcuucaacauucuuugcaa

SEQ ID NO: 2111842 - RNA, 15 nt, Homo sapiens
ugcuggggaccucac

SEQ ID NO: 2111843 - RNA, 20 nt, Homo sapiens
gugacugggaccugaaugac

SEQ ID NO: 2111844 - RNA, 17 nt, Homo sapiens
aaagaaauugcaugcag

SEQ ID NO: 2111845 - RNA, 14 nt, Homo sapiens
gcugagagaccuga

SEQ ID NO: 2111846 - RNA, 16 nt, Homo sapiens
uaaucuggacuccucu

SEQ ID NO: 2111847 - RNA, 14 nt, Homo sapiens
aauaucacaucacu

SEQ ID NO: 2111848 - RNA, 16 nt, Homo sapiens
uuacuucccuaaugaa

SEQ ID NO: 2111849 - RNA, 21 nt, Homo sapiens
cuguagucccagcuacucggg

SEQ ID NO: 2111850 - RNA, 21 nt, Homo sapiens
acucaauaaauauuuuugcug

SEQ ID NO: 2111851 - RNA, 17 nt, Homo sapiens
cugguuuucugccaaug

SEQ ID NO: 2111852 - RNA, 18 nt, Homo sapiens
auccacauugccagugac

SEQ ID NO: 2111853 - RNA, 21 nt, Homo sapiens
gcgaccaccaacacacaggaa

SEQ ID NO: 2111854 - RNA, 18 nt, Homo sapiens
aaaguucccacuccuuca

SEQ ID NO: 2111855 - RNA, 18 nt, Homo sapiens
caaguccucacucuucaa

SEQ ID NO: 2111856 - RNA, 17 nt, Homo sapiens
ugaaugugacuacuuag

SEQ ID NO: 2111857 - RNA, 14 nt, Homo sapiens
caucgguagcuuga

SEQ ID NO: 2111858 - RNA, 11 nt, Homo sapiens
caaaguuggcg

SEQ ID NO: 2111859 - RNA, 15 nt, Homo sapiens
uaaauauccugcuca

SEQ ID NO: 2111860 - RNA, 23 nt, Homo sapiens
acuucggacaccugccauggaca

SEQ ID NO: 2111861 - RNA, 16 nt, Homo sapiens
uggcuucuccuuggcu

SEQ ID NO: 2111862 - RNA, 15 nt, Homo sapiens
uggaaguccagaaca

SEQ ID NO: 2111863 - RNA, 16 nt, Homo sapiens
aucucacuaccuuauu

SEQ ID NO: 2111864 - RNA, 14 nt, Homo sapiens
cuuucuauuugacu

SEQ ID NO: 2111865 - RNA, 18 nt, Homo sapiens
ccuucuggaaacugugaa

SEQ ID NO: 2111866 - RNA, 18 nt, Homo sapiens
aauguauuuagcuacagc

SEQ ID NO: 2111867 - RNA, 17 nt, Homo sapiens
aggugcugaaugaagcu

SEQ ID NO: 2111868 - RNA, 23 nt, Homo sapiens
augcaggcccuuugaagccucag

SEQ ID NO: 2111869 - RNA, 14 nt, Homo sapiens
accccaacucuccc

SEQ ID NO: 2111870 - RNA, 16 nt, Homo sapiens
acagaccugugugugc

SEQ ID NO: 2111871 - RNA, 22 nt, Homo sapiens
ucauucugcauucucuagucag

SEQ ID NO: 2111872 - RNA, 20 nt, Homo sapiens
gagguggagcuugcaaugag

SEQ ID NO: 2111873 - RNA, 13 nt, Homo sapiens
cuuuccccaagga

SEQ ID NO: 2111874 - RNA, 11 nt, Homo sapiens
uuucaccacau

SEQ ID NO: 2111875 - RNA, 22 nt, Homo sapiens
gacacagcgucccuagcaguga

SEQ ID NO: 2111876 - RNA, 17 nt, Homo sapiens
gcacacgccuguauucc

SEQ ID NO: 2111877 - RNA, 22 nt, Homo sapiens
acaggcugugacucuucucuca

SEQ ID NO: 2111878 - RNA, 16 nt, Homo sapiens
acaaccuccgugcugg

SEQ ID NO: 2111879 - RNA, 22 nt, Homo sapiens
aggagggcuuugugucuggcca

SEQ ID NO: 2111880 - RNA, 12 nt, Homo sapiens
gcauuccaugau

SEQ ID NO: 2111881 - RNA, 22 nt, Homo sapiens
gauuuaauuuuuuaaacuguag

SEQ ID NO: 2111882 - RNA, 22 nt, Homo sapiens
cuagagcuagaugugucuuacc

SEQ ID NO: 2111883 - RNA, 15 nt, Homo sapiens
agcaacgcuauucca

SEQ ID NO: 2111884 - RNA, 15 nt, Homo sapiens
gcaaaaugcuuacag

SEQ ID NO: 2111885 - RNA, 23 nt, Homo sapiens
uggcguuguggggaugaacuuuu

SEQ ID NO: 2111886 - RNA, 12 nt, Homo sapiens
gaggccacagaa

SEQ ID NO: 2111887 - RNA, 15 nt, Homo sapiens
auugcuuuuaugaua

SEQ ID NO: 2111888 - RNA, 18 nt, Homo sapiens
uaggagcagaaaugcaag

SEQ ID NO: 2111889 - RNA, 17 nt, Homo sapiens
uguuuucuaaagccagg

SEQ ID NO: 2111890 - RNA, 15 nt, Homo sapiens
caagaaaacaacuuc

SEQ ID NO: 2111891 - RNA, 11 nt, Homo sapiens
uugcaauaaga

SEQ ID NO: 2111892 - RNA, 23 nt, Homo sapiens
caagagagaaagaaguaggcaug

SEQ ID NO: 2111893 - RNA, 19 nt, Homo sapiens
agagugcauuacuuugaau

SEQ ID NO: 2111894 - RNA, 14 nt, Homo sapiens
accaagccugccau

SEQ ID NO: 2111895 - RNA, 15 nt, Homo sapiens
ucaagugaucuuuca

SEQ ID NO: 2111896 - RNA, 16 nt, Homo sapiens
agaccauaauguuaca

SEQ ID NO: 2111897 - RNA, 15 nt, Homo sapiens
aaugaugguguuaaa

SEQ ID NO: 2111898 - RNA, 17 nt, Homo sapiens
ucacugcagggcacugu

SEQ ID NO: 2111899 - RNA, 16 nt, Homo sapiens
cagaggaugagcucua

SEQ ID NO: 2111900 - RNA, 15 nt, Homo sapiens
guucuaccauuacca

SEQ ID NO: 2111901 - RNA, 21 nt, Homo sapiens
aaaacuguuuguuaucucuug

SEQ ID NO: 2111902 - RNA, 14 nt, Homo sapiens
auaacuuuuuccaa

SEQ ID NO: 2111903 - RNA, 22 nt, Homo sapiens
ccccaacguuccacaacagucc

SEQ ID NO: 2111904 - RNA, 17 nt, Homo sapiens
ugaagauuaucacuuaa

SEQ ID NO: 2111905 - RNA, 16 nt, Homo sapiens
ccauuccaaaguucuu

SEQ ID NO: 2111906 - RNA, 22 nt, Homo sapiens
cagaaacaaugacauccagaaa

SEQ ID NO: 2111907 - RNA, 20 nt, Homo sapiens
gcauuugugcccacucucca

SEQ ID NO: 2111908 - RNA, 11 nt, Homo sapiens
acaacacuggu

SEQ ID NO: 2111909 - RNA, 15 nt, Homo sapiens
caguaugaagacacu

SEQ ID NO: 2111910 - RNA, 17 nt, Homo sapiens
cuccaccggugccuccu

SEQ ID NO: 2111911 - RNA, 15 nt, Homo sapiens
cagcaguguugcuca

SEQ ID NO: 2111912 - RNA, 22 nt, Homo sapiens
ugcaucacguaccccacugggc

SEQ ID NO: 2111913 - RNA, 15 nt, Homo sapiens
aggaaguauggcaaa

SEQ ID NO: 2111914 - RNA, 17 nt, Homo sapiens
caagaccccaccuccac

SEQ ID NO: 2111915 - RNA, 19 nt, Homo sapiens
agccacucaguucuuccuc

SEQ ID NO: 2111916 - RNA, 16 nt, Homo sapiens
gcugcacccacccagg

SEQ ID NO: 2111917 - RNA, 21 nt, Homo sapiens
uggagcuaaggccagcuagag

SEQ ID NO: 2111918 - RNA, 14 nt, Homo sapiens
cugauaaaccaaaa

SEQ ID NO: 2111919 - RNA, 14 nt, Homo sapiens
uaaaccaacucuaa

SEQ ID NO: 2111920 - RNA, 20 nt, Homo sapiens
agugaaagcaucacuuggga

SEQ ID NO: 2111921 - RNA, 15 nt, Homo sapiens
cugguguuggggaaa

SEQ ID NO: 2111922 - RNA, 12 nt, Homo sapiens
cgauggagacac

SEQ ID NO: 2111923 - RNA, 13 nt, Homo sapiens
caaaccugcaguu

SEQ ID NO: 2111924 - RNA, 10 nt, Homo sapiens
ucaaaaccug

SEQ ID NO: 2111925 - RNA, 16 nt, Homo sapiens
gcugaggccucgaggg

SEQ ID NO: 2111926 - RNA, 22 nt, Homo sapiens
ggauuccagagcacugcuccag

SEQ ID NO: 2111927 - RNA, 22 nt, Homo sapiens
cccaaaagaauuaucaucccaa

SEQ ID NO: 2111928 - RNA, 21 nt, Homo sapiens
uuuacgaucuguuuccaaauc

SEQ ID NO: 2111929 - RNA, 17 nt, Homo sapiens
ucuagugaaugaaucuc

SEQ ID NO: 2111930 - RNA, 14 nt, Homo sapiens
aaagugacuaccag

SEQ ID NO: 2111931 - RNA, 22 nt, Homo sapiens
cugaggcacaagaaucacuuga

SEQ ID NO: 2111932 - RNA, 14 nt, Homo sapiens
uauauagucucaag

SEQ ID NO: 2111933 - RNA, 14 nt, Homo sapiens
cacaagguuuuaua

SEQ ID NO: 2111934 - RNA, 15 nt, Homo sapiens
cacucucuagcuuua

SEQ ID NO: 2111935 - RNA, 21 nt, Homo sapiens
guaacaugaggggacauuuug

SEQ ID NO: 2111936 - RNA, 23 nt, Homo sapiens
ucuaguuccucuucuuaagggga

SEQ ID NO: 2111937 - RNA, 17 nt, Homo sapiens
auucauuuggugacugu

SEQ ID NO: 2111938 - RNA, 16 nt, Homo sapiens
acuucucuuugccuca

SEQ ID NO: 2111939 - RNA, 22 nt, Homo sapiens
aauuaaauuuuagaucuuucaa

SEQ ID NO: 2111940 - RNA, 15 nt, Homo sapiens
ucugugugcucugau

SEQ ID NO: 2111941 - RNA, 17 nt, Homo sapiens
ggcguggcccguggccu

SEQ ID NO: 2111942 - RNA, 22 nt, Homo sapiens
auuuguaaugucuugagcucua

SEQ ID NO: 2111943 - RNA, 16 nt, Homo sapiens
acaguaguguauuaaa

SEQ ID NO: 2111944 - RNA, 15 nt, Homo sapiens
uuggccagcaaaaac

SEQ ID NO: 2111945 - RNA, 12 nt, Homo sapiens
ugccccugagac

SEQ ID NO: 2111946 - RNA, 19 nt, Homo sapiens
cuuccacucuggaaccuua

SEQ ID NO: 2111947 - RNA, 22 nt, Homo sapiens
auuuuguaagcuauaacauauu

SEQ ID NO: 2111948 - RNA, 23 nt, Homo sapiens
acaguauugagcuuugcauuuau

SEQ ID NO: 2111949 - RNA, 16 nt, Homo sapiens
uacuuuggacugaguu

SEQ ID NO: 2111950 - RNA, 20 nt, Homo sapiens
ucugcuuucuauuaccccuc

SEQ ID NO: 2111951 - RNA, 14 nt, Homo sapiens
uuuaagaaguugcu

SEQ ID NO: 2111952 - RNA, 21 nt, Homo sapiens
auuuaggaaaugggcagugaa

SEQ ID NO: 2111953 - RNA, 20 nt, Homo sapiens
ugcaguuccccgagaacuuu

SEQ ID NO: 2111954 - RNA, 14 nt, Homo sapiens
accuauuuuuccag

SEQ ID NO: 2111955 - RNA, 14 nt, Homo sapiens
ugucugcccagcaa

SEQ ID NO: 2111956 - RNA, 18 nt, Homo sapiens
accugucaaccugaauua

SEQ ID NO: 2111957 - RNA, 15 nt, Homo sapiens
ugaaguuugcuauuc

SEQ ID NO: 2111958 - RNA, 17 nt, Homo sapiens
uuuauccaaaaugugua

SEQ ID NO: 2111959 - RNA, 19 nt, Homo sapiens
ccugugccccuggaugcac

SEQ ID NO: 2111960 - RNA, 22 nt, Homo sapiens
cuaauuagaaauuuauauguca

SEQ ID NO: 2111961 - RNA, 18 nt, Homo sapiens
ucuugcaauaaaugaaga

SEQ ID NO: 2111962 - RNA, 13 nt, Homo sapiens
cauaccacuugaa

SEQ ID NO: 2111963 - RNA, 17 nt, Homo sapiens
cgcuaauucaaggaauu

SEQ ID NO: 2111964 - RNA, 13 nt, Homo sapiens
uggcccaccccac

SEQ ID NO: 2111965 - RNA, 23 nt, Homo sapiens
ucacaaauaaguaauaucuuuca

SEQ ID NO: 2111966 - RNA, 13 nt, Homo sapiens
gcagcugauucca

SEQ ID NO: 2111967 - RNA, 14 nt, Homo sapiens
uacagcuuggcacu

SEQ ID NO: 2111968 - RNA, 18 nt, Homo sapiens
ccagcaugcugagauuac

SEQ ID NO: 2111969 - RNA, 14 nt, Homo sapiens
agucaguugcauuc

SEQ ID NO: 2111970 - RNA, 16 nt, Homo sapiens
auuaauauuuaugucu

SEQ ID NO: 2111971 - RNA, 15 nt, Homo sapiens
cagagaaaucugcau

SEQ ID NO: 2111972 - RNA, 21 nt, Homo sapiens
ggcucaccuugugcuggggac

SEQ ID NO: 2111973 - RNA, 19 nt, Homo sapiens
aaguaacuuuuacaaaaca

SEQ ID NO: 2111974 - RNA, 23 nt, Homo sapiens
cucugguuguuuaugcaagagcu

SEQ ID NO: 2111975 - RNA, 15 nt, Homo sapiens
gcuuuaaaaaugcaa

SEQ ID NO: 2111976 - RNA, 18 nt, Homo sapiens
ucaaggauaggcuuuauu

SEQ ID NO: 2111977 - RNA, 13 nt, Homo sapiens
aguuccacuuaua

SEQ ID NO: 2111978 - RNA, 16 nt, Homo sapiens
aaaugaagggauauaa

SEQ ID NO: 2111979 - RNA, 14 nt, Homo sapiens
aauuaccugauaag

SEQ ID NO: 2111980 - RNA, 23 nt, Homo sapiens
aaaauucuagucuguuucauuac

SEQ ID NO: 2111981 - RNA, 14 nt, Homo sapiens
aauucuccaacagc

SEQ ID NO: 2111982 - RNA, 18 nt, Homo sapiens
cucuugccuuuuacuuaa

SEQ ID NO: 2111983 - RNA, 18 nt, Homo sapiens
ggccacuuuccagggugg

SEQ ID NO: 2111984 - RNA, 18 nt, Homo sapiens
agguuuaaacaucacuug

SEQ ID NO: 2111985 - RNA, 19 nt, Homo sapiens
uuuccaaaucccuuucaug

SEQ ID NO: 2111986 - RNA, 13 nt, Homo sapiens
guauuucaucucu

SEQ ID NO: 2111987 - RNA, 22 nt, Homo sapiens
uugggaaaagaagcugucagaa

SEQ ID NO: 2111988 - RNA, 16 nt, Homo sapiens
aggccuccugccaugu

SEQ ID NO: 2111989 - RNA, 19 nt, Homo sapiens
aucugaagugguucagucu

SEQ ID NO: 2111990 - RNA, 13 nt, Homo sapiens
aaucaaauagcau

SEQ ID NO: 2111991 - RNA, 19 nt, Homo sapiens
ugaggccucacuacucgag

SEQ ID NO: 2111992 - RNA, 23 nt, Homo sapiens
cuaagacugugacaacugucuaa

SEQ ID NO: 2111993 - RNA, 15 nt, Homo sapiens
auaaaguuguugcau

SEQ ID NO: 2111994 - RNA, 13 nt, Homo sapiens
uguucuucagucc

SEQ ID NO: 2111995 - RNA, 13 nt, Homo sapiens
auauauucuuaca

SEQ ID NO: 2111996 - RNA, 13 nt, Homo sapiens
aaccuuucuacuu

SEQ ID NO: 2111997 - RNA, 11 nt, Homo sapiens
ccacuguaaau

SEQ ID NO: 2111998 - RNA, 16 nt, Homo sapiens
accaggacuagggcug

SEQ ID NO: 2111999 - RNA, 13 nt, Homo sapiens
ucccaaagugccu

SEQ ID NO: 2112000 - RNA, 12 nt, Homo sapiens
ucucucaaugaa

SEQ ID NO: 2112001 - RNA, 22 nt, Homo sapiens
acaagcauggaaaaucagugac

SEQ ID NO: 2112002 - RNA, 22 nt, Homo sapiens
gcacugagggucuggugccaau

SEQ ID NO: 2112003 - RNA, 19 nt, Homo sapiens
aucauggaauuuaugcaaa

SEQ ID NO: 2112004 - RNA, 21 nt, Homo sapiens
agccacccaggggaaugaucu

SEQ ID NO: 2112005 - RNA, 22 nt, Homo sapiens
ugucugggugaccucacuuuag

SEQ ID NO: 2112006 - RNA, 13 nt, Homo sapiens
cguuggagacuga

SEQ ID NO: 2112007 - RNA, 17 nt, Homo sapiens
cuagcgcaagaccaguc

SEQ ID NO: 2112008 - RNA, 19 nt, Homo sapiens
uugagugacuugagcccaa

SEQ ID NO: 2112009 - RNA, 23 nt, Homo sapiens
cagauuuaaaaaaagaacauaaa

SEQ ID NO: 2112010 - RNA, 20 nt, Homo sapiens
cagccucccaaguagcugga

SEQ ID NO: 2112011 - RNA, 17 nt, Homo sapiens
uucugauaccacugcac

SEQ ID NO: 2112012 - RNA, 14 nt, Homo sapiens
agguugaagccaag

SEQ ID NO: 2112013 - RNA, 14 nt, Homo sapiens
gggaugcugugagc

SEQ ID NO: 2112014 - RNA, 23 nt, Homo sapiens
acaauccaaaaauguuuuucaaa

SEQ ID NO: 2112015 - RNA, 13 nt, Homo sapiens
ccuuuuuauaggu

SEQ ID NO: 2112016 - RNA, 22 nt, Homo sapiens
uguaaucccaacacuguggaag

SEQ ID NO: 2112017 - RNA, 22 nt, Homo sapiens
ugggugguguuuguaacaauca

SEQ ID NO: 2112018 - RNA, 13 nt, Homo sapiens
caaaauugaugug

SEQ ID NO: 2112019 - RNA, 18 nt, Homo sapiens
guuuucacucagcuuaau

SEQ ID NO: 2112020 - RNA, 16 nt, Homo sapiens
gcucugaauguccuga

SEQ ID NO: 2112021 - RNA, 19 nt, Homo sapiens
agccgacucagcaacuuuc

SEQ ID NO: 2112022 - RNA, 13 nt, Homo sapiens
gaugacaaccucc

SEQ ID NO: 2112023 - RNA, 14 nt, Homo sapiens
ucugcacucuugua

SEQ ID NO: 2112024 - RNA, 18 nt, Homo sapiens
uccacaauuuugucucua

SEQ ID NO: 2112025 - RNA, 21 nt, Homo sapiens
acaaggacuagagcucaggcc

SEQ ID NO: 2112026 - RNA, 16 nt, Homo sapiens
ugggcucuacuaccug

SEQ ID NO: 2112027 - RNA, 21 nt, Homo sapiens
caaaaacagcagaacuucuga

SEQ ID NO: 2112028 - RNA, 22 nt, Homo sapiens
ugaaugaaauauaaacugugag

SEQ ID NO: 2112029 - RNA, 17 nt, Homo sapiens
accuccuaggaguacaa

SEQ ID NO: 2112030 - RNA, 20 nt, Homo sapiens
cugugagugcgucugagggg

SEQ ID NO: 2112031 - RNA, 15 nt, Homo sapiens
cagagcuguggcaca

SEQ ID NO: 2112032 - RNA, 12 nt, Homo sapiens
ucaucuacugaa

SEQ ID NO: 2112033 - RNA, 20 nt, Homo sapiens
ggcauuugcaccuaccucac

SEQ ID NO: 2112034 - RNA, 20 nt, Homo sapiens
cauccaaaguucccuaugaa

SEQ ID NO: 2112035 - RNA, 19 nt, Homo sapiens
aguuauuggaucagugaaa

SEQ ID NO: 2112036 - RNA, 22 nt, Homo sapiens
ucugauccuaguuccaccauca

SEQ ID NO: 2112037 - RNA, 17 nt, Homo sapiens
uuuuuacaugcagagua

SEQ ID NO: 2112038 - RNA, 22 nt, Homo sapiens
gcacuaacucguguuuggagcu

SEQ ID NO: 2112039 - RNA, 19 nt, Homo sapiens
cucaguguaccacuacuua

SEQ ID NO: 2112040 - RNA, 12 nt, Homo sapiens
ccuuugcacugu

SEQ ID NO: 2112041 - RNA, 12 nt, Homo sapiens
ccuaugcacuga

SEQ ID NO: 2112042 - RNA, 13 nt, Homo sapiens
gaucauugugaag

SEQ ID NO: 2112043 - RNA, 19 nt, Homo sapiens
ugcgcuacaaccgccagau

SEQ ID NO: 2112044 - RNA, 22 nt, Homo sapiens
gaggcagggacaagucuuucuc

SEQ ID NO: 2112045 - RNA, 18 nt, Homo sapiens
caaguaaaucuaucucua

SEQ ID NO: 2112046 - RNA, 13 nt, Homo sapiens
cacaaacuuuaaa

SEQ ID NO: 2112047 - RNA, 14 nt, Homo sapiens
agccuggcaucugu

SEQ ID NO: 2112048 - RNA, 20 nt, Homo sapiens
uggaaagccucugcugccau

SEQ ID NO: 2112049 - RNA, 20 nt, Homo sapiens
ugcuuuacuuugcccaggga

SEQ ID NO: 2112050 - RNA, 18 nt, Homo sapiens
ucaggcaaggucuggccu

SEQ ID NO: 2112051 - RNA, 13 nt, Homo sapiens
ucuccuugcacuu

SEQ ID NO: 2112052 - RNA, 20 nt, Homo sapiens
augagaguagagggcacugg

SEQ ID NO: 2112053 - RNA, 15 nt, Homo sapiens
cugaacuugccuuaa

SEQ ID NO: 2112054 - RNA, 12 nt, Homo sapiens
cauuugucacag

SEQ ID NO: 2112055 - RNA, 17 nt, Homo sapiens
ggugaguccccuacucc

SEQ ID NO: 2112056 - RNA, 17 nt, Homo sapiens
uguggccagccuggcau

SEQ ID NO: 2112057 - RNA, 20 nt, Homo sapiens
uaaagggcgcaaagggcaug

SEQ ID NO: 2112058 - RNA, 12 nt, Homo sapiens
augaucugccau

SEQ ID NO: 2112059 - RNA, 16 nt, Homo sapiens
uaguggaccacuugga

SEQ ID NO: 2112060 - RNA, 14 nt, Homo sapiens
aaccaugguaugaa

SEQ ID NO: 2112061 - RNA, 23 nt, Homo sapiens
auugauagcagauaucacgacag

SEQ ID NO: 2112062 - RNA, 20 nt, Homo sapiens
cauccuuauuagcucuacug

SEQ ID NO: 2112063 - RNA, 21 nt, Homo sapiens
auccccaucccucuacuuucc

SEQ ID NO: 2112064 - RNA, 19 nt, Homo sapiens
gaggacuucuggcagggaa

SEQ ID NO: 2112065 - RNA, 21 nt, Homo sapiens
gagaacccaauuuuguuucaa

SEQ ID NO: 2112066 - RNA, 19 nt, Homo sapiens
gacuuagaauaaugaaggu

SEQ ID NO: 2112067 - RNA, 19 nt, Homo sapiens
cuggacaggcuucgucuca

SEQ ID NO: 2112068 - RNA, 18 nt, Homo sapiens
ugcccaaccaaugcacac

SEQ ID NO: 2112069 - RNA, 13 nt, Homo sapiens
cauuuauaaaaua

SEQ ID NO: 2112070 - RNA, 21 nt, Homo sapiens
acacacacucaccaguggccu

SEQ ID NO: 2112071 - RNA, 23 nt, Homo sapiens
gucaggaacagaaggaugaauga

SEQ ID NO: 2112072 - RNA, 23 nt, Homo sapiens
cacuauccuuccucucugugaug

SEQ ID NO: 2112073 - RNA, 17 nt, Homo sapiens
aauccuauuaaaacaca

SEQ ID NO: 2112074 - RNA, 14 nt, Homo sapiens
agccagcucccagc

SEQ ID NO: 2112075 - RNA, 22 nt, Homo sapiens
aggaaaucaaauaugcaaagca

SEQ ID NO: 2112076 - RNA, 19 nt, Homo sapiens
auagcauuggggacauggg

SEQ ID NO: 2112077 - RNA, 19 nt, Homo sapiens
uaucaugaaacacuucuca

SEQ ID NO: 2112078 - RNA, 21 nt, Homo sapiens
cagagaagggcuuggacucaa

SEQ ID NO: 2112079 - RNA, 19 nt, Homo sapiens
uacucaaguaccaccaagg

SEQ ID NO: 2112080 - RNA, 19 nt, Homo sapiens
caggcuggagugcagugac

SEQ ID NO: 2112081 - RNA, 22 nt, Homo sapiens
cucaggggugauaacucaggaa

SEQ ID NO: 2112082 - RNA, 15 nt, Homo sapiens
aaagagccaguuuau

SEQ ID NO: 2112083 - RNA, 13 nt, Homo sapiens
aagaguugccaaa

SEQ ID NO: 2112084 - RNA, 21 nt, Homo sapiens
uauaccgugccacuuuccacc

SEQ ID NO: 2112085 - RNA, 18 nt, Homo sapiens
uguugucacccaagagau

SEQ ID NO: 2112086 - RNA, 13 nt, Homo sapiens
aggaauauuugca

SEQ ID NO: 2112087 - RNA, 13 nt, Homo sapiens
acugugugccagg

SEQ ID NO: 2112088 - RNA, 21 nt, Homo sapiens
aguagagacuuugaggaagaa

SEQ ID NO: 2112089 - RNA, 15 nt, Homo sapiens
ucgcacacacaguga

SEQ ID NO: 2112090 - RNA, 17 nt, Homo sapiens
cuggacaagccacagcc

SEQ ID NO: 2112091 - RNA, 19 nt, Homo sapiens
caacuugaaauuauaucug

SEQ ID NO: 2112092 - RNA, 12 nt, Homo sapiens
cgucccuaccuc

SEQ ID NO: 2112093 - RNA, 20 nt, Homo sapiens
ccagaggauugcugccccau

SEQ ID NO: 2112094 - RNA, 16 nt, Homo sapiens
gagggguugcggggga

SEQ ID NO: 2112095 - RNA, 13 nt, Homo sapiens
aggacacagucag

SEQ ID NO: 2112096 - RNA, 14 nt, Homo sapiens
cccuccacccacua

SEQ ID NO: 2112097 - RNA, 12 nt, Homo sapiens
auguucugcuca

SEQ ID NO: 2112098 - RNA, 18 nt, Homo sapiens
aauuaucuuaucuacuga

SEQ ID NO: 2112099 - RNA, 17 nt, Homo sapiens
gguucugcuacucccca

SEQ ID NO: 2112100 - RNA, 21 nt, Homo sapiens
ggaaagucacccaaacacuuc

SEQ ID NO: 2112101 - RNA, 23 nt, Homo sapiens
cugcucuuuaggauggggaguau

SEQ ID NO: 2112102 - RNA, 13 nt, Homo sapiens
gauauauaugugc

SEQ ID NO: 2112103 - RNA, 22 nt, Homo sapiens
gggcagcuuugcccuccaagag

SEQ ID NO: 2112104 - RNA, 19 nt, Homo sapiens
ucggaagggguuccucaaa

SEQ ID NO: 2112105 - RNA, 17 nt, Homo sapiens
ugaaauuggaaaggacu

SEQ ID NO: 2112106 - RNA, 22 nt, Homo sapiens
caggcuguggguagaugugcaa

SEQ ID NO: 2112107 - RNA, 11 nt, Homo sapiens
gccuaccuggg

SEQ ID NO: 2112108 - RNA, 20 nt, Homo sapiens
ggaaagugauuuuuuuccac

SEQ ID NO: 2112109 - RNA, 20 nt, Homo sapiens
agugcaguuugguguguccu

SEQ ID NO: 2112110 - RNA, 13 nt, Homo sapiens
ucuguaauuucac

SEQ ID NO: 2112111 - RNA, 13 nt, Homo sapiens
gccauaauguugc

SEQ ID NO: 2112112 - RNA, 17 nt, Homo sapiens
gaugaccguguacaaua

SEQ ID NO: 2112113 - RNA, 19 nt, Homo sapiens
auaugccaagcuaauuuau

SEQ ID NO: 2112114 - RNA, 12 nt, Homo sapiens
ggcaacaaaaga

SEQ ID NO: 2112115 - RNA, 21 nt, Homo sapiens
ucuguuuuuucagucugugaa

SEQ ID NO: 2112116 - RNA, 15 nt, Homo sapiens
aacaggcuaccaacu

SEQ ID NO: 2112117 - RNA, 13 nt, Homo sapiens
agagcacagugau

SEQ ID NO: 2112118 - RNA, 15 nt, Homo sapiens
ccucccacacuuccc

SEQ ID NO: 2112119 - RNA, 17 nt, Homo sapiens
uacaauugaaaugacua

SEQ ID NO: 2112120 - RNA, 16 nt, Homo sapiens
uugacauuuugaucac

SEQ ID NO: 2112121 - RNA, 16 nt, Homo sapiens
aggcuggagugcagua

SEQ ID NO: 2112122 - RNA, 15 nt, Homo sapiens
acugcaggagcaguu

SEQ ID NO: 2112123 - RNA, 21 nt, Homo sapiens
aagguauuuuguaauauucuc

SEQ ID NO: 2112124 - RNA, 20 nt, Homo sapiens
cagcucacugguccauuucu

SEQ ID NO: 2112125 - RNA, 15 nt, Homo sapiens
cuuauagagcacaau

SEQ ID NO: 2112126 - RNA, 16 nt, Homo sapiens
gaaaacucccaauaca

SEQ ID NO: 2112127 - RNA, 17 nt, Homo sapiens
ucuauaagaaaaaggaa

SEQ ID NO: 2112128 - RNA, 16 nt, Homo sapiens
cuguauuaccuauuca

SEQ ID NO: 2112129 - RNA, 13 nt, Homo sapiens
gccugccuugaag

SEQ ID NO: 2112130 - RNA, 17 nt, Homo sapiens
aaggaguaaucugugua

SEQ ID NO: 2112131 - RNA, 19 nt, Homo sapiens
auuuuuccaguaacuuuuc

SEQ ID NO: 2112132 - RNA, 13 nt, Homo sapiens
ggaaaggugcuca

SEQ ID NO: 2112133 - RNA, 18 nt, Homo sapiens
agccagccacacuugaac

SEQ ID NO: 2112134 - RNA, 12 nt, Homo sapiens
cacacuuugcca

SEQ ID NO: 2112135 - RNA, 17 nt, Homo sapiens
acaaaauucaaagcaug

SEQ ID NO: 2112136 - RNA, 17 nt, Homo sapiens
agcagaaucucagagaa

SEQ ID NO: 2112137 - RNA, 22 nt, Homo sapiens
agaggauugagauaacauuucc

SEQ ID NO: 2112138 - RNA, 16 nt, Homo sapiens
uuuauuugagacagag

SEQ ID NO: 2112139 - RNA, 19 nt, Homo sapiens
uccaaccccccaccugcca

SEQ ID NO: 2112140 - RNA, 21 nt, Homo sapiens
acugccccacggagacagagg

SEQ ID NO: 2112141 - RNA, 20 nt, Homo sapiens
auuuggcagagucugaagaa

SEQ ID NO: 2112142 - RNA, 21 nt, Homo sapiens
cugugcucacccauugucuca

SEQ ID NO: 2112143 - RNA, 9 nt, Homo sapiens
gaucuugaa

SEQ ID NO: 2112144 - RNA, 20 nt, Homo sapiens
uccuuaauagccauaugcaa

SEQ ID NO: 2112145 - RNA, 22 nt, Homo sapiens
aauaugaggggacugcaugcaa

SEQ ID NO: 2112146 - RNA, 12 nt, Homo sapiens
ggcaucauggaa

SEQ ID NO: 2112147 - RNA, 17 nt, Homo sapiens
acuucuugcuucaguca

SEQ ID NO: 2112148 - RNA, 24 nt, Homo sapiens
cucccucuuucuucccaugacccc

SEQ ID NO: 2112149 - RNA, 13 nt, Homo sapiens
uucucucacugug

SEQ ID NO: 2112150 - RNA, 19 nt, Homo sapiens
caacuguuugcacuuacag

SEQ ID NO: 2112151 - RNA, 20 nt, Homo sapiens
ccuucagaacagaggcauuu

SEQ ID NO: 2112152 - RNA, 14 nt, Homo sapiens
uuucaugugcuuua

SEQ ID NO: 2112153 - RNA, 14 nt, Homo sapiens
cauaugcagagccc

SEQ ID NO: 2112154 - RNA, 12 nt, Homo sapiens
ggacagagccau

SEQ ID NO: 2112155 - RNA, 17 nt, Homo sapiens
caugccucucucaggcc

SEQ ID NO: 2112156 - RNA, 16 nt, Homo sapiens
ccaacucugcacucca

SEQ ID NO: 2112157 - RNA, 17 nt, Homo sapiens
ucauccuuccauccauc

SEQ ID NO: 2112158 - RNA, 17 nt, Homo sapiens
uuucucaacuucucuac

SEQ ID NO: 2112159 - RNA, 14 nt, Homo sapiens
auguguagaauuug

SEQ ID NO: 2112160 - RNA, 18 nt, Homo sapiens
acaaucccaccuagccca

SEQ ID NO: 2112161 - RNA, 20 nt, Homo sapiens
cgccuccccuuugugacuuc

SEQ ID NO: 2112162 - RNA, 16 nt, Homo sapiens
gggccuuauccaguca

SEQ ID NO: 2112163 - RNA, 17 nt, Homo sapiens
ugcuaccaggaugcuaa

SEQ ID NO: 2112164 - RNA, 19 nt, Homo sapiens
auucagcauuauuccucca

SEQ ID NO: 2112165 - RNA, 17 nt, Homo sapiens
caagcuggaugcagugg

SEQ ID NO: 2112166 - RNA, 18 nt, Homo sapiens
uguuggcuccagucuucc

SEQ ID NO: 2112167 - RNA, 19 nt, Homo sapiens
auaauuuauacaggucaua

SEQ ID NO: 2112168 - RNA, 19 nt, Homo sapiens
ggacauaguaaaugauuca

SEQ ID NO: 2112169 - RNA, 14 nt, Homo sapiens
uguuucuguuccaa

SEQ ID NO: 2112170 - RNA, 13 nt, Homo sapiens
ccaagaagccagc

SEQ ID NO: 2112171 - RNA, 16 nt, Homo sapiens
aagaaugacaggcuuu

SEQ ID NO: 2112172 - RNA, 14 nt, Homo sapiens
cuaugcugcaauac

SEQ ID NO: 2112173 - RNA, 18 nt, Homo sapiens
gauuuauuaaauaaucuc

SEQ ID NO: 2112174 - RNA, 22 nt, Homo sapiens
gucauccaaacucaaacuugag

SEQ ID NO: 2112175 - RNA, 22 nt, Homo sapiens
cuugccuggaaagaggcagucu

SEQ ID NO: 2112176 - RNA, 20 nt, Homo sapiens
uauacacacauauacauaua

SEQ ID NO: 2112177 - RNA, 21 nt, Homo sapiens
agucuauuugagacuccucag

SEQ ID NO: 2112178 - RNA, 11 nt, Homo sapiens
guuaagacuga

SEQ ID NO: 2112179 - RNA, 20 nt, Homo sapiens
ucaguuguggccucauucag

SEQ ID NO: 2112180 - RNA, 13 nt, Homo sapiens
caucuuguuucau

SEQ ID NO: 2112181 - RNA, 22 nt, Homo sapiens
uuaugcaacuaacuguuuacau

SEQ ID NO: 2112182 - RNA, 18 nt, Homo sapiens
aaaaguuuacaacuugau

SEQ ID NO: 2112183 - RNA, 22 nt, Homo sapiens
ccgcuucaaaauaaguguaauc

SEQ ID NO: 2112184 - RNA, 13 nt, Homo sapiens
cugaauacaagcc

SEQ ID NO: 2112185 - RNA, 13 nt, Homo sapiens
ucccugacagagg

SEQ ID NO: 2112186 - RNA, 16 nt, Homo sapiens
aaaugcccauuugccu

SEQ ID NO: 2112187 - RNA, 21 nt, Homo sapiens
ccagacuggucucccaaguga

SEQ ID NO: 2112188 - RNA, 18 nt, Homo sapiens
aaaaaggccuuugggauu

SEQ ID NO: 2112189 - RNA, 21 nt, Homo sapiens
cuucaggaaggacauggacaa

SEQ ID NO: 2112190 - RNA, 18 nt, Homo sapiens
uuacacaaaggaccucag

SEQ ID NO: 2112191 - RNA, 20 nt, Homo sapiens
auuaacuuaagauuugcuca

SEQ ID NO: 2112192 - RNA, 21 nt, Homo sapiens
caggacagaggauuugcucug

SEQ ID NO: 2112193 - RNA, 20 nt, Homo sapiens
aacuuggaugucacugccug

SEQ ID NO: 2112194 - RNA, 17 nt, Homo sapiens
guguuauuugcacacug

SEQ ID NO: 2112195 - RNA, 19 nt, Homo sapiens
aaucuaaacuuuauuccaa

SEQ ID NO: 2112196 - RNA, 13 nt, Homo sapiens
gaagccugcuccu

SEQ ID NO: 2112197 - RNA, 20 nt, Homo sapiens
aggaccuuaaaugcuacuga

SEQ ID NO: 2112198 - RNA, 18 nt, Homo sapiens
gcugccggcugcacccug

SEQ ID NO: 2112199 - RNA, 12 nt, Homo sapiens
acucucuuccuu

SEQ ID NO: 2112200 - RNA, 18 nt, Homo sapiens
uuccaguguucuaugaac

SEQ ID NO: 2112201 - RNA, 15 nt, Homo sapiens
uauuuuaaaccaauu

SEQ ID NO: 2112202 - RNA, 15 nt, Homo sapiens
aauugggaguccagg

SEQ ID NO: 2112203 - RNA, 18 nt, Homo sapiens
uacuccuugccauuuuca

SEQ ID NO: 2112204 - RNA, 18 nt, Homo sapiens
ccuucucuucuauccugc

SEQ ID NO: 2112205 - RNA, 18 nt, Homo sapiens
cacuucccgccuccauga

SEQ ID NO: 2112206 - RNA, 19 nt, Homo sapiens
caucagucccccugugcau

SEQ ID NO: 2112207 - RNA, 16 nt, Homo sapiens
uuccagaaucuugacu

SEQ ID NO: 2112208 - RNA, 15 nt, Homo sapiens
gcugagaacuccuga

SEQ ID NO: 2112209 - RNA, 14 nt, Homo sapiens
agaaaucacaauga

SEQ ID NO: 2112210 - RNA, 18 nt, Homo sapiens
cuguacauuauaaaccuu

SEQ ID NO: 2112211 - RNA, 22 nt, Homo sapiens
acuugauuuuuuucauuuugcc

SEQ ID NO: 2112212 - RNA, 15 nt, Homo sapiens
aagaugacucugaga

SEQ ID NO: 2112213 - RNA, 14 nt, Homo sapiens
uuuuuuaacuugaa

SEQ ID NO: 2112214 - RNA, 16 nt, Homo sapiens
caacccaauauugcua

SEQ ID NO: 2112215 - RNA, 23 nt, Homo sapiens
aacuucucccuucuccugaccua

SEQ ID NO: 2112216 - RNA, 16 nt, Homo sapiens
gggcagggacccgggg

SEQ ID NO: 2112217 - RNA, 20 nt, Homo sapiens
ugaacuuguagcuguaaaac

SEQ ID NO: 2112218 - RNA, 12 nt, Homo sapiens
caccacagcaga

SEQ ID NO: 2112219 - RNA, 16 nt, Homo sapiens
auuggaccagugcucu

SEQ ID NO: 2112220 - RNA, 13 nt, Homo sapiens
caaaugaaugagc

SEQ ID NO: 2112221 - RNA, 13 nt, Homo sapiens
uggauuagcuuuu

SEQ ID NO: 2112222 - RNA, 14 nt, Homo sapiens
gaaaccuacagcau

SEQ ID NO: 2112223 - RNA, 23 nt, Homo sapiens
cagaaauuccuucccacucaugu

SEQ ID NO: 2112224 - RNA, 18 nt, Homo sapiens
caagaauuguuaccuguc

SEQ ID NO: 2112225 - RNA, 18 nt, Homo sapiens
uauauagaauuuccugua

SEQ ID NO: 2112226 - RNA, 21 nt, Homo sapiens
cucaaguagcauuuacugugu

SEQ ID NO: 2112227 - RNA, 16 nt, Homo sapiens
acauuaggcuguggug

SEQ ID NO: 2112228 - RNA, 23 nt, Homo sapiens
cauucauugcagcaguagccuua

SEQ ID NO: 2112229 - RNA, 16 nt, Homo sapiens
uaaaccugaagauguc

SEQ ID NO: 2112230 - RNA, 20 nt, Homo sapiens
gaucuagccuccaucaugaa

SEQ ID NO: 2112231 - RNA, 19 nt, Homo sapiens
caguggucccagaaccuau

SEQ ID NO: 2112232 - RNA, 20 nt, Homo sapiens
aagagcagucuaucauugca

SEQ ID NO: 2112233 - RNA, 22 nt, Homo sapiens
agucacggcugcgcacuguguc

SEQ ID NO: 2112234 - RNA, 14 nt, Homo sapiens
auacuuaaucucac

SEQ ID NO: 2112235 - RNA, 22 nt, Homo sapiens
gggcuguccugagcccccugca

SEQ ID NO: 2112236 - RNA, 12 nt, Homo sapiens
acccuguugcua

SEQ ID NO: 2112237 - RNA, 17 nt, Homo sapiens
aaagcgcuuuuccuugg

SEQ ID NO: 2112238 - RNA, 23 nt, Homo sapiens
cuaauuguacccuucuugucucu

SEQ ID NO: 2112239 - RNA, 21 nt, Homo sapiens
cuccccaguagagaaacauuu

SEQ ID NO: 2112240 - RNA, 22 nt, Homo sapiens
auaaaccguuuuuaacacauag

SEQ ID NO: 2112241 - RNA, 20 nt, Homo sapiens
uguaccaugugcuacagggg

SEQ ID NO: 2112242 - RNA, 16 nt, Homo sapiens
aucuaauaaacuucca

SEQ ID NO: 2112243 - RNA, 18 nt, Homo sapiens
agcuagcuucugcaaugu

SEQ ID NO: 2112244 - RNA, 22 nt, Homo sapiens
uuaaccaagauuaaaugggaug

SEQ ID NO: 2112245 - RNA, 17 nt, Homo sapiens
uuaguacguguggcuug

SEQ ID NO: 2112246 - RNA, 18 nt, Homo sapiens
guuuuuauaccagcuuaa

SEQ ID NO: 2112247 - RNA, 16 nt, Homo sapiens
aacagauccaauggga

SEQ ID NO: 2112248 - RNA, 21 nt, Homo sapiens
caggagggguuaaagcugccg

SEQ ID NO: 2112249 - RNA, 21 nt, Homo sapiens
uauauuguagcaguuacagcu

SEQ ID NO: 2112250 - RNA, 22 nt, Homo sapiens
uuggcucaugucuguaauccca

SEQ ID NO: 2112251 - RNA, 21 nt, Homo sapiens
gcauacuacaguaacugugac

SEQ ID NO: 2112252 - RNA, 18 nt, Homo sapiens
auuuuuguagcacugaca

SEQ ID NO: 2112253 - RNA, 19 nt, Homo sapiens
gacgaggggugucuugggc

SEQ ID NO: 2112254 - RNA, 17 nt, Homo sapiens
aagccacaagucuucca

SEQ ID NO: 2112255 - RNA, 17 nt, Homo sapiens
aguccuacaagcuaaaa

SEQ ID NO: 2112256 - RNA, 15 nt, Homo sapiens
aucuccauucucuca

SEQ ID NO: 2112257 - RNA, 20 nt, Homo sapiens
agguucaaugagaugguggc

SEQ ID NO: 2112258 - RNA, 19 nt, Homo sapiens
aucucauuugguacaguca

SEQ ID NO: 2112259 - RNA, 14 nt, Homo sapiens
uucucuccaccagg

SEQ ID NO: 2112260 - RNA, 20 nt, Homo sapiens
agaagagccugacuguguuc

SEQ ID NO: 2112261 - RNA, 17 nt, Homo sapiens
cuuccagaaaacaaaac

SEQ ID NO: 2112262 - RNA, 22 nt, Homo sapiens
aguggagaguguuccuguugaa

SEQ ID NO: 2112263 - RNA, 19 nt, Homo sapiens
uagaaauguauccugauaa

SEQ ID NO: 2112264 - RNA, 21 nt, Homo sapiens
uuucugucaggggcucccaca

SEQ ID NO: 2112265 - RNA, 22 nt, Homo sapiens
uucaguagcaggaccugccaag

SEQ ID NO: 2112266 - RNA, 22 nt, Homo sapiens
uauguacccuacccugcacauu

SEQ ID NO: 2112267 - RNA, 18 nt, Homo sapiens
cacaaaggauuugaugcu

SEQ ID NO: 2112268 - RNA, 19 nt, Homo sapiens
cccaaggaagaacaaauau

SEQ ID NO: 2112269 - RNA, 23 nt, Homo sapiens
aggagacaaguuccaugggauac

SEQ ID NO: 2112270 - RNA, 21 nt, Homo sapiens
acaagauaaugcuggcuccaa

SEQ ID NO: 2112271 - RNA, 12 nt, Homo sapiens
ugagucuucacu

SEQ ID NO: 2112272 - RNA, 20 nt, Homo sapiens
ucauugauagaacuacuuug

SEQ ID NO: 2112273 - RNA, 23 nt, Homo sapiens
agaagggccagauuucauucuca

SEQ ID NO: 2112274 - RNA, 12 nt, Homo sapiens
ugcagcauacca

SEQ ID NO: 2112275 - RNA, 21 nt, Homo sapiens
accagugaaagaguagugcau

SEQ ID NO: 2112276 - RNA, 21 nt, Homo sapiens
acauguuaaugacaauauucc

SEQ ID NO: 2112277 - RNA, 21 nt, Homo sapiens
ugguaugugggugacccugga

SEQ ID NO: 2112278 - RNA, 12 nt, Homo sapiens
ccauaggccauu

SEQ ID NO: 2112279 - RNA, 13 nt, Homo sapiens
aauaaaggcaccu

SEQ ID NO: 2112280 - RNA, 13 nt, Homo sapiens
gagggagugcugu

SEQ ID NO: 2112281 - RNA, 14 nt, Homo sapiens
cuccuuuuaagggu

SEQ ID NO: 2112282 - RNA, 13 nt, Homo sapiens
agagcccuugccu

SEQ ID NO: 2112283 - RNA, 17 nt, Homo sapiens
cgaggccuauuguugaa

SEQ ID NO: 2112284 - RNA, 20 nt, Homo sapiens
auauauuuacaaggaguuau

SEQ ID NO: 2112285 - RNA, 15 nt, Homo sapiens
ucuguccuaccucca

SEQ ID NO: 2112286 - RNA, 13 nt, Homo sapiens
aaagcaaaccugu

SEQ ID NO: 2112287 - RNA, 18 nt, Homo sapiens
gaacaucccaagccagaa

SEQ ID NO: 2112288 - RNA, 14 nt, Homo sapiens
aaaaacuauaugua

SEQ ID NO: 2112289 - RNA, 16 nt, Homo sapiens
accuucaagaucucau

SEQ ID NO: 2112290 - RNA, 16 nt, Homo sapiens
uauccaaucugugaug

SEQ ID NO: 2112291 - RNA, 14 nt, Homo sapiens
gauuaaugaccuga

SEQ ID NO: 2112292 - RNA, 20 nt, Homo sapiens
gguggcucugugugcucuga

SEQ ID NO: 2112293 - RNA, 16 nt, Homo sapiens
uguaaugagagcacuu

SEQ ID NO: 2112294 - RNA, 17 nt, Homo sapiens
ggaaucguacauuuugc

SEQ ID NO: 2112295 - RNA, 22 nt, Homo sapiens
aacagcaacacaaagcuuuugc

SEQ ID NO: 2112296 - RNA, 19 nt, Homo sapiens
gcuugcugguagcacuugc

SEQ ID NO: 2112297 - RNA, 20 nt, Homo sapiens
ugccucgcuccccacucugc

SEQ ID NO: 2112298 - RNA, 17 nt, Homo sapiens
gaauaucaucugucauu

SEQ ID NO: 2112299 - RNA, 16 nt, Homo sapiens
cuuagcagcauuccau

SEQ ID NO: 2112300 - RNA, 20 nt, Homo sapiens
auaccccuuacuuagcaugc

SEQ ID NO: 2112301 - RNA, 11 nt, Homo sapiens
caggcucugcu

SEQ ID NO: 2112302 - RNA, 14 nt, Homo sapiens
gaugguaaaguuag

SEQ ID NO: 2112303 - RNA, 13 nt, Homo sapiens
acaccugagacau

SEQ ID NO: 2112304 - RNA, 12 nt, Homo sapiens
uuuucucaguca

SEQ ID NO: 2112305 - RNA, 12 nt, Homo sapiens
uccacucagcuu

SEQ ID NO: 2112306 - RNA, 13 nt, Homo sapiens
augguaacuuuac

SEQ ID NO: 2112307 - RNA, 13 nt, Homo sapiens
gcagggacuguaa

SEQ ID NO: 2112308 - RNA, 20 nt, Homo sapiens
gaaaguccagcuaacauacu

SEQ ID NO: 2112309 - RNA, 19 nt, Homo sapiens
gucaucccucccaaugcca

SEQ ID NO: 2112310 - RNA, 15 nt, Homo sapiens
caacaaaaagacaug

SEQ ID NO: 2112311 - RNA, 19 nt, Homo sapiens
cagguaagggggugcagca

SEQ ID NO: 2112312 - RNA, 15 nt, Homo sapiens
cuucuccgaggggcu

SEQ ID NO: 2112313 - RNA, 22 nt, Homo sapiens
uaaaauuagaggacacuauuga

SEQ ID NO: 2112314 - RNA, 21 nt, Homo sapiens
auuuuuguagcacugacagau

SEQ ID NO: 2112315 - RNA, 13 nt, Homo sapiens
agauuaaaucaua

SEQ ID NO: 2112316 - RNA, 13 nt, Homo sapiens
ugagcguuugcac

SEQ ID NO: 2112317 - RNA, 15 nt, Homo sapiens
ucugugcacugccca

SEQ ID NO: 2112318 - RNA, 21 nt, Homo sapiens
agaaccugcuaaggcugccuc

SEQ ID NO: 2112319 - RNA, 21 nt, Homo sapiens
agucuggcgucuccagacucu

SEQ ID NO: 2112320 - RNA, 14 nt, Homo sapiens
ccaaauuuggcuaa

SEQ ID NO: 2112321 - RNA, 16 nt, Homo sapiens
cuuaaaaaguuauaac

SEQ ID NO: 2112322 - RNA, 16 nt, Homo sapiens
ugaaagggguugugaa

SEQ ID NO: 2112323 - RNA, 18 nt, Homo sapiens
cguuuucuaauugcuuau

SEQ ID NO: 2112324 - RNA, 13 nt, Homo sapiens
auuccaccaacag

SEQ ID NO: 2112325 - RNA, 14 nt, Homo sapiens
cuuaaugcucugau

SEQ ID NO: 2112326 - RNA, 23 nt, Homo sapiens
augccuguaauccuagcacuuug

SEQ ID NO: 2112327 - RNA, 20 nt, Homo sapiens
uaucaggacugugaccaaag

SEQ ID NO: 2112328 - RNA, 15 nt, Homo sapiens
uugcaccauugcacu

SEQ ID NO: 2112329 - RNA, 15 nt, Homo sapiens
uacauacauacauau

SEQ ID NO: 2112330 - RNA, 13 nt, Homo sapiens
aaugaacagugau

SEQ ID NO: 2112331 - RNA, 14 nt, Homo sapiens
gagauaguugcuaa

SEQ ID NO: 2112332 - RNA, 13 nt, Homo sapiens
cacccaccugcug

SEQ ID NO: 2112333 - RNA, 13 nt, Homo sapiens
cugggaugccugu

SEQ ID NO: 2112334 - RNA, 16 nt, Homo sapiens
uuuaaggucugacuga

SEQ ID NO: 2112335 - RNA, 19 nt, Homo sapiens
cuugcacccaggcccagcu

SEQ ID NO: 2112336 - RNA, 19 nt, Homo sapiens
agugagucgagauugcacu

SEQ ID NO: 2112337 - RNA, 14 nt, Homo sapiens
cugcagacauucuc

SEQ ID NO: 2112338 - RNA, 13 nt, Homo sapiens
aguaccuggaccu

SEQ ID NO: 2112339 - RNA, 24 nt, Homo sapiens
aaaguuuuugucacuaucuucaca

SEQ ID NO: 2112340 - RNA, 14 nt, Homo sapiens
cuuaaccuaccugg

SEQ ID NO: 2112341 - RNA, 15 nt, Homo sapiens
caucaguucauugac

SEQ ID NO: 2112342 - RNA, 23 nt, Homo sapiens
cagccuggaggccgggugcucag

SEQ ID NO: 2112343 - RNA, 21 nt, Homo sapiens
cuccuguuuguugagugcacu

SEQ ID NO: 2112344 - RNA, 20 nt, Homo sapiens
aucugcugaaagcucagcug

SEQ ID NO: 2112345 - RNA, 23 nt, Homo sapiens
aagaaaguuuagaagcugagaca

SEQ ID NO: 2112346 - RNA, 18 nt, Homo sapiens
cuauguuuggcugcuaga

SEQ ID NO: 2112347 - RNA, 23 nt, Homo sapiens
agcuacguauuuaauagcaaaga

SEQ ID NO: 2112348 - RNA, 23 nt, Homo sapiens
agaugaauccuagcuucuuccau

SEQ ID NO: 2112349 - RNA, 17 nt, Homo sapiens
aguccuucccuuucauu

SEQ ID NO: 2112350 - RNA, 23 nt, Homo sapiens
uggaguccuguucucagagcucc

SEQ ID NO: 2112351 - RNA, 14 nt, Homo sapiens
cccuuggugcgagg

SEQ ID NO: 2112352 - RNA, 19 nt, Homo sapiens
auaggaggaucacuugaac

SEQ ID NO: 2112353 - RNA, 22 nt, Homo sapiens
aucaguucuguguggugcauuc

SEQ ID NO: 2112354 - RNA, 16 nt, Homo sapiens
aaaauggccagugaga

SEQ ID NO: 2112355 - RNA, 21 nt, Homo sapiens
gaaaaaaugugccauuuugca

SEQ ID NO: 2112356 - RNA, 16 nt, Homo sapiens
uuccuggcagcugcug

SEQ ID NO: 2112357 - RNA, 19 nt, Homo sapiens
aacaccaguguuagcuuaa

SEQ ID NO: 2112358 - RNA, 19 nt, Homo sapiens
cuuucaucuaaauuacuga

SEQ ID NO: 2112359 - RNA, 12 nt, Homo sapiens
auuugguguaca

SEQ ID NO: 2112360 - RNA, 22 nt, Homo sapiens
auccuaaauaaaaaaagacaaa

SEQ ID NO: 2112361 - RNA, 21 nt, Homo sapiens
gcccuucacuguccauuccaa

SEQ ID NO: 2112362 - RNA, 22 nt, Homo sapiens
uucguggagcccuacucacaca

SEQ ID NO: 2112363 - RNA, 18 nt, Homo sapiens
uuaaagucaacaaccaug

SEQ ID NO: 2112364 - RNA, 19 nt, Homo sapiens
agcggcuuccugaugaugg

SEQ ID NO: 2112365 - RNA, 19 nt, Homo sapiens
aagccugguccccagaaau

SEQ ID NO: 2112366 - RNA, 13 nt, Homo sapiens
cagccucuacagc

SEQ ID NO: 2112367 - RNA, 12 nt, Homo sapiens
aucaugugaaau

SEQ ID NO: 2112368 - RNA, 17 nt, Homo sapiens
aagugaacacuuaccug

SEQ ID NO: 2112369 - RNA, 17 nt, Homo sapiens
cauucuacuucagcuuu

SEQ ID NO: 2112370 - RNA, 18 nt, Homo sapiens
uggccaaauaugcacuuu

SEQ ID NO: 2112371 - RNA, 22 nt, Homo sapiens
ccagcacucacacccuaacuca

SEQ ID NO: 2112372 - RNA, 22 nt, Homo sapiens
aacacuuuaacgucuuacauuu

SEQ ID NO: 2112373 - RNA, 17 nt, Homo sapiens
ucuagagacacauugga

SEQ ID NO: 2112374 - RNA, 14 nt, Homo sapiens
ccugggaauggaau

SEQ ID NO: 2112375 - RNA, 13 nt, Homo sapiens
uuuagcagucaga

SEQ ID NO: 2112376 - RNA, 22 nt, Homo sapiens
ccuauaauuuuaaaguaucauu

SEQ ID NO: 2112377 - RNA, 20 nt, Homo sapiens
ccucugagcuuugcauguuc

SEQ ID NO: 2112378 - RNA, 17 nt, Homo sapiens
uggggaaaaaacugugc

SEQ ID NO: 2112379 - RNA, 13 nt, Homo sapiens
gcaguauggccau

SEQ ID NO: 2112380 - RNA, 20 nt, Homo sapiens
guuuaugucaucauacauga

SEQ ID NO: 2112381 - RNA, 18 nt, Homo sapiens
auuuuuuugagacagagu

SEQ ID NO: 2112382 - RNA, 13 nt, Homo sapiens
acacaccucuuga

SEQ ID NO: 2112383 - RNA, 19 nt, Homo sapiens
agguagacuuuuaauauca

SEQ ID NO: 2112384 - RNA, 18 nt, Homo sapiens
ucaucuucaaaaaauuau

SEQ ID NO: 2112385 - RNA, 15 nt, Homo sapiens
uagaacuuucugcuu

SEQ ID NO: 2112386 - RNA, 11 nt, Homo sapiens
uaccugcugag

SEQ ID NO: 2112387 - RNA, 13 nt, Homo sapiens
gccuguaacagcc

SEQ ID NO: 2112388 - RNA, 16 nt, Homo sapiens
ugucaaugauuucaaa

SEQ ID NO: 2112389 - RNA, 22 nt, Homo sapiens
uguacccuaaaacuuaaaguau

SEQ ID NO: 2112390 - RNA, 14 nt, Homo sapiens
augcccaaccuaag

SEQ ID NO: 2112391 - RNA, 21 nt, Homo sapiens
cacgaaaugggccauuccagu

SEQ ID NO: 2112392 - RNA, 21 nt, Homo sapiens
uguccagagauaaaaaucaua

SEQ ID NO: 2112393 - RNA, 19 nt, Homo sapiens
guauaacacaauaugaaua

SEQ ID NO: 2112394 - RNA, 16 nt, Homo sapiens
cuuaagugugcaaaau

SEQ ID NO: 2112395 - RNA, 19 nt, Homo sapiens
aauccuucuggcagauuca

SEQ ID NO: 2112396 - RNA, 21 nt, Homo sapiens
aacugugucuggcguucucaa

SEQ ID NO: 2112397 - RNA, 19 nt, Homo sapiens
agagguuuagacagcagua

SEQ ID NO: 2112398 - RNA, 16 nt, Homo sapiens
guguuccucaccaaua

SEQ ID NO: 2112399 - RNA, 13 nt, Homo sapiens
aagucagcuuuca

SEQ ID NO: 2112400 - RNA, 17 nt, Homo sapiens
guauaugagacuuucaa

SEQ ID NO: 2112401 - RNA, 21 nt, Homo sapiens
gcagccuuuacguucaucacc

SEQ ID NO: 2112402 - RNA, 17 nt, Homo sapiens
uucaugaaacuguccac

SEQ ID NO: 2112403 - RNA, 23 nt, Homo sapiens
gugaucauuagggcugaggucug

SEQ ID NO: 2112404 - RNA, 19 nt, Homo sapiens
cuucgcacacacccaugua

SEQ ID NO: 2112405 - RNA, 18 nt, Homo sapiens
agccaggagcagcccugg

SEQ ID NO: 2112406 - RNA, 15 nt, Homo sapiens
cuccaguaucuccaa

SEQ ID NO: 2112407 - RNA, 14 nt, Homo sapiens
gaaauagugccuua

SEQ ID NO: 2112408 - RNA, 18 nt, Homo sapiens
aauaaugaaggugccauu

SEQ ID NO: 2112409 - RNA, 16 nt, Homo sapiens
gccucccuuucuggga

SEQ ID NO: 2112410 - RNA, 13 nt, Homo sapiens
uuagagaguauaa

SEQ ID NO: 2112411 - RNA, 14 nt, Homo sapiens
uuuaaccaacagaa

SEQ ID NO: 2112412 - RNA, 17 nt, Homo sapiens
cccaggcuggacugcaa

SEQ ID NO: 2112413 - RNA, 14 nt, Homo sapiens
gagcccgagggccu

SEQ ID NO: 2112414 - RNA, 14 nt, Homo sapiens
ccuauguacuugaa

SEQ ID NO: 2112415 - RNA, 24 nt, Homo sapiens
uuuacuuccauaggacauacugca

SEQ ID NO: 2112416 - RNA, 13 nt, Homo sapiens
caaaccaucccag

SEQ ID NO: 2112417 - RNA, 18 nt, Homo sapiens
uuggaugguguuacauau

SEQ ID NO: 2112418 - RNA, 21 nt, Homo sapiens
acucccuagucuccaccugag

SEQ ID NO: 2112419 - RNA, 15 nt, Homo sapiens
aucgaggagcuagaa

SEQ ID NO: 2112420 - RNA, 14 nt, Homo sapiens
caauuucagacucc

SEQ ID NO: 2112421 - RNA, 24 nt, Homo sapiens
ucaaaaugucuaagauaguaacaa

SEQ ID NO: 2112422 - RNA, 22 nt, Homo sapiens
agccuggccagccuacaauggg

SEQ ID NO: 2112423 - RNA, 21 nt, Homo sapiens
gcaucucugcauuuauccuau

SEQ ID NO: 2112424 - RNA, 17 nt, Homo sapiens
ccuguuuucucccucuc

SEQ ID NO: 2112425 - RNA, 23 nt, Homo sapiens
caguguugacauagccuuugugc

SEQ ID NO: 2112426 - RNA, 18 nt, Homo sapiens
agauuuuguuagccaaca

SEQ ID NO: 2112427 - RNA, 20 nt, Homo sapiens
agagugagagacauuaacuc

SEQ ID NO: 2112428 - RNA, 17 nt, Homo sapiens
cagggcagccugucacc

SEQ ID NO: 2112429 - RNA, 15 nt, Homo sapiens
gcccugcagugcccu

SEQ ID NO: 2112430 - RNA, 21 nt, Homo sapiens
ugaaaaaaaaaaacacaaaaa

SEQ ID NO: 2112431 - RNA, 20 nt, Homo sapiens
uauuuuguguuccuaucaaa

SEQ ID NO: 2112432 - RNA, 20 nt, Homo sapiens
uacauuguacuuauacaccu

SEQ ID NO: 2112433 - RNA, 15 nt, Homo sapiens
uauuuuaauaaacac

SEQ ID NO: 2112434 - RNA, 15 nt, Homo sapiens
gcugcuuaauaccaa

SEQ ID NO: 2112435 - RNA, 22 nt, Homo sapiens
ggucugggaaaugagcagggau

SEQ ID NO: 2112436 - RNA, 17 nt, Homo sapiens
gaaguugcugcugugaa

SEQ ID NO: 2112437 - RNA, 12 nt, Homo sapiens
accugagcauga

SEQ ID NO: 2112438 - RNA, 23 nt, Homo sapiens
cuaucaggugccccucuuccaaa

SEQ ID NO: 2112439 - RNA, 20 nt, Homo sapiens
ucagaugguacggacuuccu

SEQ ID NO: 2112440 - RNA, 15 nt, Homo sapiens
uggcgcucucagcuu

SEQ ID NO: 2112441 - RNA, 17 nt, Homo sapiens
uaagagacaacuaucaa

SEQ ID NO: 2112442 - RNA, 14 nt, Homo sapiens
ugcacugacagugg

SEQ ID NO: 2112443 - RNA, 15 nt, Homo sapiens
uugucaaaaggaagu

SEQ ID NO: 2112444 - RNA, 16 nt, Homo sapiens
ugcccaggcaaagugc

SEQ ID NO: 2112445 - RNA, 13 nt, Homo sapiens
aacuagcauucuu

SEQ ID NO: 2112446 - RNA, 18 nt, Homo sapiens
uaaaaauaaaucccaugg

SEQ ID NO: 2112447 - RNA, 13 nt, Homo sapiens
aaaggaccucauu

SEQ ID NO: 2112448 - RNA, 18 nt, Homo sapiens
ugagaccaguguaucagg

SEQ ID NO: 2112449 - RNA, 22 nt, Homo sapiens
cucagguuuguuuugugaauuu

SEQ ID NO: 2112450 - RNA, 17 nt, Homo sapiens
caccauucccaccagcu

SEQ ID NO: 2112451 - RNA, 18 nt, Homo sapiens
aaaaccacagcugggcag

SEQ ID NO: 2112452 - RNA, 19 nt, Homo sapiens
aauaaccguaaagguuuau

SEQ ID NO: 2112453 - RNA, 19 nt, Homo sapiens
ugagccaaagaacaaauaa

SEQ ID NO: 2112454 - RNA, 17 nt, Homo sapiens
accaaaauuacuaauaa

SEQ ID NO: 2112455 - RNA, 14 nt, Homo sapiens
acaacuuaaugugc

SEQ ID NO: 2112456 - RNA, 14 nt, Homo sapiens
gccuugggcugcuc

SEQ ID NO: 2112457 - RNA, 16 nt, Homo sapiens
gaggaauuuggcugcu

SEQ ID NO: 2112458 - RNA, 16 nt, Homo sapiens
agcagucauagggcug

SEQ ID NO: 2112459 - RNA, 13 nt, Homo sapiens
cuaaugugucauc

SEQ ID NO: 2112460 - RNA, 15 nt, Homo sapiens
ggcaagagaauugaa

SEQ ID NO: 2112461 - RNA, 18 nt, Homo sapiens
caaccagaggaaucuaua

SEQ ID NO: 2112462 - RNA, 12 nt, Homo sapiens
gcugagaacaaa

SEQ ID NO: 2112463 - RNA, 19 nt, Homo sapiens
uuaagaaacaaaagugcau

SEQ ID NO: 2112464 - RNA, 16 nt, Homo sapiens
cagagauaaaccaaua

SEQ ID NO: 2112465 - RNA, 17 nt, Homo sapiens
auuauaaacuguaugcu

SEQ ID NO: 2112466 - RNA, 14 nt, Homo sapiens
augcauuucuauca

SEQ ID NO: 2112467 - RNA, 19 nt, Homo sapiens
gcagaacugaagagacuag

SEQ ID NO: 2112468 - RNA, 19 nt, Homo sapiens
auacacauuuuuugccacu

SEQ ID NO: 2112469 - RNA, 21 nt, Homo sapiens
uucauauauccgaacuacugu

SEQ ID NO: 2112470 - RNA, 15 nt, Homo sapiens
gcugccucccugucc

SEQ ID NO: 2112471 - RNA, 20 nt, Homo sapiens
ucccaaguaggugggauuac

SEQ ID NO: 2112472 - RNA, 12 nt, Homo sapiens
aacaauccaaaa

SEQ ID NO: 2112473 - RNA, 12 nt, Homo sapiens
auaaauccauca

SEQ ID NO: 2112474 - RNA, 17 nt, Homo sapiens
gauauuuuuuggugugc

SEQ ID NO: 2112475 - RNA, 20 nt, Homo sapiens
ugguaacuguuaaauugcug

SEQ ID NO: 2112476 - RNA, 11 nt, Homo sapiens
uccuucccaau

SEQ ID NO: 2112477 - RNA, 22 nt, Homo sapiens
ggccagggugggaagagaagaa

SEQ ID NO: 2112478 - RNA, 20 nt, Homo sapiens
agggcgagacuccgucucaa

SEQ ID NO: 2112479 - RNA, 13 nt, Homo sapiens
aggacuaggcaug

SEQ ID NO: 2112480 - RNA, 20 nt, Homo sapiens
auaaacuguaugcucacaac

SEQ ID NO: 2112481 - RNA, 18 nt, Homo sapiens
augaagcuuuauacgugu

SEQ ID NO: 2112482 - RNA, 19 nt, Homo sapiens
aagauggauguaauucuca

SEQ ID NO: 2112483 - RNA, 23 nt, Homo sapiens
ugagugcaaauccauagcacaag

SEQ ID NO: 2112484 - RNA, 22 nt, Homo sapiens
uuucucgcacaauacaacucac

SEQ ID NO: 2112485 - RNA, 18 nt, Homo sapiens
ugggcagugcaggacaac

SEQ ID NO: 2112486 - RNA, 13 nt, Homo sapiens
acaagugacugua

SEQ ID NO: 2112487 - RNA, 23 nt, Homo sapiens
guaacuaaaacuuuucaguucua

SEQ ID NO: 2112488 - RNA, 14 nt, Homo sapiens
ucgagcaucaggcu

SEQ ID NO: 2112489 - RNA, 13 nt, Homo sapiens
uucacuucacugu

SEQ ID NO: 2112490 - RNA, 19 nt, Homo sapiens
accgugaccguuugcuaua

SEQ ID NO: 2112491 - RNA, 21 nt, Homo sapiens
aggaaacuccacaucugccuu

SEQ ID NO: 2112492 - RNA, 19 nt, Homo sapiens
gggugcucucucugagggg

SEQ ID NO: 2112493 - RNA, 16 nt, Homo sapiens
uaaauucacauccuca

SEQ ID NO: 2112494 - RNA, 14 nt, Homo sapiens
ugacaagcacugcu

SEQ ID NO: 2112495 - RNA, 14 nt, Homo sapiens
aggaaucagcucaa

SEQ ID NO: 2112496 - RNA, 15 nt, Homo sapiens
uugaaaucugaaugc

SEQ ID NO: 2112497 - RNA, 16 nt, Homo sapiens
gauucaugcacuguag

SEQ ID NO: 2112498 - RNA, 22 nt, Homo sapiens
aacugaugcgaaaacuugaauc

SEQ ID NO: 2112499 - RNA, 19 nt, Homo sapiens
cugcaaguguaucuccuuu

SEQ ID NO: 2112500 - RNA, 16 nt, Homo sapiens
uaguuaaagaaaggaa

SEQ ID NO: 2112501 - RNA, 21 nt, Homo sapiens
cuuuccuggacuuaacucuaa

SEQ ID NO: 2112502 - RNA, 23 nt, Homo sapiens
cucuucuacguauaaauaugaaa

SEQ ID NO: 2112503 - RNA, 19 nt, Homo sapiens
cugagcaaaucaccacaaa

SEQ ID NO: 2112504 - RNA, 17 nt, Homo sapiens
auuuugguuuguguauc

SEQ ID NO: 2112505 - RNA, 14 nt, Homo sapiens
guaugguguguuca

SEQ ID NO: 2112506 - RNA, 14 nt, Homo sapiens
aauacaucaaagag

SEQ ID NO: 2112507 - RNA, 18 nt, Homo sapiens
auaaaaugaaccugauca

SEQ ID NO: 2112508 - RNA, 22 nt, Homo sapiens
gcugggccaguuccuccaagag

SEQ ID NO: 2112509 - RNA, 19 nt, Homo sapiens
ccacgugugcagacugugg

SEQ ID NO: 2112510 - RNA, 17 nt, Homo sapiens
aaaaaggugccaucuca

SEQ ID NO: 2112511 - RNA, 17 nt, Homo sapiens
ugaguuagacucaaggg

SEQ ID NO: 2112512 - RNA, 16 nt, Homo sapiens
uguugugauguacaca

SEQ ID NO: 2112513 - RNA, 18 nt, Homo sapiens
accucaaguguccugaaa

SEQ ID NO: 2112514 - RNA, 14 nt, Homo sapiens
caguggugccauca

SEQ ID NO: 2112515 - RNA, 20 nt, Homo sapiens
aaacugagccucuuuucaau

SEQ ID NO: 2112516 - RNA, 20 nt, Homo sapiens
cuuuaguacucaauguuucu

SEQ ID NO: 2112517 - RNA, 18 nt, Homo sapiens
caaaaaaguuguuaacua

SEQ ID NO: 2112518 - RNA, 14 nt, Homo sapiens
ggauuccugagcug

SEQ ID NO: 2112519 - RNA, 14 nt, Homo sapiens
auaugcuccugccu

SEQ ID NO: 2112520 - RNA, 23 nt, Homo sapiens
uacuggaaugguguuuugucaga

SEQ ID NO: 2112521 - RNA, 16 nt, Homo sapiens
aauuacccuuuugcag

SEQ ID NO: 2112522 - RNA, 19 nt, Homo sapiens
cuuugagaccauccauucu

SEQ ID NO: 2112523 - RNA, 14 nt, Homo sapiens
uugcacuggauaaa

SEQ ID NO: 2112524 - RNA, 22 nt, Homo sapiens
ucaaaucuuaagagaauccaca

SEQ ID NO: 2112525 - RNA, 15 nt, Homo sapiens
gauauccugaucucg

SEQ ID NO: 2112526 - RNA, 19 nt, Homo sapiens
uauacaaagcugucacuca

SEQ ID NO: 2112527 - RNA, 16 nt, Homo sapiens
ugagaaggccaggaaa

SEQ ID NO: 2112528 - RNA, 19 nt, Homo sapiens
auuucaaaguccagauacc

SEQ ID NO: 2112529 - RNA, 23 nt, Homo sapiens
uuauaagagugccguaacaacug

SEQ ID NO: 2112530 - RNA, 13 nt, Homo sapiens
acaugaccaaaaa

SEQ ID NO: 2112531 - RNA, 23 nt, Homo sapiens
uccucacaucuuucacacuucca

SEQ ID NO: 2112532 - RNA, 19 nt, Homo sapiens
aauaguuuugauccuaaau

SEQ ID NO: 2112533 - RNA, 22 nt, Homo sapiens
ugaaugccaguccagaugugcc

SEQ ID NO: 2112534 - RNA, 23 nt, Homo sapiens
acuacacagcuccugagcuugau

SEQ ID NO: 2112535 - RNA, 14 nt, Homo sapiens
uacaaaacaauuca

SEQ ID NO: 2112536 - RNA, 14 nt, Homo sapiens
uguacuacagcuau

SEQ ID NO: 2112537 - RNA, 19 nt, Homo sapiens
uagaagauuuuaugcugcu

SEQ ID NO: 2112538 - RNA, 19 nt, Homo sapiens
uuugccaaaauaccagagc

SEQ ID NO: 2112539 - RNA, 22 nt, Homo sapiens
ugcccagucgaccccaaaggaa

SEQ ID NO: 2112540 - RNA, 16 nt, Homo sapiens
auguccuccucuguga

SEQ ID NO: 2112541 - RNA, 21 nt, Homo sapiens
ucaaaugaguaacauuugcug

SEQ ID NO: 2112542 - RNA, 19 nt, Homo sapiens
agcuaugauaugugcuugu

SEQ ID NO: 2112543 - RNA, 20 nt, Homo sapiens
ugcuguuuuuuuugcugcua

SEQ ID NO: 2112544 - RNA, 19 nt, Homo sapiens
gccugugugcguguguaua

SEQ ID NO: 2112545 - RNA, 14 nt, Homo sapiens
cacuuuuuccaaau

SEQ ID NO: 2112546 - RNA, 22 nt, Homo sapiens
acuagaaccuucuaauccaugu

SEQ ID NO: 2112547 - RNA, 21 nt, Homo sapiens
ggccuggggcgagcacuguga

SEQ ID NO: 2112548 - RNA, 16 nt, Homo sapiens
uagccauguggcugcc

SEQ ID NO: 2112549 - RNA, 17 nt, Homo sapiens
uccacgccucugcugua

SEQ ID NO: 2112550 - RNA, 20 nt, Homo sapiens
auuacuauugcaaaagggaa

SEQ ID NO: 2112551 - RNA, 22 nt, Homo sapiens
aggaguccaguuugugcaagac

SEQ ID NO: 2112552 - RNA, 15 nt, Homo sapiens
uuaauuauauuucua

SEQ ID NO: 2112553 - RNA, 13 nt, Homo sapiens
ccugcacugggaa

SEQ ID NO: 2112554 - RNA, 13 nt, Homo sapiens
gccugggccucug

SEQ ID NO: 2112555 - RNA, 20 nt, Homo sapiens
uccaacaugugcucagggaa

SEQ ID NO: 2112556 - RNA, 19 nt, Homo sapiens
aggugggggaacacugaga

SEQ ID NO: 2112557 - RNA, 19 nt, Homo sapiens
aacauguggacuuuuacaa

SEQ ID NO: 2112558 - RNA, 12 nt, Homo sapiens
accucauuugca

SEQ ID NO: 2112559 - RNA, 24 nt, Homo sapiens
ccugauaaacauuaaacacuguaa

SEQ ID NO: 2112560 - RNA, 20 nt, Homo sapiens
auugaagaccagcuuucuca

SEQ ID NO: 2112561 - RNA, 14 nt, Homo sapiens
cuuagaaagucuga

SEQ ID NO: 2112562 - RNA, 13 nt, Homo sapiens
ucuaacaaacaag

SEQ ID NO: 2112563 - RNA, 15 nt, Homo sapiens
agauaucagugucuc

SEQ ID NO: 2112564 - RNA, 22 nt, Homo sapiens
aauaaaaugccccacauuuuac

SEQ ID NO: 2112565 - RNA, 19 nt, Homo sapiens
uguaaaaagaaaaaccacu

SEQ ID NO: 2112566 - RNA, 23 nt, Homo sapiens
agacaagcauugggucagaccca

SEQ ID NO: 2112567 - RNA, 13 nt, Homo sapiens
auccugaccagcu

SEQ ID NO: 2112568 - RNA, 16 nt, Homo sapiens
ugaucaguugccaaag

SEQ ID NO: 2112569 - RNA, 17 nt, Homo sapiens
ggcuaguuaauccaaac

SEQ ID NO: 2112570 - RNA, 12 nt, Homo sapiens
cacaauucuguc

SEQ ID NO: 2112571 - RNA, 17 nt, Homo sapiens
cuagaguucauggauau

SEQ ID NO: 2112572 - RNA, 20 nt, Homo sapiens
ucauccugaacagcauggca

SEQ ID NO: 2112573 - RNA, 22 nt, Homo sapiens
ccacauagguaaaaacuggaau

SEQ ID NO: 2112574 - RNA, 20 nt, Homo sapiens
gugugccccccauccuggcc

SEQ ID NO: 2112575 - RNA, 22 nt, Homo sapiens
uuucucaaaggcccucagugag

SEQ ID NO: 2112576 - RNA, 21 nt, Homo sapiens
uguauccucugaccuacauac

SEQ ID NO: 2112577 - RNA, 16 nt, Homo sapiens
auguaaacuguuucuu

SEQ ID NO: 2112578 - RNA, 23 nt, Homo sapiens
augaccaguaaaggcugcugcua

SEQ ID NO: 2112579 - RNA, 17 nt, Homo sapiens
uagaaucaagucuguga

SEQ ID NO: 2112580 - RNA, 19 nt, Homo sapiens
cauucaggcaacgcacaaa

SEQ ID NO: 2112581 - RNA, 19 nt, Homo sapiens
cagacuucaagaccauccu

SEQ ID NO: 2112582 - RNA, 20 nt, Homo sapiens
ugcugcaaacccaugaagcu

SEQ ID NO: 2112583 - RNA, 12 nt, Homo sapiens
caaguggcaugu

SEQ ID NO: 2112584 - RNA, 15 nt, Homo sapiens
guuggccugguggcc

SEQ ID NO: 2112585 - RNA, 16 nt, Homo sapiens
auaacuuccacagggu

SEQ ID NO: 2112586 - RNA, 21 nt, Homo sapiens
uccagccgccggcugugcagu

SEQ ID NO: 2112587 - RNA, 13 nt, Homo sapiens
acauuccuaucaa

SEQ ID NO: 2112588 - RNA, 17 nt, Homo sapiens
aagcacuuuaagaauau

SEQ ID NO: 2112589 - RNA, 15 nt, Homo sapiens
acagucccuauggaa

SEQ ID NO: 2112590 - RNA, 17 nt, Homo sapiens
agaacgggaguggccau

SEQ ID NO: 2112591 - RNA, 14 nt, Homo sapiens
aguaaauuaggcag

SEQ ID NO: 2112592 - RNA, 13 nt, Homo sapiens
aaaguccagcuca

SEQ ID NO: 2112593 - RNA, 15 nt, Homo sapiens
ccacuugaacaaaau

SEQ ID NO: 2112594 - RNA, 15 nt, Homo sapiens
gguuaugacagggag

SEQ ID NO: 2112595 - RNA, 14 nt, Homo sapiens
ugcuccuccuccau

SEQ ID NO: 2112596 - RNA, 19 nt, Homo sapiens
cagccugggcagcauagca

SEQ ID NO: 2112597 - RNA, 17 nt, Homo sapiens
ggacgcacagugcaguu

SEQ ID NO: 2112598 - RNA, 17 nt, Homo sapiens
agcucauaaacugccaa

SEQ ID NO: 2112599 - RNA, 19 nt, Homo sapiens
agcacuccgcaucaccuca

SEQ ID NO: 2112600 - RNA, 20 nt, Homo sapiens
ucacaugggcagaaaaaugg

SEQ ID NO: 2112601 - RNA, 13 nt, Homo sapiens
caauaacagguca

SEQ ID NO: 2112602 - RNA, 13 nt, Homo sapiens
uuuauaagucauu

SEQ ID NO: 2112603 - RNA, 19 nt, Homo sapiens
ggagaaagcugacuuggcu

SEQ ID NO: 2112604 - RNA, 11 nt, Homo sapiens
ugucugaagac

SEQ ID NO: 2112605 - RNA, 15 nt, Homo sapiens
ugcccagacuacagg

SEQ ID NO: 2112606 - RNA, 18 nt, Homo sapiens
aaaucuuccuuacugucu

SEQ ID NO: 2112607 - RNA, 13 nt, Homo sapiens
gaguggugacagg

SEQ ID NO: 2112608 - RNA, 23 nt, Homo sapiens
aaugcaguuguggugugccaugc

SEQ ID NO: 2112609 - RNA, 15 nt, Homo sapiens
ugagccccagugcug

SEQ ID NO: 2112610 - RNA, 15 nt, Homo sapiens
aacuuaacaugcugu

SEQ ID NO: 2112611 - RNA, 15 nt, Homo sapiens
aucauucaacucucc

SEQ ID NO: 2112612 - RNA, 23 nt, Homo sapiens
augaaaaauauugcugaacuacu

SEQ ID NO: 2112613 - RNA, 18 nt, Homo sapiens
agaaggccagaauacugg

SEQ ID NO: 2112614 - RNA, 16 nt, Homo sapiens
guaagcacucaauaaa

SEQ ID NO: 2112615 - RNA, 22 nt, Homo sapiens
gccuacccccugaaagugacag

SEQ ID NO: 2112616 - RNA, 22 nt, Homo sapiens
ucugggagcuacaaaauuucau

SEQ ID NO: 2112617 - RNA, 22 nt, Homo sapiens
ccucuaugugcaacugacagau

SEQ ID NO: 2112618 - RNA, 20 nt, Homo sapiens
auauaaacacuccacagugu

SEQ ID NO: 2112619 - RNA, 18 nt, Homo sapiens
caggccagugaccucauu

SEQ ID NO: 2112620 - RNA, 11 nt, Homo sapiens
gacaucaaaau

SEQ ID NO: 2112621 - RNA, 16 nt, Homo sapiens
aagcagugcuucucaa

SEQ ID NO: 2112622 - RNA, 22 nt, Homo sapiens
cuugcaaaugaaugccuuucaa

SEQ ID NO: 2112623 - RNA, 19 nt, Homo sapiens
agcuguuggauuucaguga

SEQ ID NO: 2112624 - RNA, 21 nt, Homo sapiens
aauguuggacagacacuguug

SEQ ID NO: 2112625 - RNA, 12 nt, Homo sapiens
auggcagggaua

SEQ ID NO: 2112626 - RNA, 15 nt, Homo sapiens
guucugucuucccaa

SEQ ID NO: 2112627 - RNA, 19 nt, Homo sapiens
acagcaucuccaagcagcu

SEQ ID NO: 2112628 - RNA, 18 nt, Homo sapiens
aucagcagagaacuggaa

SEQ ID NO: 2112629 - RNA, 22 nt, Homo sapiens
aucugauaugaccccaguucag

SEQ ID NO: 2112630 - RNA, 21 nt, Homo sapiens
aggaaggacuuuggcaaguga

SEQ ID NO: 2112631 - RNA, 22 nt, Homo sapiens
ccagaaggguagcugggcgggg

SEQ ID NO: 2112632 - RNA, 14 nt, Homo sapiens
caucuauuuucuca

SEQ ID NO: 2112633 - RNA, 18 nt, Homo sapiens
cuuggagagucggccaga

SEQ ID NO: 2112634 - RNA, 17 nt, Homo sapiens
gcuucaccgcauuccag

SEQ ID NO: 2112635 - RNA, 18 nt, Homo sapiens
cauaugacugauuacuca

SEQ ID NO: 2112636 - RNA, 15 nt, Homo sapiens
ucugauaacagaauu

SEQ ID NO: 2112637 - RNA, 22 nt, Homo sapiens
cugagaugaaaacuagggcuca

SEQ ID NO: 2112638 - RNA, 16 nt, Homo sapiens
gcagugaacacacuca

SEQ ID NO: 2112639 - RNA, 13 nt, Homo sapiens
aaaauugauauac

SEQ ID NO: 2112640 - RNA, 17 nt, Homo sapiens
ugcuuugcugcuaugaa

SEQ ID NO: 2112641 - RNA, 23 nt, Homo sapiens
cuggaagcucggcgaauucucag

SEQ ID NO: 2112642 - RNA, 14 nt, Homo sapiens
caaaaacaauguaa

SEQ ID NO: 2112643 - RNA, 22 nt, Homo sapiens
uuugacugaauguuuuauggaa

SEQ ID NO: 2112644 - RNA, 15 nt, Homo sapiens
acaccggccuugcau

SEQ ID NO: 2112645 - RNA, 19 nt, Homo sapiens
caacuuccagagaagccau

SEQ ID NO: 2112646 - RNA, 15 nt, Homo sapiens
ccaagaaaguccagu

SEQ ID NO: 2112647 - RNA, 22 nt, Homo sapiens
cacuaacuuaauguguauucau

SEQ ID NO: 2112648 - RNA, 13 nt, Homo sapiens
gauuuaaaaggga

SEQ ID NO: 2112649 - RNA, 20 nt, Homo sapiens
cacaaggcacaccagugcaa

SEQ ID NO: 2112650 - RNA, 17 nt, Homo sapiens
ccugaggaugggucaga

SEQ ID NO: 2112651 - RNA, 20 nt, Homo sapiens
agcagaauguuguacuugaa

SEQ ID NO: 2112652 - RNA, 12 nt, Homo sapiens
uguacaaaaggg

SEQ ID NO: 2112653 - RNA, 21 nt, Homo sapiens
cugagggaggaggcaggaguu

SEQ ID NO: 2112654 - RNA, 18 nt, Homo sapiens
uucucaucauauuguaug

SEQ ID NO: 2112655 - RNA, 19 nt, Homo sapiens
gggaaggggugggagccaa

SEQ ID NO: 2112656 - RNA, 17 nt, Homo sapiens
aacuccauacuccacuc

SEQ ID NO: 2112657 - RNA, 18 nt, Homo sapiens
aaguuaguuccacugaga

SEQ ID NO: 2112658 - RNA, 22 nt, Homo sapiens
cugagaaauagugcacuccaag

SEQ ID NO: 2112659 - RNA, 21 nt, Homo sapiens
agucgcaggauccgcugccac

SEQ ID NO: 2112660 - RNA, 21 nt, Homo sapiens
auggacagauggaccaaaaga

SEQ ID NO: 2112661 - RNA, 16 nt, Homo sapiens
ccaggagcagcagcca

SEQ ID NO: 2112662 - RNA, 18 nt, Homo sapiens
agauccuuuuccauccca

SEQ ID NO: 2112663 - RNA, 12 nt, Homo sapiens
ucagaaccagag

SEQ ID NO: 2112664 - RNA, 22 nt, Homo sapiens
cuuauuuuguaagagugagcuc

SEQ ID NO: 2112665 - RNA, 12 nt, Homo sapiens
ugaaaaaugccu

SEQ ID NO: 2112666 - RNA, 20 nt, Homo sapiens
uacuucuuguguguaugcac

SEQ ID NO: 2112667 - RNA, 21 nt, Homo sapiens
aagagaguggaagaacugcaa

SEQ ID NO: 2112668 - RNA, 13 nt, Homo sapiens
aagccucuggguu

SEQ ID NO: 2112669 - RNA, 18 nt, Homo sapiens
uuugguuuugugugguau

SEQ ID NO: 2112670 - RNA, 22 nt, Homo sapiens
acagagcacuagguucaauucc

SEQ ID NO: 2112671 - RNA, 12 nt, Homo sapiens
ugccugccauuu

SEQ ID NO: 2112672 - RNA, 19 nt, Homo sapiens
cgagaccagccuggccaac

SEQ ID NO: 2112673 - RNA, 19 nt, Homo sapiens
cucucaaaacccugucucc

SEQ ID NO: 2112674 - RNA, 14 nt, Homo sapiens
uucccuuaaauaca

SEQ ID NO: 2112675 - RNA, 21 nt, Homo sapiens
uaggagggugccccugggaac

SEQ ID NO: 2112676 - RNA, 22 nt, Homo sapiens
uuguuuuggggacagacuuuua

SEQ ID NO: 2112677 - RNA, 18 nt, Homo sapiens
uaauguagauaaagcacu

SEQ ID NO: 2112678 - RNA, 19 nt, Homo sapiens
uucaugcuugacauaccua

SEQ ID NO: 2112679 - RNA, 19 nt, Homo sapiens
gacggaggccuacucuucc

SEQ ID NO: 2112680 - RNA, 12 nt, Homo sapiens
agugcacugcuc

SEQ ID NO: 2112681 - RNA, 12 nt, Homo sapiens
aguccacugcug

SEQ ID NO: 2112682 - RNA, 22 nt, Homo sapiens
uuuaagaggcuuuggcccaaug

SEQ ID NO: 2112683 - RNA, 15 nt, Homo sapiens
ucuguagugccaugg

SEQ ID NO: 2112684 - RNA, 14 nt, Homo sapiens
aagaggauacaaau

SEQ ID NO: 2112685 - RNA, 19 nt, Homo sapiens
ucgcaccacugcacuccag

SEQ ID NO: 2112686 - RNA, 12 nt, Homo sapiens
guugguuugugu

SEQ ID NO: 2112687 - RNA, 22 nt, Homo sapiens
cauucagucaagugaggugaca

SEQ ID NO: 2112688 - RNA, 19 nt, Homo sapiens
uugaaacuaucucaugcca

SEQ ID NO: 2112689 - RNA, 21 nt, Homo sapiens
ugcauauguuuuccacauaaa

SEQ ID NO: 2112690 - RNA, 15 nt, Homo sapiens
ccagcucagugccaa

SEQ ID NO: 2112691 - RNA, 12 nt, Homo sapiens
ugguuaucugaa

SEQ ID NO: 2112692 - RNA, 11 nt, Homo sapiens
guacuauccag

SEQ ID NO: 2112693 - RNA, 16 nt, Homo sapiens
cacuagguuucaccuc

SEQ ID NO: 2112694 - RNA, 17 nt, Homo sapiens
cgugaucacugagccau

SEQ ID NO: 2112695 - RNA, 21 nt, Homo sapiens
ucaguagagaauuauuugccu

SEQ ID NO: 2112696 - RNA, 14 nt, Homo sapiens
gugugccauuuuaa

SEQ ID NO: 2112697 - RNA, 21 nt, Homo sapiens
aggccuucaguuuauuuccac

SEQ ID NO: 2112698 - RNA, 22 nt, Homo sapiens
ucaccauuucuuggcauuggaa

SEQ ID NO: 2112699 - RNA, 19 nt, Homo sapiens
cuaguuaaugucagugaca

SEQ ID NO: 2112700 - RNA, 16 nt, Homo sapiens
augacggcuaccacac

SEQ ID NO: 2112701 - RNA, 20 nt, Homo sapiens
cccauaauaaaauaucauau

SEQ ID NO: 2112702 - RNA, 15 nt, Homo sapiens
uccagugagcacuag

SEQ ID NO: 2112703 - RNA, 14 nt, Homo sapiens
gacugcaacauaca

SEQ ID NO: 2112704 - RNA, 16 nt, Homo sapiens
ucauucugcauugcua

SEQ ID NO: 2112705 - RNA, 19 nt, Homo sapiens
ugugguugaaaaccacagu

SEQ ID NO: 2112706 - RNA, 22 nt, Homo sapiens
uuuggggguaaaguuugcucua

SEQ ID NO: 2112707 - RNA, 21 nt, Homo sapiens
uuauuucggagcgcaaugcca

SEQ ID NO: 2112708 - RNA, 22 nt, Homo sapiens
gaauagacacuucaccaaagag

SEQ ID NO: 2112709 - RNA, 19 nt, Homo sapiens
uggguacaauguacauuau

SEQ ID NO: 2112710 - RNA, 18 nt, Homo sapiens
uguuccauuggguccucu

SEQ ID NO: 2112711 - RNA, 18 nt, Homo sapiens
uauccacuacauucugaa

SEQ ID NO: 2112712 - RNA, 20 nt, Homo sapiens
cuggauugcgccuaaugugu

SEQ ID NO: 2112713 - RNA, 18 nt, Homo sapiens
auacucauuucuaaaaga

SEQ ID NO: 2112714 - RNA, 16 nt, Homo sapiens
cuggaauuacaaaacu

SEQ ID NO: 2112715 - RNA, 22 nt, Homo sapiens
ugagaucaccccacuuccauca

SEQ ID NO: 2112716 - RNA, 14 nt, Homo sapiens
cuucccuugcucau

SEQ ID NO: 2112717 - RNA, 22 nt, Homo sapiens
cagaaauugugugugcaagaaa

SEQ ID NO: 2112718 - RNA, 17 nt, Homo sapiens
acagagacuuuaaucac

SEQ ID NO: 2112719 - RNA, 13 nt, Homo sapiens
ccuggaagacaga

SEQ ID NO: 2112720 - RNA, 18 nt, Homo sapiens
ccucucauagaaauugcc

SEQ ID NO: 2112721 - RNA, 15 nt, Homo sapiens
caguugcugucacaa

SEQ ID NO: 2112722 - RNA, 13 nt, Homo sapiens
aacacuacuccuu

SEQ ID NO: 2112723 - RNA, 11 nt, Homo sapiens
aaaacaaagca

SEQ ID NO: 2112724 - RNA, 15 nt, Homo sapiens
auauuuaaccaaaga

SEQ ID NO: 2112725 - RNA, 18 nt, Homo sapiens
acagcagugaucucaggg

SEQ ID NO: 2112726 - RNA, 13 nt, Homo sapiens
cuuucucuuaaca

SEQ ID NO: 2112727 - RNA, 21 nt, Homo sapiens
acgaaaugcuaugacuguauc

SEQ ID NO: 2112728 - RNA, 15 nt, Homo sapiens
aucaguguuaccguu

SEQ ID NO: 2112729 - RNA, 22 nt, Homo sapiens
cucuuggcugagauagcagagg

SEQ ID NO: 2112730 - RNA, 21 nt, Homo sapiens
acaggcuuggagggaagggag

SEQ ID NO: 2112731 - RNA, 15 nt, Homo sapiens
augccuguaauccca

SEQ ID NO: 2112732 - RNA, 23 nt, Homo sapiens
uguuccuccuccccucuccuagc

SEQ ID NO: 2112733 - RNA, 19 nt, Homo sapiens
gggaagcggcccuaaggga

SEQ ID NO: 2112734 - RNA, 20 nt, Homo sapiens
auucugaaggccuuguuaaa

SEQ ID NO: 2112735 - RNA, 19 nt, Homo sapiens
cuguaauggguaauucuga

SEQ ID NO: 2112736 - RNA, 17 nt, Homo sapiens
ucugugcgcguggcgug

SEQ ID NO: 2112737 - RNA, 15 nt, Homo sapiens
agcaaaccaaagacc

SEQ ID NO: 2112738 - RNA, 17 nt, Homo sapiens
cuucuccaccaaagaca

SEQ ID NO: 2112739 - RNA, 19 nt, Homo sapiens
acuucagaaauauaugcag

SEQ ID NO: 2112740 - RNA, 17 nt, Homo sapiens
ugcucggccgucuucac

SEQ ID NO: 2112741 - RNA, 14 nt, Homo sapiens
uuccagaagaucug

SEQ ID NO: 2112742 - RNA, 18 nt, Homo sapiens
guuuuauauuuuauaugu

SEQ ID NO: 2112743 - RNA, 16 nt, Homo sapiens
aggcugagaacacugu

SEQ ID NO: 2112744 - RNA, 14 nt, Homo sapiens
uuuauccacuuuuc

SEQ ID NO: 2112745 - RNA, 14 nt, Homo sapiens
uggacacacgguca

SEQ ID NO: 2112746 - RNA, 16 nt, Homo sapiens
acucaaagacauuugu

SEQ ID NO: 2112747 - RNA, 15 nt, Homo sapiens
caggauccagugaca

SEQ ID NO: 2112748 - RNA, 16 nt, Homo sapiens
cggcccacagguuucc

SEQ ID NO: 2112749 - RNA, 18 nt, Homo sapiens
guugaagaggugagcacg

SEQ ID NO: 2112750 - RNA, 18 nt, Homo sapiens
cucuggcccacugagcca

SEQ ID NO: 2112751 - RNA, 22 nt, Homo sapiens
gagaggcaaaggcucucacucc

SEQ ID NO: 2112752 - RNA, 10 nt, Homo sapiens
auuaauuccu

SEQ ID NO: 2112753 - RNA, 14 nt, Homo sapiens
uucuuaacaaccga

SEQ ID NO: 2112754 - RNA, 17 nt, Homo sapiens
agcucguuccuaccugg

SEQ ID NO: 2112755 - RNA, 20 nt, Homo sapiens
cugccugccgguaaacacgc

SEQ ID NO: 2112756 - RNA, 15 nt, Homo sapiens
gcacuguccugacca

SEQ ID NO: 2112757 - RNA, 21 nt, Homo sapiens
ucaauggacugcaccuuguga

SEQ ID NO: 2112758 - RNA, 16 nt, Homo sapiens
ucuccuucccauuucu

SEQ ID NO: 2112759 - RNA, 22 nt, Homo sapiens
ggggcccaaauucuuucagugg

SEQ ID NO: 2112760 - RNA, 13 nt, Homo sapiens
gggccacugccag

SEQ ID NO: 2112761 - RNA, 15 nt, Homo sapiens
ccaugauauaacuuu

SEQ ID NO: 2112762 - RNA, 21 nt, Homo sapiens
aaacuggguugagggaugcug

SEQ ID NO: 2112763 - RNA, 21 nt, Homo sapiens
cuuuaaacugcagcgucagaa

SEQ ID NO: 2112764 - RNA, 15 nt, Homo sapiens
cauggcuggcacauu

SEQ ID NO: 2112765 - RNA, 13 nt, Homo sapiens
ugcagcuuccaaa

SEQ ID NO: 2112766 - RNA, 21 nt, Homo sapiens
cuucauccucugagugugacc

SEQ ID NO: 2112767 - RNA, 18 nt, Homo sapiens
uucaucuauuucugagaa

SEQ ID NO: 2112768 - RNA, 17 nt, Homo sapiens
gagacugaccaucaugc

SEQ ID NO: 2112769 - RNA, 17 nt, Homo sapiens
cauuuaacugcagugua

SEQ ID NO: 2112770 - RNA, 15 nt, Homo sapiens
cauuugcaccuaccu

SEQ ID NO: 2112771 - RNA, 14 nt, Homo sapiens
uggccagagccagc

SEQ ID NO: 2112772 - RNA, 13 nt, Homo sapiens
ugagaacuuccaa

SEQ ID NO: 2112773 - RNA, 23 nt, Homo sapiens
uaagaugugcagcauuucacuua

SEQ ID NO: 2112774 - RNA, 11 nt, Homo sapiens
agggccuguau

SEQ ID NO: 2112775 - RNA, 19 nt, Homo sapiens
uucugcuccucuccaggca

SEQ ID NO: 2112776 - RNA, 18 nt, Homo sapiens
acaauaaagcaguccugu

SEQ ID NO: 2112777 - RNA, 16 nt, Homo sapiens
gcugucacauacaacu

SEQ ID NO: 2112778 - RNA, 21 nt, Homo sapiens
ugucauacagagaagucacag

SEQ ID NO: 2112779 - RNA, 18 nt, Homo sapiens
cagaaacaaaaacacuaa

SEQ ID NO: 2112780 - RNA, 18 nt, Homo sapiens
aagaauuaaaaacuuuca

SEQ ID NO: 2112781 - RNA, 19 nt, Homo sapiens
gccagcugucgcaucucag

SEQ ID NO: 2112782 - RNA, 16 nt, Homo sapiens
gcccagggaagccaaa

SEQ ID NO: 2112783 - RNA, 18 nt, Homo sapiens
aacucugggcagcuggag

SEQ ID NO: 2112784 - RNA, 15 nt, Homo sapiens
uggcuagaguuucca

SEQ ID NO: 2112785 - RNA, 13 nt, Homo sapiens
guuuuaaauugca

SEQ ID NO: 2112786 - RNA, 15 nt, Homo sapiens
ccacuauuugcagag

SEQ ID NO: 2112787 - RNA, 22 nt, Homo sapiens
agggacagcaugccccuuggcu

SEQ ID NO: 2112788 - RNA, 18 nt, Homo sapiens
augaagaaucugcucuga

SEQ ID NO: 2112789 - RNA, 19 nt, Homo sapiens
uccucaucaucacucaucu

SEQ ID NO: 2112790 - RNA, 21 nt, Homo sapiens
guagcccuggguuuaauguca

SEQ ID NO: 2112791 - RNA, 23 nt, Homo sapiens
ccuugcacaggccacuugcucag

SEQ ID NO: 2112792 - RNA, 14 nt, Homo sapiens
cagcacuagaguca

SEQ ID NO: 2112793 - RNA, 21 nt, Homo sapiens
uugguaccuuucuagccuuag

SEQ ID NO: 2112794 - RNA, 18 nt, Homo sapiens
cugaguucucauccacag

SEQ ID NO: 2112795 - RNA, 19 nt, Homo sapiens
gacaaguauuaauaguuca

SEQ ID NO: 2112796 - RNA, 20 nt, Homo sapiens
caaaacaaccacuuucucag

SEQ ID NO: 2112797 - RNA, 20 nt, Homo sapiens
uuuugaaauaaaguauuuau

SEQ ID NO: 2112798 - RNA, 14 nt, Homo sapiens
aggucuaaucagug

SEQ ID NO: 2112799 - RNA, 23 nt, Homo sapiens
ugcugcugcgcccuuaccuuccc

SEQ ID NO: 2112800 - RNA, 22 nt, Homo sapiens
aaagcauuacauuuccaaauga

SEQ ID NO: 2112801 - RNA, 16 nt, Homo sapiens
uaugugggugggacca

SEQ ID NO: 2112802 - RNA, 16 nt, Homo sapiens
ugugugcagcauuguu

SEQ ID NO: 2112803 - RNA, 16 nt, Homo sapiens
cacaguaagucauuua

SEQ ID NO: 2112804 - RNA, 15 nt, Homo sapiens
caaggacucagauga

SEQ ID NO: 2112805 - RNA, 21 nt, Homo sapiens
agccugcggggugcccucuca

SEQ ID NO: 2112806 - RNA, 22 nt, Homo sapiens
agagcagcugccauugcagauu

SEQ ID NO: 2112807 - RNA, 22 nt, Homo sapiens
caguggcacgaucucagcucac

SEQ ID NO: 2112808 - RNA, 22 nt, Homo sapiens
cugcucuuucucugccagugac

SEQ ID NO: 2112809 - RNA, 22 nt, Homo sapiens
ucguuuugcccgauuccguauu

SEQ ID NO: 2112810 - RNA, 14 nt, Homo sapiens
uguaugauguguug

SEQ ID NO: 2112811 - RNA, 13 nt, Homo sapiens
caguggaugagug

SEQ ID NO: 2112812 - RNA, 23 nt, Homo sapiens
uucuuccacccacaaacuccagg

SEQ ID NO: 2112813 - RNA, 14 nt, Homo sapiens
uuccacccacaaac

SEQ ID NO: 2112814 - RNA, 18 nt, Homo sapiens
acgaaucucaucccucaa

SEQ ID NO: 2112815 - RNA, 15 nt, Homo sapiens
aagaauacacaggau

SEQ ID NO: 2112816 - RNA, 14 nt, Homo sapiens
gugccacucagaga

SEQ ID NO: 2112817 - RNA, 16 nt, Homo sapiens
cucauguuacucagug

SEQ ID NO: 2112818 - RNA, 23 nt, Homo sapiens
aaaaauucuagauuaccaugaag

SEQ ID NO: 2112819 - RNA, 20 nt, Homo sapiens
caccugagacaugcugaaau

SEQ ID NO: 2112820 - RNA, 20 nt, Homo sapiens
uucaccccuacacugugaag

SEQ ID NO: 2112821 - RNA, 16 nt, Homo sapiens
ugcgagagaaagggag

SEQ ID NO: 2112822 - RNA, 21 nt, Homo sapiens
ccaaagauucuuuauaucuga

SEQ ID NO: 2112823 - RNA, 19 nt, Homo sapiens
cuuacccacgugcuguucc

SEQ ID NO: 2112824 - RNA, 22 nt, Homo sapiens
uuuguacagauggggucuugcu

SEQ ID NO: 2112825 - RNA, 22 nt, Homo sapiens
uaugguaggaacugcugggcuu

SEQ ID NO: 2112826 - RNA, 17 nt, Homo sapiens
agcuagugaagaccaga

SEQ ID NO: 2112827 - RNA, 16 nt, Homo sapiens
augauagaagauauau

SEQ ID NO: 2112828 - RNA, 15 nt, Homo sapiens
agacagagcccugug

SEQ ID NO: 2112829 - RNA, 15 nt, Homo sapiens
gccuggccucugccu

SEQ ID NO: 2112830 - RNA, 16 nt, Homo sapiens
aguuguuaugccauga

SEQ ID NO: 2112831 - RNA, 18 nt, Homo sapiens
cagcgaccucggugggcc

SEQ ID NO: 2112832 - RNA, 15 nt, Homo sapiens
caccugcuaaucaca

SEQ ID NO: 2112833 - RNA, 18 nt, Homo sapiens
ccucaaaugacccaaaga

SEQ ID NO: 2112834 - RNA, 17 nt, Homo sapiens
cagcugguucgugguuu

SEQ ID NO: 2112835 - RNA, 18 nt, Homo sapiens
ggcccaggucagccacug

SEQ ID NO: 2112836 - RNA, 22 nt, Homo sapiens
cuuuucaaggaaaaaugcugcu

SEQ ID NO: 2112837 - RNA, 22 nt, Homo sapiens
ugcugaaggacagaacauugcc

SEQ ID NO: 2112838 - RNA, 19 nt, Homo sapiens
ucugcauauccauaagaau

SEQ ID NO: 2112839 - RNA, 21 nt, Homo sapiens
ccaaugcacgcacacaucagu

SEQ ID NO: 2112840 - RNA, 15 nt, Homo sapiens
uucucaaaguuuuga

SEQ ID NO: 2112841 - RNA, 22 nt, Homo sapiens
uccugugaguaaucuugcaaau

SEQ ID NO: 2112842 - RNA, 20 nt, Homo sapiens
ucuaguauuggaucugaaaa

SEQ ID NO: 2112843 - RNA, 15 nt, Homo sapiens
agcuucccuugccuc

SEQ ID NO: 2112844 - RNA, 12 nt, Homo sapiens
agaacacugugc

SEQ ID NO: 2112845 - RNA, 16 nt, Homo sapiens
aauuaacucaccagau

SEQ ID NO: 2112846 - RNA, 20 nt, Homo sapiens
ggugcuaaugucaaaccacu

SEQ ID NO: 2112847 - RNA, 22 nt, Homo sapiens
gcaguucugcacccagccaaac

SEQ ID NO: 2112848 - RNA, 20 nt, Homo sapiens
uccuggaagcagagcaaaau

SEQ ID NO: 2112849 - RNA, 18 nt, Homo sapiens
ucugggagggucggggga

SEQ ID NO: 2112850 - RNA, 23 nt, Homo sapiens
gggaggauugcuugaacccaaga

SEQ ID NO: 2112851 - RNA, 17 nt, Homo sapiens
aacacguuggcucaguc

SEQ ID NO: 2112852 - RNA, 16 nt, Homo sapiens
guuuuaacccuuaaua

SEQ ID NO: 2112853 - RNA, 21 nt, Homo sapiens
cuauuuauucauucagugaga

SEQ ID NO: 2112854 - RNA, 22 nt, Homo sapiens
gaaguagaauuuguccaauaac

SEQ ID NO: 2112855 - RNA, 17 nt, Homo sapiens
acacgagcaaacccaga

SEQ ID NO: 2112856 - RNA, 16 nt, Homo sapiens
ucacagggacugaaaa

SEQ ID NO: 2112857 - RNA, 20 nt, Homo sapiens
cuccaccugcucugugccca

SEQ ID NO: 2112858 - RNA, 14 nt, Homo sapiens
uggggaguccaggg

SEQ ID NO: 2112859 - RNA, 19 nt, Homo sapiens
uaaacugcugaauucaccu

SEQ ID NO: 2112860 - RNA, 14 nt, Homo sapiens
uaagaaaauuuacu

SEQ ID NO: 2112861 - RNA, 22 nt, Homo sapiens
caagugugucuccugugcugcg

SEQ ID NO: 2112862 - RNA, 16 nt, Homo sapiens
acccucaccacccaac

SEQ ID NO: 2112863 - RNA, 16 nt, Homo sapiens
aucugaaccacuuugc

SEQ ID NO: 2112864 - RNA, 20 nt, Homo sapiens
uacacauauacaaauguaua

SEQ ID NO: 2112865 - RNA, 12 nt, Homo sapiens
uguaaaaacuga

SEQ ID NO: 2112866 - RNA, 20 nt, Homo sapiens
gaacauucgaccuccauuac

SEQ ID NO: 2112867 - RNA, 15 nt, Homo sapiens
ugggaucuuucugac

SEQ ID NO: 2112868 - RNA, 17 nt, Homo sapiens
aaacagaugucuucuug

SEQ ID NO: 2112869 - RNA, 22 nt, Homo sapiens
acuaccuucaugcauagguuua

SEQ ID NO: 2112870 - RNA, 15 nt, Homo sapiens
caacauggggaccag

SEQ ID NO: 2112871 - RNA, 18 nt, Homo sapiens
ucauaaaaguuugcaugu

SEQ ID NO: 2112872 - RNA, 20 nt, Homo sapiens
aauaaauauuguguugugca

SEQ ID NO: 2112873 - RNA, 19 nt, Homo sapiens
gauccagauccagacugua

SEQ ID NO: 2112874 - RNA, 17 nt, Homo sapiens
caagacauagcauccaa

SEQ ID NO: 2112875 - RNA, 15 nt, Homo sapiens
acacuaugugcaaaa

SEQ ID NO: 2112876 - RNA, 13 nt, Homo sapiens
agcuaaucugccu

SEQ ID NO: 2112877 - RNA, 17 nt, Homo sapiens
gacacaggccugcucuc

SEQ ID NO: 2112878 - RNA, 18 nt, Homo sapiens
gcugacacagccacugcg

SEQ ID NO: 2112879 - RNA, 20 nt, Homo sapiens
cacccuccccugucuucucu

SEQ ID NO: 2112880 - RNA, 14 nt, Homo sapiens
gagucucauuauuu

SEQ ID NO: 2112881 - RNA, 20 nt, Homo sapiens
auuccagguguguucaguag

SEQ ID NO: 2112882 - RNA, 16 nt, Homo sapiens
aguuuuuaauuugaug

SEQ ID NO: 2112883 - RNA, 18 nt, Homo sapiens
cucccgugggcaucucaa

SEQ ID NO: 2112884 - RNA, 15 nt, Homo sapiens
cugggcucacugugc

SEQ ID NO: 2112885 - RNA, 16 nt, Homo sapiens
auguacauagugcuaa

SEQ ID NO: 2112886 - RNA, 14 nt, Homo sapiens
caaaagaugucuga

SEQ ID NO: 2112887 - RNA, 14 nt, Homo sapiens
agacagaguuucac

SEQ ID NO: 2112888 - RNA, 13 nt, Homo sapiens
guaggacugcuga

SEQ ID NO: 2112889 - RNA, 15 nt, Homo sapiens
agugccccuggccaa

SEQ ID NO: 2112890 - RNA, 20 nt, Homo sapiens
aauaaauaagaucagacucu

SEQ ID NO: 2112891 - RNA, 20 nt, Homo sapiens
uaccagaggaaguuauggca

SEQ ID NO: 2112892 - RNA, 13 nt, Homo sapiens
uauuagcuuauau

SEQ ID NO: 2112893 - RNA, 13 nt, Homo sapiens
gaguagcugagau

SEQ ID NO: 2112894 - RNA, 13 nt, Homo sapiens
ugcuauggggaca

SEQ ID NO: 2112895 - RNA, 17 nt, Homo sapiens
gugaaaucugugcaaua

SEQ ID NO: 2112896 - RNA, 18 nt, Homo sapiens
acugccuccugccugggg

SEQ ID NO: 2112897 - RNA, 13 nt, Homo sapiens
aucagaccugguu

SEQ ID NO: 2112898 - RNA, 23 nt, Homo sapiens
uaugccacaccuggccuuaaaga

SEQ ID NO: 2112899 - RNA, 12 nt, Homo sapiens
guguuguucaua

SEQ ID NO: 2112900 - RNA, 19 nt, Homo sapiens
uuucuacuguauaaacaaa

SEQ ID NO: 2112901 - RNA, 15 nt, Homo sapiens
aacuccugaccuuag

SEQ ID NO: 2112902 - RNA, 18 nt, Homo sapiens
uuucuggaaaacugccuu

SEQ ID NO: 2112903 - RNA, 17 nt, Homo sapiens
agauaauuguuucauuc

SEQ ID NO: 2112904 - RNA, 17 nt, Homo sapiens
cuuccuccucgcugcca

SEQ ID NO: 2112905 - RNA, 14 nt, Homo sapiens
ggagcccucaucuu

SEQ ID NO: 2112906 - RNA, 21 nt, Homo sapiens
uccuguuuuucacauuuuccu

SEQ ID NO: 2112907 - RNA, 16 nt, Homo sapiens
ugcaggacuugagaag

SEQ ID NO: 2112908 - RNA, 20 nt, Homo sapiens
cccagcccuccccaccugcu

SEQ ID NO: 2112909 - RNA, 22 nt, Homo sapiens
gugcuuucccagucccauuccu

SEQ ID NO: 2112910 - RNA, 22 nt, Homo sapiens
aaaaacagcaggggcauuaguu

SEQ ID NO: 2112911 - RNA, 22 nt, Homo sapiens
gguacauaggcuucuauuaccu

SEQ ID NO: 2112912 - RNA, 21 nt, Homo sapiens
acaaaggauacuuuuacaggu

SEQ ID NO: 2112913 - RNA, 19 nt, Homo sapiens
caucugcccugacugaaug

SEQ ID NO: 2112914 - RNA, 22 nt, Homo sapiens
ucugaaaacaagagacugcuug

SEQ ID NO: 2112915 - RNA, 12 nt, Homo sapiens
caaugaagggaa

SEQ ID NO: 2112916 - RNA, 14 nt, Homo sapiens
gaagagggucugca

SEQ ID NO: 2112917 - RNA, 22 nt, Homo sapiens
uucccucucccggcaacaucuc

SEQ ID NO: 2112918 - RNA, 22 nt, Homo sapiens
cugucuucgaggacagcaaugc

SEQ ID NO: 2112919 - RNA, 19 nt, Homo sapiens
aguaauuuugcuccuugau

SEQ ID NO: 2112920 - RNA, 21 nt, Homo sapiens
augguaaaaugagugaucuca

SEQ ID NO: 2112921 - RNA, 20 nt, Homo sapiens
acagucacuugggagcugcu

SEQ ID NO: 2112922 - RNA, 16 nt, Homo sapiens
ucuagaugcaaauaca

SEQ ID NO: 2112923 - RNA, 15 nt, Homo sapiens
ugcuuccauuaaaag

SEQ ID NO: 2112924 - RNA, 19 nt, Homo sapiens
acuuagcaagaccugaaaa

SEQ ID NO: 2112925 - RNA, 23 nt, Homo sapiens
agagccaagcuaaugugguagug

SEQ ID NO: 2112926 - RNA, 19 nt, Homo sapiens
aacauuugguugcuacugu

SEQ ID NO: 2112927 - RNA, 23 nt, Homo sapiens
aggcuuucagaagcucuucuaaa

SEQ ID NO: 2112928 - RNA, 19 nt, Homo sapiens
ucaagggcuuuauuacaga

SEQ ID NO: 2112929 - RNA, 22 nt, Homo sapiens
uuuuaagaagacauacugcuug

SEQ ID NO: 2112930 - RNA, 14 nt, Homo sapiens
caaaacuccaggca

SEQ ID NO: 2112931 - RNA, 14 nt, Homo sapiens
ccaggagacauaua

SEQ ID NO: 2112932 - RNA, 16 nt, Homo sapiens
ugcucauugaacuuua

SEQ ID NO: 2112933 - RNA, 14 nt, Homo sapiens
ugggggucaggggc

SEQ ID NO: 2112934 - RNA, 20 nt, Homo sapiens
aacacacagcaacauccaga

SEQ ID NO: 2112935 - RNA, 13 nt, Homo sapiens
uaugugagcucac

SEQ ID NO: 2112936 - RNA, 17 nt, Homo sapiens
acauuucccugcugagu

SEQ ID NO: 2112937 - RNA, 22 nt, Homo sapiens
acggaauauuuaaacaguagcu

SEQ ID NO: 2112938 - RNA, 17 nt, Homo sapiens
acugcauaauagccuaa

SEQ ID NO: 2112939 - RNA, 19 nt, Homo sapiens
agcaauucuccugccuuag

SEQ ID NO: 2112940 - RNA, 22 nt, Homo sapiens
cuacacagcucagcagacaucc

SEQ ID NO: 2112941 - RNA, 23 nt, Homo sapiens
agccaagcaaaugccugccaaau

SEQ ID NO: 2112942 - RNA, 13 nt, Homo sapiens
gcgacacugggag

SEQ ID NO: 2112943 - RNA, 12 nt, Homo sapiens
ccaacaugguga

SEQ ID NO: 2112944 - RNA, 22 nt, Homo sapiens
cagcuuccagaugauccuugca

SEQ ID NO: 2112945 - RNA, 19 nt, Homo sapiens
guuuucuaacccagucuua

SEQ ID NO: 2112946 - RNA, 17 nt, Homo sapiens
agaggugacaguggaug

SEQ ID NO: 2112947 - RNA, 21 nt, Homo sapiens
uaucaaucaccuugcauuuca

SEQ ID NO: 2112948 - RNA, 14 nt, Homo sapiens
uuuuaaaacauuca

SEQ ID NO: 2112949 - RNA, 14 nt, Homo sapiens
uuuaauaacauacu

SEQ ID NO: 2112950 - RNA, 17 nt, Homo sapiens
aaucauggagcugagga

SEQ ID NO: 2112951 - RNA, 14 nt, Homo sapiens
agcagaauacuggu

SEQ ID NO: 2112952 - RNA, 13 nt, Homo sapiens
ugucccgugcaug

SEQ ID NO: 2112953 - RNA, 18 nt, Homo sapiens
agaauacaguaagcugcu

SEQ ID NO: 2112954 - RNA, 14 nt, Homo sapiens
gcagaguauguucu

SEQ ID NO: 2112955 - RNA, 18 nt, Homo sapiens
aauaaaaaggaaaacaga

SEQ ID NO: 2112956 - RNA, 23 nt, Homo sapiens
gcagcggugccucaacacccugg

SEQ ID NO: 2112957 - RNA, 19 nt, Homo sapiens
cugcugcagcaugaaggca

SEQ ID NO: 2112958 - RNA, 14 nt, Homo sapiens
cuuuguauccauga

SEQ ID NO: 2112959 - RNA, 22 nt, Homo sapiens
gaagguuggcgggggcacgugu

SEQ ID NO: 2112960 - RNA, 14 nt, Homo sapiens
cagcaaaagagcua

SEQ ID NO: 2112961 - RNA, 21 nt, Homo sapiens
uuauuuaggaaguugacuuau

SEQ ID NO: 2112962 - RNA, 19 nt, Homo sapiens
caauguaaauaguauaaag

SEQ ID NO: 2112963 - RNA, 15 nt, Homo sapiens
aguugaaugggcaca

SEQ ID NO: 2112964 - RNA, 15 nt, Homo sapiens
aacguucugcugcuu

SEQ ID NO: 2112965 - RNA, 14 nt, Homo sapiens
uuaagacuacugaa

SEQ ID NO: 2112966 - RNA, 19 nt, Homo sapiens
uccugaagaucaagccagu

SEQ ID NO: 2112967 - RNA, 20 nt, Homo sapiens
ucuuaggcaaucacauagug

SEQ ID NO: 2112968 - RNA, 19 nt, Homo sapiens
auuuaaaaaaaaacauuca

SEQ ID NO: 2112969 - RNA, 14 nt, Homo sapiens
ugcacuaacagagu

SEQ ID NO: 2112970 - RNA, 21 nt, Homo sapiens
uccaagggacccuuugccuuu

SEQ ID NO: 2112971 - RNA, 19 nt, Homo sapiens
uucguguauagcuguguga

SEQ ID NO: 2112972 - RNA, 20 nt, Homo sapiens
agccuggccagacacaggcc

SEQ ID NO: 2112973 - RNA, 12 nt, Homo sapiens
uggauugagggu

SEQ ID NO: 2112974 - RNA, 22 nt, Homo sapiens
gaaaugguccgcuuuccuggag

SEQ ID NO: 2112975 - RNA, 23 nt, Homo sapiens
uucugucaaaugugucucacauc

SEQ ID NO: 2112976 - RNA, 20 nt, Homo sapiens
uuugguuuucagauaugcuu

SEQ ID NO: 2112977 - RNA, 16 nt, Homo sapiens
uguuuguuguauacuu

SEQ ID NO: 2112978 - RNA, 16 nt, Homo sapiens
aauugcaaaucuugaa

SEQ ID NO: 2112979 - RNA, 21 nt, Homo sapiens
gaauuuuauuuuuugggaaaa

SEQ ID NO: 2112980 - RNA, 15 nt, Homo sapiens
ccuugccagacaugu

SEQ ID NO: 2112981 - RNA, 22 nt, Homo sapiens
aguauagagaaaaguguauuag

SEQ ID NO: 2112982 - RNA, 11 nt, Homo sapiens
ucgcaucucag

SEQ ID NO: 2112983 - RNA, 13 nt, Homo sapiens
gcucccucugugu

SEQ ID NO: 2112984 - RNA, 22 nt, Homo sapiens
ugcaguacucaguaaggcagug

SEQ ID NO: 2112985 - RNA, 15 nt, Homo sapiens
aggcugaaagacagg

SEQ ID NO: 2112986 - RNA, 10 nt, Homo sapiens
uacaguauau

SEQ ID NO: 2112987 - RNA, 18 nt, Homo sapiens
caugagggccacauucca

SEQ ID NO: 2112988 - RNA, 15 nt, Homo sapiens
uaucagcucucugca

SEQ ID NO: 2112989 - RNA, 16 nt, Homo sapiens
acuagaugaccucauu

SEQ ID NO: 2112990 - RNA, 17 nt, Homo sapiens
ggucuguggugcagugu

SEQ ID NO: 2112991 - RNA, 22 nt, Homo sapiens
cucuaaccauucuguauugauu

SEQ ID NO: 2112992 - RNA, 21 nt, Homo sapiens
acacaaagcuguugaaauauu

SEQ ID NO: 2112993 - RNA, 15 nt, Homo sapiens
gcuggguuauucaga

SEQ ID NO: 2112994 - RNA, 22 nt, Homo sapiens
acguggguucaauuugccauug

SEQ ID NO: 2112995 - RNA, 19 nt, Homo sapiens
agaggcugaggcuggcaca

SEQ ID NO: 2112996 - RNA, 22 nt, Homo sapiens
auaaccucaaagugacuauuca

SEQ ID NO: 2112997 - RNA, 12 nt, Homo sapiens
ugaaucuugucc

SEQ ID NO: 2112998 - RNA, 20 nt, Homo sapiens
gccaggccuuacaucuggcu

SEQ ID NO: 2112999 - RNA, 21 nt, Homo sapiens
gacuguaaaugaggacuucug

SEQ ID NO: 2113000 - RNA, 12 nt, Homo sapiens
acacacccaggc

SEQ ID NO: 2113001 - RNA, 18 nt, Homo sapiens
caggaaaguucagaguuu

SEQ ID NO: 2113002 - RNA, 18 nt, Homo sapiens
uuuuuccagauuugcuca

SEQ ID NO: 2113003 - RNA, 21 nt, Homo sapiens
ggccucuucuuccuaccuuga

SEQ ID NO: 2113004 - RNA, 23 nt, Homo sapiens
uguuccucuuacgcucugcucaa

SEQ ID NO: 2113005 - RNA, 15 nt, Homo sapiens
accugguacugaggu

SEQ ID NO: 2113006 - RNA, 15 nt, Homo sapiens
auguaaaacccaaaa

SEQ ID NO: 2113007 - RNA, 19 nt, Homo sapiens
caaauuugugguccacuga

SEQ ID NO: 2113008 - RNA, 12 nt, Homo sapiens
uucugcagaaau

SEQ ID NO: 2113009 - RNA, 19 nt, Homo sapiens
cuauauaccucacuagcca

SEQ ID NO: 2113010 - RNA, 21 nt, Homo sapiens
aaucuucucaucuuuuaucua

SEQ ID NO: 2113011 - RNA, 18 nt, Homo sapiens
aagucguuucaggacaug

SEQ ID NO: 2113012 - RNA, 15 nt, Homo sapiens
cagcaauccaugaga

SEQ ID NO: 2113013 - RNA, 14 nt, Homo sapiens
auuuauuucuagca

SEQ ID NO: 2113014 - RNA, 18 nt, Homo sapiens
agagcucucaugaugcua

SEQ ID NO: 2113015 - RNA, 13 nt, Homo sapiens
ugccucagcucag

SEQ ID NO: 2113016 - RNA, 13 nt, Homo sapiens
auuacacucugua

SEQ ID NO: 2113017 - RNA, 17 nt, Homo sapiens
aacugucccccaaaaaa

SEQ ID NO: 2113018 - RNA, 12 nt, Homo sapiens
uccuccaacagc

SEQ ID NO: 2113019 - RNA, 16 nt, Homo sapiens
uuagagguuugucaac

SEQ ID NO: 2113020 - RNA, 13 nt, Homo sapiens
caugcgcacucuc

SEQ ID NO: 2113021 - RNA, 18 nt, Homo sapiens
uccuaaucagccucgcuc

SEQ ID NO: 2113022 - RNA, 16 nt, Homo sapiens
gggcauggagccagug

SEQ ID NO: 2113023 - RNA, 14 nt, Homo sapiens
uaauuaaguacaac

SEQ ID NO: 2113024 - RNA, 23 nt, Homo sapiens
ucgccucucccaccccaugcauu

SEQ ID NO: 2113025 - RNA, 14 nt, Homo sapiens
gucuuucauugcua

SEQ ID NO: 2113026 - RNA, 20 nt, Homo sapiens
aggaaacucuccaugauuau

SEQ ID NO: 2113027 - RNA, 23 nt, Homo sapiens
uguacauaccuccuugcacaaau

SEQ ID NO: 2113028 - RNA, 16 nt, Homo sapiens
auuguagaaacacagu

SEQ ID NO: 2113029 - RNA, 18 nt, Homo sapiens
agcaucucccagcaagac

SEQ ID NO: 2113030 - RNA, 12 nt, Homo sapiens
aacaaucacugg

SEQ ID NO: 2113031 - RNA, 18 nt, Homo sapiens
agcuggcaaacugugaau

SEQ ID NO: 2113032 - RNA, 18 nt, Homo sapiens
ccucaacuccgugcuuaa

SEQ ID NO: 2113033 - RNA, 16 nt, Homo sapiens
uauuaagagcacguau

SEQ ID NO: 2113034 - RNA, 14 nt, Homo sapiens
cugaagcuaguuca

SEQ ID NO: 2113035 - RNA, 20 nt, Homo sapiens
uauuuuauucccuuucacaa

SEQ ID NO: 2113036 - RNA, 17 nt, Homo sapiens
uuuauuguuuucaacuc

SEQ ID NO: 2113037 - RNA, 23 nt, Homo sapiens
caguuaaggaagauccugaagca

SEQ ID NO: 2113038 - RNA, 22 nt, Homo sapiens
uucaggccgagccagguucaca

SEQ ID NO: 2113039 - RNA, 18 nt, Homo sapiens
gcccacaacucccuugca

SEQ ID NO: 2113040 - RNA, 15 nt, Homo sapiens
guggcccuucacugu

SEQ ID NO: 2113041 - RNA, 15 nt, Homo sapiens
aacuuuguaugucau

SEQ ID NO: 2113042 - RNA, 16 nt, Homo sapiens
cacuugaaaagugugu

SEQ ID NO: 2113043 - RNA, 18 nt, Homo sapiens
ucuuuugugucagugucu

SEQ ID NO: 2113044 - RNA, 18 nt, Homo sapiens
uccugaccccucccugca

SEQ ID NO: 2113045 - RNA, 13 nt, Homo sapiens
aagacaucugccu

SEQ ID NO: 2113046 - RNA, 13 nt, Homo sapiens
aucccacugggag

SEQ ID NO: 2113047 - RNA, 12 nt, Homo sapiens
acauuuugugac

SEQ ID NO: 2113048 - RNA, 12 nt, Homo sapiens
auauaugcaaaa

SEQ ID NO: 2113049 - RNA, 20 nt, Homo sapiens
acaaggugcacagaccucag

SEQ ID NO: 2113050 - RNA, 15 nt, Homo sapiens
gaaacuugucacuug

SEQ ID NO: 2113051 - RNA, 14 nt, Homo sapiens
aggccugacugcca

SEQ ID NO: 2113052 - RNA, 13 nt, Homo sapiens
cccccaccaugca

SEQ ID NO: 2113053 - RNA, 17 nt, Homo sapiens
uuccuuuuugacacuga

SEQ ID NO: 2113054 - RNA, 18 nt, Homo sapiens
uaauaaaaaggaguauac

SEQ ID NO: 2113055 - RNA, 20 nt, Homo sapiens
ccagccucuagaacagccag

SEQ ID NO: 2113056 - RNA, 19 nt, Homo sapiens
agacuuuuuuuuaacacuu

SEQ ID NO: 2113057 - RNA, 22 nt, Homo sapiens
gcagagagccauuuugugaaug

SEQ ID NO: 2113058 - RNA, 20 nt, Homo sapiens
aaaauaauuauaaauaucau

SEQ ID NO: 2113059 - RNA, 17 nt, Homo sapiens
uucauuuucaucacugg

SEQ ID NO: 2113060 - RNA, 23 nt, Homo sapiens
uccccucccugugacccguucca

SEQ ID NO: 2113061 - RNA, 19 nt, Homo sapiens
ccuacccucccagcgaguu

SEQ ID NO: 2113062 - RNA, 13 nt, Homo sapiens
auacuuuacaugg

SEQ ID NO: 2113063 - RNA, 16 nt, Homo sapiens
ggagcggagcuugccu

SEQ ID NO: 2113064 - RNA, 16 nt, Homo sapiens
uggccaggcugaucuc

SEQ ID NO: 2113065 - RNA, 15 nt, Homo sapiens
aagguauugagacau

SEQ ID NO: 2113066 - RNA, 22 nt, Homo sapiens
aaggaucuucccacuuugccac

SEQ ID NO: 2113067 - RNA, 22 nt, Homo sapiens
aguucaccuccugacaguauua

SEQ ID NO: 2113068 - RNA, 19 nt, Homo sapiens
acucugccucugccugcau

SEQ ID NO: 2113069 - RNA, 14 nt, Homo sapiens
ugaaaccaugacug

SEQ ID NO: 2113070 - RNA, 16 nt, Homo sapiens
ucccacgugcacagcu

SEQ ID NO: 2113071 - RNA, 15 nt, Homo sapiens
aauuuacaaaccucu

SEQ ID NO: 2113072 - RNA, 16 nt, Homo sapiens
aggucauaugcacguu

SEQ ID NO: 2113073 - RNA, 19 nt, Homo sapiens
ugcuugaguggacagcagc

SEQ ID NO: 2113074 - RNA, 23 nt, Homo sapiens
cuuggcaguguggacaugagcag

SEQ ID NO: 2113075 - RNA, 21 nt, Homo sapiens
uucagugucgggaauuuuccc

SEQ ID NO: 2113076 - RNA, 23 nt, Homo sapiens
cagaaaacagaggccacacuuuc

SEQ ID NO: 2113077 - RNA, 16 nt, Homo sapiens
uauuucugcauggaaa

SEQ ID NO: 2113078 - RNA, 14 nt, Homo sapiens
ccuuaccgcucugu

SEQ ID NO: 2113079 - RNA, 15 nt, Homo sapiens
uaggguccugaaugu

SEQ ID NO: 2113080 - RNA, 19 nt, Homo sapiens
aauuaaauuucacaauaua

SEQ ID NO: 2113081 - RNA, 12 nt, Homo sapiens
agccuguaccuu

SEQ ID NO: 2113082 - RNA, 18 nt, Homo sapiens
cauuguuucccaucacug

SEQ ID NO: 2113083 - RNA, 23 nt, Homo sapiens
aaaguuguuguaaccugcuguga

SEQ ID NO: 2113084 - RNA, 15 nt, Homo sapiens
ugcauacucugugca

SEQ ID NO: 2113085 - RNA, 16 nt, Homo sapiens
aaacagacccucccac

SEQ ID NO: 2113086 - RNA, 18 nt, Homo sapiens
cuuagagcuuuaccuaaa

SEQ ID NO: 2113087 - RNA, 21 nt, Homo sapiens
cuugcgauucugcagccacaa

SEQ ID NO: 2113088 - RNA, 18 nt, Homo sapiens
uacuuauuuuccaauaaa

SEQ ID NO: 2113089 - RNA, 17 nt, Homo sapiens
agccccuggggccuaga

SEQ ID NO: 2113090 - RNA, 20 nt, Homo sapiens
agugaccccugaccucacug

SEQ ID NO: 2113091 - RNA, 18 nt, Homo sapiens
uugcccagggacuuccuc

SEQ ID NO: 2113092 - RNA, 14 nt, Homo sapiens
uccugucauauaau

SEQ ID NO: 2113093 - RNA, 14 nt, Homo sapiens
uaaggaaauaucau

SEQ ID NO: 2113094 - RNA, 16 nt, Homo sapiens
cgcuacaccacucugg

SEQ ID NO: 2113095 - RNA, 15 nt, Homo sapiens
ucaacuguugccagg

SEQ ID NO: 2113096 - RNA, 15 nt, Homo sapiens
auuccuuuucccaac

SEQ ID NO: 2113097 - RNA, 21 nt, Homo sapiens
aggugcuuuguaauauucucc

SEQ ID NO: 2113098 - RNA, 17 nt, Homo sapiens
ggcuacacacaaaccag

SEQ ID NO: 2113099 - RNA, 17 nt, Homo sapiens
uacagccagaagcccau

SEQ ID NO: 2113100 - RNA, 13 nt, Homo sapiens
cuacuauucuguu

SEQ ID NO: 2113101 - RNA, 19 nt, Homo sapiens
aucuuacacgaagaaauag

SEQ ID NO: 2113102 - RNA, 23 nt, Homo sapiens
gaacaucuggagagagagcaaga

SEQ ID NO: 2113103 - RNA, 23 nt, Homo sapiens
auucaacagguuuuccugaagaa

SEQ ID NO: 2113104 - RNA, 16 nt, Homo sapiens
aguuuauuacaaugua

SEQ ID NO: 2113105 - RNA, 13 nt, Homo sapiens
ccugugugacugg

SEQ ID NO: 2113106 - RNA, 14 nt, Homo sapiens
aaguuaaagagaca

SEQ ID NO: 2113107 - RNA, 12 nt, Homo sapiens
uccacaaugaaa

SEQ ID NO: 2113108 - RNA, 18 nt, Homo sapiens
aacaacuuaugacuaaaa

SEQ ID NO: 2113109 - RNA, 20 nt, Homo sapiens
gacuccaccuuggaccucag

SEQ ID NO: 2113110 - RNA, 21 nt, Homo sapiens
auggaaacagaugaaaagccu

SEQ ID NO: 2113111 - RNA, 17 nt, Homo sapiens
aaagugcugagauuaca

SEQ ID NO: 2113112 - RNA, 20 nt, Homo sapiens
ucuuuucuaucucaucuuga

SEQ ID NO: 2113113 - RNA, 14 nt, Homo sapiens
uuaccugaccucuu

SEQ ID NO: 2113114 - RNA, 23 nt, Homo sapiens
acauuguacuuauacaccuuauu

SEQ ID NO: 2113115 - RNA, 13 nt, Homo sapiens
auggaagcauauu

SEQ ID NO: 2113116 - RNA, 18 nt, Homo sapiens
gaaccacuuguagauuug

SEQ ID NO: 2113117 - RNA, 22 nt, Homo sapiens
ccuugcuuuacaaaccaaccau

SEQ ID NO: 2113118 - RNA, 20 nt, Homo sapiens
aucucuuuagagaaguccaa

SEQ ID NO: 2113119 - RNA, 18 nt, Homo sapiens
aggguggggucuggucac

SEQ ID NO: 2113120 - RNA, 13 nt, Homo sapiens
aagacccauuccu

SEQ ID NO: 2113121 - RNA, 21 nt, Homo sapiens
uccauagugcacuagcauuuu

SEQ ID NO: 2113122 - RNA, 21 nt, Homo sapiens
uagaucauaacagaacuuauu

SEQ ID NO: 2113123 - RNA, 14 nt, Homo sapiens
aucagacuuuuaca

SEQ ID NO: 2113124 - RNA, 17 nt, Homo sapiens
gccaccccggugucauc

SEQ ID NO: 2113125 - RNA, 16 nt, Homo sapiens
ucuaaaaauccauaaa

SEQ ID NO: 2113126 - RNA, 13 nt, Homo sapiens
aagcuugcugcuc

SEQ ID NO: 2113127 - RNA, 20 nt, Homo sapiens
auggucuuggcagcaccugu

SEQ ID NO: 2113128 - RNA, 23 nt, Homo sapiens
cuuucaggaggaggaggggagug

SEQ ID NO: 2113129 - RNA, 20 nt, Homo sapiens
gaaaugcugccugccugucu

SEQ ID NO: 2113130 - RNA, 14 nt, Homo sapiens
gcaguggcgugauc

SEQ ID NO: 2113131 - RNA, 23 nt, Homo sapiens
uaaaagcuacuauguacugccuu

SEQ ID NO: 2113132 - RNA, 19 nt, Homo sapiens
uucuugacauuuaaacuca

SEQ ID NO: 2113133 - RNA, 17 nt, Homo sapiens
agcagaguugucuuaaa

SEQ ID NO: 2113134 - RNA, 17 nt, Homo sapiens
gaaaugccugcuuugaa

SEQ ID NO: 2113135 - RNA, 19 nt, Homo sapiens
cagugcaaauuguaucuua

SEQ ID NO: 2113136 - RNA, 17 nt, Homo sapiens
acggaugaccauaugca

SEQ ID NO: 2113137 - RNA, 15 nt, Homo sapiens
aaugucuggggacag

SEQ ID NO: 2113138 - RNA, 19 nt, Homo sapiens
auuuuggcuuaaaaaucau

SEQ ID NO: 2113139 - RNA, 16 nt, Homo sapiens
cuggggacccccgugg

SEQ ID NO: 2113140 - RNA, 19 nt, Homo sapiens
aaaagaaguguuccuucau

SEQ ID NO: 2113141 - RNA, 19 nt, Homo sapiens
gagaaguugaggggagcau

SEQ ID NO: 2113142 - RNA, 12 nt, Homo sapiens
ccagacccugaa

SEQ ID NO: 2113143 - RNA, 12 nt, Homo sapiens
ccugacccugua

SEQ ID NO: 2113144 - RNA, 18 nt, Homo sapiens
acugaaaacaagccauga

SEQ ID NO: 2113145 - RNA, 21 nt, Homo sapiens
cagaagccccaacugugauca

SEQ ID NO: 2113146 - RNA, 15 nt, Homo sapiens
agacugacaaccuca

SEQ ID NO: 2113147 - RNA, 20 nt, Homo sapiens
gggccagcugccccucauuu

SEQ ID NO: 2113148 - RNA, 17 nt, Homo sapiens
caaaaucugucacuaca

SEQ ID NO: 2113149 - RNA, 14 nt, Homo sapiens
ggugacguagaauu

SEQ ID NO: 2113150 - RNA, 19 nt, Homo sapiens
aguuauucucuucacuccc

SEQ ID NO: 2113151 - RNA, 16 nt, Homo sapiens
ugaagaaaagagucca

SEQ ID NO: 2113152 - RNA, 16 nt, Homo sapiens
cagaaguaucaagcca

SEQ ID NO: 2113153 - RNA, 18 nt, Homo sapiens
uaaaaaugagugcuuaaa

SEQ ID NO: 2113154 - RNA, 14 nt, Homo sapiens
ucuggaugaaggca

SEQ ID NO: 2113155 - RNA, 18 nt, Homo sapiens
ccagcggaaacaggugug

SEQ ID NO: 2113156 - RNA, 15 nt, Homo sapiens
ugucuuaacugucac

SEQ ID NO: 2113157 - RNA, 19 nt, Homo sapiens
gcacccuaguucuaccuca

SEQ ID NO: 2113158 - RNA, 21 nt, Homo sapiens
cugccuaggguccuguccaug

SEQ ID NO: 2113159 - RNA, 22 nt, Homo sapiens
cuucuuaauguacauagugcua

SEQ ID NO: 2113160 - RNA, 13 nt, Homo sapiens
uaaauucuggaac

SEQ ID NO: 2113161 - RNA, 13 nt, Homo sapiens
aaagcuggcccag

SEQ ID NO: 2113162 - RNA, 14 nt, Homo sapiens
cuguacugaaggug

SEQ ID NO: 2113163 - RNA, 18 nt, Homo sapiens
gcucuaauguuugcauau

SEQ ID NO: 2113164 - RNA, 17 nt, Homo sapiens
uuguucccgauggucuc

SEQ ID NO: 2113165 - RNA, 19 nt, Homo sapiens
uggcuuuuuuuuguagcca

SEQ ID NO: 2113166 - RNA, 13 nt, Homo sapiens
ugggaacuccuaa

SEQ ID NO: 2113167 - RNA, 16 nt, Homo sapiens
agaauuguuuugcauu

SEQ ID NO: 2113168 - RNA, 17 nt, Homo sapiens
cauccagaaguuccuca

SEQ ID NO: 2113169 - RNA, 23 nt, Homo sapiens
uucagggggccaggugcacagac

SEQ ID NO: 2113170 - RNA, 18 nt, Homo sapiens
uucuuaauaaacuugcuu

SEQ ID NO: 2113171 - RNA, 19 nt, Homo sapiens
uuaguaguaaacugaaggu

SEQ ID NO: 2113172 - RNA, 19 nt, Homo sapiens
ugucuaauaaacacagauu

SEQ ID NO: 2113173 - RNA, 11 nt, Homo sapiens
cuugugaaggc

SEQ ID NO: 2113174 - RNA, 17 nt, Homo sapiens
acacaggcuucaucaag

SEQ ID NO: 2113175 - RNA, 18 nt, Homo sapiens
acacugagauauucagcc

SEQ ID NO: 2113176 - RNA, 17 nt, Homo sapiens
cagacaauaaacccuca

SEQ ID NO: 2113177 - RNA, 19 nt, Homo sapiens
uaugauugugcacauacuu

SEQ ID NO: 2113178 - RNA, 17 nt, Homo sapiens
aucaugcaugcacucuu

SEQ ID NO: 2113179 - RNA, 13 nt, Homo sapiens
ccucgccagcugc

SEQ ID NO: 2113180 - RNA, 11 nt, Homo sapiens
auuaauaugcu

SEQ ID NO: 2113181 - RNA, 19 nt, Homo sapiens
cccagggcuugugugcaca

SEQ ID NO: 2113182 - RNA, 22 nt, Homo sapiens
aggucccgaaaggggcacuggu

SEQ ID NO: 2113183 - RNA, 17 nt, Homo sapiens
guuaaacauugaaguaa

SEQ ID NO: 2113184 - RNA, 16 nt, Homo sapiens
gaaaggaacugcaaua

SEQ ID NO: 2113185 - RNA, 16 nt, Homo sapiens
cucuguugaaucacag

SEQ ID NO: 2113186 - RNA, 16 nt, Homo sapiens
cuggacaccacccaga

SEQ ID NO: 2113187 - RNA, 14 nt, Homo sapiens
auguuguguaacag

SEQ ID NO: 2113188 - RNA, 19 nt, Homo sapiens
ucgcagagaggccaggugc

SEQ ID NO: 2113189 - RNA, 21 nt, Homo sapiens
uuacagagauauaaaugaagu

SEQ ID NO: 2113190 - RNA, 19 nt, Homo sapiens
cauuguaucuucauacaaa

SEQ ID NO: 2113191 - RNA, 19 nt, Homo sapiens
cucaucacccaguccuggc

SEQ ID NO: 2113192 - RNA, 19 nt, Homo sapiens
aggucugaaucuucaccau

SEQ ID NO: 2113193 - RNA, 13 nt, Homo sapiens
aucuucagauuaa

SEQ ID NO: 2113194 - RNA, 18 nt, Homo sapiens
aguccacaagaacaauuc

SEQ ID NO: 2113195 - RNA, 16 nt, Homo sapiens
auacagaaaugcaaaa

SEQ ID NO: 2113196 - RNA, 19 nt, Homo sapiens
uguauguuguacaaucaaa

SEQ ID NO: 2113197 - RNA, 15 nt, Homo sapiens
agguucuucagggcc

SEQ ID NO: 2113198 - RNA, 16 nt, Homo sapiens
cagugaagauguguaa

SEQ ID NO: 2113199 - RNA, 17 nt, Homo sapiens
cagcugggaagcccuuu

SEQ ID NO: 2113200 - RNA, 15 nt, Homo sapiens
cauguggacuggugc

SEQ ID NO: 2113201 - RNA, 12 nt, Homo sapiens
ccuccuuuccca

SEQ ID NO: 2113202 - RNA, 15 nt, Homo sapiens
aauggggaauucucu

SEQ ID NO: 2113203 - RNA, 17 nt, Homo sapiens
cucuuaaucaaauagca

SEQ ID NO: 2113204 - RNA, 14 nt, Homo sapiens
ucuauaauuuaccu

SEQ ID NO: 2113205 - RNA, 20 nt, Homo sapiens
acagcucuccuccuccaucu

SEQ ID NO: 2113206 - RNA, 20 nt, Homo sapiens
aaaccaucaaaaauauucca

SEQ ID NO: 2113207 - RNA, 23 nt, Homo sapiens
gauguagcaugcuuguugcaauu

SEQ ID NO: 2113208 - RNA, 23 nt, Homo sapiens
auuuaggauaaccuugugccuug

SEQ ID NO: 2113209 - RNA, 14 nt, Homo sapiens
uuggugggucucaa

SEQ ID NO: 2113210 - RNA, 22 nt, Homo sapiens
uuuucugcuaaaaaguccuuga

SEQ ID NO: 2113211 - RNA, 13 nt, Homo sapiens
uucuguugccaca

SEQ ID NO: 2113212 - RNA, 15 nt, Homo sapiens
uuuauguucuaguga

SEQ ID NO: 2113213 - RNA, 14 nt, Homo sapiens
gcaagagacuacuc

SEQ ID NO: 2113214 - RNA, 14 nt, Homo sapiens
ucuauuuuaaucuu

SEQ ID NO: 2113215 - RNA, 18 nt, Homo sapiens
gugucugcucucauccau

SEQ ID NO: 2113216 - RNA, 15 nt, Homo sapiens
aaugccagacuucua

SEQ ID NO: 2113217 - RNA, 15 nt, Homo sapiens
gccaggccaacugcc

SEQ ID NO: 2113218 - RNA, 16 nt, Homo sapiens
uuacuguuuuugauaa

SEQ ID NO: 2113219 - RNA, 16 nt, Homo sapiens
cuuggcucaccugaag

SEQ ID NO: 2113220 - RNA, 20 nt, Homo sapiens
uucuugaaauguaggcauca

SEQ ID NO: 2113221 - RNA, 15 nt, Homo sapiens
ucuacaaaaaaccag

SEQ ID NO: 2113222 - RNA, 16 nt, Homo sapiens
auaugauugugcacau

SEQ ID NO: 2113223 - RNA, 16 nt, Homo sapiens
cuuugauucuguaaua

SEQ ID NO: 2113224 - RNA, 16 nt, Homo sapiens
ucuuuuuucucucuua

SEQ ID NO: 2113225 - RNA, 22 nt, Homo sapiens
acucugcugcuuagacauaaca

SEQ ID NO: 2113226 - RNA, 22 nt, Homo sapiens
acgcugcgugccaugaguccau

SEQ ID NO: 2113227 - RNA, 16 nt, Homo sapiens
gauuuaauccaguuau

SEQ ID NO: 2113228 - RNA, 21 nt, Homo sapiens
guagaccaaaucaaaugcuca

SEQ ID NO: 2113229 - RNA, 14 nt, Homo sapiens
uuucagacuuuaaa

SEQ ID NO: 2113230 - RNA, 18 nt, Homo sapiens
cuagacaauuucuucuaa

SEQ ID NO: 2113231 - RNA, 15 nt, Homo sapiens
uugucagcaucugac

SEQ ID NO: 2113232 - RNA, 14 nt, Homo sapiens
uccucuacauacca

SEQ ID NO: 2113233 - RNA, 22 nt, Homo sapiens
accacuuuuaacagaacagaca

SEQ ID NO: 2113234 - RNA, 15 nt, Homo sapiens
agcagaccgugauuu

SEQ ID NO: 2113235 - RNA, 14 nt, Homo sapiens
aggagaacacuaga

SEQ ID NO: 2113236 - RNA, 14 nt, Homo sapiens
caauacaacuuuac

SEQ ID NO: 2113237 - RNA, 16 nt, Homo sapiens
ggucugagaauggaau

SEQ ID NO: 2113238 - RNA, 18 nt, Homo sapiens
aaauuccucuuacuguaa

SEQ ID NO: 2113239 - RNA, 14 nt, Homo sapiens
acguaagcacuguu

SEQ ID NO: 2113240 - RNA, 11 nt, Homo sapiens
ugacacaugcu

SEQ ID NO: 2113241 - RNA, 15 nt, Homo sapiens
aaauaaaucacagau

SEQ ID NO: 2113242 - RNA, 22 nt, Homo sapiens
aagucuuaaggacaaagugcca

SEQ ID NO: 2113243 - RNA, 19 nt, Homo sapiens
ugggcuauaaaagauuccu

SEQ ID NO: 2113244 - RNA, 22 nt, Homo sapiens
guccugaauguuucagaccaca

SEQ ID NO: 2113245 - RNA, 24 nt, Homo sapiens
acagucuccccagauauggaccau

SEQ ID NO: 2113246 - RNA, 18 nt, Homo sapiens
cugagcacgcuaccaaau

SEQ ID NO: 2113247 - RNA, 13 nt, Homo sapiens
auaggcagcaucu

SEQ ID NO: 2113248 - RNA, 18 nt, Homo sapiens
ucucucaacaccaugauu

SEQ ID NO: 2113249 - RNA, 12 nt, Homo sapiens
acccauucuucc

SEQ ID NO: 2113250 - RNA, 19 nt, Homo sapiens
aauuuuuuuuucaacacuc

SEQ ID NO: 2113251 - RNA, 20 nt, Homo sapiens
auguuucuaucuuguauguc

SEQ ID NO: 2113252 - RNA, 12 nt, Homo sapiens
ucugcucaguga

SEQ ID NO: 2113253 - RNA, 19 nt, Homo sapiens
aacaauguuuuuuauacuu

SEQ ID NO: 2113254 - RNA, 13 nt, Homo sapiens
uauucaacagaaa

SEQ ID NO: 2113255 - RNA, 17 nt, Homo sapiens
aggcugugcucuuccuc

SEQ ID NO: 2113256 - RNA, 23 nt, Homo sapiens
aaaaagagacccacaauaaacuc

SEQ ID NO: 2113257 - RNA, 19 nt, Homo sapiens
ggucucauucauccuuaug

SEQ ID NO: 2113258 - RNA, 21 nt, Homo sapiens
caaagaguauguuguaagaaa

SEQ ID NO: 2113259 - RNA, 22 nt, Homo sapiens
guagauuaccugccacuuccag

SEQ ID NO: 2113260 - RNA, 17 nt, Homo sapiens
auuauuguagucuugca

SEQ ID NO: 2113261 - RNA, 19 nt, Homo sapiens
guuaacuuaauaguauuua

SEQ ID NO: 2113262 - RNA, 18 nt, Homo sapiens
aagcccauucauuccauu

SEQ ID NO: 2113263 - RNA, 22 nt, Homo sapiens
cgagauagccaaggccaaagga

SEQ ID NO: 2113264 - RNA, 15 nt, Homo sapiens
ucauguucuagucug

SEQ ID NO: 2113265 - RNA, 22 nt, Homo sapiens
ugagaaaugaauaagcuuucuc

SEQ ID NO: 2113266 - RNA, 14 nt, Homo sapiens
cucccaucaccucu

SEQ ID NO: 2113267 - RNA, 23 nt, Homo sapiens
aaugccccugaauuuaaauagcu

SEQ ID NO: 2113268 - RNA, 23 nt, Homo sapiens
aucuacaccaaugaaaacaugua

SEQ ID NO: 2113269 - RNA, 16 nt, Homo sapiens
cucaguguuaauacug

SEQ ID NO: 2113270 - RNA, 12 nt, Homo sapiens
uggugcuuccca

SEQ ID NO: 2113271 - RNA, 22 nt, Homo sapiens
guggcucacgccuguaauccca

SEQ ID NO: 2113272 - RNA, 18 nt, Homo sapiens
gcaauacuacaaccucac

SEQ ID NO: 2113273 - RNA, 18 nt, Homo sapiens
aggcagggcaaaugacau

SEQ ID NO: 2113274 - RNA, 22 nt, Homo sapiens
aagacuggaagcuaauuugcau

SEQ ID NO: 2113275 - RNA, 17 nt, Homo sapiens
cugucuccaugcuggau

SEQ ID NO: 2113276 - RNA, 13 nt, Homo sapiens
acccuucccucac

SEQ ID NO: 2113277 - RNA, 13 nt, Homo sapiens
ccaacuccauacu

SEQ ID NO: 2113278 - RNA, 16 nt, Homo sapiens
ugguaauuuguaucug

SEQ ID NO: 2113279 - RNA, 16 nt, Homo sapiens
guccuuugggacucau

SEQ ID NO: 2113280 - RNA, 14 nt, Homo sapiens
agcagccacucagu

SEQ ID NO: 2113281 - RNA, 15 nt, Homo sapiens
aaucagucagccgcu

SEQ ID NO: 2113282 - RNA, 22 nt, Homo sapiens
uuaaauauuguaauaugacaga

SEQ ID NO: 2113283 - RNA, 22 nt, Homo sapiens
uggcccauagaaacaugacacu

SEQ ID NO: 2113284 - RNA, 19 nt, Homo sapiens
cuagaacacccacuggcca

SEQ ID NO: 2113285 - RNA, 17 nt, Homo sapiens
uuuugucuauaugugcg

SEQ ID NO: 2113286 - RNA, 12 nt, Homo sapiens
uuuccaaaagua

SEQ ID NO: 2113287 - RNA, 12 nt, Homo sapiens
cacuauuuccau

SEQ ID NO: 2113288 - RNA, 15 nt, Homo sapiens
gucaggaaacauuca

SEQ ID NO: 2113289 - RNA, 15 nt, Homo sapiens
gucuugaaacaagca

SEQ ID NO: 2113290 - RNA, 21 nt, Homo sapiens
uuaauacauaguguauuuugc

SEQ ID NO: 2113291 - RNA, 22 nt, Homo sapiens
agucagggaccugcugcucagu

SEQ ID NO: 2113292 - RNA, 22 nt, Homo sapiens
cucagaccccaggucagcaucu

SEQ ID NO: 2113293 - RNA, 16 nt, Homo sapiens
agcuagcaacauuugu

SEQ ID NO: 2113294 - RNA, 20 nt, Homo sapiens
aaaaaaguguccuauaauuc

SEQ ID NO: 2113295 - RNA, 16 nt, Homo sapiens
gagaaugacccuguca

SEQ ID NO: 2113296 - RNA, 19 nt, Homo sapiens
ggccugggugugugugagc

SEQ ID NO: 2113297 - RNA, 20 nt, Homo sapiens
uguagcucuaggguauauau

SEQ ID NO: 2113298 - RNA, 21 nt, Homo sapiens
guugcccaggcugcucuugaa

SEQ ID NO: 2113299 - RNA, 16 nt, Homo sapiens
agccaggccugaccuc

SEQ ID NO: 2113300 - RNA, 19 nt, Homo sapiens
cuguucauuucacacagug

SEQ ID NO: 2113301 - RNA, 22 nt, Homo sapiens
gaaucuucaagaccaaagcaga

SEQ ID NO: 2113302 - RNA, 21 nt, Homo sapiens
aaaccugugauuucugugcca

SEQ ID NO: 2113303 - RNA, 17 nt, Homo sapiens
guuccuuggggggccaa

SEQ ID NO: 2113304 - RNA, 22 nt, Homo sapiens
uuggcuucucaauagaguguug

SEQ ID NO: 2113305 - RNA, 13 nt, Homo sapiens
agcugggccgagu

SEQ ID NO: 2113306 - RNA, 19 nt, Homo sapiens
cuaggacucugcacugaau

SEQ ID NO: 2113307 - RNA, 18 nt, Homo sapiens
gucuacucagcauuugau

SEQ ID NO: 2113308 - RNA, 18 nt, Homo sapiens
gggaaggccaggaccaug

SEQ ID NO: 2113309 - RNA, 19 nt, Homo sapiens
ucacaaccacucauucaaa

SEQ ID NO: 2113310 - RNA, 19 nt, Homo sapiens
guuacuuuuuuacacugau

SEQ ID NO: 2113311 - RNA, 19 nt, Homo sapiens
aagaauuuaagaaacuuau

SEQ ID NO: 2113312 - RNA, 15 nt, Homo sapiens
gcaacaauauccuuu

SEQ ID NO: 2113313 - RNA, 15 nt, Homo sapiens
auuucuacguggaug

SEQ ID NO: 2113314 - RNA, 21 nt, Homo sapiens
gcacuguccagggcccaugua

SEQ ID NO: 2113315 - RNA, 14 nt, Homo sapiens
ggaaguccuagccc

SEQ ID NO: 2113316 - RNA, 13 nt, Homo sapiens
aaaguaaugccac

SEQ ID NO: 2113317 - RNA, 14 nt, Homo sapiens
ccaggaggggccug

SEQ ID NO: 2113318 - RNA, 19 nt, Homo sapiens
auugaugacaguaguacca

SEQ ID NO: 2113319 - RNA, 14 nt, Homo sapiens
caaauaagugcauu

SEQ ID NO: 2113320 - RNA, 17 nt, Homo sapiens
gacccgcucuggaccaa

SEQ ID NO: 2113321 - RNA, 19 nt, Homo sapiens
uguaagauaaaccaguuga

SEQ ID NO: 2113322 - RNA, 19 nt, Homo sapiens
aucuagaugaggugcuuug

SEQ ID NO: 2113323 - RNA, 18 nt, Homo sapiens
gacacacaggcagcugaa

SEQ ID NO: 2113324 - RNA, 21 nt, Homo sapiens
uuccgagcacacauaaaagca

SEQ ID NO: 2113325 - RNA, 22 nt, Homo sapiens
gaacucuagagggcgagggaug

SEQ ID NO: 2113326 - RNA, 21 nt, Homo sapiens
aagaauuauuuuauacacaga

SEQ ID NO: 2113327 - RNA, 18 nt, Homo sapiens
acauguugucacauucuc

SEQ ID NO: 2113328 - RNA, 22 nt, Homo sapiens
guuuauacacaacuuugcaaau

SEQ ID NO: 2113329 - RNA, 14 nt, Homo sapiens
acccuuugcuguga

SEQ ID NO: 2113330 - RNA, 16 nt, Homo sapiens
cugcauggagaagggu

SEQ ID NO: 2113331 - RNA, 11 nt, Homo sapiens
ugggacagggc

SEQ ID NO: 2113332 - RNA, 22 nt, Homo sapiens
accacaaggcugaaaagugcuu

SEQ ID NO: 2113333 - RNA, 23 nt, Homo sapiens
acagguuuuguguuuugucauua

SEQ ID NO: 2113334 - RNA, 15 nt, Homo sapiens
ccaggggcagugaag

SEQ ID NO: 2113335 - RNA, 16 nt, Homo sapiens
uaagauuuaauucaca

SEQ ID NO: 2113336 - RNA, 23 nt, Homo sapiens
acacuggaccccacuggcugaga

SEQ ID NO: 2113337 - RNA, 11 nt, Homo sapiens
agauuccauuu

SEQ ID NO: 2113338 - RNA, 21 nt, Homo sapiens
auauggacucugcacaugaau

SEQ ID NO: 2113339 - RNA, 16 nt, Homo sapiens
gugguuuuucagcucc

SEQ ID NO: 2113340 - RNA, 22 nt, Homo sapiens
ccaaucgccccacccguuccua

SEQ ID NO: 2113341 - RNA, 23 nt, Homo sapiens
acagcaauucaugguucaaguau

SEQ ID NO: 2113342 - RNA, 18 nt, Homo sapiens
ugguccgaagucuuccau

SEQ ID NO: 2113343 - RNA, 23 nt, Homo sapiens
acuuuaucgcucuaaaguaaaac

SEQ ID NO: 2113344 - RNA, 21 nt, Homo sapiens
auuauuuuugcucugcucugu

SEQ ID NO: 2113345 - RNA, 22 nt, Homo sapiens
ccuuuauuaaugaacugugaca

SEQ ID NO: 2113346 - RNA, 21 nt, Homo sapiens
cuauuucaccauguugccaau

SEQ ID NO: 2113347 - RNA, 15 nt, Homo sapiens
gaagcauaaagcaau

SEQ ID NO: 2113348 - RNA, 18 nt, Homo sapiens
ucuggucauaaugaacac

SEQ ID NO: 2113349 - RNA, 21 nt, Homo sapiens
acagugagucgaggacaggga

SEQ ID NO: 2113350 - RNA, 20 nt, Homo sapiens
uuuugagaugggggucucac

SEQ ID NO: 2113351 - RNA, 23 nt, Homo sapiens
uccuucaucaugaguucugcuga

SEQ ID NO: 2113352 - RNA, 19 nt, Homo sapiens
ccuacaccaacugcucuca

SEQ ID NO: 2113353 - RNA, 21 nt, Homo sapiens
uccuagccacaucacuacagu

SEQ ID NO: 2113354 - RNA, 17 nt, Homo sapiens
uuuaccuacucuaugua

SEQ ID NO: 2113355 - RNA, 16 nt, Homo sapiens
auuuaauucaccucag

SEQ ID NO: 2113356 - RNA, 17 nt, Homo sapiens
ucugauuccaaauaagu

SEQ ID NO: 2113357 - RNA, 17 nt, Homo sapiens
agauugcaccacugcuc

SEQ ID NO: 2113358 - RNA, 17 nt, Homo sapiens
ucccgaguagcugagau

SEQ ID NO: 2113359 - RNA, 21 nt, Homo sapiens
aaccucauccucuccacagcu

SEQ ID NO: 2113360 - RNA, 14 nt, Homo sapiens
ugaagauuauuuca

SEQ ID NO: 2113361 - RNA, 18 nt, Homo sapiens
cuucugagcacuguuuau

SEQ ID NO: 2113362 - RNA, 18 nt, Homo sapiens
cuggggcuuuaacuccug

SEQ ID NO: 2113363 - RNA, 20 nt, Homo sapiens
auuuaagaauaaagucuugu

SEQ ID NO: 2113364 - RNA, 15 nt, Homo sapiens
aggagacucaccucu

SEQ ID NO: 2113365 - RNA, 18 nt, Homo sapiens
guccuggauucacuggcu

SEQ ID NO: 2113366 - RNA, 23 nt, Homo sapiens
auauggagcuuuuccugauguuc

SEQ ID NO: 2113367 - RNA, 17 nt, Homo sapiens
caggauugucacuccaa

SEQ ID NO: 2113368 - RNA, 21 nt, Homo sapiens
uccccuggggagucugggcac

SEQ ID NO: 2113369 - RNA, 19 nt, Homo sapiens
ccuuguuucagggcugugg

SEQ ID NO: 2113370 - RNA, 14 nt, Homo sapiens
ugaaacaaaacugg

SEQ ID NO: 2113371 - RNA, 21 nt, Homo sapiens
cuccaugcuccucaccugucu

SEQ ID NO: 2113372 - RNA, 16 nt, Homo sapiens
auccucugaguuaaau

SEQ ID NO: 2113373 - RNA, 19 nt, Homo sapiens
aggcaccugccaccaugcc

SEQ ID NO: 2113374 - RNA, 15 nt, Homo sapiens
gugaagagcauuugg

SEQ ID NO: 2113375 - RNA, 14 nt, Homo sapiens
ugacaauugcaaau

SEQ ID NO: 2113376 - RNA, 20 nt, Homo sapiens
cccacuaaaagaauugugac

SEQ ID NO: 2113377 - RNA, 18 nt, Homo sapiens
ugcaguauucuugcacug

SEQ ID NO: 2113378 - RNA, 16 nt, Homo sapiens
uucaggcuuuaggcau

SEQ ID NO: 2113379 - RNA, 23 nt, Homo sapiens
aaucccccaccuccaacuuuccc

SEQ ID NO: 2113380 - RNA, 19 nt, Homo sapiens
gccacauggcggagaguuu

SEQ ID NO: 2113381 - RNA, 21 nt, Homo sapiens
agcccucucccucaguccuuu

SEQ ID NO: 2113382 - RNA, 16 nt, Homo sapiens
uaaaaguccugucacc

SEQ ID NO: 2113383 - RNA, 23 nt, Homo sapiens
aacuaagcaaguauauuuauuuc

SEQ ID NO: 2113384 - RNA, 22 nt, Homo sapiens
guaacaagagugauucuugcug

SEQ ID NO: 2113385 - RNA, 20 nt, Homo sapiens
uuaccuguacacugacuuga

SEQ ID NO: 2113386 - RNA, 17 nt, Homo sapiens
ccagugaaccaaagaga

SEQ ID NO: 2113387 - RNA, 19 nt, Homo sapiens
aucuauguuugugugauuu

SEQ ID NO: 2113388 - RNA, 23 nt, Homo sapiens
gaugggauggcaaaugcugugaa

SEQ ID NO: 2113389 - RNA, 19 nt, Homo sapiens
uagcggggaggggguuauc

SEQ ID NO: 2113390 - RNA, 19 nt, Homo sapiens
ggacuuccacauuuuugca

SEQ ID NO: 2113391 - RNA, 20 nt, Homo sapiens
gcaugggagugaucucacca

SEQ ID NO: 2113392 - RNA, 17 nt, Homo sapiens
aucuuagggugaaccac

SEQ ID NO: 2113393 - RNA, 17 nt, Homo sapiens
ggacuggcacacuggcc

SEQ ID NO: 2113394 - RNA, 15 nt, Homo sapiens
uucauucaagcuuca

SEQ ID NO: 2113395 - RNA, 19 nt, Homo sapiens
ucccugucauagagcugca

SEQ ID NO: 2113396 - RNA, 15 nt, Homo sapiens
agagguggcccuccc

SEQ ID NO: 2113397 - RNA, 20 nt, Homo sapiens
aguugcucuuucgguagugg

SEQ ID NO: 2113398 - RNA, 19 nt, Homo sapiens
ccgacuuuccauugauuca

SEQ ID NO: 2113399 - RNA, 22 nt, Homo sapiens
agagucaggaagggaaagccag

SEQ ID NO: 2113400 - RNA, 15 nt, Homo sapiens
uuuaagucacauuau

SEQ ID NO: 2113401 - RNA, 23 nt, Homo sapiens
uccagaaaucugcugcauuucac

SEQ ID NO: 2113402 - RNA, 13 nt, Homo sapiens
agagacuacucug

SEQ ID NO: 2113403 - RNA, 21 nt, Homo sapiens
acagguguuguccaagcucuu

SEQ ID NO: 2113404 - RNA, 19 nt, Homo sapiens
uccacauuuguuuugccaa

SEQ ID NO: 2113405 - RNA, 14 nt, Homo sapiens
ggacuaacccaaug

SEQ ID NO: 2113406 - RNA, 18 nt, Homo sapiens
ggacuacacccaagccug

SEQ ID NO: 2113407 - RNA, 15 nt, Homo sapiens
caagucuaaugaaga

SEQ ID NO: 2113408 - RNA, 13 nt, Homo sapiens
ucacuacagccuc

SEQ ID NO: 2113409 - RNA, 22 nt, Homo sapiens
aacuaaaggaaacaaagcaaua

SEQ ID NO: 2113410 - RNA, 12 nt, Homo sapiens
ugaucaucucac

SEQ ID NO: 2113411 - RNA, 15 nt, Homo sapiens
guaagaagcugugaa

SEQ ID NO: 2113412 - RNA, 15 nt, Homo sapiens
augugcccccagacg

SEQ ID NO: 2113413 - RNA, 16 nt, Homo sapiens
cuccuuccuucaagcc

SEQ ID NO: 2113414 - RNA, 16 nt, Homo sapiens
ccaaauguucacuggu

SEQ ID NO: 2113415 - RNA, 20 nt, Homo sapiens
gaacaagcuggcuucuguga

SEQ ID NO: 2113416 - RNA, 22 nt, Homo sapiens
ggccugauuuaucuagcugucc

SEQ ID NO: 2113417 - RNA, 19 nt, Homo sapiens
ccucagucaggcacuggcu

SEQ ID NO: 2113418 - RNA, 20 nt, Homo sapiens
cugaacugaaaggacugugu

SEQ ID NO: 2113419 - RNA, 15 nt, Homo sapiens
aaaagcaaagaugca

SEQ ID NO: 2113420 - RNA, 14 nt, Homo sapiens
accccagagcagug

SEQ ID NO: 2113421 - RNA, 11 nt, Homo sapiens
caggugcagcc

SEQ ID NO: 2113422 - RNA, 17 nt, Homo sapiens
aaggcuguuaaauuaca

SEQ ID NO: 2113423 - RNA, 16 nt, Homo sapiens
gaauaaaauacucucu

SEQ ID NO: 2113424 - RNA, 21 nt, Homo sapiens
aaggaccugaaauuccaaagu

SEQ ID NO: 2113425 - RNA, 22 nt, Homo sapiens
ucuacugugacugauguuacau

SEQ ID NO: 2113426 - RNA, 15 nt, Homo sapiens
ugccucaaugccagu

SEQ ID NO: 2113427 - RNA, 14 nt, Homo sapiens
uagauaucaugcaa

SEQ ID NO: 2113428 - RNA, 16 nt, Homo sapiens
uuguagaguuguacug

SEQ ID NO: 2113429 - RNA, 16 nt, Homo sapiens
aaaggcuaaaagggaa

SEQ ID NO: 2113430 - RNA, 16 nt, Homo sapiens
ucugucuaucugugaa

SEQ ID NO: 2113431 - RNA, 21 nt, Homo sapiens
auuacaguguccuaccacucu

SEQ ID NO: 2113432 - RNA, 13 nt, Homo sapiens
cgacacucagggc

SEQ ID NO: 2113433 - RNA, 18 nt, Homo sapiens
aauacacucaagugccau

SEQ ID NO: 2113434 - RNA, 11 nt, Homo sapiens
cacaugcacag

SEQ ID NO: 2113435 - RNA, 11 nt, Homo sapiens
cagaugcacac

SEQ ID NO: 2113436 - RNA, 17 nt, Homo sapiens
ggucacuuaaaaugugc

SEQ ID NO: 2113437 - RNA, 18 nt, Homo sapiens
gacaacagcccugucuca

SEQ ID NO: 2113438 - RNA, 19 nt, Homo sapiens
ccagauugaaaaguguccu

SEQ ID NO: 2113439 - RNA, 13 nt, Homo sapiens
cuauuuguauugu

SEQ ID NO: 2113440 - RNA, 18 nt, Homo sapiens
cuuuugagaguauagcau

SEQ ID NO: 2113441 - RNA, 18 nt, Homo sapiens
cucuguacagcugcucuu

SEQ ID NO: 2113442 - RNA, 23 nt, Homo sapiens
uaaaaagaaauuuugccugccau

SEQ ID NO: 2113443 - RNA, 21 nt, Homo sapiens
ccuaugacccugugccugugu

SEQ ID NO: 2113444 - RNA, 23 nt, Homo sapiens
auuauuuacugacauauaucuau

SEQ ID NO: 2113445 - RNA, 17 nt, Homo sapiens
gacucacaagaagacca

SEQ ID NO: 2113446 - RNA, 14 nt, Homo sapiens
uacaggacauauau

SEQ ID NO: 2113447 - RNA, 19 nt, Homo sapiens
uggcuguugacgcaccugu

SEQ ID NO: 2113448 - RNA, 23 nt, Homo sapiens
acucuauaaauaaaaccugacag

SEQ ID NO: 2113449 - RNA, 19 nt, Homo sapiens
aagcaaauaaaugccuucc

SEQ ID NO: 2113450 - RNA, 13 nt, Homo sapiens
accugaugcaguc

SEQ ID NO: 2113451 - RNA, 14 nt, Homo sapiens
uaugcagaauguuu

SEQ ID NO: 2113452 - RNA, 11 nt, Homo sapiens
caggagcucuu

SEQ ID NO: 2113453 - RNA, 15 nt, Homo sapiens
gauugggaaagauag

SEQ ID NO: 2113454 - RNA, 15 nt, Homo sapiens
aauguaaaguuacac

SEQ ID NO: 2113455 - RNA, 18 nt, Homo sapiens
uauagaaccaugaauucu

SEQ ID NO: 2113456 - RNA, 13 nt, Homo sapiens
aaugagugcaccu

SEQ ID NO: 2113457 - RNA, 21 nt, Homo sapiens
uauuuuuuuuuaauuuugaua

SEQ ID NO: 2113458 - RNA, 21 nt, Homo sapiens
ccucagcaguccacaaagcau

SEQ ID NO: 2113459 - RNA, 19 nt, Homo sapiens
ucacaugcuuuguuuccau

SEQ ID NO: 2113460 - RNA, 16 nt, Homo sapiens
agacugcuugacaaag

SEQ ID NO: 2113461 - RNA, 14 nt, Homo sapiens
uugauuaugaauag

SEQ ID NO: 2113462 - RNA, 20 nt, Homo sapiens
cagaauaggaaaacauugca

SEQ ID NO: 2113463 - RNA, 18 nt, Homo sapiens
cuauauuaucaugcaaau

SEQ ID NO: 2113464 - RNA, 20 nt, Homo sapiens
cuagacuggccuaggggcca

SEQ ID NO: 2113465 - RNA, 15 nt, Homo sapiens
caaaggugauuuucc

SEQ ID NO: 2113466 - RNA, 23 nt, Homo sapiens
uuuggaaugcuucuucucaggca

SEQ ID NO: 2113467 - RNA, 21 nt, Homo sapiens
aguuccucauuagcauuuugc

SEQ ID NO: 2113468 - RNA, 13 nt, Homo sapiens
uccagcaaacuca

SEQ ID NO: 2113469 - RNA, 19 nt, Homo sapiens
aagaauuuaauguacagua

SEQ ID NO: 2113470 - RNA, 14 nt, Homo sapiens
aaauaaaaacuuau

SEQ ID NO: 2113471 - RNA, 19 nt, Homo sapiens
ggcggaaccuggcugcgaa

SEQ ID NO: 2113472 - RNA, 15 nt, Homo sapiens
uuacaaaugucuaag

SEQ ID NO: 2113473 - RNA, 17 nt, Homo sapiens
aaggauaugcaguaugc

SEQ ID NO: 2113474 - RNA, 15 nt, Homo sapiens
uuauuuaauaacauu

SEQ ID NO: 2113475 - RNA, 15 nt, Homo sapiens
auguuauaaagcaaa

SEQ ID NO: 2113476 - RNA, 22 nt, Homo sapiens
auuaguccuugcuuggcugcuu

SEQ ID NO: 2113477 - RNA, 12 nt, Homo sapiens
uccugucauggc

SEQ ID NO: 2113478 - RNA, 20 nt, Homo sapiens
cacuccuggggggccugaaa

SEQ ID NO: 2113479 - RNA, 23 nt, Homo sapiens
ggacacuacacuggggcccuuca

SEQ ID NO: 2113480 - RNA, 15 nt, Homo sapiens
cagccacaggaccac

SEQ ID NO: 2113481 - RNA, 20 nt, Homo sapiens
ccuuccaggaguuuugcccc

SEQ ID NO: 2113482 - RNA, 14 nt, Homo sapiens
uagcauccaagugg

SEQ ID NO: 2113483 - RNA, 22 nt, Homo sapiens
uggcugugagggguguuuggga

SEQ ID NO: 2113484 - RNA, 20 nt, Homo sapiens
ccagugcaacacugaagcuc

SEQ ID NO: 2113485 - RNA, 13 nt, Homo sapiens
cuaugaaauauca

SEQ ID NO: 2113486 - RNA, 16 nt, Homo sapiens
gauauaaaaaguacag

SEQ ID NO: 2113487 - RNA, 17 nt, Homo sapiens
ccugugugccauuuuaa

SEQ ID NO: 2113488 - RNA, 14 nt, Homo sapiens
accuggacugagcc

SEQ ID NO: 2113489 - RNA, 15 nt, Homo sapiens
ccucaggacccaggg

SEQ ID NO: 2113490 - RNA, 20 nt, Homo sapiens
aaauauuucaauaacuuaga

SEQ ID NO: 2113491 - RNA, 23 nt, Homo sapiens
ccccgguggcugaagaggcugcc

SEQ ID NO: 2113492 - RNA, 13 nt, Homo sapiens
cuaagugcuuauu

SEQ ID NO: 2113493 - RNA, 20 nt, Homo sapiens
gucuuuggcuucagaauugu

SEQ ID NO: 2113494 - RNA, 16 nt, Homo sapiens
auccagaaauacuuaa

SEQ ID NO: 2113495 - RNA, 16 nt, Homo sapiens
caguuaaggaagaucc

SEQ ID NO: 2113496 - RNA, 14 nt, Homo sapiens
uuuagagaaguaua

SEQ ID NO: 2113497 - RNA, 15 nt, Homo sapiens
aagggaaaauuagcu

SEQ ID NO: 2113498 - RNA, 22 nt, Homo sapiens
gcaucauuuucaccuccauuuc

SEQ ID NO: 2113499 - RNA, 18 nt, Homo sapiens
aauuacuguaacugauua

SEQ ID NO: 2113500 - RNA, 19 nt, Homo sapiens
ccaggaggguaacagaaga

SEQ ID NO: 2113501 - RNA, 14 nt, Homo sapiens
agcuagugccuuua

SEQ ID NO: 2113502 - RNA, 15 nt, Homo sapiens
cagcuucacccugag

SEQ ID NO: 2113503 - RNA, 13 nt, Homo sapiens
ccucgggaagcag

SEQ ID NO: 2113504 - RNA, 21 nt, Homo sapiens
agccacuuugcuaccaugaca

SEQ ID NO: 2113505 - RNA, 12 nt, Homo sapiens
aaugguucucuu

SEQ ID NO: 2113506 - RNA, 23 nt, Homo sapiens
ugacacaaagguggaauaaacau

SEQ ID NO: 2113507 - RNA, 13 nt, Homo sapiens
ucuuacuuggcuu

SEQ ID NO: 2113508 - RNA, 22 nt, Homo sapiens
cuacuaugugcugggugccucc

SEQ ID NO: 2113509 - RNA, 20 nt, Homo sapiens
agcauugccauaccauuccc

SEQ ID NO: 2113510 - RNA, 15 nt, Homo sapiens
augcaguucugagca

SEQ ID NO: 2113511 - RNA, 17 nt, Homo sapiens
ucuagaagauaucauga

SEQ ID NO: 2113512 - RNA, 14 nt, Homo sapiens
aggggcucuggaga

SEQ ID NO: 2113513 - RNA, 23 nt, Homo sapiens
uuuguaaacuucugaagacugag

SEQ ID NO: 2113514 - RNA, 12 nt, Homo sapiens
cucacgauucca

SEQ ID NO: 2113515 - RNA, 12 nt, Homo sapiens
gaaaaaccuguu

SEQ ID NO: 2113516 - RNA, 19 nt, Homo sapiens
cugcagcuccucugccuuu

SEQ ID NO: 2113517 - RNA, 23 nt, Homo sapiens
ccaugggguaggaggaugggcuc

SEQ ID NO: 2113518 - RNA, 19 nt, Homo sapiens
ugguacaacacuugcacaa

SEQ ID NO: 2113519 - RNA, 22 nt, Homo sapiens
uauaauccuaccagaaggaaag

SEQ ID NO: 2113520 - RNA, 13 nt, Homo sapiens
gguggaugccugg

SEQ ID NO: 2113521 - RNA, 16 nt, Homo sapiens
uauuuccacugaacaa

SEQ ID NO: 2113522 - RNA, 19 nt, Homo sapiens
uggaauuccacagggacca

SEQ ID NO: 2113523 - RNA, 17 nt, Homo sapiens
gaucugggaacucccaa

SEQ ID NO: 2113524 - RNA, 21 nt, Homo sapiens
accaucucuccuccuuuucac

SEQ ID NO: 2113525 - RNA, 21 nt, Homo sapiens
ucuaugggcagaucuaccccu

SEQ ID NO: 2113526 - RNA, 16 nt, Homo sapiens
ccaagugggauuugca

SEQ ID NO: 2113527 - RNA, 14 nt, Homo sapiens
caaggccugugcug

SEQ ID NO: 2113528 - RNA, 15 nt, Homo sapiens
cagaaccagugacaa

SEQ ID NO: 2113529 - RNA, 15 nt, Homo sapiens
ugaccuuccaagagc

SEQ ID NO: 2113530 - RNA, 21 nt, Homo sapiens
gguuagguagcaacaacagaa

SEQ ID NO: 2113531 - RNA, 19 nt, Homo sapiens
uggaaaaauguuugucuca

SEQ ID NO: 2113532 - RNA, 19 nt, Homo sapiens
augaacuguggugccacau

SEQ ID NO: 2113533 - RNA, 23 nt, Homo sapiens
cucugccuagucuacaguacuga

SEQ ID NO: 2113534 - RNA, 17 nt, Homo sapiens
cuuugucccguggcauu

SEQ ID NO: 2113535 - RNA, 20 nt, Homo sapiens
ccauguccugaaaaaugcuc

SEQ ID NO: 2113536 - RNA, 13 nt, Homo sapiens
uucucucacugau

SEQ ID NO: 2113537 - RNA, 18 nt, Homo sapiens
augccccugacaucauca

SEQ ID NO: 2113538 - RNA, 19 nt, Homo sapiens
augauguuuccagauuaca

SEQ ID NO: 2113539 - RNA, 12 nt, Homo sapiens
ccuagggacaca

SEQ ID NO: 2113540 - RNA, 21 nt, Homo sapiens
cccuuaaacauuggacaguga

SEQ ID NO: 2113541 - RNA, 16 nt, Homo sapiens
cuuuuaggccaaggaa

SEQ ID NO: 2113542 - RNA, 14 nt, Homo sapiens
ccuucgguuuguau

SEQ ID NO: 2113543 - RNA, 20 nt, Homo sapiens
cugccugcccguaaacacgc

SEQ ID NO: 2113544 - RNA, 17 nt, Homo sapiens
aguucacauacaaauca

SEQ ID NO: 2113545 - RNA, 17 nt, Homo sapiens
auacuuugacaaggaaa

SEQ ID NO: 2113546 - RNA, 23 nt, Homo sapiens
aaagaagcaaucuccuuacugug

SEQ ID NO: 2113547 - RNA, 18 nt, Homo sapiens
ccuuuuaaagaagcuuua

SEQ ID NO: 2113548 - RNA, 15 nt, Homo sapiens
augugucccagugaa

SEQ ID NO: 2113549 - RNA, 22 nt, Homo sapiens
caggccugagccacugugccca

SEQ ID NO: 2113550 - RNA, 12 nt, Homo sapiens
uagugcauuuag

SEQ ID NO: 2113551 - RNA, 23 nt, Homo sapiens
ucgugauuggaaacucaccaucg

SEQ ID NO: 2113552 - RNA, 16 nt, Homo sapiens
cagucaccucauggaa

SEQ ID NO: 2113553 - RNA, 16 nt, Homo sapiens
uauugguauggacaaa

SEQ ID NO: 2113554 - RNA, 17 nt, Homo sapiens
gauaaauuugacuguua

SEQ ID NO: 2113555 - RNA, 13 nt, Homo sapiens
aauuccacucaaa

SEQ ID NO: 2113556 - RNA, 17 nt, Homo sapiens
uauaaacacaguaagau

SEQ ID NO: 2113557 - RNA, 22 nt, Homo sapiens
caucaauauuauauucaagaua

SEQ ID NO: 2113558 - RNA, 23 nt, Homo sapiens
ccagaugccuccccaagacuguc

SEQ ID NO: 2113559 - RNA, 18 nt, Homo sapiens
aguucuuacacauuccau

SEQ ID NO: 2113560 - RNA, 14 nt, Homo sapiens
caaggccagggcac

SEQ ID NO: 2113561 - RNA, 14 nt, Homo sapiens
ggagggcacagcag

SEQ ID NO: 2113562 - RNA, 16 nt, Homo sapiens
auguaaaugccacaaa

SEQ ID NO: 2113563 - RNA, 22 nt, Homo sapiens
ccaagcucccugccccaaauaa

SEQ ID NO: 2113564 - RNA, 23 nt, Homo sapiens
ccuguaaucccagcacuuuggga

SEQ ID NO: 2113565 - RNA, 20 nt, Homo sapiens
guauuaaaaaaaacaaaaag

SEQ ID NO: 2113566 - RNA, 16 nt, Homo sapiens
gcacccaacuagcucu

SEQ ID NO: 2113567 - RNA, 14 nt, Homo sapiens
uaaaauuacauucu

SEQ ID NO: 2113568 - RNA, 15 nt, Homo sapiens
uuacuauaauugaga

SEQ ID NO: 2113569 - RNA, 16 nt, Homo sapiens
acguggaaaugucucg

SEQ ID NO: 2113570 - RNA, 17 nt, Homo sapiens
uuacaggcgugagccac

SEQ ID NO: 2113571 - RNA, 23 nt, Homo sapiens
cugcagcucagggacuggcacac

SEQ ID NO: 2113572 - RNA, 18 nt, Homo sapiens
auugggagcaaucuggaa

SEQ ID NO: 2113573 - RNA, 16 nt, Homo sapiens
aucugccucuauucaa

SEQ ID NO: 2113574 - RNA, 21 nt, Homo sapiens
uaugaaaauuauacugagaac

SEQ ID NO: 2113575 - RNA, 21 nt, Homo sapiens
uuucaggccacauggcuaaag

SEQ ID NO: 2113576 - RNA, 16 nt, Homo sapiens
cauuuucacagcacua

SEQ ID NO: 2113577 - RNA, 15 nt, Homo sapiens
aauuauuuaugaacu

SEQ ID NO: 2113578 - RNA, 16 nt, Homo sapiens
ugaagugcauggguca

SEQ ID NO: 2113579 - RNA, 14 nt, Homo sapiens
uuuuauucuauauu

SEQ ID NO: 2113580 - RNA, 14 nt, Homo sapiens
auuuacucaauauc

SEQ ID NO: 2113581 - RNA, 23 nt, Homo sapiens
acaccucccccuuucacacugga

SEQ ID NO: 2113582 - RNA, 22 nt, Homo sapiens
aaauuaaagucuuccauugcau

SEQ ID NO: 2113583 - RNA, 17 nt, Homo sapiens
gucaccaggcaaccagg

SEQ ID NO: 2113584 - RNA, 12 nt, Homo sapiens
auacuccuugcu

SEQ ID NO: 2113585 - RNA, 14 nt, Homo sapiens
acacacacccaggc

SEQ ID NO: 2113586 - RNA, 17 nt, Homo sapiens
guuauuauuucuucauu

SEQ ID NO: 2113587 - RNA, 22 nt, Homo sapiens
cuaauuuuuggagaaaugucau

SEQ ID NO: 2113588 - RNA, 17 nt, Homo sapiens
uuucccuuuauuucucu

SEQ ID NO: 2113589 - RNA, 21 nt, Homo sapiens
uccuguccucuggaucacaga

SEQ ID NO: 2113590 - RNA, 17 nt, Homo sapiens
uacauugaguagacaca

SEQ ID NO: 2113591 - RNA, 15 nt, Homo sapiens
ccuaauguggcagcu

SEQ ID NO: 2113592 - RNA, 14 nt, Homo sapiens
cuuuuuucuuacca

SEQ ID NO: 2113593 - RNA, 17 nt, Homo sapiens
aucucagcucaccucaa

SEQ ID NO: 2113594 - RNA, 20 nt, Homo sapiens
acaagcauauguuagcauua

SEQ ID NO: 2113595 - RNA, 22 nt, Homo sapiens
ugcugcuucaauuuauaccuca

SEQ ID NO: 2113596 - RNA, 20 nt, Homo sapiens
ugccaggcaccaucugccaa

SEQ ID NO: 2113597 - RNA, 22 nt, Homo sapiens
cucuauacaaaaugauuuugaa

SEQ ID NO: 2113598 - RNA, 18 nt, Homo sapiens
aacaaccaugucauuuca

SEQ ID NO: 2113599 - RNA, 21 nt, Homo sapiens
uaccccuaacauacugcauuu

SEQ ID NO: 2113600 - RNA, 17 nt, Homo sapiens
ggacuaacccaaugccu

SEQ ID NO: 2113601 - RNA, 15 nt, Homo sapiens
agaugcaaccucacu

SEQ ID NO: 2113602 - RNA, 14 nt, Homo sapiens
uggaaagacuugaa

SEQ ID NO: 2113603 - RNA, 16 nt, Homo sapiens
aauauuucauuuugau

SEQ ID NO: 2113604 - RNA, 16 nt, Homo sapiens
acucagccaagcacag

SEQ ID NO: 2113605 - RNA, 16 nt, Homo sapiens
ucuuugacuauaacaa

SEQ ID NO: 2113606 - RNA, 13 nt, Homo sapiens
cacuuggugcugc

SEQ ID NO: 2113607 - RNA, 13 nt, Homo sapiens
aucucaguucucu

SEQ ID NO: 2113608 - RNA, 18 nt, Homo sapiens
auucuuuagagauuauaa

SEQ ID NO: 2113609 - RNA, 21 nt, Homo sapiens
uacaggugcaagccacuaugu

SEQ ID NO: 2113610 - RNA, 13 nt, Homo sapiens
cugacacaggaaa

SEQ ID NO: 2113611 - RNA, 23 nt, Homo sapiens
gccugccggccgcccagacacca

SEQ ID NO: 2113612 - RNA, 19 nt, Homo sapiens
ucucacuguguugcccagg

SEQ ID NO: 2113613 - RNA, 23 nt, Homo sapiens
guugcccaggcuagagugcaaug

SEQ ID NO: 2113614 - RNA, 12 nt, Homo sapiens
ugagaaagccaa

SEQ ID NO: 2113615 - RNA, 16 nt, Homo sapiens
ucagaugacagauguu

SEQ ID NO: 2113616 - RNA, 14 nt, Homo sapiens
cgggccaugauucu

SEQ ID NO: 2113617 - RNA, 13 nt, Homo sapiens
cgggagacucuga

SEQ ID NO: 2113618 - RNA, 15 nt, Homo sapiens
auauacauauaugag

SEQ ID NO: 2113619 - RNA, 15 nt, Homo sapiens
guagugccacuguug

SEQ ID NO: 2113620 - RNA, 22 nt, Homo sapiens
ugucugcaugaaggucuaccug

SEQ ID NO: 2113621 - RNA, 13 nt, Homo sapiens
accugcauugaac

SEQ ID NO: 2113622 - RNA, 15 nt, Homo sapiens
uaguauuucucagga

SEQ ID NO: 2113623 - RNA, 21 nt, Homo sapiens
uaaugcacauccucauucacu

SEQ ID NO: 2113624 - RNA, 15 nt, Homo sapiens
acauuuuuguacaca

SEQ ID NO: 2113625 - RNA, 14 nt, Homo sapiens
guccugcacugucc

SEQ ID NO: 2113626 - RNA, 15 nt, Homo sapiens
ugcguaaaucaacuu

SEQ ID NO: 2113627 - RNA, 15 nt, Homo sapiens
agggcagagaauggc

SEQ ID NO: 2113628 - RNA, 18 nt, Homo sapiens
aucccaagaaauggaauc

SEQ ID NO: 2113629 - RNA, 14 nt, Homo sapiens
uggcaacucaaggc

SEQ ID NO: 2113630 - RNA, 13 nt, Homo sapiens
ccagcaacgcuca

SEQ ID NO: 2113631 - RNA, 21 nt, Homo sapiens
ugugugaaacaauguugucca

SEQ ID NO: 2113632 - RNA, 14 nt, Homo sapiens
aaucuacaacauaa

SEQ ID NO: 2113633 - RNA, 17 nt, Homo sapiens
auacauacuauagauuc

SEQ ID NO: 2113634 - RNA, 15 nt, Homo sapiens
ucccugacauuuagu

SEQ ID NO: 2113635 - RNA, 24 nt, Homo sapiens
uuaguaaauuaagagcauaaacaa

SEQ ID NO: 2113636 - RNA, 15 nt, Homo sapiens
caucugguccaguuc

SEQ ID NO: 2113637 - RNA, 14 nt, Homo sapiens
uaaauaugaaauga

SEQ ID NO: 2113638 - RNA, 17 nt, Homo sapiens
cuagaaacaaggauucu

SEQ ID NO: 2113639 - RNA, 17 nt, Homo sapiens
uaaaguaucugagauua

SEQ ID NO: 2113640 - RNA, 22 nt, Homo sapiens
cuuuugagagcucuucagagau

SEQ ID NO: 2113641 - RNA, 20 nt, Homo sapiens
augaguaauacaucaaagag

SEQ ID NO: 2113642 - RNA, 20 nt, Homo sapiens
guggcccuccaguguaugag

SEQ ID NO: 2113643 - RNA, 19 nt, Homo sapiens
ucgcgccaguacauuccaa

SEQ ID NO: 2113644 - RNA, 23 nt, Homo sapiens
gaaaggcaucuaagacauucacc

SEQ ID NO: 2113645 - RNA, 20 nt, Homo sapiens
gcuggccggggcucugggug

SEQ ID NO: 2113646 - RNA, 20 nt, Homo sapiens
aggaaccucgaguacugugg

SEQ ID NO: 2113647 - RNA, 23 nt, Homo sapiens
ccaacugaagccuucuucugcca

SEQ ID NO: 2113648 - RNA, 22 nt, Homo sapiens
ccugcaggucacugaaacuuca

SEQ ID NO: 2113649 - RNA, 16 nt, Homo sapiens
cacaacggcagugaag

SEQ ID NO: 2113650 - RNA, 12 nt, Homo sapiens
cggccaaacaga

SEQ ID NO: 2113651 - RNA, 15 nt, Homo sapiens
agcugggcuuggccu

SEQ ID NO: 2113652 - RNA, 21 nt, Homo sapiens
uuaaaaaucuuucagaauaca

SEQ ID NO: 2113653 - RNA, 14 nt, Homo sapiens
gcagcuccuggaau

SEQ ID NO: 2113654 - RNA, 15 nt, Homo sapiens
aggugaggucuggga

SEQ ID NO: 2113655 - RNA, 13 nt, Homo sapiens
caaaauaaugagg

SEQ ID NO: 2113656 - RNA, 19 nt, Homo sapiens
cauguuguaagcacugacu

SEQ ID NO: 2113657 - RNA, 17 nt, Homo sapiens
agcucaaggcaaugggc

SEQ ID NO: 2113658 - RNA, 20 nt, Homo sapiens
agcauguuuuguugcucagu

SEQ ID NO: 2113659 - RNA, 16 nt, Homo sapiens
gcccuggccacuggcc

SEQ ID NO: 2113660 - RNA, 15 nt, Homo sapiens
auauguuccaugccu

SEQ ID NO: 2113661 - RNA, 18 nt, Homo sapiens
uacagaagaguuucuuaa

SEQ ID NO: 2113662 - RNA, 17 nt, Homo sapiens
guuuaccguguguuaua

SEQ ID NO: 2113663 - RNA, 18 nt, Homo sapiens
cuggggacaacugcggug

SEQ ID NO: 2113664 - RNA, 23 nt, Homo sapiens
gaagcccugauguguccucaggg

SEQ ID NO: 2113665 - RNA, 15 nt, Homo sapiens
acauuaguugcacua

SEQ ID NO: 2113666 - RNA, 21 nt, Homo sapiens
augccccuggcccugccucac

SEQ ID NO: 2113667 - RNA, 18 nt, Homo sapiens
ccuggugcuuuccuucau

SEQ ID NO: 2113668 - RNA, 13 nt, Homo sapiens
auaaagaacauuc

SEQ ID NO: 2113669 - RNA, 16 nt, Homo sapiens
ggauguagccaugacc

SEQ ID NO: 2113670 - RNA, 19 nt, Homo sapiens
agcugcuauccccaucucc

SEQ ID NO: 2113671 - RNA, 13 nt, Homo sapiens
ugaaucuauuaua

SEQ ID NO: 2113672 - RNA, 16 nt, Homo sapiens
augcaauuuuucaaga

SEQ ID NO: 2113673 - RNA, 21 nt, Homo sapiens
ugcgguacaggagucagccau

SEQ ID NO: 2113674 - RNA, 11 nt, Homo sapiens
acuagacugua

SEQ ID NO: 2113675 - RNA, 17 nt, Homo sapiens
agcagcucuucagcaca

SEQ ID NO: 2113676 - RNA, 20 nt, Homo sapiens
uauucaaacauuauucucaa

SEQ ID NO: 2113677 - RNA, 20 nt, Homo sapiens
ggauuucacaccccauucuc

SEQ ID NO: 2113678 - RNA, 20 nt, Homo sapiens
gaccaguuuaaccugaugca

SEQ ID NO: 2113679 - RNA, 17 nt, Homo sapiens
auugagaccaaggggag

SEQ ID NO: 2113680 - RNA, 15 nt, Homo sapiens
cugggccuucucacc

SEQ ID NO: 2113681 - RNA, 13 nt, Homo sapiens
gcagacaaccuca

SEQ ID NO: 2113682 - RNA, 14 nt, Homo sapiens
caaaacugugcuuu

SEQ ID NO: 2113683 - RNA, 22 nt, Homo sapiens
ggucgcccuuucuuaccaucug

SEQ ID NO: 2113684 - RNA, 23 nt, Homo sapiens
gcuaauccacaaccuguuaccac

SEQ ID NO: 2113685 - RNA, 17 nt, Homo sapiens
cucuuguuucacuccac

SEQ ID NO: 2113686 - RNA, 16 nt, Homo sapiens
ccuggcaggccagugu

SEQ ID NO: 2113687 - RNA, 13 nt, Homo sapiens
aagggaccugcuc

SEQ ID NO: 2113688 - RNA, 21 nt, Homo sapiens
cagucccagcuaacucugacc

SEQ ID NO: 2113689 - RNA, 18 nt, Homo sapiens
aagugacucucacaagau

SEQ ID NO: 2113690 - RNA, 17 nt, Homo sapiens
gaaugaggcaauuucaa

SEQ ID NO: 2113691 - RNA, 19 nt, Homo sapiens
guuaagcagccugccauau

SEQ ID NO: 2113692 - RNA, 18 nt, Homo sapiens
cauuuguuuguauacaua

SEQ ID NO: 2113693 - RNA, 18 nt, Homo sapiens
cuccugcaucucaugagu

SEQ ID NO: 2113694 - RNA, 22 nt, Homo sapiens
cuuuucuccucacuguauccag

SEQ ID NO: 2113695 - RNA, 23 nt, Homo sapiens
cauggugcagugccgcucuguag

SEQ ID NO: 2113696 - RNA, 22 nt, Homo sapiens
accauauagagguguaacacuu

SEQ ID NO: 2113697 - RNA, 19 nt, Homo sapiens
gccgauccggggcccucuc

SEQ ID NO: 2113698 - RNA, 16 nt, Homo sapiens
aguaguuucauuuccu

SEQ ID NO: 2113699 - RNA, 17 nt, Homo sapiens
gcugcaaagccuuucca

SEQ ID NO: 2113700 - RNA, 11 nt, Homo sapiens
ggcgcuuucug

SEQ ID NO: 2113701 - RNA, 14 nt, Homo sapiens
cccaguaacugcac

SEQ ID NO: 2113702 - RNA, 15 nt, Homo sapiens
ugaaucuguacccuu

SEQ ID NO: 2113703 - RNA, 23 nt, Homo sapiens
ugaauucacuccagucaacagau

SEQ ID NO: 2113704 - RNA, 22 nt, Homo sapiens
aacaaguggaccucgucccauc

SEQ ID NO: 2113705 - RNA, 14 nt, Homo sapiens
gcaacuuaauacuc

SEQ ID NO: 2113706 - RNA, 19 nt, Homo sapiens
ugaugacaggucagcagua

SEQ ID NO: 2113707 - RNA, 13 nt, Homo sapiens
ccuuuuaugcaaa

SEQ ID NO: 2113708 - RNA, 23 nt, Homo sapiens
aggcacccgcccuuuccuugccu

SEQ ID NO: 2113709 - RNA, 15 nt, Homo sapiens
aacaguaccagugua

SEQ ID NO: 2113710 - RNA, 15 nt, Homo sapiens
aaguaaaccacaaaa

SEQ ID NO: 2113711 - RNA, 13 nt, Homo sapiens
cugcagaauccag

SEQ ID NO: 2113712 - RNA, 13 nt, Homo sapiens
uccaggaacugca

SEQ ID NO: 2113713 - RNA, 16 nt, Homo sapiens
uuuaaauaaaggaaau

SEQ ID NO: 2113714 - RNA, 21 nt, Homo sapiens
cuaaagcagaggcaacacugg

SEQ ID NO: 2113715 - RNA, 16 nt, Homo sapiens
guuuauuguucaauau

SEQ ID NO: 2113716 - RNA, 13 nt, Homo sapiens
ugacgguggaauu

SEQ ID NO: 2113717 - RNA, 22 nt, Homo sapiens
ggaaaaagaaugaugcuaugaa

SEQ ID NO: 2113718 - RNA, 12 nt, Homo sapiens
gagcagccugug

SEQ ID NO: 2113719 - RNA, 12 nt, Homo sapiens
guagaaagugau

SEQ ID NO: 2113720 - RNA, 13 nt, Homo sapiens
cuuccaccacaga

SEQ ID NO: 2113721 - RNA, 13 nt, Homo sapiens
cacauaucuagua

SEQ ID NO: 2113722 - RNA, 14 nt, Homo sapiens
caccucaugucauu

SEQ ID NO: 2113723 - RNA, 13 nt, Homo sapiens
aagcugaugucca

SEQ ID NO: 2113724 - RNA, 20 nt, Homo sapiens
uauugucuuuugacauccag

SEQ ID NO: 2113725 - RNA, 20 nt, Homo sapiens
agaauaaaauuuuuaaucuu

SEQ ID NO: 2113726 - RNA, 15 nt, Homo sapiens
gauaaaguuccuuaa

SEQ ID NO: 2113727 - RNA, 22 nt, Homo sapiens
aauagauuguuuugccacuuag

SEQ ID NO: 2113728 - RNA, 21 nt, Homo sapiens
agaaauuuuaaaauaauagaa

SEQ ID NO: 2113729 - RNA, 14 nt, Homo sapiens
gccaacccuuucau

SEQ ID NO: 2113730 - RNA, 13 nt, Homo sapiens
acuuaacaauuaa

SEQ ID NO: 2113731 - RNA, 21 nt, Homo sapiens
ggcagcgcccuuccucuccac

SEQ ID NO: 2113732 - RNA, 20 nt, Homo sapiens
uggccaaggggccagcugcc

SEQ ID NO: 2113733 - RNA, 22 nt, Homo sapiens
uggaggcccaguucacccugau

SEQ ID NO: 2113734 - RNA, 22 nt, Homo sapiens
auuuaggccuuaacacacuggc

SEQ ID NO: 2113735 - RNA, 12 nt, Homo sapiens
ccauucugggac

SEQ ID NO: 2113736 - RNA, 18 nt, Homo sapiens
gcauaauaugaagccuuu

SEQ ID NO: 2113737 - RNA, 17 nt, Homo sapiens
gugaauaaaaauuaagg

SEQ ID NO: 2113738 - RNA, 15 nt, Homo sapiens
gccgggcuccaggga

SEQ ID NO: 2113739 - RNA, 15 nt, Homo sapiens
agcuuuaaugauaug

SEQ ID NO: 2113740 - RNA, 20 nt, Homo sapiens
cugccucccaacagugggga

SEQ ID NO: 2113741 - RNA, 11 nt, Homo sapiens
agcaauuacuc

SEQ ID NO: 2113742 - RNA, 11 nt, Homo sapiens
agaaauuacua

SEQ ID NO: 2113743 - RNA, 17 nt, Homo sapiens
agcacagacggaggaag

SEQ ID NO: 2113744 - RNA, 17 nt, Homo sapiens
gcacugaggaccagcca

SEQ ID NO: 2113745 - RNA, 14 nt, Homo sapiens
uauaauauaccaau

SEQ ID NO: 2113746 - RNA, 12 nt, Homo sapiens
aacacaaagaca

SEQ ID NO: 2113747 - RNA, 18 nt, Homo sapiens
agucaccagccagaggau

SEQ ID NO: 2113748 - RNA, 17 nt, Homo sapiens
uggagagagagcaagau

SEQ ID NO: 2113749 - RNA, 23 nt, Homo sapiens
uaggcagagccauaauggacuaa

SEQ ID NO: 2113750 - RNA, 21 nt, Homo sapiens
gcauacucuaugugauuuauu

SEQ ID NO: 2113751 - RNA, 14 nt, Homo sapiens
ucuuguucugugau

SEQ ID NO: 2113752 - RNA, 19 nt, Homo sapiens
uccaaacagaccccuguuc

SEQ ID NO: 2113753 - RNA, 16 nt, Homo sapiens
cauauggacucugcac

SEQ ID NO: 2113754 - RNA, 22 nt, Homo sapiens
ugugggugccaguccuccucag

SEQ ID NO: 2113755 - RNA, 13 nt, Homo sapiens
gcaucagcuuucc

SEQ ID NO: 2113756 - RNA, 22 nt, Homo sapiens
gagauguggaaaagccaagagg

SEQ ID NO: 2113757 - RNA, 13 nt, Homo sapiens
augugaagucucu

SEQ ID NO: 2113758 - RNA, 18 nt, Homo sapiens
acugccccuugcuucuca

SEQ ID NO: 2113759 - RNA, 23 nt, Homo sapiens
aucuuuuuuuuauuccacaucua

SEQ ID NO: 2113760 - RNA, 13 nt, Homo sapiens
ccauugugaacca

SEQ ID NO: 2113761 - RNA, 15 nt, Homo sapiens
ugaugcugggacccu

SEQ ID NO: 2113762 - RNA, 15 nt, Homo sapiens
gugccuaugggaaug

SEQ ID NO: 2113763 - RNA, 20 nt, Homo sapiens
ugguccaugggccauaugaa

SEQ ID NO: 2113764 - RNA, 16 nt, Homo sapiens
uggagugcagugccac

SEQ ID NO: 2113765 - RNA, 23 nt, Homo sapiens
aagccugccucaaucaguauuca

SEQ ID NO: 2113766 - RNA, 15 nt, Homo sapiens
uuuacuugucuuuga

SEQ ID NO: 2113767 - RNA, 16 nt, Homo sapiens
uguugcgccacugaga

SEQ ID NO: 2113768 - RNA, 22 nt, Homo sapiens
uaugcaaaaggguaagaugaaa

SEQ ID NO: 2113769 - RNA, 14 nt, Homo sapiens
auaccugguuugcu

SEQ ID NO: 2113770 - RNA, 23 nt, Homo sapiens
aggcuucugcagcuuuggcugca

SEQ ID NO: 2113771 - RNA, 22 nt, Homo sapiens
agaagccccuuauuuuuagcca

SEQ ID NO: 2113772 - RNA, 18 nt, Homo sapiens
uggguacuuguggacaca

SEQ ID NO: 2113773 - RNA, 18 nt, Homo sapiens
cuuauucacugagucuca

SEQ ID NO: 2113774 - RNA, 18 nt, Homo sapiens
uccuguggucucugacca

SEQ ID NO: 2113775 - RNA, 21 nt, Homo sapiens
ggccuauuccaggaauuccuc

SEQ ID NO: 2113776 - RNA, 15 nt, Homo sapiens
ugcacacacagaugc

SEQ ID NO: 2113777 - RNA, 12 nt, Homo sapiens
gucuuucacuga

SEQ ID NO: 2113778 - RNA, 21 nt, Homo sapiens
acaugaccugaucacuagccu

SEQ ID NO: 2113779 - RNA, 18 nt, Homo sapiens
acauuugacuucuagaaa

SEQ ID NO: 2113780 - RNA, 13 nt, Homo sapiens
ucacauuuucuca

SEQ ID NO: 2113781 - RNA, 21 nt, Homo sapiens
ccaagugaagguucccaagga

SEQ ID NO: 2113782 - RNA, 21 nt, Homo sapiens
cacuguacuaucagguucaca

SEQ ID NO: 2113783 - RNA, 13 nt, Homo sapiens
acuguguuauauu

SEQ ID NO: 2113784 - RNA, 20 nt, Homo sapiens
aggcuagaacacuacagggg

SEQ ID NO: 2113785 - RNA, 20 nt, Homo sapiens
aacagcccaaacuguauaca

SEQ ID NO: 2113786 - RNA, 21 nt, Homo sapiens
aaucuaucgugucaaccccaa

SEQ ID NO: 2113787 - RNA, 22 nt, Homo sapiens
gcuggccucuuggcaccugccu

SEQ ID NO: 2113788 - RNA, 20 nt, Homo sapiens
aggcuggagugaaguggugu

SEQ ID NO: 2113789 - RNA, 23 nt, Homo sapiens
guguacuucuucauccauagaca

SEQ ID NO: 2113790 - RNA, 19 nt, Homo sapiens
uacccuggagcaagaccug

SEQ ID NO: 2113791 - RNA, 11 nt, Homo sapiens
uaucucuggca

SEQ ID NO: 2113792 - RNA, 18 nt, Homo sapiens
caugaucaucacaaucau

SEQ ID NO: 2113793 - RNA, 23 nt, Homo sapiens
aaugaaagucaaauuuacuuuaa

SEQ ID NO: 2113794 - RNA, 20 nt, Homo sapiens
ugaaaacaauccagcacucu

SEQ ID NO: 2113795 - RNA, 22 nt, Homo sapiens
caaaucguggcacguauugcug

SEQ ID NO: 2113796 - RNA, 15 nt, Homo sapiens
aaauucuucacaugu

SEQ ID NO: 2113797 - RNA, 20 nt, Homo sapiens
uugcauuugucaaagcauug

SEQ ID NO: 2113798 - RNA, 15 nt, Homo sapiens
cagaaauuauuggua

SEQ ID NO: 2113799 - RNA, 19 nt, Homo sapiens
gauaugcacacacacggau

SEQ ID NO: 2113800 - RNA, 22 nt, Homo sapiens
cuuucucccaggccaggcuccu

SEQ ID NO: 2113801 - RNA, 17 nt, Homo sapiens
guuagggaugacuguga

SEQ ID NO: 2113802 - RNA, 13 nt, Homo sapiens
auuuauuuaugua

SEQ ID NO: 2113803 - RNA, 15 nt, Homo sapiens
aaaauaguggccaga

SEQ ID NO: 2113804 - RNA, 19 nt, Homo sapiens
uucguguggcuccugguaa

SEQ ID NO: 2113805 - RNA, 16 nt, Homo sapiens
gucuugucuuugauau

SEQ ID NO: 2113806 - RNA, 13 nt, Homo sapiens
caacugaccaguu

SEQ ID NO: 2113807 - RNA, 13 nt, Homo sapiens
cugucucagggug

SEQ ID NO: 2113808 - RNA, 14 nt, Homo sapiens
auaauuuuugcaga

SEQ ID NO: 2113809 - RNA, 20 nt, Homo sapiens
uuuaaaaauaaagcuacuga

SEQ ID NO: 2113810 - RNA, 17 nt, Homo sapiens
gaaagcugaaaagcaua

SEQ ID NO: 2113811 - RNA, 22 nt, Homo sapiens
ggcugaagaaugaagaccacug

SEQ ID NO: 2113812 - RNA, 23 nt, Homo sapiens
uggagaauuccaguuguauuuga

SEQ ID NO: 2113813 - RNA, 19 nt, Homo sapiens
cugcucccccugguggugg

SEQ ID NO: 2113814 - RNA, 12 nt, Homo sapiens
agccaggucucc

SEQ ID NO: 2113815 - RNA, 19 nt, Homo sapiens
acgaugccugcaggcaugg

SEQ ID NO: 2113816 - RNA, 22 nt, Homo sapiens
ucuucaaacugugaagcauuua

SEQ ID NO: 2113817 - RNA, 17 nt, Homo sapiens
acaugcagcucugauga

SEQ ID NO: 2113818 - RNA, 18 nt, Homo sapiens
aguuucugaguuuuacca

SEQ ID NO: 2113819 - RNA, 12 nt, Homo sapiens
aauaauuccaac

SEQ ID NO: 2113820 - RNA, 14 nt, Homo sapiens
uuuucuacuuugaa

SEQ ID NO: 2113821 - RNA, 17 nt, Homo sapiens
uguccaugugugugcaa

SEQ ID NO: 2113822 - RNA, 17 nt, Homo sapiens
cauuguuaugcacuuuu

SEQ ID NO: 2113823 - RNA, 22 nt, Homo sapiens
uguaaaaaaaaaugccuuugag

SEQ ID NO: 2113824 - RNA, 19 nt, Homo sapiens
cauaauucuugcuaugaaa

SEQ ID NO: 2113825 - RNA, 23 nt, Homo sapiens
gcggggcuuuccugcacauucuc

SEQ ID NO: 2113826 - RNA, 18 nt, Homo sapiens
acauacgcaccacaucuc

SEQ ID NO: 2113827 - RNA, 18 nt, Homo sapiens
aauaaaugucacugccaa

SEQ ID NO: 2113828 - RNA, 22 nt, Homo sapiens
gugugucccccuaugcuccagu

SEQ ID NO: 2113829 - RNA, 19 nt, Homo sapiens
uuacaacaagcaaacugaa

SEQ ID NO: 2113830 - RNA, 22 nt, Homo sapiens
gguugugcccuccaccuaccug

SEQ ID NO: 2113831 - RNA, 15 nt, Homo sapiens
accucuggccaaaua

SEQ ID NO: 2113832 - RNA, 16 nt, Homo sapiens
cacuuuauaaauauca

SEQ ID NO: 2113833 - RNA, 21 nt, Homo sapiens
ugacauuuuuccucucugcaa

SEQ ID NO: 2113834 - RNA, 18 nt, Homo sapiens
caauuacaacagugagaa

SEQ ID NO: 2113835 - RNA, 14 nt, Homo sapiens
cugaccacagaauu

SEQ ID NO: 2113836 - RNA, 23 nt, Homo sapiens
gggaucagaguucccaagaaagg

SEQ ID NO: 2113837 - RNA, 23 nt, Homo sapiens
aaauuuugggggaaaaaauccaa

SEQ ID NO: 2113838 - RNA, 20 nt, Homo sapiens
accaugcauuuaaaguauuc

SEQ ID NO: 2113839 - RNA, 18 nt, Homo sapiens
agguaugcaaucaaaucu

SEQ ID NO: 2113840 - RNA, 23 nt, Homo sapiens
cauagaaaauuggguguguauac

SEQ ID NO: 2113841 - RNA, 11 nt, Homo sapiens
cauaugugcua

SEQ ID NO: 2113842 - RNA, 11 nt, Homo sapiens
cuaaugugcau

SEQ ID NO: 2113843 - RNA, 22 nt, Homo sapiens
caucuacuuuuuuuuuaauuaa

SEQ ID NO: 2113844 - RNA, 23 nt, Homo sapiens
guauaugaacuuaacaugcugug

SEQ ID NO: 2113845 - RNA, 23 nt, Homo sapiens
gcugaaacguggguaaggauuua

SEQ ID NO: 2113846 - RNA, 15 nt, Homo sapiens
aacaccaagcacagc

SEQ ID NO: 2113847 - RNA, 14 nt, Homo sapiens
ggauagucugucca

SEQ ID NO: 2113848 - RNA, 22 nt, Homo sapiens
agcagggcgaggaccaauaauu

SEQ ID NO: 2113849 - RNA, 12 nt, Homo sapiens
ucccuaacacuu

SEQ ID NO: 2113850 - RNA, 17 nt, Homo sapiens
uaaaaucauucaauauc

SEQ ID NO: 2113851 - RNA, 21 nt, Homo sapiens
aauucagcuccuuucuguccu

SEQ ID NO: 2113852 - RNA, 21 nt, Homo sapiens
guuuuauucugacuuccucug

SEQ ID NO: 2113853 - RNA, 16 nt, Homo sapiens
uuuaaaaaaacugaag

SEQ ID NO: 2113854 - RNA, 19 nt, Homo sapiens
ugucaagacaaggucuugc

SEQ ID NO: 2113855 - RNA, 23 nt, Homo sapiens
uuacauaguuuucuuccuuugaa

SEQ ID NO: 2113856 - RNA, 22 nt, Homo sapiens
aaacacauucuuauugacaauu

SEQ ID NO: 2113857 - RNA, 17 nt, Homo sapiens
ucugaucguuuauucuc

SEQ ID NO: 2113858 - RNA, 15 nt, Homo sapiens
ccuggacuacaggag

SEQ ID NO: 2113859 - RNA, 18 nt, Homo sapiens
ucaagauccugucuugcu

SEQ ID NO: 2113860 - RNA, 22 nt, Homo sapiens
gucucucucucucucucucuuu

SEQ ID NO: 2113861 - RNA, 16 nt, Homo sapiens
ugagggugacagccac

SEQ ID NO: 2113862 - RNA, 14 nt, Homo sapiens
caacacuuuuucca

SEQ ID NO: 2113863 - RNA, 21 nt, Homo sapiens
acuuauuauuaauaaugaagu

SEQ ID NO: 2113864 - RNA, 13 nt, Homo sapiens
guuuggcuuucag

SEQ ID NO: 2113865 - RNA, 14 nt, Homo sapiens
ccacaggacauuuc

SEQ ID NO: 2113866 - RNA, 16 nt, Homo sapiens
gccuugugucacuggc

SEQ ID NO: 2113867 - RNA, 19 nt, Homo sapiens
aauuacccuuucauucagc

SEQ ID NO: 2113868 - RNA, 21 nt, Homo sapiens
ucaagaagcguuaugugcagu

SEQ ID NO: 2113869 - RNA, 18 nt, Homo sapiens
gcaguauagaaaaguuaa

SEQ ID NO: 2113870 - RNA, 16 nt, Homo sapiens
caaggucucacacucc

SEQ ID NO: 2113871 - RNA, 24 nt, Homo sapiens
cugccuggguaggccccacaaggc

SEQ ID NO: 2113872 - RNA, 16 nt, Homo sapiens
uucucucuuacauuga

SEQ ID NO: 2113873 - RNA, 13 nt, Homo sapiens
aggaacacuggag

SEQ ID NO: 2113874 - RNA, 20 nt, Homo sapiens
auccuacauaauacccagga

SEQ ID NO: 2113875 - RNA, 15 nt, Homo sapiens
aucacauuaucaucu

SEQ ID NO: 2113876 - RNA, 15 nt, Homo sapiens
gggcuauugggcccu

SEQ ID NO: 2113877 - RNA, 21 nt, Homo sapiens
aaaagauacccaaaggucaag

SEQ ID NO: 2113878 - RNA, 21 nt, Homo sapiens
agcaacacucuauauuuagau

SEQ ID NO: 2113879 - RNA, 17 nt, Homo sapiens
ccuggggggcacagcca

SEQ ID NO: 2113880 - RNA, 14 nt, Homo sapiens
cacagaccucuccc

SEQ ID NO: 2113881 - RNA, 22 nt, Homo sapiens
cagaaguucgagacuagccugg

SEQ ID NO: 2113882 - RNA, 15 nt, Homo sapiens
cuggaagggccaagg

SEQ ID NO: 2113883 - RNA, 20 nt, Homo sapiens
uuaaaaaaauuuuugcaaau

SEQ ID NO: 2113884 - RNA, 17 nt, Homo sapiens
ucccacccacacagcug

SEQ ID NO: 2113885 - RNA, 16 nt, Homo sapiens
guuucaguucugugua

SEQ ID NO: 2113886 - RNA, 17 nt, Homo sapiens
uauagcagauuguguaa

SEQ ID NO: 2113887 - RNA, 18 nt, Homo sapiens
ggacucauccuugcccag

SEQ ID NO: 2113888 - RNA, 16 nt, Homo sapiens
auccagugguggguaa

SEQ ID NO: 2113889 - RNA, 19 nt, Homo sapiens
cacagauuuccucucuaaa

SEQ ID NO: 2113890 - RNA, 23 nt, Homo sapiens
ugagacaggagaaacacuugaac

SEQ ID NO: 2113891 - RNA, 21 nt, Homo sapiens
gaugagcuuugucuacuucaa

SEQ ID NO: 2113892 - RNA, 19 nt, Homo sapiens
cuccuuucuuucuaacucc

SEQ ID NO: 2113893 - RNA, 23 nt, Homo sapiens
gaaaaauauugaacucaaugaua

SEQ ID NO: 2113894 - RNA, 13 nt, Homo sapiens
gacuuacuuagaa

SEQ ID NO: 2113895 - RNA, 21 nt, Homo sapiens
ucuuaacuggucuccuugcuu

SEQ ID NO: 2113896 - RNA, 15 nt, Homo sapiens
ugagaaaaggcaaaa

SEQ ID NO: 2113897 - RNA, 13 nt, Homo sapiens
cuuagaauaucua

SEQ ID NO: 2113898 - RNA, 20 nt, Homo sapiens
aggugauucgcccaccucag

SEQ ID NO: 2113899 - RNA, 17 nt, Homo sapiens
uccugacuccuaccugc

SEQ ID NO: 2113900 - RNA, 18 nt, Homo sapiens
ucauuuguaguugccuua

SEQ ID NO: 2113901 - RNA, 13 nt, Homo sapiens
gcgccacaggacc

SEQ ID NO: 2113902 - RNA, 16 nt, Homo sapiens
cuaaucuaaacuguag

SEQ ID NO: 2113903 - RNA, 22 nt, Homo sapiens
agcaucugagcuaacuuauauu

SEQ ID NO: 2113904 - RNA, 19 nt, Homo sapiens
cuugcugaauuucaggcau

SEQ ID NO: 2113905 - RNA, 19 nt, Homo sapiens
acuaagcaaauaggcaaaa

SEQ ID NO: 2113906 - RNA, 17 nt, Homo sapiens
ucaucucacauuuuccc

SEQ ID NO: 2113907 - RNA, 18 nt, Homo sapiens
gcacacuggcucacccag

SEQ ID NO: 2113908 - RNA, 20 nt, Homo sapiens
cugaaacacuggaccugggg

SEQ ID NO: 2113909 - RNA, 14 nt, Homo sapiens
agcuggaggcacaa

SEQ ID NO: 2113910 - RNA, 19 nt, Homo sapiens
ucauaucuuuuaauugugu

SEQ ID NO: 2113911 - RNA, 20 nt, Homo sapiens
aaaaaccuuuacaguuagca

SEQ ID NO: 2113912 - RNA, 17 nt, Homo sapiens
caaacaugcaguacuuu

SEQ ID NO: 2113913 - RNA, 19 nt, Homo sapiens
acuguaaugaaucuaagca

SEQ ID NO: 2113914 - RNA, 16 nt, Homo sapiens
uuuagcgagcccagag

SEQ ID NO: 2113915 - RNA, 17 nt, Homo sapiens
agcuuccaaauguguca

SEQ ID NO: 2113916 - RNA, 11 nt, Homo sapiens
aguuguauuag

SEQ ID NO: 2113917 - RNA, 12 nt, Homo sapiens
ugugagcggaag

SEQ ID NO: 2113918 - RNA, 19 nt, Homo sapiens
gcugagcucccagaccccc

SEQ ID NO: 2113919 - RNA, 19 nt, Homo sapiens
ggagccccuucugcucagc

SEQ ID NO: 2113920 - RNA, 21 nt, Homo sapiens
aaaauagacuaaccucuacca

SEQ ID NO: 2113921 - RNA, 22 nt, Homo sapiens
agaaauacaauauaucuugucu

SEQ ID NO: 2113922 - RNA, 20 nt, Homo sapiens
gagaacagcauaugauuucu

SEQ ID NO: 2113923 - RNA, 22 nt, Homo sapiens
gaggacaugcaugacacuucca

SEQ ID NO: 2113924 - RNA, 13 nt, Homo sapiens
ucccaaagccaga

SEQ ID NO: 2113925 - RNA, 21 nt, Homo sapiens
gacucacuagacucaggaaag

SEQ ID NO: 2113926 - RNA, 21 nt, Homo sapiens
guaccuguauuaaaagauucc

SEQ ID NO: 2113927 - RNA, 18 nt, Homo sapiens
uuaaauccugaagagcau

SEQ ID NO: 2113928 - RNA, 19 nt, Homo sapiens
aagauggcgacaaaaguga

SEQ ID NO: 2113929 - RNA, 14 nt, Homo sapiens
uacagagcugagca

SEQ ID NO: 2113930 - RNA, 22 nt, Homo sapiens
uuaagguacuaauuaacuuaaa

SEQ ID NO: 2113931 - RNA, 21 nt, Homo sapiens
ccaauaaaacugauguuacua

SEQ ID NO: 2113932 - RNA, 21 nt, Homo sapiens
uuguaaaguauuuaagguaca

SEQ ID NO: 2113933 - RNA, 18 nt, Homo sapiens
uuagccagagaugcaaua

SEQ ID NO: 2113934 - RNA, 16 nt, Homo sapiens
uguggugcccaugagg

SEQ ID NO: 2113935 - RNA, 18 nt, Homo sapiens
aagagaucugggcauuaa

SEQ ID NO: 2113936 - RNA, 18 nt, Homo sapiens
acaugacccggaugaacu

SEQ ID NO: 2113937 - RNA, 16 nt, Homo sapiens
aaaauccuaacauuca

SEQ ID NO: 2113938 - RNA, 14 nt, Homo sapiens
cuuucuuguugcug

SEQ ID NO: 2113939 - RNA, 16 nt, Homo sapiens
ucggaagacuugccac

SEQ ID NO: 2113940 - RNA, 14 nt, Homo sapiens
caguucauuguggg

SEQ ID NO: 2113941 - RNA, 15 nt, Homo sapiens
uaaauaacaaaucuc

SEQ ID NO: 2113942 - RNA, 17 nt, Homo sapiens
agcgucagaaucguguu

SEQ ID NO: 2113943 - RNA, 18 nt, Homo sapiens
uucaccaccaucuccagc

SEQ ID NO: 2113944 - RNA, 22 nt, Homo sapiens
cuaacccuuugugugcucucca

SEQ ID NO: 2113945 - RNA, 18 nt, Homo sapiens
uaaagauuuauuuagcua

SEQ ID NO: 2113946 - RNA, 13 nt, Homo sapiens
agaucugcacugg

SEQ ID NO: 2113947 - RNA, 19 nt, Homo sapiens
aaagauccaacaaggccau

SEQ ID NO: 2113948 - RNA, 18 nt, Homo sapiens
uaugguaaagagauguca

SEQ ID NO: 2113949 - RNA, 20 nt, Homo sapiens
cuaaugagagugcacugcuc

SEQ ID NO: 2113950 - RNA, 18 nt, Homo sapiens
gauuuugaagagauuuua

SEQ ID NO: 2113951 - RNA, 19 nt, Homo sapiens
ccaauccuagcccucauuu

SEQ ID NO: 2113952 - RNA, 14 nt, Homo sapiens
uuuacagugccacg

SEQ ID NO: 2113953 - RNA, 20 nt, Homo sapiens
ugaccucagcgguugccagg

SEQ ID NO: 2113954 - RNA, 18 nt, Homo sapiens
acuacaauuuaaagcaaa

SEQ ID NO: 2113955 - RNA, 20 nt, Homo sapiens
accacaaaaauugacucaaa

SEQ ID NO: 2113956 - RNA, 18 nt, Homo sapiens
acagaugugaaaauauac

SEQ ID NO: 2113957 - RNA, 21 nt, Homo sapiens
guugauccugaguuacgugaa

SEQ ID NO: 2113958 - RNA, 17 nt, Homo sapiens
ccaaugaaaacaguccc

SEQ ID NO: 2113959 - RNA, 18 nt, Homo sapiens
uuuuccuaaggaaggaaa

SEQ ID NO: 2113960 - RNA, 20 nt, Homo sapiens
aguuauuucaaccagcacau

SEQ ID NO: 2113961 - RNA, 16 nt, Homo sapiens
gccaacauacuuuaag

SEQ ID NO: 2113962 - RNA, 18 nt, Homo sapiens
gcugaacaaaauuaaacu

SEQ ID NO: 2113963 - RNA, 16 nt, Homo sapiens
aaaagcccccaguuaa

SEQ ID NO: 2113964 - RNA, 15 nt, Homo sapiens
agacaguuucuugca

SEQ ID NO: 2113965 - RNA, 19 nt, Homo sapiens
ucaguguuggccaugauga

SEQ ID NO: 2113966 - RNA, 12 nt, Homo sapiens
uauccugaucuc

SEQ ID NO: 2113967 - RNA, 11 nt, Homo sapiens
gacagugcagu

SEQ ID NO: 2113968 - RNA, 20 nt, Homo sapiens
gcgaaacccggugcaucugg

SEQ ID NO: 2113969 - RNA, 21 nt, Homo sapiens
acacugcugcuccagugcagg

SEQ ID NO: 2113970 - RNA, 21 nt, Homo sapiens
ccuugcugccgucaccucucc

SEQ ID NO: 2113971 - RNA, 22 nt, Homo sapiens
caucucccuuccaccucacaac

SEQ ID NO: 2113972 - RNA, 15 nt, Homo sapiens
aguugacuuccuuau

SEQ ID NO: 2113973 - RNA, 15 nt, Homo sapiens
aguuucuuuccugcc

SEQ ID NO: 2113974 - RNA, 23 nt, Homo sapiens
ucgaugauggaaauuagccacau

SEQ ID NO: 2113975 - RNA, 19 nt, Homo sapiens
ugaagaaaaaauacauuuu

SEQ ID NO: 2113976 - RNA, 12 nt, Homo sapiens
uuuuucagaaag

SEQ ID NO: 2113977 - RNA, 18 nt, Homo sapiens
ucacaaaguuaaacguga

SEQ ID NO: 2113978 - RNA, 16 nt, Homo sapiens
ucccacgacuguugua

SEQ ID NO: 2113979 - RNA, 16 nt, Homo sapiens
uccugugaaaauauga

SEQ ID NO: 2113980 - RNA, 20 nt, Homo sapiens
ccucuuuguuucugcuucau

SEQ ID NO: 2113981 - RNA, 12 nt, Homo sapiens
gcucacaguccu

SEQ ID NO: 2113982 - RNA, 14 nt, Homo sapiens
aaagaaauaaucuc

SEQ ID NO: 2113983 - RNA, 20 nt, Homo sapiens
caucugcacggugggagacc

SEQ ID NO: 2113984 - RNA, 14 nt, Homo sapiens
aaaacaguguuucc

SEQ ID NO: 2113985 - RNA, 13 nt, Homo sapiens
ccccuguggucac

SEQ ID NO: 2113986 - RNA, 17 nt, Homo sapiens
cucacugcaaucucugc

SEQ ID NO: 2113987 - RNA, 20 nt, Homo sapiens
aguuaugguuuuccaucuua

SEQ ID NO: 2113988 - RNA, 21 nt, Homo sapiens
caccaggcccacgaggagcag

SEQ ID NO: 2113989 - RNA, 12 nt, Homo sapiens
cuuucucagugu

SEQ ID NO: 2113990 - RNA, 12 nt, Homo sapiens
cuugcucagugg

SEQ ID NO: 2113991 - RNA, 19 nt, Homo sapiens
ccacagcggauguuguaga

SEQ ID NO: 2113992 - RNA, 20 nt, Homo sapiens
caggaacccuccuccuguca

SEQ ID NO: 2113993 - RNA, 13 nt, Homo sapiens
auuguuuacccaa

SEQ ID NO: 2113994 - RNA, 17 nt, Homo sapiens
aucaucgaagucuuccc

SEQ ID NO: 2113995 - RNA, 15 nt, Homo sapiens
cucucaggugccagu

SEQ ID NO: 2113996 - RNA, 18 nt, Homo sapiens
ggacaaaacacugugucc

SEQ ID NO: 2113997 - RNA, 17 nt, Homo sapiens
cuaaacuaucaauaaua

SEQ ID NO: 2113998 - RNA, 17 nt, Homo sapiens
aaguacuuuccaaucuc

SEQ ID NO: 2113999 - RNA, 14 nt, Homo sapiens
acaagccugagaac

SEQ ID NO: 2114000 - RNA, 18 nt, Homo sapiens
accaagcacccuuccacu

SEQ ID NO: 2114001 - RNA, 19 nt, Homo sapiens
cauaaaaaucccucuuccu

SEQ ID NO: 2114002 - RNA, 17 nt, Homo sapiens
cugaguuugaacacaga

SEQ ID NO: 2114003 - RNA, 20 nt, Homo sapiens
aggugugaccccaccugcuc

SEQ ID NO: 2114004 - RNA, 14 nt, Homo sapiens
caacccacuggccc

SEQ ID NO: 2114005 - RNA, 14 nt, Homo sapiens
ugagagaccaggag

SEQ ID NO: 2114006 - RNA, 15 nt, Homo sapiens
caggaacucccagca

SEQ ID NO: 2114007 - RNA, 14 nt, Homo sapiens
ccacccccagcuca

SEQ ID NO: 2114008 - RNA, 15 nt, Homo sapiens
uguuacugccuauaa

SEQ ID NO: 2114009 - RNA, 19 nt, Homo sapiens
cagaaagcuccuuccagac

SEQ ID NO: 2114010 - RNA, 14 nt, Homo sapiens
ugaacacaucagcu

SEQ ID NO: 2114011 - RNA, 17 nt, Homo sapiens
auggcaagugauaucac

SEQ ID NO: 2114012 - RNA, 14 nt, Homo sapiens
uuccaugaaguuug

SEQ ID NO: 2114013 - RNA, 22 nt, Homo sapiens
auacuugauuuaaucaccacuc

SEQ ID NO: 2114014 - RNA, 22 nt, Homo sapiens
ucucaaauaauaaaguaauuga

SEQ ID NO: 2114015 - RNA, 18 nt, Homo sapiens
gacauuucuaacauaugu

SEQ ID NO: 2114016 - RNA, 16 nt, Homo sapiens
uggacugugugcucag

SEQ ID NO: 2114017 - RNA, 21 nt, Homo sapiens
ucugugaccccuccuugucag

SEQ ID NO: 2114018 - RNA, 16 nt, Homo sapiens
ggucuuggggucauga

SEQ ID NO: 2114019 - RNA, 16 nt, Homo sapiens
uggcauaguggcuuaa

SEQ ID NO: 2114020 - RNA, 21 nt, Homo sapiens
agcacaacccccccaaaacaa

SEQ ID NO: 2114021 - RNA, 17 nt, Homo sapiens
guguuuuugcaggugag

SEQ ID NO: 2114022 - RNA, 17 nt, Homo sapiens
aggcucagagaugugca

SEQ ID NO: 2114023 - RNA, 21 nt, Homo sapiens
gauugagcuacuucaggacuu

SEQ ID NO: 2114024 - RNA, 16 nt, Homo sapiens
caguccaagaccccaa

SEQ ID NO: 2114025 - RNA, 15 nt, Homo sapiens
accugccucugaccc

SEQ ID NO: 2114026 - RNA, 18 nt, Homo sapiens
ucccuggggcuccugcuu

SEQ ID NO: 2114027 - RNA, 22 nt, Homo sapiens
ugggcuaggguggucagaggaa

SEQ ID NO: 2114028 - RNA, 21 nt, Homo sapiens
aaggaguaaucuguguacaaa

SEQ ID NO: 2114029 - RNA, 23 nt, Homo sapiens
uugguuaaaggaaguuuguucac

SEQ ID NO: 2114030 - RNA, 17 nt, Homo sapiens
uuagaaauaauggucau

SEQ ID NO: 2114031 - RNA, 17 nt, Homo sapiens
aaaauugugaucagacc

SEQ ID NO: 2114032 - RNA, 21 nt, Homo sapiens
uauguaaaaccaacaaaaaga

SEQ ID NO: 2114033 - RNA, 13 nt, Homo sapiens
gccuuuaucuuga

SEQ ID NO: 2114034 - RNA, 15 nt, Homo sapiens
aaugaagugcaauac

SEQ ID NO: 2114035 - RNA, 14 nt, Homo sapiens
auuuucugcauuau

SEQ ID NO: 2114036 - RNA, 21 nt, Homo sapiens
uggucagggccccucuaccca

SEQ ID NO: 2114037 - RNA, 14 nt, Homo sapiens
uccucuccuaccca

SEQ ID NO: 2114038 - RNA, 18 nt, Homo sapiens
agucugaaccaauagaaa

SEQ ID NO: 2114039 - RNA, 20 nt, Homo sapiens
cuacaaaaaaugcagaacuu

SEQ ID NO: 2114040 - RNA, 15 nt, Homo sapiens
auuuuugaaaacugg

SEQ ID NO: 2114041 - RNA, 20 nt, Homo sapiens
caaaguaaaggccuccuccc

SEQ ID NO: 2114042 - RNA, 20 nt, Homo sapiens
ggucagagacugcuguguuu

SEQ ID NO: 2114043 - RNA, 19 nt, Homo sapiens
cuuguaugguuuuucacca

SEQ ID NO: 2114044 - RNA, 18 nt, Homo sapiens
ucacacgggggcagcuga

SEQ ID NO: 2114045 - RNA, 19 nt, Homo sapiens
uacugcugagauacauaca

SEQ ID NO: 2114046 - RNA, 21 nt, Homo sapiens
cacuucgaugacuggauacag

SEQ ID NO: 2114047 - RNA, 17 nt, Homo sapiens
aauaguguguccaugca

SEQ ID NO: 2114048 - RNA, 13 nt, Homo sapiens
uuaaaaaccauua

SEQ ID NO: 2114049 - RNA, 21 nt, Homo sapiens
guaacuuuauuggucuugccc

SEQ ID NO: 2114050 - RNA, 17 nt, Homo sapiens
ugcaggaaggaggugca

SEQ ID NO: 2114051 - RNA, 18 nt, Homo sapiens
ucaccccugcccugggau

SEQ ID NO: 2114052 - RNA, 17 nt, Homo sapiens
uguaguuuaauacagga

SEQ ID NO: 2114053 - RNA, 17 nt, Homo sapiens
gaggugacggcacuccc

SEQ ID NO: 2114054 - RNA, 16 nt, Homo sapiens
cuagcacuuggagcca

SEQ ID NO: 2114055 - RNA, 22 nt, Homo sapiens
gcugauucaauaaaaugcacug

SEQ ID NO: 2114056 - RNA, 17 nt, Homo sapiens
augcauguuuccugcuc

SEQ ID NO: 2114057 - RNA, 18 nt, Homo sapiens
gcauggaacagugcagga

SEQ ID NO: 2114058 - RNA, 16 nt, Homo sapiens
cugaggacaccaguga

SEQ ID NO: 2114059 - RNA, 20 nt, Homo sapiens
ugaaaacccucgauguucau

SEQ ID NO: 2114060 - RNA, 14 nt, Homo sapiens
gugcagacaggcug

SEQ ID NO: 2114061 - RNA, 18 nt, Homo sapiens
auagcaucuucucauucc

SEQ ID NO: 2114062 - RNA, 18 nt, Homo sapiens
auacuuggaccucagcca

SEQ ID NO: 2114063 - RNA, 15 nt, Homo sapiens
acaccuaugucauuu

SEQ ID NO: 2114064 - RNA, 14 nt, Homo sapiens
aguguccuaugcaa

SEQ ID NO: 2114065 - RNA, 21 nt, Homo sapiens
cucagaaugggaggacuccag

SEQ ID NO: 2114066 - RNA, 12 nt, Homo sapiens
gggacacaggag

SEQ ID NO: 2114067 - RNA, 14 nt, Homo sapiens
auaugcagucucuu

SEQ ID NO: 2114068 - RNA, 13 nt, Homo sapiens
aagccuucugcag

SEQ ID NO: 2114069 - RNA, 19 nt, Homo sapiens
caugaaaucaacucagugg

SEQ ID NO: 2114070 - RNA, 23 nt, Homo sapiens
agcacaggagcugccaugucaga

SEQ ID NO: 2114071 - RNA, 20 nt, Homo sapiens
auugcagcgauuaauaacag

SEQ ID NO: 2114072 - RNA, 21 nt, Homo sapiens
agucaagcucuggguacugaa

SEQ ID NO: 2114073 - RNA, 14 nt, Homo sapiens
aaauauuuuaccca

SEQ ID NO: 2114074 - RNA, 15 nt, Homo sapiens
cuggaaaaaggugaa

SEQ ID NO: 2114075 - RNA, 21 nt, Homo sapiens
auguucuacuuaaauauauua

SEQ ID NO: 2114076 - RNA, 20 nt, Homo sapiens
ccaugucguaguuacucuca

SEQ ID NO: 2114077 - RNA, 16 nt, Homo sapiens
ugaccgcaccucacac

SEQ ID NO: 2114078 - RNA, 17 nt, Homo sapiens
cagcccaaucugccaga

SEQ ID NO: 2114079 - RNA, 15 nt, Homo sapiens
gauuucacugacacu

SEQ ID NO: 2114080 - RNA, 15 nt, Homo sapiens
gaccuugcugccaca

SEQ ID NO: 2114081 - RNA, 13 nt, Homo sapiens
aagaaaacuuuga

SEQ ID NO: 2114082 - RNA, 21 nt, Homo sapiens
cuuuuaggacugucugaaaau

SEQ ID NO: 2114083 - RNA, 15 nt, Homo sapiens
uaaagcuuauuuccc

SEQ ID NO: 2114084 - RNA, 13 nt, Homo sapiens
ugagggacguggu

SEQ ID NO: 2114085 - RNA, 17 nt, Homo sapiens
cucuaaggcaguagaau

SEQ ID NO: 2114086 - RNA, 15 nt, Homo sapiens
gauaagagaauaccu

SEQ ID NO: 2114087 - RNA, 20 nt, Homo sapiens
gaaauggaacagugaggaau

SEQ ID NO: 2114088 - RNA, 21 nt, Homo sapiens
cuggggccaacuggaaccauu

SEQ ID NO: 2114089 - RNA, 22 nt, Homo sapiens
ccuagacuuugggaucaaauaa

SEQ ID NO: 2114090 - RNA, 20 nt, Homo sapiens
acucuuucauucuucucaca

SEQ ID NO: 2114091 - RNA, 20 nt, Homo sapiens
acagguuacaacagauuugu

SEQ ID NO: 2114092 - RNA, 17 nt, Homo sapiens
gcagucucuauaccaau

SEQ ID NO: 2114093 - RNA, 13 nt, Homo sapiens
agaagugugauug

SEQ ID NO: 2114094 - RNA, 19 nt, Homo sapiens
acacgcguccacauacacu

SEQ ID NO: 2114095 - RNA, 15 nt, Homo sapiens
ggccauaaagaucaa

SEQ ID NO: 2114096 - RNA, 21 nt, Homo sapiens
gaacaugcccacaacuuguca

SEQ ID NO: 2114097 - RNA, 12 nt, Homo sapiens
uuguuugggauu

SEQ ID NO: 2114098 - RNA, 16 nt, Homo sapiens
ugccuccccuguggaa

SEQ ID NO: 2114099 - RNA, 20 nt, Homo sapiens
cuugcaaauagccagugcua

SEQ ID NO: 2114100 - RNA, 13 nt, Homo sapiens
guuuugccuuaaa

SEQ ID NO: 2114101 - RNA, 15 nt, Homo sapiens
auuuuauacauuaac

SEQ ID NO: 2114102 - RNA, 21 nt, Homo sapiens
caauucuauuacgugcaauac

SEQ ID NO: 2114103 - RNA, 13 nt, Homo sapiens
guuuuuauucaaa

SEQ ID NO: 2114104 - RNA, 16 nt, Homo sapiens
cccuccaccagugugc

SEQ ID NO: 2114105 - RNA, 21 nt, Homo sapiens
auuuccacuaaaaaauuaaau

SEQ ID NO: 2114106 - RNA, 15 nt, Homo sapiens
gauaugcguauuaua

SEQ ID NO: 2114107 - RNA, 13 nt, Homo sapiens
uggggacagggcu

SEQ ID NO: 2114108 - RNA, 18 nt, Homo sapiens
ucacucaaaugaauuugc

SEQ ID NO: 2114109 - RNA, 20 nt, Homo sapiens
ugauaguuaauuauuucaac

SEQ ID NO: 2114110 - RNA, 16 nt, Homo sapiens
ucucccuuguccugcu

SEQ ID NO: 2114111 - RNA, 21 nt, Homo sapiens
auucuacuucugucuuccuuc

SEQ ID NO: 2114112 - RNA, 14 nt, Homo sapiens
aagguaugggagag

SEQ ID NO: 2114113 - RNA, 17 nt, Homo sapiens
gucuaccaaaaacaaua

SEQ ID NO: 2114114 - RNA, 11 nt, Homo sapiens
ggcugcaguga

SEQ ID NO: 2114115 - RNA, 20 nt, Homo sapiens
auauuucucauuuagcauug

SEQ ID NO: 2114116 - RNA, 20 nt, Homo sapiens
ucaccagaaaauuaauuuca

SEQ ID NO: 2114117 - RNA, 16 nt, Homo sapiens
cucucuuauaaauucu

SEQ ID NO: 2114118 - RNA, 17 nt, Homo sapiens
cgaugcagugcuuccaa

SEQ ID NO: 2114119 - RNA, 24 nt, Homo sapiens
ccacuugccugugcuacaauucau

SEQ ID NO: 2114120 - RNA, 17 nt, Homo sapiens
uuaaguuucucuucacc

SEQ ID NO: 2114121 - RNA, 23 nt, Homo sapiens
aguugggacccaaaacacaggaa

SEQ ID NO: 2114122 - RNA, 14 nt, Homo sapiens
ccuuaucugucaca

SEQ ID NO: 2114123 - RNA, 14 nt, Homo sapiens
cuugcucugucacc

SEQ ID NO: 2114124 - RNA, 18 nt, Homo sapiens
accaggucuacagugaua

SEQ ID NO: 2114125 - RNA, 12 nt, Homo sapiens
uauacauaugau

SEQ ID NO: 2114126 - RNA, 14 nt, Homo sapiens
uaugaaagacucaa

SEQ ID NO: 2114127 - RNA, 14 nt, Homo sapiens
cuaugaagcuuucu

SEQ ID NO: 2114128 - RNA, 17 nt, Homo sapiens
aagguaguaacuuucca

SEQ ID NO: 2114129 - RNA, 14 nt, Homo sapiens
agagucugucuuga

SEQ ID NO: 2114130 - RNA, 15 nt, Homo sapiens
ggcuggacaugcuga

SEQ ID NO: 2114131 - RNA, 21 nt, Homo sapiens
uggaccaauagggcugagcuc

SEQ ID NO: 2114132 - RNA, 15 nt, Homo sapiens
ggaucuaucuguauu

SEQ ID NO: 2114133 - RNA, 18 nt, Homo sapiens
caucuugaucaaccaaaa

SEQ ID NO: 2114134 - RNA, 14 nt, Homo sapiens
gguuuaaaagucac

SEQ ID NO: 2114135 - RNA, 17 nt, Homo sapiens
aggaacugcuugugcac

SEQ ID NO: 2114136 - RNA, 15 nt, Homo sapiens
uguauauacuuuuaa

SEQ ID NO: 2114137 - RNA, 24 nt, Homo sapiens
ggaccagcuuggcucaggcugagc

SEQ ID NO: 2114138 - RNA, 21 nt, Homo sapiens
uaaaaaccugcuuggugugua

SEQ ID NO: 2114139 - RNA, 23 nt, Homo sapiens
uuacaaaacaugauuguuuacag

SEQ ID NO: 2114140 - RNA, 17 nt, Homo sapiens
cuccuuguccacccacc

SEQ ID NO: 2114141 - RNA, 18 nt, Homo sapiens
uucugucaggagagcagc

SEQ ID NO: 2114142 - RNA, 22 nt, Homo sapiens
cuauccuuuuuuccuuuccuga

SEQ ID NO: 2114143 - RNA, 14 nt, Homo sapiens
agcuuccagugcau

SEQ ID NO: 2114144 - RNA, 17 nt, Homo sapiens
uacugaguucucaucca

SEQ ID NO: 2114145 - RNA, 16 nt, Homo sapiens
gaaaucugugcaauaa

SEQ ID NO: 2114146 - RNA, 21 nt, Homo sapiens
auuauguguugccaaaaccaa

SEQ ID NO: 2114147 - RNA, 20 nt, Homo sapiens
agggguuugcuuacagugau

SEQ ID NO: 2114148 - RNA, 11 nt, Homo sapiens
ucaagugcagu

SEQ ID NO: 2114149 - RNA, 11 nt, Homo sapiens
ccuucccucau

SEQ ID NO: 2114150 - RNA, 18 nt, Homo sapiens
acuuuaaaugacauuugu

SEQ ID NO: 2114151 - RNA, 16 nt, Homo sapiens
caggaaucucagagac

SEQ ID NO: 2114152 - RNA, 16 nt, Homo sapiens
guggcucgacugcuca

SEQ ID NO: 2114153 - RNA, 13 nt, Homo sapiens
cauacaacauaua

SEQ ID NO: 2114154 - RNA, 13 nt, Homo sapiens
accaaaugugcuu

SEQ ID NO: 2114155 - RNA, 13 nt, Homo sapiens
ugaaaaugacauu

SEQ ID NO: 2114156 - RNA, 13 nt, Homo sapiens
accauaugugcua

SEQ ID NO: 2114157 - RNA, 20 nt, Homo sapiens
agcccuucaccaucuaccug

SEQ ID NO: 2114158 - RNA, 15 nt, Homo sapiens
gaucuguuaccaaua

SEQ ID NO: 2114159 - RNA, 13 nt, Homo sapiens
auccccagacuca

SEQ ID NO: 2114160 - RNA, 20 nt, Homo sapiens
gacucugucuaaaaaacaaa

SEQ ID NO: 2114161 - RNA, 16 nt, Homo sapiens
gagauaggggaaauca

SEQ ID NO: 2114162 - RNA, 14 nt, Homo sapiens
uaccauuaucuuau

SEQ ID NO: 2114163 - RNA, 15 nt, Homo sapiens
cgaugggcaucacac

SEQ ID NO: 2114164 - RNA, 16 nt, Homo sapiens
uuugccgacauguuug

SEQ ID NO: 2114165 - RNA, 22 nt, Homo sapiens
aaacauaugucugucuuugcaa

SEQ ID NO: 2114166 - RNA, 17 nt, Homo sapiens
uacacaaggaaggcauu

SEQ ID NO: 2114167 - RNA, 17 nt, Homo sapiens
ugggcgugugugacacu

SEQ ID NO: 2114168 - RNA, 14 nt, Homo sapiens
uugaucacuacaag

SEQ ID NO: 2114169 - RNA, 11 nt, Homo sapiens
guccuuuacaa

SEQ ID NO: 2114170 - RNA, 20 nt, Homo sapiens
cuuuuugcugccugugagca

SEQ ID NO: 2114171 - RNA, 14 nt, Homo sapiens
aggaguaggacaaa

SEQ ID NO: 2114172 - RNA, 17 nt, Homo sapiens
ugcccugugcaugccau

SEQ ID NO: 2114173 - RNA, 18 nt, Homo sapiens
gugcacaucuacaugcca

SEQ ID NO: 2114174 - RNA, 13 nt, Homo sapiens
cuaaagugucuau

SEQ ID NO: 2114175 - RNA, 22 nt, Homo sapiens
accaugcuuguggccaaugcau

SEQ ID NO: 2114176 - RNA, 15 nt, Homo sapiens
gagggccuggucacc

SEQ ID NO: 2114177 - RNA, 15 nt, Homo sapiens
cuguucuuacuguaa

SEQ ID NO: 2114178 - RNA, 16 nt, Homo sapiens
ggcguggggccaauac

SEQ ID NO: 2114179 - RNA, 19 nt, Homo sapiens
gagacauggcuugccacag

SEQ ID NO: 2114180 - RNA, 20 nt, Homo sapiens
agaucauccagaaguuccuc

SEQ ID NO: 2114181 - RNA, 12 nt, Homo sapiens
gcugcauaguau

SEQ ID NO: 2114182 - RNA, 22 nt, Homo sapiens
gcuuauucuuuuguucuugaaa

SEQ ID NO: 2114183 - RNA, 21 nt, Homo sapiens
acuggagcuucucuuuaacuc

SEQ ID NO: 2114184 - RNA, 15 nt, Homo sapiens
cuuuuccaacccaug

SEQ ID NO: 2114185 - RNA, 15 nt, Homo sapiens
aagcgauccuccugc

SEQ ID NO: 2114186 - RNA, 12 nt, Homo sapiens
guucuucagaga

SEQ ID NO: 2114187 - RNA, 21 nt, Homo sapiens
ucacgaggaaaagagaaggaa

SEQ ID NO: 2114188 - RNA, 15 nt, Homo sapiens
ucccaccuguagucc

SEQ ID NO: 2114189 - RNA, 21 nt, Homo sapiens
ccuaagaucaaaccccaugga

SEQ ID NO: 2114190 - RNA, 16 nt, Homo sapiens
cuaaugaacucuuuca

SEQ ID NO: 2114191 - RNA, 21 nt, Homo sapiens
cugcuguugauuccacugaaa

SEQ ID NO: 2114192 - RNA, 22 nt, Homo sapiens
uuuaagcaaauacuuagcaaaa

SEQ ID NO: 2114193 - RNA, 13 nt, Homo sapiens
aggauguggcuua

SEQ ID NO: 2114194 - RNA, 14 nt, Homo sapiens
ucugugcaucuggc

SEQ ID NO: 2114195 - RNA, 17 nt, Homo sapiens
caggaccaucccggccg

SEQ ID NO: 2114196 - RNA, 18 nt, Homo sapiens
acaguccuggacuccugc

SEQ ID NO: 2114197 - RNA, 22 nt, Homo sapiens
aaauaacuuacaagacuguaaa

SEQ ID NO: 2114198 - RNA, 17 nt, Homo sapiens
aaauagucuuccacaaa

SEQ ID NO: 2114199 - RNA, 16 nt, Homo sapiens
guaagaaucauuguaa

SEQ ID NO: 2114200 - RNA, 16 nt, Homo sapiens
caaaauauguuuaaaa

SEQ ID NO: 2114201 - RNA, 12 nt, Homo sapiens
aguguggaacca

SEQ ID NO: 2114202 - RNA, 15 nt, Homo sapiens
gguccaaggucucca

SEQ ID NO: 2114203 - RNA, 15 nt, Homo sapiens
auacagcacuuugac

SEQ ID NO: 2114204 - RNA, 14 nt, Homo sapiens
gcccagcuccaggg

SEQ ID NO: 2114205 - RNA, 17 nt, Homo sapiens
uacuggucccuuccuuu

SEQ ID NO: 2114206 - RNA, 22 nt, Homo sapiens
cagggucucacuauauugcuca

SEQ ID NO: 2114207 - RNA, 14 nt, Homo sapiens
uaaacugauuuauc

SEQ ID NO: 2114208 - RNA, 13 nt, Homo sapiens
cuccaggugcaga

SEQ ID NO: 2114209 - RNA, 13 nt, Homo sapiens
cuucugaagguaa

SEQ ID NO: 2114210 - RNA, 23 nt, Homo sapiens
aaaucuuuuaucaacuguauacu

SEQ ID NO: 2114211 - RNA, 14 nt, Homo sapiens
ucccuccuuuucac

SEQ ID NO: 2114212 - RNA, 21 nt, Homo sapiens
guuucuugacaauggggucag

SEQ ID NO: 2114213 - RNA, 20 nt, Homo sapiens
caggguuucaccauguuggc

SEQ ID NO: 2114214 - RNA, 15 nt, Homo sapiens
ggcacacacugacca

SEQ ID NO: 2114215 - RNA, 13 nt, Homo sapiens
uagcaacuuugau

SEQ ID NO: 2114216 - RNA, 20 nt, Homo sapiens
acuucagaagcaaacaauau

SEQ ID NO: 2114217 - RNA, 16 nt, Homo sapiens
accgaguggcugucau

SEQ ID NO: 2114218 - RNA, 21 nt, Homo sapiens
cuaaaaagagacugugccaug

SEQ ID NO: 2114219 - RNA, 16 nt, Homo sapiens
ucacagcuaguuugag

SEQ ID NO: 2114220 - RNA, 17 nt, Homo sapiens
auugacacacagcacuc

SEQ ID NO: 2114221 - RNA, 19 nt, Homo sapiens
aaucacuucuccaaucagu

SEQ ID NO: 2114222 - RNA, 21 nt, Homo sapiens
ucaauaaaauagugacauaaa

SEQ ID NO: 2114223 - RNA, 14 nt, Homo sapiens
cacuguucaucuca

SEQ ID NO: 2114224 - RNA, 18 nt, Homo sapiens
ggcauuaggaguguuuca

SEQ ID NO: 2114225 - RNA, 23 nt, Homo sapiens
ccugaauucaguugcuuugccca

SEQ ID NO: 2114226 - RNA, 20 nt, Homo sapiens
cagcuccagaauaccuucuu

SEQ ID NO: 2114227 - RNA, 20 nt, Homo sapiens
auuaaaaccaucuggcagac

SEQ ID NO: 2114228 - RNA, 18 nt, Homo sapiens
gccuucuguggccucuug

SEQ ID NO: 2114229 - RNA, 18 nt, Homo sapiens
uauggcagaggugcaaga

SEQ ID NO: 2114230 - RNA, 16 nt, Homo sapiens
ugcaugauacuaucug

SEQ ID NO: 2114231 - RNA, 13 nt, Homo sapiens
agcacuugaaaau

SEQ ID NO: 2114232 - RNA, 11 nt, Homo sapiens
accucccugac

SEQ ID NO: 2114233 - RNA, 15 nt, Homo sapiens
auuccccuacaucaa

SEQ ID NO: 2114234 - RNA, 18 nt, Homo sapiens
aauaaacaagucaaagac

SEQ ID NO: 2114235 - RNA, 18 nt, Homo sapiens
gcuccugggggaugcucu

SEQ ID NO: 2114236 - RNA, 17 nt, Homo sapiens
caacccggcacugcccu

SEQ ID NO: 2114237 - RNA, 16 nt, Homo sapiens
auaguuuugaauccuu

SEQ ID NO: 2114238 - RNA, 16 nt, Homo sapiens
auauuuaagaagccaa

SEQ ID NO: 2114239 - RNA, 16 nt, Homo sapiens
gccuugggcuuucccg

SEQ ID NO: 2114240 - RNA, 13 nt, Homo sapiens
ugagaugauggaa

SEQ ID NO: 2114241 - RNA, 20 nt, Homo sapiens
ugccaguuguuaaaaugagc

SEQ ID NO: 2114242 - RNA, 18 nt, Homo sapiens
aaaaugauguauguugaa

SEQ ID NO: 2114243 - RNA, 12 nt, Homo sapiens
uggcucaugccu

SEQ ID NO: 2114244 - RNA, 18 nt, Homo sapiens
gccagggucucgucagga

SEQ ID NO: 2114245 - RNA, 19 nt, Homo sapiens
aguuaguaggauaugccug

SEQ ID NO: 2114246 - RNA, 15 nt, Homo sapiens
auuuucacagcacua

SEQ ID NO: 2114247 - RNA, 14 nt, Homo sapiens
agaaauccauaucu

SEQ ID NO: 2114248 - RNA, 22 nt, Homo sapiens
gcugauguuuauguacuguaaa

SEQ ID NO: 2114249 - RNA, 18 nt, Homo sapiens
uagacacuacaacauaug

SEQ ID NO: 2114250 - RNA, 12 nt, Homo sapiens
ggucuagccuau

SEQ ID NO: 2114251 - RNA, 15 nt, Homo sapiens
auauagaaccaugaa

SEQ ID NO: 2114252 - RNA, 19 nt, Homo sapiens
aucccugucauuuuuaaca

SEQ ID NO: 2114253 - RNA, 21 nt, Homo sapiens
ucaaaauccuuccaaagaauu

SEQ ID NO: 2114254 - RNA, 18 nt, Homo sapiens
gucuacucuuaagccauc

SEQ ID NO: 2114255 - RNA, 15 nt, Homo sapiens
uuccccgaugugagc

SEQ ID NO: 2114256 - RNA, 15 nt, Homo sapiens
ggcacccuuagccac

SEQ ID NO: 2114257 - RNA, 15 nt, Homo sapiens
ucaaugguacucuaa

SEQ ID NO: 2114258 - RNA, 17 nt, Homo sapiens
aaccuggacacucucuu

SEQ ID NO: 2114259 - RNA, 12 nt, Homo sapiens
ucccuaccuccu

SEQ ID NO: 2114260 - RNA, 12 nt, Homo sapiens
acacuaccacau

SEQ ID NO: 2114261 - RNA, 16 nt, Homo sapiens
uccaccugugcugcug

SEQ ID NO: 2114262 - RNA, 22 nt, Homo sapiens
agagugcaagccccugcuccag

SEQ ID NO: 2114263 - RNA, 18 nt, Homo sapiens
cgugaaauucuauugaaa

SEQ ID NO: 2114264 - RNA, 12 nt, Homo sapiens
ucucauucaaag

SEQ ID NO: 2114265 - RNA, 21 nt, Homo sapiens
augaaugcagauuacacugau

SEQ ID NO: 2114266 - RNA, 15 nt, Homo sapiens
guauuaaacucuaau

SEQ ID NO: 2114267 - RNA, 15 nt, Homo sapiens
aaacuuguacuuaca

SEQ ID NO: 2114268 - RNA, 19 nt, Homo sapiens
cuuucccuaaagaacauac

SEQ ID NO: 2114269 - RNA, 17 nt, Homo sapiens
uucaccaaaugaugcca

SEQ ID NO: 2114270 - RNA, 21 nt, Homo sapiens
ucgggaugccuuuuuuuccau

SEQ ID NO: 2114271 - RNA, 13 nt, Homo sapiens
aagccaguggcag

SEQ ID NO: 2114272 - RNA, 20 nt, Homo sapiens
aaaaccacuggaaaguuuau

SEQ ID NO: 2114273 - RNA, 17 nt, Homo sapiens
caaggccucccacagug

SEQ ID NO: 2114274 - RNA, 14 nt, Homo sapiens
uauauucacuuuca

SEQ ID NO: 2114275 - RNA, 21 nt, Homo sapiens
cugccuuuccauccauggcca

SEQ ID NO: 2114276 - RNA, 17 nt, Homo sapiens
cacagaucaagugaaca

SEQ ID NO: 2114277 - RNA, 15 nt, Homo sapiens
gcacuauucuuugua

SEQ ID NO: 2114278 - RNA, 14 nt, Homo sapiens
ucaucaacaaucac

SEQ ID NO: 2114279 - RNA, 22 nt, Homo sapiens
cauugaguaaaguuuuaaaaag

SEQ ID NO: 2114280 - RNA, 22 nt, Homo sapiens
ggaaacggucacgagacccaga

SEQ ID NO: 2114281 - RNA, 23 nt, Homo sapiens
caucucaaaaaaaaacaacuauu

SEQ ID NO: 2114282 - RNA, 18 nt, Homo sapiens
gaccuugacagagcagcu

SEQ ID NO: 2114283 - RNA, 11 nt, Homo sapiens
cuccacuaccc

SEQ ID NO: 2114284 - RNA, 17 nt, Homo sapiens
ggcagacucaccaccua

SEQ ID NO: 2114285 - RNA, 22 nt, Homo sapiens
gcacaagucaccaugccuggcu

SEQ ID NO: 2114286 - RNA, 17 nt, Homo sapiens
aggaaccgaggacucca

SEQ ID NO: 2114287 - RNA, 18 nt, Homo sapiens
uacccuuuagacuguagc

SEQ ID NO: 2114288 - RNA, 13 nt, Homo sapiens
gacuggugcugca

SEQ ID NO: 2114289 - RNA, 19 nt, Homo sapiens
aaauagcaagagugugaaa

SEQ ID NO: 2114290 - RNA, 15 nt, Homo sapiens
cccuacucaccugag

SEQ ID NO: 2114291 - RNA, 18 nt, Homo sapiens
aaagccaaacucugccag

SEQ ID NO: 2114292 - RNA, 22 nt, Homo sapiens
acugugggauguguucuucuuu

SEQ ID NO: 2114293 - RNA, 18 nt, Homo sapiens
agugugaccccacugcca

SEQ ID NO: 2114294 - RNA, 21 nt, Homo sapiens
augaucucucuagcuuuguca

SEQ ID NO: 2114295 - RNA, 14 nt, Homo sapiens
auaaacauaugcaa

SEQ ID NO: 2114296 - RNA, 15 nt, Homo sapiens
gauaucaugccccug

SEQ ID NO: 2114297 - RNA, 14 nt, Homo sapiens
agauguguucuccu

SEQ ID NO: 2114298 - RNA, 20 nt, Homo sapiens
uaaacauugguauauuucca

SEQ ID NO: 2114299 - RNA, 17 nt, Homo sapiens
cuacaacaugauagaac

SEQ ID NO: 2114300 - RNA, 20 nt, Homo sapiens
aacccucccaaaacagggaa

SEQ ID NO: 2114301 - RNA, 13 nt, Homo sapiens
ccaaaacauugau

SEQ ID NO: 2114302 - RNA, 20 nt, Homo sapiens
auugcgccauugcacuccag

SEQ ID NO: 2114303 - RNA, 23 nt, Homo sapiens
uuuugcagaauuaacuauaacaa

SEQ ID NO: 2114304 - RNA, 19 nt, Homo sapiens
gguuucccuguguggacca

SEQ ID NO: 2114305 - RNA, 12 nt, Homo sapiens
auuugcacugaa

SEQ ID NO: 2114306 - RNA, 16 nt, Homo sapiens
gaaaaugucacuguua

SEQ ID NO: 2114307 - RNA, 18 nt, Homo sapiens
auuccauaauacauaaca

SEQ ID NO: 2114308 - RNA, 13 nt, Homo sapiens
uugaagugcacau

SEQ ID NO: 2114309 - RNA, 16 nt, Homo sapiens
ccuuggggauucuucc

SEQ ID NO: 2114310 - RNA, 18 nt, Homo sapiens
aaucauacaaauacuauc

SEQ ID NO: 2114311 - RNA, 15 nt, Homo sapiens
aaggagagucuugca

SEQ ID NO: 2114312 - RNA, 22 nt, Homo sapiens
gacaggacccugggaccacaga

SEQ ID NO: 2114313 - RNA, 16 nt, Homo sapiens
acccagcaguucuguu

SEQ ID NO: 2114314 - RNA, 14 nt, Homo sapiens
guaaguaaugauac

SEQ ID NO: 2114315 - RNA, 16 nt, Homo sapiens
ugaagugagaacucca

SEQ ID NO: 2114316 - RNA, 20 nt, Homo sapiens
aauuuuugaacaacuguugg

SEQ ID NO: 2114317 - RNA, 13 nt, Homo sapiens
cagugacuucuuu

SEQ ID NO: 2114318 - RNA, 14 nt, Homo sapiens
aaaggcugcuguga

SEQ ID NO: 2114319 - RNA, 20 nt, Homo sapiens
gacagucucaagcacuaaaa

SEQ ID NO: 2114320 - RNA, 17 nt, Homo sapiens
ggcuuuuuccaucucaa

SEQ ID NO: 2114321 - RNA, 16 nt, Homo sapiens
uaguggcauccauuuc

SEQ ID NO: 2114322 - RNA, 19 nt, Homo sapiens
gagacugcuacagugcaua

SEQ ID NO: 2114323 - RNA, 22 nt, Homo sapiens
aauugauuuuuaaacagcaggu

SEQ ID NO: 2114324 - RNA, 17 nt, Homo sapiens
auuggcuuaaguaugcu

SEQ ID NO: 2114325 - RNA, 15 nt, Homo sapiens
ccucugccugcauuc

SEQ ID NO: 2114326 - RNA, 19 nt, Homo sapiens
cuacgugcgcucugccauu

SEQ ID NO: 2114327 - RNA, 13 nt, Homo sapiens
uggaagcaaagac

SEQ ID NO: 2114328 - RNA, 22 nt, Homo sapiens
aauugugguuuauugaauguga

SEQ ID NO: 2114329 - RNA, 18 nt, Homo sapiens
gcauuuucugcaucucca

SEQ ID NO: 2114330 - RNA, 19 nt, Homo sapiens
ugucccacgugucuuccac

SEQ ID NO: 2114331 - RNA, 15 nt, Homo sapiens
cuuuacuaauggugu

SEQ ID NO: 2114332 - RNA, 14 nt, Homo sapiens
augauugugcacau

SEQ ID NO: 2114333 - RNA, 22 nt, Homo sapiens
uccuguaaaauaugaaauuaua

SEQ ID NO: 2114334 - RNA, 21 nt, Homo sapiens
gccaagauugcaccacugcuc

SEQ ID NO: 2114335 - RNA, 21 nt, Homo sapiens
acucuuccccauaaucacuga

SEQ ID NO: 2114336 - RNA, 17 nt, Homo sapiens
aagcagaucauuuccca

SEQ ID NO: 2114337 - RNA, 14 nt, Homo sapiens
aggucucacacucc

SEQ ID NO: 2114338 - RNA, 14 nt, Homo sapiens
gggugagccaagga

SEQ ID NO: 2114339 - RNA, 17 nt, Homo sapiens
guacucuuuaacauaca

SEQ ID NO: 2114340 - RNA, 22 nt, Homo sapiens
caagaaccgguuuccaaagaca

SEQ ID NO: 2114341 - RNA, 14 nt, Homo sapiens
gcugcuggagccca

SEQ ID NO: 2114342 - RNA, 17 nt, Homo sapiens
agcugagugcugaaaua

SEQ ID NO: 2114343 - RNA, 19 nt, Homo sapiens
auaaaacagaauauugaca

SEQ ID NO: 2114344 - RNA, 20 nt, Homo sapiens
uccuaaucaagagucucucc

SEQ ID NO: 2114345 - RNA, 23 nt, Homo sapiens
ccuggcaggugccccgugguaca

SEQ ID NO: 2114346 - RNA, 13 nt, Homo sapiens
uucuccuccaugg

SEQ ID NO: 2114347 - RNA, 18 nt, Homo sapiens
aguuggggguguggcucu

SEQ ID NO: 2114348 - RNA, 12 nt, Homo sapiens
cauggucaagua

SEQ ID NO: 2114349 - RNA, 15 nt, Homo sapiens
ucgugugcugcugcu

SEQ ID NO: 2114350 - RNA, 20 nt, Homo sapiens
cuaguagcggaucucacuca

SEQ ID NO: 2114351 - RNA, 19 nt, Homo sapiens
auuugguuuuccuguauag

SEQ ID NO: 2114352 - RNA, 20 nt, Homo sapiens
cagaaaugauuacuaaggaa

SEQ ID NO: 2114353 - RNA, 21 nt, Homo sapiens
augcggaccaaacuacuucau

SEQ ID NO: 2114354 - RNA, 16 nt, Homo sapiens
ucaauaccgcucagua

SEQ ID NO: 2114355 - RNA, 18 nt, Homo sapiens
acccagggaacagccacu

SEQ ID NO: 2114356 - RNA, 22 nt, Homo sapiens
aagcaacuuuacugagacaaug

SEQ ID NO: 2114357 - RNA, 14 nt, Homo sapiens
gggaaagaaaggga

SEQ ID NO: 2114358 - RNA, 14 nt, Homo sapiens
gaaauaaccaugaa

SEQ ID NO: 2114359 - RNA, 14 nt, Homo sapiens
aguaauggcauuuu

SEQ ID NO: 2114360 - RNA, 22 nt, Homo sapiens
gcuguaaacuaccauguggcca

SEQ ID NO: 2114361 - RNA, 19 nt, Homo sapiens
caacccugcccugccccac

SEQ ID NO: 2114362 - RNA, 18 nt, Homo sapiens
caggguaacugugcugaa

SEQ ID NO: 2114363 - RNA, 15 nt, Homo sapiens
gacggggacugggga

SEQ ID NO: 2114364 - RNA, 17 nt, Homo sapiens
cugaugagcacaucucu

SEQ ID NO: 2114365 - RNA, 12 nt, Homo sapiens
aaggugaacuuu

SEQ ID NO: 2114366 - RNA, 15 nt, Homo sapiens
gaguuggaguuuuau

SEQ ID NO: 2114367 - RNA, 15 nt, Homo sapiens
ggcauugagaucuac

SEQ ID NO: 2114368 - RNA, 14 nt, Homo sapiens
guaucacacuguau

SEQ ID NO: 2114369 - RNA, 16 nt, Homo sapiens
gauacauguaauucua

SEQ ID NO: 2114370 - RNA, 14 nt, Homo sapiens
aucugaagugguuc

SEQ ID NO: 2114371 - RNA, 13 nt, Homo sapiens
aggaaucaucucc

SEQ ID NO: 2114372 - RNA, 15 nt, Homo sapiens
uggugucugugacau

SEQ ID NO: 2114373 - RNA, 17 nt, Homo sapiens
caugucuacaaucugcu

SEQ ID NO: 2114374 - RNA, 16 nt, Homo sapiens
auaugauuaguaaaga

SEQ ID NO: 2114375 - RNA, 10 nt, Homo sapiens
aaaucacuuu

SEQ ID NO: 2114376 - RNA, 17 nt, Homo sapiens
gcauucuacaccuggac

SEQ ID NO: 2114377 - RNA, 17 nt, Homo sapiens
ucuacacugagguuuga

SEQ ID NO: 2114378 - RNA, 16 nt, Homo sapiens
cugaacacacacgcca

SEQ ID NO: 2114379 - RNA, 19 nt, Homo sapiens
gcagaaggugaaauggagg

SEQ ID NO: 2114380 - RNA, 21 nt, Homo sapiens
cagccaccacccacaaucaca

SEQ ID NO: 2114381 - RNA, 14 nt, Homo sapiens
uucuucaugaggcc

SEQ ID NO: 2114382 - RNA, 13 nt, Homo sapiens
auuaucaaaaagc

SEQ ID NO: 2114383 - RNA, 18 nt, Homo sapiens
acauagugcuaacaugaa

SEQ ID NO: 2114384 - RNA, 15 nt, Homo sapiens
aaaauguuaugugcu

SEQ ID NO: 2114385 - RNA, 13 nt, Homo sapiens
gagcccaguuuca

SEQ ID NO: 2114386 - RNA, 18 nt, Homo sapiens
gugucuguaggugucucu

SEQ ID NO: 2114387 - RNA, 20 nt, Homo sapiens
gagccaaguccagauuuaca

SEQ ID NO: 2114388 - RNA, 18 nt, Homo sapiens
agcuuaagugacuuccuc

SEQ ID NO: 2114389 - RNA, 21 nt, Homo sapiens
uucaucccucgggugugcuau

SEQ ID NO: 2114390 - RNA, 16 nt, Homo sapiens
gauuauaaacaaccua

SEQ ID NO: 2114391 - RNA, 21 nt, Homo sapiens
uauuggaaaggucauuguggc

SEQ ID NO: 2114392 - RNA, 19 nt, Homo sapiens
ggcuuucugggugugacug

SEQ ID NO: 2114393 - RNA, 20 nt, Homo sapiens
ccugagcccaggagguggag

SEQ ID NO: 2114394 - RNA, 13 nt, Homo sapiens
ccaaagagacugg

SEQ ID NO: 2114395 - RNA, 17 nt, Homo sapiens
gcaaaguuuacagaugu

SEQ ID NO: 2114396 - RNA, 15 nt, Homo sapiens
uagaauuuagcuuau

SEQ ID NO: 2114397 - RNA, 14 nt, Homo sapiens
gaaggcuucacucu

SEQ ID NO: 2114398 - RNA, 19 nt, Homo sapiens
agcccucccccagcaguug

SEQ ID NO: 2114399 - RNA, 12 nt, Homo sapiens
gaauaagucccu

SEQ ID NO: 2114400 - RNA, 21 nt, Homo sapiens
gaaaaaugcaagccaucucua

SEQ ID NO: 2114401 - RNA, 17 nt, Homo sapiens
ucaguuaggcagugcag

SEQ ID NO: 2114402 - RNA, 19 nt, Homo sapiens
aaacccuugagcucaagug

SEQ ID NO: 2114403 - RNA, 14 nt, Homo sapiens
cacagaaucuccau

SEQ ID NO: 2114404 - RNA, 23 nt, Homo sapiens
agcccuccucucccagugacaac

SEQ ID NO: 2114405 - RNA, 12 nt, Homo sapiens
uucuguggcuca

SEQ ID NO: 2114406 - RNA, 13 nt, Homo sapiens
ggaaagacuugaa

SEQ ID NO: 2114407 - RNA, 19 nt, Homo sapiens
gacugcagggguccacugu

SEQ ID NO: 2114408 - RNA, 16 nt, Homo sapiens
cuaaaggacucuccag

SEQ ID NO: 2114409 - RNA, 20 nt, Homo sapiens
ccucuccugggcagcugccu

SEQ ID NO: 2114410 - RNA, 18 nt, Homo sapiens
accuaaauaugagcccag

SEQ ID NO: 2114411 - RNA, 15 nt, Homo sapiens
uucuugauagccuca

SEQ ID NO: 2114412 - RNA, 13 nt, Homo sapiens
ugccuucucaggg

SEQ ID NO: 2114413 - RNA, 13 nt, Homo sapiens
uggcuucucacgg

SEQ ID NO: 2114414 - RNA, 22 nt, Homo sapiens
uaaaagcuacuauguacugccu

SEQ ID NO: 2114415 - RNA, 18 nt, Homo sapiens
auuacaagaucuuuccaa

SEQ ID NO: 2114416 - RNA, 19 nt, Homo sapiens
ggcuuuuugccaucuguga

SEQ ID NO: 2114417 - RNA, 17 nt, Homo sapiens
acucuuaaguugaucua

SEQ ID NO: 2114418 - RNA, 17 nt, Homo sapiens
aauuguacuaaagccaa

SEQ ID NO: 2114419 - RNA, 20 nt, Homo sapiens
uaagggggugcagcagugag

SEQ ID NO: 2114420 - RNA, 19 nt, Homo sapiens
aaguauuaagaauaucuaa

SEQ ID NO: 2114421 - RNA, 17 nt, Homo sapiens
aucugcauuuagcacaa

SEQ ID NO: 2114422 - RNA, 16 nt, Homo sapiens
ccagaacaggacucca

SEQ ID NO: 2114423 - RNA, 21 nt, Homo sapiens
aaggcuucuccacaaccuccu

SEQ ID NO: 2114424 - RNA, 13 nt, Homo sapiens
caacaccaugauu

SEQ ID NO: 2114425 - RNA, 15 nt, Homo sapiens
ccaaugaaaacaguc

SEQ ID NO: 2114426 - RNA, 20 nt, Homo sapiens
ugcacuccagccugagcgac

SEQ ID NO: 2114427 - RNA, 20 nt, Homo sapiens
uacacuccagccugagcaac

SEQ ID NO: 2114428 - RNA, 22 nt, Homo sapiens
aaggaggacgguuaacuuguau

SEQ ID NO: 2114429 - RNA, 17 nt, Homo sapiens
ucccaguuaacuguuaa

SEQ ID NO: 2114430 - RNA, 12 nt, Homo sapiens
aguaaagucaac

SEQ ID NO: 2114431 - RNA, 13 nt, Homo sapiens
aauccauccugcu

SEQ ID NO: 2114432 - RNA, 15 nt, Homo sapiens
aguggucgcuuacuu

SEQ ID NO: 2114433 - RNA, 16 nt, Homo sapiens
agcacacuuuuccaca

SEQ ID NO: 2114434 - RNA, 21 nt, Homo sapiens
ggcagacaucggccuccauga

SEQ ID NO: 2114435 - RNA, 12 nt, Homo sapiens
cacugcauuugc

SEQ ID NO: 2114436 - RNA, 21 nt, Homo sapiens
aaacgcaaaaccugcaguucc

SEQ ID NO: 2114437 - RNA, 15 nt, Homo sapiens
gaggggaaugggagg

SEQ ID NO: 2114438 - RNA, 17 nt, Homo sapiens
ucuuggauuagccuuug

SEQ ID NO: 2114439 - RNA, 13 nt, Homo sapiens
uuacagacaggaa

SEQ ID NO: 2114440 - RNA, 13 nt, Homo sapiens
ucaccuucuaguu

SEQ ID NO: 2114441 - RNA, 21 nt, Homo sapiens
gcuguggcauuguugaugcuc

SEQ ID NO: 2114442 - RNA, 15 nt, Homo sapiens
cuagaucaacagauc

SEQ ID NO: 2114443 - RNA, 15 nt, Homo sapiens
cuucccaaacuccca

SEQ ID NO: 2114444 - RNA, 15 nt, Homo sapiens
accugccacucugcc

SEQ ID NO: 2114445 - RNA, 23 nt, Homo sapiens
aaguagauuggcugggcaaaaga

SEQ ID NO: 2114446 - RNA, 17 nt, Homo sapiens
acugugauacaguuuug

SEQ ID NO: 2114447 - RNA, 22 nt, Homo sapiens
agagaugauucggauuugacaa

SEQ ID NO: 2114448 - RNA, 16 nt, Homo sapiens
ugaagguaacugagag

SEQ ID NO: 2114449 - RNA, 22 nt, Homo sapiens
aauaucccuacauguauugcac

SEQ ID NO: 2114450 - RNA, 19 nt, Homo sapiens
gcucguuucuuagaccucu

SEQ ID NO: 2114451 - RNA, 20 nt, Homo sapiens
ucugcaaugggcacugggau

SEQ ID NO: 2114452 - RNA, 23 nt, Homo sapiens
uaauuuuguuuauauuuucccau

SEQ ID NO: 2114453 - RNA, 13 nt, Homo sapiens
caggaguuuugcc

SEQ ID NO: 2114454 - RNA, 19 nt, Homo sapiens
ugacuguguguugugaaau

SEQ ID NO: 2114455 - RNA, 18 nt, Homo sapiens
ugaacuacagacuaaaga

SEQ ID NO: 2114456 - RNA, 17 nt, Homo sapiens
uccagucuggaugacag

SEQ ID NO: 2114457 - RNA, 22 nt, Homo sapiens
acuucgaaaacuuuaacaaaca

SEQ ID NO: 2114458 - RNA, 18 nt, Homo sapiens
aucuuaguauuugcauau

SEQ ID NO: 2114459 - RNA, 16 nt, Homo sapiens
cuucucacacuggagg

SEQ ID NO: 2114460 - RNA, 15 nt, Homo sapiens
ucauauuauuauuaa

SEQ ID NO: 2114461 - RNA, 14 nt, Homo sapiens
augauggcacugag

SEQ ID NO: 2114462 - RNA, 14 nt, Homo sapiens
ccuguggccugaag

SEQ ID NO: 2114463 - RNA, 18 nt, Homo sapiens
uuugacauuaauuaugaa

SEQ ID NO: 2114464 - RNA, 13 nt, Homo sapiens
uucagcagucagu

SEQ ID NO: 2114465 - RNA, 15 nt, Homo sapiens
uuccucacuuugaag

SEQ ID NO: 2114466 - RNA, 21 nt, Homo sapiens
gcaucaauuuucaaacaaccg

SEQ ID NO: 2114467 - RNA, 22 nt, Homo sapiens
gauaauuuauuuuuaccuucac

SEQ ID NO: 2114468 - RNA, 13 nt, Homo sapiens
cagauuuaucuaa

SEQ ID NO: 2114469 - RNA, 21 nt, Homo sapiens
cuccugcacacagggcagucc

SEQ ID NO: 2114470 - RNA, 13 nt, Homo sapiens
ugguuacauauca

SEQ ID NO: 2114471 - RNA, 19 nt, Homo sapiens
auucacauccaaugcauag

SEQ ID NO: 2114472 - RNA, 17 nt, Homo sapiens
ucuucuuauucaugcuu

SEQ ID NO: 2114473 - RNA, 18 nt, Homo sapiens
gacauugcggacagccac

SEQ ID NO: 2114474 - RNA, 17 nt, Homo sapiens
uuuugccugcaagagaa

SEQ ID NO: 2114475 - RNA, 17 nt, Homo sapiens
uaugugcaacugacaga

SEQ ID NO: 2114476 - RNA, 20 nt, Homo sapiens
ugucguaggaaaaccaugac

SEQ ID NO: 2114477 - RNA, 19 nt, Homo sapiens
uggauacaagguuuggcaa

SEQ ID NO: 2114478 - RNA, 12 nt, Homo sapiens
uacgaagacaaa

SEQ ID NO: 2114479 - RNA, 14 nt, Homo sapiens
ccaugacauugcau

SEQ ID NO: 2114480 - RNA, 14 nt, Homo sapiens
cucuaaacauuuca

SEQ ID NO: 2114481 - RNA, 19 nt, Homo sapiens
uauuaaccucagcauuuac

SEQ ID NO: 2114482 - RNA, 20 nt, Homo sapiens
uugcagugagcugagaucac

SEQ ID NO: 2114483 - RNA, 16 nt, Homo sapiens
gcagggagugucugca

SEQ ID NO: 2114484 - RNA, 17 nt, Homo sapiens
cugagauauauuugcua

SEQ ID NO: 2114485 - RNA, 16 nt, Homo sapiens
caguacccucucagcu

SEQ ID NO: 2114486 - RNA, 22 nt, Homo sapiens
cucagcacuguuuucaucacaa

SEQ ID NO: 2114487 - RNA, 19 nt, Homo sapiens
agggacuccaugcugccag

SEQ ID NO: 2114488 - RNA, 13 nt, Homo sapiens
cugagcugugcag

SEQ ID NO: 2114489 - RNA, 19 nt, Homo sapiens
uagucucugaacuagguga

SEQ ID NO: 2114490 - RNA, 22 nt, Homo sapiens
uugucaugguuacaaacuacag

SEQ ID NO: 2114491 - RNA, 15 nt, Homo sapiens
agucaggcuucucuu

SEQ ID NO: 2114492 - RNA, 15 nt, Homo sapiens
uuucuggugccauuu

SEQ ID NO: 2114493 - RNA, 15 nt, Homo sapiens
aaauuccucuguaga

SEQ ID NO: 2114494 - RNA, 22 nt, Homo sapiens
uauuccauauucauguaaacaa

SEQ ID NO: 2114495 - RNA, 18 nt, Homo sapiens
uguuucugaucugaugca

SEQ ID NO: 2114496 - RNA, 16 nt, Homo sapiens
acaagauaagcuucca

SEQ ID NO: 2114497 - RNA, 18 nt, Homo sapiens
acuacauauuugcacuga

SEQ ID NO: 2114498 - RNA, 17 nt, Homo sapiens
cuguauuuugauauaau

SEQ ID NO: 2114499 - RNA, 18 nt, Homo sapiens
ucugggauuaagggcaaa

SEQ ID NO: 2114500 - RNA, 23 nt, Homo sapiens
ugcucagcacaggccugggaccu

SEQ ID NO: 2114501 - RNA, 23 nt, Homo sapiens
cugugcuucgacuacugcuccug

SEQ ID NO: 2114502 - RNA, 15 nt, Homo sapiens
uugggaacaggguua

SEQ ID NO: 2114503 - RNA, 17 nt, Homo sapiens
aggacugugaccaaagc

SEQ ID NO: 2114504 - RNA, 21 nt, Homo sapiens
aauuuaggaccaauaccuccu

SEQ ID NO: 2114505 - RNA, 14 nt, Homo sapiens
agaauguuguacuu

SEQ ID NO: 2114506 - RNA, 19 nt, Homo sapiens
acuaauaaacuguguaguu

SEQ ID NO: 2114507 - RNA, 18 nt, Homo sapiens
ccuuccccagacccagag

SEQ ID NO: 2114508 - RNA, 14 nt, Homo sapiens
aaacccccagugua

SEQ ID NO: 2114509 - RNA, 23 nt, Homo sapiens
ccaaaccaauucaccaacacagu

SEQ ID NO: 2114510 - RNA, 18 nt, Homo sapiens
gccaucaaaaugcuuuuu

SEQ ID NO: 2114511 - RNA, 19 nt, Homo sapiens
auuuuucucuuuuaaucua

SEQ ID NO: 2114512 - RNA, 15 nt, Homo sapiens
auauaaacacuauau

SEQ ID NO: 2114513 - RNA, 19 nt, Homo sapiens
agagacagcaggucucaug

SEQ ID NO: 2114514 - RNA, 18 nt, Homo sapiens
uccuggagaaaagggaug

SEQ ID NO: 2114515 - RNA, 21 nt, Homo sapiens
ugcugaaggagaaaaagacag

SEQ ID NO: 2114516 - RNA, 16 nt, Homo sapiens
ccugucuuuacuuuaa

SEQ ID NO: 2114517 - RNA, 18 nt, Homo sapiens
gcaugaaaaacauuccac

SEQ ID NO: 2114518 - RNA, 23 nt, Homo sapiens
aacaagauuuuaaagacauguag

SEQ ID NO: 2114519 - RNA, 14 nt, Homo sapiens
cuuucccucaucca

SEQ ID NO: 2114520 - RNA, 21 nt, Homo sapiens
agagacagcucuucuacuacc

SEQ ID NO: 2114521 - RNA, 20 nt, Homo sapiens
ugccagcccaacugugagac

SEQ ID NO: 2114522 - RNA, 16 nt, Homo sapiens
augcaacauacgggaa

SEQ ID NO: 2114523 - RNA, 16 nt, Homo sapiens
cagcugguaaucuugc

SEQ ID NO: 2114524 - RNA, 19 nt, Homo sapiens
cuuauguuaacugacaagc

SEQ ID NO: 2114525 - RNA, 20 nt, Homo sapiens
uugucagacauaaagccaug

SEQ ID NO: 2114526 - RNA, 14 nt, Homo sapiens
caaacacagucacu

SEQ ID NO: 2114527 - RNA, 18 nt, Homo sapiens
aaccuucuuuucaaugca

SEQ ID NO: 2114528 - RNA, 19 nt, Homo sapiens
ccccuccucucugccgcaa

SEQ ID NO: 2114529 - RNA, 18 nt, Homo sapiens
gucaccggucagugccuu

SEQ ID NO: 2114530 - RNA, 21 nt, Homo sapiens
cgccugugggcgcauacuaca

SEQ ID NO: 2114531 - RNA, 16 nt, Homo sapiens
cuuauccccagcuguu

SEQ ID NO: 2114532 - RNA, 13 nt, Homo sapiens
ugcaaugagccau

SEQ ID NO: 2114533 - RNA, 20 nt, Homo sapiens
uggcauuuucuaugguuaca

SEQ ID NO: 2114534 - RNA, 20 nt, Homo sapiens
ggagaguacagugagccaag

SEQ ID NO: 2114535 - RNA, 16 nt, Homo sapiens
cuuggggacaucucau

SEQ ID NO: 2114536 - RNA, 16 nt, Homo sapiens
uccugccgcagugauc

SEQ ID NO: 2114537 - RNA, 16 nt, Homo sapiens
caguauugagcugccu

SEQ ID NO: 2114538 - RNA, 17 nt, Homo sapiens
uuaucguuaagcacaag

SEQ ID NO: 2114539 - RNA, 24 nt, Homo sapiens
uacagaaucuaacugguggacaug

SEQ ID NO: 2114540 - RNA, 17 nt, Homo sapiens
acccugcaaaaugagac

SEQ ID NO: 2114541 - RNA, 19 nt, Homo sapiens
cuagugaccuuaaacugaa

SEQ ID NO: 2114542 - RNA, 23 nt, Homo sapiens
uucauggauauguuauacugaac

SEQ ID NO: 2114543 - RNA, 15 nt, Homo sapiens
aaagacaauggaaac

SEQ ID NO: 2114544 - RNA, 19 nt, Homo sapiens
accagucagggacagcagc

SEQ ID NO: 2114545 - RNA, 15 nt, Homo sapiens
uuaauucacagaaua

SEQ ID NO: 2114546 - RNA, 16 nt, Homo sapiens
ucuggcucagcccggg

SEQ ID NO: 2114547 - RNA, 18 nt, Homo sapiens
auccauauuuccuauugu

SEQ ID NO: 2114548 - RNA, 15 nt, Homo sapiens
cacgcugaaggcuua

SEQ ID NO: 2114549 - RNA, 17 nt, Homo sapiens
uggggccccauuugcca

SEQ ID NO: 2114550 - RNA, 22 nt, Homo sapiens
caguuuuuaacaauaaauucuu

SEQ ID NO: 2114551 - RNA, 17 nt, Homo sapiens
gauaccuuccaucucaa

SEQ ID NO: 2114552 - RNA, 10 nt, Homo sapiens
aacagaauug

SEQ ID NO: 2114553 - RNA, 20 nt, Homo sapiens
gcuuuggacacacacagcuu

SEQ ID NO: 2114554 - RNA, 13 nt, Homo sapiens
cacacuacuguau

SEQ ID NO: 2114555 - RNA, 18 nt, Homo sapiens
agacagauuuguucauag

SEQ ID NO: 2114556 - RNA, 13 nt, Homo sapiens
gaaaggagcugcu

SEQ ID NO: 2114557 - RNA, 13 nt, Homo sapiens
uucuaaucaaagc

SEQ ID NO: 2114558 - RNA, 13 nt, Homo sapiens
ugcucucauuuca

SEQ ID NO: 2114559 - RNA, 17 nt, Homo sapiens
cccuaccaaaaauugcc

SEQ ID NO: 2114560 - RNA, 20 nt, Homo sapiens
guaucucaaaucugcuuuca

SEQ ID NO: 2114561 - RNA, 20 nt, Homo sapiens
cuggccucucuagcacaauu

SEQ ID NO: 2114562 - RNA, 18 nt, Homo sapiens
uaaagaagcuaaccugcc

SEQ ID NO: 2114563 - RNA, 17 nt, Homo sapiens
cacacguggugaccuca

SEQ ID NO: 2114564 - RNA, 14 nt, Homo sapiens
gcaaguuuacuuuu

SEQ ID NO: 2114565 - RNA, 15 nt, Homo sapiens
gagaugcugggccag

SEQ ID NO: 2114566 - RNA, 11 nt, Homo sapiens
ccuaagcacuu

SEQ ID NO: 2114567 - RNA, 16 nt, Homo sapiens
cauucuauaagcuauu

SEQ ID NO: 2114568 - RNA, 14 nt, Homo sapiens
uggcaguacagagu

SEQ ID NO: 2114569 - RNA, 19 nt, Homo sapiens
ccauacaguguacucuuau

SEQ ID NO: 2114570 - RNA, 17 nt, Homo sapiens
aacauuucacaguauuu

SEQ ID NO: 2114571 - RNA, 20 nt, Homo sapiens
ugaugauuuuaacaguuuua

SEQ ID NO: 2114572 - RNA, 21 nt, Homo sapiens
ccuuuggacaaaugcauuuag

SEQ ID NO: 2114573 - RNA, 23 nt, Homo sapiens
uaaaagcaaaaggauauucacuu

SEQ ID NO: 2114574 - RNA, 16 nt, Homo sapiens
ccuggcucagccucaa

SEQ ID NO: 2114575 - RNA, 14 nt, Homo sapiens
gcagugcucaccca

SEQ ID NO: 2114576 - RNA, 14 nt, Homo sapiens
cacgcacugcacug

SEQ ID NO: 2114577 - RNA, 15 nt, Homo sapiens
cucucuggcuuccau

SEQ ID NO: 2114578 - RNA, 18 nt, Homo sapiens
agcauuaucuuaucauuu

SEQ ID NO: 2114579 - RNA, 13 nt, Homo sapiens
gugcuggugaccc

SEQ ID NO: 2114580 - RNA, 20 nt, Homo sapiens
caugcuuugugccaucacug

SEQ ID NO: 2114581 - RNA, 16 nt, Homo sapiens
uaugagcaaguuuaua

SEQ ID NO: 2114582 - RNA, 18 nt, Homo sapiens
acuacuagugugacuccu

SEQ ID NO: 2114583 - RNA, 19 nt, Homo sapiens
gcccgcugccugcacugga

SEQ ID NO: 2114584 - RNA, 17 nt, Homo sapiens
ccaacuucaauuuacuu

SEQ ID NO: 2114585 - RNA, 20 nt, Homo sapiens
cuuaauccaauauuuugccu

SEQ ID NO: 2114586 - RNA, 18 nt, Homo sapiens
aguuguuuuccugcuuua

SEQ ID NO: 2114587 - RNA, 11 nt, Homo sapiens
uacaugugauu

SEQ ID NO: 2114588 - RNA, 18 nt, Homo sapiens
aagcauucuccccagugu

SEQ ID NO: 2114589 - RNA, 18 nt, Homo sapiens
ugccaggaggaacaaaga

SEQ ID NO: 2114590 - RNA, 22 nt, Homo sapiens
cagagcauugcuauuuaucuca

SEQ ID NO: 2114591 - RNA, 15 nt, Homo sapiens
uacauuaauuaccuu

SEQ ID NO: 2114592 - RNA, 15 nt, Homo sapiens
uuuccuaaaagugua

SEQ ID NO: 2114593 - RNA, 19 nt, Homo sapiens
gaggcugcuguggggacca

SEQ ID NO: 2114594 - RNA, 19 nt, Homo sapiens
gaguauggccacugcccca

SEQ ID NO: 2114595 - RNA, 21 nt, Homo sapiens
ucccuuggggaagaagggaac

SEQ ID NO: 2114596 - RNA, 21 nt, Homo sapiens
ugcugcaccucucuucugcac

SEQ ID NO: 2114597 - RNA, 16 nt, Homo sapiens
acaaugguagcucuga

SEQ ID NO: 2114598 - RNA, 17 nt, Homo sapiens
aucgccacaaacucuau

SEQ ID NO: 2114599 - RNA, 21 nt, Homo sapiens
uuagaaagaaaauuauauucu

SEQ ID NO: 2114600 - RNA, 14 nt, Homo sapiens
uaagcccucaggag

SEQ ID NO: 2114601 - RNA, 18 nt, Homo sapiens
gggccaccaugcacucaa

SEQ ID NO: 2114602 - RNA, 16 nt, Homo sapiens
cuauuuuuguacaaaa

SEQ ID NO: 2114603 - RNA, 24 nt, Homo sapiens
acacugaacuccuauuugaccaga

SEQ ID NO: 2114604 - RNA, 18 nt, Homo sapiens
ugaggaggauguauguca

SEQ ID NO: 2114605 - RNA, 20 nt, Homo sapiens
aagcgauccuaucaccucag

SEQ ID NO: 2114606 - RNA, 15 nt, Homo sapiens
gauccaguugcacua

SEQ ID NO: 2114607 - RNA, 18 nt, Homo sapiens
uuguggaggcagugucau

SEQ ID NO: 2114608 - RNA, 20 nt, Homo sapiens
gagggcaaucuuugccuuua

SEQ ID NO: 2114609 - RNA, 15 nt, Homo sapiens
ucguggguaaauaua

SEQ ID NO: 2114610 - RNA, 20 nt, Homo sapiens
aucccaaguagaaucucagu

SEQ ID NO: 2114611 - RNA, 16 nt, Homo sapiens
agagaugggacuagga

SEQ ID NO: 2114612 - RNA, 10 nt, Homo sapiens
agacuuccug

SEQ ID NO: 2114613 - RNA, 16 nt, Homo sapiens
acuggcagcaucuuca

SEQ ID NO: 2114614 - RNA, 20 nt, Homo sapiens
ugccaggagauggaauauca

SEQ ID NO: 2114615 - RNA, 15 nt, Homo sapiens
ccaacaauacuuugu

SEQ ID NO: 2114616 - RNA, 15 nt, Homo sapiens
ugugugaguauguau

SEQ ID NO: 2114617 - RNA, 19 nt, Homo sapiens
uugucuaagaaacauugga

SEQ ID NO: 2114618 - RNA, 15 nt, Homo sapiens
cuuaguaagugcuuu

SEQ ID NO: 2114619 - RNA, 22 nt, Homo sapiens
cacagaagcuuccugagcuuca

SEQ ID NO: 2114620 - RNA, 12 nt, Homo sapiens
gggugggaccac

SEQ ID NO: 2114621 - RNA, 22 nt, Homo sapiens
cagaguggaguugaaacugcua

SEQ ID NO: 2114622 - RNA, 13 nt, Homo sapiens
uuaugaacaucca

SEQ ID NO: 2114623 - RNA, 18 nt, Homo sapiens
ucuacaggccagcaccuu

SEQ ID NO: 2114624 - RNA, 23 nt, Homo sapiens
uagaggugcucauucauuuaaca

SEQ ID NO: 2114625 - RNA, 23 nt, Homo sapiens
acagaaaaucuuuccucuucuca

SEQ ID NO: 2114626 - RNA, 18 nt, Homo sapiens
aaagagacaaacuguaaa

SEQ ID NO: 2114627 - RNA, 23 nt, Homo sapiens
acucugcuuaaacaaagcaguau

SEQ ID NO: 2114628 - RNA, 19 nt, Homo sapiens
uuaucacgcagaucacuaa

SEQ ID NO: 2114629 - RNA, 17 nt, Homo sapiens
ucccucugcugaucuca

SEQ ID NO: 2114630 - RNA, 15 nt, Homo sapiens
aucagccucuggcca

SEQ ID NO: 2114631 - RNA, 16 nt, Homo sapiens
gggauaucuacugugg

SEQ ID NO: 2114632 - RNA, 17 nt, Homo sapiens
gagcagaugacugagaa

SEQ ID NO: 2114633 - RNA, 18 nt, Homo sapiens
aggggccaugcuguguga

SEQ ID NO: 2114634 - RNA, 11 nt, Homo sapiens
cuaaggaguaa

SEQ ID NO: 2114635 - RNA, 14 nt, Homo sapiens
gggaaccacuccca

SEQ ID NO: 2114636 - RNA, 18 nt, Homo sapiens
gggugcgcucaccugcag

SEQ ID NO: 2114637 - RNA, 23 nt, Homo sapiens
ucuaguuuuaucuuaacacugaa

SEQ ID NO: 2114638 - RNA, 21 nt, Homo sapiens
guacaguucugggguacaugu

SEQ ID NO: 2114639 - RNA, 19 nt, Homo sapiens
uauaggguguggcuccuac

SEQ ID NO: 2114640 - RNA, 18 nt, Homo sapiens
ccucucuuuaugcuugcu

SEQ ID NO: 2114641 - RNA, 19 nt, Homo sapiens
cuaagaaaauuauguauuu

SEQ ID NO: 2114642 - RNA, 16 nt, Homo sapiens
gauggccccuccacug

SEQ ID NO: 2114643 - RNA, 12 nt, Homo sapiens
acuaguaacaug

SEQ ID NO: 2114644 - RNA, 21 nt, Homo sapiens
aaguugcugcuugugaucuca

SEQ ID NO: 2114645 - RNA, 22 nt, Homo sapiens
ucucacucucccuggagcugcu

SEQ ID NO: 2114646 - RNA, 17 nt, Homo sapiens
gggugucaagugccugc

SEQ ID NO: 2114647 - RNA, 15 nt, Homo sapiens
guauauauacauaca

SEQ ID NO: 2114648 - RNA, 19 nt, Homo sapiens
uaaauguguuagcacugau

SEQ ID NO: 2114649 - RNA, 19 nt, Homo sapiens
cuuaauuuaccuguuguug

SEQ ID NO: 2114650 - RNA, 19 nt, Homo sapiens
caaucaucuccaauggaaa

SEQ ID NO: 2114651 - RNA, 12 nt, Homo sapiens
aggcugugagca

SEQ ID NO: 2114652 - RNA, 18 nt, Homo sapiens
auguuuugaaauguacca

SEQ ID NO: 2114653 - RNA, 17 nt, Homo sapiens
cugauucucuacaugcu

SEQ ID NO: 2114654 - RNA, 19 nt, Homo sapiens
ucaagacaagccuggccua

SEQ ID NO: 2114655 - RNA, 18 nt, Homo sapiens
ucaugcuuuugcuugcaa

SEQ ID NO: 2114656 - RNA, 15 nt, Homo sapiens
cugagcuugagcucc

SEQ ID NO: 2114657 - RNA, 18 nt, Homo sapiens
cuugaaacguuugcccca

SEQ ID NO: 2114658 - RNA, 23 nt, Homo sapiens
cgucagggagaggucaccagcug

SEQ ID NO: 2114659 - RNA, 18 nt, Homo sapiens
cuggagacaaggugcuaa

SEQ ID NO: 2114660 - RNA, 18 nt, Homo sapiens
aaccccugaccuacccca

SEQ ID NO: 2114661 - RNA, 13 nt, Homo sapiens
cagcccgucuucu

SEQ ID NO: 2114662 - RNA, 14 nt, Homo sapiens
uccauggugugaga

SEQ ID NO: 2114663 - RNA, 17 nt, Homo sapiens
cacuuaucccaagagaa

SEQ ID NO: 2114664 - RNA, 16 nt, Homo sapiens
cagcuucuauuagcca

SEQ ID NO: 2114665 - RNA, 16 nt, Homo sapiens
cacaagguccacuccc

SEQ ID NO: 2114666 - RNA, 12 nt, Homo sapiens
caagacagaugg

SEQ ID NO: 2114667 - RNA, 12 nt, Homo sapiens
gacuucucugaa

SEQ ID NO: 2114668 - RNA, 17 nt, Homo sapiens
gaaucuuuguaccaaaa

SEQ ID NO: 2114669 - RNA, 18 nt, Homo sapiens
ccaggccgagaugugcaa

SEQ ID NO: 2114670 - RNA, 16 nt, Homo sapiens
augcagccugcucuug

SEQ ID NO: 2114671 - RNA, 12 nt, Homo sapiens
augaaaccaaag

SEQ ID NO: 2114672 - RNA, 23 nt, Homo sapiens
aacaucuuuucuugccucugucc

SEQ ID NO: 2114673 - RNA, 17 nt, Homo sapiens
uuuuaagaagacauacu

SEQ ID NO: 2114674 - RNA, 21 nt, Homo sapiens
uuguggagcgccagcucugcc

SEQ ID NO: 2114675 - RNA, 17 nt, Homo sapiens
cagcuaagccugaugau

SEQ ID NO: 2114676 - RNA, 17 nt, Homo sapiens
gccccccaucaccagag

SEQ ID NO: 2114677 - RNA, 14 nt, Homo sapiens
uggcugccuuagaa

SEQ ID NO: 2114678 - RNA, 17 nt, Homo sapiens
gcaagugagacccuguc

SEQ ID NO: 2114679 - RNA, 20 nt, Homo sapiens
cugugcccacgugugcagac

SEQ ID NO: 2114680 - RNA, 20 nt, Homo sapiens
aacuaccagugggcauguau

SEQ ID NO: 2114681 - RNA, 12 nt, Homo sapiens
guauaugcauuc

SEQ ID NO: 2114682 - RNA, 23 nt, Homo sapiens
aaucuauuacaccuuuaucucaa

SEQ ID NO: 2114683 - RNA, 20 nt, Homo sapiens
uccuugaguccccaccagcu

SEQ ID NO: 2114684 - RNA, 18 nt, Homo sapiens
agcgucccuagcagugaa

SEQ ID NO: 2114685 - RNA, 19 nt, Homo sapiens
agagagggcugagccaugg

SEQ ID NO: 2114686 - RNA, 18 nt, Homo sapiens
gugguccaauggguguga

SEQ ID NO: 2114687 - RNA, 19 nt, Homo sapiens
guucuagcauggcauauuu

SEQ ID NO: 2114688 - RNA, 20 nt, Homo sapiens
uacaaaaccaucauuucaac

SEQ ID NO: 2114689 - RNA, 16 nt, Homo sapiens
caccccuuauccagga

SEQ ID NO: 2114690 - RNA, 15 nt, Homo sapiens
aaugaccucaaggaa

SEQ ID NO: 2114691 - RNA, 14 nt, Homo sapiens
cucuacuacacagg

SEQ ID NO: 2114692 - RNA, 15 nt, Homo sapiens
gcauucauaacagaa

SEQ ID NO: 2114693 - RNA, 20 nt, Homo sapiens
uuaagcagauggaaugcugu

SEQ ID NO: 2114694 - RNA, 17 nt, Homo sapiens
ugaagcagcacugugag

SEQ ID NO: 2114695 - RNA, 17 nt, Homo sapiens
guaggugucugccuuca

SEQ ID NO: 2114696 - RNA, 16 nt, Homo sapiens
ggaggauggcacuccg

SEQ ID NO: 2114697 - RNA, 15 nt, Homo sapiens
ugugacucagcauca

SEQ ID NO: 2114698 - RNA, 18 nt, Homo sapiens
aggggguaggagagcacu

SEQ ID NO: 2114699 - RNA, 17 nt, Homo sapiens
uuccaccaaauucugaa

SEQ ID NO: 2114700 - RNA, 13 nt, Homo sapiens
aagguuaucagug

SEQ ID NO: 2114701 - RNA, 14 nt, Homo sapiens
uguggauuggaaua

SEQ ID NO: 2114702 - RNA, 19 nt, Homo sapiens
agcccagauugugccacug

SEQ ID NO: 2114703 - RNA, 22 nt, Homo sapiens
uccacuuaccuagauucuacau

SEQ ID NO: 2114704 - RNA, 18 nt, Homo sapiens
ccaaccguucccucacag

SEQ ID NO: 2114705 - RNA, 19 nt, Homo sapiens
ucgacugcucaaccucacc

SEQ ID NO: 2114706 - RNA, 17 nt, Homo sapiens
caggagugguggaaccu

SEQ ID NO: 2114707 - RNA, 16 nt, Homo sapiens
cagcugaacagccaaa

SEQ ID NO: 2114708 - RNA, 16 nt, Homo sapiens
ugaccauuugacuguu

SEQ ID NO: 2114709 - RNA, 18 nt, Homo sapiens
uuagugccucccagaaca

SEQ ID NO: 2114710 - RNA, 21 nt, Homo sapiens
auuauaaauaaauaccaaaaa

SEQ ID NO: 2114711 - RNA, 18 nt, Homo sapiens
aaagaacccuagcacaaa

SEQ ID NO: 2114712 - RNA, 22 nt, Homo sapiens
gguaggcugcugcccugcugug

SEQ ID NO: 2114713 - RNA, 13 nt, Homo sapiens
ugaauggaagcaa

SEQ ID NO: 2114714 - RNA, 16 nt, Homo sapiens
acaccuggaccauuug

SEQ ID NO: 2114715 - RNA, 14 nt, Homo sapiens
agcaggacagacac

SEQ ID NO: 2114716 - RNA, 15 nt, Homo sapiens
cuccucaguuccuca

SEQ ID NO: 2114717 - RNA, 16 nt, Homo sapiens
auguaaucucaccuca

SEQ ID NO: 2114718 - RNA, 22 nt, Homo sapiens
uggggagcaaguguuaauaaua

SEQ ID NO: 2114719 - RNA, 18 nt, Homo sapiens
cauaaauaauuccaauag

SEQ ID NO: 2114720 - RNA, 21 nt, Homo sapiens
ccaaacacuguuucuaacuca

SEQ ID NO: 2114721 - RNA, 19 nt, Homo sapiens
uugauuuugaaccugauga

SEQ ID NO: 2114722 - RNA, 15 nt, Homo sapiens
uggaauaacucugug

SEQ ID NO: 2114723 - RNA, 14 nt, Homo sapiens
cugcaggugcugcu

SEQ ID NO: 2114724 - RNA, 23 nt, Homo sapiens
ucuuaaacacaaauuucauuucc

SEQ ID NO: 2114725 - RNA, 15 nt, Homo sapiens
cuccugucuccagca

SEQ ID NO: 2114726 - RNA, 15 nt, Homo sapiens
ugguuuugugcacau

SEQ ID NO: 2114727 - RNA, 18 nt, Homo sapiens
ggaggaaaugaaugcuga

SEQ ID NO: 2114728 - RNA, 14 nt, Homo sapiens
aucuauucucucca

SEQ ID NO: 2114729 - RNA, 17 nt, Homo sapiens
aacuacccaaaacaagc

SEQ ID NO: 2114730 - RNA, 17 nt, Homo sapiens
cauccucccauugccca

SEQ ID NO: 2114731 - RNA, 21 nt, Homo sapiens
ccuggggccuuccuggcuuug

SEQ ID NO: 2114732 - RNA, 14 nt, Homo sapiens
aacauuccuguuga

SEQ ID NO: 2114733 - RNA, 23 nt, Homo sapiens
ugcuggguccauaucacacacau

SEQ ID NO: 2114734 - RNA, 22 nt, Homo sapiens
uaucauuaaccuuaucauaaau

SEQ ID NO: 2114735 - RNA, 20 nt, Homo sapiens
uacaugcauuacugcaugca

SEQ ID NO: 2114736 - RNA, 13 nt, Homo sapiens
uacagacagacau

SEQ ID NO: 2114737 - RNA, 22 nt, Homo sapiens
ccagauaacuuucggcagguuc

SEQ ID NO: 2114738 - RNA, 18 nt, Homo sapiens
uuacauagguauauauau

SEQ ID NO: 2114739 - RNA, 22 nt, Homo sapiens
agacucaaugugcucuguaaca

SEQ ID NO: 2114740 - RNA, 13 nt, Homo sapiens
auaaacaccacac

SEQ ID NO: 2114741 - RNA, 17 nt, Homo sapiens
ggucacuuaagaaguaa

SEQ ID NO: 2114742 - RNA, 12 nt, Homo sapiens
gagcaaacagaa

SEQ ID NO: 2114743 - RNA, 23 nt, Homo sapiens
acugcaccaccgaccaacuccag

SEQ ID NO: 2114744 - RNA, 14 nt, Homo sapiens
agagugauugcagc

SEQ ID NO: 2114745 - RNA, 14 nt, Homo sapiens
caagacacagaaua

SEQ ID NO: 2114746 - RNA, 19 nt, Homo sapiens
ccucaauaagccagcaaac

SEQ ID NO: 2114747 - RNA, 22 nt, Homo sapiens
guggcuucuuaaucuuuucaca

SEQ ID NO: 2114748 - RNA, 17 nt, Homo sapiens
auaucauuuuuuuaaca

SEQ ID NO: 2114749 - RNA, 13 nt, Homo sapiens
guuccccuggaaa

SEQ ID NO: 2114750 - RNA, 18 nt, Homo sapiens
uaucauuauagcauguaa

SEQ ID NO: 2114751 - RNA, 16 nt, Homo sapiens
uccccaccaaccaaga

SEQ ID NO: 2114752 - RNA, 14 nt, Homo sapiens
cuucaagaucucau

SEQ ID NO: 2114753 - RNA, 15 nt, Homo sapiens
aaaauuagagaucau

SEQ ID NO: 2114754 - RNA, 16 nt, Homo sapiens
ugcuuuccugccuccu

SEQ ID NO: 2114755 - RNA, 22 nt, Homo sapiens
cauggcuggcagagguuucuag

SEQ ID NO: 2114756 - RNA, 20 nt, Homo sapiens
uuaauagaaauaaauuccua

SEQ ID NO: 2114757 - RNA, 13 nt, Homo sapiens
aguuacaaaaacc

SEQ ID NO: 2114758 - RNA, 19 nt, Homo sapiens
acucaguaaaauguuuaau

SEQ ID NO: 2114759 - RNA, 14 nt, Homo sapiens
ucauuauaagcuau

SEQ ID NO: 2114760 - RNA, 14 nt, Homo sapiens
ucaaauuaagcaua

SEQ ID NO: 2114761 - RNA, 14 nt, Homo sapiens
guuuucacaguucc

SEQ ID NO: 2114762 - RNA, 17 nt, Homo sapiens
auagaccuaacugugaa

SEQ ID NO: 2114763 - RNA, 15 nt, Homo sapiens
gaccugagcugggag

SEQ ID NO: 2114764 - RNA, 17 nt, Homo sapiens
aguacaaugaguguuau

SEQ ID NO: 2114765 - RNA, 17 nt, Homo sapiens
uugcaugugacucugaa

SEQ ID NO: 2114766 - RNA, 14 nt, Homo sapiens
agguugcgaugccu

SEQ ID NO: 2114767 - RNA, 21 nt, Homo sapiens
uaauauacagucaguucucau

SEQ ID NO: 2114768 - RNA, 18 nt, Homo sapiens
aauagaucuuagggugaa

SEQ ID NO: 2114769 - RNA, 18 nt, Homo sapiens
acagugccaauaaaugau

SEQ ID NO: 2114770 - RNA, 23 nt, Homo sapiens
ugaugaaaauaauuuacugugac

SEQ ID NO: 2114771 - RNA, 15 nt, Homo sapiens
gucugucaugccaaa

SEQ ID NO: 2114772 - RNA, 22 nt, Homo sapiens
cagccuggcuucaaauuguaag

SEQ ID NO: 2114773 - RNA, 14 nt, Homo sapiens
acaugccuugaaac

SEQ ID NO: 2114774 - RNA, 21 nt, Homo sapiens
aacaggcccccaugugccucu

SEQ ID NO: 2114775 - RNA, 16 nt, Homo sapiens
uucaguucuuacacau

SEQ ID NO: 2114776 - RNA, 16 nt, Homo sapiens
ucccccuaaacuguga

SEQ ID NO: 2114777 - RNA, 16 nt, Homo sapiens
agcaacucugacucuu

SEQ ID NO: 2114778 - RNA, 15 nt, Homo sapiens
acagcuguaauaaca

SEQ ID NO: 2114779 - RNA, 15 nt, Homo sapiens
auaccuguuguacac

SEQ ID NO: 2114780 - RNA, 23 nt, Homo sapiens
acauuuucguccuguagcacgcu

SEQ ID NO: 2114781 - RNA, 15 nt, Homo sapiens
cuaaugaaaccugug

SEQ ID NO: 2114782 - RNA, 19 nt, Homo sapiens
ccccgugggccauggcaau

SEQ ID NO: 2114783 - RNA, 15 nt, Homo sapiens
ugauauucuaucugu

SEQ ID NO: 2114784 - RNA, 19 nt, Homo sapiens
aguucuggcugaacacugg

SEQ ID NO: 2114785 - RNA, 23 nt, Homo sapiens
cugugaauagucugugugcacaa

SEQ ID NO: 2114786 - RNA, 23 nt, Homo sapiens
uuaugugaguguguguuugugcu

SEQ ID NO: 2114787 - RNA, 22 nt, Homo sapiens
uaaauccugucuuauuuguuca

SEQ ID NO: 2114788 - RNA, 16 nt, Homo sapiens
agccaugggucugugc

SEQ ID NO: 2114789 - RNA, 14 nt, Homo sapiens
caggcuugcauuaa

SEQ ID NO: 2114790 - RNA, 21 nt, Homo sapiens
ugcccaggcuggagugcaaug

SEQ ID NO: 2114791 - RNA, 21 nt, Homo sapiens
uaacaagcugucuacuggaca

SEQ ID NO: 2114792 - RNA, 13 nt, Homo sapiens
caagaaugcauuc

SEQ ID NO: 2114793 - RNA, 13 nt, Homo sapiens
ccaucaugccuga

SEQ ID NO: 2114794 - RNA, 15 nt, Homo sapiens
cuaugccuugcacac

SEQ ID NO: 2114795 - RNA, 21 nt, Homo sapiens
agaaauuccauacuucucuca

SEQ ID NO: 2114796 - RNA, 21 nt, Homo sapiens
acugccuuuagaaaauauaag

SEQ ID NO: 2114797 - RNA, 23 nt, Homo sapiens
cacacaaagugaaauuaguauuu

SEQ ID NO: 2114798 - RNA, 18 nt, Homo sapiens
aaugaguucaacuuugag

SEQ ID NO: 2114799 - RNA, 16 nt, Homo sapiens
accgugugucauguca

SEQ ID NO: 2114800 - RNA, 13 nt, Homo sapiens
cuccugccuugau

SEQ ID NO: 2114801 - RNA, 20 nt, Homo sapiens
cagagaauucucuuauccaa

SEQ ID NO: 2114802 - RNA, 20 nt, Homo sapiens
cugcucccuccagaauggaa

SEQ ID NO: 2114803 - RNA, 21 nt, Homo sapiens
auuucuacuuugauaaaguaa

SEQ ID NO: 2114804 - RNA, 21 nt, Homo sapiens
gcuacugcacguaacacuccu

SEQ ID NO: 2114805 - RNA, 22 nt, Homo sapiens
aauuaacuccguuuccaaauac

SEQ ID NO: 2114806 - RNA, 23 nt, Homo sapiens
ugcucugagaauuguugagauac

SEQ ID NO: 2114807 - RNA, 18 nt, Homo sapiens
aacaauccaaaugcauuc

SEQ ID NO: 2114808 - RNA, 22 nt, Homo sapiens
auacauaaaaaagggacaagca

SEQ ID NO: 2114809 - RNA, 21 nt, Homo sapiens
uccaaguugcugcaaaauaca

SEQ ID NO: 2114810 - RNA, 16 nt, Homo sapiens
aagaaaacaguacaga

SEQ ID NO: 2114811 - RNA, 22 nt, Homo sapiens
agauuuuaggaaaugaaugugu

SEQ ID NO: 2114812 - RNA, 14 nt, Homo sapiens
uuucuggugccauu

SEQ ID NO: 2114813 - RNA, 15 nt, Homo sapiens
cuucggcuugugagg

SEQ ID NO: 2114814 - RNA, 15 nt, Homo sapiens
ccuuccccaccaagu

SEQ ID NO: 2114815 - RNA, 17 nt, Homo sapiens
aggaacugcaggucaag

SEQ ID NO: 2114816 - RNA, 22 nt, Homo sapiens
cacccuccccugggcccaucuc

SEQ ID NO: 2114817 - RNA, 22 nt, Homo sapiens
aucacuuacucaguuagaauuu

SEQ ID NO: 2114818 - RNA, 19 nt, Homo sapiens
ggauucuguacaugcauug

SEQ ID NO: 2114819 - RNA, 21 nt, Homo sapiens
cugcccacgucccgggcacug

SEQ ID NO: 2114820 - RNA, 16 nt, Homo sapiens
gauaaacauuccuguu

SEQ ID NO: 2114821 - RNA, 15 nt, Homo sapiens
ggaagcuccacuguc

SEQ ID NO: 2114822 - RNA, 16 nt, Homo sapiens
agaaagcuuccuucaa

SEQ ID NO: 2114823 - RNA, 12 nt, Homo sapiens
auaaacagcucu

SEQ ID NO: 2114824 - RNA, 19 nt, Homo sapiens
uacugcaauuaaagugaua

SEQ ID NO: 2114825 - RNA, 21 nt, Homo sapiens
uucuuauggaagaaaugggag

SEQ ID NO: 2114826 - RNA, 9 nt, Homo sapiens
guccaucuu

SEQ ID NO: 2114827 - RNA, 12 nt, Homo sapiens
cacgcugcagug

SEQ ID NO: 2114828 - RNA, 20 nt, Homo sapiens
cuucaacaugguuaccucug

SEQ ID NO: 2114829 - RNA, 20 nt, Homo sapiens
ucuuuuccaacacaucuaua

SEQ ID NO: 2114830 - RNA, 14 nt, Homo sapiens
agaacuucaagaag

SEQ ID NO: 2114831 - RNA, 14 nt, Homo sapiens
auguaacagccaaa

SEQ ID NO: 2114832 - RNA, 21 nt, Homo sapiens
gauuaggacuuuuauugugaa

SEQ ID NO: 2114833 - RNA, 21 nt, Homo sapiens
aggaggccgcuuagugcugcu

SEQ ID NO: 2114834 - RNA, 22 nt, Homo sapiens
ccaggacgcuucugaaugcugc

SEQ ID NO: 2114835 - RNA, 20 nt, Homo sapiens
ggaaaacaaauauuucacuu

SEQ ID NO: 2114836 - RNA, 19 nt, Homo sapiens
uuaccuuguuaagacaaaa

SEQ ID NO: 2114837 - RNA, 17 nt, Homo sapiens
aaauacuuuaacuucca

SEQ ID NO: 2114838 - RNA, 18 nt, Homo sapiens
guccguugacgugaccaa

SEQ ID NO: 2114839 - RNA, 18 nt, Homo sapiens
gaaggacacagugaugaa

SEQ ID NO: 2114840 - RNA, 20 nt, Homo sapiens
uaugguauauauacauauau

SEQ ID NO: 2114841 - RNA, 16 nt, Homo sapiens
aggguggcagaacuug

SEQ ID NO: 2114842 - RNA, 14 nt, Homo sapiens
gaggacacaauggc

SEQ ID NO: 2114843 - RNA, 21 nt, Homo sapiens
uaauaagcaaagggagcacug

SEQ ID NO: 2114844 - RNA, 16 nt, Homo sapiens
agauuuugaaugauau

SEQ ID NO: 2114845 - RNA, 12 nt, Homo sapiens
agagcagggucu

SEQ ID NO: 2114846 - RNA, 21 nt, Homo sapiens
uggcacagugcuuacauaugu

SEQ ID NO: 2114847 - RNA, 22 nt, Homo sapiens
ccuuaauuauugcacuagagaa

SEQ ID NO: 2114848 - RNA, 19 nt, Homo sapiens
auuguauuucuucaucccu

SEQ ID NO: 2114849 - RNA, 20 nt, Homo sapiens
ccucccggguucgcaccauu

SEQ ID NO: 2114850 - RNA, 22 nt, Homo sapiens
acacuuguuucuuguucaucca

SEQ ID NO: 2114851 - RNA, 22 nt, Homo sapiens
gcccucaauaagccagcaaacc

SEQ ID NO: 2114852 - RNA, 11 nt, Homo sapiens
caggugcaaaa

SEQ ID NO: 2114853 - RNA, 13 nt, Homo sapiens
accuucccagcua

SEQ ID NO: 2114854 - RNA, 20 nt, Homo sapiens
gaccuacuuccuccuagcaa

SEQ ID NO: 2114855 - RNA, 20 nt, Homo sapiens
uacagaaaauuguugugcuu

SEQ ID NO: 2114856 - RNA, 17 nt, Homo sapiens
guccucacaucuuucac

SEQ ID NO: 2114857 - RNA, 20 nt, Homo sapiens
aaaccaaccauuucuagaga

SEQ ID NO: 2114858 - RNA, 17 nt, Homo sapiens
gagaagucuaacgcuga

SEQ ID NO: 2114859 - RNA, 16 nt, Homo sapiens
ucagaggggacucuga

SEQ ID NO: 2114860 - RNA, 14 nt, Homo sapiens
aagcaaauggccaa

SEQ ID NO: 2114861 - RNA, 17 nt, Homo sapiens
cccagcacuuugggaga

SEQ ID NO: 2114862 - RNA, 20 nt, Homo sapiens
ccugccucugacucacacuu

SEQ ID NO: 2114863 - RNA, 17 nt, Homo sapiens
cuccaaugaaagacacu

SEQ ID NO: 2114864 - RNA, 19 nt, Homo sapiens
auucccuggccgcuucucc

SEQ ID NO: 2114865 - RNA, 17 nt, Homo sapiens
uuggugcuuuguucuca

SEQ ID NO: 2114866 - RNA, 20 nt, Homo sapiens
cccaggagccucacuggggc

SEQ ID NO: 2114867 - RNA, 18 nt, Homo sapiens
auggcaguccuggaggca

SEQ ID NO: 2114868 - RNA, 16 nt, Homo sapiens
gggcaggaucucagcc

SEQ ID NO: 2114869 - RNA, 13 nt, Homo sapiens
auauguugcugaa

SEQ ID NO: 2114870 - RNA, 14 nt, Homo sapiens
ccauacuccuauga

SEQ ID NO: 2114871 - RNA, 21 nt, Homo sapiens
caugcaccuuccagcccgggg

SEQ ID NO: 2114872 - RNA, 21 nt, Homo sapiens
ccauucuaaaucaaggcauau

SEQ ID NO: 2114873 - RNA, 21 nt, Homo sapiens
uuacuauguuucucagauucc

SEQ ID NO: 2114874 - RNA, 18 nt, Homo sapiens
ucugaaaaagacauaaaa

SEQ ID NO: 2114875 - RNA, 17 nt, Homo sapiens
ccaagcuucaacccuca

SEQ ID NO: 2114876 - RNA, 18 nt, Homo sapiens
auagcgacagugugggac

SEQ ID NO: 2114877 - RNA, 14 nt, Homo sapiens
aggugccaggugug

SEQ ID NO: 2114878 - RNA, 18 nt, Homo sapiens
uuccaccuagagcuagau

SEQ ID NO: 2114879 - RNA, 20 nt, Homo sapiens
aacagaguaacugaccuuca

SEQ ID NO: 2114880 - RNA, 14 nt, Homo sapiens
aauaaaccuuggaa

SEQ ID NO: 2114881 - RNA, 14 nt, Homo sapiens
ggcuuccugcugag

SEQ ID NO: 2114882 - RNA, 14 nt, Homo sapiens
auuucgaaacugcc

SEQ ID NO: 2114883 - RNA, 16 nt, Homo sapiens
aauugaaaaguuauuu

SEQ ID NO: 2114884 - RNA, 14 nt, Homo sapiens
ggccguaucuguca

SEQ ID NO: 2114885 - RNA, 20 nt, Homo sapiens
auccauagacacaguauuga

SEQ ID NO: 2114886 - RNA, 13 nt, Homo sapiens
ucacccauggaac

SEQ ID NO: 2114887 - RNA, 13 nt, Homo sapiens
aggugcugagcaa

SEQ ID NO: 2114888 - RNA, 13 nt, Homo sapiens
ugcugcuguggaa

SEQ ID NO: 2114889 - RNA, 13 nt, Homo sapiens
uuggcaaugccau

SEQ ID NO: 2114890 - RNA, 20 nt, Homo sapiens
ucccuggguuagacugccag

SEQ ID NO: 2114891 - RNA, 13 nt, Homo sapiens
cgggcaggcauuu

SEQ ID NO: 2114892 - RNA, 10 nt, Homo sapiens
ugaaagcaga

SEQ ID NO: 2114893 - RNA, 17 nt, Homo sapiens
ugccugaauccaucagg

SEQ ID NO: 2114894 - RNA, 19 nt, Homo sapiens
cuccagauuagagccugua

SEQ ID NO: 2114895 - RNA, 18 nt, Homo sapiens
cauugacugauggugaaa

SEQ ID NO: 2114896 - RNA, 18 nt, Homo sapiens
gauguacacauuuuguaa

SEQ ID NO: 2114897 - RNA, 16 nt, Homo sapiens
aaccuggggcuaauca

SEQ ID NO: 2114898 - RNA, 19 nt, Homo sapiens
gagucggauuaccaaaaca

SEQ ID NO: 2114899 - RNA, 17 nt, Homo sapiens
uauguguugccaaaacc

SEQ ID NO: 2114900 - RNA, 11 nt, Homo sapiens
auggacacuuu

SEQ ID NO: 2114901 - RNA, 18 nt, Homo sapiens
aaaagcuaaugucuucua

SEQ ID NO: 2114902 - RNA, 12 nt, Homo sapiens
aaaccaucagcu

SEQ ID NO: 2114903 - RNA, 16 nt, Homo sapiens
cauucaggugaccucc

SEQ ID NO: 2114904 - RNA, 13 nt, Homo sapiens
aggagaacccaau

SEQ ID NO: 2114905 - RNA, 13 nt, Homo sapiens
gaguucuugcccu

SEQ ID NO: 2114906 - RNA, 11 nt, Homo sapiens
ugaaccuucaa

SEQ ID NO: 2114907 - RNA, 22 nt, Homo sapiens
ugccagcuggaucgcugcacau

SEQ ID NO: 2114908 - RNA, 12 nt, Homo sapiens
uggaaaagccaa

SEQ ID NO: 2114909 - RNA, 14 nt, Homo sapiens
uuggccgagcuccu

SEQ ID NO: 2114910 - RNA, 14 nt, Homo sapiens
ucaacccgcugcuu

SEQ ID NO: 2114911 - RNA, 22 nt, Homo sapiens
gaaauaaacgcuccccucagac

SEQ ID NO: 2114912 - RNA, 18 nt, Homo sapiens
uguucaaguguccccaga

SEQ ID NO: 2114913 - RNA, 17 nt, Homo sapiens
aggcugaggcaagagaa

SEQ ID NO: 2114914 - RNA, 19 nt, Homo sapiens
gagacuguacauaauugca

SEQ ID NO: 2114915 - RNA, 13 nt, Homo sapiens
ugguuccccagga

SEQ ID NO: 2114916 - RNA, 19 nt, Homo sapiens
gcaucugucccacugggac

SEQ ID NO: 2114917 - RNA, 15 nt, Homo sapiens
gguuuuguacacugc

SEQ ID NO: 2114918 - RNA, 13 nt, Homo sapiens
agggugcagucca

SEQ ID NO: 2114919 - RNA, 15 nt, Homo sapiens
uguuugucauaugga

SEQ ID NO: 2114920 - RNA, 14 nt, Homo sapiens
ccacagaagccagg

SEQ ID NO: 2114921 - RNA, 15 nt, Homo sapiens
ucugcugcuucucca

SEQ ID NO: 2114922 - RNA, 11 nt, Homo sapiens
accuaauccaa

SEQ ID NO: 2114923 - RNA, 14 nt, Homo sapiens
augaauugucuuca

SEQ ID NO: 2114924 - RNA, 13 nt, Homo sapiens
uccagauaagcag

SEQ ID NO: 2114925 - RNA, 13 nt, Homo sapiens
aguccuguucaga

SEQ ID NO: 2114926 - RNA, 19 nt, Homo sapiens
ugcaguucaccugcacuua

SEQ ID NO: 2114927 - RNA, 17 nt, Homo sapiens
uccuauaguuuuacucc

SEQ ID NO: 2114928 - RNA, 14 nt, Homo sapiens
uuaaauacaaaagg

SEQ ID NO: 2114929 - RNA, 17 nt, Homo sapiens
uacuccauauucuuccc

SEQ ID NO: 2114930 - RNA, 20 nt, Homo sapiens
gacaaugaagaugaugcuau

SEQ ID NO: 2114931 - RNA, 22 nt, Homo sapiens
cacccuugagaaggugcuuugu

SEQ ID NO: 2114932 - RNA, 17 nt, Homo sapiens
caggaugcagcacugcg

SEQ ID NO: 2114933 - RNA, 16 nt, Homo sapiens
caccacgccuggcuaa

SEQ ID NO: 2114934 - RNA, 16 nt, Homo sapiens
agaggcgagaugagcc

SEQ ID NO: 2114935 - RNA, 18 nt, Homo sapiens
augaaguuaugcugucau

SEQ ID NO: 2114936 - RNA, 21 nt, Homo sapiens
ugggcaggcaggagcagggga

SEQ ID NO: 2114937 - RNA, 22 nt, Homo sapiens
augacguuaugggcacaugccu

SEQ ID NO: 2114938 - RNA, 13 nt, Homo sapiens
gaggaguaacaau

SEQ ID NO: 2114939 - RNA, 18 nt, Homo sapiens
accaaguaugacaaccuc

SEQ ID NO: 2114940 - RNA, 15 nt, Homo sapiens
uugugagcuucagau

SEQ ID NO: 2114941 - RNA, 15 nt, Homo sapiens
uugccucuugcaauu

SEQ ID NO: 2114942 - RNA, 19 nt, Homo sapiens
uaaaaaguaccacauucca

SEQ ID NO: 2114943 - RNA, 16 nt, Homo sapiens
ccagaaacuacaugau

SEQ ID NO: 2114944 - RNA, 22 nt, Homo sapiens
gaccugcucugcccucucccca

SEQ ID NO: 2114945 - RNA, 13 nt, Homo sapiens
aucauuauuucau

SEQ ID NO: 2114946 - RNA, 14 nt, Homo sapiens
aaaacacagacauu

SEQ ID NO: 2114947 - RNA, 14 nt, Homo sapiens
ugggccucucuggg

SEQ ID NO: 2114948 - RNA, 12 nt, Homo sapiens
cccagacuuuag

SEQ ID NO: 2114949 - RNA, 18 nt, Homo sapiens
agauuuuucuauccaaau

SEQ ID NO: 2114950 - RNA, 19 nt, Homo sapiens
gccccacagggcaaggaca

SEQ ID NO: 2114951 - RNA, 22 nt, Homo sapiens
gaaagucagcugaaggaugguu

SEQ ID NO: 2114952 - RNA, 23 nt, Homo sapiens
auuauuuauugucggaagacuug

SEQ ID NO: 2114953 - RNA, 19 nt, Homo sapiens
gaaauguggagaacauuca

SEQ ID NO: 2114954 - RNA, 17 nt, Homo sapiens
caugucacuacuguccg

SEQ ID NO: 2114955 - RNA, 13 nt, Homo sapiens
ucguccugccugg

SEQ ID NO: 2114956 - RNA, 23 nt, Homo sapiens
uugguaucuacuucuacauccaa

SEQ ID NO: 2114957 - RNA, 12 nt, Homo sapiens
gugacugaaauu

SEQ ID NO: 2114958 - RNA, 13 nt, Homo sapiens
uggcucugugaaa

SEQ ID NO: 2114959 - RNA, 14 nt, Homo sapiens
ucuaugaacuugca

SEQ ID NO: 2114960 - RNA, 20 nt, Homo sapiens
ggaggugaccccagguuucu

SEQ ID NO: 2114961 - RNA, 12 nt, Homo sapiens
uagaaacacagu

SEQ ID NO: 2114962 - RNA, 14 nt, Homo sapiens
uggucuuugcugcu

SEQ ID NO: 2114963 - RNA, 17 nt, Homo sapiens
acuuccagcaaaaucca

SEQ ID NO: 2114964 - RNA, 23 nt, Homo sapiens
aagccuaccguauuucagccaug

SEQ ID NO: 2114965 - RNA, 17 nt, Homo sapiens
uuaaguuugacuacaua

SEQ ID NO: 2114966 - RNA, 16 nt, Homo sapiens
agugagcucuggauga

SEQ ID NO: 2114967 - RNA, 18 nt, Homo sapiens
cagaagagaaggaagcca

SEQ ID NO: 2114968 - RNA, 22 nt, Homo sapiens
caucuauuuuauuuuauugaau

SEQ ID NO: 2114969 - RNA, 15 nt, Homo sapiens
ucacacacacucuga

SEQ ID NO: 2114970 - RNA, 15 nt, Homo sapiens
ggucagaaggccagc

SEQ ID NO: 2114971 - RNA, 21 nt, Homo sapiens
aaguguuaauacuaguuguga

SEQ ID NO: 2114972 - RNA, 19 nt, Homo sapiens
uguuuccuuauauuaugga

SEQ ID NO: 2114973 - RNA, 17 nt, Homo sapiens
agauucaaacucaauga

SEQ ID NO: 2114974 - RNA, 16 nt, Homo sapiens
uuacuugcauugaaua

SEQ ID NO: 2114975 - RNA, 17 nt, Homo sapiens
uccagaucuugccucca

SEQ ID NO: 2114976 - RNA, 15 nt, Homo sapiens
ggcagaaugaaaauu

SEQ ID NO: 2114977 - RNA, 20 nt, Homo sapiens
cucuacccuggcacuauaau

SEQ ID NO: 2114978 - RNA, 15 nt, Homo sapiens
uugguuuuuacucaa

SEQ ID NO: 2114979 - RNA, 16 nt, Homo sapiens
guuugcaaaugucagu

SEQ ID NO: 2114980 - RNA, 21 nt, Homo sapiens
aauggugcuuuaugugagaua

SEQ ID NO: 2114981 - RNA, 16 nt, Homo sapiens
uggagaaccagggcuc

SEQ ID NO: 2114982 - RNA, 15 nt, Homo sapiens
agugaugaugcaugg

SEQ ID NO: 2114983 - RNA, 18 nt, Homo sapiens
cucuuguuccgugccagg

SEQ ID NO: 2114984 - RNA, 22 nt, Homo sapiens
gauaccuguaguggaacuaaaa

SEQ ID NO: 2114985 - RNA, 23 nt, Homo sapiens
uccagucucuucugcuggcagaa

SEQ ID NO: 2114986 - RNA, 13 nt, Homo sapiens
uggagaagcucaa

SEQ ID NO: 2114987 - RNA, 18 nt, Homo sapiens
ggcaagucuagagucuca

SEQ ID NO: 2114988 - RNA, 16 nt, Homo sapiens
agaagaaagacacaaa

SEQ ID NO: 2114989 - RNA, 15 nt, Homo sapiens
gcggaucucuggagu

SEQ ID NO: 2114990 - RNA, 15 nt, Homo sapiens
aacaguuuuacaaua

SEQ ID NO: 2114991 - RNA, 15 nt, Homo sapiens
aguugcuuuguuaca

SEQ ID NO: 2114992 - RNA, 14 nt, Homo sapiens
acauauucaaggag

SEQ ID NO: 2114993 - RNA, 18 nt, Homo sapiens
uguccuuuuucaggagaa

SEQ ID NO: 2114994 - RNA, 16 nt, Homo sapiens
ggaucaugguacauuu

SEQ ID NO: 2114995 - RNA, 18 nt, Homo sapiens
aggcauuuuuguaaugag

SEQ ID NO: 2114996 - RNA, 19 nt, Homo sapiens
uaaaacuggcaucugacac

SEQ ID NO: 2114997 - RNA, 19 nt, Homo sapiens
caggcauugaaugacaagc

SEQ ID NO: 2114998 - RNA, 21 nt, Homo sapiens
uuaugaauauaaugaaugaga

SEQ ID NO: 2114999 - RNA, 22 nt, Homo sapiens
uuacaguaaauacacugugaag

SEQ ID NO: 2115000 - RNA, 15 nt, Homo sapiens
aucauuucaguauca

SEQ ID NO: 2115001 - RNA, 17 nt, Homo sapiens
cuuucacucacaacacu

SEQ ID NO: 2115002 - RNA, 23 nt, Homo sapiens
cagcugugaacauggacucuucc

SEQ ID NO: 2115003 - RNA, 21 nt, Homo sapiens
accuugcaaacucuauaaaga

SEQ ID NO: 2115004 - RNA, 12 nt, Homo sapiens
uagaaacccaag

SEQ ID NO: 2115005 - RNA, 13 nt, Homo sapiens
uagcuugauuuuc

SEQ ID NO: 2115006 - RNA, 15 nt, Homo sapiens
uguaccagugaauuu

SEQ ID NO: 2115007 - RNA, 17 nt, Homo sapiens
aaaggccgucauuucau

SEQ ID NO: 2115008 - RNA, 14 nt, Homo sapiens
cauggcucacaaac

SEQ ID NO: 2115009 - RNA, 15 nt, Homo sapiens
aaagggcacauuucu

SEQ ID NO: 2115010 - RNA, 15 nt, Homo sapiens
cuucugccuucucag

SEQ ID NO: 2115011 - RNA, 18 nt, Homo sapiens
aauucaguaacaaagguu

SEQ ID NO: 2115012 - RNA, 21 nt, Homo sapiens
gcaguccuggguccuccuuuc

SEQ ID NO: 2115013 - RNA, 19 nt, Homo sapiens
acucaugauuucuucuuac

SEQ ID NO: 2115014 - RNA, 16 nt, Homo sapiens
uaaucugcaugaagga

SEQ ID NO: 2115015 - RNA, 18 nt, Homo sapiens
auugaauguuaaugguca

SEQ ID NO: 2115016 - RNA, 22 nt, Homo sapiens
cucuuacugcaguaacacuggc

SEQ ID NO: 2115017 - RNA, 23 nt, Homo sapiens
ugcaauuuccccucuguguccuc

SEQ ID NO: 2115018 - RNA, 13 nt, Homo sapiens
ggugucagagcug

SEQ ID NO: 2115019 - RNA, 19 nt, Homo sapiens
aacaguaaaggccauguga

SEQ ID NO: 2115020 - RNA, 13 nt, Homo sapiens
acacacacaccaa

SEQ ID NO: 2115021 - RNA, 23 nt, Homo sapiens
aaaguauguaccaaaacauugau

SEQ ID NO: 2115022 - RNA, 22 nt, Homo sapiens
ugguucaauuucagaaguaaug

SEQ ID NO: 2115023 - RNA, 21 nt, Homo sapiens
uguaugcuaauugaacaugca

SEQ ID NO: 2115024 - RNA, 12 nt, Homo sapiens
ccuuuauacaug

SEQ ID NO: 2115025 - RNA, 15 nt, Homo sapiens
cauccacaaaacccu

SEQ ID NO: 2115026 - RNA, 19 nt, Homo sapiens
uccagugguucugcuucaa

SEQ ID NO: 2115027 - RNA, 18 nt, Homo sapiens
gaccguuuuuacuaagua

SEQ ID NO: 2115028 - RNA, 19 nt, Homo sapiens
gcgugaccagcaguacuca

SEQ ID NO: 2115029 - RNA, 15 nt, Homo sapiens
caggcuggacaugcu

SEQ ID NO: 2115030 - RNA, 17 nt, Homo sapiens
uuccaaaauaaagcaua

SEQ ID NO: 2115031 - RNA, 13 nt, Homo sapiens
cgaccccaccacc

SEQ ID NO: 2115032 - RNA, 20 nt, Homo sapiens
uuuuugauccucuacugugc

SEQ ID NO: 2115033 - RNA, 22 nt, Homo sapiens
uacuucauuuucucaaagggca

SEQ ID NO: 2115034 - RNA, 20 nt, Homo sapiens
uggagaaggagaaccgugaa

SEQ ID NO: 2115035 - RNA, 17 nt, Homo sapiens
uuccugcagccccagaa

SEQ ID NO: 2115036 - RNA, 14 nt, Homo sapiens
cucugaaaccagug

SEQ ID NO: 2115037 - RNA, 14 nt, Homo sapiens
uaccaaaggugcua

SEQ ID NO: 2115038 - RNA, 23 nt, Homo sapiens
uauuuccuuuccagucauuucaa

SEQ ID NO: 2115039 - RNA, 21 nt, Homo sapiens
uaacuuggagagggacgaaga

SEQ ID NO: 2115040 - RNA, 23 nt, Homo sapiens
uacgcaaacacaccgaugcacac

SEQ ID NO: 2115041 - RNA, 22 nt, Homo sapiens
gaauugauucaagauuggacau

SEQ ID NO: 2115042 - RNA, 16 nt, Homo sapiens
agggugcuaacguauc

SEQ ID NO: 2115043 - RNA, 14 nt, Homo sapiens
cagacgccauuuaa

SEQ ID NO: 2115044 - RNA, 14 nt, Homo sapiens
gaggcuggggaccc

SEQ ID NO: 2115045 - RNA, 21 nt, Homo sapiens
gacuguauaguuuaaagggag

SEQ ID NO: 2115046 - RNA, 17 nt, Homo sapiens
cuuuuccucucaugucu

SEQ ID NO: 2115047 - RNA, 12 nt, Homo sapiens
augggacagggg

SEQ ID NO: 2115048 - RNA, 14 nt, Homo sapiens
cuucuaauaaacag

SEQ ID NO: 2115049 - RNA, 21 nt, Homo sapiens
aggcuauguaaacaaaccaca

SEQ ID NO: 2115050 - RNA, 16 nt, Homo sapiens
cugacauaugcuaacc

SEQ ID NO: 2115051 - RNA, 16 nt, Homo sapiens
acuuccaugacauaag

SEQ ID NO: 2115052 - RNA, 15 nt, Homo sapiens
cugucauuacgucaa

SEQ ID NO: 2115053 - RNA, 14 nt, Homo sapiens
uuuuuuguagccag

SEQ ID NO: 2115054 - RNA, 16 nt, Homo sapiens
gaacauuuuuuaccaa

SEQ ID NO: 2115055 - RNA, 23 nt, Homo sapiens
ucucuuucuuuuucugucucucu

SEQ ID NO: 2115056 - RNA, 13 nt, Homo sapiens
ugucucacagccc

SEQ ID NO: 2115057 - RNA, 16 nt, Homo sapiens
cacacuuuuggaacca

SEQ ID NO: 2115058 - RNA, 20 nt, Homo sapiens
aggcucccccuccucugacu

SEQ ID NO: 2115059 - RNA, 21 nt, Homo sapiens
gcacugacauuguuggccaaa

SEQ ID NO: 2115060 - RNA, 13 nt, Homo sapiens
cagcccgugcacc

SEQ ID NO: 2115061 - RNA, 16 nt, Homo sapiens
ucugcuggauucuaaa

SEQ ID NO: 2115062 - RNA, 20 nt, Homo sapiens
caaauuuggguauaugcagu

SEQ ID NO: 2115063 - RNA, 19 nt, Homo sapiens
ugcaccccucugcccucau

SEQ ID NO: 2115064 - RNA, 18 nt, Homo sapiens
cagaaccccugucacaca

SEQ ID NO: 2115065 - RNA, 17 nt, Homo sapiens
uaauaaaggucacauaa

SEQ ID NO: 2115066 - RNA, 21 nt, Homo sapiens
cgaaagacgugauucaauuca

SEQ ID NO: 2115067 - RNA, 14 nt, Homo sapiens
aguuugaaccaaga

SEQ ID NO: 2115068 - RNA, 14 nt, Homo sapiens
aauaugaauugaca

SEQ ID NO: 2115069 - RNA, 18 nt, Homo sapiens
aaucauuuuaagugcaug

SEQ ID NO: 2115070 - RNA, 20 nt, Homo sapiens
guucaccaucccaaagccaa

SEQ ID NO: 2115071 - RNA, 16 nt, Homo sapiens
gugaauuagcucacuu

SEQ ID NO: 2115072 - RNA, 17 nt, Homo sapiens
cacaugaccugaucacu

SEQ ID NO: 2115073 - RNA, 14 nt, Homo sapiens
ccaacguccccucc

SEQ ID NO: 2115074 - RNA, 20 nt, Homo sapiens
cagaaccggucccagccugg

SEQ ID NO: 2115075 - RNA, 15 nt, Homo sapiens
ucaagggcacuguga

SEQ ID NO: 2115076 - RNA, 13 nt, Homo sapiens
uucccccacugau

SEQ ID NO: 2115077 - RNA, 12 nt, Homo sapiens
gaggccaaacac

SEQ ID NO: 2115078 - RNA, 13 nt, Homo sapiens
ccaaaacucugua

SEQ ID NO: 2115079 - RNA, 17 nt, Homo sapiens
auccuaacguuugucau

SEQ ID NO: 2115080 - RNA, 15 nt, Homo sapiens
aaguuauaccuuccu

SEQ ID NO: 2115081 - RNA, 17 nt, Homo sapiens
aagcuaguguaccuccu

SEQ ID NO: 2115082 - RNA, 21 nt, Homo sapiens
ggaagcccagcuccagggcca

SEQ ID NO: 2115083 - RNA, 20 nt, Homo sapiens
gcuuaggaaauugcucauaa

SEQ ID NO: 2115084 - RNA, 19 nt, Homo sapiens
guacuuagcagcuaucucu

SEQ ID NO: 2115085 - RNA, 16 nt, Homo sapiens
ccucccagacuugccu

SEQ ID NO: 2115086 - RNA, 14 nt, Homo sapiens
uuaauuuccagggu

SEQ ID NO: 2115087 - RNA, 15 nt, Homo sapiens
ccugggcaaugugau

SEQ ID NO: 2115088 - RNA, 14 nt, Homo sapiens
cucaaaaaguuaaa

SEQ ID NO: 2115089 - RNA, 14 nt, Homo sapiens
gcugaaaacccgaa

SEQ ID NO: 2115090 - RNA, 15 nt, Homo sapiens
gaaggaaugcaauaa

SEQ ID NO: 2115091 - RNA, 16 nt, Homo sapiens
cauagcgaagaccagu

SEQ ID NO: 2115092 - RNA, 13 nt, Homo sapiens
uccauguacugua

SEQ ID NO: 2115093 - RNA, 21 nt, Homo sapiens
cugucuuagucauaccaucca

SEQ ID NO: 2115094 - RNA, 13 nt, Homo sapiens
uacugauacuaca

SEQ ID NO: 2115095 - RNA, 23 nt, Homo sapiens
auauuuugcaauaguuaccucaa

SEQ ID NO: 2115096 - RNA, 22 nt, Homo sapiens
aaaaauauaaaguacaucucua

SEQ ID NO: 2115097 - RNA, 16 nt, Homo sapiens
aagcauuuucauuucu

SEQ ID NO: 2115098 - RNA, 16 nt, Homo sapiens
cuuuucagugauacuc

SEQ ID NO: 2115099 - RNA, 15 nt, Homo sapiens
guaguugacaauucu

SEQ ID NO: 2115100 - RNA, 21 nt, Homo sapiens
auacuuucuaaaugccuuuga

SEQ ID NO: 2115101 - RNA, 15 nt, Homo sapiens
ggagccacacagaga

SEQ ID NO: 2115102 - RNA, 20 nt, Homo sapiens
aaagcuuuauacaguugaau

SEQ ID NO: 2115103 - RNA, 22 nt, Homo sapiens
cacccccgacggccuccaggag

SEQ ID NO: 2115104 - RNA, 23 nt, Homo sapiens
ucaccuccgaacuguucaagugu

SEQ ID NO: 2115105 - RNA, 20 nt, Homo sapiens
caguauccacaauagcugac

SEQ ID NO: 2115106 - RNA, 15 nt, Homo sapiens
ucauuucuugugaug

SEQ ID NO: 2115107 - RNA, 18 nt, Homo sapiens
accuuuggugcuuuccag

SEQ ID NO: 2115108 - RNA, 16 nt, Homo sapiens
cgguuugucaguucuu

SEQ ID NO: 2115109 - RNA, 22 nt, Homo sapiens
caagauuuuuuaauuguuuaaa

SEQ ID NO: 2115110 - RNA, 19 nt, Homo sapiens
aaaauagacuaaccucuac

SEQ ID NO: 2115111 - RNA, 16 nt, Homo sapiens
accuagggcacuuuaa

SEQ ID NO: 2115112 - RNA, 20 nt, Homo sapiens
acacucauuuuguuagcgag

SEQ ID NO: 2115113 - RNA, 12 nt, Homo sapiens
guuuuguggaaa

SEQ ID NO: 2115114 - RNA, 19 nt, Homo sapiens
cuguuuguauauuugcaaa

SEQ ID NO: 2115115 - RNA, 13 nt, Homo sapiens
acagauggcccaa

SEQ ID NO: 2115116 - RNA, 22 nt, Homo sapiens
agaaguucucaaaguuaauuca

SEQ ID NO: 2115117 - RNA, 17 nt, Homo sapiens
aaacuauguaaugcuua

SEQ ID NO: 2115118 - RNA, 24 nt, Homo sapiens
cacaguggguggugaguucugacu

SEQ ID NO: 2115119 - RNA, 17 nt, Homo sapiens
uuaagaugguaagaccu

SEQ ID NO: 2115120 - RNA, 16 nt, Homo sapiens
caggguuucugcacug

SEQ ID NO: 2115121 - RNA, 19 nt, Homo sapiens
ggaagaaacaaaguugaac

SEQ ID NO: 2115122 - RNA, 15 nt, Homo sapiens
aauacaaacaaugga

SEQ ID NO: 2115123 - RNA, 19 nt, Homo sapiens
ggagaaacaggcccagaga

SEQ ID NO: 2115124 - RNA, 16 nt, Homo sapiens
aagaaccgagcaauuu

SEQ ID NO: 2115125 - RNA, 15 nt, Homo sapiens
augccuauaccugaa

SEQ ID NO: 2115126 - RNA, 16 nt, Homo sapiens
gcucaacaucucagga

SEQ ID NO: 2115127 - RNA, 20 nt, Homo sapiens
caguuuugccuaauggcaaa

SEQ ID NO: 2115128 - RNA, 22 nt, Homo sapiens
guuuguugugauauagaacaaa

SEQ ID NO: 2115129 - RNA, 16 nt, Homo sapiens
auuauccauucccaag

SEQ ID NO: 2115130 - RNA, 16 nt, Homo sapiens
ggaaagcacaccucau

SEQ ID NO: 2115131 - RNA, 17 nt, Homo sapiens
uuaaauaaacuguuuuc

SEQ ID NO: 2115132 - RNA, 20 nt, Homo sapiens
ugguuguggcgugugaguca

SEQ ID NO: 2115133 - RNA, 18 nt, Homo sapiens
ccauuuccugaucuagca

SEQ ID NO: 2115134 - RNA, 13 nt, Homo sapiens
agccaaauguaau

SEQ ID NO: 2115135 - RNA, 17 nt, Homo sapiens
acauggacugcuucauc

SEQ ID NO: 2115136 - RNA, 23 nt, Homo sapiens
caugucuaauucauuuacucacc

SEQ ID NO: 2115137 - RNA, 14 nt, Homo sapiens
accauccaguacuu

SEQ ID NO: 2115138 - RNA, 18 nt, Homo sapiens
uugucaguucuuggugcu

SEQ ID NO: 2115139 - RNA, 15 nt, Homo sapiens
caaauaucucagagg

SEQ ID NO: 2115140 - RNA, 22 nt, Homo sapiens
auaacauuuaaagagauuuccc

SEQ ID NO: 2115141 - RNA, 16 nt, Homo sapiens
acauaccugguuugcu

SEQ ID NO: 2115142 - RNA, 16 nt, Homo sapiens
aguuacaagcauugaa

SEQ ID NO: 2115143 - RNA, 13 nt, Homo sapiens
cuugcccuuuacg

SEQ ID NO: 2115144 - RNA, 12 nt, Homo sapiens
gcugauuucccu

SEQ ID NO: 2115145 - RNA, 20 nt, Homo sapiens
ucaacauuaaggcaguauga

SEQ ID NO: 2115146 - RNA, 19 nt, Homo sapiens
gccugugcccauaugguca

SEQ ID NO: 2115147 - RNA, 21 nt, Homo sapiens
uaaauuuccccaacaguguga

SEQ ID NO: 2115148 - RNA, 17 nt, Homo sapiens
aaagacguugccuauaa

SEQ ID NO: 2115149 - RNA, 23 nt, Homo sapiens
cuugucuaaauaaguuugcaauu

SEQ ID NO: 2115150 - RNA, 20 nt, Homo sapiens
gcaaagagugggccgcugug

SEQ ID NO: 2115151 - RNA, 12 nt, Homo sapiens
accuuacaggga

SEQ ID NO: 2115152 - RNA, 14 nt, Homo sapiens
uccaauauuaaaag

SEQ ID NO: 2115153 - RNA, 14 nt, Homo sapiens
auggacaacucaau

SEQ ID NO: 2115154 - RNA, 13 nt, Homo sapiens
aaagcauggaugu

SEQ ID NO: 2115155 - RNA, 19 nt, Homo sapiens
ugggccccuggcacucuug

SEQ ID NO: 2115156 - RNA, 18 nt, Homo sapiens
caauggugcucauuucau

SEQ ID NO: 2115157 - RNA, 19 nt, Homo sapiens
gucuuuguuaagacugcug

SEQ ID NO: 2115158 - RNA, 22 nt, Homo sapiens
acuugaacugauucacaucuca

SEQ ID NO: 2115159 - RNA, 12 nt, Homo sapiens
accucacugggg

SEQ ID NO: 2115160 - RNA, 17 nt, Homo sapiens
ucaaggcuuaccuguga

SEQ ID NO: 2115161 - RNA, 14 nt, Homo sapiens
aagacuggcuuuag

SEQ ID NO: 2115162 - RNA, 22 nt, Homo sapiens
guauuuaauauuuucaaagaga

SEQ ID NO: 2115163 - RNA, 18 nt, Homo sapiens
cauuuuaaaagugccauu

SEQ ID NO: 2115164 - RNA, 19 nt, Homo sapiens
cuucuucaucuucaccaga

SEQ ID NO: 2115165 - RNA, 18 nt, Homo sapiens
aaguaucauuuauuugaa

SEQ ID NO: 2115166 - RNA, 23 nt, Homo sapiens
ccaguccaaauggcuauuauaaa

SEQ ID NO: 2115167 - RNA, 13 nt, Homo sapiens
aaauuacugugua

SEQ ID NO: 2115168 - RNA, 11 nt, Homo sapiens
uugugaugcuc

SEQ ID NO: 2115169 - RNA, 13 nt, Homo sapiens
gaaauaaacauaa

SEQ ID NO: 2115170 - RNA, 14 nt, Homo sapiens
ugaaggcgugcaag

SEQ ID NO: 2115171 - RNA, 19 nt, Homo sapiens
cuccauuucccacuuccac

SEQ ID NO: 2115172 - RNA, 15 nt, Homo sapiens
cagaaagaugcccua

SEQ ID NO: 2115173 - RNA, 21 nt, Homo sapiens
uucaguuguggccucauucag

SEQ ID NO: 2115174 - RNA, 15 nt, Homo sapiens
aauuaccagaaccac

SEQ ID NO: 2115175 - RNA, 21 nt, Homo sapiens
aaaaugaucuauugcagauau

SEQ ID NO: 2115176 - RNA, 14 nt, Homo sapiens
cagcuucuccagga

SEQ ID NO: 2115177 - RNA, 16 nt, Homo sapiens
aagcagccaagcuccu

SEQ ID NO: 2115178 - RNA, 14 nt, Homo sapiens
uaaaagcagagcau

SEQ ID NO: 2115179 - RNA, 21 nt, Homo sapiens
agcuggguuggaaaacaguau

SEQ ID NO: 2115180 - RNA, 15 nt, Homo sapiens
cuccaaaggcacuga

SEQ ID NO: 2115181 - RNA, 16 nt, Homo sapiens
uuaauggcuaguacug

SEQ ID NO: 2115182 - RNA, 18 nt, Homo sapiens
uauuccccccuacuugag

SEQ ID NO: 2115183 - RNA, 19 nt, Homo sapiens
ggccuaaauaaaugagcug

SEQ ID NO: 2115184 - RNA, 21 nt, Homo sapiens
acugcaacuugugaacuccau

SEQ ID NO: 2115185 - RNA, 23 nt, Homo sapiens
uguuguauucuccuuugcacugu

SEQ ID NO: 2115186 - RNA, 13 nt, Homo sapiens
uauguacugccuu

SEQ ID NO: 2115187 - RNA, 13 nt, Homo sapiens
gauggacuuccug

SEQ ID NO: 2115188 - RNA, 18 nt, Homo sapiens
ucaggagcugcuaaacuc

SEQ ID NO: 2115189 - RNA, 14 nt, Homo sapiens
gccaugcccuugag

SEQ ID NO: 2115190 - RNA, 22 nt, Homo sapiens
gcauccacuucacaguucugaa

SEQ ID NO: 2115191 - RNA, 15 nt, Homo sapiens
aucuuucaccaagua

SEQ ID NO: 2115192 - RNA, 20 nt, Homo sapiens
cuuaggcuaagagaugugac

SEQ ID NO: 2115193 - RNA, 14 nt, Homo sapiens
auuuuuuucuacau

SEQ ID NO: 2115194 - RNA, 21 nt, Homo sapiens
auuccuugcugaaacgcaucu

SEQ ID NO: 2115195 - RNA, 14 nt, Homo sapiens
aagaucaauauaca

SEQ ID NO: 2115196 - RNA, 23 nt, Homo sapiens
gugucauuuggcuuuccagucau

SEQ ID NO: 2115197 - RNA, 16 nt, Homo sapiens
acuuagacaguaugca

SEQ ID NO: 2115198 - RNA, 22 nt, Homo sapiens
uccccacaggagcccugcagug

SEQ ID NO: 2115199 - RNA, 16 nt, Homo sapiens
acuaugaaugggcaaa

SEQ ID NO: 2115200 - RNA, 18 nt, Homo sapiens
ggggaacugcguggugcu

SEQ ID NO: 2115201 - RNA, 14 nt, Homo sapiens
aguaagauaucuca

SEQ ID NO: 2115202 - RNA, 14 nt, Homo sapiens
cuuuucaacacaca

SEQ ID NO: 2115203 - RNA, 22 nt, Homo sapiens
uacuccacacauaaaaacuuag

SEQ ID NO: 2115204 - RNA, 19 nt, Homo sapiens
agggaacaaguugagcuau

SEQ ID NO: 2115205 - RNA, 20 nt, Homo sapiens
agauauggacucucuaagga

SEQ ID NO: 2115206 - RNA, 15 nt, Homo sapiens
aggaccacucagccc

SEQ ID NO: 2115207 - RNA, 14 nt, Homo sapiens
aacuaguguuuguu

SEQ ID NO: 2115208 - RNA, 15 nt, Homo sapiens
cucuggucuauauaa

SEQ ID NO: 2115209 - RNA, 20 nt, Homo sapiens
caggcugggauggagcacuu

SEQ ID NO: 2115210 - RNA, 21 nt, Homo sapiens
ccugugguggccuggugcaca

SEQ ID NO: 2115211 - RNA, 12 nt, Homo sapiens
cugaagauauau

SEQ ID NO: 2115212 - RNA, 14 nt, Homo sapiens
uccagcauuugcca

SEQ ID NO: 2115213 - RNA, 18 nt, Homo sapiens
gccgcggacgcaccuggg

SEQ ID NO: 2115214 - RNA, 17 nt, Homo sapiens
agaagacuucuuugcaa

SEQ ID NO: 2115215 - RNA, 20 nt, Homo sapiens
ugcauauuuuauuauaguca

SEQ ID NO: 2115216 - RNA, 16 nt, Homo sapiens
uucuaggcucacugca

SEQ ID NO: 2115217 - RNA, 19 nt, Homo sapiens
uuuaccacaggaugcauau

SEQ ID NO: 2115218 - RNA, 17 nt, Homo sapiens
gagcuccuuagccuuug

SEQ ID NO: 2115219 - RNA, 17 nt, Homo sapiens
agaucuuaagauuccau

SEQ ID NO: 2115220 - RNA, 17 nt, Homo sapiens
uguauuuuuguacccuu

SEQ ID NO: 2115221 - RNA, 23 nt, Homo sapiens
gcagucacuuuuccugugcuguu

SEQ ID NO: 2115222 - RNA, 17 nt, Homo sapiens
ccacucucccaccuccu

SEQ ID NO: 2115223 - RNA, 19 nt, Homo sapiens
ugcaauauagagacugugu

SEQ ID NO: 2115224 - RNA, 22 nt, Homo sapiens
ugcacaacauccucagaaccau

SEQ ID NO: 2115225 - RNA, 10 nt, Homo sapiens
accauuugca

SEQ ID NO: 2115226 - RNA, 10 nt, Homo sapiens
aacauuugcc

SEQ ID NO: 2115227 - RNA, 12 nt, Homo sapiens
gaauagaacucu

SEQ ID NO: 2115228 - RNA, 16 nt, Homo sapiens
gcuuuuguuugcucuu

SEQ ID NO: 2115229 - RNA, 15 nt, Homo sapiens
auuaccuccauccau

SEQ ID NO: 2115230 - RNA, 20 nt, Homo sapiens
caacuuguauuaaagacaga

SEQ ID NO: 2115231 - RNA, 19 nt, Homo sapiens
cucugcucagugaucucac

SEQ ID NO: 2115232 - RNA, 19 nt, Homo sapiens
cuacuugggaggcugaggc

SEQ ID NO: 2115233 - RNA, 17 nt, Homo sapiens
ccauggggaggagaccu

SEQ ID NO: 2115234 - RNA, 20 nt, Homo sapiens
augucuaauucauuuacuca

SEQ ID NO: 2115235 - RNA, 20 nt, Homo sapiens
uucagacuuuaaaauucuaa

SEQ ID NO: 2115236 - RNA, 14 nt, Homo sapiens
uuggggcaagucau

SEQ ID NO: 2115237 - RNA, 12 nt, Homo sapiens
agcucgagcaaa

SEQ ID NO: 2115238 - RNA, 15 nt, Homo sapiens
gcuaacugguuaaac

SEQ ID NO: 2115239 - RNA, 15 nt, Homo sapiens
ccuggccucaaguga

SEQ ID NO: 2115240 - RNA, 16 nt, Homo sapiens
cguaguccgcuuucuc

SEQ ID NO: 2115241 - RNA, 14 nt, Homo sapiens
ucaauaucuuuauu

SEQ ID NO: 2115242 - RNA, 18 nt, Homo sapiens
gcagugcuguccaacaag

SEQ ID NO: 2115243 - RNA, 11 nt, Homo sapiens
aauuaccaugc

SEQ ID NO: 2115244 - RNA, 12 nt, Homo sapiens
agagugccaucc

SEQ ID NO: 2115245 - RNA, 18 nt, Homo sapiens
cuugaacaaaaaugacag

SEQ ID NO: 2115246 - RNA, 15 nt, Homo sapiens
gaugaauugcauuau

SEQ ID NO: 2115247 - RNA, 15 nt, Homo sapiens
gcauuccugaugacc

SEQ ID NO: 2115248 - RNA, 17 nt, Homo sapiens
agugcacuccaagaaac

SEQ ID NO: 2115249 - RNA, 18 nt, Homo sapiens
ccccagcauuacgauccc

SEQ ID NO: 2115250 - RNA, 16 nt, Homo sapiens
gauuuccuuaaccuua

SEQ ID NO: 2115251 - RNA, 23 nt, Homo sapiens
acaguuguaccacugcuaauaaa

SEQ ID NO: 2115252 - RNA, 21 nt, Homo sapiens
cugugcacacacacacacaug

SEQ ID NO: 2115253 - RNA, 16 nt, Homo sapiens
cgguguuuaagacauu

SEQ ID NO: 2115254 - RNA, 16 nt, Homo sapiens
ugaagacuuacagcaa

SEQ ID NO: 2115255 - RNA, 17 nt, Homo sapiens
cacacacucaccagugg

SEQ ID NO: 2115256 - RNA, 19 nt, Homo sapiens
acuucauuugaugcuaaau

SEQ ID NO: 2115257 - RNA, 20 nt, Homo sapiens
uuuaaguaaaagucuaccug

SEQ ID NO: 2115258 - RNA, 16 nt, Homo sapiens
aagaaccuaaaguagc

SEQ ID NO: 2115259 - RNA, 17 nt, Homo sapiens
guagaagaaaauuuaau

SEQ ID NO: 2115260 - RNA, 13 nt, Homo sapiens
gcuuggaaaggac

SEQ ID NO: 2115261 - RNA, 17 nt, Homo sapiens
auggagugcaccaaaga

SEQ ID NO: 2115262 - RNA, 22 nt, Homo sapiens
cuuguucuuccucuuaccugua

SEQ ID NO: 2115263 - RNA, 22 nt, Homo sapiens
aaaauguguuccauugccauag

SEQ ID NO: 2115264 - RNA, 14 nt, Homo sapiens
uugcuuccauuauu

SEQ ID NO: 2115265 - RNA, 21 nt, Homo sapiens
augguguaaauauuagugcag

SEQ ID NO: 2115266 - RNA, 22 nt, Homo sapiens
aucuuugcuuuauaaaagaaca

SEQ ID NO: 2115267 - RNA, 19 nt, Homo sapiens
cugcggggggcaccagagg

SEQ ID NO: 2115268 - RNA, 17 nt, Homo sapiens
aaaaaguuaaucuucau

SEQ ID NO: 2115269 - RNA, 17 nt, Homo sapiens
uccaucucugccuguca

SEQ ID NO: 2115270 - RNA, 14 nt, Homo sapiens
aucuacuaauucca

SEQ ID NO: 2115271 - RNA, 18 nt, Homo sapiens
uagaaccacuuggcugcu

SEQ ID NO: 2115272 - RNA, 22 nt, Homo sapiens
ugggggaaugcaccuccccaaa

SEQ ID NO: 2115273 - RNA, 14 nt, Homo sapiens
uaccagcuuucuau

SEQ ID NO: 2115274 - RNA, 13 nt, Homo sapiens
agguggugccagu

SEQ ID NO: 2115275 - RNA, 15 nt, Homo sapiens
aauuuaaaaucauuc

SEQ ID NO: 2115276 - RNA, 19 nt, Homo sapiens
uucaggcuuauaacaaaua

SEQ ID NO: 2115277 - RNA, 16 nt, Homo sapiens
ugauggucggugguug

SEQ ID NO: 2115278 - RNA, 19 nt, Homo sapiens
cugucuggaggggagcucu

SEQ ID NO: 2115279 - RNA, 23 nt, Homo sapiens
caggcaccugcacuuacaggccu

SEQ ID NO: 2115280 - RNA, 23 nt, Homo sapiens
ucuuaagacgugauuuugcugua

SEQ ID NO: 2115281 - RNA, 17 nt, Homo sapiens
uucauaguaauuucacu

SEQ ID NO: 2115282 - RNA, 19 nt, Homo sapiens
uuccuuuuucuaugaaaua

SEQ ID NO: 2115283 - RNA, 17 nt, Homo sapiens
ugccucgcucagucagu

SEQ ID NO: 2115284 - RNA, 15 nt, Homo sapiens
gaagaaugcauucaa

SEQ ID NO: 2115285 - RNA, 14 nt, Homo sapiens
cagaaagauuugau

SEQ ID NO: 2115286 - RNA, 22 nt, Homo sapiens
guugggggaggggagacuuuga

SEQ ID NO: 2115287 - RNA, 14 nt, Homo sapiens
uaugauacugaugc

SEQ ID NO: 2115288 - RNA, 18 nt, Homo sapiens
agaagcacuucugcugca

SEQ ID NO: 2115289 - RNA, 14 nt, Homo sapiens
aggaaaaccaugac

SEQ ID NO: 2115290 - RNA, 24 nt, Homo sapiens
gccaagugcccucucugaaccuca

SEQ ID NO: 2115291 - RNA, 22 nt, Homo sapiens
uuuguggccuuggcugacauga

SEQ ID NO: 2115292 - RNA, 18 nt, Homo sapiens
uaauucgagcaaacaacu

SEQ ID NO: 2115293 - RNA, 11 nt, Homo sapiens
ugcaaagggaa

SEQ ID NO: 2115294 - RNA, 18 nt, Homo sapiens
aacauggauguguugccc

SEQ ID NO: 2115295 - RNA, 15 nt, Homo sapiens
accauucaugaugaa

SEQ ID NO: 2115296 - RNA, 19 nt, Homo sapiens
auggugaaaauauuugaca

SEQ ID NO: 2115297 - RNA, 24 nt, Homo sapiens
aagcacagaguggcuuggccucaa

SEQ ID NO: 2115298 - RNA, 17 nt, Homo sapiens
gaaaaauauugaacuca

SEQ ID NO: 2115299 - RNA, 22 nt, Homo sapiens
cuaaaugaaugagccaaaauga

SEQ ID NO: 2115300 - RNA, 21 nt, Homo sapiens
ugcuagcccauuagaagcaca

SEQ ID NO: 2115301 - RNA, 18 nt, Homo sapiens
uuuacaauguucauccca

SEQ ID NO: 2115302 - RNA, 14 nt, Homo sapiens
aaauuuuuuuccag

SEQ ID NO: 2115303 - RNA, 20 nt, Homo sapiens
uguacaauaaguuacuugaa

SEQ ID NO: 2115304 - RNA, 13 nt, Homo sapiens
gcuuuccuuccuc

SEQ ID NO: 2115305 - RNA, 13 nt, Homo sapiens
ugcuguacccaga

SEQ ID NO: 2115306 - RNA, 13 nt, Homo sapiens
uuaaaagcaugaa

SEQ ID NO: 2115307 - RNA, 13 nt, Homo sapiens
auccagccucaug

SEQ ID NO: 2115308 - RNA, 15 nt, Homo sapiens
ggacagcaucaaaga

SEQ ID NO: 2115309 - RNA, 15 nt, Homo sapiens
ggauccacacugaga

SEQ ID NO: 2115310 - RNA, 22 nt, Homo sapiens
aucguuuuggggggaaugcucc

SEQ ID NO: 2115311 - RNA, 23 nt, Homo sapiens
gaaacucagauuuaaccuguuau

SEQ ID NO: 2115312 - RNA, 17 nt, Homo sapiens
gaacugcccagccucag

SEQ ID NO: 2115313 - RNA, 17 nt, Homo sapiens
ucuaccuucaagaacca

SEQ ID NO: 2115314 - RNA, 22 nt, Homo sapiens
acugugucacccagacuggaau

SEQ ID NO: 2115315 - RNA, 12 nt, Homo sapiens
gaaagaggugaa

SEQ ID NO: 2115316 - RNA, 18 nt, Homo sapiens
cauugaacuucuuuagua

SEQ ID NO: 2115317 - RNA, 18 nt, Homo sapiens
cauuuaucaacuguugau

SEQ ID NO: 2115318 - RNA, 23 nt, Homo sapiens
cuuauacgaguaauaugccugcu

SEQ ID NO: 2115319 - RNA, 18 nt, Homo sapiens
ggcaauccagacagcagg

SEQ ID NO: 2115320 - RNA, 22 nt, Homo sapiens
ucauugucuacauagugacaug

SEQ ID NO: 2115321 - RNA, 20 nt, Homo sapiens
gccuuccagcugcugucuuc

SEQ ID NO: 2115322 - RNA, 16 nt, Homo sapiens
caaggugccuguuaua

SEQ ID NO: 2115323 - RNA, 15 nt, Homo sapiens
cccaaucagcacuga

SEQ ID NO: 2115324 - RNA, 21 nt, Homo sapiens
uuucugucaagcauauuggaa

SEQ ID NO: 2115325 - RNA, 15 nt, Homo sapiens
gggccaaagaaccaa

SEQ ID NO: 2115326 - RNA, 17 nt, Homo sapiens
cuucucuucucugcaau

SEQ ID NO: 2115327 - RNA, 15 nt, Homo sapiens
accagaaaggugauu

SEQ ID NO: 2115328 - RNA, 15 nt, Homo sapiens
cucaacuguuuucau

SEQ ID NO: 2115329 - RNA, 16 nt, Homo sapiens
uuugcuauuagacugu

SEQ ID NO: 2115330 - RNA, 22 nt, Homo sapiens
uguacuuauauccacacugcac

SEQ ID NO: 2115331 - RNA, 18 nt, Homo sapiens
cuuaucccagugaucacc

SEQ ID NO: 2115332 - RNA, 21 nt, Homo sapiens
ucuuucuaaugcugauaugau

SEQ ID NO: 2115333 - RNA, 23 nt, Homo sapiens
cuggcugcaaaggguaucaggug

SEQ ID NO: 2115334 - RNA, 14 nt, Homo sapiens
ugcgcaacuggagc

SEQ ID NO: 2115335 - RNA, 17 nt, Homo sapiens
uugcccugaauggucuc

SEQ ID NO: 2115336 - RNA, 15 nt, Homo sapiens
ucagaguaucuuuac

SEQ ID NO: 2115337 - RNA, 24 nt, Homo sapiens
gagacuggaccgcugacugcacca

SEQ ID NO: 2115338 - RNA, 18 nt, Homo sapiens
auucucuucuugcuauau

SEQ ID NO: 2115339 - RNA, 13 nt, Homo sapiens
accagcaacuaau

SEQ ID NO: 2115340 - RNA, 14 nt, Homo sapiens
aaaugcagugaauu

SEQ ID NO: 2115341 - RNA, 20 nt, Homo sapiens
uuucaacaaauuucauugca

SEQ ID NO: 2115342 - RNA, 12 nt, Homo sapiens
gcaaacguuucu

SEQ ID NO: 2115343 - RNA, 15 nt, Homo sapiens
gaacgcaugcagggc

SEQ ID NO: 2115344 - RNA, 22 nt, Homo sapiens
gcuuaaaauaaaguuaaacuga

SEQ ID NO: 2115345 - RNA, 23 nt, Homo sapiens
aagaagggaagccuuuugcaaau

SEQ ID NO: 2115346 - RNA, 16 nt, Homo sapiens
cucauucaucuugcaa

SEQ ID NO: 2115347 - RNA, 21 nt, Homo sapiens
gcccuccccuccggacuggug

SEQ ID NO: 2115348 - RNA, 14 nt, Homo sapiens
auuaaugcuaucaa

SEQ ID NO: 2115349 - RNA, 15 nt, Homo sapiens
auauuguagcaguua

SEQ ID NO: 2115350 - RNA, 11 nt, Homo sapiens
acgcacugcac

SEQ ID NO: 2115351 - RNA, 14 nt, Homo sapiens
ugcucgcugagaaa

SEQ ID NO: 2115352 - RNA, 20 nt, Homo sapiens
ugaccugcugagcucugaga

SEQ ID NO: 2115353 - RNA, 20 nt, Homo sapiens
acagaagcuuuuuguuugca

SEQ ID NO: 2115354 - RNA, 23 nt, Homo sapiens
gcauagagggagaggaagcacac

SEQ ID NO: 2115355 - RNA, 14 nt, Homo sapiens
cuuacuuugcuuga

SEQ ID NO: 2115356 - RNA, 23 nt, Homo sapiens
gcauauaugaugguggucaucca

SEQ ID NO: 2115357 - RNA, 24 nt, Homo sapiens
caaaugguggaggauugcugccag

SEQ ID NO: 2115358 - RNA, 13 nt, Homo sapiens
cugccauaacaua

SEQ ID NO: 2115359 - RNA, 23 nt, Homo sapiens
uuaacugaauaccacucuguaau

SEQ ID NO: 2115360 - RNA, 20 nt, Homo sapiens
aggagucaacguguuuaccu

SEQ ID NO: 2115361 - RNA, 22 nt, Homo sapiens
cccugccugccucuuggccuca

SEQ ID NO: 2115362 - RNA, 15 nt, Homo sapiens
aaccaaacccagaca

SEQ ID NO: 2115363 - RNA, 17 nt, Homo sapiens
auuaccgcguuguaaaa

SEQ ID NO: 2115364 - RNA, 17 nt, Homo sapiens
aagaagugggacuuccc

SEQ ID NO: 2115365 - RNA, 23 nt, Homo sapiens
aggcuggaguguaguggcaugau

SEQ ID NO: 2115366 - RNA, 17 nt, Homo sapiens
ccuugguaauuauaucu

SEQ ID NO: 2115367 - RNA, 15 nt, Homo sapiens
aaauuuuuaggcaaa

SEQ ID NO: 2115368 - RNA, 21 nt, Homo sapiens
augugaacuuucucagcauau

SEQ ID NO: 2115369 - RNA, 15 nt, Homo sapiens
gacuaauuaggcaag

SEQ ID NO: 2115370 - RNA, 14 nt, Homo sapiens
gaauauaauacugu

SEQ ID NO: 2115371 - RNA, 14 nt, Homo sapiens
ugacuuccugccau

SEQ ID NO: 2115372 - RNA, 14 nt, Homo sapiens
uaguaaauagggaa

SEQ ID NO: 2115373 - RNA, 21 nt, Homo sapiens
accagaucugucuccaagacc

SEQ ID NO: 2115374 - RNA, 21 nt, Homo sapiens
cccccgugaggaugucacuca

SEQ ID NO: 2115375 - RNA, 16 nt, Homo sapiens
uguguauacauaugua

SEQ ID NO: 2115376 - RNA, 16 nt, Homo sapiens
cuuuccuuucuuuacu

SEQ ID NO: 2115377 - RNA, 12 nt, Homo sapiens
gaaccaauagaa

SEQ ID NO: 2115378 - RNA, 18 nt, Homo sapiens
auuucuagacuuccacaa

SEQ ID NO: 2115379 - RNA, 17 nt, Homo sapiens
aguuccuggcccaucaa

SEQ ID NO: 2115380 - RNA, 11 nt, Homo sapiens
acacacuccuu

SEQ ID NO: 2115381 - RNA, 16 nt, Homo sapiens
acucauauucugggcu

SEQ ID NO: 2115382 - RNA, 15 nt, Homo sapiens
acuguuuuuaaucuc

SEQ ID NO: 2115383 - RNA, 15 nt, Homo sapiens
uaaucacuacuguau

SEQ ID NO: 2115384 - RNA, 21 nt, Homo sapiens
gccuuuauuuggcaaauaacu

SEQ ID NO: 2115385 - RNA, 13 nt, Homo sapiens
ugcuacagugcau

SEQ ID NO: 2115386 - RNA, 17 nt, Homo sapiens
acgcuuaagucaucauu

SEQ ID NO: 2115387 - RNA, 15 nt, Homo sapiens
uaauuuuucugggaa

SEQ ID NO: 2115388 - RNA, 13 nt, Homo sapiens
gaagagaagggca

SEQ ID NO: 2115389 - RNA, 15 nt, Homo sapiens
auucaccuauguuau

SEQ ID NO: 2115390 - RNA, 10 nt, Homo sapiens
uuaaaaccaa

SEQ ID NO: 2115391 - RNA, 19 nt, Homo sapiens
aaguggaguugacucugga

SEQ ID NO: 2115392 - RNA, 19 nt, Homo sapiens
gaaaguuuccccaccagug

SEQ ID NO: 2115393 - RNA, 15 nt, Homo sapiens
aacgucaucucaggg

SEQ ID NO: 2115394 - RNA, 19 nt, Homo sapiens
ugucaaguggaaacaugcu

SEQ ID NO: 2115395 - RNA, 9 nt, Homo sapiens
agugugaga

SEQ ID NO: 2115396 - RNA, 21 nt, Homo sapiens
ugccuguacuaaggagcauga

SEQ ID NO: 2115397 - RNA, 17 nt, Homo sapiens
acuauuuaucugugcaa

SEQ ID NO: 2115398 - RNA, 19 nt, Homo sapiens
cucaagcuaugugagcuca

SEQ ID NO: 2115399 - RNA, 19 nt, Homo sapiens
cccagucacugugagcucc

SEQ ID NO: 2115400 - RNA, 14 nt, Homo sapiens
aggggcugcugccu

SEQ ID NO: 2115401 - RNA, 22 nt, Homo sapiens
aaugauacuuaaccaguuagaa

SEQ ID NO: 2115402 - RNA, 17 nt, Homo sapiens
uuucaaaagaacauucu

SEQ ID NO: 2115403 - RNA, 12 nt, Homo sapiens
uccucacugcca

SEQ ID NO: 2115404 - RNA, 13 nt, Homo sapiens
auuagaaggcaga

SEQ ID NO: 2115405 - RNA, 15 nt, Homo sapiens
aacaaacuuacuguc

SEQ ID NO: 2115406 - RNA, 17 nt, Homo sapiens
aaugauaugaccaaaau

SEQ ID NO: 2115407 - RNA, 17 nt, Homo sapiens
uggcaaacauuuuucca

SEQ ID NO: 2115408 - RNA, 21 nt, Homo sapiens
agaaaacuugaauucauagaa

SEQ ID NO: 2115409 - RNA, 18 nt, Homo sapiens
caaguucuagaaggucuc

SEQ ID NO: 2115410 - RNA, 22 nt, Homo sapiens
uaggucuuaagaugcaaaucaa

SEQ ID NO: 2115411 - RNA, 16 nt, Homo sapiens
aaaugaacuacugcua

SEQ ID NO: 2115412 - RNA, 12 nt, Homo sapiens
uaugccacucag
